United States Patent 11,492,591 (UNIVERSAL DONOR STEM CELLS AND RELATED METHODS) - sequence listing, part 7

SEQ ID NO: 197926 - DNA, 20 bp, Artificial
  CRISPR gRNA sequence
tactgcacttttaggagatt

SEQ ID NO: 197927 - DNA, 20 bp, Artificial
  CRISPR gRNA sequence
ctgcacttttaggagattag

SEQ ID NO: 197928 - DNA, 20 bp, Artificial
  CRISPR gRNA sequence
cacttttaggagattagatc

SEQ ID NO: 197929 - DNA, 20 bp, Artificial
  CRISPR gRNA sequence
ttaggagattagatcctgag

SEQ ID NO: 197930 - DNA, 20 bp, Artificial
  CRISPR gRNA sequence
taggagattagatcctgagg

SEQ ID NO: 197931 - DNA, 20 bp, Artificial
  CRISPR gRNA sequence
aggagattagatcctgagga

SEQ ID NO: 197932 - DNA, 20 bp, Artificial
  CRISPR gRNA sequence
ggagattagatcctgaggaa

SEQ ID NO: 197933 - DNA, 20 bp, Artificial
  CRISPR gRNA sequence
gatcctgaggaaaaccatac

SEQ ID NO: 197934 - DNA, 20 bp, Artificial
  CRISPR gRNA sequence
aggaaaaccatacagctgaa

SEQ ID NO: 197935 - DNA, 20 bp, Artificial
  CRISPR gRNA sequence
aattggtcatcccaggtaat

SEQ ID NO: 197936 - DNA, 20 bp, Artificial
  CRISPR gRNA sequence
gtcatcccaggtaatattct

SEQ ID NO: 197937 - DNA, 20 bp, Artificial
  CRISPR gRNA sequence
tgaatgtgtccattaaaata

SEQ ID NO: 197938 - DNA, 20 bp, Artificial
  CRISPR gRNA sequence
aatgtgtccattaaaatatg

SEQ ID NO: 197939 - DNA, 20 bp, Artificial
  CRISPR gRNA sequence
aaatatgtctaacactgtcc

SEQ ID NO: 197940 - DNA, 20 bp, Artificial
  CRISPR gRNA sequence
acactgtcccctagcaccta

SEQ ID NO: 197941 - DNA, 20 bp, Artificial
  CRISPR gRNA sequence
tcccctagcacctagcatga

SEQ ID NO: 197942 - DNA, 20 bp, Artificial
  CRISPR gRNA sequence
gcacctagcatgatgtctgc

SEQ ID NO: 197943 - DNA, 20 bp, Artificial
  CRISPR gRNA sequence
gcatgatgtctgcctatcat

SEQ ID NO: 197944 - DNA, 20 bp, Artificial
  CRISPR gRNA sequence
cctatcatagtcattcagtg

SEQ ID NO: 197945 - DNA, 20 bp, Artificial
  CRISPR gRNA sequence
tcatagtcattcagtgattg

SEQ ID NO: 197946 - DNA, 20 bp, Artificial
  CRISPR gRNA sequence
agtgattgttgaataaatga

SEQ ID NO: 197947 - DNA, 20 bp, Artificial
  CRISPR gRNA sequence
ttgaataaatgaatgaatga

SEQ ID NO: 197948 - DNA, 20 bp, Artificial
  CRISPR gRNA sequence
aataaatgaatgaatgaata

SEQ ID NO: 197949 - DNA, 20 bp, Artificial
  CRISPR gRNA sequence
tgtttacaaaatatatccta

SEQ ID NO: 197950 - DNA, 20 bp, Artificial
  CRISPR gRNA sequence
acaaaatatatcctaattcc

SEQ ID NO: 197951 - DNA, 20 bp, Artificial
  CRISPR gRNA sequence
caaaatatatcctaattcct

SEQ ID NO: 197952 - DNA, 20 bp, Artificial
  CRISPR gRNA sequence
attcctcacctccattcatc

SEQ ID NO: 197953 - DNA, 20 bp, Artificial
  CRISPR gRNA sequence
ctcacctccattcatccaaa

SEQ ID NO: 197954 - DNA, 20 bp, Artificial
  CRISPR gRNA sequence
acctccattcatccaaacca

SEQ ID NO: 197955 - DNA, 20 bp, Artificial
  CRISPR gRNA sequence
cattcatccaaaccatattg

SEQ ID NO: 197956 - DNA, 20 bp, Artificial
  CRISPR gRNA sequence
atccaaaccatattgttact

SEQ ID NO: 197957 - DNA, 20 bp, Artificial
  CRISPR gRNA sequence
ttacttaataaacattcagc

SEQ ID NO: 197958 - DNA, 20 bp, Artificial
  CRISPR gRNA sequence
cttaataaacattcagcaga

SEQ ID NO: 197959 - DNA, 20 bp, Artificial
  CRISPR gRNA sequence
aataaacattcagcagatat

SEQ ID NO: 197960 - DNA, 20 bp, Artificial
  CRISPR gRNA sequence
ataaacattcagcagatatt

SEQ ID NO: 197961 - DNA, 20 bp, Artificial
  CRISPR gRNA sequence
agcagatatttatggaatat

SEQ ID NO: 197962 - DNA, 20 bp, Artificial
  CRISPR gRNA sequence
atggaatataccttttgttc

SEQ ID NO: 197963 - DNA, 20 bp, Artificial
  CRISPR gRNA sequence
tggaatataccttttgttcc

SEQ ID NO: 197964 - DNA, 20 bp, Artificial
  CRISPR gRNA sequence
ttgttccatgcattgtagta

SEQ ID NO: 197965 - DNA, 20 bp, Artificial
  CRISPR gRNA sequence
tgttccatgcattgtagtac

SEQ ID NO: 197966 - DNA, 20 bp, Artificial
  CRISPR gRNA sequence
gttccatgcattgtagtact

SEQ ID NO: 197967 - DNA, 20 bp, Artificial
  CRISPR gRNA sequence
ttccatgcattgtagtactc

SEQ ID NO: 197968 - DNA, 20 bp, Artificial
  CRISPR gRNA sequence
catgcattgtagtactcatt

SEQ ID NO: 197969 - DNA, 20 bp, Artificial
  CRISPR gRNA sequence
tagtactcattggatacaca

SEQ ID NO: 197970 - DNA, 20 bp, Artificial
  CRISPR gRNA sequence
attggatacacatagaataa

SEQ ID NO: 197971 - DNA, 20 bp, Artificial
  CRISPR gRNA sequence
gatacacatagaataataag

SEQ ID NO: 197972 - DNA, 20 bp, Artificial
  CRISPR gRNA sequence
agttcacactcttcaggaaa

SEQ ID NO: 197973 - DNA, 20 bp, Artificial
  CRISPR gRNA sequence
acactcttcaggaaacagat

SEQ ID NO: 197974 - DNA, 20 bp, Artificial
  CRISPR gRNA sequence
ttcaggaaacagataaaaaa

SEQ ID NO: 197975 - DNA, 20 bp, Artificial
  CRISPR gRNA sequence
caggaaacagataaaaaact

SEQ ID NO: 197976 - DNA, 20 bp, Artificial
  CRISPR gRNA sequence
aggaaacagataaaaaacta

SEQ ID NO: 197977 - DNA, 20 bp, Artificial
  CRISPR gRNA sequence
agaaacaaacaaaaaacagg

SEQ ID NO: 197978 - DNA, 20 bp, Artificial
  CRISPR gRNA sequence
tcatagccgggaaacctggg

SEQ ID NO: 197979 - DNA, 20 bp, Artificial
  CRISPR gRNA sequence
catagccgggaaacctgggg

SEQ ID NO: 197980 - DNA, 20 bp, Artificial
  CRISPR gRNA sequence
atagccgggaaacctgggga

SEQ ID NO: 197981 - DNA, 20 bp, Artificial
  CRISPR gRNA sequence
gggaatacctgagaggaata

SEQ ID NO: 197982 - DNA, 20 bp, Artificial
  CRISPR gRNA sequence
agaggaatactcaattcagg

SEQ ID NO: 197983 - DNA, 20 bp, Artificial
  CRISPR gRNA sequence
aattcaggccttgtttcagg

SEQ ID NO: 197984 - DNA, 20 bp, Artificial
  CRISPR gRNA sequence
aggccttgtttcaggaatcc

SEQ ID NO: 197985 - DNA, 20 bp, Artificial
  CRISPR gRNA sequence
gtttcaggaatccaaatcct

SEQ ID NO: 197986 - DNA, 20 bp, Artificial
  CRISPR gRNA sequence
tttcaggaatccaaatcctg

SEQ ID NO: 197987 - DNA, 20 bp, Artificial
  CRISPR gRNA sequence
caggaatccaaatcctggca

SEQ ID NO: 197988 - DNA, 20 bp, Artificial
  CRISPR gRNA sequence
aggaatccaaatcctggcac

SEQ ID NO: 197989 - DNA, 20 bp, Artificial
  CRISPR gRNA sequence
gcacatcagagctgcttccc

SEQ ID NO: 197990 - DNA, 20 bp, Artificial
  CRISPR gRNA sequence
cttccctctttccagggtgg

SEQ ID NO: 197991 - DNA, 20 bp, Artificial
  CRISPR gRNA sequence
ccctctttccagggtggcag

SEQ ID NO: 197992 - DNA, 20 bp, Artificial
  CRISPR gRNA sequence
cctctttccagggtggcagg

SEQ ID NO: 197993 - DNA, 20 bp, Artificial
  CRISPR gRNA sequence
tttccagggtggcaggaaat

SEQ ID NO: 197994 - DNA, 20 bp, Artificial
  CRISPR gRNA sequence
tccagggtggcaggaaataa

SEQ ID NO: 197995 - DNA, 20 bp, Artificial
  CRISPR gRNA sequence
ccagggtggcaggaaataaa

SEQ ID NO: 197996 - DNA, 20 bp, Artificial
  CRISPR gRNA sequence
cagggtggcaggaaataaat

SEQ ID NO: 197997 - DNA, 20 bp, Artificial
  CRISPR gRNA sequence
ttctatcttatgccaaacat

SEQ ID NO: 197998 - DNA, 20 bp, Artificial
  CRISPR gRNA sequence
tctatcttatgccaaacatg

SEQ ID NO: 197999 - DNA, 20 bp, Artificial
  CRISPR gRNA sequence
ctatcttatgccaaacatga

SEQ ID NO: 198000 - DNA, 20 bp, Artificial
  CRISPR gRNA sequence
tatcttatgccaaacatgag

SEQ ID NO: 198001 - DNA, 20 bp, Artificial
  CRISPR gRNA sequence
tcttatgccaaacatgaggg

SEQ ID NO: 198002 - DNA, 20 bp, Artificial
  CRISPR gRNA sequence
atgccaaacatgagggaccc

SEQ ID NO: 198003 - DNA, 20 bp, Artificial
  CRISPR gRNA sequence
tgccaaacatgagggaccct

SEQ ID NO: 198004 - DNA, 20 bp, Artificial
  CRISPR gRNA sequence
tctccccggtgcctctccca

SEQ ID NO: 198005 - DNA, 20 bp, Artificial
  CRISPR gRNA sequence
ctccccggtgcctctcccaa

SEQ ID NO: 198006 - DNA, 20 bp, Artificial
  CRISPR gRNA sequence
tccccggtgcctctcccaag

SEQ ID NO: 198007 - DNA, 20 bp, Artificial
  CRISPR gRNA sequence
cccggtgcctctcccaaggt

SEQ ID NO: 198008 - DNA, 20 bp, Artificial
  CRISPR gRNA sequence
tcccaaggtagtctacaata

SEQ ID NO: 198009 - DNA, 20 bp, Artificial
  CRISPR gRNA sequence
ccaaggtagtctacaatatt

SEQ ID NO: 198010 - DNA, 20 bp, Artificial
  CRISPR gRNA sequence
caatatttcaactctagcag

SEQ ID NO: 198011 - DNA, 20 bp, Artificial
  CRISPR gRNA sequence
caactctagcagtctgctta

SEQ ID NO: 198012 - DNA, 20 bp, Artificial
  CRISPR gRNA sequence
aactctagcagtctgcttag

SEQ ID NO: 198013 - DNA, 20 bp, Artificial
  CRISPR gRNA sequence
tagcagtctgcttagtgcat

SEQ ID NO: 198014 - DNA, 20 bp, Artificial
  CRISPR gRNA sequence
gcagtctgcttagtgcatag

SEQ ID NO: 198015 - DNA, 20 bp, Artificial
  CRISPR gRNA sequence
cttagtgcatagaacatgag

SEQ ID NO: 198016 - DNA, 20 bp, Artificial
  CRISPR gRNA sequence
agtgcatagaacatgaggct

SEQ ID NO: 198017 - DNA, 20 bp, Artificial
  CRISPR gRNA sequence
gtgcatagaacatgaggctg

SEQ ID NO: 198018 - DNA, 20 bp, Artificial
  CRISPR gRNA sequence
tgtgtccctgggcaaattac

SEQ ID NO: 198019 - DNA, 20 bp, Artificial
  CRISPR gRNA sequence
ggcaaattactagacttctg

SEQ ID NO: 198020 - DNA, 20 bp, Artificial
  CRISPR gRNA sequence
ctagacttctgtgtgcttca

SEQ ID NO: 198021 - DNA, 20 bp, Artificial
  CRISPR gRNA sequence
gacttctgtgtgcttcactt

SEQ ID NO: 198022 - DNA, 20 bp, Artificial
  CRISPR gRNA sequence
ctgtgtgcttcactttccct

SEQ ID NO: 198023 - DNA, 20 bp, Artificial
  CRISPR gRNA sequence
tgtgtgcttcactttccctg

SEQ ID NO: 198024 - DNA, 20 bp, Artificial
  CRISPR gRNA sequence
tgtgcttcactttccctgta

SEQ ID NO: 198025 - DNA, 20 bp, Artificial
  CRISPR gRNA sequence
cactttccctgtaggattat

SEQ ID NO: 198026 - DNA, 20 bp, Artificial
  CRISPR gRNA sequence
actttccctgtaggattata

SEQ ID NO: 198027 - DNA, 20 bp, Artificial
  CRISPR gRNA sequence
tccctgtaggattataatct

SEQ ID NO: 198028 - DNA, 20 bp, Artificial
  CRISPR gRNA sequence
ccctgtaggattataatcta

SEQ ID NO: 198029 - DNA, 20 bp, Artificial
  CRISPR gRNA sequence
cctgtaggattataatctac

SEQ ID NO: 198030 - DNA, 20 bp, Artificial
  CRISPR gRNA sequence
taggattataatctactgag

SEQ ID NO: 198031 - DNA, 20 bp, Artificial
  CRISPR gRNA sequence
taatctactgagcaagctta

SEQ ID NO: 198032 - DNA, 20 bp, Artificial
  CRISPR gRNA sequence
ctgagcaagcttattgtaag

SEQ ID NO: 198033 - DNA, 20 bp, Artificial
  CRISPR gRNA sequence
agcaagcttattgtaagggt

SEQ ID NO: 198034 - DNA, 20 bp, Artificial
  CRISPR gRNA sequence
attgtaagggtcagattagc

SEQ ID NO: 198035 - DNA, 20 bp, Artificial
  CRISPR gRNA sequence
ttgtaagggtcagattagca

SEQ ID NO: 198036 - DNA, 20 bp, Artificial
  CRISPR gRNA sequence
taagggtcagattagcaaca

SEQ ID NO: 198037 - DNA, 20 bp, Artificial
  CRISPR gRNA sequence
gcaacagtgtatgaaaatga

SEQ ID NO: 198038 - DNA, 20 bp, Artificial
  CRISPR gRNA sequence
gagaccattgcctgcacaaa

SEQ ID NO: 198039 - DNA, 20 bp, Artificial
  CRISPR gRNA sequence
agaccattgcctgcacaaat

SEQ ID NO: 198040 - DNA, 20 bp, Artificial
  CRISPR gRNA sequence
cctgcacaaattcaactatt

SEQ ID NO: 198041 - DNA, 20 bp, Artificial
  CRISPR gRNA sequence
cacaaattcaactatttttt

SEQ ID NO: 198042 - DNA, 20 bp, Artificial
  CRISPR gRNA sequence
aactatttttttttatctca

SEQ ID NO: 198043 - DNA, 20 bp, Artificial
  CRISPR gRNA sequence
tttttttttatctcactact

SEQ ID NO: 198044 - DNA, 20 bp, Artificial
  CRISPR gRNA sequence
ttttttatctcactactcta

SEQ ID NO: 198045 - DNA, 20 bp, Artificial
  CRISPR gRNA sequence
tttttatctcactactctac

SEQ ID NO: 198046 - DNA, 20 bp, Artificial
  CRISPR gRNA sequence
ttttatctcactactctaca

SEQ ID NO: 198047 - DNA, 20 bp, Artificial
  CRISPR gRNA sequence
tttatctcactactctacag

SEQ ID NO: 198048 - DNA, 20 bp, Artificial
  CRISPR gRNA sequence
ttatctcactactctacaga

SEQ ID NO: 198049 - DNA, 20 bp, Artificial
  CRISPR gRNA sequence
tatctcactactctacagaa

SEQ ID NO: 198050 - DNA, 20 bp, Artificial
  CRISPR gRNA sequence
atctcactactctacagaag

SEQ ID NO: 198051 - DNA, 20 bp, Artificial
  CRISPR gRNA sequence
tctcactactctacagaagt

SEQ ID NO: 198052 - DNA, 20 bp, Artificial
  CRISPR gRNA sequence
actactctacagaagtaggt

SEQ ID NO: 198053 - DNA, 20 bp, Artificial
  CRISPR gRNA sequence
ctctacagaagtaggtaggg

SEQ ID NO: 198054 - DNA, 20 bp, Artificial
  CRISPR gRNA sequence
tacagaagtaggtagggtgg

SEQ ID NO: 198055 - DNA, 20 bp, Artificial
  CRISPR gRNA sequence
cagaagtaggtagggtggga

SEQ ID NO: 198056 - DNA, 20 bp, Artificial
  CRISPR gRNA sequence
atgagaggctcagaatgtga

SEQ ID NO: 198057 - DNA, 20 bp, Artificial
  CRISPR gRNA sequence
agaatgtgaaagaaagtgag

SEQ ID NO: 198058 - DNA, 20 bp, Artificial
  CRISPR gRNA sequence
aatataaacacaaagatatt

SEQ ID NO: 198059 - DNA, 20 bp, Artificial
  CRISPR gRNA sequence
atataaacacaaagatattc

SEQ ID NO: 198060 - DNA, 20 bp, Artificial
  CRISPR gRNA sequence
tgagaagagctgctcactgc

SEQ ID NO: 198061 - DNA, 20 bp, Artificial
  CRISPR gRNA sequence
agaagagctgctcactgccc

SEQ ID NO: 198062 - DNA, 20 bp, Artificial
  CRISPR gRNA sequence
ctcactgccccctcccccaa

SEQ ID NO: 198063 - DNA, 20 bp, Artificial
  CRISPR gRNA sequence
actgccccctcccccaatac

SEQ ID NO: 198064 - DNA, 20 bp, Artificial
  CRISPR gRNA sequence
ccccctcccccaatacatgt

SEQ ID NO: 198065 - DNA, 20 bp, Artificial
  CRISPR gRNA sequence
ccccaatacatgttgatagg

SEQ ID NO: 198066 - DNA, 20 bp, Artificial
  CRISPR gRNA sequence
ataggaaaatgccacgtact

SEQ ID NO: 198067 - DNA, 20 bp, Artificial
  CRISPR gRNA sequence
cagcaaaaacaactgaaaaa

SEQ ID NO: 198068 - DNA, 20 bp, Artificial
  CRISPR gRNA sequence
agcaaaaacaactgaaaaat

SEQ ID NO: 198069 - DNA, 20 bp, Artificial
  CRISPR gRNA sequence
aaaaattagatagaaaagtc

SEQ ID NO: 198070 - DNA, 20 bp, Artificial
  CRISPR gRNA sequence
gatagaaaagtcaatcaata

SEQ ID NO: 198071 - DNA, 20 bp, Artificial
  CRISPR gRNA sequence
tgaacagaaagagggggaaa

SEQ ID NO: 198072 - DNA, 20 bp, Artificial
  CRISPR gRNA sequence
tagaaaatgatggggatgct

SEQ ID NO: 198073 - DNA, 20 bp, Artificial
  CRISPR gRNA sequence
agaaaatgatggggatgctc

SEQ ID NO: 198074 - DNA, 20 bp, Artificial
  CRISPR gRNA sequence
gaaaatgatggggatgctct

SEQ ID NO: 198075 - DNA, 20 bp, Artificial
  CRISPR gRNA sequence
ttactggggtacgagtcctc

SEQ ID NO: 198076 - DNA, 20 bp, Artificial
  CRISPR gRNA sequence
actggggtacgagtcctcag

SEQ ID NO: 198077 - DNA, 20 bp, Artificial
  CRISPR gRNA sequence
ctggggtacgagtcctcagg

SEQ ID NO: 198078 - DNA, 20 bp, Artificial
  CRISPR gRNA sequence
gggtacgagtcctcaggtat

SEQ ID NO: 198079 - DNA, 20 bp, Artificial
  CRISPR gRNA sequence
aggtattgaactggctttca

SEQ ID NO: 198080 - DNA, 20 bp, Artificial
  CRISPR gRNA sequence
aactggctttcagtaaaagc

SEQ ID NO: 198081 - DNA, 20 bp, Artificial
  CRISPR gRNA sequence
gctttcagtaaaagctagat

SEQ ID NO: 198082 - DNA, 20 bp, Artificial
  CRISPR gRNA sequence
tcagtaaaagctagattagt

SEQ ID NO: 198083 - DNA, 20 bp, Artificial
  CRISPR gRNA sequence
cagtaaaagctagattagtg

SEQ ID NO: 198084 - DNA, 20 bp, Artificial
  CRISPR gRNA sequence
agtaaaagctagattagtgg

SEQ ID NO: 198085 - DNA, 20 bp, Artificial
  CRISPR gRNA sequence
gattagtgggttcctgccat

SEQ ID NO: 198086 - DNA, 20 bp, Artificial
  CRISPR gRNA sequence
gtgggttcctgccatttaca

SEQ ID NO: 198087 - DNA, 20 bp, Artificial
  CRISPR gRNA sequence
ctgccatttacaagctgttt

SEQ ID NO: 198088 - DNA, 20 bp, Artificial
  CRISPR gRNA sequence
ccatttacaagctgttttat

SEQ ID NO: 198089 - DNA, 20 bp, Artificial
  CRISPR gRNA sequence
acaagctgttttatgacaac

SEQ ID NO: 198090 - DNA, 20 bp, Artificial
  CRISPR gRNA sequence
caagctgttttatgacaact

SEQ ID NO: 198091 - DNA, 20 bp, Artificial
  CRISPR gRNA sequence
ttttatgacaacttacttgt

SEQ ID NO: 198092 - DNA, 20 bp, Artificial
  CRISPR gRNA sequence
tatgacaacttacttgttgg

SEQ ID NO: 198093 - DNA, 20 bp, Artificial
  CRISPR gRNA sequence
atgacaacttacttgttggg

SEQ ID NO: 198094 - DNA, 20 bp, Artificial
  CRISPR gRNA sequence
tgacaacttacttgttgggt

SEQ ID NO: 198095 - DNA, 20 bp, Artificial
  CRISPR gRNA sequence
acttgttgggtggcctacag

SEQ ID NO: 198096 - DNA, 20 bp, Artificial
  CRISPR gRNA sequence
cttgttgggtggcctacagt

SEQ ID NO: 198097 - DNA, 20 bp, Artificial
  CRISPR gRNA sequence
gttgggtggcctacagtaac

SEQ ID NO: 198098 - DNA, 20 bp, Artificial
  CRISPR gRNA sequence
ttgggtggcctacagtaact

SEQ ID NO: 198099 - DNA, 20 bp, Artificial
  CRISPR gRNA sequence
ggtggcctacagtaactcac

SEQ ID NO: 198100 - DNA, 20 bp, Artificial
  CRISPR gRNA sequence
cagtaactcacctaactgca

SEQ ID NO: 198101 - DNA, 20 bp, Artificial
  CRISPR gRNA sequence
acctaactgcactgagtctg

SEQ ID NO: 198102 - DNA, 20 bp, Artificial
  CRISPR gRNA sequence
actgcactgagtctgtttcc

SEQ ID NO: 198103 - DNA, 20 bp, Artificial
  CRISPR gRNA sequence
cactgagtctgtttcctcat

SEQ ID NO: 198104 - DNA, 20 bp, Artificial
  CRISPR gRNA sequence
agtctgtttcctcatctgta

SEQ ID NO: 198105 - DNA, 20 bp, Artificial
  CRISPR gRNA sequence
tttcctcatctgtaaattgg

SEQ ID NO: 198106 - DNA, 20 bp, Artificial
  CRISPR gRNA sequence
cctcatctgtaaattgggga

SEQ ID NO: 198107 - DNA, 20 bp, Artificial
  CRISPR gRNA sequence
ctcatctgtaaattggggat

SEQ ID NO: 198108 - DNA, 20 bp, Artificial
  CRISPR gRNA sequence
atctgtaaattggggatttt

SEQ ID NO: 198109 - DNA, 20 bp, Artificial
  CRISPR gRNA sequence
taaattggggattttttttt

SEQ ID NO: 198110 - DNA, 20 bp, Artificial
  CRISPR gRNA sequence
gggatttttttttaaatacc

SEQ ID NO: 198111 - DNA, 20 bp, Artificial
  CRISPR gRNA sequence
ttttttaaatacctggcatg

SEQ ID NO: 198112 - DNA, 20 bp, Artificial
  CRISPR gRNA sequence
tttttaaatacctggcatgc

SEQ ID NO: 198113 - DNA, 20 bp, Artificial
  CRISPR gRNA sequence
ttttaaatacctggcatgcc

SEQ ID NO: 198114 - DNA, 20 bp, Artificial
  CRISPR gRNA sequence
tttaaatacctggcatgcct

SEQ ID NO: 198115 - DNA, 20 bp, Artificial
  CRISPR gRNA sequence
ttaaatacctggcatgccta

SEQ ID NO: 198116 - DNA, 20 bp, Artificial
  CRISPR gRNA sequence
taaatacctggcatgcctaa

SEQ ID NO: 198117 - DNA, 20 bp, Artificial
  CRISPR gRNA sequence
aaatacctggcatgcctaac

SEQ ID NO: 198118 - DNA, 20 bp, Artificial
  CRISPR gRNA sequence
aatacctggcatgcctaact

SEQ ID NO: 198119 - DNA, 20 bp, Artificial
  CRISPR gRNA sequence
gcatgcctaactcataaagt

SEQ ID NO: 198120 - DNA, 20 bp, Artificial
  CRISPR gRNA sequence
actcataaagttgttctgaa

SEQ ID NO: 198121 - DNA, 20 bp, Artificial
  CRISPR gRNA sequence
ataaagttgttctgaaactg

SEQ ID NO: 198122 - DNA, 20 bp, Artificial
  CRISPR gRNA sequence
ttctgaaactgaaataaaac

SEQ ID NO: 198123 - DNA, 20 bp, Artificial
  CRISPR gRNA sequence
tgaaactgaaataaaacata

SEQ ID NO: 198124 - DNA, 20 bp, Artificial
  CRISPR gRNA sequence
aaactgaaataaaacatacg

SEQ ID NO: 198125 - DNA, 20 bp, Artificial
  CRISPR gRNA sequence
aaataaaacatacgtgaaca

SEQ ID NO: 198126 - DNA, 20 bp, Artificial
  CRISPR gRNA sequence
taaactgtaagttacggaaa

SEQ ID NO: 198127 - DNA, 20 bp, Artificial
  CRISPR gRNA sequence
taagttacggaaaaagctgg

SEQ ID NO: 198128 - DNA, 20 bp, Artificial
  CRISPR gRNA sequence
cggaaaaagctggctgttgt

SEQ ID NO: 198129 - DNA, 20 bp, Artificial
  CRISPR gRNA sequence
gctgttgttgtgtctttaaa

SEQ ID NO: 198130 - DNA, 20 bp, Artificial
  CRISPR gRNA sequence
ttgttgtgtctttaaagttt

SEQ ID NO: 198131 - DNA, 20 bp, Artificial
  CRISPR gRNA sequence
ttgtgtctttaaagtttcac

SEQ ID NO: 198132 - DNA, 20 bp, Artificial
  CRISPR gRNA sequence
tgtctttaaagtttcacctg

SEQ ID NO: 198133 - DNA, 20 bp, Artificial
  CRISPR gRNA sequence
taaagtttcacctgggtagt

SEQ ID NO: 198134 - DNA, 20 bp, Artificial
  CRISPR gRNA sequence
aaagtttcacctgggtagtc

SEQ ID NO: 198135 - DNA, 20 bp, Artificial
  CRISPR gRNA sequence
aagtttcacctgggtagtca

SEQ ID NO: 198136 - DNA, 20 bp, Artificial
  CRISPR gRNA sequence
cacctgggtagtcaaagatg

SEQ ID NO: 198137 - DNA, 20 bp, Artificial
  CRISPR gRNA sequence
acctgggtagtcaaagatgg

SEQ ID NO: 198138 - DNA, 20 bp, Artificial
  CRISPR gRNA sequence
ggtagtcaaagatggatcat

SEQ ID NO: 198139 - DNA, 20 bp, Artificial
  CRISPR gRNA sequence
agtggagagctgagccaggc

SEQ ID NO: 198140 - DNA, 20 bp, Artificial
  CRISPR gRNA sequence
agccaggcaggagctgacta

SEQ ID NO: 198141 - DNA, 20 bp, Artificial
  CRISPR gRNA sequence
actaagggtgagaggtggga

SEQ ID NO: 198142 - DNA, 20 bp, Artificial
  CRISPR gRNA sequence
agggtgagaggtgggagtta

SEQ ID NO: 198143 - DNA, 20 bp, Artificial
  CRISPR gRNA sequence
gcagcctctgaacatctgtg

SEQ ID NO: 198144 - DNA, 20 bp, Artificial
  CRISPR gRNA sequence
tgaacatctgtgtaccatgg

SEQ ID NO: 198145 - DNA, 20 bp, Artificial
  CRISPR gRNA sequence
aacatctgtgtaccatggga

SEQ ID NO: 198146 - DNA, 20 bp, Artificial
  CRISPR gRNA sequence
tgtaccatgggacccccttt

SEQ ID NO: 198147 - DNA, 20 bp, Artificial
  CRISPR gRNA sequence
tcctcctgcatggtacccca

SEQ ID NO: 198148 - DNA, 20 bp, Artificial
  CRISPR gRNA sequence
cctcctgcatggtaccccag

SEQ ID NO: 198149 - DNA, 20 bp, Artificial
  CRISPR gRNA sequence
ctcctgcatggtaccccaga

SEQ ID NO: 198150 - DNA, 20 bp, Artificial
  CRISPR gRNA sequence
ctgcatggtaccccagacaa

SEQ ID NO: 198151 - DNA, 20 bp, Artificial
  CRISPR gRNA sequence
catggtaccccagacaagga

SEQ ID NO: 198152 - DNA, 20 bp, Artificial
  CRISPR gRNA sequence
gtaagagatactaatggctt

SEQ ID NO: 198153 - DNA, 20 bp, Artificial
  CRISPR gRNA sequence
atggcttgttgtccagagat

SEQ ID NO: 198154 - DNA, 20 bp, Artificial
  CRISPR gRNA sequence
gttgtccagagatgttcaaa

SEQ ID NO: 198155 - DNA, 20 bp, Artificial
  CRISPR gRNA sequence
ttgtccagagatgttcaaac

SEQ ID NO: 198156 - DNA, 20 bp, Artificial
  CRISPR gRNA sequence
tccagagatgttcaaactgc

SEQ ID NO: 198157 - DNA, 20 bp, Artificial
  CRISPR gRNA sequence
aaactgcagagaaagataag

SEQ ID NO: 198158 - DNA, 20 bp, Artificial
  CRISPR gRNA sequence
cagagaaagataagacaaca

SEQ ID NO: 198159 - DNA, 20 bp, Artificial
  CRISPR gRNA sequence
gcctccaatcatgatgacag

SEQ ID NO: 198160 - DNA, 20 bp, Artificial
  CRISPR gRNA sequence
caatcatgatgacagatagg

SEQ ID NO: 198161 - DNA, 20 bp, Artificial
  CRISPR gRNA sequence
cttagcagtgctggttggcc

SEQ ID NO: 198162 - DNA, 20 bp, Artificial
  CRISPR gRNA sequence
agcagtgctggttggccttc

SEQ ID NO: 198163 - DNA, 20 bp, Artificial
  CRISPR gRNA sequence
gcagtgctggttggccttcc

SEQ ID NO: 198164 - DNA, 20 bp, Artificial
  CRISPR gRNA sequence
gttggccttccatgttctac

SEQ ID NO: 198165 - DNA, 20 bp, Artificial
  CRISPR gRNA sequence
gccttccatgttctactgtg

SEQ ID NO: 198166 - DNA, 20 bp, Artificial
  CRISPR gRNA sequence
ccatgttctactgtgggcca

SEQ ID NO: 198167 - DNA, 20 bp, Artificial
  CRISPR gRNA sequence
catgttctactgtgggccat

SEQ ID NO: 198168 - DNA, 20 bp, Artificial
  CRISPR gRNA sequence
tactgtgggccatctctgcc

SEQ ID NO: 198169 - DNA, 20 bp, Artificial
  CRISPR gRNA sequence
ctgtgggccatctctgccat

SEQ ID NO: 198170 - DNA, 20 bp, Artificial
  CRISPR gRNA sequence
tgggccatctctgccatgta

SEQ ID NO: 198171 - DNA, 20 bp, Artificial
  CRISPR gRNA sequence
tgccatgtactgtaggctac

SEQ ID NO: 198172 - DNA, 20 bp, Artificial
  CRISPR gRNA sequence
ccatgtactgtaggctacta

SEQ ID NO: 198173 - DNA, 20 bp, Artificial
  CRISPR gRNA sequence
taggctactagcttctatat

SEQ ID NO: 198174 - DNA, 20 bp, Artificial
  CRISPR gRNA sequence
ctagcttctatattaaagaa

SEQ ID NO: 198175 - DNA, 20 bp, Artificial
  CRISPR gRNA sequence
gcttctatattaaagaatgc

SEQ ID NO: 198176 - DNA, 20 bp, Artificial
  CRISPR gRNA sequence
ctatattaaagaatgcaaga

SEQ ID NO: 198177 - DNA, 20 bp, Artificial
  CRISPR gRNA sequence
tatattaaagaatgcaagag

SEQ ID NO: 198178 - DNA, 20 bp, Artificial
  CRISPR gRNA sequence
tattaaagaatgcaagaggg

SEQ ID NO: 198179 - DNA, 20 bp, Artificial
  CRISPR gRNA sequence
aagaatgcaagaggggccag

SEQ ID NO: 198180 - DNA, 20 bp, Artificial
  CRISPR gRNA sequence
atgcctgtaatctcagcact

SEQ ID NO: 198181 - DNA, 20 bp, Artificial
  CRISPR gRNA sequence
taatctcagcactttgggag

SEQ ID NO: 198182 - DNA, 20 bp, Artificial
  CRISPR gRNA sequence
agcactttgggaggccaagg

SEQ ID NO: 198183 - DNA, 20 bp, Artificial
  CRISPR gRNA sequence
tgggaggccaaggtgggcag

SEQ ID NO: 198184 - DNA, 20 bp, Artificial
  CRISPR gRNA sequence
gggaggccaaggtgggcaga

SEQ ID NO: 198185 - DNA, 20 bp, Artificial
  CRISPR gRNA sequence
ggaggccaaggtgggcagat

SEQ ID NO: 198186 - DNA, 20 bp, Artificial
  CRISPR gRNA sequence
gaggtcaggagtttgtgacc

SEQ ID NO: 198187 - DNA, 20 bp, Artificial
  CRISPR gRNA sequence
aggtcaggagtttgtgacca

SEQ ID NO: 198188 - DNA, 20 bp, Artificial
  CRISPR gRNA sequence
gtgaccagcctggccaacat

SEQ ID NO: 198189 - DNA, 20 bp, Artificial
  CRISPR gRNA sequence
tgaccagcctggccaacatg

SEQ ID NO: 198190 - DNA, 20 bp, Artificial
  CRISPR gRNA sequence
gccaacatggtgaaactctg

SEQ ID NO: 198191 - DNA, 20 bp, Artificial
  CRISPR gRNA sequence
tgcctttactaaaaatataa

SEQ ID NO: 198192 - DNA, 20 bp, Artificial
  CRISPR gRNA sequence
cctttactaaaaatataaaa

SEQ ID NO: 198193 - DNA, 20 bp, Artificial
  CRISPR gRNA sequence
tactaaaaatataaaaatta

SEQ ID NO: 198194 - DNA, 20 bp, Artificial
  CRISPR gRNA sequence
actaaaaatataaaaattag

SEQ ID NO: 198195 - DNA, 20 bp, Artificial
  CRISPR gRNA sequence
ctaaaaatataaaaattagc

SEQ ID NO: 198196 - DNA, 20 bp, Artificial
  CRISPR gRNA sequence
aaaatataaaaattagctgg

SEQ ID NO: 198197 - DNA, 20 bp, Artificial
  CRISPR gRNA sequence
gctgggtgtggtggtgtgca

SEQ ID NO: 198198 - DNA, 20 bp, Artificial
  CRISPR gRNA sequence
ggtgtggtggtgtgcacctg

SEQ ID NO: 198199 - DNA, 20 bp, Artificial
  CRISPR gRNA sequence
taatcccagctactcgggag

SEQ ID NO: 198200 - DNA, 20 bp, Artificial
  CRISPR gRNA sequence
ctcgggagactgaggcacaa

SEQ ID NO: 198201 - DNA, 20 bp, Artificial
  CRISPR gRNA sequence
gggagactgaggcacaagaa

SEQ ID NO: 198202 - DNA, 20 bp, Artificial
  CRISPR gRNA sequence
aggcacaagaattgcttgaa

SEQ ID NO: 198203 - DNA, 20 bp, Artificial
  CRISPR gRNA sequence
cttgaacctgggaggcggaa

SEQ ID NO: 198204 - DNA, 20 bp, Artificial
  CRISPR gRNA sequence
gaacctgggaggcggaagtt

SEQ ID NO: 198205 - DNA, 20 bp, Artificial
  CRISPR gRNA sequence
aacctgggaggcggaagttg

SEQ ID NO: 198206 - DNA, 20 bp, Artificial
  CRISPR gRNA sequence
ggaggcggaagttgcagtga

SEQ ID NO: 198207 - DNA, 20 bp, Artificial
  CRISPR gRNA sequence
cagtgagcccagattgcgcc

SEQ ID NO: 198208 - DNA, 20 bp, Artificial
  CRISPR gRNA sequence
cgccactgcactccaccctg

SEQ ID NO: 198209 - DNA, 20 bp, Artificial
  CRISPR gRNA sequence
cactccaccctgggcaacag

SEQ ID NO: 198210 - DNA, 20 bp, Artificial
  CRISPR gRNA sequence
caccctgggcaacagagaaa

SEQ ID NO: 198211 - DNA, 20 bp, Artificial
  CRISPR gRNA sequence
ggcaacagagaaagactctg

SEQ ID NO: 198212 - DNA, 20 bp, Artificial
  CRISPR gRNA sequence
tgcctcaaaaaaaaaaaaaa

SEQ ID NO: 198213 - DNA, 20 bp, Artificial
  CRISPR gRNA sequence
cctcaaaaaaaaaaaaaaaa

SEQ ID NO: 198214 - DNA, 20 bp, Artificial
  CRISPR gRNA sequence
aaaaaaaaaaaaaaaaagca

SEQ ID NO: 198215 - DNA, 20 bp, Artificial
  CRISPR gRNA sequence
aatagtgagcagccactcca

SEQ ID NO: 198216 - DNA, 20 bp, Artificial
  CRISPR gRNA sequence
atagtgagcagccactccat

SEQ ID NO: 198217 - DNA, 20 bp, Artificial
  CRISPR gRNA sequence
catgtggtactgtgcaagca

SEQ ID NO: 198218 - DNA, 20 bp, Artificial
  CRISPR gRNA sequence
tgcaagcacattataaatat

SEQ ID NO: 198219 - DNA, 20 bp, Artificial
  CRISPR gRNA sequence
taaatattagcctcacaaga

SEQ ID NO: 198220 - DNA, 20 bp, Artificial
  CRISPR gRNA sequence
gcctcacaagaaatgtatta

SEQ ID NO: 198221 - DNA, 20 bp, Artificial
  CRISPR gRNA sequence
acaagaaatgtattagcatt

SEQ ID NO: 198222 - DNA, 20 bp, Artificial
  CRISPR gRNA sequence
gcatttgtattttgtacact

SEQ ID NO: 198223 - DNA, 20 bp, Artificial
  CRISPR gRNA sequence
gtattttgtacactggttaa

SEQ ID NO: 198224 - DNA, 20 bp, Artificial
  CRISPR gRNA sequence
tattttgtacactggttaag

SEQ ID NO: 198225 - DNA, 20 bp, Artificial
  CRISPR gRNA sequence
tgtacactggttaagtatct

SEQ ID NO: 198226 - DNA, 20 bp, Artificial
  CRISPR gRNA sequence
gtacactggttaagtatctt

SEQ ID NO: 198227 - DNA, 20 bp, Artificial
  CRISPR gRNA sequence
tacactggttaagtatcttg

SEQ ID NO: 198228 - DNA, 20 bp, Artificial
  CRISPR gRNA sequence
gttaagtatcttgcccaaga

SEQ ID NO: 198229 - DNA, 20 bp, Artificial
  CRISPR gRNA sequence
agtatcttgcccaagacctc

SEQ ID NO: 198230 - DNA, 20 bp, Artificial
  CRISPR gRNA sequence
gcccaagacctcaaaactgg

SEQ ID NO: 198231 - DNA, 20 bp, Artificial
  CRISPR gRNA sequence
cccaagacctcaaaactggt

SEQ ID NO: 198232 - DNA, 20 bp, Artificial
  CRISPR gRNA sequence
aaaactggttaagggcagca

SEQ ID NO: 198233 - DNA, 20 bp, Artificial
  CRISPR gRNA sequence
gttaagggcagcagaattta

SEQ ID NO: 198234 - DNA, 20 bp, Artificial
  CRISPR gRNA sequence
agggcagcagaatttagccc

SEQ ID NO: 198235 - DNA, 20 bp, Artificial
  CRISPR gRNA sequence
agccccagcaccaccttttc

SEQ ID NO: 198236 - DNA, 20 bp, Artificial
  CRISPR gRNA sequence
gccccagcaccaccttttca

SEQ ID NO: 198237 - DNA, 20 bp, Artificial
  CRISPR gRNA sequence
ttcaaagcctgggcttctca

SEQ ID NO: 198238 - DNA, 20 bp, Artificial
  CRISPR gRNA sequence
tcaaagcctgggcttctcac

SEQ ID NO: 198239 - DNA, 20 bp, Artificial
  CRISPR gRNA sequence
caaagcctgggcttctcaca

SEQ ID NO: 198240 - DNA, 20 bp, Artificial
  CRISPR gRNA sequence
aaagcctgggcttctcacac

SEQ ID NO: 198241 - DNA, 20 bp, Artificial
  CRISPR gRNA sequence
ggcttctcacacttctccat

SEQ ID NO: 198242 - DNA, 20 bp, Artificial
  CRISPR gRNA sequence
ctcacacttctccatgctgt

SEQ ID NO: 198243 - DNA, 20 bp, Artificial
  CRISPR gRNA sequence
tcacacttctccatgctgtt

SEQ ID NO: 198244 - DNA, 20 bp, Artificial
  CRISPR gRNA sequence
acacttctccatgctgttcc

SEQ ID NO: 198245 - DNA, 20 bp, Artificial
  CRISPR gRNA sequence
ctccatgctgttcccatttt

SEQ ID NO: 198246 - DNA, 20 bp, Artificial
  CRISPR gRNA sequence
tccatgctgttcccatttta

SEQ ID NO: 198247 - DNA, 20 bp, Artificial
  CRISPR gRNA sequence
catgctgttcccattttaac

SEQ ID NO: 198248 - DNA, 20 bp, Artificial
  CRISPR gRNA sequence
ttcccattttaacacaggta

SEQ ID NO: 198249 - DNA, 20 bp, Artificial
  CRISPR gRNA sequence
ccattttaacacaggtatct

SEQ ID NO: 198250 - DNA, 20 bp, Artificial
  CRISPR gRNA sequence
taacacaggtatctcgccat

SEQ ID NO: 198251 - DNA, 20 bp, Artificial
  CRISPR gRNA sequence
aacacaggtatctcgccatt

SEQ ID NO: 198252 - DNA, 20 bp, Artificial
  CRISPR gRNA sequence
acacaggtatctcgccattc

SEQ ID NO: 198253 - DNA, 20 bp, Artificial
  CRISPR gRNA sequence
gccattccagccactcaaac

SEQ ID NO: 198254 - DNA, 20 bp, Artificial
  CRISPR gRNA sequence
cagccactcaaactttggca

SEQ ID NO: 198255 - DNA, 20 bp, Artificial
  CRISPR gRNA sequence
aaactttggcatttaagaaa

SEQ ID NO: 198256 - DNA, 20 bp, Artificial
  CRISPR gRNA sequence
tggcatttaagaaaattatc

SEQ ID NO: 198257 - DNA, 20 bp, Artificial
  CRISPR gRNA sequence
ggcatttaagaaaattatcc

SEQ ID NO: 198258 - DNA, 20 bp, Artificial
  CRISPR gRNA sequence
gcatttaagaaaattatcct

SEQ ID NO: 198259 - DNA, 20 bp, Artificial
  CRISPR gRNA sequence
aagaaaattatcctaaagct

SEQ ID NO: 198260 - DNA, 20 bp, Artificial
  CRISPR gRNA sequence
agaaaattatcctaaagcta

SEQ ID NO: 198261 - DNA, 20 bp, Artificial
  CRISPR gRNA sequence
tcctaaagctaaactaaact

SEQ ID NO: 198262 - DNA, 20 bp, Artificial
  CRISPR gRNA sequence
aagctaaactaaacttcaag

SEQ ID NO: 198263 - DNA, 20 bp, Artificial
  CRISPR gRNA sequence
aactaaacttcaaggatgac

SEQ ID NO: 198264 - DNA, 20 bp, Artificial
  CRISPR gRNA sequence
aacttcaaggatgaccattc

SEQ ID NO: 198265 - DNA, 20 bp, Artificial
  CRISPR gRNA sequence
caaggatgaccattctcctg

SEQ ID NO: 198266 - DNA, 20 bp, Artificial
  CRISPR gRNA sequence
aaggatgaccattctcctga

SEQ ID NO: 198267 - DNA, 20 bp, Artificial
  CRISPR gRNA sequence
tcctgaccccttcccatcaa

SEQ ID NO: 198268 - DNA, 20 bp, Artificial
  CRISPR gRNA sequence
ctgaccccttcccatcaaaa

SEQ ID NO: 198269 - DNA, 20 bp, Artificial
  CRISPR gRNA sequence
accccttcccatcaaaattt

SEQ ID NO: 198270 - DNA, 20 bp, Artificial
  CRISPR gRNA sequence
cccatcaaaattttatcttt

SEQ ID NO: 198271 - DNA, 20 bp, Artificial
  CRISPR gRNA sequence
ccatcaaaattttatcttta

SEQ ID NO: 198272 - DNA, 20 bp, Artificial
  CRISPR gRNA sequence
tatctttagtcagtttgttt

SEQ ID NO: 198273 - DNA, 20 bp, Artificial
  CRISPR gRNA sequence
atctttagtcagtttgtttt

SEQ ID NO: 198274 - DNA, 20 bp, Artificial
  CRISPR gRNA sequence
tctttagtcagtttgttttc

SEQ ID NO: 198275 - DNA, 20 bp, Artificial
  CRISPR gRNA sequence
tagtcagtttgttttcgttt

SEQ ID NO: 198276 - DNA, 20 bp, Artificial
  CRISPR gRNA sequence
agtcagtttgttttcgtttt

SEQ ID NO: 198277 - DNA, 20 bp, Artificial
  CRISPR gRNA sequence
gtcagtttgttttcgttttg

SEQ ID NO: 198278 - DNA, 20 bp, Artificial
  CRISPR gRNA sequence
gttttcgttttgttttgttt

SEQ ID NO: 198279 - DNA, 20 bp, Artificial
  CRISPR gRNA sequence
ttttcgttttgttttgtttt

SEQ ID NO: 198280 - DNA, 20 bp, Artificial
  CRISPR gRNA sequence
tcgttttgttttgtttttca

SEQ ID NO: 198281 - DNA, 20 bp, Artificial
  CRISPR gRNA sequence
cgttttgttttgtttttcag

SEQ ID NO: 198282 - DNA, 20 bp, Artificial
  CRISPR gRNA sequence
gttttgttttgtttttcaga

SEQ ID NO: 198283 - DNA, 20 bp, Artificial
  CRISPR gRNA sequence
tgttttgtttttcagaacta

SEQ ID NO: 198284 - DNA, 20 bp, Artificial
  CRISPR gRNA sequence
gttttgtttttcagaactac

SEQ ID NO: 198285 - DNA, 20 bp, Artificial
  CRISPR gRNA sequence
ttttgtttttcagaactacc

SEQ ID NO: 198286 - DNA, 20 bp, Artificial
  CRISPR gRNA sequence
tgtttttcagaactacctct

SEQ ID NO: 198287 - DNA, 20 bp, Artificial
  CRISPR gRNA sequence
gtttttcagaactacctctg

SEQ ID NO: 198288 - DNA, 20 bp, Artificial
  CRISPR gRNA sequence
tttttcagaactacctctgg

SEQ ID NO: 198289 - DNA, 20 bp, Artificial
  CRISPR gRNA sequence
ttcagaactacctctggcac

SEQ ID NO: 198290 - DNA, 20 bp, Artificial
  CRISPR gRNA sequence
tcagaactacctctggcaca

SEQ ID NO: 198291 - DNA, 20 bp, Artificial
  CRISPR gRNA sequence
cagaactacctctggcacat

SEQ ID NO: 198292 - DNA, 20 bp, Artificial
  CRISPR gRNA sequence
agaactacctctggcacatc

SEQ ID NO: 198293 - DNA, 20 bp, Artificial
  CRISPR gRNA sequence
cctctggcacatcctccaaa

SEQ ID NO: 198294 - DNA, 20 bp, Artificial
  CRISPR gRNA sequence
tggcacatcctccaaatgaa

SEQ ID NO: 198295 - DNA, 20 bp, Artificial
  CRISPR gRNA sequence
gcacatcctccaaatgaaag

SEQ ID NO: 198296 - DNA, 20 bp, Artificial
  CRISPR gRNA sequence
caaatgaaaggactcacttg

SEQ ID NO: 198297 - DNA, 20 bp, Artificial
  CRISPR gRNA sequence
acttggtaattctgggagcc

SEQ ID NO: 198298 - DNA, 20 bp, Artificial
  CRISPR gRNA sequence
ggtaattctgggagccatct

SEQ ID NO: 198299 - DNA, 20 bp, Artificial
  CRISPR gRNA sequence
gtaattctgggagccatctt

SEQ ID NO: 198300 - DNA, 20 bp, Artificial
  CRISPR gRNA sequence
tgggagccatcttattatgc

SEQ ID NO: 198301 - DNA, 20 bp, Artificial
  CRISPR gRNA sequence
ggagccatcttattatgcct

SEQ ID NO: 198302 - DNA, 20 bp, Artificial
  CRISPR gRNA sequence
attatgccttggtgtagcac

SEQ ID NO: 198303 - DNA, 20 bp, Artificial
  CRISPR gRNA sequence
ttatgccttggtgtagcact

SEQ ID NO: 198304 - DNA, 20 bp, Artificial
  CRISPR gRNA sequence
tgccttggtgtagcactgac

SEQ ID NO: 198305 - DNA, 20 bp, Artificial
  CRISPR gRNA sequence
ggtgtagcactgacattcat

SEQ ID NO: 198306 - DNA, 20 bp, Artificial
  CRISPR gRNA sequence
gtgtagcactgacattcatc

SEQ ID NO: 198307 - DNA, 20 bp, Artificial
  CRISPR gRNA sequence
acattcatcttccgtttaag

SEQ ID NO: 198308 - DNA, 20 bp, Artificial
  CRISPR gRNA sequence
atcttccgtttaagaaaagg

SEQ ID NO: 198309 - DNA, 20 bp, Artificial
  CRISPR gRNA sequence
ccgtttaagaaaaggtagta

SEQ ID NO: 198310 - DNA, 20 bp, Artificial
  CRISPR gRNA sequence
cgtttaagaaaaggtagtat

SEQ ID NO: 198311 - DNA, 20 bp, Artificial
  CRISPR gRNA sequence
aagaaaaggtagtatttcct

SEQ ID NO: 198312 - DNA, 20 bp, Artificial
  CRISPR gRNA sequence
agaaaaggtagtatttcctt

SEQ ID NO: 198313 - DNA, 20 bp, Artificial
  CRISPR gRNA sequence
ccttaattgcagtggtctcc

SEQ ID NO: 198314 - DNA, 20 bp, Artificial
  CRISPR gRNA sequence
cttaattgcagtggtctcca

SEQ ID NO: 198315 - DNA, 20 bp, Artificial
  CRISPR gRNA sequence
aattgcagtggtctccactg

SEQ ID NO: 198316 - DNA, 20 bp, Artificial
  CRISPR gRNA sequence
attgcagtggtctccactgg

SEQ ID NO: 198317 - DNA, 20 bp, Artificial
  CRISPR gRNA sequence
cagtggtctccactgggggt

SEQ ID NO: 198318 - DNA, 20 bp, Artificial
  CRISPR gRNA sequence
cactgggggtgaggaagggg

SEQ ID NO: 198319 - DNA, 20 bp, Artificial
  CRISPR gRNA sequence
ggggtgaggaaggggtgaga

SEQ ID NO: 198320 - DNA, 20 bp, Artificial
  CRISPR gRNA sequence
gatcatggctgcaaggaaac

SEQ ID NO: 198321 - DNA, 20 bp, Artificial
  CRISPR gRNA sequence
caaggaaacccgacttaacc

SEQ ID NO: 198322 - DNA, 20 bp, Artificial
  CRISPR gRNA sequence
aacctctgcaaggtggtgca

SEQ ID NO: 198323 - DNA, 20 bp, Artificial
  CRISPR gRNA sequence
acctctgcaaggtggtgcaa

SEQ ID NO: 198324 - DNA, 20 bp, Artificial
  CRISPR gRNA sequence
tgcaaggtggtgcaaaggca

SEQ ID NO: 198325 - DNA, 20 bp, Artificial
  CRISPR gRNA sequence
caaggtggtgcaaaggcatt

SEQ ID NO: 198326 - DNA, 20 bp, Artificial
  CRISPR gRNA sequence
cactgttcaacagcaattat

SEQ ID NO: 198327 - DNA, 20 bp, Artificial
  CRISPR gRNA sequence
ttcaacagcaattatattga

SEQ ID NO: 198328 - DNA, 20 bp, Artificial
  CRISPR gRNA sequence
aacagcaattatattgaagc

SEQ ID NO: 198329 - DNA, 20 bp, Artificial
  CRISPR gRNA sequence
tattgaagctgagtgggatc

SEQ ID NO: 198330 - DNA, 20 bp, Artificial
  CRISPR gRNA sequence
aagctgagtgggatcactgg

SEQ ID NO: 198331 - DNA, 20 bp, Artificial
  CRISPR gRNA sequence
agtgggatcactgggtgaag

SEQ ID NO: 198332 - DNA, 20 bp, Artificial
  CRISPR gRNA sequence
ggtgaagatgaagcgtaagg

SEQ ID NO: 198333 - DNA, 20 bp, Artificial
  CRISPR gRNA sequence
ttttctatcatgaaaataac

SEQ ID NO: 198334 - DNA, 20 bp, Artificial
  CRISPR gRNA sequence
tttctatcatgaaaataacc

SEQ ID NO: 198335 - DNA, 20 bp, Artificial
  CRISPR gRNA sequence
ttctatcatgaaaataacca

SEQ ID NO: 198336 - DNA, 20 bp, Artificial
  CRISPR gRNA sequence
tctatcatgaaaataaccac

SEQ ID NO: 198337 - DNA, 20 bp, Artificial
  CRISPR gRNA sequence
ctatcatgaaaataaccaca

SEQ ID NO: 198338 - DNA, 20 bp, Artificial
  CRISPR gRNA sequence
tatcatgaaaataaccacag

SEQ ID NO: 198339 - DNA, 20 bp, Artificial
  CRISPR gRNA sequence
tcatgaaaataaccacagac

SEQ ID NO: 198340 - DNA, 20 bp, Artificial
  CRISPR gRNA sequence
acagaagagaaagagctaaa

SEQ ID NO: 198341 - DNA, 20 bp, Artificial
  CRISPR gRNA sequence
cagaagagaaagagctaaaa

SEQ ID NO: 198342 - DNA, 20 bp, Artificial
  CRISPR gRNA sequence
aaatgcccgtcattttcagt

SEQ ID NO: 198343 - DNA, 20 bp, Artificial
  CRISPR gRNA sequence
tcagttgcattttagtcttg

SEQ ID NO: 198344 - DNA, 20 bp, Artificial
  CRISPR gRNA sequence
cagttgcattttagtcttgc

SEQ ID NO: 198345 - DNA, 20 bp, Artificial
  CRISPR gRNA sequence
agttgcattttagtcttgca

SEQ ID NO: 198346 - DNA, 20 bp, Artificial
  CRISPR gRNA sequence
cattttagtcttgcattagt

SEQ ID NO: 198347 - DNA, 20 bp, Artificial
  CRISPR gRNA sequence
tagtcttgcattagttgcaa

SEQ ID NO: 198348 - DNA, 20 bp, Artificial
  CRISPR gRNA sequence
agtcttgcattagttgcaac

SEQ ID NO: 198349 - DNA, 20 bp, Artificial
  CRISPR gRNA sequence
gtcttgcattagttgcaacc

SEQ ID NO: 198350 - DNA, 20 bp, Artificial
  CRISPR gRNA sequence
gcattagttgcaaccagctg

SEQ ID NO: 198351 - DNA, 20 bp, Artificial
  CRISPR gRNA sequence
cattagttgcaaccagctgg

SEQ ID NO: 198352 - DNA, 20 bp, Artificial
  CRISPR gRNA sequence
gttgcaaccagctggtttct

SEQ ID NO: 198353 - DNA, 20 bp, Artificial
  CRISPR gRNA sequence
caaccagctggtttctgggt

SEQ ID NO: 198354 - DNA, 20 bp, Artificial
  CRISPR gRNA sequence
gtttctgggtaccctaagta

SEQ ID NO: 198355 - DNA, 20 bp, Artificial
  CRISPR gRNA sequence
ctgggtaccctaagtaataa

SEQ ID NO: 198356 - DNA, 20 bp, Artificial
  CRISPR gRNA sequence
tgggtaccctaagtaataaa

SEQ ID NO: 198357 - DNA, 20 bp, Artificial
  CRISPR gRNA sequence
ggtaccctaagtaataaaaa

SEQ ID NO: 198358 - DNA, 20 bp, Artificial
  CRISPR gRNA sequence
agtaataaaaatagttcctc

SEQ ID NO: 198359 - DNA, 20 bp, Artificial
  CRISPR gRNA sequence
ctctgtagaactgtagtatg

SEQ ID NO: 198360 - DNA, 20 bp, Artificial
  CRISPR gRNA sequence
tgtagaactgtagtatgttt

SEQ ID NO: 198361 - DNA, 20 bp, Artificial
  CRISPR gRNA sequence
tagaactgtagtatgtttac

SEQ ID NO: 198362 - DNA, 20 bp, Artificial
  CRISPR gRNA sequence
tagtatgtttaccatagagt

SEQ ID NO: 198363 - DNA, 20 bp, Artificial
  CRISPR gRNA sequence
accatagagtattttgcaaa

SEQ ID NO: 198364 - DNA, 20 bp, Artificial
  CRISPR gRNA sequence
ccatagagtattttgcaaaa

SEQ ID NO: 198365 - DNA, 20 bp, Artificial
  CRISPR gRNA sequence
tgcaaaatttttggtagagg

SEQ ID NO: 198366 - DNA, 20 bp, Artificial
  CRISPR gRNA sequence
gcaaaatttttggtagagga

SEQ ID NO: 198367 - DNA, 20 bp, Artificial
  CRISPR gRNA sequence
caaaatttttggtagaggat

SEQ ID NO: 198368 - DNA, 20 bp, Artificial
  CRISPR gRNA sequence
ttggtagaggatgttacata

SEQ ID NO: 198369 - DNA, 20 bp, Artificial
  CRISPR gRNA sequence
tggtagaggatgttacataa

SEQ ID NO: 198370 - DNA, 20 bp, Artificial
  CRISPR gRNA sequence
ggtagaggatgttacataat

SEQ ID NO: 198371 - DNA, 20 bp, Artificial
  CRISPR gRNA sequence
gtagaggatgttacataatt

SEQ ID NO: 198372 - DNA, 20 bp, Artificial
  CRISPR gRNA sequence
cataatttgcatgtgttcat

SEQ ID NO: 198373 - DNA, 20 bp, Artificial
  CRISPR gRNA sequence
gcatgtgttcatttctccat

SEQ ID NO: 198374 - DNA, 20 bp, Artificial
  CRISPR gRNA sequence
catgtgttcatttctccatt

SEQ ID NO: 198375 - DNA, 20 bp, Artificial
  CRISPR gRNA sequence
atttctccatttacctgtgg

SEQ ID NO: 198376 - DNA, 20 bp, Artificial
  CRISPR gRNA sequence
ctccatttacctgtgggaac

SEQ ID NO: 198377 - DNA, 20 bp, Artificial
  CRISPR gRNA sequence
tccatttacctgtgggaaca

SEQ ID NO: 198378 - DNA, 20 bp, Artificial
  CRISPR gRNA sequence
catttacctgtgggaacaat

SEQ ID NO: 198379 - DNA, 20 bp, Artificial
  CRISPR gRNA sequence
acctgtgggaacaattaaaa

SEQ ID NO: 198380 - DNA, 20 bp, Artificial
  CRISPR gRNA sequence
cctgtgggaacaattaaaat

SEQ ID NO: 198381 - DNA, 20 bp, Artificial
  CRISPR gRNA sequence
tgggaacaattaaaatccag

SEQ ID NO: 198382 - DNA, 20 bp, Artificial
  CRISPR gRNA sequence
aaatccaggaaaatgagtat

SEQ ID NO: 198383 - DNA, 20 bp, Artificial
  CRISPR gRNA sequence
aaataatttcctcccattta

SEQ ID NO: 198384 - DNA, 20 bp, Artificial
  CRISPR gRNA sequence
cctcccatttaagatgagtc

SEQ ID NO: 198385 - DNA, 20 bp, Artificial
  CRISPR gRNA sequence
ctcccatttaagatgagtca

SEQ ID NO: 198386 - DNA, 20 bp, Artificial
  CRISPR gRNA sequence
ccatttaagatgagtcagag

SEQ ID NO: 198387 - DNA, 20 bp, Artificial
  CRISPR gRNA sequence
aagatgagtcagagtaaata

SEQ ID NO: 198388 - DNA, 20 bp, Artificial
  CRISPR gRNA sequence
agatgagtcagagtaaataa

SEQ ID NO: 198389 - DNA, 20 bp, Artificial
  CRISPR gRNA sequence
ctccaatacttagagaagta

SEQ ID NO: 198390 - DNA, 20 bp, Artificial
  CRISPR gRNA sequence
caatacttagagaagtatac

SEQ ID NO: 198391 - DNA, 20 bp, Artificial
  CRISPR gRNA sequence
agagaagtataccaagagat

SEQ ID NO: 198392 - DNA, 20 bp, Artificial
  CRISPR gRNA sequence
gagaagtataccaagagatc

SEQ ID NO: 198393 - DNA, 20 bp, Artificial
  CRISPR gRNA sequence
tctgatgttaaatagggaag

SEQ ID NO: 198394 - DNA, 20 bp, Artificial
  CRISPR gRNA sequence
atgttaaatagggaagtaga

SEQ ID NO: 198395 - DNA, 20 bp, Artificial
  CRISPR gRNA sequence
aatagggaagtagaatatgg

SEQ ID NO: 198396 - DNA, 20 bp, Artificial
  CRISPR gRNA sequence
caatagtcgttgaaaaattc

SEQ ID NO: 198397 - DNA, 20 bp, Artificial
  CRISPR gRNA sequence
aaaaattccccataacccct

SEQ ID NO: 198398 - DNA, 20 bp, Artificial
  CRISPR gRNA sequence
cccataaccccttacatggg

SEQ ID NO: 198399 - DNA, 20 bp, Artificial
  CRISPR gRNA sequence
acatgggggaaagtagtgtt

SEQ ID NO: 198400 - DNA, 20 bp, Artificial
  CRISPR gRNA sequence
catgggggaaagtagtgtta

SEQ ID NO: 198401 - DNA, 20 bp, Artificial
  CRISPR gRNA sequence
actgagagagtagagataag

SEQ ID NO: 198402 - DNA, 20 bp, Artificial
  CRISPR gRNA sequence
agagagtagagataagctgt

SEQ ID NO: 198403 - DNA, 20 bp, Artificial
  CRISPR gRNA sequence
tttccaaaaattatattctt

SEQ ID NO: 198404 - DNA, 20 bp, Artificial
  CRISPR gRNA sequence
ccaaaaattatattcttaac

SEQ ID NO: 198405 - DNA, 20 bp, Artificial
  CRISPR gRNA sequence
caaaaattatattcttaaca

SEQ ID NO: 198406 - DNA, 20 bp, Artificial
  CRISPR gRNA sequence
tattcttaacaggactgaga

SEQ ID NO: 198407 - DNA, 20 bp, Artificial
  CRISPR gRNA sequence
ttaacaggactgagatagcc

SEQ ID NO: 198408 - DNA, 20 bp, Artificial
  CRISPR gRNA sequence
aacaggactgagatagccag

SEQ ID NO: 198409 - DNA, 20 bp, Artificial
  CRISPR gRNA sequence
acaggactgagatagccaga

SEQ ID NO: 198410 - DNA, 20 bp, Artificial
  CRISPR gRNA sequence
agatagccagaatataagga

SEQ ID NO: 198411 - DNA, 20 bp, Artificial
  CRISPR gRNA sequence
caatgacagtaagatcctga

SEQ ID NO: 198412 - DNA, 20 bp, Artificial
  CRISPR gRNA sequence
aatgacagtaagatcctgag

SEQ ID NO: 198413 - DNA, 20 bp, Artificial
  CRISPR gRNA sequence
agatggagttgatttgcaca

SEQ ID NO: 198414 - DNA, 20 bp, Artificial
  CRISPR gRNA sequence
atttgcacaaagaaataatt

SEQ ID NO: 198415 - DNA, 20 bp, Artificial
  CRISPR gRNA sequence
gcacaaagaaataattgttg

SEQ ID NO: 198416 - DNA, 20 bp, Artificial
  CRISPR gRNA sequence
cacaaagaaataattgttgc

SEQ ID NO: 198417 - DNA, 20 bp, Artificial
  CRISPR gRNA sequence
ttgccagcatgcattttgaa

SEQ ID NO: 198418 - DNA, 20 bp, Artificial
  CRISPR gRNA sequence
ccagcatgcattttgaatat

SEQ ID NO: 198419 - DNA, 20 bp, Artificial
  CRISPR gRNA sequence
tgaatatttctctggaaaaa

SEQ ID NO: 198420 - DNA, 20 bp, Artificial
  CRISPR gRNA sequence
gaatatttctctggaaaaaa

SEQ ID NO: 198421 - DNA, 20 bp, Artificial
  CRISPR gRNA sequence
aatatttctctggaaaaaaa

SEQ ID NO: 198422 - DNA, 20 bp, Artificial
  CRISPR gRNA sequence
ctctggaaaaaaagattagt

SEQ ID NO: 198423 - DNA, 20 bp, Artificial
  CRISPR gRNA sequence
tctggaaaaaaagattagtt

SEQ ID NO: 198424 - DNA, 20 bp, Artificial
  CRISPR gRNA sequence
tggaaaaaaagattagttgg

SEQ ID NO: 198425 - DNA, 20 bp, Artificial
  CRISPR gRNA sequence
gaaaaaaagattagttggca

SEQ ID NO: 198426 - DNA, 20 bp, Artificial
  CRISPR gRNA sequence
gttggcagtagaaatggata

SEQ ID NO: 198427 - DNA, 20 bp, Artificial
  CRISPR gRNA sequence
gcagtagaaatggatagaaa

SEQ ID NO: 198428 - DNA, 20 bp, Artificial
  CRISPR gRNA sequence
aaatacctcagaatttggtt

SEQ ID NO: 198429 - DNA, 20 bp, Artificial
  CRISPR gRNA sequence
agaatttggttcatctctgg

SEQ ID NO: 198430 - DNA, 20 bp, Artificial
  CRISPR gRNA sequence
ggttcatctctgggaaaaga

SEQ ID NO: 198431 - DNA, 20 bp, Artificial
  CRISPR gRNA sequence
gttcatctctgggaaaagat

SEQ ID NO: 198432 - DNA, 20 bp, Artificial
  CRISPR gRNA sequence
atctctgggaaaagatgaaa

SEQ ID NO: 198433 - DNA, 20 bp, Artificial
  CRISPR gRNA sequence
tgggaaaagatgaaaaataa

SEQ ID NO: 198434 - DNA, 20 bp, Artificial
  CRISPR gRNA sequence
ggaaaagatgaaaaataaaa

SEQ ID NO: 198435 - DNA, 20 bp, Artificial
  CRISPR gRNA sequence
ctcaagaacatctaggatca

SEQ ID NO: 198436 - DNA, 20 bp, Artificial
  CRISPR gRNA sequence
aagaacatctaggatcaaaa

SEQ ID NO: 198437 - DNA, 20 bp, Artificial
  CRISPR gRNA sequence
ggatcaaaagcatgtgccct

SEQ ID NO: 198438 - DNA, 20 bp, Artificial
  CRISPR gRNA sequence
cactattgaattaattaacc

SEQ ID NO: 198439 - DNA, 20 bp, Artificial
  CRISPR gRNA sequence
ttgaattaattaacctcata

SEQ ID NO: 198440 - DNA, 20 bp, Artificial
  CRISPR gRNA sequence
aattaattaacctcataagt

SEQ ID NO: 198441 - DNA, 20 bp, Artificial
  CRISPR gRNA sequence
attaacctcataagttggga

SEQ ID NO: 198442 - DNA, 20 bp, Artificial
  CRISPR gRNA sequence
acctcataagttgggacctg

SEQ ID NO: 198443 - DNA, 20 bp, Artificial
  CRISPR gRNA sequence
ataagttgggacctgtggaa

SEQ ID NO: 198444 - DNA, 20 bp, Artificial
  CRISPR gRNA sequence
ggacctgtggaataaggatg

SEQ ID NO: 198445 - DNA, 20 bp, Artificial
  CRISPR gRNA sequence
tggaataaggatgtccacca

SEQ ID NO: 198446 - DNA, 20 bp, Artificial
  CRISPR gRNA sequence
cctagggattacaaatgttt

SEQ ID NO: 198447 - DNA, 20 bp, Artificial
  CRISPR gRNA sequence
ctagggattacaaatgtttc

SEQ ID NO: 198448 - DNA, 20 bp, Artificial
  CRISPR gRNA sequence
gggattacaaatgtttcaca

SEQ ID NO: 198449 - DNA, 20 bp, Artificial
  CRISPR gRNA sequence
caaatgtttcacagaacttg

SEQ ID NO: 198450 - DNA, 20 bp, Artificial
  CRISPR gRNA sequence
cacagaacttgaaatttaaa

SEQ ID NO: 198451 - DNA, 20 bp, Artificial
  CRISPR gRNA sequence
acagaacttgaaatttaaac

SEQ ID NO: 198452 - DNA, 20 bp, Artificial
  CRISPR gRNA sequence
gaaatttaaacttgggtcac

SEQ ID NO: 198453 - DNA, 20 bp, Artificial
  CRISPR gRNA sequence
aaatttaaacttgggtcact

SEQ ID NO: 198454 - DNA, 20 bp, Artificial
  CRISPR gRNA sequence
aaacttgggtcactgtatgg

SEQ ID NO: 198455 - DNA, 20 bp, Artificial
  CRISPR gRNA sequence
aacttgggtcactgtatggg

SEQ ID NO: 198456 - DNA, 20 bp, Artificial
  CRISPR gRNA sequence
gggtcactgtatgggatgta

SEQ ID NO: 198457 - DNA, 20 bp, Artificial
  CRISPR gRNA sequence
ggtcactgtatgggatgtag

SEQ ID NO: 198458 - DNA, 20 bp, Artificial
  CRISPR gRNA sequence
tatgggatgtagagctgtgc

SEQ ID NO: 198459 - DNA, 20 bp, Artificial
  CRISPR gRNA sequence
tgctatatggaaataaaaat

SEQ ID NO: 198460 - DNA, 20 bp, Artificial
  CRISPR gRNA sequence
tatggaaataaaaatgattt

SEQ ID NO: 198461 - DNA, 20 bp, Artificial
  CRISPR gRNA sequence
ctttttctcaagggagaatg

SEQ ID NO: 198462 - DNA, 20 bp, Artificial
  CRISPR gRNA sequence
tttttctcaagggagaatga

SEQ ID NO: 198463 - DNA, 20 bp, Artificial
  CRISPR gRNA sequence
tttctcaagggagaatgatg

SEQ ID NO: 198464 - DNA, 20 bp, Artificial
  CRISPR gRNA sequence
ttctcaagggagaatgatgg

SEQ ID NO: 198465 - DNA, 20 bp, Artificial
  CRISPR gRNA sequence
tctcaagggagaatgatgga

SEQ ID NO: 198466 - DNA, 20 bp, Artificial
  CRISPR gRNA sequence
ctcaagggagaatgatggat

SEQ ID NO: 198467 - DNA, 20 bp, Artificial
  CRISPR gRNA sequence
tcaagggagaatgatggatg

SEQ ID NO: 198468 - DNA, 20 bp, Artificial
  CRISPR gRNA sequence
aagggagaatgatggatgtg

SEQ ID NO: 198469 - DNA, 20 bp, Artificial
  CRISPR gRNA sequence
aaagaagcaaagtggtaaga

SEQ ID NO: 198470 - DNA, 20 bp, Artificial
  CRISPR gRNA sequence
ggaagtaaaagtcaaaggaa

SEQ ID NO: 198471 - DNA, 20 bp, Artificial
  CRISPR gRNA sequence
aagcaataacaaagagaaat

SEQ ID NO: 198472 - DNA, 20 bp, Artificial
  CRISPR gRNA sequence
ctctccttttaaagaatgct

SEQ ID NO: 198473 - DNA, 20 bp, Artificial
  CRISPR gRNA sequence
tccttttaaagaatgctggt

SEQ ID NO: 198474 - DNA, 20 bp, Artificial
  CRISPR gRNA sequence
cttttaaagaatgctggttc

SEQ ID NO: 198475 - DNA, 20 bp, Artificial
  CRISPR gRNA sequence
ttaaagaatgctggttcccc

SEQ ID NO: 198476 - DNA, 20 bp, Artificial
  CRISPR gRNA sequence
taaagaatgctggttcccct

SEQ ID NO: 198477 - DNA, 20 bp, Artificial
  CRISPR gRNA sequence
aaagaatgctggttcccctt

SEQ ID NO: 198478 - DNA, 20 bp, Artificial
  CRISPR gRNA sequence
aagaatgctggttccccttt

SEQ ID NO: 198479 - DNA, 20 bp, Artificial
  CRISPR gRNA sequence
gttcccctttgcctcacagc

SEQ ID NO: 198480 - DNA, 20 bp, Artificial
  CRISPR gRNA sequence
ccctttgcctcacagctaac

SEQ ID NO: 198481 - DNA, 20 bp, Artificial
  CRISPR gRNA sequence
tgcctcacagctaacacaag

SEQ ID NO: 198482 - DNA, 20 bp, Artificial
  CRISPR gRNA sequence
gcctcacagctaacacaaga

SEQ ID NO: 198483 - DNA, 20 bp, Artificial
  CRISPR gRNA sequence
cctcacagctaacacaagaa

SEQ ID NO: 198484 - DNA, 20 bp, Artificial
  CRISPR gRNA sequence
acagctaacacaagaactcc

SEQ ID NO: 198485 - DNA, 20 bp, Artificial
  CRISPR gRNA sequence
acacaagaactcctccaccg

SEQ ID NO: 198486 - DNA, 20 bp, Artificial
  CRISPR gRNA sequence
ctccaccgtctgaggaggtt

SEQ ID NO: 198487 - DNA, 20 bp, Artificial
  CRISPR gRNA sequence
caccgtctgaggaggtttag

SEQ ID NO: 198488 - DNA, 20 bp, Artificial
  CRISPR gRNA sequence
aggaggtttaggagcaggga

SEQ ID NO: 198489 - DNA, 20 bp, Artificial
  CRISPR gRNA sequence
aggagcagggaaggggaagg

SEQ ID NO: 198490 - DNA, 20 bp, Artificial
  CRISPR gRNA sequence
ggagcagggaaggggaagga

SEQ ID NO: 198491 - DNA, 20 bp, Artificial
  CRISPR gRNA sequence
catttgctaatcttctgttg

SEQ ID NO: 198492 - DNA, 20 bp, Artificial
  CRISPR gRNA sequence
atttgctaatcttctgttgc

SEQ ID NO: 198493 - DNA, 20 bp, Artificial
  CRISPR gRNA sequence
gctaatcttctgttgccctg

SEQ ID NO: 198494 - DNA, 20 bp, Artificial
  CRISPR gRNA sequence
ctaatcttctgttgccctgc

SEQ ID NO: 198495 - DNA, 20 bp, Artificial
  CRISPR gRNA sequence
atcttctgttgccctgcacc

SEQ ID NO: 198496 - DNA, 20 bp, Artificial
  CRISPR gRNA sequence
ctgttgccctgcaccctagc

SEQ ID NO: 198497 - DNA, 20 bp, Artificial
  CRISPR gRNA sequence
tgttgccctgcaccctagca

SEQ ID NO: 198498 - DNA, 20 bp, Artificial
  CRISPR gRNA sequence
ttgccctgcaccctagcagc

SEQ ID NO: 198499 - DNA, 20 bp, Artificial
  CRISPR gRNA sequence
ccctgcaccctagcagctcc

SEQ ID NO: 198500 - DNA, 20 bp, Artificial
  CRISPR gRNA sequence
caccctagcagctccttgca

SEQ ID NO: 198501 - DNA, 20 bp, Artificial
  CRISPR gRNA sequence
gcagctccttgcagcagggg

SEQ ID NO: 198502 - DNA, 20 bp, Artificial
  CRISPR gRNA sequence
cttgcagcaggggacaagga

SEQ ID NO: 198503 - DNA, 20 bp, Artificial
  CRISPR gRNA sequence
gcagcaggggacaaggatga

SEQ ID NO: 198504 - DNA, 20 bp, Artificial
  CRISPR gRNA sequence
cagcaggggacaaggatgac

SEQ ID NO: 198505 - DNA, 20 bp, Artificial
  CRISPR gRNA sequence
aggtggatggataattaatt

SEQ ID NO: 198506 - DNA, 20 bp, Artificial
  CRISPR gRNA sequence
ggtggatggataattaattg

SEQ ID NO: 198507 - DNA, 20 bp, Artificial
  CRISPR gRNA sequence
attgattctaaaatattgtg

SEQ ID NO: 198508 - DNA, 20 bp, Artificial
  CRISPR gRNA sequence
attctaaaatattgtgtgtc

SEQ ID NO: 198509 - DNA, 20 bp, Artificial
  CRISPR gRNA sequence
taaaatattgtgtgtcagta

SEQ ID NO: 198510 - DNA, 20 bp, Artificial
  CRISPR gRNA sequence
aaatattgtgtgtcagtatt

SEQ ID NO: 198511 - DNA, 20 bp, Artificial
  CRISPR gRNA sequence
tgtgtcagtattgtaatact

SEQ ID NO: 198512 - DNA, 20 bp, Artificial
  CRISPR gRNA sequence
taatactatgttaattgcac

SEQ ID NO: 198513 - DNA, 20 bp, Artificial
  CRISPR gRNA sequence
tgttaattgcaccatgcacg

SEQ ID NO: 198514 - DNA, 20 bp, Artificial
  CRISPR gRNA sequence
attgcaccatgcacggtatc

SEQ ID NO: 198515 - DNA, 20 bp, Artificial
  CRISPR gRNA sequence
caccatgcacggtatctcat

SEQ ID NO: 198516 - DNA, 20 bp, Artificial
  CRISPR gRNA sequence
atttaatcccccaccccttg

SEQ ID NO: 198517 - DNA, 20 bp, Artificial
  CRISPR gRNA sequence
aatcccccaccccttgccat

SEQ ID NO: 198518 - DNA, 20 bp, Artificial
  CRISPR gRNA sequence
atcccccaccccttgccatt

SEQ ID NO: 198519 - DNA, 20 bp, Artificial
  CRISPR gRNA sequence
gccattaccaaagagagaga

SEQ ID NO: 198520 - DNA, 20 bp, Artificial
  CRISPR gRNA sequence
ccattaccaaagagagagag

SEQ ID NO: 198521 - DNA, 20 bp, Artificial
  CRISPR gRNA sequence
ccaaagagagagagagagag

SEQ ID NO: 198522 - DNA, 20 bp, Artificial
  CRISPR gRNA sequence
gaatttatcctcattttaca

SEQ ID NO: 198523 - DNA, 20 bp, Artificial
  CRISPR gRNA sequence
atcctcattttacagtagag

SEQ ID NO: 198524 - DNA, 20 bp, Artificial
  CRISPR gRNA sequence
tcctcattttacagtagaga

SEQ ID NO: 198525 - DNA, 20 bp, Artificial
  CRISPR gRNA sequence
attttacagtagagaaaaca

SEQ ID NO: 198526 - DNA, 20 bp, Artificial
  CRISPR gRNA sequence
tacagtagagaaaacagagg

SEQ ID NO: 198527 - DNA, 20 bp, Artificial
  CRISPR gRNA sequence
acagtagagaaaacagaggg

SEQ ID NO: 198528 - DNA, 20 bp, Artificial
  CRISPR gRNA sequence
cagtagagaaaacagagggt

SEQ ID NO: 198529 - DNA, 20 bp, Artificial
  CRISPR gRNA sequence
atcacaaaaatcaagcttgg

SEQ ID NO: 198530 - DNA, 20 bp, Artificial
  CRISPR gRNA sequence
gggggccattagcctaacca

SEQ ID NO: 198531 - DNA, 20 bp, Artificial
  CRISPR gRNA sequence
ggggccattagcctaaccac

SEQ ID NO: 198532 - DNA, 20 bp, Artificial
  CRISPR gRNA sequence
gcctaaccacagacccttac

SEQ ID NO: 198533 - DNA, 20 bp, Artificial
  CRISPR gRNA sequence
accacagacccttactctta

SEQ ID NO: 198534 - DNA, 20 bp, Artificial
  CRISPR gRNA sequence
actcttaacccatctgcttc

SEQ ID NO: 198535 - DNA, 20 bp, Artificial
  CRISPR gRNA sequence
ctcttaacccatctgcttca

SEQ ID NO: 198536 - DNA, 20 bp, Artificial
  CRISPR gRNA sequence
ttaacccatctgcttcaatc

SEQ ID NO: 198537 - DNA, 20 bp, Artificial
  CRISPR gRNA sequence
aacccatctgcttcaatcca

SEQ ID NO: 198538 - DNA, 20 bp, Artificial
  CRISPR gRNA sequence
acccatctgcttcaatccat

SEQ ID NO: 198539 - DNA, 20 bp, Artificial
  CRISPR gRNA sequence
cttcaatccattttgctaca

SEQ ID NO: 198540 - DNA, 20 bp, Artificial
  CRISPR gRNA sequence
caatccattttgctacaaat

SEQ ID NO: 198541 - DNA, 20 bp, Artificial
  CRISPR gRNA sequence
aatccattttgctacaaatg

SEQ ID NO: 198542 - DNA, 20 bp, Artificial
  CRISPR gRNA sequence
tgctacaaatgtttacattt

SEQ ID NO: 198543 - DNA, 20 bp, Artificial
  CRISPR gRNA sequence
gctacaaatgtttacattta

SEQ ID NO: 198544 - DNA, 20 bp, Artificial
  CRISPR gRNA sequence
ctacaaatgtttacatttat

SEQ ID NO: 198545 - DNA, 20 bp, Artificial
  CRISPR gRNA sequence
caaatgtttacatttataag

SEQ ID NO: 198546 - DNA, 20 bp, Artificial
  CRISPR gRNA sequence
acatttataagcagggcaga

SEQ ID NO: 198547 - DNA, 20 bp, Artificial
  CRISPR gRNA sequence
catttataagcagggcagaa

SEQ ID NO: 198548 - DNA, 20 bp, Artificial
  CRISPR gRNA sequence
ataagcagggcagaaaaacc

SEQ ID NO: 198549 - DNA, 20 bp, Artificial
  CRISPR gRNA sequence
taagcagggcagaaaaacct

SEQ ID NO: 198550 - DNA, 20 bp, Artificial
  CRISPR gRNA sequence
atccaggttattgaactaag

SEQ ID NO: 198551 - DNA, 20 bp, Artificial
  CRISPR gRNA sequence
ttgaactaagaagaaagtta

SEQ ID NO: 198552 - DNA, 20 bp, Artificial
  CRISPR gRNA sequence
aactaagaagaaagttatat

SEQ ID NO: 198553 - DNA, 20 bp, Artificial
  CRISPR gRNA sequence
agaagaaagttatattaagg

SEQ ID NO: 198554 - DNA, 20 bp, Artificial
  CRISPR gRNA sequence
tattaaggtttctaattttt

SEQ ID NO: 198555 - DNA, 20 bp, Artificial
  CRISPR gRNA sequence
aggtttctaatttttttaat

SEQ ID NO: 198556 - DNA, 20 bp, Artificial
  CRISPR gRNA sequence
ctaatttttttaatgtagtt

SEQ ID NO: 198557 - DNA, 20 bp, Artificial
  CRISPR gRNA sequence
taatttttttaatgtagtta

SEQ ID NO: 198558 - DNA, 20 bp, Artificial
  CRISPR gRNA sequence
atttttttaatgtagttaga

SEQ ID NO: 198559 - DNA, 20 bp, Artificial
  CRISPR gRNA sequence
ttttaatgtagttagaaacc

SEQ ID NO: 198560 - DNA, 20 bp, Artificial
  CRISPR gRNA sequence
tttaatgtagttagaaacca

SEQ ID NO: 198561 - DNA, 20 bp, Artificial
  CRISPR gRNA sequence
ttaatgtagttagaaaccaa

SEQ ID NO: 198562 - DNA, 20 bp, Artificial
  CRISPR gRNA sequence
taatgtagttagaaaccaaa

SEQ ID NO: 198563 - DNA, 20 bp, Artificial
  CRISPR gRNA sequence
aatgtagttagaaaccaaac

SEQ ID NO: 198564 - DNA, 20 bp, Artificial
  CRISPR gRNA sequence
atgtagttagaaaccaaact

SEQ ID NO: 198565 - DNA, 20 bp, Artificial
  CRISPR gRNA sequence
gaaaccaaacttaacaatga

SEQ ID NO: 198566 - DNA, 20 bp, Artificial
  CRISPR gRNA sequence
aacaatgagcccaagtttaa

SEQ ID NO: 198567 - DNA, 20 bp, Artificial
  CRISPR gRNA sequence
acaatgagcccaagtttaaa

SEQ ID NO: 198568 - DNA, 20 bp, Artificial
  CRISPR gRNA sequence
aaagcagtctaattaacctg

SEQ ID NO: 198569 - DNA, 20 bp, Artificial
  CRISPR gRNA sequence
aagcagtctaattaacctgg

SEQ ID NO: 198570 - DNA, 20 bp, Artificial
  CRISPR gRNA sequence
attaacctggacaagctcag

SEQ ID NO: 198571 - DNA, 20 bp, Artificial
  CRISPR gRNA sequence
acctggacaagctcaggcaa

SEQ ID NO: 198572 - DNA, 20 bp, Artificial
  CRISPR gRNA sequence
gacaagctcaggcaagtttc

SEQ ID NO: 198573 - DNA, 20 bp, Artificial
  CRISPR gRNA sequence
aggcaagtttcattctgtgg

SEQ ID NO: 198574 - DNA, 20 bp, Artificial
  CRISPR gRNA sequence
cattctgtggcccatagcat

SEQ ID NO: 198575 - DNA, 20 bp, Artificial
  CRISPR gRNA sequence
attctgtggcccatagcatc

SEQ ID NO: 198576 - DNA, 20 bp, Artificial
  CRISPR gRNA sequence
tgtggcccatagcatcatct

SEQ ID NO: 198577 - DNA, 20 bp, Artificial
  CRISPR gRNA sequence
tggcccatagcatcatctgt

SEQ ID NO: 198578 - DNA, 20 bp, Artificial
  CRISPR gRNA sequence
tgttgtaaagctaagtagca

SEQ ID NO: 198579 - DNA, 20 bp, Artificial
  CRISPR gRNA sequence
taaagctaagtagcaaatgt

SEQ ID NO: 198580 - DNA, 20 bp, Artificial
  CRISPR gRNA sequence
agtagcaaatgttgtttggg

SEQ ID NO: 198581 - DNA, 20 bp, Artificial
  CRISPR gRNA sequence
tttgggtcatgctgggggac

SEQ ID NO: 198582 - DNA, 20 bp, Artificial
  CRISPR gRNA sequence
gggtcatgctgggggacaag

SEQ ID NO: 198583 - DNA, 20 bp, Artificial
  CRISPR gRNA sequence
ggtcatgctgggggacaagc

SEQ ID NO: 198584 - DNA, 20 bp, Artificial
  CRISPR gRNA sequence
ggggacaagccatcccaatt

SEQ ID NO: 198585 - DNA, 20 bp, Artificial
  CRISPR gRNA sequence
gctcaggactgaggggtttt

SEQ ID NO: 198586 - DNA, 20 bp, Artificial
  CRISPR gRNA sequence
ctcaggactgaggggttttc

SEQ ID NO: 198587 - DNA, 20 bp, Artificial
  CRISPR gRNA sequence
aggactgaggggttttccag

SEQ ID NO: 198588 - DNA, 20 bp, Artificial
  CRISPR gRNA sequence
aggggttttccaggatatca

SEQ ID NO: 198589 - DNA, 20 bp, Artificial
  CRISPR gRNA sequence
tccaggatatcatgtaagga

SEQ ID NO: 198590 - DNA, 20 bp, Artificial
  CRISPR gRNA sequence
ccaggatatcatgtaaggat

SEQ ID NO: 198591 - DNA, 20 bp, Artificial
  CRISPR gRNA sequence
caggatatcatgtaaggata

SEQ ID NO: 198592 - DNA, 20 bp, Artificial
  CRISPR gRNA sequence
ggtacaaatataacctgctg

SEQ ID NO: 198593 - DNA, 20 bp, Artificial
  CRISPR gRNA sequence
ctgctttctctcatttcaaa

SEQ ID NO: 198594 - DNA, 20 bp, Artificial
  CRISPR gRNA sequence
ctttctctcatttcaaattt

SEQ ID NO: 198595 - DNA, 20 bp, Artificial
  CRISPR gRNA sequence
tctctcatttcaaatttatc

SEQ ID NO: 198596 - DNA, 20 bp, Artificial
  CRISPR gRNA sequence
ctctcatttcaaatttatca

SEQ ID NO: 198597 - DNA, 20 bp, Artificial
  CRISPR gRNA sequence
tctcatttcaaatttatcat

SEQ ID NO: 198598 - DNA, 20 bp, Artificial
  CRISPR gRNA sequence
tcatttcaaatttatcattt

SEQ ID NO: 198599 - DNA, 20 bp, Artificial
  CRISPR gRNA sequence
atttcaaatttatcatttat

SEQ ID NO: 198600 - DNA, 20 bp, Artificial
  CRISPR gRNA sequence
caaatttatcatttatcata

SEQ ID NO: 198601 - DNA, 20 bp, Artificial
  CRISPR gRNA sequence
aaatttatcatttatcatat

SEQ ID NO: 198602 - DNA, 20 bp, Artificial
  CRISPR gRNA sequence
atcatttatcatatcagcaa

SEQ ID NO: 198603 - DNA, 20 bp, Artificial
  CRISPR gRNA sequence
tcatttatcatatcagcaac

SEQ ID NO: 198604 - DNA, 20 bp, Artificial
  CRISPR gRNA sequence
atcatatcagcaactatgag

SEQ ID NO: 198605 - DNA, 20 bp, Artificial
  CRISPR gRNA sequence
tcatatcagcaactatgagt

SEQ ID NO: 198606 - DNA, 20 bp, Artificial
  CRISPR gRNA sequence
tgagttatgttttttattag

SEQ ID NO: 198607 - DNA, 20 bp, Artificial
  CRISPR gRNA sequence
tgttttttattagatttctt

SEQ ID NO: 198608 - DNA, 20 bp, Artificial
  CRISPR gRNA sequence
tttattagatttcttgttac

SEQ ID NO: 198609 - DNA, 20 bp, Artificial
  CRISPR gRNA sequence
ttattagatttcttgttact

SEQ ID NO: 198610 - DNA, 20 bp, Artificial
  CRISPR gRNA sequence
tattagatttcttgttactt

SEQ ID NO: 198611 - DNA, 20 bp, Artificial
  CRISPR gRNA sequence
attagatttcttgttacttt

SEQ ID NO: 198612 - DNA, 20 bp, Artificial
  CRISPR gRNA sequence
ttagatttcttgttactttt

SEQ ID NO: 198613 - DNA, 20 bp, Artificial
  CRISPR gRNA sequence
gatttcttgttactttttcc

SEQ ID NO: 198614 - DNA, 20 bp, Artificial
  CRISPR gRNA sequence
cttgttactttttccccaga

SEQ ID NO: 198615 - DNA, 20 bp, Artificial
  CRISPR gRNA sequence
ttgttactttttccccagac

SEQ ID NO: 198616 - DNA, 20 bp, Artificial
  CRISPR gRNA sequence
gttactttttccccagacca

SEQ ID NO: 198617 - DNA, 20 bp, Artificial
  CRISPR gRNA sequence
ttactttttccccagaccac

SEQ ID NO: 198618 - DNA, 20 bp, Artificial
  CRISPR gRNA sequence
ctttttccccagaccacttc

SEQ ID NO: 198619 - DNA, 20 bp, Artificial
  CRISPR gRNA sequence
tttccccagaccacttccca

SEQ ID NO: 198620 - DNA, 20 bp, Artificial
  CRISPR gRNA sequence
ttccccagaccacttcccat

SEQ ID NO: 198621 - DNA, 20 bp, Artificial
  CRISPR gRNA sequence
tccccagaccacttcccatg

SEQ ID NO: 198622 - DNA, 20 bp, Artificial
  CRISPR gRNA sequence
ccccagaccacttcccatga

SEQ ID NO: 198623 - DNA, 20 bp, Artificial
  CRISPR gRNA sequence
cccagaccacttcccatgaa

SEQ ID NO: 198624 - DNA, 20 bp, Artificial
  CRISPR gRNA sequence
cccatgaaattaatatacta

SEQ ID NO: 198625 - DNA, 20 bp, Artificial
  CRISPR gRNA sequence
ccatgaaattaatatactat

SEQ ID NO: 198626 - DNA, 20 bp, Artificial
  CRISPR gRNA sequence
atatactattatcactctcc

SEQ ID NO: 198627 - DNA, 20 bp, Artificial
  CRISPR gRNA sequence
ttatcactctccagatacac

SEQ ID NO: 198628 - DNA, 20 bp, Artificial
  CRISPR gRNA sequence
tcactctccagatacacatt

SEQ ID NO: 198629 - DNA, 20 bp, Artificial
  CRISPR gRNA sequence
tccagatacacatttggagg

SEQ ID NO: 198630 - DNA, 20 bp, Artificial
  CRISPR gRNA sequence
cagatacacatttggaggag

SEQ ID NO: 198631 - DNA, 20 bp, Artificial
  CRISPR gRNA sequence
ggaggagacgtaatccagca

SEQ ID NO: 198632 - DNA, 20 bp, Artificial
  CRISPR gRNA sequence
gaggagacgtaatccagcat

SEQ ID NO: 198633 - DNA, 20 bp, Artificial
  CRISPR gRNA sequence
gaacttctgatcttcaagca

SEQ ID NO: 198634 - DNA, 20 bp, Artificial
  CRISPR gRNA sequence
ctgatcttcaagcagggatt

SEQ ID NO: 198635 - DNA, 20 bp, Artificial
  CRISPR gRNA sequence
tgatcttcaagcagggattc

SEQ ID NO: 198636 - DNA, 20 bp, Artificial
  CRISPR gRNA sequence
atcttcaagcagggattctc

SEQ ID NO: 198637 - DNA, 20 bp, Artificial
  CRISPR gRNA sequence
caagcagggattctcaacct

SEQ ID NO: 198638 - DNA, 20 bp, Artificial
  CRISPR gRNA sequence
aagcagggattctcaacctg

SEQ ID NO: 198639 - DNA, 20 bp, Artificial
  CRISPR gRNA sequence
tcaacctgtggtttaggggt

SEQ ID NO: 198640 - DNA, 20 bp, Artificial
  CRISPR gRNA sequence
aacctgtggtttaggggttc

SEQ ID NO: 198641 - DNA, 20 bp, Artificial
  CRISPR gRNA sequence
tggtttaggggttcatcggg

SEQ ID NO: 198642 - DNA, 20 bp, Artificial
  CRISPR gRNA sequence
aggggttcatcggggctgag

SEQ ID NO: 198643 - DNA, 20 bp, Artificial
  CRISPR gRNA sequence
ggggttcatcggggctgagc

SEQ ID NO: 198644 - DNA, 20 bp, Artificial
  CRISPR gRNA sequence
atcggggctgagcgtgacaa

SEQ ID NO: 198645 - DNA, 20 bp, Artificial
  CRISPR gRNA sequence
agcgtgacaagaggaaggaa

SEQ ID NO: 198646 - DNA, 20 bp, Artificial
  CRISPR gRNA sequence
cttcctcttgtcacgctcag

SEQ ID NO: 198647 - DNA, 20 bp, Artificial
  CRISPR gRNA sequence
cctcttgtcacgctcagccc

SEQ ID NO: 198648 - DNA, 20 bp, Artificial
  CRISPR gRNA sequence
ctcttgtcacgctcagcccc

SEQ ID NO: 198649 - DNA, 20 bp, Artificial
  CRISPR gRNA sequence
ttgtcacgctcagccccgat

SEQ ID NO: 198650 - DNA, 20 bp, Artificial
  CRISPR gRNA sequence
gtcacgctcagccccgatga

SEQ ID NO: 198651 - DNA, 20 bp, Artificial
  CRISPR gRNA sequence
tcacgctcagccccgatgaa

SEQ ID NO: 198652 - DNA, 20 bp, Artificial
  CRISPR gRNA sequence
agccccgatgaacccctaaa

SEQ ID NO: 198653 - DNA, 20 bp, Artificial
  CRISPR gRNA sequence
aaccacaggttgagaatccc

SEQ ID NO: 198654 - DNA, 20 bp, Artificial
  CRISPR gRNA sequence
agaatccctgcttgaagatc

SEQ ID NO: 198655 - DNA, 20 bp, Artificial
  CRISPR gRNA sequence
cttgaagatcagaagttcca

SEQ ID NO: 198656 - DNA, 20 bp, Artificial
  CRISPR gRNA sequence
gaagatcagaagttccaatg

SEQ ID NO: 198657 - DNA, 20 bp, Artificial
  CRISPR gRNA sequence
aagatcagaagttccaatgc

SEQ ID NO: 198658 - DNA, 20 bp, Artificial
  CRISPR gRNA sequence
caatgctggattacgtctcc

SEQ ID NO: 198659 - DNA, 20 bp, Artificial
  CRISPR gRNA sequence
gattacgtctcctccaaatg

SEQ ID NO: 198660 - DNA, 20 bp, Artificial
  CRISPR gRNA sequence
cgtctcctccaaatgtgtat

SEQ ID NO: 198661 - DNA, 20 bp, Artificial
  CRISPR gRNA sequence
ctccaaatgtgtatctggag

SEQ ID NO: 198662 - DNA, 20 bp, Artificial
  CRISPR gRNA sequence
caaatgtgtatctggagagt

SEQ ID NO: 198663 - DNA, 20 bp, Artificial
  CRISPR gRNA sequence
gagagtgataatagtatatt

SEQ ID NO: 198664 - DNA, 20 bp, Artificial
  CRISPR gRNA sequence
atttcatgggaagtggtctg

SEQ ID NO: 198665 - DNA, 20 bp, Artificial
  CRISPR gRNA sequence
catgggaagtggtctgggga

SEQ ID NO: 198666 - DNA, 20 bp, Artificial
  CRISPR gRNA sequence
atgggaagtggtctggggaa

SEQ ID NO: 198667 - DNA, 20 bp, Artificial
  CRISPR gRNA sequence
gggaaaaagtaacaagaaat

SEQ ID NO: 198668 - DNA, 20 bp, Artificial
  CRISPR gRNA sequence
ataaaaaacataactcatag

SEQ ID NO: 198669 - DNA, 20 bp, Artificial
  CRISPR gRNA sequence
atagttgctgatatgataaa

SEQ ID NO: 198670 - DNA, 20 bp, Artificial
  CRISPR gRNA sequence
ctgatatgataaatgataaa

SEQ ID NO: 198671 - DNA, 20 bp, Artificial
  CRISPR gRNA sequence
atatgataaatgataaattt

SEQ ID NO: 198672 - DNA, 20 bp, Artificial
  CRISPR gRNA sequence
gaaatgagagaaagcagcag

SEQ ID NO: 198673 - DNA, 20 bp, Artificial
  CRISPR gRNA sequence
aaatgagagaaagcagcagg

SEQ ID NO: 198674 - DNA, 20 bp, Artificial
  CRISPR gRNA sequence
tatttgtacccaattatcct

SEQ ID NO: 198675 - DNA, 20 bp, Artificial
  CRISPR gRNA sequence
gtacccaattatccttacat

SEQ ID NO: 198676 - DNA, 20 bp, Artificial
  CRISPR gRNA sequence
tacccaattatccttacatg

SEQ ID NO: 198677 - DNA, 20 bp, Artificial
  CRISPR gRNA sequence
tccttacatgatatcctgga

SEQ ID NO: 198678 - DNA, 20 bp, Artificial
  CRISPR gRNA sequence
acatgatatcctggaaaacc

SEQ ID NO: 198679 - DNA, 20 bp, Artificial
  CRISPR gRNA sequence
catgatatcctggaaaaccc

SEQ ID NO: 198680 - DNA, 20 bp, Artificial
  CRISPR gRNA sequence
gaaaacccctcagtcctgag

SEQ ID NO: 198681 - DNA, 20 bp, Artificial
  CRISPR gRNA sequence
agtcctgagcaaattgggat

SEQ ID NO: 198682 - DNA, 20 bp, Artificial
  CRISPR gRNA sequence
agcaaattgggatggcttgt

SEQ ID NO: 198683 - DNA, 20 bp, Artificial
  CRISPR gRNA sequence
ggatggcttgtcccccagca

SEQ ID NO: 198684 - DNA, 20 bp, Artificial
  CRISPR gRNA sequence
gtcccccagcatgacccaaa

SEQ ID NO: 198685 - DNA, 20 bp, Artificial
  CRISPR gRNA sequence
tcccccagcatgacccaaac

SEQ ID NO: 198686 - DNA, 20 bp, Artificial
  CRISPR gRNA sequence
gctacttagctttacaacac

SEQ ID NO: 198687 - DNA, 20 bp, Artificial
  CRISPR gRNA sequence
ctacttagctttacaacaca

SEQ ID NO: 198688 - DNA, 20 bp, Artificial
  CRISPR gRNA sequence
cttagctttacaacacagat

SEQ ID NO: 198689 - DNA, 20 bp, Artificial
  CRISPR gRNA sequence
agctttacaacacagatgat

SEQ ID NO: 198690 - DNA, 20 bp, Artificial
  CRISPR gRNA sequence
gctttacaacacagatgatg

SEQ ID NO: 198691 - DNA, 20 bp, Artificial
  CRISPR gRNA sequence
tacaacacagatgatgctat

SEQ ID NO: 198692 - DNA, 20 bp, Artificial
  CRISPR gRNA sequence
acaacacagatgatgctatg

SEQ ID NO: 198693 - DNA, 20 bp, Artificial
  CRISPR gRNA sequence
caacacagatgatgctatgg

SEQ ID NO: 198694 - DNA, 20 bp, Artificial
  CRISPR gRNA sequence
tgggccacagaatgaaactt

SEQ ID NO: 198695 - DNA, 20 bp, Artificial
  CRISPR gRNA sequence
gcctgagcttgtccaggtta

SEQ ID NO: 198696 - DNA, 20 bp, Artificial
  CRISPR gRNA sequence
cctgagcttgtccaggttaa

SEQ ID NO: 198697 - DNA, 20 bp, Artificial
  CRISPR gRNA sequence
agcttgtccaggttaattag

SEQ ID NO: 198698 - DNA, 20 bp, Artificial
  CRISPR gRNA sequence
gtccaggttaattagactgc

SEQ ID NO: 198699 - DNA, 20 bp, Artificial
  CRISPR gRNA sequence
tccaggttaattagactgct

SEQ ID NO: 198700 - DNA, 20 bp, Artificial
  CRISPR gRNA sequence
attagactgctttaaacttg

SEQ ID NO: 198701 - DNA, 20 bp, Artificial
  CRISPR gRNA sequence
gactgctttaaacttgggct

SEQ ID NO: 198702 - DNA, 20 bp, Artificial
  CRISPR gRNA sequence
ctttaaacttgggctcattg

SEQ ID NO: 198703 - DNA, 20 bp, Artificial
  CRISPR gRNA sequence
taaacttgggctcattgtta

SEQ ID NO: 198704 - DNA, 20 bp, Artificial
  CRISPR gRNA sequence
aaacttgggctcattgttaa

SEQ ID NO: 198705 - DNA, 20 bp, Artificial
  CRISPR gRNA sequence
aacttgggctcattgttaag

SEQ ID NO: 198706 - DNA, 20 bp, Artificial
  CRISPR gRNA sequence
gggctcattgttaagtttgg

SEQ ID NO: 198707 - DNA, 20 bp, Artificial
  CRISPR gRNA sequence
ggctcattgttaagtttggt

SEQ ID NO: 198708 - DNA, 20 bp, Artificial
  CRISPR gRNA sequence
attgttaagtttggtttcta

SEQ ID NO: 198709 - DNA, 20 bp, Artificial
  CRISPR gRNA sequence
ttaagtttggtttctaacta

SEQ ID NO: 198710 - DNA, 20 bp, Artificial
  CRISPR gRNA sequence
agtttggtttctaactacat

SEQ ID NO: 198711 - DNA, 20 bp, Artificial
  CRISPR gRNA sequence
ggtttctaactacattaaaa

SEQ ID NO: 198712 - DNA, 20 bp, Artificial
  CRISPR gRNA sequence
gtttctaactacattaaaaa

SEQ ID NO: 198713 - DNA, 20 bp, Artificial
  CRISPR gRNA sequence
ctaactacattaaaaaaatt

SEQ ID NO: 198714 - DNA, 20 bp, Artificial
  CRISPR gRNA sequence
taactacattaaaaaaatta

SEQ ID NO: 198715 - DNA, 20 bp, Artificial
  CRISPR gRNA sequence
actacattaaaaaaattaga

SEQ ID NO: 198716 - DNA, 20 bp, Artificial
  CRISPR gRNA sequence
cattaaaaaaattagaaacc

SEQ ID NO: 198717 - DNA, 20 bp, Artificial
  CRISPR gRNA sequence
aaaaaattagaaaccttaat

SEQ ID NO: 198718 - DNA, 20 bp, Artificial
  CRISPR gRNA sequence
gaaaccttaatataactttc

SEQ ID NO: 198719 - DNA, 20 bp, Artificial
  CRISPR gRNA sequence
aatataactttcttcttagt

SEQ ID NO: 198720 - DNA, 20 bp, Artificial
  CRISPR gRNA sequence
atataactttcttcttagtt

SEQ ID NO: 198721 - DNA, 20 bp, Artificial
  CRISPR gRNA sequence
tcttcttagttcaataacct

SEQ ID NO: 198722 - DNA, 20 bp, Artificial
  CRISPR gRNA sequence
cttcttagttcaataacctg

SEQ ID NO: 198723 - DNA, 20 bp, Artificial
  CRISPR gRNA sequence
ttcttagttcaataacctgg

SEQ ID NO: 198724 - DNA, 20 bp, Artificial
  CRISPR gRNA sequence
cttagttcaataacctggat

SEQ ID NO: 198725 - DNA, 20 bp, Artificial
  CRISPR gRNA sequence
ttagttcaataacctggatg

SEQ ID NO: 198726 - DNA, 20 bp, Artificial
  CRISPR gRNA sequence
agttcaataacctggatgag

SEQ ID NO: 198727 - DNA, 20 bp, Artificial
  CRISPR gRNA sequence
gttcaataacctggatgagg

SEQ ID NO: 198728 - DNA, 20 bp, Artificial
  CRISPR gRNA sequence
aataacctggatgaggtttt

SEQ ID NO: 198729 - DNA, 20 bp, Artificial
  CRISPR gRNA sequence
gatgaggtttttctgccctg

SEQ ID NO: 198730 - DNA, 20 bp, Artificial
  CRISPR gRNA sequence
ttctgccctgcttataaatg

SEQ ID NO: 198731 - DNA, 20 bp, Artificial
  CRISPR gRNA sequence
tctgccctgcttataaatgt

SEQ ID NO: 198732 - DNA, 20 bp, Artificial
  CRISPR gRNA sequence
ctgccctgcttataaatgta

SEQ ID NO: 198733 - DNA, 20 bp, Artificial
  CRISPR gRNA sequence
tgccctgcttataaatgtaa

SEQ ID NO: 198734 - DNA, 20 bp, Artificial
  CRISPR gRNA sequence
ccctgcttataaatgtaaac

SEQ ID NO: 198735 - DNA, 20 bp, Artificial
  CRISPR gRNA sequence
cttataaatgtaaacatttg

SEQ ID NO: 198736 - DNA, 20 bp, Artificial
  CRISPR gRNA sequence
ataaatgtaaacatttgtag

SEQ ID NO: 198737 - DNA, 20 bp, Artificial
  CRISPR gRNA sequence
taaatgtaaacatttgtagc

SEQ ID NO: 198738 - DNA, 20 bp, Artificial
  CRISPR gRNA sequence
gtagcaaaatggattgaagc

SEQ ID NO: 198739 - DNA, 20 bp, Artificial
  CRISPR gRNA sequence
tagcaaaatggattgaagca

SEQ ID NO: 198740 - DNA, 20 bp, Artificial
  CRISPR gRNA sequence
aagcagatgggttaagagta

SEQ ID NO: 198741 - DNA, 20 bp, Artificial
  CRISPR gRNA sequence
agagtaagggtctgtggtta

SEQ ID NO: 198742 - DNA, 20 bp, Artificial
  CRISPR gRNA sequence
tggttaggctaatggccccc

SEQ ID NO: 198743 - DNA, 20 bp, Artificial
  CRISPR gRNA sequence
ggctaatggcccccaagctt

SEQ ID NO: 198744 - DNA, 20 bp, Artificial
  CRISPR gRNA sequence
atggcccccaagcttgattt

SEQ ID NO: 198745 - DNA, 20 bp, Artificial
  CRISPR gRNA sequence
gatttttgtgatcagctgtg

SEQ ID NO: 198746 - DNA, 20 bp, Artificial
  CRISPR gRNA sequence
atttttgtgatcagctgtgt

SEQ ID NO: 198747 - DNA, 20 bp, Artificial
  CRISPR gRNA sequence
ttgtgatcagctgtgtgttc

SEQ ID NO: 198748 - DNA, 20 bp, Artificial
  CRISPR gRNA sequence
tgtgatcagctgtgtgttct

SEQ ID NO: 198749 - DNA, 20 bp, Artificial
  CRISPR gRNA sequence
gtgatcagctgtgtgttctt

SEQ ID NO: 198750 - DNA, 20 bp, Artificial
  CRISPR gRNA sequence
tgatcagctgtgtgttcttg

SEQ ID NO: 198751 - DNA, 20 bp, Artificial
  CRISPR gRNA sequence
tgtgttcttgggcactttac

SEQ ID NO: 198752 - DNA, 20 bp, Artificial
  CRISPR gRNA sequence
ttgggcactttacattatct

SEQ ID NO: 198753 - DNA, 20 bp, Artificial
  CRISPR gRNA sequence
gggcactttacattatcttc

SEQ ID NO: 198754 - DNA, 20 bp, Artificial
  CRISPR gRNA sequence
ggcactttacattatcttct

SEQ ID NO: 198755 - DNA, 20 bp, Artificial
  CRISPR gRNA sequence
tacattatcttcttgaccct

SEQ ID NO: 198756 - DNA, 20 bp, Artificial
  CRISPR gRNA sequence
acattatcttcttgaccctc

SEQ ID NO: 198757 - DNA, 20 bp, Artificial
  CRISPR gRNA sequence
cattatcttcttgaccctct

SEQ ID NO: 198758 - DNA, 20 bp, Artificial
  CRISPR gRNA sequence
tcttcttgaccctctgtttt

SEQ ID NO: 198759 - DNA, 20 bp, Artificial
  CRISPR gRNA sequence
cttgaccctctgttttctct

SEQ ID NO: 198760 - DNA, 20 bp, Artificial
  CRISPR gRNA sequence
ttgaccctctgttttctcta

SEQ ID NO: 198761 - DNA, 20 bp, Artificial
  CRISPR gRNA sequence
gaccctctgttttctctact

SEQ ID NO: 198762 - DNA, 20 bp, Artificial
  CRISPR gRNA sequence
accctctgttttctctactg

SEQ ID NO: 198763 - DNA, 20 bp, Artificial
  CRISPR gRNA sequence
tgttttctctactgtaaaat

SEQ ID NO: 198764 - DNA, 20 bp, Artificial
  CRISPR gRNA sequence
ttttctctactgtaaaatga

SEQ ID NO: 198765 - DNA, 20 bp, Artificial
  CRISPR gRNA sequence
tctctactgtaaaatgagga

SEQ ID NO: 198766 - DNA, 20 bp, Artificial
  CRISPR gRNA sequence
ctctactgtaaaatgaggat

SEQ ID NO: 198767 - DNA, 20 bp, Artificial
  CRISPR gRNA sequence
tctactgtaaaatgaggata

SEQ ID NO: 198768 - DNA, 20 bp, Artificial
  CRISPR gRNA sequence
tactgtaaaatgaggataaa

SEQ ID NO: 198769 - DNA, 20 bp, Artificial
  CRISPR gRNA sequence
ctgtaaaatgaggataaatt

SEQ ID NO: 198770 - DNA, 20 bp, Artificial
  CRISPR gRNA sequence
taaaatgaggataaattcta

SEQ ID NO: 198771 - DNA, 20 bp, Artificial
  CRISPR gRNA sequence
tagtatttctctctctctct

SEQ ID NO: 198772 - DNA, 20 bp, Artificial
  CRISPR gRNA sequence
gtatttctctctctctctct

SEQ ID NO: 198773 - DNA, 20 bp, Artificial
  CRISPR gRNA sequence
ctctctctctctctctctct

SEQ ID NO: 198774 - DNA, 20 bp, Artificial
  CRISPR gRNA sequence
tctctctctctctctctctc

SEQ ID NO: 198775 - DNA, 20 bp, Artificial
  CRISPR gRNA sequence
tctctctctctctctctctc

SEQ ID NO: 198776 - DNA, 20 bp, Artificial
  CRISPR gRNA sequence
tctctctctctctctctctt

SEQ ID NO: 198777 - DNA, 20 bp, Artificial
  CRISPR gRNA sequence
tctctctctctctctctttg

SEQ ID NO: 198778 - DNA, 20 bp, Artificial
  CRISPR gRNA sequence
tctctctctctctctttggt

SEQ ID NO: 198779 - DNA, 20 bp, Artificial
  CRISPR gRNA sequence
tctctctctctctttggtaa

SEQ ID NO: 198780 - DNA, 20 bp, Artificial
  CRISPR gRNA sequence
tctctctctctttggtaatg

SEQ ID NO: 198781 - DNA, 20 bp, Artificial
  CRISPR gRNA sequence
tctctctctttggtaatggc

SEQ ID NO: 198782 - DNA, 20 bp, Artificial
  CRISPR gRNA sequence
tctctctttggtaatggcaa

SEQ ID NO: 198783 - DNA, 20 bp, Artificial
  CRISPR gRNA sequence
tctctttggtaatggcaagg

SEQ ID NO: 198784 - DNA, 20 bp, Artificial
  CRISPR gRNA sequence
tctttggtaatggcaagggg

SEQ ID NO: 198785 - DNA, 20 bp, Artificial
  CRISPR gRNA sequence
tttggtaatggcaaggggtg

SEQ ID NO: 198786 - DNA, 20 bp, Artificial
  CRISPR gRNA sequence
tggtaatggcaaggggtggg

SEQ ID NO: 198787 - DNA, 20 bp, Artificial
  CRISPR gRNA sequence
ggtaatggcaaggggtgggg

SEQ ID NO: 198788 - DNA, 20 bp, Artificial
  CRISPR gRNA sequence
gtaatggcaaggggtggggg

SEQ ID NO: 198789 - DNA, 20 bp, Artificial
  CRISPR gRNA sequence
aatgagataccgtgcatggt

SEQ ID NO: 198790 - DNA, 20 bp, Artificial
  CRISPR gRNA sequence
acatagtattacaatactga

SEQ ID NO: 198791 - DNA, 20 bp, Artificial
  CRISPR gRNA sequence
caatactgacacacaatatt

SEQ ID NO: 198792 - DNA, 20 bp, Artificial
  CRISPR gRNA sequence
acacacaatattttagaatc

SEQ ID NO: 198793 - DNA, 20 bp, Artificial
  CRISPR gRNA sequence
tagaatcaattaattatcca

SEQ ID NO: 198794 - DNA, 20 bp, Artificial
  CRISPR gRNA sequence
agaatcaattaattatccat

SEQ ID NO: 198795 - DNA, 20 bp, Artificial
  CRISPR gRNA sequence
gaatcaattaattatccatc

SEQ ID NO: 198796 - DNA, 20 bp, Artificial
  CRISPR gRNA sequence
attatccatccacctaagtc

SEQ ID NO: 198797 - DNA, 20 bp, Artificial
  CRISPR gRNA sequence
tccatccacctaagtcatcc

SEQ ID NO: 198798 - DNA, 20 bp, Artificial
  CRISPR gRNA sequence
agtcatccttgtcccctgct

SEQ ID NO: 198799 - DNA, 20 bp, Artificial
  CRISPR gRNA sequence
gtcccctgctgcaaggagct

SEQ ID NO: 198800 - DNA, 20 bp, Artificial
  CRISPR gRNA sequence
tcccctgctgcaaggagctg

SEQ ID NO: 198801 - DNA, 20 bp, Artificial
  CRISPR gRNA sequence
ctgcaaggagctgctagggt

SEQ ID NO: 198802 - DNA, 20 bp, Artificial
  CRISPR gRNA sequence
caaggagctgctagggtgca

SEQ ID NO: 198803 - DNA, 20 bp, Artificial
  CRISPR gRNA sequence
ctagggtgcagggcaacaga

SEQ ID NO: 198804 - DNA, 20 bp, Artificial
  CRISPR gRNA sequence
gggtgcagggcaacagaaga

SEQ ID NO: 198805 - DNA, 20 bp, Artificial
  CRISPR gRNA sequence
gcaaatgaagctgactcctt

SEQ ID NO: 198806 - DNA, 20 bp, Artificial
  CRISPR gRNA sequence
actccttccccttccctgct

SEQ ID NO: 198807 - DNA, 20 bp, Artificial
  CRISPR gRNA sequence
cttccccttccctgctccta

SEQ ID NO: 198808 - DNA, 20 bp, Artificial
  CRISPR gRNA sequence
ccccttccctgctcctaaac

SEQ ID NO: 198809 - DNA, 20 bp, Artificial
  CRISPR gRNA sequence
cccttccctgctcctaaacc

SEQ ID NO: 198810 - DNA, 20 bp, Artificial
  CRISPR gRNA sequence
ccctgctcctaaacctcctc

SEQ ID NO: 198811 - DNA, 20 bp, Artificial
  CRISPR gRNA sequence
cctgctcctaaacctcctca

SEQ ID NO: 198812 - DNA, 20 bp, Artificial
  CRISPR gRNA sequence
ctcctaaacctcctcagacg

SEQ ID NO: 198813 - DNA, 20 bp, Artificial
  CRISPR gRNA sequence
ctaaacctcctcagacggtg

SEQ ID NO: 198814 - DNA, 20 bp, Artificial
  CRISPR gRNA sequence
aacctcctcagacggtggag

SEQ ID NO: 198815 - DNA, 20 bp, Artificial
  CRISPR gRNA sequence
ctcagacggtggaggagttc

SEQ ID NO: 198816 - DNA, 20 bp, Artificial
  CRISPR gRNA sequence
agacggtggaggagttcttg

SEQ ID NO: 198817 - DNA, 20 bp, Artificial
  CRISPR gRNA sequence
ttgtgttagctgtgaggcaa

SEQ ID NO: 198818 - DNA, 20 bp, Artificial
  CRISPR gRNA sequence
gtgttagctgtgaggcaaag

SEQ ID NO: 198819 - DNA, 20 bp, Artificial
  CRISPR gRNA sequence
tgttagctgtgaggcaaagg

SEQ ID NO: 198820 - DNA, 20 bp, Artificial
  CRISPR gRNA sequence
gctgtgaggcaaaggggaac

SEQ ID NO: 198821 - DNA, 20 bp, Artificial
  CRISPR gRNA sequence
tgaggcaaaggggaaccagc

SEQ ID NO: 198822 - DNA, 20 bp, Artificial
  CRISPR gRNA sequence
tttaaaaggagaggagatta

SEQ ID NO: 198823 - DNA, 20 bp, Artificial
  CRISPR gRNA sequence
taaaaggagaggagattatg

SEQ ID NO: 198824 - DNA, 20 bp, Artificial
  CRISPR gRNA sequence
aaaaggagaggagattatga

SEQ ID NO: 198825 - DNA, 20 bp, Artificial
  CRISPR gRNA sequence
aaaggagaggagattatgac

SEQ ID NO: 198826 - DNA, 20 bp, Artificial
  CRISPR gRNA sequence
tgactgatggatttctcttt

SEQ ID NO: 198827 - DNA, 20 bp, Artificial
  CRISPR gRNA sequence
atggatttctctttgttatt

SEQ ID NO: 198828 - DNA, 20 bp, Artificial
  CRISPR gRNA sequence
ctctttgttattgctttagc

SEQ ID NO: 198829 - DNA, 20 bp, Artificial
  CRISPR gRNA sequence
tctttgttattgctttagct

SEQ ID NO: 198830 - DNA, 20 bp, Artificial
  CRISPR gRNA sequence
tttgttattgctttagcttt

SEQ ID NO: 198831 - DNA, 20 bp, Artificial
  CRISPR gRNA sequence
tgttattgctttagcttttt

SEQ ID NO: 198832 - DNA, 20 bp, Artificial
  CRISPR gRNA sequence
gttattgctttagctttttg

SEQ ID NO: 198833 - DNA, 20 bp, Artificial
  CRISPR gRNA sequence
ttattgctttagctttttgt

SEQ ID NO: 198834 - DNA, 20 bp, Artificial
  CRISPR gRNA sequence
ttgctttagctttttgtttc

SEQ ID NO: 198835 - DNA, 20 bp, Artificial
  CRISPR gRNA sequence
ctttagctttttgtttcctt

SEQ ID NO: 198836 - DNA, 20 bp, Artificial
  CRISPR gRNA sequence
tagctttttgtttcctttga

SEQ ID NO: 198837 - DNA, 20 bp, Artificial
  CRISPR gRNA sequence
agctttttgtttcctttgac

SEQ ID NO: 198838 - DNA, 20 bp, Artificial
  CRISPR gRNA sequence
gctttttgtttcctttgact

SEQ ID NO: 198839 - DNA, 20 bp, Artificial
  CRISPR gRNA sequence
tttgtttcctttgactttta

SEQ ID NO: 198840 - DNA, 20 bp, Artificial
  CRISPR gRNA sequence
ttgtttcctttgacttttac

SEQ ID NO: 198841 - DNA, 20 bp, Artificial
  CRISPR gRNA sequence
tgtttcctttgacttttact

SEQ ID NO: 198842 - DNA, 20 bp, Artificial
  CRISPR gRNA sequence
gtttcctttgacttttactt

SEQ ID NO: 198843 - DNA, 20 bp, Artificial
  CRISPR gRNA sequence
tttcctttgacttttacttc

SEQ ID NO: 198844 - DNA, 20 bp, Artificial
  CRISPR gRNA sequence
cctttgacttttacttccca

SEQ ID NO: 198845 - DNA, 20 bp, Artificial
  CRISPR gRNA sequence
ctttgacttttacttcccaa

SEQ ID NO: 198846 - DNA, 20 bp, Artificial
  CRISPR gRNA sequence
tgacttttacttcccaattc

SEQ ID NO: 198847 - DNA, 20 bp, Artificial
  CRISPR gRNA sequence
gacttttacttcccaattcc

SEQ ID NO: 198848 - DNA, 20 bp, Artificial
  CRISPR gRNA sequence
acttttacttcccaattcct

SEQ ID NO: 198849 - DNA, 20 bp, Artificial
  CRISPR gRNA sequence
ttacttcccaattccttctg

SEQ ID NO: 198850 - DNA, 20 bp, Artificial
  CRISPR gRNA sequence
tacttcccaattccttctga

SEQ ID NO: 198851 - DNA, 20 bp, Artificial
  CRISPR gRNA sequence
acttcccaattccttctgat

SEQ ID NO: 198852 - DNA, 20 bp, Artificial
  CRISPR gRNA sequence
cttcccaattccttctgata

SEQ ID NO: 198853 - DNA, 20 bp, Artificial
  CRISPR gRNA sequence
cccaattccttctgatattc

SEQ ID NO: 198854 - DNA, 20 bp, Artificial
  CRISPR gRNA sequence
ccaattccttctgatattct

SEQ ID NO: 198855 - DNA, 20 bp, Artificial
  CRISPR gRNA sequence
cttctgatattcttaccact

SEQ ID NO: 198856 - DNA, 20 bp, Artificial
  CRISPR gRNA sequence
ctgatattcttaccactttg

SEQ ID NO: 198857 - DNA, 20 bp, Artificial
  CRISPR gRNA sequence
tgatattcttaccactttgc

SEQ ID NO: 198858 - DNA, 20 bp, Artificial
  CRISPR gRNA sequence
atattcttaccactttgctt

SEQ ID NO: 198859 - DNA, 20 bp, Artificial
  CRISPR gRNA sequence
ttaccactttgcttctttga

SEQ ID NO: 198860 - DNA, 20 bp, Artificial
  CRISPR gRNA sequence
accactttgcttctttgagt

SEQ ID NO: 198861 - DNA, 20 bp, Artificial
  CRISPR gRNA sequence
ccactttgcttctttgagtt

SEQ ID NO: 198862 - DNA, 20 bp, Artificial
  CRISPR gRNA sequence
tgcttctttgagtttgtatc

SEQ ID NO: 198863 - DNA, 20 bp, Artificial
  CRISPR gRNA sequence
gcttctttgagtttgtatct

SEQ ID NO: 198864 - DNA, 20 bp, Artificial
  CRISPR gRNA sequence
cttctttgagtttgtatctt

SEQ ID NO: 198865 - DNA, 20 bp, Artificial
  CRISPR gRNA sequence
ctttgagtttgtatcttgga

SEQ ID NO: 198866 - DNA, 20 bp, Artificial
  CRISPR gRNA sequence
tttgagtttgtatcttggat

SEQ ID NO: 198867 - DNA, 20 bp, Artificial
  CRISPR gRNA sequence
tgagtttgtatcttggatgc

SEQ ID NO: 198868 - DNA, 20 bp, Artificial
  CRISPR gRNA sequence
gagtttgtatcttggatgcc

SEQ ID NO: 198869 - DNA, 20 bp, Artificial
  CRISPR gRNA sequence
agtttgtatcttggatgcca

SEQ ID NO: 198870 - DNA, 20 bp, Artificial
  CRISPR gRNA sequence
gtatcttggatgccacattt

SEQ ID NO: 198871 - DNA, 20 bp, Artificial
  CRISPR gRNA sequence
tatcttggatgccacatttt

SEQ ID NO: 198872 - DNA, 20 bp, Artificial
  CRISPR gRNA sequence
ggatgccacattttttcaca

SEQ ID NO: 198873 - DNA, 20 bp, Artificial
  CRISPR gRNA sequence
gatgccacattttttcacat

SEQ ID NO: 198874 - DNA, 20 bp, Artificial
  CRISPR gRNA sequence
tttcacatccatcattctcc

SEQ ID NO: 198875 - DNA, 20 bp, Artificial
  CRISPR gRNA sequence
ttcacatccatcattctccc

SEQ ID NO: 198876 - DNA, 20 bp, Artificial
  CRISPR gRNA sequence
tcacatccatcattctccct

SEQ ID NO: 198877 - DNA, 20 bp, Artificial
  CRISPR gRNA sequence
cacatccatcattctccctt

SEQ ID NO: 198878 - DNA, 20 bp, Artificial
  CRISPR gRNA sequence
acatccatcattctcccttg

SEQ ID NO: 198879 - DNA, 20 bp, Artificial
  CRISPR gRNA sequence
tcccttgagaaaaagaaatc

SEQ ID NO: 198880 - DNA, 20 bp, Artificial
  CRISPR gRNA sequence
ccttgagaaaaagaaatcat

SEQ ID NO: 198881 - DNA, 20 bp, Artificial
  CRISPR gRNA sequence
gagaaaaagaaatcattttt

SEQ ID NO: 198882 - DNA, 20 bp, Artificial
  CRISPR gRNA sequence
agaaaaagaaatcattttta

SEQ ID NO: 198883 - DNA, 20 bp, Artificial
  CRISPR gRNA sequence
ttatttccatatagcacagc

SEQ ID NO: 198884 - DNA, 20 bp, Artificial
  CRISPR gRNA sequence
tatttccatatagcacagct

SEQ ID NO: 198885 - DNA, 20 bp, Artificial
  CRISPR gRNA sequence
atttccatatagcacagctc

SEQ ID NO: 198886 - DNA, 20 bp, Artificial
  CRISPR gRNA sequence
tttccatatagcacagctct

SEQ ID NO: 198887 - DNA, 20 bp, Artificial
  CRISPR gRNA sequence
ccatatagcacagctctaca

SEQ ID NO: 198888 - DNA, 20 bp, Artificial
  CRISPR gRNA sequence
catatagcacagctctacat

SEQ ID NO: 198889 - DNA, 20 bp, Artificial
  CRISPR gRNA sequence
tacatcccatacagtgaccc

SEQ ID NO: 198890 - DNA, 20 bp, Artificial
  CRISPR gRNA sequence
catcccatacagtgacccaa

SEQ ID NO: 198891 - DNA, 20 bp, Artificial
  CRISPR gRNA sequence
aaatttcaagttctgtgaaa

SEQ ID NO: 198892 - DNA, 20 bp, Artificial
  CRISPR gRNA sequence
aatttcaagttctgtgaaac

SEQ ID NO: 198893 - DNA, 20 bp, Artificial
  CRISPR gRNA sequence
caagttctgtgaaacatttg

SEQ ID NO: 198894 - DNA, 20 bp, Artificial
  CRISPR gRNA sequence
aagttctgtgaaacatttgt

SEQ ID NO: 198895 - DNA, 20 bp, Artificial
  CRISPR gRNA sequence
tgtgaaacatttgtaatccc

SEQ ID NO: 198896 - DNA, 20 bp, Artificial
  CRISPR gRNA sequence
tgaaacatttgtaatcccta

SEQ ID NO: 198897 - DNA, 20 bp, Artificial
  CRISPR gRNA sequence
gtaatccctaggaagtctgg

SEQ ID NO: 198898 - DNA, 20 bp, Artificial
  CRISPR gRNA sequence
taatccctaggaagtctggt

SEQ ID NO: 198899 - DNA, 20 bp, Artificial
  CRISPR gRNA sequence
ggaagtctggtggacatcct

SEQ ID NO: 198900 - DNA, 20 bp, Artificial
  CRISPR gRNA sequence
gtggacatccttattccaca

SEQ ID NO: 198901 - DNA, 20 bp, Artificial
  CRISPR gRNA sequence
attccacaggtcccaactta

SEQ ID NO: 198902 - DNA, 20 bp, Artificial
  CRISPR gRNA sequence
ttccacaggtcccaacttat

SEQ ID NO: 198903 - DNA, 20 bp, Artificial
  CRISPR gRNA sequence
cacaggtcccaacttatgag

SEQ ID NO: 198904 - DNA, 20 bp, Artificial
  CRISPR gRNA sequence
atgaggttaattaattcaat

SEQ ID NO: 198905 - DNA, 20 bp, Artificial
  CRISPR gRNA sequence
tgaggttaattaattcaata

SEQ ID NO: 198906 - DNA, 20 bp, Artificial
  CRISPR gRNA sequence
attaattcaatagtgtaggg

SEQ ID NO: 198907 - DNA, 20 bp, Artificial
  CRISPR gRNA sequence
attcaatagtgtagggcaca

SEQ ID NO: 198908 - DNA, 20 bp, Artificial
  CRISPR gRNA sequence
aatagtgtagggcacatgct

SEQ ID NO: 198909 - DNA, 20 bp, Artificial
  CRISPR gRNA sequence
ttgatcctagatgttcttga

SEQ ID NO: 198910 - DNA, 20 bp, Artificial
  CRISPR gRNA sequence
tgatcctagatgttcttgag

SEQ ID NO: 198911 - DNA, 20 bp, Artificial
  CRISPR gRNA sequence
gatcctagatgttcttgagg

SEQ ID NO: 198912 - DNA, 20 bp, Artificial
  CRISPR gRNA sequence
atcctagatgttcttgagga

SEQ ID NO: 198913 - DNA, 20 bp, Artificial
  CRISPR gRNA sequence
gatgttcttgaggagtatac

SEQ ID NO: 198914 - DNA, 20 bp, Artificial
  CRISPR gRNA sequence
ttgaggagtatacactttta

SEQ ID NO: 198915 - DNA, 20 bp, Artificial
  CRISPR gRNA sequence
gaggagtatacacttttatt

SEQ ID NO: 198916 - DNA, 20 bp, Artificial
  CRISPR gRNA sequence
aggagtatacacttttattt

SEQ ID NO: 198917 - DNA, 20 bp, Artificial
  CRISPR gRNA sequence
ttatttttcatcttttccca

SEQ ID NO: 198918 - DNA, 20 bp, Artificial
  CRISPR gRNA sequence
tatttttcatcttttcccag

SEQ ID NO: 198919 - DNA, 20 bp, Artificial
  CRISPR gRNA sequence
atttttcatcttttcccaga

SEQ ID NO: 198920 - DNA, 20 bp, Artificial
  CRISPR gRNA sequence
tttttcatcttttcccagag

SEQ ID NO: 198921 - DNA, 20 bp, Artificial
  CRISPR gRNA sequence
ttcatcttttcccagagatg

SEQ ID NO: 198922 - DNA, 20 bp, Artificial
  CRISPR gRNA sequence
tcatcttttcccagagatga

SEQ ID NO: 198923 - DNA, 20 bp, Artificial
  CRISPR gRNA sequence
catcttttcccagagatgaa

SEQ ID NO: 198924 - DNA, 20 bp, Artificial
  CRISPR gRNA sequence
atcttttcccagagatgaac

SEQ ID NO: 198925 - DNA, 20 bp, Artificial
  CRISPR gRNA sequence
ttcccagagatgaaccaaat

SEQ ID NO: 198926 - DNA, 20 bp, Artificial
  CRISPR gRNA sequence
tcccagagatgaaccaaatt

SEQ ID NO: 198927 - DNA, 20 bp, Artificial
  CRISPR gRNA sequence
cccagagatgaaccaaattc

SEQ ID NO: 198928 - DNA, 20 bp, Artificial
  CRISPR gRNA sequence
ccagagatgaaccaaattct

SEQ ID NO: 198929 - DNA, 20 bp, Artificial
  CRISPR gRNA sequence
tgaggtattttaatatctat

SEQ ID NO: 198930 - DNA, 20 bp, Artificial
  CRISPR gRNA sequence
aggtattttaatatctattg

SEQ ID NO: 198931 - DNA, 20 bp, Artificial
  CRISPR gRNA sequence
taatatctattgatttctat

SEQ ID NO: 198932 - DNA, 20 bp, Artificial
  CRISPR gRNA sequence
aatatctattgatttctatc

SEQ ID NO: 198933 - DNA, 20 bp, Artificial
  CRISPR gRNA sequence
atatctattgatttctatcc

SEQ ID NO: 198934 - DNA, 20 bp, Artificial
  CRISPR gRNA sequence
ttgatttctatccatttcta

SEQ ID NO: 198935 - DNA, 20 bp, Artificial
  CRISPR gRNA sequence
atttctatccatttctactg

SEQ ID NO: 198936 - DNA, 20 bp, Artificial
  CRISPR gRNA sequence
ctatccatttctactgccaa

SEQ ID NO: 198937 - DNA, 20 bp, Artificial
  CRISPR gRNA sequence
tatccatttctactgccaac

SEQ ID NO: 198938 - DNA, 20 bp, Artificial
  CRISPR gRNA sequence
tccatttctactgccaacta

SEQ ID NO: 198939 - DNA, 20 bp, Artificial
  CRISPR gRNA sequence
ctactgccaactaatctttt

SEQ ID NO: 198940 - DNA, 20 bp, Artificial
  CRISPR gRNA sequence
tactgccaactaatcttttt

SEQ ID NO: 198941 - DNA, 20 bp, Artificial
  CRISPR gRNA sequence
ctgccaactaatcttttttt

SEQ ID NO: 198942 - DNA, 20 bp, Artificial
  CRISPR gRNA sequence
ccaactaatctttttttcca

SEQ ID NO: 198943 - DNA, 20 bp, Artificial
  CRISPR gRNA sequence
atctttttttccagagaaat

SEQ ID NO: 198944 - DNA, 20 bp, Artificial
  CRISPR gRNA sequence
tttttccagagaaatattca

SEQ ID NO: 198945 - DNA, 20 bp, Artificial
  CRISPR gRNA sequence
ttttccagagaaatattcaa

SEQ ID NO: 198946 - DNA, 20 bp, Artificial
  CRISPR gRNA sequence
tttccagagaaatattcaaa

SEQ ID NO: 198947 - DNA, 20 bp, Artificial
  CRISPR gRNA sequence
ttccagagaaatattcaaaa

SEQ ID NO: 198948 - DNA, 20 bp, Artificial
  CRISPR gRNA sequence
tccagagaaatattcaaaat

SEQ ID NO: 198949 - DNA, 20 bp, Artificial
  CRISPR gRNA sequence
ccagagaaatattcaaaatg

SEQ ID NO: 198950 - DNA, 20 bp, Artificial
  CRISPR gRNA sequence
cagagaaatattcaaaatgc

SEQ ID NO: 198951 - DNA, 20 bp, Artificial
  CRISPR gRNA sequence
aaaatgcatgctggcaacaa

SEQ ID NO: 198952 - DNA, 20 bp, Artificial
  CRISPR gRNA sequence
gcaacaattatttctttgtg

SEQ ID NO: 198953 - DNA, 20 bp, Artificial
  CRISPR gRNA sequence
tttctttgtgcaaatcaact

SEQ ID NO: 198954 - DNA, 20 bp, Artificial
  CRISPR gRNA sequence
ctttgtgcaaatcaactcca

SEQ ID NO: 198955 - DNA, 20 bp, Artificial
  CRISPR gRNA sequence
tttgtgcaaatcaactccat

SEQ ID NO: 198956 - DNA, 20 bp, Artificial
  CRISPR gRNA sequence
tgtgcaaatcaactccatct

SEQ ID NO: 198957 - DNA, 20 bp, Artificial
  CRISPR gRNA sequence
gtgcaaatcaactccatctc

SEQ ID NO: 198958 - DNA, 20 bp, Artificial
  CRISPR gRNA sequence
tgcaaatcaactccatctca

SEQ ID NO: 198959 - DNA, 20 bp, Artificial
  CRISPR gRNA sequence
catctcaggatcttactgtc

SEQ ID NO: 198960 - DNA, 20 bp, Artificial
  CRISPR gRNA sequence
aggatcttactgtcattgaa

SEQ ID NO: 198961 - DNA, 20 bp, Artificial
  CRISPR gRNA sequence
actgtcattgaaacttgatc

SEQ ID NO: 198962 - DNA, 20 bp, Artificial
  CRISPR gRNA sequence
ctgtcattgaaacttgatcc

SEQ ID NO: 198963 - DNA, 20 bp, Artificial
  CRISPR gRNA sequence
tcattgaaacttgatcctta

SEQ ID NO: 198964 - DNA, 20 bp, Artificial
  CRISPR gRNA sequence
aaacttgatccttatattct

SEQ ID NO: 198965 - DNA, 20 bp, Artificial
  CRISPR gRNA sequence
gatccttatattctggctat

SEQ ID NO: 198966 - DNA, 20 bp, Artificial
  CRISPR gRNA sequence
atccttatattctggctatc

SEQ ID NO: 198967 - DNA, 20 bp, Artificial
  CRISPR gRNA sequence
atattctggctatctcagtc

SEQ ID NO: 198968 - DNA, 20 bp, Artificial
  CRISPR gRNA sequence
tattctggctatctcagtcc

SEQ ID NO: 198969 - DNA, 20 bp, Artificial
  CRISPR gRNA sequence
tggctatctcagtcctgtta

SEQ ID NO: 198970 - DNA, 20 bp, Artificial
  CRISPR gRNA sequence
gctatctcagtcctgttaag

SEQ ID NO: 198971 - DNA, 20 bp, Artificial
  CRISPR gRNA sequence
tctcagtcctgttaagaata

SEQ ID NO: 198972 - DNA, 20 bp, Artificial
  CRISPR gRNA sequence
agtcctgttaagaatataat

SEQ ID NO: 198973 - DNA, 20 bp, Artificial
  CRISPR gRNA sequence
ttaagaatataatttttgga

SEQ ID NO: 198974 - DNA, 20 bp, Artificial
  CRISPR gRNA sequence
agaatataatttttggaaac

SEQ ID NO: 198975 - DNA, 20 bp, Artificial
  CRISPR gRNA sequence
ttggaaacagcttatctcta

SEQ ID NO: 198976 - DNA, 20 bp, Artificial
  CRISPR gRNA sequence
tggaaacagcttatctctac

SEQ ID NO: 198977 - DNA, 20 bp, Artificial
  CRISPR gRNA sequence
ggaaacagcttatctctact

SEQ ID NO: 198978 - DNA, 20 bp, Artificial
  CRISPR gRNA sequence
gaaacagcttatctctactc

SEQ ID NO: 198979 - DNA, 20 bp, Artificial
  CRISPR gRNA sequence
atctctactctctcagttaa

SEQ ID NO: 198980 - DNA, 20 bp, Artificial
  CRISPR gRNA sequence
tctctactctctcagttaac

SEQ ID NO: 198981 - DNA, 20 bp, Artificial
  CRISPR gRNA sequence
tactctctcagttaacacta

SEQ ID NO: 198982 - DNA, 20 bp, Artificial
  CRISPR gRNA sequence
ctctctcagttaacactact

SEQ ID NO: 198983 - DNA, 20 bp, Artificial
  CRISPR gRNA sequence
tctcagttaacactactttc

SEQ ID NO: 198984 - DNA, 20 bp, Artificial
  CRISPR gRNA sequence
tcagttaacactactttccc

SEQ ID NO: 198985 - DNA, 20 bp, Artificial
  CRISPR gRNA sequence
agttaacactactttccccc

SEQ ID NO: 198986 - DNA, 20 bp, Artificial
  CRISPR gRNA sequence
acactactttcccccatgta

SEQ ID NO: 198987 - DNA, 20 bp, Artificial
  CRISPR gRNA sequence
ctttcccccatgtaaggggt

SEQ ID NO: 198988 - DNA, 20 bp, Artificial
  CRISPR gRNA sequence
tcccccatgtaaggggttat

SEQ ID NO: 198989 - DNA, 20 bp, Artificial
  CRISPR gRNA sequence
cccccatgtaaggggttatg

SEQ ID NO: 198990 - DNA, 20 bp, Artificial
  CRISPR gRNA sequence
ccccatgtaaggggttatgg

SEQ ID NO: 198991 - DNA, 20 bp, Artificial
  CRISPR gRNA sequence
tggggaatttttcaacgact

SEQ ID NO: 198992 - DNA, 20 bp, Artificial
  CRISPR gRNA sequence
ttcaacgactattggaatcc

SEQ ID NO: 198993 - DNA, 20 bp, Artificial
  CRISPR gRNA sequence
tcaacgactattggaatccc

SEQ ID NO: 198994 - DNA, 20 bp, Artificial
  CRISPR gRNA sequence
caacgactattggaatcccc

SEQ ID NO: 198995 - DNA, 20 bp, Artificial
  CRISPR gRNA sequence
aacgactattggaatcccct

SEQ ID NO: 198996 - DNA, 20 bp, Artificial
  CRISPR gRNA sequence
ttggaatccccttccatatt

SEQ ID NO: 198997 - DNA, 20 bp, Artificial
  CRISPR gRNA sequence
gaatccccttccatattcta

SEQ ID NO: 198998 - DNA, 20 bp, Artificial
  CRISPR gRNA sequence
ccatattctacttccctatt

SEQ ID NO: 198999 - DNA, 20 bp, Artificial
  CRISPR gRNA sequence
catattctacttccctattt

SEQ ID NO: 199000 - DNA, 20 bp, Artificial
  CRISPR gRNA sequence
tacttccctatttaacatca

SEQ ID NO: 199001 - DNA, 20 bp, Artificial
  CRISPR gRNA sequence
cttccctatttaacatcaga

SEQ ID NO: 199002 - DNA, 20 bp, Artificial
  CRISPR gRNA sequence
ccctatttaacatcagacaa

SEQ ID NO: 199003 - DNA, 20 bp, Artificial
  CRISPR gRNA sequence
cctatttaacatcagacaac

SEQ ID NO: 199004 - DNA, 20 bp, Artificial
  CRISPR gRNA sequence
tttaacatcagacaactcta

SEQ ID NO: 199005 - DNA, 20 bp, Artificial
  CRISPR gRNA sequence
aacatcagacaactctatac

SEQ ID NO: 199006 - DNA, 20 bp, Artificial
  CRISPR gRNA sequence
acatcagacaactctatacc

SEQ ID NO: 199007 - DNA, 20 bp, Artificial
  CRISPR gRNA sequence
tataccatcactggatctct

SEQ ID NO: 199008 - DNA, 20 bp, Artificial
  CRISPR gRNA sequence
taccatcactggatctcttg

SEQ ID NO: 199009 - DNA, 20 bp, Artificial
  CRISPR gRNA sequence
gatctcttggtatacttctc

SEQ ID NO: 199010 - DNA, 20 bp, Artificial
  CRISPR gRNA sequence
ttggtatacttctctaagta

SEQ ID NO: 199011 - DNA, 20 bp, Artificial
  CRISPR gRNA sequence
ggtatacttctctaagtatt

SEQ ID NO: 199012 - DNA, 20 bp, Artificial
  CRISPR gRNA sequence
gtatacttctctaagtattg

SEQ ID NO: 199013 - DNA, 20 bp, Artificial
  CRISPR gRNA sequence
ctctaagtattggaggaatt

SEQ ID NO: 199014 - DNA, 20 bp, Artificial
  CRISPR gRNA sequence
tctaagtattggaggaatta

SEQ ID NO: 199015 - DNA, 20 bp, Artificial
  CRISPR gRNA sequence
taagtattggaggaattatt

SEQ ID NO: 199016 - DNA, 20 bp, Artificial
  CRISPR gRNA sequence
agtattggaggaattattta

SEQ ID NO: 199017 - DNA, 20 bp, Artificial
  CRISPR gRNA sequence
gaggaattatttactctgac

SEQ ID NO: 199018 - DNA, 20 bp, Artificial
  CRISPR gRNA sequence
tttactctgactcatcttaa

SEQ ID NO: 199019 - DNA, 20 bp, Artificial
  CRISPR gRNA sequence
actctgactcatcttaaatg

SEQ ID NO: 199020 - DNA, 20 bp, Artificial
  CRISPR gRNA sequence
ctctgactcatcttaaatgg

SEQ ID NO: 199021 - DNA, 20 bp, Artificial
  CRISPR gRNA sequence
tgactcatcttaaatgggag

SEQ ID NO: 199022 - DNA, 20 bp, Artificial
  CRISPR gRNA sequence
actcatcttaaatgggagga

SEQ ID NO: 199023 - DNA, 20 bp, Artificial
  CRISPR gRNA sequence
atcttaaatgggaggaaatt

SEQ ID NO: 199024 - DNA, 20 bp, Artificial
  CRISPR gRNA sequence
aaatgggaggaaattatttg

SEQ ID NO: 199025 - DNA, 20 bp, Artificial
  CRISPR gRNA sequence
aatgggaggaaattatttga

SEQ ID NO: 199026 - DNA, 20 bp, Artificial
  CRISPR gRNA sequence
tttgaatatactcattttcc

SEQ ID NO: 199027 - DNA, 20 bp, Artificial
  CRISPR gRNA sequence
gaatatactcattttcctgg

SEQ ID NO: 199028 - DNA, 20 bp, Artificial
  CRISPR gRNA sequence
aatatactcattttcctgga

SEQ ID NO: 199029 - DNA, 20 bp, Artificial
  CRISPR gRNA sequence
attttcctggattttaattg

SEQ ID NO: 199030 - DNA, 20 bp, Artificial
  CRISPR gRNA sequence
tcctggattttaattgttcc

SEQ ID NO: 199031 - DNA, 20 bp, Artificial
  CRISPR gRNA sequence
cctggattttaattgttccc

SEQ ID NO: 199032 - DNA, 20 bp, Artificial
  CRISPR gRNA sequence
ctggattttaattgttccca

SEQ ID NO: 199033 - DNA, 20 bp, Artificial
  CRISPR gRNA sequence
gattttaattgttcccacag

SEQ ID NO: 199034 - DNA, 20 bp, Artificial
  CRISPR gRNA sequence
taattgttcccacaggtaaa

SEQ ID NO: 199035 - DNA, 20 bp, Artificial
  CRISPR gRNA sequence
aattgttcccacaggtaaat

SEQ ID NO: 199036 - DNA, 20 bp, Artificial
  CRISPR gRNA sequence
attgttcccacaggtaaatg

SEQ ID NO: 199037 - DNA, 20 bp, Artificial
  CRISPR gRNA sequence
ttcccacaggtaaatggaga

SEQ ID NO: 199038 - DNA, 20 bp, Artificial
  CRISPR gRNA sequence
ccacaggtaaatggagaaat

SEQ ID NO: 199039 - DNA, 20 bp, Artificial
  CRISPR gRNA sequence
tgtaacatcctctaccaaaa

SEQ ID NO: 199040 - DNA, 20 bp, Artificial
  CRISPR gRNA sequence
taccaaaaattttgcaaaat

SEQ ID NO: 199041 - DNA, 20 bp, Artificial
  CRISPR gRNA sequence
ccaaaaattttgcaaaatac

SEQ ID NO: 199042 - DNA, 20 bp, Artificial
  CRISPR gRNA sequence
tgcaaaatactctatggtaa

SEQ ID NO: 199043 - DNA, 20 bp, Artificial
  CRISPR gRNA sequence
gcaaaatactctatggtaaa

SEQ ID NO: 199044 - DNA, 20 bp, Artificial
  CRISPR gRNA sequence
caaaatactctatggtaaac

SEQ ID NO: 199045 - DNA, 20 bp, Artificial
  CRISPR gRNA sequence
tatggtaaacatactacagt

SEQ ID NO: 199046 - DNA, 20 bp, Artificial
  CRISPR gRNA sequence
tggtaaacatactacagttc

SEQ ID NO: 199047 - DNA, 20 bp, Artificial
  CRISPR gRNA sequence
cagttctacagaggaactat

SEQ ID NO: 199048 - DNA, 20 bp, Artificial
  CRISPR gRNA sequence
tacagaggaactatttttat

SEQ ID NO: 199049 - DNA, 20 bp, Artificial
  CRISPR gRNA sequence
cagaggaactatttttatta

SEQ ID NO: 199050 - DNA, 20 bp, Artificial
  CRISPR gRNA sequence
tttttattacttagggtacc

SEQ ID NO: 199051 - DNA, 20 bp, Artificial
  CRISPR gRNA sequence
ttattacttagggtacccag

SEQ ID NO: 199052 - DNA, 20 bp, Artificial
  CRISPR gRNA sequence
tattacttagggtacccaga

SEQ ID NO: 199053 - DNA, 20 bp, Artificial
  CRISPR gRNA sequence
attacttagggtacccagaa

SEQ ID NO: 199054 - DNA, 20 bp, Artificial
  CRISPR gRNA sequence
ttacttagggtacccagaaa

SEQ ID NO: 199055 - DNA, 20 bp, Artificial
  CRISPR gRNA sequence
cttagggtacccagaaacca

SEQ ID NO: 199056 - DNA, 20 bp, Artificial
  CRISPR gRNA sequence
agggtacccagaaaccagct

SEQ ID NO: 199057 - DNA, 20 bp, Artificial
  CRISPR gRNA sequence
gggtacccagaaaccagctg

SEQ ID NO: 199058 - DNA, 20 bp, Artificial
  CRISPR gRNA sequence
gttgcaactaatgcaagact

SEQ ID NO: 199059 - DNA, 20 bp, Artificial
  CRISPR gRNA sequence
caactaatgcaagactaaaa

SEQ ID NO: 199060 - DNA, 20 bp, Artificial
  CRISPR gRNA sequence
atgcaagactaaaatgcaac

SEQ ID NO: 199061 - DNA, 20 bp, Artificial
  CRISPR gRNA sequence
aaatgcaactgaaaatgacg

SEQ ID NO: 199062 - DNA, 20 bp, Artificial
  CRISPR gRNA sequence
aaaatgacgggcattttagc

SEQ ID NO: 199063 - DNA, 20 bp, Artificial
  CRISPR gRNA sequence
tagctctttctcttctgtaa

SEQ ID NO: 199064 - DNA, 20 bp, Artificial
  CRISPR gRNA sequence
agctctttctcttctgtaag

SEQ ID NO: 199065 - DNA, 20 bp, Artificial
  CRISPR gRNA sequence
gctctttctcttctgtaagt

SEQ ID NO: 199066 - DNA, 20 bp, Artificial
  CRISPR gRNA sequence
tttctcttctgtaagtctgt

SEQ ID NO: 199067 - DNA, 20 bp, Artificial
  CRISPR gRNA sequence
tctcttctgtaagtctgtgg

SEQ ID NO: 199068 - DNA, 20 bp, Artificial
  CRISPR gRNA sequence
ctcttctgtaagtctgtggt

SEQ ID NO: 199069 - DNA, 20 bp, Artificial
  CRISPR gRNA sequence
tcttctgtaagtctgtggtt

SEQ ID NO: 199070 - DNA, 20 bp, Artificial
  CRISPR gRNA sequence
ttctgtaagtctgtggttat

SEQ ID NO: 199071 - DNA, 20 bp, Artificial
  CRISPR gRNA sequence
ctgtaagtctgtggttattt

SEQ ID NO: 199072 - DNA, 20 bp, Artificial
  CRISPR gRNA sequence
tgtaagtctgtggttatttt

SEQ ID NO: 199073 - DNA, 20 bp, Artificial
  CRISPR gRNA sequence
taagtctgtggttattttca

SEQ ID NO: 199074 - DNA, 20 bp, Artificial
  CRISPR gRNA sequence
tggttattttcatgatagaa

SEQ ID NO: 199075 - DNA, 20 bp, Artificial
  CRISPR gRNA sequence
ttttcatgatagaaaaaaac

SEQ ID NO: 199076 - DNA, 20 bp, Artificial
  CRISPR gRNA sequence
tcatgatagaaaaaaactgt

SEQ ID NO: 199077 - DNA, 20 bp, Artificial
  CRISPR gRNA sequence
catgatagaaaaaaactgta

SEQ ID NO: 199078 - DNA, 20 bp, Artificial
  CRISPR gRNA sequence
atgatagaaaaaaactgtat

SEQ ID NO: 199079 - DNA, 20 bp, Artificial
  CRISPR gRNA sequence
tatgacactgcatcttctac

SEQ ID NO: 199080 - DNA, 20 bp, Artificial
  CRISPR gRNA sequence
catcttctacctccatccat

SEQ ID NO: 199081 - DNA, 20 bp, Artificial
  CRISPR gRNA sequence
ctacctccatccatacccat

SEQ ID NO: 199082 - DNA, 20 bp, Artificial
  CRISPR gRNA sequence
tacctccatccatacccatt

SEQ ID NO: 199083 - DNA, 20 bp, Artificial
  CRISPR gRNA sequence
cctccatccatacccattct

SEQ ID NO: 199084 - DNA, 20 bp, Artificial
  CRISPR gRNA sequence
catccatacccattctcctg

SEQ ID NO: 199085 - DNA, 20 bp, Artificial
  CRISPR gRNA sequence
tcctgcccctcaccccttac

SEQ ID NO: 199086 - DNA, 20 bp, Artificial
  CRISPR gRNA sequence
ctgcccctcaccccttacgc

SEQ ID NO: 199087 - DNA, 20 bp, Artificial
  CRISPR gRNA sequence
cccctcaccccttacgcttc

SEQ ID NO: 199088 - DNA, 20 bp, Artificial
  CRISPR gRNA sequence
accccttacgcttcatcttc

SEQ ID NO: 199089 - DNA, 20 bp, Artificial
  CRISPR gRNA sequence
acgcttcatcttcacccagt

SEQ ID NO: 199090 - DNA, 20 bp, Artificial
  CRISPR gRNA sequence
cgcttcatcttcacccagtg

SEQ ID NO: 199091 - DNA, 20 bp, Artificial
  CRISPR gRNA sequence
catcttcacccagtgatccc

SEQ ID NO: 199092 - DNA, 20 bp, Artificial
  CRISPR gRNA sequence
atcttcacccagtgatccca

SEQ ID NO: 199093 - DNA, 20 bp, Artificial
  CRISPR gRNA sequence
cacccagtgatcccactcag

SEQ ID NO: 199094 - DNA, 20 bp, Artificial
  CRISPR gRNA sequence
acccagtgatcccactcagc

SEQ ID NO: 199095 - DNA, 20 bp, Artificial
  CRISPR gRNA sequence
agcttcaatataattgctgt

SEQ ID NO: 199096 - DNA, 20 bp, Artificial
  CRISPR gRNA sequence
caatataattgctgttgaac

SEQ ID NO: 199097 - DNA, 20 bp, Artificial
  CRISPR gRNA sequence
aatataattgctgttgaaca

SEQ ID NO: 199098 - DNA, 20 bp, Artificial
  CRISPR gRNA sequence
ctgttgaacagtggaatgcc

SEQ ID NO: 199099 - DNA, 20 bp, Artificial
  CRISPR gRNA sequence
ttgaacagtggaatgccttt

SEQ ID NO: 199100 - DNA, 20 bp, Artificial
  CRISPR gRNA sequence
aacagtggaatgcctttgca

SEQ ID NO: 199101 - DNA, 20 bp, Artificial
  CRISPR gRNA sequence
tgcaccaccttgcagaggtt

SEQ ID NO: 199102 - DNA, 20 bp, Artificial
  CRISPR gRNA sequence
gcaccaccttgcagaggtta

SEQ ID NO: 199103 - DNA, 20 bp, Artificial
  CRISPR gRNA sequence
caccaccttgcagaggttaa

SEQ ID NO: 199104 - DNA, 20 bp, Artificial
  CRISPR gRNA sequence
gcagaggttaagtcgggttt

SEQ ID NO: 199105 - DNA, 20 bp, Artificial
  CRISPR gRNA sequence
cagaggttaagtcgggtttc

SEQ ID NO: 199106 - DNA, 20 bp, Artificial
  CRISPR gRNA sequence
agtcgggtttccttgcagcc

SEQ ID NO: 199107 - DNA, 20 bp, Artificial
  CRISPR gRNA sequence
ccttgcagccatgatccaat

SEQ ID NO: 199108 - DNA, 20 bp, Artificial
  CRISPR gRNA sequence
cttgcagccatgatccaatt

SEQ ID NO: 199109 - DNA, 20 bp, Artificial
  CRISPR gRNA sequence
gcagccatgatccaattctc

SEQ ID NO: 199110 - DNA, 20 bp, Artificial
  CRISPR gRNA sequence
cagccatgatccaattctca

SEQ ID NO: 199111 - DNA, 20 bp, Artificial
  CRISPR gRNA sequence
tcaccccttcctcaccccca

SEQ ID NO: 199112 - DNA, 20 bp, Artificial
  CRISPR gRNA sequence
accccttcctcacccccagt

SEQ ID NO: 199113 - DNA, 20 bp, Artificial
  CRISPR gRNA sequence
cctcacccccagtggagacc

SEQ ID NO: 199114 - DNA, 20 bp, Artificial
  CRISPR gRNA sequence
ctcacccccagtggagacca

SEQ ID NO: 199115 - DNA, 20 bp, Artificial
  CRISPR gRNA sequence
acccccagtggagaccactg

SEQ ID NO: 199116 - DNA, 20 bp, Artificial
  CRISPR gRNA sequence
caattaaggaaatactacct

SEQ ID NO: 199117 - DNA, 20 bp, Artificial
  CRISPR gRNA sequence
aggaaatactaccttttctt

SEQ ID NO: 199118 - DNA, 20 bp, Artificial
  CRISPR gRNA sequence
ccttttcttaaacggaagat

SEQ ID NO: 199119 - DNA, 20 bp, Artificial
  CRISPR gRNA sequence
ttcttaaacggaagatgaat

SEQ ID NO: 199120 - DNA, 20 bp, Artificial
  CRISPR gRNA sequence
tcttaaacggaagatgaatg

SEQ ID NO: 199121 - DNA, 20 bp, Artificial
  CRISPR gRNA sequence
cttaaacggaagatgaatgt

SEQ ID NO: 199122 - DNA, 20 bp, Artificial
  CRISPR gRNA sequence
ttaaacggaagatgaatgtc

SEQ ID NO: 199123 - DNA, 20 bp, Artificial
  CRISPR gRNA sequence
aaacggaagatgaatgtcag

SEQ ID NO: 199124 - DNA, 20 bp, Artificial
  CRISPR gRNA sequence
aacggaagatgaatgtcagt

SEQ ID NO: 199125 - DNA, 20 bp, Artificial
  CRISPR gRNA sequence
caccaaggcataataagatg

SEQ ID NO: 199126 - DNA, 20 bp, Artificial
  CRISPR gRNA sequence
ccagaattaccaagtgagtc

SEQ ID NO: 199127 - DNA, 20 bp, Artificial
  CRISPR gRNA sequence
ccaagtgagtcctttcattt

SEQ ID NO: 199128 - DNA, 20 bp, Artificial
  CRISPR gRNA sequence
tcatttggaggatgtgccag

SEQ ID NO: 199129 - DNA, 20 bp, Artificial
  CRISPR gRNA sequence
catttggaggatgtgccaga

SEQ ID NO: 199130 - DNA, 20 bp, Artificial
  CRISPR gRNA sequence
atttggaggatgtgccagag

SEQ ID NO: 199131 - DNA, 20 bp, Artificial
  CRISPR gRNA sequence
ggaggatgtgccagaggtag

SEQ ID NO: 199132 - DNA, 20 bp, Artificial
  CRISPR gRNA sequence
gaggatgtgccagaggtagt

SEQ ID NO: 199133 - DNA, 20 bp, Artificial
  CRISPR gRNA sequence
tgaaaaacaaaacaaaacga

SEQ ID NO: 199134 - DNA, 20 bp, Artificial
  CRISPR gRNA sequence
aaaaacaaaacaaaacgaaa

SEQ ID NO: 199135 - DNA, 20 bp, Artificial
  CRISPR gRNA sequence
actaaagataaaattttgat

SEQ ID NO: 199136 - DNA, 20 bp, Artificial
  CRISPR gRNA sequence
aagataaaattttgatggga

SEQ ID NO: 199137 - DNA, 20 bp, Artificial
  CRISPR gRNA sequence
tgatgggaaggggtcaggag

SEQ ID NO: 199138 - DNA, 20 bp, Artificial
  CRISPR gRNA sequence
gatgggaaggggtcaggaga

SEQ ID NO: 199139 - DNA, 20 bp, Artificial
  CRISPR gRNA sequence
atgggaaggggtcaggagaa

SEQ ID NO: 199140 - DNA, 20 bp, Artificial
  CRISPR gRNA sequence
gaagtttagtttagctttag

SEQ ID NO: 199141 - DNA, 20 bp, Artificial
  CRISPR gRNA sequence
aagtttagtttagctttagg

SEQ ID NO: 199142 - DNA, 20 bp, Artificial
  CRISPR gRNA sequence
agtttagctttaggataatt

SEQ ID NO: 199143 - DNA, 20 bp, Artificial
  CRISPR gRNA sequence
gtttagctttaggataattt

SEQ ID NO: 199144 - DNA, 20 bp, Artificial
  CRISPR gRNA sequence
agctttaggataattttctt

SEQ ID NO: 199145 - DNA, 20 bp, Artificial
  CRISPR gRNA sequence
gctttaggataattttctta

SEQ ID NO: 199146 - DNA, 20 bp, Artificial
  CRISPR gRNA sequence
taggataattttcttaaatg

SEQ ID NO: 199147 - DNA, 20 bp, Artificial
  CRISPR gRNA sequence
aggataattttcttaaatgc

SEQ ID NO: 199148 - DNA, 20 bp, Artificial
  CRISPR gRNA sequence
ggataattttcttaaatgcc

SEQ ID NO: 199149 - DNA, 20 bp, Artificial
  CRISPR gRNA sequence
tcttaaatgccaaagtttga

SEQ ID NO: 199150 - DNA, 20 bp, Artificial
  CRISPR gRNA sequence
cttaaatgccaaagtttgag

SEQ ID NO: 199151 - DNA, 20 bp, Artificial
  CRISPR gRNA sequence
ttaaatgccaaagtttgagt

SEQ ID NO: 199152 - DNA, 20 bp, Artificial
  CRISPR gRNA sequence
aaatgccaaagtttgagtgg

SEQ ID NO: 199153 - DNA, 20 bp, Artificial
  CRISPR gRNA sequence
aatgccaaagtttgagtggc

SEQ ID NO: 199154 - DNA, 20 bp, Artificial
  CRISPR gRNA sequence
gagtggctggaatggcgaga

SEQ ID NO: 199155 - DNA, 20 bp, Artificial
  CRISPR gRNA sequence
agtggctggaatggcgagat

SEQ ID NO: 199156 - DNA, 20 bp, Artificial
  CRISPR gRNA sequence
gaatggcgagatacctgtgt

SEQ ID NO: 199157 - DNA, 20 bp, Artificial
  CRISPR gRNA sequence
tgttaaaatgggaacagcat

SEQ ID NO: 199158 - DNA, 20 bp, Artificial
  CRISPR gRNA sequence
aaatgggaacagcatggaga

SEQ ID NO: 199159 - DNA, 20 bp, Artificial
  CRISPR gRNA sequence
tgaaaaggtggtgctggggc

SEQ ID NO: 199160 - DNA, 20 bp, Artificial
  CRISPR gRNA sequence
gaaaaggtggtgctggggct

SEQ ID NO: 199161 - DNA, 20 bp, Artificial
  CRISPR gRNA sequence
aaaaggtggtgctggggcta

SEQ ID NO: 199162 - DNA, 20 bp, Artificial
  CRISPR gRNA sequence
gggctaaattctgctgccct

SEQ ID NO: 199163 - DNA, 20 bp, Artificial
  CRISPR gRNA sequence
aattctgctgcccttaacca

SEQ ID NO: 199164 - DNA, 20 bp, Artificial
  CRISPR gRNA sequence
tgctgcccttaaccagtttt

SEQ ID NO: 199165 - DNA, 20 bp, Artificial
  CRISPR gRNA sequence
ctgcccttaaccagttttga

SEQ ID NO: 199166 - DNA, 20 bp, Artificial
  CRISPR gRNA sequence
cccttaaccagttttgaggt

SEQ ID NO: 199167 - DNA, 20 bp, Artificial
  CRISPR gRNA sequence
aaccagttttgaggtcttgg

SEQ ID NO: 199168 - DNA, 20 bp, Artificial
  CRISPR gRNA sequence
accagttttgaggtcttggg

SEQ ID NO: 199169 - DNA, 20 bp, Artificial
  CRISPR gRNA sequence
tgaggtcttgggcaagatac

SEQ ID NO: 199170 - DNA, 20 bp, Artificial
  CRISPR gRNA sequence
gaggtcttgggcaagatact

SEQ ID NO: 199171 - DNA, 20 bp, Artificial
  CRISPR gRNA sequence
aggtcttgggcaagatactt

SEQ ID NO: 199172 - DNA, 20 bp, Artificial
  CRISPR gRNA sequence
gggcaagatacttaaccagt

SEQ ID NO: 199173 - DNA, 20 bp, Artificial
  CRISPR gRNA sequence
ggcaagatacttaaccagtg

SEQ ID NO: 199174 - DNA, 20 bp, Artificial
  CRISPR gRNA sequence
aaccagtgtacaaaatacaa

SEQ ID NO: 199175 - DNA, 20 bp, Artificial
  CRISPR gRNA sequence
accagtgtacaaaatacaaa

SEQ ID NO: 199176 - DNA, 20 bp, Artificial
  CRISPR gRNA sequence
atacatttcttgtgaggcta

SEQ ID NO: 199177 - DNA, 20 bp, Artificial
  CRISPR gRNA sequence
cttgtgaggctaatatttat

SEQ ID NO: 199178 - DNA, 20 bp, Artificial
  CRISPR gRNA sequence
ttgtgaggctaatatttata

SEQ ID NO: 199179 - DNA, 20 bp, Artificial
  CRISPR gRNA sequence
gtgaggctaatatttataat

SEQ ID NO: 199180 - DNA, 20 bp, Artificial
  CRISPR gRNA sequence
tgaggctaatatttataatg

SEQ ID NO: 199181 - DNA, 20 bp, Artificial
  CRISPR gRNA sequence
atatttataatgtgcttgca

SEQ ID NO: 199182 - DNA, 20 bp, Artificial
  CRISPR gRNA sequence
ataatgtgcttgcacagtac

SEQ ID NO: 199183 - DNA, 20 bp, Artificial
  CRISPR gRNA sequence
taatgtgcttgcacagtacc

SEQ ID NO: 199184 - DNA, 20 bp, Artificial
  CRISPR gRNA sequence
gcacagtaccacatggagtg

SEQ ID NO: 199185 - DNA, 20 bp, Artificial
  CRISPR gRNA sequence
cacagtaccacatggagtgg

SEQ ID NO: 199186 - DNA, 20 bp, Artificial
  CRISPR gRNA sequence
ctcactattaaatggcggcc

SEQ ID NO: 199187 - DNA, 20 bp, Artificial
  CRISPR gRNA sequence
actattaaatggcggccttg

SEQ ID NO: 199188 - DNA, 20 bp, Artificial
  CRISPR gRNA sequence
ttaaatggcggccttgatta

SEQ ID NO: 199189 - DNA, 20 bp, Artificial
  CRISPR gRNA sequence
aatggcggccttgattattt

SEQ ID NO: 199190 - DNA, 20 bp, Artificial
  CRISPR gRNA sequence
gattatttcacttcctcttg

SEQ ID NO: 199191 - DNA, 20 bp, Artificial
  CRISPR gRNA sequence
attatttcacttcctcttgc

SEQ ID NO: 199192 - DNA, 20 bp, Artificial
  CRISPR gRNA sequence
tttcacttcctcttgctttt

SEQ ID NO: 199193 - DNA, 20 bp, Artificial
  CRISPR gRNA sequence
cacttcctcttgcttttttt

SEQ ID NO: 199194 - DNA, 20 bp, Artificial
  CRISPR gRNA sequence
acttcctcttgctttttttt

SEQ ID NO: 199195 - DNA, 20 bp, Artificial
  CRISPR gRNA sequence
cctcttgctttttttttttt

SEQ ID NO: 199196 - DNA, 20 bp, Artificial
  CRISPR gRNA sequence
ctcttgcttttttttttttt

SEQ ID NO: 199197 - DNA, 20 bp, Artificial
  CRISPR gRNA sequence
ttgctttttttttttttttt

SEQ ID NO: 199198 - DNA, 20 bp, Artificial
  CRISPR gRNA sequence
gctttttttttttttttttg

SEQ ID NO: 199199 - DNA, 20 bp, Artificial
  CRISPR gRNA sequence
ctttttttttttttttttga

SEQ ID NO: 199200 - DNA, 20 bp, Artificial
  CRISPR gRNA sequence
tttttttttttttttgaggc

SEQ ID NO: 199201 - DNA, 20 bp, Artificial
  CRISPR gRNA sequence
ttttttttttttttgaggca

SEQ ID NO: 199202 - DNA, 20 bp, Artificial
  CRISPR gRNA sequence
tttttttttttttgaggcag

SEQ ID NO: 199203 - DNA, 20 bp, Artificial
  CRISPR gRNA sequence
ttttttttttttgaggcaga

SEQ ID NO: 199204 - DNA, 20 bp, Artificial
  CRISPR gRNA sequence
tttttttttttgaggcagag

SEQ ID NO: 199205 - DNA, 20 bp, Artificial
  CRISPR gRNA sequence
ttttttttttgaggcagagt

SEQ ID NO: 199206 - DNA, 20 bp, Artificial
  CRISPR gRNA sequence
tttttttttgaggcagagtc

SEQ ID NO: 199207 - DNA, 20 bp, Artificial
  CRISPR gRNA sequence
ttttttttgaggcagagtct

SEQ ID NO: 199208 - DNA, 20 bp, Artificial
  CRISPR gRNA sequence
tttttttgaggcagagtctt

SEQ ID NO: 199209 - DNA, 20 bp, Artificial
  CRISPR gRNA sequence
ttttttgaggcagagtcttt

SEQ ID NO: 199210 - DNA, 20 bp, Artificial
  CRISPR gRNA sequence
tttttgaggcagagtctttc

SEQ ID NO: 199211 - DNA, 20 bp, Artificial
  CRISPR gRNA sequence
ttttgaggcagagtctttct

SEQ ID NO: 199212 - DNA, 20 bp, Artificial
  CRISPR gRNA sequence
tttgaggcagagtctttctc

SEQ ID NO: 199213 - DNA, 20 bp, Artificial
  CRISPR gRNA sequence
ttgaggcagagtctttctct

SEQ ID NO: 199214 - DNA, 20 bp, Artificial
  CRISPR gRNA sequence
tgaggcagagtctttctctg

SEQ ID NO: 199215 - DNA, 20 bp, Artificial
  CRISPR gRNA sequence
gaggcagagtctttctctgt

SEQ ID NO: 199216 - DNA, 20 bp, Artificial
  CRISPR gRNA sequence
aggcagagtctttctctgtt

SEQ ID NO: 199217 - DNA, 20 bp, Artificial
  CRISPR gRNA sequence
tctctgttgcccagggtgga

SEQ ID NO: 199218 - DNA, 20 bp, Artificial
  CRISPR gRNA sequence
ctctgttgcccagggtggag

SEQ ID NO: 199219 - DNA, 20 bp, Artificial
  CRISPR gRNA sequence
tctgttgcccagggtggagt

SEQ ID NO: 199220 - DNA, 20 bp, Artificial
  CRISPR gRNA sequence
tgttgcccagggtggagtgc

SEQ ID NO: 199221 - DNA, 20 bp, Artificial
  CRISPR gRNA sequence
ttgcccagggtggagtgcag

SEQ ID NO: 199222 - DNA, 20 bp, Artificial
  CRISPR gRNA sequence
cccagggtggagtgcagtgg

SEQ ID NO: 199223 - DNA, 20 bp, Artificial
  CRISPR gRNA sequence
ggctcactgcaacttccgcc

SEQ ID NO: 199224 - DNA, 20 bp, Artificial
  CRISPR gRNA sequence
actgcaacttccgcctccca

SEQ ID NO: 199225 - DNA, 20 bp, Artificial
  CRISPR gRNA sequence
caacttccgcctcccaggtt

SEQ ID NO: 199226 - DNA, 20 bp, Artificial
  CRISPR gRNA sequence
ccgcctcccaggttcaagca

SEQ ID NO: 199227 - DNA, 20 bp, Artificial
  CRISPR gRNA sequence
cgcctcccaggttcaagcaa

SEQ ID NO: 199228 - DNA, 20 bp, Artificial
  CRISPR gRNA sequence
ccaggttcaagcaattcttg

SEQ ID NO: 199229 - DNA, 20 bp, Artificial
  CRISPR gRNA sequence
aagcaattcttgtgcctcag

SEQ ID NO: 199230 - DNA, 20 bp, Artificial
  CRISPR gRNA sequence
ttgtgcctcagtctcccgag

SEQ ID NO: 199231 - DNA, 20 bp, Artificial
  CRISPR gRNA sequence
gtgcctcagtctcccgagta

SEQ ID NO: 199232 - DNA, 20 bp, Artificial
  CRISPR gRNA sequence
tgcctcagtctcccgagtag

SEQ ID NO: 199233 - DNA, 20 bp, Artificial
  CRISPR gRNA sequence
agtctcccgagtagctggga

SEQ ID NO: 199234 - DNA, 20 bp, Artificial
  CRISPR gRNA sequence
ccgagtagctgggattacag

SEQ ID NO: 199235 - DNA, 20 bp, Artificial
  CRISPR gRNA sequence
ggattacaggtgcacaccac

SEQ ID NO: 199236 - DNA, 20 bp, Artificial
  CRISPR gRNA sequence
caggtgcacaccaccacacc

SEQ ID NO: 199237 - DNA, 20 bp, Artificial
  CRISPR gRNA sequence
atttttatatttttagtaaa

SEQ ID NO: 199238 - DNA, 20 bp, Artificial
  CRISPR gRNA sequence
ttatatttttagtaaaggca

SEQ ID NO: 199239 - DNA, 20 bp, Artificial
  CRISPR gRNA sequence
tatatttttagtaaaggcag

SEQ ID NO: 199240 - DNA, 20 bp, Artificial
  CRISPR gRNA sequence
atatttttagtaaaggcaga

SEQ ID NO: 199241 - DNA, 20 bp, Artificial
  CRISPR gRNA sequence
tatttttagtaaaggcagag

SEQ ID NO: 199242 - DNA, 20 bp, Artificial
  CRISPR gRNA sequence
ttagtaaaggcagagtttca

SEQ ID NO: 199243 - DNA, 20 bp, Artificial
  CRISPR gRNA sequence
tagtaaaggcagagtttcac

SEQ ID NO: 199244 - DNA, 20 bp, Artificial
  CRISPR gRNA sequence
agtaaaggcagagtttcacc

SEQ ID NO: 199245 - DNA, 20 bp, Artificial
  CRISPR gRNA sequence
gtaaaggcagagtttcacca

SEQ ID NO: 199246 - DNA, 20 bp, Artificial
  CRISPR gRNA sequence
caccatgttggccaggctgg

SEQ ID NO: 199247 - DNA, 20 bp, Artificial
  CRISPR gRNA sequence
accatgttggccaggctggt

SEQ ID NO: 199248 - DNA, 20 bp, Artificial
  CRISPR gRNA sequence
gccaggctggtcacaaactc

SEQ ID NO: 199249 - DNA, 20 bp, Artificial
  CRISPR gRNA sequence
gtcacaaactcctgacctca

SEQ ID NO: 199250 - DNA, 20 bp, Artificial
  CRISPR gRNA sequence
ctgacctcaagtgatctgcc

SEQ ID NO: 199251 - DNA, 20 bp, Artificial
  CRISPR gRNA sequence
acctcaagtgatctgcccac

SEQ ID NO: 199252 - DNA, 20 bp, Artificial
  CRISPR gRNA sequence
aagtgatctgcccaccttgg

SEQ ID NO: 199253 - DNA, 20 bp, Artificial
  CRISPR gRNA sequence
cccaccttggcctcccaaag

SEQ ID NO: 199254 - DNA, 20 bp, Artificial
  CRISPR gRNA sequence
ggcctcccaaagtgctgaga

SEQ ID NO: 199255 - DNA, 20 bp, Artificial
  CRISPR gRNA sequence
gcctcccaaagtgctgagat

SEQ ID NO: 199256 - DNA, 20 bp, Artificial
  CRISPR gRNA sequence
ccaaagtgctgagattacag

SEQ ID NO: 199257 - DNA, 20 bp, Artificial
  CRISPR gRNA sequence
agattacaggcatgagcctc

SEQ ID NO: 199258 - DNA, 20 bp, Artificial
  CRISPR gRNA sequence
caggcatgagcctccgctcc

SEQ ID NO: 199259 - DNA, 20 bp, Artificial
  CRISPR gRNA sequence
cgctcctggcccctcttgca

SEQ ID NO: 199260 - DNA, 20 bp, Artificial
  CRISPR gRNA sequence
ctggcccctcttgcattctt

SEQ ID NO: 199261 - DNA, 20 bp, Artificial
  CRISPR gRNA sequence
gcccctcttgcattctttaa

SEQ ID NO: 199262 - DNA, 20 bp, Artificial
  CRISPR gRNA sequence
ttgcattctttaatatagaa

SEQ ID NO: 199263 - DNA, 20 bp, Artificial
  CRISPR gRNA sequence
gcattctttaatatagaagc

SEQ ID NO: 199264 - DNA, 20 bp, Artificial
  CRISPR gRNA sequence
cattctttaatatagaagct

SEQ ID NO: 199265 - DNA, 20 bp, Artificial
  CRISPR gRNA sequence
tttaatatagaagctagtag

SEQ ID NO: 199266 - DNA, 20 bp, Artificial
  CRISPR gRNA sequence
taatatagaagctagtagcc

SEQ ID NO: 199267 - DNA, 20 bp, Artificial
  CRISPR gRNA sequence
aatatagaagctagtagcct

SEQ ID NO: 199268 - DNA, 20 bp, Artificial
  CRISPR gRNA sequence
atatagaagctagtagccta

SEQ ID NO: 199269 - DNA, 20 bp, Artificial
  CRISPR gRNA sequence
gtagcctacagtacatggca

SEQ ID NO: 199270 - DNA, 20 bp, Artificial
  CRISPR gRNA sequence
cagtacatggcagagatggc

SEQ ID NO: 199271 - DNA, 20 bp, Artificial
  CRISPR gRNA sequence
ctaaggagctcccacctcct

SEQ ID NO: 199272 - DNA, 20 bp, Artificial
  CRISPR gRNA sequence
aggagctcccacctcctcct

SEQ ID NO: 199273 - DNA, 20 bp, Artificial
  CRISPR gRNA sequence
ccacctcctcctatctgtca

SEQ ID NO: 199274 - DNA, 20 bp, Artificial
  CRISPR gRNA sequence
ctcctatctgtcatcatgat

SEQ ID NO: 199275 - DNA, 20 bp, Artificial
  CRISPR gRNA sequence
ctatctgtcatcatgattgg

SEQ ID NO: 199276 - DNA, 20 bp, Artificial
  CRISPR gRNA sequence
tctgtcatcatgattggagg

SEQ ID NO: 199277 - DNA, 20 bp, Artificial
  CRISPR gRNA sequence
tcatcatgattggaggccaa

SEQ ID NO: 199278 - DNA, 20 bp, Artificial
  CRISPR gRNA sequence
gaggccaatgcttgttgtct

SEQ ID NO: 199279 - DNA, 20 bp, Artificial
  CRISPR gRNA sequence
gttgtcttatctttctctgc

SEQ ID NO: 199280 - DNA, 20 bp, Artificial
  CRISPR gRNA sequence
ttgtcttatctttctctgca

SEQ ID NO: 199281 - DNA, 20 bp, Artificial
  CRISPR gRNA sequence
tcttatctttctctgcagtt

SEQ ID NO: 199282 - DNA, 20 bp, Artificial
  CRISPR gRNA sequence
atctttctctgcagtttgaa

SEQ ID NO: 199283 - DNA, 20 bp, Artificial
  CRISPR gRNA sequence
tctttctctgcagtttgaac

SEQ ID NO: 199284 - DNA, 20 bp, Artificial
  CRISPR gRNA sequence
tctctgcagtttgaacatct

SEQ ID NO: 199285 - DNA, 20 bp, Artificial
  CRISPR gRNA sequence
ctctgcagtttgaacatctc

SEQ ID NO: 199286 - DNA, 20 bp, Artificial
  CRISPR gRNA sequence
tctgcagtttgaacatctct

SEQ ID NO: 199287 - DNA, 20 bp, Artificial
  CRISPR gRNA sequence
tgcagtttgaacatctctgg

SEQ ID NO: 199288 - DNA, 20 bp, Artificial
  CRISPR gRNA sequence
cagtttgaacatctctggac

SEQ ID NO: 199289 - DNA, 20 bp, Artificial
  CRISPR gRNA sequence
gaacatctctggacaacaag

SEQ ID NO: 199290 - DNA, 20 bp, Artificial
  CRISPR gRNA sequence
aacatctctggacaacaagc

SEQ ID NO: 199291 - DNA, 20 bp, Artificial
  CRISPR gRNA sequence
tggacaacaagccattagta

SEQ ID NO: 199292 - DNA, 20 bp, Artificial
  CRISPR gRNA sequence
gacaacaagccattagtatc

SEQ ID NO: 199293 - DNA, 20 bp, Artificial
  CRISPR gRNA sequence
gtatctcttactaggctcct

SEQ ID NO: 199294 - DNA, 20 bp, Artificial
  CRISPR gRNA sequence
ttactaggctccttgtctgg

SEQ ID NO: 199295 - DNA, 20 bp, Artificial
  CRISPR gRNA sequence
actaggctccttgtctgggg

SEQ ID NO: 199296 - DNA, 20 bp, Artificial
  CRISPR gRNA sequence
ctaggctccttgtctggggt

SEQ ID NO: 199297 - DNA, 20 bp, Artificial
  CRISPR gRNA sequence
ggctccttgtctggggtacc

SEQ ID NO: 199298 - DNA, 20 bp, Artificial
  CRISPR gRNA sequence
cttgtctggggtaccatgca

SEQ ID NO: 199299 - DNA, 20 bp, Artificial
  CRISPR gRNA sequence
gtctggggtaccatgcagga

SEQ ID NO: 199300 - DNA, 20 bp, Artificial
  CRISPR gRNA sequence
tctggggtaccatgcaggag

SEQ ID NO: 199301 - DNA, 20 bp, Artificial
  CRISPR gRNA sequence
gggtaccatgcaggaggaaa

SEQ ID NO: 199302 - DNA, 20 bp, Artificial
  CRISPR gRNA sequence
agaggctgctaactcccacc

SEQ ID NO: 199303 - DNA, 20 bp, Artificial
  CRISPR gRNA sequence
ctaactcccacctctcaccc

SEQ ID NO: 199304 - DNA, 20 bp, Artificial
  CRISPR gRNA sequence
actcccacctctcaccctta

SEQ ID NO: 199305 - DNA, 20 bp, Artificial
  CRISPR gRNA sequence
ccacctctcacccttagtca

SEQ ID NO: 199306 - DNA, 20 bp, Artificial
  CRISPR gRNA sequence
tcacccttagtcagctcctg

SEQ ID NO: 199307 - DNA, 20 bp, Artificial
  CRISPR gRNA sequence
acccttagtcagctcctgcc

SEQ ID NO: 199308 - DNA, 20 bp, Artificial
  CRISPR gRNA sequence
agtcagctcctgcctggctc

SEQ ID NO: 199309 - DNA, 20 bp, Artificial
  CRISPR gRNA sequence
gtcagctcctgcctggctca

SEQ ID NO: 199310 - DNA, 20 bp, Artificial
  CRISPR gRNA sequence
ctgcctggctcagctctcca

SEQ ID NO: 199311 - DNA, 20 bp, Artificial
  CRISPR gRNA sequence
cctggctcagctctccactg

SEQ ID NO: 199312 - DNA, 20 bp, Artificial
  CRISPR gRNA sequence
gctcagctctccactgagac

SEQ ID NO: 199313 - DNA, 20 bp, Artificial
  CRISPR gRNA sequence
agctctccactgagacccat

SEQ ID NO: 199314 - DNA, 20 bp, Artificial
  CRISPR gRNA sequence
tccactgagacccatgatcc

SEQ ID NO: 199315 - DNA, 20 bp, Artificial
  CRISPR gRNA sequence
cactgagacccatgatccat

SEQ ID NO: 199316 - DNA, 20 bp, Artificial
  CRISPR gRNA sequence
agacccatgatccatctttg

SEQ ID NO: 199317 - DNA, 20 bp, Artificial
  CRISPR gRNA sequence
tgactacccaggtgaaactt

SEQ ID NO: 199318 - DNA, 20 bp, Artificial
  CRISPR gRNA sequence
gactacccaggtgaaacttt

SEQ ID NO: 199319 - DNA, 20 bp, Artificial
  CRISPR gRNA sequence
actacccaggtgaaacttta

SEQ ID NO: 199320 - DNA, 20 bp, Artificial
  CRISPR gRNA sequence
cccaggtgaaactttaaaga

SEQ ID NO: 199321 - DNA, 20 bp, Artificial
  CRISPR gRNA sequence
taaagacacaacaacagcca

SEQ ID NO: 199322 - DNA, 20 bp, Artificial
  CRISPR gRNA sequence
aaagacacaacaacagccag

SEQ ID NO: 199323 - DNA, 20 bp, Artificial
  CRISPR gRNA sequence
aagacacaacaacagccagc

SEQ ID NO: 199324 - DNA, 20 bp, Artificial
  CRISPR gRNA sequence
tttccgtaacttacagttta

SEQ ID NO: 199325 - DNA, 20 bp, Artificial
  CRISPR gRNA sequence
ttccgtaacttacagtttac

SEQ ID NO: 199326 - DNA, 20 bp, Artificial
  CRISPR gRNA sequence
tccgtaacttacagtttaca

SEQ ID NO: 199327 - DNA, 20 bp, Artificial
  CRISPR gRNA sequence
ccgtaacttacagtttacaa

SEQ ID NO: 199328 - DNA, 20 bp, Artificial
  CRISPR gRNA sequence
cgtaacttacagtttacaat

SEQ ID NO: 199329 - DNA, 20 bp, Artificial
  CRISPR gRNA sequence
acagtttacaatgcctgttc

SEQ ID NO: 199330 - DNA, 20 bp, Artificial
  CRISPR gRNA sequence
cagtttacaatgcctgttca

SEQ ID NO: 199331 - DNA, 20 bp, Artificial
  CRISPR gRNA sequence
acaatgcctgttcacgtatg

SEQ ID NO: 199332 - DNA, 20 bp, Artificial
  CRISPR gRNA sequence
caatgcctgttcacgtatgt

SEQ ID NO: 199333 - DNA, 20 bp, Artificial
  CRISPR gRNA sequence
ttcacgtatgttttatttca

SEQ ID NO: 199334 - DNA, 20 bp, Artificial
  CRISPR gRNA sequence
acgtatgttttatttcagtt

SEQ ID NO: 199335 - DNA, 20 bp, Artificial
  CRISPR gRNA sequence
tatttcagtttcagaacaac

SEQ ID NO: 199336 - DNA, 20 bp, Artificial
  CRISPR gRNA sequence
atttcagtttcagaacaact

SEQ ID NO: 199337 - DNA, 20 bp, Artificial
  CRISPR gRNA sequence
tttcagtttcagaacaactt

SEQ ID NO: 199338 - DNA, 20 bp, Artificial
  CRISPR gRNA sequence
cagtttcagaacaactttat

SEQ ID NO: 199339 - DNA, 20 bp, Artificial
  CRISPR gRNA sequence
agtttcagaacaactttatg

SEQ ID NO: 199340 - DNA, 20 bp, Artificial
  CRISPR gRNA sequence
cagaacaactttatgagtta

SEQ ID NO: 199341 - DNA, 20 bp, Artificial
  CRISPR gRNA sequence
agaacaactttatgagttag

SEQ ID NO: 199342 - DNA, 20 bp, Artificial
  CRISPR gRNA sequence
tatgagttaggcatgccagg

SEQ ID NO: 199343 - DNA, 20 bp, Artificial
  CRISPR gRNA sequence
atgagttaggcatgccaggt

SEQ ID NO: 199344 - DNA, 20 bp, Artificial
  CRISPR gRNA sequence
tgagttaggcatgccaggta

SEQ ID NO: 199345 - DNA, 20 bp, Artificial
  CRISPR gRNA sequence
ggcatgccaggtatttaaaa

SEQ ID NO: 199346 - DNA, 20 bp, Artificial
  CRISPR gRNA sequence
aaaaaaaaatccccaattta

SEQ ID NO: 199347 - DNA, 20 bp, Artificial
  CRISPR gRNA sequence
aaaaaaaatccccaatttac

SEQ ID NO: 199348 - DNA, 20 bp, Artificial
  CRISPR gRNA sequence
acagatgaggaaacagactc

SEQ ID NO: 199349 - DNA, 20 bp, Artificial
  CRISPR gRNA sequence
cagatgaggaaacagactca

SEQ ID NO: 199350 - DNA, 20 bp, Artificial
  CRISPR gRNA sequence
agtgcagttaggtgagttac

SEQ ID NO: 199351 - DNA, 20 bp, Artificial
  CRISPR gRNA sequence
ggtgagttactgtaggccac

SEQ ID NO: 199352 - DNA, 20 bp, Artificial
  CRISPR gRNA sequence
ctgtaggccacccaacaagt

SEQ ID NO: 199353 - DNA, 20 bp, Artificial
  CRISPR gRNA sequence
taggccacccaacaagtaag

SEQ ID NO: 199354 - DNA, 20 bp, Artificial
  CRISPR gRNA sequence
tcataaaacagcttgtaaat

SEQ ID NO: 199355 - DNA, 20 bp, Artificial
  CRISPR gRNA sequence
gtaaatggcaggaacccact

SEQ ID NO: 199356 - DNA, 20 bp, Artificial
  CRISPR gRNA sequence
taaatggcaggaacccacta

SEQ ID NO: 199357 - DNA, 20 bp, Artificial
  CRISPR gRNA sequence
atctagcttttactgaaagc

SEQ ID NO: 199358 - DNA, 20 bp, Artificial
  CRISPR gRNA sequence
gcttttactgaaagccagtt

SEQ ID NO: 199359 - DNA, 20 bp, Artificial
  CRISPR gRNA sequence
ttactgaaagccagttcaat

SEQ ID NO: 199360 - DNA, 20 bp, Artificial
  CRISPR gRNA sequence
tactgaaagccagttcaata

SEQ ID NO: 199361 - DNA, 20 bp, Artificial
  CRISPR gRNA sequence
actgaaagccagttcaatac

SEQ ID NO: 199362 - DNA, 20 bp, Artificial
  CRISPR gRNA sequence
ctgaaagccagttcaatacc

SEQ ID NO: 199363 - DNA, 20 bp, Artificial
  CRISPR gRNA sequence
aaagccagttcaatacctga

SEQ ID NO: 199364 - DNA, 20 bp, Artificial
  CRISPR gRNA sequence
aatacctgaggactcgtacc

SEQ ID NO: 199365 - DNA, 20 bp, Artificial
  CRISPR gRNA sequence
aggactcgtaccccagtaag

SEQ ID NO: 199366 - DNA, 20 bp, Artificial
  CRISPR gRNA sequence
gtaccccagtaagagcatcc

SEQ ID NO: 199367 - DNA, 20 bp, Artificial
  CRISPR gRNA sequence
tctaaagttttttccccctc

SEQ ID NO: 199368 - DNA, 20 bp, Artificial
  CRISPR gRNA sequence
ctaaagttttttccccctct

SEQ ID NO: 199369 - DNA, 20 bp, Artificial
  CRISPR gRNA sequence
taaagttttttccccctctt

SEQ ID NO: 199370 - DNA, 20 bp, Artificial
  CRISPR gRNA sequence
aagttttttccccctctttc

SEQ ID NO: 199371 - DNA, 20 bp, Artificial
  CRISPR gRNA sequence
tttccccctctttctgttca

SEQ ID NO: 199372 - DNA, 20 bp, Artificial
  CRISPR gRNA sequence
ttccccctctttctgttcac

SEQ ID NO: 199373 - DNA, 20 bp, Artificial
  CRISPR gRNA sequence
tccccctctttctgttcaca

SEQ ID NO: 199374 - DNA, 20 bp, Artificial
  CRISPR gRNA sequence
ccccctctttctgttcacaa

SEQ ID NO: 199375 - DNA, 20 bp, Artificial
  CRISPR gRNA sequence
cccctctttctgttcacaac

SEQ ID NO: 199376 - DNA, 20 bp, Artificial
  CRISPR gRNA sequence
tttctgttcacaacaccgtc

SEQ ID NO: 199377 - DNA, 20 bp, Artificial
  CRISPR gRNA sequence
tctgttcacaacaccgtcct

SEQ ID NO: 199378 - DNA, 20 bp, Artificial
  CRISPR gRNA sequence
ctgttcacaacaccgtcctg

SEQ ID NO: 199379 - DNA, 20 bp, Artificial
  CRISPR gRNA sequence
tgttcacaacaccgtcctgg

SEQ ID NO: 199380 - DNA, 20 bp, Artificial
  CRISPR gRNA sequence
ttcacaacaccgtcctggat

SEQ ID NO: 199381 - DNA, 20 bp, Artificial
  CRISPR gRNA sequence
acaacaccgtcctggattat

SEQ ID NO: 199382 - DNA, 20 bp, Artificial
  CRISPR gRNA sequence
gattatcttttcctattgat

SEQ ID NO: 199383 - DNA, 20 bp, Artificial
  CRISPR gRNA sequence
tcttttcctattgattgact

SEQ ID NO: 199384 - DNA, 20 bp, Artificial
  CRISPR gRNA sequence
ttcctattgattgacttttc

SEQ ID NO: 199385 - DNA, 20 bp, Artificial
  CRISPR gRNA sequence
tcctattgattgacttttct

SEQ ID NO: 199386 - DNA, 20 bp, Artificial
  CRISPR gRNA sequence
cctattgattgacttttcta

SEQ ID NO: 199387 - DNA, 20 bp, Artificial
  CRISPR gRNA sequence
ctattgattgacttttctat

SEQ ID NO: 199388 - DNA, 20 bp, Artificial
  CRISPR gRNA sequence
ttgattgacttttctatcta

SEQ ID NO: 199389 - DNA, 20 bp, Artificial
  CRISPR gRNA sequence
attgacttttctatctaatt

SEQ ID NO: 199390 - DNA, 20 bp, Artificial
  CRISPR gRNA sequence
acttttctatctaatttttc

SEQ ID NO: 199391 - DNA, 20 bp, Artificial
  CRISPR gRNA sequence
ttctatctaatttttcagtt

SEQ ID NO: 199392 - DNA, 20 bp, Artificial
  CRISPR gRNA sequence
tctatctaatttttcagttg

SEQ ID NO: 199393 - DNA, 20 bp, Artificial
  CRISPR gRNA sequence
ctatctaatttttcagttgt

SEQ ID NO: 199394 - DNA, 20 bp, Artificial
  CRISPR gRNA sequence
tatctaatttttcagttgtt

SEQ ID NO: 199395 - DNA, 20 bp, Artificial
  CRISPR gRNA sequence
tctaatttttcagttgtttt

SEQ ID NO: 199396 - DNA, 20 bp, Artificial
  CRISPR gRNA sequence
atttttcagttgtttttgct

SEQ ID NO: 199397 - DNA, 20 bp, Artificial
  CRISPR gRNA sequence
ttcagttgtttttgctgaag

SEQ ID NO: 199398 - DNA, 20 bp, Artificial
  CRISPR gRNA sequence
tcagttgtttttgctgaagt

SEQ ID NO: 199399 - DNA, 20 bp, Artificial
  CRISPR gRNA sequence
cagttgtttttgctgaagta

SEQ ID NO: 199400 - DNA, 20 bp, Artificial
  CRISPR gRNA sequence
agttgtttttgctgaagtac

SEQ ID NO: 199401 - DNA, 20 bp, Artificial
  CRISPR gRNA sequence
tttttgctgaagtacgtggc

SEQ ID NO: 199402 - DNA, 20 bp, Artificial
  CRISPR gRNA sequence
ttgctgaagtacgtggcatt

SEQ ID NO: 199403 - DNA, 20 bp, Artificial
  CRISPR gRNA sequence
tgctgaagtacgtggcattt

SEQ ID NO: 199404 - DNA, 20 bp, Artificial
  CRISPR gRNA sequence
gctgaagtacgtggcatttt

SEQ ID NO: 199405 - DNA, 20 bp, Artificial
  CRISPR gRNA sequence
ctgaagtacgtggcattttc

SEQ ID NO: 199406 - DNA, 20 bp, Artificial
  CRISPR gRNA sequence
aagtacgtggcattttccta

SEQ ID NO: 199407 - DNA, 20 bp, Artificial
  CRISPR gRNA sequence
tcctatcaacatgtattggg

SEQ ID NO: 199408 - DNA, 20 bp, Artificial
  CRISPR gRNA sequence
cctatcaacatgtattgggg

SEQ ID NO: 199409 - DNA, 20 bp, Artificial
  CRISPR gRNA sequence
ctatcaacatgtattggggg

SEQ ID NO: 199410 - DNA, 20 bp, Artificial
  CRISPR gRNA sequence
tcaacatgtattgggggagg

SEQ ID NO: 199411 - DNA, 20 bp, Artificial
  CRISPR gRNA sequence
ggggagggggcagtgagcag

SEQ ID NO: 199412 - DNA, 20 bp, Artificial
  CRISPR gRNA sequence
ttctcagaatatctttgtgt

SEQ ID NO: 199413 - DNA, 20 bp, Artificial
  CRISPR gRNA sequence
ctcagaatatctttgtgttt

SEQ ID NO: 199414 - DNA, 20 bp, Artificial
  CRISPR gRNA sequence
tcagaatatctttgtgttta

SEQ ID NO: 199415 - DNA, 20 bp, Artificial
  CRISPR gRNA sequence
agaatatctttgtgtttata

SEQ ID NO: 199416 - DNA, 20 bp, Artificial
  CRISPR gRNA sequence
tgtgtttatattaaatatca

SEQ ID NO: 199417 - DNA, 20 bp, Artificial
  CRISPR gRNA sequence
gtgtttatattaaatatcat

SEQ ID NO: 199418 - DNA, 20 bp, Artificial
  CRISPR gRNA sequence
tgtttatattaaatatcatg

SEQ ID NO: 199419 - DNA, 20 bp, Artificial
  CRISPR gRNA sequence
atattaaatatcatgctcac

SEQ ID NO: 199420 - DNA, 20 bp, Artificial
  CRISPR gRNA sequence
tattaaatatcatgctcact

SEQ ID NO: 199421 - DNA, 20 bp, Artificial
  CRISPR gRNA sequence
aatatcatgctcactcgcct

SEQ ID NO: 199422 - DNA, 20 bp, Artificial
  CRISPR gRNA sequence
actcgcctcactttctttca

SEQ ID NO: 199423 - DNA, 20 bp, Artificial
  CRISPR gRNA sequence
gcctcactttctttcacatt

SEQ ID NO: 199424 - DNA, 20 bp, Artificial
  CRISPR gRNA sequence
actttctttcacattctgag

SEQ ID NO: 199425 - DNA, 20 bp, Artificial
  CRISPR gRNA sequence
tctttcacattctgagcctc

SEQ ID NO: 199426 - DNA, 20 bp, Artificial
  CRISPR gRNA sequence
ctttcacattctgagcctct

SEQ ID NO: 199427 - DNA, 20 bp, Artificial
  CRISPR gRNA sequence
tttcacattctgagcctctc

SEQ ID NO: 199428 - DNA, 20 bp, Artificial
  CRISPR gRNA sequence
tcacattctgagcctctcat

SEQ ID NO: 199429 - DNA, 20 bp, Artificial
  CRISPR gRNA sequence
cacattctgagcctctcatc

SEQ ID NO: 199430 - DNA, 20 bp, Artificial
  CRISPR gRNA sequence
acattctgagcctctcatca

SEQ ID NO: 199431 - DNA, 20 bp, Artificial
  CRISPR gRNA sequence
tgagcctctcatcagactct

SEQ ID NO: 199432 - DNA, 20 bp, Artificial
  CRISPR gRNA sequence
agcctctcatcagactctgt

SEQ ID NO: 199433 - DNA, 20 bp, Artificial
  CRISPR gRNA sequence
tcatcagactctgtctccca

SEQ ID NO: 199434 - DNA, 20 bp, Artificial
  CRISPR gRNA sequence
atcagactctgtctcccacc

SEQ ID NO: 199435 - DNA, 20 bp, Artificial
  CRISPR gRNA sequence
tgtctcccaccctacctact

SEQ ID NO: 199436 - DNA, 20 bp, Artificial
  CRISPR gRNA sequence
tctcccaccctacctacttc

SEQ ID NO: 199437 - DNA, 20 bp, Artificial
  CRISPR gRNA sequence
ccaccctacctacttctgta

SEQ ID NO: 199438 - DNA, 20 bp, Artificial
  CRISPR gRNA sequence
cctacttctgtagagtagtg

SEQ ID NO: 199439 - DNA, 20 bp, Artificial
  CRISPR gRNA sequence
cttctgtagagtagtgagat

SEQ ID NO: 199440 - DNA, 20 bp, Artificial
  CRISPR gRNA sequence
ctgtagagtagtgagataaa

SEQ ID NO: 199441 - DNA, 20 bp, Artificial
  CRISPR gRNA sequence
tgtagagtagtgagataaaa

SEQ ID NO: 199442 - DNA, 20 bp, Artificial
  CRISPR gRNA sequence
tagagtagtgagataaaaaa

SEQ ID NO: 199443 - DNA, 20 bp, Artificial
  CRISPR gRNA sequence
aatttgtgcaggcaatggtc

SEQ ID NO: 199444 - DNA, 20 bp, Artificial
  CRISPR gRNA sequence
gtgcaggcaatggtctcaaa

SEQ ID NO: 199445 - DNA, 20 bp, Artificial
  CRISPR gRNA sequence
tgcaggcaatggtctcaaat

SEQ ID NO: 199446 - DNA, 20 bp, Artificial
  CRISPR gRNA sequence
aaatcattttcatacactgt

SEQ ID NO: 199447 - DNA, 20 bp, Artificial
  CRISPR gRNA sequence
tcatacactgttgctaatct

SEQ ID NO: 199448 - DNA, 20 bp, Artificial
  CRISPR gRNA sequence
catacactgttgctaatctg

SEQ ID NO: 199449 - DNA, 20 bp, Artificial
  CRISPR gRNA sequence
atacactgttgctaatctga

SEQ ID NO: 199450 - DNA, 20 bp, Artificial
  CRISPR gRNA sequence
ttgctaatctgacccttaca

SEQ ID NO: 199451 - DNA, 20 bp, Artificial
  CRISPR gRNA sequence
ctaatctgacccttacaata

SEQ ID NO: 199452 - DNA, 20 bp, Artificial
  CRISPR gRNA sequence
atctgacccttacaataagc

SEQ ID NO: 199453 - DNA, 20 bp, Artificial
  CRISPR gRNA sequence
acccttacaataagcttgct

SEQ ID NO: 199454 - DNA, 20 bp, Artificial
  CRISPR gRNA sequence
acaataagcttgctcagtag

SEQ ID NO: 199455 - DNA, 20 bp, Artificial
  CRISPR gRNA sequence
caataagcttgctcagtaga

SEQ ID NO: 199456 - DNA, 20 bp, Artificial
  CRISPR gRNA sequence
gctcagtagattataatcct

SEQ ID NO: 199457 - DNA, 20 bp, Artificial
  CRISPR gRNA sequence
ctcagtagattataatccta

SEQ ID NO: 199458 - DNA, 20 bp, Artificial
  CRISPR gRNA sequence
agtagattataatcctacag

SEQ ID NO: 199459 - DNA, 20 bp, Artificial
  CRISPR gRNA sequence
taatcctacagggaaagtga

SEQ ID NO: 199460 - DNA, 20 bp, Artificial
  CRISPR gRNA sequence
cagggaaagtgaagcacaca

SEQ ID NO: 199461 - DNA, 20 bp, Artificial
  CRISPR gRNA sequence
gtaatttgcccagggacaca

SEQ ID NO: 199462 - DNA, 20 bp, Artificial
  CRISPR gRNA sequence
gcccagggacacacagcctc

SEQ ID NO: 199463 - DNA, 20 bp, Artificial
  CRISPR gRNA sequence
cccagggacacacagcctca

SEQ ID NO: 199464 - DNA, 20 bp, Artificial
  CRISPR gRNA sequence
atgttctatgcactaagcag

SEQ ID NO: 199465 - DNA, 20 bp, Artificial
  CRISPR gRNA sequence
tatgcactaagcagactgct

SEQ ID NO: 199466 - DNA, 20 bp, Artificial
  CRISPR gRNA sequence
tgcactaagcagactgctag

SEQ ID NO: 199467 - DNA, 20 bp, Artificial
  CRISPR gRNA sequence
agcagactgctagagttgaa

SEQ ID NO: 199468 - DNA, 20 bp, Artificial
  CRISPR gRNA sequence
ctagagttgaaatattgtag

SEQ ID NO: 199469 - DNA, 20 bp, Artificial
  CRISPR gRNA sequence
gagttgaaatattgtagact

SEQ ID NO: 199470 - DNA, 20 bp, Artificial
  CRISPR gRNA sequence
aaatattgtagactaccttg

SEQ ID NO: 199471 - DNA, 20 bp, Artificial
  CRISPR gRNA sequence
tagactaccttgggagaggc

SEQ ID NO: 199472 - DNA, 20 bp, Artificial
  CRISPR gRNA sequence
ccttgggagaggcaccgggg

SEQ ID NO: 199473 - DNA, 20 bp, Artificial
  CRISPR gRNA sequence
gggagaggcaccggggagaa

SEQ ID NO: 199474 - DNA, 20 bp, Artificial
  CRISPR gRNA sequence
ggagaggcaccggggagaaa

SEQ ID NO: 199475 - DNA, 20 bp, Artificial
  CRISPR gRNA sequence
atgtttggcataagatagaa

SEQ ID NO: 199476 - DNA, 20 bp, Artificial
  CRISPR gRNA sequence
ggcataagatagaaaaatat

SEQ ID NO: 199477 - DNA, 20 bp, Artificial
  CRISPR gRNA sequence
gcataagatagaaaaatatg

SEQ ID NO: 199478 - DNA, 20 bp, Artificial
  CRISPR gRNA sequence
catttatttcctgccaccct

SEQ ID NO: 199479 - DNA, 20 bp, Artificial
  CRISPR gRNA sequence
atttcctgccaccctggaaa

SEQ ID NO: 199480 - DNA, 20 bp, Artificial
  CRISPR gRNA sequence
tttcctgccaccctggaaag

SEQ ID NO: 199481 - DNA, 20 bp, Artificial
  CRISPR gRNA sequence
cctgccaccctggaaagagg

SEQ ID NO: 199482 - DNA, 20 bp, Artificial
  CRISPR gRNA sequence
ctgccaccctggaaagaggg

SEQ ID NO: 199483 - DNA, 20 bp, Artificial
  CRISPR gRNA sequence
ccaccctggaaagagggaag

SEQ ID NO: 199484 - DNA, 20 bp, Artificial
  CRISPR gRNA sequence
gaaagagggaagcagctctg

SEQ ID NO: 199485 - DNA, 20 bp, Artificial
  CRISPR gRNA sequence
tgatgtgccaggatttggat

SEQ ID NO: 199486 - DNA, 20 bp, Artificial
  CRISPR gRNA sequence
atgtgccaggatttggattc

SEQ ID NO: 199487 - DNA, 20 bp, Artificial
  CRISPR gRNA sequence
ggattcctgaaacaaggcct

SEQ ID NO: 199488 - DNA, 20 bp, Artificial
  CRISPR gRNA sequence
gattcctgaaacaaggcctg

SEQ ID NO: 199489 - DNA, 20 bp, Artificial
  CRISPR gRNA sequence
ctgaaacaaggcctgaattg

SEQ ID NO: 199490 - DNA, 20 bp, Artificial
  CRISPR gRNA sequence
aaacaaggcctgaattgagt

SEQ ID NO: 199491 - DNA, 20 bp, Artificial
  CRISPR gRNA sequence
aattgagtattcctctcagg

SEQ ID NO: 199492 - DNA, 20 bp, Artificial
  CRISPR gRNA sequence
agtattcctctcaggtattc

SEQ ID NO: 199493 - DNA, 20 bp, Artificial
  CRISPR gRNA sequence
ctctcaggtattccccaggt

SEQ ID NO: 199494 - DNA, 20 bp, Artificial
  CRISPR gRNA sequence
tcaggtattccccaggtttc

SEQ ID NO: 199495 - DNA, 20 bp, Artificial
  CRISPR gRNA sequence
aggtattccccaggtttccc

SEQ ID NO: 199496 - DNA, 20 bp, Artificial
  CRISPR gRNA sequence
cccaggtttcccggctatga

SEQ ID NO: 199497 - DNA, 20 bp, Artificial
  CRISPR gRNA sequence
cccggctatgaaagcatttc

SEQ ID NO: 199498 - DNA, 20 bp, Artificial
  CRISPR gRNA sequence
ccggctatgaaagcatttcc

SEQ ID NO: 199499 - DNA, 20 bp, Artificial
  CRISPR gRNA sequence
tgaaagcatttcccacatgg

SEQ ID NO: 199500 - DNA, 20 bp, Artificial
  CRISPR gRNA sequence
cccacatggtgttggattgc

SEQ ID NO: 199501 - DNA, 20 bp, Artificial
  CRISPR gRNA sequence
ccacatggtgttggattgcc

SEQ ID NO: 199502 - DNA, 20 bp, Artificial
  CRISPR gRNA sequence
gattgcctgttttttgtttg

SEQ ID NO: 199503 - DNA, 20 bp, Artificial
  CRISPR gRNA sequence
cctgttttttgtttgtttct

SEQ ID NO: 199504 - DNA, 20 bp, Artificial
  CRISPR gRNA sequence
ttttttgtttgtttcttagt

SEQ ID NO: 199505 - DNA, 20 bp, Artificial
  CRISPR gRNA sequence
tttgtttgtttcttagtttt

SEQ ID NO: 199506 - DNA, 20 bp, Artificial
  CRISPR gRNA sequence
ttgtttgtttcttagttttt

SEQ ID NO: 199507 - DNA, 20 bp, Artificial
  CRISPR gRNA sequence
tgtttgtttcttagtttttt

SEQ ID NO: 199508 - DNA, 20 bp, Artificial
  CRISPR gRNA sequence
gtttgtttcttagtttttta

SEQ ID NO: 199509 - DNA, 20 bp, Artificial
  CRISPR gRNA sequence
tttgtttcttagttttttat

SEQ ID NO: 199510 - DNA, 20 bp, Artificial
  CRISPR gRNA sequence
gtttcttagttttttatctg

SEQ ID NO: 199511 - DNA, 20 bp, Artificial
  CRISPR gRNA sequence
tttcttagttttttatctgt

SEQ ID NO: 199512 - DNA, 20 bp, Artificial
  CRISPR gRNA sequence
cttagttttttatctgtttc

SEQ ID NO: 199513 - DNA, 20 bp, Artificial
  CRISPR gRNA sequence
ttagttttttatctgtttcc

SEQ ID NO: 199514 - DNA, 20 bp, Artificial
  CRISPR gRNA sequence
agttttttatctgtttcctg

SEQ ID NO: 199515 - DNA, 20 bp, Artificial
  CRISPR gRNA sequence
gttttttatctgtttcctga

SEQ ID NO: 199516 - DNA, 20 bp, Artificial
  CRISPR gRNA sequence
tttatctgtttcctgaagag

SEQ ID NO: 199517 - DNA, 20 bp, Artificial
  CRISPR gRNA sequence
ttatctgtttcctgaagagt

SEQ ID NO: 199518 - DNA, 20 bp, Artificial
  CRISPR gRNA sequence
tatctgtttcctgaagagtg

SEQ ID NO: 199519 - DNA, 20 bp, Artificial
  CRISPR gRNA sequence
atctgtttcctgaagagtgt

SEQ ID NO: 199520 - DNA, 20 bp, Artificial
  CRISPR gRNA sequence
tctgtttcctgaagagtgtg

SEQ ID NO: 199521 - DNA, 20 bp, Artificial
  CRISPR gRNA sequence
tttcctgaagagtgtgaact

SEQ ID NO: 199522 - DNA, 20 bp, Artificial
  CRISPR gRNA sequence
cctgaagagtgtgaactgag

SEQ ID NO: 199523 - DNA, 20 bp, Artificial
  CRISPR gRNA sequence
ctgaagagtgtgaactgagt

SEQ ID NO: 199524 - DNA, 20 bp, Artificial
  CRISPR gRNA sequence
aagagtgtgaactgagtctt

SEQ ID NO: 199525 - DNA, 20 bp, Artificial
  CRISPR gRNA sequence
agtcttattattctatgtgt

SEQ ID NO: 199526 - DNA, 20 bp, Artificial
  CRISPR gRNA sequence
attattctatgtgtatccaa

SEQ ID NO: 199527 - DNA, 20 bp, Artificial
  CRISPR gRNA sequence
ttattctatgtgtatccaat

SEQ ID NO: 199528 - DNA, 20 bp, Artificial
  CRISPR gRNA sequence
ttctatgtgtatccaatgag

SEQ ID NO: 199529 - DNA, 20 bp, Artificial
  CRISPR gRNA sequence
tatgtgtatccaatgagtac

SEQ ID NO: 199530 - DNA, 20 bp, Artificial
  CRISPR gRNA sequence
tgtgtatccaatgagtacta

SEQ ID NO: 199531 - DNA, 20 bp, Artificial
  CRISPR gRNA sequence
caatgcatggaacaaaaggt

SEQ ID NO: 199532 - DNA, 20 bp, Artificial
  CRISPR gRNA sequence
cataaatatctgctgaatgt

SEQ ID NO: 199533 - DNA, 20 bp, Artificial
  CRISPR gRNA sequence
ctgaatgtttattaagtaac

SEQ ID NO: 199534 - DNA, 20 bp, Artificial
  CRISPR gRNA sequence
aatgtttattaagtaacaat

SEQ ID NO: 199535 - DNA, 20 bp, Artificial
  CRISPR gRNA sequence
attaagtaacaatatggttt

SEQ ID NO: 199536 - DNA, 20 bp, Artificial
  CRISPR gRNA sequence
ttaagtaacaatatggtttg

SEQ ID NO: 199537 - DNA, 20 bp, Artificial
  CRISPR gRNA sequence
agtaacaatatggtttggat

SEQ ID NO: 199538 - DNA, 20 bp, Artificial
  CRISPR gRNA sequence
ggatgaatggaggtgaggaa

SEQ ID NO: 199539 - DNA, 20 bp, Artificial
  CRISPR gRNA sequence
gatgaatggaggtgaggaat

SEQ ID NO: 199540 - DNA, 20 bp, Artificial
  CRISPR gRNA sequence
ggatatattttgtaaacata

SEQ ID NO: 199541 - DNA, 20 bp, Artificial
  CRISPR gRNA sequence
tgtaaacatagtgttattca

SEQ ID NO: 199542 - DNA, 20 bp, Artificial
  CRISPR gRNA sequence
gtaaacatagtgttattcat

SEQ ID NO: 199543 - DNA, 20 bp, Artificial
  CRISPR gRNA sequence
taaacatagtgttattcatt

SEQ ID NO: 199544 - DNA, 20 bp, Artificial
  CRISPR gRNA sequence
ttcattcattcatttattca

SEQ ID NO: 199545 - DNA, 20 bp, Artificial
  CRISPR gRNA sequence
attcattcatttattcaaca

SEQ ID NO: 199546 - DNA, 20 bp, Artificial
  CRISPR gRNA sequence
attcatttattcaacaatca

SEQ ID NO: 199547 - DNA, 20 bp, Artificial
  CRISPR gRNA sequence
atttattcaacaatcactga

SEQ ID NO: 199548 - DNA, 20 bp, Artificial
  CRISPR gRNA sequence
attcaacaatcactgaatga

SEQ ID NO: 199549 - DNA, 20 bp, Artificial
  CRISPR gRNA sequence
ttcaacaatcactgaatgac

SEQ ID NO: 199550 - DNA, 20 bp, Artificial
  CRISPR gRNA sequence
aacaatcactgaatgactat

SEQ ID NO: 199551 - DNA, 20 bp, Artificial
  CRISPR gRNA sequence
aatgactatgataggcagac

SEQ ID NO: 199552 - DNA, 20 bp, Artificial
  CRISPR gRNA sequence
tgataggcagacatcatgct

SEQ ID NO: 199553 - DNA, 20 bp, Artificial
  CRISPR gRNA sequence
ggtgctaggggacagtgtta

SEQ ID NO: 199554 - DNA, 20 bp, Artificial
  CRISPR gRNA sequence
ggggacagtgttagacatat

SEQ ID NO: 199555 - DNA, 20 bp, Artificial
  CRISPR gRNA sequence
gacatattttaatggacaca

SEQ ID NO: 199556 - DNA, 20 bp, Artificial
  CRISPR gRNA sequence
taatggacacattcagaata

SEQ ID NO: 199557 - DNA, 20 bp, Artificial
  CRISPR gRNA sequence
aatggacacattcagaatat

SEQ ID NO: 199558 - DNA, 20 bp, Artificial
  CRISPR gRNA sequence
atggacacattcagaatatt

SEQ ID NO: 199559 - DNA, 20 bp, Artificial
  CRISPR gRNA sequence
agaatattacctgggatgac

SEQ ID NO: 199560 - DNA, 20 bp, Artificial
  CRISPR gRNA sequence
cctgggatgaccaattcagc

SEQ ID NO: 199561 - DNA, 20 bp, Artificial
  CRISPR gRNA sequence
ggatgaccaattcagctgta

SEQ ID NO: 199562 - DNA, 20 bp, Artificial
  CRISPR gRNA sequence
agctgtatggttttcctcag

SEQ ID NO: 199563 - DNA, 20 bp, Artificial
  CRISPR gRNA sequence
tatggttttcctcaggatct

SEQ ID NO: 199564 - DNA, 20 bp, Artificial
  CRISPR gRNA sequence
tcctcaggatctaatctcct

SEQ ID NO: 199565 - DNA, 20 bp, Artificial
  CRISPR gRNA sequence
cctcaggatctaatctccta

SEQ ID NO: 199566 - DNA, 20 bp, Artificial
  CRISPR gRNA sequence
ctcaggatctaatctcctaa

SEQ ID NO: 199567 - DNA, 20 bp, Artificial
  CRISPR gRNA sequence
aggatctaatctcctaaaag

SEQ ID NO: 199568 - DNA, 20 bp, Artificial
  CRISPR gRNA sequence
atctcctaaaagtgcagtag

SEQ ID NO: 199569 - DNA, 20 bp, Artificial
  CRISPR gRNA sequence
ctaaaagtgcagtagaaaat

SEQ ID NO: 199570 - DNA, 20 bp, Artificial
  CRISPR gRNA sequence
aaagtgcagtagaaaatctc

SEQ ID NO: 199571 - DNA, 20 bp, Artificial
  CRISPR gRNA sequence
attagttgttgtgttgattc

SEQ ID NO: 199572 - DNA, 20 bp, Artificial
  CRISPR gRNA sequence
gttgttgtgttgattctcag

SEQ ID NO: 199573 - DNA, 20 bp, Artificial
  CRISPR gRNA sequence
ttgtgttgattctcagtgtg

SEQ ID NO: 199574 - DNA, 20 bp, Artificial
  CRISPR gRNA sequence
tgttgattctcagtgtgctg

SEQ ID NO: 199575 - DNA, 20 bp, Artificial
  CRISPR gRNA sequence
attctcagtgtgctggtcac

SEQ ID NO: 199576 - DNA, 20 bp, Artificial
  CRISPR gRNA sequence
tcagtgtgctggtcacattg

SEQ ID NO: 199577 - DNA, 20 bp, Artificial
  CRISPR gRNA sequence
agtgtgctggtcacattgaa

SEQ ID NO: 199578 - DNA, 20 bp, Artificial
  CRISPR gRNA sequence
gtcacattgaaaagcttctc

SEQ ID NO: 199579 - DNA, 20 bp, Artificial
  CRISPR gRNA sequence
aaaagcttctcctctctctt

SEQ ID NO: 199580 - DNA, 20 bp, Artificial
  CRISPR gRNA sequence
ctcctctctcttggaattgg

SEQ ID NO: 199581 - DNA, 20 bp, Artificial
  CRISPR gRNA sequence
tcctctctcttggaattggt

SEQ ID NO: 199582 - DNA, 20 bp, Artificial
  CRISPR gRNA sequence
ctctctcttggaattggtgg

SEQ ID NO: 199583 - DNA, 20 bp, Artificial
  CRISPR gRNA sequence
tctcttggaattggtggtgg

SEQ ID NO: 199584 - DNA, 20 bp, Artificial
  CRISPR gRNA sequence
tcttggaattggtggtggtg

SEQ ID NO: 199585 - DNA, 20 bp, Artificial
  CRISPR gRNA sequence
ttggaattggtggtggtggt

SEQ ID NO: 199586 - DNA, 20 bp, Artificial
  CRISPR gRNA sequence
ggaattggtggtggtggtct

SEQ ID NO: 199587 - DNA, 20 bp, Artificial
  CRISPR gRNA sequence
gaattggtggtggtggtctt

SEQ ID NO: 199588 - DNA, 20 bp, Artificial
  CRISPR gRNA sequence
gtggtggtggtcttaccact

SEQ ID NO: 199589 - DNA, 20 bp, Artificial
  CRISPR gRNA sequence
accactcaggacttgatggt

SEQ ID NO: 199590 - DNA, 20 bp, Artificial
  CRISPR gRNA sequence
ccactcaggacttgatggtc

SEQ ID NO: 199591 - DNA, 20 bp, Artificial
  CRISPR gRNA sequence
aggacttgatggtcactgct

SEQ ID NO: 199592 - DNA, 20 bp, Artificial
  CRISPR gRNA sequence
gatggtcactgcttgtccag

SEQ ID NO: 199593 - DNA, 20 bp, Artificial
  CRISPR gRNA sequence
atggtcactgcttgtccaga

SEQ ID NO: 199594 - DNA, 20 bp, Artificial
  CRISPR gRNA sequence
cttgtccagatgacttcggc

SEQ ID NO: 199595 - DNA, 20 bp, Artificial
  CRISPR gRNA sequence
gtccagatgacttcggcctt

SEQ ID NO: 199596 - DNA, 20 bp, Artificial
  CRISPR gRNA sequence
tccagatgacttcggccttg

SEQ ID NO: 199597 - DNA, 20 bp, Artificial
  CRISPR gRNA sequence
cggccttggggtagccctca

SEQ ID NO: 199598 - DNA, 20 bp, Artificial
  CRISPR gRNA sequence
ggccttggggtagccctcag

SEQ ID NO: 199599 - DNA, 20 bp, Artificial
  CRISPR gRNA sequence
ggggtagccctcagcctgac

SEQ ID NO: 199600 - DNA, 20 bp, Artificial
  CRISPR gRNA sequence
gggtagccctcagcctgaca

SEQ ID NO: 199601 - DNA, 20 bp, Artificial
  CRISPR gRNA sequence
agcctgacatgtcagttcat

SEQ ID NO: 199602 - DNA, 20 bp, Artificial
  CRISPR gRNA sequence
acatgtcagttcatgttcag

SEQ ID NO: 199603 - DNA, 20 bp, Artificial
  CRISPR gRNA sequence
atgttcagaggtgactggat

SEQ ID NO: 199604 - DNA, 20 bp, Artificial
  CRISPR gRNA sequence
agaggtgactggatccacaa

SEQ ID NO: 199605 - DNA, 20 bp, Artificial
  CRISPR gRNA sequence
gatccacaaccaaaattctt

SEQ ID NO: 199606 - DNA, 20 bp, Artificial
  CRISPR gRNA sequence
tttggttgattttgttgtat

SEQ ID NO: 199607 - DNA, 20 bp, Artificial
  CRISPR gRNA sequence
tggttgattttgttgtatgg

SEQ ID NO: 199608 - DNA, 20 bp, Artificial
  CRISPR gRNA sequence
ggttgattttgttgtatggg

SEQ ID NO: 199609 - DNA, 20 bp, Artificial
  CRISPR gRNA sequence
gttgattttgttgtatgggg

SEQ ID NO: 199610 - DNA, 20 bp, Artificial
  CRISPR gRNA sequence
attttgttgtatggggctag

SEQ ID NO: 199611 - DNA, 20 bp, Artificial
  CRISPR gRNA sequence
tgttgtatggggctaggaca

SEQ ID NO: 199612 - DNA, 20 bp, Artificial
  CRISPR gRNA sequence
gttgtatggggctaggacat

SEQ ID NO: 199613 - DNA, 20 bp, Artificial
  CRISPR gRNA sequence
ttgtatggggctaggacata

SEQ ID NO: 199614 - DNA, 20 bp, Artificial
  CRISPR gRNA sequence
tatggggctaggacataaac

SEQ ID NO: 199615 - DNA, 20 bp, Artificial
  CRISPR gRNA sequence
ggacataaacaaaaagaagt

SEQ ID NO: 199616 - DNA, 20 bp, Artificial
  CRISPR gRNA sequence
ttgctgagcacagaactacg

SEQ ID NO: 199617 - DNA, 20 bp, Artificial
  CRISPR gRNA sequence
tgctgagcacagaactacgt

SEQ ID NO: 199618 - DNA, 20 bp, Artificial
  CRISPR gRNA sequence
gctgagcacagaactacgta

SEQ ID NO: 199619 - DNA, 20 bp, Artificial
  CRISPR gRNA sequence
ctgagcacagaactacgtac

SEQ ID NO: 199620 - DNA, 20 bp, Artificial
  CRISPR gRNA sequence
agcacagaactacgtacata

SEQ ID NO: 199621 - DNA, 20 bp, Artificial
  CRISPR gRNA sequence
cgtacatagcttgatgctgt

SEQ ID NO: 199622 - DNA, 20 bp, Artificial
  CRISPR gRNA sequence
gatgctgtccacattagaaa

SEQ ID NO: 199623 - DNA, 20 bp, Artificial
  CRISPR gRNA sequence
atgctgtccacattagaaag

SEQ ID NO: 199624 - DNA, 20 bp, Artificial
  CRISPR gRNA sequence
tccacattagaaagagtatc

SEQ ID NO: 199625 - DNA, 20 bp, Artificial
  CRISPR gRNA sequence
gaaagagtatcaatgcaggc

SEQ ID NO: 199626 - DNA, 20 bp, Artificial
  CRISPR gRNA sequence
gttctcagagggatatgctt

SEQ ID NO: 199627 - DNA, 20 bp, Artificial
  CRISPR gRNA sequence
tcagagggatatgcttaatg

SEQ ID NO: 199628 - DNA, 20 bp, Artificial
  CRISPR gRNA sequence
agagggatatgcttaatgtt

SEQ ID NO: 199629 - DNA, 20 bp, Artificial
  CRISPR gRNA sequence
aatgttcagatgcctcagcc

SEQ ID NO: 199630 - DNA, 20 bp, Artificial
  CRISPR gRNA sequence
atgttcagatgcctcagccg

SEQ ID NO: 199631 - DNA, 20 bp, Artificial
  CRISPR gRNA sequence
agatgcctcagccgtgggga

SEQ ID NO: 199632 - DNA, 20 bp, Artificial
  CRISPR gRNA sequence
agccgtggggaacacctgct

SEQ ID NO: 199633 - DNA, 20 bp, Artificial
  CRISPR gRNA sequence
ctagctctgcctcaattcaa

SEQ ID NO: 199634 - DNA, 20 bp, Artificial
  CRISPR gRNA sequence
gctctgcctcaattcaattc

SEQ ID NO: 199635 - DNA, 20 bp, Artificial
  CRISPR gRNA sequence
tgcctcaattcaattcaaag

SEQ ID NO: 199636 - DNA, 20 bp, Artificial
  CRISPR gRNA sequence
cctcaattcaattcaaagtt

SEQ ID NO: 199637 - DNA, 20 bp, Artificial
  CRISPR gRNA sequence
aattcaattcaaagttggga

SEQ ID NO: 199638 - DNA, 20 bp, Artificial
  CRISPR gRNA sequence
aattcaaagttgggacaagt

SEQ ID NO: 199639 - DNA, 20 bp, Artificial
  CRISPR gRNA sequence
aaagttgggacaagtttgga

SEQ ID NO: 199640 - DNA, 20 bp, Artificial
  CRISPR gRNA sequence
ggacaagtttggattaatag

SEQ ID NO: 199641 - DNA, 20 bp, Artificial
  CRISPR gRNA sequence
ggattaataggaatgactat

SEQ ID NO: 199642 - DNA, 20 bp, Artificial
  CRISPR gRNA sequence
gattaataggaatgactatc

SEQ ID NO: 199643 - DNA, 20 bp, Artificial
  CRISPR gRNA sequence
ataggaatgactatctttct

SEQ ID NO: 199644 - DNA, 20 bp, Artificial
  CRISPR gRNA sequence
tctttctataaaaatcatgt

SEQ ID NO: 199645 - DNA, 20 bp, Artificial
  CRISPR gRNA sequence
tctataaaaatcatgttggt

SEQ ID NO: 199646 - DNA, 20 bp, Artificial
  CRISPR gRNA sequence
ctataaaaatcatgttggta

SEQ ID NO: 199647 - DNA, 20 bp, Artificial
  CRISPR gRNA sequence
tataaaaatcatgttggtac

SEQ ID NO: 199648 - DNA, 20 bp, Artificial
  CRISPR gRNA sequence
taaaaatcatgttggtacat

SEQ ID NO: 199649 - DNA, 20 bp, Artificial
  CRISPR gRNA sequence
gtacatttattgggctcaaa

SEQ ID NO: 199650 - DNA, 20 bp, Artificial
  CRISPR gRNA sequence
attgggctcaaacaaaatgt

SEQ ID NO: 199651 - DNA, 20 bp, Artificial
  CRISPR gRNA sequence
ttgggctcaaacaaaatgta

SEQ ID NO: 199652 - DNA, 20 bp, Artificial
  CRISPR gRNA sequence
ggctcaaacaaaatgtaaag

SEQ ID NO: 199653 - DNA, 20 bp, Artificial
  CRISPR gRNA sequence
aaacaaaatgtaaagattaa

SEQ ID NO: 199654 - DNA, 20 bp, Artificial
  CRISPR gRNA sequence
atttacactaaaaccccaga

SEQ ID NO: 199655 - DNA, 20 bp, Artificial
  CRISPR gRNA sequence
acactaaaaccccagacttc

SEQ ID NO: 199656 - DNA, 20 bp, Artificial
  CRISPR gRNA sequence
cactaaaaccccagacttca

SEQ ID NO: 199657 - DNA, 20 bp, Artificial
  CRISPR gRNA sequence
aaaccccagacttcaccact

SEQ ID NO: 199658 - DNA, 20 bp, Artificial
  CRISPR gRNA sequence
caccactatgtaatatatcc

SEQ ID NO: 199659 - DNA, 20 bp, Artificial
  CRISPR gRNA sequence
accactatgtaatatatcca

SEQ ID NO: 199660 - DNA, 20 bp, Artificial
  CRISPR gRNA sequence
tgtaatatatccatgtgaca

SEQ ID NO: 199661 - DNA, 20 bp, Artificial
  CRISPR gRNA sequence
ctcttgtaccccttaaattt

SEQ ID NO: 199662 - DNA, 20 bp, Artificial
  CRISPR gRNA sequence
ttgtaccccttaaatttcta

SEQ ID NO: 199663 - DNA, 20 bp, Artificial
  CRISPR gRNA sequence
gtaccccttaaatttctaca

SEQ ID NO: 199664 - DNA, 20 bp, Artificial
  CRISPR gRNA sequence
taccccttaaatttctacaa

SEQ ID NO: 199665 - DNA, 20 bp, Artificial
  CRISPR gRNA sequence
aaatttctacaaaaaataat

SEQ ID NO: 199666 - DNA, 20 bp, Artificial
  CRISPR gRNA sequence
aatttctacaaaaaataatt

SEQ ID NO: 199667 - DNA, 20 bp, Artificial
  CRISPR gRNA sequence
ctacaaaaaataatttaaag

SEQ ID NO: 199668 - DNA, 20 bp, Artificial
  CRISPR gRNA sequence
tacaaaaaataatttaaaga

SEQ ID NO: 199669 - DNA, 20 bp, Artificial
  CRISPR gRNA sequence
caaaaaataatttaaagaga

SEQ ID NO: 199670 - DNA, 20 bp, Artificial
  CRISPR gRNA sequence
aaagagaattatctttaaac

SEQ ID NO: 199671 - DNA, 20 bp, Artificial
  CRISPR gRNA sequence
aagagaattatctttaaacc

SEQ ID NO: 199672 - DNA, 20 bp, Artificial
  CRISPR gRNA sequence
tctttaaaccagaagtcttt

SEQ ID NO: 199673 - DNA, 20 bp, Artificial
  CRISPR gRNA sequence
taaaccagaagtctttctat

SEQ ID NO: 199674 - DNA, 20 bp, Artificial
  CRISPR gRNA sequence
aaaccagaagtctttctatt

SEQ ID NO: 199675 - DNA, 20 bp, Artificial
  CRISPR gRNA sequence
aaccagaagtctttctattc

SEQ ID NO: 199676 - DNA, 20 bp, Artificial
  CRISPR gRNA sequence
tctattcaaatacaaaatat

SEQ ID NO: 199677 - DNA, 20 bp, Artificial
  CRISPR gRNA sequence
ctattcaaatacaaaatatc

SEQ ID NO: 199678 - DNA, 20 bp, Artificial
  CRISPR gRNA sequence
tattcaaatacaaaatatcc

SEQ ID NO: 199679 - DNA, 20 bp, Artificial
  CRISPR gRNA sequence
ttcaaatacaaaatatccct

SEQ ID NO: 199680 - DNA, 20 bp, Artificial
  CRISPR gRNA sequence
aaatacaaaatatccctctc

SEQ ID NO: 199681 - DNA, 20 bp, Artificial
  CRISPR gRNA sequence
tccatttgttcaggttttca

SEQ ID NO: 199682 - DNA, 20 bp, Artificial
  CRISPR gRNA sequence
catttgttcaggttttcata

SEQ ID NO: 199683 - DNA, 20 bp, Artificial
  CRISPR gRNA sequence
gttcaggttttcatatgttt

SEQ ID NO: 199684 - DNA, 20 bp, Artificial
  CRISPR gRNA sequence
ttcaggttttcatatgtttc

SEQ ID NO: 199685 - DNA, 20 bp, Artificial
  CRISPR gRNA sequence
aggttttcatatgtttctca

SEQ ID NO: 199686 - DNA, 20 bp, Artificial
  CRISPR gRNA sequence
tcatatgtttctcagtaaag

SEQ ID NO: 199687 - DNA, 20 bp, Artificial
  CRISPR gRNA sequence
catatgtttctcagtaaagt

SEQ ID NO: 199688 - DNA, 20 bp, Artificial
  CRISPR gRNA sequence
atatgtttctcagtaaagtg

SEQ ID NO: 199689 - DNA, 20 bp, Artificial
  CRISPR gRNA sequence
ctcagtaaagtgcttcttct

SEQ ID NO: 199690 - DNA, 20 bp, Artificial
  CRISPR gRNA sequence
tcagtaaagtgcttcttctt

SEQ ID NO: 199691 - DNA, 20 bp, Artificial
  CRISPR gRNA sequence
agtaaagtgcttcttcttaa

SEQ ID NO: 199692 - DNA, 20 bp, Artificial
  CRISPR gRNA sequence
cttcttaaatttattcttgg

SEQ ID NO: 199693 - DNA, 20 bp, Artificial
  CRISPR gRNA sequence
ttcttaaatttattcttgga

SEQ ID NO: 199694 - DNA, 20 bp, Artificial
  CRISPR gRNA sequence
cttaaatttattcttggata

SEQ ID NO: 199695 - DNA, 20 bp, Artificial
  CRISPR gRNA sequence
ttaaatttattcttggatat

SEQ ID NO: 199696 - DNA, 20 bp, Artificial
  CRISPR gRNA sequence
aaatttattcttggatattt

SEQ ID NO: 199697 - DNA, 20 bp, Artificial
  CRISPR gRNA sequence
aatttattcttggatatttt

SEQ ID NO: 199698 - DNA, 20 bp, Artificial
  CRISPR gRNA sequence
attcttggatattttatttt

SEQ ID NO: 199699 - DNA, 20 bp, Artificial
  CRISPR gRNA sequence
ttcttggatattttattttt

SEQ ID NO: 199700 - DNA, 20 bp, Artificial
  CRISPR gRNA sequence
ttggatattttatttttgtt

SEQ ID NO: 199701 - DNA, 20 bp, Artificial
  CRISPR gRNA sequence
ggatattttatttttgttgt

SEQ ID NO: 199702 - DNA, 20 bp, Artificial
  CRISPR gRNA sequence
gatattttatttttgttgtt

SEQ ID NO: 199703 - DNA, 20 bp, Artificial
  CRISPR gRNA sequence
tatttttgttgttataaatc

SEQ ID NO: 199704 - DNA, 20 bp, Artificial
  CRISPR gRNA sequence
atttttgttgttataaatct

SEQ ID NO: 199705 - DNA, 20 bp, Artificial
  CRISPR gRNA sequence
tttttgttgttataaatctg

SEQ ID NO: 199706 - DNA, 20 bp, Artificial
  CRISPR gRNA sequence
ttgttgttataaatctgtct

SEQ ID NO: 199707 - DNA, 20 bp, Artificial
  CRISPR gRNA sequence
tgttgttataaatctgtctt

SEQ ID NO: 199708 - DNA, 20 bp, Artificial
  CRISPR gRNA sequence
gttgttataaatctgtcttt

SEQ ID NO: 199709 - DNA, 20 bp, Artificial
  CRISPR gRNA sequence
ttgttataaatctgtcttta

SEQ ID NO: 199710 - DNA, 20 bp, Artificial
  CRISPR gRNA sequence
ttataaatctgtctttataa

SEQ ID NO: 199711 - DNA, 20 bp, Artificial
  CRISPR gRNA sequence
taaatctgtctttataaaca

SEQ ID NO: 199712 - DNA, 20 bp, Artificial
  CRISPR gRNA sequence
tctttataaacatgaatctc

SEQ ID NO: 199713 - DNA, 20 bp, Artificial
  CRISPR gRNA sequence
tataaacatgaatctctcca

SEQ ID NO: 199714 - DNA, 20 bp, Artificial
  CRISPR gRNA sequence
ataaacatgaatctctccag

SEQ ID NO: 199715 - DNA, 20 bp, Artificial
  CRISPR gRNA sequence
taaacatgaatctctccagc

SEQ ID NO: 199716 - DNA, 20 bp, Artificial
  CRISPR gRNA sequence
tccagctggtatgctttctt

SEQ ID NO: 199717 - DNA, 20 bp, Artificial
  CRISPR gRNA sequence
cagctggtatgctttctttt

SEQ ID NO: 199718 - DNA, 20 bp, Artificial
  CRISPR gRNA sequence
gtatgctttcttttcttaga

SEQ ID NO: 199719 - DNA, 20 bp, Artificial
  CRISPR gRNA sequence
tcttttcttagacttcagta

SEQ ID NO: 199720 - DNA, 20 bp, Artificial
  CRISPR gRNA sequence
cttttcttagacttcagtaa

SEQ ID NO: 199721 - DNA, 20 bp, Artificial
  CRISPR gRNA sequence
ttttcttagacttcagtaaa

SEQ ID NO: 199722 - DNA, 20 bp, Artificial
  CRISPR gRNA sequence
ttcttagacttcagtaaaca

SEQ ID NO: 199723 - DNA, 20 bp, Artificial
  CRISPR gRNA sequence
tcttagacttcagtaaacag

SEQ ID NO: 199724 - DNA, 20 bp, Artificial
  CRISPR gRNA sequence
cttagacttcagtaaacaga

SEQ ID NO: 199725 - DNA, 20 bp, Artificial
  CRISPR gRNA sequence
ttagacttcagtaaacagaa

SEQ ID NO: 199726 - DNA, 20 bp, Artificial
  CRISPR gRNA sequence
agacttcagtaaacagaaaa

SEQ ID NO: 199727 - DNA, 20 bp, Artificial
  CRISPR gRNA sequence
gacttcagtaaacagaaaac

SEQ ID NO: 199728 - DNA, 20 bp, Artificial
  CRISPR gRNA sequence
cagtaaacagaaaacctgat

SEQ ID NO: 199729 - DNA, 20 bp, Artificial
  CRISPR gRNA sequence
agtaaacagaaaacctgatt

SEQ ID NO: 199730 - DNA, 20 bp, Artificial
  CRISPR gRNA sequence
attttgaggtgtcattcact

SEQ ID NO: 199731 - DNA, 20 bp, Artificial
  CRISPR gRNA sequence
tgaggtgtcattcacttttc

SEQ ID NO: 199732 - DNA, 20 bp, Artificial
  CRISPR gRNA sequence
gaggtgtcattcacttttct

SEQ ID NO: 199733 - DNA, 20 bp, Artificial
  CRISPR gRNA sequence
aggtgtcattcacttttctg

SEQ ID NO: 199734 - DNA, 20 bp, Artificial
  CRISPR gRNA sequence
acttttctgatttgaagtca

SEQ ID NO: 199735 - DNA, 20 bp, Artificial
  CRISPR gRNA sequence
ttctgatttgaagtcaatga

SEQ ID NO: 199736 - DNA, 20 bp, Artificial
  CRISPR gRNA sequence
tctgatttgaagtcaatgat

SEQ ID NO: 199737 - DNA, 20 bp, Artificial
  CRISPR gRNA sequence
ctgatttgaagtcaatgatc

SEQ ID NO: 199738 - DNA, 20 bp, Artificial
  CRISPR gRNA sequence
tgatttgaagtcaatgatca

SEQ ID NO: 199739 - DNA, 20 bp, Artificial
  CRISPR gRNA sequence
atttgaagtcaatgatcaga

SEQ ID NO: 199740 - DNA, 20 bp, Artificial
  CRISPR gRNA sequence
gaagtcaatgatcagaaatt

SEQ ID NO: 199741 - DNA, 20 bp, Artificial
  CRISPR gRNA sequence
aagtcaatgatcagaaatta

SEQ ID NO: 199742 - DNA, 20 bp, Artificial
  CRISPR gRNA sequence
gatatgaaaatacatagtat

SEQ ID NO: 199743 - DNA, 20 bp, Artificial
  CRISPR gRNA sequence
catctgtaaacagtgatata

SEQ ID NO: 199744 - DNA, 20 bp, Artificial
  CRISPR gRNA sequence
atctgtaaacagtgatatat

SEQ ID NO: 199745 - DNA, 20 bp, Artificial
  CRISPR gRNA sequence
taaacagtgatatatgttcc

SEQ ID NO: 199746 - DNA, 20 bp, Artificial
  CRISPR gRNA sequence
ctggtgatactttttaatgt

SEQ ID NO: 199747 - DNA, 20 bp, Artificial
  CRISPR gRNA sequence
gtgatactttttaatgttta

SEQ ID NO: 199748 - DNA, 20 bp, Artificial
  CRISPR gRNA sequence
tttaatgtttaaatttgttc

SEQ ID NO: 199749 - DNA, 20 bp, Artificial
  CRISPR gRNA sequence
ttaatgtttaaatttgttct

SEQ ID NO: 199750 - DNA, 20 bp, Artificial
  CRISPR gRNA sequence
taatgtttaaatttgttctt

SEQ ID NO: 199751 - DNA, 20 bp, Artificial
  CRISPR gRNA sequence
aatgtttaaatttgttcttt

SEQ ID NO: 199752 - DNA, 20 bp, Artificial
  CRISPR gRNA sequence
atgtttaaatttgttcttta

SEQ ID NO: 199753 - DNA, 20 bp, Artificial
  CRISPR gRNA sequence
aaatttgttctttattttag

SEQ ID NO: 199754 - DNA, 20 bp, Artificial
  CRISPR gRNA sequence
aatttgttctttattttaga

SEQ ID NO: 199755 - DNA, 20 bp, Artificial
  CRISPR gRNA sequence
gttctttattttagaagttt

SEQ ID NO: 199756 - DNA, 20 bp, Artificial
  CRISPR gRNA sequence
ttctttattttagaagtttt

SEQ ID NO: 199757 - DNA, 20 bp, Artificial
  CRISPR gRNA sequence
tttattttagaagttttaaa

SEQ ID NO: 199758 - DNA, 20 bp, Artificial
  CRISPR gRNA sequence
tattttagaagttttaaatt

SEQ ID NO: 199759 - DNA, 20 bp, Artificial
  CRISPR gRNA sequence
attttagaagttttaaattt

SEQ ID NO: 199760 - DNA, 20 bp, Artificial
  CRISPR gRNA sequence
ttttagaagttttaaattta

SEQ ID NO: 199761 - DNA, 20 bp, Artificial
  CRISPR gRNA sequence
tagaagttttaaatttacaa

SEQ ID NO: 199762 - DNA, 20 bp, Artificial
  CRISPR gRNA sequence
agaagttttaaatttacaaa

SEQ ID NO: 199763 - DNA, 20 bp, Artificial
  CRISPR gRNA sequence
gaagttttaaatttacaaaa

SEQ ID NO: 199764 - DNA, 20 bp, Artificial
  CRISPR gRNA sequence
taaatttacaaaaaagttgc

SEQ ID NO: 199765 - DNA, 20 bp, Artificial
  CRISPR gRNA sequence
aaatttacaaaaaagttgca

SEQ ID NO: 199766 - DNA, 20 bp, Artificial
  CRISPR gRNA sequence
aatttacaaaaaagttgcaa

SEQ ID NO: 199767 - DNA, 20 bp, Artificial
  CRISPR gRNA sequence
acaaaaaagttgcaaagata

SEQ ID NO: 199768 - DNA, 20 bp, Artificial
  CRISPR gRNA sequence
caaaaaagttgcaaagatag

SEQ ID NO: 199769 - DNA, 20 bp, Artificial
  CRISPR gRNA sequence
caaagatagtatagagttac

SEQ ID NO: 199770 - DNA, 20 bp, Artificial
  CRISPR gRNA sequence
ctgtatactccttacccggt

SEQ ID NO: 199771 - DNA, 20 bp, Artificial
  CRISPR gRNA sequence
tatactccttacccggtttc

SEQ ID NO: 199772 - DNA, 20 bp, Artificial
  CRISPR gRNA sequence
cttacccggtttcctctatt

SEQ ID NO: 199773 - DNA, 20 bp, Artificial
  CRISPR gRNA sequence
acccggtttcctctattgtt

SEQ ID NO: 199774 - DNA, 20 bp, Artificial
  CRISPR gRNA sequence
cccggtttcctctattgtta

SEQ ID NO: 199775 - DNA, 20 bp, Artificial
  CRISPR gRNA sequence
cctctattgttagtatctta

SEQ ID NO: 199776 - DNA, 20 bp, Artificial
  CRISPR gRNA sequence
ctctattgttagtatcttac

SEQ ID NO: 199777 - DNA, 20 bp, Artificial
  CRISPR gRNA sequence
tattgttagtatcttacatt

SEQ ID NO: 199778 - DNA, 20 bp, Artificial
  CRISPR gRNA sequence
ttgttagtatcttacattac

SEQ ID NO: 199779 - DNA, 20 bp, Artificial
  CRISPR gRNA sequence
ttagtatcttacattaccat

SEQ ID NO: 199780 - DNA, 20 bp, Artificial
  CRISPR gRNA sequence
gtatcttacattaccatggt

SEQ ID NO: 199781 - DNA, 20 bp, Artificial
  CRISPR gRNA sequence
acattaccatggtacaatcg

SEQ ID NO: 199782 - DNA, 20 bp, Artificial
  CRISPR gRNA sequence
cattaccatggtacaatcgt

SEQ ID NO: 199783 - DNA, 20 bp, Artificial
  CRISPR gRNA sequence
ccatggtacaatcgtcataa

SEQ ID NO: 199784 - DNA, 20 bp, Artificial
  CRISPR gRNA sequence
aggacgttagtacattatta

SEQ ID NO: 199785 - DNA, 20 bp, Artificial
  CRISPR gRNA sequence
gtacattattaataactaaa

SEQ ID NO: 199786 - DNA, 20 bp, Artificial
  CRISPR gRNA sequence
ttaataactaaactgcataa

SEQ ID NO: 199787 - DNA, 20 bp, Artificial
  CRISPR gRNA sequence
ataactaaactgcataattt

SEQ ID NO: 199788 - DNA, 20 bp, Artificial
  CRISPR gRNA sequence
aactgcataatttattccat

SEQ ID NO: 199789 - DNA, 20 bp, Artificial
  CRISPR gRNA sequence
cataatttattccattcctc

SEQ ID NO: 199790 - DNA, 20 bp, Artificial
  CRISPR gRNA sequence
attccattcctccagttttt

SEQ ID NO: 199791 - DNA, 20 bp, Artificial
  CRISPR gRNA sequence
ttccattcctccagtttttc

SEQ ID NO: 199792 - DNA, 20 bp, Artificial
  CRISPR gRNA sequence
cattcctccagtttttccct

SEQ ID NO: 199793 - DNA, 20 bp, Artificial
  CRISPR gRNA sequence
ctccagtttttccctaatat

SEQ ID NO: 199794 - DNA, 20 bp, Artificial
  CRISPR gRNA sequence
cagtttttccctaatatcct

SEQ ID NO: 199795 - DNA, 20 bp, Artificial
  CRISPR gRNA sequence
ttccctaatatcctttttct

SEQ ID NO: 199796 - DNA, 20 bp, Artificial
  CRISPR gRNA sequence
tccctaatatcctttttctg

SEQ ID NO: 199797 - DNA, 20 bp, Artificial
  CRISPR gRNA sequence
ccctaatatcctttttctgt

SEQ ID NO: 199798 - DNA, 20 bp, Artificial
  CRISPR gRNA sequence
cctaatatcctttttctgtt

SEQ ID NO: 199799 - DNA, 20 bp, Artificial
  CRISPR gRNA sequence
atatcctttttctgttctgg

SEQ ID NO: 199800 - DNA, 20 bp, Artificial
  CRISPR gRNA sequence
tttctgttctgggatgctat

SEQ ID NO: 199801 - DNA, 20 bp, Artificial
  CRISPR gRNA sequence
ttctgttctgggatgctatc

SEQ ID NO: 199802 - DNA, 20 bp, Artificial
  CRISPR gRNA sequence
tctgttctgggatgctatct

SEQ ID NO: 199803 - DNA, 20 bp, Artificial
  CRISPR gRNA sequence
ctgttctgggatgctatcta

SEQ ID NO: 199804 - DNA, 20 bp, Artificial
  CRISPR gRNA sequence
tgttctgggatgctatctag

SEQ ID NO: 199805 - DNA, 20 bp, Artificial
  CRISPR gRNA sequence
ttctgggatgctatctagga

SEQ ID NO: 199806 - DNA, 20 bp, Artificial
  CRISPR gRNA sequence
tgggatgctatctaggatac

SEQ ID NO: 199807 - DNA, 20 bp, Artificial
  CRISPR gRNA sequence
ggatgctatctaggatacca

SEQ ID NO: 199808 - DNA, 20 bp, Artificial
  CRISPR gRNA sequence
tctaggataccacattatga

SEQ ID NO: 199809 - DNA, 20 bp, Artificial
  CRISPR gRNA sequence
ggataccacattatgatatt

SEQ ID NO: 199810 - DNA, 20 bp, Artificial
  CRISPR gRNA sequence
tgatatttacattttaagct

SEQ ID NO: 199811 - DNA, 20 bp, Artificial
  CRISPR gRNA sequence
acattttaagcttttaaatg

SEQ ID NO: 199812 - DNA, 20 bp, Artificial
  CRISPR gRNA sequence
cattttaagcttttaaatgc

SEQ ID NO: 199813 - DNA, 20 bp, Artificial
  CRISPR gRNA sequence
taagcttttaaatgctggct

SEQ ID NO: 199814 - DNA, 20 bp, Artificial
  CRISPR gRNA sequence
aagcttttaaatgctggcta

SEQ ID NO: 199815 - DNA, 20 bp, Artificial
  CRISPR gRNA sequence
agcttttaaatgctggctat

SEQ ID NO: 199816 - DNA, 20 bp, Artificial
  CRISPR gRNA sequence
ttaaatgctggctattttaa

SEQ ID NO: 199817 - DNA, 20 bp, Artificial
  CRISPR gRNA sequence
taaatgctggctattttaat

SEQ ID NO: 199818 - DNA, 20 bp, Artificial
  CRISPR gRNA sequence
aaatgctggctattttaata

SEQ ID NO: 199819 - DNA, 20 bp, Artificial
  CRISPR gRNA sequence
aatgctggctattttaataa

SEQ ID NO: 199820 - DNA, 20 bp, Artificial
  CRISPR gRNA sequence
gctattttaataaatcattt

SEQ ID NO: 199821 - DNA, 20 bp, Artificial
  CRISPR gRNA sequence
ttttaataaatcatttaagt

SEQ ID NO: 199822 - DNA, 20 bp, Artificial
  CRISPR gRNA sequence
taataaatcatttaagtaat

SEQ ID NO: 199823 - DNA, 20 bp, Artificial
  CRISPR gRNA sequence
aataaatcatttaagtaatt

SEQ ID NO: 199824 - DNA, 20 bp, Artificial
  CRISPR gRNA sequence
ataaatcatttaagtaatta

SEQ ID NO: 199825 - DNA, 20 bp, Artificial
  CRISPR gRNA sequence
aagtaattatgctcaaggaa

SEQ ID NO: 199826 - DNA, 20 bp, Artificial
  CRISPR gRNA sequence
agtaattatgctcaaggaag

SEQ ID NO: 199827 - DNA, 20 bp, Artificial
  CRISPR gRNA sequence
tgctcaaggaagaaagtttg

SEQ ID NO: 199828 - DNA, 20 bp, Artificial
  CRISPR gRNA sequence
aaggaagaaagtttgattca

SEQ ID NO: 199829 - DNA, 20 bp, Artificial
  CRISPR gRNA sequence
gattcaattttagatcattg

SEQ ID NO: 199830 - DNA, 20 bp, Artificial
  CRISPR gRNA sequence
attcaattttagatcattgg

SEQ ID NO: 199831 - DNA, 20 bp, Artificial
  CRISPR gRNA sequence
aattttagatcattggtttg

SEQ ID NO: 199832 - DNA, 20 bp, Artificial
  CRISPR gRNA sequence
tagatcattggtttgggacc

SEQ ID NO: 199833 - DNA, 20 bp, Artificial
  CRISPR gRNA sequence
agatcattggtttgggaccc

SEQ ID NO: 199834 - DNA, 20 bp, Artificial
  CRISPR gRNA sequence
gatcattggtttgggaccct

SEQ ID NO: 199835 - DNA, 20 bp, Artificial
  CRISPR gRNA sequence
gtttgggaccctttcaggat

SEQ ID NO: 199836 - DNA, 20 bp, Artificial
  CRISPR gRNA sequence
gggaccctttcaggattaag

SEQ ID NO: 199837 - DNA, 20 bp, Artificial
  CRISPR gRNA sequence
ggaccctttcaggattaaga

SEQ ID NO: 199838 - DNA, 20 bp, Artificial
  CRISPR gRNA sequence
tcaggattaagatacgtagt

SEQ ID NO: 199839 - DNA, 20 bp, Artificial
  CRISPR gRNA sequence
caggattaagatacgtagtt

SEQ ID NO: 199840 - DNA, 20 bp, Artificial
  CRISPR gRNA sequence
aggattaagatacgtagttt

SEQ ID NO: 199841 - DNA, 20 bp, Artificial
  CRISPR gRNA sequence
agatacgtagtttgctgaca

SEQ ID NO: 199842 - DNA, 20 bp, Artificial
  CRISPR gRNA sequence
gctgacaattctagtagatt

SEQ ID NO: 199843 - DNA, 20 bp, Artificial
  CRISPR gRNA sequence
ctgacaattctagtagattg

SEQ ID NO: 199844 - DNA, 20 bp, Artificial
  CRISPR gRNA sequence
acaattctagtagattgttt

SEQ ID NO: 199845 - DNA, 20 bp, Artificial
  CRISPR gRNA sequence
tagtagattgtttagtgcac

SEQ ID NO: 199846 - DNA, 20 bp, Artificial
  CRISPR gRNA sequence
gtagattgtttagtgcacct

SEQ ID NO: 199847 - DNA, 20 bp, Artificial
  CRISPR gRNA sequence
tttagtgcacctatatagca

SEQ ID NO: 199848 - DNA, 20 bp, Artificial
  CRISPR gRNA sequence
agtgcacctatatagcataa

SEQ ID NO: 199849 - DNA, 20 bp, Artificial
  CRISPR gRNA sequence
gtgcacctatatagcataag

SEQ ID NO: 199850 - DNA, 20 bp, Artificial
  CRISPR gRNA sequence
tatagcataagagctttatt

SEQ ID NO: 199851 - DNA, 20 bp, Artificial
  CRISPR gRNA sequence
tattcatgtttattcattac

SEQ ID NO: 199852 - DNA, 20 bp, Artificial
  CRISPR gRNA sequence
attcatgtttattcattaca

SEQ ID NO: 199853 - DNA, 20 bp, Artificial
  CRISPR gRNA sequence
ttcatgtttattcattacaa

SEQ ID NO: 199854 - DNA, 20 bp, Artificial
  CRISPR gRNA sequence
atgtttattcattacaagta

SEQ ID NO: 199855 - DNA, 20 bp, Artificial
  CRISPR gRNA sequence
attcattacaagtacattaa

SEQ ID NO: 199856 - DNA, 20 bp, Artificial
  CRISPR gRNA sequence
ttcattacaagtacattaac

SEQ ID NO: 199857 - DNA, 20 bp, Artificial
  CRISPR gRNA sequence
attacaagtacattaacatg

SEQ ID NO: 199858 - DNA, 20 bp, Artificial
  CRISPR gRNA sequence
caagtacattaacatgttct

SEQ ID NO: 199859 - DNA, 20 bp, Artificial
  CRISPR gRNA sequence
acatgttcttattttgttgg

SEQ ID NO: 199860 - DNA, 20 bp, Artificial
  CRISPR gRNA sequence
ttattttgttggtataatct

SEQ ID NO: 199861 - DNA, 20 bp, Artificial
  CRISPR gRNA sequence
attttgttggtataatcttt

SEQ ID NO: 199862 - DNA, 20 bp, Artificial
  CRISPR gRNA sequence
ttttgttggtataatctttt

SEQ ID NO: 199863 - DNA, 20 bp, Artificial
  CRISPR gRNA sequence
tgttggtataatcttttttt

SEQ ID NO: 199864 - DNA, 20 bp, Artificial
  CRISPR gRNA sequence
gttggtataatctttttttt

SEQ ID NO: 199865 - DNA, 20 bp, Artificial
  CRISPR gRNA sequence
ttggtataatctttttttta

SEQ ID NO: 199866 - DNA, 20 bp, Artificial
  CRISPR gRNA sequence
gtataatcttttttttactt

SEQ ID NO: 199867 - DNA, 20 bp, Artificial
  CRISPR gRNA sequence
ttttttacttctaatactat

SEQ ID NO: 199868 - DNA, 20 bp, Artificial
  CRISPR gRNA sequence
tttttacttctaatactata

SEQ ID NO: 199869 - DNA, 20 bp, Artificial
  CRISPR gRNA sequence
ttttacttctaatactatag

SEQ ID NO: 199870 - DNA, 20 bp, Artificial
  CRISPR gRNA sequence
tttacttctaatactatagt

SEQ ID NO: 199871 - DNA, 20 bp, Artificial
  CRISPR gRNA sequence
ttacttctaatactatagtg

SEQ ID NO: 199872 - DNA, 20 bp, Artificial
  CRISPR gRNA sequence
tacttctaatactatagtgt

SEQ ID NO: 199873 - DNA, 20 bp, Artificial
  CRISPR gRNA sequence
acttctaatactatagtgta

SEQ ID NO: 199874 - DNA, 20 bp, Artificial
  CRISPR gRNA sequence
cttctaatactatagtgtaa

SEQ ID NO: 199875 - DNA, 20 bp, Artificial
  CRISPR gRNA sequence
ctaatactatagtgtaacca

SEQ ID NO: 199876 - DNA, 20 bp, Artificial
  CRISPR gRNA sequence
taatactatagtgtaaccac

SEQ ID NO: 199877 - DNA, 20 bp, Artificial
  CRISPR gRNA sequence
atactatagtgtaaccacta

SEQ ID NO: 199878 - DNA, 20 bp, Artificial
  CRISPR gRNA sequence
tagtgtaaccactaatgatc

SEQ ID NO: 199879 - DNA, 20 bp, Artificial
  CRISPR gRNA sequence
atgatctagagccttaattc

SEQ ID NO: 199880 - DNA, 20 bp, Artificial
  CRISPR gRNA sequence
gagccttaattctccattcc

SEQ ID NO: 199881 - DNA, 20 bp, Artificial
  CRISPR gRNA sequence
aattctccattcctttacca

SEQ ID NO: 199882 - DNA, 20 bp, Artificial
  CRISPR gRNA sequence
attctccattcctttaccaa

SEQ ID NO: 199883 - DNA, 20 bp, Artificial
  CRISPR gRNA sequence
tccattcctttaccaaggac

SEQ ID NO: 199884 - DNA, 20 bp, Artificial
  CRISPR gRNA sequence
cattcctttaccaaggacag

SEQ ID NO: 199885 - DNA, 20 bp, Artificial
  CRISPR gRNA sequence
ctttaccaaggacagcaata

SEQ ID NO: 199886 - DNA, 20 bp, Artificial
  CRISPR gRNA sequence
taccaaggacagcaatagat

SEQ ID NO: 199887 - DNA, 20 bp, Artificial
  CRISPR gRNA sequence
accaaggacagcaatagatt

SEQ ID NO: 199888 - DNA, 20 bp, Artificial
  CRISPR gRNA sequence
ccaaggacagcaatagattt

SEQ ID NO: 199889 - DNA, 20 bp, Artificial
  CRISPR gRNA sequence
gtgaggtaatttcttcacag

SEQ ID NO: 199890 - DNA, 20 bp, Artificial
  CRISPR gRNA sequence
tgaggtaatttcttcacaga

SEQ ID NO: 199891 - DNA, 20 bp, Artificial
  CRISPR gRNA sequence
cttcacagagagttaataca

SEQ ID NO: 199892 - DNA, 20 bp, Artificial
  CRISPR gRNA sequence
ttcacagagagttaatacaa

SEQ ID NO: 199893 - DNA, 20 bp, Artificial
  CRISPR gRNA sequence
cacagagagttaatacaaaa

SEQ ID NO: 199894 - DNA, 20 bp, Artificial
  CRISPR gRNA sequence
acagagagttaatacaaaac

SEQ ID NO: 199895 - DNA, 20 bp, Artificial
  CRISPR gRNA sequence
atacaaaacggctaggatca

SEQ ID NO: 199896 - DNA, 20 bp, Artificial
  CRISPR gRNA sequence
ggatcaaatgaaactgaaat

SEQ ID NO: 199897 - DNA, 20 bp, Artificial
  CRISPR gRNA sequence
aaataaataatgagtgatgt

SEQ ID NO: 199898 - DNA, 20 bp, Artificial
  CRISPR gRNA sequence
tgatactcctatatcaatga

SEQ ID NO: 199899 - DNA, 20 bp, Artificial
  CRISPR gRNA sequence
gatactcctatatcaatgaa

SEQ ID NO: 199900 - DNA, 20 bp, Artificial
  CRISPR gRNA sequence
atactcctatatcaatgaaa

SEQ ID NO: 199901 - DNA, 20 bp, Artificial
  CRISPR gRNA sequence
ctatatcaatgaaaccacta

SEQ ID NO: 199902 - DNA, 20 bp, Artificial
  CRISPR gRNA sequence
tatcaatgaaaccactacca

SEQ ID NO: 199903 - DNA, 20 bp, Artificial
  CRISPR gRNA sequence
ccagtggaaacactggaaat

SEQ ID NO: 199904 - DNA, 20 bp, Artificial
  CRISPR gRNA sequence
gaaatcaataaaattatgat

SEQ ID NO: 199905 - DNA, 20 bp, Artificial
  CRISPR gRNA sequence
tgatttcaaaacacaaaaat

SEQ ID NO: 199906 - DNA, 20 bp, Artificial
  CRISPR gRNA sequence
caaaacacaaaaataatagt

SEQ ID NO: 199907 - DNA, 20 bp, Artificial
  CRISPR gRNA sequence
aaaacacaaaaataatagtt

SEQ ID NO: 199908 - DNA, 20 bp, Artificial
  CRISPR gRNA sequence
ttatgtgtaggttgctttgg

SEQ ID NO: 199909 - DNA, 20 bp, Artificial
  CRISPR gRNA sequence
atgtgtaggttgctttgggg

SEQ ID NO: 199910 - DNA, 20 bp, Artificial
  CRISPR gRNA sequence
tgtgtaggttgctttggggt

SEQ ID NO: 199911 - DNA, 20 bp, Artificial
  CRISPR gRNA sequence
ctttggggtagctacggatt

SEQ ID NO: 199912 - DNA, 20 bp, Artificial
  CRISPR gRNA sequence
tggggtagctacggattttc

SEQ ID NO: 199913 - DNA, 20 bp, Artificial
  CRISPR gRNA sequence
ggggtagctacggattttca

SEQ ID NO: 199914 - DNA, 20 bp, Artificial
  CRISPR gRNA sequence
gggtagctacggattttcaa

SEQ ID NO: 199915 - DNA, 20 bp, Artificial
  CRISPR gRNA sequence
cggattttcaaattctctta

SEQ ID NO: 199916 - DNA, 20 bp, Artificial
  CRISPR gRNA sequence
tcaaattctcttatctaatt

SEQ ID NO: 199917 - DNA, 20 bp, Artificial
  CRISPR gRNA sequence
caaattctcttatctaattt

SEQ ID NO: 199918 - DNA, 20 bp, Artificial
  CRISPR gRNA sequence
aaattctcttatctaatttt

SEQ ID NO: 199919 - DNA, 20 bp, Artificial
  CRISPR gRNA sequence
tcttatctaattttgactaa

SEQ ID NO: 199920 - DNA, 20 bp, Artificial
  CRISPR gRNA sequence
ttatctaattttgactaaac

SEQ ID NO: 199921 - DNA, 20 bp, Artificial
  CRISPR gRNA sequence
atctaattttgactaaacta

SEQ ID NO: 199922 - DNA, 20 bp, Artificial
  CRISPR gRNA sequence
tctaattttgactaaactaa

SEQ ID NO: 199923 - DNA, 20 bp, Artificial
  CRISPR gRNA sequence
attttgactaaactaaccat

SEQ ID NO: 199924 - DNA, 20 bp, Artificial
  CRISPR gRNA sequence
tgactaaactaaccatctta

SEQ ID NO: 199925 - DNA, 20 bp, Artificial
  CRISPR gRNA sequence
gactaaactaaccatcttac

SEQ ID NO: 199926 - DNA, 20 bp, Artificial
  CRISPR gRNA sequence
actaaactaaccatcttaca

SEQ ID NO: 199927 - DNA, 20 bp, Artificial
  CRISPR gRNA sequence
aactaaccatcttacaaaat

SEQ ID NO: 199928 - DNA, 20 bp, Artificial
  CRISPR gRNA sequence
accatcttacaaaattaaac

SEQ ID NO: 199929 - DNA, 20 bp, Artificial
  CRISPR gRNA sequence
acaaaattaaacaactaatt

SEQ ID NO: 199930 - DNA, 20 bp, Artificial
  CRISPR gRNA sequence
caaaattaaacaactaatta

SEQ ID NO: 199931 - DNA, 20 bp, Artificial
  CRISPR gRNA sequence
aacaactaattaaaaagttt

SEQ ID NO: 199932 - DNA, 20 bp, Artificial
  CRISPR gRNA sequence
attaaaaagtttcccacaaa

SEQ ID NO: 199933 - DNA, 20 bp, Artificial
  CRISPR gRNA sequence
aaaagtttcccacaaagaaa

SEQ ID NO: 199934 - DNA, 20 bp, Artificial
  CRISPR gRNA sequence
cccacaaagaaactgaggac

SEQ ID NO: 199935 - DNA, 20 bp, Artificial
  CRISPR gRNA sequence
ccacaaagaaactgaggact

SEQ ID NO: 199936 - DNA, 20 bp, Artificial
  CRISPR gRNA sequence
aggactgaagataatactaa

SEQ ID NO: 199937 - DNA, 20 bp, Artificial
  CRISPR gRNA sequence
aagataatactaataattca

SEQ ID NO: 199938 - DNA, 20 bp, Artificial
  CRISPR gRNA sequence
ataattcaagcacaacccag

SEQ ID NO: 199939 - DNA, 20 bp, Artificial
  CRISPR gRNA sequence
aagcacaacccagaggaaac

SEQ ID NO: 199940 - DNA, 20 bp, Artificial
  CRISPR gRNA sequence
tttatcggccactgtatgag

SEQ ID NO: 199941 - DNA, 20 bp, Artificial
  CRISPR gRNA sequence
ttatcggccactgtatgagg

SEQ ID NO: 199942 - DNA, 20 bp, Artificial
  CRISPR gRNA sequence
tatcggccactgtatgaggt

SEQ ID NO: 199943 - DNA, 20 bp, Artificial
  CRISPR gRNA sequence
atcggccactgtatgaggtg

SEQ ID NO: 199944 - DNA, 20 bp, Artificial
  CRISPR gRNA sequence
tcggccactgtatgaggtgg

SEQ ID NO: 199945 - DNA, 20 bp, Artificial
  CRISPR gRNA sequence
tatgaggtggtaaacagtaa

SEQ ID NO: 199946 - DNA, 20 bp, Artificial
  CRISPR gRNA sequence
aattagacctcgcagtgtta

SEQ ID NO: 199947 - DNA, 20 bp, Artificial
  CRISPR gRNA sequence
attagacctcgcagtgttat

SEQ ID NO: 199948 - DNA, 20 bp, Artificial
  CRISPR gRNA sequence
gacctcgcagtgttatataa

SEQ ID NO: 199949 - DNA, 20 bp, Artificial
  CRISPR gRNA sequence
gcagtgttatataaaaaaac

SEQ ID NO: 199950 - DNA, 20 bp, Artificial
  CRISPR gRNA sequence
tataaaaaaacacaaacctc

SEQ ID NO: 199951 - DNA, 20 bp, Artificial
  CRISPR gRNA sequence
aagattattgacaccatcca

SEQ ID NO: 199952 - DNA, 20 bp, Artificial
  CRISPR gRNA sequence
ttgacaccatccacctttgt

SEQ ID NO: 199953 - DNA, 20 bp, Artificial
  CRISPR gRNA sequence
acaccatccacctttgttaa

SEQ ID NO: 199954 - DNA, 20 bp, Artificial
  CRISPR gRNA sequence
tgttaatgataaagttcacc

SEQ ID NO: 199955 - DNA, 20 bp, Artificial
  CRISPR gRNA sequence
gttaatgataaagttcaccc

SEQ ID NO: 199956 - DNA, 20 bp, Artificial
  CRISPR gRNA sequence
ttaatgataaagttcaccct

SEQ ID NO: 199957 - DNA, 20 bp, Artificial
  CRISPR gRNA sequence
atgataaagttcaccctaag

SEQ ID NO: 199958 - DNA, 20 bp, Artificial
  CRISPR gRNA sequence
accctaaggtatattatgcc

SEQ ID NO: 199959 - DNA, 20 bp, Artificial
  CRISPR gRNA sequence
aggtatattatgccttgaca

SEQ ID NO: 199960 - DNA, 20 bp, Artificial
  CRISPR gRNA sequence
tgccttgacatattagctaa

SEQ ID NO: 199961 - DNA, 20 bp, Artificial
  CRISPR gRNA sequence
gacatattagctaatgatag

SEQ ID NO: 199962 - DNA, 20 bp, Artificial
  CRISPR gRNA sequence
acatattagctaatgatagt

SEQ ID NO: 199963 - DNA, 20 bp, Artificial
  CRISPR gRNA sequence
gctaatgatagtgaagcatc

SEQ ID NO: 199964 - DNA, 20 bp, Artificial
  CRISPR gRNA sequence
atgatagtgaagcatcacaa

SEQ ID NO: 199965 - DNA, 20 bp, Artificial
  CRISPR gRNA sequence
gtaaaaactgaaaatattgt

SEQ ID NO: 199966 - DNA, 20 bp, Artificial
  CRISPR gRNA sequence
aaaatattgtttattaaatt

SEQ ID NO: 199967 - DNA, 20 bp, Artificial
  CRISPR gRNA sequence
tttattaaatttttatttca

SEQ ID NO: 199968 - DNA, 20 bp, Artificial
  CRISPR gRNA sequence
attaaatttttatttcaacc

SEQ ID NO: 199969 - DNA, 20 bp, Artificial
  CRISPR gRNA sequence
ttaaatttttatttcaacct

SEQ ID NO: 199970 - DNA, 20 bp, Artificial
  CRISPR gRNA sequence
aatttttatttcaacctctt

SEQ ID NO: 199971 - DNA, 20 bp, Artificial
  CRISPR gRNA sequence
ttatttcaacctcttaaaat

SEQ ID NO: 199972 - DNA, 20 bp, Artificial
  CRISPR gRNA sequence
tatttcaacctcttaaaatg

SEQ ID NO: 199973 - DNA, 20 bp, Artificial
  CRISPR gRNA sequence
atttcaacctcttaaaatgt

SEQ ID NO: 199974 - DNA, 20 bp, Artificial
  CRISPR gRNA sequence
tttcaacctcttaaaatgtc

SEQ ID NO: 199975 - DNA, 20 bp, Artificial
  CRISPR gRNA sequence
caacctcttaaaatgtctgt

SEQ ID NO: 199976 - DNA, 20 bp, Artificial
  CRISPR gRNA sequence
aacctcttaaaatgtctgtt

SEQ ID NO: 199977 - DNA, 20 bp, Artificial
  CRISPR gRNA sequence
ttaaaatgtctgtttttgta

SEQ ID NO: 199978 - DNA, 20 bp, Artificial
  CRISPR gRNA sequence
aaaatgtctgtttttgtaca

SEQ ID NO: 199979 - DNA, 20 bp, Artificial
  CRISPR gRNA sequence
aaatgtctgtttttgtacaa

SEQ ID NO: 199980 - DNA, 20 bp, Artificial
  CRISPR gRNA sequence
tttttgtacaaatgtctatt

SEQ ID NO: 199981 - DNA, 20 bp, Artificial
  CRISPR gRNA sequence
ttgtacaaatgtctattagg

SEQ ID NO: 199982 - DNA, 20 bp, Artificial
  CRISPR gRNA sequence
tgtacaaatgtctattaggt

SEQ ID NO: 199983 - DNA, 20 bp, Artificial
  CRISPR gRNA sequence
gtacaaatgtctattaggtt

SEQ ID NO: 199984 - DNA, 20 bp, Artificial
  CRISPR gRNA sequence
tacaaatgtctattaggttg

SEQ ID NO: 199985 - DNA, 20 bp, Artificial
  CRISPR gRNA sequence
ttaggttgaaccagatgtaa

SEQ ID NO: 199986 - DNA, 20 bp, Artificial
  CRISPR gRNA sequence
ggttgaaccagatgtaactg

SEQ ID NO: 199987 - DNA, 20 bp, Artificial
  CRISPR gRNA sequence
aaccagatgtaactggtaac

SEQ ID NO: 199988 - DNA, 20 bp, Artificial
  CRISPR gRNA sequence
gtaacattcaaccttttttt

SEQ ID NO: 199989 - DNA, 20 bp, Artificial
  CRISPR gRNA sequence
aacctttttttgctcttcaa

SEQ ID NO: 199990 - DNA, 20 bp, Artificial
  CRISPR gRNA sequence
tttttgctcttcaaaaacgg

SEQ ID NO: 199991 - DNA, 20 bp, Artificial
  CRISPR gRNA sequence
ttttgctcttcaaaaacggc

SEQ ID NO: 199992 - DNA, 20 bp, Artificial
  CRISPR gRNA sequence
tttgctcttcaaaaacggca

SEQ ID NO: 199993 - DNA, 20 bp, Artificial
  CRISPR gRNA sequence
ttgctcttcaaaaacggcag

SEQ ID NO: 199994 - DNA, 20 bp, Artificial
  CRISPR gRNA sequence
tgctcttcaaaaacggcagt

SEQ ID NO: 199995 - DNA, 20 bp, Artificial
  CRISPR gRNA sequence
gctcttcaaaaacggcagtt

SEQ ID NO: 199996 - DNA, 20 bp, Artificial
  CRISPR gRNA sequence
ctcttcaaaaacggcagttt

SEQ ID NO: 199997 - DNA, 20 bp, Artificial
  CRISPR gRNA sequence
ttcaaaaacggcagtttctt

SEQ ID NO: 199998 - DNA, 20 bp, Artificial
  CRISPR gRNA sequence
caaaaacggcagtttcttat

SEQ ID NO: 199999 - DNA, 20 bp, Artificial
  CRISPR gRNA sequence
aaaaacggcagtttcttatg

SEQ ID NO: 200000 - DNA, 20 bp, Artificial
  CRISPR gRNA sequence
cttatgatacaacttatata

SEQ ID NO: 200001 - DNA, 20 bp, Artificial
  CRISPR gRNA sequence
ttatgatacaacttatatat

SEQ ID NO: 200002 - DNA, 20 bp, Artificial
  CRISPR gRNA sequence
atgatacaacttatatatta

SEQ ID NO: 200003 - DNA, 20 bp, Artificial
  CRISPR gRNA sequence
tgatacaacttatatattaa

SEQ ID NO: 200004 - DNA, 20 bp, Artificial
  CRISPR gRNA sequence
atatattaacagaaagtaaa

SEQ ID NO: 200005 - DNA, 20 bp, Artificial
  CRISPR gRNA sequence
tatattaacagaaagtaaaa

SEQ ID NO: 200006 - DNA, 20 bp, Artificial
  CRISPR gRNA sequence
acagaaagtaaaatttttat

SEQ ID NO: 200007 - DNA, 20 bp, Artificial
  CRISPR gRNA sequence
ttataattacacacaaatgt

SEQ ID NO: 200008 - DNA, 20 bp, Artificial
  CRISPR gRNA sequence
tataattacacacaaatgtg

SEQ ID NO: 200009 - DNA, 20 bp, Artificial
  CRISPR gRNA sequence
ataattacacacaaatgtgc

SEQ ID NO: 200010 - DNA, 20 bp, Artificial
  CRISPR gRNA sequence
taattacacacaaatgtgca

SEQ ID NO: 200011 - DNA, 20 bp, Artificial
  CRISPR gRNA sequence
cacacaaatgtgcatgcaca

SEQ ID NO: 200012 - DNA, 20 bp, Artificial
  CRISPR gRNA sequence
aaaatgttttacagatgaga

SEQ ID NO: 200013 - DNA, 20 bp, Artificial
  CRISPR gRNA sequence
tacagatgagatgagtaatc

SEQ ID NO: 200014 - DNA, 20 bp, Artificial
  CRISPR gRNA sequence
acagatgagatgagtaatca

SEQ ID NO: 200015 - DNA, 20 bp, Artificial
  CRISPR gRNA sequence
cagatgagatgagtaatcaa

SEQ ID NO: 200016 - DNA, 20 bp, Artificial
  CRISPR gRNA sequence
ttgcagacccagaacactat

SEQ ID NO: 200017 - DNA, 20 bp, Artificial
  CRISPR gRNA sequence
tgcagacccagaacactata

SEQ ID NO: 200018 - DNA, 20 bp, Artificial
  CRISPR gRNA sequence
gcagacccagaacactatac

SEQ ID NO: 200019 - DNA, 20 bp, Artificial
  CRISPR gRNA sequence
cagacccagaacactatact

SEQ ID NO: 200020 - DNA, 20 bp, Artificial
  CRISPR gRNA sequence
tactaatgttggacaatcaa

SEQ ID NO: 200021 - DNA, 20 bp, Artificial
  CRISPR gRNA sequence
atgttggacaatcaaaacca

SEQ ID NO: 200022 - DNA, 20 bp, Artificial
  CRISPR gRNA sequence
gacaatcaaaaccaagaaaa

SEQ ID NO: 200023 - DNA, 20 bp, Artificial
  CRISPR gRNA sequence
tgaagtcaacatataacttg

SEQ ID NO: 200024 - DNA, 20 bp, Artificial
  CRISPR gRNA sequence
gaagtcaacatataacttga

SEQ ID NO: 200025 - DNA, 20 bp, Artificial
  CRISPR gRNA sequence
aagtcaacatataacttgat

SEQ ID NO: 200026 - DNA, 20 bp, Artificial
  CRISPR gRNA sequence
gatacgtacaccagaggtac

SEQ ID NO: 200027 - DNA, 20 bp, Artificial
  CRISPR gRNA sequence
atacgtacaccagaggtaca

SEQ ID NO: 200028 - DNA, 20 bp, Artificial
  CRISPR gRNA sequence
ttaagggcccagacttcaga

SEQ ID NO: 200029 - DNA, 20 bp, Artificial
  CRISPR gRNA sequence
agggcccagacttcagagct

SEQ ID NO: 200030 - DNA, 20 bp, Artificial
  CRISPR gRNA sequence
cagagctaatctgcttgggt

SEQ ID NO: 200031 - DNA, 20 bp, Artificial
  CRISPR gRNA sequence
agagctaatctgcttgggtt

SEQ ID NO: 200032 - DNA, 20 bp, Artificial
  CRISPR gRNA sequence
atctgcttgggtttagaact

SEQ ID NO: 200033 - DNA, 20 bp, Artificial
  CRISPR gRNA sequence
cttgggtttagaactagctt

SEQ ID NO: 200034 - DNA, 20 bp, Artificial
  CRISPR gRNA sequence
gggtttagaactagctttat

SEQ ID NO: 200035 - DNA, 20 bp, Artificial
  CRISPR gRNA sequence
ggtttagaactagctttatc

SEQ ID NO: 200036 - DNA, 20 bp, Artificial
  CRISPR gRNA sequence
agaactagctttatcatttt

SEQ ID NO: 200037 - DNA, 20 bp, Artificial
  CRISPR gRNA sequence
gaactagctttatcattttc

SEQ ID NO: 200038 - DNA, 20 bp, Artificial
  CRISPR gRNA sequence
gctttatcattttctaggct

SEQ ID NO: 200039 - DNA, 20 bp, Artificial
  CRISPR gRNA sequence
tatcattttctaggctgggt

SEQ ID NO: 200040 - DNA, 20 bp, Artificial
  CRISPR gRNA sequence
atcattttctaggctgggtg

SEQ ID NO: 200041 - DNA, 20 bp, Artificial
  CRISPR gRNA sequence
tcattttctaggctgggtga

SEQ ID NO: 200042 - DNA, 20 bp, Artificial
  CRISPR gRNA sequence
tctaggctgggtgaatttgg

SEQ ID NO: 200043 - DNA, 20 bp, Artificial
  CRISPR gRNA sequence
ctaggctgggtgaatttggg

SEQ ID NO: 200044 - DNA, 20 bp, Artificial
  CRISPR gRNA sequence
taggctgggtgaatttgggc

SEQ ID NO: 200045 - DNA, 20 bp, Artificial
  CRISPR gRNA sequence
ggctgggtgaatttgggcaa

SEQ ID NO: 200046 - DNA, 20 bp, Artificial
  CRISPR gRNA sequence
ggtgaatttgggcaaattac

SEQ ID NO: 200047 - DNA, 20 bp, Artificial
  CRISPR gRNA sequence
gggcaaattacttaatttct

SEQ ID NO: 200048 - DNA, 20 bp, Artificial
  CRISPR gRNA sequence
ggcaaattacttaatttctt

SEQ ID NO: 200049 - DNA, 20 bp, Artificial
  CRISPR gRNA sequence
cttaatttctttggacctca

SEQ ID NO: 200050 - DNA, 20 bp, Artificial
  CRISPR gRNA sequence
aatttctttggacctcagtt

SEQ ID NO: 200051 - DNA, 20 bp, Artificial
  CRISPR gRNA sequence
atttctttggacctcagttt

SEQ ID NO: 200052 - DNA, 20 bp, Artificial
  CRISPR gRNA sequence
ctttggacctcagtttcctc

SEQ ID NO: 200053 - DNA, 20 bp, Artificial
  CRISPR gRNA sequence
tttggacctcagtttcctca

SEQ ID NO: 200054 - DNA, 20 bp, Artificial
  CRISPR gRNA sequence
tggacctcagtttcctcatc

SEQ ID NO: 200055 - DNA, 20 bp, Artificial
  CRISPR gRNA sequence
ggacctcagtttcctcatcc

SEQ ID NO: 200056 - DNA, 20 bp, Artificial
  CRISPR gRNA sequence
gacctcagtttcctcatcct

SEQ ID NO: 200057 - DNA, 20 bp, Artificial
  CRISPR gRNA sequence
agtttcctcatccttaaaat

SEQ ID NO: 200058 - DNA, 20 bp, Artificial
  CRISPR gRNA sequence
cctcatccttaaaatgggaa

SEQ ID NO: 200059 - DNA, 20 bp, Artificial
  CRISPR gRNA sequence
ctcatccttaaaatgggaat

SEQ ID NO: 200060 - DNA, 20 bp, Artificial
  CRISPR gRNA sequence
atccttaaaatgggaataat

SEQ ID NO: 200061 - DNA, 20 bp, Artificial
  CRISPR gRNA sequence
aaaatgggaataataccact

SEQ ID NO: 200062 - DNA, 20 bp, Artificial
  CRISPR gRNA sequence
aaatgggaataataccactt

SEQ ID NO: 200063 - DNA, 20 bp, Artificial
  CRISPR gRNA sequence
atcatggaatcaaagattcc

SEQ ID NO: 200064 - DNA, 20 bp, Artificial
  CRISPR gRNA sequence
tcatggaatcaaagattcca

SEQ ID NO: 200065 - DNA, 20 bp, Artificial
  CRISPR gRNA sequence
catcattgaaagacacactc

SEQ ID NO: 200066 - DNA, 20 bp, Artificial
  CRISPR gRNA sequence
aaagacacactcagatttca

SEQ ID NO: 200067 - DNA, 20 bp, Artificial
  CRISPR gRNA sequence
agatttcagacacaacaaaa

SEQ ID NO: 200068 - DNA, 20 bp, Artificial
  CRISPR gRNA sequence
cagacacaacaaaatgtgaa

SEQ ID NO: 200069 - DNA, 20 bp, Artificial
  CRISPR gRNA sequence
agacacaacaaaatgtgaaa

SEQ ID NO: 200070 - DNA, 20 bp, Artificial
  CRISPR gRNA sequence
atcttacatgatgaagcact

SEQ ID NO: 200071 - DNA, 20 bp, Artificial
  CRISPR gRNA sequence
acatgatgaagcacttaccc

SEQ ID NO: 200072 - DNA, 20 bp, Artificial
  CRISPR gRNA sequence
catgatgaagcacttacccc

SEQ ID NO: 200073 - DNA, 20 bp, Artificial
  CRISPR gRNA sequence
accccctagagtcatttcca

SEQ ID NO: 200074 - DNA, 20 bp, Artificial
  CRISPR gRNA sequence
ccccctagagtcatttccag

SEQ ID NO: 200075 - DNA, 20 bp, Artificial
  CRISPR gRNA sequence
gagtcatttccaggaggaaa

SEQ ID NO: 200076 - DNA, 20 bp, Artificial
  CRISPR gRNA sequence
ccaggaggaaatgaactaat

SEQ ID NO: 200077 - DNA, 20 bp, Artificial
  CRISPR gRNA sequence
caggaggaaatgaactaatt

SEQ ID NO: 200078 - DNA, 20 bp, Artificial
  CRISPR gRNA sequence
atttagacagagtgttcagt

SEQ ID NO: 200079 - DNA, 20 bp, Artificial
  CRISPR gRNA sequence
agacagagtgttcagtacag

SEQ ID NO: 200080 - DNA, 20 bp, Artificial
  CRISPR gRNA sequence
gacagagtgttcagtacagg

SEQ ID NO: 200081 - DNA, 20 bp, Artificial
  CRISPR gRNA sequence
agtacagggcctaacacaca

SEQ ID NO: 200082 - DNA, 20 bp, Artificial
  CRISPR gRNA sequence
acacacagaataagcaagtg

SEQ ID NO: 200083 - DNA, 20 bp, Artificial
  CRISPR gRNA sequence
attgtagtagtactcgatag

SEQ ID NO: 200084 - DNA, 20 bp, Artificial
  CRISPR gRNA sequence
tagtagtactcgatagtagc

SEQ ID NO: 200085 - DNA, 20 bp, Artificial
  CRISPR gRNA sequence
gatagtagcagtagcagagc

SEQ ID NO: 200086 - DNA, 20 bp, Artificial
  CRISPR gRNA sequence
ctcctcttcctccttttact

SEQ ID NO: 200087 - DNA, 20 bp, Artificial
  CRISPR gRNA sequence
ctcttcctccttttactact

SEQ ID NO: 200088 - DNA, 20 bp, Artificial
  CRISPR gRNA sequence
ttcctccttttactactgct

SEQ ID NO: 200089 - DNA, 20 bp, Artificial
  CRISPR gRNA sequence
cctccttttactactgctgc

SEQ ID NO: 200090 - DNA, 20 bp, Artificial
  CRISPR gRNA sequence
ctccttttactactgctgct

SEQ ID NO: 200091 - DNA, 20 bp, Artificial
  CRISPR gRNA sequence
cttttactactgctgctcca

SEQ ID NO: 200092 - DNA, 20 bp, Artificial
  CRISPR gRNA sequence
ttactactgctgctccagtg

SEQ ID NO: 200093 - DNA, 20 bp, Artificial
  CRISPR gRNA sequence
tactactgctgctccagtgt

SEQ ID NO: 200094 - DNA, 20 bp, Artificial
  CRISPR gRNA sequence
actactgctgctccagtgta

SEQ ID NO: 200095 - DNA, 20 bp, Artificial
  CRISPR gRNA sequence
ctactgctgctccagtgtac

SEQ ID NO: 200096 - DNA, 20 bp, Artificial
  CRISPR gRNA sequence
ctgctgctccagtgtaccct

SEQ ID NO: 200097 - DNA, 20 bp, Artificial
  CRISPR gRNA sequence
ctgctccagtgtacccttta

SEQ ID NO: 200098 - DNA, 20 bp, Artificial
  CRISPR gRNA sequence
ctccagtgtaccctttagaa

SEQ ID NO: 200099 - DNA, 20 bp, Artificial
  CRISPR gRNA sequence
cagtgtaccctttagaagct

SEQ ID NO: 200100 - DNA, 20 bp, Artificial
  CRISPR gRNA sequence
tagaagctgctaacagttcc

SEQ ID NO: 200101 - DNA, 20 bp, Artificial
  CRISPR gRNA sequence
agaagctgctaacagttcct

SEQ ID NO: 200102 - DNA, 20 bp, Artificial
  CRISPR gRNA sequence
gaagctgctaacagttcctg

SEQ ID NO: 200103 - DNA, 20 bp, Artificial
  CRISPR gRNA sequence
ctaacagttcctgatgaaca

SEQ ID NO: 200104 - DNA, 20 bp, Artificial
  CRISPR gRNA sequence
acagttcctgatgaacagtc

SEQ ID NO: 200105 - DNA, 20 bp, Artificial
  CRISPR gRNA sequence
ctgatgaacagtctggaaat

SEQ ID NO: 200106 - DNA, 20 bp, Artificial
  CRISPR gRNA sequence
atgaacagtctggaaataaa

SEQ ID NO: 200107 - DNA, 20 bp, Artificial
  CRISPR gRNA sequence
gaaataaattttcacatatc

SEQ ID NO: 200108 - DNA, 20 bp, Artificial
  CRISPR gRNA sequence
tcacatatccaaatctgttc

SEQ ID NO: 200109 - DNA, 20 bp, Artificial
  CRISPR gRNA sequence
cacatatccaaatctgttca

SEQ ID NO: 200110 - DNA, 20 bp, Artificial
  CRISPR gRNA sequence
acatatccaaatctgttcat

SEQ ID NO: 200111 - DNA, 20 bp, Artificial
  CRISPR gRNA sequence
ttcatgtttccaaaatttta

SEQ ID NO: 200112 - DNA, 20 bp, Artificial
  CRISPR gRNA sequence
atgtttccaaaattttaggc

SEQ ID NO: 200113 - DNA, 20 bp, Artificial
  CRISPR gRNA sequence
ccaaaattttaggctaatcc

SEQ ID NO: 200114 - DNA, 20 bp, Artificial
  CRISPR gRNA sequence
caaaattttaggctaatcct

SEQ ID NO: 200115 - DNA, 20 bp, Artificial
  CRISPR gRNA sequence
taggctaatcctatttgagg

SEQ ID NO: 200116 - DNA, 20 bp, Artificial
  CRISPR gRNA sequence
aggctaatcctatttgagga

SEQ ID NO: 200117 - DNA, 20 bp, Artificial
  CRISPR gRNA sequence
ggctaatcctatttgaggaa

SEQ ID NO: 200118 - DNA, 20 bp, Artificial
  CRISPR gRNA sequence
atcctatttgaggaaatcat

SEQ ID NO: 200119 - DNA, 20 bp, Artificial
  CRISPR gRNA sequence
tttgaggaaatcattcattc

SEQ ID NO: 200120 - DNA, 20 bp, Artificial
  CRISPR gRNA sequence
gaggaaatcattcattcatt

SEQ ID NO: 200121 - DNA, 20 bp, Artificial
  CRISPR gRNA sequence
aggaaatcattcattcattg

SEQ ID NO: 200122 - DNA, 20 bp, Artificial
  CRISPR gRNA sequence
attcattgactcaacaaata

SEQ ID NO: 200123 - DNA, 20 bp, Artificial
  CRISPR gRNA sequence
attgactcaacaaatatttt

SEQ ID NO: 200124 - DNA, 20 bp, Artificial
  CRISPR gRNA sequence
actcaacaaatatttttttg

SEQ ID NO: 200125 - DNA, 20 bp, Artificial
  CRISPR gRNA sequence
aacaaatatttttttgtgtg

SEQ ID NO: 200126 - DNA, 20 bp, Artificial
  CRISPR gRNA sequence
ttttgtgtgctcttttcgta

SEQ ID NO: 200127 - DNA, 20 bp, Artificial
  CRISPR gRNA sequence
tttgtgtgctcttttcgtac

SEQ ID NO: 200128 - DNA, 20 bp, Artificial
  CRISPR gRNA sequence
ttgtgtgctcttttcgtacc

SEQ ID NO: 200129 - DNA, 20 bp, Artificial
  CRISPR gRNA sequence
tgtgtgctcttttcgtacca

SEQ ID NO: 200130 - DNA, 20 bp, Artificial
  CRISPR gRNA sequence
gtgtgctcttttcgtaccac

SEQ ID NO: 200131 - DNA, 20 bp, Artificial
  CRISPR gRNA sequence
tgtgctcttttcgtaccacc

SEQ ID NO: 200132 - DNA, 20 bp, Artificial
  CRISPR gRNA sequence
ttttcgtaccaccactctgc

SEQ ID NO: 200133 - DNA, 20 bp, Artificial
  CRISPR gRNA sequence
ttcgtaccaccactctgctg

SEQ ID NO: 200134 - DNA, 20 bp, Artificial
  CRISPR gRNA sequence
tcgtaccaccactctgctgt

SEQ ID NO: 200135 - DNA, 20 bp, Artificial
  CRISPR gRNA sequence
cgtaccaccactctgctgta

SEQ ID NO: 200136 - DNA, 20 bp, Artificial
  CRISPR gRNA sequence
gtaccaccactctgctgtat

SEQ ID NO: 200137 - DNA, 20 bp, Artificial
  CRISPR gRNA sequence
tgctgtatatcaggccctgg

SEQ ID NO: 200138 - DNA, 20 bp, Artificial
  CRISPR gRNA sequence
ctgtatatcaggccctgggg

SEQ ID NO: 200139 - DNA, 20 bp, Artificial
  CRISPR gRNA sequence
tatatcaggccctggggatg

SEQ ID NO: 200140 - DNA, 20 bp, Artificial
  CRISPR gRNA sequence
gggatgcaacaatattataa

SEQ ID NO: 200141 - DNA, 20 bp, Artificial
  CRISPR gRNA sequence
taaaacaggcccaaatcttt

SEQ ID NO: 200142 - DNA, 20 bp, Artificial
  CRISPR gRNA sequence
tgtgcttgtggagtttatat

SEQ ID NO: 200143 - DNA, 20 bp, Artificial
  CRISPR gRNA sequence
gtgcttgtggagtttatatt

SEQ ID NO: 200144 - DNA, 20 bp, Artificial
  CRISPR gRNA sequence
tgcttgtggagtttatattc

SEQ ID NO: 200145 - DNA, 20 bp, Artificial
  CRISPR gRNA sequence
gtggagtttatattctagga

SEQ ID NO: 200146 - DNA, 20 bp, Artificial
  CRISPR gRNA sequence
tggagtttatattctaggag

SEQ ID NO: 200147 - DNA, 20 bp, Artificial
  CRISPR gRNA sequence
atattctaggaggagagaga

SEQ ID NO: 200148 - DNA, 20 bp, Artificial
  CRISPR gRNA sequence
tattctaggaggagagagac

SEQ ID NO: 200149 - DNA, 20 bp, Artificial
  CRISPR gRNA sequence
taggaggagagagacaataa

SEQ ID NO: 200150 - DNA, 20 bp, Artificial
  CRISPR gRNA sequence
ggaggagagagacaataaac

SEQ ID NO: 200151 - DNA, 20 bp, Artificial
  CRISPR gRNA sequence
cacaatatactagatagaga

SEQ ID NO: 200152 - DNA, 20 bp, Artificial
  CRISPR gRNA sequence
gatagagataaatgctacag

SEQ ID NO: 200153 - DNA, 20 bp, Artificial
  CRISPR gRNA sequence
cagagaacacttaaacaggg

SEQ ID NO: 200154 - DNA, 20 bp, Artificial
  CRISPR gRNA sequence
aaacagggctgggaattttg

SEQ ID NO: 200155 - DNA, 20 bp, Artificial
  CRISPR gRNA sequence
aacagggctgggaattttgg

SEQ ID NO: 200156 - DNA, 20 bp, Artificial
  CRISPR gRNA sequence
ggaattttggggagagatgg

SEQ ID NO: 200157 - DNA, 20 bp, Artificial
  CRISPR gRNA sequence
tggggagagatggggttggt

SEQ ID NO: 200158 - DNA, 20 bp, Artificial
  CRISPR gRNA sequence
ggggagagatggggttggtg

SEQ ID NO: 200159 - DNA, 20 bp, Artificial
  CRISPR gRNA sequence
gggagagatggggttggtgg

SEQ ID NO: 200160 - DNA, 20 bp, Artificial
  CRISPR gRNA sequence
gtggggaatgacagcagtcg

SEQ ID NO: 200161 - DNA, 20 bp, Artificial
  CRISPR gRNA sequence
ggtccatatgatccaaatag

SEQ ID NO: 200162 - DNA, 20 bp, Artificial
  CRISPR gRNA sequence
gtccatatgatccaaatagc

SEQ ID NO: 200163 - DNA, 20 bp, Artificial
  CRISPR gRNA sequence
tatcgggacaactatgcaac

SEQ ID NO: 200164 - DNA, 20 bp, Artificial
  CRISPR gRNA sequence
atcgggacaactatgcaaca

SEQ ID NO: 200165 - DNA, 20 bp, Artificial
  CRISPR gRNA sequence
tcgggacaactatgcaacac

SEQ ID NO: 200166 - DNA, 20 bp, Artificial
  CRISPR gRNA sequence
tgcaacactttgatctttca

SEQ ID NO: 200167 - DNA, 20 bp, Artificial
  CRISPR gRNA sequence
tgatctttcagctgcctaat

SEQ ID NO: 200168 - DNA, 20 bp, Artificial
  CRISPR gRNA sequence
gatctttcagctgcctaatc

SEQ ID NO: 200169 - DNA, 20 bp, Artificial
  CRISPR gRNA sequence
atctttcagctgcctaatct

SEQ ID NO: 200170 - DNA, 20 bp, Artificial
  CRISPR gRNA sequence
tcagctgcctaatctcattg

SEQ ID NO: 200171 - DNA, 20 bp, Artificial
  CRISPR gRNA sequence
cagctgcctaatctcattga

SEQ ID NO: 200172 - DNA, 20 bp, Artificial
  CRISPR gRNA sequence
agctgcctaatctcattgaa

SEQ ID NO: 200173 - DNA, 20 bp, Artificial
  CRISPR gRNA sequence
cctaatctcattgaaggttc

SEQ ID NO: 200174 - DNA, 20 bp, Artificial
  CRISPR gRNA sequence
atctcattgaaggttctgaa

SEQ ID NO: 200175 - DNA, 20 bp, Artificial
  CRISPR gRNA sequence
attgaaggttctgaaagtct

SEQ ID NO: 200176 - DNA, 20 bp, Artificial
  CRISPR gRNA sequence
aaggttctgaaagtctgaat

SEQ ID NO: 200177 - DNA, 20 bp, Artificial
  CRISPR gRNA sequence
tgaaagtctgaatgaacatt

SEQ ID NO: 200178 - DNA, 20 bp, Artificial
  CRISPR gRNA sequence
aaagtctgaatgaacatttc

SEQ ID NO: 200179 - DNA, 20 bp, Artificial
  CRISPR gRNA sequence
aatgaacatttcgttttccc

SEQ ID NO: 200180 - DNA, 20 bp, Artificial
  CRISPR gRNA sequence
cgttttccctgctgttaggt

SEQ ID NO: 200181 - DNA, 20 bp, Artificial
  CRISPR gRNA sequence
gttttccctgctgttaggtt

SEQ ID NO: 200182 - DNA, 20 bp, Artificial
  CRISPR gRNA sequence
tccctgctgttaggttcagc

SEQ ID NO: 200183 - DNA, 20 bp, Artificial
  CRISPR gRNA sequence
ccctgctgttaggttcagcg

SEQ ID NO: 200184 - DNA, 20 bp, Artificial
  CRISPR gRNA sequence
cctgctgttaggttcagcga

SEQ ID NO: 200185 - DNA, 20 bp, Artificial
  CRISPR gRNA sequence
ctgttaggttcagcgattaa

SEQ ID NO: 200186 - DNA, 20 bp, Artificial
  CRISPR gRNA sequence
ttaggttcagcgattaaaga

SEQ ID NO: 200187 - DNA, 20 bp, Artificial
  CRISPR gRNA sequence
ggttcagcgattaaagaaaa

SEQ ID NO: 200188 - DNA, 20 bp, Artificial
  CRISPR gRNA sequence
agcgattaaagaaaaacact

SEQ ID NO: 200189 - DNA, 20 bp, Artificial
  CRISPR gRNA sequence
aagaaaaacacttttaattg

SEQ ID NO: 200190 - DNA, 20 bp, Artificial
  CRISPR gRNA sequence
ttaattgaaagttagtggcc

SEQ ID NO: 200191 - DNA, 20 bp, Artificial
  CRISPR gRNA sequence
taattgaaagttagtggcct

SEQ ID NO: 200192 - DNA, 20 bp, Artificial
  CRISPR gRNA sequence
aattgaaagttagtggcctg

SEQ ID NO: 200193 - DNA, 20 bp, Artificial
  CRISPR gRNA sequence
attgaaagttagtggcctga

SEQ ID NO: 200194 - DNA, 20 bp, Artificial
  CRISPR gRNA sequence
aaagttagtggcctgagagt

SEQ ID NO: 200195 - DNA, 20 bp, Artificial
  CRISPR gRNA sequence
gtggcctgagagtctggcat

SEQ ID NO: 200196 - DNA, 20 bp, Artificial
  CRISPR gRNA sequence
agagtctggcatttaaactc

SEQ ID NO: 200197 - DNA, 20 bp, Artificial
  CRISPR gRNA sequence
gcatttaaactcacaaacaa

SEQ ID NO: 200198 - DNA, 20 bp, Artificial
  CRISPR gRNA sequence
aaactcacaaacaagaaagg

SEQ ID NO: 200199 - DNA, 20 bp, Artificial
  CRISPR gRNA sequence
aactcacaaacaagaaaggt

SEQ ID NO: 200200 - DNA, 20 bp, Artificial
  CRISPR gRNA sequence
acaaacaagaaaggtgcaat

SEQ ID NO: 200201 - DNA, 20 bp, Artificial
  CRISPR gRNA sequence
agtgaatccaaaactaaatt

SEQ ID NO: 200202 - DNA, 20 bp, Artificial
  CRISPR gRNA sequence
aattctttcaaatttcagtt

SEQ ID NO: 200203 - DNA, 20 bp, Artificial
  CRISPR gRNA sequence
tttcaaatttcagttttgaa

SEQ ID NO: 200204 - DNA, 20 bp, Artificial
  CRISPR gRNA sequence
tcaaatttcagttttgaaat

SEQ ID NO: 200205 - DNA, 20 bp, Artificial
  CRISPR gRNA sequence
caaatttcagttttgaaatg

SEQ ID NO: 200206 - DNA, 20 bp, Artificial
  CRISPR gRNA sequence
aaatttcagttttgaaatgt

SEQ ID NO: 200207 - DNA, 20 bp, Artificial
  CRISPR gRNA sequence
cagttttgaaatgtttcacc

SEQ ID NO: 200208 - DNA, 20 bp, Artificial
  CRISPR gRNA sequence
agttttgaaatgtttcacct

SEQ ID NO: 200209 - DNA, 20 bp, Artificial
  CRISPR gRNA sequence
tgaaatgtttcacctttaaa

SEQ ID NO: 200210 - DNA, 20 bp, Artificial
  CRISPR gRNA sequence
gaaatgtttcacctttaaaa

SEQ ID NO: 200211 - DNA, 20 bp, Artificial
  CRISPR gRNA sequence
aaatgtttcacctttaaaat

SEQ ID NO: 200212 - DNA, 20 bp, Artificial
  CRISPR gRNA sequence
cacctttaaaataccatggt

SEQ ID NO: 200213 - DNA, 20 bp, Artificial
  CRISPR gRNA sequence
acctttaaaataccatggtg

SEQ ID NO: 200214 - DNA, 20 bp, Artificial
  CRISPR gRNA sequence
taaaataccatggtgagtaa

SEQ ID NO: 200215 - DNA, 20 bp, Artificial
  CRISPR gRNA sequence
aaaataccatggtgagtaaa

SEQ ID NO: 200216 - DNA, 20 bp, Artificial
  CRISPR gRNA sequence
aaataccatggtgagtaaac

SEQ ID NO: 200217 - DNA, 20 bp, Artificial
  CRISPR gRNA sequence
ctgtggggaagctatgttac

SEQ ID NO: 200218 - DNA, 20 bp, Artificial
  CRISPR gRNA sequence
tggggaagctatgttaccac

SEQ ID NO: 200219 - DNA, 20 bp, Artificial
  CRISPR gRNA sequence
tgttaccacacatttgctgt

SEQ ID NO: 200220 - DNA, 20 bp, Artificial
  CRISPR gRNA sequence
ccacacatttgctgtgatgg

SEQ ID NO: 200221 - DNA, 20 bp, Artificial
  CRISPR gRNA sequence
gctgtgatgggaagtgaagt

SEQ ID NO: 200222 - DNA, 20 bp, Artificial
  CRISPR gRNA sequence
ctgtgatgggaagtgaagtt

SEQ ID NO: 200223 - DNA, 20 bp, Artificial
  CRISPR gRNA sequence
tgatgggaagtgaagttcaa

SEQ ID NO: 200224 - DNA, 20 bp, Artificial
  CRISPR gRNA sequence
aacagcattactgtgaaatc

SEQ ID NO: 200225 - DNA, 20 bp, Artificial
  CRISPR gRNA sequence
ctgtgaaatcatttgcatat

SEQ ID NO: 200226 - DNA, 20 bp, Artificial
  CRISPR gRNA sequence
tgaaatcatttgcatatgga

SEQ ID NO: 200227 - DNA, 20 bp, Artificial
  CRISPR gRNA sequence
gcatatggaggtgactcagg

SEQ ID NO: 200228 - DNA, 20 bp, Artificial
  CRISPR gRNA sequence
catatggaggtgactcagga

SEQ ID NO: 200229 - DNA, 20 bp, Artificial
  CRISPR gRNA sequence
aggagttctacttccctgag

SEQ ID NO: 200230 - DNA, 20 bp, Artificial
  CRISPR gRNA sequence
tacttccctgagttgggaag

SEQ ID NO: 200231 - DNA, 20 bp, Artificial
  CRISPR gRNA sequence
cttccctgagttgggaagct

SEQ ID NO: 200232 - DNA, 20 bp, Artificial
  CRISPR gRNA sequence
ccctgagttgggaagctcct

SEQ ID NO: 200233 - DNA, 20 bp, Artificial
  CRISPR gRNA sequence
cctgagttgggaagctcctg

SEQ ID NO: 200234 - DNA, 20 bp, Artificial
  CRISPR gRNA sequence
agttgggaagctcctgcaag

SEQ ID NO: 200235 - DNA, 20 bp, Artificial
  CRISPR gRNA sequence
ggaagctcctgcaagccagc

SEQ ID NO: 200236 - DNA, 20 bp, Artificial
  CRISPR gRNA sequence
ctgcaagccagctgcctcat

SEQ ID NO: 200237 - DNA, 20 bp, Artificial
  CRISPR gRNA sequence
caagccagctgcctcatttc

SEQ ID NO: 200238 - DNA, 20 bp, Artificial
  CRISPR gRNA sequence
cctcatttccattggagaca

SEQ ID NO: 200239 - DNA, 20 bp, Artificial
  CRISPR gRNA sequence
atttccattggagacacggc

SEQ ID NO: 200240 - DNA, 20 bp, Artificial
  CRISPR gRNA sequence
ccattggagacacggcctca

SEQ ID NO: 200241 - DNA, 20 bp, Artificial
  CRISPR gRNA sequence
cattggagacacggcctcag

SEQ ID NO: 200242 - DNA, 20 bp, Artificial
  CRISPR gRNA sequence
gagacacggcctcagtgcaa

SEQ ID NO: 200243 - DNA, 20 bp, Artificial
  CRISPR gRNA sequence
agtgcaagtgaagcttggtg

SEQ ID NO: 200244 - DNA, 20 bp, Artificial
  CRISPR gRNA sequence
ggtggttgccttgttctaag

SEQ ID NO: 200245 - DNA, 20 bp, Artificial
  CRISPR gRNA sequence
gtggttgccttgttctaagt

SEQ ID NO: 200246 - DNA, 20 bp, Artificial
  CRISPR gRNA sequence
ccttgttctaagtgcagaag

SEQ ID NO: 200247 - DNA, 20 bp, Artificial
  CRISPR gRNA sequence
gttctaagtgcagaaggttc

SEQ ID NO: 200248 - DNA, 20 bp, Artificial
  CRISPR gRNA sequence
ttctaagtgcagaaggttca

SEQ ID NO: 200249 - DNA, 20 bp, Artificial
  CRISPR gRNA sequence
taagtgcagaaggttcagac

SEQ ID NO: 200250 - DNA, 20 bp, Artificial
  CRISPR gRNA sequence
agtgcagaaggttcagactt

SEQ ID NO: 200251 - DNA, 20 bp, Artificial
  CRISPR gRNA sequence
agacttttggtatagctgaa

SEQ ID NO: 200252 - DNA, 20 bp, Artificial
  CRISPR gRNA sequence
ttggtatagctgaactcaat

SEQ ID NO: 200253 - DNA, 20 bp, Artificial
  CRISPR gRNA sequence
tggtatagctgaactcaatc

SEQ ID NO: 200254 - DNA, 20 bp, Artificial
  CRISPR gRNA sequence
ggtatagctgaactcaatcc

SEQ ID NO: 200255 - DNA, 20 bp, Artificial
  CRISPR gRNA sequence
gtatagctgaactcaatccc

SEQ ID NO: 200256 - DNA, 20 bp, Artificial
  CRISPR gRNA sequence
aactcaatcccaaaaccact

SEQ ID NO: 200257 - DNA, 20 bp, Artificial
  CRISPR gRNA sequence
aatcccaaaaccactgtatg

SEQ ID NO: 200258 - DNA, 20 bp, Artificial
  CRISPR gRNA sequence
tatgcaaatgacaagatgga

SEQ ID NO: 200259 - DNA, 20 bp, Artificial
  CRISPR gRNA sequence
ggagtagaatgccaattaag

SEQ ID NO: 200260 - DNA, 20 bp, Artificial
  CRISPR gRNA sequence
agtaatttacaatacaaaat

SEQ ID NO: 200261 - DNA, 20 bp, Artificial
  CRISPR gRNA sequence
acaatacaaaatggaattgt

SEQ ID NO: 200262 - DNA, 20 bp, Artificial
  CRISPR gRNA sequence
caatacaaaatggaattgtc

SEQ ID NO: 200263 - DNA, 20 bp, Artificial
  CRISPR gRNA sequence
tcaaacaaatcaggtcctca

SEQ ID NO: 200264 - DNA, 20 bp, Artificial
  CRISPR gRNA sequence
aaacctggttggtcatttgc

SEQ ID NO: 200265 - DNA, 20 bp, Artificial
  CRISPR gRNA sequence
gttggtcatttgctttgctc

SEQ ID NO: 200266 - DNA, 20 bp, Artificial
  CRISPR gRNA sequence
gtcatttgctttgctccagg

SEQ ID NO: 200267 - DNA, 20 bp, Artificial
  CRISPR gRNA sequence
gctttgctccaggaagaact

SEQ ID NO: 200268 - DNA, 20 bp, Artificial
  CRISPR gRNA sequence
ctttgctccaggaagaactc

SEQ ID NO: 200269 - DNA, 20 bp, Artificial
  CRISPR gRNA sequence
tgctccaggaagaactcccc

SEQ ID NO: 200270 - DNA, 20 bp, Artificial
  CRISPR gRNA sequence
gctccaggaagaactccccc

SEQ ID NO: 200271 - DNA, 20 bp, Artificial
  CRISPR gRNA sequence
ctccaggaagaactccccct

SEQ ID NO: 200272 - DNA, 20 bp, Artificial
  CRISPR gRNA sequence
caggaagaactcccccttgg

SEQ ID NO: 200273 - DNA, 20 bp, Artificial
  CRISPR gRNA sequence
ccccttggaaaaaccatcag

SEQ ID NO: 200274 - DNA, 20 bp, Artificial
  CRISPR gRNA sequence
ggaaaaaccatcagtgccgg

SEQ ID NO: 200275 - DNA, 20 bp, Artificial
  CRISPR gRNA sequence
gaaaaaccatcagtgccgga

SEQ ID NO: 200276 - DNA, 20 bp, Artificial
  CRISPR gRNA sequence
cctattgtgttgatccatgg

SEQ ID NO: 200277 - DNA, 20 bp, Artificial
  CRISPR gRNA sequence
ctattgtgttgatccatggc

SEQ ID NO: 200278 - DNA, 20 bp, Artificial
  CRISPR gRNA sequence
ttgtgttgatccatggcaaa

SEQ ID NO: 200279 - DNA, 20 bp, Artificial
  CRISPR gRNA sequence
tgttgatccatggcaaagga

SEQ ID NO: 200280 - DNA, 20 bp, Artificial
  CRISPR gRNA sequence
atccatggcaaaggagactg

SEQ ID NO: 200281 - DNA, 20 bp, Artificial
  CRISPR gRNA sequence
cagatacacaagggatatta

SEQ ID NO: 200282 - DNA, 20 bp, Artificial
  CRISPR gRNA sequence
tggagcccagacgacctgaa

SEQ ID NO: 200283 - DNA, 20 bp, Artificial
  CRISPR gRNA sequence
aataaaacccttccctacta

SEQ ID NO: 200284 - DNA, 20 bp, Artificial
  CRISPR gRNA sequence
ccctactacaaggacagctg

SEQ ID NO: 200285 - DNA, 20 bp, Artificial
  CRISPR gRNA sequence
cctactacaaggacagctgt

SEQ ID NO: 200286 - DNA, 20 bp, Artificial
  CRISPR gRNA sequence
ctacaaggacagctgtccct

SEQ ID NO: 200287 - DNA, 20 bp, Artificial
  CRISPR gRNA sequence
caaggacagctgtcccttcc

SEQ ID NO: 200288 - DNA, 20 bp, Artificial
  CRISPR gRNA sequence
tcccttccctacacactccc

SEQ ID NO: 200289 - DNA, 20 bp, Artificial
  CRISPR gRNA sequence
ccctacacactccctacagg

SEQ ID NO: 200290 - DNA, 20 bp, Artificial
  CRISPR gRNA sequence
cctacacactccctacaggc

SEQ ID NO: 200291 - DNA, 20 bp, Artificial
  CRISPR gRNA sequence
cacactccctacaggctgat

SEQ ID NO: 200292 - DNA, 20 bp, Artificial
  CRISPR gRNA sequence
cctacaggctgatgagagac

SEQ ID NO: 200293 - DNA, 20 bp, Artificial
  CRISPR gRNA sequence
caggctgatgagagaccttt

SEQ ID NO: 200294 - DNA, 20 bp, Artificial
  CRISPR gRNA sequence
atgagagaccttttttggaa

SEQ ID NO: 200295 - DNA, 20 bp, Artificial
  CRISPR gRNA sequence
ttttggaagcagaaacttat

SEQ ID NO: 200296 - DNA, 20 bp, Artificial
  CRISPR gRNA sequence
tttggaagcagaaacttata

SEQ ID NO: 200297 - DNA, 20 bp, Artificial
  CRISPR gRNA sequence
ttggaagcagaaacttatac

SEQ ID NO: 200298 - DNA, 20 bp, Artificial
  CRISPR gRNA sequence
tggaagcagaaacttatact

SEQ ID NO: 200299 - DNA, 20 bp, Artificial
  CRISPR gRNA sequence
ggaagcagaaacttatactt

SEQ ID NO: 200300 - DNA, 20 bp, Artificial
  CRISPR gRNA sequence
gaagcagaaacttatacttt

SEQ ID NO: 200301 - DNA, 20 bp, Artificial
  CRISPR gRNA sequence
atactttatgctgccttctt

SEQ ID NO: 200302 - DNA, 20 bp, Artificial
  CRISPR gRNA sequence
tactttatgctgccttcttc

SEQ ID NO: 200303 - DNA, 20 bp, Artificial
  CRISPR gRNA sequence
tatgctgccttcttcctgac

SEQ ID NO: 200304 - DNA, 20 bp, Artificial
  CRISPR gRNA sequence
atgctgccttcttcctgact

SEQ ID NO: 200305 - DNA, 20 bp, Artificial
  CRISPR gRNA sequence
tgctgccttcttcctgactg

SEQ ID NO: 200306 - DNA, 20 bp, Artificial
  CRISPR gRNA sequence
ccttcttcctgactgccagg

SEQ ID NO: 200307 - DNA, 20 bp, Artificial
  CRISPR gRNA sequence
cttcctgactgccaggatta

SEQ ID NO: 200308 - DNA, 20 bp, Artificial
  CRISPR gRNA sequence
ttcctgactgccaggattat

SEQ ID NO: 200309 - DNA, 20 bp, Artificial
  CRISPR gRNA sequence
cctgactgccaggattatac

SEQ ID NO: 200310 - DNA, 20 bp, Artificial
  CRISPR gRNA sequence
ctgactgccaggattatact

SEQ ID NO: 200311 - DNA, 20 bp, Artificial
  CRISPR gRNA sequence
actgccaggattatactctt

SEQ ID NO: 200312 - DNA, 20 bp, Artificial
  CRISPR gRNA sequence
ccaggattatactcttcctt

SEQ ID NO: 200313 - DNA, 20 bp, Artificial
  CRISPR gRNA sequence
tactcttcctttccatccca

SEQ ID NO: 200314 - DNA, 20 bp, Artificial
  CRISPR gRNA sequence
ttcctttccatcccagatct

SEQ ID NO: 200315 - DNA, 20 bp, Artificial
  CRISPR gRNA sequence
cctttccatcccagatctag

SEQ ID NO: 200316 - DNA, 20 bp, Artificial
  CRISPR gRNA sequence
ctttccatcccagatctagc

SEQ ID NO: 200317 - DNA, 20 bp, Artificial
  CRISPR gRNA sequence
tccatcccagatctagcaat

SEQ ID NO: 200318 - DNA, 20 bp, Artificial
  CRISPR gRNA sequence
ccatcccagatctagcaatg

SEQ ID NO: 200319 - DNA, 20 bp, Artificial
  CRISPR gRNA sequence
catcccagatctagcaatgc

SEQ ID NO: 200320 - DNA, 20 bp, Artificial
  CRISPR gRNA sequence
gcaatgctgttgatgaggct

SEQ ID NO: 200321 - DNA, 20 bp, Artificial
  CRISPR gRNA sequence
ttgatgaggctaagtcatga

SEQ ID NO: 200322 - DNA, 20 bp, Artificial
  CRISPR gRNA sequence
atgaggctaagtcatgatga

SEQ ID NO: 200323 - DNA, 20 bp, Artificial
  CRISPR gRNA sequence
agtcatgatgatttctttaa

SEQ ID NO: 200324 - DNA, 20 bp, Artificial
  CRISPR gRNA sequence
ctttaatatcttggaacaca

SEQ ID NO: 200325 - DNA, 20 bp, Artificial
  CRISPR gRNA sequence
tttaatatcttggaacacag

SEQ ID NO: 200326 - DNA, 20 bp, Artificial
  CRISPR gRNA sequence
taatatcttggaacacagta

SEQ ID NO: 200327 - DNA, 20 bp, Artificial
  CRISPR gRNA sequence
aatatcttggaacacagtag

SEQ ID NO: 200328 - DNA, 20 bp, Artificial
  CRISPR gRNA sequence
atatcttggaacacagtaga

SEQ ID NO: 200329 - DNA, 20 bp, Artificial
  CRISPR gRNA sequence
ggaacacagtagatgcctga

SEQ ID NO: 200330 - DNA, 20 bp, Artificial
  CRISPR gRNA sequence
gaacacagtagatgcctgat

SEQ ID NO: 200331 - DNA, 20 bp, Artificial
  CRISPR gRNA sequence
atatttgcggatggactgga

SEQ ID NO: 200332 - DNA, 20 bp, Artificial
  CRISPR gRNA sequence
gcggatggactggagaaaaa

SEQ ID NO: 200333 - DNA, 20 bp, Artificial
  CRISPR gRNA sequence
cggatggactggagaaaaac

SEQ ID NO: 200334 - DNA, 20 bp, Artificial
  CRISPR gRNA sequence
gagaaaaactgaaagtataa

SEQ ID NO: 200335 - DNA, 20 bp, Artificial
  CRISPR gRNA sequence
aaagtataaaccacaacatc

SEQ ID NO: 200336 - DNA, 20 bp, Artificial
  CRISPR gRNA sequence
aagagatgtcatgaatggag

SEQ ID NO: 200337 - DNA, 20 bp, Artificial
  CRISPR gRNA sequence
aatctactttacaagtggta

SEQ ID NO: 200338 - DNA, 20 bp, Artificial
  CRISPR gRNA sequence
ctttacaagtggtatcttct

SEQ ID NO: 200339 - DNA, 20 bp, Artificial
  CRISPR gRNA sequence
tacaagtggtatcttcttga

SEQ ID NO: 200340 - DNA, 20 bp, Artificial
  CRISPR gRNA sequence
acaagtggtatcttcttgac

SEQ ID NO: 200341 - DNA, 20 bp, Artificial
  CRISPR gRNA sequence
caagtggtatcttcttgaca

SEQ ID NO: 200342 - DNA, 20 bp, Artificial
  CRISPR gRNA sequence
cttgacaatagtggcattac

SEQ ID NO: 200343 - DNA, 20 bp, Artificial
  CRISPR gRNA sequence
ttgacaatagtggcattacc

SEQ ID NO: 200344 - DNA, 20 bp, Artificial
  CRISPR gRNA sequence
gacaatagtggcattacctg

SEQ ID NO: 200345 - DNA, 20 bp, Artificial
  CRISPR gRNA sequence
acaatagtggcattacctga

SEQ ID NO: 200346 - DNA, 20 bp, Artificial
  CRISPR gRNA sequence
cctgagccagtatcagggac

SEQ ID NO: 200347 - DNA, 20 bp, Artificial
  CRISPR gRNA sequence
agccagtatcagggaccaga

SEQ ID NO: 200348 - DNA, 20 bp, Artificial
  CRISPR gRNA sequence
atacatttctcttaatcccc

SEQ ID NO: 200349 - DNA, 20 bp, Artificial
  CRISPR gRNA sequence
ctcttaatccccacatgatt

SEQ ID NO: 200350 - DNA, 20 bp, Artificial
  CRISPR gRNA sequence
tcttaatccccacatgattt

SEQ ID NO: 200351 - DNA, 20 bp, Artificial
  CRISPR gRNA sequence
ttaatccccacatgattttg

SEQ ID NO: 200352 - DNA, 20 bp, Artificial
  CRISPR gRNA sequence
aatccccacatgattttgtt

SEQ ID NO: 200353 - DNA, 20 bp, Artificial
  CRISPR gRNA sequence
atccccacatgattttgttt

SEQ ID NO: 200354 - DNA, 20 bp, Artificial
  CRISPR gRNA sequence
tgtttttgagtttatagtta

SEQ ID NO: 200355 - DNA, 20 bp, Artificial
  CRISPR gRNA sequence
gtttttgagtttatagttat

SEQ ID NO: 200356 - DNA, 20 bp, Artificial
  CRISPR gRNA sequence
tttttgagtttatagttatc

SEQ ID NO: 200357 - DNA, 20 bp, Artificial
  CRISPR gRNA sequence
ttgagtttatagttatcagt

SEQ ID NO: 200358 - DNA, 20 bp, Artificial
  CRISPR gRNA sequence
tgagtttatagttatcagtg

SEQ ID NO: 200359 - DNA, 20 bp, Artificial
  CRISPR gRNA sequence
gagtttatagttatcagtga

SEQ ID NO: 200360 - DNA, 20 bp, Artificial
  CRISPR gRNA sequence
agtttatagttatcagtgat

SEQ ID NO: 200361 - DNA, 20 bp, Artificial
  CRISPR gRNA sequence
atagttatcagtgatcattg

SEQ ID NO: 200362 - DNA, 20 bp, Artificial
  CRISPR gRNA sequence
tagttatcagtgatcattga

SEQ ID NO: 200363 - DNA, 20 bp, Artificial
  CRISPR gRNA sequence
tcagtgatcattgattaata

SEQ ID NO: 200364 - DNA, 20 bp, Artificial
  CRISPR gRNA sequence
attaataattgatcagtgat

SEQ ID NO: 200365 - DNA, 20 bp, Artificial
  CRISPR gRNA sequence
ataattgatcagtgatcagt

SEQ ID NO: 200366 - DNA, 20 bp, Artificial
  CRISPR gRNA sequence
atcagtgatcagtgacaaat

SEQ ID NO: 200367 - DNA, 20 bp, Artificial
  CRISPR gRNA sequence
tttctacttgtattgttagc

SEQ ID NO: 200368 - DNA, 20 bp, Artificial
  CRISPR gRNA sequence
ttctacttgtattgttagcc

SEQ ID NO: 200369 - DNA, 20 bp, Artificial
  CRISPR gRNA sequence
tctacttgtattgttagccc

SEQ ID NO: 200370 - DNA, 20 bp, Artificial
  CRISPR gRNA sequence
ctacttgtattgttagccct

SEQ ID NO: 200371 - DNA, 20 bp, Artificial
  CRISPR gRNA sequence
tacttgtattgttagccctc

SEQ ID NO: 200372 - DNA, 20 bp, Artificial
  CRISPR gRNA sequence
cttgtattgttagccctcag

SEQ ID NO: 200373 - DNA, 20 bp, Artificial
  CRISPR gRNA sequence
gtattgttagccctcagatt

SEQ ID NO: 200374 - DNA, 20 bp, Artificial
  CRISPR gRNA sequence
tattgttagccctcagattg

SEQ ID NO: 200375 - DNA, 20 bp, Artificial
  CRISPR gRNA sequence
ttagccctcagattgatggt

SEQ ID NO: 200376 - DNA, 20 bp, Artificial
  CRISPR gRNA sequence
gccctcagattgatggtagt

SEQ ID NO: 200377 - DNA, 20 bp, Artificial
  CRISPR gRNA sequence
agattgatggtagttagccc

SEQ ID NO: 200378 - DNA, 20 bp, Artificial
  CRISPR gRNA sequence
atggtagttagcccaggaat

SEQ ID NO: 200379 - DNA, 20 bp, Artificial
  CRISPR gRNA sequence
gcccaggaatggaaagacca

SEQ ID NO: 200380 - DNA, 20 bp, Artificial
  CRISPR gRNA sequence
aattctagtcaaatattaaa

SEQ ID NO: 200381 - DNA, 20 bp, Artificial
  CRISPR gRNA sequence
attctagtcaaatattaaaa

SEQ ID NO: 200382 - DNA, 20 bp, Artificial
  CRISPR gRNA sequence
tagtcaaatattaaaaggtc

SEQ ID NO: 200383 - DNA, 20 bp, Artificial
  CRISPR gRNA sequence
gtcaaatattaaaaggtcat

SEQ ID NO: 200384 - DNA, 20 bp, Artificial
  CRISPR gRNA sequence
aaaggtcatcatgtaaatga

SEQ ID NO: 200385 - DNA, 20 bp, Artificial
  CRISPR gRNA sequence
caactagaggggcagatttc

SEQ ID NO: 200386 - DNA, 20 bp, Artificial
  CRISPR gRNA sequence
gaggggcagatttcagctta

SEQ ID NO: 200387 - DNA, 20 bp, Artificial
  CRISPR gRNA sequence
cagcttactattagggagta

SEQ ID NO: 200388 - DNA, 20 bp, Artificial
  CRISPR gRNA sequence
agcttactattagggagtaa

SEQ ID NO: 200389 - DNA, 20 bp, Artificial
  CRISPR gRNA sequence
actattagggagtaatttca

SEQ ID NO: 200390 - DNA, 20 bp, Artificial
  CRISPR gRNA sequence
ctattagggagtaatttcaa

SEQ ID NO: 200391 - DNA, 20 bp, Artificial
  CRISPR gRNA sequence
ttagggagtaatttcaacag

SEQ ID NO: 200392 - DNA, 20 bp, Artificial
  CRISPR gRNA sequence
gggagtaatttcaacaggat

SEQ ID NO: 200393 - DNA, 20 bp, Artificial
  CRISPR gRNA sequence
caacaggatatggaagggat

SEQ ID NO: 200394 - DNA, 20 bp, Artificial
  CRISPR gRNA sequence
aacaggatatggaagggata

SEQ ID NO: 200395 - DNA, 20 bp, Artificial
  CRISPR gRNA sequence
tgggatatgacagggacgcc

SEQ ID NO: 200396 - DNA, 20 bp, Artificial
  CRISPR gRNA sequence
caggaaatataagaacagaa

SEQ ID NO: 200397 - DNA, 20 bp, Artificial
  CRISPR gRNA sequence
tgggggatttttgttctttg

SEQ ID NO: 200398 - DNA, 20 bp, Artificial
  CRISPR gRNA sequence
ggggatttttgttctttgtg

SEQ ID NO: 200399 - DNA, 20 bp, Artificial
  CRISPR gRNA sequence
ttgttctttgtgggagtttg

SEQ ID NO: 200400 - DNA, 20 bp, Artificial
  CRISPR gRNA sequence
tgttctttgtgggagtttgg

SEQ ID NO: 200401 - DNA, 20 bp, Artificial
  CRISPR gRNA sequence
gttctttgtgggagtttgga

SEQ ID NO: 200402 - DNA, 20 bp, Artificial
  CRISPR gRNA sequence
ttctttgtgggagtttggat

SEQ ID NO: 200403 - DNA, 20 bp, Artificial
  CRISPR gRNA sequence
tttgtgggagtttggattag

SEQ ID NO: 200404 - DNA, 20 bp, Artificial
  CRISPR gRNA sequence
tgtgggagtttggattagct

SEQ ID NO: 200405 - DNA, 20 bp, Artificial
  CRISPR gRNA sequence
gtgggagtttggattagctg

SEQ ID NO: 200406 - DNA, 20 bp, Artificial
  CRISPR gRNA sequence
tgggagtttggattagctgc

SEQ ID NO: 200407 - DNA, 20 bp, Artificial
  CRISPR gRNA sequence
ggattagctgctcctgcctg

SEQ ID NO: 200408 - DNA, 20 bp, Artificial
  CRISPR gRNA sequence
gattagctgctcctgcctgg

SEQ ID NO: 200409 - DNA, 20 bp, Artificial
  CRISPR gRNA sequence
gctgctcctgcctgggatcc

SEQ ID NO: 200410 - DNA, 20 bp, Artificial
  CRISPR gRNA sequence
ctcctgcctgggatcctttc

SEQ ID NO: 200411 - DNA, 20 bp, Artificial
  CRISPR gRNA sequence
ctgcctgggatcctttcagc

SEQ ID NO: 200412 - DNA, 20 bp, Artificial
  CRISPR gRNA sequence
cctgggatcctttcagctct

SEQ ID NO: 200413 - DNA, 20 bp, Artificial
  CRISPR gRNA sequence
ggatcctttcagctctcaat

SEQ ID NO: 200414 - DNA, 20 bp, Artificial
  CRISPR gRNA sequence
tcagctctcaattctgtgaa

SEQ ID NO: 200415 - DNA, 20 bp, Artificial
  CRISPR gRNA sequence
cagctctcaattctgtgaaa

SEQ ID NO: 200416 - DNA, 20 bp, Artificial
  CRISPR gRNA sequence
agctctcaattctgtgaaac

SEQ ID NO: 200417 - DNA, 20 bp, Artificial
  CRISPR gRNA sequence
tcaattctgtgaaactcaac

SEQ ID NO: 200418 - DNA, 20 bp, Artificial
  CRISPR gRNA sequence
aattctgtgaaactcaacaa

SEQ ID NO: 200419 - DNA, 20 bp, Artificial
  CRISPR gRNA sequence
tgtgaaactcaacaatgaaa

SEQ ID NO: 200420 - DNA, 20 bp, Artificial
  CRISPR gRNA sequence
tgaaactcaacaatgaaagc

SEQ ID NO: 200421 - DNA, 20 bp, Artificial
  CRISPR gRNA sequence
aacaatgaaagcagaggtgt

SEQ ID NO: 200422 - DNA, 20 bp, Artificial
  CRISPR gRNA sequence
tcctttacttagctagtgcc

SEQ ID NO: 200423 - DNA, 20 bp, Artificial
  CRISPR gRNA sequence
cctttacttagctagtgcca

SEQ ID NO: 200424 - DNA, 20 bp, Artificial
  CRISPR gRNA sequence
ctttacttagctagtgccaa

SEQ ID NO: 200425 - DNA, 20 bp, Artificial
  CRISPR gRNA sequence
tacttagctagtgccaacac

SEQ ID NO: 200426 - DNA, 20 bp, Artificial
  CRISPR gRNA sequence
acttagctagtgccaacaca

SEQ ID NO: 200427 - DNA, 20 bp, Artificial
  CRISPR gRNA sequence
cttagctagtgccaacacaa

SEQ ID NO: 200428 - DNA, 20 bp, Artificial
  CRISPR gRNA sequence
agctagtgccaacacaaaac

SEQ ID NO: 200429 - DNA, 20 bp, Artificial
  CRISPR gRNA sequence
gctagtgccaacacaaaact

SEQ ID NO: 200430 - DNA, 20 bp, Artificial
  CRISPR gRNA sequence
gtgccaacacaaaactttga

SEQ ID NO: 200431 - DNA, 20 bp, Artificial
  CRISPR gRNA sequence
tgaactcaagtgacctgata

SEQ ID NO: 200432 - DNA, 20 bp, Artificial
  CRISPR gRNA sequence
gaactcaagtgacctgataa

SEQ ID NO: 200433 - DNA, 20 bp, Artificial
  CRISPR gRNA sequence
aactcaagtgacctgataac

SEQ ID NO: 200434 - DNA, 20 bp, Artificial
  CRISPR gRNA sequence
aagtgacctgataacataac

SEQ ID NO: 200435 - DNA, 20 bp, Artificial
  CRISPR gRNA sequence
ataacataactgtgggtcaa

SEQ ID NO: 200436 - DNA, 20 bp, Artificial
  CRISPR gRNA sequence
tgggtcaataccgaggaact

SEQ ID NO: 200437 - DNA, 20 bp, Artificial
  CRISPR gRNA sequence
acactcctagttccttttca

SEQ ID NO: 200438 - DNA, 20 bp, Artificial
  CRISPR gRNA sequence
ctagttccttttcaattccc

SEQ ID NO: 200439 - DNA, 20 bp, Artificial
  CRISPR gRNA sequence
gttccttttcaattccccaa

SEQ ID NO: 200440 - DNA, 20 bp, Artificial
  CRISPR gRNA sequence
cttttcaattccccaagaca

SEQ ID NO: 200441 - DNA, 20 bp, Artificial
  CRISPR gRNA sequence
ttcaattccccaagacaaca

SEQ ID NO: 200442 - DNA, 20 bp, Artificial
  CRISPR gRNA sequence
tcaattccccaagacaacat

SEQ ID NO: 200443 - DNA, 20 bp, Artificial
  CRISPR gRNA sequence
caattccccaagacaacatc

SEQ ID NO: 200444 - DNA, 20 bp, Artificial
  CRISPR gRNA sequence
aattccccaagacaacatca

SEQ ID NO: 200445 - DNA, 20 bp, Artificial
  CRISPR gRNA sequence
cccaagacaacatcagtata

SEQ ID NO: 200446 - DNA, 20 bp, Artificial
  CRISPR gRNA sequence
tcaagatgaatatatgccca

SEQ ID NO: 200447 - DNA, 20 bp, Artificial
  CRISPR gRNA sequence
caagatgaatatatgcccag

SEQ ID NO: 200448 - DNA, 20 bp, Artificial
  CRISPR gRNA sequence
aagatgaatatatgcccagt

SEQ ID NO: 200449 - DNA, 20 bp, Artificial
  CRISPR gRNA sequence
atcctgtactggaagaatag

SEQ ID NO: 200450 - DNA, 20 bp, Artificial
  CRISPR gRNA sequence
tcctgtactggaagaatagg

SEQ ID NO: 200451 - DNA, 20 bp, Artificial
  CRISPR gRNA sequence
tactggaagaataggttctt

SEQ ID NO: 200452 - DNA, 20 bp, Artificial
  CRISPR gRNA sequence
gaagaataggttctttcaca

SEQ ID NO: 200453 - DNA, 20 bp, Artificial
  CRISPR gRNA sequence
tttcacacttaatgtgatta

SEQ ID NO: 200454 - DNA, 20 bp, Artificial
  CRISPR gRNA sequence
tcacacttaatgtgattatt

SEQ ID NO: 200455 - DNA, 20 bp, Artificial
  CRISPR gRNA sequence
cacacttaatgtgattattt

SEQ ID NO: 200456 - DNA, 20 bp, Artificial
  CRISPR gRNA sequence
acacttaatgtgattatttt

SEQ ID NO: 200457 - DNA, 20 bp, Artificial
  CRISPR gRNA sequence
aatgtgattattttttgtct

SEQ ID NO: 200458 - DNA, 20 bp, Artificial
  CRISPR gRNA sequence
atgtgattattttttgtctt

SEQ ID NO: 200459 - DNA, 20 bp, Artificial
  CRISPR gRNA sequence
ttttttgtcttcatagggtg

SEQ ID NO: 200460 - DNA, 20 bp, Artificial
  CRISPR gRNA sequence
tttgtcttcatagggtgact

SEQ ID NO: 200461 - DNA, 20 bp, Artificial
  CRISPR gRNA sequence
ttgtcttcatagggtgactt

SEQ ID NO: 200462 - DNA, 20 bp, Artificial
  CRISPR gRNA sequence
tgtcttcatagggtgacttc

SEQ ID NO: 200463 - DNA, 20 bp, Artificial
  CRISPR gRNA sequence
gtcttcatagggtgacttca

SEQ ID NO: 200464 - DNA, 20 bp, Artificial
  CRISPR gRNA sequence
tcttcatagggtgacttcaa

SEQ ID NO: 200465 - DNA, 20 bp, Artificial
  CRISPR gRNA sequence
catagggtgacttcaagtct

SEQ ID NO: 200466 - DNA, 20 bp, Artificial
  CRISPR gRNA sequence
atagggtgacttcaagtctt

SEQ ID NO: 200467 - DNA, 20 bp, Artificial
  CRISPR gRNA sequence
caagtcttttttaatgtgaa

SEQ ID NO: 200468 - DNA, 20 bp, Artificial
  CRISPR gRNA sequence
aagtcttttttaatgtgaac

SEQ ID NO: 200469 - DNA, 20 bp, Artificial
  CRISPR gRNA sequence
ttttaatgtgaaccttacag

SEQ ID NO: 200470 - DNA, 20 bp, Artificial
  CRISPR gRNA sequence
tttaatgtgaaccttacagt

SEQ ID NO: 200471 - DNA, 20 bp, Artificial
  CRISPR gRNA sequence
ttaatgtgaaccttacagtg

SEQ ID NO: 200472 - DNA, 20 bp, Artificial
  CRISPR gRNA sequence
taatgtgaaccttacagtgg

SEQ ID NO: 200473 - DNA, 20 bp, Artificial
  CRISPR gRNA sequence
aatgtgaaccttacagtggg

SEQ ID NO: 200474 - DNA, 20 bp, Artificial
  CRISPR gRNA sequence
atgtgaaccttacagtgggg

SEQ ID NO: 200475 - DNA, 20 bp, Artificial
  CRISPR gRNA sequence
acagtggggtttgttctgaa

SEQ ID NO: 200476 - DNA, 20 bp, Artificial
  CRISPR gRNA sequence
cagtggggtttgttctgaat

SEQ ID NO: 200477 - DNA, 20 bp, Artificial
  CRISPR gRNA sequence
gttctgaatatatttatttg

SEQ ID NO: 200478 - DNA, 20 bp, Artificial
  CRISPR gRNA sequence
ttctgaatatatttatttgc

SEQ ID NO: 200479 - DNA, 20 bp, Artificial
  CRISPR gRNA sequence
tgaatatatttatttgcatt

SEQ ID NO: 200480 - DNA, 20 bp, Artificial
  CRISPR gRNA sequence
aatatatttatttgcatttg

SEQ ID NO: 200481 - DNA, 20 bp, Artificial
  CRISPR gRNA sequence
atttgcatttgatatagaga

SEQ ID NO: 200482 - DNA, 20 bp, Artificial
  CRISPR gRNA sequence
tttgcatttgatatagagag

SEQ ID NO: 200483 - DNA, 20 bp, Artificial
  CRISPR gRNA sequence
gcatttgatatagagaggct

SEQ ID NO: 200484 - DNA, 20 bp, Artificial
  CRISPR gRNA sequence
catttgatatagagaggctc

SEQ ID NO: 200485 - DNA, 20 bp, Artificial
  CRISPR gRNA sequence
gatatagagaggctcaaaaa

SEQ ID NO: 200486 - DNA, 20 bp, Artificial
  CRISPR gRNA sequence
atatagagaggctcaaaaaa

SEQ ID NO: 200487 - DNA, 20 bp, Artificial
  CRISPR gRNA sequence
aaaaaaggaaaactgacgga

SEQ ID NO: 200488 - DNA, 20 bp, Artificial
  CRISPR gRNA sequence
acggacctaataaaataaaa

SEQ ID NO: 200489 - DNA, 20 bp, Artificial
  CRISPR gRNA sequence
ataaaataaaaaaatagtag

SEQ ID NO: 200490 - DNA, 20 bp, Artificial
  CRISPR gRNA sequence
aataaaaaaatttctggagg

SEQ ID NO: 200491 - DNA, 20 bp, Artificial
  CRISPR gRNA sequence
ctggagggacacacaaataa

SEQ ID NO: 200492 - DNA, 20 bp, Artificial
  CRISPR gRNA sequence
tggagggacacacaaataat

SEQ ID NO: 200493 - DNA, 20 bp, Artificial
  CRISPR gRNA sequence
gagggacacacaaataatgg

SEQ ID NO: 200494 - DNA, 20 bp, Artificial
  CRISPR gRNA sequence
ctctctctgcatgccatggg

SEQ ID NO: 200495 - DNA, 20 bp, Artificial
  CRISPR gRNA sequence
tctctgcatgccatgggaga

SEQ ID NO: 200496 - DNA, 20 bp, Artificial
  CRISPR gRNA sequence
tctgcatgccatgggagata

SEQ ID NO: 200497 - DNA, 20 bp, Artificial
  CRISPR gRNA sequence
tgcatgccatgggagatagt

SEQ ID NO: 200498 - DNA, 20 bp, Artificial
  CRISPR gRNA sequence
catgccatgggagatagtgg

SEQ ID NO: 200499 - DNA, 20 bp, Artificial
  CRISPR gRNA sequence
ttgcaattcatttgatctct

SEQ ID NO: 200500 - DNA, 20 bp, Artificial
  CRISPR gRNA sequence
tgcaattcatttgatctctt

SEQ ID NO: 200501 - DNA, 20 bp, Artificial
  CRISPR gRNA sequence
gcaattcatttgatctcttc

SEQ ID NO: 200502 - DNA, 20 bp, Artificial
  CRISPR gRNA sequence
caattcatttgatctcttcc

SEQ ID NO: 200503 - DNA, 20 bp, Artificial
  CRISPR gRNA sequence
atttgatctcttccacagta

SEQ ID NO: 200504 - DNA, 20 bp, Artificial
  CRISPR gRNA sequence
gatctcttccacagtatctg

SEQ ID NO: 200505 - DNA, 20 bp, Artificial
  CRISPR gRNA sequence
atctcttccacagtatctga

SEQ ID NO: 200506 - DNA, 20 bp, Artificial
  CRISPR gRNA sequence
ttccacagtatctgaattat

SEQ ID NO: 200507 - DNA, 20 bp, Artificial
  CRISPR gRNA sequence
ccacagtatctgaattattt

SEQ ID NO: 200508 - DNA, 20 bp, Artificial
  CRISPR gRNA sequence
cacagtatctgaattatttg

SEQ ID NO: 200509 - DNA, 20 bp, Artificial
  CRISPR gRNA sequence
aattatttgcaagtatacgt

SEQ ID NO: 200510 - DNA, 20 bp, Artificial
  CRISPR gRNA sequence
tttgcaagtatacgtattcc

SEQ ID NO: 200511 - DNA, 20 bp, Artificial
  CRISPR gRNA sequence
gcaagtatacgtattccatt

SEQ ID NO: 200512 - DNA, 20 bp, Artificial
  CRISPR gRNA sequence
caagtatacgtattccattt

SEQ ID NO: 200513 - DNA, 20 bp, Artificial
  CRISPR gRNA sequence
catttgtaataaaaaagtaa

SEQ ID NO: 200514 - DNA, 20 bp, Artificial
  CRISPR gRNA sequence
gtaataaaaaagtaaagact

SEQ ID NO: 200515 - DNA, 20 bp, Artificial
  CRISPR gRNA sequence
taataaaaaagtaaagacta

SEQ ID NO: 200516 - DNA, 20 bp, Artificial
  CRISPR gRNA sequence
gaaattctttttggaaaact

SEQ ID NO: 200517 - DNA, 20 bp, Artificial
  CRISPR gRNA sequence
tttttggaaaactgtacata

SEQ ID NO: 200518 - DNA, 20 bp, Artificial
  CRISPR gRNA sequence
tttggaaaactgtacatact

SEQ ID NO: 200519 - DNA, 20 bp, Artificial
  CRISPR gRNA sequence
ttggaaaactgtacatactg

SEQ ID NO: 200520 - DNA, 20 bp, Artificial
  CRISPR gRNA sequence
tggaaaactgtacatactgt

SEQ ID NO: 200521 - DNA, 20 bp, Artificial
  CRISPR gRNA sequence
ggaaaactgtacatactgta

SEQ ID NO: 200522 - DNA, 20 bp, Artificial
  CRISPR gRNA sequence
gaaaactgtacatactgtag

SEQ ID NO: 200523 - DNA, 20 bp, Artificial
  CRISPR gRNA sequence
tacatactgtagaacatggc

SEQ ID NO: 200524 - DNA, 20 bp, Artificial
  CRISPR gRNA sequence
tagaacatggctctgtgttg

SEQ ID NO: 200525 - DNA, 20 bp, Artificial
  CRISPR gRNA sequence
tgtgttgtttgtctctggat

SEQ ID NO: 200526 - DNA, 20 bp, Artificial
  CRISPR gRNA sequence
tgttgtttgtctctggattt

SEQ ID NO: 200527 - DNA, 20 bp, Artificial
  CRISPR gRNA sequence
tttgtctctggatttccagt

SEQ ID NO: 200528 - DNA, 20 bp, Artificial
  CRISPR gRNA sequence
gtctctggatttccagtgac

SEQ ID NO: 200529 - DNA, 20 bp, Artificial
  CRISPR gRNA sequence
tctctggatttccagtgact

SEQ ID NO: 200530 - DNA, 20 bp, Artificial
  CRISPR gRNA sequence
tggatttccagtgactatca

SEQ ID NO: 200531 - DNA, 20 bp, Artificial
  CRISPR gRNA sequence
gatttccagtgactatcaaa

SEQ ID NO: 200532 - DNA, 20 bp, Artificial
  CRISPR gRNA sequence
ccagtgactatcaaataggt

SEQ ID NO: 200533 - DNA, 20 bp, Artificial
  CRISPR gRNA sequence
cagtgactatcaaataggtg

SEQ ID NO: 200534 - DNA, 20 bp, Artificial
  CRISPR gRNA sequence
tcaaataggtgctcaagaaa

SEQ ID NO: 200535 - DNA, 20 bp, Artificial
  CRISPR gRNA sequence
aagaaattggataattatgt

SEQ ID NO: 200536 - DNA, 20 bp, Artificial
  CRISPR gRNA sequence
gataattatgtgaatgaatt

SEQ ID NO: 200537 - DNA, 20 bp, Artificial
  CRISPR gRNA sequence
tgtgaatgaattcatgaatt

SEQ ID NO: 200538 - DNA, 20 bp, Artificial
  CRISPR gRNA sequence
atgaattgaatgaatgaatg

SEQ ID NO: 200539 - DNA, 20 bp, Artificial
  CRISPR gRNA sequence
aatgaatgaatgaacagact

SEQ ID NO: 200540 - DNA, 20 bp, Artificial
  CRISPR gRNA sequence
tgctgttctgtttgaaaata

SEQ ID NO: 200541 - DNA, 20 bp, Artificial
  CRISPR gRNA sequence
ttctgtttgaaaataagtat

SEQ ID NO: 200542 - DNA, 20 bp, Artificial
  CRISPR gRNA sequence
tgtttgaaaataagtatgga

SEQ ID NO: 200543 - DNA, 20 bp, Artificial
  CRISPR gRNA sequence
tttgaaaataagtatggact

SEQ ID NO: 200544 - DNA, 20 bp, Artificial
  CRISPR gRNA sequence
gaaaataagtatggacttac

SEQ ID NO: 200545 - DNA, 20 bp, Artificial
  CRISPR gRNA sequence
aaaataagtatggacttaca

SEQ ID NO: 200546 - DNA, 20 bp, Artificial
  CRISPR gRNA sequence
acaagaatgaaaagtcttca

SEQ ID NO: 200547 - DNA, 20 bp, Artificial
  CRISPR gRNA sequence
caagaatgaaaagtcttcaa

SEQ ID NO: 200548 - DNA, 20 bp, Artificial
  CRISPR gRNA sequence
caacacttggaatatgtttt

SEQ ID NO: 200549 - DNA, 20 bp, Artificial
  CRISPR gRNA sequence
aacacttggaatatgttttc

SEQ ID NO: 200550 - DNA, 20 bp, Artificial
  CRISPR gRNA sequence
ggaatatgttttcaataaag

SEQ ID NO: 200551 - DNA, 20 bp, Artificial
  CRISPR gRNA sequence
gaatatgttttcaataaaga

SEQ ID NO: 200552 - DNA, 20 bp, Artificial
  CRISPR gRNA sequence
tcaataaagatcaggcctct

SEQ ID NO: 200553 - DNA, 20 bp, Artificial
  CRISPR gRNA sequence
caataaagatcaggcctctc

SEQ ID NO: 200554 - DNA, 20 bp, Artificial
  CRISPR gRNA sequence
aataaagatcaggcctctca

SEQ ID NO: 200555 - DNA, 20 bp, Artificial
  CRISPR gRNA sequence
tcatctataataattcttac

SEQ ID NO: 200556 - DNA, 20 bp, Artificial
  CRISPR gRNA sequence
atctataataattcttacca

SEQ ID NO: 200557 - DNA, 20 bp, Artificial
  CRISPR gRNA sequence
taataattcttaccattgac

SEQ ID NO: 200558 - DNA, 20 bp, Artificial
  CRISPR gRNA sequence
ttaccattgactttcacagt

SEQ ID NO: 200559 - DNA, 20 bp, Artificial
  CRISPR gRNA sequence
accattgactttcacagtaa

SEQ ID NO: 200560 - DNA, 20 bp, Artificial
  CRISPR gRNA sequence
ccattgactttcacagtaat

SEQ ID NO: 200561 - DNA, 20 bp, Artificial
  CRISPR gRNA sequence
actttcacagtaattcgctt

SEQ ID NO: 200562 - DNA, 20 bp, Artificial
  CRISPR gRNA sequence
tcacagtaattcgcttgtag

SEQ ID NO: 200563 - DNA, 20 bp, Artificial
  CRISPR gRNA sequence
cacagtaattcgcttgtagt

SEQ ID NO: 200564 - DNA, 20 bp, Artificial
  CRISPR gRNA sequence
acagtaattcgcttgtagtc

SEQ ID NO: 200565 - DNA, 20 bp, Artificial
  CRISPR gRNA sequence
gcttgtagtcggcaccacca

SEQ ID NO: 200566 - DNA, 20 bp, Artificial
  CRISPR gRNA sequence
gtagtcggcaccaccatagc

SEQ ID NO: 200567 - DNA, 20 bp, Artificial
  CRISPR gRNA sequence
tagtcggcaccaccatagct

SEQ ID NO: 200568 - DNA, 20 bp, Artificial
  CRISPR gRNA sequence
atcatgcagcggtacacccc

SEQ ID NO: 200569 - DNA, 20 bp, Artificial
  CRISPR gRNA sequence
catcctgcaatttcacatct

SEQ ID NO: 200570 - DNA, 20 bp, Artificial
  CRISPR gRNA sequence
caatttcacatctgtgatct

SEQ ID NO: 200571 - DNA, 20 bp, Artificial
  CRISPR gRNA sequence
cacatctgtgatctgaagtg

SEQ ID NO: 200572 - DNA, 20 bp, Artificial
  CRISPR gRNA sequence
acatctgtgatctgaagtgc

SEQ ID NO: 200573 - DNA, 20 bp, Artificial
  CRISPR gRNA sequence
tgatctgaagtgcagcattt

SEQ ID NO: 200574 - DNA, 20 bp, Artificial
  CRISPR gRNA sequence
aagtgcagcatttcccaggg

SEQ ID NO: 200575 - DNA, 20 bp, Artificial
  CRISPR gRNA sequence
cccagggagagctggtcctt

SEQ ID NO: 200576 - DNA, 20 bp, Artificial
  CRISPR gRNA sequence
ccagggagagctggtccttc

SEQ ID NO: 200577 - DNA, 20 bp, Artificial
  CRISPR gRNA sequence
gtccttcaacagccgggccc

SEQ ID NO: 200578 - DNA, 20 bp, Artificial
  CRISPR gRNA sequence
caacagccgggccctctgtc

SEQ ID NO: 200579 - DNA, 20 bp, Artificial
  CRISPR gRNA sequence
aacagccgggccctctgtct

SEQ ID NO: 200580 - DNA, 20 bp, Artificial
  CRISPR gRNA sequence
tgtctgtagctactatgctg

SEQ ID NO: 200581 - DNA, 20 bp, Artificial
  CRISPR gRNA sequence
tctgtagctactatgctgaa

SEQ ID NO: 200582 - DNA, 20 bp, Artificial
  CRISPR gRNA sequence
tagctactatgctgaacctt

SEQ ID NO: 200583 - DNA, 20 bp, Artificial
  CRISPR gRNA sequence
ctatgctgaaccttcaggtc

SEQ ID NO: 200584 - DNA, 20 bp, Artificial
  CRISPR gRNA sequence
tgctgaaccttcaggtcttc

SEQ ID NO: 200585 - DNA, 20 bp, Artificial
  CRISPR gRNA sequence
aaccttcaggtcttcctctc

SEQ ID NO: 200586 - DNA, 20 bp, Artificial
  CRISPR gRNA sequence
caggtcttcctctccatgca

SEQ ID NO: 200587 - DNA, 20 bp, Artificial
  CRISPR gRNA sequence
aggtcttcctctccatgcac

SEQ ID NO: 200588 - DNA, 20 bp, Artificial
  CRISPR gRNA sequence
cctctccatgcacaaattga

SEQ ID NO: 200589 - DNA, 20 bp, Artificial
  CRISPR gRNA sequence
ctctccatgcacaaattgaa

SEQ ID NO: 200590 - DNA, 20 bp, Artificial
  CRISPR gRNA sequence
tccatgcacaaattgaataa

SEQ ID NO: 200591 - DNA, 20 bp, Artificial
  CRISPR gRNA sequence
catgcacaaattgaataatg

SEQ ID NO: 200592 - DNA, 20 bp, Artificial
  CRISPR gRNA sequence
aataatgttcttatcctcca

SEQ ID NO: 200593 - DNA, 20 bp, Artificial
  CRISPR gRNA sequence
ttatcctccatttcccaata

SEQ ID NO: 200594 - DNA, 20 bp, Artificial
  CRISPR gRNA sequence
atcctccatttcccaataga

SEQ ID NO: 200595 - DNA, 20 bp, Artificial
  CRISPR gRNA sequence
tcctccatttcccaatagac

SEQ ID NO: 200596 - DNA, 20 bp, Artificial
  CRISPR gRNA sequence
catttcccaatagacaatta

SEQ ID NO: 200597 - DNA, 20 bp, Artificial
  CRISPR gRNA sequence
cccaatagacaattagtgca

SEQ ID NO: 200598 - DNA, 20 bp, Artificial
  CRISPR gRNA sequence
ccaatagacaattagtgcag

SEQ ID NO: 200599 - DNA, 20 bp, Artificial
  CRISPR gRNA sequence
gtgcagccaggtctaattgt

SEQ ID NO: 200600 - DNA, 20 bp, Artificial
  CRISPR gRNA sequence
attgtttttctactgggaat

SEQ ID NO: 200601 - DNA, 20 bp, Artificial
  CRISPR gRNA sequence
tttttctactgggaatttgc

SEQ ID NO: 200602 - DNA, 20 bp, Artificial
  CRISPR gRNA sequence
ttctactgggaatttgcatt

SEQ ID NO: 200603 - DNA, 20 bp, Artificial
  CRISPR gRNA sequence
tctactgggaatttgcattc

SEQ ID NO: 200604 - DNA, 20 bp, Artificial
  CRISPR gRNA sequence
ctactgggaatttgcattca

SEQ ID NO: 200605 - DNA, 20 bp, Artificial
  CRISPR gRNA sequence
tactgggaatttgcattcaa

SEQ ID NO: 200606 - DNA, 20 bp, Artificial
  CRISPR gRNA sequence
ctgggaatttgcattcaatt

SEQ ID NO: 200607 - DNA, 20 bp, Artificial
  CRISPR gRNA sequence
ggaatttgcattcaattgtc

SEQ ID NO: 200608 - DNA, 20 bp, Artificial
  CRISPR gRNA sequence
gcattcaattgtcatattgc

SEQ ID NO: 200609 - DNA, 20 bp, Artificial
  CRISPR gRNA sequence
cattcaattgtcatattgct

SEQ ID NO: 200610 - DNA, 20 bp, Artificial
  CRISPR gRNA sequence
aattgtcatattgctaccat

SEQ ID NO: 200611 - DNA, 20 bp, Artificial
  CRISPR gRNA sequence
tcatattgctaccatactct

SEQ ID NO: 200612 - DNA, 20 bp, Artificial
  CRISPR gRNA sequence
ctaccatactctaccacata

SEQ ID NO: 200613 - DNA, 20 bp, Artificial
  CRISPR gRNA sequence
ccatactctaccacatatag

SEQ ID NO: 200614 - DNA, 20 bp, Artificial
  CRISPR gRNA sequence
taccacatataggtccttgg

SEQ ID NO: 200615 - DNA, 20 bp, Artificial
  CRISPR gRNA sequence
ccacatataggtccttggga

SEQ ID NO: 200616 - DNA, 20 bp, Artificial
  CRISPR gRNA sequence
gggaaccgtgacagtaaatg

SEQ ID NO: 200617 - DNA, 20 bp, Artificial
  CRISPR gRNA sequence
ggaaccgtgacagtaaatgc

SEQ ID NO: 200618 - DNA, 20 bp, Artificial
  CRISPR gRNA sequence
aaaagaaagaaggacaatct

SEQ ID NO: 200619 - DNA, 20 bp, Artificial
  CRISPR gRNA sequence
cagaaaagggaaaattcctc

SEQ ID NO: 200620 - DNA, 20 bp, Artificial
  CRISPR gRNA sequence
agaaaagggaaaattcctcg

SEQ ID NO: 200621 - DNA, 20 bp, Artificial
  CRISPR gRNA sequence
ctcgaaacatttacaaaatt

SEQ ID NO: 200622 - DNA, 20 bp, Artificial
  CRISPR gRNA sequence
gaaacatttacaaaattggc

SEQ ID NO: 200623 - DNA, 20 bp, Artificial
  CRISPR gRNA sequence
acaaaattggcacagcgttt

SEQ ID NO: 200624 - DNA, 20 bp, Artificial
  CRISPR gRNA sequence
caaaattggcacagcgttta

SEQ ID NO: 200625 - DNA, 20 bp, Artificial
  CRISPR gRNA sequence
gcacagcgtttataaatcac

SEQ ID NO: 200626 - DNA, 20 bp, Artificial
  CRISPR gRNA sequence
ataaatcactttatctggtc

SEQ ID NO: 200627 - DNA, 20 bp, Artificial
  CRISPR gRNA sequence
taaatcactttatctggtcg

SEQ ID NO: 200628 - DNA, 20 bp, Artificial
  CRISPR gRNA sequence
tatctggtcggttatgttat

SEQ ID NO: 200629 - DNA, 20 bp, Artificial
  CRISPR gRNA sequence
atctggtcggttatgttatc

SEQ ID NO: 200630 - DNA, 20 bp, Artificial
  CRISPR gRNA sequence
tctggtcggttatgttatca

SEQ ID NO: 200631 - DNA, 20 bp, Artificial
  CRISPR gRNA sequence
gtcggttatgttatcattat

SEQ ID NO: 200632 - DNA, 20 bp, Artificial
  CRISPR gRNA sequence
tgttatcattatatttaaga

SEQ ID NO: 200633 - DNA, 20 bp, Artificial
  CRISPR gRNA sequence
tcattatatttaagaacttg

SEQ ID NO: 200634 - DNA, 20 bp, Artificial
  CRISPR gRNA sequence
tatttaagaacttgctaaac

SEQ ID NO: 200635 - DNA, 20 bp, Artificial
  CRISPR gRNA sequence
aagaacttgctaaacacata

SEQ ID NO: 200636 - DNA, 20 bp, Artificial
  CRISPR gRNA sequence
agaacttgctaaacacatat

SEQ ID NO: 200637 - DNA, 20 bp, Artificial
  CRISPR gRNA sequence
gctaaacacatattttatcc

SEQ ID NO: 200638 - DNA, 20 bp, Artificial
  CRISPR gRNA sequence
ctaaacacatattttatcca

SEQ ID NO: 200639 - DNA, 20 bp, Artificial
  CRISPR gRNA sequence
aacacatattttatccaatg

SEQ ID NO: 200640 - DNA, 20 bp, Artificial
  CRISPR gRNA sequence
tatccaatgggcttgaaata

SEQ ID NO: 200641 - DNA, 20 bp, Artificial
  CRISPR gRNA sequence
atccaatgggcttgaaatat

SEQ ID NO: 200642 - DNA, 20 bp, Artificial
  CRISPR gRNA sequence
tccaatgggcttgaaatatg

SEQ ID NO: 200643 - DNA, 20 bp, Artificial
  CRISPR gRNA sequence
gaaatatgttttgggacact

SEQ ID NO: 200644 - DNA, 20 bp, Artificial
  CRISPR gRNA sequence
aaatatgttttgggacacta

SEQ ID NO: 200645 - DNA, 20 bp, Artificial
  CRISPR gRNA sequence
tgggacactatatctcatgc

SEQ ID NO: 200646 - DNA, 20 bp, Artificial
  CRISPR gRNA sequence
gggacactatatctcatgct

SEQ ID NO: 200647 - DNA, 20 bp, Artificial
  CRISPR gRNA sequence
ggacactatatctcatgctg

SEQ ID NO: 200648 - DNA, 20 bp, Artificial
  CRISPR gRNA sequence
tatctcatgctgagacacag

SEQ ID NO: 200649 - DNA, 20 bp, Artificial
  CRISPR gRNA sequence
atgctgagacacagtgtccc

SEQ ID NO: 200650 - DNA, 20 bp, Artificial
  CRISPR gRNA sequence
agacacagtgtcccaatagc

SEQ ID NO: 200651 - DNA, 20 bp, Artificial
  CRISPR gRNA sequence
gctaaacaagttgcccccac

SEQ ID NO: 200652 - DNA, 20 bp, Artificial
  CRISPR gRNA sequence
aacaagttgcccccacaatt

SEQ ID NO: 200653 - DNA, 20 bp, Artificial
  CRISPR gRNA sequence
cccccacaatttataaacat

SEQ ID NO: 200654 - DNA, 20 bp, Artificial
  CRISPR gRNA sequence
ataaacatatattactgtat

SEQ ID NO: 200655 - DNA, 20 bp, Artificial
  CRISPR gRNA sequence
taaacatatattactgtata

SEQ ID NO: 200656 - DNA, 20 bp, Artificial
  CRISPR gRNA sequence
ctgtataaatattatatgga

SEQ ID NO: 200657 - DNA, 20 bp, Artificial
  CRISPR gRNA sequence
tataaatattatatggagat

SEQ ID NO: 200658 - DNA, 20 bp, Artificial
  CRISPR gRNA sequence
tatggagatggagtccttac

SEQ ID NO: 200659 - DNA, 20 bp, Artificial
  CRISPR gRNA sequence
acaaccagggagacttggtt

SEQ ID NO: 200660 - DNA, 20 bp, Artificial
  CRISPR gRNA sequence
caaccagggagacttggttt

SEQ ID NO: 200661 - DNA, 20 bp, Artificial
  CRISPR gRNA sequence
ggtttcatgtagacatcccc

SEQ ID NO: 200662 - DNA, 20 bp, Artificial
  CRISPR gRNA sequence
gtttcatgtagacatcccca

SEQ ID NO: 200663 - DNA, 20 bp, Artificial
  CRISPR gRNA sequence
catgtagacatccccagaat

SEQ ID NO: 200664 - DNA, 20 bp, Artificial
  CRISPR gRNA sequence
atgtagacatccccagaatg

SEQ ID NO: 200665 - DNA, 20 bp, Artificial
  CRISPR gRNA sequence
tgacaggacacctatttgct

SEQ ID NO: 200666 - DNA, 20 bp, Artificial
  CRISPR gRNA sequence
gacaggacacctatttgctt

SEQ ID NO: 200667 - DNA, 20 bp, Artificial
  CRISPR gRNA sequence
acaggacacctatttgcttc

SEQ ID NO: 200668 - DNA, 20 bp, Artificial
  CRISPR gRNA sequence
tttgcttcctacatagaggg

SEQ ID NO: 200669 - DNA, 20 bp, Artificial
  CRISPR gRNA sequence
gcttcctacatagagggaat

SEQ ID NO: 200670 - DNA, 20 bp, Artificial
  CRISPR gRNA sequence
cttcctacatagagggaatg

SEQ ID NO: 200671 - DNA, 20 bp, Artificial
  CRISPR gRNA sequence
cctacatagagggaatggta

SEQ ID NO: 200672 - DNA, 20 bp, Artificial
  CRISPR gRNA sequence
ctacatagagggaatggtag

SEQ ID NO: 200673 - DNA, 20 bp, Artificial
  CRISPR gRNA sequence
catagagggaatggtagatt

SEQ ID NO: 200674 - DNA, 20 bp, Artificial
  CRISPR gRNA sequence
taacagtcatctctttttac

SEQ ID NO: 200675 - DNA, 20 bp, Artificial
  CRISPR gRNA sequence
acagtcatctctttttactt

SEQ ID NO: 200676 - DNA, 20 bp, Artificial
  CRISPR gRNA sequence
tttttacttccctaaacttt

SEQ ID NO: 200677 - DNA, 20 bp, Artificial
  CRISPR gRNA sequence
tttacttccctaaacttttg

SEQ ID NO: 200678 - DNA, 20 bp, Artificial
  CRISPR gRNA sequence
ttacttccctaaacttttga

SEQ ID NO: 200679 - DNA, 20 bp, Artificial
  CRISPR gRNA sequence
tacttccctaaacttttgat

SEQ ID NO: 200680 - DNA, 20 bp, Artificial
  CRISPR gRNA sequence
acttccctaaacttttgatc

SEQ ID NO: 200681 - DNA, 20 bp, Artificial
  CRISPR gRNA sequence
cttccctaaacttttgatca

SEQ ID NO: 200682 - DNA, 20 bp, Artificial
  CRISPR gRNA sequence
ccctaaacttttgatcagtt

SEQ ID NO: 200683 - DNA, 20 bp, Artificial
  CRISPR gRNA sequence
cctaaacttttgatcagttt

SEQ ID NO: 200684 - DNA, 20 bp, Artificial
  CRISPR gRNA sequence
aacttttgatcagttttctg

SEQ ID NO: 200685 - DNA, 20 bp, Artificial
  CRISPR gRNA sequence
ttgatcagttttctggcaag

SEQ ID NO: 200686 - DNA, 20 bp, Artificial
  CRISPR gRNA sequence
tgatcagttttctggcaaga

SEQ ID NO: 200687 - DNA, 20 bp, Artificial
  CRISPR gRNA sequence
gatcagttttctggcaagaa

SEQ ID NO: 200688 - DNA, 20 bp, Artificial
  CRISPR gRNA sequence
atcagttttctggcaagaag

SEQ ID NO: 200689 - DNA, 20 bp, Artificial
  CRISPR gRNA sequence
tctggcaagaagtacattgg

SEQ ID NO: 200690 - DNA, 20 bp, Artificial
  CRISPR gRNA sequence
ctggcaagaagtacattggt

SEQ ID NO: 200691 - DNA, 20 bp, Artificial
  CRISPR gRNA sequence
tggcaagaagtacattggta

SEQ ID NO: 200692 - DNA, 20 bp, Artificial
  CRISPR gRNA sequence
gcaagaagtacattggtatg

SEQ ID NO: 200693 - DNA, 20 bp, Artificial
  CRISPR gRNA sequence
gtatggagttcaggaaagag

SEQ ID NO: 200694 - DNA, 20 bp, Artificial
  CRISPR gRNA sequence
aggaaagagcacagggtgat

SEQ ID NO: 200695 - DNA, 20 bp, Artificial
  CRISPR gRNA sequence
tgttagcctgacattttcca

SEQ ID NO: 200696 - DNA, 20 bp, Artificial
  CRISPR gRNA sequence
gcctgacattttccatgtat

SEQ ID NO: 200697 - DNA, 20 bp, Artificial
  CRISPR gRNA sequence
acattttccatgtatcttac

SEQ ID NO: 200698 - DNA, 20 bp, Artificial
  CRISPR gRNA sequence
tccatgtatcttacaattct

SEQ ID NO: 200699 - DNA, 20 bp, Artificial
  CRISPR gRNA sequence
ccatgtatcttacaattctt

SEQ ID NO: 200700 - DNA, 20 bp, Artificial
  CRISPR gRNA sequence
catgtatcttacaattcttc

SEQ ID NO: 200701 - DNA, 20 bp, Artificial
  CRISPR gRNA sequence
acaattcttccttaaagtat

SEQ ID NO: 200702 - DNA, 20 bp, Artificial
  CRISPR gRNA sequence
caattcttccttaaagtatc

SEQ ID NO: 200703 - DNA, 20 bp, Artificial
  CRISPR gRNA sequence
ttccttaaagtatcctcatc

SEQ ID NO: 200704 - DNA, 20 bp, Artificial
  CRISPR gRNA sequence
ccttaaagtatcctcatcag

SEQ ID NO: 200705 - DNA, 20 bp, Artificial
  CRISPR gRNA sequence
cttaaagtatcctcatcagg

SEQ ID NO: 200706 - DNA, 20 bp, Artificial
  CRISPR gRNA sequence
aaagtatcctcatcaggaaa

SEQ ID NO: 200707 - DNA, 20 bp, Artificial
  CRISPR gRNA sequence
aagtatcctcatcaggaaag

SEQ ID NO: 200708 - DNA, 20 bp, Artificial
  CRISPR gRNA sequence
atcaggaaaggcatgtcaca

SEQ ID NO: 200709 - DNA, 20 bp, Artificial
  CRISPR gRNA sequence
aaagatcaaaggatcttggc

SEQ ID NO: 200710 - DNA, 20 bp, Artificial
  CRISPR gRNA sequence
ggccttgttgaaagcaaaca

SEQ ID NO: 200711 - DNA, 20 bp, Artificial
  CRISPR gRNA sequence
gccttgttgaaagcaaacaa

SEQ ID NO: 200712 - DNA, 20 bp, Artificial
  CRISPR gRNA sequence
gttgaaagcaaacaaataaa

SEQ ID NO: 200713 - DNA, 20 bp, Artificial
  CRISPR gRNA sequence
ttgaaagcaaacaaataaat

SEQ ID NO: 200714 - DNA, 20 bp, Artificial
  CRISPR gRNA sequence
aaagcaaacaaataaatgta

SEQ ID NO: 200715 - DNA, 20 bp, Artificial
  CRISPR gRNA sequence
ccccagatattttcagtagt

SEQ ID NO: 200716 - DNA, 20 bp, Artificial
  CRISPR gRNA sequence
cccagatattttcagtagtt

SEQ ID NO: 200717 - DNA, 20 bp, Artificial
  CRISPR gRNA sequence
tcagtagttaaccctgggaa

SEQ ID NO: 200718 - DNA, 20 bp, Artificial
  CRISPR gRNA sequence
cagtagttaaccctgggaaa

SEQ ID NO: 200719 - DNA, 20 bp, Artificial
  CRISPR gRNA sequence
agtagttaaccctgggaaat

SEQ ID NO: 200720 - DNA, 20 bp, Artificial
  CRISPR gRNA sequence
accctgggaaatgggtaata

SEQ ID NO: 200721 - DNA, 20 bp, Artificial
  CRISPR gRNA sequence
ggaaatgggtaatagattat

SEQ ID NO: 200722 - DNA, 20 bp, Artificial
  CRISPR gRNA sequence
ttttgtgtctttcaatttgt

SEQ ID NO: 200723 - DNA, 20 bp, Artificial
  CRISPR gRNA sequence
tgtgtctttcaatttgtcta

SEQ ID NO: 200724 - DNA, 20 bp, Artificial
  CRISPR gRNA sequence
gtgtctttcaatttgtctat

SEQ ID NO: 200725 - DNA, 20 bp, Artificial
  CRISPR gRNA sequence
tgtctttcaatttgtctata

SEQ ID NO: 200726 - DNA, 20 bp, Artificial
  CRISPR gRNA sequence
tcaatttgtctatattctct

SEQ ID NO: 200727 - DNA, 20 bp, Artificial
  CRISPR gRNA sequence
caatttgtctatattctcta

SEQ ID NO: 200728 - DNA, 20 bp, Artificial
  CRISPR gRNA sequence
aatttgtctatattctctat

SEQ ID NO: 200729 - DNA, 20 bp, Artificial
  CRISPR gRNA sequence
gtctatattctctatatttt

SEQ ID NO: 200730 - DNA, 20 bp, Artificial
  CRISPR gRNA sequence
tctatattctctatattttt

SEQ ID NO: 200731 - DNA, 20 bp, Artificial
  CRISPR gRNA sequence
tattctctatatttttacaa

SEQ ID NO: 200732 - DNA, 20 bp, Artificial
  CRISPR gRNA sequence
tctatatttttacaaaatga

SEQ ID NO: 200733 - DNA, 20 bp, Artificial
  CRISPR gRNA sequence
tatatttttacaaaatgaca

SEQ ID NO: 200734 - DNA, 20 bp, Artificial
  CRISPR gRNA sequence
tatttttacaaaatgacaca

SEQ ID NO: 200735 - DNA, 20 bp, Artificial
  CRISPR gRNA sequence
ttacaaaatgacacaggtaa

SEQ ID NO: 200736 - DNA, 20 bp, Artificial
  CRISPR gRNA sequence
tacaaaatgacacaggtaac

SEQ ID NO: 200737 - DNA, 20 bp, Artificial
  CRISPR gRNA sequence
acaaaatgacacaggtaact

SEQ ID NO: 200738 - DNA, 20 bp, Artificial
  CRISPR gRNA sequence
caaaatgacacaggtaactt

SEQ ID NO: 200739 - DNA, 20 bp, Artificial
  CRISPR gRNA sequence
tatcattgcgtaaagtagaa

SEQ ID NO: 200740 - DNA, 20 bp, Artificial
  CRISPR gRNA sequence
atcattgcgtaaagtagaaa

SEQ ID NO: 200741 - DNA, 20 bp, Artificial
  CRISPR gRNA sequence
tcattgcgtaaagtagaaag

SEQ ID NO: 200742 - DNA, 20 bp, Artificial
  CRISPR gRNA sequence
cgtaaagtagaaagaagact

SEQ ID NO: 200743 - DNA, 20 bp, Artificial
  CRISPR gRNA sequence
tgccattgtgtaaagtagaa

SEQ ID NO: 200744 - DNA, 20 bp, Artificial
  CRISPR gRNA sequence
gccattgtgtaaagtagaag

SEQ ID NO: 200745 - DNA, 20 bp, Artificial
  CRISPR gRNA sequence
ccattgtgtaaagtagaaga

SEQ ID NO: 200746 - DNA, 20 bp, Artificial
  CRISPR gRNA sequence
tgtaaagtagaagaaagaat

SEQ ID NO: 200747 - DNA, 20 bp, Artificial
  CRISPR gRNA sequence
tctctataagaaaattgcat

SEQ ID NO: 200748 - DNA, 20 bp, Artificial
  CRISPR gRNA sequence
tctataagaaaattgcatgc

SEQ ID NO: 200749 - DNA, 20 bp, Artificial
  CRISPR gRNA sequence
tataagaaaattgcatgcat

SEQ ID NO: 200750 - DNA, 20 bp, Artificial
  CRISPR gRNA sequence
taagaaaattgcatgcattt

SEQ ID NO: 200751 - DNA, 20 bp, Artificial
  CRISPR gRNA sequence
catgcattttaaatgatcat

SEQ ID NO: 200752 - DNA, 20 bp, Artificial
  CRISPR gRNA sequence
taaatgatcattttagtttt

SEQ ID NO: 200753 - DNA, 20 bp, Artificial
  CRISPR gRNA sequence
aaatgatcattttagtttta

SEQ ID NO: 200754 - DNA, 20 bp, Artificial
  CRISPR gRNA sequence
aatgatcattttagttttaa

SEQ ID NO: 200755 - DNA, 20 bp, Artificial
  CRISPR gRNA sequence
tagttttaaactcatggtta

SEQ ID NO: 200756 - DNA, 20 bp, Artificial
  CRISPR gRNA sequence
agttttaaactcatggttaa

SEQ ID NO: 200757 - DNA, 20 bp, Artificial
  CRISPR gRNA sequence
gttttaaactcatggttaaa

SEQ ID NO: 200758 - DNA, 20 bp, Artificial
  CRISPR gRNA sequence
taaactcatggttaaaatat

SEQ ID NO: 200759 - DNA, 20 bp, Artificial
  CRISPR gRNA sequence
aaactcatggttaaaatatt

SEQ ID NO: 200760 - DNA, 20 bp, Artificial
  CRISPR gRNA sequence
aactcatggttaaaatattt

SEQ ID NO: 200761 - DNA, 20 bp, Artificial
  CRISPR gRNA sequence
atggttaaaatatttaaaat

SEQ ID NO: 200762 - DNA, 20 bp, Artificial
  CRISPR gRNA sequence
aaatatttaaaatatagaac

SEQ ID NO: 200763 - DNA, 20 bp, Artificial
  CRISPR gRNA sequence
aaaatatagaacctaatgga

SEQ ID NO: 200764 - DNA, 20 bp, Artificial
  CRISPR gRNA sequence
aaatatagaacctaatggaa

SEQ ID NO: 200765 - DNA, 20 bp, Artificial
  CRISPR gRNA sequence
atggaaggatttggtgtctt

SEQ ID NO: 200766 - DNA, 20 bp, Artificial
  CRISPR gRNA sequence
ggtgtcttaccgttcagcaa

SEQ ID NO: 200767 - DNA, 20 bp, Artificial
  CRISPR gRNA sequence
gtgtcttaccgttcagcaaa

SEQ ID NO: 200768 - DNA, 20 bp, Artificial
  CRISPR gRNA sequence
accgttcagcaaatgccagt

SEQ ID NO: 200769 - DNA, 20 bp, Artificial
  CRISPR gRNA sequence
ccgttcagcaaatgccagta

SEQ ID NO: 200770 - DNA, 20 bp, Artificial
  CRISPR gRNA sequence
agcaaatgccagtaggtcat

SEQ ID NO: 200771 - DNA, 20 bp, Artificial
  CRISPR gRNA sequence
atctttctggaatgccctaa

SEQ ID NO: 200772 - DNA, 20 bp, Artificial
  CRISPR gRNA sequence
tctggaatgccctaattatg

SEQ ID NO: 200773 - DNA, 20 bp, Artificial
  CRISPR gRNA sequence
ctggaatgccctaattatgg

SEQ ID NO: 200774 - DNA, 20 bp, Artificial
  CRISPR gRNA sequence
tggaatgccctaattatgga

SEQ ID NO: 200775 - DNA, 20 bp, Artificial
  CRISPR gRNA sequence
gaatgccctaattatggaaa

SEQ ID NO: 200776 - DNA, 20 bp, Artificial
  CRISPR gRNA sequence
attatggaaaacacgaaaag

SEQ ID NO: 200777 - DNA, 20 bp, Artificial
  CRISPR gRNA sequence
tggaaaacacgaaaagaaga

SEQ ID NO: 200778 - DNA, 20 bp, Artificial
  CRISPR gRNA sequence
cttcacttaataattaaaca

SEQ ID NO: 200779 - DNA, 20 bp, Artificial
  CRISPR gRNA sequence
cacttaataattaaacatac

SEQ ID NO: 200780 - DNA, 20 bp, Artificial
  CRISPR gRNA sequence
acttaataattaaacataca

SEQ ID NO: 200781 - DNA, 20 bp, Artificial
  CRISPR gRNA sequence
aataattaaacatacaatat

SEQ ID NO: 200782 - DNA, 20 bp, Artificial
  CRISPR gRNA sequence
ataattaaacatacaatatg

SEQ ID NO: 200783 - DNA, 20 bp, Artificial
  CRISPR gRNA sequence
aacatacaatatgacaatat

SEQ ID NO: 200784 - DNA, 20 bp, Artificial
  CRISPR gRNA sequence
gtgtagccaggactagcacc

SEQ ID NO: 200785 - DNA, 20 bp, Artificial
  CRISPR gRNA sequence
tgtagccaggactagcaccc

SEQ ID NO: 200786 - DNA, 20 bp, Artificial
  CRISPR gRNA sequence
gtgatgttttcactgcacca

SEQ ID NO: 200787 - DNA, 20 bp, Artificial
  CRISPR gRNA sequence
gatgttttcactgcaccatg

SEQ ID NO: 200788 - DNA, 20 bp, Artificial
  CRISPR gRNA sequence
aaaataattatgaaacacat

SEQ ID NO: 200789 - DNA, 20 bp, Artificial
  CRISPR gRNA sequence
taaaactctgctctaattaa

SEQ ID NO: 200790 - DNA, 20 bp, Artificial
  CRISPR gRNA sequence
tgctctaattaaaagcttat

SEQ ID NO: 200791 - DNA, 20 bp, Artificial
  CRISPR gRNA sequence
gctctaattaaaagcttatt

SEQ ID NO: 200792 - DNA, 20 bp, Artificial
  CRISPR gRNA sequence
tcattctttacattgttacc

SEQ ID NO: 200793 - DNA, 20 bp, Artificial
  CRISPR gRNA sequence
tacattgttacctagaatat

SEQ ID NO: 200794 - DNA, 20 bp, Artificial
  CRISPR gRNA sequence
cattaataaattaaattttt

SEQ ID NO: 200795 - DNA, 20 bp, Artificial
  CRISPR gRNA sequence
atttttcagaaatgtgcttg

SEQ ID NO: 200796 - DNA, 20 bp, Artificial
  CRISPR gRNA sequence
aatgtgcttgtggtctgctg

SEQ ID NO: 200797 - DNA, 20 bp, Artificial
  CRISPR gRNA sequence
gtgcttgtggtctgctgtag

SEQ ID NO: 200798 - DNA, 20 bp, Artificial
  CRISPR gRNA sequence
gtggtctgctgtagcagcaa

SEQ ID NO: 200799 - DNA, 20 bp, Artificial
  CRISPR gRNA sequence
tgctgtagcagcaatagaaa

SEQ ID NO: 200800 - DNA, 20 bp, Artificial
  CRISPR gRNA sequence
atagaaatagcccaacaaaa

SEQ ID NO: 200801 - DNA, 20 bp, Artificial
  CRISPR gRNA sequence
atagcttaaaatgttttatt

SEQ ID NO: 200802 - DNA, 20 bp, Artificial
  CRISPR gRNA sequence
attaagtatatataatatta

SEQ ID NO: 200803 - DNA, 20 bp, Artificial
  CRISPR gRNA sequence
ttaagtatatataatattac

SEQ ID NO: 200804 - DNA, 20 bp, Artificial
  CRISPR gRNA sequence
taagtatatataatattaca

SEQ ID NO: 200805 - DNA, 20 bp, Artificial
  CRISPR gRNA sequence
attacagggtaatatttaca

SEQ ID NO: 200806 - DNA, 20 bp, Artificial
  CRISPR gRNA sequence
atgtttttttttaaataaaa

SEQ ID NO: 200807 - DNA, 20 bp, Artificial
  CRISPR gRNA sequence
ttttaaataaaaaagtacct

SEQ ID NO: 200808 - DNA, 20 bp, Artificial
  CRISPR gRNA sequence
aataaaaaagtaccttggca

SEQ ID NO: 200809 - DNA, 20 bp, Artificial
  CRISPR gRNA sequence
aagtaccttggcaaagattg

SEQ ID NO: 200810 - DNA, 20 bp, Artificial
  CRISPR gRNA sequence
gcaaagattgcagatattca

SEQ ID NO: 200811 - DNA, 20 bp, Artificial
  CRISPR gRNA sequence
cagatattcaaagctttaaa

SEQ ID NO: 200812 - DNA, 20 bp, Artificial
  CRISPR gRNA sequence
ataaaaaaaaaaacctttaa

SEQ ID NO: 200813 - DNA, 20 bp, Artificial
  CRISPR gRNA sequence
aaaaacctttaacggtaaca

SEQ ID NO: 200814 - DNA, 20 bp, Artificial
  CRISPR gRNA sequence
acacagctgtaaaacaactt

SEQ ID NO: 200815 - DNA, 20 bp, Artificial
  CRISPR gRNA sequence
ttcaaatcactgcaaaaaaa

SEQ ID NO: 200816 - DNA, 20 bp, Artificial
  CRISPR gRNA sequence
aaaaaatggctactgacaaa

SEQ ID NO: 200817 - DNA, 20 bp, Artificial
  CRISPR gRNA sequence
cctttaattgctatgcaaaa

SEQ ID NO: 200818 - DNA, 20 bp, Artificial
  CRISPR gRNA sequence
ttgctatgcaaaaaagctcc

SEQ ID NO: 200819 - DNA, 20 bp, Artificial
  CRISPR gRNA sequence
gctatgcaaaaaagctccaa

SEQ ID NO: 200820 - DNA, 20 bp, Artificial
  CRISPR gRNA sequence
tatgcaaaaaagctccaaga

SEQ ID NO: 200821 - DNA, 20 bp, Artificial
  CRISPR gRNA sequence
atgcaaaaaagctccaagag

SEQ ID NO: 200822 - DNA, 20 bp, Artificial
  CRISPR gRNA sequence
ccaagagaggatcttgcaca

SEQ ID NO: 200823 - DNA, 20 bp, Artificial
  CRISPR gRNA sequence
gatcttgcacatagcaacac

SEQ ID NO: 200824 - DNA, 20 bp, Artificial
  CRISPR gRNA sequence
tcttgcacatagcaacactg

SEQ ID NO: 200825 - DNA, 20 bp, Artificial
  CRISPR gRNA sequence
acactggagttctctttatt

SEQ ID NO: 200826 - DNA, 20 bp, Artificial
  CRISPR gRNA sequence
ggagttctctttatttagaa

SEQ ID NO: 200827 - DNA, 20 bp, Artificial
  CRISPR gRNA sequence
tctttatttagaatggttaa

SEQ ID NO: 200828 - DNA, 20 bp, Artificial
  CRISPR gRNA sequence
taatagatatttatacgatg

SEQ ID NO: 200829 - DNA, 20 bp, Artificial
  CRISPR gRNA sequence
aatagatatttatacgatgt

SEQ ID NO: 200830 - DNA, 20 bp, Artificial
  CRISPR gRNA sequence
tgggatctaattctcaacaa

SEQ ID NO: 200831 - DNA, 20 bp, Artificial
  CRISPR gRNA sequence
aaaatgttttcttctctcac

SEQ ID NO: 200832 - DNA, 20 bp, Artificial
  CRISPR gRNA sequence
gtcatgataacaacactttt

SEQ ID NO: 200833 - DNA, 20 bp, Artificial
  CRISPR gRNA sequence
taacaacacttttaagattt

SEQ ID NO: 200834 - DNA, 20 bp, Artificial
  CRISPR gRNA sequence
agatttaagatgttgtctta

SEQ ID NO: 200835 - DNA, 20 bp, Artificial
  CRISPR gRNA sequence
atttaagatgttgtcttaca

SEQ ID NO: 200836 - DNA, 20 bp, Artificial
  CRISPR gRNA sequence
tttaagatgttgtcttacag

SEQ ID NO: 200837 - DNA, 20 bp, Artificial
  CRISPR gRNA sequence
taagatgttgtcttacagag

SEQ ID NO: 200838 - DNA, 20 bp, Artificial
  CRISPR gRNA sequence
tgttgtcttacagaggagct

SEQ ID NO: 200839 - DNA, 20 bp, Artificial
  CRISPR gRNA sequence
aatgctttctttttttcaaa

SEQ ID NO: 200840 - DNA, 20 bp, Artificial
  CRISPR gRNA sequence
tgctttctttttttcaaaaa

SEQ ID NO: 200841 - DNA, 20 bp, Artificial
  CRISPR gRNA sequence
tttcaaaaagagaaatttat

SEQ ID NO: 200842 - DNA, 20 bp, Artificial
  CRISPR gRNA sequence
aaaaagagaaatttatgaga

SEQ ID NO: 200843 - DNA, 20 bp, Artificial
  CRISPR gRNA sequence
agagaaatttatgagaaagc

SEQ ID NO: 200844 - DNA, 20 bp, Artificial
  CRISPR gRNA sequence
ggtcttcaatgatcttaatt

SEQ ID NO: 200845 - DNA, 20 bp, Artificial
  CRISPR gRNA sequence
atcttaattaagaactgtca

SEQ ID NO: 200846 - DNA, 20 bp, Artificial
  CRISPR gRNA sequence
attaagaactgtcaaagcta

SEQ ID NO: 200847 - DNA, 20 bp, Artificial
  CRISPR gRNA sequence
ttaagaactgtcaaagctaa

SEQ ID NO: 200848 - DNA, 20 bp, Artificial
  CRISPR gRNA sequence
agaactgtcaaagctaaagg

SEQ ID NO: 200849 - DNA, 20 bp, Artificial
  CRISPR gRNA sequence
ctaaaggcagaaaaactgcc

SEQ ID NO: 200850 - DNA, 20 bp, Artificial
  CRISPR gRNA sequence
actcactgctcatctcttca

SEQ ID NO: 200851 - DNA, 20 bp, Artificial
  CRISPR gRNA sequence
ctcatctcttcaaagttacc

SEQ ID NO: 200852 - DNA, 20 bp, Artificial
  CRISPR gRNA sequence
gttacctggattatccctat

SEQ ID NO: 200853 - DNA, 20 bp, Artificial
  CRISPR gRNA sequence
tcactgaaaatgacctaaca

SEQ ID NO: 200854 - DNA, 20 bp, Artificial
  CRISPR gRNA sequence
cactgaaaatgacctaacaa

SEQ ID NO: 200855 - DNA, 20 bp, Artificial
  CRISPR gRNA sequence
aatgacctaacaaaggaccc

SEQ ID NO: 200856 - DNA, 20 bp, Artificial
  CRISPR gRNA sequence
gacctaacaaaggaccccag

SEQ ID NO: 200857 - DNA, 20 bp, Artificial
  CRISPR gRNA sequence
acctaacaaaggaccccagc

SEQ ID NO: 200858 - DNA, 20 bp, Artificial
  CRISPR gRNA sequence
caaaggaccccagcaggtga

SEQ ID NO: 200859 - DNA, 20 bp, Artificial
  CRISPR gRNA sequence
aggaccccagcaggtgatgg

SEQ ID NO: 200860 - DNA, 20 bp, Artificial
  CRISPR gRNA sequence
ccccagcaggtgatggcagt

SEQ ID NO: 200861 - DNA, 20 bp, Artificial
  CRISPR gRNA sequence
gtaattttaaaatatgacac

SEQ ID NO: 200862 - DNA, 20 bp, Artificial
  CRISPR gRNA sequence
aaaatacaataaaaaataaa

SEQ ID NO: 200863 - DNA, 20 bp, Artificial
  CRISPR gRNA sequence
ttgcccgacaatcatttctc

SEQ ID NO: 200864 - DNA, 20 bp, Artificial
  CRISPR gRNA sequence
atttctccagtttccaacaa

SEQ ID NO: 200865 - DNA, 20 bp, Artificial
  CRISPR gRNA sequence
tttctccagtttccaacaac

SEQ ID NO: 200866 - DNA, 20 bp, Artificial
  CRISPR gRNA sequence
tttccaacaacaggtaaatt

SEQ ID NO: 200867 - DNA, 20 bp, Artificial
  CRISPR gRNA sequence
ttccaacaacaggtaaatta

SEQ ID NO: 200868 - DNA, 20 bp, Artificial
  CRISPR gRNA sequence
ccaacaacaggtaaattaag

SEQ ID NO: 200869 - DNA, 20 bp, Artificial
  CRISPR gRNA sequence
gtgtttccatacatacacca

SEQ ID NO: 200870 - DNA, 20 bp, Artificial
  CRISPR gRNA sequence
catttttgaatacccatttt

SEQ ID NO: 200871 - DNA, 20 bp, Artificial
  CRISPR gRNA sequence
ttgaatacccattttaagac

SEQ ID NO: 200872 - DNA, 20 bp, Artificial
  CRISPR gRNA sequence
gaatacccattttaagacaa

SEQ ID NO: 200873 - DNA, 20 bp, Artificial
  CRISPR gRNA sequence
attttaagacaagagaaacc

SEQ ID NO: 200874 - DNA, 20 bp, Artificial
  CRISPR gRNA sequence
ttaagacaagagaaacctag

SEQ ID NO: 200875 - DNA, 20 bp, Artificial
  CRISPR gRNA sequence
taagacaagagaaacctaga

SEQ ID NO: 200876 - DNA, 20 bp, Artificial
  CRISPR gRNA sequence
gaaacctagaaggttgatta

SEQ ID NO: 200877 - DNA, 20 bp, Artificial
  CRISPR gRNA sequence
acagcttaatttttattact

SEQ ID NO: 200878 - DNA, 20 bp, Artificial
  CRISPR gRNA sequence
cttaatttttattactgaga

SEQ ID NO: 200879 - DNA, 20 bp, Artificial
  CRISPR gRNA sequence
taatttttattactgagatg

SEQ ID NO: 200880 - DNA, 20 bp, Artificial
  CRISPR gRNA sequence
aatttttattactgagatgg

SEQ ID NO: 200881 - DNA, 20 bp, Artificial
  CRISPR gRNA sequence
tttttattactgagatggag

SEQ ID NO: 200882 - DNA, 20 bp, Artificial
  CRISPR gRNA sequence
gagtaaacttatcgtgtttt

SEQ ID NO: 200883 - DNA, 20 bp, Artificial
  CRISPR gRNA sequence
tatcgtgttttgagctttgt

SEQ ID NO: 200884 - DNA, 20 bp, Artificial
  CRISPR gRNA sequence
tgttagtgcaaataacaatt

SEQ ID NO: 200885 - DNA, 20 bp, Artificial
  CRISPR gRNA sequence
tagtgcaaataacaatttgg

SEQ ID NO: 200886 - DNA, 20 bp, Artificial
  CRISPR gRNA sequence
gtcacttactaaattgacta

SEQ ID NO: 200887 - DNA, 20 bp, Artificial
  CRISPR gRNA sequence
tgactatagcatcctgaaaa

SEQ ID NO: 200888 - DNA, 20 bp, Artificial
  CRISPR gRNA sequence
aaaagaaatatttccaatta

SEQ ID NO: 200889 - DNA, 20 bp, Artificial
  CRISPR gRNA sequence
aaagaaatatttccaattac

SEQ ID NO: 200890 - DNA, 20 bp, Artificial
  CRISPR gRNA sequence
aaatatttccaattacggga

SEQ ID NO: 200891 - DNA, 20 bp, Artificial
  CRISPR gRNA sequence
tattttaattctgacattct

SEQ ID NO: 200892 - DNA, 20 bp, Artificial
  CRISPR gRNA sequence
attttaattctgacattctt

SEQ ID NO: 200893 - DNA, 20 bp, Artificial
  CRISPR gRNA sequence
ttttaattctgacattctta

SEQ ID NO: 200894 - DNA, 20 bp, Artificial
  CRISPR gRNA sequence
gacattcttagggatttaaa

SEQ ID NO: 200895 - DNA, 20 bp, Artificial
  CRISPR gRNA sequence
tcttagggatttaaacagaa

SEQ ID NO: 200896 - DNA, 20 bp, Artificial
  CRISPR gRNA sequence
ggatttaaacagaatggacc

SEQ ID NO: 200897 - DNA, 20 bp, Artificial
  CRISPR gRNA sequence
atttaaacagaatggacctg

SEQ ID NO: 200898 - DNA, 20 bp, Artificial
  CRISPR gRNA sequence
cagaatggacctggagtttc

SEQ ID NO: 200899 - DNA, 20 bp, Artificial
  CRISPR gRNA sequence
agaatggacctggagtttcc

SEQ ID NO: 200900 - DNA, 20 bp, Artificial
  CRISPR gRNA sequence
aatggacctggagtttccag

SEQ ID NO: 200901 - DNA, 20 bp, Artificial
  CRISPR gRNA sequence
gagaaaaataatcacctttg

SEQ ID NO: 200902 - DNA, 20 bp, Artificial
  CRISPR gRNA sequence
agaaaaataatcacctttga

SEQ ID NO: 200903 - DNA, 20 bp, Artificial
  CRISPR gRNA sequence
taatcacctttgaaggtttt

SEQ ID NO: 200904 - DNA, 20 bp, Artificial
  CRISPR gRNA sequence
atcacctttgaaggttttta

SEQ ID NO: 200905 - DNA, 20 bp, Artificial
  CRISPR gRNA sequence
gtttttagagcatgtgaaat

SEQ ID NO: 200906 - DNA, 20 bp, Artificial
  CRISPR gRNA sequence
aaaaaaacaaaaaaaaaaaa

SEQ ID NO: 200907 - DNA, 20 bp, Artificial
  CRISPR gRNA sequence
aaacaaaaaaaaaaaacaga

SEQ ID NO: 200908 - DNA, 20 bp, Artificial
  CRISPR gRNA sequence
aaaaaaaaaaaacagaaaga

SEQ ID NO: 200909 - DNA, 20 bp, Artificial
  CRISPR gRNA sequence
cagaaagaaagaaaactctc

SEQ ID NO: 200910 - DNA, 20 bp, Artificial
  CRISPR gRNA sequence
ctcaagctcaccctattaaa

SEQ ID NO: 200911 - DNA, 20 bp, Artificial
  CRISPR gRNA sequence
aaaagtgataaatctaaata

SEQ ID NO: 200912 - DNA, 20 bp, Artificial
  CRISPR gRNA sequence
aatcatttaacttatgtacc

SEQ ID NO: 200913 - DNA, 20 bp, Artificial
  CRISPR gRNA sequence
ctgatgtatgcaaaacactg

SEQ ID NO: 200914 - DNA, 20 bp, Artificial
  CRISPR gRNA sequence
tgatgtatgcaaaacactgc

SEQ ID NO: 200915 - DNA, 20 bp, Artificial
  CRISPR gRNA sequence
tgtatgcaaaacactgcagg

SEQ ID NO: 200916 - DNA, 20 bp, Artificial
  CRISPR gRNA sequence
tatgcaaaacactgcaggaa

SEQ ID NO: 200917 - DNA, 20 bp, Artificial
  CRISPR gRNA sequence
tgcaaaacactgcaggaaga

SEQ ID NO: 200918 - DNA, 20 bp, Artificial
  CRISPR gRNA sequence
actgcaggaagagagaatga

SEQ ID NO: 200919 - DNA, 20 bp, Artificial
  CRISPR gRNA sequence
caggaagagagaatgaaaga

SEQ ID NO: 200920 - DNA, 20 bp, Artificial
  CRISPR gRNA sequence
agagagaatgaaagaaagaa

SEQ ID NO: 200921 - DNA, 20 bp, Artificial
  CRISPR gRNA sequence
aatgaaagaaagaaaagctc

SEQ ID NO: 200922 - DNA, 20 bp, Artificial
  CRISPR gRNA sequence
agaaagaaaagctctagcta

SEQ ID NO: 200923 - DNA, 20 bp, Artificial
  CRISPR gRNA sequence
aagaaaagctctagctatag

SEQ ID NO: 200924 - DNA, 20 bp, Artificial
  CRISPR gRNA sequence
agaaaagctctagctataga

SEQ ID NO: 200925 - DNA, 20 bp, Artificial
  CRISPR gRNA sequence
atagaaggaattttaaaatc

SEQ ID NO: 200926 - DNA, 20 bp, Artificial
  CRISPR gRNA sequence
tagaaggaattttaaaatca

SEQ ID NO: 200927 - DNA, 20 bp, Artificial
  CRISPR gRNA sequence
gaaggaattttaaaatcaag

SEQ ID NO: 200928 - DNA, 20 bp, Artificial
  CRISPR gRNA sequence
ggaattttaaaatcaaggag

SEQ ID NO: 200929 - DNA, 20 bp, Artificial
  CRISPR gRNA sequence
aattttaaaatcaaggagaa

SEQ ID NO: 200930 - DNA, 20 bp, Artificial
  CRISPR gRNA sequence
ttaaaatcaaggagaagagc

SEQ ID NO: 200931 - DNA, 20 bp, Artificial
  CRISPR gRNA sequence
taaaatcaaggagaagagca

SEQ ID NO: 200932 - DNA, 20 bp, Artificial
  CRISPR gRNA sequence
gagcaaggccaaaaaactaa

SEQ ID NO: 200933 - DNA, 20 bp, Artificial
  CRISPR gRNA sequence
gccaaaaaactaatagaact

SEQ ID NO: 200934 - DNA, 20 bp, Artificial
  CRISPR gRNA sequence
aaaaaactaatagaactaag

SEQ ID NO: 200935 - DNA, 20 bp, Artificial
  CRISPR gRNA sequence
aaaactaatagaactaagca

SEQ ID NO: 200936 - DNA, 20 bp, Artificial
  CRISPR gRNA sequence
gaactaagcagagatgcata

SEQ ID NO: 200937 - DNA, 20 bp, Artificial
  CRISPR gRNA sequence
cagagatgcataaagtacta

SEQ ID NO: 200938 - DNA, 20 bp, Artificial
  CRISPR gRNA sequence
agagatgcataaagtactat

SEQ ID NO: 200939 - DNA, 20 bp, Artificial
  CRISPR gRNA sequence
tgcataaagtactataggaa

SEQ ID NO: 200940 - DNA, 20 bp, Artificial
  CRISPR gRNA sequence
taaagtactataggaatggt

SEQ ID NO: 200941 - DNA, 20 bp, Artificial
  CRISPR gRNA sequence
tactataggaatggtaagtt

SEQ ID NO: 200942 - DNA, 20 bp, Artificial
  CRISPR gRNA sequence
ctataggaatggtaagttaa

SEQ ID NO: 200943 - DNA, 20 bp, Artificial
  CRISPR gRNA sequence
aatggtaagttaagagacaa

SEQ ID NO: 200944 - DNA, 20 bp, Artificial
  CRISPR gRNA sequence
tggtaagttaagagacaaaa

SEQ ID NO: 200945 - DNA, 20 bp, Artificial
  CRISPR gRNA sequence
taagttaagagacaaaagag

SEQ ID NO: 200946 - DNA, 20 bp, Artificial
  CRISPR gRNA sequence
gagacaaaagagcagctaca

SEQ ID NO: 200947 - DNA, 20 bp, Artificial
  CRISPR gRNA sequence
aaagagcagctacacagatg

SEQ ID NO: 200948 - DNA, 20 bp, Artificial
  CRISPR gRNA sequence
agagcagctacacagatgaa

SEQ ID NO: 200949 - DNA, 20 bp, Artificial
  CRISPR gRNA sequence
gagcagctacacagatgaag

SEQ ID NO: 200950 - DNA, 20 bp, Artificial
  CRISPR gRNA sequence
acagatgaagaggaactgca

SEQ ID NO: 200951 - DNA, 20 bp, Artificial
  CRISPR gRNA sequence
cagatgaagaggaactgcaa

SEQ ID NO: 200952 - DNA, 20 bp, Artificial
  CRISPR gRNA sequence
gatgaagaggaactgcaaag

SEQ ID NO: 200953 - DNA, 20 bp, Artificial
  CRISPR gRNA sequence
ctgcaaaggagaatgttttg

SEQ ID NO: 200954 - DNA, 20 bp, Artificial
  CRISPR gRNA sequence
tgcaaaggagaatgttttga

SEQ ID NO: 200955 - DNA, 20 bp, Artificial
  CRISPR gRNA sequence
caaaggagaatgttttgaag

SEQ ID NO: 200956 - DNA, 20 bp, Artificial
  CRISPR gRNA sequence
aggagaatgttttgaaggag

SEQ ID NO: 200957 - DNA, 20 bp, Artificial
  CRISPR gRNA sequence
gttttgaaggagaagacaaa

SEQ ID NO: 200958 - DNA, 20 bp, Artificial
  CRISPR gRNA sequence
aggagaagacaaatagaatt

SEQ ID NO: 200959 - DNA, 20 bp, Artificial
  CRISPR gRNA sequence
agacaaatagaatttggcaa

SEQ ID NO: 200960 - DNA, 20 bp, Artificial
  CRISPR gRNA sequence
caaatagaatttggcaaaag

SEQ ID NO: 200961 - DNA, 20 bp, Artificial
  CRISPR gRNA sequence
tagaatttggcaaaagtagc

SEQ ID NO: 200962 - DNA, 20 bp, Artificial
  CRISPR gRNA sequence
atttggcaaaagtagctgga

SEQ ID NO: 200963 - DNA, 20 bp, Artificial
  CRISPR gRNA sequence
tttggcaaaagtagctggaa

SEQ ID NO: 200964 - DNA, 20 bp, Artificial
  CRISPR gRNA sequence
agtagctggaaaggttgttg

SEQ ID NO: 200965 - DNA, 20 bp, Artificial
  CRISPR gRNA sequence
ctggaaaggttgttgcagaa

SEQ ID NO: 200966 - DNA, 20 bp, Artificial
  CRISPR gRNA sequence
tggaaaggttgttgcagaaa

SEQ ID NO: 200967 - DNA, 20 bp, Artificial
  CRISPR gRNA sequence
ttgttgcagaaaaggacaaa

SEQ ID NO: 200968 - DNA, 20 bp, Artificial
  CRISPR gRNA sequence
aggacaaatggtgtcactgt

SEQ ID NO: 200969 - DNA, 20 bp, Artificial
  CRISPR gRNA sequence
acacaataaataaaactgaa

SEQ ID NO: 200970 - DNA, 20 bp, Artificial
  CRISPR gRNA sequence
caataaataaaactgaatgg

SEQ ID NO: 200971 - DNA, 20 bp, Artificial
  CRISPR gRNA sequence
ataaataaaactgaatggaa

SEQ ID NO: 200972 - DNA, 20 bp, Artificial
  CRISPR gRNA sequence
aaactgaatggaagagtcaa

SEQ ID NO: 200973 - DNA, 20 bp, Artificial
  CRISPR gRNA sequence
ctgaatggaagagtcaacag

SEQ ID NO: 200974 - DNA, 20 bp, Artificial
  CRISPR gRNA sequence
gaagagtcaacagcagaaac

SEQ ID NO: 200975 - DNA, 20 bp, Artificial
  CRISPR gRNA sequence
aagagtcaacagcagaaact

SEQ ID NO: 200976 - DNA, 20 bp, Artificial
  CRISPR gRNA sequence
tcaacagcagaaactgggat

SEQ ID NO: 200977 - DNA, 20 bp, Artificial
  CRISPR gRNA sequence
caacagcagaaactgggatc

SEQ ID NO: 200978 - DNA, 20 bp, Artificial
  CRISPR gRNA sequence
aacagcagaaactgggatca

SEQ ID NO: 200979 - DNA, 20 bp, Artificial
  CRISPR gRNA sequence
cagcagaaactgggatcagg

SEQ ID NO: 200980 - DNA, 20 bp, Artificial
  CRISPR gRNA sequence
aactgggatcagggagtaaa

SEQ ID NO: 200981 - DNA, 20 bp, Artificial
  CRISPR gRNA sequence
agggagtaaaaagcatatta

SEQ ID NO: 200982 - DNA, 20 bp, Artificial
  CRISPR gRNA sequence
gggagtaaaaagcatattat

SEQ ID NO: 200983 - DNA, 20 bp, Artificial
  CRISPR gRNA sequence
aagcatattatgggacaaaa

SEQ ID NO: 200984 - DNA, 20 bp, Artificial
  CRISPR gRNA sequence
gcaatttaaatgtgatgtga

SEQ ID NO: 200985 - DNA, 20 bp, Artificial
  CRISPR gRNA sequence
aaatgtgatgtgatggaatt

SEQ ID NO: 200986 - DNA, 20 bp, Artificial
  CRISPR gRNA sequence
aatgtgatgtgatggaattt

SEQ ID NO: 200987 - DNA, 20 bp, Artificial
  CRISPR gRNA sequence
tgtgatgtgatggaatttgg

SEQ ID NO: 200988 - DNA, 20 bp, Artificial
  CRISPR gRNA sequence
gccattacaaatctgattta

SEQ ID NO: 200989 - DNA, 20 bp, Artificial
  CRISPR gRNA sequence
cattacaaatctgatttaaa

SEQ ID NO: 200990 - DNA, 20 bp, Artificial
  CRISPR gRNA sequence
tacaaatctgatttaaagag

SEQ ID NO: 200991 - DNA, 20 bp, Artificial
  CRISPR gRNA sequence
acaaatctgatttaaagaga

SEQ ID NO: 200992 - DNA, 20 bp, Artificial
  CRISPR gRNA sequence
ctgatttaaagagaaggaac

SEQ ID NO: 200993 - DNA, 20 bp, Artificial
  CRISPR gRNA sequence
gaactggcccaatgatgccc

SEQ ID NO: 200994 - DNA, 20 bp, Artificial
  CRISPR gRNA sequence
ctggcccaatgatgcccaag

SEQ ID NO: 200995 - DNA, 20 bp, Artificial
  CRISPR gRNA sequence
tggcccaatgatgcccaagc

SEQ ID NO: 200996 - DNA, 20 bp, Artificial
  CRISPR gRNA sequence
gcccaatgatgcccaagcag

SEQ ID NO: 200997 - DNA, 20 bp, Artificial
  CRISPR gRNA sequence
cccaatgatgcccaagcagg

SEQ ID NO: 200998 - DNA, 20 bp, Artificial
  CRISPR gRNA sequence
caggaggactcctgcttctg

SEQ ID NO: 200999 - DNA, 20 bp, Artificial
  CRISPR gRNA sequence
tgcttctgtggtcacttatc

SEQ ID NO: 201000 - DNA, 20 bp, Artificial
  CRISPR gRNA sequence
cttctgtggtcacttatcca

SEQ ID NO: 201001 - DNA, 20 bp, Artificial
  CRISPR gRNA sequence
ctgtggtcacttatccagag

SEQ ID NO: 201002 - DNA, 20 bp, Artificial
  CRISPR gRNA sequence
tatccagagaagctgacaac

SEQ ID NO: 201003 - DNA, 20 bp, Artificial
  CRISPR gRNA sequence
cagagaagctgacaactagt

SEQ ID NO: 201004 - DNA, 20 bp, Artificial
  CRISPR gRNA sequence
gagaagctgacaactagtga

SEQ ID NO: 201005 - DNA, 20 bp, Artificial
  CRISPR gRNA sequence
agctgacaactagtgagagc

SEQ ID NO: 201006 - DNA, 20 bp, Artificial
  CRISPR gRNA sequence
ctgacaactagtgagagcaa

SEQ ID NO: 201007 - DNA, 20 bp, Artificial
  CRISPR gRNA sequence
caactagtgagagcaagagt

SEQ ID NO: 201008 - DNA, 20 bp, Artificial
  CRISPR gRNA sequence
gagcaagagttggtttcatc

SEQ ID NO: 201009 - DNA, 20 bp, Artificial
  CRISPR gRNA sequence
ggcatttcccccactatctc

SEQ ID NO: 201010 - DNA, 20 bp, Artificial
  CRISPR gRNA sequence
atttcccccactatctctgg

SEQ ID NO: 201011 - DNA, 20 bp, Artificial
  CRISPR gRNA sequence
ctatctctggtggcattgtc

SEQ ID NO: 201012 - DNA, 20 bp, Artificial
  CRISPR gRNA sequence
tatctctggtggcattgtct

SEQ ID NO: 201013 - DNA, 20 bp, Artificial
  CRISPR gRNA sequence
atctctggtggcattgtcta

SEQ ID NO: 201014 - DNA, 20 bp, Artificial
  CRISPR gRNA sequence
tctggtggcattgtctaggg

SEQ ID NO: 201015 - DNA, 20 bp, Artificial
  CRISPR gRNA sequence
tagggcagtgaatgcctcaa

SEQ ID NO: 201016 - DNA, 20 bp, Artificial
  CRISPR gRNA sequence
agggcagtgaatgcctcaaa

SEQ ID NO: 201017 - DNA, 20 bp, Artificial
  CRISPR gRNA sequence
gcagtgaatgcctcaaaagg

SEQ ID NO: 201018 - DNA, 20 bp, Artificial
  CRISPR gRNA sequence
cagtgaatgcctcaaaaggc

SEQ ID NO: 201019 - DNA, 20 bp, Artificial
  CRISPR gRNA sequence
tgaatgcctcaaaaggcagg

SEQ ID NO: 201020 - DNA, 20 bp, Artificial
  CRISPR gRNA sequence
tcaaaaggcaggcagcatta

SEQ ID NO: 201021 - DNA, 20 bp, Artificial
  CRISPR gRNA sequence
aaaaggcaggcagcattaaa

SEQ ID NO: 201022 - DNA, 20 bp, Artificial
  CRISPR gRNA sequence
cagcattaaagagaacacaa

SEQ ID NO: 201023 - DNA, 20 bp, Artificial
  CRISPR gRNA sequence
attaaagagaacacaatgga

SEQ ID NO: 201024 - DNA, 20 bp, Artificial
  CRISPR gRNA sequence
agagaacacaatggatggat

SEQ ID NO: 201025 - DNA, 20 bp, Artificial
  CRISPR gRNA sequence
acaatggatggatgagatcc

SEQ ID NO: 201026 - DNA, 20 bp, Artificial
  CRISPR gRNA sequence
aatggatggatgagatccaa

SEQ ID NO: 201027 - DNA, 20 bp, Artificial
  CRISPR gRNA sequence
agagcgaaccccaaataaat

SEQ ID NO: 201028 - DNA, 20 bp, Artificial
  CRISPR gRNA sequence
agcgaaccccaaataaatga

SEQ ID NO: 201029 - DNA, 20 bp, Artificial
  CRISPR gRNA sequence
gagagtttactacatattaa

SEQ ID NO: 201030 - DNA, 20 bp, Artificial
  CRISPR gRNA sequence
agagtttactacatattaaa

SEQ ID NO: 201031 - DNA, 20 bp, Artificial
  CRISPR gRNA sequence
catattaaaaggtacaactt

SEQ ID NO: 201032 - DNA, 20 bp, Artificial
  CRISPR gRNA sequence
ttataaaaaattttactata

SEQ ID NO: 201033 - DNA, 20 bp, Artificial
  CRISPR gRNA sequence
gattttcataccttttctaa

SEQ ID NO: 201034 - DNA, 20 bp, Artificial
  CRISPR gRNA sequence
attttcataccttttctaat

SEQ ID NO: 201035 - DNA, 20 bp, Artificial
  CRISPR gRNA sequence
tttcataccttttctaatag

SEQ ID NO: 201036 - DNA, 20 bp, Artificial
  CRISPR gRNA sequence
taccttttctaataggagct

SEQ ID NO: 201037 - DNA, 20 bp, Artificial
  CRISPR gRNA sequence
taggagcttggatctttttc

SEQ ID NO: 201038 - DNA, 20 bp, Artificial
  CRISPR gRNA sequence
ttcatcaaaactgattttta

SEQ ID NO: 201039 - DNA, 20 bp, Artificial
  CRISPR gRNA sequence
tgatttttaaagtaacaaac

SEQ ID NO: 201040 - DNA, 20 bp, Artificial
  CRISPR gRNA sequence
gatttttaaagtaacaaact

SEQ ID NO: 201041 - DNA, 20 bp, Artificial
  CRISPR gRNA sequence
tttaaagtaacaaactaggt

SEQ ID NO: 201042 - DNA, 20 bp, Artificial
  CRISPR gRNA sequence
tagcaaaatgtaaatatttt

SEQ ID NO: 201043 - DNA, 20 bp, Artificial
  CRISPR gRNA sequence
caaaatgtaaatattttcag

SEQ ID NO: 201044 - DNA, 20 bp, Artificial
  CRISPR gRNA sequence
aaaatgtaaatattttcaga

SEQ ID NO: 201045 - DNA, 20 bp, Artificial
  CRISPR gRNA sequence
taaatattttcagaaggaaa

SEQ ID NO: 201046 - DNA, 20 bp, Artificial
  CRISPR gRNA sequence
ttcagaaggaaaaagtgctg

SEQ ID NO: 201047 - DNA, 20 bp, Artificial
  CRISPR gRNA sequence
tcagaaggaaaaagtgctgc

SEQ ID NO: 201048 - DNA, 20 bp, Artificial
  CRISPR gRNA sequence
agaaggaaaaagtgctgcag

SEQ ID NO: 201049 - DNA, 20 bp, Artificial
  CRISPR gRNA sequence
aaaagtgctgcaggagccat

SEQ ID NO: 201050 - DNA, 20 bp, Artificial
  CRISPR gRNA sequence
ggagccatcagatttgtata

SEQ ID NO: 201051 - DNA, 20 bp, Artificial
  CRISPR gRNA sequence
gagccatcagatttgtataa

SEQ ID NO: 201052 - DNA, 20 bp, Artificial
  CRISPR gRNA sequence
cagatttgtataaaggaata

SEQ ID NO: 201053 - DNA, 20 bp, Artificial
  CRISPR gRNA sequence
ctctatatatgttattattt

SEQ ID NO: 201054 - DNA, 20 bp, Artificial
  CRISPR gRNA sequence
atatatgttattattttgga

SEQ ID NO: 201055 - DNA, 20 bp, Artificial
  CRISPR gRNA sequence
ttttggacagctacacaatc

SEQ ID NO: 201056 - DNA, 20 bp, Artificial
  CRISPR gRNA sequence
tttggacagctacacaatca

SEQ ID NO: 201057 - DNA, 20 bp, Artificial
  CRISPR gRNA sequence
ggacagctacacaatcaagg

SEQ ID NO: 201058 - DNA, 20 bp, Artificial
  CRISPR gRNA sequence
tgtatatacatacgtatata

SEQ ID NO: 201059 - DNA, 20 bp, Artificial
  CRISPR gRNA sequence
gtatacatattttttttttc

SEQ ID NO: 201060 - DNA, 20 bp, Artificial
  CRISPR gRNA sequence
tacatattttttttttcaag

SEQ ID NO: 201061 - DNA, 20 bp, Artificial
  CRISPR gRNA sequence
catattttttttttcaagaa

SEQ ID NO: 201062 - DNA, 20 bp, Artificial
  CRISPR gRNA sequence
ttcaagaagagctgtcttgc

SEQ ID NO: 201063 - DNA, 20 bp, Artificial
  CRISPR gRNA sequence
agctgtcttgctagtatgct

SEQ ID NO: 201064 - DNA, 20 bp, Artificial
  CRISPR gRNA sequence
gctagtatgctcagttttct

SEQ ID NO: 201065 - DNA, 20 bp, Artificial
  CRISPR gRNA sequence
tagtatgctcagttttctga

SEQ ID NO: 201066 - DNA, 20 bp, Artificial
  CRISPR gRNA sequence
agtatgctcagttttctgag

SEQ ID NO: 201067 - DNA, 20 bp, Artificial
  CRISPR gRNA sequence
ctcagttttctgagaggcct

SEQ ID NO: 201068 - DNA, 20 bp, Artificial
  CRISPR gRNA sequence
agttttctgagaggcctcag

SEQ ID NO: 201069 - DNA, 20 bp, Artificial
  CRISPR gRNA sequence
gttttctgagaggcctcagc

SEQ ID NO: 201070 - DNA, 20 bp, Artificial
  CRISPR gRNA sequence
gcctcagcaggtcataaatt

SEQ ID NO: 201071 - DNA, 20 bp, Artificial
  CRISPR gRNA sequence
cctcagcaggtcataaattt

SEQ ID NO: 201072 - DNA, 20 bp, Artificial
  CRISPR gRNA sequence
tcataaatttaggtttgcca

SEQ ID NO: 201073 - DNA, 20 bp, Artificial
  CRISPR gRNA sequence
cataaatttaggtttgccat

SEQ ID NO: 201074 - DNA, 20 bp, Artificial
  CRISPR gRNA sequence
tttgccatgggcaaactact

SEQ ID NO: 201075 - DNA, 20 bp, Artificial
  CRISPR gRNA sequence
atgaaatatgacaatcaatt

SEQ ID NO: 201076 - DNA, 20 bp, Artificial
  CRISPR gRNA sequence
tgacaatcaatttggcataa

SEQ ID NO: 201077 - DNA, 20 bp, Artificial
  CRISPR gRNA sequence
acaatcaatttggcataaaa

SEQ ID NO: 201078 - DNA, 20 bp, Artificial
  CRISPR gRNA sequence
caatcaatttggcataaaag

SEQ ID NO: 201079 - DNA, 20 bp, Artificial
  CRISPR gRNA sequence
tttggcataaaagaggcaca

SEQ ID NO: 201080 - DNA, 20 bp, Artificial
  CRISPR gRNA sequence
ttggcataaaagaggcacac

SEQ ID NO: 201081 - DNA, 20 bp, Artificial
  CRISPR gRNA sequence
aggcacacgggaacatctga

SEQ ID NO: 201082 - DNA, 20 bp, Artificial
  CRISPR gRNA sequence
acgggaacatctgatggact

SEQ ID NO: 201083 - DNA, 20 bp, Artificial
  CRISPR gRNA sequence
tgaatatcttattacacaaa

SEQ ID NO: 201084 - DNA, 20 bp, Artificial
  CRISPR gRNA sequence
gaatatcttattacacaaac

SEQ ID NO: 201085 - DNA, 20 bp, Artificial
  CRISPR gRNA sequence
tatcttattacacaaacagg

SEQ ID NO: 201086 - DNA, 20 bp, Artificial
  CRISPR gRNA sequence
ggaagaattacgtattttta

SEQ ID NO: 201087 - DNA, 20 bp, Artificial
  CRISPR gRNA sequence
gaagaattacgtatttttac

SEQ ID NO: 201088 - DNA, 20 bp, Artificial
  CRISPR gRNA sequence
aagaattacgtatttttaca

SEQ ID NO: 201089 - DNA, 20 bp, Artificial
  CRISPR gRNA sequence
tacgtatttttacagggtat

SEQ ID NO: 201090 - DNA, 20 bp, Artificial
  CRISPR gRNA sequence
tatttttacagggtattggt

SEQ ID NO: 201091 - DNA, 20 bp, Artificial
  CRISPR gRNA sequence
ttttacagggtattggtgag

SEQ ID NO: 201092 - DNA, 20 bp, Artificial
  CRISPR gRNA sequence
ggtattggtgagcagtcaaa

SEQ ID NO: 201093 - DNA, 20 bp, Artificial
  CRISPR gRNA sequence
tggtgagcagtcaaaaagcg

SEQ ID NO: 201094 - DNA, 20 bp, Artificial
  CRISPR gRNA sequence
aaaaagcgtggcaaattacc

SEQ ID NO: 201095 - DNA, 20 bp, Artificial
  CRISPR gRNA sequence
aagcgtggcaaattacctag

SEQ ID NO: 201096 - DNA, 20 bp, Artificial
  CRISPR gRNA sequence
aaattacctagaagttttaa

SEQ ID NO: 201097 - DNA, 20 bp, Artificial
  CRISPR gRNA sequence
ctagaagttttaaaagtttt

SEQ ID NO: 201098 - DNA, 20 bp, Artificial
  CRISPR gRNA sequence
aaatataattccacccaata

SEQ ID NO: 201099 - DNA, 20 bp, Artificial
  CRISPR gRNA sequence
tatttaaatgtttttactaa

SEQ ID NO: 201100 - DNA, 20 bp, Artificial
  CRISPR gRNA sequence
aattaacctttgctctcctg

SEQ ID NO: 201101 - DNA, 20 bp, Artificial
  CRISPR gRNA sequence
attaacctttgctctcctgt

SEQ ID NO: 201102 - DNA, 20 bp, Artificial
  CRISPR gRNA sequence
gtaccccacctttgtccata

SEQ ID NO: 201103 - DNA, 20 bp, Artificial
  CRISPR gRNA sequence
ccccacctttgtccatacag

SEQ ID NO: 201104 - DNA, 20 bp, Artificial
  CRISPR gRNA sequence
tacaaacacacatccacaaa

SEQ ID NO: 201105 - DNA, 20 bp, Artificial
  CRISPR gRNA sequence
acaaacacacatccacaaac

SEQ ID NO: 201106 - DNA, 20 bp, Artificial
  CRISPR gRNA sequence
aggtaaaaaacgaatgctaa

SEQ ID NO: 201107 - DNA, 20 bp, Artificial
  CRISPR gRNA sequence
aacgaatgctaaaagtctaa

SEQ ID NO: 201108 - DNA, 20 bp, Artificial
  CRISPR gRNA sequence
ctaaaagtctaaaagtactc

SEQ ID NO: 201109 - DNA, 20 bp, Artificial
  CRISPR gRNA sequence
taaaagtctaaaagtactcc

SEQ ID NO: 201110 - DNA, 20 bp, Artificial
  CRISPR gRNA sequence
ctccaggcgatcacaactgt

SEQ ID NO: 201111 - DNA, 20 bp, Artificial
  CRISPR gRNA sequence
aacattaattttcttctaac

SEQ ID NO: 201112 - DNA, 20 bp, Artificial
  CRISPR gRNA sequence
acattaattttcttctaacc

SEQ ID NO: 201113 - DNA, 20 bp, Artificial
  CRISPR gRNA sequence
taattttcttctaaccagga

SEQ ID NO: 201114 - DNA, 20 bp, Artificial
  CRISPR gRNA sequence
aattttcttctaaccaggat

SEQ ID NO: 201115 - DNA, 20 bp, Artificial
  CRISPR gRNA sequence
tctaaccaggataggaaatg

SEQ ID NO: 201116 - DNA, 20 bp, Artificial
  CRISPR gRNA sequence
ctaaccaggataggaaatgt

SEQ ID NO: 201117 - DNA, 20 bp, Artificial
  CRISPR gRNA sequence
ttttgtttacttttcaatca

SEQ ID NO: 201118 - DNA, 20 bp, Artificial
  CRISPR gRNA sequence
tttgtttacttttcaatcat

SEQ ID NO: 201119 - DNA, 20 bp, Artificial
  CRISPR gRNA sequence
ttgtttacttttcaatcata

SEQ ID NO: 201120 - DNA, 20 bp, Artificial
  CRISPR gRNA sequence
tgtttacttttcaatcatag

SEQ ID NO: 201121 - DNA, 20 bp, Artificial
  CRISPR gRNA sequence
ttacttttcaatcatagggg

SEQ ID NO: 201122 - DNA, 20 bp, Artificial
  CRISPR gRNA sequence
tacttttcaatcatagggga

SEQ ID NO: 201123 - DNA, 20 bp, Artificial
  CRISPR gRNA sequence
acttttcaatcataggggaa

SEQ ID NO: 201124 - DNA, 20 bp, Artificial
  CRISPR gRNA sequence
cttttcaatcataggggaag

SEQ ID NO: 201125 - DNA, 20 bp, Artificial
  CRISPR gRNA sequence
tttcaatcataggggaaggg

SEQ ID NO: 201126 - DNA, 20 bp, Artificial
  CRISPR gRNA sequence
tcataggggaaggggagtac

SEQ ID NO: 201127 - DNA, 20 bp, Artificial
  CRISPR gRNA sequence
cataggggaaggggagtacg

SEQ ID NO: 201128 - DNA, 20 bp, Artificial
  CRISPR gRNA sequence
aggggaaggggagtacgagg

SEQ ID NO: 201129 - DNA, 20 bp, Artificial
  CRISPR gRNA sequence
ggggaaggggagtacgaggc

SEQ ID NO: 201130 - DNA, 20 bp, Artificial
  CRISPR gRNA sequence
gggagtacgaggcaggacta

SEQ ID NO: 201131 - DNA, 20 bp, Artificial
  CRISPR gRNA sequence
ggagtacgaggcaggactac

SEQ ID NO: 201132 - DNA, 20 bp, Artificial
  CRISPR gRNA sequence
agtacgaggcaggactacag

SEQ ID NO: 201133 - DNA, 20 bp, Artificial
  CRISPR gRNA sequence
gtacgaggcaggactacagg

SEQ ID NO: 201134 - DNA, 20 bp, Artificial
  CRISPR gRNA sequence
cgaggcaggactacaggagg

SEQ ID NO: 201135 - DNA, 20 bp, Artificial
  CRISPR gRNA sequence
gaggcaggactacaggagga

SEQ ID NO: 201136 - DNA, 20 bp, Artificial
  CRISPR gRNA sequence
tgaatgtttatcatgcaaca

SEQ ID NO: 201137 - DNA, 20 bp, Artificial
  CRISPR gRNA sequence
atcatgcaacatagatacaa

SEQ ID NO: 201138 - DNA, 20 bp, Artificial
  CRISPR gRNA sequence
acagtaataaatccccattc

SEQ ID NO: 201139 - DNA, 20 bp, Artificial
  CRISPR gRNA sequence
cagtaataaatccccattca

SEQ ID NO: 201140 - DNA, 20 bp, Artificial
  CRISPR gRNA sequence
agtaataaatccccattcaa

SEQ ID NO: 201141 - DNA, 20 bp, Artificial
  CRISPR gRNA sequence
ataaatccccattcaagggc

SEQ ID NO: 201142 - DNA, 20 bp, Artificial
  CRISPR gRNA sequence
ccattcaagggctggcctgt

SEQ ID NO: 201143 - DNA, 20 bp, Artificial
  CRISPR gRNA sequence
gggctggcctgttggcctga

SEQ ID NO: 201144 - DNA, 20 bp, Artificial
  CRISPR gRNA sequence
acacacattttgttgccatg

SEQ ID NO: 201145 - DNA, 20 bp, Artificial
  CRISPR gRNA sequence
cacacattttgttgccatgc

SEQ ID NO: 201146 - DNA, 20 bp, Artificial
  CRISPR gRNA sequence
cacattttgttgccatgcag

SEQ ID NO: 201147 - DNA, 20 bp, Artificial
  CRISPR gRNA sequence
gttgccatgcaggagactca

SEQ ID NO: 201148 - DNA, 20 bp, Artificial
  CRISPR gRNA sequence
atcttgcttttttcatgccc

SEQ ID NO: 201149 - DNA, 20 bp, Artificial
  CRISPR gRNA sequence
gcttttttcatgccccagat

SEQ ID NO: 201150 - DNA, 20 bp, Artificial
  CRISPR gRNA sequence
tttcatgccccagatcagaa

SEQ ID NO: 201151 - DNA, 20 bp, Artificial
  CRISPR gRNA sequence
catgccccagatcagaaaag

SEQ ID NO: 201152 - DNA, 20 bp, Artificial
  CRISPR gRNA sequence
cccagatcagaaaagaagtg

SEQ ID NO: 201153 - DNA, 20 bp, Artificial
  CRISPR gRNA sequence
aaagaagtgaagaaacactg

SEQ ID NO: 201154 - DNA, 20 bp, Artificial
  CRISPR gRNA sequence
gtagatttttgccttcaaat

SEQ ID NO: 201155 - DNA, 20 bp, Artificial
  CRISPR gRNA sequence
agatttttgccttcaaatca

SEQ ID NO: 201156 - DNA, 20 bp, Artificial
  CRISPR gRNA sequence
gatttttgccttcaaatcag

SEQ ID NO: 201157 - DNA, 20 bp, Artificial
  CRISPR gRNA sequence
ttttgccttcaaatcagagg

SEQ ID NO: 201158 - DNA, 20 bp, Artificial
  CRISPR gRNA sequence
tttgccttcaaatcagagga

SEQ ID NO: 201159 - DNA, 20 bp, Artificial
  CRISPR gRNA sequence
ttgccttcaaatcagaggaa

SEQ ID NO: 201160 - DNA, 20 bp, Artificial
  CRISPR gRNA sequence
gaatacatatgttacaacca

SEQ ID NO: 201161 - DNA, 20 bp, Artificial
  CRISPR gRNA sequence
ccatagctatttttgctgaa

SEQ ID NO: 201162 - DNA, 20 bp, Artificial
  CRISPR gRNA sequence
tttgctgaaaagtgtgaaca

SEQ ID NO: 201163 - DNA, 20 bp, Artificial
  CRISPR gRNA sequence
aagtgtgaacacagtgctct

SEQ ID NO: 201164 - DNA, 20 bp, Artificial
  CRISPR gRNA sequence
gaacacagtgctctgagaac

SEQ ID NO: 201165 - DNA, 20 bp, Artificial
  CRISPR gRNA sequence
cagtgctctgagaacaagtc

SEQ ID NO: 201166 - DNA, 20 bp, Artificial
  CRISPR gRNA sequence
gtctggctccttcctgcaac

SEQ ID NO: 201167 - DNA, 20 bp, Artificial
  CRISPR gRNA sequence
aactggtgctaccgtgtcac

SEQ ID NO: 201168 - DNA, 20 bp, Artificial
  CRISPR gRNA sequence
gtgtcactagaccatgttca

SEQ ID NO: 201169 - DNA, 20 bp, Artificial
  CRISPR gRNA sequence
gtcactagaccatgttcaaa

SEQ ID NO: 201170 - DNA, 20 bp, Artificial
  CRISPR gRNA sequence
tcactagaccatgttcaaag

SEQ ID NO: 201171 - DNA, 20 bp, Artificial
  CRISPR gRNA sequence
actagaccatgttcaaagag

SEQ ID NO: 201172 - DNA, 20 bp, Artificial
  CRISPR gRNA sequence
accatgttcaaagaggagaa

SEQ ID NO: 201173 - DNA, 20 bp, Artificial
  CRISPR gRNA sequence
ccatgttcaaagaggagaaa

SEQ ID NO: 201174 - DNA, 20 bp, Artificial
  CRISPR gRNA sequence
aaaaggtgctacatcttgta

SEQ ID NO: 201175 - DNA, 20 bp, Artificial
  CRISPR gRNA sequence
aggtgctacatcttgtacag

SEQ ID NO: 201176 - DNA, 20 bp, Artificial
  CRISPR gRNA sequence
tgctacatcttgtacagcag

SEQ ID NO: 201177 - DNA, 20 bp, Artificial
  CRISPR gRNA sequence
acatcttgtacagcagaagc

SEQ ID NO: 201178 - DNA, 20 bp, Artificial
  CRISPR gRNA sequence
tgtacagcagaagcaagtaa

SEQ ID NO: 201179 - DNA, 20 bp, Artificial
  CRISPR gRNA sequence
gtacagcagaagcaagtaac

SEQ ID NO: 201180 - DNA, 20 bp, Artificial
  CRISPR gRNA sequence
acagcagaagcaagtaacag

SEQ ID NO: 201181 - DNA, 20 bp, Artificial
  CRISPR gRNA sequence
cagcagaagcaagtaacagg

SEQ ID NO: 201182 - DNA, 20 bp, Artificial
  CRISPR gRNA sequence
gaagcaagtaacaggaggac

SEQ ID NO: 201183 - DNA, 20 bp, Artificial
  CRISPR gRNA sequence
caagtaacaggaggacaaga

SEQ ID NO: 201184 - DNA, 20 bp, Artificial
  CRISPR gRNA sequence
aagtaacaggaggacaagac

SEQ ID NO: 201185 - DNA, 20 bp, Artificial
  CRISPR gRNA sequence
agtaacaggaggacaagaca

SEQ ID NO: 201186 - DNA, 20 bp, Artificial
  CRISPR gRNA sequence
ggaggacaagacagggtttc

SEQ ID NO: 201187 - DNA, 20 bp, Artificial
  CRISPR gRNA sequence
gaggacaagacagggtttca

SEQ ID NO: 201188 - DNA, 20 bp, Artificial
  CRISPR gRNA sequence
aggacaagacagggtttcaa

SEQ ID NO: 201189 - DNA, 20 bp, Artificial
  CRISPR gRNA sequence
ggacaagacagggtttcaag

SEQ ID NO: 201190 - DNA, 20 bp, Artificial
  CRISPR gRNA sequence
tcaaggggttatgtgaataa

SEQ ID NO: 201191 - DNA, 20 bp, Artificial
  CRISPR gRNA sequence
caaggggttatgtgaataaa

SEQ ID NO: 201192 - DNA, 20 bp, Artificial
  CRISPR gRNA sequence
gaaaacatatccatcaataa

SEQ ID NO: 201193 - DNA, 20 bp, Artificial
  CRISPR gRNA sequence
caataaaagtaccctaaatc

SEQ ID NO: 201194 - DNA, 20 bp, Artificial
  CRISPR gRNA sequence
aataaaagtaccctaaatct

SEQ ID NO: 201195 - DNA, 20 bp, Artificial
  CRISPR gRNA sequence
aaaagtaccctaaatctggg

SEQ ID NO: 201196 - DNA, 20 bp, Artificial
  CRISPR gRNA sequence
aaagtaccctaaatctggga

SEQ ID NO: 201197 - DNA, 20 bp, Artificial
  CRISPR gRNA sequence
acctgttacactgtttgttg

SEQ ID NO: 201198 - DNA, 20 bp, Artificial
  CRISPR gRNA sequence
cctgttacactgtttgttga

SEQ ID NO: 201199 - DNA, 20 bp, Artificial
  CRISPR gRNA sequence
ctgttacactgtttgttgaa

SEQ ID NO: 201200 - DNA, 20 bp, Artificial
  CRISPR gRNA sequence
tgttacactgtttgttgaag

SEQ ID NO: 201201 - DNA, 20 bp, Artificial
  CRISPR gRNA sequence
gttacactgtttgttgaagg

SEQ ID NO: 201202 - DNA, 20 bp, Artificial
  CRISPR gRNA sequence
tgtttgttgaagggggaatg

SEQ ID NO: 201203 - DNA, 20 bp, Artificial
  CRISPR gRNA sequence
gtttgttgaagggggaatgt

SEQ ID NO: 201204 - DNA, 20 bp, Artificial
  CRISPR gRNA sequence
ttgaagggggaatgtgggaa

SEQ ID NO: 201205 - DNA, 20 bp, Artificial
  CRISPR gRNA sequence
atgtgggaatggcaaccccc

SEQ ID NO: 201206 - DNA, 20 bp, Artificial
  CRISPR gRNA sequence
gaatggcaacccccaagaat

SEQ ID NO: 201207 - DNA, 20 bp, Artificial
  CRISPR gRNA sequence
aatggcaacccccaagaatg

SEQ ID NO: 201208 - DNA, 20 bp, Artificial
  CRISPR gRNA sequence
tccatcaatatcacatcata

SEQ ID NO: 201209 - DNA, 20 bp, Artificial
  CRISPR gRNA sequence
catcaatatcacatcatacg

SEQ ID NO: 201210 - DNA, 20 bp, Artificial
  CRISPR gRNA sequence
acatcatacggagatcatac

SEQ ID NO: 201211 - DNA, 20 bp, Artificial
  CRISPR gRNA sequence
aatttattattccattgacc

SEQ ID NO: 201212 - DNA, 20 bp, Artificial
  CRISPR gRNA sequence
ttattattccattgacccag

SEQ ID NO: 201213 - DNA, 20 bp, Artificial
  CRISPR gRNA sequence
ttattccattgacccagaag

SEQ ID NO: 201214 - DNA, 20 bp, Artificial
  CRISPR gRNA sequence
ttccattgacccagaagtgg

SEQ ID NO: 201215 - DNA, 20 bp, Artificial
  CRISPR gRNA sequence
cagaagtggcagacacctct

SEQ ID NO: 201216 - DNA, 20 bp, Artificial
  CRISPR gRNA sequence
catactgccataactgccca

SEQ ID NO: 201217 - DNA, 20 bp, Artificial
  CRISPR gRNA sequence
cccaaagctgctgtgaacct

SEQ ID NO: 201218 - DNA, 20 bp, Artificial
  CRISPR gRNA sequence
aagctgctgtgaacctgagt

SEQ ID NO: 201219 - DNA, 20 bp, Artificial
  CRISPR gRNA sequence
gctgtgaacctgagttggca

SEQ ID NO: 201220 - DNA, 20 bp, Artificial
  CRISPR gRNA sequence
ctgtgaacctgagttggcaa

SEQ ID NO: 201221 - DNA, 20 bp, Artificial
  CRISPR gRNA sequence
ctgagttggcaaaggtttga

SEQ ID NO: 201222 - DNA, 20 bp, Artificial
  CRISPR gRNA sequence
agttggcaaaggtttgatgg

SEQ ID NO: 201223 - DNA, 20 bp, Artificial
  CRISPR gRNA sequence
aaaggtttgatggaagccac

SEQ ID NO: 201224 - DNA, 20 bp, Artificial
  CRISPR gRNA sequence
atggaagccactggttttca

SEQ ID NO: 201225 - DNA, 20 bp, Artificial
  CRISPR gRNA sequence
ctggttttcatagatatctc

SEQ ID NO: 201226 - DNA, 20 bp, Artificial
  CRISPR gRNA sequence
tggttttcatagatatctct

SEQ ID NO: 201227 - DNA, 20 bp, Artificial
  CRISPR gRNA sequence
agatatctctgggtaatcac

SEQ ID NO: 201228 - DNA, 20 bp, Artificial
  CRISPR gRNA sequence
gatatctctgggtaatcacc

SEQ ID NO: 201229 - DNA, 20 bp, Artificial
  CRISPR gRNA sequence
atatctctgggtaatcacca

SEQ ID NO: 201230 - DNA, 20 bp, Artificial
  CRISPR gRNA sequence
tctctgggtaatcaccaggg

SEQ ID NO: 201231 - DNA, 20 bp, Artificial
  CRISPR gRNA sequence
gtaatcaccagggcagtgct

SEQ ID NO: 201232 - DNA, 20 bp, Artificial
  CRISPR gRNA sequence
atcaccagggcagtgctaag

SEQ ID NO: 201233 - DNA, 20 bp, Artificial
  CRISPR gRNA sequence
caccctgaaccaatttaaac

SEQ ID NO: 201234 - DNA, 20 bp, Artificial
  CRISPR gRNA sequence
accaatttaaactggttacc

SEQ ID NO: 201235 - DNA, 20 bp, Artificial
  CRISPR gRNA sequence
caatttaaactggttaccta

SEQ ID NO: 201236 - DNA, 20 bp, Artificial
  CRISPR gRNA sequence
aatttaaactggttacctag

SEQ ID NO: 201237 - DNA, 20 bp, Artificial
  CRISPR gRNA sequence
taaactggttacctagaggc

SEQ ID NO: 201238 - DNA, 20 bp, Artificial
  CRISPR gRNA sequence
aactggttacctagaggcca

SEQ ID NO: 201239 - DNA, 20 bp, Artificial
  CRISPR gRNA sequence
actggttacctagaggccag

SEQ ID NO: 201240 - DNA, 20 bp, Artificial
  CRISPR gRNA sequence
tacctagaggccagaggccc

SEQ ID NO: 201241 - DNA, 20 bp, Artificial
  CRISPR gRNA sequence
acctagaggccagaggccct

SEQ ID NO: 201242 - DNA, 20 bp, Artificial
  CRISPR gRNA sequence
ccagaggccctaggacctga

SEQ ID NO: 201243 - DNA, 20 bp, Artificial
  CRISPR gRNA sequence
cagaggccctaggacctgaa

SEQ ID NO: 201244 - DNA, 20 bp, Artificial
  CRISPR gRNA sequence
gacctgaaaggcatcattct

SEQ ID NO: 201245 - DNA, 20 bp, Artificial
  CRISPR gRNA sequence
taaaaataacaacaaaaaac

SEQ ID NO: 201246 - DNA, 20 bp, Artificial
  CRISPR gRNA sequence
acaaaaaactggatctcaat

SEQ ID NO: 201247 - DNA, 20 bp, Artificial
  CRISPR gRNA sequence
caaaaaactggatctcaatt

SEQ ID NO: 201248 - DNA, 20 bp, Artificial
  CRISPR gRNA sequence
tctcaattgggcaaacaaca

SEQ ID NO: 201249 - DNA, 20 bp, Artificial
  CRISPR gRNA sequence
ttattttattaactaaatta

SEQ ID NO: 201250 - DNA, 20 bp, Artificial
  CRISPR gRNA sequence
aacttaactaacaatcacgt

SEQ ID NO: 201251 - DNA, 20 bp, Artificial
  CRISPR gRNA sequence
acttaactaacaatcacgta

SEQ ID NO: 201252 - DNA, 20 bp, Artificial
  CRISPR gRNA sequence
cttaactaacaatcacgtaa

SEQ ID NO: 201253 - DNA, 20 bp, Artificial
  CRISPR gRNA sequence
acaatcacgtaagggtctca

SEQ ID NO: 201254 - DNA, 20 bp, Artificial
  CRISPR gRNA sequence
caatcacgtaagggtctcat

SEQ ID NO: 201255 - DNA, 20 bp, Artificial
  CRISPR gRNA sequence
agggtctcataggtgacaac

SEQ ID NO: 201256 - DNA, 20 bp, Artificial
  CRISPR gRNA sequence
ttcttgtttcttctccccaa

SEQ ID NO: 201257 - DNA, 20 bp, Artificial
  CRISPR gRNA sequence
ctccccaacagtgaatcatc

SEQ ID NO: 201258 - DNA, 20 bp, Artificial
  CRISPR gRNA sequence
tccccaacagtgaatcatca

SEQ ID NO: 201259 - DNA, 20 bp, Artificial
  CRISPR gRNA sequence
acagtgaatcatcaaggcca

SEQ ID NO: 201260 - DNA, 20 bp, Artificial
  CRISPR gRNA sequence
aggccatggtgcttaaacac

SEQ ID NO: 201261 - DNA, 20 bp, Artificial
  CRISPR gRNA sequence
cgtcttactactctccaaat

SEQ ID NO: 201262 - DNA, 20 bp, Artificial
  CRISPR gRNA sequence
tcttactactctccaaatcg

SEQ ID NO: 201263 - DNA, 20 bp, Artificial
  CRISPR gRNA sequence
cggagtccatcacttcactt

SEQ ID NO: 201264 - DNA, 20 bp, Artificial
  CRISPR gRNA sequence
tcacttcacttcagttattc

SEQ ID NO: 201265 - DNA, 20 bp, Artificial
  CRISPR gRNA sequence
tctattttctatccattaaa

SEQ ID NO: 201266 - DNA, 20 bp, Artificial
  CRISPR gRNA sequence
aaaagttgacacattaaaaa

SEQ ID NO: 201267 - DNA, 20 bp, Artificial
  CRISPR gRNA sequence
tgacacattaaaaaaagttt

SEQ ID NO: 201268 - DNA, 20 bp, Artificial
  CRISPR gRNA sequence
taaaaaaagtttcagatata

SEQ ID NO: 201269 - DNA, 20 bp, Artificial
  CRISPR gRNA sequence
atatatagtatctaaaaatt

SEQ ID NO: 201270 - DNA, 20 bp, Artificial
  CRISPR gRNA sequence
gtatctaaaaattaagaaaa

SEQ ID NO: 201271 - DNA, 20 bp, Artificial
  CRISPR gRNA sequence
attaagaaaatagacctgca

SEQ ID NO: 201272 - DNA, 20 bp, Artificial
  CRISPR gRNA sequence
ttaagaaaatagacctgcaa

SEQ ID NO: 201273 - DNA, 20 bp, Artificial
  CRISPR gRNA sequence
gaaaatagacctgcaaaggt

SEQ ID NO: 201274 - DNA, 20 bp, Artificial
  CRISPR gRNA sequence
aaatagacctgcaaaggtca

SEQ ID NO: 201275 - DNA, 20 bp, Artificial
  CRISPR gRNA sequence
agacctgcaaaggtcagaga

SEQ ID NO: 201276 - DNA, 20 bp, Artificial
  CRISPR gRNA sequence
caaaggtcagagacagaaac

SEQ ID NO: 201277 - DNA, 20 bp, Artificial
  CRISPR gRNA sequence
aaaggtcagagacagaaacc

SEQ ID NO: 201278 - DNA, 20 bp, Artificial
  CRISPR gRNA sequence
acagaaaccaggcaaatcat

SEQ ID NO: 201279 - DNA, 20 bp, Artificial
  CRISPR gRNA sequence
atcattagcctttttaattt

SEQ ID NO: 201280 - DNA, 20 bp, Artificial
  CRISPR gRNA sequence
ttagcctttttaatttcagt

SEQ ID NO: 201281 - DNA, 20 bp, Artificial
  CRISPR gRNA sequence
tttttaatttcagtaagaaa

SEQ ID NO: 201282 - DNA, 20 bp, Artificial
  CRISPR gRNA sequence
ttttaatttcagtaagaaaa

SEQ ID NO: 201283 - DNA, 20 bp, Artificial
  CRISPR gRNA sequence
aaaaggccaatgccaaatga

SEQ ID NO: 201284 - DNA, 20 bp, Artificial
  CRISPR gRNA sequence
aaatgaaagtaaaaaatcaa

SEQ ID NO: 201285 - DNA, 20 bp, Artificial
  CRISPR gRNA sequence
atgaaagtaaaaaatcaaca

SEQ ID NO: 201286 - DNA, 20 bp, Artificial
  CRISPR gRNA sequence
gtctgataatctctgtttgc

SEQ ID NO: 201287 - DNA, 20 bp, Artificial
  CRISPR gRNA sequence
tctgataatctctgtttgct

SEQ ID NO: 201288 - DNA, 20 bp, Artificial
  CRISPR gRNA sequence
ataatctctgtttgctgggt

SEQ ID NO: 201289 - DNA, 20 bp, Artificial
  CRISPR gRNA sequence
ctctgtttgctgggttggct

SEQ ID NO: 201290 - DNA, 20 bp, Artificial
  CRISPR gRNA sequence
tctgtttgctgggttggctg

SEQ ID NO: 201291 - DNA, 20 bp, Artificial
  CRISPR gRNA sequence
ttgctgggttggctgaggaa

SEQ ID NO: 201292 - DNA, 20 bp, Artificial
  CRISPR gRNA sequence
gggttggctgaggaaaagcc

SEQ ID NO: 201293 - DNA, 20 bp, Artificial
  CRISPR gRNA sequence
gttggctgaggaaaagccaa

SEQ ID NO: 201294 - DNA, 20 bp, Artificial
  CRISPR gRNA sequence
caagagatgttgatttttca

SEQ ID NO: 201295 - DNA, 20 bp, Artificial
  CRISPR gRNA sequence
atgttgatttttcaaagcaa

SEQ ID NO: 201296 - DNA, 20 bp, Artificial
  CRISPR gRNA sequence
aaagcaaaagatgttgatcc

SEQ ID NO: 201297 - DNA, 20 bp, Artificial
  CRISPR gRNA sequence
atattctataatattcactt

SEQ ID NO: 201298 - DNA, 20 bp, Artificial
  CRISPR gRNA sequence
ctccatcattcatttaatgt

SEQ ID NO: 201299 - DNA, 20 bp, Artificial
  CRISPR gRNA sequence
aagtaaaataaacatctgat

SEQ ID NO: 201300 - DNA, 20 bp, Artificial
  CRISPR gRNA sequence
aataaacatctgatcagctg

SEQ ID NO: 201301 - DNA, 20 bp, Artificial
  CRISPR gRNA sequence
atctgatcagctgtagatga

SEQ ID NO: 201302 - DNA, 20 bp, Artificial
  CRISPR gRNA sequence
ctgatcagctgtagatgaaa

SEQ ID NO: 201303 - DNA, 20 bp, Artificial
  CRISPR gRNA sequence
ctgtagatgaaagagaaaaa

SEQ ID NO: 201304 - DNA, 20 bp, Artificial
  CRISPR gRNA sequence
atggtactgactctgatccc

SEQ ID NO: 201305 - DNA, 20 bp, Artificial
  CRISPR gRNA sequence
tggtactgactctgatccct

SEQ ID NO: 201306 - DNA, 20 bp, Artificial
  CRISPR gRNA sequence
tactgactctgatccctagg

SEQ ID NO: 201307 - DNA, 20 bp, Artificial
  CRISPR gRNA sequence
cctgaacctcattcattgac

SEQ ID NO: 201308 - DNA, 20 bp, Artificial
  CRISPR gRNA sequence
ctgaacctcattcattgaca

SEQ ID NO: 201309 - DNA, 20 bp, Artificial
  CRISPR gRNA sequence
aacctcattcattgacaagg

SEQ ID NO: 201310 - DNA, 20 bp, Artificial
  CRISPR gRNA sequence
tgacaaggcagacatactgt

SEQ ID NO: 201311 - DNA, 20 bp, Artificial
  CRISPR gRNA sequence
gcagacatactgtaagcaat

SEQ ID NO: 201312 - DNA, 20 bp, Artificial
  CRISPR gRNA sequence
gacatactgtaagcaataag

SEQ ID NO: 201313 - DNA, 20 bp, Artificial
  CRISPR gRNA sequence
tgtaagcaataagcagttgt

SEQ ID NO: 201314 - DNA, 20 bp, Artificial
  CRISPR gRNA sequence
aagcaataagcagttgtcag

SEQ ID NO: 201315 - DNA, 20 bp, Artificial
  CRISPR gRNA sequence
agcaataagcagttgtcagt

SEQ ID NO: 201316 - DNA, 20 bp, Artificial
  CRISPR gRNA sequence
aataagcagttgtcagtggg

SEQ ID NO: 201317 - DNA, 20 bp, Artificial
  CRISPR gRNA sequence
tgtcagtgggaagtacccac

SEQ ID NO: 201318 - DNA, 20 bp, Artificial
  CRISPR gRNA sequence
agtgggaagtacccaccagc

SEQ ID NO: 201319 - DNA, 20 bp, Artificial
  CRISPR gRNA sequence
ttttaaaaacaaattctgat

SEQ ID NO: 201320 - DNA, 20 bp, Artificial
  CRISPR gRNA sequence
aattctgatcagctgaatat

SEQ ID NO: 201321 - DNA, 20 bp, Artificial
  CRISPR gRNA sequence
agctgaatattagcaaaatt

SEQ ID NO: 201322 - DNA, 20 bp, Artificial
  CRISPR gRNA sequence
ctgaatattagcaaaattaa

SEQ ID NO: 201323 - DNA, 20 bp, Artificial
  CRISPR gRNA sequence
gcaaaattaagagaatcttg

SEQ ID NO: 201324 - DNA, 20 bp, Artificial
  CRISPR gRNA sequence
gagaatcttgaagatcatcg

SEQ ID NO: 201325 - DNA, 20 bp, Artificial
  CRISPR gRNA sequence
agatttcatcacaaatattc

SEQ ID NO: 201326 - DNA, 20 bp, Artificial
  CRISPR gRNA sequence
gatttcatcacaaatattca

SEQ ID NO: 201327 - DNA, 20 bp, Artificial
  CRISPR gRNA sequence
ttttacaatatttcctgatg

SEQ ID NO: 201328 - DNA, 20 bp, Artificial
  CRISPR gRNA sequence
tacaatatttcctgatgcag

SEQ ID NO: 201329 - DNA, 20 bp, Artificial
  CRISPR gRNA sequence
cctgatgcagtagtttaaaa

SEQ ID NO: 201330 - DNA, 20 bp, Artificial
  CRISPR gRNA sequence
gtttaaaaaagtcacatctt

SEQ ID NO: 201331 - DNA, 20 bp, Artificial
  CRISPR gRNA sequence
ttaaaaaagtcacatcttaa

SEQ ID NO: 201332 - DNA, 20 bp, Artificial
  CRISPR gRNA sequence
catcttaagagaaattaaca

SEQ ID NO: 201333 - DNA, 20 bp, Artificial
  CRISPR gRNA sequence
atcttaagagaaattaacaa

SEQ ID NO: 201334 - DNA, 20 bp, Artificial
  CRISPR gRNA sequence
ttaagagaaattaacaaagg

SEQ ID NO: 201335 - DNA, 20 bp, Artificial
  CRISPR gRNA sequence
aagagaaattaacaaaggaa

SEQ ID NO: 201336 - DNA, 20 bp, Artificial
  CRISPR gRNA sequence
agagaaattaacaaaggaag

SEQ ID NO: 201337 - DNA, 20 bp, Artificial
  CRISPR gRNA sequence
taacaaaggaagaggcactc

SEQ ID NO: 201338 - DNA, 20 bp, Artificial
  CRISPR gRNA sequence
gaagaggcactcaagattct

SEQ ID NO: 201339 - DNA, 20 bp, Artificial
  CRISPR gRNA sequence
ttagattgctttcctgaaaa

SEQ ID NO: 201340 - DNA, 20 bp, Artificial
  CRISPR gRNA sequence
agattgctttcctgaaaatg

SEQ ID NO: 201341 - DNA, 20 bp, Artificial
  CRISPR gRNA sequence
gctttcctgaaaatggagaa

SEQ ID NO: 201342 - DNA, 20 bp, Artificial
  CRISPR gRNA sequence
cctgaaaatggagaaaagtt

SEQ ID NO: 201343 - DNA, 20 bp, Artificial
  CRISPR gRNA sequence
aaaagtttagtttcttcata

SEQ ID NO: 201344 - DNA, 20 bp, Artificial
  CRISPR gRNA sequence
ttagtttcttcatacagcta

SEQ ID NO: 201345 - DNA, 20 bp, Artificial
  CRISPR gRNA sequence
tacagaacaatgacaccacc

SEQ ID NO: 201346 - DNA, 20 bp, Artificial
  CRISPR gRNA sequence
acagaacaatgacaccacca

SEQ ID NO: 201347 - DNA, 20 bp, Artificial
  CRISPR gRNA sequence
acaatgacaccaccaaggaa

SEQ ID NO: 201348 - DNA, 20 bp, Artificial
  CRISPR gRNA sequence
caatgacaccaccaaggaaa

SEQ ID NO: 201349 - DNA, 20 bp, Artificial
  CRISPR gRNA sequence
gacaccaccaaggaaaagga

SEQ ID NO: 201350 - DNA, 20 bp, Artificial
  CRISPR gRNA sequence
acaccaccaaggaaaaggaa

SEQ ID NO: 201351 - DNA, 20 bp, Artificial
  CRISPR gRNA sequence
ccaaggaaaaggaaaggaca

SEQ ID NO: 201352 - DNA, 20 bp, Artificial
  CRISPR gRNA sequence
tagaaattaaaaaaaaaaaa

SEQ ID NO: 201353 - DNA, 20 bp, Artificial
  CRISPR gRNA sequence
agaaattaaaaaaaaaaaat

SEQ ID NO: 201354 - DNA, 20 bp, Artificial
  CRISPR gRNA sequence
aaaaaaaaaaaataggacat

SEQ ID NO: 201355 - DNA, 20 bp, Artificial
  CRISPR gRNA sequence
acaaaccatgccacaattcc

SEQ ID NO: 201356 - DNA, 20 bp, Artificial
  CRISPR gRNA sequence
gaacaaaccatgccatgcca

SEQ ID NO: 201357 - DNA, 20 bp, Artificial
  CRISPR gRNA sequence
ccatgccatgccacagttac

SEQ ID NO: 201358 - DNA, 20 bp, Artificial
  CRISPR gRNA sequence
acagttaccagaacaaacca

SEQ ID NO: 201359 - DNA, 20 bp, Artificial
  CRISPR gRNA sequence
caaaccatggtcacaattcc

SEQ ID NO: 201360 - DNA, 20 bp, Artificial
  CRISPR gRNA sequence
atggtcacaattcctggtac

SEQ ID NO: 201361 - DNA, 20 bp, Artificial
  CRISPR gRNA sequence
taacttattcctgtgaacta

SEQ ID NO: 201362 - DNA, 20 bp, Artificial
  CRISPR gRNA sequence
ctgtgaactatagtcttttt

SEQ ID NO: 201363 - DNA, 20 bp, Artificial
  CRISPR gRNA sequence
tgtgaactatagtctttttt

SEQ ID NO: 201364 - DNA, 20 bp, Artificial
  CRISPR gRNA sequence
tgaactatagtcttttttag

SEQ ID NO: 201365 - DNA, 20 bp, Artificial
  CRISPR gRNA sequence
gaactatagtcttttttagg

SEQ ID NO: 201366 - DNA, 20 bp, Artificial
  CRISPR gRNA sequence
aactatagtcttttttagga

SEQ ID NO: 201367 - DNA, 20 bp, Artificial
  CRISPR gRNA sequence
agtcttttttaggagggtaa

SEQ ID NO: 201368 - DNA, 20 bp, Artificial
  CRISPR gRNA sequence
agggtaatggcttatataac

SEQ ID NO: 201369 - DNA, 20 bp, Artificial
  CRISPR gRNA sequence
tataacaagacatgctttta

SEQ ID NO: 201370 - DNA, 20 bp, Artificial
  CRISPR gRNA sequence
ataacaagacatgcttttaa

SEQ ID NO: 201371 - DNA, 20 bp, Artificial
  CRISPR gRNA sequence
gctgtgacacaaacatacaa

SEQ ID NO: 201372 - DNA, 20 bp, Artificial
  CRISPR gRNA sequence
gtgacacaaacatacaaaag

SEQ ID NO: 201373 - DNA, 20 bp, Artificial
  CRISPR gRNA sequence
tgacacaaacatacaaaagt

SEQ ID NO: 201374 - DNA, 20 bp, Artificial
  CRISPR gRNA sequence
tttgttcaccaatgcatgac

SEQ ID NO: 201375 - DNA, 20 bp, Artificial
  CRISPR gRNA sequence
tgttcaccaatgcatgactg

SEQ ID NO: 201376 - DNA, 20 bp, Artificial
  CRISPR gRNA sequence
tttttttttttttttttctt

SEQ ID NO: 201377 - DNA, 20 bp, Artificial
  CRISPR gRNA sequence
tttttttttttttcttgaga

SEQ ID NO: 201378 - DNA, 20 bp, Artificial
  CRISPR gRNA sequence
tttttttttttcttgagacg

SEQ ID NO: 201379 - DNA, 20 bp, Artificial
  CRISPR gRNA sequence
cggagtcttgctctgtcacc

SEQ ID NO: 201380 - DNA, 20 bp, Artificial
  CRISPR gRNA sequence
ggagtcttgctctgtcaccc

SEQ ID NO: 201381 - DNA, 20 bp, Artificial
  CRISPR gRNA sequence
tcttgctctgtcacccaggc

SEQ ID NO: 201382 - DNA, 20 bp, Artificial
  CRISPR gRNA sequence
ttgctctgtcacccaggctg

SEQ ID NO: 201383 - DNA, 20 bp, Artificial
  CRISPR gRNA sequence
ctgtcacccaggctggagtg

SEQ ID NO: 201384 - DNA, 20 bp, Artificial
  CRISPR gRNA sequence
tcacccaggctggagtgtag

SEQ ID NO: 201385 - DNA, 20 bp, Artificial
  CRISPR gRNA sequence
ggagtgtagtggcacgatct

SEQ ID NO: 201386 - DNA, 20 bp, Artificial
  CRISPR gRNA sequence
gcacgatcttggctcactgc

SEQ ID NO: 201387 - DNA, 20 bp, Artificial
  CRISPR gRNA sequence
tcactgcaagctctgcctcc

SEQ ID NO: 201388 - DNA, 20 bp, Artificial
  CRISPR gRNA sequence
cactgcaagctctgcctccc

SEQ ID NO: 201389 - DNA, 20 bp, Artificial
  CRISPR gRNA sequence
ttcacgccattctcctgcct

SEQ ID NO: 201390 - DNA, 20 bp, Artificial
  CRISPR gRNA sequence
ttctcctgcctcagcctccc

SEQ ID NO: 201391 - DNA, 20 bp, Artificial
  CRISPR gRNA sequence
tcctgcctcagcctcccaag

SEQ ID NO: 201392 - DNA, 20 bp, Artificial
  CRISPR gRNA sequence
gcctcagcctcccaagtagc

SEQ ID NO: 201393 - DNA, 20 bp, Artificial
  CRISPR gRNA sequence
cctcagcctcccaagtagct

SEQ ID NO: 201394 - DNA, 20 bp, Artificial
  CRISPR gRNA sequence
ctcccaagtagctgggacca

SEQ ID NO: 201395 - DNA, 20 bp, Artificial
  CRISPR gRNA sequence
tcccaagtagctgggaccac

SEQ ID NO: 201396 - DNA, 20 bp, Artificial
  CRISPR gRNA sequence
caggtgcccgccaccatgcc

SEQ ID NO: 201397 - DNA, 20 bp, Artificial
  CRISPR gRNA sequence
catgcccggctaattttttg

SEQ ID NO: 201398 - DNA, 20 bp, Artificial
  CRISPR gRNA sequence
cggctaattttttgtagttt

SEQ ID NO: 201399 - DNA, 20 bp, Artificial
  CRISPR gRNA sequence
ctaattttttgtagttttag

SEQ ID NO: 201400 - DNA, 20 bp, Artificial
  CRISPR gRNA sequence
aattttttgtagttttagta

SEQ ID NO: 201401 - DNA, 20 bp, Artificial
  CRISPR gRNA sequence
ttttgtagttttagtagaga

SEQ ID NO: 201402 - DNA, 20 bp, Artificial
  CRISPR gRNA sequence
tttgtagttttagtagagac

SEQ ID NO: 201403 - DNA, 20 bp, Artificial
  CRISPR gRNA sequence
ttgtagttttagtagagacg

SEQ ID NO: 201404 - DNA, 20 bp, Artificial
  CRISPR gRNA sequence
gagacggggtttcaccgtgt

SEQ ID NO: 201405 - DNA, 20 bp, Artificial
  CRISPR gRNA sequence
cggggtttcaccgtgttagc

SEQ ID NO: 201406 - DNA, 20 bp, Artificial
  CRISPR gRNA sequence
ggggtttcaccgtgttagcc

SEQ ID NO: 201407 - DNA, 20 bp, Artificial
  CRISPR gRNA sequence
tttcaccgtgttagccagga

SEQ ID NO: 201408 - DNA, 20 bp, Artificial
  CRISPR gRNA sequence
accttgtgatccgcccgcct

SEQ ID NO: 201409 - DNA, 20 bp, Artificial
  CRISPR gRNA sequence
ccgcccgcctcggcctccca

SEQ ID NO: 201410 - DNA, 20 bp, Artificial
  CRISPR gRNA sequence
gcctcggcctcccaaagtgc

SEQ ID NO: 201411 - DNA, 20 bp, Artificial
  CRISPR gRNA sequence
cctcggcctcccaaagtgct

SEQ ID NO: 201412 - DNA, 20 bp, Artificial
  CRISPR gRNA sequence
ctcccaaagtgctgggatta

SEQ ID NO: 201413 - DNA, 20 bp, Artificial
  CRISPR gRNA sequence
tcccaaagtgctgggattac

SEQ ID NO: 201414 - DNA, 20 bp, Artificial
  CRISPR gRNA sequence
agtgctgggattacaggcgt

SEQ ID NO: 201415 - DNA, 20 bp, Artificial
  CRISPR gRNA sequence
caggcgtgagccaccgcgcc

SEQ ID NO: 201416 - DNA, 20 bp, Artificial
  CRISPR gRNA sequence
agccaccgcgcccggccgac

SEQ ID NO: 201417 - DNA, 20 bp, Artificial
  CRISPR gRNA sequence
ccaccgcgcccggccgactg

SEQ ID NO: 201418 - DNA, 20 bp, Artificial
  CRISPR gRNA sequence
atgcaaatattaatgacact

SEQ ID NO: 201419 - DNA, 20 bp, Artificial
  CRISPR gRNA sequence
tgcaaatattaatgacactt

SEQ ID NO: 201420 - DNA, 20 bp, Artificial
  CRISPR gRNA sequence
gcaaatattaatgacacttg

SEQ ID NO: 201421 - DNA, 20 bp, Artificial
  CRISPR gRNA sequence
caaatattaatgacacttgg

SEQ ID NO: 201422 - DNA, 20 bp, Artificial
  CRISPR gRNA sequence
aaatattaatgacacttggg

SEQ ID NO: 201423 - DNA, 20 bp, Artificial
  CRISPR gRNA sequence
aatgacacttggggggaata

SEQ ID NO: 201424 - DNA, 20 bp, Artificial
  CRISPR gRNA sequence
tggggggaatatagcttcct

SEQ ID NO: 201425 - DNA, 20 bp, Artificial
  CRISPR gRNA sequence
ttaaatgctgcactttgcta

SEQ ID NO: 201426 - DNA, 20 bp, Artificial
  CRISPR gRNA sequence
aatgctgcactttgctacag

SEQ ID NO: 201427 - DNA, 20 bp, Artificial
  CRISPR gRNA sequence
tgctgcactttgctacagaa

SEQ ID NO: 201428 - DNA, 20 bp, Artificial
  CRISPR gRNA sequence
gctgcactttgctacagaag

SEQ ID NO: 201429 - DNA, 20 bp, Artificial
  CRISPR gRNA sequence
ctgcactttgctacagaaga

SEQ ID NO: 201430 - DNA, 20 bp, Artificial
  CRISPR gRNA sequence
cactttgctacagaagaggg

SEQ ID NO: 201431 - DNA, 20 bp, Artificial
  CRISPR gRNA sequence
actttgctacagaagagggc

SEQ ID NO: 201432 - DNA, 20 bp, Artificial
  CRISPR gRNA sequence
tgctacagaagagggcaggt

SEQ ID NO: 201433 - DNA, 20 bp, Artificial
  CRISPR gRNA sequence
gctacagaagagggcaggta

SEQ ID NO: 201434 - DNA, 20 bp, Artificial
  CRISPR gRNA sequence
gaagagggcaggtaaggtca

SEQ ID NO: 201435 - DNA, 20 bp, Artificial
  CRISPR gRNA sequence
taaggtcacagactttaaaa

SEQ ID NO: 201436 - DNA, 20 bp, Artificial
  CRISPR gRNA sequence
ctttaaaacagtaaaatata

SEQ ID NO: 201437 - DNA, 20 bp, Artificial
  CRISPR gRNA sequence
agcaaactatttacatgacc

SEQ ID NO: 201438 - DNA, 20 bp, Artificial
  CRISPR gRNA sequence
gcaaactatttacatgaccg

SEQ ID NO: 201439 - DNA, 20 bp, Artificial
  CRISPR gRNA sequence
aaactatttacatgaccgag

SEQ ID NO: 201440 - DNA, 20 bp, Artificial
  CRISPR gRNA sequence
aggagtgattataaatatca

SEQ ID NO: 201441 - DNA, 20 bp, Artificial
  CRISPR gRNA sequence
ggagtgattataaatatcaa

SEQ ID NO: 201442 - DNA, 20 bp, Artificial
  CRISPR gRNA sequence
tgattataaatatcaaaggt

SEQ ID NO: 201443 - DNA, 20 bp, Artificial
  CRISPR gRNA sequence
ttataaatatcaaaggtaag

SEQ ID NO: 201444 - DNA, 20 bp, Artificial
  CRISPR gRNA sequence
gtaagaagacattttttgat

SEQ ID NO: 201445 - DNA, 20 bp, Artificial
  CRISPR gRNA sequence
tactaaatgccaacaaaact

SEQ ID NO: 201446 - DNA, 20 bp, Artificial
  CRISPR gRNA sequence
actaaatgccaacaaaactg

SEQ ID NO: 201447 - DNA, 20 bp, Artificial
  CRISPR gRNA sequence
ctgaggaatcataatatgtt

SEQ ID NO: 201448 - DNA, 20 bp, Artificial
  CRISPR gRNA sequence
tgaggaatcataatatgtta

SEQ ID NO: 201449 - DNA, 20 bp, Artificial
  CRISPR gRNA sequence
aaaaccaaaataaatgcttg

SEQ ID NO: 201450 - DNA, 20 bp, Artificial
  CRISPR gRNA sequence
tctcaaacctatgtatcttt

SEQ ID NO: 201451 - DNA, 20 bp, Artificial
  CRISPR gRNA sequence
tttctttgaaatattctata

SEQ ID NO: 201452 - DNA, 20 bp, Artificial
  CRISPR gRNA sequence
ttgaaatattctataaagat

SEQ ID NO: 201453 - DNA, 20 bp, Artificial
  CRISPR gRNA sequence
aaatattctataaagattag

SEQ ID NO: 201454 - DNA, 20 bp, Artificial
  CRISPR gRNA sequence
ctataaagattagaagttat

SEQ ID NO: 201455 - DNA, 20 bp, Artificial
  CRISPR gRNA sequence
aagattagaagttattagcc

SEQ ID NO: 201456 - DNA, 20 bp, Artificial
  CRISPR gRNA sequence
gattagaagttattagccca

SEQ ID NO: 201457 - DNA, 20 bp, Artificial
  CRISPR gRNA sequence
cagagttcttaaaaaaaaaa

SEQ ID NO: 201458 - DNA, 20 bp, Artificial
  CRISPR gRNA sequence
agttcttaaaaaaaaaatgg

SEQ ID NO: 201459 - DNA, 20 bp, Artificial
  CRISPR gRNA sequence
taaaaaaaaaatggaagcaa

SEQ ID NO: 201460 - DNA, 20 bp, Artificial
  CRISPR gRNA sequence
aaaaaatggaagcaaaagct

SEQ ID NO: 201461 - DNA, 20 bp, Artificial
  CRISPR gRNA sequence
aaaaatggaagcaaaagctg

SEQ ID NO: 201462 - DNA, 20 bp, Artificial
  CRISPR gRNA sequence
tctctttaatcatctcccaa

SEQ ID NO: 201463 - DNA, 20 bp, Artificial
  CRISPR gRNA sequence
ctctttaatcatctcccaaa

SEQ ID NO: 201464 - DNA, 20 bp, Artificial
  CRISPR gRNA sequence
ttaatcatctcccaaaaggt

SEQ ID NO: 201465 - DNA, 20 bp, Artificial
  CRISPR gRNA sequence
tctcccaaaaggttagaacc

SEQ ID NO: 201466 - DNA, 20 bp, Artificial
  CRISPR gRNA sequence
gttagaaccaagctcctgat

SEQ ID NO: 201467 - DNA, 20 bp, Artificial
  CRISPR gRNA sequence
aaccaagctcctgattggaa

SEQ ID NO: 201468 - DNA, 20 bp, Artificial
  CRISPR gRNA sequence
caagctcctgattggaaaag

SEQ ID NO: 201469 - DNA, 20 bp, Artificial
  CRISPR gRNA sequence
agctcctgattggaaaagca

SEQ ID NO: 201470 - DNA, 20 bp, Artificial
  CRISPR gRNA sequence
attggaaaagcagagatgtt

SEQ ID NO: 201471 - DNA, 20 bp, Artificial
  CRISPR gRNA sequence
gcagagatgttaagtcccca

SEQ ID NO: 201472 - DNA, 20 bp, Artificial
  CRISPR gRNA sequence
cagagatgttaagtccccat

SEQ ID NO: 201473 - DNA, 20 bp, Artificial
  CRISPR gRNA sequence
tgcaacaaaatcaccaacac

SEQ ID NO: 201474 - DNA, 20 bp, Artificial
  CRISPR gRNA sequence
aatcaccaacacaagcataa

SEQ ID NO: 201475 - DNA, 20 bp, Artificial
  CRISPR gRNA sequence
gaaactctgtcaaaatgata

SEQ ID NO: 201476 - DNA, 20 bp, Artificial
  CRISPR gRNA sequence
aaaatgataaagatttgtgc

SEQ ID NO: 201477 - DNA, 20 bp, Artificial
  CRISPR gRNA sequence
attatttatgtgccttataa

SEQ ID NO: 201478 - DNA, 20 bp, Artificial
  CRISPR gRNA sequence
ttatttatgtgccttataaa

SEQ ID NO: 201479 - DNA, 20 bp, Artificial
  CRISPR gRNA sequence
gccttataaaaggcatctta

SEQ ID NO: 201480 - DNA, 20 bp, Artificial
  CRISPR gRNA sequence
taaaaggcatcttaaagtta

SEQ ID NO: 201481 - DNA, 20 bp, Artificial
  CRISPR gRNA sequence
catcttaaagttacagtcac

SEQ ID NO: 201482 - DNA, 20 bp, Artificial
  CRISPR gRNA sequence
aaagttacagtcaccagaca

SEQ ID NO: 201483 - DNA, 20 bp, Artificial
  CRISPR gRNA sequence
tctgaaaaacattttacaaa

SEQ ID NO: 201484 - DNA, 20 bp, Artificial
  CRISPR gRNA sequence
gaaaaacattttacaaaaag

SEQ ID NO: 201485 - DNA, 20 bp, Artificial
  CRISPR gRNA sequence
aagtggtaatttctctttgc

SEQ ID NO: 201486 - DNA, 20 bp, Artificial
  CRISPR gRNA sequence
agtggtaatttctctttgct

SEQ ID NO: 201487 - DNA, 20 bp, Artificial
  CRISPR gRNA sequence
tggtaatttctctttgctgg

SEQ ID NO: 201488 - DNA, 20 bp, Artificial
  CRISPR gRNA sequence
tttgctgggagccatatgac

SEQ ID NO: 201489 - DNA, 20 bp, Artificial
  CRISPR gRNA sequence
tgctgggagccatatgactg

SEQ ID NO: 201490 - DNA, 20 bp, Artificial
  CRISPR gRNA sequence
gtctgattcgtgacacccta

SEQ ID NO: 201491 - DNA, 20 bp, Artificial
  CRISPR gRNA sequence
gtgacaccctacagttttta

SEQ ID NO: 201492 - DNA, 20 bp, Artificial
  CRISPR gRNA sequence
acaccctacagtttttacag

SEQ ID NO: 201493 - DNA, 20 bp, Artificial
  CRISPR gRNA sequence
ccctacagtttttacagtag

SEQ ID NO: 201494 - DNA, 20 bp, Artificial
  CRISPR gRNA sequence
agtagtagttttgcaatttt

SEQ ID NO: 201495 - DNA, 20 bp, Artificial
  CRISPR gRNA sequence
tagttttgcaatttttagca

SEQ ID NO: 201496 - DNA, 20 bp, Artificial
  CRISPR gRNA sequence
ttttgcaatttttagcaaag

SEQ ID NO: 201497 - DNA, 20 bp, Artificial
  CRISPR gRNA sequence
atttttagcaaagtagattt

SEQ ID NO: 201498 - DNA, 20 bp, Artificial
  CRISPR gRNA sequence
agatttaagttgtatacatc

SEQ ID NO: 201499 - DNA, 20 bp, Artificial
  CRISPR gRNA sequence
tgtgaacctttatcatctga

SEQ ID NO: 201500 - DNA, 20 bp, Artificial
  CRISPR gRNA sequence
cagtgtcccttttactaaaa

SEQ ID NO: 201501 - DNA, 20 bp, Artificial
  CRISPR gRNA sequence
gtgtcccttttactaaaaaa

SEQ ID NO: 201502 - DNA, 20 bp, Artificial
  CRISPR gRNA sequence
taaaaaagagccacattttc

SEQ ID NO: 201503 - DNA, 20 bp, Artificial
  CRISPR gRNA sequence
aaaagagccacattttcaag

SEQ ID NO: 201504 - DNA, 20 bp, Artificial
  CRISPR gRNA sequence
ttaactgatctataattatt

SEQ ID NO: 201505 - DNA, 20 bp, Artificial
  CRISPR gRNA sequence
ccttttgattctttgaatgc

SEQ ID NO: 201506 - DNA, 20 bp, Artificial
  CRISPR gRNA sequence
cttttgattctttgaatgct

SEQ ID NO: 201507 - DNA, 20 bp, Artificial
  CRISPR gRNA sequence
gattctttgaatgctaggat

SEQ ID NO: 201508 - DNA, 20 bp, Artificial
  CRISPR gRNA sequence
tgaatgctaggattagtaac

SEQ ID NO: 201509 - DNA, 20 bp, Artificial
  CRISPR gRNA sequence
gctaggattagtaacaagcc

SEQ ID NO: 201510 - DNA, 20 bp, Artificial
  CRISPR gRNA sequence
aggattagtaacaagccaag

SEQ ID NO: 201511 - DNA, 20 bp, Artificial
  CRISPR gRNA sequence
ggattagtaacaagccaagc

SEQ ID NO: 201512 - DNA, 20 bp, Artificial
  CRISPR gRNA sequence
ttagtaacaagccaagcagg

SEQ ID NO: 201513 - DNA, 20 bp, Artificial
  CRISPR gRNA sequence
taacaagccaagcaggcagt

SEQ ID NO: 201514 - DNA, 20 bp, Artificial
  CRISPR gRNA sequence
aagccaagcaggcagttagt

SEQ ID NO: 201515 - DNA, 20 bp, Artificial
  CRISPR gRNA sequence
agccaagcaggcagttagtg

SEQ ID NO: 201516 - DNA, 20 bp, Artificial
  CRISPR gRNA sequence
agttagtgaggttccacaat

SEQ ID NO: 201517 - DNA, 20 bp, Artificial
  CRISPR gRNA sequence
atatgcaatgatatgctaac

SEQ ID NO: 201518 - DNA, 20 bp, Artificial
  CRISPR gRNA sequence
ctaactagtctacaactcta

SEQ ID NO: 201519 - DNA, 20 bp, Artificial
  CRISPR gRNA sequence
ctacagccaaattaattgta

SEQ ID NO: 201520 - DNA, 20 bp, Artificial
  CRISPR gRNA sequence
aaagctatcatttcattatg

SEQ ID NO: 201521 - DNA, 20 bp, Artificial
  CRISPR gRNA sequence
ttcattatgtagcctttctg

SEQ ID NO: 201522 - DNA, 20 bp, Artificial
  CRISPR gRNA sequence
ctttctgtggatcataccca

SEQ ID NO: 201523 - DNA, 20 bp, Artificial
  CRISPR gRNA sequence
tcatacccacagcattcaca

SEQ ID NO: 201524 - DNA, 20 bp, Artificial
  CRISPR gRNA sequence
catacccacagcattcacaa

SEQ ID NO: 201525 - DNA, 20 bp, Artificial
  CRISPR gRNA sequence
cacagcattcacaaaggaaa

SEQ ID NO: 201526 - DNA, 20 bp, Artificial
  CRISPR gRNA sequence
attcacaaaggaaacagact

SEQ ID NO: 201527 - DNA, 20 bp, Artificial
  CRISPR gRNA sequence
acaaaggaaacagacttagt

SEQ ID NO: 201528 - DNA, 20 bp, Artificial
  CRISPR gRNA sequence
caaaggaaacagacttagtt

SEQ ID NO: 201529 - DNA, 20 bp, Artificial
  CRISPR gRNA sequence
aacagacttagttgggaaat

SEQ ID NO: 201530 - DNA, 20 bp, Artificial
  CRISPR gRNA sequence
cttagttgggaaatcagatc

SEQ ID NO: 201531 - DNA, 20 bp, Artificial
  CRISPR gRNA sequence
ttagttgggaaatcagatct

SEQ ID NO: 201532 - DNA, 20 bp, Artificial
  CRISPR gRNA sequence
aaatcagatctaggtttaca

SEQ ID NO: 201533 - DNA, 20 bp, Artificial
  CRISPR gRNA sequence
cagatctaggtttacaaaga

SEQ ID NO: 201534 - DNA, 20 bp, Artificial
  CRISPR gRNA sequence
ggtttacaaagaaagaaaat

SEQ ID NO: 201535 - DNA, 20 bp, Artificial
  CRISPR gRNA sequence
agaaagaaaatgagatgttt

SEQ ID NO: 201536 - DNA, 20 bp, Artificial
  CRISPR gRNA sequence
gatgttttggtctatctctg

SEQ ID NO: 201537 - DNA, 20 bp, Artificial
  CRISPR gRNA sequence
ttggtctatctctgtggcaa

SEQ ID NO: 201538 - DNA, 20 bp, Artificial
  CRISPR gRNA sequence
aaaatgtgtacatcacaaat

SEQ ID NO: 201539 - DNA, 20 bp, Artificial
  CRISPR gRNA sequence
atgtgtacatcacaaattgg

SEQ ID NO: 201540 - DNA, 20 bp, Artificial
  CRISPR gRNA sequence
catcacaaattggaagtaat

SEQ ID NO: 201541 - DNA, 20 bp, Artificial
  CRISPR gRNA sequence
atcacaaattggaagtaatt

SEQ ID NO: 201542 - DNA, 20 bp, Artificial
  CRISPR gRNA sequence
taattgggatccttctctac

SEQ ID NO: 201543 - DNA, 20 bp, Artificial
  CRISPR gRNA sequence
aattgggatccttctctact

SEQ ID NO: 201544 - DNA, 20 bp, Artificial
  CRISPR gRNA sequence
attgggatccttctctacta

SEQ ID NO: 201545 - DNA, 20 bp, Artificial
  CRISPR gRNA sequence
ttgggatccttctctactag

SEQ ID NO: 201546 - DNA, 20 bp, Artificial
  CRISPR gRNA sequence
tgggatccttctctactagg

SEQ ID NO: 201547 - DNA, 20 bp, Artificial
  CRISPR gRNA sequence
gtgccatgcttcgtctcaac

SEQ ID NO: 201548 - DNA, 20 bp, Artificial
  CRISPR gRNA sequence
ccatgcttcgtctcaaccag

SEQ ID NO: 201549 - DNA, 20 bp, Artificial
  CRISPR gRNA sequence
ttcgtctcaaccagtagcaa

SEQ ID NO: 201550 - DNA, 20 bp, Artificial
  CRISPR gRNA sequence
tcgtctcaaccagtagcaaa

SEQ ID NO: 201551 - DNA, 20 bp, Artificial
  CRISPR gRNA sequence
ccccttgcccaaatatcact

SEQ ID NO: 201552 - DNA, 20 bp, Artificial
  CRISPR gRNA sequence
tgcccaaatatcacttggtt

SEQ ID NO: 201553 - DNA, 20 bp, Artificial
  CRISPR gRNA sequence
gcccaaatatcacttggtta

SEQ ID NO: 201554 - DNA, 20 bp, Artificial
  CRISPR gRNA sequence
aaatatcacttggttaaggt

SEQ ID NO: 201555 - DNA, 20 bp, Artificial
  CRISPR gRNA sequence
tatcacttggttaaggtaag

SEQ ID NO: 201556 - DNA, 20 bp, Artificial
  CRISPR gRNA sequence
ggttaaggtaagcagctact

SEQ ID NO: 201557 - DNA, 20 bp, Artificial
  CRISPR gRNA sequence
ggtaagcagctacttagaca

SEQ ID NO: 201558 - DNA, 20 bp, Artificial
  CRISPR gRNA sequence
gcagctacttagacacagaa

SEQ ID NO: 201559 - DNA, 20 bp, Artificial
  CRISPR gRNA sequence
acagaatagtgcatttttcc

SEQ ID NO: 201560 - DNA, 20 bp, Artificial
  CRISPR gRNA sequence
gaatagtgcatttttcccag

SEQ ID NO: 201561 - DNA, 20 bp, Artificial
  CRISPR gRNA sequence
agtgcatttttcccagtggt

SEQ ID NO: 201562 - DNA, 20 bp, Artificial
  CRISPR gRNA sequence
cagtggtgagaatattataa

SEQ ID NO: 201563 - DNA, 20 bp, Artificial
  CRISPR gRNA sequence
aattcttttttatttttttt

SEQ ID NO: 201564 - DNA, 20 bp, Artificial
  CRISPR gRNA sequence
cttttttattttttttgaga

SEQ ID NO: 201565 - DNA, 20 bp, Artificial
  CRISPR gRNA sequence
tttttattttttttgagaca

SEQ ID NO: 201566 - DNA, 20 bp, Artificial
  CRISPR gRNA sequence
acagagtctcactctgtcac

SEQ ID NO: 201567 - DNA, 20 bp, Artificial
  CRISPR gRNA sequence
cagagtctcactctgtcacc

SEQ ID NO: 201568 - DNA, 20 bp, Artificial
  CRISPR gRNA sequence
gtctcactctgtcaccaggc

SEQ ID NO: 201569 - DNA, 20 bp, Artificial
  CRISPR gRNA sequence
ctcactctgtcaccaggctg

SEQ ID NO: 201570 - DNA, 20 bp, Artificial
  CRISPR gRNA sequence
tctgtcaccaggctggagtg

SEQ ID NO: 201571 - DNA, 20 bp, Artificial
  CRISPR gRNA sequence
gtcaccaggctggagtgcgg

SEQ ID NO: 201572 - DNA, 20 bp, Artificial
  CRISPR gRNA sequence
tcactgcaacatctgccttc

SEQ ID NO: 201573 - DNA, 20 bp, Artificial
  CRISPR gRNA sequence
cactgcaacatctgccttcc

SEQ ID NO: 201574 - DNA, 20 bp, Artificial
  CRISPR gRNA sequence
aacatctgccttccgggttc

SEQ ID NO: 201575 - DNA, 20 bp, Artificial
  CRISPR gRNA sequence
ttcaagcaattctcctgcct

SEQ ID NO: 201576 - DNA, 20 bp, Artificial
  CRISPR gRNA sequence
ttctcctgcctcagcctccc

SEQ ID NO: 201577 - DNA, 20 bp, Artificial
  CRISPR gRNA sequence
tcctgcctcagcctcccgag

SEQ ID NO: 201578 - DNA, 20 bp, Artificial
  CRISPR gRNA sequence
gcctcagcctcccgagtagc

SEQ ID NO: 201579 - DNA, 20 bp, Artificial
  CRISPR gRNA sequence
cctcagcctcccgagtagct

SEQ ID NO: 201580 - DNA, 20 bp, Artificial
  CRISPR gRNA sequence
ctcccgagtagctgggactg

SEQ ID NO: 201581 - DNA, 20 bp, Artificial
  CRISPR gRNA sequence
cagatacacaccaccatgcc

SEQ ID NO: 201582 - DNA, 20 bp, Artificial
  CRISPR gRNA sequence
agatacacaccaccatgccc

SEQ ID NO: 201583 - DNA, 20 bp, Artificial
  CRISPR gRNA sequence
ccaggtaatttttgtatttt

SEQ ID NO: 201584 - DNA, 20 bp, Artificial
  CRISPR gRNA sequence
ggtaatttttgtattttcag

SEQ ID NO: 201585 - DNA, 20 bp, Artificial
  CRISPR gRNA sequence
taatttttgtattttcagta

SEQ ID NO: 201586 - DNA, 20 bp, Artificial
  CRISPR gRNA sequence
ttttgtattttcagtagaga

SEQ ID NO: 201587 - DNA, 20 bp, Artificial
  CRISPR gRNA sequence
tttgtattttcagtagagac

SEQ ID NO: 201588 - DNA, 20 bp, Artificial
  CRISPR gRNA sequence
ttgtattttcagtagagaca

SEQ ID NO: 201589 - DNA, 20 bp, Artificial
  CRISPR gRNA sequence
gagacagggtttcaacatgt

SEQ ID NO: 201590 - DNA, 20 bp, Artificial
  CRISPR gRNA sequence
cagggtttcaacatgttggc

SEQ ID NO: 201591 - DNA, 20 bp, Artificial
  CRISPR gRNA sequence
agggtttcaacatgttggcc

SEQ ID NO: 201592 - DNA, 20 bp, Artificial
  CRISPR gRNA sequence
tttcaacatgttggccagga

SEQ ID NO: 201593 - DNA, 20 bp, Artificial
  CRISPR gRNA sequence
acctcgtgatctgcccgcct

SEQ ID NO: 201594 - DNA, 20 bp, Artificial
  CRISPR gRNA sequence
tctgcccgccttggcctccc

SEQ ID NO: 201595 - DNA, 20 bp, Artificial
  CRISPR gRNA sequence
ctgcccgccttggcctccca

SEQ ID NO: 201596 - DNA, 20 bp, Artificial
  CRISPR gRNA sequence
gccttggcctcccaaggtgc

SEQ ID NO: 201597 - DNA, 20 bp, Artificial
  CRISPR gRNA sequence
ccttggcctcccaaggtgcc

SEQ ID NO: 201598 - DNA, 20 bp, Artificial
  CRISPR gRNA sequence
tcccaaggtgccgggatcgc

SEQ ID NO: 201599 - DNA, 20 bp, Artificial
  CRISPR gRNA sequence
ggtgccgggatcgcaagcgt

SEQ ID NO: 201600 - DNA, 20 bp, Artificial
  CRISPR gRNA sequence
caagcgtgagccaccgcacc

SEQ ID NO: 201601 - DNA, 20 bp, Artificial
  CRISPR gRNA sequence
ataattcttgatgaataatc

SEQ ID NO: 201602 - DNA, 20 bp, Artificial
  CRISPR gRNA sequence
aattcttgatgaataatcaa

SEQ ID NO: 201603 - DNA, 20 bp, Artificial
  CRISPR gRNA sequence
tcttgatgaataatcaagag

SEQ ID NO: 201604 - DNA, 20 bp, Artificial
  CRISPR gRNA sequence
ttgatgaataatcaagagta

SEQ ID NO: 201605 - DNA, 20 bp, Artificial
  CRISPR gRNA sequence
taatcaagagtagagatgcc

SEQ ID NO: 201606 - DNA, 20 bp, Artificial
  CRISPR gRNA sequence
aatcaagagtagagatgcca

SEQ ID NO: 201607 - DNA, 20 bp, Artificial
  CRISPR gRNA sequence
aagagtagagatgccaagga

SEQ ID NO: 201608 - DNA, 20 bp, Artificial
  CRISPR gRNA sequence
agatgccaaggaaagaaaaa

SEQ ID NO: 201609 - DNA, 20 bp, Artificial
  CRISPR gRNA sequence
atgccaaggaaagaaaaaaa

SEQ ID NO: 201610 - DNA, 20 bp, Artificial
  CRISPR gRNA sequence
tgccaaggaaagaaaaaaag

SEQ ID NO: 201611 - DNA, 20 bp, Artificial
  CRISPR gRNA sequence
aaaaaaagaggaaaaaaacc

SEQ ID NO: 201612 - DNA, 20 bp, Artificial
  CRISPR gRNA sequence
aaaaaacctagattcttcct

SEQ ID NO: 201613 - DNA, 20 bp, Artificial
  CRISPR gRNA sequence
aaaaacctagattcttccta

SEQ ID NO: 201614 - DNA, 20 bp, Artificial
  CRISPR gRNA sequence
cctagattcttcctaaggca

SEQ ID NO: 201615 - DNA, 20 bp, Artificial
  CRISPR gRNA sequence
gattcttcctaaggcataga

SEQ ID NO: 201616 - DNA, 20 bp, Artificial
  CRISPR gRNA sequence
attcttcctaaggcatagac

SEQ ID NO: 201617 - DNA, 20 bp, Artificial
  CRISPR gRNA sequence
ttcttcctaaggcatagaca

SEQ ID NO: 201618 - DNA, 20 bp, Artificial
  CRISPR gRNA sequence
agggcattctaactgttttg

SEQ ID NO: 201619 - DNA, 20 bp, Artificial
  CRISPR gRNA sequence
gggcattctaactgttttgc

SEQ ID NO: 201620 - DNA, 20 bp, Artificial
  CRISPR gRNA sequence
attctaactgttttgcgggc

SEQ ID NO: 201621 - DNA, 20 bp, Artificial
  CRISPR gRNA sequence
ggccagatcaaattatgatc

SEQ ID NO: 201622 - DNA, 20 bp, Artificial
  CRISPR gRNA sequence
gatcaaattatgatctggta

SEQ ID NO: 201623 - DNA, 20 bp, Artificial
  CRISPR gRNA sequence
atcaaattatgatctggtaa

SEQ ID NO: 201624 - DNA, 20 bp, Artificial
  CRISPR gRNA sequence
ttatgatctggtaaaggatt

SEQ ID NO: 201625 - DNA, 20 bp, Artificial
  CRISPR gRNA sequence
atgatctggtaaaggattaa

SEQ ID NO: 201626 - DNA, 20 bp, Artificial
  CRISPR gRNA sequence
tgaaataaccacataccatt

SEQ ID NO: 201627 - DNA, 20 bp, Artificial
  CRISPR gRNA sequence
gaaataaccacataccatta

SEQ ID NO: 201628 - DNA, 20 bp, Artificial
  CRISPR gRNA sequence
aaataaccacataccattaa

SEQ ID NO: 201629 - DNA, 20 bp, Artificial
  CRISPR gRNA sequence
aataaccacataccattaag

SEQ ID NO: 201630 - DNA, 20 bp, Artificial
  CRISPR gRNA sequence
accattaaggggttcctcta

SEQ ID NO: 201631 - DNA, 20 bp, Artificial
  CRISPR gRNA sequence
atttatgtcatgtcatttta

SEQ ID NO: 201632 - DNA, 20 bp, Artificial
  CRISPR gRNA sequence
atgctaatatttaaattacg

SEQ ID NO: 201633 - DNA, 20 bp, Artificial
  CRISPR gRNA sequence
taatatttaaattacgtagt

SEQ ID NO: 201634 - DNA, 20 bp, Artificial
  CRISPR gRNA sequence
tatttaaattacgtagtaag

SEQ ID NO: 201635 - DNA, 20 bp, Artificial
  CRISPR gRNA sequence
gtagtaagcagtaaatccta

SEQ ID NO: 201636 - DNA, 20 bp, Artificial
  CRISPR gRNA sequence
aatcctacagtcaaaaaaaa

SEQ ID NO: 201637 - DNA, 20 bp, Artificial
  CRISPR gRNA sequence
aaaaaacaaaacaacgaaat

SEQ ID NO: 201638 - DNA, 20 bp, Artificial
  CRISPR gRNA sequence
aaataagcctgtaaatgtta

SEQ ID NO: 201639 - DNA, 20 bp, Artificial
  CRISPR gRNA sequence
agcctgtaaatgttaaagca

SEQ ID NO: 201640 - DNA, 20 bp, Artificial
  CRISPR gRNA sequence
atgttaaagcaaagcttgcc

SEQ ID NO: 201641 - DNA, 20 bp, Artificial
  CRISPR gRNA sequence
taaagcaaagcttgccaagt

SEQ ID NO: 201642 - DNA, 20 bp, Artificial
  CRISPR gRNA sequence
aaagcaaagcttgccaagtc

SEQ ID NO: 201643 - DNA, 20 bp, Artificial
  CRISPR gRNA sequence
agcttgccaagtcgggttaa

SEQ ID NO: 201644 - DNA, 20 bp, Artificial
  CRISPR gRNA sequence
cttaatattatttttctaaa

SEQ ID NO: 201645 - DNA, 20 bp, Artificial
  CRISPR gRNA sequence
atttcccacttcaccactct

SEQ ID NO: 201646 - DNA, 20 bp, Artificial
  CRISPR gRNA sequence
cacttcaccactctcagctc

SEQ ID NO: 201647 - DNA, 20 bp, Artificial
  CRISPR gRNA sequence
tctaacttctaaaaatatga

SEQ ID NO: 201648 - DNA, 20 bp, Artificial
  CRISPR gRNA sequence
ttctaaaaatatgaaagtgc

SEQ ID NO: 201649 - DNA, 20 bp, Artificial
  CRISPR gRNA sequence
tatgaaagtgcaagcataaa

SEQ ID NO: 201650 - DNA, 20 bp, Artificial
  CRISPR gRNA sequence
gcaagcataaatagcaacaa

SEQ ID NO: 201651 - DNA, 20 bp, Artificial
  CRISPR gRNA sequence
caacaacagaataaataaca

SEQ ID NO: 201652 - DNA, 20 bp, Artificial
  CRISPR gRNA sequence
acagaataaataacacagtg

SEQ ID NO: 201653 - DNA, 20 bp, Artificial
  CRISPR gRNA sequence
agaataaataacacagtgaa

SEQ ID NO: 201654 - DNA, 20 bp, Artificial
  CRISPR gRNA sequence
gaataaataacacagtgaag

SEQ ID NO: 201655 - DNA, 20 bp, Artificial
  CRISPR gRNA sequence
taaataacacagtgaagagg

SEQ ID NO: 201656 - DNA, 20 bp, Artificial
  CRISPR gRNA sequence
ataacacagtgaagaggtgg

SEQ ID NO: 201657 - DNA, 20 bp, Artificial
  CRISPR gRNA sequence
gtgaagaggtggaagcaaaa

SEQ ID NO: 201658 - DNA, 20 bp, Artificial
  CRISPR gRNA sequence
agcaaaacagaatcatcttt

SEQ ID NO: 201659 - DNA, 20 bp, Artificial
  CRISPR gRNA sequence
taagtatcgcaaattgaact

SEQ ID NO: 201660 - DNA, 20 bp, Artificial
  CRISPR gRNA sequence
cgcaaattgaactcagtaac

SEQ ID NO: 201661 - DNA, 20 bp, Artificial
  CRISPR gRNA sequence
gcaaattgaactcagtaact

SEQ ID NO: 201662 - DNA, 20 bp, Artificial
  CRISPR gRNA sequence
attgaactcagtaactggga

SEQ ID NO: 201663 - DNA, 20 bp, Artificial
  CRISPR gRNA sequence
aactgggaaagaaaatgtgt

SEQ ID NO: 201664 - DNA, 20 bp, Artificial
  CRISPR gRNA sequence
actgggaaagaaaatgtgtt

SEQ ID NO: 201665 - DNA, 20 bp, Artificial
  CRISPR gRNA sequence
agaaaatgtgttaggattca

SEQ ID NO: 201666 - DNA, 20 bp, Artificial
  CRISPR gRNA sequence
gaaaatgtgttaggattcac

SEQ ID NO: 201667 - DNA, 20 bp, Artificial
  CRISPR gRNA sequence
tgtgttaggattcacaggtc

SEQ ID NO: 201668 - DNA, 20 bp, Artificial
  CRISPR gRNA sequence
taggattcacaggtccagtt

SEQ ID NO: 201669 - DNA, 20 bp, Artificial
  CRISPR gRNA sequence
cacaggtccagttaagttgc

SEQ ID NO: 201670 - DNA, 20 bp, Artificial
  CRISPR gRNA sequence
ctggcctcttgtgaccaaca

SEQ ID NO: 201671 - DNA, 20 bp, Artificial
  CRISPR gRNA sequence
tcttgtgaccaacatagcta

SEQ ID NO: 201672 - DNA, 20 bp, Artificial
  CRISPR gRNA sequence
agctatggcaccaatctttc

SEQ ID NO: 201673 - DNA, 20 bp, Artificial
  CRISPR gRNA sequence
ctttctagaatatacccctg

SEQ ID NO: 201674 - DNA, 20 bp, Artificial
  CRISPR gRNA sequence
tctagaatatacccctgtgg

SEQ ID NO: 201675 - DNA, 20 bp, Artificial
  CRISPR gRNA sequence
tacccgccccacctgccctt

SEQ ID NO: 201676 - DNA, 20 bp, Artificial
  CRISPR gRNA sequence
acccgccccacctgcccttt

SEQ ID NO: 201677 - DNA, 20 bp, Artificial
  CRISPR gRNA sequence
acctgccctttaggcacaat

SEQ ID NO: 201678 - DNA, 20 bp, Artificial
  CRISPR gRNA sequence
cctgccctttaggcacaatg

SEQ ID NO: 201679 - DNA, 20 bp, Artificial
  CRISPR gRNA sequence
ttaggcacaatgaggcttgt

SEQ ID NO: 201680 - DNA, 20 bp, Artificial
  CRISPR gRNA sequence
acaatgaggcttgtcagact

SEQ ID NO: 201681 - DNA, 20 bp, Artificial
  CRISPR gRNA sequence
atgaggcttgtcagacttag

SEQ ID NO: 201682 - DNA, 20 bp, Artificial
  CRISPR gRNA sequence
gcatatgtgacctctacctc

SEQ ID NO: 201683 - DNA, 20 bp, Artificial
  CRISPR gRNA sequence
gtgacctctacctccggcca

SEQ ID NO: 201684 - DNA, 20 bp, Artificial
  CRISPR gRNA sequence
cctctacctccggccacaga

SEQ ID NO: 201685 - DNA, 20 bp, Artificial
  CRISPR gRNA sequence
ctacctccggccacagacag

SEQ ID NO: 201686 - DNA, 20 bp, Artificial
  CRISPR gRNA sequence
cacagacagaagactctctt

SEQ ID NO: 201687 - DNA, 20 bp, Artificial
  CRISPR gRNA sequence
gaagactctctttggcattc

SEQ ID NO: 201688 - DNA, 20 bp, Artificial
  CRISPR gRNA sequence
catctatcatcactccgtta

SEQ ID NO: 201689 - DNA, 20 bp, Artificial
  CRISPR gRNA sequence
atctatcatcactccgttat

SEQ ID NO: 201690 - DNA, 20 bp, Artificial
  CRISPR gRNA sequence
tatcatcactccgttatagg

SEQ ID NO: 201691 - DNA, 20 bp, Artificial
  CRISPR gRNA sequence
tcactccgttataggaagct

SEQ ID NO: 201692 - DNA, 20 bp, Artificial
  CRISPR gRNA sequence
aagtacaatataatcctttc

SEQ ID NO: 201693 - DNA, 20 bp, Artificial
  CRISPR gRNA sequence
gtacaatataatcctttcca

SEQ ID NO: 201694 - DNA, 20 bp, Artificial
  CRISPR gRNA sequence
tatgtccacaacatacctct

SEQ ID NO: 201695 - DNA, 20 bp, Artificial
  CRISPR gRNA sequence
atgtccacaacatacctctt

SEQ ID NO: 201696 - DNA, 20 bp, Artificial
  CRISPR gRNA sequence
cttgggcctgtcactgtgat

SEQ ID NO: 201697 - DNA, 20 bp, Artificial
  CRISPR gRNA sequence
ctcctttcttgcaatttcct

SEQ ID NO: 201698 - DNA, 20 bp, Artificial
  CRISPR gRNA sequence
tttcttgcaatttcctcaga

SEQ ID NO: 201699 - DNA, 20 bp, Artificial
  CRISPR gRNA sequence
atttcctcagatggcttaat

SEQ ID NO: 201700 - DNA, 20 bp, Artificial
  CRISPR gRNA sequence
tttcctcagatggcttaata

SEQ ID NO: 201701 - DNA, 20 bp, Artificial
  CRISPR gRNA sequence
gatggcttaataaggtatct

SEQ ID NO: 201702 - DNA, 20 bp, Artificial
  CRISPR gRNA sequence
atggcttaataaggtatcta

SEQ ID NO: 201703 - DNA, 20 bp, Artificial
  CRISPR gRNA sequence
ctaaggtacaatgaaacctt

SEQ ID NO: 201704 - DNA, 20 bp, Artificial
  CRISPR gRNA sequence
gtacaatgaaaccttaagca

SEQ ID NO: 201705 - DNA, 20 bp, Artificial
  CRISPR gRNA sequence
gaaaccttaagcacagtttt

SEQ ID NO: 201706 - DNA, 20 bp, Artificial
  CRISPR gRNA sequence
aaaccttaagcacagtttta

SEQ ID NO: 201707 - DNA, 20 bp, Artificial
  CRISPR gRNA sequence
aaccttaagcacagttttaa

SEQ ID NO: 201708 - DNA, 20 bp, Artificial
  CRISPR gRNA sequence
atgtttataaaacatttgta

SEQ ID NO: 201709 - DNA, 20 bp, Artificial
  CRISPR gRNA sequence
tgtttataaaacatttgtat

SEQ ID NO: 201710 - DNA, 20 bp, Artificial
  CRISPR gRNA sequence
tttataaaacatttgtatgg

SEQ ID NO: 201711 - DNA, 20 bp, Artificial
  CRISPR gRNA sequence
tataaaacatttgtatggga

SEQ ID NO: 201712 - DNA, 20 bp, Artificial
  CRISPR gRNA sequence
ataaaacatttgtatgggag

SEQ ID NO: 201713 - DNA, 20 bp, Artificial
  CRISPR gRNA sequence
gatcgaatcataactccgaa

SEQ ID NO: 201714 - DNA, 20 bp, Artificial
  CRISPR gRNA sequence
taactccgaacagatgtttt

SEQ ID NO: 201715 - DNA, 20 bp, Artificial
  CRISPR gRNA sequence
caatatttacatttatttta

SEQ ID NO: 201716 - DNA, 20 bp, Artificial
  CRISPR gRNA sequence
attttatagattataattat

SEQ ID NO: 201717 - DNA, 20 bp, Artificial
  CRISPR gRNA sequence
aattatcagtgatgtcaact

SEQ ID NO: 201718 - DNA, 20 bp, Artificial
  CRISPR gRNA sequence
tcagtgatgtcaacttagta

SEQ ID NO: 201719 - DNA, 20 bp, Artificial
  CRISPR gRNA sequence
atagatttctcctcattttt

SEQ ID NO: 201720 - DNA, 20 bp, Artificial
  CRISPR gRNA sequence
tgcacatccaatgaatccaa

SEQ ID NO: 201721 - DNA, 20 bp, Artificial
  CRISPR gRNA sequence
gcacatccaatgaatccaac

SEQ ID NO: 201722 - DNA, 20 bp, Artificial
  CRISPR gRNA sequence
atccaatgaatccaacaggt

SEQ ID NO: 201723 - DNA, 20 bp, Artificial
  CRISPR gRNA sequence
tccaatgaatccaacaggtg

SEQ ID NO: 201724 - DNA, 20 bp, Artificial
  CRISPR gRNA sequence
caacaggtgaggtgatatat

SEQ ID NO: 201725 - DNA, 20 bp, Artificial
  CRISPR gRNA sequence
gtgaggtgatatattggaat

SEQ ID NO: 201726 - DNA, 20 bp, Artificial
  CRISPR gRNA sequence
aatcagcttccttctgattg

SEQ ID NO: 201727 - DNA, 20 bp, Artificial
  CRISPR gRNA sequence
tcagcttccttctgattgca

SEQ ID NO: 201728 - DNA, 20 bp, Artificial
  CRISPR gRNA sequence
ttctgattgcagagataata

SEQ ID NO: 201729 - DNA, 20 bp, Artificial
  CRISPR gRNA sequence
tagccattattcctactttc

SEQ ID NO: 201730 - DNA, 20 bp, Artificial
  CRISPR gRNA sequence
ttattcctactttccagttt

SEQ ID NO: 201731 - DNA, 20 bp, Artificial
  CRISPR gRNA sequence
tattcctactttccagtttt

SEQ ID NO: 201732 - DNA, 20 bp, Artificial
  CRISPR gRNA sequence
tactttccagttttgggtgt

SEQ ID NO: 201733 - DNA, 20 bp, Artificial
  CRISPR gRNA sequence
tttccagttttgggtgtgag

SEQ ID NO: 201734 - DNA, 20 bp, Artificial
  CRISPR gRNA sequence
cagttttgggtgtgagaagt

SEQ ID NO: 201735 - DNA, 20 bp, Artificial
  CRISPR gRNA sequence
tgagaagtcagtacaatctt

SEQ ID NO: 201736 - DNA, 20 bp, Artificial
  CRISPR gRNA sequence
gacactaaaatgaccaaaca

SEQ ID NO: 201737 - DNA, 20 bp, Artificial
  CRISPR gRNA sequence
acactaaaatgaccaaacac

SEQ ID NO: 201738 - DNA, 20 bp, Artificial
  CRISPR gRNA sequence
accaaacacaggttttaaaa

SEQ ID NO: 201739 - DNA, 20 bp, Artificial
  CRISPR gRNA sequence
cacaggttttaaaatagaac

SEQ ID NO: 201740 - DNA, 20 bp, Artificial
  CRISPR gRNA sequence
gaactggacccattcatgca

SEQ ID NO: 201741 - DNA, 20 bp, Artificial
  CRISPR gRNA sequence
aactggacccattcatgcaa

SEQ ID NO: 201742 - DNA, 20 bp, Artificial
  CRISPR gRNA sequence
acattctcttaatttgacgt

SEQ ID NO: 201743 - DNA, 20 bp, Artificial
  CRISPR gRNA sequence
taatttgacgtgagacaaaa

SEQ ID NO: 201744 - DNA, 20 bp, Artificial
  CRISPR gRNA sequence
ttgacgtgagacaaaacaga

SEQ ID NO: 201745 - DNA, 20 bp, Artificial
  CRISPR gRNA sequence
agcaaaatatctcaattacc

SEQ ID NO: 201746 - DNA, 20 bp, Artificial
  CRISPR gRNA sequence
atctcaattaccaagttcct

SEQ ID NO: 201747 - DNA, 20 bp, Artificial
  CRISPR gRNA sequence
taataaactttaacttaccc

SEQ ID NO: 201748 - DNA, 20 bp, Artificial
  CRISPR gRNA sequence
aataaactttaacttaccct

SEQ ID NO: 201749 - DNA, 20 bp, Artificial
  CRISPR gRNA sequence
taaactttaacttaccctag

SEQ ID NO: 201750 - DNA, 20 bp, Artificial
  CRISPR gRNA sequence
aaactttaacttaccctagg

SEQ ID NO: 201751 - DNA, 20 bp, Artificial
  CRISPR gRNA sequence
acttaccctaggaggttgta

SEQ ID NO: 201752 - DNA, 20 bp, Artificial
  CRISPR gRNA sequence
aggttgtatagtcttctgat

SEQ ID NO: 201753 - DNA, 20 bp, Artificial
  CRISPR gRNA sequence
ttgtatagtcttctgattgg

SEQ ID NO: 201754 - DNA, 20 bp, Artificial
  CRISPR gRNA sequence
agctgatataaataacaaat

SEQ ID NO: 201755 - DNA, 20 bp, Artificial
  CRISPR gRNA sequence
tttaataaatgaaataaact

SEQ ID NO: 201756 - DNA, 20 bp, Artificial
  CRISPR gRNA sequence
ttaataaatgaaataaacta

SEQ ID NO: 201757 - DNA, 20 bp, Artificial
  CRISPR gRNA sequence
atgaaataaactaaggcatt

SEQ ID NO: 201758 - DNA, 20 bp, Artificial
  CRISPR gRNA sequence
atttggtaatgtttaatttt

SEQ ID NO: 201759 - DNA, 20 bp, Artificial
  CRISPR gRNA sequence
taattttaagataaaatgtt

SEQ ID NO: 201760 - DNA, 20 bp, Artificial
  CRISPR gRNA sequence
aattttaagataaaatgttc

SEQ ID NO: 201761 - DNA, 20 bp, Artificial
  CRISPR gRNA sequence
attttaagataaaatgttca

SEQ ID NO: 201762 - DNA, 20 bp, Artificial
  CRISPR gRNA sequence
aatgttcagggctaaaacta

SEQ ID NO: 201763 - DNA, 20 bp, Artificial
  CRISPR gRNA sequence
atgttcagggctaaaactaa

SEQ ID NO: 201764 - DNA, 20 bp, Artificial
  CRISPR gRNA sequence
agggctaaaactaaaggtgc

SEQ ID NO: 201765 - DNA, 20 bp, Artificial
  CRISPR gRNA sequence
ggctaaaactaaaggtgcca

SEQ ID NO: 201766 - DNA, 20 bp, Artificial
  CRISPR gRNA sequence
ggtgccagagatgttaatga

SEQ ID NO: 201767 - DNA, 20 bp, Artificial
  CRISPR gRNA sequence
tgccagagatgttaatgaaa

SEQ ID NO: 201768 - DNA, 20 bp, Artificial
  CRISPR gRNA sequence
agatgttaatgaaagagttc

SEQ ID NO: 201769 - DNA, 20 bp, Artificial
  CRISPR gRNA sequence
tgaaagagttccagctctga

SEQ ID NO: 201770 - DNA, 20 bp, Artificial
  CRISPR gRNA sequence
atacactgatttgaaaaatg

SEQ ID NO: 201771 - DNA, 20 bp, Artificial
  CRISPR gRNA sequence
aataacccatctacatcaaa

SEQ ID NO: 201772 - DNA, 20 bp, Artificial
  CRISPR gRNA sequence
atgccatctttcccccaaat

SEQ ID NO: 201773 - DNA, 20 bp, Artificial
  CRISPR gRNA sequence
aaatcagccacttgttacac

SEQ ID NO: 201774 - DNA, 20 bp, Artificial
  CRISPR gRNA sequence
cagccacttgttacactggc

SEQ ID NO: 201775 - DNA, 20 bp, Artificial
  CRISPR gRNA sequence
ccacttgttacactggctgg

SEQ ID NO: 201776 - DNA, 20 bp, Artificial
  CRISPR gRNA sequence
cacttgttacactggctggt

SEQ ID NO: 201777 - DNA, 20 bp, Artificial
  CRISPR gRNA sequence
tcaccaacatacccccacca

SEQ ID NO: 201778 - DNA, 20 bp, Artificial
  CRISPR gRNA sequence
caccaacatacccccaccat

SEQ ID NO: 201779 - DNA, 20 bp, Artificial
  CRISPR gRNA sequence
tcctccctcctctatctacc

SEQ ID NO: 201780 - DNA, 20 bp, Artificial
  CRISPR gRNA sequence
ctccctcctctatctaccca

SEQ ID NO: 201781 - DNA, 20 bp, Artificial
  CRISPR gRNA sequence
tcctctatctacccagagtg

SEQ ID NO: 201782 - DNA, 20 bp, Artificial
  CRISPR gRNA sequence
ctatctacccagagtgtaga

SEQ ID NO: 201783 - DNA, 20 bp, Artificial
  CRISPR gRNA sequence
agagtgtagacagaatgtgc

SEQ ID NO: 201784 - DNA, 20 bp, Artificial
  CRISPR gRNA sequence
ccccactactccatctccct

SEQ ID NO: 201785 - DNA, 20 bp, Artificial
  CRISPR gRNA sequence
tcactgctcctgtgtcttac

SEQ ID NO: 201786 - DNA, 20 bp, Artificial
  CRISPR gRNA sequence
gctcctgtgtcttacaagct

SEQ ID NO: 201787 - DNA, 20 bp, Artificial
  CRISPR gRNA sequence
tctttctccacatcactccc

SEQ ID NO: 201788 - DNA, 20 bp, Artificial
  CRISPR gRNA sequence
ctttctccacatcactccct

SEQ ID NO: 201789 - DNA, 20 bp, Artificial
  CRISPR gRNA sequence
catcactccctgggtctttc

SEQ ID NO: 201790 - DNA, 20 bp, Artificial
  CRISPR gRNA sequence
cctgggtctttccagtttca

SEQ ID NO: 201791 - DNA, 20 bp, Artificial
  CRISPR gRNA sequence
tttccagtttcaaagctcca

SEQ ID NO: 201792 - DNA, 20 bp, Artificial
  CRISPR gRNA sequence
tccagtttcaaagctccaaa

SEQ ID NO: 201793 - DNA, 20 bp, Artificial
  CRISPR gRNA sequence
tccaaagagctaacaaacta

SEQ ID NO: 201794 - DNA, 20 bp, Artificial
  CRISPR gRNA sequence
aacaaactaaagaaaatact

SEQ ID NO: 201795 - DNA, 20 bp, Artificial
  CRISPR gRNA sequence
aactaaagaaaatactcaga

SEQ ID NO: 201796 - DNA, 20 bp, Artificial
  CRISPR gRNA sequence
gaaaatactcagatagctct

SEQ ID NO: 201797 - DNA, 20 bp, Artificial
  CRISPR gRNA sequence
ttcctctatctatttcttct

SEQ ID NO: 201798 - DNA, 20 bp, Artificial
  CRISPR gRNA sequence
ctatttcttcttagctttct

SEQ ID NO: 201799 - DNA, 20 bp, Artificial
  CRISPR gRNA sequence
cctttttcactgcttccaaa

SEQ ID NO: 201800 - DNA, 20 bp, Artificial
  CRISPR gRNA sequence
tccaaatggattcattaatg

SEQ ID NO: 201801 - DNA, 20 bp, Artificial
  CRISPR gRNA sequence
tggattcattaatgaagttg

SEQ ID NO: 201802 - DNA, 20 bp, Artificial
  CRISPR gRNA sequence
ggattcattaatgaagttga

SEQ ID NO: 201803 - DNA, 20 bp, Artificial
  CRISPR gRNA sequence
ttaatgaagttgaaggaata

SEQ ID NO: 201804 - DNA, 20 bp, Artificial
  CRISPR gRNA sequence
gttgaaggaatacagtacat

SEQ ID NO: 201805 - DNA, 20 bp, Artificial
  CRISPR gRNA sequence
aggaatacagtacatgagca

SEQ ID NO: 201806 - DNA, 20 bp, Artificial
  CRISPR gRNA sequence
gtacatgagcaaagtgacga

SEQ ID NO: 201807 - DNA, 20 bp, Artificial
  CRISPR gRNA sequence
tacatgagcaaagtgacgaa

SEQ ID NO: 201808 - DNA, 20 bp, Artificial
  CRISPR gRNA sequence
acatgagcaaagtgacgaaa

SEQ ID NO: 201809 - DNA, 20 bp, Artificial
  CRISPR gRNA sequence
gcaaagtgacgaaagggaaa

SEQ ID NO: 201810 - DNA, 20 bp, Artificial
  CRISPR gRNA sequence
gaaagggaaaaagaataccc

SEQ ID NO: 201811 - DNA, 20 bp, Artificial
  CRISPR gRNA sequence
gggaaaaagaataccctagt

SEQ ID NO: 201812 - DNA, 20 bp, Artificial
  CRISPR gRNA sequence
ggaaaaagaataccctagtt

SEQ ID NO: 201813 - DNA, 20 bp, Artificial
  CRISPR gRNA sequence
gaaaaagaataccctagttg

SEQ ID NO: 201814 - DNA, 20 bp, Artificial
  CRISPR gRNA sequence
aaaagaataccctagttggg

SEQ ID NO: 201815 - DNA, 20 bp, Artificial
  CRISPR gRNA sequence
aaagaataccctagttgggg

SEQ ID NO: 201816 - DNA, 20 bp, Artificial
  CRISPR gRNA sequence
aagaataccctagttgggga

SEQ ID NO: 201817 - DNA, 20 bp, Artificial
  CRISPR gRNA sequence
aataccctagttggggaggg

SEQ ID NO: 201818 - DNA, 20 bp, Artificial
  CRISPR gRNA sequence
accctagttggggagggaag

SEQ ID NO: 201819 - DNA, 20 bp, Artificial
  CRISPR gRNA sequence
cctagttggggagggaagaa

SEQ ID NO: 201820 - DNA, 20 bp, Artificial
  CRISPR gRNA sequence
gttggggagggaagaagaga

SEQ ID NO: 201821 - DNA, 20 bp, Artificial
  CRISPR gRNA sequence
tccttataaaaaaaacaaat

SEQ ID NO: 201822 - DNA, 20 bp, Artificial
  CRISPR gRNA sequence
ttataaaaaaaacaaatgag

SEQ ID NO: 201823 - DNA, 20 bp, Artificial
  CRISPR gRNA sequence
tataaaaaaaacaaatgaga

SEQ ID NO: 201824 - DNA, 20 bp, Artificial
  CRISPR gRNA sequence
aaaaaaacaaatgagaaggc

SEQ ID NO: 201825 - DNA, 20 bp, Artificial
  CRISPR gRNA sequence
acaaatgagaaggctggccg

SEQ ID NO: 201826 - DNA, 20 bp, Artificial
  CRISPR gRNA sequence
aatgagaaggctggccgtgg

SEQ ID NO: 201827 - DNA, 20 bp, Artificial
  CRISPR gRNA sequence
gtggctcatgcctgtaatcc

SEQ ID NO: 201828 - DNA, 20 bp, Artificial
  CRISPR gRNA sequence
tgcctgtaatcccagcactt

SEQ ID NO: 201829 - DNA, 20 bp, Artificial
  CRISPR gRNA sequence
gcctgtaatcccagcacttt

SEQ ID NO: 201830 - DNA, 20 bp, Artificial
  CRISPR gRNA sequence
ctgtaatcccagcactttgg

SEQ ID NO: 201831 - DNA, 20 bp, Artificial
  CRISPR gRNA sequence
tgtaatcccagcactttggg

SEQ ID NO: 201832 - DNA, 20 bp, Artificial
  CRISPR gRNA sequence
tcccagcactttgggaggcc

SEQ ID NO: 201833 - DNA, 20 bp, Artificial
  CRISPR gRNA sequence
cccagcactttgggaggcca

SEQ ID NO: 201834 - DNA, 20 bp, Artificial
  CRISPR gRNA sequence
ctttgggaggccaaggcaaa

SEQ ID NO: 201835 - DNA, 20 bp, Artificial
  CRISPR gRNA sequence
ccaaggcaaatagattgctt

SEQ ID NO: 201836 - DNA, 20 bp, Artificial
  CRISPR gRNA sequence
gcaaatagattgcttgagct

SEQ ID NO: 201837 - DNA, 20 bp, Artificial
  CRISPR gRNA sequence
caaatagattgcttgagctc

SEQ ID NO: 201838 - DNA, 20 bp, Artificial
  CRISPR gRNA sequence
ttgcttgagctcaggcattc

SEQ ID NO: 201839 - DNA, 20 bp, Artificial
  CRISPR gRNA sequence
tgagctcaggcattcaagac

SEQ ID NO: 201840 - DNA, 20 bp, Artificial
  CRISPR gRNA sequence
tcaggcattcaagaccagcc

SEQ ID NO: 201841 - DNA, 20 bp, Artificial
  CRISPR gRNA sequence
caggcattcaagaccagcct

SEQ ID NO: 201842 - DNA, 20 bp, Artificial
  CRISPR gRNA sequence
tctaccaaaaatacaaaaat

SEQ ID NO: 201843 - DNA, 20 bp, Artificial
  CRISPR gRNA sequence
ccaaaaatacaaaaattagc

SEQ ID NO: 201844 - DNA, 20 bp, Artificial
  CRISPR gRNA sequence
aatacaaaaattagctggcg

SEQ ID NO: 201845 - DNA, 20 bp, Artificial
  CRISPR gRNA sequence
acaaaaattagctggcgtgg

SEQ ID NO: 201846 - DNA, 20 bp, Artificial
  CRISPR gRNA sequence
ggcgtggtggtgcatgcctg

SEQ ID NO: 201847 - DNA, 20 bp, Artificial
  CRISPR gRNA sequence
atgcctgtggtgcatgcctg

SEQ ID NO: 201848 - DNA, 20 bp, Artificial
  CRISPR gRNA sequence
gtggtgcatgcctgtagtcc

SEQ ID NO: 201849 - DNA, 20 bp, Artificial
  CRISPR gRNA sequence
tgcctgtagtcccagctacg

SEQ ID NO: 201850 - DNA, 20 bp, Artificial
  CRISPR gRNA sequence
ctgtagtcccagctacgtgg

SEQ ID NO: 201851 - DNA, 20 bp, Artificial
  CRISPR gRNA sequence
tgtagtcccagctacgtgga

SEQ ID NO: 201852 - DNA, 20 bp, Artificial
  CRISPR gRNA sequence
tcccagctacgtggaaggct

SEQ ID NO: 201853 - DNA, 20 bp, Artificial
  CRISPR gRNA sequence
cccagctacgtggaaggctg

SEQ ID NO: 201854 - DNA, 20 bp, Artificial
  CRISPR gRNA sequence
agctacgtggaaggctgagg

SEQ ID NO: 201855 - DNA, 20 bp, Artificial
  CRISPR gRNA sequence
gctacgtggaaggctgaggt

SEQ ID NO: 201856 - DNA, 20 bp, Artificial
  CRISPR gRNA sequence
tacgtggaaggctgaggtgg

SEQ ID NO: 201857 - DNA, 20 bp, Artificial
  CRISPR gRNA sequence
acgtggaaggctgaggtggg

SEQ ID NO: 201858 - DNA, 20 bp, Artificial
  CRISPR gRNA sequence
tgggaggatctccctcgtcc

SEQ ID NO: 201859 - DNA, 20 bp, Artificial
  CRISPR gRNA sequence
gggaggatctccctcgtcct

SEQ ID NO: 201860 - DNA, 20 bp, Artificial
  CRISPR gRNA sequence
gaggatctccctcgtcctgg

SEQ ID NO: 201861 - DNA, 20 bp, Artificial
  CRISPR gRNA sequence
aggatctccctcgtcctggg

SEQ ID NO: 201862 - DNA, 20 bp, Artificial
  CRISPR gRNA sequence
atctccctcgtcctgggagg

SEQ ID NO: 201863 - DNA, 20 bp, Artificial
  CRISPR gRNA sequence
ctccctcgtcctgggaggca

SEQ ID NO: 201864 - DNA, 20 bp, Artificial
  CRISPR gRNA sequence
tccctcgtcctgggaggcag

SEQ ID NO: 201865 - DNA, 20 bp, Artificial
  CRISPR gRNA sequence
gtcctgggaggcagaggctg

SEQ ID NO: 201866 - DNA, 20 bp, Artificial
  CRISPR gRNA sequence
tgggaggcagaggctgcagc

SEQ ID NO: 201867 - DNA, 20 bp, Artificial
  CRISPR gRNA sequence
aggcagaggctgcagcgagc

SEQ ID NO: 201868 - DNA, 20 bp, Artificial
  CRISPR gRNA sequence
ggcagaggctgcagcgagct

SEQ ID NO: 201869 - DNA, 20 bp, Artificial
  CRISPR gRNA sequence
gcagaggctgcagcgagctg

SEQ ID NO: 201870 - DNA, 20 bp, Artificial
  CRISPR gRNA sequence
ggggtcgtgccactgcactc

SEQ ID NO: 201871 - DNA, 20 bp, Artificial
  CRISPR gRNA sequence
cgtgccactgcactccagcc

SEQ ID NO: 201872 - DNA, 20 bp, Artificial
  CRISPR gRNA sequence
gtgccactgcactccagcct

SEQ ID NO: 201873 - DNA, 20 bp, Artificial
  CRISPR gRNA sequence
ctgcactccagcctgggcga

SEQ ID NO: 201874 - DNA, 20 bp, Artificial
  CRISPR gRNA sequence
gcactccagcctgggcgaca

SEQ ID NO: 201875 - DNA, 20 bp, Artificial
  CRISPR gRNA sequence
tccagcctgggcgacagagc

SEQ ID NO: 201876 - DNA, 20 bp, Artificial
  CRISPR gRNA sequence
cccaaaaaaacaaataaata

SEQ ID NO: 201877 - DNA, 20 bp, Artificial
  CRISPR gRNA sequence
aaaacaaataaatacagaat

SEQ ID NO: 201878 - DNA, 20 bp, Artificial
  CRISPR gRNA sequence
aatacagaataagaatccta

SEQ ID NO: 201879 - DNA, 20 bp, Artificial
  CRISPR gRNA sequence
cagaataagaatcctacaga

SEQ ID NO: 201880 - DNA, 20 bp, Artificial
  CRISPR gRNA sequence
taagaatcctacagatggaa

SEQ ID NO: 201881 - DNA, 20 bp, Artificial
  CRISPR gRNA sequence
acagatggaaaagcgttgaa

SEQ ID NO: 201882 - DNA, 20 bp, Artificial
  CRISPR gRNA sequence
gaaacatgccatgaaccact

SEQ ID NO: 201883 - DNA, 20 bp, Artificial
  CRISPR gRNA sequence
acatgccatgaaccactcag

SEQ ID NO: 201884 - DNA, 20 bp, Artificial
  CRISPR gRNA sequence
catgccatgaaccactcagc

SEQ ID NO: 201885 - DNA, 20 bp, Artificial
  CRISPR gRNA sequence
tgccatgaaccactcagcag

SEQ ID NO: 201886 - DNA, 20 bp, Artificial
  CRISPR gRNA sequence
gccatgaaccactcagcagg

SEQ ID NO: 201887 - DNA, 20 bp, Artificial
  CRISPR gRNA sequence
ccatgaaccactcagcagga

SEQ ID NO: 201888 - DNA, 20 bp, Artificial
  CRISPR gRNA sequence
catgaaccactcagcaggag

SEQ ID NO: 201889 - DNA, 20 bp, Artificial
  CRISPR gRNA sequence
atgaaccactcagcaggagg

SEQ ID NO: 201890 - DNA, 20 bp, Artificial
  CRISPR gRNA sequence
aggagggggatcctactgaa

SEQ ID NO: 201891 - DNA, 20 bp, Artificial
  CRISPR gRNA sequence
gagggggatcctactgaaca

SEQ ID NO: 201892 - DNA, 20 bp, Artificial
  CRISPR gRNA sequence
gggggatcctactgaacaga

SEQ ID NO: 201893 - DNA, 20 bp, Artificial
  CRISPR gRNA sequence
ggggatcctactgaacagag

SEQ ID NO: 201894 - DNA, 20 bp, Artificial
  CRISPR gRNA sequence
aacagagaggcccattccgc

SEQ ID NO: 201895 - DNA, 20 bp, Artificial
  CRISPR gRNA sequence
acagagaggcccattccgct

SEQ ID NO: 201896 - DNA, 20 bp, Artificial
  CRISPR gRNA sequence
aggcccattccgctgggacc

SEQ ID NO: 201897 - DNA, 20 bp, Artificial
  CRISPR gRNA sequence
ggcccattccgctgggacct

SEQ ID NO: 201898 - DNA, 20 bp, Artificial
  CRISPR gRNA sequence
cattccgctgggacctgggc

SEQ ID NO: 201899 - DNA, 20 bp, Artificial
  CRISPR gRNA sequence
ctgggacctgggctggatga

SEQ ID NO: 201900 - DNA, 20 bp, Artificial
  CRISPR gRNA sequence
cctgggctggatgacagcac

SEQ ID NO: 201901 - DNA, 20 bp, Artificial
  CRISPR gRNA sequence
acagcactggattttctcat

SEQ ID NO: 201902 - DNA, 20 bp, Artificial
  CRISPR gRNA sequence
gcactggattttctcatcag

SEQ ID NO: 201903 - DNA, 20 bp, Artificial
  CRISPR gRNA sequence
tggattttctcatcagcaga

SEQ ID NO: 201904 - DNA, 20 bp, Artificial
  CRISPR gRNA sequence
gattttctcatcagcagatg

SEQ ID NO: 201905 - DNA, 20 bp, Artificial
  CRISPR gRNA sequence
attttctcatcagcagatgg

SEQ ID NO: 201906 - DNA, 20 bp, Artificial
  CRISPR gRNA sequence
agcagatggaggcacgcctc

SEQ ID NO: 201907 - DNA, 20 bp, Artificial
  CRISPR gRNA sequence
gcagatggaggcacgcctcc

SEQ ID NO: 201908 - DNA, 20 bp, Artificial
  CRISPR gRNA sequence
ctgcacactcgaattctgtc

SEQ ID NO: 201909 - DNA, 20 bp, Artificial
  CRISPR gRNA sequence
cgaattctgtcaagcttcca

SEQ ID NO: 201910 - DNA, 20 bp, Artificial
  CRISPR gRNA sequence
ttctgtcaagcttccaaagc

SEQ ID NO: 201911 - DNA, 20 bp, Artificial
  CRISPR gRNA sequence
tgtcaagcttccaaagctgg

SEQ ID NO: 201912 - DNA, 20 bp, Artificial
  CRISPR gRNA sequence
gtcaagcttccaaagctggc

SEQ ID NO: 201913 - DNA, 20 bp, Artificial
  CRISPR gRNA sequence
tcaagcttccaaagctggca

SEQ ID NO: 201914 - DNA, 20 bp, Artificial
  CRISPR gRNA sequence
cttccaaagctggcagggaa

SEQ ID NO: 201915 - DNA, 20 bp, Artificial
  CRISPR gRNA sequence
ttccaaagctggcagggaaa

SEQ ID NO: 201916 - DNA, 20 bp, Artificial
  CRISPR gRNA sequence
tccaaagctggcagggaaaa

SEQ ID NO: 201917 - DNA, 20 bp, Artificial
  CRISPR gRNA sequence
aaagctggcagggaaaaggg

SEQ ID NO: 201918 - DNA, 20 bp, Artificial
  CRISPR gRNA sequence
aagctggcagggaaaagggt

SEQ ID NO: 201919 - DNA, 20 bp, Artificial
  CRISPR gRNA sequence
aaaagggtgggtcctgaccc

SEQ ID NO: 201920 - DNA, 20 bp, Artificial
  CRISPR gRNA sequence
aaagggtgggtcctgaccca

SEQ ID NO: 201921 - DNA, 20 bp, Artificial
  CRISPR gRNA sequence
ggtgggtcctgacccaagga

SEQ ID NO: 201922 - DNA, 20 bp, Artificial
  CRISPR gRNA sequence
cccaaggaaagccaatctgt

SEQ ID NO: 201923 - DNA, 20 bp, Artificial
  CRISPR gRNA sequence
aggaaagccaatctgtgagc

SEQ ID NO: 201924 - DNA, 20 bp, Artificial
  CRISPR gRNA sequence
ccaatctgtgagccagccaa

SEQ ID NO: 201925 - DNA, 20 bp, Artificial
  CRISPR gRNA sequence
tctgtgagccagccaaaagc

SEQ ID NO: 201926 - DNA, 20 bp, Artificial
  CRISPR gRNA sequence
tgagccagccaaaagctggt

SEQ ID NO: 201927 - DNA, 20 bp, Artificial
  CRISPR gRNA sequence
gctggtgagtctttctcaaa

SEQ ID NO: 201928 - DNA, 20 bp, Artificial
  CRISPR gRNA sequence
ctggtgagtctttctcaaac

SEQ ID NO: 201929 - DNA, 20 bp, Artificial
  CRISPR gRNA sequence
tctttctcaaacaggaaaaa

SEQ ID NO: 201930 - DNA, 20 bp, Artificial
  CRISPR gRNA sequence
tcaaacaggaaaaatggcaa

SEQ ID NO: 201931 - DNA, 20 bp, Artificial
  CRISPR gRNA sequence
caggaaaaatggcaacagac

SEQ ID NO: 201932 - DNA, 20 bp, Artificial
  CRISPR gRNA sequence
tggcaacagactggactgac

SEQ ID NO: 201933 - DNA, 20 bp, Artificial
  CRISPR gRNA sequence
gacaagtttctccctgccac

SEQ ID NO: 201934 - DNA, 20 bp, Artificial
  CRISPR gRNA sequence
tctccctgccactggactct

SEQ ID NO: 201935 - DNA, 20 bp, Artificial
  CRISPR gRNA sequence
ccctgccactggactctaag

SEQ ID NO: 201936 - DNA, 20 bp, Artificial
  CRISPR gRNA sequence
cactggactctaagaagaaa

SEQ ID NO: 201937 - DNA, 20 bp, Artificial
  CRISPR gRNA sequence
agaagaaacagaaaaaaacc

SEQ ID NO: 201938 - DNA, 20 bp, Artificial
  CRISPR gRNA sequence
gaaacagaaaaaaacccaga

SEQ ID NO: 201939 - DNA, 20 bp, Artificial
  CRISPR gRNA sequence
cagaaaaaaacccagaaagt

SEQ ID NO: 201940 - DNA, 20 bp, Artificial
  CRISPR gRNA sequence
aaaacccagaaagttggtga

SEQ ID NO: 201941 - DNA, 20 bp, Artificial
  CRISPR gRNA sequence
aaacccagaaagttggtgat

SEQ ID NO: 201942 - DNA, 20 bp, Artificial
  CRISPR gRNA sequence
cccagaaagttggtgatggg

SEQ ID NO: 201943 - DNA, 20 bp, Artificial
  CRISPR gRNA sequence
ccagaaagttggtgatggga

SEQ ID NO: 201944 - DNA, 20 bp, Artificial
  CRISPR gRNA sequence
cagaaagttggtgatgggaa

SEQ ID NO: 201945 - DNA, 20 bp, Artificial
  CRISPR gRNA sequence
aagttggtgatgggaaggga

SEQ ID NO: 201946 - DNA, 20 bp, Artificial
  CRISPR gRNA sequence
gatgggaagggaaagtgaaa

SEQ ID NO: 201947 - DNA, 20 bp, Artificial
  CRISPR gRNA sequence
aagggaaagtgaaaaagaaa

SEQ ID NO: 201948 - DNA, 20 bp, Artificial
  CRISPR gRNA sequence
gaaagtgaaaaagaaacaga

SEQ ID NO: 201949 - DNA, 20 bp, Artificial
  CRISPR gRNA sequence
aaagtgaaaaagaaacagaa

SEQ ID NO: 201950 - DNA, 20 bp, Artificial
  CRISPR gRNA sequence
agtgaaaaagaaacagaaag

SEQ ID NO: 201951 - DNA, 20 bp, Artificial
  CRISPR gRNA sequence
aaaagaaacagaaaggagac

SEQ ID NO: 201952 - DNA, 20 bp, Artificial
  CRISPR gRNA sequence
aaagaaacagaaaggagaca

SEQ ID NO: 201953 - DNA, 20 bp, Artificial
  CRISPR gRNA sequence
aacagaaaggagacaaggat

SEQ ID NO: 201954 - DNA, 20 bp, Artificial
  CRISPR gRNA sequence
aggagacaaggatgagtcca

SEQ ID NO: 201955 - DNA, 20 bp, Artificial
  CRISPR gRNA sequence
caaggatgagtccaaagctg

SEQ ID NO: 201956 - DNA, 20 bp, Artificial
  CRISPR gRNA sequence
aaggatgagtccaaagctgt

SEQ ID NO: 201957 - DNA, 20 bp, Artificial
  CRISPR gRNA sequence
atgagtccaaagctgtaggt

SEQ ID NO: 201958 - DNA, 20 bp, Artificial
  CRISPR gRNA sequence
tccaaagctgtaggtaagaa

SEQ ID NO: 201959 - DNA, 20 bp, Artificial
  CRISPR gRNA sequence
aggtaagaaaagttgtctgt

SEQ ID NO: 201960 - DNA, 20 bp, Artificial
  CRISPR gRNA sequence
taagaaaagttgtctgtgag

SEQ ID NO: 201961 - DNA, 20 bp, Artificial
  CRISPR gRNA sequence
aagaaaagttgtctgtgaga

SEQ ID NO: 201962 - DNA, 20 bp, Artificial
  CRISPR gRNA sequence
tgtctgtgagaaggcatgaa

SEQ ID NO: 201963 - DNA, 20 bp, Artificial
  CRISPR gRNA sequence
gtctgtgagaaggcatgaat

SEQ ID NO: 201964 - DNA, 20 bp, Artificial
  CRISPR gRNA sequence
ggcatgaataggataaaaaa

SEQ ID NO: 201965 - DNA, 20 bp, Artificial
  CRISPR gRNA sequence
atgaataggataaaaaacag

SEQ ID NO: 201966 - DNA, 20 bp, Artificial
  CRISPR gRNA sequence
taaaaaacagtggcataaac

SEQ ID NO: 201967 - DNA, 20 bp, Artificial
  CRISPR gRNA sequence
aaaaacagtggcataaacaa

SEQ ID NO: 201968 - DNA, 20 bp, Artificial
  CRISPR gRNA sequence
aaaacagtggcataaacaag

SEQ ID NO: 201969 - DNA, 20 bp, Artificial
  CRISPR gRNA sequence
aaacagtggcataaacaaga

SEQ ID NO: 201970 - DNA, 20 bp, Artificial
  CRISPR gRNA sequence
agtggcataaacaagagggt

SEQ ID NO: 201971 - DNA, 20 bp, Artificial
  CRISPR gRNA sequence
gcataaacaagagggtgagc

SEQ ID NO: 201972 - DNA, 20 bp, Artificial
  CRISPR gRNA sequence
aaacaagagggtgagctagc

SEQ ID NO: 201973 - DNA, 20 bp, Artificial
  CRISPR gRNA sequence
agggtgagctagctggctaa

SEQ ID NO: 201974 - DNA, 20 bp, Artificial
  CRISPR gRNA sequence
gggtgagctagctggctaat

SEQ ID NO: 201975 - DNA, 20 bp, Artificial
  CRISPR gRNA sequence
agctagctggctaataggca

SEQ ID NO: 201976 - DNA, 20 bp, Artificial
  CRISPR gRNA sequence
ggctaataggcaaagaatca

SEQ ID NO: 201977 - DNA, 20 bp, Artificial
  CRISPR gRNA sequence
aataggcaaagaatcaaaga

SEQ ID NO: 201978 - DNA, 20 bp, Artificial
  CRISPR gRNA sequence
taggcaaagaatcaaagaca

SEQ ID NO: 201979 - DNA, 20 bp, Artificial
  CRISPR gRNA sequence
aggcaaagaatcaaagacag

SEQ ID NO: 201980 - DNA, 20 bp, Artificial
  CRISPR gRNA sequence
gaatcaaagacagaggaact

SEQ ID NO: 201981 - DNA, 20 bp, Artificial
  CRISPR gRNA sequence
aatcaaagacagaggaactc

SEQ ID NO: 201982 - DNA, 20 bp, Artificial
  CRISPR gRNA sequence
aactcaggaactataactga

SEQ ID NO: 201983 - DNA, 20 bp, Artificial
  CRISPR gRNA sequence
actcaggaactataactgac

SEQ ID NO: 201984 - DNA, 20 bp, Artificial
  CRISPR gRNA sequence
ctcaggaactataactgaca

SEQ ID NO: 201985 - DNA, 20 bp, Artificial
  CRISPR gRNA sequence
tcaggaactataactgacag

SEQ ID NO: 201986 - DNA, 20 bp, Artificial
  CRISPR gRNA sequence
atcaccttactcttgctgct

SEQ ID NO: 201987 - DNA, 20 bp, Artificial
  CRISPR gRNA sequence
caccttactcttgctgctga

SEQ ID NO: 201988 - DNA, 20 bp, Artificial
  CRISPR gRNA sequence
accttactcttgctgctgag

SEQ ID NO: 201989 - DNA, 20 bp, Artificial
  CRISPR gRNA sequence
ccttactcttgctgctgaga

SEQ ID NO: 201990 - DNA, 20 bp, Artificial
  CRISPR gRNA sequence
gagagggcaacacgatgctt

SEQ ID NO: 201991 - DNA, 20 bp, Artificial
  CRISPR gRNA sequence
gatgcttcagttctttgata

SEQ ID NO: 201992 - DNA, 20 bp, Artificial
  CRISPR gRNA sequence
ttcagttctttgatatggaa

SEQ ID NO: 201993 - DNA, 20 bp, Artificial
  CRISPR gRNA sequence
gaatggatccttccaattcc

SEQ ID NO: 201994 - DNA, 20 bp, Artificial
  CRISPR gRNA sequence
acatactgtcccacccctgt

SEQ ID NO: 201995 - DNA, 20 bp, Artificial
  CRISPR gRNA sequence
catactgtcccacccctgtg

SEQ ID NO: 201996 - DNA, 20 bp, Artificial
  CRISPR gRNA sequence
tgtcccacccctgtgaggcc

SEQ ID NO: 201997 - DNA, 20 bp, Artificial
  CRISPR gRNA sequence
tgaggcccagttatgtatct

SEQ ID NO: 201998 - DNA, 20 bp, Artificial
  CRISPR gRNA sequence
cagttatgtatctgagctca

SEQ ID NO: 201999 - DNA, 20 bp, Artificial
  CRISPR gRNA sequence
agttatgtatctgagctcat

SEQ ID NO: 202000 - DNA, 20 bp, Artificial
  CRISPR gRNA sequence
ttatgtatctgagctcatag

SEQ ID NO: 202001 - DNA, 20 bp, Artificial
  CRISPR gRNA sequence
tatctgagctcataggagtc

SEQ ID NO: 202002 - DNA, 20 bp, Artificial
  CRISPR gRNA sequence
cataggagtccagtttctgt

SEQ ID NO: 202003 - DNA, 20 bp, Artificial
  CRISPR gRNA sequence
tccagtttctgttagtgcca

SEQ ID NO: 202004 - DNA, 20 bp, Artificial
  CRISPR gRNA sequence
ccagtttctgttagtgccat

SEQ ID NO: 202005 - DNA, 20 bp, Artificial
  CRISPR gRNA sequence
gtttctgttagtgccatggg

SEQ ID NO: 202006 - DNA, 20 bp, Artificial
  CRISPR gRNA sequence
gtgccatgggcggctttaaa

SEQ ID NO: 202007 - DNA, 20 bp, Artificial
  CRISPR gRNA sequence
tgccatgggcggctttaaat

SEQ ID NO: 202008 - DNA, 20 bp, Artificial
  CRISPR gRNA sequence
taaataggcctcccttactg

SEQ ID NO: 202009 - DNA, 20 bp, Artificial
  CRISPR gRNA sequence
aataggcctcccttactgtg

SEQ ID NO: 202010 - DNA, 20 bp, Artificial
  CRISPR gRNA sequence
ataggcctcccttactgtgg

SEQ ID NO: 202011 - DNA, 20 bp, Artificial
  CRISPR gRNA sequence
tcccttactgtggaggaacc

SEQ ID NO: 202012 - DNA, 20 bp, Artificial
  CRISPR gRNA sequence
cccttactgtggaggaacct

SEQ ID NO: 202013 - DNA, 20 bp, Artificial
  CRISPR gRNA sequence
ccttactgtggaggaacctg

SEQ ID NO: 202014 - DNA, 20 bp, Artificial
  CRISPR gRNA sequence
cttactgtggaggaacctgg

SEQ ID NO: 202015 - DNA, 20 bp, Artificial
  CRISPR gRNA sequence
tactgtggaggaacctgggg

SEQ ID NO: 202016 - DNA, 20 bp, Artificial
  CRISPR gRNA sequence
aggaacctgggggagtgact

SEQ ID NO: 202017 - DNA, 20 bp, Artificial
  CRISPR gRNA sequence
cttggtccttgtatccaaac

SEQ ID NO: 202018 - DNA, 20 bp, Artificial
  CRISPR gRNA sequence
ggtccttgtatccaaacaag

SEQ ID NO: 202019 - DNA, 20 bp, Artificial
  CRISPR gRNA sequence
aagaagccaacctcttttta

SEQ ID NO: 202020 - DNA, 20 bp, Artificial
  CRISPR gRNA sequence
aagccaacctctttttaaag

SEQ ID NO: 202021 - DNA, 20 bp, Artificial
  CRISPR gRNA sequence
aacctctttttaaagtagaa

SEQ ID NO: 202022 - DNA, 20 bp, Artificial
  CRISPR gRNA sequence
acctctttttaaagtagaac

SEQ ID NO: 202023 - DNA, 20 bp, Artificial
  CRISPR gRNA sequence
cctctttttaaagtagaaca

SEQ ID NO: 202024 - DNA, 20 bp, Artificial
  CRISPR gRNA sequence
taaagtagaacagggtaaaa

SEQ ID NO: 202025 - DNA, 20 bp, Artificial
  CRISPR gRNA sequence
aaagtagaacagggtaaaat

SEQ ID NO: 202026 - DNA, 20 bp, Artificial
  CRISPR gRNA sequence
tagaacagggtaaaatgggt

SEQ ID NO: 202027 - DNA, 20 bp, Artificial
  CRISPR gRNA sequence
agaacagggtaaaatgggtt

SEQ ID NO: 202028 - DNA, 20 bp, Artificial
  CRISPR gRNA sequence
gggttgggatgcactacatt

SEQ ID NO: 202029 - DNA, 20 bp, Artificial
  CRISPR gRNA sequence
ttgggatgcactacatttag

SEQ ID NO: 202030 - DNA, 20 bp, Artificial
  CRISPR gRNA sequence
agcagcctccccaataaact

SEQ ID NO: 202031 - DNA, 20 bp, Artificial
  CRISPR gRNA sequence
agcctccccaataaactaag

SEQ ID NO: 202032 - DNA, 20 bp, Artificial
  CRISPR gRNA sequence
caataaactaagcagaaata

SEQ ID NO: 202033 - DNA, 20 bp, Artificial
  CRISPR gRNA sequence
ataaactaagcagaaataca

SEQ ID NO: 202034 - DNA, 20 bp, Artificial
  CRISPR gRNA sequence
cagaaatacagagctttatt

SEQ ID NO: 202035 - DNA, 20 bp, Artificial
  CRISPR gRNA sequence
agaaatacagagctttattt

SEQ ID NO: 202036 - DNA, 20 bp, Artificial
  CRISPR gRNA sequence
agagctttatttgggaacat

SEQ ID NO: 202037 - DNA, 20 bp, Artificial
  CRISPR gRNA sequence
gagctttatttgggaacatc

SEQ ID NO: 202038 - DNA, 20 bp, Artificial
  CRISPR gRNA sequence
tttatttgggaacatcagga

SEQ ID NO: 202039 - DNA, 20 bp, Artificial
  CRISPR gRNA sequence
ccttatatctatgttctaca

SEQ ID NO: 202040 - DNA, 20 bp, Artificial
  CRISPR gRNA sequence
atctatgttctacaaagaaa

SEQ ID NO: 202041 - DNA, 20 bp, Artificial
  CRISPR gRNA sequence
ctatgttctacaaagaaaaa

SEQ ID NO: 202042 - DNA, 20 bp, Artificial
  CRISPR gRNA sequence
acaactatctaaatttctga

SEQ ID NO: 202043 - DNA, 20 bp, Artificial
  CRISPR gRNA sequence
ctaaatttctgatggtaata

SEQ ID NO: 202044 - DNA, 20 bp, Artificial
  CRISPR gRNA sequence
aatttctgatggtaatatgg

SEQ ID NO: 202045 - DNA, 20 bp, Artificial
  CRISPR gRNA sequence
ctgatggtaatatggaagtt

SEQ ID NO: 202046 - DNA, 20 bp, Artificial
  CRISPR gRNA sequence
gatggtaatatggaagttca

SEQ ID NO: 202047 - DNA, 20 bp, Artificial
  CRISPR gRNA sequence
taatatggaagttcagagat

SEQ ID NO: 202048 - DNA, 20 bp, Artificial
  CRISPR gRNA sequence
aatatggaagttcagagata

SEQ ID NO: 202049 - DNA, 20 bp, Artificial
  CRISPR gRNA sequence
gaagttcagagataaggttt

SEQ ID NO: 202050 - DNA, 20 bp, Artificial
  CRISPR gRNA sequence
agttcagagataaggtttta

SEQ ID NO: 202051 - DNA, 20 bp, Artificial
  CRISPR gRNA sequence
ggttttagagttacattttt

SEQ ID NO: 202052 - DNA, 20 bp, Artificial
  CRISPR gRNA sequence
gagctcataaatgtatttat

SEQ ID NO: 202053 - DNA, 20 bp, Artificial
  CRISPR gRNA sequence
tttatcagaataaacactgc

SEQ ID NO: 202054 - DNA, 20 bp, Artificial
  CRISPR gRNA sequence
ttatcagaataaacactgcc

SEQ ID NO: 202055 - DNA, 20 bp, Artificial
  CRISPR gRNA sequence
agaataaacactgccaggtg

SEQ ID NO: 202056 - DNA, 20 bp, Artificial
  CRISPR gRNA sequence
ataaacactgccaggtgtag

SEQ ID NO: 202057 - DNA, 20 bp, Artificial
  CRISPR gRNA sequence
ggtgtagtggcacatgcctg

SEQ ID NO: 202058 - DNA, 20 bp, Artificial
  CRISPR gRNA sequence
gtggcacatgcctgtagtcc

SEQ ID NO: 202059 - DNA, 20 bp, Artificial
  CRISPR gRNA sequence
tgcctgtagtcccagctact

SEQ ID NO: 202060 - DNA, 20 bp, Artificial
  CRISPR gRNA sequence
gcctgtagtcccagctactt

SEQ ID NO: 202061 - DNA, 20 bp, Artificial
  CRISPR gRNA sequence
ctgtagtcccagctacttgg

SEQ ID NO: 202062 - DNA, 20 bp, Artificial
  CRISPR gRNA sequence
tgtagtcccagctacttggg

SEQ ID NO: 202063 - DNA, 20 bp, Artificial
  CRISPR gRNA sequence
tcccagctacttgggaggct

SEQ ID NO: 202064 - DNA, 20 bp, Artificial
  CRISPR gRNA sequence
cccagctacttgggaggctg

SEQ ID NO: 202065 - DNA, 20 bp, Artificial
  CRISPR gRNA sequence
agctacttgggaggctgagg

SEQ ID NO: 202066 - DNA, 20 bp, Artificial
  CRISPR gRNA sequence
gctacttgggaggctgaggt

SEQ ID NO: 202067 - DNA, 20 bp, Artificial
  CRISPR gRNA sequence
tacttgggaggctgaggtgg

SEQ ID NO: 202068 - DNA, 20 bp, Artificial
  CRISPR gRNA sequence
ctgaggtgggagcattgctt

SEQ ID NO: 202069 - DNA, 20 bp, Artificial
  CRISPR gRNA sequence
gtgggagcattgcttgagcc

SEQ ID NO: 202070 - DNA, 20 bp, Artificial
  CRISPR gRNA sequence
tgggagcattgcttgagccc

SEQ ID NO: 202071 - DNA, 20 bp, Artificial
  CRISPR gRNA sequence
ggagcattgcttgagcccag

SEQ ID NO: 202072 - DNA, 20 bp, Artificial
  CRISPR gRNA sequence
ttgcttgagcccaggagctc

SEQ ID NO: 202073 - DNA, 20 bp, Artificial
  CRISPR gRNA sequence
tgcttgagcccaggagctcg

SEQ ID NO: 202074 - DNA, 20 bp, Artificial
  CRISPR gRNA sequence
tgagcccaggagctcgaggc

SEQ ID NO: 202075 - DNA, 20 bp, Artificial
  CRISPR gRNA sequence
ccaggagctcgaggccagcc

SEQ ID NO: 202076 - DNA, 20 bp, Artificial
  CRISPR gRNA sequence
gccagcctggtcaacataat

SEQ ID NO: 202077 - DNA, 20 bp, Artificial
  CRISPR gRNA sequence
aaaaacaaaacaaaacaaaa

SEQ ID NO: 202078 - DNA, 20 bp, Artificial
  CRISPR gRNA sequence
atagaatattgctaaccgcc

SEQ ID NO: 202079 - DNA, 20 bp, Artificial
  CRISPR gRNA sequence
ccttttcttccctaataatg

SEQ ID NO: 202080 - DNA, 20 bp, Artificial
  CRISPR gRNA sequence
ttcttccctaataatgtaga

SEQ ID NO: 202081 - DNA, 20 bp, Artificial
  CRISPR gRNA sequence
aatgtagaaagaatactttc

SEQ ID NO: 202082 - DNA, 20 bp, Artificial
  CRISPR gRNA sequence
tagttctaaatctccgatcc

SEQ ID NO: 202083 - DNA, 20 bp, Artificial
  CRISPR gRNA sequence
agttctaaatctccgatcca

SEQ ID NO: 202084 - DNA, 20 bp, Artificial
  CRISPR gRNA sequence
gttctaaatctccgatccaa

SEQ ID NO: 202085 - DNA, 20 bp, Artificial
  CRISPR gRNA sequence
ctccgatccaagggatgtca

SEQ ID NO: 202086 - DNA, 20 bp, Artificial
  CRISPR gRNA sequence
gatccaagggatgtcacagt

SEQ ID NO: 202087 - DNA, 20 bp, Artificial
  CRISPR gRNA sequence
caagggatgtcacagttggc

SEQ ID NO: 202088 - DNA, 20 bp, Artificial
  CRISPR gRNA sequence
ctggcccattctgaaaaaaa

SEQ ID NO: 202089 - DNA, 20 bp, Artificial
  CRISPR gRNA sequence
ctgaaaaaaaaagatttatg

SEQ ID NO: 202090 - DNA, 20 bp, Artificial
  CRISPR gRNA sequence
aaaaaaagatttatgaagaa

SEQ ID NO: 202091 - DNA, 20 bp, Artificial
  CRISPR gRNA sequence
ttatgaagaatggtacttca

SEQ ID NO: 202092 - DNA, 20 bp, Artificial
  CRISPR gRNA sequence
tatgaagaatggtacttcaa

SEQ ID NO: 202093 - DNA, 20 bp, Artificial
  CRISPR gRNA sequence
atgaagaatggtacttcaaa

SEQ ID NO: 202094 - DNA, 20 bp, Artificial
  CRISPR gRNA sequence
atggtacttcaaagggacat

SEQ ID NO: 202095 - DNA, 20 bp, Artificial
  CRISPR gRNA sequence
tacttcaaagggacatcagt

SEQ ID NO: 202096 - DNA, 20 bp, Artificial
  CRISPR gRNA sequence
ctaaatattataaaaccaaa

SEQ ID NO: 202097 - DNA, 20 bp, Artificial
  CRISPR gRNA sequence
tataaaaccaaacagtgtac

SEQ ID NO: 202098 - DNA, 20 bp, Artificial
  CRISPR gRNA sequence
tgtacaagttaatttcacct

SEQ ID NO: 202099 - DNA, 20 bp, Artificial
  CRISPR gRNA sequence
tgagttaattctctccaata

SEQ ID NO: 202100 - DNA, 20 bp, Artificial
  CRISPR gRNA sequence
ggatataacccatgtgacaa

SEQ ID NO: 202101 - DNA, 20 bp, Artificial
  CRISPR gRNA sequence
acgatttctgctgctaccat

SEQ ID NO: 202102 - DNA, 20 bp, Artificial
  CRISPR gRNA sequence
tctgctgctaccatgagcct

SEQ ID NO: 202103 - DNA, 20 bp, Artificial
  CRISPR gRNA sequence
ccatgagcctaagacattga

SEQ ID NO: 202104 - DNA, 20 bp, Artificial
  CRISPR gRNA sequence
tatatatattttttaaccac

SEQ ID NO: 202105 - DNA, 20 bp, Artificial
  CRISPR gRNA sequence
attttttaaccacaagcctt

SEQ ID NO: 202106 - DNA, 20 bp, Artificial
  CRISPR gRNA sequence
aagccttaagcattccatat

SEQ ID NO: 202107 - DNA, 20 bp, Artificial
  CRISPR gRNA sequence
ccatgccataaatacatttc

SEQ ID NO: 202108 - DNA, 20 bp, Artificial
  CRISPR gRNA sequence
catgccataaatacatttcc

SEQ ID NO: 202109 - DNA, 20 bp, Artificial
  CRISPR gRNA sequence
atgccataaatacatttcca

SEQ ID NO: 202110 - DNA, 20 bp, Artificial
  CRISPR gRNA sequence
tttccagggtttaaattttt

SEQ ID NO: 202111 - DNA, 20 bp, Artificial
  CRISPR gRNA sequence
tacctctccttaaattgaac

SEQ ID NO: 202112 - DNA, 20 bp, Artificial
  CRISPR gRNA sequence
tctgaatttgtatctataca

SEQ ID NO: 202113 - DNA, 20 bp, Artificial
  CRISPR gRNA sequence
ctgcatcattctaaaatatc

SEQ ID NO: 202114 - DNA, 20 bp, Artificial
  CRISPR gRNA sequence
tgcatcattctaaaatatct

SEQ ID NO: 202115 - DNA, 20 bp, Artificial
  CRISPR gRNA sequence
ctaaaatatctgggatgttg

SEQ ID NO: 202116 - DNA, 20 bp, Artificial
  CRISPR gRNA sequence
ctgggatgttgtggtaaata

SEQ ID NO: 202117 - DNA, 20 bp, Artificial
  CRISPR gRNA sequence
aatatggtacttactgctac

SEQ ID NO: 202118 - DNA, 20 bp, Artificial
  CRISPR gRNA sequence
tgcccttatattgaactaac

SEQ ID NO: 202119 - DNA, 20 bp, Artificial
  CRISPR gRNA sequence
tatattgaactaactggtaa

SEQ ID NO: 202120 - DNA, 20 bp, Artificial
  CRISPR gRNA sequence
ctggtaatggctttaaaaat

SEQ ID NO: 202121 - DNA, 20 bp, Artificial
  CRISPR gRNA sequence
taatggctttaaaaatgaga

SEQ ID NO: 202122 - DNA, 20 bp, Artificial
  CRISPR gRNA sequence
aaacgttctctacaaacaac

SEQ ID NO: 202123 - DNA, 20 bp, Artificial
  CRISPR gRNA sequence
acaaacaacaagcccaactt

SEQ ID NO: 202124 - DNA, 20 bp, Artificial
  CRISPR gRNA sequence
acaacaagcccaactttagt

SEQ ID NO: 202125 - DNA, 20 bp, Artificial
  CRISPR gRNA sequence
aagcccaactttagtgagtt

SEQ ID NO: 202126 - DNA, 20 bp, Artificial
  CRISPR gRNA sequence
ccaactttagtgagtttggt

SEQ ID NO: 202127 - DNA, 20 bp, Artificial
  CRISPR gRNA sequence
caactttagtgagtttggtt

SEQ ID NO: 202128 - DNA, 20 bp, Artificial
  CRISPR gRNA sequence
cttttctatgctttcacatt

SEQ ID NO: 202129 - DNA, 20 bp, Artificial
  CRISPR gRNA sequence
tcacattaagttattgtgcc

SEQ ID NO: 202130 - DNA, 20 bp, Artificial
  CRISPR gRNA sequence
aattaaaatgcttccaataa

SEQ ID NO: 202131 - DNA, 20 bp, Artificial
  CRISPR gRNA sequence
aaaagaaaaaaaatacaaca

SEQ ID NO: 202132 - DNA, 20 bp, Artificial
  CRISPR gRNA sequence
aaaatacaacacagtttaaa

SEQ ID NO: 202133 - DNA, 20 bp, Artificial
  CRISPR gRNA sequence
cagtttaaaaagttaaaaaa

SEQ ID NO: 202134 - DNA, 20 bp, Artificial
  CRISPR gRNA sequence
ttaaaaagttaaaaaataga

SEQ ID NO: 202135 - DNA, 20 bp, Artificial
  CRISPR gRNA sequence
agttaaaaaatagaaagtga

SEQ ID NO: 202136 - DNA, 20 bp, Artificial
  CRISPR gRNA sequence
gaaagtgaaagtcactttca

SEQ ID NO: 202137 - DNA, 20 bp, Artificial
  CRISPR gRNA sequence
gtgaaagtcactttcacaga

SEQ ID NO: 202138 - DNA, 20 bp, Artificial
  CRISPR gRNA sequence
gtcactttcacagaaagttg

SEQ ID NO: 202139 - DNA, 20 bp, Artificial
  CRISPR gRNA sequence
ctttcacagaaagttgtaga

SEQ ID NO: 202140 - DNA, 20 bp, Artificial
  CRISPR gRNA sequence
cagaaagttgtagaaagtga

SEQ ID NO: 202141 - DNA, 20 bp, Artificial
  CRISPR gRNA sequence
agaaagttgtagaaagtgaa

SEQ ID NO: 202142 - DNA, 20 bp, Artificial
  CRISPR gRNA sequence
gaaaggcctactctttaaaa

SEQ ID NO: 202143 - DNA, 20 bp, Artificial
  CRISPR gRNA sequence
actctttaaaatagcaaatt

SEQ ID NO: 202144 - DNA, 20 bp, Artificial
  CRISPR gRNA sequence
ctctttaaaatagcaaatta

SEQ ID NO: 202145 - DNA, 20 bp, Artificial
  CRISPR gRNA sequence
aaattaaggctacaaattta

SEQ ID NO: 202146 - DNA, 20 bp, Artificial
  CRISPR gRNA sequence
taaggctacaaatttaaagt

SEQ ID NO: 202147 - DNA, 20 bp, Artificial
  CRISPR gRNA sequence
ggaaataataaaaattataa

SEQ ID NO: 202148 - DNA, 20 bp, Artificial
  CRISPR gRNA sequence
tataaaagttaaaaatctca

SEQ ID NO: 202149 - DNA, 20 bp, Artificial
  CRISPR gRNA sequence
gcgacattaacttcttcttg

SEQ ID NO: 202150 - DNA, 20 bp, Artificial
  CRISPR gRNA sequence
gacattaacttcttcttgaa

SEQ ID NO: 202151 - DNA, 20 bp, Artificial
  CRISPR gRNA sequence
ttaacttcttcttgaagaga

SEQ ID NO: 202152 - DNA, 20 bp, Artificial
  CRISPR gRNA sequence
ttcttcttgaagagaaagct

SEQ ID NO: 202153 - DNA, 20 bp, Artificial
  CRISPR gRNA sequence
gcttggatttttaactattt

SEQ ID NO: 202154 - DNA, 20 bp, Artificial
  CRISPR gRNA sequence
cttggatttttaactatttg

SEQ ID NO: 202155 - DNA, 20 bp, Artificial
  CRISPR gRNA sequence
ttaaatcaaaacacaatcat

SEQ ID NO: 202156 - DNA, 20 bp, Artificial
  CRISPR gRNA sequence
taaatcaaaacacaatcatt

SEQ ID NO: 202157 - DNA, 20 bp, Artificial
  CRISPR gRNA sequence
atcattaggcttttctaaaa

SEQ ID NO: 202158 - DNA, 20 bp, Artificial
  CRISPR gRNA sequence
taaaacagaacacgtgcaat

SEQ ID NO: 202159 - DNA, 20 bp, Artificial
  CRISPR gRNA sequence
gcaatgagtaaaaattattt

SEQ ID NO: 202160 - DNA, 20 bp, Artificial
  CRISPR gRNA sequence
aatgagtaaaaattattttg

SEQ ID NO: 202161 - DNA, 20 bp, Artificial
  CRISPR gRNA sequence
tttgcaaccttaatgttaca

SEQ ID NO: 202162 - DNA, 20 bp, Artificial
  CRISPR gRNA sequence
accttaatgttacatagatt

SEQ ID NO: 202163 - DNA, 20 bp, Artificial
  CRISPR gRNA sequence
tacatagattcagatttaca

SEQ ID NO: 202164 - DNA, 20 bp, Artificial
  CRISPR gRNA sequence
tagattcagatttacacagt

SEQ ID NO: 202165 - DNA, 20 bp, Artificial
  CRISPR gRNA sequence
tttacacagtcagattatat

SEQ ID NO: 202166 - DNA, 20 bp, Artificial
  CRISPR gRNA sequence
aaccatattaatgttcctcc

SEQ ID NO: 202167 - DNA, 20 bp, Artificial
  CRISPR gRNA sequence
ctagtctaccatgttatcta

SEQ ID NO: 202168 - DNA, 20 bp, Artificial
  CRISPR gRNA sequence
agtctaccatgttatctaaa

SEQ ID NO: 202169 - DNA, 20 bp, Artificial
  CRISPR gRNA sequence
tcttgcctttcaactgactg

SEQ ID NO: 202170 - DNA, 20 bp, Artificial
  CRISPR gRNA sequence
cttgcctttcaactgactgt

SEQ ID NO: 202171 - DNA, 20 bp, Artificial
  CRISPR gRNA sequence
gtaggtgtccctctgaaccc

SEQ ID NO: 202172 - DNA, 20 bp, Artificial
  CRISPR gRNA sequence
gtccctctgaaccctggcat

SEQ ID NO: 202173 - DNA, 20 bp, Artificial
  CRISPR gRNA sequence
tctgaaccctggcatcagac

SEQ ID NO: 202174 - DNA, 20 bp, Artificial
  CRISPR gRNA sequence
atcagacaagttgatttaaa

SEQ ID NO: 202175 - DNA, 20 bp, Artificial
  CRISPR gRNA sequence
gttgatttaaaaagttaatt

SEQ ID NO: 202176 - DNA, 20 bp, Artificial
  CRISPR gRNA sequence
ttgatttaaaaagttaattt

SEQ ID NO: 202177 - DNA, 20 bp, Artificial
  CRISPR gRNA sequence
taggatactatcaataaaat

SEQ ID NO: 202178 - DNA, 20 bp, Artificial
  CRISPR gRNA sequence
aggatactatcaataaaatt

SEQ ID NO: 202179 - DNA, 20 bp, Artificial
  CRISPR gRNA sequence
tgcactaaattttaaacata

SEQ ID NO: 202180 - DNA, 20 bp, Artificial
  CRISPR gRNA sequence
taaacatatagcataaattt

SEQ ID NO: 202181 - DNA, 20 bp, Artificial
  CRISPR gRNA sequence
atagcataaattttagcata

SEQ ID NO: 202182 - DNA, 20 bp, Artificial
  CRISPR gRNA sequence
ttatatgctaacctatgaca

SEQ ID NO: 202183 - DNA, 20 bp, Artificial
  CRISPR gRNA sequence
atgacaaagaaaaaataatt

SEQ ID NO: 202184 - DNA, 20 bp, Artificial
  CRISPR gRNA sequence
tgacaaagaaaaaataattt

SEQ ID NO: 202185 - DNA, 20 bp, Artificial
  CRISPR gRNA sequence
gacaaagaaaaaataatttg

SEQ ID NO: 202186 - DNA, 20 bp, Artificial
  CRISPR gRNA sequence
aataatttggggtacttgtc

SEQ ID NO: 202187 - DNA, 20 bp, Artificial
  CRISPR gRNA sequence
tggggtacttgtcaagattt

SEQ ID NO: 202188 - DNA, 20 bp, Artificial
  CRISPR gRNA sequence
agtcattttaattttaatgt

SEQ ID NO: 202189 - DNA, 20 bp, Artificial
  CRISPR gRNA sequence
ttttaattttaatgtcagaa

SEQ ID NO: 202190 - DNA, 20 bp, Artificial
  CRISPR gRNA sequence
ttttaatgtcagaacagtga

SEQ ID NO: 202191 - DNA, 20 bp, Artificial
  CRISPR gRNA sequence
tttaatgtcagaacagtgac

SEQ ID NO: 202192 - DNA, 20 bp, Artificial
  CRISPR gRNA sequence
tgtcagaacagtgacaggta

SEQ ID NO: 202193 - DNA, 20 bp, Artificial
  CRISPR gRNA sequence
gaacagtgacaggtacagta

SEQ ID NO: 202194 - DNA, 20 bp, Artificial
  CRISPR gRNA sequence
cagtgacaggtacagtacag

SEQ ID NO: 202195 - DNA, 20 bp, Artificial
  CRISPR gRNA sequence
ggtacagtacagtggtttca

SEQ ID NO: 202196 - DNA, 20 bp, Artificial
  CRISPR gRNA sequence
gtacagtacagtggtttcac

SEQ ID NO: 202197 - DNA, 20 bp, Artificial
  CRISPR gRNA sequence
gtacagtggtttcacaggct

SEQ ID NO: 202198 - DNA, 20 bp, Artificial
  CRISPR gRNA sequence
acagtggtttcacaggcttg

SEQ ID NO: 202199 - DNA, 20 bp, Artificial
  CRISPR gRNA sequence
cagtggtttcacaggcttgg

SEQ ID NO: 202200 - DNA, 20 bp, Artificial
  CRISPR gRNA sequence
tcacaggcttggaggaacgt

SEQ ID NO: 202201 - DNA, 20 bp, Artificial
  CRISPR gRNA sequence
gcttggaggaacgtaagtga

SEQ ID NO: 202202 - DNA, 20 bp, Artificial
  CRISPR gRNA sequence
ttggaggaacgtaagtgatg

SEQ ID NO: 202203 - DNA, 20 bp, Artificial
  CRISPR gRNA sequence
gaggaacgtaagtgatggag

SEQ ID NO: 202204 - DNA, 20 bp, Artificial
  CRISPR gRNA sequence
aggaacgtaagtgatggaga

SEQ ID NO: 202205 - DNA, 20 bp, Artificial
  CRISPR gRNA sequence
aacgtaagtgatggagaagg

SEQ ID NO: 202206 - DNA, 20 bp, Artificial
  CRISPR gRNA sequence
acgtaagtgatggagaaggc

SEQ ID NO: 202207 - DNA, 20 bp, Artificial
  CRISPR gRNA sequence
gtaagtgatggagaaggcag

SEQ ID NO: 202208 - DNA, 20 bp, Artificial
  CRISPR gRNA sequence
aagtgatggagaaggcagga

SEQ ID NO: 202209 - DNA, 20 bp, Artificial
  CRISPR gRNA sequence
atggagaaggcaggagagtg

SEQ ID NO: 202210 - DNA, 20 bp, Artificial
  CRISPR gRNA sequence
gaaggcaggagagtgaagtt

SEQ ID NO: 202211 - DNA, 20 bp, Artificial
  CRISPR gRNA sequence
aaggcaggagagtgaagtta

SEQ ID NO: 202212 - DNA, 20 bp, Artificial
  CRISPR gRNA sequence
ggcaggagagtgaagttaag

SEQ ID NO: 202213 - DNA, 20 bp, Artificial
  CRISPR gRNA sequence
gcaggagagtgaagttaagg

SEQ ID NO: 202214 - DNA, 20 bp, Artificial
  CRISPR gRNA sequence
ggagagtgaagttaaggagg

SEQ ID NO: 202215 - DNA, 20 bp, Artificial
  CRISPR gRNA sequence
gagtgaagttaaggaggtgg

SEQ ID NO: 202216 - DNA, 20 bp, Artificial
  CRISPR gRNA sequence
gaagttaaggaggtggcaga

SEQ ID NO: 202217 - DNA, 20 bp, Artificial
  CRISPR gRNA sequence
ggtggcagatagacaatgct

SEQ ID NO: 202218 - DNA, 20 bp, Artificial
  CRISPR gRNA sequence
gacaatgcttagttccactt

SEQ ID NO: 202219 - DNA, 20 bp, Artificial
  CRISPR gRNA sequence
tccacttgagacattgtcac

SEQ ID NO: 202220 - DNA, 20 bp, Artificial
  CRISPR gRNA sequence
gacattgtcaccagacctgc

SEQ ID NO: 202221 - DNA, 20 bp, Artificial
  CRISPR gRNA sequence
acctgctggcaactgtactg

SEQ ID NO: 202222 - DNA, 20 bp, Artificial
  CRISPR gRNA sequence
tactgaagatcattctatgc

SEQ ID NO: 202223 - DNA, 20 bp, Artificial
  CRISPR gRNA sequence
agatcattctatgctagata

SEQ ID NO: 202224 - DNA, 20 bp, Artificial
  CRISPR gRNA sequence
tcattctatgctagatatgg

SEQ ID NO: 202225 - DNA, 20 bp, Artificial
  CRISPR gRNA sequence
cattctatgctagatatgga

SEQ ID NO: 202226 - DNA, 20 bp, Artificial
  CRISPR gRNA sequence
tatgctagatatggaaggca

SEQ ID NO: 202227 - DNA, 20 bp, Artificial
  CRISPR gRNA sequence
atgctagatatggaaggcat

SEQ ID NO: 202228 - DNA, 20 bp, Artificial
  CRISPR gRNA sequence
tgctagatatggaaggcatg

SEQ ID NO: 202229 - DNA, 20 bp, Artificial
  CRISPR gRNA sequence
tagatatggaaggcatgggg

SEQ ID NO: 202230 - DNA, 20 bp, Artificial
  CRISPR gRNA sequence
atggaaggcatggggtggca

SEQ ID NO: 202231 - DNA, 20 bp, Artificial
  CRISPR gRNA sequence
tggaaggcatggggtggcat

SEQ ID NO: 202232 - DNA, 20 bp, Artificial
  CRISPR gRNA sequence
gaaggcatggggtggcatgg

SEQ ID NO: 202233 - DNA, 20 bp, Artificial
  CRISPR gRNA sequence
atggggtggcatgggagtaa

SEQ ID NO: 202234 - DNA, 20 bp, Artificial
  CRISPR gRNA sequence
tggggtggcatgggagtaaa

SEQ ID NO: 202235 - DNA, 20 bp, Artificial
  CRISPR gRNA sequence
ggggtggcatgggagtaaaa

SEQ ID NO: 202236 - DNA, 20 bp, Artificial
  CRISPR gRNA sequence
ggtggcatgggagtaaaagg

SEQ ID NO: 202237 - DNA, 20 bp, Artificial
  CRISPR gRNA sequence
gtggcatgggagtaaaaggg

SEQ ID NO: 202238 - DNA, 20 bp, Artificial
  CRISPR gRNA sequence
gagtaaaagggaggacaacc

SEQ ID NO: 202239 - DNA, 20 bp, Artificial
  CRISPR gRNA sequence
aaaagggaggacaacccaga

SEQ ID NO: 202240 - DNA, 20 bp, Artificial
  CRISPR gRNA sequence
gggaggacaacccagatagt

SEQ ID NO: 202241 - DNA, 20 bp, Artificial
  CRISPR gRNA sequence
ggaggacaacccagatagtg

SEQ ID NO: 202242 - DNA, 20 bp, Artificial
  CRISPR gRNA sequence
ccagatagtgaggaaaaaat

SEQ ID NO: 202243 - DNA, 20 bp, Artificial
  CRISPR gRNA sequence
agatagtgaggaaaaaataa

SEQ ID NO: 202244 - DNA, 20 bp, Artificial
  CRISPR gRNA sequence
aataagagcgtgctgcccgt

SEQ ID NO: 202245 - DNA, 20 bp, Artificial
  CRISPR gRNA sequence
agcgtgctgcccgtcagcca

SEQ ID NO: 202246 - DNA, 20 bp, Artificial
  CRISPR gRNA sequence
gcgtgctgcccgtcagccaa

SEQ ID NO: 202247 - DNA, 20 bp, Artificial
  CRISPR gRNA sequence
ggtatctcatactacttcac

SEQ ID NO: 202248 - DNA, 20 bp, Artificial
  CRISPR gRNA sequence
tatctcatactacttcacca

SEQ ID NO: 202249 - DNA, 20 bp, Artificial
  CRISPR gRNA sequence
actacttcaccagagttgta

SEQ ID NO: 202250 - DNA, 20 bp, Artificial
  CRISPR gRNA sequence
tgcaaatcacacactattct

SEQ ID NO: 202251 - DNA, 20 bp, Artificial
  CRISPR gRNA sequence
gcaaatcacacactattctc

SEQ ID NO: 202252 - DNA, 20 bp, Artificial
  CRISPR gRNA sequence
acactattctcaggcatttg

SEQ ID NO: 202253 - DNA, 20 bp, Artificial
  CRISPR gRNA sequence
cactattctcaggcatttgt

SEQ ID NO: 202254 - DNA, 20 bp, Artificial
  CRISPR gRNA sequence
actattctcaggcatttgtg

SEQ ID NO: 202255 - DNA, 20 bp, Artificial
  CRISPR gRNA sequence
tattctcaggcatttgtggg

SEQ ID NO: 202256 - DNA, 20 bp, Artificial
  CRISPR gRNA sequence
tttgtggggagcaacaaaac

SEQ ID NO: 202257 - DNA, 20 bp, Artificial
  CRISPR gRNA sequence
ttgtggggagcaacaaaacc

SEQ ID NO: 202258 - DNA, 20 bp, Artificial
  CRISPR gRNA sequence
gtggggagcaacaaaaccag

SEQ ID NO: 202259 - DNA, 20 bp, Artificial
  CRISPR gRNA sequence
aaaccaggagtgtcatcttc

SEQ ID NO: 202260 - DNA, 20 bp, Artificial
  CRISPR gRNA sequence
ggagtgtcatcttccagaac

SEQ ID NO: 202261 - DNA, 20 bp, Artificial
  CRISPR gRNA sequence
atcttccagaaccagacaca

SEQ ID NO: 202262 - DNA, 20 bp, Artificial
  CRISPR gRNA sequence
agaaccagacacatggtgat

SEQ ID NO: 202263 - DNA, 20 bp, Artificial
  CRISPR gRNA sequence
accagacacatggtgattgg

SEQ ID NO: 202264 - DNA, 20 bp, Artificial
  CRISPR gRNA sequence
attggaagatgtaacaaaaa

SEQ ID NO: 202265 - DNA, 20 bp, Artificial
  CRISPR gRNA sequence
tagaatatgcaccaacattc

SEQ ID NO: 202266 - DNA, 20 bp, Artificial
  CRISPR gRNA sequence
aacattcaagatgttcactg

SEQ ID NO: 202267 - DNA, 20 bp, Artificial
  CRISPR gRNA sequence
acatgaattccattctgctt

SEQ ID NO: 202268 - DNA, 20 bp, Artificial
  CRISPR gRNA sequence
gatgtctccattgtatttta

SEQ ID NO: 202269 - DNA, 20 bp, Artificial
  CRISPR gRNA sequence
ttgtattttatggcattatg

SEQ ID NO: 202270 - DNA, 20 bp, Artificial
  CRISPR gRNA sequence
ggcattatgtggtataaaat

SEQ ID NO: 202271 - DNA, 20 bp, Artificial
  CRISPR gRNA sequence
taaaattagaaaatttcatt

SEQ ID NO: 202272 - DNA, 20 bp, Artificial
  CRISPR gRNA sequence
aatttcattgagcaacaact

SEQ ID NO: 202273 - DNA, 20 bp, Artificial
  CRISPR gRNA sequence
gacttatgaactcatatgct

SEQ ID NO: 202274 - DNA, 20 bp, Artificial
  CRISPR gRNA sequence
acttatgaactcatatgcta

SEQ ID NO: 202275 - DNA, 20 bp, Artificial
  CRISPR gRNA sequence
actcatatgctaaggatacg

SEQ ID NO: 202276 - DNA, 20 bp, Artificial
  CRISPR gRNA sequence
tgctaaggatacgcagattt

SEQ ID NO: 202277 - DNA, 20 bp, Artificial
  CRISPR gRNA sequence
aggatacgcagattttagtt

SEQ ID NO: 202278 - DNA, 20 bp, Artificial
  CRISPR gRNA sequence
attttaattatttatctaat

SEQ ID NO: 202279 - DNA, 20 bp, Artificial
  CRISPR gRNA sequence
tatctaataagcattaatta

SEQ ID NO: 202280 - DNA, 20 bp, Artificial
  CRISPR gRNA sequence
taataagcattaattaaaga

SEQ ID NO: 202281 - DNA, 20 bp, Artificial
  CRISPR gRNA sequence
gcattaattaaagaaagaca

SEQ ID NO: 202282 - DNA, 20 bp, Artificial
  CRISPR gRNA sequence
gaaagacacagaatatatga

SEQ ID NO: 202283 - DNA, 20 bp, Artificial
  CRISPR gRNA sequence
gaattcaattaacaatcatc

SEQ ID NO: 202284 - DNA, 20 bp, Artificial
  CRISPR gRNA sequence
ttaacaatcatcaagaacca

SEQ ID NO: 202285 - DNA, 20 bp, Artificial
  CRISPR gRNA sequence
aatcatcaagaaccaaagtt

SEQ ID NO: 202286 - DNA, 20 bp, Artificial
  CRISPR gRNA sequence
agaaccaaagttcagaaata

SEQ ID NO: 202287 - DNA, 20 bp, Artificial
  CRISPR gRNA sequence
gaaccaaagttcagaaataa

SEQ ID NO: 202288 - DNA, 20 bp, Artificial
  CRISPR gRNA sequence
aagttcagaaataaaggtaa

SEQ ID NO: 202289 - DNA, 20 bp, Artificial
  CRISPR gRNA sequence
gttttttgaaactattatgt

SEQ ID NO: 202290 - DNA, 20 bp, Artificial
  CRISPR gRNA sequence
aactattatgtgagtcatat

SEQ ID NO: 202291 - DNA, 20 bp, Artificial
  CRISPR gRNA sequence
ttatttgactataacaattc

SEQ ID NO: 202292 - DNA, 20 bp, Artificial
  CRISPR gRNA sequence
aacaattcaagtttcgtatt

SEQ ID NO: 202293 - DNA, 20 bp, Artificial
  CRISPR gRNA sequence
tcaagtttcgtattaagttt

SEQ ID NO: 202294 - DNA, 20 bp, Artificial
  CRISPR gRNA sequence
ttaagttttagaaacacata

SEQ ID NO: 202295 - DNA, 20 bp, Artificial
  CRISPR gRNA sequence
ttttagaaacacatacagca

SEQ ID NO: 202296 - DNA, 20 bp, Artificial
  CRISPR gRNA sequence
catacagcaaagtttaccta

SEQ ID NO: 202297 - DNA, 20 bp, Artificial
  CRISPR gRNA sequence
agcaaagtttacctaaagca

SEQ ID NO: 202298 - DNA, 20 bp, Artificial
  CRISPR gRNA sequence
aaagtttacctaaagcaaag

SEQ ID NO: 202299 - DNA, 20 bp, Artificial
  CRISPR gRNA sequence
ataacttttgattattttga

SEQ ID NO: 202300 - DNA, 20 bp, Artificial
  CRISPR gRNA sequence
taacttttgattattttgat

SEQ ID NO: 202301 - DNA, 20 bp, Artificial
  CRISPR gRNA sequence
cttttgattattttgatagg

SEQ ID NO: 202302 - DNA, 20 bp, Artificial
  CRISPR gRNA sequence
gattattttgataggtggtt

SEQ ID NO: 202303 - DNA, 20 bp, Artificial
  CRISPR gRNA sequence
ttattttgataggtggttaa

SEQ ID NO: 202304 - DNA, 20 bp, Artificial
  CRISPR gRNA sequence
aatataatttttttaaaaaa

SEQ ID NO: 202305 - DNA, 20 bp, Artificial
  CRISPR gRNA sequence
actaatataaattacattat

SEQ ID NO: 202306 - DNA, 20 bp, Artificial
  CRISPR gRNA sequence
ctaatataaattacattatt

SEQ ID NO: 202307 - DNA, 20 bp, Artificial
  CRISPR gRNA sequence
tacattattgggaacatctt

SEQ ID NO: 202308 - DNA, 20 bp, Artificial
  CRISPR gRNA sequence
tattgggaacatcttgagct

SEQ ID NO: 202309 - DNA, 20 bp, Artificial
  CRISPR gRNA sequence
attgggaacatcttgagctt

SEQ ID NO: 202310 - DNA, 20 bp, Artificial
  CRISPR gRNA sequence
ggaacatcttgagcttaggt

SEQ ID NO: 202311 - DNA, 20 bp, Artificial
  CRISPR gRNA sequence
gagcttaggtaagataacat

SEQ ID NO: 202312 - DNA, 20 bp, Artificial
  CRISPR gRNA sequence
aggtaagataacattagttt

SEQ ID NO: 202313 - DNA, 20 bp, Artificial
  CRISPR gRNA sequence
ggtaagataacattagtttc

SEQ ID NO: 202314 - DNA, 20 bp, Artificial
  CRISPR gRNA sequence
catatatctcaataaaaaat

SEQ ID NO: 202315 - DNA, 20 bp, Artificial
  CRISPR gRNA sequence
ataaaaaataagaatttatg

SEQ ID NO: 202316 - DNA, 20 bp, Artificial
  CRISPR gRNA sequence
cagaaatgttacttgaaaat

SEQ ID NO: 202317 - DNA, 20 bp, Artificial
  CRISPR gRNA sequence
aaatgttacttgaaaattgg

SEQ ID NO: 202318 - DNA, 20 bp, Artificial
  CRISPR gRNA sequence
aattggcagattaaatatac

SEQ ID NO: 202319 - DNA, 20 bp, Artificial
  CRISPR gRNA sequence
ggcagattaaatatacaagt

SEQ ID NO: 202320 - DNA, 20 bp, Artificial
  CRISPR gRNA sequence
tatacaagttagaaacaatg

SEQ ID NO: 202321 - DNA, 20 bp, Artificial
  CRISPR gRNA sequence
ttactaataattgattttaa

SEQ ID NO: 202322 - DNA, 20 bp, Artificial
  CRISPR gRNA sequence
tactaataattgattttaaa

SEQ ID NO: 202323 - DNA, 20 bp, Artificial
  CRISPR gRNA sequence
ctaataattgattttaaaag

SEQ ID NO: 202324 - DNA, 20 bp, Artificial
  CRISPR gRNA sequence
attgattttaaaaggagtaa

SEQ ID NO: 202325 - DNA, 20 bp, Artificial
  CRISPR gRNA sequence
actcaatgttttcattatat

SEQ ID NO: 202326 - DNA, 20 bp, Artificial
  CRISPR gRNA sequence
ttcattatattggttttaac

SEQ ID NO: 202327 - DNA, 20 bp, Artificial
  CRISPR gRNA sequence
ttttaactagaactgtttta

SEQ ID NO: 202328 - DNA, 20 bp, Artificial
  CRISPR gRNA sequence
actgttttaaagtcatgcat

SEQ ID NO: 202329 - DNA, 20 bp, Artificial
  CRISPR gRNA sequence
tgttttaaagtcatgcatta

SEQ ID NO: 202330 - DNA, 20 bp, Artificial
  CRISPR gRNA sequence
gttttaaagtcatgcattag

SEQ ID NO: 202331 - DNA, 20 bp, Artificial
  CRISPR gRNA sequence
ctttaaatgaacaaaattga

SEQ ID NO: 202332 - DNA, 20 bp, Artificial
  CRISPR gRNA sequence
tgtgaattttaattcctgtc

SEQ ID NO: 202333 - DNA, 20 bp, Artificial
  CRISPR gRNA sequence
gtgaattttaattcctgtct

SEQ ID NO: 202334 - DNA, 20 bp, Artificial
  CRISPR gRNA sequence
tgaattttaattcctgtctg

SEQ ID NO: 202335 - DNA, 20 bp, Artificial
  CRISPR gRNA sequence
tctggggtgtctatgtctgc

SEQ ID NO: 202336 - DNA, 20 bp, Artificial
  CRISPR gRNA sequence
gtgtctatgtctgcaagaaa

SEQ ID NO: 202337 - DNA, 20 bp, Artificial
  CRISPR gRNA sequence
gtctatgtctgcaagaaaaa

SEQ ID NO: 202338 - DNA, 20 bp, Artificial
  CRISPR gRNA sequence
atgtctgcaagaaaaagagc

SEQ ID NO: 202339 - DNA, 20 bp, Artificial
  CRISPR gRNA sequence
aagagcaagtgacaaacaaa

SEQ ID NO: 202340 - DNA, 20 bp, Artificial
  CRISPR gRNA sequence
agagcaagtgacaaacaaac

SEQ ID NO: 202341 - DNA, 20 bp, Artificial
  CRISPR gRNA sequence
gacaaacaaacaggtctgtg

SEQ ID NO: 202342 - DNA, 20 bp, Artificial
  CRISPR gRNA sequence
acaaacaaacaggtctgtgc

SEQ ID NO: 202343 - DNA, 20 bp, Artificial
  CRISPR gRNA sequence
acaaacaggtctgtgcagga

SEQ ID NO: 202344 - DNA, 20 bp, Artificial
  CRISPR gRNA sequence
tgtgcaggacagctctatca

SEQ ID NO: 202345 - DNA, 20 bp, Artificial
  CRISPR gRNA sequence
cagctctatcacagaaacac

SEQ ID NO: 202346 - DNA, 20 bp, Artificial
  CRISPR gRNA sequence
tcctattctattacttaaaa

SEQ ID NO: 202347 - DNA, 20 bp, Artificial
  CRISPR gRNA sequence
ttacttaaaatggatcctca

SEQ ID NO: 202348 - DNA, 20 bp, Artificial
  CRISPR gRNA sequence
aagatctctccccttttact

SEQ ID NO: 202349 - DNA, 20 bp, Artificial
  CRISPR gRNA sequence
ccccttttacttagtataaa

SEQ ID NO: 202350 - DNA, 20 bp, Artificial
  CRISPR gRNA sequence
cccttttacttagtataaaa

SEQ ID NO: 202351 - DNA, 20 bp, Artificial
  CRISPR gRNA sequence
taaaaaggtacacattctaa

SEQ ID NO: 202352 - DNA, 20 bp, Artificial
  CRISPR gRNA sequence
ggtacacattctaatagata

SEQ ID NO: 202353 - DNA, 20 bp, Artificial
  CRISPR gRNA sequence
cattttcctttaaactactt

SEQ ID NO: 202354 - DNA, 20 bp, Artificial
  CRISPR gRNA sequence
caattgtattttctgacttc

SEQ ID NO: 202355 - DNA, 20 bp, Artificial
  CRISPR gRNA sequence
tctgacttctggtcttaaac

SEQ ID NO: 202356 - DNA, 20 bp, Artificial
  CRISPR gRNA sequence
gacttctggtcttaaactgg

SEQ ID NO: 202357 - DNA, 20 bp, Artificial
  CRISPR gRNA sequence
caattgtattttctcatttt

SEQ ID NO: 202358 - DNA, 20 bp, Artificial
  CRISPR gRNA sequence
tctcatttttggtcctaaac

SEQ ID NO: 202359 - DNA, 20 bp, Artificial
  CRISPR gRNA sequence
catttttggtcctaaactgg

SEQ ID NO: 202360 - DNA, 20 bp, Artificial
  CRISPR gRNA sequence
aactggaagaacaaactaaa

SEQ ID NO: 202361 - DNA, 20 bp, Artificial
  CRISPR gRNA sequence
caaactaaaaagcattttct

SEQ ID NO: 202362 - DNA, 20 bp, Artificial
  CRISPR gRNA sequence
agtgatatatctgaaattat

SEQ ID NO: 202363 - DNA, 20 bp, Artificial
  CRISPR gRNA sequence
tatatctgaaattattggca

SEQ ID NO: 202364 - DNA, 20 bp, Artificial
  CRISPR gRNA sequence
atatctgaaattattggcat

SEQ ID NO: 202365 - DNA, 20 bp, Artificial
  CRISPR gRNA sequence
tggcataggttaatgaaaat

SEQ ID NO: 202366 - DNA, 20 bp, Artificial
  CRISPR gRNA sequence
cccacaaatttcatataaac

SEQ ID NO: 202367 - DNA, 20 bp, Artificial
  CRISPR gRNA sequence
aatttcatataaactagtcc

SEQ ID NO: 202368 - DNA, 20 bp, Artificial
  CRISPR gRNA sequence
actagtccaagtaattgtgc

SEQ ID NO: 202369 - DNA, 20 bp, Artificial
  CRISPR gRNA sequence
tagtccaagtaattgtgcta

SEQ ID NO: 202370 - DNA, 20 bp, Artificial
  CRISPR gRNA sequence
caagtaattgtgctagagct

SEQ ID NO: 202371 - DNA, 20 bp, Artificial
  CRISPR gRNA sequence
aagatactcaaacctgaaat

SEQ ID NO: 202372 - DNA, 20 bp, Artificial
  CRISPR gRNA sequence
atactcaaacctgaaatcag

SEQ ID NO: 202373 - DNA, 20 bp, Artificial
  CRISPR gRNA sequence
actcaaacctgaaatcagaa

SEQ ID NO: 202374 - DNA, 20 bp, Artificial
  CRISPR gRNA sequence
ctcaaacctgaaatcagaag

SEQ ID NO: 202375 - DNA, 20 bp, Artificial
  CRISPR gRNA sequence
tcaaacctgaaatcagaaga

SEQ ID NO: 202376 - DNA, 20 bp, Artificial
  CRISPR gRNA sequence
atcagaagagggccatgcat

SEQ ID NO: 202377 - DNA, 20 bp, Artificial
  CRISPR gRNA sequence
aaacaaataaaattctgtat

SEQ ID NO: 202378 - DNA, 20 bp, Artificial
  CRISPR gRNA sequence
aataaaattctgtattagaa

SEQ ID NO: 202379 - DNA, 20 bp, Artificial
  CRISPR gRNA sequence
tgaaataacttactaaaaaa

SEQ ID NO: 202380 - DNA, 20 bp, Artificial
  CRISPR gRNA sequence
taaaaaacagtaataatccc

SEQ ID NO: 202381 - DNA, 20 bp, Artificial
  CRISPR gRNA sequence
cagtaataatcccaagtttt

SEQ ID NO: 202382 - DNA, 20 bp, Artificial
  CRISPR gRNA sequence
gtaataatcccaagttttaa

SEQ ID NO: 202383 - DNA, 20 bp, Artificial
  CRISPR gRNA sequence
aataatcccaagttttaaga

SEQ ID NO: 202384 - DNA, 20 bp, Artificial
  CRISPR gRNA sequence
tatatgtttattaacttaac

SEQ ID NO: 202385 - DNA, 20 bp, Artificial
  CRISPR gRNA sequence
gtaaaatgactcaaaattat

SEQ ID NO: 202386 - DNA, 20 bp, Artificial
  CRISPR gRNA sequence
aaatgactcaaaattattag

SEQ ID NO: 202387 - DNA, 20 bp, Artificial
  CRISPR gRNA sequence
tcaaaattattagaagaaca

SEQ ID NO: 202388 - DNA, 20 bp, Artificial
  CRISPR gRNA sequence
aacacataccttatcatatc

SEQ ID NO: 202389 - DNA, 20 bp, Artificial
  CRISPR gRNA sequence
taccttatcatatcaagaaa

SEQ ID NO: 202390 - DNA, 20 bp, Artificial
  CRISPR gRNA sequence
accttatcatatcaagaaat

SEQ ID NO: 202391 - DNA, 20 bp, Artificial
  CRISPR gRNA sequence
tcatatcaagaaatgggaac

SEQ ID NO: 202392 - DNA, 20 bp, Artificial
  CRISPR gRNA sequence
gaaatgggaactggtgtttc

SEQ ID NO: 202393 - DNA, 20 bp, Artificial
  CRISPR gRNA sequence
ggaactggtgtttcaagtct

SEQ ID NO: 202394 - DNA, 20 bp, Artificial
  CRISPR gRNA sequence
gaactggtgtttcaagtcta

SEQ ID NO: 202395 - DNA, 20 bp, Artificial
  CRISPR gRNA sequence
tctaaggctccaaccaattt

SEQ ID NO: 202396 - DNA, 20 bp, Artificial
  CRISPR gRNA sequence
ggctccaaccaatttgagcc

SEQ ID NO: 202397 - DNA, 20 bp, Artificial
  CRISPR gRNA sequence
tttgagcccagttattttaa

SEQ ID NO: 202398 - DNA, 20 bp, Artificial
  CRISPR gRNA sequence
taaaagctcttccacaaata

SEQ ID NO: 202399 - DNA, 20 bp, Artificial
  CRISPR gRNA sequence
aaaagctcttccacaaatac

SEQ ID NO: 202400 - DNA, 20 bp, Artificial
  CRISPR gRNA sequence
ttccacaaatacaggcatat

SEQ ID NO: 202401 - DNA, 20 bp, Artificial
  CRISPR gRNA sequence
caaatacaggcatatcagtt

SEQ ID NO: 202402 - DNA, 20 bp, Artificial
  CRISPR gRNA sequence
aaatacaggcatatcagttt

SEQ ID NO: 202403 - DNA, 20 bp, Artificial
  CRISPR gRNA sequence
aggcatatcagtttgggtgc

SEQ ID NO: 202404 - DNA, 20 bp, Artificial
  CRISPR gRNA sequence
agtttgggtgctagaacaat

SEQ ID NO: 202405 - DNA, 20 bp, Artificial
  CRISPR gRNA sequence
tgctagaacaatcagccacc

SEQ ID NO: 202406 - DNA, 20 bp, Artificial
  CRISPR gRNA sequence
cagccaccaagccatatata

SEQ ID NO: 202407 - DNA, 20 bp, Artificial
  CRISPR gRNA sequence
atatacagctaatatctttg

SEQ ID NO: 202408 - DNA, 20 bp, Artificial
  CRISPR gRNA sequence
acagctaatatctttgtagc

SEQ ID NO: 202409 - DNA, 20 bp, Artificial
  CRISPR gRNA sequence
cagctaatatctttgtagcg

SEQ ID NO: 202410 - DNA, 20 bp, Artificial
  CRISPR gRNA sequence
gctaatatctttgtagcgag

SEQ ID NO: 202411 - DNA, 20 bp, Artificial
  CRISPR gRNA sequence
ctaatatctttgtagcgagg

SEQ ID NO: 202412 - DNA, 20 bp, Artificial
  CRISPR gRNA sequence
tatctttgtagcgaggagga

SEQ ID NO: 202413 - DNA, 20 bp, Artificial
  CRISPR gRNA sequence
gaggaaagcactattaccac

SEQ ID NO: 202414 - DNA, 20 bp, Artificial
  CRISPR gRNA sequence
aggaaagcactattaccact

SEQ ID NO: 202415 - DNA, 20 bp, Artificial
  CRISPR gRNA sequence
ggaaagcactattaccactg

SEQ ID NO: 202416 - DNA, 20 bp, Artificial
  CRISPR gRNA sequence
ctattaccactggggtaaat

SEQ ID NO: 202417 - DNA, 20 bp, Artificial
  CRISPR gRNA sequence
ttaccactggggtaaattgg

SEQ ID NO: 202418 - DNA, 20 bp, Artificial
  CRISPR gRNA sequence
gggtaaattggaagtttaaa

SEQ ID NO: 202419 - DNA, 20 bp, Artificial
  CRISPR gRNA sequence
aattggaagtttaaaaagaa

SEQ ID NO: 202420 - DNA, 20 bp, Artificial
  CRISPR gRNA sequence
gaagtttaaaaagaaaagct

SEQ ID NO: 202421 - DNA, 20 bp, Artificial
  CRISPR gRNA sequence
tcagaatgctaaatgctgtc

SEQ ID NO: 202422 - DNA, 20 bp, Artificial
  CRISPR gRNA sequence
gaacaaaaactcttatttat

SEQ ID NO: 202423 - DNA, 20 bp, Artificial
  CRISPR gRNA sequence
caaaaactcttatttattgg

SEQ ID NO: 202424 - DNA, 20 bp, Artificial
  CRISPR gRNA sequence
ttggtggtgataatacaaaa

SEQ ID NO: 202425 - DNA, 20 bp, Artificial
  CRISPR gRNA sequence
ggtgataatacaaaatggta

SEQ ID NO: 202426 - DNA, 20 bp, Artificial
  CRISPR gRNA sequence
atggtacagctattttgata

SEQ ID NO: 202427 - DNA, 20 bp, Artificial
  CRISPR gRNA sequence
ggtacagctattttgataca

SEQ ID NO: 202428 - DNA, 20 bp, Artificial
  CRISPR gRNA sequence
tacagctattttgatacaga

SEQ ID NO: 202429 - DNA, 20 bp, Artificial
  CRISPR gRNA sequence
ctattttgatacagagagtt

SEQ ID NO: 202430 - DNA, 20 bp, Artificial
  CRISPR gRNA sequence
ttttgatacagagagtttgg

SEQ ID NO: 202431 - DNA, 20 bp, Artificial
  CRISPR gRNA sequence
ttatttcaacatactcttta

SEQ ID NO: 202432 - DNA, 20 bp, Artificial
  CRISPR gRNA sequence
agtcccgtaattgcactcct

SEQ ID NO: 202433 - DNA, 20 bp, Artificial
  CRISPR gRNA sequence
ctccttggtatttgcccaaa

SEQ ID NO: 202434 - DNA, 20 bp, Artificial
  CRISPR gRNA sequence
ctgcactaaaaaaaaaaatc

SEQ ID NO: 202435 - DNA, 20 bp, Artificial
  CRISPR gRNA sequence
caagtctatatatttttaaa

SEQ ID NO: 202436 - DNA, 20 bp, Artificial
  CRISPR gRNA sequence
agtctatatatttttaaaaa

SEQ ID NO: 202437 - DNA, 20 bp, Artificial
  CRISPR gRNA sequence
tctatatatttttaaaaaga

SEQ ID NO: 202438 - DNA, 20 bp, Artificial
  CRISPR gRNA sequence
tatatttttaaaaagagaga

SEQ ID NO: 202439 - DNA, 20 bp, Artificial
  CRISPR gRNA sequence
tttaaaaagagagaaagaaa

SEQ ID NO: 202440 - DNA, 20 bp, Artificial
  CRISPR gRNA sequence
aagagagaaagaaaaagaaa

SEQ ID NO: 202441 - DNA, 20 bp, Artificial
  CRISPR gRNA sequence
agagagaaagaaaaagaaaa

SEQ ID NO: 202442 - DNA, 20 bp, Artificial
  CRISPR gRNA sequence
gagaaagaaaaagaaaaagg

SEQ ID NO: 202443 - DNA, 20 bp, Artificial
  CRISPR gRNA sequence
aaagaaaaagaaaaaggaag

SEQ ID NO: 202444 - DNA, 20 bp, Artificial
  CRISPR gRNA sequence
agaaaaagaaaaaggaagaa

SEQ ID NO: 202445 - DNA, 20 bp, Artificial
  CRISPR gRNA sequence
ggaagaagagctctgtccaa

SEQ ID NO: 202446 - DNA, 20 bp, Artificial
  CRISPR gRNA sequence
tgtccaaaagtaacccaaat

SEQ ID NO: 202447 - DNA, 20 bp, Artificial
  CRISPR gRNA sequence
gtccaaaagtaacccaaatt

SEQ ID NO: 202448 - DNA, 20 bp, Artificial
  CRISPR gRNA sequence
agtaacccaaattaggtcta

SEQ ID NO: 202449 - DNA, 20 bp, Artificial
  CRISPR gRNA sequence
acccaaattaggtctacaga

SEQ ID NO: 202450 - DNA, 20 bp, Artificial
  CRISPR gRNA sequence
gatgactcttacccgcaata

SEQ ID NO: 202451 - DNA, 20 bp, Artificial
  CRISPR gRNA sequence
tgactcttacccgcaataca

SEQ ID NO: 202452 - DNA, 20 bp, Artificial
  CRISPR gRNA sequence
ttacccgcaatacagagact

SEQ ID NO: 202453 - DNA, 20 bp, Artificial
  CRISPR gRNA sequence
acagagactcagtccaacca

SEQ ID NO: 202454 - DNA, 20 bp, Artificial
  CRISPR gRNA sequence
agactcagtccaaccacagc

SEQ ID NO: 202455 - DNA, 20 bp, Artificial
  CRISPR gRNA sequence
gactcagtccaaccacagcg

SEQ ID NO: 202456 - DNA, 20 bp, Artificial
  CRISPR gRNA sequence
gtccaaccacagcgaggata

SEQ ID NO: 202457 - DNA, 20 bp, Artificial
  CRISPR gRNA sequence
tccaaccacagcgaggatat

SEQ ID NO: 202458 - DNA, 20 bp, Artificial
  CRISPR gRNA sequence
tatcacctgaataaccaata

SEQ ID NO: 202459 - DNA, 20 bp, Artificial
  CRISPR gRNA sequence
taaccaatatggcaatgacg

SEQ ID NO: 202460 - DNA, 20 bp, Artificial
  CRISPR gRNA sequence
aaccaatatggcaatgacga

SEQ ID NO: 202461 - DNA, 20 bp, Artificial
  CRISPR gRNA sequence
ccaatatggcaatgacgaag

SEQ ID NO: 202462 - DNA, 20 bp, Artificial
  CRISPR gRNA sequence
caatatggcaatgacgaagg

SEQ ID NO: 202463 - DNA, 20 bp, Artificial
  CRISPR gRNA sequence
aaggaggttaatccaatcgc

SEQ ID NO: 202464 - DNA, 20 bp, Artificial
  CRISPR gRNA sequence
ggaggttaatccaatcgctg

SEQ ID NO: 202465 - DNA, 20 bp, Artificial
  CRISPR gRNA sequence
gaggttaatccaatcgctgg

SEQ ID NO: 202466 - DNA, 20 bp, Artificial
  CRISPR gRNA sequence
gttaatccaatcgctggagg

SEQ ID NO: 202467 - DNA, 20 bp, Artificial
  CRISPR gRNA sequence
ttaatccaatcgctggagga

SEQ ID NO: 202468 - DNA, 20 bp, Artificial
  CRISPR gRNA sequence
ccaatcgctggaggaaggaa

SEQ ID NO: 202469 - DNA, 20 bp, Artificial
  CRISPR gRNA sequence
caatcgctggaggaaggaaa

SEQ ID NO: 202470 - DNA, 20 bp, Artificial
  CRISPR gRNA sequence
gaggaaggaaaaggatgtaa

SEQ ID NO: 202471 - DNA, 20 bp, Artificial
  CRISPR gRNA sequence
gaaggaaaaggatgtaacag

SEQ ID NO: 202472 - DNA, 20 bp, Artificial
  CRISPR gRNA sequence
ggatgtaacagaagcatgtc

SEQ ID NO: 202473 - DNA, 20 bp, Artificial
  CRISPR gRNA sequence
atgtaacagaagcatgtcaa

SEQ ID NO: 202474 - DNA, 20 bp, Artificial
  CRISPR gRNA sequence
gcatgtcaagagtatttaaa

SEQ ID NO: 202475 - DNA, 20 bp, Artificial
  CRISPR gRNA sequence
caataacttccacttgcatt

SEQ ID NO: 202476 - DNA, 20 bp, Artificial
  CRISPR gRNA sequence
ccacttgcatttggtataat

SEQ ID NO: 202477 - DNA, 20 bp, Artificial
  CRISPR gRNA sequence
cacttgcatttggtataatc

SEQ ID NO: 202478 - DNA, 20 bp, Artificial
  CRISPR gRNA sequence
acttgcatttggtataatca

SEQ ID NO: 202479 - DNA, 20 bp, Artificial
  CRISPR gRNA sequence
ggtataatcagggatctcct

SEQ ID NO: 202480 - DNA, 20 bp, Artificial
  CRISPR gRNA sequence
tcagggatctcctaagacca

SEQ ID NO: 202481 - DNA, 20 bp, Artificial
  CRISPR gRNA sequence
ctaagaccaaagactgactc

SEQ ID NO: 202482 - DNA, 20 bp, Artificial
  CRISPR gRNA sequence
aagaccaaagactgactctg

SEQ ID NO: 202483 - DNA, 20 bp, Artificial
  CRISPR gRNA sequence
ctctggagttcattgtttga

SEQ ID NO: 202484 - DNA, 20 bp, Artificial
  CRISPR gRNA sequence
tggagttcattgtttgacgg

SEQ ID NO: 202485 - DNA, 20 bp, Artificial
  CRISPR gRNA sequence
tttgacggtagatgttaact

SEQ ID NO: 202486 - DNA, 20 bp, Artificial
  CRISPR gRNA sequence
gtgatctaacccttccacac

SEQ ID NO: 202487 - DNA, 20 bp, Artificial
  CRISPR gRNA sequence
atctaacccttccacacaag

SEQ ID NO: 202488 - DNA, 20 bp, Artificial
  CRISPR gRNA sequence
aacccttccacacaagtagt

SEQ ID NO: 202489 - DNA, 20 bp, Artificial
  CRISPR gRNA sequence
cagctccaaattcacacatt

SEQ ID NO: 202490 - DNA, 20 bp, Artificial
  CRISPR gRNA sequence
ctccaaattcacacattcgg

SEQ ID NO: 202491 - DNA, 20 bp, Artificial
  CRISPR gRNA sequence
tcggcagcctttaattttca

SEQ ID NO: 202492 - DNA, 20 bp, Artificial
  CRISPR gRNA sequence
cagcctttaattttcacagt

SEQ ID NO: 202493 - DNA, 20 bp, Artificial
  CRISPR gRNA sequence
tttaattttcacagtcagct

SEQ ID NO: 202494 - DNA, 20 bp, Artificial
  CRISPR gRNA sequence
attttcacagtcagctaagc

SEQ ID NO: 202495 - DNA, 20 bp, Artificial
  CRISPR gRNA sequence
cacagtcagctaagctggac

SEQ ID NO: 202496 - DNA, 20 bp, Artificial
  CRISPR gRNA sequence
agtcagctaagctggactgg

SEQ ID NO: 202497 - DNA, 20 bp, Artificial
  CRISPR gRNA sequence
gaagtttttaccctaaatct

SEQ ID NO: 202498 - DNA, 20 bp, Artificial
  CRISPR gRNA sequence
tgtgcattttacaatatgaa

SEQ ID NO: 202499 - DNA, 20 bp, Artificial
  CRISPR gRNA sequence
atgtcttctccacatgcaca

SEQ ID NO: 202500 - DNA, 20 bp, Artificial
  CRISPR gRNA sequence
cacatggaattgctcttgct

SEQ ID NO: 202501 - DNA, 20 bp, Artificial
  CRISPR gRNA sequence
acatggaattgctcttgctg

SEQ ID NO: 202502 - DNA, 20 bp, Artificial
  CRISPR gRNA sequence
catggaattgctcttgctga

SEQ ID NO: 202503 - DNA, 20 bp, Artificial
  CRISPR gRNA sequence
aacatcatgctctctatctc

SEQ ID NO: 202504 - DNA, 20 bp, Artificial
  CRISPR gRNA sequence
atacctttccaatgtacaac

SEQ ID NO: 202505 - DNA, 20 bp, Artificial
  CRISPR gRNA sequence
ctttccaatgtacaacgagc

SEQ ID NO: 202506 - DNA, 20 bp, Artificial
  CRISPR gRNA sequence
ttccaatgtacaacgagcca

SEQ ID NO: 202507 - DNA, 20 bp, Artificial
  CRISPR gRNA sequence
aatgtacaacgagccagaga

SEQ ID NO: 202508 - DNA, 20 bp, Artificial
  CRISPR gRNA sequence
atgtacaacgagccagagat

SEQ ID NO: 202509 - DNA, 20 bp, Artificial
  CRISPR gRNA sequence
acgagccagagataggctct

SEQ ID NO: 202510 - DNA, 20 bp, Artificial
  CRISPR gRNA sequence
cagagataggctctaagacc

SEQ ID NO: 202511 - DNA, 20 bp, Artificial
  CRISPR gRNA sequence
tgttaaatgtgactctttaa

SEQ ID NO: 202512 - DNA, 20 bp, Artificial
  CRISPR gRNA sequence
ttaatagtaataactaaata

SEQ ID NO: 202513 - DNA, 20 bp, Artificial
  CRISPR gRNA sequence
atagtaataactaaatatgg

SEQ ID NO: 202514 - DNA, 20 bp, Artificial
  CRISPR gRNA sequence
agtgatctactttcaaaatg

SEQ ID NO: 202515 - DNA, 20 bp, Artificial
  CRISPR gRNA sequence
agtgaaaatgatactgatta

SEQ ID NO: 202516 - DNA, 20 bp, Artificial
  CRISPR gRNA sequence
aaatgatactgattatagtt

SEQ ID NO: 202517 - DNA, 20 bp, Artificial
  CRISPR gRNA sequence
cataccatctcttaaaacta

SEQ ID NO: 202518 - DNA, 20 bp, Artificial
  CRISPR gRNA sequence
tctcttaaaactacagtatt

SEQ ID NO: 202519 - DNA, 20 bp, Artificial
  CRISPR gRNA sequence
ctcttaaaactacagtatta

SEQ ID NO: 202520 - DNA, 20 bp, Artificial
  CRISPR gRNA sequence
tgattcataattccatttta

SEQ ID NO: 202521 - DNA, 20 bp, Artificial
  CRISPR gRNA sequence
ataattccattttatagaac

SEQ ID NO: 202522 - DNA, 20 bp, Artificial
  CRISPR gRNA sequence
tagaaccagtcttcttaatg

SEQ ID NO: 202523 - DNA, 20 bp, Artificial
  CRISPR gRNA sequence
aaccagtcttcttaatgcag

SEQ ID NO: 202524 - DNA, 20 bp, Artificial
  CRISPR gRNA sequence
cagtcttcttaatgcagaag

SEQ ID NO: 202525 - DNA, 20 bp, Artificial
  CRISPR gRNA sequence
tcttcttaatgcagaagcag

SEQ ID NO: 202526 - DNA, 20 bp, Artificial
  CRISPR gRNA sequence
ttaatgcagaagcagaagct

SEQ ID NO: 202527 - DNA, 20 bp, Artificial
  CRISPR gRNA sequence
cagaagcagaagcttagcaa

SEQ ID NO: 202528 - DNA, 20 bp, Artificial
  CRISPR gRNA sequence
aagcagaagcttagcaaaag

SEQ ID NO: 202529 - DNA, 20 bp, Artificial
  CRISPR gRNA sequence
gcagaagcttagcaaaagaa

SEQ ID NO: 202530 - DNA, 20 bp, Artificial
  CRISPR gRNA sequence
aagcttagcaaaagaagaga

SEQ ID NO: 202531 - DNA, 20 bp, Artificial
  CRISPR gRNA sequence
taacttcaaaaaactgaaat

SEQ ID NO: 202532 - DNA, 20 bp, Artificial
  CRISPR gRNA sequence
agaatatgaaaataatcatt

SEQ ID NO: 202533 - DNA, 20 bp, Artificial
  CRISPR gRNA sequence
atatgaaaataatcattaag

SEQ ID NO: 202534 - DNA, 20 bp, Artificial
  CRISPR gRNA sequence
ataatcattaagaagttata

SEQ ID NO: 202535 - DNA, 20 bp, Artificial
  CRISPR gRNA sequence
taatttaaaattatgctgat

SEQ ID NO: 202536 - DNA, 20 bp, Artificial
  CRISPR gRNA sequence
ttggcatcaaatacatatga

SEQ ID NO: 202537 - DNA, 20 bp, Artificial
  CRISPR gRNA sequence
gaaagtcactttttacaaaa

SEQ ID NO: 202538 - DNA, 20 bp, Artificial
  CRISPR gRNA sequence
tttttacaaaacagctaacc

SEQ ID NO: 202539 - DNA, 20 bp, Artificial
  CRISPR gRNA sequence
aaccttaaaattaatatgaa

SEQ ID NO: 202540 - DNA, 20 bp, Artificial
  CRISPR gRNA sequence
accttaaaattaatatgaat

SEQ ID NO: 202541 - DNA, 20 bp, Artificial
  CRISPR gRNA sequence
atgaatgggaaaatgtcact

SEQ ID NO: 202542 - DNA, 20 bp, Artificial
  CRISPR gRNA sequence
tgggaaaatgtcactaagaa

SEQ ID NO: 202543 - DNA, 20 bp, Artificial
  CRISPR gRNA sequence
ttaataaacctactcttatt

SEQ ID NO: 202544 - DNA, 20 bp, Artificial
  CRISPR gRNA sequence
gagttgtaaaaaatttatat

SEQ ID NO: 202545 - DNA, 20 bp, Artificial
  CRISPR gRNA sequence
ctgctgttttgtaaatgaaa

SEQ ID NO: 202546 - DNA, 20 bp, Artificial
  CRISPR gRNA sequence
tgctgttttgtaaatgaaaa

SEQ ID NO: 202547 - DNA, 20 bp, Artificial
  CRISPR gRNA sequence
tgttttgtaaatgaaaaagg

SEQ ID NO: 202548 - DNA, 20 bp, Artificial
  CRISPR gRNA sequence
actcacctgtactaaacaca

SEQ ID NO: 202549 - DNA, 20 bp, Artificial
  CRISPR gRNA sequence
cacctgtactaaacacatag

SEQ ID NO: 202550 - DNA, 20 bp, Artificial
  CRISPR gRNA sequence
gtactaaacacatagtagtg

SEQ ID NO: 202551 - DNA, 20 bp, Artificial
  CRISPR gRNA sequence
aagtaatattaatatccctg

SEQ ID NO: 202552 - DNA, 20 bp, Artificial
  CRISPR gRNA sequence
taatattaatatccctgtag

SEQ ID NO: 202553 - DNA, 20 bp, Artificial
  CRISPR gRNA sequence
gtagaagtcacaattaaacc

SEQ ID NO: 202554 - DNA, 20 bp, Artificial
  CRISPR gRNA sequence
tagaagtcacaattaaacca

SEQ ID NO: 202555 - DNA, 20 bp, Artificial
  CRISPR gRNA sequence
agtcacaattaaaccaaggc

SEQ ID NO: 202556 - DNA, 20 bp, Artificial
  CRISPR gRNA sequence
cacaattaaaccaaggccag

SEQ ID NO: 202557 - DNA, 20 bp, Artificial
  CRISPR gRNA sequence
ctgaaaacctcacacaaaat

SEQ ID NO: 202558 - DNA, 20 bp, Artificial
  CRISPR gRNA sequence
ttagtgactattttttgatt

SEQ ID NO: 202559 - DNA, 20 bp, Artificial
  CRISPR gRNA sequence
ttttgattaagaccaaactt

SEQ ID NO: 202560 - DNA, 20 bp, Artificial
  CRISPR gRNA sequence
acatctaaatctcaacattt

SEQ ID NO: 202561 - DNA, 20 bp, Artificial
  CRISPR gRNA sequence
aacatgctgaaaccttgaat

SEQ ID NO: 202562 - DNA, 20 bp, Artificial
  CRISPR gRNA sequence
ggctctgcctccttcttaac

SEQ ID NO: 202563 - DNA, 20 bp, Artificial
  CRISPR gRNA sequence
cctccttcttaactagttta

SEQ ID NO: 202564 - DNA, 20 bp, Artificial
  CRISPR gRNA sequence
ttaactagtttacagaattc

SEQ ID NO: 202565 - DNA, 20 bp, Artificial
  CRISPR gRNA sequence
ctagtttacagaattccagt

SEQ ID NO: 202566 - DNA, 20 bp, Artificial
  CRISPR gRNA sequence
ttcccttcatctgctgtatt

SEQ ID NO: 202567 - DNA, 20 bp, Artificial
  CRISPR gRNA sequence
gctgtattcagtatgcccca

SEQ ID NO: 202568 - DNA, 20 bp, Artificial
  CRISPR gRNA sequence
gtcaaatcaattgttccttc

SEQ ID NO: 202569 - DNA, 20 bp, Artificial
  CRISPR gRNA sequence
cctgctgtcttcactaactt

SEQ ID NO: 202570 - DNA, 20 bp, Artificial
  CRISPR gRNA sequence
tcactaacttcagataccaa

SEQ ID NO: 202571 - DNA, 20 bp, Artificial
  CRISPR gRNA sequence
actaacttcagataccaata

SEQ ID NO: 202572 - DNA, 20 bp, Artificial
  CRISPR gRNA sequence
cagataccaatagagctgcc

SEQ ID NO: 202573 - DNA, 20 bp, Artificial
  CRISPR gRNA sequence
gcattcttctccacaaacga

SEQ ID NO: 202574 - DNA, 20 bp, Artificial
  CRISPR gRNA sequence
ccacaaacgatggtgtgcta

SEQ ID NO: 202575 - DNA, 20 bp, Artificial
  CRISPR gRNA sequence
cgatggtgtgctatagttat

SEQ ID NO: 202576 - DNA, 20 bp, Artificial
  CRISPR gRNA sequence
gatggtgtgctatagttatt

SEQ ID NO: 202577 - DNA, 20 bp, Artificial
  CRISPR gRNA sequence
tgtgctatagttattaggtt

SEQ ID NO: 202578 - DNA, 20 bp, Artificial
  CRISPR gRNA sequence
atagttattaggttgagtcc

SEQ ID NO: 202579 - DNA, 20 bp, Artificial
  CRISPR gRNA sequence
caaatgcaactgccaatttc

SEQ ID NO: 202580 - DNA, 20 bp, Artificial
  CRISPR gRNA sequence
caactgccaatttccagact

SEQ ID NO: 202581 - DNA, 20 bp, Artificial
  CRISPR gRNA sequence
ttcattctactttcatgtct

SEQ ID NO: 202582 - DNA, 20 bp, Artificial
  CRISPR gRNA sequence
ctttcatgtcttggccaatg

SEQ ID NO: 202583 - DNA, 20 bp, Artificial
  CRISPR gRNA sequence
gccaatgaagtttgcctctg

SEQ ID NO: 202584 - DNA, 20 bp, Artificial
  CRISPR gRNA sequence
atgaagtttgcctctgtagt

SEQ ID NO: 202585 - DNA, 20 bp, Artificial
  CRISPR gRNA sequence
ctctgtagtgagttgaatga

SEQ ID NO: 202586 - DNA, 20 bp, Artificial
  CRISPR gRNA sequence
cctgtgaatattacctaata

SEQ ID NO: 202587 - DNA, 20 bp, Artificial
  CRISPR gRNA sequence
aatattacctaatacagcaa

SEQ ID NO: 202588 - DNA, 20 bp, Artificial
  CRISPR gRNA sequence
tattacctaatacagcaaaa

SEQ ID NO: 202589 - DNA, 20 bp, Artificial
  CRISPR gRNA sequence
agagtgaatactgcattata

SEQ ID NO: 202590 - DNA, 20 bp, Artificial
  CRISPR gRNA sequence
aatactgcattatatggcaa

SEQ ID NO: 202591 - DNA, 20 bp, Artificial
  CRISPR gRNA sequence
atatggcaaaagatatgatg

SEQ ID NO: 202592 - DNA, 20 bp, Artificial
  CRISPR gRNA sequence
gcaaaagatatgatgaagtt

SEQ ID NO: 202593 - DNA, 20 bp, Artificial
  CRISPR gRNA sequence
caaaagatatgatgaagtta

SEQ ID NO: 202594 - DNA, 20 bp, Artificial
  CRISPR gRNA sequence
tgatgaagttaaggatctga

SEQ ID NO: 202595 - DNA, 20 bp, Artificial
  CRISPR gRNA sequence
gatgaagttaaggatctgaa

SEQ ID NO: 202596 - DNA, 20 bp, Artificial
  CRISPR gRNA sequence
tgaagttaaggatctgaaag

SEQ ID NO: 202597 - DNA, 20 bp, Artificial
  CRISPR gRNA sequence
gaagttaaggatctgaaagg

SEQ ID NO: 202598 - DNA, 20 bp, Artificial
  CRISPR gRNA sequence
agttaaggatctgaaaggag

SEQ ID NO: 202599 - DNA, 20 bp, Artificial
  CRISPR gRNA sequence
ctgaaaggaggagcttaccc

SEQ ID NO: 202600 - DNA, 20 bp, Artificial
  CRISPR gRNA sequence
gagcttaccctggattatat

SEQ ID NO: 202601 - DNA, 20 bp, Artificial
  CRISPR gRNA sequence
cttaccctggattatatgag

SEQ ID NO: 202602 - DNA, 20 bp, Artificial
  CRISPR gRNA sequence
ttaccctggattatatgagt

SEQ ID NO: 202603 - DNA, 20 bp, Artificial
  CRISPR gRNA sequence
ccaatgacaaatgtgctcat

SEQ ID NO: 202604 - DNA, 20 bp, Artificial
  CRISPR gRNA sequence
aatgacaaatgtgctcataa

SEQ ID NO: 202605 - DNA, 20 bp, Artificial
  CRISPR gRNA sequence
tgacaaatgtgctcataaga

SEQ ID NO: 202606 - DNA, 20 bp, Artificial
  CRISPR gRNA sequence
acaaatgtgctcataagaga

SEQ ID NO: 202607 - DNA, 20 bp, Artificial
  CRISPR gRNA sequence
caaatgtgctcataagagag

SEQ ID NO: 202608 - DNA, 20 bp, Artificial
  CRISPR gRNA sequence
gtgctcataagagagaggct

SEQ ID NO: 202609 - DNA, 20 bp, Artificial
  CRISPR gRNA sequence
tgctcataagagagaggctg

SEQ ID NO: 202610 - DNA, 20 bp, Artificial
  CRISPR gRNA sequence
gctcataagagagaggctga

SEQ ID NO: 202611 - DNA, 20 bp, Artificial
  CRISPR gRNA sequence
tcataagagagaggctgagg

SEQ ID NO: 202612 - DNA, 20 bp, Artificial
  CRISPR gRNA sequence
agggagatttaacaaaaaca

SEQ ID NO: 202613 - DNA, 20 bp, Artificial
  CRISPR gRNA sequence
ggagatttaacaaaaacaca

SEQ ID NO: 202614 - DNA, 20 bp, Artificial
  CRISPR gRNA sequence
gagatttaacaaaaacacag

SEQ ID NO: 202615 - DNA, 20 bp, Artificial
  CRISPR gRNA sequence
ttaacaaaaacacagaggca

SEQ ID NO: 202616 - DNA, 20 bp, Artificial
  CRISPR gRNA sequence
aaaacacagaggcaaagaca

SEQ ID NO: 202617 - DNA, 20 bp, Artificial
  CRISPR gRNA sequence
aacacagaggcaaagacata

SEQ ID NO: 202618 - DNA, 20 bp, Artificial
  CRISPR gRNA sequence
acacagaggcaaagacatag

SEQ ID NO: 202619 - DNA, 20 bp, Artificial
  CRISPR gRNA sequence
cagaggcaaagacatagagg

SEQ ID NO: 202620 - DNA, 20 bp, Artificial
  CRISPR gRNA sequence
agaggcaaagacatagagga

SEQ ID NO: 202621 - DNA, 20 bp, Artificial
  CRISPR gRNA sequence
aggcaaagacatagaggaag

SEQ ID NO: 202622 - DNA, 20 bp, Artificial
  CRISPR gRNA sequence
ggcaaagacatagaggaagg

SEQ ID NO: 202623 - DNA, 20 bp, Artificial
  CRISPR gRNA sequence
caaagacatagaggaaggag

SEQ ID NO: 202624 - DNA, 20 bp, Artificial
  CRISPR gRNA sequence
aaagacatagaggaaggagg

SEQ ID NO: 202625 - DNA, 20 bp, Artificial
  CRISPR gRNA sequence
gaaggaggaggcaatgtgac

SEQ ID NO: 202626 - DNA, 20 bp, Artificial
  CRISPR gRNA sequence
aggaggaggcaatgtgacca

SEQ ID NO: 202627 - DNA, 20 bp, Artificial
  CRISPR gRNA sequence
gaggaggcaatgtgaccaga

SEQ ID NO: 202628 - DNA, 20 bp, Artificial
  CRISPR gRNA sequence
aggaggcaatgtgaccagag

SEQ ID NO: 202629 - DNA, 20 bp, Artificial
  CRISPR gRNA sequence
aggcaatgtgaccagagagg

SEQ ID NO: 202630 - DNA, 20 bp, Artificial
  CRISPR gRNA sequence
gcaatgtgaccagagaggca

SEQ ID NO: 202631 - DNA, 20 bp, Artificial
  CRISPR gRNA sequence
caatgtgaccagagaggcag

SEQ ID NO: 202632 - DNA, 20 bp, Artificial
  CRISPR gRNA sequence
aatgtgaccagagaggcaga

SEQ ID NO: 202633 - DNA, 20 bp, Artificial
  CRISPR gRNA sequence
gtgaccagagaggcagaggg

SEQ ID NO: 202634 - DNA, 20 bp, Artificial
  CRISPR gRNA sequence
gaccagagaggcagagggtg

SEQ ID NO: 202635 - DNA, 20 bp, Artificial
  CRISPR gRNA sequence
gagttatgctgccgcaaact

SEQ ID NO: 202636 - DNA, 20 bp, Artificial
  CRISPR gRNA sequence
agttatgctgccgcaaacta

SEQ ID NO: 202637 - DNA, 20 bp, Artificial
  CRISPR gRNA sequence
tgataaacactgtcattctt

SEQ ID NO: 202638 - DNA, 20 bp, Artificial
  CRISPR gRNA sequence
tgtcattcttcagcaaattc

SEQ ID NO: 202639 - DNA, 20 bp, Artificial
  CRISPR gRNA sequence
cattcttcagcaaattccag

SEQ ID NO: 202640 - DNA, 20 bp, Artificial
  CRISPR gRNA sequence
cttcagcaaattccagaagc

SEQ ID NO: 202641 - DNA, 20 bp, Artificial
  CRISPR gRNA sequence
cagcaaattccagaagctag

SEQ ID NO: 202642 - DNA, 20 bp, Artificial
  CRISPR gRNA sequence
gcaaattccagaagctagaa

SEQ ID NO: 202643 - DNA, 20 bp, Artificial
  CRISPR gRNA sequence
ttccagaagctagaagagcc

SEQ ID NO: 202644 - DNA, 20 bp, Artificial
  CRISPR gRNA sequence
aagctagaagagccaagaaa

SEQ ID NO: 202645 - DNA, 20 bp, Artificial
  CRISPR gRNA sequence
aagaaatggattcttccata

SEQ ID NO: 202646 - DNA, 20 bp, Artificial
  CRISPR gRNA sequence
ggattcttccatacagcctt

SEQ ID NO: 202647 - DNA, 20 bp, Artificial
  CRISPR gRNA sequence
attcttccatacagccttga

SEQ ID NO: 202648 - DNA, 20 bp, Artificial
  CRISPR gRNA sequence
ttcttccatacagccttgag

SEQ ID NO: 202649 - DNA, 20 bp, Artificial
  CRISPR gRNA sequence
tcttccatacagccttgaga

SEQ ID NO: 202650 - DNA, 20 bp, Artificial
  CRISPR gRNA sequence
ttccatacagccttgagagg

SEQ ID NO: 202651 - DNA, 20 bp, Artificial
  CRISPR gRNA sequence
tacagccttgagagggagtg

SEQ ID NO: 202652 - DNA, 20 bp, Artificial
  CRISPR gRNA sequence
ccctgatgacgtcctgattt

SEQ ID NO: 202653 - DNA, 20 bp, Artificial
  CRISPR gRNA sequence
acgtcctgatttcagactta

SEQ ID NO: 202654 - DNA, 20 bp, Artificial
  CRISPR gRNA sequence
gatttcagacttatggcctc

SEQ ID NO: 202655 - DNA, 20 bp, Artificial
  CRISPR gRNA sequence
cagacttatggcctccagca

SEQ ID NO: 202656 - DNA, 20 bp, Artificial
  CRISPR gRNA sequence
cttatggcctccagcatgga

SEQ ID NO: 202657 - DNA, 20 bp, Artificial
  CRISPR gRNA sequence
ttatggcctccagcatggaa

SEQ ID NO: 202658 - DNA, 20 bp, Artificial
  CRISPR gRNA sequence
tatggcctccagcatggaaa

SEQ ID NO: 202659 - DNA, 20 bp, Artificial
  CRISPR gRNA sequence
aaagggaattgctattgttt

SEQ ID NO: 202660 - DNA, 20 bp, Artificial
  CRISPR gRNA sequence
ttgctattgtttaagccacc

SEQ ID NO: 202661 - DNA, 20 bp, Artificial
  CRISPR gRNA sequence
tgtttaagccacccagtttg

SEQ ID NO: 202662 - DNA, 20 bp, Artificial
  CRISPR gRNA sequence
tttgtggtcatctgttccaa

SEQ ID NO: 202663 - DNA, 20 bp, Artificial
  CRISPR gRNA sequence
gtcatctgttccaacagccc

SEQ ID NO: 202664 - DNA, 20 bp, Artificial
  CRISPR gRNA sequence
tcatctgttccaacagccct

SEQ ID NO: 202665 - DNA, 20 bp, Artificial
  CRISPR gRNA sequence
acagccctaggaaactaatg

SEQ ID NO: 202666 - DNA, 20 bp, Artificial
  CRISPR gRNA sequence
taatgcagccctcctcacct

SEQ ID NO: 202667 - DNA, 20 bp, Artificial
  CRISPR gRNA sequence
ctacctcctgcgttcctgcc

SEQ ID NO: 202668 - DNA, 20 bp, Artificial
  CRISPR gRNA sequence
tacctcctgcgttcctgcct

SEQ ID NO: 202669 - DNA, 20 bp, Artificial
  CRISPR gRNA sequence
taggaactgcacatcttacc

SEQ ID NO: 202670 - DNA, 20 bp, Artificial
  CRISPR gRNA sequence
aggaactgcacatcttacct

SEQ ID NO: 202671 - DNA, 20 bp, Artificial
  CRISPR gRNA sequence
cacatcttacctgggacgaa

SEQ ID NO: 202672 - DNA, 20 bp, Artificial
  CRISPR gRNA sequence
cttacctgggacgaaaagaa

SEQ ID NO: 202673 - DNA, 20 bp, Artificial
  CRISPR gRNA sequence
ggctccaacaatgacaatga

SEQ ID NO: 202674 - DNA, 20 bp, Artificial
  CRISPR gRNA sequence
atgacaatgacagtgatcac

SEQ ID NO: 202675 - DNA, 20 bp, Artificial
  CRISPR gRNA sequence
aatgacagtgatcactagtc

SEQ ID NO: 202676 - DNA, 20 bp, Artificial
  CRISPR gRNA sequence
gtgatcactagtccagcaac

SEQ ID NO: 202677 - DNA, 20 bp, Artificial
  CRISPR gRNA sequence
cactagtccagcaacaagta

SEQ ID NO: 202678 - DNA, 20 bp, Artificial
  CRISPR gRNA sequence
tgttttctcatccataccac

SEQ ID NO: 202679 - DNA, 20 bp, Artificial
  CRISPR gRNA sequence
ataccaccggatctatattt

SEQ ID NO: 202680 - DNA, 20 bp, Artificial
  CRISPR gRNA sequence
ctatatttaagtgcttaaaa

SEQ ID NO: 202681 - DNA, 20 bp, Artificial
  CRISPR gRNA sequence
gtgcttaaaaaagaaaaaca

SEQ ID NO: 202682 - DNA, 20 bp, Artificial
  CRISPR gRNA sequence
aattatatgaactcaatcac

SEQ ID NO: 202683 - DNA, 20 bp, Artificial
  CRISPR gRNA sequence
tatgaactcaatcacaagtg

SEQ ID NO: 202684 - DNA, 20 bp, Artificial
  CRISPR gRNA sequence
aagccattttaataacttgt

SEQ ID NO: 202685 - DNA, 20 bp, Artificial
  CRISPR gRNA sequence
agccattttaataacttgta

SEQ ID NO: 202686 - DNA, 20 bp, Artificial
  CRISPR gRNA sequence
ttttaataacttgtaaggta

SEQ ID NO: 202687 - DNA, 20 bp, Artificial
  CRISPR gRNA sequence
ttaataacttgtaaggtaca

SEQ ID NO: 202688 - DNA, 20 bp, Artificial
  CRISPR gRNA sequence
aaggtacagagacaaactga

SEQ ID NO: 202689 - DNA, 20 bp, Artificial
  CRISPR gRNA sequence
gtacagagacaaactgacag

SEQ ID NO: 202690 - DNA, 20 bp, Artificial
  CRISPR gRNA sequence
actataatgtaataacttat

SEQ ID NO: 202691 - DNA, 20 bp, Artificial
  CRISPR gRNA sequence
ctataatgtaataacttatg

SEQ ID NO: 202692 - DNA, 20 bp, Artificial
  CRISPR gRNA sequence
aacaactccttaatatcatc

SEQ ID NO: 202693 - DNA, 20 bp, Artificial
  CRISPR gRNA sequence
tcacctcacatctctttcat

SEQ ID NO: 202694 - DNA, 20 bp, Artificial
  CRISPR gRNA sequence
acatctctttcataagcaaa

SEQ ID NO: 202695 - DNA, 20 bp, Artificial
  CRISPR gRNA sequence
taagcaaatggataacgtca

SEQ ID NO: 202696 - DNA, 20 bp, Artificial
  CRISPR gRNA sequence
gcaaatggataacgtcacgg

SEQ ID NO: 202697 - DNA, 20 bp, Artificial
  CRISPR gRNA sequence
acgtcacggcagtataaata

SEQ ID NO: 202698 - DNA, 20 bp, Artificial
  CRISPR gRNA sequence
cacggcagtataaatatgga

SEQ ID NO: 202699 - DNA, 20 bp, Artificial
  CRISPR gRNA sequence
aaatatggatggtgaattta

SEQ ID NO: 202700 - DNA, 20 bp, Artificial
  CRISPR gRNA sequence
aatatggatggtgaatttat

SEQ ID NO: 202701 - DNA, 20 bp, Artificial
  CRISPR gRNA sequence
attttcctacactaacaaat

SEQ ID NO: 202702 - DNA, 20 bp, Artificial
  CRISPR gRNA sequence
ttttcctacactaacaaatg

SEQ ID NO: 202703 - DNA, 20 bp, Artificial
  CRISPR gRNA sequence
acaaatgaggttctatacat

SEQ ID NO: 202704 - DNA, 20 bp, Artificial
  CRISPR gRNA sequence
ttctatacatcagtctttct

SEQ ID NO: 202705 - DNA, 20 bp, Artificial
  CRISPR gRNA sequence
tgatgtattactaataaatt

SEQ ID NO: 202706 - DNA, 20 bp, Artificial
  CRISPR gRNA sequence
gtattactaataaattgagc

SEQ ID NO: 202707 - DNA, 20 bp, Artificial
  CRISPR gRNA sequence
actaataaattgagctagat

SEQ ID NO: 202708 - DNA, 20 bp, Artificial
  CRISPR gRNA sequence
aattgagctagataagtttt

SEQ ID NO: 202709 - DNA, 20 bp, Artificial
  CRISPR gRNA sequence
attgagctagataagttttt

SEQ ID NO: 202710 - DNA, 20 bp, Artificial
  CRISPR gRNA sequence
ttgagctagataagtttttg

SEQ ID NO: 202711 - DNA, 20 bp, Artificial
  CRISPR gRNA sequence
tgagctagataagtttttgg

SEQ ID NO: 202712 - DNA, 20 bp, Artificial
  CRISPR gRNA sequence
gagctagataagtttttggg

SEQ ID NO: 202713 - DNA, 20 bp, Artificial
  CRISPR gRNA sequence
gctagataagtttttggggg

SEQ ID NO: 202714 - DNA, 20 bp, Artificial
  CRISPR gRNA sequence
ctagataagtttttgggggg

SEQ ID NO: 202715 - DNA, 20 bp, Artificial
  CRISPR gRNA sequence
tagataagtttttgggggga

SEQ ID NO: 202716 - DNA, 20 bp, Artificial
  CRISPR gRNA sequence
agataagtttttggggggag

SEQ ID NO: 202717 - DNA, 20 bp, Artificial
  CRISPR gRNA sequence
gataagtttttggggggagg

SEQ ID NO: 202718 - DNA, 20 bp, Artificial
  CRISPR gRNA sequence
ataagtttttggggggaggg

SEQ ID NO: 202719 - DNA, 20 bp, Artificial
  CRISPR gRNA sequence
ggacactgctctgcataata

SEQ ID NO: 202720 - DNA, 20 bp, Artificial
  CRISPR gRNA sequence
tctgcataatatagaatgtt

SEQ ID NO: 202721 - DNA, 20 bp, Artificial
  CRISPR gRNA sequence
ctgcataatatagaatgttg

SEQ ID NO: 202722 - DNA, 20 bp, Artificial
  CRISPR gRNA sequence
gcataatatagaatgttgag

SEQ ID NO: 202723 - DNA, 20 bp, Artificial
  CRISPR gRNA sequence
agaatgttgaggagcatccc

SEQ ID NO: 202724 - DNA, 20 bp, Artificial
  CRISPR gRNA sequence
catccctggcctctacatac

SEQ ID NO: 202725 - DNA, 20 bp, Artificial
  CRISPR gRNA sequence
ggcctctacatactagatgc

SEQ ID NO: 202726 - DNA, 20 bp, Artificial
  CRISPR gRNA sequence
acatactagatgctagtaac

SEQ ID NO: 202727 - DNA, 20 bp, Artificial
  CRISPR gRNA sequence
agatgctagtaactagatgc

SEQ ID NO: 202728 - DNA, 20 bp, Artificial
  CRISPR gRNA sequence
tatgttaatcaaactgtttt

SEQ ID NO: 202729 - DNA, 20 bp, Artificial
  CRISPR gRNA sequence
acattgtcaatgcccccgat

SEQ ID NO: 202730 - DNA, 20 bp, Artificial
  CRISPR gRNA sequence
ccgatgagcaaaaccactcc

SEQ ID NO: 202731 - DNA, 20 bp, Artificial
  CRISPR gRNA sequence
actgatgtacataatactaa

SEQ ID NO: 202732 - DNA, 20 bp, Artificial
  CRISPR gRNA sequence
ctgatgtacataatactaat

SEQ ID NO: 202733 - DNA, 20 bp, Artificial
  CRISPR gRNA sequence
ataatactaatgggaaataa

SEQ ID NO: 202734 - DNA, 20 bp, Artificial
  CRISPR gRNA sequence
taatactaatgggaaataat

SEQ ID NO: 202735 - DNA, 20 bp, Artificial
  CRISPR gRNA sequence
atgggttaattaacaatatt

SEQ ID NO: 202736 - DNA, 20 bp, Artificial
  CRISPR gRNA sequence
taattaacaatattgagaaa

SEQ ID NO: 202737 - DNA, 20 bp, Artificial
  CRISPR gRNA sequence
attaacaatattgagaaaaa

SEQ ID NO: 202738 - DNA, 20 bp, Artificial
  CRISPR gRNA sequence
tgtcctaccttataaaaaat

SEQ ID NO: 202739 - DNA, 20 bp, Artificial
  CRISPR gRNA sequence
taaaaaattagtaaacaatc

SEQ ID NO: 202740 - DNA, 20 bp, Artificial
  CRISPR gRNA sequence
tagtaaacaatctggaaatc

SEQ ID NO: 202741 - DNA, 20 bp, Artificial
  CRISPR gRNA sequence
ttttgttttgaaaaaaatga

SEQ ID NO: 202742 - DNA, 20 bp, Artificial
  CRISPR gRNA sequence
aaaaaatgacagaataaaac

SEQ ID NO: 202743 - DNA, 20 bp, Artificial
  CRISPR gRNA sequence
aaaaatgacagaataaaact

SEQ ID NO: 202744 - DNA, 20 bp, Artificial
  CRISPR gRNA sequence
aatgacagaataaaactggg

SEQ ID NO: 202745 - DNA, 20 bp, Artificial
  CRISPR gRNA sequence
acccttgtgaaatcctgatg

SEQ ID NO: 202746 - DNA, 20 bp, Artificial
  CRISPR gRNA sequence
gaaatcctgatgaagaaaaa

SEQ ID NO: 202747 - DNA, 20 bp, Artificial
  CRISPR gRNA sequence
tttaataaaaataaactgca

SEQ ID NO: 202748 - DNA, 20 bp, Artificial
  CRISPR gRNA sequence
aataaactgcaaagactcaa

SEQ ID NO: 202749 - DNA, 20 bp, Artificial
  CRISPR gRNA sequence
ataaactgcaaagactcaat

SEQ ID NO: 202750 - DNA, 20 bp, Artificial
  CRISPR gRNA sequence
catgttattgtttctgctgc

SEQ ID NO: 202751 - DNA, 20 bp, Artificial
  CRISPR gRNA sequence
ctgctgctagctccactgtc

SEQ ID NO: 202752 - DNA, 20 bp, Artificial
  CRISPR gRNA sequence
gtatctcataccttctctga

SEQ ID NO: 202753 - DNA, 20 bp, Artificial
  CRISPR gRNA sequence
tcataccttctctgaaagaa

SEQ ID NO: 202754 - DNA, 20 bp, Artificial
  CRISPR gRNA sequence
ccttctctgaaagaatggaa

SEQ ID NO: 202755 - DNA, 20 bp, Artificial
  CRISPR gRNA sequence
cttctctgaaagaatggaat

SEQ ID NO: 202756 - DNA, 20 bp, Artificial
  CRISPR gRNA sequence
atgggtcaatctgcgaatat

SEQ ID NO: 202757 - DNA, 20 bp, Artificial
  CRISPR gRNA sequence
tatatgaatcttttaaattt

SEQ ID NO: 202758 - DNA, 20 bp, Artificial
  CRISPR gRNA sequence
ttaaattttggttaatattg

SEQ ID NO: 202759 - DNA, 20 bp, Artificial
  CRISPR gRNA sequence
ttgaagttgattttttcacc

SEQ ID NO: 202760 - DNA, 20 bp, Artificial
  CRISPR gRNA sequence
tgaagttgattttttcacca

SEQ ID NO: 202761 - DNA, 20 bp, Artificial
  CRISPR gRNA sequence
agttgattttttcaccaagg

SEQ ID NO: 202762 - DNA, 20 bp, Artificial
  CRISPR gRNA sequence
tttcaccaaggaagttgttt

SEQ ID NO: 202763 - DNA, 20 bp, Artificial
  CRISPR gRNA sequence
ttcaccaaggaagttgttta

SEQ ID NO: 202764 - DNA, 20 bp, Artificial
  CRISPR gRNA sequence
agttgtttaaggcaacctaa

SEQ ID NO: 202765 - DNA, 20 bp, Artificial
  CRISPR gRNA sequence
aggcaacctaaaagcaaact

SEQ ID NO: 202766 - DNA, 20 bp, Artificial
  CRISPR gRNA sequence
caacctaaaagcaaactgag

SEQ ID NO: 202767 - DNA, 20 bp, Artificial
  CRISPR gRNA sequence
cctaaaagcaaactgagtag

SEQ ID NO: 202768 - DNA, 20 bp, Artificial
  CRISPR gRNA sequence
aaagcaaactgagtagcgga

SEQ ID NO: 202769 - DNA, 20 bp, Artificial
  CRISPR gRNA sequence
aactgagtagcggaaagaaa

SEQ ID NO: 202770 - DNA, 20 bp, Artificial
  CRISPR gRNA sequence
gctgctgtgtgtcatccaca

SEQ ID NO: 202771 - DNA, 20 bp, Artificial
  CRISPR gRNA sequence
tgctgtgtgtcatccacata

SEQ ID NO: 202772 - DNA, 20 bp, Artificial
  CRISPR gRNA sequence
gtgtgtcatccacatagaga

SEQ ID NO: 202773 - DNA, 20 bp, Artificial
  CRISPR gRNA sequence
catagagatagtctccatga

SEQ ID NO: 202774 - DNA, 20 bp, Artificial
  CRISPR gRNA sequence
tctccatgacagtaatcaat

SEQ ID NO: 202775 - DNA, 20 bp, Artificial
  CRISPR gRNA sequence
ccatgacagtaatcaattgg

SEQ ID NO: 202776 - DNA, 20 bp, Artificial
  CRISPR gRNA sequence
atcaattggtggctgtcatg

SEQ ID NO: 202777 - DNA, 20 bp, Artificial
  CRISPR gRNA sequence
tcaattggtggctgtcatga

SEQ ID NO: 202778 - DNA, 20 bp, Artificial
  CRISPR gRNA sequence
caattggtggctgtcatgaa

SEQ ID NO: 202779 - DNA, 20 bp, Artificial
  CRISPR gRNA sequence
aattggtggctgtcatgaag

SEQ ID NO: 202780 - DNA, 20 bp, Artificial
  CRISPR gRNA sequence
aatattttaaatgttatatt

SEQ ID NO: 202781 - DNA, 20 bp, Artificial
  CRISPR gRNA sequence
taaatgttatatttagcatt

SEQ ID NO: 202782 - DNA, 20 bp, Artificial
  CRISPR gRNA sequence
atttagttttttttcttcta

SEQ ID NO: 202783 - DNA, 20 bp, Artificial
  CRISPR gRNA sequence
acagtgacaaacattaaata

SEQ ID NO: 202784 - DNA, 20 bp, Artificial
  CRISPR gRNA sequence
acaaacattaaataaagtaa

SEQ ID NO: 202785 - DNA, 20 bp, Artificial
  CRISPR gRNA sequence
ataaagtaaaagcaataaat

SEQ ID NO: 202786 - DNA, 20 bp, Artificial
  CRISPR gRNA sequence
tgtgataaaaatctatgttt

SEQ ID NO: 202787 - DNA, 20 bp, Artificial
  CRISPR gRNA sequence
gtgataaaaatctatgttta

SEQ ID NO: 202788 - DNA, 20 bp, Artificial
  CRISPR gRNA sequence
tctatgtttaaggtatatga

SEQ ID NO: 202789 - DNA, 20 bp, Artificial
  CRISPR gRNA sequence
ctatgtttaaggtatatgac

SEQ ID NO: 202790 - DNA, 20 bp, Artificial
  CRISPR gRNA sequence
gacaggtacctaaatatttc

SEQ ID NO: 202791 - DNA, 20 bp, Artificial
  CRISPR gRNA sequence
ataatttataacctcaattt

SEQ ID NO: 202792 - DNA, 20 bp, Artificial
  CRISPR gRNA sequence
cctcaattttagtctcttta

SEQ ID NO: 202793 - DNA, 20 bp, Artificial
  CRISPR gRNA sequence
ctcaattttagtctctttat

SEQ ID NO: 202794 - DNA, 20 bp, Artificial
  CRISPR gRNA sequence
tcaattttagtctctttatg

SEQ ID NO: 202795 - DNA, 20 bp, Artificial
  CRISPR gRNA sequence
aattttagtctctttatggg

SEQ ID NO: 202796 - DNA, 20 bp, Artificial
  CRISPR gRNA sequence
tagtctctttatggggagat

SEQ ID NO: 202797 - DNA, 20 bp, Artificial
  CRISPR gRNA sequence
tttatggggagataagtcct

SEQ ID NO: 202798 - DNA, 20 bp, Artificial
  CRISPR gRNA sequence
aaataaccaatttattaatg

SEQ ID NO: 202799 - DNA, 20 bp, Artificial
  CRISPR gRNA sequence
caatttattaatgtggattt

SEQ ID NO: 202800 - DNA, 20 bp, Artificial
  CRISPR gRNA sequence
taatgtggatttcagttaca

SEQ ID NO: 202801 - DNA, 20 bp, Artificial
  CRISPR gRNA sequence
tggatttcagttacacagtt

SEQ ID NO: 202802 - DNA, 20 bp, Artificial
  CRISPR gRNA sequence
taactgaaatccacattaat

SEQ ID NO: 202803 - DNA, 20 bp, Artificial
  CRISPR gRNA sequence
actgaaatccacattaatca

SEQ ID NO: 202804 - DNA, 20 bp, Artificial
  CRISPR gRNA sequence
gaaatccacattaatcagag

SEQ ID NO: 202805 - DNA, 20 bp, Artificial
  CRISPR gRNA sequence
aatccacattaatcagagaa

SEQ ID NO: 202806 - DNA, 20 bp, Artificial
  CRISPR gRNA sequence
gaagagaaacccatattaat

SEQ ID NO: 202807 - DNA, 20 bp, Artificial
  CRISPR gRNA sequence
attaatcagaaaacatccta

SEQ ID NO: 202808 - DNA, 20 bp, Artificial
  CRISPR gRNA sequence
atcagaaaacatcctatggc

SEQ ID NO: 202809 - DNA, 20 bp, Artificial
  CRISPR gRNA sequence
catcctatggcaagttcccc

SEQ ID NO: 202810 - DNA, 20 bp, Artificial
  CRISPR gRNA sequence
tttgattcattacttccgcc

SEQ ID NO: 202811 - DNA, 20 bp, Artificial
  CRISPR gRNA sequence
tcattacttccgcccagccc

SEQ ID NO: 202812 - DNA, 20 bp, Artificial
  CRISPR gRNA sequence
ggacttatgtgtctaatact

SEQ ID NO: 202813 - DNA, 20 bp, Artificial
  CRISPR gRNA sequence
atgtgtctaatactcagtca

SEQ ID NO: 202814 - DNA, 20 bp, Artificial
  CRISPR gRNA sequence
tcatagccttgccttcttat

SEQ ID NO: 202815 - DNA, 20 bp, Artificial
  CRISPR gRNA sequence
catagccttgccttcttata

SEQ ID NO: 202816 - DNA, 20 bp, Artificial
  CRISPR gRNA sequence
ccttgccttcttataaggca

SEQ ID NO: 202817 - DNA, 20 bp, Artificial
  CRISPR gRNA sequence
ttgccttcttataaggcaca

SEQ ID NO: 202818 - DNA, 20 bp, Artificial
  CRISPR gRNA sequence
ttcataacttccctattttc

SEQ ID NO: 202819 - DNA, 20 bp, Artificial
  CRISPR gRNA sequence
tcataacttccctattttct

SEQ ID NO: 202820 - DNA, 20 bp, Artificial
  CRISPR gRNA sequence
tattttctaggctcaaatgc

SEQ ID NO: 202821 - DNA, 20 bp, Artificial
  CRISPR gRNA sequence
ttctaggctcaaatgctggc

SEQ ID NO: 202822 - DNA, 20 bp, Artificial
  CRISPR gRNA sequence
atgctggctagaatgaaact

SEQ ID NO: 202823 - DNA, 20 bp, Artificial
  CRISPR gRNA sequence
tagaatgaaactgagtgtat

SEQ ID NO: 202824 - DNA, 20 bp, Artificial
  CRISPR gRNA sequence
actgagtgtataagtcacaa

SEQ ID NO: 202825 - DNA, 20 bp, Artificial
  CRISPR gRNA sequence
ctgagtgtataagtcacaaa

SEQ ID NO: 202826 - DNA, 20 bp, Artificial
  CRISPR gRNA sequence
agtcacaaaaggcacataca

SEQ ID NO: 202827 - DNA, 20 bp, Artificial
  CRISPR gRNA sequence
aaaaggcacatacacagaaa

SEQ ID NO: 202828 - DNA, 20 bp, Artificial
  CRISPR gRNA sequence
aaaggcacatacacagaaaa

SEQ ID NO: 202829 - DNA, 20 bp, Artificial
  CRISPR gRNA sequence
acagaaaaaggaactttctc

SEQ ID NO: 202830 - DNA, 20 bp, Artificial
  CRISPR gRNA sequence
catatatattgttatctaaa

SEQ ID NO: 202831 - DNA, 20 bp, Artificial
  CRISPR gRNA sequence
tatatattgttatctaaata

SEQ ID NO: 202832 - DNA, 20 bp, Artificial
  CRISPR gRNA sequence
gttatctaaatagagcttga

SEQ ID NO: 202833 - DNA, 20 bp, Artificial
  CRISPR gRNA sequence
tagagcttgaaagttctgca

SEQ ID NO: 202834 - DNA, 20 bp, Artificial
  CRISPR gRNA sequence
agagcttgaaagttctgcaa

SEQ ID NO: 202835 - DNA, 20 bp, Artificial
  CRISPR gRNA sequence
gagcttgaaagttctgcaaa

SEQ ID NO: 202836 - DNA, 20 bp, Artificial
  CRISPR gRNA sequence
aagttctgcaaagggttata

SEQ ID NO: 202837 - DNA, 20 bp, Artificial
  CRISPR gRNA sequence
ttctgcaaagggttataaag

SEQ ID NO: 202838 - DNA, 20 bp, Artificial
  CRISPR gRNA sequence
tgcaaagggttataaagtag

SEQ ID NO: 202839 - DNA, 20 bp, Artificial
  CRISPR gRNA sequence
gctgtttcaaatgcacctca

SEQ ID NO: 202840 - DNA, 20 bp, Artificial
  CRISPR gRNA sequence
acagtcaatcaaacattcat

SEQ ID NO: 202841 - DNA, 20 bp, Artificial
  CRISPR gRNA sequence
acattcataagaaactcttc

SEQ ID NO: 202842 - DNA, 20 bp, Artificial
  CRISPR gRNA sequence
cattcataagaaactcttcc

SEQ ID NO: 202843 - DNA, 20 bp, Artificial
  CRISPR gRNA sequence
taagaaactcttccaggttt

SEQ ID NO: 202844 - DNA, 20 bp, Artificial
  CRISPR gRNA sequence
gtttaagtcaatgcataaaa

SEQ ID NO: 202845 - DNA, 20 bp, Artificial
  CRISPR gRNA sequence
caatgcataaaaaagctact

SEQ ID NO: 202846 - DNA, 20 bp, Artificial
  CRISPR gRNA sequence
ataaaaaagctactaagatc

SEQ ID NO: 202847 - DNA, 20 bp, Artificial
  CRISPR gRNA sequence
agctactaagatcaagcaac

SEQ ID NO: 202848 - DNA, 20 bp, Artificial
  CRISPR gRNA sequence
caagcaacaagaatttgcct

SEQ ID NO: 202849 - DNA, 20 bp, Artificial
  CRISPR gRNA sequence
agcaacaagaatttgcctta

SEQ ID NO: 202850 - DNA, 20 bp, Artificial
  CRISPR gRNA sequence
caagaatttgccttagagta

SEQ ID NO: 202851 - DNA, 20 bp, Artificial
  CRISPR gRNA sequence
tagagtacagtataatttca

SEQ ID NO: 202852 - DNA, 20 bp, Artificial
  CRISPR gRNA sequence
acagtataatttcatggaaa

SEQ ID NO: 202853 - DNA, 20 bp, Artificial
  CRISPR gRNA sequence
cagtataatttcatggaaaa

SEQ ID NO: 202854 - DNA, 20 bp, Artificial
  CRISPR gRNA sequence
cttttctttttttttttttt

SEQ ID NO: 202855 - DNA, 20 bp, Artificial
  CRISPR gRNA sequence
tttctttttttttttttttg

SEQ ID NO: 202856 - DNA, 20 bp, Artificial
  CRISPR gRNA sequence
tttttttttttttttggaga

SEQ ID NO: 202857 - DNA, 20 bp, Artificial
  CRISPR gRNA sequence
tttttttttttttggagaca

SEQ ID NO: 202858 - DNA, 20 bp, Artificial
  CRISPR gRNA sequence
gagtctctcactccgttacc

SEQ ID NO: 202859 - DNA, 20 bp, Artificial
  CRISPR gRNA sequence
agtctctcactccgttaccc

SEQ ID NO: 202860 - DNA, 20 bp, Artificial
  CRISPR gRNA sequence
tctcactccgttacccaggc

SEQ ID NO: 202861 - DNA, 20 bp, Artificial
  CRISPR gRNA sequence
tcactccgttacccaggctg

SEQ ID NO: 202862 - DNA, 20 bp, Artificial
  CRISPR gRNA sequence
ccgttacccaggctggagtg

SEQ ID NO: 202863 - DNA, 20 bp, Artificial
  CRISPR gRNA sequence
ttacccaggctggagtgcag

SEQ ID NO: 202864 - DNA, 20 bp, Artificial
  CRISPR gRNA sequence
ggagtgcagtggcacaatct

SEQ ID NO: 202865 - DNA, 20 bp, Artificial
  CRISPR gRNA sequence
tcactgcaaactctgcctcc

SEQ ID NO: 202866 - DNA, 20 bp, Artificial
  CRISPR gRNA sequence
cactgcaaactctgcctccc

SEQ ID NO: 202867 - DNA, 20 bp, Artificial
  CRISPR gRNA sequence
gttcaatgattctcctgcct

SEQ ID NO: 202868 - DNA, 20 bp, Artificial
  CRISPR gRNA sequence
ttctcctgcctcagcctccc

SEQ ID NO: 202869 - DNA, 20 bp, Artificial
  CRISPR gRNA sequence
tcctgcctcagcctcccgag

SEQ ID NO: 202870 - DNA, 20 bp, Artificial
  CRISPR gRNA sequence
gcctcagcctcccgagtagc

SEQ ID NO: 202871 - DNA, 20 bp, Artificial
  CRISPR gRNA sequence
cctcagcctcccgagtagct

SEQ ID NO: 202872 - DNA, 20 bp, Artificial
  CRISPR gRNA sequence
ctcccgagtagctgggacta

SEQ ID NO: 202873 - DNA, 20 bp, Artificial
  CRISPR gRNA sequence
tcccgagtagctgggactac

SEQ ID NO: 202874 - DNA, 20 bp, Artificial
  CRISPR gRNA sequence
ggactacaggcatgcgccac

SEQ ID NO: 202875 - DNA, 20 bp, Artificial
  CRISPR gRNA sequence
gactacaggcatgcgccacc

SEQ ID NO: 202876 - DNA, 20 bp, Artificial
  CRISPR gRNA sequence
caggcatgcgccaccaggcc

SEQ ID NO: 202877 - DNA, 20 bp, Artificial
  CRISPR gRNA sequence
aattcttttttttttttttt

SEQ ID NO: 202878 - DNA, 20 bp, Artificial
  CRISPR gRNA sequence
tcttttttttttttttttag

SEQ ID NO: 202879 - DNA, 20 bp, Artificial
  CRISPR gRNA sequence
ttttttttttttttttagta

SEQ ID NO: 202880 - DNA, 20 bp, Artificial
  CRISPR gRNA sequence
ttttttttttttagtagaga

SEQ ID NO: 202881 - DNA, 20 bp, Artificial
  CRISPR gRNA sequence
tttttttttttagtagagac

SEQ ID NO: 202882 - DNA, 20 bp, Artificial
  CRISPR gRNA sequence
ttttttttttagtagagacg

SEQ ID NO: 202883 - DNA, 20 bp, Artificial
  CRISPR gRNA sequence
gagacggggtttcacattgt

SEQ ID NO: 202884 - DNA, 20 bp, Artificial
  CRISPR gRNA sequence
cggggtttcacattgttggc

SEQ ID NO: 202885 - DNA, 20 bp, Artificial
  CRISPR gRNA sequence
ggggtttcacattgttggcc

SEQ ID NO: 202886 - DNA, 20 bp, Artificial
  CRISPR gRNA sequence
ttgttggccaggctgatctc

SEQ ID NO: 202887 - DNA, 20 bp, Artificial
  CRISPR gRNA sequence
acctcatgatccacctgcca

SEQ ID NO: 202888 - DNA, 20 bp, Artificial
  CRISPR gRNA sequence
ccacctgccacggcctccca

SEQ ID NO: 202889 - DNA, 20 bp, Artificial
  CRISPR gRNA sequence
gccacggcctcccaaagtgc

SEQ ID NO: 202890 - DNA, 20 bp, Artificial
  CRISPR gRNA sequence
ccacggcctcccaaagtgct

SEQ ID NO: 202891 - DNA, 20 bp, Artificial
  CRISPR gRNA sequence
ctcccaaagtgctgggatta

SEQ ID NO: 202892 - DNA, 20 bp, Artificial
  CRISPR gRNA sequence
tcccaaagtgctgggattac

SEQ ID NO: 202893 - DNA, 20 bp, Artificial
  CRISPR gRNA sequence
agtgctgggattacaggtgt

SEQ ID NO: 202894 - DNA, 20 bp, Artificial
  CRISPR gRNA sequence
caggtgtgagccaccatgcc

SEQ ID NO: 202895 - DNA, 20 bp, Artificial
  CRISPR gRNA sequence
acatccttcttaacaaaaat

SEQ ID NO: 202896 - DNA, 20 bp, Artificial
  CRISPR gRNA sequence
atccttcttaacaaaaataa

SEQ ID NO: 202897 - DNA, 20 bp, Artificial
  CRISPR gRNA sequence
catataaaatttatcctctt

SEQ ID NO: 202898 - DNA, 20 bp, Artificial
  CRISPR gRNA sequence
atataaaatttatcctctta

SEQ ID NO: 202899 - DNA, 20 bp, Artificial
  CRISPR gRNA sequence
aaatttatcctcttaaggct

SEQ ID NO: 202900 - DNA, 20 bp, Artificial
  CRISPR gRNA sequence
tttatcctcttaaggcttag

SEQ ID NO: 202901 - DNA, 20 bp, Artificial
  CRISPR gRNA sequence
tatcctcttaaggcttagaa

SEQ ID NO: 202902 - DNA, 20 bp, Artificial
  CRISPR gRNA sequence
aaggcttagaagagctgtta

SEQ ID NO: 202903 - DNA, 20 bp, Artificial
  CRISPR gRNA sequence
aggcttagaagagctgttat

SEQ ID NO: 202904 - DNA, 20 bp, Artificial
  CRISPR gRNA sequence
gcttagaagagctgttatag

SEQ ID NO: 202905 - DNA, 20 bp, Artificial
  CRISPR gRNA sequence
agagctgttataggagaaaa

SEQ ID NO: 202906 - DNA, 20 bp, Artificial
  CRISPR gRNA sequence
ggagaaaacagtgcaaacaa

SEQ ID NO: 202907 - DNA, 20 bp, Artificial
  CRISPR gRNA sequence
aacatcacaaaatactacca

SEQ ID NO: 202908 - DNA, 20 bp, Artificial
  CRISPR gRNA sequence
tcacaaaatactaccataga

SEQ ID NO: 202909 - DNA, 20 bp, Artificial
  CRISPR gRNA sequence
cacaaaatactaccatagac

SEQ ID NO: 202910 - DNA, 20 bp, Artificial
  CRISPR gRNA sequence
acaaaatactaccatagaca

SEQ ID NO: 202911 - DNA, 20 bp, Artificial
  CRISPR gRNA sequence
gacagggttccaccataaaa

SEQ ID NO: 202912 - DNA, 20 bp, Artificial
  CRISPR gRNA sequence
aaaatggtccgtctctcttt

SEQ ID NO: 202913 - DNA, 20 bp, Artificial
  CRISPR gRNA sequence
gtccgtctctctttgagtat

SEQ ID NO: 202914 - DNA, 20 bp, Artificial
  CRISPR gRNA sequence
ataagtacactatatattga

SEQ ID NO: 202915 - DNA, 20 bp, Artificial
  CRISPR gRNA sequence
agtacactatatattgaaag

SEQ ID NO: 202916 - DNA, 20 bp, Artificial
  CRISPR gRNA sequence
ctatatattgaaagtagttt

SEQ ID NO: 202917 - DNA, 20 bp, Artificial
  CRISPR gRNA sequence
tagttttggttcctgttgat

SEQ ID NO: 202918 - DNA, 20 bp, Artificial
  CRISPR gRNA sequence
ttcaactactacttattttc

SEQ ID NO: 202919 - DNA, 20 bp, Artificial
  CRISPR gRNA sequence
tcaactactacttattttcc

SEQ ID NO: 202920 - DNA, 20 bp, Artificial
  CRISPR gRNA sequence
cttaaacttttccttaaatt

SEQ ID NO: 202921 - DNA, 20 bp, Artificial
  CRISPR gRNA sequence
aaacttttccttaaattaag

SEQ ID NO: 202922 - DNA, 20 bp, Artificial
  CRISPR gRNA sequence
ttccaacaaatacacatgtt

SEQ ID NO: 202923 - DNA, 20 bp, Artificial
  CRISPR gRNA sequence
tccaacaaatacacatgttg

SEQ ID NO: 202924 - DNA, 20 bp, Artificial
  CRISPR gRNA sequence
atacacatgttgaggatccc

SEQ ID NO: 202925 - DNA, 20 bp, Artificial
  CRISPR gRNA sequence
tctgaaatccaaaacacttc

SEQ ID NO: 202926 - DNA, 20 bp, Artificial
  CRISPR gRNA sequence
atccaaaacacttctggtcc

SEQ ID NO: 202927 - DNA, 20 bp, Artificial
  CRISPR gRNA sequence
tccaaaacacttctggtccc

SEQ ID NO: 202928 - DNA, 20 bp, Artificial
  CRISPR gRNA sequence
acttctggtcccaggcattc

SEQ ID NO: 202929 - DNA, 20 bp, Artificial
  CRISPR gRNA sequence
gtcccaggcattctggataa

SEQ ID NO: 202930 - DNA, 20 bp, Artificial
  CRISPR gRNA sequence
ggacactccacctgtctctg

SEQ ID NO: 202931 - DNA, 20 bp, Artificial
  CRISPR gRNA sequence
gacactccacctgtctctgt

SEQ ID NO: 202932 - DNA, 20 bp, Artificial
  CRISPR gRNA sequence
acactccacctgtctctgtg

SEQ ID NO: 202933 - DNA, 20 bp, Artificial
  CRISPR gRNA sequence
tctgtggggtctactaatga

SEQ ID NO: 202934 - DNA, 20 bp, Artificial
  CRISPR gRNA sequence
tgtggggtctactaatgaaa

SEQ ID NO: 202935 - DNA, 20 bp, Artificial
  CRISPR gRNA sequence
tactaatgaaagagtatctc

SEQ ID NO: 202936 - DNA, 20 bp, Artificial
  CRISPR gRNA sequence
actaatgaaagagtatctcc

SEQ ID NO: 202937 - DNA, 20 bp, Artificial
  CRISPR gRNA sequence
gagtatctccaggttttctt

SEQ ID NO: 202938 - DNA, 20 bp, Artificial
  CRISPR gRNA sequence
ggttttcttcagtgaatctt

SEQ ID NO: 202939 - DNA, 20 bp, Artificial
  CRISPR gRNA sequence
ttcttcagtgaatcttcaga

SEQ ID NO: 202940 - DNA, 20 bp, Artificial
  CRISPR gRNA sequence
cttcagtgaatcttcagaaa

SEQ ID NO: 202941 - DNA, 20 bp, Artificial
  CRISPR gRNA sequence
tcttcagaaagagtttcttt

SEQ ID NO: 202942 - DNA, 20 bp, Artificial
  CRISPR gRNA sequence
gctcattttctttgctcaca

SEQ ID NO: 202943 - DNA, 20 bp, Artificial
  CRISPR gRNA sequence
ttgctcacatggtcacattt

SEQ ID NO: 202944 - DNA, 20 bp, Artificial
  CRISPR gRNA sequence
ctcacatggtcacatttcag

SEQ ID NO: 202945 - DNA, 20 bp, Artificial
  CRISPR gRNA sequence
tcacatggtcacatttcagc

SEQ ID NO: 202946 - DNA, 20 bp, Artificial
  CRISPR gRNA sequence
tcacatttcagcaggtacca

SEQ ID NO: 202947 - DNA, 20 bp, Artificial
  CRISPR gRNA sequence
agcaggtaccacagctaatg

SEQ ID NO: 202948 - DNA, 20 bp, Artificial
  CRISPR gRNA sequence
gcaggtaccacagctaatgt

SEQ ID NO: 202949 - DNA, 20 bp, Artificial
  CRISPR gRNA sequence
caggtaccacagctaatgtg

SEQ ID NO: 202950 - DNA, 20 bp, Artificial
  CRISPR gRNA sequence
gtaccacagctaatgtgggg

SEQ ID NO: 202951 - DNA, 20 bp, Artificial
  CRISPR gRNA sequence
taccacagctaatgtggggt

SEQ ID NO: 202952 - DNA, 20 bp, Artificial
  CRISPR gRNA sequence
tggggtaggtatcttgttgc

SEQ ID NO: 202953 - DNA, 20 bp, Artificial
  CRISPR gRNA sequence
taggtatcttgttgctagcc

SEQ ID NO: 202954 - DNA, 20 bp, Artificial
  CRISPR gRNA sequence
agcccagtcgtcaaatttct

SEQ ID NO: 202955 - DNA, 20 bp, Artificial
  CRISPR gRNA sequence
agtcgtcaaatttctcagta

SEQ ID NO: 202956 - DNA, 20 bp, Artificial
  CRISPR gRNA sequence
caaatttctcagtatagtga

SEQ ID NO: 202957 - DNA, 20 bp, Artificial
  CRISPR gRNA sequence
aaatttctcagtatagtgaa

SEQ ID NO: 202958 - DNA, 20 bp, Artificial
  CRISPR gRNA sequence
aatttctcagtatagtgaaa

SEQ ID NO: 202959 - DNA, 20 bp, Artificial
  CRISPR gRNA sequence
tctcagtatagtgaaagggc

SEQ ID NO: 202960 - DNA, 20 bp, Artificial
  CRISPR gRNA sequence
ctcagtatagtgaaagggca

SEQ ID NO: 202961 - DNA, 20 bp, Artificial
  CRISPR gRNA sequence
gggcaaggaatttgatataa

SEQ ID NO: 202962 - DNA, 20 bp, Artificial
  CRISPR gRNA sequence
atttgatataatagatgcca

SEQ ID NO: 202963 - DNA, 20 bp, Artificial
  CRISPR gRNA sequence
ccatagaacccaataacctc

SEQ ID NO: 202964 - DNA, 20 bp, Artificial
  CRISPR gRNA sequence
catagaacccaataacctca

SEQ ID NO: 202965 - DNA, 20 bp, Artificial
  CRISPR gRNA sequence
attgatcttttcttgtcctt

SEQ ID NO: 202966 - DNA, 20 bp, Artificial
  CRISPR gRNA sequence
atcttttcttgtccttcagt

SEQ ID NO: 202967 - DNA, 20 bp, Artificial
  CRISPR gRNA sequence
ttttcttgtccttcagtaag

SEQ ID NO: 202968 - DNA, 20 bp, Artificial
  CRISPR gRNA sequence
atgtatcaaaacattaaatg

SEQ ID NO: 202969 - DNA, 20 bp, Artificial
  CRISPR gRNA sequence
gcagcaaaaaaaataaattc

SEQ ID NO: 202970 - DNA, 20 bp, Artificial
  CRISPR gRNA sequence
aattcaagtaattctccact

SEQ ID NO: 202971 - DNA, 20 bp, Artificial
  CRISPR gRNA sequence
gtaattctccacttagcatt

SEQ ID NO: 202972 - DNA, 20 bp, Artificial
  CRISPR gRNA sequence
ataactcaatgtgttgttaa

SEQ ID NO: 202973 - DNA, 20 bp, Artificial
  CRISPR gRNA sequence
actcaatgtgttgttaacag

SEQ ID NO: 202974 - DNA, 20 bp, Artificial
  CRISPR gRNA sequence
ctcaatgtgttgttaacagc

SEQ ID NO: 202975 - DNA, 20 bp, Artificial
  CRISPR gRNA sequence
caggctcttatcaaattttc

SEQ ID NO: 202976 - DNA, 20 bp, Artificial
  CRISPR gRNA sequence
aaattttctagtatgacttt

SEQ ID NO: 202977 - DNA, 20 bp, Artificial
  CRISPR gRNA sequence
tttctagtatgactttcaga

SEQ ID NO: 202978 - DNA, 20 bp, Artificial
  CRISPR gRNA sequence
agtatgactttcagacggct

SEQ ID NO: 202979 - DNA, 20 bp, Artificial
  CRISPR gRNA sequence
tgactttcagacggcttggc

SEQ ID NO: 202980 - DNA, 20 bp, Artificial
  CRISPR gRNA sequence
gactttcagacggcttggca

SEQ ID NO: 202981 - DNA, 20 bp, Artificial
  CRISPR gRNA sequence
tttaaaatctgcatgctctt

SEQ ID NO: 202982 - DNA, 20 bp, Artificial
  CRISPR gRNA sequence
ttaaaatctgcatgctctta

SEQ ID NO: 202983 - DNA, 20 bp, Artificial
  CRISPR gRNA sequence
atgctcttaaggattaccct

SEQ ID NO: 202984 - DNA, 20 bp, Artificial
  CRISPR gRNA sequence
tgaaatcaatacacaaaata

SEQ ID NO: 202985 - DNA, 20 bp, Artificial
  CRISPR gRNA sequence
atacacaaaataaagtacat

SEQ ID NO: 202986 - DNA, 20 bp, Artificial
  CRISPR gRNA sequence
ataaagtacatgagaaataa

SEQ ID NO: 202987 - DNA, 20 bp, Artificial
  CRISPR gRNA sequence
taacaaaaaatgtataacct

SEQ ID NO: 202988 - DNA, 20 bp, Artificial
  CRISPR gRNA sequence
aaatgtataaccttagtgct

SEQ ID NO: 202989 - DNA, 20 bp, Artificial
  CRISPR gRNA sequence
ccttagtgctcagcctgaca

SEQ ID NO: 202990 - DNA, 20 bp, Artificial
  CRISPR gRNA sequence
cttagtgctcagcctgacac

SEQ ID NO: 202991 - DNA, 20 bp, Artificial
  CRISPR gRNA sequence
cagcctgacacaggaatacc

SEQ ID NO: 202992 - DNA, 20 bp, Artificial
  CRISPR gRNA sequence
gacacaggaataccaagtat

SEQ ID NO: 202993 - DNA, 20 bp, Artificial
  CRISPR gRNA sequence
acacaggaataccaagtatc

SEQ ID NO: 202994 - DNA, 20 bp, Artificial
  CRISPR gRNA sequence
cacaggaataccaagtatca

SEQ ID NO: 202995 - DNA, 20 bp, Artificial
  CRISPR gRNA sequence
acaggaataccaagtatcag

SEQ ID NO: 202996 - DNA, 20 bp, Artificial
  CRISPR gRNA sequence
aggaataccaagtatcaggg

SEQ ID NO: 202997 - DNA, 20 bp, Artificial
  CRISPR gRNA sequence
taacatttttgtgaacaaat

SEQ ID NO: 202998 - DNA, 20 bp, Artificial
  CRISPR gRNA sequence
aacatttttgtgaacaaatt

SEQ ID NO: 202999 - DNA, 20 bp, Artificial
  CRISPR gRNA sequence
tatatgttctataaaataat

SEQ ID NO: 203000 - DNA, 20 bp, Artificial
  CRISPR gRNA sequence
ataaaataattagtaaccaa

SEQ ID NO: 203001 - DNA, 20 bp, Artificial
  CRISPR gRNA sequence
aaataattagtaaccaaaag

SEQ ID NO: 203002 - DNA, 20 bp, Artificial
  CRISPR gRNA sequence
aataattagtaaccaaaagc

SEQ ID NO: 203003 - DNA, 20 bp, Artificial
  CRISPR gRNA sequence
accaaaagcaggctacttct

SEQ ID NO: 203004 - DNA, 20 bp, Artificial
  CRISPR gRNA sequence
gctacttctaagaaatctgt

SEQ ID NO: 203005 - DNA, 20 bp, Artificial
  CRISPR gRNA sequence
ctacttctaagaaatctgtt

SEQ ID NO: 203006 - DNA, 20 bp, Artificial
  CRISPR gRNA sequence
ttctaagaaatctgttgggt

SEQ ID NO: 203007 - DNA, 20 bp, Artificial
  CRISPR gRNA sequence
actgtgtacctacaatgtac

SEQ ID NO: 203008 - DNA, 20 bp, Artificial
  CRISPR gRNA sequence
aatgtaccagccccttttgc

SEQ ID NO: 203009 - DNA, 20 bp, Artificial
  CRISPR gRNA sequence
cccttttgctagtctaaatc

SEQ ID NO: 203010 - DNA, 20 bp, Artificial
  CRISPR gRNA sequence
ccttttgctagtctaaatca

SEQ ID NO: 203011 - DNA, 20 bp, Artificial
  CRISPR gRNA sequence
gctagtctaaatcaaggaac

SEQ ID NO: 203012 - DNA, 20 bp, Artificial
  CRISPR gRNA sequence
agtctaaatcaaggaacaag

SEQ ID NO: 203013 - DNA, 20 bp, Artificial
  CRISPR gRNA sequence
ttatttgacaataattgatt

SEQ ID NO: 203014 - DNA, 20 bp, Artificial
  CRISPR gRNA sequence
atcactattctaaatgctga

SEQ ID NO: 203015 - DNA, 20 bp, Artificial
  CRISPR gRNA sequence
atgctgacagtgaacacgaa

SEQ ID NO: 203016 - DNA, 20 bp, Artificial
  CRISPR gRNA sequence
tgaacacgaaaagcaaacac

SEQ ID NO: 203017 - DNA, 20 bp, Artificial
  CRISPR gRNA sequence
gaacacgaaaagcaaacaca

SEQ ID NO: 203018 - DNA, 20 bp, Artificial
  CRISPR gRNA sequence
gcaaacacaaggcctgcctc

SEQ ID NO: 203019 - DNA, 20 bp, Artificial
  CRISPR gRNA sequence
caaacacaaggcctgcctca

SEQ ID NO: 203020 - DNA, 20 bp, Artificial
  CRISPR gRNA sequence
tcaaggcccttacattctaa

SEQ ID NO: 203021 - DNA, 20 bp, Artificial
  CRISPR gRNA sequence
caaggcccttacattctaat

SEQ ID NO: 203022 - DNA, 20 bp, Artificial
  CRISPR gRNA sequence
gcccttacattctaatgggt

SEQ ID NO: 203023 - DNA, 20 bp, Artificial
  CRISPR gRNA sequence
atgggtgagtgtgtgtgttt

SEQ ID NO: 203024 - DNA, 20 bp, Artificial
  CRISPR gRNA sequence
tgggtgagtgtgtgtgtttg

SEQ ID NO: 203025 - DNA, 20 bp, Artificial
  CRISPR gRNA sequence
gggtgagtgtgtgtgtttga

SEQ ID NO: 203026 - DNA, 20 bp, Artificial
  CRISPR gRNA sequence
ggtgagtgtgtgtgtttgag

SEQ ID NO: 203027 - DNA, 20 bp, Artificial
  CRISPR gRNA sequence
tgagtgtgtgtgtttgaggg

SEQ ID NO: 203028 - DNA, 20 bp, Artificial
  CRISPR gRNA sequence
gagtgtgtgtgtttgagggg

SEQ ID NO: 203029 - DNA, 20 bp, Artificial
  CRISPR gRNA sequence
agtgtgtgtgtttgagggga

SEQ ID NO: 203030 - DNA, 20 bp, Artificial
  CRISPR gRNA sequence
gtgtgtgtgtttgaggggag

SEQ ID NO: 203031 - DNA, 20 bp, Artificial
  CRISPR gRNA sequence
tgtgtgtgtttgaggggagg

SEQ ID NO: 203032 - DNA, 20 bp, Artificial
  CRISPR gRNA sequence
gtgtgtgtttgaggggaggg

SEQ ID NO: 203033 - DNA, 20 bp, Artificial
  CRISPR gRNA sequence
gtttgaggggaggggggtgt

SEQ ID NO: 203034 - DNA, 20 bp, Artificial
  CRISPR gRNA sequence
gggaggggggtgtgagtgat

SEQ ID NO: 203035 - DNA, 20 bp, Artificial
  CRISPR gRNA sequence
tactcccaaaacttctttcc

SEQ ID NO: 203036 - DNA, 20 bp, Artificial
  CRISPR gRNA sequence
caaaacttctttcccagtta

SEQ ID NO: 203037 - DNA, 20 bp, Artificial
  CRISPR gRNA sequence
aaacttctttcccagttaaa

SEQ ID NO: 203038 - DNA, 20 bp, Artificial
  CRISPR gRNA sequence
ttctttcccagttaaagaga

SEQ ID NO: 203039 - DNA, 20 bp, Artificial
  CRISPR gRNA sequence
tcccagttaaagagatggtg

SEQ ID NO: 203040 - DNA, 20 bp, Artificial
  CRISPR gRNA sequence
cccagttaaagagatggtga

SEQ ID NO: 203041 - DNA, 20 bp, Artificial
  CRISPR gRNA sequence
gtgaaggcctactctactct

SEQ ID NO: 203042 - DNA, 20 bp, Artificial
  CRISPR gRNA sequence
tttaatctttcaaattcatg

SEQ ID NO: 203043 - DNA, 20 bp, Artificial
  CRISPR gRNA sequence
ctttcaaattcatgcagatg

SEQ ID NO: 203044 - DNA, 20 bp, Artificial
  CRISPR gRNA sequence
gaagcaatgacatgtccctc

SEQ ID NO: 203045 - DNA, 20 bp, Artificial
  CRISPR gRNA sequence
cctctagccacctgaaaaaa

SEQ ID NO: 203046 - DNA, 20 bp, Artificial
  CRISPR gRNA sequence
aaaacagctaatgttatgaa

SEQ ID NO: 203047 - DNA, 20 bp, Artificial
  CRISPR gRNA sequence
agctaatgttatgaatggac

SEQ ID NO: 203048 - DNA, 20 bp, Artificial
  CRISPR gRNA sequence
taatgttatgaatggacaag

SEQ ID NO: 203049 - DNA, 20 bp, Artificial
  CRISPR gRNA sequence
aatgttatgaatggacaaga

SEQ ID NO: 203050 - DNA, 20 bp, Artificial
  CRISPR gRNA sequence
ttttctgattttgtgaccaa

SEQ ID NO: 203051 - DNA, 20 bp, Artificial
  CRISPR gRNA sequence
ctgattttgtgaccaataga

SEQ ID NO: 203052 - DNA, 20 bp, Artificial
  CRISPR gRNA sequence
gaccaatagacagcacatac

SEQ ID NO: 203053 - DNA, 20 bp, Artificial
  CRISPR gRNA sequence
agcacatacaagataaaatg

SEQ ID NO: 203054 - DNA, 20 bp, Artificial
  CRISPR gRNA sequence
gcacatacaagataaaatgc

SEQ ID NO: 203055 - DNA, 20 bp, Artificial
  CRISPR gRNA sequence
tgaaatctaatgaaattacc

SEQ ID NO: 203056 - DNA, 20 bp, Artificial
  CRISPR gRNA sequence
atgaaattaccaagtcaact

SEQ ID NO: 203057 - DNA, 20 bp, Artificial
  CRISPR gRNA sequence
tgaaattaccaagtcaactt

SEQ ID NO: 203058 - DNA, 20 bp, Artificial
  CRISPR gRNA sequence
gaaattaccaagtcaacttg

SEQ ID NO: 203059 - DNA, 20 bp, Artificial
  CRISPR gRNA sequence
gtcaacttggggataaaatc

SEQ ID NO: 203060 - DNA, 20 bp, Artificial
  CRISPR gRNA sequence
aaaatcaagtctatcatgct

SEQ ID NO: 203061 - DNA, 20 bp, Artificial
  CRISPR gRNA sequence
taagtttccatgacacccca

SEQ ID NO: 203062 - DNA, 20 bp, Artificial
  CRISPR gRNA sequence
ttccatgacaccccaaagac

SEQ ID NO: 203063 - DNA, 20 bp, Artificial
  CRISPR gRNA sequence
ctggatttgacacacccata

SEQ ID NO: 203064 - DNA, 20 bp, Artificial
  CRISPR gRNA sequence
tggatttgacacacccatat

SEQ ID NO: 203065 - DNA, 20 bp, Artificial
  CRISPR gRNA sequence
cacacccatataggctcaca

SEQ ID NO: 203066 - DNA, 20 bp, Artificial
  CRISPR gRNA sequence
atataggctcacacagactg

SEQ ID NO: 203067 - DNA, 20 bp, Artificial
  CRISPR gRNA sequence
tccaacaaaacccaaaaccc

SEQ ID NO: 203068 - DNA, 20 bp, Artificial
  CRISPR gRNA sequence
aagaatttaatgcctgccca

SEQ ID NO: 203069 - DNA, 20 bp, Artificial
  CRISPR gRNA sequence
ctgcccaaagacatgacatt

SEQ ID NO: 203070 - DNA, 20 bp, Artificial
  CRISPR gRNA sequence
gcccaaagacatgacatttg

SEQ ID NO: 203071 - DNA, 20 bp, Artificial
  CRISPR gRNA sequence
gacatgacatttggagtgat

SEQ ID NO: 203072 - DNA, 20 bp, Artificial
  CRISPR gRNA sequence
tgacatttggagtgattggt

SEQ ID NO: 203073 - DNA, 20 bp, Artificial
  CRISPR gRNA sequence
atttggagtgattggtaagt

SEQ ID NO: 203074 - DNA, 20 bp, Artificial
  CRISPR gRNA sequence
tggagtgattggtaagtaag

SEQ ID NO: 203075 - DNA, 20 bp, Artificial
  CRISPR gRNA sequence
gagtgattggtaagtaagca

SEQ ID NO: 203076 - DNA, 20 bp, Artificial
  CRISPR gRNA sequence
gtgattggtaagtaagcaga

SEQ ID NO: 203077 - DNA, 20 bp, Artificial
  CRISPR gRNA sequence
ttggtaagtaagcagagaga

SEQ ID NO: 203078 - DNA, 20 bp, Artificial
  CRISPR gRNA sequence
tggtaagtaagcagagagac

SEQ ID NO: 203079 - DNA, 20 bp, Artificial
  CRISPR gRNA sequence
taagtaagcagagagacagg

SEQ ID NO: 203080 - DNA, 20 bp, Artificial
  CRISPR gRNA sequence
aagtaagcagagagacagga

SEQ ID NO: 203081 - DNA, 20 bp, Artificial
  CRISPR gRNA sequence
agagagacaggaaggcttac

SEQ ID NO: 203082 - DNA, 20 bp, Artificial
  CRISPR gRNA sequence
gagagacaggaaggcttacc

SEQ ID NO: 203083 - DNA, 20 bp, Artificial
  CRISPR gRNA sequence
cttaccaggctgatgcgtat

SEQ ID NO: 203084 - DNA, 20 bp, Artificial
  CRISPR gRNA sequence
aggctgatgcgtatcagact

SEQ ID NO: 203085 - DNA, 20 bp, Artificial
  CRISPR gRNA sequence
cagactaagaataaatcata

SEQ ID NO: 203086 - DNA, 20 bp, Artificial
  CRISPR gRNA sequence
ctaagaataaatcataaaga

SEQ ID NO: 203087 - DNA, 20 bp, Artificial
  CRISPR gRNA sequence
gaataaatcataaagaaaga

SEQ ID NO: 203088 - DNA, 20 bp, Artificial
  CRISPR gRNA sequence
aataaatcataaagaaagat

SEQ ID NO: 203089 - DNA, 20 bp, Artificial
  CRISPR gRNA sequence
tgggtttgatttcattatta

SEQ ID NO: 203090 - DNA, 20 bp, Artificial
  CRISPR gRNA sequence
gtgctgttttctgataactc

SEQ ID NO: 203091 - DNA, 20 bp, Artificial
  CRISPR gRNA sequence
tgctgttttctgataactct

SEQ ID NO: 203092 - DNA, 20 bp, Artificial
  CRISPR gRNA sequence
gttttctgataactctagga

SEQ ID NO: 203093 - DNA, 20 bp, Artificial
  CRISPR gRNA sequence
taactctaggaaagtaattt

SEQ ID NO: 203094 - DNA, 20 bp, Artificial
  CRISPR gRNA sequence
aagtaattttagaatatatt

SEQ ID NO: 203095 - DNA, 20 bp, Artificial
  CRISPR gRNA sequence
gaatatatttggtgtctgtt

SEQ ID NO: 203096 - DNA, 20 bp, Artificial
  CRISPR gRNA sequence
ctgtaaatgaatattgtttt

SEQ ID NO: 203097 - DNA, 20 bp, Artificial
  CRISPR gRNA sequence
aatgaatattgttttcagtg

SEQ ID NO: 203098 - DNA, 20 bp, Artificial
  CRISPR gRNA sequence
attgttttcagtgcagaata

SEQ ID NO: 203099 - DNA, 20 bp, Artificial
  CRISPR gRNA sequence
cagtgcagaataaagcacat

SEQ ID NO: 203100 - DNA, 20 bp, Artificial
  CRISPR gRNA sequence
aatttaaattactatttttc

SEQ ID NO: 203101 - DNA, 20 bp, Artificial
  CRISPR gRNA sequence
acacatgcatacacaaatga

SEQ ID NO: 203102 - DNA, 20 bp, Artificial
  CRISPR gRNA sequence
caaatgaaagcttctgaaac

SEQ ID NO: 203103 - DNA, 20 bp, Artificial
  CRISPR gRNA sequence
aaagcttctgaaactggtac

SEQ ID NO: 203104 - DNA, 20 bp, Artificial
  CRISPR gRNA sequence
ccaattataaaattacttga

SEQ ID NO: 203105 - DNA, 20 bp, Artificial
  CRISPR gRNA sequence
attataaaattacttgacag

SEQ ID NO: 203106 - DNA, 20 bp, Artificial
  CRISPR gRNA sequence
aaaattacttgacagaagac

SEQ ID NO: 203107 - DNA, 20 bp, Artificial
  CRISPR gRNA sequence
ttgtcacaatgaatactgac

SEQ ID NO: 203108 - DNA, 20 bp, Artificial
  CRISPR gRNA sequence
aatgaatactgactagacat

SEQ ID NO: 203109 - DNA, 20 bp, Artificial
  CRISPR gRNA sequence
actgactagacatcagtcta

SEQ ID NO: 203110 - DNA, 20 bp, Artificial
  CRISPR gRNA sequence
ctgactagacatcagtctat

SEQ ID NO: 203111 - DNA, 20 bp, Artificial
  CRISPR gRNA sequence
ctagacatcagtctatagga

SEQ ID NO: 203112 - DNA, 20 bp, Artificial
  CRISPR gRNA sequence
agacatcagtctataggaca

SEQ ID NO: 203113 - DNA, 20 bp, Artificial
  CRISPR gRNA sequence
agtctataggacagagataa

SEQ ID NO: 203114 - DNA, 20 bp, Artificial
  CRISPR gRNA sequence
tctataggacagagataaaa

SEQ ID NO: 203115 - DNA, 20 bp, Artificial
  CRISPR gRNA sequence
aggacagagataaaagagtc

SEQ ID NO: 203116 - DNA, 20 bp, Artificial
  CRISPR gRNA sequence
ggacagagataaaagagtcc

SEQ ID NO: 203117 - DNA, 20 bp, Artificial
  CRISPR gRNA sequence
gagtccaggctttgtgcatc

SEQ ID NO: 203118 - DNA, 20 bp, Artificial
  CRISPR gRNA sequence
atcaagtactttgaacataa

SEQ ID NO: 203119 - DNA, 20 bp, Artificial
  CRISPR gRNA sequence
actttgaacataaaagatga

SEQ ID NO: 203120 - DNA, 20 bp, Artificial
  CRISPR gRNA sequence
ttgaacataaaagatgaaag

SEQ ID NO: 203121 - DNA, 20 bp, Artificial
  CRISPR gRNA sequence
gaacataaaagatgaaagaa

SEQ ID NO: 203122 - DNA, 20 bp, Artificial
  CRISPR gRNA sequence
aacataaaagatgaaagaag

SEQ ID NO: 203123 - DNA, 20 bp, Artificial
  CRISPR gRNA sequence
tgaaagaagaggatgtccaa

SEQ ID NO: 203124 - DNA, 20 bp, Artificial
  CRISPR gRNA sequence
tatcaactttccctgccttg

SEQ ID NO: 203125 - DNA, 20 bp, Artificial
  CRISPR gRNA sequence
ttgtggatttcacaattttt

SEQ ID NO: 203126 - DNA, 20 bp, Artificial
  CRISPR gRNA sequence
tttcacaatttttgagtata

SEQ ID NO: 203127 - DNA, 20 bp, Artificial
  CRISPR gRNA sequence
tcacaatttttgagtatatg

SEQ ID NO: 203128 - DNA, 20 bp, Artificial
  CRISPR gRNA sequence
caatttttgagtatatggag

SEQ ID NO: 203129 - DNA, 20 bp, Artificial
  CRISPR gRNA sequence
aatttttgagtatatggaga

SEQ ID NO: 203130 - DNA, 20 bp, Artificial
  CRISPR gRNA sequence
atggagaaggttgtgatgtc

SEQ ID NO: 203131 - DNA, 20 bp, Artificial
  CRISPR gRNA sequence
aaggttgtgatgtctggatt

SEQ ID NO: 203132 - DNA, 20 bp, Artificial
  CRISPR gRNA sequence
ttgtgatgtctggatttgga

SEQ ID NO: 203133 - DNA, 20 bp, Artificial
  CRISPR gRNA sequence
tgtgatgtctggatttggaa

SEQ ID NO: 203134 - DNA, 20 bp, Artificial
  CRISPR gRNA sequence
gtgatgtctggatttggaaa

SEQ ID NO: 203135 - DNA, 20 bp, Artificial
  CRISPR gRNA sequence
gtctggatttggaaagggtc

SEQ ID NO: 203136 - DNA, 20 bp, Artificial
  CRISPR gRNA sequence
tctggatttggaaagggtca

SEQ ID NO: 203137 - DNA, 20 bp, Artificial
  CRISPR gRNA sequence
ctggatttggaaagggtcaa

SEQ ID NO: 203138 - DNA, 20 bp, Artificial
  CRISPR gRNA sequence
gggtcaagggatttctacaa

SEQ ID NO: 203139 - DNA, 20 bp, Artificial
  CRISPR gRNA sequence
gtcaagggatttctacaaaa

SEQ ID NO: 203140 - DNA, 20 bp, Artificial
  CRISPR gRNA sequence
ctacaaaagagtaaaatgct

SEQ ID NO: 203141 - DNA, 20 bp, Artificial
  CRISPR gRNA sequence
aagagtaaaatgctgagcta

SEQ ID NO: 203142 - DNA, 20 bp, Artificial
  CRISPR gRNA sequence
aattcctcctacaataaaat

SEQ ID NO: 203143 - DNA, 20 bp, Artificial
  CRISPR gRNA sequence
ctacaataaaatcagcacat

SEQ ID NO: 203144 - DNA, 20 bp, Artificial
  CRISPR gRNA sequence
ataagcacattatttaataa

SEQ ID NO: 203145 - DNA, 20 bp, Artificial
  CRISPR gRNA sequence
aacagaatgtgatcattata

SEQ ID NO: 203146 - DNA, 20 bp, Artificial
  CRISPR gRNA sequence
gaatgtgatcattatatgga

SEQ ID NO: 203147 - DNA, 20 bp, Artificial
  CRISPR gRNA sequence
aatgtgatcattatatggac

SEQ ID NO: 203148 - DNA, 20 bp, Artificial
  CRISPR gRNA sequence
atcattatatggacaggacc

SEQ ID NO: 203149 - DNA, 20 bp, Artificial
  CRISPR gRNA sequence
tcattatatggacaggacca

SEQ ID NO: 203150 - DNA, 20 bp, Artificial
  CRISPR gRNA sequence
cattatatggacaggaccaa

SEQ ID NO: 203151 - DNA, 20 bp, Artificial
  CRISPR gRNA sequence
atatggacaggaccaaggga

SEQ ID NO: 203152 - DNA, 20 bp, Artificial
  CRISPR gRNA sequence
acaggaccaagggaaagcac

SEQ ID NO: 203153 - DNA, 20 bp, Artificial
  CRISPR gRNA sequence
caggaccaagggaaagcact

SEQ ID NO: 203154 - DNA, 20 bp, Artificial
  CRISPR gRNA sequence
ggaccaagggaaagcactgg

SEQ ID NO: 203155 - DNA, 20 bp, Artificial
  CRISPR gRNA sequence
agggaaagcactgggagttc

SEQ ID NO: 203156 - DNA, 20 bp, Artificial
  CRISPR gRNA sequence
gggagttcaagattattgaa

SEQ ID NO: 203157 - DNA, 20 bp, Artificial
  CRISPR gRNA sequence
tattgaacagaattcactgt

SEQ ID NO: 203158 - DNA, 20 bp, Artificial
  CRISPR gRNA sequence
attgaacagaattcactgta

SEQ ID NO: 203159 - DNA, 20 bp, Artificial
  CRISPR gRNA sequence
ttgaacagaattcactgtaa

SEQ ID NO: 203160 - DNA, 20 bp, Artificial
  CRISPR gRNA sequence
tgaacagaattcactgtaag

SEQ ID NO: 203161 - DNA, 20 bp, Artificial
  CRISPR gRNA sequence
tcactgtaaggggccatgca

SEQ ID NO: 203162 - DNA, 20 bp, Artificial
  CRISPR gRNA sequence
ctgtaaggggccatgcatgg

SEQ ID NO: 203163 - DNA, 20 bp, Artificial
  CRISPR gRNA sequence
gtggctaatgcctgtaatct

SEQ ID NO: 203164 - DNA, 20 bp, Artificial
  CRISPR gRNA sequence
tgcctgtaatctcagcactt

SEQ ID NO: 203165 - DNA, 20 bp, Artificial
  CRISPR gRNA sequence
gcctgtaatctcagcacttt

SEQ ID NO: 203166 - DNA, 20 bp, Artificial
  CRISPR gRNA sequence
ctgtaatctcagcactttgg

SEQ ID NO: 203167 - DNA, 20 bp, Artificial
  CRISPR gRNA sequence
tgtaatctcagcactttggg

SEQ ID NO: 203168 - DNA, 20 bp, Artificial
  CRISPR gRNA sequence
tctcagcactttgggaggcc

SEQ ID NO: 203169 - DNA, 20 bp, Artificial
  CRISPR gRNA sequence
agcactttgggaggccgaga

SEQ ID NO: 203170 - DNA, 20 bp, Artificial
  CRISPR gRNA sequence
ctttgggaggccgagacaga

SEQ ID NO: 203171 - DNA, 20 bp, Artificial
  CRISPR gRNA sequence
ggccgagacagacggatcac

SEQ ID NO: 203172 - DNA, 20 bp, Artificial
  CRISPR gRNA sequence
gccgagacagacggatcacg

SEQ ID NO: 203173 - DNA, 20 bp, Artificial
  CRISPR gRNA sequence
agacagacggatcacgaggt

SEQ ID NO: 203174 - DNA, 20 bp, Artificial
  CRISPR gRNA sequence
gacagacggatcacgaggtc

SEQ ID NO: 203175 - DNA, 20 bp, Artificial
  CRISPR gRNA sequence
cagacggatcacgaggtcag

SEQ ID NO: 203176 - DNA, 20 bp, Artificial
  CRISPR gRNA sequence
gatcacgaggtcaggagttc

SEQ ID NO: 203177 - DNA, 20 bp, Artificial
  CRISPR gRNA sequence
cgaggtcaggagttcgagac

SEQ ID NO: 203178 - DNA, 20 bp, Artificial
  CRISPR gRNA sequence
tcaggagttcgagaccagcc

SEQ ID NO: 203179 - DNA, 20 bp, Artificial
  CRISPR gRNA sequence
cgagaccagcctggccaata

SEQ ID NO: 203180 - DNA, 20 bp, Artificial
  CRISPR gRNA sequence
ctaaaaatacaaaaattacc

SEQ ID NO: 203181 - DNA, 20 bp, Artificial
  CRISPR gRNA sequence
taaaaatacaaaaattaccc

SEQ ID NO: 203182 - DNA, 20 bp, Artificial
  CRISPR gRNA sequence
atacaaaaattacccaggca

SEQ ID NO: 203183 - DNA, 20 bp, Artificial
  CRISPR gRNA sequence
caaaaattacccaggcatgg

SEQ ID NO: 203184 - DNA, 20 bp, Artificial
  CRISPR gRNA sequence
ccaggcatggtggtgcacgc

SEQ ID NO: 203185 - DNA, 20 bp, Artificial
  CRISPR gRNA sequence
ggcatggtggtgcacgccag

SEQ ID NO: 203186 - DNA, 20 bp, Artificial
  CRISPR gRNA sequence
tggtgcacgccagtagcctg

SEQ ID NO: 203187 - DNA, 20 bp, Artificial
  CRISPR gRNA sequence
gccagtagcctgtagctact

SEQ ID NO: 203188 - DNA, 20 bp, Artificial
  CRISPR gRNA sequence
ccagtagcctgtagctactc

SEQ ID NO: 203189 - DNA, 20 bp, Artificial
  CRISPR gRNA sequence
agtagcctgtagctactcgg

SEQ ID NO: 203190 - DNA, 20 bp, Artificial
  CRISPR gRNA sequence
gtagcctgtagctactcggg

SEQ ID NO: 203191 - DNA, 20 bp, Artificial
  CRISPR gRNA sequence
ctgtagctactcgggaggct

SEQ ID NO: 203192 - DNA, 20 bp, Artificial
  CRISPR gRNA sequence
agctactcgggaggctgaga

SEQ ID NO: 203193 - DNA, 20 bp, Artificial
  CRISPR gRNA sequence
tactcgggaggctgagacag

SEQ ID NO: 203194 - DNA, 20 bp, Artificial
  CRISPR gRNA sequence
acagaagaatcgcttgaacc

SEQ ID NO: 203195 - DNA, 20 bp, Artificial
  CRISPR gRNA sequence
cagaagaatcgcttgaacct

SEQ ID NO: 203196 - DNA, 20 bp, Artificial
  CRISPR gRNA sequence
gaagaatcgcttgaacctgg

SEQ ID NO: 203197 - DNA, 20 bp, Artificial
  CRISPR gRNA sequence
aagaatcgcttgaacctggg

SEQ ID NO: 203198 - DNA, 20 bp, Artificial
  CRISPR gRNA sequence
aatcgcttgaacctgggagg

SEQ ID NO: 203199 - DNA, 20 bp, Artificial
  CRISPR gRNA sequence
tcgcttgaacctgggaggcg

SEQ ID NO: 203200 - DNA, 20 bp, Artificial
  CRISPR gRNA sequence
cgcttgaacctgggaggcgg

SEQ ID NO: 203201 - DNA, 20 bp, Artificial
  CRISPR gRNA sequence
aacctgggaggcggaggttg

SEQ ID NO: 203202 - DNA, 20 bp, Artificial
  CRISPR gRNA sequence
tgggaggcggaggttgcagt

SEQ ID NO: 203203 - DNA, 20 bp, Artificial
  CRISPR gRNA sequence
ggcggaggttgcagtgagcc

SEQ ID NO: 203204 - DNA, 20 bp, Artificial
  CRISPR gRNA sequence
gagatcacgccactgcactc

SEQ ID NO: 203205 - DNA, 20 bp, Artificial
  CRISPR gRNA sequence
cacgccactgcactccagcc

SEQ ID NO: 203206 - DNA, 20 bp, Artificial
  CRISPR gRNA sequence
acgccactgcactccagcct

SEQ ID NO: 203207 - DNA, 20 bp, Artificial
  CRISPR gRNA sequence
ctgcactccagcctgggcaa

SEQ ID NO: 203208 - DNA, 20 bp, Artificial
  CRISPR gRNA sequence
gcactccagcctgggcaaca

SEQ ID NO: 203209 - DNA, 20 bp, Artificial
  CRISPR gRNA sequence
tccagcctgggcaacagagc

SEQ ID NO: 203210 - DNA, 20 bp, Artificial
  CRISPR gRNA sequence
aaaaaaaaaaaaaaaaaaaa

SEQ ID NO: 203211 - DNA, 20 bp, Artificial
  CRISPR gRNA sequence
aaaaaaaaaaaaagaattca

SEQ ID NO: 203212 - DNA, 20 bp, Artificial
  CRISPR gRNA sequence
tcacagtaaacttaataaca

SEQ ID NO: 203213 - DNA, 20 bp, Artificial
  CRISPR gRNA sequence
taataacaaagtcttattac

SEQ ID NO: 203214 - DNA, 20 bp, Artificial
  CRISPR gRNA sequence
aataacaaagtcttattacc

SEQ ID NO: 203215 - DNA, 20 bp, Artificial
  CRISPR gRNA sequence
ataacaaagtcttattacca

SEQ ID NO: 203216 - DNA, 20 bp, Artificial
  CRISPR gRNA sequence
taacaaagtcttattaccag

SEQ ID NO: 203217 - DNA, 20 bp, Artificial
  CRISPR gRNA sequence
tattaccaggggccatcaac

SEQ ID NO: 203218 - DNA, 20 bp, Artificial
  CRISPR gRNA sequence
attaccaggggccatcaacc

SEQ ID NO: 203219 - DNA, 20 bp, Artificial
  CRISPR gRNA sequence
aggggccatcaaccaggtca

SEQ ID NO: 203220 - DNA, 20 bp, Artificial
  CRISPR gRNA sequence
tattgtatattttactttct

SEQ ID NO: 203221 - DNA, 20 bp, Artificial
  CRISPR gRNA sequence
gtatattttactttcttgga

SEQ ID NO: 203222 - DNA, 20 bp, Artificial
  CRISPR gRNA sequence
tttcttggatggaaatttcc

SEQ ID NO: 203223 - DNA, 20 bp, Artificial
  CRISPR gRNA sequence
ggatggaaatttcctagtcc

SEQ ID NO: 203224 - DNA, 20 bp, Artificial
  CRISPR gRNA sequence
ggaaatttcctagtccaaga

SEQ ID NO: 203225 - DNA, 20 bp, Artificial
  CRISPR gRNA sequence
gaaatttcctagtccaagat

SEQ ID NO: 203226 - DNA, 20 bp, Artificial
  CRISPR gRNA sequence
aggctatgtcttcacttttt

SEQ ID NO: 203227 - DNA, 20 bp, Artificial
  CRISPR gRNA sequence
aataatttttctaatctatg

SEQ ID NO: 203228 - DNA, 20 bp, Artificial
  CRISPR gRNA sequence
ttattttaaatatgctttca

SEQ ID NO: 203229 - DNA, 20 bp, Artificial
  CRISPR gRNA sequence
gctgaattactttcattatt

SEQ ID NO: 203230 - DNA, 20 bp, Artificial
  CRISPR gRNA sequence
ttcattattaagctgtcctc

SEQ ID NO: 203231 - DNA, 20 bp, Artificial
  CRISPR gRNA sequence
ctgtcctcaagtcaaaactc

SEQ ID NO: 203232 - DNA, 20 bp, Artificial
  CRISPR gRNA sequence
tgtcctcaagtcaaaactca

SEQ ID NO: 203233 - DNA, 20 bp, Artificial
  CRISPR gRNA sequence
caagtcaaaactcaaggact

SEQ ID NO: 203234 - DNA, 20 bp, Artificial
  CRISPR gRNA sequence
gtcaaaactcaaggacttgg

SEQ ID NO: 203235 - DNA, 20 bp, Artificial
  CRISPR gRNA sequence
tcaaaactcaaggacttggt

SEQ ID NO: 203236 - DNA, 20 bp, Artificial
  CRISPR gRNA sequence
caaggacttggtaggatctc

SEQ ID NO: 203237 - DNA, 20 bp, Artificial
  CRISPR gRNA sequence
aaggacttggtaggatctca

SEQ ID NO: 203238 - DNA, 20 bp, Artificial
  CRISPR gRNA sequence
gacttggtaggatctcaagg

SEQ ID NO: 203239 - DNA, 20 bp, Artificial
  CRISPR gRNA sequence
ggatctcaaggtagtgtaat

SEQ ID NO: 203240 - DNA, 20 bp, Artificial
  CRISPR gRNA sequence
ttttctaacaatgatttcta

SEQ ID NO: 203241 - DNA, 20 bp, Artificial
  CRISPR gRNA sequence
tttctaacaatgatttctac

SEQ ID NO: 203242 - DNA, 20 bp, Artificial
  CRISPR gRNA sequence
tctacaggaacatctactca

SEQ ID NO: 203243 - DNA, 20 bp, Artificial
  CRISPR gRNA sequence
acatctactcaaagacatct

SEQ ID NO: 203244 - DNA, 20 bp, Artificial
  CRISPR gRNA sequence
agccgtaaccaaaatctctg

SEQ ID NO: 203245 - DNA, 20 bp, Artificial
  CRISPR gRNA sequence
ccgtaaccaaaatctctgtg

SEQ ID NO: 203246 - DNA, 20 bp, Artificial
  CRISPR gRNA sequence
aatctctgtggagtaatttt

SEQ ID NO: 203247 - DNA, 20 bp, Artificial
  CRISPR gRNA sequence
ctctgtggagtaattttgag

SEQ ID NO: 203248 - DNA, 20 bp, Artificial
  CRISPR gRNA sequence
tctgtggagtaattttgagc

SEQ ID NO: 203249 - DNA, 20 bp, Artificial
  CRISPR gRNA sequence
ctgtggagtaattttgagca

SEQ ID NO: 203250 - DNA, 20 bp, Artificial
  CRISPR gRNA sequence
gtggagtaattttgagcagg

SEQ ID NO: 203251 - DNA, 20 bp, Artificial
  CRISPR gRNA sequence
tggagtaattttgagcaggg

SEQ ID NO: 203252 - DNA, 20 bp, Artificial
  CRISPR gRNA sequence
ggagtaattttgagcaggga

SEQ ID NO: 203253 - DNA, 20 bp, Artificial
  CRISPR gRNA sequence
gagtaattttgagcagggag

SEQ ID NO: 203254 - DNA, 20 bp, Artificial
  CRISPR gRNA sequence
aattttgagcagggagggga

SEQ ID NO: 203255 - DNA, 20 bp, Artificial
  CRISPR gRNA sequence
aagttgaaaaaaaaaaatta

SEQ ID NO: 203256 - DNA, 20 bp, Artificial
  CRISPR gRNA sequence
aaaaaaaaattaaagatgcc

SEQ ID NO: 203257 - DNA, 20 bp, Artificial
  CRISPR gRNA sequence
aattaaagatgcctagaata

SEQ ID NO: 203258 - DNA, 20 bp, Artificial
  CRISPR gRNA sequence
ctagaatacagttttaaatt

SEQ ID NO: 203259 - DNA, 20 bp, Artificial
  CRISPR gRNA sequence
acagttttaaatttggaatc

SEQ ID NO: 203260 - DNA, 20 bp, Artificial
  CRISPR gRNA sequence
tttaaatttggaatcaagta

SEQ ID NO: 203261 - DNA, 20 bp, Artificial
  CRISPR gRNA sequence
aaatttggaatcaagtacag

SEQ ID NO: 203262 - DNA, 20 bp, Artificial
  CRISPR gRNA sequence
cactattctgatatgaattc

SEQ ID NO: 203263 - DNA, 20 bp, Artificial
  CRISPR gRNA sequence
gatatgaattccagttacca

SEQ ID NO: 203264 - DNA, 20 bp, Artificial
  CRISPR gRNA sequence
tcaaataaatccctcataaa

SEQ ID NO: 203265 - DNA, 20 bp, Artificial
  CRISPR gRNA sequence
attaccacaatatattaact

SEQ ID NO: 203266 - DNA, 20 bp, Artificial
  CRISPR gRNA sequence
attaactgagtaactgcata

SEQ ID NO: 203267 - DNA, 20 bp, Artificial
  CRISPR gRNA sequence
caacttcactgctatttctt

SEQ ID NO: 203268 - DNA, 20 bp, Artificial
  CRISPR gRNA sequence
ttcaaaaataactatgtaaa

SEQ ID NO: 203269 - DNA, 20 bp, Artificial
  CRISPR gRNA sequence
aaaaataactatgtaaatag

SEQ ID NO: 203270 - DNA, 20 bp, Artificial
  CRISPR gRNA sequence
agcagatgtcccatcatgat

SEQ ID NO: 203271 - DNA, 20 bp, Artificial
  CRISPR gRNA sequence
caaccatgtcacttcttttg

SEQ ID NO: 203272 - DNA, 20 bp, Artificial
  CRISPR gRNA sequence
tcacttcttttgaagactgt

SEQ ID NO: 203273 - DNA, 20 bp, Artificial
  CRISPR gRNA sequence
ttttgaagactgttggtgac

SEQ ID NO: 203274 - DNA, 20 bp, Artificial
  CRISPR gRNA sequence
gtcactgtacatctgatatt

SEQ ID NO: 203275 - DNA, 20 bp, Artificial
  CRISPR gRNA sequence
tcactgtacatctgatattt

SEQ ID NO: 203276 - DNA, 20 bp, Artificial
  CRISPR gRNA sequence
tctgatatttaggtcatgca

SEQ ID NO: 203277 - DNA, 20 bp, Artificial
  CRISPR gRNA sequence
atatttaggtcatgcacaga

SEQ ID NO: 203278 - DNA, 20 bp, Artificial
  CRISPR gRNA sequence
taggtcatgcacagacagca

SEQ ID NO: 203279 - DNA, 20 bp, Artificial
  CRISPR gRNA sequence
catgcacagacagcaaagta

SEQ ID NO: 203280 - DNA, 20 bp, Artificial
  CRISPR gRNA sequence
tgcacagacagcaaagtatg

SEQ ID NO: 203281 - DNA, 20 bp, Artificial
  CRISPR gRNA sequence
tttgttacctccttgtttcc

SEQ ID NO: 203282 - DNA, 20 bp, Artificial
  CRISPR gRNA sequence
acccatgtgacattttataa

SEQ ID NO: 203283 - DNA, 20 bp, Artificial
  CRISPR gRNA sequence
ttttataatggataaatcaa

SEQ ID NO: 203284 - DNA, 20 bp, Artificial
  CRISPR gRNA sequence
ttataatggataaatcaaaa

SEQ ID NO: 203285 - DNA, 20 bp, Artificial
  CRISPR gRNA sequence
tataatggataaatcaaaag

SEQ ID NO: 203286 - DNA, 20 bp, Artificial
  CRISPR gRNA sequence
gataaatcaaaagaggaaac

SEQ ID NO: 203287 - DNA, 20 bp, Artificial
  CRISPR gRNA sequence
ataaatcaaaagaggaaact

SEQ ID NO: 203288 - DNA, 20 bp, Artificial
  CRISPR gRNA sequence
atcaaaagaggaaactaggc

SEQ ID NO: 203289 - DNA, 20 bp, Artificial
  CRISPR gRNA sequence
aaagaggaaactaggcaaga

SEQ ID NO: 203290 - DNA, 20 bp, Artificial
  CRISPR gRNA sequence
aaactaggcaagaaagatga

SEQ ID NO: 203291 - DNA, 20 bp, Artificial
  CRISPR gRNA sequence
actaggcaagaaagatgaaa

SEQ ID NO: 203292 - DNA, 20 bp, Artificial
  CRISPR gRNA sequence
gcaagaaagatgaaagagta

SEQ ID NO: 203293 - DNA, 20 bp, Artificial
  CRISPR gRNA sequence
aaataaaaactgacaaatgc

SEQ ID NO: 203294 - DNA, 20 bp, Artificial
  CRISPR gRNA sequence
aataaaaactgacaaatgct

SEQ ID NO: 203295 - DNA, 20 bp, Artificial
  CRISPR gRNA sequence
taaaaactgacaaatgctag

SEQ ID NO: 203296 - DNA, 20 bp, Artificial
  CRISPR gRNA sequence
tgctaggagtgaaatttgaa

SEQ ID NO: 203297 - DNA, 20 bp, Artificial
  CRISPR gRNA sequence
aaatttgaatagaccataaa

SEQ ID NO: 203298 - DNA, 20 bp, Artificial
  CRISPR gRNA sequence
atttgaatagaccataaatg

SEQ ID NO: 203299 - DNA, 20 bp, Artificial
  CRISPR gRNA sequence
gaatagaccataaatggagt

SEQ ID NO: 203300 - DNA, 20 bp, Artificial
  CRISPR gRNA sequence
atagaccataaatggagtaa

SEQ ID NO: 203301 - DNA, 20 bp, Artificial
  CRISPR gRNA sequence
gaccataaatggagtaagag

SEQ ID NO: 203302 - DNA, 20 bp, Artificial
  CRISPR gRNA sequence
aaatggagtaagagaagaaa

SEQ ID NO: 203303 - DNA, 20 bp, Artificial
  CRISPR gRNA sequence
tgtcgacattactgcaatgc

SEQ ID NO: 203304 - DNA, 20 bp, Artificial
  CRISPR gRNA sequence
tactgcaatgcaagaaactc

SEQ ID NO: 203305 - DNA, 20 bp, Artificial
  CRISPR gRNA sequence
ctgcaatgcaagaaactcta

SEQ ID NO: 203306 - DNA, 20 bp, Artificial
  CRISPR gRNA sequence
tgcaagaaactctagagatg

SEQ ID NO: 203307 - DNA, 20 bp, Artificial
  CRISPR gRNA sequence
agaaactctagagatgaagc

SEQ ID NO: 203308 - DNA, 20 bp, Artificial
  CRISPR gRNA sequence
aactctagagatgaagccag

SEQ ID NO: 203309 - DNA, 20 bp, Artificial
  CRISPR gRNA sequence
gagatgaagccagaagaact

SEQ ID NO: 203310 - DNA, 20 bp, Artificial
  CRISPR gRNA sequence
gaagccagaagaactcagcg

SEQ ID NO: 203311 - DNA, 20 bp, Artificial
  CRISPR gRNA sequence
aagccagaagaactcagcga

SEQ ID NO: 203312 - DNA, 20 bp, Artificial
  CRISPR gRNA sequence
ccagaagaactcagcgaagg

SEQ ID NO: 203313 - DNA, 20 bp, Artificial
  CRISPR gRNA sequence
gtggacttactgatataaat

SEQ ID NO: 203314 - DNA, 20 bp, Artificial
  CRISPR gRNA sequence
tggacttactgatataaatg

SEQ ID NO: 203315 - DNA, 20 bp, Artificial
  CRISPR gRNA sequence
cttactgatataaatgagga

SEQ ID NO: 203316 - DNA, 20 bp, Artificial
  CRISPR gRNA sequence
ctgatataaatgaggaaagt

SEQ ID NO: 203317 - DNA, 20 bp, Artificial
  CRISPR gRNA sequence
tgatataaatgaggaaagtg

SEQ ID NO: 203318 - DNA, 20 bp, Artificial
  CRISPR gRNA sequence
atataaatgaggaaagtgag

SEQ ID NO: 203319 - DNA, 20 bp, Artificial
  CRISPR gRNA sequence
tataaatgaggaaagtgagg

SEQ ID NO: 203320 - DNA, 20 bp, Artificial
  CRISPR gRNA sequence
agtgaggaggatgtaacaaa

SEQ ID NO: 203321 - DNA, 20 bp, Artificial
  CRISPR gRNA sequence
aggatgtaacaaaaagaata

SEQ ID NO: 203322 - DNA, 20 bp, Artificial
  CRISPR gRNA sequence
caaaaagaataaagatgtcc

SEQ ID NO: 203323 - DNA, 20 bp, Artificial
  CRISPR gRNA sequence
aaaagaataaagatgtccca

SEQ ID NO: 203324 - DNA, 20 bp, Artificial
  CRISPR gRNA sequence
aaagaataaagatgtcccag

SEQ ID NO: 203325 - DNA, 20 bp, Artificial
  CRISPR gRNA sequence
gaataaagatgtcccagagg

SEQ ID NO: 203326 - DNA, 20 bp, Artificial
  CRISPR gRNA sequence
gatgtcccagaggaagtgac

SEQ ID NO: 203327 - DNA, 20 bp, Artificial
  CRISPR gRNA sequence
aaacattcaaaaaaacatta

SEQ ID NO: 203328 - DNA, 20 bp, Artificial
  CRISPR gRNA sequence
aacattcaaaaaaacattaa

SEQ ID NO: 203329 - DNA, 20 bp, Artificial
  CRISPR gRNA sequence
aggaattctttcatgacatt

SEQ ID NO: 203330 - DNA, 20 bp, Artificial
  CRISPR gRNA sequence
gaattctttcatgacattga

SEQ ID NO: 203331 - DNA, 20 bp, Artificial
  CRISPR gRNA sequence
ttcatgacattgagagtgca

SEQ ID NO: 203332 - DNA, 20 bp, Artificial
  CRISPR gRNA sequence
tcatgacattgagagtgcaa

SEQ ID NO: 203333 - DNA, 20 bp, Artificial
  CRISPR gRNA sequence
tgagagtgcaaaggataaaa

SEQ ID NO: 203334 - DNA, 20 bp, Artificial
  CRISPR gRNA sequence
gagtgcaaaggataaaacgg

SEQ ID NO: 203335 - DNA, 20 bp, Artificial
  CRISPR gRNA sequence
ggtagaaaccgatccaaact

SEQ ID NO: 203336 - DNA, 20 bp, Artificial
  CRISPR gRNA sequence
gaaaccgatccaaacttaga

SEQ ID NO: 203337 - DNA, 20 bp, Artificial
  CRISPR gRNA sequence
aaaccgatccaaacttagaa

SEQ ID NO: 203338 - DNA, 20 bp, Artificial
  CRISPR gRNA sequence
aaccgatccaaacttagaaa

SEQ ID NO: 203339 - DNA, 20 bp, Artificial
  CRISPR gRNA sequence
accgatccaaacttagaaag

SEQ ID NO: 203340 - DNA, 20 bp, Artificial
  CRISPR gRNA sequence
aaggggtatgacaattcacc

SEQ ID NO: 203341 - DNA, 20 bp, Artificial
  CRISPR gRNA sequence
tatgacaattcaccaagcca

SEQ ID NO: 203342 - DNA, 20 bp, Artificial
  CRISPR gRNA sequence
tgacaattcaccaagccata

SEQ ID NO: 203343 - DNA, 20 bp, Artificial
  CRISPR gRNA sequence
caattcaccaagccatagag

SEQ ID NO: 203344 - DNA, 20 bp, Artificial
  CRISPR gRNA sequence
agatgcttgctctgtatcca

SEQ ID NO: 203345 - DNA, 20 bp, Artificial
  CRISPR gRNA sequence
ctctgtatccaaagttatgc

SEQ ID NO: 203346 - DNA, 20 bp, Artificial
  CRISPR gRNA sequence
tgtatccaaagttatgcaag

SEQ ID NO: 203347 - DNA, 20 bp, Artificial
  CRISPR gRNA sequence
gttatgcaagaagaacacac

SEQ ID NO: 203348 - DNA, 20 bp, Artificial
  CRISPR gRNA sequence
atttaccacatactaaatac

SEQ ID NO: 203349 - DNA, 20 bp, Artificial
  CRISPR gRNA sequence
gccgttgttattgataataa

SEQ ID NO: 203350 - DNA, 20 bp, Artificial
  CRISPR gRNA sequence
cgttgttattgataataaca

SEQ ID NO: 203351 - DNA, 20 bp, Artificial
  CRISPR gRNA sequence
ttgataataacagagttttt

SEQ ID NO: 203352 - DNA, 20 bp, Artificial
  CRISPR gRNA sequence
tgataataacagagttttta

SEQ ID NO: 203353 - DNA, 20 bp, Artificial
  CRISPR gRNA sequence
taacaacaaaaaaaatttta

SEQ ID NO: 203354 - DNA, 20 bp, Artificial
  CRISPR gRNA sequence
aacaacaaaaaaaattttaa

SEQ ID NO: 203355 - DNA, 20 bp, Artificial
  CRISPR gRNA sequence
aaaaaaaattttaaaggtca

SEQ ID NO: 203356 - DNA, 20 bp, Artificial
  CRISPR gRNA sequence
gtcatggaacaatataataa

SEQ ID NO: 203357 - DNA, 20 bp, Artificial
  CRISPR gRNA sequence
agtttttcccattcatcatg

SEQ ID NO: 203358 - DNA, 20 bp, Artificial
  CRISPR gRNA sequence
tcatcatgaagattgttttg

SEQ ID NO: 203359 - DNA, 20 bp, Artificial
  CRISPR gRNA sequence
aagattgttttgcagaattt

SEQ ID NO: 203360 - DNA, 20 bp, Artificial
  CRISPR gRNA sequence
ttgcagaatttcagcttaca

SEQ ID NO: 203361 - DNA, 20 bp, Artificial
  CRISPR gRNA sequence
agcttacatggtcatgttta

SEQ ID NO: 203362 - DNA, 20 bp, Artificial
  CRISPR gRNA sequence
tggtcatgtttatggtcttg

SEQ ID NO: 203363 - DNA, 20 bp, Artificial
  CRISPR gRNA sequence
tggtcttgcggttttgtgcg

SEQ ID NO: 203364 - DNA, 20 bp, Artificial
  CRISPR gRNA sequence
cttgcggttttgtgcgaagc

SEQ ID NO: 203365 - DNA, 20 bp, Artificial
  CRISPR gRNA sequence
agtattgcctgtataaaaca

SEQ ID NO: 203366 - DNA, 20 bp, Artificial
  CRISPR gRNA sequence
ctgtataaaacaaagttaca

SEQ ID NO: 203367 - DNA, 20 bp, Artificial
  CRISPR gRNA sequence
tgtataaaacaaagttacaa

SEQ ID NO: 203368 - DNA, 20 bp, Artificial
  CRISPR gRNA sequence
aaaacaaagttacaaaggca

SEQ ID NO: 203369 - DNA, 20 bp, Artificial
  CRISPR gRNA sequence
caaagttacaaaggcaaaga

SEQ ID NO: 203370 - DNA, 20 bp, Artificial
  CRISPR gRNA sequence
ttacaaaggcaaagaaagaa

SEQ ID NO: 203371 - DNA, 20 bp, Artificial
  CRISPR gRNA sequence
aaaggcaaagaaagaacaga

SEQ ID NO: 203372 - DNA, 20 bp, Artificial
  CRISPR gRNA sequence
aaggcaaagaaagaacagat

SEQ ID NO: 203373 - DNA, 20 bp, Artificial
  CRISPR gRNA sequence
gaacagataggcctatctca

SEQ ID NO: 203374 - DNA, 20 bp, Artificial
  CRISPR gRNA sequence
ctcaaagaatttcaaaatgt

SEQ ID NO: 203375 - DNA, 20 bp, Artificial
  CRISPR gRNA sequence
aagaatttcaaaatgttagc

SEQ ID NO: 203376 - DNA, 20 bp, Artificial
  CRISPR gRNA sequence
gttagccagttctttacata

SEQ ID NO: 203377 - DNA, 20 bp, Artificial
  CRISPR gRNA sequence
gccagttctttacatacagt

SEQ ID NO: 203378 - DNA, 20 bp, Artificial
  CRISPR gRNA sequence
acagttggaccttaatcctg

SEQ ID NO: 203379 - DNA, 20 bp, Artificial
  CRISPR gRNA sequence
cagttggaccttaatcctgc

SEQ ID NO: 203380 - DNA, 20 bp, Artificial
  CRISPR gRNA sequence
gaccttaatcctgcaggaac

SEQ ID NO: 203381 - DNA, 20 bp, Artificial
  CRISPR gRNA sequence
ccttaatcctgcaggaactg

SEQ ID NO: 203382 - DNA, 20 bp, Artificial
  CRISPR gRNA sequence
cttaatcctgcaggaactgg

SEQ ID NO: 203383 - DNA, 20 bp, Artificial
  CRISPR gRNA sequence
tcctgcaggaactggaggac

SEQ ID NO: 203384 - DNA, 20 bp, Artificial
  CRISPR gRNA sequence
cctgcaggaactggaggact

SEQ ID NO: 203385 - DNA, 20 bp, Artificial
  CRISPR gRNA sequence
gcaggaactggaggactagg

SEQ ID NO: 203386 - DNA, 20 bp, Artificial
  CRISPR gRNA sequence
gaactggaggactaggtgga

SEQ ID NO: 203387 - DNA, 20 bp, Artificial
  CRISPR gRNA sequence
gacagcacttaaaatgatat

SEQ ID NO: 203388 - DNA, 20 bp, Artificial
  CRISPR gRNA sequence
cagcacttaaaatgatatca

SEQ ID NO: 203389 - DNA, 20 bp, Artificial
  CRISPR gRNA sequence
acttaaaatgatatcagagt

SEQ ID NO: 203390 - DNA, 20 bp, Artificial
  CRISPR gRNA sequence
aaaatgatatcagagtgaga

SEQ ID NO: 203391 - DNA, 20 bp, Artificial
  CRISPR gRNA sequence
atgatatcagagtgagaaag

SEQ ID NO: 203392 - DNA, 20 bp, Artificial
  CRISPR gRNA sequence
gaaagaagaatcctgaaaat

SEQ ID NO: 203393 - DNA, 20 bp, Artificial
  CRISPR gRNA sequence
gaagaatcctgaaaatcagc

SEQ ID NO: 203394 - DNA, 20 bp, Artificial
  CRISPR gRNA sequence
aagaatcctgaaaatcagcc

SEQ ID NO: 203395 - DNA, 20 bp, Artificial
  CRISPR gRNA sequence
tcagccaggaacttaattgt

SEQ ID NO: 203396 - DNA, 20 bp, Artificial
  CRISPR gRNA sequence
gccaggaacttaattgtcag

SEQ ID NO: 203397 - DNA, 20 bp, Artificial
  CRISPR gRNA sequence
caggaacttaattgtcagta

SEQ ID NO: 203398 - DNA, 20 bp, Artificial
  CRISPR gRNA sequence
gaacttaattgtcagtagag

SEQ ID NO: 203399 - DNA, 20 bp, Artificial
  CRISPR gRNA sequence
tcagtagagtggcaaactgt

SEQ ID NO: 203400 - DNA, 20 bp, Artificial
  CRISPR gRNA sequence
tagagtggcaaactgtgagt

SEQ ID NO: 203401 - DNA, 20 bp, Artificial
  CRISPR gRNA sequence
tggcaaactgtgagttggtg

SEQ ID NO: 203402 - DNA, 20 bp, Artificial
  CRISPR gRNA sequence
ctgtgagttggtgtagtttt

SEQ ID NO: 203403 - DNA, 20 bp, Artificial
  CRISPR gRNA sequence
tagttttcagaacacaaaca

SEQ ID NO: 203404 - DNA, 20 bp, Artificial
  CRISPR gRNA sequence
cgtctgaaattcaatactat

SEQ ID NO: 203405 - DNA, 20 bp, Artificial
  CRISPR gRNA sequence
gaaattcaatactatcagtt

SEQ ID NO: 203406 - DNA, 20 bp, Artificial
  CRISPR gRNA sequence
caatactatcagttaagcct

SEQ ID NO: 203407 - DNA, 20 bp, Artificial
  CRISPR gRNA sequence
taagccttggtgtttgattc

SEQ ID NO: 203408 - DNA, 20 bp, Artificial
  CRISPR gRNA sequence
gtttgattctagcaatctct

SEQ ID NO: 203409 - DNA, 20 bp, Artificial
  CRISPR gRNA sequence
caatctctgagctgtttgct

SEQ ID NO: 203410 - DNA, 20 bp, Artificial
  CRISPR gRNA sequence
tctgagctgtttgctaagca

SEQ ID NO: 203411 - DNA, 20 bp, Artificial
  CRISPR gRNA sequence
tgagctgtttgctaagcata

SEQ ID NO: 203412 - DNA, 20 bp, Artificial
  CRISPR gRNA sequence
agcatagagattctgcttaa

SEQ ID NO: 203413 - DNA, 20 bp, Artificial
  CRISPR gRNA sequence
gattctgcttaaaagttcct

SEQ ID NO: 203414 - DNA, 20 bp, Artificial
  CRISPR gRNA sequence
gcttaaaagttcctaagtta

SEQ ID NO: 203415 - DNA, 20 bp, Artificial
  CRISPR gRNA sequence
aaagttcctaagttaaagct

SEQ ID NO: 203416 - DNA, 20 bp, Artificial
  CRISPR gRNA sequence
cctaagttaaagctaagcta

SEQ ID NO: 203417 - DNA, 20 bp, Artificial
  CRISPR gRNA sequence
ctaagttaaagctaagctaa

SEQ ID NO: 203418 - DNA, 20 bp, Artificial
  CRISPR gRNA sequence
ttaaagctaagctaaaggtg

SEQ ID NO: 203419 - DNA, 20 bp, Artificial
  CRISPR gRNA sequence
taaagctaagctaaaggtga

SEQ ID NO: 203420 - DNA, 20 bp, Artificial
  CRISPR gRNA sequence
aagctaaaggtgaaggtatt

SEQ ID NO: 203421 - DNA, 20 bp, Artificial
  CRISPR gRNA sequence
agctaaaggtgaaggtattt

SEQ ID NO: 203422 - DNA, 20 bp, Artificial
  CRISPR gRNA sequence
atttaggaacatttccctgt

SEQ ID NO: 203423 - DNA, 20 bp, Artificial
  CRISPR gRNA sequence
ttaggaacatttccctgtaa

SEQ ID NO: 203424 - DNA, 20 bp, Artificial
  CRISPR gRNA sequence
taggaacatttccctgtaag

SEQ ID NO: 203425 - DNA, 20 bp, Artificial
  CRISPR gRNA sequence
aggcctttatctttgaaacg

SEQ ID NO: 203426 - DNA, 20 bp, Artificial
  CRISPR gRNA sequence
tttatctttgaaacgtggtc

SEQ ID NO: 203427 - DNA, 20 bp, Artificial
  CRISPR gRNA sequence
ttatctttgaaacgtggtcc

SEQ ID NO: 203428 - DNA, 20 bp, Artificial
  CRISPR gRNA sequence
tatctttgaaacgtggtcca

SEQ ID NO: 203429 - DNA, 20 bp, Artificial
  CRISPR gRNA sequence
aacgtggtccagggctcacc

SEQ ID NO: 203430 - DNA, 20 bp, Artificial
  CRISPR gRNA sequence
gtccagggctcaccaagtgc

SEQ ID NO: 203431 - DNA, 20 bp, Artificial
  CRISPR gRNA sequence
agggctcaccaagtgctggc

SEQ ID NO: 203432 - DNA, 20 bp, Artificial
  CRISPR gRNA sequence
gggctcaccaagtgctggct

SEQ ID NO: 203433 - DNA, 20 bp, Artificial
  CRISPR gRNA sequence
accaagtgctggctgggctc

SEQ ID NO: 203434 - DNA, 20 bp, Artificial
  CRISPR gRNA sequence
ccaagtgctggctgggctct

SEQ ID NO: 203435 - DNA, 20 bp, Artificial
  CRISPR gRNA sequence
aagtgctggctgggctctgg

SEQ ID NO: 203436 - DNA, 20 bp, Artificial
  CRISPR gRNA sequence
tggctgggctctgggagttt

SEQ ID NO: 203437 - DNA, 20 bp, Artificial
  CRISPR gRNA sequence
gctgggctctgggagtttaa

SEQ ID NO: 203438 - DNA, 20 bp, Artificial
  CRISPR gRNA sequence
tgggagtttaagagtcttct

SEQ ID NO: 203439 - DNA, 20 bp, Artificial
  CRISPR gRNA sequence
gggagtttaagagtcttctc

SEQ ID NO: 203440 - DNA, 20 bp, Artificial
  CRISPR gRNA sequence
gtcttctcaggcttcttcct

SEQ ID NO: 203441 - DNA, 20 bp, Artificial
  CRISPR gRNA sequence
ttctcaggcttcttcctcag

SEQ ID NO: 203442 - DNA, 20 bp, Artificial
  CRISPR gRNA sequence
tctcaggcttcttcctcagt

SEQ ID NO: 203443 - DNA, 20 bp, Artificial
  CRISPR gRNA sequence
ttcttcctcagtaggaccaa

SEQ ID NO: 203444 - DNA, 20 bp, Artificial
  CRISPR gRNA sequence
agtaggaccaatggcatcct

SEQ ID NO: 203445 - DNA, 20 bp, Artificial
  CRISPR gRNA sequence
ggcatcctgagacatctttc

SEQ ID NO: 203446 - DNA, 20 bp, Artificial
  CRISPR gRNA sequence
ctgagacatctttcaagata

SEQ ID NO: 203447 - DNA, 20 bp, Artificial
  CRISPR gRNA sequence
catctttcaagatacagctc

SEQ ID NO: 203448 - DNA, 20 bp, Artificial
  CRISPR gRNA sequence
caagatacagctctggtata

SEQ ID NO: 203449 - DNA, 20 bp, Artificial
  CRISPR gRNA sequence
ataaagaaactctttctcct

SEQ ID NO: 203450 - DNA, 20 bp, Artificial
  CRISPR gRNA sequence
aaagaaactctttctcctca

SEQ ID NO: 203451 - DNA, 20 bp, Artificial
  CRISPR gRNA sequence
aaactctttctcctcagagt

SEQ ID NO: 203452 - DNA, 20 bp, Artificial
  CRISPR gRNA sequence
tctcctcagagtgagcaaat

SEQ ID NO: 203453 - DNA, 20 bp, Artificial
  CRISPR gRNA sequence
ctcctcagagtgagcaaatg

SEQ ID NO: 203454 - DNA, 20 bp, Artificial
  CRISPR gRNA sequence
tcctcagagtgagcaaatga

SEQ ID NO: 203455 - DNA, 20 bp, Artificial
  CRISPR gRNA sequence
taacctgctgtctttactga

SEQ ID NO: 203456 - DNA, 20 bp, Artificial
  CRISPR gRNA sequence
tgctgtctttactgaaagtt

SEQ ID NO: 203457 - DNA, 20 bp, Artificial
  CRISPR gRNA sequence
tctttactgaaagtttagcc

SEQ ID NO: 203458 - DNA, 20 bp, Artificial
  CRISPR gRNA sequence
actgaaagtttagcctggta

SEQ ID NO: 203459 - DNA, 20 bp, Artificial
  CRISPR gRNA sequence
ctgaaagtttagcctggtaa

SEQ ID NO: 203460 - DNA, 20 bp, Artificial
  CRISPR gRNA sequence
agtttagcctggtaaaggtc

SEQ ID NO: 203461 - DNA, 20 bp, Artificial
  CRISPR gRNA sequence
gtttagcctggtaaaggtcc

SEQ ID NO: 203462 - DNA, 20 bp, Artificial
  CRISPR gRNA sequence
gtaaaggtccaggtttgtct

SEQ ID NO: 203463 - DNA, 20 bp, Artificial
  CRISPR gRNA sequence
caggtttgtcttggaccaca

SEQ ID NO: 203464 - DNA, 20 bp, Artificial
  CRISPR gRNA sequence
ggaccacaaagactcacatg

SEQ ID NO: 203465 - DNA, 20 bp, Artificial
  CRISPR gRNA sequence
accacaaagactcacatgca

SEQ ID NO: 203466 - DNA, 20 bp, Artificial
  CRISPR gRNA sequence
caaagactcacatgcagagc

SEQ ID NO: 203467 - DNA, 20 bp, Artificial
  CRISPR gRNA sequence
gcagagctggaaaaaccact

SEQ ID NO: 203468 - DNA, 20 bp, Artificial
  CRISPR gRNA sequence
agagctggaaaaaccactga

SEQ ID NO: 203469 - DNA, 20 bp, Artificial
  CRISPR gRNA sequence
ccactgagagaaatcccctg

SEQ ID NO: 203470 - DNA, 20 bp, Artificial
  CRISPR gRNA sequence
gagagaaatcccctgtagcc

SEQ ID NO: 203471 - DNA, 20 bp, Artificial
  CRISPR gRNA sequence
aaatcccctgtagccaagta

SEQ ID NO: 203472 - DNA, 20 bp, Artificial
  CRISPR gRNA sequence
agccaagtacagaccataaa

SEQ ID NO: 203473 - DNA, 20 bp, Artificial
  CRISPR gRNA sequence
tacagaccataaatggtaat

SEQ ID NO: 203474 - DNA, 20 bp, Artificial
  CRISPR gRNA sequence
acagaccataaatggtaatc

SEQ ID NO: 203475 - DNA, 20 bp, Artificial
  CRISPR gRNA sequence
ccataaatggtaatcaggaa

SEQ ID NO: 203476 - DNA, 20 bp, Artificial
  CRISPR gRNA sequence
aatggtaatcaggaaaagtt

SEQ ID NO: 203477 - DNA, 20 bp, Artificial
  CRISPR gRNA sequence
ggtaatcaggaaaagttaag

SEQ ID NO: 203478 - DNA, 20 bp, Artificial
  CRISPR gRNA sequence
caggaaaagttaagcagaac

SEQ ID NO: 203479 - DNA, 20 bp, Artificial
  CRISPR gRNA sequence
actagaaatctataaaataa

SEQ ID NO: 203480 - DNA, 20 bp, Artificial
  CRISPR gRNA sequence
aatctataaaataaaagtca

SEQ ID NO: 203481 - DNA, 20 bp, Artificial
  CRISPR gRNA sequence
atctataaaataaaagtcat

SEQ ID NO: 203482 - DNA, 20 bp, Artificial
  CRISPR gRNA sequence
aaaataaaagtcatgggtct

SEQ ID NO: 203483 - DNA, 20 bp, Artificial
  CRISPR gRNA sequence
ctgagttattatgaatgctt

SEQ ID NO: 203484 - DNA, 20 bp, Artificial
  CRISPR gRNA sequence
agttattatgaatgctttag

SEQ ID NO: 203485 - DNA, 20 bp, Artificial
  CRISPR gRNA sequence
ctttagaagatttaccatac

SEQ ID NO: 203486 - DNA, 20 bp, Artificial
  CRISPR gRNA sequence
attctaaaaaatatacatct

SEQ ID NO: 203487 - DNA, 20 bp, Artificial
  CRISPR gRNA sequence
ctaaaaaatatacatctaag

SEQ ID NO: 203488 - DNA, 20 bp, Artificial
  CRISPR gRNA sequence
taaaaaatatacatctaagc

SEQ ID NO: 203489 - DNA, 20 bp, Artificial
  CRISPR gRNA sequence
aaaatatacatctaagcagg

SEQ ID NO: 203490 - DNA, 20 bp, Artificial
  CRISPR gRNA sequence
aatatacatctaagcaggtg

SEQ ID NO: 203491 - DNA, 20 bp, Artificial
  CRISPR gRNA sequence
acatctaagcaggtggagaa

SEQ ID NO: 203492 - DNA, 20 bp, Artificial
  CRISPR gRNA sequence
atctaagcaggtggagaata

SEQ ID NO: 203493 - DNA, 20 bp, Artificial
  CRISPR gRNA sequence
tctaagcaggtggagaatag

SEQ ID NO: 203494 - DNA, 20 bp, Artificial
  CRISPR gRNA sequence
aggtgctttctatttctatt

SEQ ID NO: 203495 - DNA, 20 bp, Artificial
  CRISPR gRNA sequence
tgctttctatttctatttgg

SEQ ID NO: 203496 - DNA, 20 bp, Artificial
  CRISPR gRNA sequence
tttctatttggtggaatgct

SEQ ID NO: 203497 - DNA, 20 bp, Artificial
  CRISPR gRNA sequence
ttctatttggtggaatgctc

SEQ ID NO: 203498 - DNA, 20 bp, Artificial
  CRISPR gRNA sequence
tggaatgctcaggccatcaa

SEQ ID NO: 203499 - DNA, 20 bp, Artificial
  CRISPR gRNA sequence
gaatgctcaggccatcaaca

SEQ ID NO: 203500 - DNA, 20 bp, Artificial
  CRISPR gRNA sequence
aatgctcaggccatcaacag

SEQ ID NO: 203501 - DNA, 20 bp, Artificial
  CRISPR gRNA sequence
gccatcaacagaggcactaa

SEQ ID NO: 203502 - DNA, 20 bp, Artificial
  CRISPR gRNA sequence
caacagaggcactaacagaa

SEQ ID NO: 203503 - DNA, 20 bp, Artificial
  CRISPR gRNA sequence
agaggcactaacagaaaagt

SEQ ID NO: 203504 - DNA, 20 bp, Artificial
  CRISPR gRNA sequence
actaacagaaaagttagatt

SEQ ID NO: 203505 - DNA, 20 bp, Artificial
  CRISPR gRNA sequence
ttggatccatgactatctca

SEQ ID NO: 203506 - DNA, 20 bp, Artificial
  CRISPR gRNA sequence
gactatctcaaagatgtgac

SEQ ID NO: 203507 - DNA, 20 bp, Artificial
  CRISPR gRNA sequence
actatctcaaagatgtgaca

SEQ ID NO: 203508 - DNA, 20 bp, Artificial
  CRISPR gRNA sequence
ctcaaagatgtgacaaggca

SEQ ID NO: 203509 - DNA, 20 bp, Artificial
  CRISPR gRNA sequence
tcaaagatgtgacaaggcat

SEQ ID NO: 203510 - DNA, 20 bp, Artificial
  CRISPR gRNA sequence
cacatacattcgtgtctccc

SEQ ID NO: 203511 - DNA, 20 bp, Artificial
  CRISPR gRNA sequence
gtgtctccctggcttaaatg

SEQ ID NO: 203512 - DNA, 20 bp, Artificial
  CRISPR gRNA sequence
tgtctccctggcttaaatgt

SEQ ID NO: 203513 - DNA, 20 bp, Artificial
  CRISPR gRNA sequence
aaatgtgggtgctacaaaac

SEQ ID NO: 203514 - DNA, 20 bp, Artificial
  CRISPR gRNA sequence
aatgtgggtgctacaaaacc

SEQ ID NO: 203515 - DNA, 20 bp, Artificial
  CRISPR gRNA sequence
atgtgggtgctacaaaacca

SEQ ID NO: 203516 - DNA, 20 bp, Artificial
  CRISPR gRNA sequence
tgcacatcacacccacattt

SEQ ID NO: 203517 - DNA, 20 bp, Artificial
  CRISPR gRNA sequence
gcacatcacacccacatttc

SEQ ID NO: 203518 - DNA, 20 bp, Artificial
  CRISPR gRNA sequence
acacccacatttcaggcatg

SEQ ID NO: 203519 - DNA, 20 bp, Artificial
  CRISPR gRNA sequence
cacatttcaggcatgtagct

SEQ ID NO: 203520 - DNA, 20 bp, Artificial
  CRISPR gRNA sequence
caggcatgtagcttggtgtc

SEQ ID NO: 203521 - DNA, 20 bp, Artificial
  CRISPR gRNA sequence
gtagcttggtgtccagcaat

SEQ ID NO: 203522 - DNA, 20 bp, Artificial
  CRISPR gRNA sequence
gcttggtgtccagcaatcag

SEQ ID NO: 203523 - DNA, 20 bp, Artificial
  CRISPR gRNA sequence
cttggtgtccagcaatcagt

SEQ ID NO: 203524 - DNA, 20 bp, Artificial
  CRISPR gRNA sequence
atcagtaggcaccctgtcac

SEQ ID NO: 203525 - DNA, 20 bp, Artificial
  CRISPR gRNA sequence
tcagtaggcaccctgtcact

SEQ ID NO: 203526 - DNA, 20 bp, Artificial
  CRISPR gRNA sequence
accctgtcactaggtatttg

SEQ ID NO: 203527 - DNA, 20 bp, Artificial
  CRISPR gRNA sequence
tcactaggtatttgcagaat

SEQ ID NO: 203528 - DNA, 20 bp, Artificial
  CRISPR gRNA sequence
tgcagaataagtaaacaaat

SEQ ID NO: 203529 - DNA, 20 bp, Artificial
  CRISPR gRNA sequence
gcagaataagtaaacaaatc

SEQ ID NO: 203530 - DNA, 20 bp, Artificial
  CRISPR gRNA sequence
caacattctgctctcctaat

SEQ ID NO: 203531 - DNA, 20 bp, Artificial
  CRISPR gRNA sequence
tctgctctcctaataagttt

SEQ ID NO: 203532 - DNA, 20 bp, Artificial
  CRISPR gRNA sequence
cctaataagttttagctact

SEQ ID NO: 203533 - DNA, 20 bp, Artificial
  CRISPR gRNA sequence
gctactcagtattatgtgct

SEQ ID NO: 203534 - DNA, 20 bp, Artificial
  CRISPR gRNA sequence
cagtattatgtgcttagata

SEQ ID NO: 203535 - DNA, 20 bp, Artificial
  CRISPR gRNA sequence
agtattatgtgcttagatat

SEQ ID NO: 203536 - DNA, 20 bp, Artificial
  CRISPR gRNA sequence
agatataggttcacccttca

SEQ ID NO: 203537 - DNA, 20 bp, Artificial
  CRISPR gRNA sequence
tcctcaaaataaatgcaaaa

SEQ ID NO: 203538 - DNA, 20 bp, Artificial
  CRISPR gRNA sequence
cctcaaaataaatgcaaaac

SEQ ID NO: 203539 - DNA, 20 bp, Artificial
  CRISPR gRNA sequence
ctcaaaataaatgcaaaacg

SEQ ID NO: 203540 - DNA, 20 bp, Artificial
  CRISPR gRNA sequence
caaaataaatgcaaaacggg

SEQ ID NO: 203541 - DNA, 20 bp, Artificial
  CRISPR gRNA sequence
aaaataaatgcaaaacgggg

SEQ ID NO: 203542 - DNA, 20 bp, Artificial
  CRISPR gRNA sequence
ataaatgcaaaacggggagg

SEQ ID NO: 203543 - DNA, 20 bp, Artificial
  CRISPR gRNA sequence
tgcaaaacggggaggcagta

SEQ ID NO: 203544 - DNA, 20 bp, Artificial
  CRISPR gRNA sequence
aacggggaggcagtacagtg

SEQ ID NO: 203545 - DNA, 20 bp, Artificial
  CRISPR gRNA sequence
ggggaggcagtacagtgcag

SEQ ID NO: 203546 - DNA, 20 bp, Artificial
  CRISPR gRNA sequence
cagtacagtgcagtggtaaa

SEQ ID NO: 203547 - DNA, 20 bp, Artificial
  CRISPR gRNA sequence
agtgcagtggtaaacagtac

SEQ ID NO: 203548 - DNA, 20 bp, Artificial
  CRISPR gRNA sequence
aacagtactagttcaaatcc

SEQ ID NO: 203549 - DNA, 20 bp, Artificial
  CRISPR gRNA sequence
agttcaaatcccagtactat

SEQ ID NO: 203550 - DNA, 20 bp, Artificial
  CRISPR gRNA sequence
gttcaaatcccagtactatc

SEQ ID NO: 203551 - DNA, 20 bp, Artificial
  CRISPR gRNA sequence
atcccagtactatcaggaaa

SEQ ID NO: 203552 - DNA, 20 bp, Artificial
  CRISPR gRNA sequence
cagtactatcaggaaacggc

SEQ ID NO: 203553 - DNA, 20 bp, Artificial
  CRISPR gRNA sequence
agtactatcaggaaacggct

SEQ ID NO: 203554 - DNA, 20 bp, Artificial
  CRISPR gRNA sequence
aggaaacggctgggtgattg

SEQ ID NO: 203555 - DNA, 20 bp, Artificial
  CRISPR gRNA sequence
ggaaacggctgggtgattgc

SEQ ID NO: 203556 - DNA, 20 bp, Artificial
  CRISPR gRNA sequence
cctgtttcttatctacaaaa

SEQ ID NO: 203557 - DNA, 20 bp, Artificial
  CRISPR gRNA sequence
ctgtttcttatctacaaaac

SEQ ID NO: 203558 - DNA, 20 bp, Artificial
  CRISPR gRNA sequence
ctacaaaacgggaataacaa

SEQ ID NO: 203559 - DNA, 20 bp, Artificial
  CRISPR gRNA sequence
aacaacagtgtctatgccca

SEQ ID NO: 203560 - DNA, 20 bp, Artificial
  CRISPR gRNA sequence
caacagtgtctatgcccata

SEQ ID NO: 203561 - DNA, 20 bp, Artificial
  CRISPR gRNA sequence
gtctatgcccatagagtttc

SEQ ID NO: 203562 - DNA, 20 bp, Artificial
  CRISPR gRNA sequence
tctatgcccatagagtttct

SEQ ID NO: 203563 - DNA, 20 bp, Artificial
  CRISPR gRNA sequence
tatgcccatagagtttctgg

SEQ ID NO: 203564 - DNA, 20 bp, Artificial
  CRISPR gRNA sequence
gggagaaataaatgtcattt

SEQ ID NO: 203565 - DNA, 20 bp, Artificial
  CRISPR gRNA sequence
aataaatgtcatttcagata

SEQ ID NO: 203566 - DNA, 20 bp, Artificial
  CRISPR gRNA sequence
taaatgtcatttcagatata

SEQ ID NO: 203567 - DNA, 20 bp, Artificial
  CRISPR gRNA sequence
cagatatagagtactttgca

SEQ ID NO: 203568 - DNA, 20 bp, Artificial
  CRISPR gRNA sequence
tactttgcacagaacctgtc

SEQ ID NO: 203569 - DNA, 20 bp, Artificial
  CRISPR gRNA sequence
tttgcacagaacctgtcaag

SEQ ID NO: 203570 - DNA, 20 bp, Artificial
  CRISPR gRNA sequence
tgcacagaacctgtcaagca

SEQ ID NO: 203571 - DNA, 20 bp, Artificial
  CRISPR gRNA sequence
cagaacctgtcaagcagagc

SEQ ID NO: 203572 - DNA, 20 bp, Artificial
  CRISPR gRNA sequence
gaacctgtcaagcagagcaa

SEQ ID NO: 203573 - DNA, 20 bp, Artificial
  CRISPR gRNA sequence
cagagcaagagctccacaaa

SEQ ID NO: 203574 - DNA, 20 bp, Artificial
  CRISPR gRNA sequence
gcaagagctccacaaatggt

SEQ ID NO: 203575 - DNA, 20 bp, Artificial
  CRISPR gRNA sequence
tcatcaacacctttaaatgt

SEQ ID NO: 203576 - DNA, 20 bp, Artificial
  CRISPR gRNA sequence
aacacctttaaatgtgagcg

SEQ ID NO: 203577 - DNA, 20 bp, Artificial
  CRISPR gRNA sequence
acacctttaaatgtgagcgc

SEQ ID NO: 203578 - DNA, 20 bp, Artificial
  CRISPR gRNA sequence
ctttaaatgtgagcgcaggc

SEQ ID NO: 203579 - DNA, 20 bp, Artificial
  CRISPR gRNA sequence
tttaaatgtgagcgcaggct

SEQ ID NO: 203580 - DNA, 20 bp, Artificial
  CRISPR gRNA sequence
caggctgggtgaatcatgta

SEQ ID NO: 203581 - DNA, 20 bp, Artificial
  CRISPR gRNA sequence
cacacacatctacctgtttc

SEQ ID NO: 203582 - DNA, 20 bp, Artificial
  CRISPR gRNA sequence
acatctacctgtttcaagat

SEQ ID NO: 203583 - DNA, 20 bp, Artificial
  CRISPR gRNA sequence
ttcccaccaaaatatttctt

SEQ ID NO: 203584 - DNA, 20 bp, Artificial
  CRISPR gRNA sequence
tcccaccaaaatatttcttt

SEQ ID NO: 203585 - DNA, 20 bp, Artificial
  CRISPR gRNA sequence
aaatatttctttaggtttat

SEQ ID NO: 203586 - DNA, 20 bp, Artificial
  CRISPR gRNA sequence
cacgttccttaaaatatgac

SEQ ID NO: 203587 - DNA, 20 bp, Artificial
  CRISPR gRNA sequence
ccagtacaaaaaatataaaa

SEQ ID NO: 203588 - DNA, 20 bp, Artificial
  CRISPR gRNA sequence
acaaaaattacaattacaat

SEQ ID NO: 203589 - DNA, 20 bp, Artificial
  CRISPR gRNA sequence
tttttcacccatcaaatttg

SEQ ID NO: 203590 - DNA, 20 bp, Artificial
  CRISPR gRNA sequence
tttcacccatcaaatttgca

SEQ ID NO: 203591 - DNA, 20 bp, Artificial
  CRISPR gRNA sequence
catcaaatttgcagagattt

SEQ ID NO: 203592 - DNA, 20 bp, Artificial
  CRISPR gRNA sequence
agattttagcgttataatat

SEQ ID NO: 203593 - DNA, 20 bp, Artificial
  CRISPR gRNA sequence
ataatatcagaattataact

SEQ ID NO: 203594 - DNA, 20 bp, Artificial
  CRISPR gRNA sequence
taatatcagaattataactg

SEQ ID NO: 203595 - DNA, 20 bp, Artificial
  CRISPR gRNA sequence
cagaattataactgaggtga

SEQ ID NO: 203596 - DNA, 20 bp, Artificial
  CRISPR gRNA sequence
attataactgaggtgaaaga

SEQ ID NO: 203597 - DNA, 20 bp, Artificial
  CRISPR gRNA sequence
ttataactgaggtgaaagac

SEQ ID NO: 203598 - DNA, 20 bp, Artificial
  CRISPR gRNA sequence
acaggtattctcatctgcaa

SEQ ID NO: 203599 - DNA, 20 bp, Artificial
  CRISPR gRNA sequence
ggtattctcatctgcaatag

SEQ ID NO: 203600 - DNA, 20 bp, Artificial
  CRISPR gRNA sequence
gtagttgatacaaacgtttc

SEQ ID NO: 203601 - DNA, 20 bp, Artificial
  CRISPR gRNA sequence
gtttctggaaaacattttgc

SEQ ID NO: 203602 - DNA, 20 bp, Artificial
  CRISPR gRNA sequence
acattttgccagtatgtatc

SEQ ID NO: 203603 - DNA, 20 bp, Artificial
  CRISPR gRNA sequence
attttgccagtatgtatcta

SEQ ID NO: 203604 - DNA, 20 bp, Artificial
  CRISPR gRNA sequence
taaaatatctctgccaattc

SEQ ID NO: 203605 - DNA, 20 bp, Artificial
  CRISPR gRNA sequence
aaaatatctctgccaattcc

SEQ ID NO: 203606 - DNA, 20 bp, Artificial
  CRISPR gRNA sequence
aattccaggcttcatatctt

SEQ ID NO: 203607 - DNA, 20 bp, Artificial
  CRISPR gRNA sequence
tccaggcttcatatctttag

SEQ ID NO: 203608 - DNA, 20 bp, Artificial
  CRISPR gRNA sequence
caggcttcatatctttagca

SEQ ID NO: 203609 - DNA, 20 bp, Artificial
  CRISPR gRNA sequence
ctttagcagagttattttca

SEQ ID NO: 203610 - DNA, 20 bp, Artificial
  CRISPR gRNA sequence
tttcatagtatcaaaaaaat

SEQ ID NO: 203611 - DNA, 20 bp, Artificial
  CRISPR gRNA sequence
aaacatccttaaaatccatc

SEQ ID NO: 203612 - DNA, 20 bp, Artificial
  CRISPR gRNA sequence
tccttaaaatccatcaagat

SEQ ID NO: 203613 - DNA, 20 bp, Artificial
  CRISPR gRNA sequence
cttaaaatccatcaagatga

SEQ ID NO: 203614 - DNA, 20 bp, Artificial
  CRISPR gRNA sequence
aatccatcaagatgagagtt

SEQ ID NO: 203615 - DNA, 20 bp, Artificial
  CRISPR gRNA sequence
gatgagagttaagtaaatta

SEQ ID NO: 203616 - DNA, 20 bp, Artificial
  CRISPR gRNA sequence
aaattatagtgcatccacaa

SEQ ID NO: 203617 - DNA, 20 bp, Artificial
  CRISPR gRNA sequence
ttatagtgcatccacaaaag

SEQ ID NO: 203618 - DNA, 20 bp, Artificial
  CRISPR gRNA sequence
gcatccacaaaagtagaaca

SEQ ID NO: 203619 - DNA, 20 bp, Artificial
  CRISPR gRNA sequence
catccacaaaagtagaacac

SEQ ID NO: 203620 - DNA, 20 bp, Artificial
  CRISPR gRNA sequence
ccacaaaagtagaacacagg

SEQ ID NO: 203621 - DNA, 20 bp, Artificial
  CRISPR gRNA sequence
agaacacaggcagctataac

SEQ ID NO: 203622 - DNA, 20 bp, Artificial
  CRISPR gRNA sequence
cagctataacaagatttctg

SEQ ID NO: 203623 - DNA, 20 bp, Artificial
  CRISPR gRNA sequence
taacaagatttctgaagaca

SEQ ID NO: 203624 - DNA, 20 bp, Artificial
  CRISPR gRNA sequence
aacaagatttctgaagacat

SEQ ID NO: 203625 - DNA, 20 bp, Artificial
  CRISPR gRNA sequence
acaagatttctgaagacatg

SEQ ID NO: 203626 - DNA, 20 bp, Artificial
  CRISPR gRNA sequence
caagatttctgaagacatgg

SEQ ID NO: 203627 - DNA, 20 bp, Artificial
  CRISPR gRNA sequence
ctgaagacatgggggaacat

SEQ ID NO: 203628 - DNA, 20 bp, Artificial
  CRISPR gRNA sequence
gggggaacatcagaacgtac

SEQ ID NO: 203629 - DNA, 20 bp, Artificial
  CRISPR gRNA sequence
atcagaacgtacaagcatat

SEQ ID NO: 203630 - DNA, 20 bp, Artificial
  CRISPR gRNA sequence
tacaagcatataagctgtac

SEQ ID NO: 203631 - DNA, 20 bp, Artificial
  CRISPR gRNA sequence
aagctgtacgagtccattta

SEQ ID NO: 203632 - DNA, 20 bp, Artificial
  CRISPR gRNA sequence
ggttacctttttttaaaaaa

SEQ ID NO: 203633 - DNA, 20 bp, Artificial
  CRISPR gRNA sequence
aaaaagataacaaaaatgaa

SEQ ID NO: 203634 - DNA, 20 bp, Artificial
  CRISPR gRNA sequence
ataacaaaaatgaatagaaa

SEQ ID NO: 203635 - DNA, 20 bp, Artificial
  CRISPR gRNA sequence
caaaaatgaatagaaaaaga

SEQ ID NO: 203636 - DNA, 20 bp, Artificial
  CRISPR gRNA sequence
aatgaatagaaaaagacaga

SEQ ID NO: 203637 - DNA, 20 bp, Artificial
  CRISPR gRNA sequence
atgaatagaaaaagacagaa

SEQ ID NO: 203638 - DNA, 20 bp, Artificial
  CRISPR gRNA sequence
tgaatagaaaaagacagaaa

SEQ ID NO: 203639 - DNA, 20 bp, Artificial
  CRISPR gRNA sequence
gaaaaagacagaaagggaaa

SEQ ID NO: 203640 - DNA, 20 bp, Artificial
  CRISPR gRNA sequence
aaaaagacagaaagggaaac

SEQ ID NO: 203641 - DNA, 20 bp, Artificial
  CRISPR gRNA sequence
aagggaaacaggaaattcac

SEQ ID NO: 203642 - DNA, 20 bp, Artificial
  CRISPR gRNA sequence
aattcaccagaatataccaa

SEQ ID NO: 203643 - DNA, 20 bp, Artificial
  CRISPR gRNA sequence
atataccaatagtttatttc

SEQ ID NO: 203644 - DNA, 20 bp, Artificial
  CRISPR gRNA sequence
tataccaatagtttatttct

SEQ ID NO: 203645 - DNA, 20 bp, Artificial
  CRISPR gRNA sequence
caatagtttatttctaggtt

SEQ ID NO: 203646 - DNA, 20 bp, Artificial
  CRISPR gRNA sequence
aatagtttatttctaggttt

SEQ ID NO: 203647 - DNA, 20 bp, Artificial
  CRISPR gRNA sequence
atagtttatttctaggtttg

SEQ ID NO: 203648 - DNA, 20 bp, Artificial
  CRISPR gRNA sequence
atttctaggtttggggacta

SEQ ID NO: 203649 - DNA, 20 bp, Artificial
  CRISPR gRNA sequence
taggtttggggactacagat

SEQ ID NO: 203650 - DNA, 20 bp, Artificial
  CRISPR gRNA sequence
aataactccctactttgtac

SEQ ID NO: 203651 - DNA, 20 bp, Artificial
  CRISPR gRNA sequence
ataactccctactttgtacg

SEQ ID NO: 203652 - DNA, 20 bp, Artificial
  CRISPR gRNA sequence
actttgtacgaggtgttcta

SEQ ID NO: 203653 - DNA, 20 bp, Artificial
  CRISPR gRNA sequence
gtgatatgtatgactttttt

SEQ ID NO: 203654 - DNA, 20 bp, Artificial
  CRISPR gRNA sequence
tatgtatgacttttttaagt

SEQ ID NO: 203655 - DNA, 20 bp, Artificial
  CRISPR gRNA sequence
aagtcagaaaaaatattgta

SEQ ID NO: 203656 - DNA, 20 bp, Artificial
  CRISPR gRNA sequence
aagctcattttgtaaaaata

SEQ ID NO: 203657 - DNA, 20 bp, Artificial
  CRISPR gRNA sequence
ttttgtaaaaatacagccaa

SEQ ID NO: 203658 - DNA, 20 bp, Artificial
  CRISPR gRNA sequence
acagtgaacaaactcactcc

SEQ ID NO: 203659 - DNA, 20 bp, Artificial
  CRISPR gRNA sequence
atgtcaccaatgataacgtc

SEQ ID NO: 203660 - DNA, 20 bp, Artificial
  CRISPR gRNA sequence
accaatgataacgtctggat

SEQ ID NO: 203661 - DNA, 20 bp, Artificial
  CRISPR gRNA sequence
tggatcagcaaacatccatc

SEQ ID NO: 203662 - DNA, 20 bp, Artificial
  CRISPR gRNA sequence
taatttcatgatctttgaaa

SEQ ID NO: 203663 - DNA, 20 bp, Artificial
  CRISPR gRNA sequence
aatttcatgatctttgaaaa

SEQ ID NO: 203664 - DNA, 20 bp, Artificial
  CRISPR gRNA sequence
aaaaaggctgttccctgccc

SEQ ID NO: 203665 - DNA, 20 bp, Artificial
  CRISPR gRNA sequence
cctgcccaagtcatatgact

SEQ ID NO: 203666 - DNA, 20 bp, Artificial
  CRISPR gRNA sequence
gtcatatgacttagccctta

SEQ ID NO: 203667 - DNA, 20 bp, Artificial
  CRISPR gRNA sequence
atgacttagcccttaaagtc

SEQ ID NO: 203668 - DNA, 20 bp, Artificial
  CRISPR gRNA sequence
aaagtctggctctgccaata

SEQ ID NO: 203669 - DNA, 20 bp, Artificial
  CRISPR gRNA sequence
ggctctgccaatatggttaa

SEQ ID NO: 203670 - DNA, 20 bp, Artificial
  CRISPR gRNA sequence
ttccctaatatcattgatgc

SEQ ID NO: 203671 - DNA, 20 bp, Artificial
  CRISPR gRNA sequence
taatatcattgatgccagaa

SEQ ID NO: 203672 - DNA, 20 bp, Artificial
  CRISPR gRNA sequence
aatatcattgatgccagaat

SEQ ID NO: 203673 - DNA, 20 bp, Artificial
  CRISPR gRNA sequence
aataggtcttaatgctacac

SEQ ID NO: 203674 - DNA, 20 bp, Artificial
  CRISPR gRNA sequence
ttttcttgacataaaaaact

SEQ ID NO: 203675 - DNA, 20 bp, Artificial
  CRISPR gRNA sequence
ttcttgacataaaaaactaa

SEQ ID NO: 203676 - DNA, 20 bp, Artificial
  CRISPR gRNA sequence
ataaaaaactaagagattat

SEQ ID NO: 203677 - DNA, 20 bp, Artificial
  CRISPR gRNA sequence
gattataagaaaatttccaa

SEQ ID NO: 203678 - DNA, 20 bp, Artificial
  CRISPR gRNA sequence
tataagaaaatttccaaaag

SEQ ID NO: 203679 - DNA, 20 bp, Artificial
  CRISPR gRNA sequence
gaaaatttccaaaagaagtc

SEQ ID NO: 203680 - DNA, 20 bp, Artificial
  CRISPR gRNA sequence
aagtctagacactatcttga

SEQ ID NO: 203681 - DNA, 20 bp, Artificial
  CRISPR gRNA sequence
agacactatcttgaaagtaa

SEQ ID NO: 203682 - DNA, 20 bp, Artificial
  CRISPR gRNA sequence
aaagttataaaatgtcttga

SEQ ID NO: 203683 - DNA, 20 bp, Artificial
  CRISPR gRNA sequence
tcttcccccttttttccttt

SEQ ID NO: 203684 - DNA, 20 bp, Artificial
  CRISPR gRNA sequence
ccttttttcctttcagacaa

SEQ ID NO: 203685 - DNA, 20 bp, Artificial
  CRISPR gRNA sequence
tttcctttcagacaaaagtt

SEQ ID NO: 203686 - DNA, 20 bp, Artificial
  CRISPR gRNA sequence
agaacatttctgaaatcact

SEQ ID NO: 203687 - DNA, 20 bp, Artificial
  CRISPR gRNA sequence
ctgaaatcactaagcatttc

SEQ ID NO: 203688 - DNA, 20 bp, Artificial
  CRISPR gRNA sequence
tttccagaatgccatacact

SEQ ID NO: 203689 - DNA, 20 bp, Artificial
  CRISPR gRNA sequence
agaatgccatacactgagaa

SEQ ID NO: 203690 - DNA, 20 bp, Artificial
  CRISPR gRNA sequence
gcttaaaacatataatcaat

SEQ ID NO: 203691 - DNA, 20 bp, Artificial
  CRISPR gRNA sequence
tccatgtttatacaccacca

SEQ ID NO: 203692 - DNA, 20 bp, Artificial
  CRISPR gRNA sequence
tttatacaccaccatagata

SEQ ID NO: 203693 - DNA, 20 bp, Artificial
  CRISPR gRNA sequence
tacaccaccatagatataga

SEQ ID NO: 203694 - DNA, 20 bp, Artificial
  CRISPR gRNA sequence
tatagacagcttaaactgct

SEQ ID NO: 203695 - DNA, 20 bp, Artificial
  CRISPR gRNA sequence
cagcttaaactgctgagtaa

SEQ ID NO: 203696 - DNA, 20 bp, Artificial
  CRISPR gRNA sequence
aaaattcataaaatatacaa

SEQ ID NO: 203697 - DNA, 20 bp, Artificial
  CRISPR gRNA sequence
aaattcataaaatatacaac

SEQ ID NO: 203698 - DNA, 20 bp, Artificial
  CRISPR gRNA sequence
aattcataaaatatacaaca

SEQ ID NO: 203699 - DNA, 20 bp, Artificial
  CRISPR gRNA sequence
aacagggcaatccactgcaa

SEQ ID NO: 203700 - DNA, 20 bp, Artificial
  CRISPR gRNA sequence
aatccactgcaatagtttac

SEQ ID NO: 203701 - DNA, 20 bp, Artificial
  CRISPR gRNA sequence
tactagcttttgtgtgttta

SEQ ID NO: 203702 - DNA, 20 bp, Artificial
  CRISPR gRNA sequence
actagcttttgtgtgtttaa

SEQ ID NO: 203703 - DNA, 20 bp, Artificial
  CRISPR gRNA sequence
ttttgtgtgtttaaaggttg

SEQ ID NO: 203704 - DNA, 20 bp, Artificial
  CRISPR gRNA sequence
ggttgcagaataaattaaat

SEQ ID NO: 203705 - DNA, 20 bp, Artificial
  CRISPR gRNA sequence
tgcagaataaattaaataag

SEQ ID NO: 203706 - DNA, 20 bp, Artificial
  CRISPR gRNA sequence
ttgcttatataaatgtttac

SEQ ID NO: 203707 - DNA, 20 bp, Artificial
  CRISPR gRNA sequence
tataaatgtttactggtctt

SEQ ID NO: 203708 - DNA, 20 bp, Artificial
  CRISPR gRNA sequence
ataaatgtttactggtcttc

SEQ ID NO: 203709 - DNA, 20 bp, Artificial
  CRISPR gRNA sequence
actggtcttcaggatgctac

SEQ ID NO: 203710 - DNA, 20 bp, Artificial
  CRISPR gRNA sequence
ctggtcttcaggatgctaca

SEQ ID NO: 203711 - DNA, 20 bp, Artificial
  CRISPR gRNA sequence
tcttcaggatgctacaagga

SEQ ID NO: 203712 - DNA, 20 bp, Artificial
  CRISPR gRNA sequence
tcaggatgctacaaggaaag

SEQ ID NO: 203713 - DNA, 20 bp, Artificial
  CRISPR gRNA sequence
caggatgctacaaggaaaga

SEQ ID NO: 203714 - DNA, 20 bp, Artificial
  CRISPR gRNA sequence
gaataaatcttgtatttaaa

SEQ ID NO: 203715 - DNA, 20 bp, Artificial
  CRISPR gRNA sequence
cttgtatttaaaaagcttaa

SEQ ID NO: 203716 - DNA, 20 bp, Artificial
  CRISPR gRNA sequence
atttaaaaagcttaaaagtt

SEQ ID NO: 203717 - DNA, 20 bp, Artificial
  CRISPR gRNA sequence
aaaagtttagactgtcacct

SEQ ID NO: 203718 - DNA, 20 bp, Artificial
  CRISPR gRNA sequence
tttaccaaaatatgaaaata

SEQ ID NO: 203719 - DNA, 20 bp, Artificial
  CRISPR gRNA sequence
atgcatattacctatttgcc

SEQ ID NO: 203720 - DNA, 20 bp, Artificial
  CRISPR gRNA sequence
atgacaattctgtgttgttg

SEQ ID NO: 203721 - DNA, 20 bp, Artificial
  CRISPR gRNA sequence
tgttgaagctaaatctaatg

SEQ ID NO: 203722 - DNA, 20 bp, Artificial
  CRISPR gRNA sequence
gctaaatctaatgcagcatc

SEQ ID NO: 203723 - DNA, 20 bp, Artificial
  CRISPR gRNA sequence
gcagcatcaagatctgcctt

SEQ ID NO: 203724 - DNA, 20 bp, Artificial
  CRISPR gRNA sequence
gcatcaagatctgccttcag

SEQ ID NO: 203725 - DNA, 20 bp, Artificial
  CRISPR gRNA sequence
aagatctgccttcagaagtc

SEQ ID NO: 203726 - DNA, 20 bp, Artificial
  CRISPR gRNA sequence
gtctggttacgttactatta

SEQ ID NO: 203727 - DNA, 20 bp, Artificial
  CRISPR gRNA sequence
tctggttacgttactattat

SEQ ID NO: 203728 - DNA, 20 bp, Artificial
  CRISPR gRNA sequence
gttacgttactattatagga

SEQ ID NO: 203729 - DNA, 20 bp, Artificial
  CRISPR gRNA sequence
cgttactattataggaaagc

SEQ ID NO: 203730 - DNA, 20 bp, Artificial
  CRISPR gRNA sequence
attataggaaagcaagatca

SEQ ID NO: 203731 - DNA, 20 bp, Artificial
  CRISPR gRNA sequence
gatcaaagaacctaactctc

SEQ ID NO: 203732 - DNA, 20 bp, Artificial
  CRISPR gRNA sequence
caaagaacctaactctctgg

SEQ ID NO: 203733 - DNA, 20 bp, Artificial
  CRISPR gRNA sequence
ctctctggtggctgcttctt

SEQ ID NO: 203734 - DNA, 20 bp, Artificial
  CRISPR gRNA sequence
ctctggtggctgcttcttta

SEQ ID NO: 203735 - DNA, 20 bp, Artificial
  CRISPR gRNA sequence
tctggtggctgcttctttag

SEQ ID NO: 203736 - DNA, 20 bp, Artificial
  CRISPR gRNA sequence
ggctgcttctttagaggctg

SEQ ID NO: 203737 - DNA, 20 bp, Artificial
  CRISPR gRNA sequence
agaggctgcagaactgcacg

SEQ ID NO: 203738 - DNA, 20 bp, Artificial
  CRISPR gRNA sequence
aggctgcagaactgcacgca

SEQ ID NO: 203739 - DNA, 20 bp, Artificial
  CRISPR gRNA sequence
ggctgcagaactgcacgcag

SEQ ID NO: 203740 - DNA, 20 bp, Artificial
  CRISPR gRNA sequence
acgcagaggatgacaaaaca

SEQ ID NO: 203741 - DNA, 20 bp, Artificial
  CRISPR gRNA sequence
tgacaaaacatagttccgac

SEQ ID NO: 203742 - DNA, 20 bp, Artificial
  CRISPR gRNA sequence
agttccgactggacttttcc

SEQ ID NO: 203743 - DNA, 20 bp, Artificial
  CRISPR gRNA sequence
gttccgactggacttttcca

SEQ ID NO: 203744 - DNA, 20 bp, Artificial
  CRISPR gRNA sequence
ttccgactggacttttccaa

SEQ ID NO: 203745 - DNA, 20 bp, Artificial
  CRISPR gRNA sequence
caagggtgaacacgtgtaca

SEQ ID NO: 203746 - DNA, 20 bp, Artificial
  CRISPR gRNA sequence
agggtgaacacgtgtacaca

SEQ ID NO: 203747 - DNA, 20 bp, Artificial
  CRISPR gRNA sequence
gtacacagagaaaatcaaac

SEQ ID NO: 203748 - DNA, 20 bp, Artificial
  CRISPR gRNA sequence
tacacagagaaaatcaaact

SEQ ID NO: 203749 - DNA, 20 bp, Artificial
  CRISPR gRNA sequence
aatcaaactgggaaaataaa

SEQ ID NO: 203750 - DNA, 20 bp, Artificial
  CRISPR gRNA sequence
tcaaactgggaaaataaaaa

SEQ ID NO: 203751 - DNA, 20 bp, Artificial
  CRISPR gRNA sequence
caaactgggaaaataaaaag

SEQ ID NO: 203752 - DNA, 20 bp, Artificial
  CRISPR gRNA sequence
aaactgggaaaataaaaaga

SEQ ID NO: 203753 - DNA, 20 bp, Artificial
  CRISPR gRNA sequence
aactgggaaaataaaaagag

SEQ ID NO: 203754 - DNA, 20 bp, Artificial
  CRISPR gRNA sequence
aggggaatctaaatgctcca

SEQ ID NO: 203755 - DNA, 20 bp, Artificial
  CRISPR gRNA sequence
gtcctaccttaaaactaatg

SEQ ID NO: 203756 - DNA, 20 bp, Artificial
  CRISPR gRNA sequence
tcctaccttaaaactaatgc

SEQ ID NO: 203757 - DNA, 20 bp, Artificial
  CRISPR gRNA sequence
ctaataacataatgtgtgtg

SEQ ID NO: 203758 - DNA, 20 bp, Artificial
  CRISPR gRNA sequence
tgaatattaaaatgtgacat

SEQ ID NO: 203759 - DNA, 20 bp, Artificial
  CRISPR gRNA sequence
ttaaaatgtgacatgagttt

SEQ ID NO: 203760 - DNA, 20 bp, Artificial
  CRISPR gRNA sequence
taaaatgtgacatgagttta

SEQ ID NO: 203761 - DNA, 20 bp, Artificial
  CRISPR gRNA sequence
gtgacatgagtttaaggtgt

SEQ ID NO: 203762 - DNA, 20 bp, Artificial
  CRISPR gRNA sequence
tattcctactattcattctt

SEQ ID NO: 203763 - DNA, 20 bp, Artificial
  CRISPR gRNA sequence
ttcctactattcattcttaa

SEQ ID NO: 203764 - DNA, 20 bp, Artificial
  CRISPR gRNA sequence
taagagattaaaaaaacacc

SEQ ID NO: 203765 - DNA, 20 bp, Artificial
  CRISPR gRNA sequence
ccaagtgaaaacaaccttct

SEQ ID NO: 203766 - DNA, 20 bp, Artificial
  CRISPR gRNA sequence
caagtgaaaacaaccttctt

SEQ ID NO: 203767 - DNA, 20 bp, Artificial
  CRISPR gRNA sequence
acaaccttcttaggaattaa

SEQ ID NO: 203768 - DNA, 20 bp, Artificial
  CRISPR gRNA sequence
taggaattaaaagtgaactg

SEQ ID NO: 203769 - DNA, 20 bp, Artificial
  CRISPR gRNA sequence
aagtgaactgcagcaaaatg

SEQ ID NO: 203770 - DNA, 20 bp, Artificial
  CRISPR gRNA sequence
agtgaactgcagcaaaatgt

SEQ ID NO: 203771 - DNA, 20 bp, Artificial
  CRISPR gRNA sequence
tgggcgacaacatatacttc

SEQ ID NO: 203772 - DNA, 20 bp, Artificial
  CRISPR gRNA sequence
gggcgacaacatatacttca

SEQ ID NO: 203773 - DNA, 20 bp, Artificial
  CRISPR gRNA sequence
gcgacaacatatacttcaag

SEQ ID NO: 203774 - DNA, 20 bp, Artificial
  CRISPR gRNA sequence
aacatatacttcaaggagac

SEQ ID NO: 203775 - DNA, 20 bp, Artificial
  CRISPR gRNA sequence
atatacttcaaggagactag

SEQ ID NO: 203776 - DNA, 20 bp, Artificial
  CRISPR gRNA sequence
catactcatatttatcataa

SEQ ID NO: 203777 - DNA, 20 bp, Artificial
  CRISPR gRNA sequence
tatcataatagcacttttcc

SEQ ID NO: 203778 - DNA, 20 bp, Artificial
  CRISPR gRNA sequence
atttcgctgacaatgtctcg

SEQ ID NO: 203779 - DNA, 20 bp, Artificial
  CRISPR gRNA sequence
atcactgaaacataaatgaa

SEQ ID NO: 203780 - DNA, 20 bp, Artificial
  CRISPR gRNA sequence
actgaaacataaatgaaaag

SEQ ID NO: 203781 - DNA, 20 bp, Artificial
  CRISPR gRNA sequence
ttttaataccaaactgtccc

SEQ ID NO: 203782 - DNA, 20 bp, Artificial
  CRISPR gRNA sequence
ataccaaactgtccccagaa

SEQ ID NO: 203783 - DNA, 20 bp, Artificial
  CRISPR gRNA sequence
taccaaactgtccccagaac

SEQ ID NO: 203784 - DNA, 20 bp, Artificial
  CRISPR gRNA sequence
ccaaactgtccccagaacag

SEQ ID NO: 203785 - DNA, 20 bp, Artificial
  CRISPR gRNA sequence
ctgtccccagaacaggagta

SEQ ID NO: 203786 - DNA, 20 bp, Artificial
  CRISPR gRNA sequence
aacaggagtatagcaaaaat

SEQ ID NO: 203787 - DNA, 20 bp, Artificial
  CRISPR gRNA sequence
acaggagtatagcaaaaatt

SEQ ID NO: 203788 - DNA, 20 bp, Artificial
  CRISPR gRNA sequence
aaaattgggaaaataacaat

SEQ ID NO: 203789 - DNA, 20 bp, Artificial
  CRISPR gRNA sequence
acaataagaatattttcatt

SEQ ID NO: 203790 - DNA, 20 bp, Artificial
  CRISPR gRNA sequence
aataagaatattttcatttg

SEQ ID NO: 203791 - DNA, 20 bp, Artificial
  CRISPR gRNA sequence
tttggagaaaaccatgaaac

SEQ ID NO: 203792 - DNA, 20 bp, Artificial
  CRISPR gRNA sequence
ttggagaaaaccatgaaact

SEQ ID NO: 203793 - DNA, 20 bp, Artificial
  CRISPR gRNA sequence
tggagaaaaccatgaaactg

SEQ ID NO: 203794 - DNA, 20 bp, Artificial
  CRISPR gRNA sequence
agaaaaccatgaaactgggg

SEQ ID NO: 203795 - DNA, 20 bp, Artificial
  CRISPR gRNA sequence
aaaccatgaaactggggaag

SEQ ID NO: 203796 - DNA, 20 bp, Artificial
  CRISPR gRNA sequence
actggggaagaagaaaacaa

SEQ ID NO: 203797 - DNA, 20 bp, Artificial
  CRISPR gRNA sequence
aacactttaaattctgctaa

SEQ ID NO: 203798 - DNA, 20 bp, Artificial
  CRISPR gRNA sequence
ctataatacatgctttatta

SEQ ID NO: 203799 - DNA, 20 bp, Artificial
  CRISPR gRNA sequence
ataatacatgctttattata

SEQ ID NO: 203800 - DNA, 20 bp, Artificial
  CRISPR gRNA sequence
tacatgctttattatagaga

SEQ ID NO: 203801 - DNA, 20 bp, Artificial
  CRISPR gRNA sequence
atggaaaaaaattaaaactg

SEQ ID NO: 203802 - DNA, 20 bp, Artificial
  CRISPR gRNA sequence
aataaaaactacacttactt

SEQ ID NO: 203803 - DNA, 20 bp, Artificial
  CRISPR gRNA sequence
cacatttttcttatgtttca

SEQ ID NO: 203804 - DNA, 20 bp, Artificial
  CRISPR gRNA sequence
acatttttcttatgtttcac

SEQ ID NO: 203805 - DNA, 20 bp, Artificial
  CRISPR gRNA sequence
atttttcttatgtttcacgg

SEQ ID NO: 203806 - DNA, 20 bp, Artificial
  CRISPR gRNA sequence
tttttcttatgtttcacggg

SEQ ID NO: 203807 - DNA, 20 bp, Artificial
  CRISPR gRNA sequence
tttcttatgtttcacgggag

SEQ ID NO: 203808 - DNA, 20 bp, Artificial
  CRISPR gRNA sequence
ttcttatgtttcacgggagg

SEQ ID NO: 203809 - DNA, 20 bp, Artificial
  CRISPR gRNA sequence
ttatgtttcacgggaggagg

SEQ ID NO: 203810 - DNA, 20 bp, Artificial
  CRISPR gRNA sequence
tttcacgggaggaggtagtg

SEQ ID NO: 203811 - DNA, 20 bp, Artificial
  CRISPR gRNA sequence
cgggaggaggtagtgcagtg

SEQ ID NO: 203812 - DNA, 20 bp, Artificial
  CRISPR gRNA sequence
gaggaggtagtgcagtgcag

SEQ ID NO: 203813 - DNA, 20 bp, Artificial
  CRISPR gRNA sequence
ggtagtgcagtgcagtggct

SEQ ID NO: 203814 - DNA, 20 bp, Artificial
  CRISPR gRNA sequence
gcagtgcagtggctgagaac

SEQ ID NO: 203815 - DNA, 20 bp, Artificial
  CRISPR gRNA sequence
cagtgcagtggctgagaaca

SEQ ID NO: 203816 - DNA, 20 bp, Artificial
  CRISPR gRNA sequence
tggctgagaacaaggctctg

SEQ ID NO: 203817 - DNA, 20 bp, Artificial
  CRISPR gRNA sequence
aggctctgtggccacactgc

SEQ ID NO: 203818 - DNA, 20 bp, Artificial
  CRISPR gRNA sequence
ggctctgtggccacactgcc

SEQ ID NO: 203819 - DNA, 20 bp, Artificial
  CRISPR gRNA sequence
gctctgtggccacactgcca

SEQ ID NO: 203820 - DNA, 20 bp, Artificial
  CRISPR gRNA sequence
aactctaacttaacactcta

SEQ ID NO: 203821 - DNA, 20 bp, Artificial
  CRISPR gRNA sequence
gtcaacacctctttgttctt

SEQ ID NO: 203822 - DNA, 20 bp, Artificial
  CRISPR gRNA sequence
ggtgtcctcaactgttacac

SEQ ID NO: 203823 - DNA, 20 bp, Artificial
  CRISPR gRNA sequence
actgttacactagtataaca

SEQ ID NO: 203824 - DNA, 20 bp, Artificial
  CRISPR gRNA sequence
aacacagtacatgtatcttg

SEQ ID NO: 203825 - DNA, 20 bp, Artificial
  CRISPR gRNA sequence
acacagtacatgtatcttga

SEQ ID NO: 203826 - DNA, 20 bp, Artificial
  CRISPR gRNA sequence
gactgttgtaactattaaca

SEQ ID NO: 203827 - DNA, 20 bp, Artificial
  CRISPR gRNA sequence
aagttaataaactacatgca

SEQ ID NO: 203828 - DNA, 20 bp, Artificial
  CRISPR gRNA sequence
agttaataaactacatgcaa

SEQ ID NO: 203829 - DNA, 20 bp, Artificial
  CRISPR gRNA sequence
gttaataaactacatgcaaa

SEQ ID NO: 203830 - DNA, 20 bp, Artificial
  CRISPR gRNA sequence
catgcaaagggcttaaaaca

SEQ ID NO: 203831 - DNA, 20 bp, Artificial
  CRISPR gRNA sequence
aaagggcttaaaacaaagct

SEQ ID NO: 203832 - DNA, 20 bp, Artificial
  CRISPR gRNA sequence
aacaaagcttagcactcact

SEQ ID NO: 203833 - DNA, 20 bp, Artificial
  CRISPR gRNA sequence
cttagcactcactaagtact

SEQ ID NO: 203834 - DNA, 20 bp, Artificial
  CRISPR gRNA sequence
agtactcagttaactaaaat

SEQ ID NO: 203835 - DNA, 20 bp, Artificial
  CRISPR gRNA sequence
taagtatgtattcatgtgtt

SEQ ID NO: 203836 - DNA, 20 bp, Artificial
  CRISPR gRNA sequence
gtatgtattcatgtgttgag

SEQ ID NO: 203837 - DNA, 20 bp, Artificial
  CRISPR gRNA sequence
gtattcatgtgttgagtggc

SEQ ID NO: 203838 - DNA, 20 bp, Artificial
  CRISPR gRNA sequence
tattcatgtgttgagtggct

SEQ ID NO: 203839 - DNA, 20 bp, Artificial
  CRISPR gRNA sequence
gttgagtggctgggtgtgta

SEQ ID NO: 203840 - DNA, 20 bp, Artificial
  CRISPR gRNA sequence
ggctgggtgtgtaaagttcc

SEQ ID NO: 203841 - DNA, 20 bp, Artificial
  CRISPR gRNA sequence
agttccaagaatgtaccttc

SEQ ID NO: 203842 - DNA, 20 bp, Artificial
  CRISPR gRNA sequence
tgtaccttcaagtaacaatg

SEQ ID NO: 203843 - DNA, 20 bp, Artificial
  CRISPR gRNA sequence
aacaatgaagtcttcctgta

SEQ ID NO: 203844 - DNA, 20 bp, Artificial
  CRISPR gRNA sequence
atgaagtcttcctgtaaaga

SEQ ID NO: 203845 - DNA, 20 bp, Artificial
  CRISPR gRNA sequence
tcttcctgtaaagacagact

SEQ ID NO: 203846 - DNA, 20 bp, Artificial
  CRISPR gRNA sequence
cttcctgtaaagacagactc

SEQ ID NO: 203847 - DNA, 20 bp, Artificial
  CRISPR gRNA sequence
ttcctgtaaagacagactca

SEQ ID NO: 203848 - DNA, 20 bp, Artificial
  CRISPR gRNA sequence
aagacagactcagggaacct

SEQ ID NO: 203849 - DNA, 20 bp, Artificial
  CRISPR gRNA sequence
cagactcagggaacctaagc

SEQ ID NO: 203850 - DNA, 20 bp, Artificial
  CRISPR gRNA sequence
agactcagggaacctaagcg

SEQ ID NO: 203851 - DNA, 20 bp, Artificial
  CRISPR gRNA sequence
ctcagggaacctaagcgagg

SEQ ID NO: 203852 - DNA, 20 bp, Artificial
  CRISPR gRNA sequence
aagcgaggaagatgcaccac

SEQ ID NO: 203853 - DNA, 20 bp, Artificial
  CRISPR gRNA sequence
agcgaggaagatgcaccact

SEQ ID NO: 203854 - DNA, 20 bp, Artificial
  CRISPR gRNA sequence
taggtactctcttctcattg

SEQ ID NO: 203855 - DNA, 20 bp, Artificial
  CRISPR gRNA sequence
tcttctcattgtggttaaaa

SEQ ID NO: 203856 - DNA, 20 bp, Artificial
  CRISPR gRNA sequence
ttctcattgtggttaaaatg

SEQ ID NO: 203857 - DNA, 20 bp, Artificial
  CRISPR gRNA sequence
ctcattgtggttaaaatgga

SEQ ID NO: 203858 - DNA, 20 bp, Artificial
  CRISPR gRNA sequence
cattgtggttaaaatggaga

SEQ ID NO: 203859 - DNA, 20 bp, Artificial
  CRISPR gRNA sequence
aaaatggagagagatgtgcc

SEQ ID NO: 203860 - DNA, 20 bp, Artificial
  CRISPR gRNA sequence
tggagagagatgtgcccggt

SEQ ID NO: 203861 - DNA, 20 bp, Artificial
  CRISPR gRNA sequence
tgcaattatccatgcataat

SEQ ID NO: 203862 - DNA, 20 bp, Artificial
  CRISPR gRNA sequence
gcaattatccatgcataatt

SEQ ID NO: 203863 - DNA, 20 bp, Artificial
  CRISPR gRNA sequence
atccatgcataattaggctt

SEQ ID NO: 203864 - DNA, 20 bp, Artificial
  CRISPR gRNA sequence
catgcataattaggcttcag

SEQ ID NO: 203865 - DNA, 20 bp, Artificial
  CRISPR gRNA sequence
atgcataattaggcttcaga

SEQ ID NO: 203866 - DNA, 20 bp, Artificial
  CRISPR gRNA sequence
agaaggactgtttatatgta

SEQ ID NO: 203867 - DNA, 20 bp, Artificial
  CRISPR gRNA sequence
ggactgtttatatgtaaagt

SEQ ID NO: 203868 - DNA, 20 bp, Artificial
  CRISPR gRNA sequence
gtttatatgtaaagtaagat

SEQ ID NO: 203869 - DNA, 20 bp, Artificial
  CRISPR gRNA sequence
tatatgtaaagtaagatgag

SEQ ID NO: 203870 - DNA, 20 bp, Artificial
  CRISPR gRNA sequence
taaagtaagatgagtggctt

SEQ ID NO: 203871 - DNA, 20 bp, Artificial
  CRISPR gRNA sequence
aaagtaagatgagtggcttt

SEQ ID NO: 203872 - DNA, 20 bp, Artificial
  CRISPR gRNA sequence
gtggctttaggatattaacg

SEQ ID NO: 203873 - DNA, 20 bp, Artificial
  CRISPR gRNA sequence
atattaacgaagctgttatt

SEQ ID NO: 203874 - DNA, 20 bp, Artificial
  CRISPR gRNA sequence
taacgaagctgttattaagt

SEQ ID NO: 203875 - DNA, 20 bp, Artificial
  CRISPR gRNA sequence
atatccacatatcctatata

SEQ ID NO: 203876 - DNA, 20 bp, Artificial
  CRISPR gRNA sequence
tatccacatatcctatataa

SEQ ID NO: 203877 - DNA, 20 bp, Artificial
  CRISPR gRNA sequence
tatcctatataaaggaaatt

SEQ ID NO: 203878 - DNA, 20 bp, Artificial
  CRISPR gRNA sequence
ataaaggaaattaagatatt

SEQ ID NO: 203879 - DNA, 20 bp, Artificial
  CRISPR gRNA sequence
aagatattaagacttcaaat

SEQ ID NO: 203880 - DNA, 20 bp, Artificial
  CRISPR gRNA sequence
agacttcaaataagatttgt

SEQ ID NO: 203881 - DNA, 20 bp, Artificial
  CRISPR gRNA sequence
tgtgagaacttttaaaaatt

SEQ ID NO: 203882 - DNA, 20 bp, Artificial
  CRISPR gRNA sequence
attgcatcttataaacccct

SEQ ID NO: 203883 - DNA, 20 bp, Artificial
  CRISPR gRNA sequence
aacccctaagaccataattt

SEQ ID NO: 203884 - DNA, 20 bp, Artificial
  CRISPR gRNA sequence
agaccataattttagctgtg

SEQ ID NO: 203885 - DNA, 20 bp, Artificial
  CRISPR gRNA sequence
aagtttctgctctaacaata

SEQ ID NO: 203886 - DNA, 20 bp, Artificial
  CRISPR gRNA sequence
tctgctctaacaataaagcc

SEQ ID NO: 203887 - DNA, 20 bp, Artificial
  CRISPR gRNA sequence
aagccaagtaaatgtactga

SEQ ID NO: 203888 - DNA, 20 bp, Artificial
  CRISPR gRNA sequence
taaatgtactgaaagtattc

SEQ ID NO: 203889 - DNA, 20 bp, Artificial
  CRISPR gRNA sequence
aatgtactgaaagtattccg

SEQ ID NO: 203890 - DNA, 20 bp, Artificial
  CRISPR gRNA sequence
attccggagtttgcctgtac

SEQ ID NO: 203891 - DNA, 20 bp, Artificial
  CRISPR gRNA sequence
ttccggagtttgcctgtaca

SEQ ID NO: 203892 - DNA, 20 bp, Artificial
  CRISPR gRNA sequence
tccggagtttgcctgtacaa

SEQ ID NO: 203893 - DNA, 20 bp, Artificial
  CRISPR gRNA sequence
ccggagtttgcctgtacaag

SEQ ID NO: 203894 - DNA, 20 bp, Artificial
  CRISPR gRNA sequence
tgtacaaggggctgtgtgat

SEQ ID NO: 203895 - DNA, 20 bp, Artificial
  CRISPR gRNA sequence
acaaggggctgtgtgattgg

SEQ ID NO: 203896 - DNA, 20 bp, Artificial
  CRISPR gRNA sequence
aaggggctgtgtgattggaa

SEQ ID NO: 203897 - DNA, 20 bp, Artificial
  CRISPR gRNA sequence
gttcttctgaatactgccct

SEQ ID NO: 203898 - DNA, 20 bp, Artificial
  CRISPR gRNA sequence
ttctgaatactgccctaagc

SEQ ID NO: 203899 - DNA, 20 bp, Artificial
  CRISPR gRNA sequence
atactgccctaagcaagcac

SEQ ID NO: 203900 - DNA, 20 bp, Artificial
  CRISPR gRNA sequence
ttctaccacgcactatctct

SEQ ID NO: 203901 - DNA, 20 bp, Artificial
  CRISPR gRNA sequence
tctaccacgcactatctctc

SEQ ID NO: 203902 - DNA, 20 bp, Artificial
  CRISPR gRNA sequence
acgcactatctctcaggtca

SEQ ID NO: 203903 - DNA, 20 bp, Artificial
  CRISPR gRNA sequence
cgcactatctctcaggtcac

SEQ ID NO: 203904 - DNA, 20 bp, Artificial
  CRISPR gRNA sequence
ctatctctcaggtcacaggt

SEQ ID NO: 203905 - DNA, 20 bp, Artificial
  CRISPR gRNA sequence
tatctctcaggtcacaggtg

SEQ ID NO: 203906 - DNA, 20 bp, Artificial
  CRISPR gRNA sequence
gtcacaggtgaggaattttc

SEQ ID NO: 203907 - DNA, 20 bp, Artificial
  CRISPR gRNA sequence
agcctttcactccataatga

SEQ ID NO: 203908 - DNA, 20 bp, Artificial
  CRISPR gRNA sequence
agccacatatttcttgtgtt

SEQ ID NO: 203909 - DNA, 20 bp, Artificial
  CRISPR gRNA sequence
taagcttataatgctataat

SEQ ID NO: 203910 - DNA, 20 bp, Artificial
  CRISPR gRNA sequence
tataatgctataataagtcc

SEQ ID NO: 203911 - DNA, 20 bp, Artificial
  CRISPR gRNA sequence
aaaatgcttacatcaatccc

SEQ ID NO: 203912 - DNA, 20 bp, Artificial
  CRISPR gRNA sequence
acatcataaactctgtttta

SEQ ID NO: 203913 - DNA, 20 bp, Artificial
  CRISPR gRNA sequence
aaactctgttttatagatat

SEQ ID NO: 203914 - DNA, 20 bp, Artificial
  CRISPR gRNA sequence
ttttatagatattagctttt

SEQ ID NO: 203915 - DNA, 20 bp, Artificial
  CRISPR gRNA sequence
gatattagcttttcagaatc

SEQ ID NO: 203916 - DNA, 20 bp, Artificial
  CRISPR gRNA sequence
ctagcattttcctctatatg

SEQ ID NO: 203917 - DNA, 20 bp, Artificial
  CRISPR gRNA sequence
gcattttcctctatatgtag

SEQ ID NO: 203918 - DNA, 20 bp, Artificial
  CRISPR gRNA sequence
attttcctctatatgtagta

SEQ ID NO: 203919 - DNA, 20 bp, Artificial
  CRISPR gRNA sequence
gactccatatgtttgctgtt

SEQ ID NO: 203920 - DNA, 20 bp, Artificial
  CRISPR gRNA sequence
actccatatgtttgctgttg

SEQ ID NO: 203921 - DNA, 20 bp, Artificial
  CRISPR gRNA sequence
ctccatatgtttgctgttga

SEQ ID NO: 203922 - DNA, 20 bp, Artificial
  CRISPR gRNA sequence
tttgctgttgagggttgcaa

SEQ ID NO: 203923 - DNA, 20 bp, Artificial
  CRISPR gRNA sequence
ttgagggttgcaatggtcat

SEQ ID NO: 203924 - DNA, 20 bp, Artificial
  CRISPR gRNA sequence
gggttgcaatggtcataaga

SEQ ID NO: 203925 - DNA, 20 bp, Artificial
  CRISPR gRNA sequence
tggtcataagacagttttgc

SEQ ID NO: 203926 - DNA, 20 bp, Artificial
  CRISPR gRNA sequence
aagacagttttgcgagtgaa

SEQ ID NO: 203927 - DNA, 20 bp, Artificial
  CRISPR gRNA sequence
acagttttgcgagtgaatgg

SEQ ID NO: 203928 - DNA, 20 bp, Artificial
  CRISPR gRNA sequence
gacttttttttatgcttctt

SEQ ID NO: 203929 - DNA, 20 bp, Artificial
  CRISPR gRNA sequence
tttttatgcttctttggttg

SEQ ID NO: 203930 - DNA, 20 bp, Artificial
  CRISPR gRNA sequence
tttggttgtggatctctact

SEQ ID NO: 203931 - DNA, 20 bp, Artificial
  CRISPR gRNA sequence
tggttgtggatctctactga

SEQ ID NO: 203932 - DNA, 20 bp, Artificial
  CRISPR gRNA sequence
tctctactgagagatgtttt

SEQ ID NO: 203933 - DNA, 20 bp, Artificial
  CRISPR gRNA sequence
ctgaatatcttcttatgcca

SEQ ID NO: 203934 - DNA, 20 bp, Artificial
  CRISPR gRNA sequence
tatcttcttatgccaaagaa

SEQ ID NO: 203935 - DNA, 20 bp, Artificial
  CRISPR gRNA sequence
atgccaaagaaaagtcactt

SEQ ID NO: 203936 - DNA, 20 bp, Artificial
  CRISPR gRNA sequence
aaagaaaagtcacttcagta

SEQ ID NO: 203937 - DNA, 20 bp, Artificial
  CRISPR gRNA sequence
agtatagcctaaaaccctac

SEQ ID NO: 203938 - DNA, 20 bp, Artificial
  CRISPR gRNA sequence
gtatagcctaaaaccctacc

SEQ ID NO: 203939 - DNA, 20 bp, Artificial
  CRISPR gRNA sequence
accctaccaggaaaaaattt

SEQ ID NO: 203940 - DNA, 20 bp, Artificial
  CRISPR gRNA sequence
cctaccaggaaaaaattttg

SEQ ID NO: 203941 - DNA, 20 bp, Artificial
  CRISPR gRNA sequence
aaaattttggagatcatgct

SEQ ID NO: 203942 - DNA, 20 bp, Artificial
  CRISPR gRNA sequence
tttttgtatctaatccccaa

SEQ ID NO: 203943 - DNA, 20 bp, Artificial
  CRISPR gRNA sequence
tatctaatccccaatggatt

SEQ ID NO: 203944 - DNA, 20 bp, Artificial
  CRISPR gRNA sequence
taatccccaatggatttggt

SEQ ID NO: 203945 - DNA, 20 bp, Artificial
  CRISPR gRNA sequence
aatccccaatggatttggta

SEQ ID NO: 203946 - DNA, 20 bp, Artificial
  CRISPR gRNA sequence
atggatttggtaaggctgta

SEQ ID NO: 203947 - DNA, 20 bp, Artificial
  CRISPR gRNA sequence
ggtaaggctgtatggtctaa

SEQ ID NO: 203948 - DNA, 20 bp, Artificial
  CRISPR gRNA sequence
aatcctcacaattatgatgt

SEQ ID NO: 203949 - DNA, 20 bp, Artificial
  CRISPR gRNA sequence
aaattattaacccctcctta

SEQ ID NO: 203950 - DNA, 20 bp, Artificial
  CRISPR gRNA sequence
ttaacccctccttatagttg

SEQ ID NO: 203951 - DNA, 20 bp, Artificial
  CRISPR gRNA sequence
tccttatagttgtagaaact

SEQ ID NO: 203952 - DNA, 20 bp, Artificial
  CRISPR gRNA sequence
ccttatagttgtagaaactg

SEQ ID NO: 203953 - DNA, 20 bp, Artificial
  CRISPR gRNA sequence
tagttgtagaaactgaggaa

SEQ ID NO: 203954 - DNA, 20 bp, Artificial
  CRISPR gRNA sequence
aaactgaggaacagtgaatt

SEQ ID NO: 203955 - DNA, 20 bp, Artificial
  CRISPR gRNA sequence
aactgaggaacagtgaattc

SEQ ID NO: 203956 - DNA, 20 bp, Artificial
  CRISPR gRNA sequence
aacagtgaattcaggctctt

SEQ ID NO: 203957 - DNA, 20 bp, Artificial
  CRISPR gRNA sequence
ccctctcattttcctcattt

SEQ ID NO: 203958 - DNA, 20 bp, Artificial
  CRISPR gRNA sequence
cattttcctcatttcagtcg

SEQ ID NO: 203959 - DNA, 20 bp, Artificial
  CRISPR gRNA sequence
tcgtggtgaccccatttctt

SEQ ID NO: 203960 - DNA, 20 bp, Artificial
  CRISPR gRNA sequence
ccccatttcttcagttgctt

SEQ ID NO: 203961 - DNA, 20 bp, Artificial
  CRISPR gRNA sequence
cccatttcttcagttgcttg

SEQ ID NO: 203962 - DNA, 20 bp, Artificial
  CRISPR gRNA sequence
ttgcttgaggctgaaaacct

SEQ ID NO: 203963 - DNA, 20 bp, Artificial
  CRISPR gRNA sequence
gcttgaggctgaaaaccttg

SEQ ID NO: 203964 - DNA, 20 bp, Artificial
  CRISPR gRNA sequence
atttctcccacatcccactc

SEQ ID NO: 203965 - DNA, 20 bp, Artificial
  CRISPR gRNA sequence
cacatcccactctagttaaa

SEQ ID NO: 203966 - DNA, 20 bp, Artificial
  CRISPR gRNA sequence
ctgactctaccttcaaaata

SEQ ID NO: 203967 - DNA, 20 bp, Artificial
  CRISPR gRNA sequence
atagccaatatctgatctca

SEQ ID NO: 203968 - DNA, 20 bp, Artificial
  CRISPR gRNA sequence
caatatctgatctcatagtc

SEQ ID NO: 203969 - DNA, 20 bp, Artificial
  CRISPR gRNA sequence
tctgatctcatagtcaagat

SEQ ID NO: 203970 - DNA, 20 bp, Artificial
  CRISPR gRNA sequence
acaatgaaatgttctttcat

SEQ ID NO: 203971 - DNA, 20 bp, Artificial
  CRISPR gRNA sequence
ccctatacacaacaaaattt

SEQ ID NO: 203972 - DNA, 20 bp, Artificial
  CRISPR gRNA sequence
cctatacacaacaaaatttt

SEQ ID NO: 203973 - DNA, 20 bp, Artificial
  CRISPR gRNA sequence
aaaattttaggatatattaa

SEQ ID NO: 203974 - DNA, 20 bp, Artificial
  CRISPR gRNA sequence
taatttgaatatattaacaa

SEQ ID NO: 203975 - DNA, 20 bp, Artificial
  CRISPR gRNA sequence
ttgaatatattaacaaaagt

SEQ ID NO: 203976 - DNA, 20 bp, Artificial
  CRISPR gRNA sequence
gaatatattaacaaaagtaa

SEQ ID NO: 203977 - DNA, 20 bp, Artificial
  CRISPR gRNA sequence
aatatattaacaaaagtaag

SEQ ID NO: 203978 - DNA, 20 bp, Artificial
  CRISPR gRNA sequence
gtaagaggtgcattcgatcc

SEQ ID NO: 203979 - DNA, 20 bp, Artificial
  CRISPR gRNA sequence
attccacaaacacttattga

SEQ ID NO: 203980 - DNA, 20 bp, Artificial
  CRISPR gRNA sequence
cacttattgaaagcccacca

SEQ ID NO: 203981 - DNA, 20 bp, Artificial
  CRISPR gRNA sequence
acttattgaaagcccaccat

SEQ ID NO: 203982 - DNA, 20 bp, Artificial
  CRISPR gRNA sequence
cttattgaaagcccaccatg

SEQ ID NO: 203983 - DNA, 20 bp, Artificial
  CRISPR gRNA sequence
tattgaaagcccaccatggg

SEQ ID NO: 203984 - DNA, 20 bp, Artificial
  CRISPR gRNA sequence
attgaaagcccaccatgggg

SEQ ID NO: 203985 - DNA, 20 bp, Artificial
  CRISPR gRNA sequence
accatggggaggaactcctc

SEQ ID NO: 203986 - DNA, 20 bp, Artificial
  CRISPR gRNA sequence
ccatggggaggaactcctct

SEQ ID NO: 203987 - DNA, 20 bp, Artificial
  CRISPR gRNA sequence
ggaactcctctaggctcttg

SEQ ID NO: 203988 - DNA, 20 bp, Artificial
  CRISPR gRNA sequence
gaactcctctaggctcttga

SEQ ID NO: 203989 - DNA, 20 bp, Artificial
  CRISPR gRNA sequence
tcctctaggctcttgaaggc

SEQ ID NO: 203990 - DNA, 20 bp, Artificial
  CRISPR gRNA sequence
tctaggctcttgaaggccag

SEQ ID NO: 203991 - DNA, 20 bp, Artificial
  CRISPR gRNA sequence
aaggccagcagtgaacaatg

SEQ ID NO: 203992 - DNA, 20 bp, Artificial
  CRISPR gRNA sequence
ggccagcagtgaacaatgca

SEQ ID NO: 203993 - DNA, 20 bp, Artificial
  CRISPR gRNA sequence
gccagcagtgaacaatgcag

SEQ ID NO: 203994 - DNA, 20 bp, Artificial
  CRISPR gRNA sequence
tgaacaatgcagaggaccct

SEQ ID NO: 203995 - DNA, 20 bp, Artificial
  CRISPR gRNA sequence
tgcagaggaccctgagtgtg

SEQ ID NO: 203996 - DNA, 20 bp, Artificial
  CRISPR gRNA sequence
cagaggaccctgagtgtgca

SEQ ID NO: 203997 - DNA, 20 bp, Artificial
  CRISPR gRNA sequence
aggaccctgagtgtgcagag

SEQ ID NO: 203998 - DNA, 20 bp, Artificial
  CRISPR gRNA sequence
ggaccctgagtgtgcagagt

SEQ ID NO: 203999 - DNA, 20 bp, Artificial
  CRISPR gRNA sequence
accctgagtgtgcagagtgg

SEQ ID NO: 204000 - DNA, 20 bp, Artificial
  CRISPR gRNA sequence
ctgagtgtgcagagtgggag

SEQ ID NO: 204001 - DNA, 20 bp, Artificial
  CRISPR gRNA sequence
tgtgcagagtgggagaagct

SEQ ID NO: 204002 - DNA, 20 bp, Artificial
  CRISPR gRNA sequence
gtgcagagtgggagaagctg

SEQ ID NO: 204003 - DNA, 20 bp, Artificial
  CRISPR gRNA sequence
cagagtgggagaagctgagg

SEQ ID NO: 204004 - DNA, 20 bp, Artificial
  CRISPR gRNA sequence
gtgggagaagctgaggcagt

SEQ ID NO: 204005 - DNA, 20 bp, Artificial
  CRISPR gRNA sequence
tgggagaagctgaggcagta

SEQ ID NO: 204006 - DNA, 20 bp, Artificial
  CRISPR gRNA sequence
agaagctgaggcagtaagga

SEQ ID NO: 204007 - DNA, 20 bp, Artificial
  CRISPR gRNA sequence
gaagctgaggcagtaaggaa

SEQ ID NO: 204008 - DNA, 20 bp, Artificial
  CRISPR gRNA sequence
aggcagtaaggaaaggcctc

SEQ ID NO: 204009 - DNA, 20 bp, Artificial
  CRISPR gRNA sequence
ggcagtaaggaaaggcctct

SEQ ID NO: 204010 - DNA, 20 bp, Artificial
  CRISPR gRNA sequence
gcagtaaggaaaggcctcta

SEQ ID NO: 204011 - DNA, 20 bp, Artificial
  CRISPR gRNA sequence
agtaaggaaaggcctctagg

SEQ ID NO: 204012 - DNA, 20 bp, Artificial
  CRISPR gRNA sequence
taaggaaaggcctctaggga

SEQ ID NO: 204013 - DNA, 20 bp, Artificial
  CRISPR gRNA sequence
aaggaaaggcctctagggag

SEQ ID NO: 204014 - DNA, 20 bp, Artificial
  CRISPR gRNA sequence
ctagggagaggaacgaaact

SEQ ID NO: 204015 - DNA, 20 bp, Artificial
  CRISPR gRNA sequence
gagaggaacgaaactaagcc

SEQ ID NO: 204016 - DNA, 20 bp, Artificial
  CRISPR gRNA sequence
agaggaacgaaactaagcct

SEQ ID NO: 204017 - DNA, 20 bp, Artificial
  CRISPR gRNA sequence
gaacgaaactaagcctagga

SEQ ID NO: 204018 - DNA, 20 bp, Artificial
  CRISPR gRNA sequence
aacgaaactaagcctaggat

SEQ ID NO: 204019 - DNA, 20 bp, Artificial
  CRISPR gRNA sequence
gaaactaagcctaggatggg

SEQ ID NO: 204020 - DNA, 20 bp, Artificial
  CRISPR gRNA sequence
aaactaagcctaggatggga

SEQ ID NO: 204021 - DNA, 20 bp, Artificial
  CRISPR gRNA sequence
actaagcctaggatgggaag

SEQ ID NO: 204022 - DNA, 20 bp, Artificial
  CRISPR gRNA sequence
gggaaggagcctacattgtg

SEQ ID NO: 204023 - DNA, 20 bp, Artificial
  CRISPR gRNA sequence
aggagcctacattgtgaaga

SEQ ID NO: 204024 - DNA, 20 bp, Artificial
  CRISPR gRNA sequence
ggagcctacattgtgaagac

SEQ ID NO: 204025 - DNA, 20 bp, Artificial
  CRISPR gRNA sequence
gagcctacattgtgaagaca

SEQ ID NO: 204026 - DNA, 20 bp, Artificial
  CRISPR gRNA sequence
gcctacattgtgaagacagg

SEQ ID NO: 204027 - DNA, 20 bp, Artificial
  CRISPR gRNA sequence
cctacattgtgaagacaggg

SEQ ID NO: 204028 - DNA, 20 bp, Artificial
  CRISPR gRNA sequence
acattgtgaagacagggagg

SEQ ID NO: 204029 - DNA, 20 bp, Artificial
  CRISPR gRNA sequence
attgtgaagacagggaggaa

SEQ ID NO: 204030 - DNA, 20 bp, Artificial
  CRISPR gRNA sequence
acagggaggaagagatgcca

SEQ ID NO: 204031 - DNA, 20 bp, Artificial
  CRISPR gRNA sequence
cagggaggaagagatgccaa

SEQ ID NO: 204032 - DNA, 20 bp, Artificial
  CRISPR gRNA sequence
aggaagagatgccaaaggaa

SEQ ID NO: 204033 - DNA, 20 bp, Artificial
  CRISPR gRNA sequence
gccaaaggaacggcaacttt

SEQ ID NO: 204034 - DNA, 20 bp, Artificial
  CRISPR gRNA sequence
acggcaactttgagaaacca

SEQ ID NO: 204035 - DNA, 20 bp, Artificial
  CRISPR gRNA sequence
cggcaactttgagaaaccaa

SEQ ID NO: 204036 - DNA, 20 bp, Artificial
  CRISPR gRNA sequence
aactttgagaaaccaaagga

SEQ ID NO: 204037 - DNA, 20 bp, Artificial
  CRISPR gRNA sequence
caaaggatggccattgtgac

SEQ ID NO: 204038 - DNA, 20 bp, Artificial
  CRISPR gRNA sequence
tggccattgtgactggaatt

SEQ ID NO: 204039 - DNA, 20 bp, Artificial
  CRISPR gRNA sequence
tgtgactggaattcagtgat

SEQ ID NO: 204040 - DNA, 20 bp, Artificial
  CRISPR gRNA sequence
aattcagtgatgagatcaaa

SEQ ID NO: 204041 - DNA, 20 bp, Artificial
  CRISPR gRNA sequence
attcagtgatgagatcaaat

SEQ ID NO: 204042 - DNA, 20 bp, Artificial
  CRISPR gRNA sequence
cagtgatgagatcaaatggg

SEQ ID NO: 204043 - DNA, 20 bp, Artificial
  CRISPR gRNA sequence
gtgatgagatcaaatgggaa

SEQ ID NO: 204044 - DNA, 20 bp, Artificial
  CRISPR gRNA sequence
atcaaatgggaagagtttgc

SEQ ID NO: 204045 - DNA, 20 bp, Artificial
  CRISPR gRNA sequence
tcaaatgggaagagtttgct

SEQ ID NO: 204046 - DNA, 20 bp, Artificial
  CRISPR gRNA sequence
caaatgggaagagtttgctg

SEQ ID NO: 204047 - DNA, 20 bp, Artificial
  CRISPR gRNA sequence
tgggaagagtttgctggggc

SEQ ID NO: 204048 - DNA, 20 bp, Artificial
  CRISPR gRNA sequence
tttgctggggcaagaccatg

SEQ ID NO: 204049 - DNA, 20 bp, Artificial
  CRISPR gRNA sequence
tgctggggcaagaccatgta

SEQ ID NO: 204050 - DNA, 20 bp, Artificial
  CRISPR gRNA sequence
aagaccatgtagagtcttaa

SEQ ID NO: 204051 - DNA, 20 bp, Artificial
  CRISPR gRNA sequence
gtagagtcttaaaagcttgt

SEQ ID NO: 204052 - DNA, 20 bp, Artificial
  CRISPR gRNA sequence
tagagtcttaaaagcttgtt

SEQ ID NO: 204053 - DNA, 20 bp, Artificial
  CRISPR gRNA sequence
gagtcttaaaagcttgttgg

SEQ ID NO: 204054 - DNA, 20 bp, Artificial
  CRISPR gRNA sequence
gtcttaaaagcttgttggga

SEQ ID NO: 204055 - DNA, 20 bp, Artificial
  CRISPR gRNA sequence
aaaagcttgttgggagagtt

SEQ ID NO: 204056 - DNA, 20 bp, Artificial
  CRISPR gRNA sequence
gagagtttggattttattct

SEQ ID NO: 204057 - DNA, 20 bp, Artificial
  CRISPR gRNA sequence
gagtttggattttattctaa

SEQ ID NO: 204058 - DNA, 20 bp, Artificial
  CRISPR gRNA sequence
tttattctaagagcaatgac

SEQ ID NO: 204059 - DNA, 20 bp, Artificial
  CRISPR gRNA sequence
attctaagagcaatgacaag

SEQ ID NO: 204060 - DNA, 20 bp, Artificial
  CRISPR gRNA sequence
taagagcaatgacaagcggc

SEQ ID NO: 204061 - DNA, 20 bp, Artificial
  CRISPR gRNA sequence
gagcaatgacaagcggctgg

SEQ ID NO: 204062 - DNA, 20 bp, Artificial
  CRISPR gRNA sequence
agcaatgacaagcggctgga

SEQ ID NO: 204063 - DNA, 20 bp, Artificial
  CRISPR gRNA sequence
agcggctggaaggctttaaa

SEQ ID NO: 204064 - DNA, 20 bp, Artificial
  CRISPR gRNA sequence
gcggctggaaggctttaaat

SEQ ID NO: 204065 - DNA, 20 bp, Artificial
  CRISPR gRNA sequence
cggctggaaggctttaaata

SEQ ID NO: 204066 - DNA, 20 bp, Artificial
  CRISPR gRNA sequence
ctggaaggctttaaataggg

SEQ ID NO: 204067 - DNA, 20 bp, Artificial
  CRISPR gRNA sequence
gacttatttcaaatcttctt

SEQ ID NO: 204068 - DNA, 20 bp, Artificial
  CRISPR gRNA sequence
ttatttcaaatcttctttgg

SEQ ID NO: 204069 - DNA, 20 bp, Artificial
  CRISPR gRNA sequence
aatcttctttggcagccaca

SEQ ID NO: 204070 - DNA, 20 bp, Artificial
  CRISPR gRNA sequence
tcttctttggcagccacatg

SEQ ID NO: 204071 - DNA, 20 bp, Artificial
  CRISPR gRNA sequence
tttggcagccacatggagaa

SEQ ID NO: 204072 - DNA, 20 bp, Artificial
  CRISPR gRNA sequence
gccacatggagaatggatta

SEQ ID NO: 204073 - DNA, 20 bp, Artificial
  CRISPR gRNA sequence
ccacatggagaatggattac

SEQ ID NO: 204074 - DNA, 20 bp, Artificial
  CRISPR gRNA sequence
cacatggagaatggattaca

SEQ ID NO: 204075 - DNA, 20 bp, Artificial
  CRISPR gRNA sequence
atggagaatggattacaggg

SEQ ID NO: 204076 - DNA, 20 bp, Artificial
  CRISPR gRNA sequence
gagaatggattacagggaag

SEQ ID NO: 204077 - DNA, 20 bp, Artificial
  CRISPR gRNA sequence
agaatggattacagggaagc

SEQ ID NO: 204078 - DNA, 20 bp, Artificial
  CRISPR gRNA sequence
tacagggaagcaggacctgt

SEQ ID NO: 204079 - DNA, 20 bp, Artificial
  CRISPR gRNA sequence
gggaagcaggacctgtcaga

SEQ ID NO: 204080 - DNA, 20 bp, Artificial
  CRISPR gRNA sequence
caggacctgtcagaaagtta

SEQ ID NO: 204081 - DNA, 20 bp, Artificial
  CRISPR gRNA sequence
gacctgtcagaaagttacag

SEQ ID NO: 204082 - DNA, 20 bp, Artificial
  CRISPR gRNA sequence
ctgtcagaaagttacagcag

SEQ ID NO: 204083 - DNA, 20 bp, Artificial
  CRISPR gRNA sequence
aagttacagcagcagtcatt

SEQ ID NO: 204084 - DNA, 20 bp, Artificial
  CRISPR gRNA sequence
ttacagcagcagtcatttgg

SEQ ID NO: 204085 - DNA, 20 bp, Artificial
  CRISPR gRNA sequence
tacagcagcagtcatttgga

SEQ ID NO: 204086 - DNA, 20 bp, Artificial
  CRISPR gRNA sequence
acagcagcagtcatttggaa

SEQ ID NO: 204087 - DNA, 20 bp, Artificial
  CRISPR gRNA sequence
agcagcagtcatttggaagg

SEQ ID NO: 204088 - DNA, 20 bp, Artificial
  CRISPR gRNA sequence
agcagtcatttggaagggag

SEQ ID NO: 204089 - DNA, 20 bp, Artificial
  CRISPR gRNA sequence
gcagtcatttggaagggaga

SEQ ID NO: 204090 - DNA, 20 bp, Artificial
  CRISPR gRNA sequence
cagtcatttggaagggagaa

SEQ ID NO: 204091 - DNA, 20 bp, Artificial
  CRISPR gRNA sequence
aagggtgtgaccaacaaacg

SEQ ID NO: 204092 - DNA, 20 bp, Artificial
  CRISPR gRNA sequence
tgaccaacaaacgcagtcct

SEQ ID NO: 204093 - DNA, 20 bp, Artificial
  CRISPR gRNA sequence
aacaaacgcagtcctgagct

SEQ ID NO: 204094 - DNA, 20 bp, Artificial
  CRISPR gRNA sequence
agttttactcatcacatttg

SEQ ID NO: 204095 - DNA, 20 bp, Artificial
  CRISPR gRNA sequence
catcacatttgaagatctaa

SEQ ID NO: 204096 - DNA, 20 bp, Artificial
  CRISPR gRNA sequence
atcacatttgaagatctaac

SEQ ID NO: 204097 - DNA, 20 bp, Artificial
  CRISPR gRNA sequence
tcacatttgaagatctaaca

SEQ ID NO: 204098 - DNA, 20 bp, Artificial
  CRISPR gRNA sequence
tctaacagggaattgctcca

SEQ ID NO: 204099 - DNA, 20 bp, Artificial
  CRISPR gRNA sequence
ctaacagggaattgctccaa

SEQ ID NO: 204100 - DNA, 20 bp, Artificial
  CRISPR gRNA sequence
acagggaattgctccaaagg

SEQ ID NO: 204101 - DNA, 20 bp, Artificial
  CRISPR gRNA sequence
ttgctccaaaggaagatgac

SEQ ID NO: 204102 - DNA, 20 bp, Artificial
  CRISPR gRNA sequence
ccaaaggaagatgactagaa

SEQ ID NO: 204103 - DNA, 20 bp, Artificial
  CRISPR gRNA sequence
caaaggaagatgactagaat

SEQ ID NO: 204104 - DNA, 20 bp, Artificial
  CRISPR gRNA sequence
aaaggaagatgactagaatg

SEQ ID NO: 204105 - DNA, 20 bp, Artificial
  CRISPR gRNA sequence
aatggggatcccgaaaccat

SEQ ID NO: 204106 - DNA, 20 bp, Artificial
  CRISPR gRNA sequence
gatcccgaaaccatgagcaa

SEQ ID NO: 204107 - DNA, 20 bp, Artificial
  CRISPR gRNA sequence
aaaccatgagcaatggctaa

SEQ ID NO: 204108 - DNA, 20 bp, Artificial
  CRISPR gRNA sequence
atgagcaatggctaaaagaa

SEQ ID NO: 204109 - DNA, 20 bp, Artificial
  CRISPR gRNA sequence
gagcaatggctaaaagaaca

SEQ ID NO: 204110 - DNA, 20 bp, Artificial
  CRISPR gRNA sequence
aagaacagagattttcatca

SEQ ID NO: 204111 - DNA, 20 bp, Artificial
  CRISPR gRNA sequence
gaacagagattttcatcaca

SEQ ID NO: 204112 - DNA, 20 bp, Artificial
  CRISPR gRNA sequence
acagagattttcatcacaga

SEQ ID NO: 204113 - DNA, 20 bp, Artificial
  CRISPR gRNA sequence
cagagattttcatcacagag

SEQ ID NO: 204114 - DNA, 20 bp, Artificial
  CRISPR gRNA sequence
tcacagagaggtataaactt

SEQ ID NO: 204115 - DNA, 20 bp, Artificial
  CRISPR gRNA sequence
acagagaggtataaacttga

SEQ ID NO: 204116 - DNA, 20 bp, Artificial
  CRISPR gRNA sequence
taaacttgagagaaatacta

SEQ ID NO: 204117 - DNA, 20 bp, Artificial
  CRISPR gRNA sequence
gagaaatactacagccctcc

SEQ ID NO: 204118 - DNA, 20 bp, Artificial
  CRISPR gRNA sequence
aatactacagccctcccagt

SEQ ID NO: 204119 - DNA, 20 bp, Artificial
  CRISPR gRNA sequence
ctacagccctcccagtgagt

SEQ ID NO: 204120 - DNA, 20 bp, Artificial
  CRISPR gRNA sequence
gccctcccagtgagtgagaa

SEQ ID NO: 204121 - DNA, 20 bp, Artificial
  CRISPR gRNA sequence
ctcccagtgagtgagaatag

SEQ ID NO: 204122 - DNA, 20 bp, Artificial
  CRISPR gRNA sequence
cagtgagtgagaatagtagc

SEQ ID NO: 204123 - DNA, 20 bp, Artificial
  CRISPR gRNA sequence
gtgagaatagtagcaagttt

SEQ ID NO: 204124 - DNA, 20 bp, Artificial
  CRISPR gRNA sequence
agcaagttttagcttgattt

SEQ ID NO: 204125 - DNA, 20 bp, Artificial
  CRISPR gRNA sequence
gcaagttttagcttgattta

SEQ ID NO: 204126 - DNA, 20 bp, Artificial
  CRISPR gRNA sequence
agttttagcttgatttaagg

SEQ ID NO: 204127 - DNA, 20 bp, Artificial
  CRISPR gRNA sequence
gaactgaaattgcctgataa

SEQ ID NO: 204128 - DNA, 20 bp, Artificial
  CRISPR gRNA sequence
aaattgcctgataacagacc

SEQ ID NO: 204129 - DNA, 20 bp, Artificial
  CRISPR gRNA sequence
gataacagaccaagatcctc

SEQ ID NO: 204130 - DNA, 20 bp, Artificial
  CRISPR gRNA sequence
ataacagaccaagatcctct

SEQ ID NO: 204131 - DNA, 20 bp, Artificial
  CRISPR gRNA sequence
acagaccaagatcctctggg

SEQ ID NO: 204132 - DNA, 20 bp, Artificial
  CRISPR gRNA sequence
taataatgtctcatcatgtc

SEQ ID NO: 204133 - DNA, 20 bp, Artificial
  CRISPR gRNA sequence
gtctcatcatgtcaagcttt

SEQ ID NO: 204134 - DNA, 20 bp, Artificial
  CRISPR gRNA sequence
cagtaaaaaatctgaatcgc

SEQ ID NO: 204135 - DNA, 20 bp, Artificial
  CRISPR gRNA sequence
aatctgaatcgccagctact

SEQ ID NO: 204136 - DNA, 20 bp, Artificial
  CRISPR gRNA sequence
atctgaatcgccagctactt

SEQ ID NO: 204137 - DNA, 20 bp, Artificial
  CRISPR gRNA sequence
tctgaatcgccagctacttg

SEQ ID NO: 204138 - DNA, 20 bp, Artificial
  CRISPR gRNA sequence
gccagctacttggggtgtga

SEQ ID NO: 204139 - DNA, 20 bp, Artificial
  CRISPR gRNA sequence
gatagaaataattcgtaaat

SEQ ID NO: 204140 - DNA, 20 bp, Artificial
  CRISPR gRNA sequence
taattcgtaaattagatgat

SEQ ID NO: 204141 - DNA, 20 bp, Artificial
  CRISPR gRNA sequence
tcgtaaattagatgatgaga

SEQ ID NO: 204142 - DNA, 20 bp, Artificial
  CRISPR gRNA sequence
aattagatgatgagatagac

SEQ ID NO: 204143 - DNA, 20 bp, Artificial
  CRISPR gRNA sequence
gatgactacttgatgactcc

SEQ ID NO: 204144 - DNA, 20 bp, Artificial
  CRISPR gRNA sequence
tcccagattctatgtgaaac

SEQ ID NO: 204145 - DNA, 20 bp, Artificial
  CRISPR gRNA sequence
ctatgtgaaacaagaaatat

SEQ ID NO: 204146 - DNA, 20 bp, Artificial
  CRISPR gRNA sequence
aatatgagacatttcaatga

SEQ ID NO: 204147 - DNA, 20 bp, Artificial
  CRISPR gRNA sequence
tatgagacatttcaatgaca

SEQ ID NO: 204148 - DNA, 20 bp, Artificial
  CRISPR gRNA sequence
tgagacatttcaatgacaga

SEQ ID NO: 204149 - DNA, 20 bp, Artificial
  CRISPR gRNA sequence
gagacatttcaatgacagag

SEQ ID NO: 204150 - DNA, 20 bp, Artificial
  CRISPR gRNA sequence
acatttcaatgacagagagg

SEQ ID NO: 204151 - DNA, 20 bp, Artificial
  CRISPR gRNA sequence
aatgacagagaggaagatta

SEQ ID NO: 204152 - DNA, 20 bp, Artificial
  CRISPR gRNA sequence
cagaacaaaaaatactgtct

SEQ ID NO: 204153 - DNA, 20 bp, Artificial
  CRISPR gRNA sequence
attcttttttttttattttt

SEQ ID NO: 204154 - DNA, 20 bp, Artificial
  CRISPR gRNA sequence
ttttttttttatttttgaga

SEQ ID NO: 204155 - DNA, 20 bp, Artificial
  CRISPR gRNA sequence
ttttttttatttttgagatg

SEQ ID NO: 204156 - DNA, 20 bp, Artificial
  CRISPR gRNA sequence
tggagtctcactctgttgcc

SEQ ID NO: 204157 - DNA, 20 bp, Artificial
  CRISPR gRNA sequence
ggagtctcactctgttgccc

SEQ ID NO: 204158 - DNA, 20 bp, Artificial
  CRISPR gRNA sequence
tctcactctgttgcccaggc

SEQ ID NO: 204159 - DNA, 20 bp, Artificial
  CRISPR gRNA sequence
tcactctgttgcccaggctg

SEQ ID NO: 204160 - DNA, 20 bp, Artificial
  CRISPR gRNA sequence
ctgttgcccaggctggagtg

SEQ ID NO: 204161 - DNA, 20 bp, Artificial
  CRISPR gRNA sequence
ttgcccaggctggagtgcag

SEQ ID NO: 204162 - DNA, 20 bp, Artificial
  CRISPR gRNA sequence
caggctggagtgcagtggtg

SEQ ID NO: 204163 - DNA, 20 bp, Artificial
  CRISPR gRNA sequence
ggagtgcagtggtgtggtct

SEQ ID NO: 204164 - DNA, 20 bp, Artificial
  CRISPR gRNA sequence
tcactgcaacctccacctcc

SEQ ID NO: 204165 - DNA, 20 bp, Artificial
  CRISPR gRNA sequence
cactgcaacctccacctccc

SEQ ID NO: 204166 - DNA, 20 bp, Artificial
  CRISPR gRNA sequence
aacctccacctcccgggttc

SEQ ID NO: 204167 - DNA, 20 bp, Artificial
  CRISPR gRNA sequence
ttcaagcaattctcctgtct

SEQ ID NO: 204168 - DNA, 20 bp, Artificial
  CRISPR gRNA sequence
ttctcctgtctcagcctccc

SEQ ID NO: 204169 - DNA, 20 bp, Artificial
  CRISPR gRNA sequence
tcctgtctcagcctcccaag

SEQ ID NO: 204170 - DNA, 20 bp, Artificial
  CRISPR gRNA sequence
gtctcagcctcccaagtagc

SEQ ID NO: 204171 - DNA, 20 bp, Artificial
  CRISPR gRNA sequence
tctcagcctcccaagtagct

SEQ ID NO: 204172 - DNA, 20 bp, Artificial
  CRISPR gRNA sequence
ctcccaagtagctgggatta

SEQ ID NO: 204173 - DNA, 20 bp, Artificial
  CRISPR gRNA sequence
tcccaagtagctgggattat

SEQ ID NO: 204174 - DNA, 20 bp, Artificial
  CRISPR gRNA sequence
caagtagctgggattatagg

SEQ ID NO: 204175 - DNA, 20 bp, Artificial
  CRISPR gRNA sequence
aagtagctgggattataggc

SEQ ID NO: 204176 - DNA, 20 bp, Artificial
  CRISPR gRNA sequence
taggcaggcgccaccatgcc

SEQ ID NO: 204177 - DNA, 20 bp, Artificial
  CRISPR gRNA sequence
ccagctaaattttgtaattt

SEQ ID NO: 204178 - DNA, 20 bp, Artificial
  CRISPR gRNA sequence
gctaaattttgtaattttgg

SEQ ID NO: 204179 - DNA, 20 bp, Artificial
  CRISPR gRNA sequence
taaattttgtaattttggta

SEQ ID NO: 204180 - DNA, 20 bp, Artificial
  CRISPR gRNA sequence
ttttgtaattttggtagaga

SEQ ID NO: 204181 - DNA, 20 bp, Artificial
  CRISPR gRNA sequence
tttgtaattttggtagagac

SEQ ID NO: 204182 - DNA, 20 bp, Artificial
  CRISPR gRNA sequence
ttgtaattttggtagagaca

SEQ ID NO: 204183 - DNA, 20 bp, Artificial
  CRISPR gRNA sequence
gagacagggttttatcatgt

SEQ ID NO: 204184 - DNA, 20 bp, Artificial
  CRISPR gRNA sequence
cagggttttatcatgttggc

SEQ ID NO: 204185 - DNA, 20 bp, Artificial
  CRISPR gRNA sequence
agggttttatcatgttggcc

SEQ ID NO: 204186 - DNA, 20 bp, Artificial
  CRISPR gRNA sequence
ttttatcatgttggccaggc

SEQ ID NO: 204187 - DNA, 20 bp, Artificial
  CRISPR gRNA sequence
tggtctcaaattcctgacct

SEQ ID NO: 204188 - DNA, 20 bp, Artificial
  CRISPR gRNA sequence
ggtctcaaattcctgacctc

SEQ ID NO: 204189 - DNA, 20 bp, Artificial
  CRISPR gRNA sequence
ctcaggtgatccacctgcct

SEQ ID NO: 204190 - DNA, 20 bp, Artificial
  CRISPR gRNA sequence
ccacctgcctcagcctccca

SEQ ID NO: 204191 - DNA, 20 bp, Artificial
  CRISPR gRNA sequence
gcctcagcctcccaaagtgc

SEQ ID NO: 204192 - DNA, 20 bp, Artificial
  CRISPR gRNA sequence
ctcccaaagtgctggtatta

SEQ ID NO: 204193 - DNA, 20 bp, Artificial
  CRISPR gRNA sequence
tcccaaagtgctggtattac

SEQ ID NO: 204194 - DNA, 20 bp, Artificial
  CRISPR gRNA sequence
aagtgctggtattacaggcg

SEQ ID NO: 204195 - DNA, 20 bp, Artificial
  CRISPR gRNA sequence
agtgctggtattacaggcgt

SEQ ID NO: 204196 - DNA, 20 bp, Artificial
  CRISPR gRNA sequence
caggcgtgggctgccacacc

SEQ ID NO: 204197 - DNA, 20 bp, Artificial
  CRISPR gRNA sequence
ctgccacacctggcctgtct

SEQ ID NO: 204198 - DNA, 20 bp, Artificial
  CRISPR gRNA sequence
ctgtctaagtgattcttaac

SEQ ID NO: 204199 - DNA, 20 bp, Artificial
  CRISPR gRNA sequence
gattcttaactggaacttat

SEQ ID NO: 204200 - DNA, 20 bp, Artificial
  CRISPR gRNA sequence
ctcccttctcattattgtgc

SEQ ID NO: 204201 - DNA, 20 bp, Artificial
  CRISPR gRNA sequence
tcccttctcattattgtgcc

SEQ ID NO: 204202 - DNA, 20 bp, Artificial
  CRISPR gRNA sequence
ttaaattgttccctgatatg

SEQ ID NO: 204203 - DNA, 20 bp, Artificial
  CRISPR gRNA sequence
taaattgttccctgatatgt

SEQ ID NO: 204204 - DNA, 20 bp, Artificial
  CRISPR gRNA sequence
aaattgttccctgatatgtg

SEQ ID NO: 204205 - DNA, 20 bp, Artificial
  CRISPR gRNA sequence
ttgttccctgatatgtgggg

SEQ ID NO: 204206 - DNA, 20 bp, Artificial
  CRISPR gRNA sequence
tgttccctgatatgtggggc

SEQ ID NO: 204207 - DNA, 20 bp, Artificial
  CRISPR gRNA sequence
tccctgatatgtggggcggg

SEQ ID NO: 204208 - DNA, 20 bp, Artificial
  CRISPR gRNA sequence
ccctgatatgtggggcgggt

SEQ ID NO: 204209 - DNA, 20 bp, Artificial
  CRISPR gRNA sequence
cctgatatgtggggcgggtg

SEQ ID NO: 204210 - DNA, 20 bp, Artificial
  CRISPR gRNA sequence
ctgatatgtggggcgggtgg

SEQ ID NO: 204211 - DNA, 20 bp, Artificial
  CRISPR gRNA sequence
tgatatgtggggcgggtggg

SEQ ID NO: 204212 - DNA, 20 bp, Artificial
  CRISPR gRNA sequence
gatatgtggggcgggtgggg

SEQ ID NO: 204213 - DNA, 20 bp, Artificial
  CRISPR gRNA sequence
atatgtggggcgggtggggg

SEQ ID NO: 204214 - DNA, 20 bp, Artificial
  CRISPR gRNA sequence
tatgtggggcgggtgggggg

SEQ ID NO: 204215 - DNA, 20 bp, Artificial
  CRISPR gRNA sequence
atgtggggcgggtggggggg

SEQ ID NO: 204216 - DNA, 20 bp, Artificial
  CRISPR gRNA sequence
tgtggggcgggtgggggggg

SEQ ID NO: 204217 - DNA, 20 bp, Artificial
  CRISPR gRNA sequence
gtggggcgggtggggggggg

SEQ ID NO: 204218 - DNA, 20 bp, Artificial
  CRISPR gRNA sequence
tggggggggggggcacacaa

SEQ ID NO: 204219 - DNA, 20 bp, Artificial
  CRISPR gRNA sequence
gggggggggggcacacaatg

SEQ ID NO: 204220 - DNA, 20 bp, Artificial
  CRISPR gRNA sequence
ggggggggcacacaatggag

SEQ ID NO: 204221 - DNA, 20 bp, Artificial
  CRISPR gRNA sequence
gggggggcacacaatggaga

SEQ ID NO: 204222 - DNA, 20 bp, Artificial
  CRISPR gRNA sequence
ggggggcacacaatggagaa

SEQ ID NO: 204223 - DNA, 20 bp, Artificial
  CRISPR gRNA sequence
acacaatggagaagggcatc

SEQ ID NO: 204224 - DNA, 20 bp, Artificial
  CRISPR gRNA sequence
cacaatggagaagggcatcc

SEQ ID NO: 204225 - DNA, 20 bp, Artificial
  CRISPR gRNA sequence
aagggcatccaggattctct

SEQ ID NO: 204226 - DNA, 20 bp, Artificial
  CRISPR gRNA sequence
tttctgctgtatttgaacta

SEQ ID NO: 204227 - DNA, 20 bp, Artificial
  CRISPR gRNA sequence
ctcctctctctaatttgtta

SEQ ID NO: 204228 - DNA, 20 bp, Artificial
  CRISPR gRNA sequence
ctctctctaatttgttacag

SEQ ID NO: 204229 - DNA, 20 bp, Artificial
  CRISPR gRNA sequence
tctctctaatttgttacagt

SEQ ID NO: 204230 - DNA, 20 bp, Artificial
  CRISPR gRNA sequence
ctaatttgttacagtgggaa

SEQ ID NO: 204231 - DNA, 20 bp, Artificial
  CRISPR gRNA sequence
tgttacagtgggaaaagttt

SEQ ID NO: 204232 - DNA, 20 bp, Artificial
  CRISPR gRNA sequence
gttacagtgggaaaagtttg

SEQ ID NO: 204233 - DNA, 20 bp, Artificial
  CRISPR gRNA sequence
tgggaaaagtttgaggatca

SEQ ID NO: 204234 - DNA, 20 bp, Artificial
  CRISPR gRNA sequence
aagtttgaggatcatggaat

SEQ ID NO: 204235 - DNA, 20 bp, Artificial
  CRISPR gRNA sequence
gatcatggaattagatattt

SEQ ID NO: 204236 - DNA, 20 bp, Artificial
  CRISPR gRNA sequence
tagatatttaagaaccaact

SEQ ID NO: 204237 - DNA, 20 bp, Artificial
  CRISPR gRNA sequence
ttaagaaccaactgagatgc

SEQ ID NO: 204238 - DNA, 20 bp, Artificial
  CRISPR gRNA sequence
taagaaccaactgagatgct

SEQ ID NO: 204239 - DNA, 20 bp, Artificial
  CRISPR gRNA sequence
aagaaccaactgagatgctg

SEQ ID NO: 204240 - DNA, 20 bp, Artificial
  CRISPR gRNA sequence
agaaccaactgagatgctgg

SEQ ID NO: 204241 - DNA, 20 bp, Artificial
  CRISPR gRNA sequence
aaaaaccaacattttatata

SEQ ID NO: 204242 - DNA, 20 bp, Artificial
  CRISPR gRNA sequence
aagccacttatatgcctatt

SEQ ID NO: 204243 - DNA, 20 bp, Artificial
  CRISPR gRNA sequence
attaagctattgatttgtta

SEQ ID NO: 204244 - DNA, 20 bp, Artificial
  CRISPR gRNA sequence
aagctattgatttgttatgg

SEQ ID NO: 204245 - DNA, 20 bp, Artificial
  CRISPR gRNA sequence
atttgttatggtagtactgt

SEQ ID NO: 204246 - DNA, 20 bp, Artificial
  CRISPR gRNA sequence
gacgttaactcttgttcctc

SEQ ID NO: 204247 - DNA, 20 bp, Artificial
  CRISPR gRNA sequence
acgttaactcttgttcctca

SEQ ID NO: 204248 - DNA, 20 bp, Artificial
  CRISPR gRNA sequence
cgttaactcttgttcctcaa

SEQ ID NO: 204249 - DNA, 20 bp, Artificial
  CRISPR gRNA sequence
gttaactcttgttcctcaag

SEQ ID NO: 204250 - DNA, 20 bp, Artificial
  CRISPR gRNA sequence
taactcttgttcctcaaggg

SEQ ID NO: 204251 - DNA, 20 bp, Artificial
  CRISPR gRNA sequence
actcttgttcctcaagggga

SEQ ID NO: 204252 - DNA, 20 bp, Artificial
  CRISPR gRNA sequence
ttgttcctcaaggggagagt

SEQ ID NO: 204253 - DNA, 20 bp, Artificial
  CRISPR gRNA sequence
gtgagacatgatacttcttt

SEQ ID NO: 204254 - DNA, 20 bp, Artificial
  CRISPR gRNA sequence
ctctgaatttctatgccact

SEQ ID NO: 204255 - DNA, 20 bp, Artificial
  CRISPR gRNA sequence
tgccactaagaacataaatt

SEQ ID NO: 204256 - DNA, 20 bp, Artificial
  CRISPR gRNA sequence
aacataaattaagcttaaaa

SEQ ID NO: 204257 - DNA, 20 bp, Artificial
  CRISPR gRNA sequence
aattaagcttaaaatggact

SEQ ID NO: 204258 - DNA, 20 bp, Artificial
  CRISPR gRNA sequence
aaatggactaagaacaatgt

SEQ ID NO: 204259 - DNA, 20 bp, Artificial
  CRISPR gRNA sequence
gtcagatatttttccatcac

SEQ ID NO: 204260 - DNA, 20 bp, Artificial
  CRISPR gRNA sequence
tttccatcacaagattaata

SEQ ID NO: 204261 - DNA, 20 bp, Artificial
  CRISPR gRNA sequence
atcacaagattaataaagat

SEQ ID NO: 204262 - DNA, 20 bp, Artificial
  CRISPR gRNA sequence
aagattaataaagataagcc

SEQ ID NO: 204263 - DNA, 20 bp, Artificial
  CRISPR gRNA sequence
agattaataaagataagcca

SEQ ID NO: 204264 - DNA, 20 bp, Artificial
  CRISPR gRNA sequence
ttcacatccttattctaccc

SEQ ID NO: 204265 - DNA, 20 bp, Artificial
  CRISPR gRNA sequence
tccttattctacccaagcta

SEQ ID NO: 204266 - DNA, 20 bp, Artificial
  CRISPR gRNA sequence
tatcactctcctccaattcc

SEQ ID NO: 204267 - DNA, 20 bp, Artificial
  CRISPR gRNA sequence
actctcctccaattcctgga

SEQ ID NO: 204268 - DNA, 20 bp, Artificial
  CRISPR gRNA sequence
ctctcctccaattcctggac

SEQ ID NO: 204269 - DNA, 20 bp, Artificial
  CRISPR gRNA sequence
tcctccaattcctggacagg

SEQ ID NO: 204270 - DNA, 20 bp, Artificial
  CRISPR gRNA sequence
caattcctggacaggcagaa

SEQ ID NO: 204271 - DNA, 20 bp, Artificial
  CRISPR gRNA sequence
cacgaaaatgaacttcttgc

SEQ ID NO: 204272 - DNA, 20 bp, Artificial
  CRISPR gRNA sequence
gaaaatgaacttcttgctag

SEQ ID NO: 204273 - DNA, 20 bp, Artificial
  CRISPR gRNA sequence
atgaacttcttgctagtgga

SEQ ID NO: 204274 - DNA, 20 bp, Artificial
  CRISPR gRNA sequence
tgaacttcttgctagtggaa

SEQ ID NO: 204275 - DNA, 20 bp, Artificial
  CRISPR gRNA sequence
ttcttgctagtggaaaggca

SEQ ID NO: 204276 - DNA, 20 bp, Artificial
  CRISPR gRNA sequence
ttgctagtggaaaggcaaag

SEQ ID NO: 204277 - DNA, 20 bp, Artificial
  CRISPR gRNA sequence
aggcaaagaagtgatattac

SEQ ID NO: 204278 - DNA, 20 bp, Artificial
  CRISPR gRNA sequence
ggcaaagaagtgatattaca

SEQ ID NO: 204279 - DNA, 20 bp, Artificial
  CRISPR gRNA sequence
gcaaagaagtgatattacaa

SEQ ID NO: 204280 - DNA, 20 bp, Artificial
  CRISPR gRNA sequence
gaagtgatattacaagggtg

SEQ ID NO: 204281 - DNA, 20 bp, Artificial
  CRISPR gRNA sequence
caagggtgtagtcaatgaat

SEQ ID NO: 204282 - DNA, 20 bp, Artificial
  CRISPR gRNA sequence
agtgtttaatttttgctttc

SEQ ID NO: 204283 - DNA, 20 bp, Artificial
  CRISPR gRNA sequence
taatttttgctttcaagctg

SEQ ID NO: 204284 - DNA, 20 bp, Artificial
  CRISPR gRNA sequence
gctgaagtgttattaaaacc

SEQ ID NO: 204285 - DNA, 20 bp, Artificial
  CRISPR gRNA sequence
ctgaagtgttattaaaaccc

SEQ ID NO: 204286 - DNA, 20 bp, Artificial
  CRISPR gRNA sequence
tcttatcactgtacaaaaat

SEQ ID NO: 204287 - DNA, 20 bp, Artificial
  CRISPR gRNA sequence
aaaaatgagacaacctaaaa

SEQ ID NO: 204288 - DNA, 20 bp, Artificial
  CRISPR gRNA sequence
tgagacaacctaaaaaagtg

SEQ ID NO: 204289 - DNA, 20 bp, Artificial
  CRISPR gRNA sequence
agacaccattcctatcaaca

SEQ ID NO: 204290 - DNA, 20 bp, Artificial
  CRISPR gRNA sequence
ccttcaaactcccacaaaca

SEQ ID NO: 204291 - DNA, 20 bp, Artificial
  CRISPR gRNA sequence
cttcaaactcccacaaacat

SEQ ID NO: 204292 - DNA, 20 bp, Artificial
  CRISPR gRNA sequence
ttcaaactcccacaaacata

SEQ ID NO: 204293 - DNA, 20 bp, Artificial
  CRISPR gRNA sequence
cccacaaacatagggaacac

SEQ ID NO: 204294 - DNA, 20 bp, Artificial
  CRISPR gRNA sequence
ccacaaacatagggaacacc

SEQ ID NO: 204295 - DNA, 20 bp, Artificial
  CRISPR gRNA sequence
acacacacacgcatacacca

SEQ ID NO: 204296 - DNA, 20 bp, Artificial
  CRISPR gRNA sequence
caaatttttacttgatgttt

SEQ ID NO: 204297 - DNA, 20 bp, Artificial
  CRISPR gRNA sequence
aaatttttacttgatgtttc

SEQ ID NO: 204298 - DNA, 20 bp, Artificial
  CRISPR gRNA sequence
ttgatgtttcaggattgtga

SEQ ID NO: 204299 - DNA, 20 bp, Artificial
  CRISPR gRNA sequence
tttctgatgtgtcgacttgc

SEQ ID NO: 204300 - DNA, 20 bp, Artificial
  CRISPR gRNA sequence
ttctgatgtgtcgacttgct

SEQ ID NO: 204301 - DNA, 20 bp, Artificial
  CRISPR gRNA sequence
tgtgtcgacttgctaggcta

SEQ ID NO: 204302 - DNA, 20 bp, Artificial
  CRISPR gRNA sequence
attatttatttaatcaaacc

SEQ ID NO: 204303 - DNA, 20 bp, Artificial
  CRISPR gRNA sequence
ttaatcaaacccagaattct

SEQ ID NO: 204304 - DNA, 20 bp, Artificial
  CRISPR gRNA sequence
taatcaaacccagaattcta

SEQ ID NO: 204305 - DNA, 20 bp, Artificial
  CRISPR gRNA sequence
tcaaacccagaattctaagg

SEQ ID NO: 204306 - DNA, 20 bp, Artificial
  CRISPR gRNA sequence
tggtcccaaaacccctgccc

SEQ ID NO: 204307 - DNA, 20 bp, Artificial
  CRISPR gRNA sequence
taattccctccccttgtgtg

SEQ ID NO: 204308 - DNA, 20 bp, Artificial
  CRISPR gRNA sequence
aattccctccccttgtgtgt

SEQ ID NO: 204309 - DNA, 20 bp, Artificial
  CRISPR gRNA sequence
ttccctccccttgtgtgtgg

SEQ ID NO: 204310 - DNA, 20 bp, Artificial
  CRISPR gRNA sequence
tccccttgtgtgtgggagac

SEQ ID NO: 204311 - DNA, 20 bp, Artificial
  CRISPR gRNA sequence
ccccttgtgtgtgggagact

SEQ ID NO: 204312 - DNA, 20 bp, Artificial
  CRISPR gRNA sequence
gactaggactgtgaatgtat

SEQ ID NO: 204313 - DNA, 20 bp, Artificial
  CRISPR gRNA sequence
attttcatgattatatcacc

SEQ ID NO: 204314 - DNA, 20 bp, Artificial
  CRISPR gRNA sequence
atgattatatcacccagcaa

SEQ ID NO: 204315 - DNA, 20 bp, Artificial
  CRISPR gRNA sequence
tgattatatcacccagcaaa

SEQ ID NO: 204316 - DNA, 20 bp, Artificial
  CRISPR gRNA sequence
gattatatcacccagcaaaa

SEQ ID NO: 204317 - DNA, 20 bp, Artificial
  CRISPR gRNA sequence
ttatatcacccagcaaaagg

SEQ ID NO: 204318 - DNA, 20 bp, Artificial
  CRISPR gRNA sequence
gggagtttgctgatgtaatt

SEQ ID NO: 204319 - DNA, 20 bp, Artificial
  CRISPR gRNA sequence
atgtaattaagatcccaaat

SEQ ID NO: 204320 - DNA, 20 bp, Artificial
  CRISPR gRNA sequence
atcccaaatcagctgacttt

SEQ ID NO: 204321 - DNA, 20 bp, Artificial
  CRISPR gRNA sequence
caaatcagctgactttaaga

SEQ ID NO: 204322 - DNA, 20 bp, Artificial
  CRISPR gRNA sequence
aatcagctgactttaagaaa

SEQ ID NO: 204323 - DNA, 20 bp, Artificial
  CRISPR gRNA sequence
tcagctgactttaagaaaga

SEQ ID NO: 204324 - DNA, 20 bp, Artificial
  CRISPR gRNA sequence
aagaaagagagattattttt

SEQ ID NO: 204325 - DNA, 20 bp, Artificial
  CRISPR gRNA sequence
agaaagagagattatttttg

SEQ ID NO: 204326 - DNA, 20 bp, Artificial
  CRISPR gRNA sequence
gaaagagagattatttttga

SEQ ID NO: 204327 - DNA, 20 bp, Artificial
  CRISPR gRNA sequence
aagagagattatttttgagg

SEQ ID NO: 204328 - DNA, 20 bp, Artificial
  CRISPR gRNA sequence
gagagattatttttgaggga

SEQ ID NO: 204329 - DNA, 20 bp, Artificial
  CRISPR gRNA sequence
gagattatttttgagggaga

SEQ ID NO: 204330 - DNA, 20 bp, Artificial
  CRISPR gRNA sequence
gattatttttgagggagaga

SEQ ID NO: 204331 - DNA, 20 bp, Artificial
  CRISPR gRNA sequence
gagagagagctgacctaacc

SEQ ID NO: 204332 - DNA, 20 bp, Artificial
  CRISPR gRNA sequence
agagagctgacctaaccaag

SEQ ID NO: 204333 - DNA, 20 bp, Artificial
  CRISPR gRNA sequence
ctaaccaagtggtctcttaa

SEQ ID NO: 204334 - DNA, 20 bp, Artificial
  CRISPR gRNA sequence
taaccaagtggtctcttaaa

SEQ ID NO: 204335 - DNA, 20 bp, Artificial
  CRISPR gRNA sequence
aaccaagtggtctcttaaaa

SEQ ID NO: 204336 - DNA, 20 bp, Artificial
  CRISPR gRNA sequence
agtggtctcttaaaagggtc

SEQ ID NO: 204337 - DNA, 20 bp, Artificial
  CRISPR gRNA sequence
gtggtctcttaaaagggtct

SEQ ID NO: 204338 - DNA, 20 bp, Artificial
  CRISPR gRNA sequence
aaaagggtctgggttcttcc

SEQ ID NO: 204339 - DNA, 20 bp, Artificial
  CRISPR gRNA sequence
gcaaaataaactcaatatgt

SEQ ID NO: 204340 - DNA, 20 bp, Artificial
  CRISPR gRNA sequence
aaaataaactcaatatgtga

SEQ ID NO: 204341 - DNA, 20 bp, Artificial
  CRISPR gRNA sequence
aaataaactcaatatgtgag

SEQ ID NO: 204342 - DNA, 20 bp, Artificial
  CRISPR gRNA sequence
aataaactcaatatgtgaga

SEQ ID NO: 204343 - DNA, 20 bp, Artificial
  CRISPR gRNA sequence
atatgtgagagggattcaac

SEQ ID NO: 204344 - DNA, 20 bp, Artificial
  CRISPR gRNA sequence
atgtgagagggattcaacaa

SEQ ID NO: 204345 - DNA, 20 bp, Artificial
  CRISPR gRNA sequence
tgtgagagggattcaacaag

SEQ ID NO: 204346 - DNA, 20 bp, Artificial
  CRISPR gRNA sequence
gagagggattcaacaagagg

SEQ ID NO: 204347 - DNA, 20 bp, Artificial
  CRISPR gRNA sequence
agaggaagattctcctttgc

SEQ ID NO: 204348 - DNA, 20 bp, Artificial
  CRISPR gRNA sequence
tttgctggctttaaatatgc

SEQ ID NO: 204349 - DNA, 20 bp, Artificial
  CRISPR gRNA sequence
ttgctggctttaaatatgca

SEQ ID NO: 204350 - DNA, 20 bp, Artificial
  CRISPR gRNA sequence
tgctggctttaaatatgcaa

SEQ ID NO: 204351 - DNA, 20 bp, Artificial
  CRISPR gRNA sequence
gctggctttaaatatgcaag

SEQ ID NO: 204352 - DNA, 20 bp, Artificial
  CRISPR gRNA sequence
tttaaatatgcaaggggcca

SEQ ID NO: 204353 - DNA, 20 bp, Artificial
  CRISPR gRNA sequence
ttaaatatgcaaggggccat

SEQ ID NO: 204354 - DNA, 20 bp, Artificial
  CRISPR gRNA sequence
taaatatgcaaggggccatg

SEQ ID NO: 204355 - DNA, 20 bp, Artificial
  CRISPR gRNA sequence
tatgcaaggggccatggggc

SEQ ID NO: 204356 - DNA, 20 bp, Artificial
  CRISPR gRNA sequence
ggggccatggggcaagaaat

SEQ ID NO: 204357 - DNA, 20 bp, Artificial
  CRISPR gRNA sequence
gggccatggggcaagaaatg

SEQ ID NO: 204358 - DNA, 20 bp, Artificial
  CRISPR gRNA sequence
ggccatggggcaagaaatga

SEQ ID NO: 204359 - DNA, 20 bp, Artificial
  CRISPR gRNA sequence
caagaaatgagggcaatctc

SEQ ID NO: 204360 - DNA, 20 bp, Artificial
  CRISPR gRNA sequence
aagaaatgagggcaatctct

SEQ ID NO: 204361 - DNA, 20 bp, Artificial
  CRISPR gRNA sequence
gaaatgagggcaatctctag

SEQ ID NO: 204362 - DNA, 20 bp, Artificial
  CRISPR gRNA sequence
taggagctgctacaattcct

SEQ ID NO: 204363 - DNA, 20 bp, Artificial
  CRISPR gRNA sequence
gagctgctacaattccttgg

SEQ ID NO: 204364 - DNA, 20 bp, Artificial
  CRISPR gRNA sequence
acaattccttggcagatact

SEQ ID NO: 204365 - DNA, 20 bp, Artificial
  CRISPR gRNA sequence
tccttggcagatacttagca

SEQ ID NO: 204366 - DNA, 20 bp, Artificial
  CRISPR gRNA sequence
gcagatacttagcaaagaaa

SEQ ID NO: 204367 - DNA, 20 bp, Artificial
  CRISPR gRNA sequence
cagatacttagcaaagaaac

SEQ ID NO: 204368 - DNA, 20 bp, Artificial
  CRISPR gRNA sequence
agatacttagcaaagaaaca

SEQ ID NO: 204369 - DNA, 20 bp, Artificial
  CRISPR gRNA sequence
tagcaaagaaacagggaccc

SEQ ID NO: 204370 - DNA, 20 bp, Artificial
  CRISPR gRNA sequence
gaccccagtcttacaatcac

SEQ ID NO: 204371 - DNA, 20 bp, Artificial
  CRISPR gRNA sequence
accccagtcttacaatcaca

SEQ ID NO: 204372 - DNA, 20 bp, Artificial
  CRISPR gRNA sequence
gaattctgtcacaattatgt

SEQ ID NO: 204373 - DNA, 20 bp, Artificial
  CRISPR gRNA sequence
ctgtcacaattatgtgagcc

SEQ ID NO: 204374 - DNA, 20 bp, Artificial
  CRISPR gRNA sequence
caattatgtgagcctagaac

SEQ ID NO: 204375 - DNA, 20 bp, Artificial
  CRISPR gRNA sequence
aagaccccaaactccaaata

SEQ ID NO: 204376 - DNA, 20 bp, Artificial
  CRISPR gRNA sequence
actccaaataaagtatgccc

SEQ ID NO: 204377 - DNA, 20 bp, Artificial
  CRISPR gRNA sequence
ctccaaataaagtatgccct

SEQ ID NO: 204378 - DNA, 20 bp, Artificial
  CRISPR gRNA sequence
cctgggcaacaccttgattt

SEQ ID NO: 204379 - DNA, 20 bp, Artificial
  CRISPR gRNA sequence
caccttgattttagtctttt

SEQ ID NO: 204380 - DNA, 20 bp, Artificial
  CRISPR gRNA sequence
tagtcttttaagactttgat

SEQ ID NO: 204381 - DNA, 20 bp, Artificial
  CRISPR gRNA sequence
gtcttttaagactttgatca

SEQ ID NO: 204382 - DNA, 20 bp, Artificial
  CRISPR gRNA sequence
aagactttgatcagagaacc

SEQ ID NO: 204383 - DNA, 20 bp, Artificial
  CRISPR gRNA sequence
gaacccagtcatgccatgac

SEQ ID NO: 204384 - DNA, 20 bp, Artificial
  CRISPR gRNA sequence
aacccagtcatgccatgacc

SEQ ID NO: 204385 - DNA, 20 bp, Artificial
  CRISPR gRNA sequence
cttgccacctacaaaacttt

SEQ ID NO: 204386 - DNA, 20 bp, Artificial
  CRISPR gRNA sequence
caaaactttgagctaaaaaa

SEQ ID NO: 204387 - DNA, 20 bp, Artificial
  CRISPR gRNA sequence
aaaactttgagctaaaaaat

SEQ ID NO: 204388 - DNA, 20 bp, Artificial
  CRISPR gRNA sequence
actttgagctaaaaaatggg

SEQ ID NO: 204389 - DNA, 20 bp, Artificial
  CRISPR gRNA sequence
taaaaaatgggtagtgtttt

SEQ ID NO: 204390 - DNA, 20 bp, Artificial
  CRISPR gRNA sequence
gttttaagctgctatatttg

SEQ ID NO: 204391 - DNA, 20 bp, Artificial
  CRISPR gRNA sequence
ctatatttgtagttgttatg

SEQ ID NO: 204392 - DNA, 20 bp, Artificial
  CRISPR gRNA sequence
ttgtagttgttatgcagcac

SEQ ID NO: 204393 - DNA, 20 bp, Artificial
  CRISPR gRNA sequence
agcactagaaaactaataca

SEQ ID NO: 204394 - DNA, 20 bp, Artificial
  CRISPR gRNA sequence
cttcatgtcttcattataaa

SEQ ID NO: 204395 - DNA, 20 bp, Artificial
  CRISPR gRNA sequence
atatgtcctgttgataataa

SEQ ID NO: 204396 - DNA, 20 bp, Artificial
  CRISPR gRNA sequence
cctgttgataataatggaat

SEQ ID NO: 204397 - DNA, 20 bp, Artificial
  CRISPR gRNA sequence
taatggaattggcaacactg

SEQ ID NO: 204398 - DNA, 20 bp, Artificial
  CRISPR gRNA sequence
ctttctaaacaaaactctaa

SEQ ID NO: 204399 - DNA, 20 bp, Artificial
  CRISPR gRNA sequence
taaacaaaactctaatagct

SEQ ID NO: 204400 - DNA, 20 bp, Artificial
  CRISPR gRNA sequence
aacaaaactctaatagctta

SEQ ID NO: 204401 - DNA, 20 bp, Artificial
  CRISPR gRNA sequence
cttagagaaaaataaacttt

SEQ ID NO: 204402 - DNA, 20 bp, Artificial
  CRISPR gRNA sequence
aaaataaactttaagttttc

SEQ ID NO: 204403 - DNA, 20 bp, Artificial
  CRISPR gRNA sequence
tcaagtttttgtattgctaa

SEQ ID NO: 204404 - DNA, 20 bp, Artificial
  CRISPR gRNA sequence
tttttgtattgctaatagaa

SEQ ID NO: 204405 - DNA, 20 bp, Artificial
  CRISPR gRNA sequence
atgataaattttatgattac

SEQ ID NO: 204406 - DNA, 20 bp, Artificial
  CRISPR gRNA sequence
tgattactagtatttgcatt

SEQ ID NO: 204407 - DNA, 20 bp, Artificial
  CRISPR gRNA sequence
tagtatttgcattcagtatt

SEQ ID NO: 204408 - DNA, 20 bp, Artificial
  CRISPR gRNA sequence
ttcagtatttagttatttac

SEQ ID NO: 204409 - DNA, 20 bp, Artificial
  CRISPR gRNA sequence
tcagtatttagttatttaca

SEQ ID NO: 204410 - DNA, 20 bp, Artificial
  CRISPR gRNA sequence
ttcacatgaaccacatatta

SEQ ID NO: 204411 - DNA, 20 bp, Artificial
  CRISPR gRNA sequence
acatgaaccacatattacgg

SEQ ID NO: 204412 - DNA, 20 bp, Artificial
  CRISPR gRNA sequence
tattacggtggtaaaaatac

SEQ ID NO: 204413 - DNA, 20 bp, Artificial
  CRISPR gRNA sequence
attacggtggtaaaaatact

SEQ ID NO: 204414 - DNA, 20 bp, Artificial
  CRISPR gRNA sequence
aatactgggttttgatgcca

SEQ ID NO: 204415 - DNA, 20 bp, Artificial
  CRISPR gRNA sequence
tactgggttttgatgccaaa

SEQ ID NO: 204416 - DNA, 20 bp, Artificial
  CRISPR gRNA sequence
gttttgatgccaaagagatc

SEQ ID NO: 204417 - DNA, 20 bp, Artificial
  CRISPR gRNA sequence
ttttgatgccaaagagatct

SEQ ID NO: 204418 - DNA, 20 bp, Artificial
  CRISPR gRNA sequence
agagatctaggtttaattct

SEQ ID NO: 204419 - DNA, 20 bp, Artificial
  CRISPR gRNA sequence
ttgcttccctatttgttaaa

SEQ ID NO: 204420 - DNA, 20 bp, Artificial
  CRISPR gRNA sequence
ttccctatttgttaaatggt

SEQ ID NO: 204421 - DNA, 20 bp, Artificial
  CRISPR gRNA sequence
taagaactccatctatctcc

SEQ ID NO: 204422 - DNA, 20 bp, Artificial
  CRISPR gRNA sequence
agaactccatctatctccta

SEQ ID NO: 204423 - DNA, 20 bp, Artificial
  CRISPR gRNA sequence
atctatctcctagagttctt

SEQ ID NO: 204424 - DNA, 20 bp, Artificial
  CRISPR gRNA sequence
ctatctcctagagttcttga

SEQ ID NO: 204425 - DNA, 20 bp, Artificial
  CRISPR gRNA sequence
tatctcctagagttcttgag

SEQ ID NO: 204426 - DNA, 20 bp, Artificial
  CRISPR gRNA sequence
tagagttcttgagaggataa

SEQ ID NO: 204427 - DNA, 20 bp, Artificial
  CRISPR gRNA sequence
agagttcttgagaggataac

SEQ ID NO: 204428 - DNA, 20 bp, Artificial
  CRISPR gRNA sequence
aacaggacacgacttacata

SEQ ID NO: 204429 - DNA, 20 bp, Artificial
  CRISPR gRNA sequence
cacgacttacataaagtatg

SEQ ID NO: 204430 - DNA, 20 bp, Artificial
  CRISPR gRNA sequence
gcacatgtgcaaataaatgt

SEQ ID NO: 204431 - DNA, 20 bp, Artificial
  CRISPR gRNA sequence
cacatgtgcaaataaatgtt

SEQ ID NO: 204432 - DNA, 20 bp, Artificial
  CRISPR gRNA sequence
tgcaaccacttccttgaaat

SEQ ID NO: 204433 - DNA, 20 bp, Artificial
  CRISPR gRNA sequence
caataatgtcttattcatca

SEQ ID NO: 204434 - DNA, 20 bp, Artificial
  CRISPR gRNA sequence
atcacagaatctgtgatgcc

SEQ ID NO: 204435 - DNA, 20 bp, Artificial
  CRISPR gRNA sequence
agaatctgtgatgcctagta

SEQ ID NO: 204436 - DNA, 20 bp, Artificial
  CRISPR gRNA sequence
gtgatgcctagtacggtgac

SEQ ID NO: 204437 - DNA, 20 bp, Artificial
  CRISPR gRNA sequence
ctagtacggtgactggcaca

SEQ ID NO: 204438 - DNA, 20 bp, Artificial
  CRISPR gRNA sequence
gtacggtgactggcacatgg

SEQ ID NO: 204439 - DNA, 20 bp, Artificial
  CRISPR gRNA sequence
tacggtgactggcacatggt

SEQ ID NO: 204440 - DNA, 20 bp, Artificial
  CRISPR gRNA sequence
actggcacatggtaggcact

SEQ ID NO: 204441 - DNA, 20 bp, Artificial
  CRISPR gRNA sequence
gcacttagtaaaattttgtt

SEQ ID NO: 204442 - DNA, 20 bp, Artificial
  CRISPR gRNA sequence
ttagtaaaattttgttaagt

SEQ ID NO: 204443 - DNA, 20 bp, Artificial
  CRISPR gRNA sequence
agtaaaattttgttaagtaa

SEQ ID NO: 204444 - DNA, 20 bp, Artificial
  CRISPR gRNA sequence
taaaattttgttaagtaaga

SEQ ID NO: 204445 - DNA, 20 bp, Artificial
  CRISPR gRNA sequence
aaaattttgttaagtaagag

SEQ ID NO: 204446 - DNA, 20 bp, Artificial
  CRISPR gRNA sequence
tatctcaaacatttccatga

SEQ ID NO: 204447 - DNA, 20 bp, Artificial
  CRISPR gRNA sequence
gatgccatctttactgtact

SEQ ID NO: 204448 - DNA, 20 bp, Artificial
  CRISPR gRNA sequence
gccatctttactgtactaag

SEQ ID NO: 204449 - DNA, 20 bp, Artificial
  CRISPR gRNA sequence
tactgtactaagaagaattt

SEQ ID NO: 204450 - DNA, 20 bp, Artificial
  CRISPR gRNA sequence
actgtactaagaagaatttg

SEQ ID NO: 204451 - DNA, 20 bp, Artificial
  CRISPR gRNA sequence
ctgtactaagaagaatttga

SEQ ID NO: 204452 - DNA, 20 bp, Artificial
  CRISPR gRNA sequence
actaagaagaatttgaggga

SEQ ID NO: 204453 - DNA, 20 bp, Artificial
  CRISPR gRNA sequence
agaagaatttgagggacaga

SEQ ID NO: 204454 - DNA, 20 bp, Artificial
  CRISPR gRNA sequence
gaagaatttgagggacagat

SEQ ID NO: 204455 - DNA, 20 bp, Artificial
  CRISPR gRNA sequence
atttgagggacagataggtt

SEQ ID NO: 204456 - DNA, 20 bp, Artificial
  CRISPR gRNA sequence
ttttttatccaacttttctt

SEQ ID NO: 204457 - DNA, 20 bp, Artificial
  CRISPR gRNA sequence
acttttcttaagctattaaa

SEQ ID NO: 204458 - DNA, 20 bp, Artificial
  CRISPR gRNA sequence
tcttaagctattaaacagtg

SEQ ID NO: 204459 - DNA, 20 bp, Artificial
  CRISPR gRNA sequence
agctattaaacagtgaagtc

SEQ ID NO: 204460 - DNA, 20 bp, Artificial
  CRISPR gRNA sequence
aaacagtgaagtctagaaaa

SEQ ID NO: 204461 - DNA, 20 bp, Artificial
  CRISPR gRNA sequence
gaaaacagctttctaatttc

SEQ ID NO: 204462 - DNA, 20 bp, Artificial
  CRISPR gRNA sequence
cagctttctaatttcaagtc

SEQ ID NO: 204463 - DNA, 20 bp, Artificial
  CRISPR gRNA sequence
aagtccagtgctccttctaa

SEQ ID NO: 204464 - DNA, 20 bp, Artificial
  CRISPR gRNA sequence
ctaatggactatatcataca

SEQ ID NO: 204465 - DNA, 20 bp, Artificial
  CRISPR gRNA sequence
taatggactatatcatacat

SEQ ID NO: 204466 - DNA, 20 bp, Artificial
  CRISPR gRNA sequence
gactatatcatacataggca

SEQ ID NO: 204467 - DNA, 20 bp, Artificial
  CRISPR gRNA sequence
ctatatcatacataggcaca

SEQ ID NO: 204468 - DNA, 20 bp, Artificial
  CRISPR gRNA sequence
tatatcatacataggcacag

SEQ ID NO: 204469 - DNA, 20 bp, Artificial
  CRISPR gRNA sequence
gtatataaaactatatctta

SEQ ID NO: 204470 - DNA, 20 bp, Artificial
  CRISPR gRNA sequence
ttatagtgtttccatgtatt

SEQ ID NO: 204471 - DNA, 20 bp, Artificial
  CRISPR gRNA sequence
tgtttccatgtattcagtcc

SEQ ID NO: 204472 - DNA, 20 bp, Artificial
  CRISPR gRNA sequence
agtcctccaaaaaatttaaa

SEQ ID NO: 204473 - DNA, 20 bp, Artificial
  CRISPR gRNA sequence
gtcctccaaaaaatttaaaa

SEQ ID NO: 204474 - DNA, 20 bp, Artificial
  CRISPR gRNA sequence
aaaaaatttaaaaaggcaca

SEQ ID NO: 204475 - DNA, 20 bp, Artificial
  CRISPR gRNA sequence
atttaaaaaggcacaaagaa

SEQ ID NO: 204476 - DNA, 20 bp, Artificial
  CRISPR gRNA sequence
actattatctgcattctatt

SEQ ID NO: 204477 - DNA, 20 bp, Artificial
  CRISPR gRNA sequence
attatctgcattctattaag

SEQ ID NO: 204478 - DNA, 20 bp, Artificial
  CRISPR gRNA sequence
gtagaattcacttctctatt

SEQ ID NO: 204479 - DNA, 20 bp, Artificial
  CRISPR gRNA sequence
tatttgcaaaaatcacgaca

SEQ ID NO: 204480 - DNA, 20 bp, Artificial
  CRISPR gRNA sequence
aaatcacgacatagtaaaaa

SEQ ID NO: 204481 - DNA, 20 bp, Artificial
  CRISPR gRNA sequence
ttctaatgcttaaatcctca

SEQ ID NO: 204482 - DNA, 20 bp, Artificial
  CRISPR gRNA sequence
aaatcctcaaagtccgtgac

SEQ ID NO: 204483 - DNA, 20 bp, Artificial
  CRISPR gRNA sequence
cctcaaagtccgtgacaagt

SEQ ID NO: 204484 - DNA, 20 bp, Artificial
  CRISPR gRNA sequence
tgacaagtaagtattcttat

SEQ ID NO: 204485 - DNA, 20 bp, Artificial
  CRISPR gRNA sequence
agtaagtattcttattagaa

SEQ ID NO: 204486 - DNA, 20 bp, Artificial
  CRISPR gRNA sequence
agaaaagaacttatactcca

SEQ ID NO: 204487 - DNA, 20 bp, Artificial
  CRISPR gRNA sequence
aagaacttatactccatagt

SEQ ID NO: 204488 - DNA, 20 bp, Artificial
  CRISPR gRNA sequence
gaacttatactccatagtaa

SEQ ID NO: 204489 - DNA, 20 bp, Artificial
  CRISPR gRNA sequence
ccccatttaacctttttgtg

SEQ ID NO: 204490 - DNA, 20 bp, Artificial
  CRISPR gRNA sequence
tgtgcagataactttttaac

SEQ ID NO: 204491 - DNA, 20 bp, Artificial
  CRISPR gRNA sequence
tgtttgtttgttgttttttt

SEQ ID NO: 204492 - DNA, 20 bp, Artificial
  CRISPR gRNA sequence
ttgtttttttcagttaaaaa

SEQ ID NO: 204493 - DNA, 20 bp, Artificial
  CRISPR gRNA sequence
agttaaaaatggttacaaca

SEQ ID NO: 204494 - DNA, 20 bp, Artificial
  CRISPR gRNA sequence
taaaaatggttacaacatag

SEQ ID NO: 204495 - DNA, 20 bp, Artificial
  CRISPR gRNA sequence
tggttacaacatagtggcac

SEQ ID NO: 204496 - DNA, 20 bp, Artificial
  CRISPR gRNA sequence
aacatagtggcaccagatac

SEQ ID NO: 204497 - DNA, 20 bp, Artificial
  CRISPR gRNA sequence
tagtggcaccagatactggt

SEQ ID NO: 204498 - DNA, 20 bp, Artificial
  CRISPR gRNA sequence
agtggcaccagatactggtg

SEQ ID NO: 204499 - DNA, 20 bp, Artificial
  CRISPR gRNA sequence
accagatactggtgaggatg

SEQ ID NO: 204500 - DNA, 20 bp, Artificial
  CRISPR gRNA sequence
cagatactggtgaggatgtg

SEQ ID NO: 204501 - DNA, 20 bp, Artificial
  CRISPR gRNA sequence
tggtgaggatgtggagaaac

SEQ ID NO: 204502 - DNA, 20 bp, Artificial
  CRISPR gRNA sequence
gatcactcttacattgttga

SEQ ID NO: 204503 - DNA, 20 bp, Artificial
  CRISPR gRNA sequence
gatggaaatgtaaaatgaaa

SEQ ID NO: 204504 - DNA, 20 bp, Artificial
  CRISPR gRNA sequence
gtaaaatgaaatagccactc

SEQ ID NO: 204505 - DNA, 20 bp, Artificial
  CRISPR gRNA sequence
atgaaatagccactctggaa

SEQ ID NO: 204506 - DNA, 20 bp, Artificial
  CRISPR gRNA sequence
atagccactctggaaaagtc

SEQ ID NO: 204507 - DNA, 20 bp, Artificial
  CRISPR gRNA sequence
gccactctggaaaagtctgg

SEQ ID NO: 204508 - DNA, 20 bp, Artificial
  CRISPR gRNA sequence
tggcagtttctttaaaaact

SEQ ID NO: 204509 - DNA, 20 bp, Artificial
  CRISPR gRNA sequence
ctaagcatatacttaccata

SEQ ID NO: 204510 - DNA, 20 bp, Artificial
  CRISPR gRNA sequence
catatacttaccatacagcc

SEQ ID NO: 204511 - DNA, 20 bp, Artificial
  CRISPR gRNA sequence
agcccagtaaccatacttct

SEQ ID NO: 204512 - DNA, 20 bp, Artificial
  CRISPR gRNA sequence
atacttctgagcatttatcc

SEQ ID NO: 204513 - DNA, 20 bp, Artificial
  CRISPR gRNA sequence
acttctgagcatttatccca

SEQ ID NO: 204514 - DNA, 20 bp, Artificial
  CRISPR gRNA sequence
aatgaaaactgtgtctacac

SEQ ID NO: 204515 - DNA, 20 bp, Artificial
  CRISPR gRNA sequence
agaacctgtacacaattgtt

SEQ ID NO: 204516 - DNA, 20 bp, Artificial
  CRISPR gRNA sequence
aacctgtacacaattgttca

SEQ ID NO: 204517 - DNA, 20 bp, Artificial
  CRISPR gRNA sequence
ctgtacacaattgttcagag

SEQ ID NO: 204518 - DNA, 20 bp, Artificial
  CRISPR gRNA sequence
cagagcagtttcatttgtaa

SEQ ID NO: 204519 - DNA, 20 bp, Artificial
  CRISPR gRNA sequence
catttgtaacagcccaaact

SEQ ID NO: 204520 - DNA, 20 bp, Artificial
  CRISPR gRNA sequence
acaaccaaaatgtcctacta

SEQ ID NO: 204521 - DNA, 20 bp, Artificial
  CRISPR gRNA sequence
caaccaaaatgtcctactat

SEQ ID NO: 204522 - DNA, 20 bp, Artificial
  CRISPR gRNA sequence
caaaatgtcctactataggt

SEQ ID NO: 204523 - DNA, 20 bp, Artificial
  CRISPR gRNA sequence
aatgtcctactataggtaag

SEQ ID NO: 204524 - DNA, 20 bp, Artificial
  CRISPR gRNA sequence
actgtgatatattcatacta

SEQ ID NO: 204525 - DNA, 20 bp, Artificial
  CRISPR gRNA sequence
tcatactatggactactact

SEQ ID NO: 204526 - DNA, 20 bp, Artificial
  CRISPR gRNA sequence
ctactactcagcaaaaaaaa

SEQ ID NO: 204527 - DNA, 20 bp, Artificial
  CRISPR gRNA sequence
tactcagcaaaaaaaaaagt

SEQ ID NO: 204528 - DNA, 20 bp, Artificial
  CRISPR gRNA sequence
actcagcaaaaaaaaaagta

SEQ ID NO: 204529 - DNA, 20 bp, Artificial
  CRISPR gRNA sequence
aaaaaaaaaagtaaggaaaa

SEQ ID NO: 204530 - DNA, 20 bp, Artificial
  CRISPR gRNA sequence
aaggaaaaaagaactattga

SEQ ID NO: 204531 - DNA, 20 bp, Artificial
  CRISPR gRNA sequence
tattgatagatgcaaaaact

SEQ ID NO: 204532 - DNA, 20 bp, Artificial
  CRISPR gRNA sequence
gatagatgcaaaaacttgga

SEQ ID NO: 204533 - DNA, 20 bp, Artificial
  CRISPR gRNA sequence
caaaaacttggatagatctc

SEQ ID NO: 204534 - DNA, 20 bp, Artificial
  CRISPR gRNA sequence
aaaaacttggatagatctca

SEQ ID NO: 204535 - DNA, 20 bp, Artificial
  CRISPR gRNA sequence
aaaacttggatagatctcaa

SEQ ID NO: 204536 - DNA, 20 bp, Artificial
  CRISPR gRNA sequence
gatctcaagggcattgtgct

SEQ ID NO: 204537 - DNA, 20 bp, Artificial
  CRISPR gRNA sequence
gggcattgtgcttagtgaaa

SEQ ID NO: 204538 - DNA, 20 bp, Artificial
  CRISPR gRNA sequence
agtgaaaaagcccttctcaa

SEQ ID NO: 204539 - DNA, 20 bp, Artificial
  CRISPR gRNA sequence
gtgaaaaagcccttctcaaa

SEQ ID NO: 204540 - DNA, 20 bp, Artificial
  CRISPR gRNA sequence
cttgtatcattccatttata

SEQ ID NO: 204541 - DNA, 20 bp, Artificial
  CRISPR gRNA sequence
ttgttgaaatgacaaaatta

SEQ ID NO: 204542 - DNA, 20 bp, Artificial
  CRISPR gRNA sequence
aaatgacaaaattatagata

SEQ ID NO: 204543 - DNA, 20 bp, Artificial
  CRISPR gRNA sequence
atgacaaaattatagatatg

SEQ ID NO: 204544 - DNA, 20 bp, Artificial
  CRISPR gRNA sequence
tgacaaaattatagatatgg

SEQ ID NO: 204545 - DNA, 20 bp, Artificial
  CRISPR gRNA sequence
tatagatatggaggacaaat

SEQ ID NO: 204546 - DNA, 20 bp, Artificial
  CRISPR gRNA sequence
gaggacaaattggtgcttgc

SEQ ID NO: 204547 - DNA, 20 bp, Artificial
  CRISPR gRNA sequence
aggacaaattggtgcttgcc

SEQ ID NO: 204548 - DNA, 20 bp, Artificial
  CRISPR gRNA sequence
caaattggtgcttgccaggt

SEQ ID NO: 204549 - DNA, 20 bp, Artificial
  CRISPR gRNA sequence
aaattggtgcttgccaggtt

SEQ ID NO: 204550 - DNA, 20 bp, Artificial
  CRISPR gRNA sequence
aattggtgcttgccaggtta

SEQ ID NO: 204551 - DNA, 20 bp, Artificial
  CRISPR gRNA sequence
ggtgcttgccaggttaggga

SEQ ID NO: 204552 - DNA, 20 bp, Artificial
  CRISPR gRNA sequence
gcttgccaggttagggacag

SEQ ID NO: 204553 - DNA, 20 bp, Artificial
  CRISPR gRNA sequence
cttgccaggttagggacagt

SEQ ID NO: 204554 - DNA, 20 bp, Artificial
  CRISPR gRNA sequence
tgccaggttagggacagtgg

SEQ ID NO: 204555 - DNA, 20 bp, Artificial
  CRISPR gRNA sequence
gccaggttagggacagtggg

SEQ ID NO: 204556 - DNA, 20 bp, Artificial
  CRISPR gRNA sequence
aggttagggacagtgggagg

SEQ ID NO: 204557 - DNA, 20 bp, Artificial
  CRISPR gRNA sequence
ttagggacagtgggaggtgg

SEQ ID NO: 204558 - DNA, 20 bp, Artificial
  CRISPR gRNA sequence
gtgggaggtggcggtatgac

SEQ ID NO: 204559 - DNA, 20 bp, Artificial
  CRISPR gRNA sequence
gaggtggcggtatgactagt

SEQ ID NO: 204560 - DNA, 20 bp, Artificial
  CRISPR gRNA sequence
gcggtatgactagtaagaat

SEQ ID NO: 204561 - DNA, 20 bp, Artificial
  CRISPR gRNA sequence
tgactagtaagaataagcat

SEQ ID NO: 204562 - DNA, 20 bp, Artificial
  CRISPR gRNA sequence
gactagtaagaataagcatg

SEQ ID NO: 204563 - DNA, 20 bp, Artificial
  CRISPR gRNA sequence
actagtaagaataagcatga

SEQ ID NO: 204564 - DNA, 20 bp, Artificial
  CRISPR gRNA sequence
tagtaagaataagcatgagg

SEQ ID NO: 204565 - DNA, 20 bp, Artificial
  CRISPR gRNA sequence
gagggagatgtttgttatga

SEQ ID NO: 204566 - DNA, 20 bp, Artificial
  CRISPR gRNA sequence
gagatgtttgttatgatgga

SEQ ID NO: 204567 - DNA, 20 bp, Artificial
  CRISPR gRNA sequence
agatgtttgttatgatggat

SEQ ID NO: 204568 - DNA, 20 bp, Artificial
  CRISPR gRNA sequence
aggtctatgtcctgattgtg

SEQ ID NO: 204569 - DNA, 20 bp, Artificial
  CRISPR gRNA sequence
ggtctatgtcctgattgtgt

SEQ ID NO: 204570 - DNA, 20 bp, Artificial
  CRISPR gRNA sequence
ctatgtcctgattgtgtagg

SEQ ID NO: 204571 - DNA, 20 bp, Artificial
  CRISPR gRNA sequence
aaataaacacgtgataaaat

SEQ ID NO: 204572 - DNA, 20 bp, Artificial
  CRISPR gRNA sequence
ataaacacgtgataaaatga

SEQ ID NO: 204573 - DNA, 20 bp, Artificial
  CRISPR gRNA sequence
attttcatattgtgtcacat

SEQ ID NO: 204574 - DNA, 20 bp, Artificial
  CRISPR gRNA sequence
tttcatattgtgtcacataa

SEQ ID NO: 204575 - DNA, 20 bp, Artificial
  CRISPR gRNA sequence
ttcatattgtgtcacataag

SEQ ID NO: 204576 - DNA, 20 bp, Artificial
  CRISPR gRNA sequence
gtcacataagaggaaaccat

SEQ ID NO: 204577 - DNA, 20 bp, Artificial
  CRISPR gRNA sequence
tcacataagaggaaaccatt

SEQ ID NO: 204578 - DNA, 20 bp, Artificial
  CRISPR gRNA sequence
cacataagaggaaaccattg

SEQ ID NO: 204579 - DNA, 20 bp, Artificial
  CRISPR gRNA sequence
acataagaggaaaccattgg

SEQ ID NO: 204580 - DNA, 20 bp, Artificial
  CRISPR gRNA sequence
cataagaggaaaccattggg

SEQ ID NO: 204581 - DNA, 20 bp, Artificial
  CRISPR gRNA sequence
gaggaaaccattggggggac

SEQ ID NO: 204582 - DNA, 20 bp, Artificial
  CRISPR gRNA sequence
aggaaaccattggggggact

SEQ ID NO: 204583 - DNA, 20 bp, Artificial
  CRISPR gRNA sequence
accattggggggactgggtg

SEQ ID NO: 204584 - DNA, 20 bp, Artificial
  CRISPR gRNA sequence
ccattggggggactgggtga

SEQ ID NO: 204585 - DNA, 20 bp, Artificial
  CRISPR gRNA sequence
cattggggggactgggtgaa

SEQ ID NO: 204586 - DNA, 20 bp, Artificial
  CRISPR gRNA sequence
gggactgggtgaagggcaca

SEQ ID NO: 204587 - DNA, 20 bp, Artificial
  CRISPR gRNA sequence
actgggtgaagggcacatgg

SEQ ID NO: 204588 - DNA, 20 bp, Artificial
  CRISPR gRNA sequence
attatttcaaaaaattaaaa

SEQ ID NO: 204589 - DNA, 20 bp, Artificial
  CRISPR gRNA sequence
aaaaaattaaaatggatgca

SEQ ID NO: 204590 - DNA, 20 bp, Artificial
  CRISPR gRNA sequence
agccaaatgtctcaaacctc

SEQ ID NO: 204591 - DNA, 20 bp, Artificial
  CRISPR gRNA sequence
caaatgtctcaaacctctgg

SEQ ID NO: 204592 - DNA, 20 bp, Artificial
  CRISPR gRNA sequence
acaatactttctccttttaa

SEQ ID NO: 204593 - DNA, 20 bp, Artificial
  CRISPR gRNA sequence
cttttaatggctcccaaaat

SEQ ID NO: 204594 - DNA, 20 bp, Artificial
  CRISPR gRNA sequence
aatggctcccaaaataagtc

SEQ ID NO: 204595 - DNA, 20 bp, Artificial
  CRISPR gRNA sequence
aagtctagtttttattttta

SEQ ID NO: 204596 - DNA, 20 bp, Artificial
  CRISPR gRNA sequence
agtctagtttttatttttat

SEQ ID NO: 204597 - DNA, 20 bp, Artificial
  CRISPR gRNA sequence
gtctagtttttatttttata

SEQ ID NO: 204598 - DNA, 20 bp, Artificial
  CRISPR gRNA sequence
tatagggtattttgcaaaca

SEQ ID NO: 204599 - DNA, 20 bp, Artificial
  CRISPR gRNA sequence
ttttgcaaacaaagataaaa

SEQ ID NO: 204600 - DNA, 20 bp, Artificial
  CRISPR gRNA sequence
ataataaactgtttttatct

SEQ ID NO: 204601 - DNA, 20 bp, Artificial
  CRISPR gRNA sequence
actgtttttatctcagatcc

SEQ ID NO: 204602 - DNA, 20 bp, Artificial
  CRISPR gRNA sequence
tccatcttcatttcatcttc

SEQ ID NO: 204603 - DNA, 20 bp, Artificial
  CRISPR gRNA sequence
cctttcaaatctcatatttt

SEQ ID NO: 204604 - DNA, 20 bp, Artificial
  CRISPR gRNA sequence
atctcatattttgagttttc

SEQ ID NO: 204605 - DNA, 20 bp, Artificial
  CRISPR gRNA sequence
gagttttccagtttacctct

SEQ ID NO: 204606 - DNA, 20 bp, Artificial
  CRISPR gRNA sequence
tgacctgcattaccccccaa

SEQ ID NO: 204607 - DNA, 20 bp, Artificial
  CRISPR gRNA sequence
cacaaaattgtacattacct

SEQ ID NO: 204608 - DNA, 20 bp, Artificial
  CRISPR gRNA sequence
tacctcagaaaaatttcaac

SEQ ID NO: 204609 - DNA, 20 bp, Artificial
  CRISPR gRNA sequence
acctcagaaaaatttcaact

SEQ ID NO: 204610 - DNA, 20 bp, Artificial
  CRISPR gRNA sequence
gaaaaatttcaactaggtat

SEQ ID NO: 204611 - DNA, 20 bp, Artificial
  CRISPR gRNA sequence
ggtattagatgatctaatac

SEQ ID NO: 204612 - DNA, 20 bp, Artificial
  CRISPR gRNA sequence
ttagatgatctaataccagt

SEQ ID NO: 204613 - DNA, 20 bp, Artificial
  CRISPR gRNA sequence
gatctaataccagttagttg

SEQ ID NO: 204614 - DNA, 20 bp, Artificial
  CRISPR gRNA sequence
ctaataccagttagttgcag

SEQ ID NO: 204615 - DNA, 20 bp, Artificial
  CRISPR gRNA sequence
actgattacacccttcatta

SEQ ID NO: 204616 - DNA, 20 bp, Artificial
  CRISPR gRNA sequence
ctgattacacccttcattaa

SEQ ID NO: 204617 - DNA, 20 bp, Artificial
  CRISPR gRNA sequence
atacttaacaacaacaaaaa

SEQ ID NO: 204618 - DNA, 20 bp, Artificial
  CRISPR gRNA sequence
tttgcccaaattaatatcaa

SEQ ID NO: 204619 - DNA, 20 bp, Artificial
  CRISPR gRNA sequence
caaattaatatcaatagtaa

SEQ ID NO: 204620 - DNA, 20 bp, Artificial
  CRISPR gRNA sequence
aatagtaaaagctacaatgt

SEQ ID NO: 204621 - DNA, 20 bp, Artificial
  CRISPR gRNA sequence
tagtaaaagctacaatgtaa

SEQ ID NO: 204622 - DNA, 20 bp, Artificial
  CRISPR gRNA sequence
gtaaaagctacaatgtaaga

SEQ ID NO: 204623 - DNA, 20 bp, Artificial
  CRISPR gRNA sequence
acaatgtaagagagatttct

SEQ ID NO: 204624 - DNA, 20 bp, Artificial
  CRISPR gRNA sequence
atgtaagagagatttctgag

SEQ ID NO: 204625 - DNA, 20 bp, Artificial
  CRISPR gRNA sequence
aagagagatttctgagcaga

SEQ ID NO: 204626 - DNA, 20 bp, Artificial
  CRISPR gRNA sequence
tcaaattctccttgcctact

SEQ ID NO: 204627 - DNA, 20 bp, Artificial
  CRISPR gRNA sequence
aaattctccttgcctactcg

SEQ ID NO: 204628 - DNA, 20 bp, Artificial
  CRISPR gRNA sequence
aaatccctctcacaatgctc

SEQ ID NO: 204629 - DNA, 20 bp, Artificial
  CRISPR gRNA sequence
aatccctctcacaatgctct

SEQ ID NO: 204630 - DNA, 20 bp, Artificial
  CRISPR gRNA sequence
acttcataaaataaacatcc

SEQ ID NO: 204631 - DNA, 20 bp, Artificial
  CRISPR gRNA sequence
cttcataaaataaacatccc

SEQ ID NO: 204632 - DNA, 20 bp, Artificial
  CRISPR gRNA sequence
ctaacatttacaacacactt

SEQ ID NO: 204633 - DNA, 20 bp, Artificial
  CRISPR gRNA sequence
acactttggtttatgctcat

SEQ ID NO: 204634 - DNA, 20 bp, Artificial
  CRISPR gRNA sequence
ggtttatgctcattagactg

SEQ ID NO: 204635 - DNA, 20 bp, Artificial
  CRISPR gRNA sequence
ttagactgtagaatacataa

SEQ ID NO: 204636 - DNA, 20 bp, Artificial
  CRISPR gRNA sequence
actgtagaatacataaaagc

SEQ ID NO: 204637 - DNA, 20 bp, Artificial
  CRISPR gRNA sequence
atctattgtcatctccattt

SEQ ID NO: 204638 - DNA, 20 bp, Artificial
  CRISPR gRNA sequence
gtcatctccatttcggacat

SEQ ID NO: 204639 - DNA, 20 bp, Artificial
  CRISPR gRNA sequence
tcatctccatttcggacatg

SEQ ID NO: 204640 - DNA, 20 bp, Artificial
  CRISPR gRNA sequence
atttcggacatgaggtaact

SEQ ID NO: 204641 - DNA, 20 bp, Artificial
  CRISPR gRNA sequence
gacatgaggtaacttggact

SEQ ID NO: 204642 - DNA, 20 bp, Artificial
  CRISPR gRNA sequence
gaggtaacttggactcggtt

SEQ ID NO: 204643 - DNA, 20 bp, Artificial
  CRISPR gRNA sequence
actcggttaagcaccttctc

SEQ ID NO: 204644 - DNA, 20 bp, Artificial
  CRISPR gRNA sequence
agcaccttctcaagatcaca

SEQ ID NO: 204645 - DNA, 20 bp, Artificial
  CRISPR gRNA sequence
gcaccttctcaagatcacac

SEQ ID NO: 204646 - DNA, 20 bp, Artificial
  CRISPR gRNA sequence
ctcaagatcacacaggtgaa

SEQ ID NO: 204647 - DNA, 20 bp, Artificial
  CRISPR gRNA sequence
agatcacacaggtgaatagt

SEQ ID NO: 204648 - DNA, 20 bp, Artificial
  CRISPR gRNA sequence
gtgaatagtaagttgctgaa

SEQ ID NO: 204649 - DNA, 20 bp, Artificial
  CRISPR gRNA sequence
tgaatagtaagttgctgaac

SEQ ID NO: 204650 - DNA, 20 bp, Artificial
  CRISPR gRNA sequence
gaatagtaagttgctgaaca

SEQ ID NO: 204651 - DNA, 20 bp, Artificial
  CRISPR gRNA sequence
aatagtaagttgctgaacag

SEQ ID NO: 204652 - DNA, 20 bp, Artificial
  CRISPR gRNA sequence
gctgaacaggggctgtaact

SEQ ID NO: 204653 - DNA, 20 bp, Artificial
  CRISPR gRNA sequence
acctcctgattctcaatcct

SEQ ID NO: 204654 - DNA, 20 bp, Artificial
  CRISPR gRNA sequence
caaacaccccattcctaatc

SEQ ID NO: 204655 - DNA, 20 bp, Artificial
  CRISPR gRNA sequence
acaccccattcctaatctgg

SEQ ID NO: 204656 - DNA, 20 bp, Artificial
  CRISPR gRNA sequence
ccccattcctaatctggtag

SEQ ID NO: 204657 - DNA, 20 bp, Artificial
  CRISPR gRNA sequence
ggtagtagattattttataa

SEQ ID NO: 204658 - DNA, 20 bp, Artificial
  CRISPR gRNA sequence
gtagattattttataaaagc

SEQ ID NO: 204659 - DNA, 20 bp, Artificial
  CRISPR gRNA sequence
tagattattttataaaagct

SEQ ID NO: 204660 - DNA, 20 bp, Artificial
  CRISPR gRNA sequence
ttttataaaagctaggcaaa

SEQ ID NO: 204661 - DNA, 20 bp, Artificial
  CRISPR gRNA sequence
aaatagttgatccaactgaa

SEQ ID NO: 204662 - DNA, 20 bp, Artificial
  CRISPR gRNA sequence
tgaacagaactgaacctatc

SEQ ID NO: 204663 - DNA, 20 bp, Artificial
  CRISPR gRNA sequence
aacagaactgaacctatcta

SEQ ID NO: 204664 - DNA, 20 bp, Artificial
  CRISPR gRNA sequence
aactgaacctatctagagtt

SEQ ID NO: 204665 - DNA, 20 bp, Artificial
  CRISPR gRNA sequence
actgaacctatctagagtta

SEQ ID NO: 204666 - DNA, 20 bp, Artificial
  CRISPR gRNA sequence
gagttaaggttctcaaaatg

SEQ ID NO: 204667 - DNA, 20 bp, Artificial
  CRISPR gRNA sequence
aaggttctcaaaatgtggtt

SEQ ID NO: 204668 - DNA, 20 bp, Artificial
  CRISPR gRNA sequence
aaatgtggttaagccatgat

SEQ ID NO: 204669 - DNA, 20 bp, Artificial
  CRISPR gRNA sequence
agccatgatcggtaatatga

SEQ ID NO: 204670 - DNA, 20 bp, Artificial
  CRISPR gRNA sequence
gccatgatcggtaatatgac

SEQ ID NO: 204671 - DNA, 20 bp, Artificial
  CRISPR gRNA sequence
atatgacaggtaattctaaa

SEQ ID NO: 204672 - DNA, 20 bp, Artificial
  CRISPR gRNA sequence
atgacaggtaattctaaata

SEQ ID NO: 204673 - DNA, 20 bp, Artificial
  CRISPR gRNA sequence
tctaaatagagatttcaaaa

SEQ ID NO: 204674 - DNA, 20 bp, Artificial
  CRISPR gRNA sequence
aatagagatttcaaaacaga

SEQ ID NO: 204675 - DNA, 20 bp, Artificial
  CRISPR gRNA sequence
acagaaagaacatactcata

SEQ ID NO: 204676 - DNA, 20 bp, Artificial
  CRISPR gRNA sequence
cagaaagaacatactcatat

SEQ ID NO: 204677 - DNA, 20 bp, Artificial
  CRISPR gRNA sequence
agaaagaacatactcatatg

SEQ ID NO: 204678 - DNA, 20 bp, Artificial
  CRISPR gRNA sequence
aacatactcatatggggttg

SEQ ID NO: 204679 - DNA, 20 bp, Artificial
  CRISPR gRNA sequence
tcatatggggttgaagaact

SEQ ID NO: 204680 - DNA, 20 bp, Artificial
  CRISPR gRNA sequence
atggggttgaagaactcagc

SEQ ID NO: 204681 - DNA, 20 bp, Artificial
  CRISPR gRNA sequence
gttgaagaactcagctagca

SEQ ID NO: 204682 - DNA, 20 bp, Artificial
  CRISPR gRNA sequence
gaagaactcagctagcacag

SEQ ID NO: 204683 - DNA, 20 bp, Artificial
  CRISPR gRNA sequence
aagaactcagctagcacagc

SEQ ID NO: 204684 - DNA, 20 bp, Artificial
  CRISPR gRNA sequence
tcagctagcacagcaggaaa

SEQ ID NO: 204685 - DNA, 20 bp, Artificial
  CRISPR gRNA sequence
ctagcacagcaggaaacagc

SEQ ID NO: 204686 - DNA, 20 bp, Artificial
  CRISPR gRNA sequence
tagcacagcaggaaacagca

SEQ ID NO: 204687 - DNA, 20 bp, Artificial
  CRISPR gRNA sequence
gcacagcaggaaacagcaag

SEQ ID NO: 204688 - DNA, 20 bp, Artificial
  CRISPR gRNA sequence
acagcaggaaacagcaagga

SEQ ID NO: 204689 - DNA, 20 bp, Artificial
  CRISPR gRNA sequence
cagcaggaaacagcaaggag

SEQ ID NO: 204690 - DNA, 20 bp, Artificial
  CRISPR gRNA sequence
gcaggaaacagcaaggagag

SEQ ID NO: 204691 - DNA, 20 bp, Artificial
  CRISPR gRNA sequence
ggagaggagactatttactt

SEQ ID NO: 204692 - DNA, 20 bp, Artificial
  CRISPR gRNA sequence
ttttactaccttctacacct

SEQ ID NO: 204693 - DNA, 20 bp, Artificial
  CRISPR gRNA sequence
cttctacacctcagcaaccc

SEQ ID NO: 204694 - DNA, 20 bp, Artificial
  CRISPR gRNA sequence
caacccaagtttgtgataaa

SEQ ID NO: 204695 - DNA, 20 bp, Artificial
  CRISPR gRNA sequence
aacccaagtttgtgataaaa

SEQ ID NO: 204696 - DNA, 20 bp, Artificial
  CRISPR gRNA sequence
acccaagtttgtgataaaaa

SEQ ID NO: 204697 - DNA, 20 bp, Artificial
  CRISPR gRNA sequence
caagtttgtgataaaaaggg

SEQ ID NO: 204698 - DNA, 20 bp, Artificial
  CRISPR gRNA sequence
tgataaaaagggcagaatca

SEQ ID NO: 204699 - DNA, 20 bp, Artificial
  CRISPR gRNA sequence
agaatcatggtgctatcatc

SEQ ID NO: 204700 - DNA, 20 bp, Artificial
  CRISPR gRNA sequence
aataaatgaatttgaatctc

SEQ ID NO: 204701 - DNA, 20 bp, Artificial
  CRISPR gRNA sequence
tctctagttctctcatattt

SEQ ID NO: 204702 - DNA, 20 bp, Artificial
  CRISPR gRNA sequence
ctcatattttggccaacaaa

SEQ ID NO: 204703 - DNA, 20 bp, Artificial
  CRISPR gRNA sequence
atattttggccaacaaaaag

SEQ ID NO: 204704 - DNA, 20 bp, Artificial
  CRISPR gRNA sequence
ggccaacaaaaagaagacca

SEQ ID NO: 204705 - DNA, 20 bp, Artificial
  CRISPR gRNA sequence
aacaaaaagaagaccaaagt

SEQ ID NO: 204706 - DNA, 20 bp, Artificial
  CRISPR gRNA sequence
acaaaaagaagaccaaagta

SEQ ID NO: 204707 - DNA, 20 bp, Artificial
  CRISPR gRNA sequence
aagaagaccaaagtaaggct

SEQ ID NO: 204708 - DNA, 20 bp, Artificial
  CRISPR gRNA sequence
gaccaaagtaaggctaagca

SEQ ID NO: 204709 - DNA, 20 bp, Artificial
  CRISPR gRNA sequence
ggctaagcacagaaaatctg

SEQ ID NO: 204710 - DNA, 20 bp, Artificial
  CRISPR gRNA sequence
tgactctcctctattctctc

SEQ ID NO: 204711 - DNA, 20 bp, Artificial
  CRISPR gRNA sequence
actctcctctattctctcca

SEQ ID NO: 204712 - DNA, 20 bp, Artificial
  CRISPR gRNA sequence
ctctcctctattctctccag

SEQ ID NO: 204713 - DNA, 20 bp, Artificial
  CRISPR gRNA sequence
tctcctctattctctccaga

SEQ ID NO: 204714 - DNA, 20 bp, Artificial
  CRISPR gRNA sequence
tcctctattctctccagagg

SEQ ID NO: 204715 - DNA, 20 bp, Artificial
  CRISPR gRNA sequence
tattctctccagagggagca

SEQ ID NO: 204716 - DNA, 20 bp, Artificial
  CRISPR gRNA sequence
ctctccagagggagcatggc

SEQ ID NO: 204717 - DNA, 20 bp, Artificial
  CRISPR gRNA sequence
tctccagagggagcatggct

SEQ ID NO: 204718 - DNA, 20 bp, Artificial
  CRISPR gRNA sequence
ggctgggacttgtcatccct

SEQ ID NO: 204719 - DNA, 20 bp, Artificial
  CRISPR gRNA sequence
gacttgtcatcccttggtca

SEQ ID NO: 204720 - DNA, 20 bp, Artificial
  CRISPR gRNA sequence
tcatcccttggtcaaagtgt

SEQ ID NO: 204721 - DNA, 20 bp, Artificial
  CRISPR gRNA sequence
catcccttggtcaaagtgta

SEQ ID NO: 204722 - DNA, 20 bp, Artificial
  CRISPR gRNA sequence
aaaaaaaaaaacacaaaaaa

SEQ ID NO: 204723 - DNA, 20 bp, Artificial
  CRISPR gRNA sequence
aaaaaaaacacaaaaaacag

SEQ ID NO: 204724 - DNA, 20 bp, Artificial
  CRISPR gRNA sequence
aaaaaaacacaaaaaacaga

SEQ ID NO: 204725 - DNA, 20 bp, Artificial
  CRISPR gRNA sequence
aaaacagaaggctgaataat

SEQ ID NO: 204726 - DNA, 20 bp, Artificial
  CRISPR gRNA sequence
cagaaggctgaataattgga

SEQ ID NO: 204727 - DNA, 20 bp, Artificial
  CRISPR gRNA sequence
gaaggctgaataattggaaa

SEQ ID NO: 204728 - DNA, 20 bp, Artificial
  CRISPR gRNA sequence
ttggaaagagacttgaaaat

SEQ ID NO: 204729 - DNA, 20 bp, Artificial
  CRISPR gRNA sequence
agagacttgaaaattagtca

SEQ ID NO: 204730 - DNA, 20 bp, Artificial
  CRISPR gRNA sequence
gagacttgaaaattagtcac

SEQ ID NO: 204731 - DNA, 20 bp, Artificial
  CRISPR gRNA sequence
cttgaaaattagtcacagga

SEQ ID NO: 204732 - DNA, 20 bp, Artificial
  CRISPR gRNA sequence
aaaattagtcacaggaaaga

SEQ ID NO: 204733 - DNA, 20 bp, Artificial
  CRISPR gRNA sequence
gtcacaggaaagaaagcact

SEQ ID NO: 204734 - DNA, 20 bp, Artificial
  CRISPR gRNA sequence
caggaaagaaagcacttgga

SEQ ID NO: 204735 - DNA, 20 bp, Artificial
  CRISPR gRNA sequence
gaaagaaagcacttggatgg

SEQ ID NO: 204736 - DNA, 20 bp, Artificial
  CRISPR gRNA sequence
agcacttggatggcagcaaa

SEQ ID NO: 204737 - DNA, 20 bp, Artificial
  CRISPR gRNA sequence
gatggcagcaaacagaaatg

SEQ ID NO: 204738 - DNA, 20 bp, Artificial
  CRISPR gRNA sequence
tggcagcaaacagaaatgaa

SEQ ID NO: 204739 - DNA, 20 bp, Artificial
  CRISPR gRNA sequence
aaatgaagagtacattaccc

SEQ ID NO: 204740 - DNA, 20 bp, Artificial
  CRISPR gRNA sequence
aatgaagagtacattacccc

SEQ ID NO: 204741 - DNA, 20 bp, Artificial
  CRISPR gRNA sequence
tacattaccccaggaccaat

SEQ ID NO: 204742 - DNA, 20 bp, Artificial
  CRISPR gRNA sequence
gaccaatcagccaaataaaa

SEQ ID NO: 204743 - DNA, 20 bp, Artificial
  CRISPR gRNA sequence
cagccaaataaaatggtcct

SEQ ID NO: 204744 - DNA, 20 bp, Artificial
  CRISPR gRNA sequence
taaaatggtccttagaccaa

SEQ ID NO: 204745 - DNA, 20 bp, Artificial
  CRISPR gRNA sequence
ggtccttagaccaaaagttt

SEQ ID NO: 204746 - DNA, 20 bp, Artificial
  CRISPR gRNA sequence
cacacaatatacaaattaac

SEQ ID NO: 204747 - DNA, 20 bp, Artificial
  CRISPR gRNA sequence
aacaagtaatacaaattaaa

SEQ ID NO: 204748 - DNA, 20 bp, Artificial
  CRISPR gRNA sequence
agtaaatgtgttttaccatg

SEQ ID NO: 204749 - DNA, 20 bp, Artificial
  CRISPR gRNA sequence
taaatgtgttttaccatgaa

SEQ ID NO: 204750 - DNA, 20 bp, Artificial
  CRISPR gRNA sequence
atgtgttttaccatgaagag

SEQ ID NO: 204751 - DNA, 20 bp, Artificial
  CRISPR gRNA sequence
atgaagagtagattaacaaa

SEQ ID NO: 204752 - DNA, 20 bp, Artificial
  CRISPR gRNA sequence
tgaagagtagattaacaaat

SEQ ID NO: 204753 - DNA, 20 bp, Artificial
  CRISPR gRNA sequence
gagtagattaacaaatagga

SEQ ID NO: 204754 - DNA, 20 bp, Artificial
  CRISPR gRNA sequence
acatcaacatttattaataa

SEQ ID NO: 204755 - DNA, 20 bp, Artificial
  CRISPR gRNA sequence
acagcctgctttttgattca

SEQ ID NO: 204756 - DNA, 20 bp, Artificial
  CRISPR gRNA sequence
cagcctgctttttgattcaa

SEQ ID NO: 204757 - DNA, 20 bp, Artificial
  CRISPR gRNA sequence
gcctgctttttgattcaaag

SEQ ID NO: 204758 - DNA, 20 bp, Artificial
  CRISPR gRNA sequence
aaggagtacctatccccatt

SEQ ID NO: 204759 - DNA, 20 bp, Artificial
  CRISPR gRNA sequence
cccatttggcctcctctcga

SEQ ID NO: 204760 - DNA, 20 bp, Artificial
  CRISPR gRNA sequence
catttggcctcctctcgaaa

SEQ ID NO: 204761 - DNA, 20 bp, Artificial
  CRISPR gRNA sequence
atttggcctcctctcgaaag

SEQ ID NO: 204762 - DNA, 20 bp, Artificial
  CRISPR gRNA sequence
gcctcctctcgaaagaggat

SEQ ID NO: 204763 - DNA, 20 bp, Artificial
  CRISPR gRNA sequence
cctcctctcgaaagaggatc

SEQ ID NO: 204764 - DNA, 20 bp, Artificial
  CRISPR gRNA sequence
gaaagaggatcaggttgcac

SEQ ID NO: 204765 - DNA, 20 bp, Artificial
  CRISPR gRNA sequence
aaagaggatcaggttgcacc

SEQ ID NO: 204766 - DNA, 20 bp, Artificial
  CRISPR gRNA sequence
tgcaccaggacaaataaaaa

SEQ ID NO: 204767 - DNA, 20 bp, Artificial
  CRISPR gRNA sequence
accaggacaaataaaaaaag

SEQ ID NO: 204768 - DNA, 20 bp, Artificial
  CRISPR gRNA sequence
aataaaaaaagaagctttca

SEQ ID NO: 204769 - DNA, 20 bp, Artificial
  CRISPR gRNA sequence
aaaaaaagaagctttcatag

SEQ ID NO: 204770 - DNA, 20 bp, Artificial
  CRISPR gRNA sequence
gtcttaccaacacgatattt

SEQ ID NO: 204771 - DNA, 20 bp, Artificial
  CRISPR gRNA sequence
gatgatcgtttcaccttctc

SEQ ID NO: 204772 - DNA, 20 bp, Artificial
  CRISPR gRNA sequence
ggttaattctgttacttcac

SEQ ID NO: 204773 - DNA, 20 bp, Artificial
  CRISPR gRNA sequence
attctgttacttcacaagtg

SEQ ID NO: 204774 - DNA, 20 bp, Artificial
  CRISPR gRNA sequence
aagtgtagtttcctgtgtgt

SEQ ID NO: 204775 - DNA, 20 bp, Artificial
  CRISPR gRNA sequence
gtagtttcctgtgtgtgaga

SEQ ID NO: 204776 - DNA, 20 bp, Artificial
  CRISPR gRNA sequence
atcactcttatccatcttca

SEQ ID NO: 204777 - DNA, 20 bp, Artificial
  CRISPR gRNA sequence
cactcttatccatcttcaaa

SEQ ID NO: 204778 - DNA, 20 bp, Artificial
  CRISPR gRNA sequence
actcttatccatcttcaaag

SEQ ID NO: 204779 - DNA, 20 bp, Artificial
  CRISPR gRNA sequence
ttcaaagaggcatctccttt

SEQ ID NO: 204780 - DNA, 20 bp, Artificial
  CRISPR gRNA sequence
catctccttttagtaattgt

SEQ ID NO: 204781 - DNA, 20 bp, Artificial
  CRISPR gRNA sequence
cttcaatttttgcactacta

SEQ ID NO: 204782 - DNA, 20 bp, Artificial
  CRISPR gRNA sequence
aatttttgcactactaaagt

SEQ ID NO: 204783 - DNA, 20 bp, Artificial
  CRISPR gRNA sequence
ttttgcactactaaagtcag

SEQ ID NO: 204784 - DNA, 20 bp, Artificial
  CRISPR gRNA sequence
tttgcactactaaagtcagt

SEQ ID NO: 204785 - DNA, 20 bp, Artificial
  CRISPR gRNA sequence
ttgcactactaaagtcagtg

SEQ ID NO: 204786 - DNA, 20 bp, Artificial
  CRISPR gRNA sequence
actactaaagtcagtgggga

SEQ ID NO: 204787 - DNA, 20 bp, Artificial
  CRISPR gRNA sequence
actaaagtcagtggggacag

SEQ ID NO: 204788 - DNA, 20 bp, Artificial
  CRISPR gRNA sequence
gtggggacagtggacttgtt

SEQ ID NO: 204789 - DNA, 20 bp, Artificial
  CRISPR gRNA sequence
ggggacagtggacttgttta

SEQ ID NO: 204790 - DNA, 20 bp, Artificial
  CRISPR gRNA sequence
acttgtttagagctccatca

SEQ ID NO: 204791 - DNA, 20 bp, Artificial
  CRISPR gRNA sequence
cttgtttagagctccatcaa

SEQ ID NO: 204792 - DNA, 20 bp, Artificial
  CRISPR gRNA sequence
tttccactttacgtatactt

SEQ ID NO: 204793 - DNA, 20 bp, Artificial
  CRISPR gRNA sequence
ccactttacgtatacttcag

SEQ ID NO: 204794 - DNA, 20 bp, Artificial
  CRISPR gRNA sequence
agtgttttgtgcctccatat

SEQ ID NO: 204795 - DNA, 20 bp, Artificial
  CRISPR gRNA sequence
gtgcctccatattagtaaca

SEQ ID NO: 204796 - DNA, 20 bp, Artificial
  CRISPR gRNA sequence
tccatattagtaacaaagca

SEQ ID NO: 204797 - DNA, 20 bp, Artificial
  CRISPR gRNA sequence
aacaaagcatggaatgacga

SEQ ID NO: 204798 - DNA, 20 bp, Artificial
  CRISPR gRNA sequence
attacaaaacgtgaattcta

SEQ ID NO: 204799 - DNA, 20 bp, Artificial
  CRISPR gRNA sequence
acagattttgttttattaaa

SEQ ID NO: 204800 - DNA, 20 bp, Artificial
  CRISPR gRNA sequence
gattttgttttattaaatag

SEQ ID NO: 204801 - DNA, 20 bp, Artificial
  CRISPR gRNA sequence
tgttttattaaatagtagct

SEQ ID NO: 204802 - DNA, 20 bp, Artificial
  CRISPR gRNA sequence
aatagtagctgagctgatcc

SEQ ID NO: 204803 - DNA, 20 bp, Artificial
  CRISPR gRNA sequence
gtagctgagctgatcctgga

SEQ ID NO: 204804 - DNA, 20 bp, Artificial
  CRISPR gRNA sequence
tagctgagctgatcctggaa

SEQ ID NO: 204805 - DNA, 20 bp, Artificial
  CRISPR gRNA sequence
agctgatcctggaaaggaaa

SEQ ID NO: 204806 - DNA, 20 bp, Artificial
  CRISPR gRNA sequence
gaaaaatgtttcattaatta

SEQ ID NO: 204807 - DNA, 20 bp, Artificial
  CRISPR gRNA sequence
aaatgtttcattaattatag

SEQ ID NO: 204808 - DNA, 20 bp, Artificial
  CRISPR gRNA sequence
attatagaagtctgtactgt

SEQ ID NO: 204809 - DNA, 20 bp, Artificial
  CRISPR gRNA sequence
aagtctgtactgtaagatct

SEQ ID NO: 204810 - DNA, 20 bp, Artificial
  CRISPR gRNA sequence
agtctgtactgtaagatctt

SEQ ID NO: 204811 - DNA, 20 bp, Artificial
  CRISPR gRNA sequence
taggcatgttacaaatcctt

SEQ ID NO: 204812 - DNA, 20 bp, Artificial
  CRISPR gRNA sequence
ttacaaatccttaagataaa

SEQ ID NO: 204813 - DNA, 20 bp, Artificial
  CRISPR gRNA sequence
aacatttccattgttcactt

SEQ ID NO: 204814 - DNA, 20 bp, Artificial
  CRISPR gRNA sequence
ccattgttcacttaagtaaa

SEQ ID NO: 204815 - DNA, 20 bp, Artificial
  CRISPR gRNA sequence
gttcacttaagtaaacagta

SEQ ID NO: 204816 - DNA, 20 bp, Artificial
  CRISPR gRNA sequence
aagtaaacagtatagcaatg

SEQ ID NO: 204817 - DNA, 20 bp, Artificial
  CRISPR gRNA sequence
taaacagtatagcaatgaag

SEQ ID NO: 204818 - DNA, 20 bp, Artificial
  CRISPR gRNA sequence
tagcaatgaagaagacctat

SEQ ID NO: 204819 - DNA, 20 bp, Artificial
  CRISPR gRNA sequence
agcaatgaagaagacctatt

SEQ ID NO: 204820 - DNA, 20 bp, Artificial
  CRISPR gRNA sequence
tattttaatattaacttgca

SEQ ID NO: 204821 - DNA, 20 bp, Artificial
  CRISPR gRNA sequence
ttaatattaacttgcacagc

SEQ ID NO: 204822 - DNA, 20 bp, Artificial
  CRISPR gRNA sequence
atattaacttgcacagctgg

SEQ ID NO: 204823 - DNA, 20 bp, Artificial
  CRISPR gRNA sequence
tattaacttgcacagctgga

SEQ ID NO: 204824 - DNA, 20 bp, Artificial
  CRISPR gRNA sequence
tattcattctcaataataca

SEQ ID NO: 204825 - DNA, 20 bp, Artificial
  CRISPR gRNA sequence
agtatacattacatgcatct

SEQ ID NO: 204826 - DNA, 20 bp, Artificial
  CRISPR gRNA sequence
gtatacattacatgcatctt

SEQ ID NO: 204827 - DNA, 20 bp, Artificial
  CRISPR gRNA sequence
atgcatcttgggaataaatt

SEQ ID NO: 204828 - DNA, 20 bp, Artificial
  CRISPR gRNA sequence
aataaattcagcaactatgt

SEQ ID NO: 204829 - DNA, 20 bp, Artificial
  CRISPR gRNA sequence
agcaactatgttggaacatg

SEQ ID NO: 204830 - DNA, 20 bp, Artificial
  CRISPR gRNA sequence
gcaactatgttggaacatgc

SEQ ID NO: 204831 - DNA, 20 bp, Artificial
  CRISPR gRNA sequence
tatgttggaacatgcaggtg

SEQ ID NO: 204832 - DNA, 20 bp, Artificial
  CRISPR gRNA sequence
gaacatgcaggtgtagtatc

SEQ ID NO: 204833 - DNA, 20 bp, Artificial
  CRISPR gRNA sequence
gcaggtgtagtatctggctt

SEQ ID NO: 204834 - DNA, 20 bp, Artificial
  CRISPR gRNA sequence
ggtgtagtatctggctttgg

SEQ ID NO: 204835 - DNA, 20 bp, Artificial
  CRISPR gRNA sequence
atctggctttggaagctttg

SEQ ID NO: 204836 - DNA, 20 bp, Artificial
  CRISPR gRNA sequence
ttactgcctactgatatatg

SEQ ID NO: 204837 - DNA, 20 bp, Artificial
  CRISPR gRNA sequence
agaaaaatattgtccttatc

SEQ ID NO: 204838 - DNA, 20 bp, Artificial
  CRISPR gRNA sequence
gaaaaatattgtccttatca

SEQ ID NO: 204839 - DNA, 20 bp, Artificial
  CRISPR gRNA sequence
tatcaaggtaaaattttgaa

SEQ ID NO: 204840 - DNA, 20 bp, Artificial
  CRISPR gRNA sequence
accaaaccaaatattttatt

SEQ ID NO: 204841 - DNA, 20 bp, Artificial
  CRISPR gRNA sequence
aacttcaacacactgctaaa

SEQ ID NO: 204842 - DNA, 20 bp, Artificial
  CRISPR gRNA sequence
ttatgctgcatttccaaaaa

SEQ ID NO: 204843 - DNA, 20 bp, Artificial
  CRISPR gRNA sequence
tgctgcatttccaaaaaaag

SEQ ID NO: 204844 - DNA, 20 bp, Artificial
  CRISPR gRNA sequence
tgcatttccaaaaaaagtgg

SEQ ID NO: 204845 - DNA, 20 bp, Artificial
  CRISPR gRNA sequence
gcatttccaaaaaaagtggc

SEQ ID NO: 204846 - DNA, 20 bp, Artificial
  CRISPR gRNA sequence
ctactgtactttaatataca

SEQ ID NO: 204847 - DNA, 20 bp, Artificial
  CRISPR gRNA sequence
actttaatatacaaagtaaa

SEQ ID NO: 204848 - DNA, 20 bp, Artificial
  CRISPR gRNA sequence
ctttaatatacaaagtaaat

SEQ ID NO: 204849 - DNA, 20 bp, Artificial
  CRISPR gRNA sequence
atcaaatcatatctttccac

SEQ ID NO: 204850 - DNA, 20 bp, Artificial
  CRISPR gRNA sequence
tcaaatcatatctttccact

SEQ ID NO: 204851 - DNA, 20 bp, Artificial
  CRISPR gRNA sequence
atcatatctttccactagga

SEQ ID NO: 204852 - DNA, 20 bp, Artificial
  CRISPR gRNA sequence
gaaaatcttaaaatactaat

SEQ ID NO: 204853 - DNA, 20 bp, Artificial
  CRISPR gRNA sequence
aaaatcttaaaatactaatg

SEQ ID NO: 204854 - DNA, 20 bp, Artificial
  CRISPR gRNA sequence
gaaaaaaaaaacattatctg

SEQ ID NO: 204855 - DNA, 20 bp, Artificial
  CRISPR gRNA sequence
tatctgtggctactttccca

SEQ ID NO: 204856 - DNA, 20 bp, Artificial
  CRISPR gRNA sequence
tactttcccatagcaaaata

SEQ ID NO: 204857 - DNA, 20 bp, Artificial
  CRISPR gRNA sequence
actttcccatagcaaaatat

SEQ ID NO: 204858 - DNA, 20 bp, Artificial
  CRISPR gRNA sequence
ttcccatagcaaaatatagg

SEQ ID NO: 204859 - DNA, 20 bp, Artificial
  CRISPR gRNA sequence
tagcaaaatataggcagcaa

SEQ ID NO: 204860 - DNA, 20 bp, Artificial
  CRISPR gRNA sequence
gcagcaatagacattttgta

SEQ ID NO: 204861 - DNA, 20 bp, Artificial
  CRISPR gRNA sequence
cagcaatagacattttgtat

SEQ ID NO: 204862 - DNA, 20 bp, Artificial
  CRISPR gRNA sequence
gcaatagacattttgtatgg

SEQ ID NO: 204863 - DNA, 20 bp, Artificial
  CRISPR gRNA sequence
cccacatttcattgacacta

SEQ ID NO: 204864 - DNA, 20 bp, Artificial
  CRISPR gRNA sequence
tcattgacactacagaacaa

SEQ ID NO: 204865 - DNA, 20 bp, Artificial
  CRISPR gRNA sequence
cagtctccaaatgtatatta

SEQ ID NO: 204866 - DNA, 20 bp, Artificial
  CRISPR gRNA sequence
agtctccaaatgtatattat

SEQ ID NO: 204867 - DNA, 20 bp, Artificial
  CRISPR gRNA sequence
attatgggtattcttcctcc

SEQ ID NO: 204868 - DNA, 20 bp, Artificial
  CRISPR gRNA sequence
tcctccaagaaaccacaaaa

SEQ ID NO: 204869 - DNA, 20 bp, Artificial
  CRISPR gRNA sequence
gaaaccacaaaacggtgaaa

SEQ ID NO: 204870 - DNA, 20 bp, Artificial
  CRISPR gRNA sequence
cacaaaacggtgaaaaagct

SEQ ID NO: 204871 - DNA, 20 bp, Artificial
  CRISPR gRNA sequence
aaacggtgaaaaagctaagt

SEQ ID NO: 204872 - DNA, 20 bp, Artificial
  CRISPR gRNA sequence
gaaaaagctaagtaagatgc

SEQ ID NO: 204873 - DNA, 20 bp, Artificial
  CRISPR gRNA sequence
gtaagatgcaagttgaaacc

SEQ ID NO: 204874 - DNA, 20 bp, Artificial
  CRISPR gRNA sequence
aagatgcaagttgaaaccaa

SEQ ID NO: 204875 - DNA, 20 bp, Artificial
  CRISPR gRNA sequence
atgcaagttgaaaccaagag

SEQ ID NO: 204876 - DNA, 20 bp, Artificial
  CRISPR gRNA sequence
caagagcagttactgctaat

SEQ ID NO: 204877 - DNA, 20 bp, Artificial
  CRISPR gRNA sequence
atcctatctacgcttctcaa

SEQ ID NO: 204878 - DNA, 20 bp, Artificial
  CRISPR gRNA sequence
tcctatctacgcttctcaat

SEQ ID NO: 204879 - DNA, 20 bp, Artificial
  CRISPR gRNA sequence
ttctcaataggataaactac

SEQ ID NO: 204880 - DNA, 20 bp, Artificial
  CRISPR gRNA sequence
aactaccagttgttgcctta

SEQ ID NO: 204881 - DNA, 20 bp, Artificial
  CRISPR gRNA sequence
taccagttgttgccttatag

SEQ ID NO: 204882 - DNA, 20 bp, Artificial
  CRISPR gRNA sequence
ccagttgttgccttatagaa

SEQ ID NO: 204883 - DNA, 20 bp, Artificial
  CRISPR gRNA sequence
cagttgttgccttatagaag

SEQ ID NO: 204884 - DNA, 20 bp, Artificial
  CRISPR gRNA sequence
ttgccttatagaagaggcac

SEQ ID NO: 204885 - DNA, 20 bp, Artificial
  CRISPR gRNA sequence
tgccttatagaagaggcact

SEQ ID NO: 204886 - DNA, 20 bp, Artificial
  CRISPR gRNA sequence
attgttcaactaaaatgtac

SEQ ID NO: 204887 - DNA, 20 bp, Artificial
  CRISPR gRNA sequence
ctaaaatgtacaagaatgtg

SEQ ID NO: 204888 - DNA, 20 bp, Artificial
  CRISPR gRNA sequence
taaaatgtacaagaatgtgt

SEQ ID NO: 204889 - DNA, 20 bp, Artificial
  CRISPR gRNA sequence
acaagaatgtgtaggaattg

SEQ ID NO: 204890 - DNA, 20 bp, Artificial
  CRISPR gRNA sequence
tagttgtcttccatattctt

SEQ ID NO: 204891 - DNA, 20 bp, Artificial
  CRISPR gRNA sequence
ttccatattcttcagccact

SEQ ID NO: 204892 - DNA, 20 bp, Artificial
  CRISPR gRNA sequence
actcagcaactcttttacct

SEQ ID NO: 204893 - DNA, 20 bp, Artificial
  CRISPR gRNA sequence
cagcaactcttttacctaag

SEQ ID NO: 204894 - DNA, 20 bp, Artificial
  CRISPR gRNA sequence
cttttacctaagtagctact

SEQ ID NO: 204895 - DNA, 20 bp, Artificial
  CRISPR gRNA sequence
taaaatatcaactttgttaa

SEQ ID NO: 204896 - DNA, 20 bp, Artificial
  CRISPR gRNA sequence
tttgttaatagttcacactt

SEQ ID NO: 204897 - DNA, 20 bp, Artificial
  CRISPR gRNA sequence
agatttacttctacataaac

SEQ ID NO: 204898 - DNA, 20 bp, Artificial
  CRISPR gRNA sequence
acataaactggaataaaaat

SEQ ID NO: 204899 - DNA, 20 bp, Artificial
  CRISPR gRNA sequence
ataaactggaataaaaatca

SEQ ID NO: 204900 - DNA, 20 bp, Artificial
  CRISPR gRNA sequence
taaactggaataaaaatcag

SEQ ID NO: 204901 - DNA, 20 bp, Artificial
  CRISPR gRNA sequence
tggaataaaaatcagaggca

SEQ ID NO: 204902 - DNA, 20 bp, Artificial
  CRISPR gRNA sequence
gcatagaatgtttctattgt

SEQ ID NO: 204903 - DNA, 20 bp, Artificial
  CRISPR gRNA sequence
ataccccatgaattgaatgc

SEQ ID NO: 204904 - DNA, 20 bp, Artificial
  CRISPR gRNA sequence
taccccatgaattgaatgca

SEQ ID NO: 204905 - DNA, 20 bp, Artificial
  CRISPR gRNA sequence
ttgaatgcaaggatgcatac

SEQ ID NO: 204906 - DNA, 20 bp, Artificial
  CRISPR gRNA sequence
caaggatgcatactggaata

SEQ ID NO: 204907 - DNA, 20 bp, Artificial
  CRISPR gRNA sequence
aaggatgcatactggaatat

SEQ ID NO: 204908 - DNA, 20 bp, Artificial
  CRISPR gRNA sequence
gcatactggaatataggtac

SEQ ID NO: 204909 - DNA, 20 bp, Artificial
  CRISPR gRNA sequence
ggacaatgttcaaaacacct

SEQ ID NO: 204910 - DNA, 20 bp, Artificial
  CRISPR gRNA sequence
cctttttaatatgctgcctt

SEQ ID NO: 204911 - DNA, 20 bp, Artificial
  CRISPR gRNA sequence
caactcacttttctatgcct

SEQ ID NO: 204912 - DNA, 20 bp, Artificial
  CRISPR gRNA sequence
ccttggtttactctctaaaa

SEQ ID NO: 204913 - DNA, 20 bp, Artificial
  CRISPR gRNA sequence
cttggtttactctctaaaat

SEQ ID NO: 204914 - DNA, 20 bp, Artificial
  CRISPR gRNA sequence
tggtttactctctaaaatag

SEQ ID NO: 204915 - DNA, 20 bp, Artificial
  CRISPR gRNA sequence
ggtttactctctaaaatagg

SEQ ID NO: 204916 - DNA, 20 bp, Artificial
  CRISPR gRNA sequence
ctaaaataggaggatctctt

SEQ ID NO: 204917 - DNA, 20 bp, Artificial
  CRISPR gRNA sequence
aaataggaggatctcttaag

SEQ ID NO: 204918 - DNA, 20 bp, Artificial
  CRISPR gRNA sequence
aataggaggatctcttaagt

SEQ ID NO: 204919 - DNA, 20 bp, Artificial
  CRISPR gRNA sequence
taggaggatctcttaagtag

SEQ ID NO: 204920 - DNA, 20 bp, Artificial
  CRISPR gRNA sequence
aggaggatctcttaagtagg

SEQ ID NO: 204921 - DNA, 20 bp, Artificial
  CRISPR gRNA sequence
ggaggatcaaaaacaaacac

SEQ ID NO: 204922 - DNA, 20 bp, Artificial
  CRISPR gRNA sequence
gaggatcaaaaacaaacacc

SEQ ID NO: 204923 - DNA, 20 bp, Artificial
  CRISPR gRNA sequence
acaaacaccgggctacttca

SEQ ID NO: 204924 - DNA, 20 bp, Artificial
  CRISPR gRNA sequence
ctacttcacagaactgtgtt

SEQ ID NO: 204925 - DNA, 20 bp, Artificial
  CRISPR gRNA sequence
aactgtgttgagcattaaca

SEQ ID NO: 204926 - DNA, 20 bp, Artificial
  CRISPR gRNA sequence
gagcattaacatggaaaaca

SEQ ID NO: 204927 - DNA, 20 bp, Artificial
  CRISPR gRNA sequence
cattaacatggaaaacatag

SEQ ID NO: 204928 - DNA, 20 bp, Artificial
  CRISPR gRNA sequence
aacatggaaaacatagcggc

SEQ ID NO: 204929 - DNA, 20 bp, Artificial
  CRISPR gRNA sequence
aatactatgctgtaaaaatg

SEQ ID NO: 204930 - DNA, 20 bp, Artificial
  CRISPR gRNA sequence
atactatgctgtaaaaatgt

SEQ ID NO: 204931 - DNA, 20 bp, Artificial
  CRISPR gRNA sequence
tactatgctgtaaaaatgta

SEQ ID NO: 204932 - DNA, 20 bp, Artificial
  CRISPR gRNA sequence
tagggtgatactataaaaac

SEQ ID NO: 204933 - DNA, 20 bp, Artificial
  CRISPR gRNA sequence
actataaaaactagataatc

SEQ ID NO: 204934 - DNA, 20 bp, Artificial
  CRISPR gRNA sequence
ggcattttaatgtaatgata

SEQ ID NO: 204935 - DNA, 20 bp, Artificial
  CRISPR gRNA sequence
gcattttaatgtaatgatat

SEQ ID NO: 204936 - DNA, 20 bp, Artificial
  CRISPR gRNA sequence
tgatatgggccctctttgac

SEQ ID NO: 204937 - DNA, 20 bp, Artificial
  CRISPR gRNA sequence
agtccaaattgttatatttc

SEQ ID NO: 204938 - DNA, 20 bp, Artificial
  CRISPR gRNA sequence
gtccaaattgttatatttct

SEQ ID NO: 204939 - DNA, 20 bp, Artificial
  CRISPR gRNA sequence
gttatatttctgggaaattg

SEQ ID NO: 204940 - DNA, 20 bp, Artificial
  CRISPR gRNA sequence
tgcagtctgaacctatattg

SEQ ID NO: 204941 - DNA, 20 bp, Artificial
  CRISPR gRNA sequence
gcagtctgaacctatattgt

SEQ ID NO: 204942 - DNA, 20 bp, Artificial
  CRISPR gRNA sequence
acctatattgtgggcatcca

SEQ ID NO: 204943 - DNA, 20 bp, Artificial
  CRISPR gRNA sequence
atccacagctcacctcttcc

SEQ ID NO: 204944 - DNA, 20 bp, Artificial
  CRISPR gRNA sequence
ttcccagttttctacatttc

SEQ ID NO: 204945 - DNA, 20 bp, Artificial
  CRISPR gRNA sequence
atttctagccacccaaatac

SEQ ID NO: 204946 - DNA, 20 bp, Artificial
  CRISPR gRNA sequence
tttctagccacccaaatact

SEQ ID NO: 204947 - DNA, 20 bp, Artificial
  CRISPR gRNA sequence
ctagccacccaaatactagg

SEQ ID NO: 204948 - DNA, 20 bp, Artificial
  CRISPR gRNA sequence
acccaaatactaggaagccc

SEQ ID NO: 204949 - DNA, 20 bp, Artificial
  CRISPR gRNA sequence
cccaaatactaggaagccca

SEQ ID NO: 204950 - DNA, 20 bp, Artificial
  CRISPR gRNA sequence
aggaagcccaaggcaaaacc

SEQ ID NO: 204951 - DNA, 20 bp, Artificial
  CRISPR gRNA sequence
cgttgcattctttaaaactt

SEQ ID NO: 204952 - DNA, 20 bp, Artificial
  CRISPR gRNA sequence
aattgtgaattatttcccct

SEQ ID NO: 204953 - DNA, 20 bp, Artificial
  CRISPR gRNA sequence
ttgtgaattatttcccctga

SEQ ID NO: 204954 - DNA, 20 bp, Artificial
  CRISPR gRNA sequence
gtgaattatttcccctgaga

SEQ ID NO: 204955 - DNA, 20 bp, Artificial
  CRISPR gRNA sequence
tcccctgagagagaaacact

SEQ ID NO: 204956 - DNA, 20 bp, Artificial
  CRISPR gRNA sequence
cccctgagagagaaacactg

SEQ ID NO: 204957 - DNA, 20 bp, Artificial
  CRISPR gRNA sequence
ccctgagagagaaacactga

SEQ ID NO: 204958 - DNA, 20 bp, Artificial
  CRISPR gRNA sequence
ctgagagagaaacactgagg

SEQ ID NO: 204959 - DNA, 20 bp, Artificial
  CRISPR gRNA sequence
gagagagaaacactgaggga

SEQ ID NO: 204960 - DNA, 20 bp, Artificial
  CRISPR gRNA sequence
gagagaaacactgagggaga

SEQ ID NO: 204961 - DNA, 20 bp, Artificial
  CRISPR gRNA sequence
agagaaacactgagggagag

SEQ ID NO: 204962 - DNA, 20 bp, Artificial
  CRISPR gRNA sequence
acactgagggagagaggaca

SEQ ID NO: 204963 - DNA, 20 bp, Artificial
  CRISPR gRNA sequence
ggagagaggacatagtatac

SEQ ID NO: 204964 - DNA, 20 bp, Artificial
  CRISPR gRNA sequence
agagaggacatagtatacca

SEQ ID NO: 204965 - DNA, 20 bp, Artificial
  CRISPR gRNA sequence
gaggacatagtataccagag

SEQ ID NO: 204966 - DNA, 20 bp, Artificial
  CRISPR gRNA sequence
tagtataccagagaagaata

SEQ ID NO: 204967 - DNA, 20 bp, Artificial
  CRISPR gRNA sequence
agtataccagagaagaataa

SEQ ID NO: 204968 - DNA, 20 bp, Artificial
  CRISPR gRNA sequence
gtataccagagaagaataaa

SEQ ID NO: 204969 - DNA, 20 bp, Artificial
  CRISPR gRNA sequence
tataccagagaagaataaag

SEQ ID NO: 204970 - DNA, 20 bp, Artificial
  CRISPR gRNA sequence
cagagaagaataaaggggtg

SEQ ID NO: 204971 - DNA, 20 bp, Artificial
  CRISPR gRNA sequence
gtgaagatgttcaaattata

SEQ ID NO: 204972 - DNA, 20 bp, Artificial
  CRISPR gRNA sequence
tgaagatgttcaaattataa

SEQ ID NO: 204973 - DNA, 20 bp, Artificial
  CRISPR gRNA sequence
agatgttcaaattataaagg

SEQ ID NO: 204974 - DNA, 20 bp, Artificial
  CRISPR gRNA sequence
gatgttcaaattataaagga

SEQ ID NO: 204975 - DNA, 20 bp, Artificial
  CRISPR gRNA sequence
ttcaaattataaaggaagga

SEQ ID NO: 204976 - DNA, 20 bp, Artificial
  CRISPR gRNA sequence
ttataaaggaaggaaagtat

SEQ ID NO: 204977 - DNA, 20 bp, Artificial
  CRISPR gRNA sequence
aaggaaagtatcagaaaata

SEQ ID NO: 204978 - DNA, 20 bp, Artificial
  CRISPR gRNA sequence
aagtatcagaaaatatggtg

SEQ ID NO: 204979 - DNA, 20 bp, Artificial
  CRISPR gRNA sequence
aaatatggtgaagattttga

SEQ ID NO: 204980 - DNA, 20 bp, Artificial
  CRISPR gRNA sequence
aatatggtgaagattttgaa

SEQ ID NO: 204981 - DNA, 20 bp, Artificial
  CRISPR gRNA sequence
atatggtgaagattttgaaa

SEQ ID NO: 204982 - DNA, 20 bp, Artificial
  CRISPR gRNA sequence
aagattttgaaagggataca

SEQ ID NO: 204983 - DNA, 20 bp, Artificial
  CRISPR gRNA sequence
gaaagggatacaaagactac

SEQ ID NO: 204984 - DNA, 20 bp, Artificial
  CRISPR gRNA sequence
aaagggatacaaagactact

SEQ ID NO: 204985 - DNA, 20 bp, Artificial
  CRISPR gRNA sequence
aagactactgggtatccttt

SEQ ID NO: 204986 - DNA, 20 bp, Artificial
  CRISPR gRNA sequence
tactgggtatcctttcagtc

SEQ ID NO: 204987 - DNA, 20 bp, Artificial
  CRISPR gRNA sequence
gtatcctttcagtcaagtgc

SEQ ID NO: 204988 - DNA, 20 bp, Artificial
  CRISPR gRNA sequence
tatcctttcagtcaagtgct

SEQ ID NO: 204989 - DNA, 20 bp, Artificial
  CRISPR gRNA sequence
aagtgctgggcaatgtctaa

SEQ ID NO: 204990 - DNA, 20 bp, Artificial
  CRISPR gRNA sequence
gcaatgtctaacagacgctt

SEQ ID NO: 204991 - DNA, 20 bp, Artificial
  CRISPR gRNA sequence
tttggaattatctgactcta

SEQ ID NO: 204992 - DNA, 20 bp, Artificial
  CRISPR gRNA sequence
ggaattatctgactctatag

SEQ ID NO: 204993 - DNA, 20 bp, Artificial
  CRISPR gRNA sequence
tgcctttcactgactttgac

SEQ ID NO: 204994 - DNA, 20 bp, Artificial
  CRISPR gRNA sequence
gcctttcactgactttgact

SEQ ID NO: 204995 - DNA, 20 bp, Artificial
  CRISPR gRNA sequence
actttgactgggctgtttta

SEQ ID NO: 204996 - DNA, 20 bp, Artificial
  CRISPR gRNA sequence
gggctgttttacagtttcat

SEQ ID NO: 204997 - DNA, 20 bp, Artificial
  CRISPR gRNA sequence
ttttacagtttcataagttg

SEQ ID NO: 204998 - DNA, 20 bp, Artificial
  CRISPR gRNA sequence
ttcataagttgtagaaaact

SEQ ID NO: 204999 - DNA, 20 bp, Artificial
  CRISPR gRNA sequence
cataagttgtagaaaactga

SEQ ID NO: 205000 - DNA, 20 bp, Artificial
  CRISPR gRNA sequence
aaaactgagagtaattcaaa

SEQ ID NO: 205001 - DNA, 20 bp, Artificial
  CRISPR gRNA sequence
caaatggattgctgtccata

SEQ ID NO: 205002 - DNA, 20 bp, Artificial
  CRISPR gRNA sequence
ttctgcaattgatttccacc

SEQ ID NO: 205003 - DNA, 20 bp, Artificial
  CRISPR gRNA sequence
tgcaattgatttccacctgg

SEQ ID NO: 205004 - DNA, 20 bp, Artificial
  CRISPR gRNA sequence
aattgatttccacctggtgg

SEQ ID NO: 205005 - DNA, 20 bp, Artificial
  CRISPR gRNA sequence
ttgatttccacctggtggaa

SEQ ID NO: 205006 - DNA, 20 bp, Artificial
  CRISPR gRNA sequence
gatttccacctggtggaaga

SEQ ID NO: 205007 - DNA, 20 bp, Artificial
  CRISPR gRNA sequence
atttccacctggtggaagag

SEQ ID NO: 205008 - DNA, 20 bp, Artificial
  CRISPR gRNA sequence
ggtggaagagaggattccaa

SEQ ID NO: 205009 - DNA, 20 bp, Artificial
  CRISPR gRNA sequence
agactacattttactgccct

SEQ ID NO: 205010 - DNA, 20 bp, Artificial
  CRISPR gRNA sequence
gactacattttactgccctg

SEQ ID NO: 205011 - DNA, 20 bp, Artificial
  CRISPR gRNA sequence
ttgaccaattttgcatttat

SEQ ID NO: 205012 - DNA, 20 bp, Artificial
  CRISPR gRNA sequence
catttattagcaaattcatt

SEQ ID NO: 205013 - DNA, 20 bp, Artificial
  CRISPR gRNA sequence
atttattagcaaattcattt

SEQ ID NO: 205014 - DNA, 20 bp, Artificial
  CRISPR gRNA sequence
tttttccaattttcttttaa

SEQ ID NO: 205015 - DNA, 20 bp, Artificial
  CRISPR gRNA sequence
ttttccaattttcttttaaa

SEQ ID NO: 205016 - DNA, 20 bp, Artificial
  CRISPR gRNA sequence
tttccaattttcttttaaaa

SEQ ID NO: 205017 - DNA, 20 bp, Artificial
  CRISPR gRNA sequence
aaagggttttgccttcttgc

SEQ ID NO: 205018 - DNA, 20 bp, Artificial
  CRISPR gRNA sequence
tagtttgcttgttaattaat

SEQ ID NO: 205019 - DNA, 20 bp, Artificial
  CRISPR gRNA sequence
ttttatatttgtatgaatca

SEQ ID NO: 205020 - DNA, 20 bp, Artificial
  CRISPR gRNA sequence
tgaatcatggtttgactttc

SEQ ID NO: 205021 - DNA, 20 bp, Artificial
  CRISPR gRNA sequence
aatcatggtttgactttcaa

SEQ ID NO: 205022 - DNA, 20 bp, Artificial
  CRISPR gRNA sequence
aagagattattcttaaaaaa

SEQ ID NO: 205023 - DNA, 20 bp, Artificial
  CRISPR gRNA sequence
gagattattcttaaaaaaaa

SEQ ID NO: 205024 - DNA, 20 bp, Artificial
  CRISPR gRNA sequence
agattattcttaaaaaaaag

SEQ ID NO: 205025 - DNA, 20 bp, Artificial
  CRISPR gRNA sequence
aaaaaaaagaggtacgaatg

SEQ ID NO: 205026 - DNA, 20 bp, Artificial
  CRISPR gRNA sequence
agaggtacgaatgaagaact

SEQ ID NO: 205027 - DNA, 20 bp, Artificial
  CRISPR gRNA sequence
atcctatgaaactttttgca

SEQ ID NO: 205028 - DNA, 20 bp, Artificial
  CRISPR gRNA sequence
tcctatgaaactttttgcaa

SEQ ID NO: 205029 - DNA, 20 bp, Artificial
  CRISPR gRNA sequence
tttttgcaaaggctttaatt

SEQ ID NO: 205030 - DNA, 20 bp, Artificial
  CRISPR gRNA sequence
tgcaaaggctttaattaagt

SEQ ID NO: 205031 - DNA, 20 bp, Artificial
  CRISPR gRNA sequence
aaggctttaattaagtaagt

SEQ ID NO: 205032 - DNA, 20 bp, Artificial
  CRISPR gRNA sequence
gctttaattaagtaagtaag

SEQ ID NO: 205033 - DNA, 20 bp, Artificial
  CRISPR gRNA sequence
ttaattaagtaagtaagaag

SEQ ID NO: 205034 - DNA, 20 bp, Artificial
  CRISPR gRNA sequence
ttaagtaagtaagaagtagt

SEQ ID NO: 205035 - DNA, 20 bp, Artificial
  CRISPR gRNA sequence
accatttcataacatatgtt

SEQ ID NO: 205036 - DNA, 20 bp, Artificial
  CRISPR gRNA sequence
catttcataacatatgttta

SEQ ID NO: 205037 - DNA, 20 bp, Artificial
  CRISPR gRNA sequence
gtttagagaatgaattttca

SEQ ID NO: 205038 - DNA, 20 bp, Artificial
  CRISPR gRNA sequence
tttagagaatgaattttcaa

SEQ ID NO: 205039 - DNA, 20 bp, Artificial
  CRISPR gRNA sequence
aatgaattttcaaaggaata

SEQ ID NO: 205040 - DNA, 20 bp, Artificial
  CRISPR gRNA sequence
aattttcaaaggaatacaga

SEQ ID NO: 205041 - DNA, 20 bp, Artificial
  CRISPR gRNA sequence
gttacaataaaaacatttta

SEQ ID NO: 205042 - DNA, 20 bp, Artificial
  CRISPR gRNA sequence
ataaaaacattttatagctg

SEQ ID NO: 205043 - DNA, 20 bp, Artificial
  CRISPR gRNA sequence
ttttatagctgaagcaattt

SEQ ID NO: 205044 - DNA, 20 bp, Artificial
  CRISPR gRNA sequence
tatagctgaagcaatttaag

SEQ ID NO: 205045 - DNA, 20 bp, Artificial
  CRISPR gRNA sequence
ttaagtagaataaatgctat

SEQ ID NO: 205046 - DNA, 20 bp, Artificial
  CRISPR gRNA sequence
aatgctattagtaaaaataa

SEQ ID NO: 205047 - DNA, 20 bp, Artificial
  CRISPR gRNA sequence
aaataacagtaaaattgacc

SEQ ID NO: 205048 - DNA, 20 bp, Artificial
  CRISPR gRNA sequence
aatttgaataacctttgcac

SEQ ID NO: 205049 - DNA, 20 bp, Artificial
  CRISPR gRNA sequence
tgcactagtaattaataaat

SEQ ID NO: 205050 - DNA, 20 bp, Artificial
  CRISPR gRNA sequence
gcactagtaattaataaata

SEQ ID NO: 205051 - DNA, 20 bp, Artificial
  CRISPR gRNA sequence
cactagtaattaataaataa

SEQ ID NO: 205052 - DNA, 20 bp, Artificial
  CRISPR gRNA sequence
tagtaattaataaataaggg

SEQ ID NO: 205053 - DNA, 20 bp, Artificial
  CRISPR gRNA sequence
agtaattaataaataagggc

SEQ ID NO: 205054 - DNA, 20 bp, Artificial
  CRISPR gRNA sequence
gcaggccaaaaatatcactc

SEQ ID NO: 205055 - DNA, 20 bp, Artificial
  CRISPR gRNA sequence
ctacaacttcaatctctata

SEQ ID NO: 205056 - DNA, 20 bp, Artificial
  CRISPR gRNA sequence
agatgcattaaaaaactatt

SEQ ID NO: 205057 - DNA, 20 bp, Artificial
  CRISPR gRNA sequence
tgcattaaaaaactattaag

SEQ ID NO: 205058 - DNA, 20 bp, Artificial
  CRISPR gRNA sequence
agtagtaaaactgtctgatt

SEQ ID NO: 205059 - DNA, 20 bp, Artificial
  CRISPR gRNA sequence
gtagtaaaactgtctgattt

SEQ ID NO: 205060 - DNA, 20 bp, Artificial
  CRISPR gRNA sequence
tagtaaaactgtctgatttg

SEQ ID NO: 205061 - DNA, 20 bp, Artificial
  CRISPR gRNA sequence
cctactcccttctcataaaa

SEQ ID NO: 205062 - DNA, 20 bp, Artificial
  CRISPR gRNA sequence
tcccttctcataaaacagca

SEQ ID NO: 205063 - DNA, 20 bp, Artificial
  CRISPR gRNA sequence
tctcataaaacagcaaagtg

SEQ ID NO: 205064 - DNA, 20 bp, Artificial
  CRISPR gRNA sequence
tgaagaaactatttaaaatg

SEQ ID NO: 205065 - DNA, 20 bp, Artificial
  CRISPR gRNA sequence
aagaaactatttaaaatgta

SEQ ID NO: 205066 - DNA, 20 bp, Artificial
  CRISPR gRNA sequence
gaaactatttaaaatgtaga

SEQ ID NO: 205067 - DNA, 20 bp, Artificial
  CRISPR gRNA sequence
taaaatgtagagagcaaata

SEQ ID NO: 205068 - DNA, 20 bp, Artificial
  CRISPR gRNA sequence
agagagcaaataaagaaaca

SEQ ID NO: 205069 - DNA, 20 bp, Artificial
  CRISPR gRNA sequence
cacagataattaacatgaat

SEQ ID NO: 205070 - DNA, 20 bp, Artificial
  CRISPR gRNA sequence
taagaaaactctgaataaac

SEQ ID NO: 205071 - DNA, 20 bp, Artificial
  CRISPR gRNA sequence
gaataaacaagatatgctta

SEQ ID NO: 205072 - DNA, 20 bp, Artificial
  CRISPR gRNA sequence
taaacaagatatgcttatag

SEQ ID NO: 205073 - DNA, 20 bp, Artificial
  CRISPR gRNA sequence
atgcttatagcagtctaaat

SEQ ID NO: 205074 - DNA, 20 bp, Artificial
  CRISPR gRNA sequence
ttatagcagtctaaatcaga

SEQ ID NO: 205075 - DNA, 20 bp, Artificial
  CRISPR gRNA sequence
tagcagtctaaatcagatag

SEQ ID NO: 205076 - DNA, 20 bp, Artificial
  CRISPR gRNA sequence
cagtctaaatcagatagcag

SEQ ID NO: 205077 - DNA, 20 bp, Artificial
  CRISPR gRNA sequence
agcagcagacaaatgtaacc

SEQ ID NO: 205078 - DNA, 20 bp, Artificial
  CRISPR gRNA sequence
cagcagacaaatgtaaccaa

SEQ ID NO: 205079 - DNA, 20 bp, Artificial
  CRISPR gRNA sequence
aatgtaaccaagagtaatgc

SEQ ID NO: 205080 - DNA, 20 bp, Artificial
  CRISPR gRNA sequence
tgtaaccaagagtaatgcca

SEQ ID NO: 205081 - DNA, 20 bp, Artificial
  CRISPR gRNA sequence
caagagtaatgccagagtta

SEQ ID NO: 205082 - DNA, 20 bp, Artificial
  CRISPR gRNA sequence
tgccagagttatagataaat

SEQ ID NO: 205083 - DNA, 20 bp, Artificial
  CRISPR gRNA sequence
agataaattagcaaataaaa

SEQ ID NO: 205084 - DNA, 20 bp, Artificial
  CRISPR gRNA sequence
gataaattagcaaataaaat

SEQ ID NO: 205085 - DNA, 20 bp, Artificial
  CRISPR gRNA sequence
gattttatatcaaatgccaa

SEQ ID NO: 205086 - DNA, 20 bp, Artificial
  CRISPR gRNA sequence
atatcaaatgccaaaagtat

SEQ ID NO: 205087 - DNA, 20 bp, Artificial
  CRISPR gRNA sequence
attagacttgaaaccttcat

SEQ ID NO: 205088 - DNA, 20 bp, Artificial
  CRISPR gRNA sequence
aaccttcattggaactgtac

SEQ ID NO: 205089 - DNA, 20 bp, Artificial
  CRISPR gRNA sequence
cattggaactgtacaagtat

SEQ ID NO: 205090 - DNA, 20 bp, Artificial
  CRISPR gRNA sequence
tgtacaagtattggtgaata

SEQ ID NO: 205091 - DNA, 20 bp, Artificial
  CRISPR gRNA sequence
tattggtgaatatagactat

SEQ ID NO: 205092 - DNA, 20 bp, Artificial
  CRISPR gRNA sequence
gcccaaaccatctcatatca

SEQ ID NO: 205093 - DNA, 20 bp, Artificial
  CRISPR gRNA sequence
aaccatctcatatcatagtc

SEQ ID NO: 205094 - DNA, 20 bp, Artificial
  CRISPR gRNA sequence
tctcatatcatagtctagaa

SEQ ID NO: 205095 - DNA, 20 bp, Artificial
  CRISPR gRNA sequence
tcatatcatagtctagaaaa

SEQ ID NO: 205096 - DNA, 20 bp, Artificial
  CRISPR gRNA sequence
tagtctagaaaagagctttg

SEQ ID NO: 205097 - DNA, 20 bp, Artificial
  CRISPR gRNA sequence
tctagaaaagagctttgtag

SEQ ID NO: 205098 - DNA, 20 bp, Artificial
  CRISPR gRNA sequence
agaaaagagctttgtagtgg

SEQ ID NO: 205099 - DNA, 20 bp, Artificial
  CRISPR gRNA sequence
aaaagagctttgtagtggca

SEQ ID NO: 205100 - DNA, 20 bp, Artificial
  CRISPR gRNA sequence
agagctttgtagtggcagag

SEQ ID NO: 205101 - DNA, 20 bp, Artificial
  CRISPR gRNA sequence
ggcagagaagactcaatcca

SEQ ID NO: 205102 - DNA, 20 bp, Artificial
  CRISPR gRNA sequence
agagaagactcaatccatgg

SEQ ID NO: 205103 - DNA, 20 bp, Artificial
  CRISPR gRNA sequence
gactcaatccatggtggtca

SEQ ID NO: 205104 - DNA, 20 bp, Artificial
  CRISPR gRNA sequence
ccatggtggtcacagcacac

SEQ ID NO: 205105 - DNA, 20 bp, Artificial
  CRISPR gRNA sequence
gtggtcacagcacacaagtt

SEQ ID NO: 205106 - DNA, 20 bp, Artificial
  CRISPR gRNA sequence
tggtcacagcacacaagttc

SEQ ID NO: 205107 - DNA, 20 bp, Artificial
  CRISPR gRNA sequence
cacagcacacaagttcaggt

SEQ ID NO: 205108 - DNA, 20 bp, Artificial
  CRISPR gRNA sequence
aaatgcaatcaacatttgtc

SEQ ID NO: 205109 - DNA, 20 bp, Artificial
  CRISPR gRNA sequence
cctgtgatgaaatattgtga

SEQ ID NO: 205110 - DNA, 20 bp, Artificial
  CRISPR gRNA sequence
ctgtgatgaaatattgtgat

SEQ ID NO: 205111 - DNA, 20 bp, Artificial
  CRISPR gRNA sequence
tgaaatattgtgataggatg

SEQ ID NO: 205112 - DNA, 20 bp, Artificial
  CRISPR gRNA sequence
gaaatattgtgataggatgt

SEQ ID NO: 205113 - DNA, 20 bp, Artificial
  CRISPR gRNA sequence
aaatattgtgataggatgtg

SEQ ID NO: 205114 - DNA, 20 bp, Artificial
  CRISPR gRNA sequence
tgtgataggatgtggggata

SEQ ID NO: 205115 - DNA, 20 bp, Artificial
  CRISPR gRNA sequence
gatatagtgatgaaaaaata

SEQ ID NO: 205116 - DNA, 20 bp, Artificial
  CRISPR gRNA sequence
aaaatatagttattatcttt

SEQ ID NO: 205117 - DNA, 20 bp, Artificial
  CRISPR gRNA sequence
aaatatagttattatctttt

SEQ ID NO: 205118 - DNA, 20 bp, Artificial
  CRISPR gRNA sequence
atatagttattatcttttag

SEQ ID NO: 205119 - DNA, 20 bp, Artificial
  CRISPR gRNA sequence
aggagcttacaattctcaaa

SEQ ID NO: 205120 - DNA, 20 bp, Artificial
  CRISPR gRNA sequence
ggagcttacaattctcaaat

SEQ ID NO: 205121 - DNA, 20 bp, Artificial
  CRISPR gRNA sequence
attctcaaatgggcgatgat

SEQ ID NO: 205122 - DNA, 20 bp, Artificial
  CRISPR gRNA sequence
cgatgataagtatataatac

SEQ ID NO: 205123 - DNA, 20 bp, Artificial
  CRISPR gRNA sequence
gatgataagtatataataca

SEQ ID NO: 205124 - DNA, 20 bp, Artificial
  CRISPR gRNA sequence
agtatataatacaaggttac

SEQ ID NO: 205125 - DNA, 20 bp, Artificial
  CRISPR gRNA sequence
caagtgttatcttttctgca

SEQ ID NO: 205126 - DNA, 20 bp, Artificial
  CRISPR gRNA sequence
ctgcatggacaacgtcctta

SEQ ID NO: 205127 - DNA, 20 bp, Artificial
  CRISPR gRNA sequence
atggacaacgtccttatgga

SEQ ID NO: 205128 - DNA, 20 bp, Artificial
  CRISPR gRNA sequence
tggacaacgtccttatggat

SEQ ID NO: 205129 - DNA, 20 bp, Artificial
  CRISPR gRNA sequence
acaacgtccttatggatggg

SEQ ID NO: 205130 - DNA, 20 bp, Artificial
  CRISPR gRNA sequence
acgtccttatggatgggcag

SEQ ID NO: 205131 - DNA, 20 bp, Artificial
  CRISPR gRNA sequence
gtccttatggatgggcagaa

SEQ ID NO: 205132 - DNA, 20 bp, Artificial
  CRISPR gRNA sequence
tggatgggcagaagagtaat

SEQ ID NO: 205133 - DNA, 20 bp, Artificial
  CRISPR gRNA sequence
cagaagagtaattggtctta

SEQ ID NO: 205134 - DNA, 20 bp, Artificial
  CRISPR gRNA sequence
aattggtcttacagatttct

SEQ ID NO: 205135 - DNA, 20 bp, Artificial
  CRISPR gRNA sequence
aagaaaattcatgttgctaa

SEQ ID NO: 205136 - DNA, 20 bp, Artificial
  CRISPR gRNA sequence
agaaaattcatgttgctaat

SEQ ID NO: 205137 - DNA, 20 bp, Artificial
  CRISPR gRNA sequence
atgttgctaataggcaaaaa

SEQ ID NO: 205138 - DNA, 20 bp, Artificial
  CRISPR gRNA sequence
ttgctaataggcaaaaacag

SEQ ID NO: 205139 - DNA, 20 bp, Artificial
  CRISPR gRNA sequence
gcaaaaacagaagaatgtca

SEQ ID NO: 205140 - DNA, 20 bp, Artificial
  CRISPR gRNA sequence
tgtcatagtccctgctcctc

SEQ ID NO: 205141 - DNA, 20 bp, Artificial
  CRISPR gRNA sequence
gtcatagtccctgctcctcc

SEQ ID NO: 205142 - DNA, 20 bp, Artificial
  CRISPR gRNA sequence
ctttatcccatactctccaa

SEQ ID NO: 205143 - DNA, 20 bp, Artificial
  CRISPR gRNA sequence
ttaatacaaactgaaacctt

SEQ ID NO: 205144 - DNA, 20 bp, Artificial
  CRISPR gRNA sequence
aatacaaactgaaaccttca

SEQ ID NO: 205145 - DNA, 20 bp, Artificial
  CRISPR gRNA sequence
atacaaactgaaaccttcag

SEQ ID NO: 205146 - DNA, 20 bp, Artificial
  CRISPR gRNA sequence
acaaactgaaaccttcagag

SEQ ID NO: 205147 - DNA, 20 bp, Artificial
  CRISPR gRNA sequence
accttcagaggagaatcctg

SEQ ID NO: 205148 - DNA, 20 bp, Artificial
  CRISPR gRNA sequence
aaatgaatcccatcacctga

SEQ ID NO: 205149 - DNA, 20 bp, Artificial
  CRISPR gRNA sequence
gaatcccatcacctgaaagc

SEQ ID NO: 205150 - DNA, 20 bp, Artificial
  CRISPR gRNA sequence
atttctgcctccatacccat

SEQ ID NO: 205151 - DNA, 20 bp, Artificial
  CRISPR gRNA sequence
gtctcctcaacgactttcct

SEQ ID NO: 205152 - DNA, 20 bp, Artificial
  CRISPR gRNA sequence
gactttccttagttgattat

SEQ ID NO: 205153 - DNA, 20 bp, Artificial
  CRISPR gRNA sequence
acatcccccattccatttac

SEQ ID NO: 205154 - DNA, 20 bp, Artificial
  CRISPR gRNA sequence
catcccccattccatttaca

SEQ ID NO: 205155 - DNA, 20 bp, Artificial
  CRISPR gRNA sequence
cctcatactttctctctccc

SEQ ID NO: 205156 - DNA, 20 bp, Artificial
  CRISPR gRNA sequence
atcccaaattaacaatctat

SEQ ID NO: 205157 - DNA, 20 bp, Artificial
  CRISPR gRNA sequence
cactccttaaatctgttacg

SEQ ID NO: 205158 - DNA, 20 bp, Artificial
  CRISPR gRNA sequence
cccctacttcttcattacta

SEQ ID NO: 205159 - DNA, 20 bp, Artificial
  CRISPR gRNA sequence
cattactacagctcttgcca

SEQ ID NO: 205160 - DNA, 20 bp, Artificial
  CRISPR gRNA sequence
tgtgaaaaatcaaatatgca

SEQ ID NO: 205161 - DNA, 20 bp, Artificial
  CRISPR gRNA sequence
tttctgtcttgacttttcca

SEQ ID NO: 205162 - DNA, 20 bp, Artificial
  CRISPR gRNA sequence
ttgacttttccacagttctt

SEQ ID NO: 205163 - DNA, 20 bp, Artificial
  CRISPR gRNA sequence
cttttccacagttcttgagc

SEQ ID NO: 205164 - DNA, 20 bp, Artificial
  CRISPR gRNA sequence
ttccacagttcttgagccag

SEQ ID NO: 205165 - DNA, 20 bp, Artificial
  CRISPR gRNA sequence
tccacagttcttgagccagt

SEQ ID NO: 205166 - DNA, 20 bp, Artificial
  CRISPR gRNA sequence
acagttcttgagccagtggg

SEQ ID NO: 205167 - DNA, 20 bp, Artificial
  CRISPR gRNA sequence
tctttcttgctcttctctct

SEQ ID NO: 205168 - DNA, 20 bp, Artificial
  CRISPR gRNA sequence
ctcttctctcttggcctcca

SEQ ID NO: 205169 - DNA, 20 bp, Artificial
  CRISPR gRNA sequence
ctgctttgtccaccccatcc

SEQ ID NO: 205170 - DNA, 20 bp, Artificial
  CRISPR gRNA sequence
ccttgactcacactaaatgt

SEQ ID NO: 205171 - DNA, 20 bp, Artificial
  CRISPR gRNA sequence
cactaaatgttagtgtccct

SEQ ID NO: 205172 - DNA, 20 bp, Artificial
  CRISPR gRNA sequence
actaaatgttagtgtcccta

SEQ ID NO: 205173 - DNA, 20 bp, Artificial
  CRISPR gRNA sequence
ctaaatgttagtgtccctaa

SEQ ID NO: 205174 - DNA, 20 bp, Artificial
  CRISPR gRNA sequence
gttagtgtccctaagggctt

SEQ ID NO: 205175 - DNA, 20 bp, Artificial
  CRISPR gRNA sequence
gtccctaagggcttcagatt

SEQ ID NO: 205176 - DNA, 20 bp, Artificial
  CRISPR gRNA sequence
attcagtaccctctgccccc

SEQ ID NO: 205177 - DNA, 20 bp, Artificial
  CRISPR gRNA sequence
agtattttccctgactccca

SEQ ID NO: 205178 - DNA, 20 bp, Artificial
  CRISPR gRNA sequence
actgcctttcttctaaactg

SEQ ID NO: 205179 - DNA, 20 bp, Artificial
  CRISPR gRNA sequence
ttcttctaaactgcagatgt

SEQ ID NO: 205180 - DNA, 20 bp, Artificial
  CRISPR gRNA sequence
tctaaactgcagatgttgga

SEQ ID NO: 205181 - DNA, 20 bp, Artificial
  CRISPR gRNA sequence
gtctgctgtgcacttccact

SEQ ID NO: 205182 - DNA, 20 bp, Artificial
  CRISPR gRNA sequence
acttccacttggatgtaata

SEQ ID NO: 205183 - DNA, 20 bp, Artificial
  CRISPR gRNA sequence
gatgtaatacagttacttca

SEQ ID NO: 205184 - DNA, 20 bp, Artificial
  CRISPR gRNA sequence
taatacagttacttcaaagt

SEQ ID NO: 205185 - DNA, 20 bp, Artificial
  CRISPR gRNA sequence
gtacccccacttcttaccct

SEQ ID NO: 205186 - DNA, 20 bp, Artificial
  CRISPR gRNA sequence
cagcctaaatcactttgcta

SEQ ID NO: 205187 - DNA, 20 bp, Artificial
  CRISPR gRNA sequence
aagtattttctatcatctac

SEQ ID NO: 205188 - DNA, 20 bp, Artificial
  CRISPR gRNA sequence
tctatcatctaccagtgaac

SEQ ID NO: 205189 - DNA, 20 bp, Artificial
  CRISPR gRNA sequence
atctaccagtgaaccagacc

SEQ ID NO: 205190 - DNA, 20 bp, Artificial
  CRISPR gRNA sequence
agtgaaccagacctggacct

SEQ ID NO: 205191 - DNA, 20 bp, Artificial
  CRISPR gRNA sequence
cctggacctaagaatcacat

SEQ ID NO: 205192 - DNA, 20 bp, Artificial
  CRISPR gRNA sequence
attagattactccctctcct

SEQ ID NO: 205193 - DNA, 20 bp, Artificial
  CRISPR gRNA sequence
ttactccctctccttagcca

SEQ ID NO: 205194 - DNA, 20 bp, Artificial
  CRISPR gRNA sequence
actccctctccttagccatg

SEQ ID NO: 205195 - DNA, 20 bp, Artificial
  CRISPR gRNA sequence
ccttagccatggagaattct

SEQ ID NO: 205196 - DNA, 20 bp, Artificial
  CRISPR gRNA sequence
tagccatggagaattcttag

SEQ ID NO: 205197 - DNA, 20 bp, Artificial
  CRISPR gRNA sequence
agccatggagaattcttagt

SEQ ID NO: 205198 - DNA, 20 bp, Artificial
  CRISPR gRNA sequence
agtaggttcaacctaattaa

SEQ ID NO: 205199 - DNA, 20 bp, Artificial
  CRISPR gRNA sequence
tgtctgttgaatgaatgaat

SEQ ID NO: 205200 - DNA, 20 bp, Artificial
  CRISPR gRNA sequence
tactgccatacccttctaac

SEQ ID NO: 205201 - DNA, 20 bp, Artificial
  CRISPR gRNA sequence
agctccctgcctccatcctc

SEQ ID NO: 205202 - DNA, 20 bp, Artificial
  CRISPR gRNA sequence
gctccctgcctccatcctca

SEQ ID NO: 205203 - DNA, 20 bp, Artificial
  CRISPR gRNA sequence
tcctcaaggtttctccatcc

SEQ ID NO: 205204 - DNA, 20 bp, Artificial
  CRISPR gRNA sequence
tggccctgatgtattttcta

SEQ ID NO: 205205 - DNA, 20 bp, Artificial
  CRISPR gRNA sequence
aaatgtgcactcctttgcct

SEQ ID NO: 205206 - DNA, 20 bp, Artificial
  CRISPR gRNA sequence
acaacaccctcaaccctttt

SEQ ID NO: 205207 - DNA, 20 bp, Artificial
  CRISPR gRNA sequence
caacaccctcaacccttttc

SEQ ID NO: 205208 - DNA, 20 bp, Artificial
  CRISPR gRNA sequence
cccttttcaggctaaattct

SEQ ID NO: 205209 - DNA, 20 bp, Artificial
  CRISPR gRNA sequence
aggctaaattctaagtacat

SEQ ID NO: 205210 - DNA, 20 bp, Artificial
  CRISPR gRNA sequence
aaattctaagtacattagca

SEQ ID NO: 205211 - DNA, 20 bp, Artificial
  CRISPR gRNA sequence
cattagcatggaatacaaac

SEQ ID NO: 205212 - DNA, 20 bp, Artificial
  CRISPR gRNA sequence
attagcatggaatacaaacg

SEQ ID NO: 205213 - DNA, 20 bp, Artificial
  CRISPR gRNA sequence
gaatacaaacgaggtccttc

SEQ ID NO: 205214 - DNA, 20 bp, Artificial
  CRISPR gRNA sequence
aggtccttcaagatcctttc

SEQ ID NO: 205215 - DNA, 20 bp, Artificial
  CRISPR gRNA sequence
tactccctcatttccacact

SEQ ID NO: 205216 - DNA, 20 bp, Artificial
  CRISPR gRNA sequence
gcactctcatccccatgcct

SEQ ID NO: 205217 - DNA, 20 bp, Artificial
  CRISPR gRNA sequence
tactgttcctcaaacctaaa

SEQ ID NO: 205218 - DNA, 20 bp, Artificial
  CRISPR gRNA sequence
ttatacactattaccccact

SEQ ID NO: 205219 - DNA, 20 bp, Artificial
  CRISPR gRNA sequence
ctattaccccactgagtaca

SEQ ID NO: 205220 - DNA, 20 bp, Artificial
  CRISPR gRNA sequence
tattaccccactgagtacat

SEQ ID NO: 205221 - DNA, 20 bp, Artificial
  CRISPR gRNA sequence
attaccccactgagtacata

SEQ ID NO: 205222 - DNA, 20 bp, Artificial
  CRISPR gRNA sequence
tgagtacatagggtgtataa

SEQ ID NO: 205223 - DNA, 20 bp, Artificial
  CRISPR gRNA sequence
acatagggtgtataatagtt

SEQ ID NO: 205224 - DNA, 20 bp, Artificial
  CRISPR gRNA sequence
aatagttaagtgcacacatt

SEQ ID NO: 205225 - DNA, 20 bp, Artificial
  CRISPR gRNA sequence
atagttaagtgcacacatta

SEQ ID NO: 205226 - DNA, 20 bp, Artificial
  CRISPR gRNA sequence
tagttaagtgcacacattaa

SEQ ID NO: 205227 - DNA, 20 bp, Artificial
  CRISPR gRNA sequence
agttaagtgcacacattaag

SEQ ID NO: 205228 - DNA, 20 bp, Artificial
  CRISPR gRNA sequence
acacattaaggggtcgaccc

SEQ ID NO: 205229 - DNA, 20 bp, Artificial
  CRISPR gRNA sequence
taaggggtcgaccctagttt

SEQ ID NO: 205230 - DNA, 20 bp, Artificial
  CRISPR gRNA sequence
gattcacctcatgtacttct

SEQ ID NO: 205231 - DNA, 20 bp, Artificial
  CRISPR gRNA sequence
acttcttagctgtataacct

SEQ ID NO: 205232 - DNA, 20 bp, Artificial
  CRISPR gRNA sequence
cttcttagctgtataacctt

SEQ ID NO: 205233 - DNA, 20 bp, Artificial
  CRISPR gRNA sequence
ttagctgtataaccttaggc

SEQ ID NO: 205234 - DNA, 20 bp, Artificial
  CRISPR gRNA sequence
agttacttacctctgctcct

SEQ ID NO: 205235 - DNA, 20 bp, Artificial
  CRISPR gRNA sequence
cctcatctataaaatgtgca

SEQ ID NO: 205236 - DNA, 20 bp, Artificial
  CRISPR gRNA sequence
ctataaaatgtgcatagtga

SEQ ID NO: 205237 - DNA, 20 bp, Artificial
  CRISPR gRNA sequence
tagtgatggtatatacctca

SEQ ID NO: 205238 - DNA, 20 bp, Artificial
  CRISPR gRNA sequence
gtgatggtatatacctcata

SEQ ID NO: 205239 - DNA, 20 bp, Artificial
  CRISPR gRNA sequence
tacctcatagagatattgtt

SEQ ID NO: 205240 - DNA, 20 bp, Artificial
  CRISPR gRNA sequence
agatattgttaagatttaat

SEQ ID NO: 205241 - DNA, 20 bp, Artificial
  CRISPR gRNA sequence
tgtatcacctttcacatata

SEQ ID NO: 205242 - DNA, 20 bp, Artificial
  CRISPR gRNA sequence
tcacctttcacatatacagc

SEQ ID NO: 205243 - DNA, 20 bp, Artificial
  CRISPR gRNA sequence
tacagcaagtactcaataaa

SEQ ID NO: 205244 - DNA, 20 bp, Artificial
  CRISPR gRNA sequence
agcaagtactcaataaatgg

SEQ ID NO: 205245 - DNA, 20 bp, Artificial
  CRISPR gRNA sequence
tactcaataaatggcagcta

SEQ ID NO: 205246 - DNA, 20 bp, Artificial
  CRISPR gRNA sequence
aacttttgctcttcctacta

SEQ ID NO: 205247 - DNA, 20 bp, Artificial
  CRISPR gRNA sequence
ttgctcttcctactaaagca

SEQ ID NO: 205248 - DNA, 20 bp, Artificial
  CRISPR gRNA sequence
cttcctactaaagcacagtt

SEQ ID NO: 205249 - DNA, 20 bp, Artificial
  CRISPR gRNA sequence
ttttacttaactgatctctc

SEQ ID NO: 205250 - DNA, 20 bp, Artificial
  CRISPR gRNA sequence
tttacttaactgatctctcc

SEQ ID NO: 205251 - DNA, 20 bp, Artificial
  CRISPR gRNA sequence
ttaactgatctctccaggct

SEQ ID NO: 205252 - DNA, 20 bp, Artificial
  CRISPR gRNA sequence
ctgatctctccaggctcaga

SEQ ID NO: 205253 - DNA, 20 bp, Artificial
  CRISPR gRNA sequence
tctctccaggctcagaaagt

SEQ ID NO: 205254 - DNA, 20 bp, Artificial
  CRISPR gRNA sequence
agtaagacactgtcttcatt

SEQ ID NO: 205255 - DNA, 20 bp, Artificial
  CRISPR gRNA sequence
ctgtcttcatttggtatcct

SEQ ID NO: 205256 - DNA, 20 bp, Artificial
  CRISPR gRNA sequence
ggtatcctaagaatctaaca

SEQ ID NO: 205257 - DNA, 20 bp, Artificial
  CRISPR gRNA sequence
gtatcctaagaatctaacac

SEQ ID NO: 205258 - DNA, 20 bp, Artificial
  CRISPR gRNA sequence
tatcctaagaatctaacaca

SEQ ID NO: 205259 - DNA, 20 bp, Artificial
  CRISPR gRNA sequence
taagaatctaacacagggtc

SEQ ID NO: 205260 - DNA, 20 bp, Artificial
  CRISPR gRNA sequence
aatctaacacagggtccaga

SEQ ID NO: 205261 - DNA, 20 bp, Artificial
  CRISPR gRNA sequence
ctaacacagggtccagaaag

SEQ ID NO: 205262 - DNA, 20 bp, Artificial
  CRISPR gRNA sequence
taacacagggtccagaaagt

SEQ ID NO: 205263 - DNA, 20 bp, Artificial
  CRISPR gRNA sequence
accttccttgtgaatgtaaa

SEQ ID NO: 205264 - DNA, 20 bp, Artificial
  CRISPR gRNA sequence
ttgtgaatgtaaaaagttta

SEQ ID NO: 205265 - DNA, 20 bp, Artificial
  CRISPR gRNA sequence
agtttaaagtataaattcca

SEQ ID NO: 205266 - DNA, 20 bp, Artificial
  CRISPR gRNA sequence
ttaaagtataaattccatag

SEQ ID NO: 205267 - DNA, 20 bp, Artificial
  CRISPR gRNA sequence
agaaaaatctaaaaatcatg

SEQ ID NO: 205268 - DNA, 20 bp, Artificial
  CRISPR gRNA sequence
gaaaaatctaaaaatcatgt

SEQ ID NO: 205269 - DNA, 20 bp, Artificial
  CRISPR gRNA sequence
aaaatctaaaaatcatgtgg

SEQ ID NO: 205270 - DNA, 20 bp, Artificial
  CRISPR gRNA sequence
atctaaaaatcatgtgggag

SEQ ID NO: 205271 - DNA, 20 bp, Artificial
  CRISPR gRNA sequence
aaaaatcatgtgggagaaga

SEQ ID NO: 205272 - DNA, 20 bp, Artificial
  CRISPR gRNA sequence
agatttttcttctgtatttc

SEQ ID NO: 205273 - DNA, 20 bp, Artificial
  CRISPR gRNA sequence
atttttcttctgtatttcaa

SEQ ID NO: 205274 - DNA, 20 bp, Artificial
  CRISPR gRNA sequence
gccactgcttctcacttgta

SEQ ID NO: 205275 - DNA, 20 bp, Artificial
  CRISPR gRNA sequence
gacttgattatgaaatcatg

SEQ ID NO: 205276 - DNA, 20 bp, Artificial
  CRISPR gRNA sequence
catgaagctgcatattttca

SEQ ID NO: 205277 - DNA, 20 bp, Artificial
  CRISPR gRNA sequence
atattttcatggaaaatctc

SEQ ID NO: 205278 - DNA, 20 bp, Artificial
  CRISPR gRNA sequence
aaaatctcaagtcacttgta

SEQ ID NO: 205279 - DNA, 20 bp, Artificial
  CRISPR gRNA sequence
tctcaagtcacttgtatggt

SEQ ID NO: 205280 - DNA, 20 bp, Artificial
  CRISPR gRNA sequence
aagtcacttgtatggttgga

SEQ ID NO: 205281 - DNA, 20 bp, Artificial
  CRISPR gRNA sequence
acttgtatggttggatagaa

SEQ ID NO: 205282 - DNA, 20 bp, Artificial
  CRISPR gRNA sequence
aaaagttccttaaaaatcac

SEQ ID NO: 205283 - DNA, 20 bp, Artificial
  CRISPR gRNA sequence
gtgtctatgaatgatcttcc

SEQ ID NO: 205284 - DNA, 20 bp, Artificial
  CRISPR gRNA sequence
gtctatgaatgatcttccta

SEQ ID NO: 205285 - DNA, 20 bp, Artificial
  CRISPR gRNA sequence
tctatgaatgatcttcctag

SEQ ID NO: 205286 - DNA, 20 bp, Artificial
  CRISPR gRNA sequence
ctatgaatgatcttcctaga

SEQ ID NO: 205287 - DNA, 20 bp, Artificial
  CRISPR gRNA sequence
ctagagggtgatgtttaaac

SEQ ID NO: 205288 - DNA, 20 bp, Artificial
  CRISPR gRNA sequence
tagagggtgatgtttaaact

SEQ ID NO: 205289 - DNA, 20 bp, Artificial
  CRISPR gRNA sequence
gatgtttaaactgggtctta

SEQ ID NO: 205290 - DNA, 20 bp, Artificial
  CRISPR gRNA sequence
atgtttaaactgggtcttaa

SEQ ID NO: 205291 - DNA, 20 bp, Artificial
  CRISPR gRNA sequence
taaactgggtcttaaaggat

SEQ ID NO: 205292 - DNA, 20 bp, Artificial
  CRISPR gRNA sequence
ctgggtcttaaaggatgagt

SEQ ID NO: 205293 - DNA, 20 bp, Artificial
  CRISPR gRNA sequence
aaggatgagtaagaatgtta

SEQ ID NO: 205294 - DNA, 20 bp, Artificial
  CRISPR gRNA sequence
aggatgagtaagaatgttat

SEQ ID NO: 205295 - DNA, 20 bp, Artificial
  CRISPR gRNA sequence
tgagtaagaatgttatggga

SEQ ID NO: 205296 - DNA, 20 bp, Artificial
  CRISPR gRNA sequence
gtaagaatgttatgggaaag

SEQ ID NO: 205297 - DNA, 20 bp, Artificial
  CRISPR gRNA sequence
taagaatgttatgggaaaga

SEQ ID NO: 205298 - DNA, 20 bp, Artificial
  CRISPR gRNA sequence
aagaatgttatgggaaagaa

SEQ ID NO: 205299 - DNA, 20 bp, Artificial
  CRISPR gRNA sequence
agaatgttatgggaaagaag

SEQ ID NO: 205300 - DNA, 20 bp, Artificial
  CRISPR gRNA sequence
atgggaaagaaggggctttc

SEQ ID NO: 205301 - DNA, 20 bp, Artificial
  CRISPR gRNA sequence
tgggaaagaaggggctttct

SEQ ID NO: 205302 - DNA, 20 bp, Artificial
  CRISPR gRNA sequence
gaaagaaggggctttctagg

SEQ ID NO: 205303 - DNA, 20 bp, Artificial
  CRISPR gRNA sequence
aagaaggggctttctaggca

SEQ ID NO: 205304 - DNA, 20 bp, Artificial
  CRISPR gRNA sequence
tctaggcagagtaacgtgta

SEQ ID NO: 205305 - DNA, 20 bp, Artificial
  CRISPR gRNA sequence
ggcagagtaacgtgtacagc

SEQ ID NO: 205306 - DNA, 20 bp, Artificial
  CRISPR gRNA sequence
gtaacgtgtacagccagata

SEQ ID NO: 205307 - DNA, 20 bp, Artificial
  CRISPR gRNA sequence
cgtgtacagccagataaaga

SEQ ID NO: 205308 - DNA, 20 bp, Artificial
  CRISPR gRNA sequence
acagccagataaagaaagtg

SEQ ID NO: 205309 - DNA, 20 bp, Artificial
  CRISPR gRNA sequence
taaagaaagtgaagaactga

SEQ ID NO: 205310 - DNA, 20 bp, Artificial
  CRISPR gRNA sequence
agaaagtgaagaactgaaag

SEQ ID NO: 205311 - DNA, 20 bp, Artificial
  CRISPR gRNA sequence
aaagtgaagaactgaaagca

SEQ ID NO: 205312 - DNA, 20 bp, Artificial
  CRISPR gRNA sequence
actgaaagcagagaattatt

SEQ ID NO: 205313 - DNA, 20 bp, Artificial
  CRISPR gRNA sequence
ctgaaagcagagaattattt

SEQ ID NO: 205314 - DNA, 20 bp, Artificial
  CRISPR gRNA sequence
aagcagagaattatttaggt

SEQ ID NO: 205315 - DNA, 20 bp, Artificial
  CRISPR gRNA sequence
agaattatttaggtgagctc

SEQ ID NO: 205316 - DNA, 20 bp, Artificial
  CRISPR gRNA sequence
gaattatttaggtgagctct

SEQ ID NO: 205317 - DNA, 20 bp, Artificial
  CRISPR gRNA sequence
ttaggtgagctctaggaaat

SEQ ID NO: 205318 - DNA, 20 bp, Artificial
  CRISPR gRNA sequence
taggtgagctctaggaaatg

SEQ ID NO: 205319 - DNA, 20 bp, Artificial
  CRISPR gRNA sequence
tgagctctaggaaatgaggt

SEQ ID NO: 205320 - DNA, 20 bp, Artificial
  CRISPR gRNA sequence
tctaggaaatgaggttggaa

SEQ ID NO: 205321 - DNA, 20 bp, Artificial
  CRISPR gRNA sequence
tgaggttggaaaagatgaat

SEQ ID NO: 205322 - DNA, 20 bp, Artificial
  CRISPR gRNA sequence
gatgaataagaaaaattcta

SEQ ID NO: 205323 - DNA, 20 bp, Artificial
  CRISPR gRNA sequence
atgaataagaaaaattctaa

SEQ ID NO: 205324 - DNA, 20 bp, Artificial
  CRISPR gRNA sequence
tgaataagaaaaattctaaa

SEQ ID NO: 205325 - DNA, 20 bp, Artificial
  CRISPR gRNA sequence
gcttccttgaatgtcatgct

SEQ ID NO: 205326 - DNA, 20 bp, Artificial
  CRISPR gRNA sequence
cttgaatgtcatgctgagtt

SEQ ID NO: 205327 - DNA, 20 bp, Artificial
  CRISPR gRNA sequence
ataaacaactgtaaaccact

SEQ ID NO: 205328 - DNA, 20 bp, Artificial
  CRISPR gRNA sequence
cattaaaaaaaaaacattga

SEQ ID NO: 205329 - DNA, 20 bp, Artificial
  CRISPR gRNA sequence
taaaaaaaaaacattgacag

SEQ ID NO: 205330 - DNA, 20 bp, Artificial
  CRISPR gRNA sequence
aaaacattgacagcagtgta

SEQ ID NO: 205331 - DNA, 20 bp, Artificial
  CRISPR gRNA sequence
aaacattgacagcagtgtaa

SEQ ID NO: 205332 - DNA, 20 bp, Artificial
  CRISPR gRNA sequence
cattgacagcagtgtaaagg

SEQ ID NO: 205333 - DNA, 20 bp, Artificial
  CRISPR gRNA sequence
attgacagcagtgtaaagga

SEQ ID NO: 205334 - DNA, 20 bp, Artificial
  CRISPR gRNA sequence
agcagtgtaaaggaaggact

SEQ ID NO: 205335 - DNA, 20 bp, Artificial
  CRISPR gRNA sequence
gcagtgtaaaggaaggactg

SEQ ID NO: 205336 - DNA, 20 bp, Artificial
  CRISPR gRNA sequence
cagtgtaaaggaaggactga

SEQ ID NO: 205337 - DNA, 20 bp, Artificial
  CRISPR gRNA sequence
tgtaaaggaaggactgaggg

SEQ ID NO: 205338 - DNA, 20 bp, Artificial
  CRISPR gRNA sequence
aaggaaggactgagggcagc

SEQ ID NO: 205339 - DNA, 20 bp, Artificial
  CRISPR gRNA sequence
aggaaggactgagggcagca

SEQ ID NO: 205340 - DNA, 20 bp, Artificial
  CRISPR gRNA sequence
ggaaggactgagggcagcaa

SEQ ID NO: 205341 - DNA, 20 bp, Artificial
  CRISPR gRNA sequence
gactgagggcagcaagggaa

SEQ ID NO: 205342 - DNA, 20 bp, Artificial
  CRISPR gRNA sequence
ctgagggcagcaagggaaaa

SEQ ID NO: 205343 - DNA, 20 bp, Artificial
  CRISPR gRNA sequence
gggcagcaagggaaaagaga

SEQ ID NO: 205344 - DNA, 20 bp, Artificial
  CRISPR gRNA sequence
ggcagcaagggaaaagagaa

SEQ ID NO: 205345 - DNA, 20 bp, Artificial
  CRISPR gRNA sequence
gcagcaagggaaaagagaaa

SEQ ID NO: 205346 - DNA, 20 bp, Artificial
  CRISPR gRNA sequence
agcaagggaaaagagaaagg

SEQ ID NO: 205347 - DNA, 20 bp, Artificial
  CRISPR gRNA sequence
gagaaagggagatccgttaa

SEQ ID NO: 205348 - DNA, 20 bp, Artificial
  CRISPR gRNA sequence
ccgttaacagactactgcaa

SEQ ID NO: 205349 - DNA, 20 bp, Artificial
  CRISPR gRNA sequence
aacagactactgcaatagtc

SEQ ID NO: 205350 - DNA, 20 bp, Artificial
  CRISPR gRNA sequence
acagactactgcaatagtcc

SEQ ID NO: 205351 - DNA, 20 bp, Artificial
  CRISPR gRNA sequence
ctactgcaatagtccaggta

SEQ ID NO: 205352 - DNA, 20 bp, Artificial
  CRISPR gRNA sequence
tagtccaggtaaagaacaac

SEQ ID NO: 205353 - DNA, 20 bp, Artificial
  CRISPR gRNA sequence
gtccaggtaaagaacaactg

SEQ ID NO: 205354 - DNA, 20 bp, Artificial
  CRISPR gRNA sequence
ccaggtaaagaacaactgga

SEQ ID NO: 205355 - DNA, 20 bp, Artificial
  CRISPR gRNA sequence
ggtaaagaacaactggagag

SEQ ID NO: 205356 - DNA, 20 bp, Artificial
  CRISPR gRNA sequence
gagagaagacctaaaactta

SEQ ID NO: 205357 - DNA, 20 bp, Artificial
  CRISPR gRNA sequence
ctaaaacttacagtaatcaa

SEQ ID NO: 205358 - DNA, 20 bp, Artificial
  CRISPR gRNA sequence
aaacttacagtaatcaacag

SEQ ID NO: 205359 - DNA, 20 bp, Artificial
  CRISPR gRNA sequence
ttacagtaatcaacagaagt

SEQ ID NO: 205360 - DNA, 20 bp, Artificial
  CRISPR gRNA sequence
taatcaacagaagttagttg

SEQ ID NO: 205361 - DNA, 20 bp, Artificial
  CRISPR gRNA sequence
aatcaacagaagttagttgt

SEQ ID NO: 205362 - DNA, 20 bp, Artificial
  CRISPR gRNA sequence
caacagaagttagttgtggg

SEQ ID NO: 205363 - DNA, 20 bp, Artificial
  CRISPR gRNA sequence
cagaagttagttgtgggaag

SEQ ID NO: 205364 - DNA, 20 bp, Artificial
  CRISPR gRNA sequence
agaagttagttgtgggaagc

SEQ ID NO: 205365 - DNA, 20 bp, Artificial
  CRISPR gRNA sequence
gaagttagttgtgggaagca

SEQ ID NO: 205366 - DNA, 20 bp, Artificial
  CRISPR gRNA sequence
aagttagttgtgggaagcag

SEQ ID NO: 205367 - DNA, 20 bp, Artificial
  CRISPR gRNA sequence
gttagttgtgggaagcaggg

SEQ ID NO: 205368 - DNA, 20 bp, Artificial
  CRISPR gRNA sequence
tgtgggaagcaggggagata

SEQ ID NO: 205369 - DNA, 20 bp, Artificial
  CRISPR gRNA sequence
tgggaagcaggggagataaa

SEQ ID NO: 205370 - DNA, 20 bp, Artificial
  CRISPR gRNA sequence
gggaagcaggggagataaag

SEQ ID NO: 205371 - DNA, 20 bp, Artificial
  CRISPR gRNA sequence
ggaagcaggggagataaaga

SEQ ID NO: 205372 - DNA, 20 bp, Artificial
  CRISPR gRNA sequence
gaagcaggggagataaagag

SEQ ID NO: 205373 - DNA, 20 bp, Artificial
  CRISPR gRNA sequence
attaaaattgtgaaccaaaa

SEQ ID NO: 205374 - DNA, 20 bp, Artificial
  CRISPR gRNA sequence
gtgaaccaaaatagtatgtg

SEQ ID NO: 205375 - DNA, 20 bp, Artificial
  CRISPR gRNA sequence
accaaaatagtatgtgtagc

SEQ ID NO: 205376 - DNA, 20 bp, Artificial
  CRISPR gRNA sequence
aaatagtatgtgtagctagt

SEQ ID NO: 205377 - DNA, 20 bp, Artificial
  CRISPR gRNA sequence
agtatgtgtagctagttaga

SEQ ID NO: 205378 - DNA, 20 bp, Artificial
  CRISPR gRNA sequence
atgtgtagctagttagatgg

SEQ ID NO: 205379 - DNA, 20 bp, Artificial
  CRISPR gRNA sequence
tgtgtagctagttagatggt

SEQ ID NO: 205380 - DNA, 20 bp, Artificial
  CRISPR gRNA sequence
gttagatggtaggctaatta

SEQ ID NO: 205381 - DNA, 20 bp, Artificial
  CRISPR gRNA sequence
tagatggtaggctaattata

SEQ ID NO: 205382 - DNA, 20 bp, Artificial
  CRISPR gRNA sequence
ggtaggctaattatagagaa

SEQ ID NO: 205383 - DNA, 20 bp, Artificial
  CRISPR gRNA sequence
taggctaattatagagaaaa

SEQ ID NO: 205384 - DNA, 20 bp, Artificial
  CRISPR gRNA sequence
aggctaattatagagaaaag

SEQ ID NO: 205385 - DNA, 20 bp, Artificial
  CRISPR gRNA sequence
agaaaagaggcttaaatatt

SEQ ID NO: 205386 - DNA, 20 bp, Artificial
  CRISPR gRNA sequence
gaaaagaggcttaaatattt

SEQ ID NO: 205387 - DNA, 20 bp, Artificial
  CRISPR gRNA sequence
aaaagaggcttaaatatttg

SEQ ID NO: 205388 - DNA, 20 bp, Artificial
  CRISPR gRNA sequence
aagaggcttaaatatttggg

SEQ ID NO: 205389 - DNA, 20 bp, Artificial
  CRISPR gRNA sequence
aatatctttccatctgtcaa

SEQ ID NO: 205390 - DNA, 20 bp, Artificial
  CRISPR gRNA sequence
ctttccatctgtcaatggac

SEQ ID NO: 205391 - DNA, 20 bp, Artificial
  CRISPR gRNA sequence
ccatctgtcaatggactagt

SEQ ID NO: 205392 - DNA, 20 bp, Artificial
  CRISPR gRNA sequence
atctgatgcacactatgttt

SEQ ID NO: 205393 - DNA, 20 bp, Artificial
  CRISPR gRNA sequence
gcacactatgtttgagaaat

SEQ ID NO: 205394 - DNA, 20 bp, Artificial
  CRISPR gRNA sequence
acactatgtttgagaaatga

SEQ ID NO: 205395 - DNA, 20 bp, Artificial
  CRISPR gRNA sequence
actatgtttgagaaatgaga

SEQ ID NO: 205396 - DNA, 20 bp, Artificial
  CRISPR gRNA sequence
ttgagaaatgagagagaaac

SEQ ID NO: 205397 - DNA, 20 bp, Artificial
  CRISPR gRNA sequence
gaaatgagagagaaacaaga

SEQ ID NO: 205398 - DNA, 20 bp, Artificial
  CRISPR gRNA sequence
agaaacaagatggctttatc

SEQ ID NO: 205399 - DNA, 20 bp, Artificial
  CRISPR gRNA sequence
tcaagcacttaaaatatatt

SEQ ID NO: 205400 - DNA, 20 bp, Artificial
  CRISPR gRNA sequence
agcacttaaaatatattaag

SEQ ID NO: 205401 - DNA, 20 bp, Artificial
  CRISPR gRNA sequence
acttaaaatatattaagtgg

SEQ ID NO: 205402 - DNA, 20 bp, Artificial
  CRISPR gRNA sequence
tgattcttttacaataaatt

SEQ ID NO: 205403 - DNA, 20 bp, Artificial
  CRISPR gRNA sequence
ttcttttacaataaatttgg

SEQ ID NO: 205404 - DNA, 20 bp, Artificial
  CRISPR gRNA sequence
tacaataaatttggcagtgt

SEQ ID NO: 205405 - DNA, 20 bp, Artificial
  CRISPR gRNA sequence
ataaatttggcagtgtaaga

SEQ ID NO: 205406 - DNA, 20 bp, Artificial
  CRISPR gRNA sequence
aatttggcagtgtaagaaag

SEQ ID NO: 205407 - DNA, 20 bp, Artificial
  CRISPR gRNA sequence
tttggcagtgtaagaaagca

SEQ ID NO: 205408 - DNA, 20 bp, Artificial
  CRISPR gRNA sequence
ggcagtgtaagaaagcagag

SEQ ID NO: 205409 - DNA, 20 bp, Artificial
  CRISPR gRNA sequence
gcagtgtaagaaagcagaga

SEQ ID NO: 205410 - DNA, 20 bp, Artificial
  CRISPR gRNA sequence
aggcaacaactgacaatgtg

SEQ ID NO: 205411 - DNA, 20 bp, Artificial
  CRISPR gRNA sequence
ggcaacaactgacaatgtgc

SEQ ID NO: 205412 - DNA, 20 bp, Artificial
  CRISPR gRNA sequence
aacaactgacaatgtgcagg

SEQ ID NO: 205413 - DNA, 20 bp, Artificial
  CRISPR gRNA sequence
acaactgacaatgtgcaggc

SEQ ID NO: 205414 - DNA, 20 bp, Artificial
  CRISPR gRNA sequence
gacaatgtgcaggcaggaac

SEQ ID NO: 205415 - DNA, 20 bp, Artificial
  CRISPR gRNA sequence
acaatgtgcaggcaggaaca

SEQ ID NO: 205416 - DNA, 20 bp, Artificial
  CRISPR gRNA sequence
caatgtgcaggcaggaacaa

SEQ ID NO: 205417 - DNA, 20 bp, Artificial
  CRISPR gRNA sequence
gtgcaggcaggaacaagggc

SEQ ID NO: 205418 - DNA, 20 bp, Artificial
  CRISPR gRNA sequence
tgcaggcaggaacaagggca

SEQ ID NO: 205419 - DNA, 20 bp, Artificial
  CRISPR gRNA sequence
gaacaagggcaaggacattt

SEQ ID NO: 205420 - DNA, 20 bp, Artificial
  CRISPR gRNA sequence
gcaaggacattttggttctt

SEQ ID NO: 205421 - DNA, 20 bp, Artificial
  CRISPR gRNA sequence
caaggacattttggttcttg

SEQ ID NO: 205422 - DNA, 20 bp, Artificial
  CRISPR gRNA sequence
ttttgttttattttttaata

SEQ ID NO: 205423 - DNA, 20 bp, Artificial
  CRISPR gRNA sequence
tttgttttattttttaatat

SEQ ID NO: 205424 - DNA, 20 bp, Artificial
  CRISPR gRNA sequence
ttgttttattttttaatatg

SEQ ID NO: 205425 - DNA, 20 bp, Artificial
  CRISPR gRNA sequence
taaaatttgatcatgtgtgc

SEQ ID NO: 205426 - DNA, 20 bp, Artificial
  CRISPR gRNA sequence
ttgatcatgtgtgcaagcta

SEQ ID NO: 205427 - DNA, 20 bp, Artificial
  CRISPR gRNA sequence
tgatcatgtgtgcaagctac

SEQ ID NO: 205428 - DNA, 20 bp, Artificial
  CRISPR gRNA sequence
gatcatgtgtgcaagctacg

SEQ ID NO: 205429 - DNA, 20 bp, Artificial
  CRISPR gRNA sequence
catgtgtgcaagctacgggg

SEQ ID NO: 205430 - DNA, 20 bp, Artificial
  CRISPR gRNA sequence
atgtgtgcaagctacgggga

SEQ ID NO: 205431 - DNA, 20 bp, Artificial
  CRISPR gRNA sequence
gtgtgcaagctacggggaag

SEQ ID NO: 205432 - DNA, 20 bp, Artificial
  CRISPR gRNA sequence
agctacggggaaggagtcaa

SEQ ID NO: 205433 - DNA, 20 bp, Artificial
  CRISPR gRNA sequence
ctacggggaaggagtcaatg

SEQ ID NO: 205434 - DNA, 20 bp, Artificial
  CRISPR gRNA sequence
acggggaaggagtcaatgga

SEQ ID NO: 205435 - DNA, 20 bp, Artificial
  CRISPR gRNA sequence
cggggaaggagtcaatggag

SEQ ID NO: 205436 - DNA, 20 bp, Artificial
  CRISPR gRNA sequence
ggggaaggagtcaatggaga

SEQ ID NO: 205437 - DNA, 20 bp, Artificial
  CRISPR gRNA sequence
aaggagtcaatggagaggga

SEQ ID NO: 205438 - DNA, 20 bp, Artificial
  CRISPR gRNA sequence
caatggagagggaaagatct

SEQ ID NO: 205439 - DNA, 20 bp, Artificial
  CRISPR gRNA sequence
gagggaaagatctaagatgc

SEQ ID NO: 205440 - DNA, 20 bp, Artificial
  CRISPR gRNA sequence
agatctaagatgcaagactg

SEQ ID NO: 205441 - DNA, 20 bp, Artificial
  CRISPR gRNA sequence
actgaagaattatgctgact

SEQ ID NO: 205442 - DNA, 20 bp, Artificial
  CRISPR gRNA sequence
gaagaattatgctgactgag

SEQ ID NO: 205443 - DNA, 20 bp, Artificial
  CRISPR gRNA sequence
aagaattatgctgactgagc

SEQ ID NO: 205444 - DNA, 20 bp, Artificial
  CRISPR gRNA sequence
tgctgactgagcaggtctcc

SEQ ID NO: 205445 - DNA, 20 bp, Artificial
  CRISPR gRNA sequence
gactgagcaggtctccaaga

SEQ ID NO: 205446 - DNA, 20 bp, Artificial
  CRISPR gRNA sequence
tgagcaggtctccaagatgg

SEQ ID NO: 205447 - DNA, 20 bp, Artificial
  CRISPR gRNA sequence
gcaggtctccaagatggtag

SEQ ID NO: 205448 - DNA, 20 bp, Artificial
  CRISPR gRNA sequence
tccaagatggtagaagtgaa

SEQ ID NO: 205449 - DNA, 20 bp, Artificial
  CRISPR gRNA sequence
ccaagatggtagaagtgaaa

SEQ ID NO: 205450 - DNA, 20 bp, Artificial
  CRISPR gRNA sequence
agatggtagaagtgaaaagg

SEQ ID NO: 205451 - DNA, 20 bp, Artificial
  CRISPR gRNA sequence
tggtagaagtgaaaaggtgg

SEQ ID NO: 205452 - DNA, 20 bp, Artificial
  CRISPR gRNA sequence
agaagtgaaaaggtggtaga

SEQ ID NO: 205453 - DNA, 20 bp, Artificial
  CRISPR gRNA sequence
gaagtgaaaaggtggtagac

SEQ ID NO: 205454 - DNA, 20 bp, Artificial
  CRISPR gRNA sequence
tagacaggttgtcctttcgt

SEQ ID NO: 205455 - DNA, 20 bp, Artificial
  CRISPR gRNA sequence
aggttgtcctttcgttggaa

SEQ ID NO: 205456 - DNA, 20 bp, Artificial
  CRISPR gRNA sequence
tgtcctttcgttggaaaagt

SEQ ID NO: 205457 - DNA, 20 bp, Artificial
  CRISPR gRNA sequence
cctttcgttggaaaagtgag

SEQ ID NO: 205458 - DNA, 20 bp, Artificial
  CRISPR gRNA sequence
ctttcgttggaaaagtgagt

SEQ ID NO: 205459 - DNA, 20 bp, Artificial
  CRISPR gRNA sequence
agtgagtaggttttcttctg

SEQ ID NO: 205460 - DNA, 20 bp, Artificial
  CRISPR gRNA sequence
agtaggttttcttctgaagc

SEQ ID NO: 205461 - DNA, 20 bp, Artificial
  CRISPR gRNA sequence
tttcttctgaagctggatga

SEQ ID NO: 205462 - DNA, 20 bp, Artificial
  CRISPR gRNA sequence
cttctgaagctggatgacgg

SEQ ID NO: 205463 - DNA, 20 bp, Artificial
  CRISPR gRNA sequence
tctgaagctggatgacggaa

SEQ ID NO: 205464 - DNA, 20 bp, Artificial
  CRISPR gRNA sequence
gctggatgacggaagagaat

SEQ ID NO: 205465 - DNA, 20 bp, Artificial
  CRISPR gRNA sequence
tgacggaagagaatgagacg

SEQ ID NO: 205466 - DNA, 20 bp, Artificial
  CRISPR gRNA sequence
gacggaagagaatgagacga

SEQ ID NO: 205467 - DNA, 20 bp, Artificial
  CRISPR gRNA sequence
gaatgagacgaaggttatct

SEQ ID NO: 205468 - DNA, 20 bp, Artificial
  CRISPR gRNA sequence
gaaggttatctaagatgtta

SEQ ID NO: 205469 - DNA, 20 bp, Artificial
  CRISPR gRNA sequence
ttatctaagatgttatagat

SEQ ID NO: 205470 - DNA, 20 bp, Artificial
  CRISPR gRNA sequence
taagatgttatagatcagtt

SEQ ID NO: 205471 - DNA, 20 bp, Artificial
  CRISPR gRNA sequence
gttatagatcagtttagtaa

SEQ ID NO: 205472 - DNA, 20 bp, Artificial
  CRISPR gRNA sequence
atagatcagtttagtaatgg

SEQ ID NO: 205473 - DNA, 20 bp, Artificial
  CRISPR gRNA sequence
tagatcagtttagtaatggt

SEQ ID NO: 205474 - DNA, 20 bp, Artificial
  CRISPR gRNA sequence
gatcagtttagtaatggtgg

SEQ ID NO: 205475 - DNA, 20 bp, Artificial
  CRISPR gRNA sequence
atcagtttagtaatggtggg

SEQ ID NO: 205476 - DNA, 20 bp, Artificial
  CRISPR gRNA sequence
tcagtttagtaatggtggga

SEQ ID NO: 205477 - DNA, 20 bp, Artificial
  CRISPR gRNA sequence
gtttagtaatggtgggaggg

SEQ ID NO: 205478 - DNA, 20 bp, Artificial
  CRISPR gRNA sequence
tagtaatggtgggagggaag

SEQ ID NO: 205479 - DNA, 20 bp, Artificial
  CRISPR gRNA sequence
gtaatggtgggagggaagca

SEQ ID NO: 205480 - DNA, 20 bp, Artificial
  CRISPR gRNA sequence
taatggtgggagggaagcag

SEQ ID NO: 205481 - DNA, 20 bp, Artificial
  CRISPR gRNA sequence
aatggtgggagggaagcaga

SEQ ID NO: 205482 - DNA, 20 bp, Artificial
  CRISPR gRNA sequence
tggtgggagggaagcagagg

SEQ ID NO: 205483 - DNA, 20 bp, Artificial
  CRISPR gRNA sequence
ccacacaccactattttttg

SEQ ID NO: 205484 - DNA, 20 bp, Artificial
  CRISPR gRNA sequence
cacaccactattttttgcag

SEQ ID NO: 205485 - DNA, 20 bp, Artificial
  CRISPR gRNA sequence
caccactattttttgcagta

SEQ ID NO: 205486 - DNA, 20 bp, Artificial
  CRISPR gRNA sequence
cactattttttgcagtagag

SEQ ID NO: 205487 - DNA, 20 bp, Artificial
  CRISPR gRNA sequence
actattttttgcagtagagt

SEQ ID NO: 205488 - DNA, 20 bp, Artificial
  CRISPR gRNA sequence
attttttgcagtagagtagg

SEQ ID NO: 205489 - DNA, 20 bp, Artificial
  CRISPR gRNA sequence
gtaggaagttaattatctgc

SEQ ID NO: 205490 - DNA, 20 bp, Artificial
  CRISPR gRNA sequence
taggaagttaattatctgct

SEQ ID NO: 205491 - DNA, 20 bp, Artificial
  CRISPR gRNA sequence
agttaattatctgctgggaa

SEQ ID NO: 205492 - DNA, 20 bp, Artificial
  CRISPR gRNA sequence
atctgctgggaatggatgtt

SEQ ID NO: 205493 - DNA, 20 bp, Artificial
  CRISPR gRNA sequence
tctgctgggaatggatgttc

SEQ ID NO: 205494 - DNA, 20 bp, Artificial
  CRISPR gRNA sequence
tgggaatggatgttcaggaa

SEQ ID NO: 205495 - DNA, 20 bp, Artificial
  CRISPR gRNA sequence
ggaatggatgttcaggaatg

SEQ ID NO: 205496 - DNA, 20 bp, Artificial
  CRISPR gRNA sequence
tggatgttcaggaatggagt

SEQ ID NO: 205497 - DNA, 20 bp, Artificial
  CRISPR gRNA sequence
atgttcaggaatggagtaag

SEQ ID NO: 205498 - DNA, 20 bp, Artificial
  CRISPR gRNA sequence
aggaatggagtaagaagtct

SEQ ID NO: 205499 - DNA, 20 bp, Artificial
  CRISPR gRNA sequence
aatggagtaagaagtctcag

SEQ ID NO: 205500 - DNA, 20 bp, Artificial
  CRISPR gRNA sequence
aagaagtctcagcagcctct

SEQ ID NO: 205501 - DNA, 20 bp, Artificial
  CRISPR gRNA sequence
agaagtctcagcagcctctt

SEQ ID NO: 205502 - DNA, 20 bp, Artificial
  CRISPR gRNA sequence
tctcagcagcctcttaggta

SEQ ID NO: 205503 - DNA, 20 bp, Artificial
  CRISPR gRNA sequence
cagcagcctcttaggtaaag

SEQ ID NO: 205504 - DNA, 20 bp, Artificial
  CRISPR gRNA sequence
gcctcttaggtaaagaagca

SEQ ID NO: 205505 - DNA, 20 bp, Artificial
  CRISPR gRNA sequence
ggtaaagaagcaaagatcat

SEQ ID NO: 205506 - DNA, 20 bp, Artificial
  CRISPR gRNA sequence
agaagcaaagatcatcagta

SEQ ID NO: 205507 - DNA, 20 bp, Artificial
  CRISPR gRNA sequence
tcatcagtaaagacacatgc

SEQ ID NO: 205508 - DNA, 20 bp, Artificial
  CRISPR gRNA sequence
cagtaaagacacatgccaga

SEQ ID NO: 205509 - DNA, 20 bp, Artificial
  CRISPR gRNA sequence
tcctacctacttttgcccct

SEQ ID NO: 205510 - DNA, 20 bp, Artificial
  CRISPR gRNA sequence
ctacttttgccccttagaac

SEQ ID NO: 205511 - DNA, 20 bp, Artificial
  CRISPR gRNA sequence
tgccccttagaactagtgtc

SEQ ID NO: 205512 - DNA, 20 bp, Artificial
  CRISPR gRNA sequence
tagaactagtgtctggcttg

SEQ ID NO: 205513 - DNA, 20 bp, Artificial
  CRISPR gRNA sequence
tagtgtctggcttgaagaac

SEQ ID NO: 205514 - DNA, 20 bp, Artificial
  CRISPR gRNA sequence
gtgtctggcttgaagaactg

SEQ ID NO: 205515 - DNA, 20 bp, Artificial
  CRISPR gRNA sequence
gcttgaagaactggagtctc

SEQ ID NO: 205516 - DNA, 20 bp, Artificial
  CRISPR gRNA sequence
actggagtctctagctacac

SEQ ID NO: 205517 - DNA, 20 bp, Artificial
  CRISPR gRNA sequence
ctggagtctctagctacact

SEQ ID NO: 205518 - DNA, 20 bp, Artificial
  CRISPR gRNA sequence
tacactgggttacgtacaaa

SEQ ID NO: 205519 - DNA, 20 bp, Artificial
  CRISPR gRNA sequence
acactgggttacgtacaaaa

SEQ ID NO: 205520 - DNA, 20 bp, Artificial
  CRISPR gRNA sequence
ggttacgtacaaaaaggatg

SEQ ID NO: 205521 - DNA, 20 bp, Artificial
  CRISPR gRNA sequence
acgtacaaaaaggatgaagt

SEQ ID NO: 205522 - DNA, 20 bp, Artificial
  CRISPR gRNA sequence
gaagtcagatctctcctcaa

SEQ ID NO: 205523 - DNA, 20 bp, Artificial
  CRISPR gRNA sequence
cctcaatggacactaaaata

SEQ ID NO: 205524 - DNA, 20 bp, Artificial
  CRISPR gRNA sequence
ctcaatggacactaaaataa

SEQ ID NO: 205525 - DNA, 20 bp, Artificial
  CRISPR gRNA sequence
tggacactaaaataaaggtc

SEQ ID NO: 205526 - DNA, 20 bp, Artificial
  CRISPR gRNA sequence
ggacactaaaataaaggtct

SEQ ID NO: 205527 - DNA, 20 bp, Artificial
  CRISPR gRNA sequence
gacactaaaataaaggtctg

SEQ ID NO: 205528 - DNA, 20 bp, Artificial
  CRISPR gRNA sequence
actaaaataaaggtctgggg

SEQ ID NO: 205529 - DNA, 20 bp, Artificial
  CRISPR gRNA sequence
taaaataaaggtctggggta

SEQ ID NO: 205530 - DNA, 20 bp, Artificial
  CRISPR gRNA sequence
aataaaggtctggggtagag

SEQ ID NO: 205531 - DNA, 20 bp, Artificial
  CRISPR gRNA sequence
ataaaggtctggggtagagt

SEQ ID NO: 205532 - DNA, 20 bp, Artificial
  CRISPR gRNA sequence
taaaggtctggggtagagtg

SEQ ID NO: 205533 - DNA, 20 bp, Artificial
  CRISPR gRNA sequence
gggtagagtggggtgtccac

SEQ ID NO: 205534 - DNA, 20 bp, Artificial
  CRISPR gRNA sequence
gggtgtccacaagttgtact

SEQ ID NO: 205535 - DNA, 20 bp, Artificial
  CRISPR gRNA sequence
aatccccctaatgaatttaa

SEQ ID NO: 205536 - DNA, 20 bp, Artificial
  CRISPR gRNA sequence
ccccctaatgaatttaaaag

SEQ ID NO: 205537 - DNA, 20 bp, Artificial
  CRISPR gRNA sequence
gaatttaaaagtggccttat

SEQ ID NO: 205538 - DNA, 20 bp, Artificial
  CRISPR gRNA sequence
taaaagtggccttataagaa

SEQ ID NO: 205539 - DNA, 20 bp, Artificial
  CRISPR gRNA sequence
aagtggccttataagaatgg

SEQ ID NO: 205540 - DNA, 20 bp, Artificial
  CRISPR gRNA sequence
gtggccttataagaatggaa

SEQ ID NO: 205541 - DNA, 20 bp, Artificial
  CRISPR gRNA sequence
tggccttataagaatggaag

SEQ ID NO: 205542 - DNA, 20 bp, Artificial
  CRISPR gRNA sequence
aagaatggaagaggccaact

SEQ ID NO: 205543 - DNA, 20 bp, Artificial
  CRISPR gRNA sequence
gaggccaacttagaattaaa

SEQ ID NO: 205544 - DNA, 20 bp, Artificial
  CRISPR gRNA sequence
aggccaacttagaattaaaa

SEQ ID NO: 205545 - DNA, 20 bp, Artificial
  CRISPR gRNA sequence
ggccaacttagaattaaaaa

SEQ ID NO: 205546 - DNA, 20 bp, Artificial
  CRISPR gRNA sequence
caacttagaattaaaaaggg

SEQ ID NO: 205547 - DNA, 20 bp, Artificial
  CRISPR gRNA sequence
aacttagaattaaaaagggc

SEQ ID NO: 205548 - DNA, 20 bp, Artificial
  CRISPR gRNA sequence
acttagaattaaaaagggca

SEQ ID NO: 205549 - DNA, 20 bp, Artificial
  CRISPR gRNA sequence
tagaattaaaaagggcaggg

SEQ ID NO: 205550 - DNA, 20 bp, Artificial
  CRISPR gRNA sequence
aaaaagggcagggcagttta

SEQ ID NO: 205551 - DNA, 20 bp, Artificial
  CRISPR gRNA sequence
agtttaaagtcaataacatc

SEQ ID NO: 205552 - DNA, 20 bp, Artificial
  CRISPR gRNA sequence
gtcaataacatccagaatta

SEQ ID NO: 205553 - DNA, 20 bp, Artificial
  CRISPR gRNA sequence
tccagaattatggccttaac

SEQ ID NO: 205554 - DNA, 20 bp, Artificial
  CRISPR gRNA sequence
tatggccttaacaagcacct

SEQ ID NO: 205555 - DNA, 20 bp, Artificial
  CRISPR gRNA sequence
aacaagcacctaagtaccat

SEQ ID NO: 205556 - DNA, 20 bp, Artificial
  CRISPR gRNA sequence
acaagcacctaagtaccatg

SEQ ID NO: 205557 - DNA, 20 bp, Artificial
  CRISPR gRNA sequence
caagcacctaagtaccatga

SEQ ID NO: 205558 - DNA, 20 bp, Artificial
  CRISPR gRNA sequence
taccatgagggaataaaaac

SEQ ID NO: 205559 - DNA, 20 bp, Artificial
  CRISPR gRNA sequence
ctgtctatatactacatctt

SEQ ID NO: 205560 - DNA, 20 bp, Artificial
  CRISPR gRNA sequence
atactacatcttaagtcatt

SEQ ID NO: 205561 - DNA, 20 bp, Artificial
  CRISPR gRNA sequence
actacatcttaagtcattaa

SEQ ID NO: 205562 - DNA, 20 bp, Artificial
  CRISPR gRNA sequence
tgaaatttgtctatatgcca

SEQ ID NO: 205563 - DNA, 20 bp, Artificial
  CRISPR gRNA sequence
aaatttgtctatatgccaaa

SEQ ID NO: 205564 - DNA, 20 bp, Artificial
  CRISPR gRNA sequence
aatttgtctatatgccaaag

SEQ ID NO: 205565 - DNA, 20 bp, Artificial
  CRISPR gRNA sequence
atttgtctatatgccaaaga

SEQ ID NO: 205566 - DNA, 20 bp, Artificial
  CRISPR gRNA sequence
agagggctttgcaaactgct

SEQ ID NO: 205567 - DNA, 20 bp, Artificial
  CRISPR gRNA sequence
tttgcaaactgcttggtgtg

SEQ ID NO: 205568 - DNA, 20 bp, Artificial
  CRISPR gRNA sequence
aaactgcttggtgtgtagta

SEQ ID NO: 205569 - DNA, 20 bp, Artificial
  CRISPR gRNA sequence
aactgcttggtgtgtagtat

SEQ ID NO: 205570 - DNA, 20 bp, Artificial
  CRISPR gRNA sequence
aggctcatacttgcttgaaa

SEQ ID NO: 205571 - DNA, 20 bp, Artificial
  CRISPR gRNA sequence
tacttgcttgaaatggaaaa

SEQ ID NO: 205572 - DNA, 20 bp, Artificial
  CRISPR gRNA sequence
ttgcttgaaatggaaaaaag

SEQ ID NO: 205573 - DNA, 20 bp, Artificial
  CRISPR gRNA sequence
atggaaaaaagtggttttga

SEQ ID NO: 205574 - DNA, 20 bp, Artificial
  CRISPR gRNA sequence
tggaaaaaagtggttttgac

SEQ ID NO: 205575 - DNA, 20 bp, Artificial
  CRISPR gRNA sequence
ggttttgacaggccttgaac

SEQ ID NO: 205576 - DNA, 20 bp, Artificial
  CRISPR gRNA sequence
tgctttaccttttaacctac

SEQ ID NO: 205577 - DNA, 20 bp, Artificial
  CRISPR gRNA sequence
taatctgaatctcaaaccat

SEQ ID NO: 205578 - DNA, 20 bp, Artificial
  CRISPR gRNA sequence
tctcaaaccatgagattgac

SEQ ID NO: 205579 - DNA, 20 bp, Artificial
  CRISPR gRNA sequence
catgagattgaccagattct

SEQ ID NO: 205580 - DNA, 20 bp, Artificial
  CRISPR gRNA sequence
agtcttatgcaactgctcca

SEQ ID NO: 205581 - DNA, 20 bp, Artificial
  CRISPR gRNA sequence
atgcaactgctccatggatt

SEQ ID NO: 205582 - DNA, 20 bp, Artificial
  CRISPR gRNA sequence
tggatttggaatgaaatatt

SEQ ID NO: 205583 - DNA, 20 bp, Artificial
  CRISPR gRNA sequence
gatttggaatgaaatattca

SEQ ID NO: 205584 - DNA, 20 bp, Artificial
  CRISPR gRNA sequence
atttggaatgaaatattcag

SEQ ID NO: 205585 - DNA, 20 bp, Artificial
  CRISPR gRNA sequence
tggaatgaaatattcagagg

SEQ ID NO: 205586 - DNA, 20 bp, Artificial
  CRISPR gRNA sequence
ggaatgaaatattcagaggt

SEQ ID NO: 205587 - DNA, 20 bp, Artificial
  CRISPR gRNA sequence
gaaatattcagaggtgggtg

SEQ ID NO: 205588 - DNA, 20 bp, Artificial
  CRISPR gRNA sequence
ttcaacactgtataatcgta

SEQ ID NO: 205589 - DNA, 20 bp, Artificial
  CRISPR gRNA sequence
caacactgtataatcgtaaa

SEQ ID NO: 205590 - DNA, 20 bp, Artificial
  CRISPR gRNA sequence
aacactgtataatcgtaaag

SEQ ID NO: 205591 - DNA, 20 bp, Artificial
  CRISPR gRNA sequence
aatcgtaaagaggaaaaacc

SEQ ID NO: 205592 - DNA, 20 bp, Artificial
  CRISPR gRNA sequence
aaacccagattctattgtct

SEQ ID NO: 205593 - DNA, 20 bp, Artificial
  CRISPR gRNA sequence
cagattctattgtcttagtc

SEQ ID NO: 205594 - DNA, 20 bp, Artificial
  CRISPR gRNA sequence
agattctattgtcttagtct

SEQ ID NO: 205595 - DNA, 20 bp, Artificial
  CRISPR gRNA sequence
ttgtcttagtctaggtatat

SEQ ID NO: 205596 - DNA, 20 bp, Artificial
  CRISPR gRNA sequence
tatatcagaatcaaatttcc

SEQ ID NO: 205597 - DNA, 20 bp, Artificial
  CRISPR gRNA sequence
atatcagaatcaaatttcct

SEQ ID NO: 205598 - DNA, 20 bp, Artificial
  CRISPR gRNA sequence
gtgctctgtattttctactt

SEQ ID NO: 205599 - DNA, 20 bp, Artificial
  CRISPR gRNA sequence
ttctactttagtactacaat

SEQ ID NO: 205600 - DNA, 20 bp, Artificial
  CRISPR gRNA sequence
tattcttgttctttttatca

SEQ ID NO: 205601 - DNA, 20 bp, Artificial
  CRISPR gRNA sequence
tcttgttctttttatcacag

SEQ ID NO: 205602 - DNA, 20 bp, Artificial
  CRISPR gRNA sequence
cacagaagaaatatctacac

SEQ ID NO: 205603 - DNA, 20 bp, Artificial
  CRISPR gRNA sequence
aatatctacactagtataca

SEQ ID NO: 205604 - DNA, 20 bp, Artificial
  CRISPR gRNA sequence
tacactagtatacaaagtga

SEQ ID NO: 205605 - DNA, 20 bp, Artificial
  CRISPR gRNA sequence
aagtaactttatgataaccc

SEQ ID NO: 205606 - DNA, 20 bp, Artificial
  CRISPR gRNA sequence
caagacgatattattaaaat

SEQ ID NO: 205607 - DNA, 20 bp, Artificial
  CRISPR gRNA sequence
gatattattaaaatcagact

SEQ ID NO: 205608 - DNA, 20 bp, Artificial
  CRISPR gRNA sequence
tattattaaaatcagactga

SEQ ID NO: 205609 - DNA, 20 bp, Artificial
  CRISPR gRNA sequence
ttaaaatcagactgagagat

SEQ ID NO: 205610 - DNA, 20 bp, Artificial
  CRISPR gRNA sequence
tgagagataagatatgaaaa

SEQ ID NO: 205611 - DNA, 20 bp, Artificial
  CRISPR gRNA sequence
aaatgtttatcttgtataaa

SEQ ID NO: 205612 - DNA, 20 bp, Artificial
  CRISPR gRNA sequence
aatgtttatcttgtataaaa

SEQ ID NO: 205613 - DNA, 20 bp, Artificial
  CRISPR gRNA sequence
gtttatcttgtataaaaagg

SEQ ID NO: 205614 - DNA, 20 bp, Artificial
  CRISPR gRNA sequence
tttatcttgtataaaaaggt

SEQ ID NO: 205615 - DNA, 20 bp, Artificial
  CRISPR gRNA sequence
atcttgtataaaaaggtagg

SEQ ID NO: 205616 - DNA, 20 bp, Artificial
  CRISPR gRNA sequence
aaaaaggtaggcagaaacct

SEQ ID NO: 205617 - DNA, 20 bp, Artificial
  CRISPR gRNA sequence
aggtaggcagaaacctaaga

SEQ ID NO: 205618 - DNA, 20 bp, Artificial
  CRISPR gRNA sequence
ggtaggcagaaacctaagac

SEQ ID NO: 205619 - DNA, 20 bp, Artificial
  CRISPR gRNA sequence
gtaggcagaaacctaagaca

SEQ ID NO: 205620 - DNA, 20 bp, Artificial
  CRISPR gRNA sequence
gcagaaacctaagacaggga

SEQ ID NO: 205621 - DNA, 20 bp, Artificial
  CRISPR gRNA sequence
attgaaaattatgccacaaa

SEQ ID NO: 205622 - DNA, 20 bp, Artificial
  CRISPR gRNA sequence
aaagaacattactatattaa

SEQ ID NO: 205623 - DNA, 20 bp, Artificial
  CRISPR gRNA sequence
taaaagcaatgcctatatac

SEQ ID NO: 205624 - DNA, 20 bp, Artificial
  CRISPR gRNA sequence
caatgcctatatactagcta

SEQ ID NO: 205625 - DNA, 20 bp, Artificial
  CRISPR gRNA sequence
catactatgaaatgcaaatc

SEQ ID NO: 205626 - DNA, 20 bp, Artificial
  CRISPR gRNA sequence
gcgaatatgcgtgattattt

SEQ ID NO: 205627 - DNA, 20 bp, Artificial
  CRISPR gRNA sequence
atgcgtgattattttggatt

SEQ ID NO: 205628 - DNA, 20 bp, Artificial
  CRISPR gRNA sequence
atttagaatatgtatcaatt

SEQ ID NO: 205629 - DNA, 20 bp, Artificial
  CRISPR gRNA sequence
tttagaatatgtatcaattt

SEQ ID NO: 205630 - DNA, 20 bp, Artificial
  CRISPR gRNA sequence
ttagaatatgtatcaatttg

SEQ ID NO: 205631 - DNA, 20 bp, Artificial
  CRISPR gRNA sequence
tagaatatgtatcaatttgg

SEQ ID NO: 205632 - DNA, 20 bp, Artificial
  CRISPR gRNA sequence
agaatatgtatcaatttggg

SEQ ID NO: 205633 - DNA, 20 bp, Artificial
  CRISPR gRNA sequence
tatgtatcaatttgggggga

SEQ ID NO: 205634 - DNA, 20 bp, Artificial
  CRISPR gRNA sequence
agtcatctatctctcatctt

SEQ ID NO: 205635 - DNA, 20 bp, Artificial
  CRISPR gRNA sequence
tatctctcatctttagaact

SEQ ID NO: 205636 - DNA, 20 bp, Artificial
  CRISPR gRNA sequence
tcaaatctccatgaacaact

SEQ ID NO: 205637 - DNA, 20 bp, Artificial
  CRISPR gRNA sequence
ccatgaacaactcagtgaca

SEQ ID NO: 205638 - DNA, 20 bp, Artificial
  CRISPR gRNA sequence
ataaaacatctgccaaaaca

SEQ ID NO: 205639 - DNA, 20 bp, Artificial
  CRISPR gRNA sequence
atctgccaaaacacagatga

SEQ ID NO: 205640 - DNA, 20 bp, Artificial
  CRISPR gRNA sequence
caaaacacagatgacagcat

SEQ ID NO: 205641 - DNA, 20 bp, Artificial
  CRISPR gRNA sequence
acacagatgacagcatgagc

SEQ ID NO: 205642 - DNA, 20 bp, Artificial
  CRISPR gRNA sequence
agcatgagcaagtgtcctaa

SEQ ID NO: 205643 - DNA, 20 bp, Artificial
  CRISPR gRNA sequence
atgagcaagtgtcctaatgg

SEQ ID NO: 205644 - DNA, 20 bp, Artificial
  CRISPR gRNA sequence
tgagcaagtgtcctaatggt

SEQ ID NO: 205645 - DNA, 20 bp, Artificial
  CRISPR gRNA sequence
gtgtcctaatggtaggcatt

SEQ ID NO: 205646 - DNA, 20 bp, Artificial
  CRISPR gRNA sequence
gctttaaaaaacactgcctc

SEQ ID NO: 205647 - DNA, 20 bp, Artificial
  CRISPR gRNA sequence
aaacactgcctctagactgc

SEQ ID NO: 205648 - DNA, 20 bp, Artificial
  CRISPR gRNA sequence
aacactgcctctagactgct

SEQ ID NO: 205649 - DNA, 20 bp, Artificial
  CRISPR gRNA sequence
acactgcctctagactgctg

SEQ ID NO: 205650 - DNA, 20 bp, Artificial
  CRISPR gRNA sequence
ctgcctctagactgctgggg

SEQ ID NO: 205651 - DNA, 20 bp, Artificial
  CRISPR gRNA sequence
cataaatacgtacttttaaa

SEQ ID NO: 205652 - DNA, 20 bp, Artificial
  CRISPR gRNA sequence
ataaatacgtacttttaaat

SEQ ID NO: 205653 - DNA, 20 bp, Artificial
  CRISPR gRNA sequence
aggcatttacttccttaaaa

SEQ ID NO: 205654 - DNA, 20 bp, Artificial
  CRISPR gRNA sequence
ttaaaaataatatattcttt

SEQ ID NO: 205655 - DNA, 20 bp, Artificial
  CRISPR gRNA sequence
aaaaataatatattctttaa

SEQ ID NO: 205656 - DNA, 20 bp, Artificial
  CRISPR gRNA sequence
gaaaacatttttatttaaac

SEQ ID NO: 205657 - DNA, 20 bp, Artificial
  CRISPR gRNA sequence
taaacaagccaaattactac

SEQ ID NO: 205658 - DNA, 20 bp, Artificial
  CRISPR gRNA sequence
agccaaattactactagact

SEQ ID NO: 205659 - DNA, 20 bp, Artificial
  CRISPR gRNA sequence
ttactactagacttagacga

SEQ ID NO: 205660 - DNA, 20 bp, Artificial
  CRISPR gRNA sequence
aaaacaactcattttgaaca

SEQ ID NO: 205661 - DNA, 20 bp, Artificial
  CRISPR gRNA sequence
aacaactcattttgaacaaa

SEQ ID NO: 205662 - DNA, 20 bp, Artificial
  CRISPR gRNA sequence
acaactcattttgaacaaag

SEQ ID NO: 205663 - DNA, 20 bp, Artificial
  CRISPR gRNA sequence
ggaatcattcaaccactgaa

SEQ ID NO: 205664 - DNA, 20 bp, Artificial
  CRISPR gRNA sequence
tcattcaaccactgaaaaga

SEQ ID NO: 205665 - DNA, 20 bp, Artificial
  CRISPR gRNA sequence
acaccatcattatttattta

SEQ ID NO: 205666 - DNA, 20 bp, Artificial
  CRISPR gRNA sequence
ttatttaaagttttatttgc

SEQ ID NO: 205667 - DNA, 20 bp, Artificial
  CRISPR gRNA sequence
aaactatgcacttttaaaca

SEQ ID NO: 205668 - DNA, 20 bp, Artificial
  CRISPR gRNA sequence
aacaaagtataattgtacat

SEQ ID NO: 205669 - DNA, 20 bp, Artificial
  CRISPR gRNA sequence
aaagtataattgtacatgag

SEQ ID NO: 205670 - DNA, 20 bp, Artificial
  CRISPR gRNA sequence
aagtataattgtacatgagt

SEQ ID NO: 205671 - DNA, 20 bp, Artificial
  CRISPR gRNA sequence
agtataattgtacatgagtg

SEQ ID NO: 205672 - DNA, 20 bp, Artificial
  CRISPR gRNA sequence
gtataattgtacatgagtgg

SEQ ID NO: 205673 - DNA, 20 bp, Artificial
  CRISPR gRNA sequence
taattgtacatgagtggggg

SEQ ID NO: 205674 - DNA, 20 bp, Artificial
  CRISPR gRNA sequence
attgtacatgagtgggggca

SEQ ID NO: 205675 - DNA, 20 bp, Artificial
  CRISPR gRNA sequence
gtacatgagtgggggcagag

SEQ ID NO: 205676 - DNA, 20 bp, Artificial
  CRISPR gRNA sequence
gggcagagtggaatgcaaca

SEQ ID NO: 205677 - DNA, 20 bp, Artificial
  CRISPR gRNA sequence
ttcacatcttgcataccatt

SEQ ID NO: 205678 - DNA, 20 bp, Artificial
  CRISPR gRNA sequence
tcacatcttgcataccatta

SEQ ID NO: 205679 - DNA, 20 bp, Artificial
  CRISPR gRNA sequence
cataccattaaggtgccttc

SEQ ID NO: 205680 - DNA, 20 bp, Artificial
  CRISPR gRNA sequence
tgcctgtaattgcatgaaat

SEQ ID NO: 205681 - DNA, 20 bp, Artificial
  CRISPR gRNA sequence
attgcatgaaatgagtatct

SEQ ID NO: 205682 - DNA, 20 bp, Artificial
  CRISPR gRNA sequence
agataacttcttttaccaca

SEQ ID NO: 205683 - DNA, 20 bp, Artificial
  CRISPR gRNA sequence
gataacttcttttaccacaa

SEQ ID NO: 205684 - DNA, 20 bp, Artificial
  CRISPR gRNA sequence
cacaaaggccactaacactg

SEQ ID NO: 205685 - DNA, 20 bp, Artificial
  CRISPR gRNA sequence
caaaggccactaacactgta

SEQ ID NO: 205686 - DNA, 20 bp, Artificial
  CRISPR gRNA sequence
aaaggccactaacactgtag

SEQ ID NO: 205687 - DNA, 20 bp, Artificial
  CRISPR gRNA sequence
aaggccactaacactgtaga

SEQ ID NO: 205688 - DNA, 20 bp, Artificial
  CRISPR gRNA sequence
actaacactgtagagggtgc

SEQ ID NO: 205689 - DNA, 20 bp, Artificial
  CRISPR gRNA sequence
ctaacactgtagagggtgcc

SEQ ID NO: 205690 - DNA, 20 bp, Artificial
  CRISPR gRNA sequence
cactgtagagggtgccagga

SEQ ID NO: 205691 - DNA, 20 bp, Artificial
  CRISPR gRNA sequence
actgtagagggtgccaggaa

SEQ ID NO: 205692 - DNA, 20 bp, Artificial
  CRISPR gRNA sequence
caggaaaggtccctgattcc

SEQ ID NO: 205693 - DNA, 20 bp, Artificial
  CRISPR gRNA sequence
aggaaaggtccctgattccc

SEQ ID NO: 205694 - DNA, 20 bp, Artificial
  CRISPR gRNA sequence
ggaaaggtccctgattcccg

SEQ ID NO: 205695 - DNA, 20 bp, Artificial
  CRISPR gRNA sequence
ggcttaattaacgaaactga

SEQ ID NO: 205696 - DNA, 20 bp, Artificial
  CRISPR gRNA sequence
cttcaatacaaatgaatgta

SEQ ID NO: 205697 - DNA, 20 bp, Artificial
  CRISPR gRNA sequence
catcactttcttactcattc

SEQ ID NO: 205698 - DNA, 20 bp, Artificial
  CRISPR gRNA sequence
cttactcattctagattcta

SEQ ID NO: 205699 - DNA, 20 bp, Artificial
  CRISPR gRNA sequence
ctcattctagattctaaagt

SEQ ID NO: 205700 - DNA, 20 bp, Artificial
  CRISPR gRNA sequence
aagtcagtctctcaaaccct

SEQ ID NO: 205701 - DNA, 20 bp, Artificial
  CRISPR gRNA sequence
tttataactacctatgtgct

SEQ ID NO: 205702 - DNA, 20 bp, Artificial
  CRISPR gRNA sequence
tcttcatacatgtccttttg

SEQ ID NO: 205703 - DNA, 20 bp, Artificial
  CRISPR gRNA sequence
acaaatactatcctgtttta

SEQ ID NO: 205704 - DNA, 20 bp, Artificial
  CRISPR gRNA sequence
cctgtattttgctttttttt

SEQ ID NO: 205705 - DNA, 20 bp, Artificial
  CRISPR gRNA sequence
ctgtattttgcttttttttt

SEQ ID NO: 205706 - DNA, 20 bp, Artificial
  CRISPR gRNA sequence
tttttaggttaatattaact

SEQ ID NO: 205707 - DNA, 20 bp, Artificial
  CRISPR gRNA sequence
aattctgaattcgatgactc

SEQ ID NO: 205708 - DNA, 20 bp, Artificial
  CRISPR gRNA sequence
attctgaattcgatgactct

SEQ ID NO: 205709 - DNA, 20 bp, Artificial
  CRISPR gRNA sequence
ttctgaattcgatgactcta

SEQ ID NO: 205710 - DNA, 20 bp, Artificial
  CRISPR gRNA sequence
cattaaaattgtgtgtaaac

SEQ ID NO: 205711 - DNA, 20 bp, Artificial
  CRISPR gRNA sequence
catgatattaactattacta

SEQ ID NO: 205712 - DNA, 20 bp, Artificial
  CRISPR gRNA sequence
gatattaactattactaaag

SEQ ID NO: 205713 - DNA, 20 bp, Artificial
  CRISPR gRNA sequence
atattaactattactaaaga

SEQ ID NO: 205714 - DNA, 20 bp, Artificial
  CRISPR gRNA sequence
aacataaatcctatcactca

SEQ ID NO: 205715 - DNA, 20 bp, Artificial
  CRISPR gRNA sequence
cactcaaagtaccattccaa

SEQ ID NO: 205716 - DNA, 20 bp, Artificial
  CRISPR gRNA sequence
taacctacctgttttaaaaa

SEQ ID NO: 205717 - DNA, 20 bp, Artificial
  CRISPR gRNA sequence
cctgttttaaaaatagtata

SEQ ID NO: 205718 - DNA, 20 bp, Artificial
  CRISPR gRNA sequence
ggtttatactttttactttt

SEQ ID NO: 205719 - DNA, 20 bp, Artificial
  CRISPR gRNA sequence
gtttatactttttacttttt

SEQ ID NO: 205720 - DNA, 20 bp, Artificial
  CRISPR gRNA sequence
tatactttttactttttagg

SEQ ID NO: 205721 - DNA, 20 bp, Artificial
  CRISPR gRNA sequence
atactgtatcacttcatatc

SEQ ID NO: 205722 - DNA, 20 bp, Artificial
  CRISPR gRNA sequence
ttcatatctggttcaatatg

SEQ ID NO: 205723 - DNA, 20 bp, Artificial
  CRISPR gRNA sequence
tcatatctggttcaatatga

SEQ ID NO: 205724 - DNA, 20 bp, Artificial
  CRISPR gRNA sequence
attatacaacacatctctga

SEQ ID NO: 205725 - DNA, 20 bp, Artificial
  CRISPR gRNA sequence
atacaacacatctctgaaag

SEQ ID NO: 205726 - DNA, 20 bp, Artificial
  CRISPR gRNA sequence
ctctgaaagcagtattattt

SEQ ID NO: 205727 - DNA, 20 bp, Artificial
  CRISPR gRNA sequence
tattattttagctataatga

SEQ ID NO: 205728 - DNA, 20 bp, Artificial
  CRISPR gRNA sequence
ttttagctataatgatagta

SEQ ID NO: 205729 - DNA, 20 bp, Artificial
  CRISPR gRNA sequence
tttagctataatgatagtaa

SEQ ID NO: 205730 - DNA, 20 bp, Artificial
  CRISPR gRNA sequence
ataatgatagtaaaggcaac

SEQ ID NO: 205731 - DNA, 20 bp, Artificial
  CRISPR gRNA sequence
aagcatactaaacgtgatga

SEQ ID NO: 205732 - DNA, 20 bp, Artificial
  CRISPR gRNA sequence
agcatactaaacgtgatgac

SEQ ID NO: 205733 - DNA, 20 bp, Artificial
  CRISPR gRNA sequence
aaacactaacatcaaccatt

SEQ ID NO: 205734 - DNA, 20 bp, Artificial
  CRISPR gRNA sequence
aacatcaaccatttagataa

SEQ ID NO: 205735 - DNA, 20 bp, Artificial
  CRISPR gRNA sequence
catcaaccatttagataacg

SEQ ID NO: 205736 - DNA, 20 bp, Artificial
  CRISPR gRNA sequence
ccatttagataacggagacc

SEQ ID NO: 205737 - DNA, 20 bp, Artificial
  CRISPR gRNA sequence
ataacggagacctggattca

SEQ ID NO: 205738 - DNA, 20 bp, Artificial
  CRISPR gRNA sequence
ggattcacagtcccaacatc

SEQ ID NO: 205739 - DNA, 20 bp, Artificial
  CRISPR gRNA sequence
gattcacagtcccaacatcc

SEQ ID NO: 205740 - DNA, 20 bp, Artificial
  CRISPR gRNA sequence
gtcccaacatccaggatgct

SEQ ID NO: 205741 - DNA, 20 bp, Artificial
  CRISPR gRNA sequence
tcccaacatccaggatgctc

SEQ ID NO: 205742 - DNA, 20 bp, Artificial
  CRISPR gRNA sequence
cccaacatccaggatgctcg

SEQ ID NO: 205743 - DNA, 20 bp, Artificial
  CRISPR gRNA sequence
caacatccaggatgctcggg

SEQ ID NO: 205744 - DNA, 20 bp, Artificial
  CRISPR gRNA sequence
aacatccaggatgctcgggg

SEQ ID NO: 205745 - DNA, 20 bp, Artificial
  CRISPR gRNA sequence
acatccaggatgctcgggga

SEQ ID NO: 205746 - DNA, 20 bp, Artificial
  CRISPR gRNA sequence
atccaggatgctcggggagg

SEQ ID NO: 205747 - DNA, 20 bp, Artificial
  CRISPR gRNA sequence
tccaggatgctcggggaggg

SEQ ID NO: 205748 - DNA, 20 bp, Artificial
  CRISPR gRNA sequence
ggatgctcggggagggagga

SEQ ID NO: 205749 - DNA, 20 bp, Artificial
  CRISPR gRNA sequence
tgctcggggagggaggaaag

SEQ ID NO: 205750 - DNA, 20 bp, Artificial
  CRISPR gRNA sequence
cggggagggaggaaagtggt

SEQ ID NO: 205751 - DNA, 20 bp, Artificial
  CRISPR gRNA sequence
ggagggaggaaagtggtaag

SEQ ID NO: 205752 - DNA, 20 bp, Artificial
  CRISPR gRNA sequence
agggaggaaagtggtaagca

SEQ ID NO: 205753 - DNA, 20 bp, Artificial
  CRISPR gRNA sequence
aaagtggtaagcagagactt

SEQ ID NO: 205754 - DNA, 20 bp, Artificial
  CRISPR gRNA sequence
aagtggtaagcagagactta

SEQ ID NO: 205755 - DNA, 20 bp, Artificial
  CRISPR gRNA sequence
agtggtaagcagagacttaa

SEQ ID NO: 205756 - DNA, 20 bp, Artificial
  CRISPR gRNA sequence
gcagagacttaagggcatct

SEQ ID NO: 205757 - DNA, 20 bp, Artificial
  CRISPR gRNA sequence
gggcatcttggaaataccta

SEQ ID NO: 205758 - DNA, 20 bp, Artificial
  CRISPR gRNA sequence
ttggaaatacctaaagtcac

SEQ ID NO: 205759 - DNA, 20 bp, Artificial
  CRISPR gRNA sequence
tacctaaagtcacaagcctt

SEQ ID NO: 205760 - DNA, 20 bp, Artificial
  CRISPR gRNA sequence
acctaaagtcacaagccttt

SEQ ID NO: 205761 - DNA, 20 bp, Artificial
  CRISPR gRNA sequence
aagtcacaagcctttaggaa

SEQ ID NO: 205762 - DNA, 20 bp, Artificial
  CRISPR gRNA sequence
gcctttaggaacggcacacc

SEQ ID NO: 205763 - DNA, 20 bp, Artificial
  CRISPR gRNA sequence
cctttaggaacggcacaccg

SEQ ID NO: 205764 - DNA, 20 bp, Artificial
  CRISPR gRNA sequence
ggcacaccgaggctaataat

SEQ ID NO: 205765 - DNA, 20 bp, Artificial
  CRISPR gRNA sequence
agtttaaaatcgaattaatt

SEQ ID NO: 205766 - DNA, 20 bp, Artificial
  CRISPR gRNA sequence
atcgaattaatttagcattc

SEQ ID NO: 205767 - DNA, 20 bp, Artificial
  CRISPR gRNA sequence
aatgtaacaattgctgtcac

SEQ ID NO: 205768 - DNA, 20 bp, Artificial
  CRISPR gRNA sequence
aattgctgtcactggtgctc

SEQ ID NO: 205769 - DNA, 20 bp, Artificial
  CRISPR gRNA sequence
ctgaattctgaatcttataa

SEQ ID NO: 205770 - DNA, 20 bp, Artificial
  CRISPR gRNA sequence
aatcttataaaagttcacaa

SEQ ID NO: 205771 - DNA, 20 bp, Artificial
  CRISPR gRNA sequence
atcttataaaagttcacaaa

SEQ ID NO: 205772 - DNA, 20 bp, Artificial
  CRISPR gRNA sequence
aaagttcacaaaaggctcta

SEQ ID NO: 205773 - DNA, 20 bp, Artificial
  CRISPR gRNA sequence
caaaaggctctatggatgtg

SEQ ID NO: 205774 - DNA, 20 bp, Artificial
  CRISPR gRNA sequence
tctatggatgtgaagtgtga

SEQ ID NO: 205775 - DNA, 20 bp, Artificial
  CRISPR gRNA sequence
ctatggatgtgaagtgtgac

SEQ ID NO: 205776 - DNA, 20 bp, Artificial
  CRISPR gRNA sequence
agtgtgacaggcactcactg

SEQ ID NO: 205777 - DNA, 20 bp, Artificial
  CRISPR gRNA sequence
tgtgacaggcactcactgta

SEQ ID NO: 205778 - DNA, 20 bp, Artificial
  CRISPR gRNA sequence
gaatgtttctattccttgct

SEQ ID NO: 205779 - DNA, 20 bp, Artificial
  CRISPR gRNA sequence
tattccttgctcagttttta

SEQ ID NO: 205780 - DNA, 20 bp, Artificial
  CRISPR gRNA sequence
ttgctcagtttttacagacg

SEQ ID NO: 205781 - DNA, 20 bp, Artificial
  CRISPR gRNA sequence
acgaagcacacgttttacaa

SEQ ID NO: 205782 - DNA, 20 bp, Artificial
  CRISPR gRNA sequence
cacgttttacaaaagcgaaa

SEQ ID NO: 205783 - DNA, 20 bp, Artificial
  CRISPR gRNA sequence
aaaagcgaaatggattccaa

SEQ ID NO: 205784 - DNA, 20 bp, Artificial
  CRISPR gRNA sequence
cgaaatggattccaaaagct

SEQ ID NO: 205785 - DNA, 20 bp, Artificial
  CRISPR gRNA sequence
gaaatggattccaaaagctc

SEQ ID NO: 205786 - DNA, 20 bp, Artificial
  CRISPR gRNA sequence
aaatggattccaaaagctcg

SEQ ID NO: 205787 - DNA, 20 bp, Artificial
  CRISPR gRNA sequence
tggattccaaaagctcgggg

SEQ ID NO: 205788 - DNA, 20 bp, Artificial
  CRISPR gRNA sequence
ggattccaaaagctcggggt

SEQ ID NO: 205789 - DNA, 20 bp, Artificial
  CRISPR gRNA sequence
gattccaaaagctcggggtg

SEQ ID NO: 205790 - DNA, 20 bp, Artificial
  CRISPR gRNA sequence
attccaaaagctcggggtgg

SEQ ID NO: 205791 - DNA, 20 bp, Artificial
  CRISPR gRNA sequence
ccaaaagctcggggtggggg

SEQ ID NO: 205792 - DNA, 20 bp, Artificial
  CRISPR gRNA sequence
caaaagctcggggtgggggt

SEQ ID NO: 205793 - DNA, 20 bp, Artificial
  CRISPR gRNA sequence
aaaagctcggggtgggggtg

SEQ ID NO: 205794 - DNA, 20 bp, Artificial
  CRISPR gRNA sequence
aaagctcggggtgggggtgg

SEQ ID NO: 205795 - DNA, 20 bp, Artificial
  CRISPR gRNA sequence
aagctcggggtgggggtggg

SEQ ID NO: 205796 - DNA, 20 bp, Artificial
  CRISPR gRNA sequence
agctcggggtgggggtgggg

SEQ ID NO: 205797 - DNA, 20 bp, Artificial
  CRISPR gRNA sequence
tcggggtgggggtggggggg

SEQ ID NO: 205798 - DNA, 20 bp, Artificial
  CRISPR gRNA sequence
ggggtgggggtgggggggtg

SEQ ID NO: 205799 - DNA, 20 bp, Artificial
  CRISPR gRNA sequence
gggtgggggtgggggggtgg

SEQ ID NO: 205800 - DNA, 20 bp, Artificial
  CRISPR gRNA sequence
gtgggggggtggaggttctt

SEQ ID NO: 205801 - DNA, 20 bp, Artificial
  CRISPR gRNA sequence
tctgctgcacatgttttgac

SEQ ID NO: 205802 - DNA, 20 bp, Artificial
  CRISPR gRNA sequence
tgctgcacatgttttgactg

SEQ ID NO: 205803 - DNA, 20 bp, Artificial
  CRISPR gRNA sequence
gctgcacatgttttgactgg

SEQ ID NO: 205804 - DNA, 20 bp, Artificial
  CRISPR gRNA sequence
aggttactgtcttcctattt

SEQ ID NO: 205805 - DNA, 20 bp, Artificial
  CRISPR gRNA sequence
ggttactgtcttcctatttc

SEQ ID NO: 205806 - DNA, 20 bp, Artificial
  CRISPR gRNA sequence
ttcctatttcaggcgaaaac

SEQ ID NO: 205807 - DNA, 20 bp, Artificial
  CRISPR gRNA sequence
aaaccagattacttttaaaa

SEQ ID NO: 205808 - DNA, 20 bp, Artificial
  CRISPR gRNA sequence
taaaacggttcccccaaata

SEQ ID NO: 205809 - DNA, 20 bp, Artificial
  CRISPR gRNA sequence
aacggttcccccaaataaag

SEQ ID NO: 205810 - DNA, 20 bp, Artificial
  CRISPR gRNA sequence
acggttcccccaaataaagt

SEQ ID NO: 205811 - DNA, 20 bp, Artificial
  CRISPR gRNA sequence
aaaaacttcaacgtacaatt

SEQ ID NO: 205812 - DNA, 20 bp, Artificial
  CRISPR gRNA sequence
gtacaatttagaatgtatgc

SEQ ID NO: 205813 - DNA, 20 bp, Artificial
  CRISPR gRNA sequence
caatttagaatgtatgcaag

SEQ ID NO: 205814 - DNA, 20 bp, Artificial
  CRISPR gRNA sequence
gaatgtatgcaagtggctga

SEQ ID NO: 205815 - DNA, 20 bp, Artificial
  CRISPR gRNA sequence
aatgtatgcaagtggctgat

SEQ ID NO: 205816 - DNA, 20 bp, Artificial
  CRISPR gRNA sequence
atgtatgcaagtggctgatg

SEQ ID NO: 205817 - DNA, 20 bp, Artificial
  CRISPR gRNA sequence
gcaagtggctgatggggcgt

SEQ ID NO: 205818 - DNA, 20 bp, Artificial
  CRISPR gRNA sequence
caagtggctgatggggcgtg

SEQ ID NO: 205819 - DNA, 20 bp, Artificial
  CRISPR gRNA sequence
aagtggctgatggggcgtga

SEQ ID NO: 205820 - DNA, 20 bp, Artificial
  CRISPR gRNA sequence
tgatggggcgtgagggtcac

SEQ ID NO: 205821 - DNA, 20 bp, Artificial
  CRISPR gRNA sequence
ggggcgtgagggtcacgaga

SEQ ID NO: 205822 - DNA, 20 bp, Artificial
  CRISPR gRNA sequence
gggcgtgagggtcacgagaa

SEQ ID NO: 205823 - DNA, 20 bp, Artificial
  CRISPR gRNA sequence
cgtgagggtcacgagaaagg

SEQ ID NO: 205824 - DNA, 20 bp, Artificial
  CRISPR gRNA sequence
tgagggtcacgagaaaggaa

SEQ ID NO: 205825 - DNA, 20 bp, Artificial
  CRISPR gRNA sequence
cacgagaaaggaagagtttc

SEQ ID NO: 205826 - DNA, 20 bp, Artificial
  CRISPR gRNA sequence
agaaaggaagagtttccagc

SEQ ID NO: 205827 - DNA, 20 bp, Artificial
  CRISPR gRNA sequence
gtttccagcaagcttatttt

SEQ ID NO: 205828 - DNA, 20 bp, Artificial
  CRISPR gRNA sequence
tttccagcaagcttattttt

SEQ ID NO: 205829 - DNA, 20 bp, Artificial
  CRISPR gRNA sequence
atttttaggattaaaaacga

SEQ ID NO: 205830 - DNA, 20 bp, Artificial
  CRISPR gRNA sequence
aaacgacagcaaaaattaca

SEQ ID NO: 205831 - DNA, 20 bp, Artificial
  CRISPR gRNA sequence
gacagcaaaaattacacggc

SEQ ID NO: 205832 - DNA, 20 bp, Artificial
  CRISPR gRNA sequence
agcaaaaattacacggccgg

SEQ ID NO: 205833 - DNA, 20 bp, Artificial
  CRISPR gRNA sequence
gattcttctgattgaatgct

SEQ ID NO: 205834 - DNA, 20 bp, Artificial
  CRISPR gRNA sequence
tcttcgctcctatgttcatg

SEQ ID NO: 205835 - DNA, 20 bp, Artificial
  CRISPR gRNA sequence
cttcgctcctatgttcatgt

SEQ ID NO: 205836 - DNA, 20 bp, Artificial
  CRISPR gRNA sequence
tcgctcctatgttcatgtgg

SEQ ID NO: 205837 - DNA, 20 bp, Artificial
  CRISPR gRNA sequence
cgctcctatgttcatgtggg

SEQ ID NO: 205838 - DNA, 20 bp, Artificial
  CRISPR gRNA sequence
atgttcatgtgggaggcaaa

SEQ ID NO: 205839 - DNA, 20 bp, Artificial
  CRISPR gRNA sequence
ttcatgtgggaggcaaacgg

SEQ ID NO: 205840 - DNA, 20 bp, Artificial
  CRISPR gRNA sequence
aaaatgcgcacttccatcgc

SEQ ID NO: 205841 - DNA, 20 bp, Artificial
  CRISPR gRNA sequence
aatgcgcacttccatcgcaa

SEQ ID NO: 205842 - DNA, 20 bp, Artificial
  CRISPR gRNA sequence
atgcgcacttccatcgcaag

SEQ ID NO: 205843 - DNA, 20 bp, Artificial
  CRISPR gRNA sequence
cacttccatcgcaagaggcc

SEQ ID NO: 205844 - DNA, 20 bp, Artificial
  CRISPR gRNA sequence
acttccatcgcaagaggccc

SEQ ID NO: 205845 - DNA, 20 bp, Artificial
  CRISPR gRNA sequence
cctcaaccccaaatgcgtct

SEQ ID NO: 205846 - DNA, 20 bp, Artificial
  CRISPR gRNA sequence
cccaaatgcgtctaagcact

SEQ ID NO: 205847 - DNA, 20 bp, Artificial
  CRISPR gRNA sequence
aaatgcgtctaagcactgag

SEQ ID NO: 205848 - DNA, 20 bp, Artificial
  CRISPR gRNA sequence
aatgcgtctaagcactgaga

SEQ ID NO: 205849 - DNA, 20 bp, Artificial
  CRISPR gRNA sequence
atgcgtctaagcactgagaa

SEQ ID NO: 205850 - DNA, 20 bp, Artificial
  CRISPR gRNA sequence
gcgtctaagcactgagaagg

SEQ ID NO: 205851 - DNA, 20 bp, Artificial
  CRISPR gRNA sequence
gtctaagcactgagaaggga

SEQ ID NO: 205852 - DNA, 20 bp, Artificial
  CRISPR gRNA sequence
tctaagcactgagaagggag

SEQ ID NO: 205853 - DNA, 20 bp, Artificial
  CRISPR gRNA sequence
ctaagcactgagaagggaga

SEQ ID NO: 205854 - DNA, 20 bp, Artificial
  CRISPR gRNA sequence
taagcactgagaagggagag

SEQ ID NO: 205855 - DNA, 20 bp, Artificial
  CRISPR gRNA sequence
gagaagggagaggggtgcga

SEQ ID NO: 205856 - DNA, 20 bp, Artificial
  CRISPR gRNA sequence
aagggagaggggtgcgaaag

SEQ ID NO: 205857 - DNA, 20 bp, Artificial
  CRISPR gRNA sequence
agggagaggggtgcgaaaga

SEQ ID NO: 205858 - DNA, 20 bp, Artificial
  CRISPR gRNA sequence
gggagaggggtgcgaaagaa

SEQ ID NO: 205859 - DNA, 20 bp, Artificial
  CRISPR gRNA sequence
ggagaggggtgcgaaagaag

SEQ ID NO: 205860 - DNA, 20 bp, Artificial
  CRISPR gRNA sequence
gtgcgaaagaaggggatccc

SEQ ID NO: 205861 - DNA, 20 bp, Artificial
  CRISPR gRNA sequence
cgaaagaaggggatccctag

SEQ ID NO: 205862 - DNA, 20 bp, Artificial
  CRISPR gRNA sequence
aaggggatccctagcagctg

SEQ ID NO: 205863 - DNA, 20 bp, Artificial
  CRISPR gRNA sequence
ctgatcgcgccctttcttgc

SEQ ID NO: 205864 - DNA, 20 bp, Artificial
  CRISPR gRNA sequence
ttgctagttaatttttgcgc

SEQ ID NO: 205865 - DNA, 20 bp, Artificial
  CRISPR gRNA sequence
tgctagttaatttttgcgcg

SEQ ID NO: 205866 - DNA, 20 bp, Artificial
  CRISPR gRNA sequence
taatttttgcgcgaggtgcg

SEQ ID NO: 205867 - DNA, 20 bp, Artificial
  CRISPR gRNA sequence
tttgcgcgaggtgcgcggtt

SEQ ID NO: 205868 - DNA, 20 bp, Artificial
  CRISPR gRNA sequence
tgcgcgaggtgcgcggtttg

SEQ ID NO: 205869 - DNA, 20 bp, Artificial
  CRISPR gRNA sequence
tcttcctgtgtgtgtgcatt

SEQ ID NO: 205870 - DNA, 20 bp, Artificial
  CRISPR gRNA sequence
ttcctgtgtgtgtgcatttg

SEQ ID NO: 205871 - DNA, 20 bp, Artificial
  CRISPR gRNA sequence
tgtgtgtgtgcatttggaga

SEQ ID NO: 205872 - DNA, 20 bp, Artificial
  CRISPR gRNA sequence
tgtgtgtgcatttggagatg

SEQ ID NO: 205873 - DNA, 20 bp, Artificial
  CRISPR gRNA sequence
tgcatttggagatggagaac

SEQ ID NO: 205874 - DNA, 20 bp, Artificial
  CRISPR gRNA sequence
gcatttggagatggagaacc

SEQ ID NO: 205875 - DNA, 20 bp, Artificial
  CRISPR gRNA sequence
tttggagatggagaaccggg

SEQ ID NO: 205876 - DNA, 20 bp, Artificial
  CRISPR gRNA sequence
tggagatggagaaccgggtg

SEQ ID NO: 205877 - DNA, 20 bp, Artificial
  CRISPR gRNA sequence
ggagatggagaaccgggtgg

SEQ ID NO: 205878 - DNA, 20 bp, Artificial
  CRISPR gRNA sequence
agatggagaaccgggtggag

SEQ ID NO: 205879 - DNA, 20 bp, Artificial
  CRISPR gRNA sequence
gagaaccgggtggaggagat

SEQ ID NO: 205880 - DNA, 20 bp, Artificial
  CRISPR gRNA sequence
agatgagccccgctctcacc

SEQ ID NO: 205881 - DNA, 20 bp, Artificial
  CRISPR gRNA sequence
gatgagccccgctctcaccc

SEQ ID NO: 205882 - DNA, 20 bp, Artificial
  CRISPR gRNA sequence
atgagccccgctctcaccca

SEQ ID NO: 205883 - DNA, 20 bp, Artificial
  CRISPR gRNA sequence
tgagccccgctctcacccag

SEQ ID NO: 205884 - DNA, 20 bp, Artificial
  CRISPR gRNA sequence
gagccccgctctcacccagg

SEQ ID NO: 205885 - DNA, 20 bp, Artificial
  CRISPR gRNA sequence
ccccgctctcacccaggggg

SEQ ID NO: 205886 - DNA, 20 bp, Artificial
  CRISPR gRNA sequence
cgctctcacccagggggaag

SEQ ID NO: 205887 - DNA, 20 bp, Artificial
  CRISPR gRNA sequence
cccagggggaagaagacgac

SEQ ID NO: 205888 - DNA, 20 bp, Artificial
  CRISPR gRNA sequence
ccagggggaagaagacgacc

SEQ ID NO: 205889 - DNA, 20 bp, Artificial
  CRISPR gRNA sequence
cagggggaagaagacgacca

SEQ ID NO: 205890 - DNA, 20 bp, Artificial
  CRISPR gRNA sequence
gggaagaagacgaccaggga

SEQ ID NO: 205891 - DNA, 20 bp, Artificial
  CRISPR gRNA sequence
ggaagaagacgaccagggaa

SEQ ID NO: 205892 - DNA, 20 bp, Artificial
  CRISPR gRNA sequence
agaagacgaccagggaaagg

SEQ ID NO: 205893 - DNA, 20 bp, Artificial
  CRISPR gRNA sequence
gaagacgaccagggaaagga

SEQ ID NO: 205894 - DNA, 20 bp, Artificial
  CRISPR gRNA sequence
aagacgaccagggaaaggaa

SEQ ID NO: 205895 - DNA, 20 bp, Artificial
  CRISPR gRNA sequence
gacgaccagggaaaggaagg

SEQ ID NO: 205896 - DNA, 20 bp, Artificial
  CRISPR gRNA sequence
acgaccagggaaaggaaggg

SEQ ID NO: 205897 - DNA, 20 bp, Artificial
  CRISPR gRNA sequence
accagggaaaggaagggagg

SEQ ID NO: 205898 - DNA, 20 bp, Artificial
  CRISPR gRNA sequence
agggaaaggaagggaggaag

SEQ ID NO: 205899 - DNA, 20 bp, Artificial
  CRISPR gRNA sequence
gggaaaggaagggaggaaga

SEQ ID NO: 205900 - DNA, 20 bp, Artificial
  CRISPR gRNA sequence
ggaaaggaagggaggaagaa

SEQ ID NO: 205901 - DNA, 20 bp, Artificial
  CRISPR gRNA sequence
gaaaggaagggaggaagaag

SEQ ID NO: 205902 - DNA, 20 bp, Artificial
  CRISPR gRNA sequence
aaaggaagggaggaagaagg

SEQ ID NO: 205903 - DNA, 20 bp, Artificial
  CRISPR gRNA sequence
aaggaagggaggaagaaggg

SEQ ID NO: 205904 - DNA, 20 bp, Artificial
  CRISPR gRNA sequence
ggggggcgcccgattccccg

SEQ ID NO: 205905 - DNA, 20 bp, Artificial
  CRISPR gRNA sequence
gggggcgcccgattccccgt

SEQ ID NO: 205906 - DNA, 20 bp, Artificial
  CRISPR gRNA sequence
ggggcgcccgattccccgtg

SEQ ID NO: 205907 - DNA, 20 bp, Artificial
  CRISPR gRNA sequence
gccctcccacgtctgcactt

SEQ ID NO: 205908 - DNA, 20 bp, Artificial
  CRISPR gRNA sequence
ccctcccacgtctgcacttc

SEQ ID NO: 205909 - DNA, 20 bp, Artificial
  CRISPR gRNA sequence
acgtctgcacttcgggcgct

SEQ ID NO: 205910 - DNA, 20 bp, Artificial
  CRISPR gRNA sequence
cgtctgcacttcgggcgctc

SEQ ID NO: 205911 - DNA, 20 bp, Artificial
  CRISPR gRNA sequence
gtctgcacttcgggcgctca

SEQ ID NO: 205912 - DNA, 20 bp, Artificial
  CRISPR gRNA sequence
acttcgggcgctcagggccc

SEQ ID NO: 205913 - DNA, 20 bp, Artificial
  CRISPR gRNA sequence
ggcccgagtgttctgcgccc

SEQ ID NO: 205914 - DNA, 20 bp, Artificial
  CRISPR gRNA sequence
tgcgccccggccaccctctt

SEQ ID NO: 205915 - DNA, 20 bp, Artificial
  CRISPR gRNA sequence
gcgccccggccaccctcttc

SEQ ID NO: 205916 - DNA, 20 bp, Artificial
  CRISPR gRNA sequence
cgccccggccaccctcttca

SEQ ID NO: 205917 - DNA, 20 bp, Artificial
  CRISPR gRNA sequence
caccctcttcagggcgccgc

SEQ ID NO: 205918 - DNA, 20 bp, Artificial
  CRISPR gRNA sequence
accctcttcagggcgccgcc

SEQ ID NO: 205919 - DNA, 20 bp, Artificial
  CRISPR gRNA sequence
tcttcagggcgccgccgggc

SEQ ID NO: 205920 - DNA, 20 bp, Artificial
  CRISPR gRNA sequence
cagggcgccgccgggctggc

SEQ ID NO: 205921 - DNA, 20 bp, Artificial
  CRISPR gRNA sequence
agggcgccgccgggctggct

SEQ ID NO: 205922 - DNA, 20 bp, Artificial
  CRISPR gRNA sequence
gggcgccgccgggctggctg

SEQ ID NO: 205923 - DNA, 20 bp, Artificial
  CRISPR gRNA sequence
ccgccgggctggctggggcg

SEQ ID NO: 205924 - DNA, 20 bp, Artificial
  CRISPR gRNA sequence
gggcgcagcccacacgcccg

SEQ ID NO: 205925 - DNA, 20 bp, Artificial
  CRISPR gRNA sequence
ggcgcagcccacacgcccgc

SEQ ID NO: 205926 - DNA, 20 bp, Artificial
  CRISPR gRNA sequence
gcgcagcccacacgcccgcg

SEQ ID NO: 205927 - DNA, 20 bp, Artificial
  CRISPR gRNA sequence
cgcagcccacacgcccgcgg

SEQ ID NO: 205928 - DNA, 20 bp, Artificial
  CRISPR gRNA sequence
cccacacgcccgcgggggcg

SEQ ID NO: 205929 - DNA, 20 bp, Artificial
  CRISPR gRNA sequence
cgcccgcgggggcgaagcga

SEQ ID NO: 205930 - DNA, 20 bp, Artificial
  CRISPR gRNA sequence
ccgcgggggcgaagcgacag

SEQ ID NO: 205931 - DNA, 20 bp, Artificial
  CRISPR gRNA sequence
gggcgaagcgacagcagccg

SEQ ID NO: 205932 - DNA, 20 bp, Artificial
  CRISPR gRNA sequence
ggcgaagcgacagcagccgc

SEQ ID NO: 205933 - DNA, 20 bp, Artificial
  CRISPR gRNA sequence
gcgaagcgacagcagccgca

SEQ ID NO: 205934 - DNA, 20 bp, Artificial
  CRISPR gRNA sequence
agcgacagcagccgcagggc

SEQ ID NO: 205935 - DNA, 20 bp, Artificial
  CRISPR gRNA sequence
gcgacagcagccgcagggct

SEQ ID NO: 205936 - DNA, 20 bp, Artificial
  CRISPR gRNA sequence
gacagcagccgcagggctgg

SEQ ID NO: 205937 - DNA, 20 bp, Artificial
  CRISPR gRNA sequence
gcagccgcagggctgggagc

SEQ ID NO: 205938 - DNA, 20 bp, Artificial
  CRISPR gRNA sequence
cagccgcagggctgggagcg

SEQ ID NO: 205939 - DNA, 20 bp, Artificial
  CRISPR gRNA sequence
gccgcagggctgggagcgag

SEQ ID NO: 205940 - DNA, 20 bp, Artificial
  CRISPR gRNA sequence
gagcgaggagccactcaccg

SEQ ID NO: 205941 - DNA, 20 bp, Artificial
  CRISPR gRNA sequence
gccactcaccgcagcacgcc

SEQ ID NO: 205942 - DNA, 20 bp, Artificial
  CRISPR gRNA sequence
tcaccgcagcacgccgagcc

SEQ ID NO: 205943 - DNA, 20 bp, Artificial
  CRISPR gRNA sequence
cagcacgccgagcccagcaa

SEQ ID NO: 205944 - DNA, 20 bp, Artificial
  CRISPR gRNA sequence
cccagcaacagcgccgctac

SEQ ID NO: 205945 - DNA, 20 bp, Artificial
  CRISPR gRNA sequence
ccagcaacagcgccgctacc

SEQ ID NO: 205946 - DNA, 20 bp, Artificial
  CRISPR gRNA sequence
cagcaacagcgccgctacca

SEQ ID NO: 205947 - DNA, 20 bp, Artificial
  CRISPR gRNA sequence
agcaacagcgccgctaccag

SEQ ID NO: 205948 - DNA, 20 bp, Artificial
  CRISPR gRNA sequence
ccacatctccgcgcccgccg

SEQ ID NO: 205949 - DNA, 20 bp, Artificial
  CRISPR gRNA sequence
cacatctccgcgcccgccgc

SEQ ID NO: 205950 - DNA, 20 bp, Artificial
  CRISPR gRNA sequence
acatctccgcgcccgccgcg

SEQ ID NO: 205951 - DNA, 20 bp, Artificial
  CRISPR gRNA sequence
cggggtcgccgccgccgccg

SEQ ID NO: 205952 - DNA, 20 bp, Artificial
  CRISPR gRNA sequence
ggggtcgccgccgccgccgc

SEQ ID NO: 205953 - DNA, 20 bp, Artificial
  CRISPR gRNA sequence
ccgccgccgccgcaggtgtc

SEQ ID NO: 205954 - DNA, 20 bp, Artificial
  CRISPR gRNA sequence
gccgccgccgcaggtgtccg

SEQ ID NO: 205955 - DNA, 20 bp, Artificial
  CRISPR gRNA sequence
gccgccgcaggtgtccggag

SEQ ID NO: 205956 - DNA, 20 bp, Artificial
  CRISPR gRNA sequence
gccgcaggtgtccggagcag

SEQ ID NO: 205957 - DNA, 20 bp, Artificial
  CRISPR gRNA sequence
agcagccgccgccgccgtta

SEQ ID NO: 205958 - DNA, 20 bp, Artificial
  CRISPR gRNA sequence
gcagccgccgccgccgttac

SEQ ID NO: 205959 - DNA, 20 bp, Artificial
  CRISPR gRNA sequence
gccgccgccgccgttacagg

SEQ ID NO: 205960 - DNA, 20 bp, Artificial
  CRISPR gRNA sequence
ccgccgccgccgttacaggc

SEQ ID NO: 205961 - DNA, 20 bp, Artificial
  CRISPR gRNA sequence
ccgaccgccgccgcgcgtca

SEQ ID NO: 205962 - DNA, 20 bp, Artificial
  CRISPR gRNA sequence
cgaccgccgccgcgcgtcac

SEQ ID NO: 205963 - DNA, 20 bp, Artificial
  CRISPR gRNA sequence
ccgccgccgcgcgtcacagg

SEQ ID NO: 205964 - DNA, 20 bp, Artificial
  CRISPR gRNA sequence
cgccgccgcgcgtcacaggc

SEQ ID NO: 205965 - DNA, 20 bp, Artificial
  CRISPR gRNA sequence
cacaggcaggacccactgcc

SEQ ID NO: 205966 - DNA, 20 bp, Artificial
  CRISPR gRNA sequence
acaggcaggacccactgccc

SEQ ID NO: 205967 - DNA, 20 bp, Artificial
  CRISPR gRNA sequence
gacccactgcccaggctgca

SEQ ID NO: 205968 - DNA, 20 bp, Artificial
  CRISPR gRNA sequence
cccgcctgctccccgcccgc

SEQ ID NO: 205969 - DNA, 20 bp, Artificial
  CRISPR gRNA sequence
cgcctgctccccgcccgcga

SEQ ID NO: 205970 - DNA, 20 bp, Artificial
  CRISPR gRNA sequence
gagagccgcgcacgcgcact

SEQ ID NO: 205971 - DNA, 20 bp, Artificial
  CRISPR gRNA sequence
cgcaaccgctgctgttgacg

SEQ ID NO: 205972 - DNA, 20 bp, Artificial
  CRISPR gRNA sequence
tgttgacgcggcgccctccc

SEQ ID NO: 205973 - DNA, 20 bp, Artificial
  CRISPR gRNA sequence
cgcggcgccctccccagtcg

SEQ ID NO: 205974 - DNA, 20 bp, Artificial
  CRISPR gRNA sequence
gcggcgccctccccagtcgc

SEQ ID NO: 205975 - DNA, 20 bp, Artificial
  CRISPR gRNA sequence
ccctccccagtcgcaggctc

SEQ ID NO: 205976 - DNA, 20 bp, Artificial
  CRISPR gRNA sequence
ccagtcgcaggctccagacc

SEQ ID NO: 205977 - DNA, 20 bp, Artificial
  CRISPR gRNA sequence
cagtcgcaggctccagaccc

SEQ ID NO: 205978 - DNA, 20 bp, Artificial
  CRISPR gRNA sequence
agtcgcaggctccagacccg

SEQ ID NO: 205979 - DNA, 20 bp, Artificial
  CRISPR gRNA sequence
ccgggtctggagcctgcgac

SEQ ID NO: 205980 - DNA, 20 bp, Artificial
  CRISPR gRNA sequence
cgggtctggagcctgcgact

SEQ ID NO: 205981 - DNA, 20 bp, Artificial
  CRISPR gRNA sequence
gggtctggagcctgcgactg

SEQ ID NO: 205982 - DNA, 20 bp, Artificial
  CRISPR gRNA sequence
gtctggagcctgcgactggg

SEQ ID NO: 205983 - DNA, 20 bp, Artificial
  CRISPR gRNA sequence
tctggagcctgcgactgggg

SEQ ID NO: 205984 - DNA, 20 bp, Artificial
  CRISPR gRNA sequence
ctggagcctgcgactgggga

SEQ ID NO: 205985 - DNA, 20 bp, Artificial
  CRISPR gRNA sequence
tggggagggcgccgcgtcaa

SEQ ID NO: 205986 - DNA, 20 bp, Artificial
  CRISPR gRNA sequence
ggagggcgccgcgtcaacag

SEQ ID NO: 205987 - DNA, 20 bp, Artificial
  CRISPR gRNA sequence
gggcgccgcgtcaacagcag

SEQ ID NO: 205988 - DNA, 20 bp, Artificial
  CRISPR gRNA sequence
cgcgtcaacagcagcggttg

SEQ ID NO: 205989 - DNA, 20 bp, Artificial
  CRISPR gRNA sequence
gcgtcaacagcagcggttgc

SEQ ID NO: 205990 - DNA, 20 bp, Artificial
  CRISPR gRNA sequence
cgtcaacagcagcggttgcg

SEQ ID NO: 205991 - DNA, 20 bp, Artificial
  CRISPR gRNA sequence
caacagcagcggttgcgggg

SEQ ID NO: 205992 - DNA, 20 bp, Artificial
  CRISPR gRNA sequence
aacagcagcggttgcggggc

SEQ ID NO: 205993 - DNA, 20 bp, Artificial
  CRISPR gRNA sequence
acagcagcggttgcggggcg

SEQ ID NO: 205994 - DNA, 20 bp, Artificial
  CRISPR gRNA sequence
agcggttgcggggcggggcc

SEQ ID NO: 205995 - DNA, 20 bp, Artificial
  CRISPR gRNA sequence
cggggccgagtgcgcgtgcg

SEQ ID NO: 205996 - DNA, 20 bp, Artificial
  CRISPR gRNA sequence
gtgcgcgtgcgcggctctcg

SEQ ID NO: 205997 - DNA, 20 bp, Artificial
  CRISPR gRNA sequence
tgcgcgtgcgcggctctcgc

SEQ ID NO: 205998 - DNA, 20 bp, Artificial
  CRISPR gRNA sequence
gcgtgcgcggctctcgcggg

SEQ ID NO: 205999 - DNA, 20 bp, Artificial
  CRISPR gRNA sequence
cgtgcgcggctctcgcgggc

SEQ ID NO: 206000 - DNA, 20 bp, Artificial
  CRISPR gRNA sequence
gtgcgcggctctcgcgggcg

SEQ ID NO: 206001 - DNA, 20 bp, Artificial
  CRISPR gRNA sequence
gcgcggctctcgcgggcggg

SEQ ID NO: 206002 - DNA, 20 bp, Artificial
  CRISPR gRNA sequence
cggctctcgcgggcggggag

SEQ ID NO: 206003 - DNA, 20 bp, Artificial
  CRISPR gRNA sequence
ggctctcgcgggcggggagc

SEQ ID NO: 206004 - DNA, 20 bp, Artificial
  CRISPR gRNA sequence
tctcgcgggcggggagcagg

SEQ ID NO: 206005 - DNA, 20 bp, Artificial
  CRISPR gRNA sequence
ctcgcgggcggggagcaggc

SEQ ID NO: 206006 - DNA, 20 bp, Artificial
  CRISPR gRNA sequence
tcgcgggcggggagcaggcg

SEQ ID NO: 206007 - DNA, 20 bp, Artificial
  CRISPR gRNA sequence
cgcgggcggggagcaggcgg

SEQ ID NO: 206008 - DNA, 20 bp, Artificial
  CRISPR gRNA sequence
cgggcggggagcaggcgggg

SEQ ID NO: 206009 - DNA, 20 bp, Artificial
  CRISPR gRNA sequence
gcggggagcaggcgggggag

SEQ ID NO: 206010 - DNA, 20 bp, Artificial
  CRISPR gRNA sequence
cggggagcaggcgggggagc

SEQ ID NO: 206011 - DNA, 20 bp, Artificial
  CRISPR gRNA sequence
ggagcaggcgggggagcggg

SEQ ID NO: 206012 - DNA, 20 bp, Artificial
  CRISPR gRNA sequence
gagcaggcgggggagcgggc

SEQ ID NO: 206013 - DNA, 20 bp, Artificial
  CRISPR gRNA sequence
caggcgggggagcgggcggg

SEQ ID NO: 206014 - DNA, 20 bp, Artificial
  CRISPR gRNA sequence
gcgggggagcgggcgggaag

SEQ ID NO: 206015 - DNA, 20 bp, Artificial
  CRISPR gRNA sequence
ggggagcgggcgggaagcag

SEQ ID NO: 206016 - DNA, 20 bp, Artificial
  CRISPR gRNA sequence
gggagcgggcgggaagcagt

SEQ ID NO: 206017 - DNA, 20 bp, Artificial
  CRISPR gRNA sequence
gagcgggcgggaagcagtgg

SEQ ID NO: 206018 - DNA, 20 bp, Artificial
  CRISPR gRNA sequence
agtgggagcgcgcgtgcgcg

SEQ ID NO: 206019 - DNA, 20 bp, Artificial
  CRISPR gRNA sequence
cgcgcgtgcgcgcggccgtg

SEQ ID NO: 206020 - DNA, 20 bp, Artificial
  CRISPR gRNA sequence
gtgcgcgcggccgtgcagcc

SEQ ID NO: 206021 - DNA, 20 bp, Artificial
  CRISPR gRNA sequence
tgcgcgcggccgtgcagcct

SEQ ID NO: 206022 - DNA, 20 bp, Artificial
  CRISPR gRNA sequence
gcgcggccgtgcagcctggg

SEQ ID NO: 206023 - DNA, 20 bp, Artificial
  CRISPR gRNA sequence
cggccgtgcagcctgggcag

SEQ ID NO: 206024 - DNA, 20 bp, Artificial
  CRISPR gRNA sequence
ggccgtgcagcctgggcagt

SEQ ID NO: 206025 - DNA, 20 bp, Artificial
  CRISPR gRNA sequence
tgggtcctgcctgtgacgcg

SEQ ID NO: 206026 - DNA, 20 bp, Artificial
  CRISPR gRNA sequence
gtcctgcctgtgacgcgcgg

SEQ ID NO: 206027 - DNA, 20 bp, Artificial
  CRISPR gRNA sequence
ctgcctgtgacgcgcggcgg

SEQ ID NO: 206028 - DNA, 20 bp, Artificial
  CRISPR gRNA sequence
ctgtgacgcgcggcggcggt

SEQ ID NO: 206029 - DNA, 20 bp, Artificial
  CRISPR gRNA sequence
gcggtcggtcctgcctgtaa

SEQ ID NO: 206030 - DNA, 20 bp, Artificial
  CRISPR gRNA sequence
gtcggtcctgcctgtaacgg

SEQ ID NO: 206031 - DNA, 20 bp, Artificial
  CRISPR gRNA sequence
ggtcctgcctgtaacggcgg

SEQ ID NO: 206032 - DNA, 20 bp, Artificial
  CRISPR gRNA sequence
cctgcctgtaacggcggcgg

SEQ ID NO: 206033 - DNA, 20 bp, Artificial
  CRISPR gRNA sequence
ggcggcggcggctgctgctc

SEQ ID NO: 206034 - DNA, 20 bp, Artificial
  CRISPR gRNA sequence
gctgctgctccggacacctg

SEQ ID NO: 206035 - DNA, 20 bp, Artificial
  CRISPR gRNA sequence
gctgctccggacacctgcgg

SEQ ID NO: 206036 - DNA, 20 bp, Artificial
  CRISPR gRNA sequence
gctccggacacctgcggcgg

SEQ ID NO: 206037 - DNA, 20 bp, Artificial
  CRISPR gRNA sequence
ccggacacctgcggcggcgg

SEQ ID NO: 206038 - DNA, 20 bp, Artificial
  CRISPR gRNA sequence
cggcggcggcggcgaccccg

SEQ ID NO: 206039 - DNA, 20 bp, Artificial
  CRISPR gRNA sequence
cggcggcggcgaccccgcgg

SEQ ID NO: 206040 - DNA, 20 bp, Artificial
  CRISPR gRNA sequence
ggcggcggcgaccccgcggc

SEQ ID NO: 206041 - DNA, 20 bp, Artificial
  CRISPR gRNA sequence
cggcgaccccgcggcgggcg

SEQ ID NO: 206042 - DNA, 20 bp, Artificial
  CRISPR gRNA sequence
gcgaccccgcggcgggcgcg

SEQ ID NO: 206043 - DNA, 20 bp, Artificial
  CRISPR gRNA sequence
ccgcggcgggcgcggagatg

SEQ ID NO: 206044 - DNA, 20 bp, Artificial
  CRISPR gRNA sequence
gggcgcggagatgtggcccc

SEQ ID NO: 206045 - DNA, 20 bp, Artificial
  CRISPR gRNA sequence
cgcggagatgtggcccctgg

SEQ ID NO: 206046 - DNA, 20 bp, Artificial
  CRISPR gRNA sequence
ggagatgtggcccctggtag

SEQ ID NO: 206047 - DNA, 20 bp, Artificial
  CRISPR gRNA sequence
cctggtagcggcgctgttgc

SEQ ID NO: 206048 - DNA, 20 bp, Artificial
  CRISPR gRNA sequence
ctggtagcggcgctgttgct

SEQ ID NO: 206049 - DNA, 20 bp, Artificial
  CRISPR gRNA sequence
agcggcgctgttgctgggct

SEQ ID NO: 206050 - DNA, 20 bp, Artificial
  CRISPR gRNA sequence
ttgctgggctcggcgtgctg

SEQ ID NO: 206051 - DNA, 20 bp, Artificial
  CRISPR gRNA sequence
tgggctcggcgtgctgcggt

SEQ ID NO: 206052 - DNA, 20 bp, Artificial
  CRISPR gRNA sequence
gctcggcgtgctgcggtgag

SEQ ID NO: 206053 - DNA, 20 bp, Artificial
  CRISPR gRNA sequence
ggtgagtggctcctcgctcc

SEQ ID NO: 206054 - DNA, 20 bp, Artificial
  CRISPR gRNA sequence
gctcctcgctcccagccctg

SEQ ID NO: 206055 - DNA, 20 bp, Artificial
  CRISPR gRNA sequence
ctgctgtcgcttcgcccccg

SEQ ID NO: 206056 - DNA, 20 bp, Artificial
  CRISPR gRNA sequence
tgctgtcgcttcgcccccgc

SEQ ID NO: 206057 - DNA, 20 bp, Artificial
  CRISPR gRNA sequence
gcttcgcccccgcgggcgtg

SEQ ID NO: 206058 - DNA, 20 bp, Artificial
  CRISPR gRNA sequence
cttcgcccccgcgggcgtgt

SEQ ID NO: 206059 - DNA, 20 bp, Artificial
  CRISPR gRNA sequence
cgggcgtgtgggctgcgccc

SEQ ID NO: 206060 - DNA, 20 bp, Artificial
  CRISPR gRNA sequence
cgtgtgggctgcgccccagc

SEQ ID NO: 206061 - DNA, 20 bp, Artificial
  CRISPR gRNA sequence
gggctgcgccccagccagcc

SEQ ID NO: 206062 - DNA, 20 bp, Artificial
  CRISPR gRNA sequence
ctgcgccccagccagcccgg

SEQ ID NO: 206063 - DNA, 20 bp, Artificial
  CRISPR gRNA sequence
gccagcccggcggcgccctg

SEQ ID NO: 206064 - DNA, 20 bp, Artificial
  CRISPR gRNA sequence
cagcccggcggcgccctgaa

SEQ ID NO: 206065 - DNA, 20 bp, Artificial
  CRISPR gRNA sequence
agcccggcggcgccctgaag

SEQ ID NO: 206066 - DNA, 20 bp, Artificial
  CRISPR gRNA sequence
gcccggcggcgccctgaaga

SEQ ID NO: 206067 - DNA, 20 bp, Artificial
  CRISPR gRNA sequence
cggcggcgccctgaagaggg

SEQ ID NO: 206068 - DNA, 20 bp, Artificial
  CRISPR gRNA sequence
ggcgccctgaagagggtggc

SEQ ID NO: 206069 - DNA, 20 bp, Artificial
  CRISPR gRNA sequence
gcgccctgaagagggtggcc

SEQ ID NO: 206070 - DNA, 20 bp, Artificial
  CRISPR gRNA sequence
cgccctgaagagggtggccg

SEQ ID NO: 206071 - DNA, 20 bp, Artificial
  CRISPR gRNA sequence
tgaagagggtggccggggcg

SEQ ID NO: 206072 - DNA, 20 bp, Artificial
  CRISPR gRNA sequence
tggccggggcgcagaacact

SEQ ID NO: 206073 - DNA, 20 bp, Artificial
  CRISPR gRNA sequence
ggccggggcgcagaacactc

SEQ ID NO: 206074 - DNA, 20 bp, Artificial
  CRISPR gRNA sequence
gcgcagaacactcgggccct

SEQ ID NO: 206075 - DNA, 20 bp, Artificial
  CRISPR gRNA sequence
actcgggccctgagcgcccg

SEQ ID NO: 206076 - DNA, 20 bp, Artificial
  CRISPR gRNA sequence
ggccctgagcgcccgaagtg

SEQ ID NO: 206077 - DNA, 20 bp, Artificial
  CRISPR gRNA sequence
gagcgcccgaagtgcagacg

SEQ ID NO: 206078 - DNA, 20 bp, Artificial
  CRISPR gRNA sequence
agcgcccgaagtgcagacgt

SEQ ID NO: 206079 - DNA, 20 bp, Artificial
  CRISPR gRNA sequence
cgcccgaagtgcagacgtgg

SEQ ID NO: 206080 - DNA, 20 bp, Artificial
  CRISPR gRNA sequence
gcccgaagtgcagacgtggg

SEQ ID NO: 206081 - DNA, 20 bp, Artificial
  CRISPR gRNA sequence
cccgaagtgcagacgtggga

SEQ ID NO: 206082 - DNA, 20 bp, Artificial
  CRISPR gRNA sequence
gcagacgtgggagggcccca

SEQ ID NO: 206083 - DNA, 20 bp, Artificial
  CRISPR gRNA sequence
cagacgtgggagggccccac

SEQ ID NO: 206084 - DNA, 20 bp, Artificial
  CRISPR gRNA sequence
agacgtgggagggccccacg

SEQ ID NO: 206085 - DNA, 20 bp, Artificial
  CRISPR gRNA sequence
gggagggccccacggggaat

SEQ ID NO: 206086 - DNA, 20 bp, Artificial
  CRISPR gRNA sequence
ggagggccccacggggaatc

SEQ ID NO: 206087 - DNA, 20 bp, Artificial
  CRISPR gRNA sequence
tcttcctcccttcctttccc

SEQ ID NO: 206088 - DNA, 20 bp, Artificial
  CRISPR gRNA sequence
cctggtcgtcttcttccccc

SEQ ID NO: 206089 - DNA, 20 bp, Artificial
  CRISPR gRNA sequence
ctggtcgtcttcttccccct

SEQ ID NO: 206090 - DNA, 20 bp, Artificial
  CRISPR gRNA sequence
tcgtcttcttccccctgggt

SEQ ID NO: 206091 - DNA, 20 bp, Artificial
  CRISPR gRNA sequence
gtcttcttccccctgggtga

SEQ ID NO: 206092 - DNA, 20 bp, Artificial
  CRISPR gRNA sequence
ttcttccccctgggtgagag

SEQ ID NO: 206093 - DNA, 20 bp, Artificial
  CRISPR gRNA sequence
tcttccccctgggtgagagc

SEQ ID NO: 206094 - DNA, 20 bp, Artificial
  CRISPR gRNA sequence
cttccccctgggtgagagcg

SEQ ID NO: 206095 - DNA, 20 bp, Artificial
  CRISPR gRNA sequence
cggggctcatctcctccacc

SEQ ID NO: 206096 - DNA, 20 bp, Artificial
  CRISPR gRNA sequence
catctccaaatgcacacaca

SEQ ID NO: 206097 - DNA, 20 bp, Artificial
  CRISPR gRNA sequence
atctccaaatgcacacacac

SEQ ID NO: 206098 - DNA, 20 bp, Artificial
  CRISPR gRNA sequence
tccaaatgcacacacacagg

SEQ ID NO: 206099 - DNA, 20 bp, Artificial
  CRISPR gRNA sequence
cacctcgcgcaaaaattaac

SEQ ID NO: 206100 - DNA, 20 bp, Artificial
  CRISPR gRNA sequence
tcgcgcaaaaattaactagc

SEQ ID NO: 206101 - DNA, 20 bp, Artificial
  CRISPR gRNA sequence
gcaaaaattaactagcaaga

SEQ ID NO: 206102 - DNA, 20 bp, Artificial
  CRISPR gRNA sequence
caaaaattaactagcaagaa

SEQ ID NO: 206103 - DNA, 20 bp, Artificial
  CRISPR gRNA sequence
aaaaattaactagcaagaaa

SEQ ID NO: 206104 - DNA, 20 bp, Artificial
  CRISPR gRNA sequence
ctagcaagaaagggcgcgat

SEQ ID NO: 206105 - DNA, 20 bp, Artificial
  CRISPR gRNA sequence
agcaagaaagggcgcgatca

SEQ ID NO: 206106 - DNA, 20 bp, Artificial
  CRISPR gRNA sequence
gcaagaaagggcgcgatcag

SEQ ID NO: 206107 - DNA, 20 bp, Artificial
  CRISPR gRNA sequence
gaaagggcgcgatcagaggc

SEQ ID NO: 206108 - DNA, 20 bp, Artificial
  CRISPR gRNA sequence
aaagggcgcgatcagaggca

SEQ ID NO: 206109 - DNA, 20 bp, Artificial
  CRISPR gRNA sequence
aagggcgcgatcagaggcaa

SEQ ID NO: 206110 - DNA, 20 bp, Artificial
  CRISPR gRNA sequence
agggcgcgatcagaggcaag

SEQ ID NO: 206111 - DNA, 20 bp, Artificial
  CRISPR gRNA sequence
cgatcagaggcaaggggctg

SEQ ID NO: 206112 - DNA, 20 bp, Artificial
  CRISPR gRNA sequence
aggcaaggggctgcagctgc

SEQ ID NO: 206113 - DNA, 20 bp, Artificial
  CRISPR gRNA sequence
ggcaaggggctgcagctgct

SEQ ID NO: 206114 - DNA, 20 bp, Artificial
  CRISPR gRNA sequence
gcaaggggctgcagctgcta

SEQ ID NO: 206115 - DNA, 20 bp, Artificial
  CRISPR gRNA sequence
ttcgcacccctctcccttct

SEQ ID NO: 206116 - DNA, 20 bp, Artificial
  CRISPR gRNA sequence
ccctctcccttctcagtgct

SEQ ID NO: 206117 - DNA, 20 bp, Artificial
  CRISPR gRNA sequence
tctcagtgcttagacgcatt

SEQ ID NO: 206118 - DNA, 20 bp, Artificial
  CRISPR gRNA sequence
ctcagtgcttagacgcattt

SEQ ID NO: 206119 - DNA, 20 bp, Artificial
  CRISPR gRNA sequence
tcagtgcttagacgcatttg

SEQ ID NO: 206120 - DNA, 20 bp, Artificial
  CRISPR gRNA sequence
gcttagacgcatttggggtt

SEQ ID NO: 206121 - DNA, 20 bp, Artificial
  CRISPR gRNA sequence
cttagacgcatttggggttg

SEQ ID NO: 206122 - DNA, 20 bp, Artificial
  CRISPR gRNA sequence
ttagacgcatttggggttga

SEQ ID NO: 206123 - DNA, 20 bp, Artificial
  CRISPR gRNA sequence
agacgcatttggggttgagg

SEQ ID NO: 206124 - DNA, 20 bp, Artificial
  CRISPR gRNA sequence
gacgcatttggggttgaggg

SEQ ID NO: 206125 - DNA, 20 bp, Artificial
  CRISPR gRNA sequence
acgcatttggggttgaggga

SEQ ID NO: 206126 - DNA, 20 bp, Artificial
  CRISPR gRNA sequence
gcatttggggttgagggagg

SEQ ID NO: 206127 - DNA, 20 bp, Artificial
  CRISPR gRNA sequence
atttggggttgagggaggga

SEQ ID NO: 206128 - DNA, 20 bp, Artificial
  CRISPR gRNA sequence
tggggttgagggagggagag

SEQ ID NO: 206129 - DNA, 20 bp, Artificial
  CRISPR gRNA sequence
ggggttgagggagggagagt

SEQ ID NO: 206130 - DNA, 20 bp, Artificial
  CRISPR gRNA sequence
ggttgagggagggagagtgg

SEQ ID NO: 206131 - DNA, 20 bp, Artificial
  CRISPR gRNA sequence
gttgagggagggagagtggg

SEQ ID NO: 206132 - DNA, 20 bp, Artificial
  CRISPR gRNA sequence
ttgagggagggagagtggga

SEQ ID NO: 206133 - DNA, 20 bp, Artificial
  CRISPR gRNA sequence
ggagggagagtgggagggcc

SEQ ID NO: 206134 - DNA, 20 bp, Artificial
  CRISPR gRNA sequence
gagggagagtgggagggccc

SEQ ID NO: 206135 - DNA, 20 bp, Artificial
  CRISPR gRNA sequence
agggcccgggcctcttgcga

SEQ ID NO: 206136 - DNA, 20 bp, Artificial
  CRISPR gRNA sequence
gcccgggcctcttgcgatgg

SEQ ID NO: 206137 - DNA, 20 bp, Artificial
  CRISPR gRNA sequence
tgcgatggaagtgcgcattt

SEQ ID NO: 206138 - DNA, 20 bp, Artificial
  CRISPR gRNA sequence
tggaagtgcgcattttggcg

SEQ ID NO: 206139 - DNA, 20 bp, Artificial
  CRISPR gRNA sequence
agtgcgcattttggcgaagt

SEQ ID NO: 206140 - DNA, 20 bp, Artificial
  CRISPR gRNA sequence
cgcattttggcgaagtcggt

SEQ ID NO: 206141 - DNA, 20 bp, Artificial
  CRISPR gRNA sequence
attttggcgaagtcggtgag

SEQ ID NO: 206142 - DNA, 20 bp, Artificial
  CRISPR gRNA sequence
ttttggcgaagtcggtgaga

SEQ ID NO: 206143 - DNA, 20 bp, Artificial
  CRISPR gRNA sequence
tttggcgaagtcggtgagaa

SEQ ID NO: 206144 - DNA, 20 bp, Artificial
  CRISPR gRNA sequence
ttggcgaagtcggtgagaag

SEQ ID NO: 206145 - DNA, 20 bp, Artificial
  CRISPR gRNA sequence
gtttgcctcccacatgaaca

SEQ ID NO: 206146 - DNA, 20 bp, Artificial
  CRISPR gRNA sequence
tttgcctcccacatgaacat

SEQ ID NO: 206147 - DNA, 20 bp, Artificial
  CRISPR gRNA sequence
tgcctcccacatgaacatag

SEQ ID NO: 206148 - DNA, 20 bp, Artificial
  CRISPR gRNA sequence
cccacatgaacataggagcg

SEQ ID NO: 206149 - DNA, 20 bp, Artificial
  CRISPR gRNA sequence
cacatgaacataggagcgaa

SEQ ID NO: 206150 - DNA, 20 bp, Artificial
  CRISPR gRNA sequence
acatgaacataggagcgaag

SEQ ID NO: 206151 - DNA, 20 bp, Artificial
  CRISPR gRNA sequence
ataggagcgaagaggacgta

SEQ ID NO: 206152 - DNA, 20 bp, Artificial
  CRISPR gRNA sequence
taggagcgaagaggacgtaa

SEQ ID NO: 206153 - DNA, 20 bp, Artificial
  CRISPR gRNA sequence
aggacgtaaaggacacaatt

SEQ ID NO: 206154 - DNA, 20 bp, Artificial
  CRISPR gRNA sequence
attaagtttcattttcaact

SEQ ID NO: 206155 - DNA, 20 bp, Artificial
  CRISPR gRNA sequence
ttttcaactcagcattcaat

SEQ ID NO: 206156 - DNA, 20 bp, Artificial
  CRISPR gRNA sequence
tcaactcagcattcaatcag

SEQ ID NO: 206157 - DNA, 20 bp, Artificial
  CRISPR gRNA sequence
attcaatcagaagaatcttc

SEQ ID NO: 206158 - DNA, 20 bp, Artificial
  CRISPR gRNA sequence
tcgtttttaatcctaaaaat

SEQ ID NO: 206159 - DNA, 20 bp, Artificial
  CRISPR gRNA sequence
aatcctaaaaataagcttgc

SEQ ID NO: 206160 - DNA, 20 bp, Artificial
  CRISPR gRNA sequence
tcgtgaccctcacgccccat

SEQ ID NO: 206161 - DNA, 20 bp, Artificial
  CRISPR gRNA sequence
acattctaaattgtacgttg

SEQ ID NO: 206162 - DNA, 20 bp, Artificial
  CRISPR gRNA sequence
gaagtttttcccactttatt

SEQ ID NO: 206163 - DNA, 20 bp, Artificial
  CRISPR gRNA sequence
aagtttttcccactttattt

SEQ ID NO: 206164 - DNA, 20 bp, Artificial
  CRISPR gRNA sequence
agtttttcccactttatttg

SEQ ID NO: 206165 - DNA, 20 bp, Artificial
  CRISPR gRNA sequence
gtttttcccactttatttgg

SEQ ID NO: 206166 - DNA, 20 bp, Artificial
  CRISPR gRNA sequence
atttgggggaaccgttttaa

SEQ ID NO: 206167 - DNA, 20 bp, Artificial
  CRISPR gRNA sequence
gaaccgttttaaaagtaatc

SEQ ID NO: 206168 - DNA, 20 bp, Artificial
  CRISPR gRNA sequence
aatctggttttcgcctgaaa

SEQ ID NO: 206169 - DNA, 20 bp, Artificial
  CRISPR gRNA sequence
atctggttttcgcctgaaat

SEQ ID NO: 206170 - DNA, 20 bp, Artificial
  CRISPR gRNA sequence
tggttttcgcctgaaatagg

SEQ ID NO: 206171 - DNA, 20 bp, Artificial
  CRISPR gRNA sequence
tttcgcctgaaataggaaga

SEQ ID NO: 206172 - DNA, 20 bp, Artificial
  CRISPR gRNA sequence
aataggaagacagtaacctc

SEQ ID NO: 206173 - DNA, 20 bp, Artificial
  CRISPR gRNA sequence
acctccagtcaaaacatgtg

SEQ ID NO: 206174 - DNA, 20 bp, Artificial
  CRISPR gRNA sequence
tccagtcaaaacatgtgcag

SEQ ID NO: 206175 - DNA, 20 bp, Artificial
  CRISPR gRNA sequence
tcaaaacatgtgcagcagaa

SEQ ID NO: 206176 - DNA, 20 bp, Artificial
  CRISPR gRNA sequence
caaaacatgtgcagcagaat

SEQ ID NO: 206177 - DNA, 20 bp, Artificial
  CRISPR gRNA sequence
atgtgcagcagaatgggatt

SEQ ID NO: 206178 - DNA, 20 bp, Artificial
  CRISPR gRNA sequence
tttggtgtttttcgacgcca

SEQ ID NO: 206179 - DNA, 20 bp, Artificial
  CRISPR gRNA sequence
cacccccccacccccacccc

SEQ ID NO: 206180 - DNA, 20 bp, Artificial
  CRISPR gRNA sequence
ccacccccaccccgagcttt

SEQ ID NO: 206181 - DNA, 20 bp, Artificial
  CRISPR gRNA sequence
gtgcttcgtctgtaaaaact

SEQ ID NO: 206182 - DNA, 20 bp, Artificial
  CRISPR gRNA sequence
ttcgtctgtaaaaactgagc

SEQ ID NO: 206183 - DNA, 20 bp, Artificial
  CRISPR gRNA sequence
tcgtctgtaaaaactgagca

SEQ ID NO: 206184 - DNA, 20 bp, Artificial
  CRISPR gRNA sequence
tgtaaaaactgagcaaggaa

SEQ ID NO: 206185 - DNA, 20 bp, Artificial
  CRISPR gRNA sequence
gcaaggaatagaaacattcg

SEQ ID NO: 206186 - DNA, 20 bp, Artificial
  CRISPR gRNA sequence
tagaaacattcgtagctcta

SEQ ID NO: 206187 - DNA, 20 bp, Artificial
  CRISPR gRNA sequence
aacattcgtagctctacagt

SEQ ID NO: 206188 - DNA, 20 bp, Artificial
  CRISPR gRNA sequence
cctgtcacacttcacatcca

SEQ ID NO: 206189 - DNA, 20 bp, Artificial
  CRISPR gRNA sequence
tgtcacacttcacatccata

SEQ ID NO: 206190 - DNA, 20 bp, Artificial
  CRISPR gRNA sequence
agccttttgtgaacttttat

SEQ ID NO: 206191 - DNA, 20 bp, Artificial
  CRISPR gRNA sequence
ttgtgaacttttataagatt

SEQ ID NO: 206192 - DNA, 20 bp, Artificial
  CRISPR gRNA sequence
cttttataagattcagaatt

SEQ ID NO: 206193 - DNA, 20 bp, Artificial
  CRISPR gRNA sequence
taagattcagaattcagctt

SEQ ID NO: 206194 - DNA, 20 bp, Artificial
  CRISPR gRNA sequence
tcagaattcagcttgagcac

SEQ ID NO: 206195 - DNA, 20 bp, Artificial
  CRISPR gRNA sequence
ttcagcttgagcaccagtga

SEQ ID NO: 206196 - DNA, 20 bp, Artificial
  CRISPR gRNA sequence
agcaattgttacatttattc

SEQ ID NO: 206197 - DNA, 20 bp, Artificial
  CRISPR gRNA sequence
ttcgattttaaactgattat

SEQ ID NO: 206198 - DNA, 20 bp, Artificial
  CRISPR gRNA sequence
tttaaactgattattagcct

SEQ ID NO: 206199 - DNA, 20 bp, Artificial
  CRISPR gRNA sequence
gcctcggtgtgccgttccta

SEQ ID NO: 206200 - DNA, 20 bp, Artificial
  CRISPR gRNA sequence
cctcggtgtgccgttcctaa

SEQ ID NO: 206201 - DNA, 20 bp, Artificial
  CRISPR gRNA sequence
ttcctaaaggcttgtgactt

SEQ ID NO: 206202 - DNA, 20 bp, Artificial
  CRISPR gRNA sequence
tcctaaaggcttgtgacttt

SEQ ID NO: 206203 - DNA, 20 bp, Artificial
  CRISPR gRNA sequence
ttgtgactttaggtatttcc

SEQ ID NO: 206204 - DNA, 20 bp, Artificial
  CRISPR gRNA sequence
ggtatttccaagatgccctt

SEQ ID NO: 206205 - DNA, 20 bp, Artificial
  CRISPR gRNA sequence
taccactttcctccctcccc

SEQ ID NO: 206206 - DNA, 20 bp, Artificial
  CRISPR gRNA sequence
tcctccctccccgagcatcc

SEQ ID NO: 206207 - DNA, 20 bp, Artificial
  CRISPR gRNA sequence
tccccgagcatcctggatgt

SEQ ID NO: 206208 - DNA, 20 bp, Artificial
  CRISPR gRNA sequence
ccccgagcatcctggatgtt

SEQ ID NO: 206209 - DNA, 20 bp, Artificial
  CRISPR gRNA sequence
ggatgttgggactgtgaatc

SEQ ID NO: 206210 - DNA, 20 bp, Artificial
  CRISPR gRNA sequence
gatgttgggactgtgaatcc

SEQ ID NO: 206211 - DNA, 20 bp, Artificial
  CRISPR gRNA sequence
ccaggtctccgttatctaaa

SEQ ID NO: 206212 - DNA, 20 bp, Artificial
  CRISPR gRNA sequence
gttatctaaatggttgatgt

SEQ ID NO: 206213 - DNA, 20 bp, Artificial
  CRISPR gRNA sequence
gtgtttcctgtcatcacgtt

SEQ ID NO: 206214 - DNA, 20 bp, Artificial
  CRISPR gRNA sequence
tgttgcctttactatcatta

SEQ ID NO: 206215 - DNA, 20 bp, Artificial
  CRISPR gRNA sequence
agctaaaataatactgcttt

SEQ ID NO: 206216 - DNA, 20 bp, Artificial
  CRISPR gRNA sequence
ctaaaataatactgctttca

SEQ ID NO: 206217 - DNA, 20 bp, Artificial
  CRISPR gRNA sequence
gtataatcgcataataattt

SEQ ID NO: 206218 - DNA, 20 bp, Artificial
  CRISPR gRNA sequence
agaacgccttcatattgaac

SEQ ID NO: 206219 - DNA, 20 bp, Artificial
  CRISPR gRNA sequence
ttcatattgaaccagatatg

SEQ ID NO: 206220 - DNA, 20 bp, Artificial
  CRISPR gRNA sequence
gaaccagatatgaagtgata

SEQ ID NO: 206221 - DNA, 20 bp, Artificial
  CRISPR gRNA sequence
atttattcaaactgcctaaa

SEQ ID NO: 206222 - DNA, 20 bp, Artificial
  CRISPR gRNA sequence
caaactgcctaaaaagtaaa

SEQ ID NO: 206223 - DNA, 20 bp, Artificial
  CRISPR gRNA sequence
accatatactatttttaaaa

SEQ ID NO: 206224 - DNA, 20 bp, Artificial
  CRISPR gRNA sequence
ccatatactatttttaaaac

SEQ ID NO: 206225 - DNA, 20 bp, Artificial
  CRISPR gRNA sequence
tatactatttttaaaacagg

SEQ ID NO: 206226 - DNA, 20 bp, Artificial
  CRISPR gRNA sequence
atactatttttaaaacaggt

SEQ ID NO: 206227 - DNA, 20 bp, Artificial
  CRISPR gRNA sequence
tatttttaaaacaggtaggt

SEQ ID NO: 206228 - DNA, 20 bp, Artificial
  CRISPR gRNA sequence
taggttagatttaaatcacg

SEQ ID NO: 206229 - DNA, 20 bp, Artificial
  CRISPR gRNA sequence
tagatttaaatcacgtagtt

SEQ ID NO: 206230 - DNA, 20 bp, Artificial
  CRISPR gRNA sequence
atcacgtagtttagaactgt

SEQ ID NO: 206231 - DNA, 20 bp, Artificial
  CRISPR gRNA sequence
gtagtttagaactgttggaa

SEQ ID NO: 206232 - DNA, 20 bp, Artificial
  CRISPR gRNA sequence
aactgttggaatggtacttt

SEQ ID NO: 206233 - DNA, 20 bp, Artificial
  CRISPR gRNA sequence
tggaatggtactttgagtga

SEQ ID NO: 206234 - DNA, 20 bp, Artificial
  CRISPR gRNA sequence
ggaatggtactttgagtgat

SEQ ID NO: 206235 - DNA, 20 bp, Artificial
  CRISPR gRNA sequence
ttgagtgataggatttatgt

SEQ ID NO: 206236 - DNA, 20 bp, Artificial
  CRISPR gRNA sequence
tgagtgataggatttatgtt

SEQ ID NO: 206237 - DNA, 20 bp, Artificial
  CRISPR gRNA sequence
gatttatgttaggccttctt

SEQ ID NO: 206238 - DNA, 20 bp, Artificial
  CRISPR gRNA sequence
tgttaggccttctttagtaa

SEQ ID NO: 206239 - DNA, 20 bp, Artificial
  CRISPR gRNA sequence
aatagttaatatcatgtaat

SEQ ID NO: 206240 - DNA, 20 bp, Artificial
  CRISPR gRNA sequence
ttttaatgtgttcgaatccc

SEQ ID NO: 206241 - DNA, 20 bp, Artificial
  CRISPR gRNA sequence
ttaatgtgttcgaatcccta

SEQ ID NO: 206242 - DNA, 20 bp, Artificial
  CRISPR gRNA sequence
atccctagagtcatcgaatt

SEQ ID NO: 206243 - DNA, 20 bp, Artificial
  CRISPR gRNA sequence
gtcatcgaattcagaattta

SEQ ID NO: 206244 - DNA, 20 bp, Artificial
  CRISPR gRNA sequence
ttatagtattttattttact

SEQ ID NO: 206245 - DNA, 20 bp, Artificial
  CRISPR gRNA sequence
ttaatattaacctaaaaaaa

SEQ ID NO: 206246 - DNA, 20 bp, Artificial
  CRISPR gRNA sequence
cctaaaaaaaaagcaaaata

SEQ ID NO: 206247 - DNA, 20 bp, Artificial
  CRISPR gRNA sequence
ctaaaaaaaaagcaaaatac

SEQ ID NO: 206248 - DNA, 20 bp, Artificial
  CRISPR gRNA sequence
agcaaaatacaggcattatg

SEQ ID NO: 206249 - DNA, 20 bp, Artificial
  CRISPR gRNA sequence
aatacaggcattatgcagtt

SEQ ID NO: 206250 - DNA, 20 bp, Artificial
  CRISPR gRNA sequence
ttatgcagttgagttgtgtt

SEQ ID NO: 206251 - DNA, 20 bp, Artificial
  CRISPR gRNA sequence
cagttgagttgtgttaagtg

SEQ ID NO: 206252 - DNA, 20 bp, Artificial
  CRISPR gRNA sequence
gttaagtgtggactgtaaaa

SEQ ID NO: 206253 - DNA, 20 bp, Artificial
  CRISPR gRNA sequence
ttaagtgtggactgtaaaac

SEQ ID NO: 206254 - DNA, 20 bp, Artificial
  CRISPR gRNA sequence
gtgtggactgtaaaacagga

SEQ ID NO: 206255 - DNA, 20 bp, Artificial
  CRISPR gRNA sequence
ttttgtatgtgtttaatata

SEQ ID NO: 206256 - DNA, 20 bp, Artificial
  CRISPR gRNA sequence
tgtttaatatatagcttcaa

SEQ ID NO: 206257 - DNA, 20 bp, Artificial
  CRISPR gRNA sequence
gtttaatatatagcttcaaa

SEQ ID NO: 206258 - DNA, 20 bp, Artificial
  CRISPR gRNA sequence
gcttcaaaaggacatgtatg

SEQ ID NO: 206259 - DNA, 20 bp, Artificial
  CRISPR gRNA sequence
caaaaggacatgtatgaaga

SEQ ID NO: 206260 - DNA, 20 bp, Artificial
  CRISPR gRNA sequence
atgtatgaagaaagatgtct

SEQ ID NO: 206261 - DNA, 20 bp, Artificial
  CRISPR gRNA sequence
aagaaagatgtctcagcaca

SEQ ID NO: 206262 - DNA, 20 bp, Artificial
  CRISPR gRNA sequence
agaaagatgtctcagcacat

SEQ ID NO: 206263 - DNA, 20 bp, Artificial
  CRISPR gRNA sequence
aagatgtctcagcacatagg

SEQ ID NO: 206264 - DNA, 20 bp, Artificial
  CRISPR gRNA sequence
cacataggtagttataaacc

SEQ ID NO: 206265 - DNA, 20 bp, Artificial
  CRISPR gRNA sequence
acataggtagttataaacca

SEQ ID NO: 206266 - DNA, 20 bp, Artificial
  CRISPR gRNA sequence
cataggtagttataaaccaa

SEQ ID NO: 206267 - DNA, 20 bp, Artificial
  CRISPR gRNA sequence
tagttataaaccaagggttt

SEQ ID NO: 206268 - DNA, 20 bp, Artificial
  CRISPR gRNA sequence
gttataaaccaagggtttga

SEQ ID NO: 206269 - DNA, 20 bp, Artificial
  CRISPR gRNA sequence
agggtttgagagactgactt

SEQ ID NO: 206270 - DNA, 20 bp, Artificial
  CRISPR gRNA sequence
gagagactgactttagaatc

SEQ ID NO: 206271 - DNA, 20 bp, Artificial
  CRISPR gRNA sequence
ctgactttagaatctagaat

SEQ ID NO: 206272 - DNA, 20 bp, Artificial
  CRISPR gRNA sequence
ctttagaatctagaatgagt

SEQ ID NO: 206273 - DNA, 20 bp, Artificial
  CRISPR gRNA sequence
agaatctagaatgagtaaga

SEQ ID NO: 206274 - DNA, 20 bp, Artificial
  CRISPR gRNA sequence
tagaatgagtaagaaagtga

SEQ ID NO: 206275 - DNA, 20 bp, Artificial
  CRISPR gRNA sequence
ctgtacattcatttgtattg

SEQ ID NO: 206276 - DNA, 20 bp, Artificial
  CRISPR gRNA sequence
ttgaagtttgattttgcttt

SEQ ID NO: 206277 - DNA, 20 bp, Artificial
  CRISPR gRNA sequence
tgctttcagtttcgttaatt

SEQ ID NO: 206278 - DNA, 20 bp, Artificial
  CRISPR gRNA sequence
cagtttcgttaattaagccc

SEQ ID NO: 206279 - DNA, 20 bp, Artificial
  CRISPR gRNA sequence
agtttcgttaattaagcccc

SEQ ID NO: 206280 - DNA, 20 bp, Artificial
  CRISPR gRNA sequence
gttaattaagccccgggaat

SEQ ID NO: 206281 - DNA, 20 bp, Artificial
  CRISPR gRNA sequence
ttaattaagccccgggaatc

SEQ ID NO: 206282 - DNA, 20 bp, Artificial
  CRISPR gRNA sequence
taattaagccccgggaatca

SEQ ID NO: 206283 - DNA, 20 bp, Artificial
  CRISPR gRNA sequence
cgggaatcagggacctttcc

SEQ ID NO: 206284 - DNA, 20 bp, Artificial
  CRISPR gRNA sequence
acctttcctggcaccctcta

SEQ ID NO: 206285 - DNA, 20 bp, Artificial
  CRISPR gRNA sequence
cctggcaccctctacagtgt

SEQ ID NO: 206286 - DNA, 20 bp, Artificial
  CRISPR gRNA sequence
ggcaccctctacagtgttag

SEQ ID NO: 206287 - DNA, 20 bp, Artificial
  CRISPR gRNA sequence
tacagtgttagtggcctttg

SEQ ID NO: 206288 - DNA, 20 bp, Artificial
  CRISPR gRNA sequence
gttagtggcctttgtggtaa

SEQ ID NO: 206289 - DNA, 20 bp, Artificial
  CRISPR gRNA sequence
agtggcctttgtggtaaaag

SEQ ID NO: 206290 - DNA, 20 bp, Artificial
  CRISPR gRNA sequence
tgtggtaaaagaagttatct

SEQ ID NO: 206291 - DNA, 20 bp, Artificial
  CRISPR gRNA sequence
atactcatttcatgcaatta

SEQ ID NO: 206292 - DNA, 20 bp, Artificial
  CRISPR gRNA sequence
tactcatttcatgcaattac

SEQ ID NO: 206293 - DNA, 20 bp, Artificial
  CRISPR gRNA sequence
tcatgcaattacaggcaaac

SEQ ID NO: 206294 - DNA, 20 bp, Artificial
  CRISPR gRNA sequence
tgcaattacaggcaaactgg

SEQ ID NO: 206295 - DNA, 20 bp, Artificial
  CRISPR gRNA sequence
gcaattacaggcaaactgga

SEQ ID NO: 206296 - DNA, 20 bp, Artificial
  CRISPR gRNA sequence
caaactggaaggcaccttaa

SEQ ID NO: 206297 - DNA, 20 bp, Artificial
  CRISPR gRNA sequence
aaggcaccttaatggtatgc

SEQ ID NO: 206298 - DNA, 20 bp, Artificial
  CRISPR gRNA sequence
tacaattatactttgtttaa

SEQ ID NO: 206299 - DNA, 20 bp, Artificial
  CRISPR gRNA sequence
atactttgtttaaaagtgca

SEQ ID NO: 206300 - DNA, 20 bp, Artificial
  CRISPR gRNA sequence
tgtttaaaagtgcatagttt

SEQ ID NO: 206301 - DNA, 20 bp, Artificial
  CRISPR gRNA sequence
ttaaaagtgcatagtttcag

SEQ ID NO: 206302 - DNA, 20 bp, Artificial
  CRISPR gRNA sequence
atagtttcagtggtatttat

SEQ ID NO: 206303 - DNA, 20 bp, Artificial
  CRISPR gRNA sequence
tttcagtggtatttattagc

SEQ ID NO: 206304 - DNA, 20 bp, Artificial
  CRISPR gRNA sequence
aaactttaaataaataatga

SEQ ID NO: 206305 - DNA, 20 bp, Artificial
  CRISPR gRNA sequence
ggtgttgtgaactgtctttt

SEQ ID NO: 206306 - DNA, 20 bp, Artificial
  CRISPR gRNA sequence
gttgtgaactgtcttttcag

SEQ ID NO: 206307 - DNA, 20 bp, Artificial
  CRISPR gRNA sequence
gattcctctttgttcaaaat

SEQ ID NO: 206308 - DNA, 20 bp, Artificial
  CRISPR gRNA sequence
agttgtttttttttttaaat

SEQ ID NO: 206309 - DNA, 20 bp, Artificial
  CRISPR gRNA sequence
gttgtttttttttttaaatc

SEQ ID NO: 206310 - DNA, 20 bp, Artificial
  CRISPR gRNA sequence
ttgtttttttttttaaatca

SEQ ID NO: 206311 - DNA, 20 bp, Artificial
  CRISPR gRNA sequence
aaaatttttttccatcgtct

SEQ ID NO: 206312 - DNA, 20 bp, Artificial
  CRISPR gRNA sequence
ttttttccatcgtctaagtc

SEQ ID NO: 206313 - DNA, 20 bp, Artificial
  CRISPR gRNA sequence
tttccatcgtctaagtctag

SEQ ID NO: 206314 - DNA, 20 bp, Artificial
  CRISPR gRNA sequence
gtctaagtctagtagtaatt

SEQ ID NO: 206315 - DNA, 20 bp, Artificial
  CRISPR gRNA sequence
aataaaaatgttttctctta

SEQ ID NO: 206316 - DNA, 20 bp, Artificial
  CRISPR gRNA sequence
aatatattatttttaattac

SEQ ID NO: 206317 - DNA, 20 bp, Artificial
  CRISPR gRNA sequence
taattacaagttgccatttt

SEQ ID NO: 206318 - DNA, 20 bp, Artificial
  CRISPR gRNA sequence
aattacaagttgccatttta

SEQ ID NO: 206319 - DNA, 20 bp, Artificial
  CRISPR gRNA sequence
tacaagttgccattttaagg

SEQ ID NO: 206320 - DNA, 20 bp, Artificial
  CRISPR gRNA sequence
ggaagtaaatgcctatttaa

SEQ ID NO: 206321 - DNA, 20 bp, Artificial
  CRISPR gRNA sequence
tatttaaaagtacgtattta

SEQ ID NO: 206322 - DNA, 20 bp, Artificial
  CRISPR gRNA sequence
atttaaaagtacgtatttat

SEQ ID NO: 206323 - DNA, 20 bp, Artificial
  CRISPR gRNA sequence
tttaaaagtacgtatttatg

SEQ ID NO: 206324 - DNA, 20 bp, Artificial
  CRISPR gRNA sequence
acgtatttatggggccgccc

SEQ ID NO: 206325 - DNA, 20 bp, Artificial
  CRISPR gRNA sequence
tatttatggggccgccccag

SEQ ID NO: 206326 - DNA, 20 bp, Artificial
  CRISPR gRNA sequence
atggggccgccccagcagtc

SEQ ID NO: 206327 - DNA, 20 bp, Artificial
  CRISPR gRNA sequence
ggggccgccccagcagtcta

SEQ ID NO: 206328 - DNA, 20 bp, Artificial
  CRISPR gRNA sequence
gggccgccccagcagtctag

SEQ ID NO: 206329 - DNA, 20 bp, Artificial
  CRISPR gRNA sequence
ccgccccagcagtctagagg

SEQ ID NO: 206330 - DNA, 20 bp, Artificial
  CRISPR gRNA sequence
tctagaggcagtgtttttta

SEQ ID NO: 206331 - DNA, 20 bp, Artificial
  CRISPR gRNA sequence
ttacactaaatgcctaccat

SEQ ID NO: 206332 - DNA, 20 bp, Artificial
  CRISPR gRNA sequence
tacactaaatgcctaccatt

SEQ ID NO: 206333 - DNA, 20 bp, Artificial
  CRISPR gRNA sequence
tcatgctgtcatctgtgttt

SEQ ID NO: 206334 - DNA, 20 bp, Artificial
  CRISPR gRNA sequence
tgctgtcatctgtgttttgg

SEQ ID NO: 206335 - DNA, 20 bp, Artificial
  CRISPR gRNA sequence
gatgttttatctttgtcact

SEQ ID NO: 206336 - DNA, 20 bp, Artificial
  CRISPR gRNA sequence
ctttgtcactgagttgttca

SEQ ID NO: 206337 - DNA, 20 bp, Artificial
  CRISPR gRNA sequence
ttgtcactgagttgttcatg

SEQ ID NO: 206338 - DNA, 20 bp, Artificial
  CRISPR gRNA sequence
agttgttcatggagatttga

SEQ ID NO: 206339 - DNA, 20 bp, Artificial
  CRISPR gRNA sequence
gttgttcatggagatttgaa

SEQ ID NO: 206340 - DNA, 20 bp, Artificial
  CRISPR gRNA sequence
tcatggagatttgaaaggcc

SEQ ID NO: 206341 - DNA, 20 bp, Artificial
  CRISPR gRNA sequence
atttgaaaggccaagttcta

SEQ ID NO: 206342 - DNA, 20 bp, Artificial
  CRISPR gRNA sequence
aaaggccaagttctaaagat

SEQ ID NO: 206343 - DNA, 20 bp, Artificial
  CRISPR gRNA sequence
aggccaagttctaaagatga

SEQ ID NO: 206344 - DNA, 20 bp, Artificial
  CRISPR gRNA sequence
caagttctaaagatgagaga

SEQ ID NO: 206345 - DNA, 20 bp, Artificial
  CRISPR gRNA sequence
atcacgcatattcgcaaaac

SEQ ID NO: 206346 - DNA, 20 bp, Artificial
  CRISPR gRNA sequence
aaaactagatttgcatttca

SEQ ID NO: 206347 - DNA, 20 bp, Artificial
  CRISPR gRNA sequence
tgcatttcatagtatgaatt

SEQ ID NO: 206348 - DNA, 20 bp, Artificial
  CRISPR gRNA sequence
tcatagtatgaattcagcta

SEQ ID NO: 206349 - DNA, 20 bp, Artificial
  CRISPR gRNA sequence
agtatgaattcagctatagc

SEQ ID NO: 206350 - DNA, 20 bp, Artificial
  CRISPR gRNA sequence
attcagctatagctagtata

SEQ ID NO: 206351 - DNA, 20 bp, Artificial
  CRISPR gRNA sequence
ttcagctatagctagtatat

SEQ ID NO: 206352 - DNA, 20 bp, Artificial
  CRISPR gRNA sequence
tataggcattgcttttaata

SEQ ID NO: 206353 - DNA, 20 bp, Artificial
  CRISPR gRNA sequence
atatagtaatgttctttttg

SEQ ID NO: 206354 - DNA, 20 bp, Artificial
  CRISPR gRNA sequence
ttcaatcactttccctgtct

SEQ ID NO: 206355 - DNA, 20 bp, Artificial
  CRISPR gRNA sequence
tcaatcactttccctgtctt

SEQ ID NO: 206356 - DNA, 20 bp, Artificial
  CRISPR gRNA sequence
ttctgcctacctttttatac

SEQ ID NO: 206357 - DNA, 20 bp, Artificial
  CRISPR gRNA sequence
tattttcatatcttatctct

SEQ ID NO: 206358 - DNA, 20 bp, Artificial
  CRISPR gRNA sequence
tgattttaataatatcgtct

SEQ ID NO: 206359 - DNA, 20 bp, Artificial
  CRISPR gRNA sequence
gattttaataatatcgtctt

SEQ ID NO: 206360 - DNA, 20 bp, Artificial
  CRISPR gRNA sequence
tatcgtcttgggttatcata

SEQ ID NO: 206361 - DNA, 20 bp, Artificial
  CRISPR gRNA sequence
gttactttcactttgtatac

SEQ ID NO: 206362 - DNA, 20 bp, Artificial
  CRISPR gRNA sequence
tttcactttgtatactagtg

SEQ ID NO: 206363 - DNA, 20 bp, Artificial
  CRISPR gRNA sequence
gatatttcttctgtgataaa

SEQ ID NO: 206364 - DNA, 20 bp, Artificial
  CRISPR gRNA sequence
tcttctgtgataaaaagaac

SEQ ID NO: 206365 - DNA, 20 bp, Artificial
  CRISPR gRNA sequence
gataaaaagaacaagaataa

SEQ ID NO: 206366 - DNA, 20 bp, Artificial
  CRISPR gRNA sequence
aaagaacaagaataatagtg

SEQ ID NO: 206367 - DNA, 20 bp, Artificial
  CRISPR gRNA sequence
aagaacaagaataatagtgt

SEQ ID NO: 206368 - DNA, 20 bp, Artificial
  CRISPR gRNA sequence
caagaataatagtgtaggat

SEQ ID NO: 206369 - DNA, 20 bp, Artificial
  CRISPR gRNA sequence
cagttttgttaaactcattg

SEQ ID NO: 206370 - DNA, 20 bp, Artificial
  CRISPR gRNA sequence
ttaaactcattgtagtacta

SEQ ID NO: 206371 - DNA, 20 bp, Artificial
  CRISPR gRNA sequence
aactcattgtagtactaaag

SEQ ID NO: 206372 - DNA, 20 bp, Artificial
  CRISPR gRNA sequence
tagtactaaagtagaaaata

SEQ ID NO: 206373 - DNA, 20 bp, Artificial
  CRISPR gRNA sequence
gtactaaagtagaaaataca

SEQ ID NO: 206374 - DNA, 20 bp, Artificial
  CRISPR gRNA sequence
agtagaaaatacagagcacc

SEQ ID NO: 206375 - DNA, 20 bp, Artificial
  CRISPR gRNA sequence
gtagaaaatacagagcaccc

SEQ ID NO: 206376 - DNA, 20 bp, Artificial
  CRISPR gRNA sequence
aaatttgattctgatatacc

SEQ ID NO: 206377 - DNA, 20 bp, Artificial
  CRISPR gRNA sequence
gattctgatatacctagact

SEQ ID NO: 206378 - DNA, 20 bp, Artificial
  CRISPR gRNA sequence
atatacctagactaagacaa

SEQ ID NO: 206379 - DNA, 20 bp, Artificial
  CRISPR gRNA sequence
tagactaagacaatagaatc

SEQ ID NO: 206380 - DNA, 20 bp, Artificial
  CRISPR gRNA sequence
agactaagacaatagaatct

SEQ ID NO: 206381 - DNA, 20 bp, Artificial
  CRISPR gRNA sequence
ttttcctctttacgattata

SEQ ID NO: 206382 - DNA, 20 bp, Artificial
  CRISPR gRNA sequence
acgattatacagtgttgaaa

SEQ ID NO: 206383 - DNA, 20 bp, Artificial
  CRISPR gRNA sequence
acagtgttgaaacagaaatc

SEQ ID NO: 206384 - DNA, 20 bp, Artificial
  CRISPR gRNA sequence
aatatttcattccaaatcca

SEQ ID NO: 206385 - DNA, 20 bp, Artificial
  CRISPR gRNA sequence
tatttcattccaaatccatg

SEQ ID NO: 206386 - DNA, 20 bp, Artificial
  CRISPR gRNA sequence
ttcattccaaatccatggag

SEQ ID NO: 206387 - DNA, 20 bp, Artificial
  CRISPR gRNA sequence
aatccatggagcagttgcat

SEQ ID NO: 206388 - DNA, 20 bp, Artificial
  CRISPR gRNA sequence
tggagcagttgcataagact

SEQ ID NO: 206389 - DNA, 20 bp, Artificial
  CRISPR gRNA sequence
gttgcataagactcagaatc

SEQ ID NO: 206390 - DNA, 20 bp, Artificial
  CRISPR gRNA sequence
tcagaatctggtcaatctca

SEQ ID NO: 206391 - DNA, 20 bp, Artificial
  CRISPR gRNA sequence
tctggtcaatctcatggttt

SEQ ID NO: 206392 - DNA, 20 bp, Artificial
  CRISPR gRNA sequence
caatctcatggtttgagatt

SEQ ID NO: 206393 - DNA, 20 bp, Artificial
  CRISPR gRNA sequence
tcatggtttgagattcagat

SEQ ID NO: 206394 - DNA, 20 bp, Artificial
  CRISPR gRNA sequence
catggtttgagattcagatt

SEQ ID NO: 206395 - DNA, 20 bp, Artificial
  CRISPR gRNA sequence
tggtttgagattcagattag

SEQ ID NO: 206396 - DNA, 20 bp, Artificial
  CRISPR gRNA sequence
ttgaatatatatcacacttg

SEQ ID NO: 206397 - DNA, 20 bp, Artificial
  CRISPR gRNA sequence
tgaatatatatcacacttgt

SEQ ID NO: 206398 - DNA, 20 bp, Artificial
  CRISPR gRNA sequence
atatcacacttgtaggttaa

SEQ ID NO: 206399 - DNA, 20 bp, Artificial
  CRISPR gRNA sequence
tatcacacttgtaggttaaa

SEQ ID NO: 206400 - DNA, 20 bp, Artificial
  CRISPR gRNA sequence
cacttgtaggttaaaaggta

SEQ ID NO: 206401 - DNA, 20 bp, Artificial
  CRISPR gRNA sequence
tgtaggttaaaaggtaaagc

SEQ ID NO: 206402 - DNA, 20 bp, Artificial
  CRISPR gRNA sequence
gtaggttaaaaggtaaagca

SEQ ID NO: 206403 - DNA, 20 bp, Artificial
  CRISPR gRNA sequence
taggttaaaaggtaaagcaa

SEQ ID NO: 206404 - DNA, 20 bp, Artificial
  CRISPR gRNA sequence
aggttaaaaggtaaagcaag

SEQ ID NO: 206405 - DNA, 20 bp, Artificial
  CRISPR gRNA sequence
aaaaggtaaagcaaggggtt

SEQ ID NO: 206406 - DNA, 20 bp, Artificial
  CRISPR gRNA sequence
ggtaaagcaaggggtttggc

SEQ ID NO: 206407 - DNA, 20 bp, Artificial
  CRISPR gRNA sequence
gcaaggggtttggctagttc

SEQ ID NO: 206408 - DNA, 20 bp, Artificial
  CRISPR gRNA sequence
caaggggtttggctagttca

SEQ ID NO: 206409 - DNA, 20 bp, Artificial
  CRISPR gRNA sequence
aaaccacttttttccatttc

SEQ ID NO: 206410 - DNA, 20 bp, Artificial
  CRISPR gRNA sequence
cacttttttccatttcaagc

SEQ ID NO: 206411 - DNA, 20 bp, Artificial
  CRISPR gRNA sequence
tttccatttcaagcaagtat

SEQ ID NO: 206412 - DNA, 20 bp, Artificial
  CRISPR gRNA sequence
atgagcctatactacacacc

SEQ ID NO: 206413 - DNA, 20 bp, Artificial
  CRISPR gRNA sequence
agcctatactacacaccaag

SEQ ID NO: 206414 - DNA, 20 bp, Artificial
  CRISPR gRNA sequence
tacacaccaagcagtttgca

SEQ ID NO: 206415 - DNA, 20 bp, Artificial
  CRISPR gRNA sequence
gcagtttgcaaagccctctt

SEQ ID NO: 206416 - DNA, 20 bp, Artificial
  CRISPR gRNA sequence
gcaaagccctctttggcata

SEQ ID NO: 206417 - DNA, 20 bp, Artificial
  CRISPR gRNA sequence
tttggcatatagacaaattt

SEQ ID NO: 206418 - DNA, 20 bp, Artificial
  CRISPR gRNA sequence
gcatatagacaaatttcaga

SEQ ID NO: 206419 - DNA, 20 bp, Artificial
  CRISPR gRNA sequence
acaaatttcagacagtatgt

SEQ ID NO: 206420 - DNA, 20 bp, Artificial
  CRISPR gRNA sequence
agtatgtctcttaatgactt

SEQ ID NO: 206421 - DNA, 20 bp, Artificial
  CRISPR gRNA sequence
tctcttaatgacttaagatg

SEQ ID NO: 206422 - DNA, 20 bp, Artificial
  CRISPR gRNA sequence
atgacttaagatgtagtata

SEQ ID NO: 206423 - DNA, 20 bp, Artificial
  CRISPR gRNA sequence
cttaagatgtagtatataga

SEQ ID NO: 206424 - DNA, 20 bp, Artificial
  CRISPR gRNA sequence
aagatgtagtatatagacag

SEQ ID NO: 206425 - DNA, 20 bp, Artificial
  CRISPR gRNA sequence
agatgtagtatatagacagt

SEQ ID NO: 206426 - DNA, 20 bp, Artificial
  CRISPR gRNA sequence
gatgtagtatatagacagta

SEQ ID NO: 206427 - DNA, 20 bp, Artificial
  CRISPR gRNA sequence
atcttgtttttattccctca

SEQ ID NO: 206428 - DNA, 20 bp, Artificial
  CRISPR gRNA sequence
ttttattccctcatggtact

SEQ ID NO: 206429 - DNA, 20 bp, Artificial
  CRISPR gRNA sequence
tttattccctcatggtactt

SEQ ID NO: 206430 - DNA, 20 bp, Artificial
  CRISPR gRNA sequence
atggtacttaggtgcttgtt

SEQ ID NO: 206431 - DNA, 20 bp, Artificial
  CRISPR gRNA sequence
tggtacttaggtgcttgtta

SEQ ID NO: 206432 - DNA, 20 bp, Artificial
  CRISPR gRNA sequence
gcttgttaaggccataattc

SEQ ID NO: 206433 - DNA, 20 bp, Artificial
  CRISPR gRNA sequence
gccctgccctttttaattct

SEQ ID NO: 206434 - DNA, 20 bp, Artificial
  CRISPR gRNA sequence
tgccctttttaattctaagt

SEQ ID NO: 206435 - DNA, 20 bp, Artificial
  CRISPR gRNA sequence
ttggcctcttccattcttat

SEQ ID NO: 206436 - DNA, 20 bp, Artificial
  CRISPR gRNA sequence
tggcctcttccattcttata

SEQ ID NO: 206437 - DNA, 20 bp, Artificial
  CRISPR gRNA sequence
aaggccacttttaaattcat

SEQ ID NO: 206438 - DNA, 20 bp, Artificial
  CRISPR gRNA sequence
aggccacttttaaattcatt

SEQ ID NO: 206439 - DNA, 20 bp, Artificial
  CRISPR gRNA sequence
ggccacttttaaattcatta

SEQ ID NO: 206440 - DNA, 20 bp, Artificial
  CRISPR gRNA sequence
gccacttttaaattcattag

SEQ ID NO: 206441 - DNA, 20 bp, Artificial
  CRISPR gRNA sequence
ccacttttaaattcattagg

SEQ ID NO: 206442 - DNA, 20 bp, Artificial
  CRISPR gRNA sequence
attcattagggggattgcgt

SEQ ID NO: 206443 - DNA, 20 bp, Artificial
  CRISPR gRNA sequence
ttcattagggggattgcgtt

SEQ ID NO: 206444 - DNA, 20 bp, Artificial
  CRISPR gRNA sequence
ttagggggattgcgttgggt

SEQ ID NO: 206445 - DNA, 20 bp, Artificial
  CRISPR gRNA sequence
gattgcgttgggtcagaact

SEQ ID NO: 206446 - DNA, 20 bp, Artificial
  CRISPR gRNA sequence
tcagaactaagtacaacttg

SEQ ID NO: 206447 - DNA, 20 bp, Artificial
  CRISPR gRNA sequence
gtggacaccccactctaccc

SEQ ID NO: 206448 - DNA, 20 bp, Artificial
  CRISPR gRNA sequence
tctaccccagacctttattt

SEQ ID NO: 206449 - DNA, 20 bp, Artificial
  CRISPR gRNA sequence
cctttattttagtgtccatt

SEQ ID NO: 206450 - DNA, 20 bp, Artificial
  CRISPR gRNA sequence
ctttattttagtgtccattg

SEQ ID NO: 206451 - DNA, 20 bp, Artificial
  CRISPR gRNA sequence
ttattttagtgtccattgag

SEQ ID NO: 206452 - DNA, 20 bp, Artificial
  CRISPR gRNA sequence
attttagtgtccattgagga

SEQ ID NO: 206453 - DNA, 20 bp, Artificial
  CRISPR gRNA sequence
catcctttttgtacgtaacc

SEQ ID NO: 206454 - DNA, 20 bp, Artificial
  CRISPR gRNA sequence
tttttgtacgtaacccagtg

SEQ ID NO: 206455 - DNA, 20 bp, Artificial
  CRISPR gRNA sequence
tgtacgtaacccagtgtagc

SEQ ID NO: 206456 - DNA, 20 bp, Artificial
  CRISPR gRNA sequence
tacgtaacccagtgtagcta

SEQ ID NO: 206457 - DNA, 20 bp, Artificial
  CRISPR gRNA sequence
cccagtgtagctagagactc

SEQ ID NO: 206458 - DNA, 20 bp, Artificial
  CRISPR gRNA sequence
gctagagactccagttcttc

SEQ ID NO: 206459 - DNA, 20 bp, Artificial
  CRISPR gRNA sequence
gagactccagttcttcaagc

SEQ ID NO: 206460 - DNA, 20 bp, Artificial
  CRISPR gRNA sequence
cagttcttcaagccagacac

SEQ ID NO: 206461 - DNA, 20 bp, Artificial
  CRISPR gRNA sequence
tcaagccagacactagttct

SEQ ID NO: 206462 - DNA, 20 bp, Artificial
  CRISPR gRNA sequence
caagccagacactagttcta

SEQ ID NO: 206463 - DNA, 20 bp, Artificial
  CRISPR gRNA sequence
aagccagacactagttctaa

SEQ ID NO: 206464 - DNA, 20 bp, Artificial
  CRISPR gRNA sequence
agccagacactagttctaag

SEQ ID NO: 206465 - DNA, 20 bp, Artificial
  CRISPR gRNA sequence
acactagttctaaggggcaa

SEQ ID NO: 206466 - DNA, 20 bp, Artificial
  CRISPR gRNA sequence
ctagttctaaggggcaaaag

SEQ ID NO: 206467 - DNA, 20 bp, Artificial
  CRISPR gRNA sequence
tagttctaaggggcaaaagt

SEQ ID NO: 206468 - DNA, 20 bp, Artificial
  CRISPR gRNA sequence
ttctaaggggcaaaagtagg

SEQ ID NO: 206469 - DNA, 20 bp, Artificial
  CRISPR gRNA sequence
tctaaggggcaaaagtaggt

SEQ ID NO: 206470 - DNA, 20 bp, Artificial
  CRISPR gRNA sequence
aagtaggtaggattgctttc

SEQ ID NO: 206471 - DNA, 20 bp, Artificial
  CRISPR gRNA sequence
tgatctttgcttctttacct

SEQ ID NO: 206472 - DNA, 20 bp, Artificial
  CRISPR gRNA sequence
atctttgcttctttacctaa

SEQ ID NO: 206473 - DNA, 20 bp, Artificial
  CRISPR gRNA sequence
tctttgcttctttacctaag

SEQ ID NO: 206474 - DNA, 20 bp, Artificial
  CRISPR gRNA sequence
tctttacctaagaggctgct

SEQ ID NO: 206475 - DNA, 20 bp, Artificial
  CRISPR gRNA sequence
cattcctgaacatccattcc

SEQ ID NO: 206476 - DNA, 20 bp, Artificial
  CRISPR gRNA sequence
tcctgaacatccattcccag

SEQ ID NO: 206477 - DNA, 20 bp, Artificial
  CRISPR gRNA sequence
tcctactctactgcaaaaaa

SEQ ID NO: 206478 - DNA, 20 bp, Artificial
  CRISPR gRNA sequence
tactctactgcaaaaaatag

SEQ ID NO: 206479 - DNA, 20 bp, Artificial
  CRISPR gRNA sequence
ctgcaaaaaatagtggtgtg

SEQ ID NO: 206480 - DNA, 20 bp, Artificial
  CRISPR gRNA sequence
aaaaatagtggtgtgtggtt

SEQ ID NO: 206481 - DNA, 20 bp, Artificial
  CRISPR gRNA sequence
taaactgatctataacatct

SEQ ID NO: 206482 - DNA, 20 bp, Artificial
  CRISPR gRNA sequence
tctcattctcttccgtcatc

SEQ ID NO: 206483 - DNA, 20 bp, Artificial
  CRISPR gRNA sequence
tctcttccgtcatccagctt

SEQ ID NO: 206484 - DNA, 20 bp, Artificial
  CRISPR gRNA sequence
cttccgtcatccagcttcag

SEQ ID NO: 206485 - DNA, 20 bp, Artificial
  CRISPR gRNA sequence
cctactcacttttccaacga

SEQ ID NO: 206486 - DNA, 20 bp, Artificial
  CRISPR gRNA sequence
ctactcacttttccaacgaa

SEQ ID NO: 206487 - DNA, 20 bp, Artificial
  CRISPR gRNA sequence
ccttttcacttctaccatct

SEQ ID NO: 206488 - DNA, 20 bp, Artificial
  CRISPR gRNA sequence
ttttcacttctaccatcttg

SEQ ID NO: 206489 - DNA, 20 bp, Artificial
  CRISPR gRNA sequence
taccatcttggagacctgct

SEQ ID NO: 206490 - DNA, 20 bp, Artificial
  CRISPR gRNA sequence
atcttggagacctgctcagt

SEQ ID NO: 206491 - DNA, 20 bp, Artificial
  CRISPR gRNA sequence
gctcagtcagcataattctt

SEQ ID NO: 206492 - DNA, 20 bp, Artificial
  CRISPR gRNA sequence
aattcttcagtcttgcatct

SEQ ID NO: 206493 - DNA, 20 bp, Artificial
  CRISPR gRNA sequence
ctccattgactccttccccg

SEQ ID NO: 206494 - DNA, 20 bp, Artificial
  CRISPR gRNA sequence
aaaataaaacaaaaaacctc

SEQ ID NO: 206495 - DNA, 20 bp, Artificial
  CRISPR gRNA sequence
tgttcctgcctgcacattgt

SEQ ID NO: 206496 - DNA, 20 bp, Artificial
  CRISPR gRNA sequence
cactgccaaatttattgtaa

SEQ ID NO: 206497 - DNA, 20 bp, Artificial
  CRISPR gRNA sequence
actgccacttaatatatttt

SEQ ID NO: 206498 - DNA, 20 bp, Artificial
  CRISPR gRNA sequence
tatattttaagtgcttgata

SEQ ID NO: 206499 - DNA, 20 bp, Artificial
  CRISPR gRNA sequence
tctctctcatttctcaaaca

SEQ ID NO: 206500 - DNA, 20 bp, Artificial
  CRISPR gRNA sequence
ttctcaaacatagtgtgcat

SEQ ID NO: 206501 - DNA, 20 bp, Artificial
  CRISPR gRNA sequence
tagtgtgcatcagatctcac

SEQ ID NO: 206502 - DNA, 20 bp, Artificial
  CRISPR gRNA sequence
agatctcactagtccattga

SEQ ID NO: 206503 - DNA, 20 bp, Artificial
  CRISPR gRNA sequence
ctcactagtccattgacaga

SEQ ID NO: 206504 - DNA, 20 bp, Artificial
  CRISPR gRNA sequence
ctagtccattgacagatgga

SEQ ID NO: 206505 - DNA, 20 bp, Artificial
  CRISPR gRNA sequence
gatattctccccaaatattt

SEQ ID NO: 206506 - DNA, 20 bp, Artificial
  CRISPR gRNA sequence
aagcctcttttctctataat

SEQ ID NO: 206507 - DNA, 20 bp, Artificial
  CRISPR gRNA sequence
taattagcctaccatctaac

SEQ ID NO: 206508 - DNA, 20 bp, Artificial
  CRISPR gRNA sequence
actagctacacatactattt

SEQ ID NO: 206509 - DNA, 20 bp, Artificial
  CRISPR gRNA sequence
taacttctgttgattactgt

SEQ ID NO: 206510 - DNA, 20 bp, Artificial
  CRISPR gRNA sequence
ctgttgattactgtaagttt

SEQ ID NO: 206511 - DNA, 20 bp, Artificial
  CRISPR gRNA sequence
tgttgattactgtaagtttt

SEQ ID NO: 206512 - DNA, 20 bp, Artificial
  CRISPR gRNA sequence
taagttttaggtcttctctc

SEQ ID NO: 206513 - DNA, 20 bp, Artificial
  CRISPR gRNA sequence
ctctccagttgttctttacc

SEQ ID NO: 206514 - DNA, 20 bp, Artificial
  CRISPR gRNA sequence
gttctttacctggactattg

SEQ ID NO: 206515 - DNA, 20 bp, Artificial
  CRISPR gRNA sequence
ctttacctggactattgcag

SEQ ID NO: 206516 - DNA, 20 bp, Artificial
  CRISPR gRNA sequence
ctattgcagtagtctgttaa

SEQ ID NO: 206517 - DNA, 20 bp, Artificial
  CRISPR gRNA sequence
ctcttttcccttgctgccct

SEQ ID NO: 206518 - DNA, 20 bp, Artificial
  CRISPR gRNA sequence
tttttaatgaaattaaatct

SEQ ID NO: 206519 - DNA, 20 bp, Artificial
  CRISPR gRNA sequence
ttaatgaaattaaatctgag

SEQ ID NO: 206520 - DNA, 20 bp, Artificial
  CRISPR gRNA sequence
aattaaatctgagtggttta

SEQ ID NO: 206521 - DNA, 20 bp, Artificial
  CRISPR gRNA sequence
ttacagttgtttatgttatc

SEQ ID NO: 206522 - DNA, 20 bp, Artificial
  CRISPR gRNA sequence
tatgttatcaagtctaaact

SEQ ID NO: 206523 - DNA, 20 bp, Artificial
  CRISPR gRNA sequence
ctaaactcagcatgacattc

SEQ ID NO: 206524 - DNA, 20 bp, Artificial
  CRISPR gRNA sequence
taaactcagcatgacattca

SEQ ID NO: 206525 - DNA, 20 bp, Artificial
  CRISPR gRNA sequence
actcagcatgacattcaagg

SEQ ID NO: 206526 - DNA, 20 bp, Artificial
  CRISPR gRNA sequence
tgacattcaaggaagccctt

SEQ ID NO: 206527 - DNA, 20 bp, Artificial
  CRISPR gRNA sequence
tcttttccaacctcatttcc

SEQ ID NO: 206528 - DNA, 20 bp, Artificial
  CRISPR gRNA sequence
ttttccaacctcatttccta

SEQ ID NO: 206529 - DNA, 20 bp, Artificial
  CRISPR gRNA sequence
cctaaataattctctgcttt

SEQ ID NO: 206530 - DNA, 20 bp, Artificial
  CRISPR gRNA sequence
agttcttcactttctttatc

SEQ ID NO: 206531 - DNA, 20 bp, Artificial
  CRISPR gRNA sequence
gctgtacacgttactctgcc

SEQ ID NO: 206532 - DNA, 20 bp, Artificial
  CRISPR gRNA sequence
tacacgttactctgcctaga

SEQ ID NO: 206533 - DNA, 20 bp, Artificial
  CRISPR gRNA sequence
aacattcttactcatccttt

SEQ ID NO: 206534 - DNA, 20 bp, Artificial
  CRISPR gRNA sequence
cttactcatcctttaagacc

SEQ ID NO: 206535 - DNA, 20 bp, Artificial
  CRISPR gRNA sequence
ccagtttaaacatcaccctc

SEQ ID NO: 206536 - DNA, 20 bp, Artificial
  CRISPR gRNA sequence
cagtttaaacatcaccctct

SEQ ID NO: 206537 - DNA, 20 bp, Artificial
  CRISPR gRNA sequence
tttaaacatcaccctctagg

SEQ ID NO: 206538 - DNA, 20 bp, Artificial
  CRISPR gRNA sequence
ccctctaggaagatcattca

SEQ ID NO: 206539 - DNA, 20 bp, Artificial
  CRISPR gRNA sequence
gacacattcttgtgattttt

SEQ ID NO: 206540 - DNA, 20 bp, Artificial
  CRISPR gRNA sequence
acacattcttgtgattttta

SEQ ID NO: 206541 - DNA, 20 bp, Artificial
  CRISPR gRNA sequence
acttttctatccaaccatac

SEQ ID NO: 206542 - DNA, 20 bp, Artificial
  CRISPR gRNA sequence
tccaaccatacaagtgactt

SEQ ID NO: 206543 - DNA, 20 bp, Artificial
  CRISPR gRNA sequence
agattttccatgaaaatatg

SEQ ID NO: 206544 - DNA, 20 bp, Artificial
  CRISPR gRNA sequence
agcttcatgatttcataatc

SEQ ID NO: 206545 - DNA, 20 bp, Artificial
  CRISPR gRNA sequence
tttcataatcaagtctatac

SEQ ID NO: 206546 - DNA, 20 bp, Artificial
  CRISPR gRNA sequence
ataatcaagtctatacaagt

SEQ ID NO: 206547 - DNA, 20 bp, Artificial
  CRISPR gRNA sequence
atcaagtctatacaagtgag

SEQ ID NO: 206548 - DNA, 20 bp, Artificial
  CRISPR gRNA sequence
aagtctatacaagtgagaag

SEQ ID NO: 206549 - DNA, 20 bp, Artificial
  CRISPR gRNA sequence
tctatacaagtgagaagcag

SEQ ID NO: 206550 - DNA, 20 bp, Artificial
  CRISPR gRNA sequence
atacaagtgagaagcagtgg

SEQ ID NO: 206551 - DNA, 20 bp, Artificial
  CRISPR gRNA sequence
tacaagtgagaagcagtggc

SEQ ID NO: 206552 - DNA, 20 bp, Artificial
  CRISPR gRNA sequence
tggcaggttctcttgaaata

SEQ ID NO: 206553 - DNA, 20 bp, Artificial
  CRISPR gRNA sequence
caggttctcttgaaatacag

SEQ ID NO: 206554 - DNA, 20 bp, Artificial
  CRISPR gRNA sequence
atcttctcccacatgatttt

SEQ ID NO: 206555 - DNA, 20 bp, Artificial
  CRISPR gRNA sequence
atttttagatttttcttcta

SEQ ID NO: 206556 - DNA, 20 bp, Artificial
  CRISPR gRNA sequence
tttaaactttttacattcac

SEQ ID NO: 206557 - DNA, 20 bp, Artificial
  CRISPR gRNA sequence
ttaaactttttacattcaca

SEQ ID NO: 206558 - DNA, 20 bp, Artificial
  CRISPR gRNA sequence
aactttttacattcacaagg

SEQ ID NO: 206559 - DNA, 20 bp, Artificial
  CRISPR gRNA sequence
actttttacattcacaagga

SEQ ID NO: 206560 - DNA, 20 bp, Artificial
  CRISPR gRNA sequence
aggtattgaatcctactttc

SEQ ID NO: 206561 - DNA, 20 bp, Artificial
  CRISPR gRNA sequence
ctactttctggaccctgtgt

SEQ ID NO: 206562 - DNA, 20 bp, Artificial
  CRISPR gRNA sequence
tggaccctgtgttagattct

SEQ ID NO: 206563 - DNA, 20 bp, Artificial
  CRISPR gRNA sequence
ggaccctgtgttagattctt

SEQ ID NO: 206564 - DNA, 20 bp, Artificial
  CRISPR gRNA sequence
gattcttaggataccaaatg

SEQ ID NO: 206565 - DNA, 20 bp, Artificial
  CRISPR gRNA sequence
cttaggataccaaatgaaga

SEQ ID NO: 206566 - DNA, 20 bp, Artificial
  CRISPR gRNA sequence
aagacagtgtcttactttct

SEQ ID NO: 206567 - DNA, 20 bp, Artificial
  CRISPR gRNA sequence
agtgtcttactttctgagcc

SEQ ID NO: 206568 - DNA, 20 bp, Artificial
  CRISPR gRNA sequence
tgtcttactttctgagcctg

SEQ ID NO: 206569 - DNA, 20 bp, Artificial
  CRISPR gRNA sequence
tcttactttctgagcctgga

SEQ ID NO: 206570 - DNA, 20 bp, Artificial
  CRISPR gRNA sequence
ctttctgagcctggagagat

SEQ ID NO: 206571 - DNA, 20 bp, Artificial
  CRISPR gRNA sequence
tgagcctggagagatcagtt

SEQ ID NO: 206572 - DNA, 20 bp, Artificial
  CRISPR gRNA sequence
gagagatcagttaagtaaaa

SEQ ID NO: 206573 - DNA, 20 bp, Artificial
  CRISPR gRNA sequence
taagtaaaatagtaattaca

SEQ ID NO: 206574 - DNA, 20 bp, Artificial
  CRISPR gRNA sequence
gtaaaatagtaattacacag

SEQ ID NO: 206575 - DNA, 20 bp, Artificial
  CRISPR gRNA sequence
aaatagtaattacacagtag

SEQ ID NO: 206576 - DNA, 20 bp, Artificial
  CRISPR gRNA sequence
aatagtaattacacagtagt

SEQ ID NO: 206577 - DNA, 20 bp, Artificial
  CRISPR gRNA sequence
taattacacagtagtaggta

SEQ ID NO: 206578 - DNA, 20 bp, Artificial
  CRISPR gRNA sequence
cagtgacaacatttgaacac

SEQ ID NO: 206579 - DNA, 20 bp, Artificial
  CRISPR gRNA sequence
agtgacaacatttgaacaca

SEQ ID NO: 206580 - DNA, 20 bp, Artificial
  CRISPR gRNA sequence
aacatttgaacacaaggcaa

SEQ ID NO: 206581 - DNA, 20 bp, Artificial
  CRISPR gRNA sequence
acatttgaacacaaggcaat

SEQ ID NO: 206582 - DNA, 20 bp, Artificial
  CRISPR gRNA sequence
atttgaacacaaggcaatgg

SEQ ID NO: 206583 - DNA, 20 bp, Artificial
  CRISPR gRNA sequence
cacaaggcaatgggagcaat

SEQ ID NO: 206584 - DNA, 20 bp, Artificial
  CRISPR gRNA sequence
acaaggcaatgggagcaata

SEQ ID NO: 206585 - DNA, 20 bp, Artificial
  CRISPR gRNA sequence
aaggcaatgggagcaataag

SEQ ID NO: 206586 - DNA, 20 bp, Artificial
  CRISPR gRNA sequence
aggcaatgggagcaataagg

SEQ ID NO: 206587 - DNA, 20 bp, Artificial
  CRISPR gRNA sequence
ggcaatgggagcaataagga

SEQ ID NO: 206588 - DNA, 20 bp, Artificial
  CRISPR gRNA sequence
gcaatgggagcaataaggag

SEQ ID NO: 206589 - DNA, 20 bp, Artificial
  CRISPR gRNA sequence
atgggagcaataaggagggg

SEQ ID NO: 206590 - DNA, 20 bp, Artificial
  CRISPR gRNA sequence
aggaggggaagaatacaatt

SEQ ID NO: 206591 - DNA, 20 bp, Artificial
  CRISPR gRNA sequence
ggaagaatacaattgagtaa

SEQ ID NO: 206592 - DNA, 20 bp, Artificial
  CRISPR gRNA sequence
agaatacaattgagtaatgg

SEQ ID NO: 206593 - DNA, 20 bp, Artificial
  CRISPR gRNA sequence
gaatacaattgagtaatggt

SEQ ID NO: 206594 - DNA, 20 bp, Artificial
  CRISPR gRNA sequence
aatacaattgagtaatggta

SEQ ID NO: 206595 - DNA, 20 bp, Artificial
  CRISPR gRNA sequence
acaattgagtaatggtaggg

SEQ ID NO: 206596 - DNA, 20 bp, Artificial
  CRISPR gRNA sequence
caattgagtaatggtaggga

SEQ ID NO: 206597 - DNA, 20 bp, Artificial
  CRISPR gRNA sequence
aattgagtaatggtagggaa

SEQ ID NO: 206598 - DNA, 20 bp, Artificial
  CRISPR gRNA sequence
attgagtaatggtagggaag

SEQ ID NO: 206599 - DNA, 20 bp, Artificial
  CRISPR gRNA sequence
taatggtagggaaggggaac

SEQ ID NO: 206600 - DNA, 20 bp, Artificial
  CRISPR gRNA sequence
tgaacaactcaactgtgctt

SEQ ID NO: 206601 - DNA, 20 bp, Artificial
  CRISPR gRNA sequence
acaactcaactgtgctttag

SEQ ID NO: 206602 - DNA, 20 bp, Artificial
  CRISPR gRNA sequence
caactcaactgtgctttagt

SEQ ID NO: 206603 - DNA, 20 bp, Artificial
  CRISPR gRNA sequence
ctcaactgtgctttagtagg

SEQ ID NO: 206604 - DNA, 20 bp, Artificial
  CRISPR gRNA sequence
caactgtgctttagtaggaa

SEQ ID NO: 206605 - DNA, 20 bp, Artificial
  CRISPR gRNA sequence
tgctttagtaggaagagcaa

SEQ ID NO: 206606 - DNA, 20 bp, Artificial
  CRISPR gRNA sequence
ttagtaggaagagcaaaagt

SEQ ID NO: 206607 - DNA, 20 bp, Artificial
  CRISPR gRNA sequence
gagcaaaagttagcaaactg

SEQ ID NO: 206608 - DNA, 20 bp, Artificial
  CRISPR gRNA sequence
aactgtagctgccatttatt

SEQ ID NO: 206609 - DNA, 20 bp, Artificial
  CRISPR gRNA sequence
agtacttgctgtatatgtga

SEQ ID NO: 206610 - DNA, 20 bp, Artificial
  CRISPR gRNA sequence
gtacttgctgtatatgtgaa

SEQ ID NO: 206611 - DNA, 20 bp, Artificial
  CRISPR gRNA sequence
aatcttaacaatatctctat

SEQ ID NO: 206612 - DNA, 20 bp, Artificial
  CRISPR gRNA sequence
atcttaacaatatctctatg

SEQ ID NO: 206613 - DNA, 20 bp, Artificial
  CRISPR gRNA sequence
ccatcactatgcacatttta

SEQ ID NO: 206614 - DNA, 20 bp, Artificial
  CRISPR gRNA sequence
actatgcacattttatagat

SEQ ID NO: 206615 - DNA, 20 bp, Artificial
  CRISPR gRNA sequence
ctatgcacattttatagatg

SEQ ID NO: 206616 - DNA, 20 bp, Artificial
  CRISPR gRNA sequence
attttatagatgaggaaact

SEQ ID NO: 206617 - DNA, 20 bp, Artificial
  CRISPR gRNA sequence
ttttatagatgaggaaactg

SEQ ID NO: 206618 - DNA, 20 bp, Artificial
  CRISPR gRNA sequence
ttatagatgaggaaactgag

SEQ ID NO: 206619 - DNA, 20 bp, Artificial
  CRISPR gRNA sequence
tagatgaggaaactgaggag

SEQ ID NO: 206620 - DNA, 20 bp, Artificial
  CRISPR gRNA sequence
gatgaggaaactgaggagca

SEQ ID NO: 206621 - DNA, 20 bp, Artificial
  CRISPR gRNA sequence
atgaggaaactgaggagcag

SEQ ID NO: 206622 - DNA, 20 bp, Artificial
  CRISPR gRNA sequence
ggaaactgaggagcagaggt

SEQ ID NO: 206623 - DNA, 20 bp, Artificial
  CRISPR gRNA sequence
cagaggtaagtaacttgcct

SEQ ID NO: 206624 - DNA, 20 bp, Artificial
  CRISPR gRNA sequence
agaggtaagtaacttgccta

SEQ ID NO: 206625 - DNA, 20 bp, Artificial
  CRISPR gRNA sequence
gtaacttgcctaaggttata

SEQ ID NO: 206626 - DNA, 20 bp, Artificial
  CRISPR gRNA sequence
ttgcctaaggttatacagct

SEQ ID NO: 206627 - DNA, 20 bp, Artificial
  CRISPR gRNA sequence
cctaaggttatacagctaag

SEQ ID NO: 206628 - DNA, 20 bp, Artificial
  CRISPR gRNA sequence
tatacagctaagaagtacat

SEQ ID NO: 206629 - DNA, 20 bp, Artificial
  CRISPR gRNA sequence
atacagctaagaagtacatg

SEQ ID NO: 206630 - DNA, 20 bp, Artificial
  CRISPR gRNA sequence
acatgaggtgaatcttaaac

SEQ ID NO: 206631 - DNA, 20 bp, Artificial
  CRISPR gRNA sequence
catgaggtgaatcttaaact

SEQ ID NO: 206632 - DNA, 20 bp, Artificial
  CRISPR gRNA sequence
atgaggtgaatcttaaacta

SEQ ID NO: 206633 - DNA, 20 bp, Artificial
  CRISPR gRNA sequence
tattatacaccctatgtact

SEQ ID NO: 206634 - DNA, 20 bp, Artificial
  CRISPR gRNA sequence
tatacaccctatgtactcag

SEQ ID NO: 206635 - DNA, 20 bp, Artificial
  CRISPR gRNA sequence
atacaccctatgtactcagt

SEQ ID NO: 206636 - DNA, 20 bp, Artificial
  CRISPR gRNA sequence
tacaccctatgtactcagtg

SEQ ID NO: 206637 - DNA, 20 bp, Artificial
  CRISPR gRNA sequence
ctatgtactcagtggggtaa

SEQ ID NO: 206638 - DNA, 20 bp, Artificial
  CRISPR gRNA sequence
agtggggtaatagtgtataa

SEQ ID NO: 206639 - DNA, 20 bp, Artificial
  CRISPR gRNA sequence
ggtaatagtgtataacagtt

SEQ ID NO: 206640 - DNA, 20 bp, Artificial
  CRISPR gRNA sequence
taatagtgtataacagttaa

SEQ ID NO: 206641 - DNA, 20 bp, Artificial
  CRISPR gRNA sequence
aatagtgtataacagttaag

SEQ ID NO: 206642 - DNA, 20 bp, Artificial
  CRISPR gRNA sequence
ataacagttaagaggctatt

SEQ ID NO: 206643 - DNA, 20 bp, Artificial
  CRISPR gRNA sequence
taacagttaagaggctattt

SEQ ID NO: 206644 - DNA, 20 bp, Artificial
  CRISPR gRNA sequence
ttaagaggctatttaggttt

SEQ ID NO: 206645 - DNA, 20 bp, Artificial
  CRISPR gRNA sequence
taagaggctatttaggtttg

SEQ ID NO: 206646 - DNA, 20 bp, Artificial
  CRISPR gRNA sequence
ggctatttaggtttgaggaa

SEQ ID NO: 206647 - DNA, 20 bp, Artificial
  CRISPR gRNA sequence
tttgaggaacagtatgtgct

SEQ ID NO: 206648 - DNA, 20 bp, Artificial
  CRISPR gRNA sequence
ttgaggaacagtatgtgcta

SEQ ID NO: 206649 - DNA, 20 bp, Artificial
  CRISPR gRNA sequence
gaacagtatgtgctaaggca

SEQ ID NO: 206650 - DNA, 20 bp, Artificial
  CRISPR gRNA sequence
aacagtatgtgctaaggcat

SEQ ID NO: 206651 - DNA, 20 bp, Artificial
  CRISPR gRNA sequence
acagtatgtgctaaggcatg

SEQ ID NO: 206652 - DNA, 20 bp, Artificial
  CRISPR gRNA sequence
atgtgctaaggcatggggat

SEQ ID NO: 206653 - DNA, 20 bp, Artificial
  CRISPR gRNA sequence
gtgctaaggcatggggatga

SEQ ID NO: 206654 - DNA, 20 bp, Artificial
  CRISPR gRNA sequence
gggatgagagtgcatttgca

SEQ ID NO: 206655 - DNA, 20 bp, Artificial
  CRISPR gRNA sequence
agagtgcatttgcatagtca

SEQ ID NO: 206656 - DNA, 20 bp, Artificial
  CRISPR gRNA sequence
tgcaataacgtcattatgat

SEQ ID NO: 206657 - DNA, 20 bp, Artificial
  CRISPR gRNA sequence
caataacgtcattatgattg

SEQ ID NO: 206658 - DNA, 20 bp, Artificial
  CRISPR gRNA sequence
acgtcattatgattggagct

SEQ ID NO: 206659 - DNA, 20 bp, Artificial
  CRISPR gRNA sequence
attatgattggagcttagtg

SEQ ID NO: 206660 - DNA, 20 bp, Artificial
  CRISPR gRNA sequence
ttggagcttagtgtggaaat

SEQ ID NO: 206661 - DNA, 20 bp, Artificial
  CRISPR gRNA sequence
tggagcttagtgtggaaatg

SEQ ID NO: 206662 - DNA, 20 bp, Artificial
  CRISPR gRNA sequence
ggagcttagtgtggaaatga

SEQ ID NO: 206663 - DNA, 20 bp, Artificial
  CRISPR gRNA sequence
agcttagtgtggaaatgagg

SEQ ID NO: 206664 - DNA, 20 bp, Artificial
  CRISPR gRNA sequence
agtgtggaaatgagggagta

SEQ ID NO: 206665 - DNA, 20 bp, Artificial
  CRISPR gRNA sequence
gtgtggaaatgagggagtac

SEQ ID NO: 206666 - DNA, 20 bp, Artificial
  CRISPR gRNA sequence
gtggaaatgagggagtacag

SEQ ID NO: 206667 - DNA, 20 bp, Artificial
  CRISPR gRNA sequence
tggaaatgagggagtacagg

SEQ ID NO: 206668 - DNA, 20 bp, Artificial
  CRISPR gRNA sequence
aaatgagggagtacaggagg

SEQ ID NO: 206669 - DNA, 20 bp, Artificial
  CRISPR gRNA sequence
aatgagggagtacaggaggt

SEQ ID NO: 206670 - DNA, 20 bp, Artificial
  CRISPR gRNA sequence
atgagggagtacaggaggtg

SEQ ID NO: 206671 - DNA, 20 bp, Artificial
  CRISPR gRNA sequence
gggagtacaggaggtggggc

SEQ ID NO: 206672 - DNA, 20 bp, Artificial
  CRISPR gRNA sequence
gtacaggaggtggggctgga

SEQ ID NO: 206673 - DNA, 20 bp, Artificial
  CRISPR gRNA sequence
tacaggaggtggggctggaa

SEQ ID NO: 206674 - DNA, 20 bp, Artificial
  CRISPR gRNA sequence
tggggctggaaaggatcttg

SEQ ID NO: 206675 - DNA, 20 bp, Artificial
  CRISPR gRNA sequence
ggggctggaaaggatcttga

SEQ ID NO: 206676 - DNA, 20 bp, Artificial
  CRISPR gRNA sequence
gtattccatgctaatgtact

SEQ ID NO: 206677 - DNA, 20 bp, Artificial
  CRISPR gRNA sequence
atgctaatgtacttagaatt

SEQ ID NO: 206678 - DNA, 20 bp, Artificial
  CRISPR gRNA sequence
tacttagaatttagcctgaa

SEQ ID NO: 206679 - DNA, 20 bp, Artificial
  CRISPR gRNA sequence
acttagaatttagcctgaaa

SEQ ID NO: 206680 - DNA, 20 bp, Artificial
  CRISPR gRNA sequence
cttagaatttagcctgaaaa

SEQ ID NO: 206681 - DNA, 20 bp, Artificial
  CRISPR gRNA sequence
aatttagcctgaaaagggtt

SEQ ID NO: 206682 - DNA, 20 bp, Artificial
  CRISPR gRNA sequence
atttagcctgaaaagggttg

SEQ ID NO: 206683 - DNA, 20 bp, Artificial
  CRISPR gRNA sequence
tttagcctgaaaagggttga

SEQ ID NO: 206684 - DNA, 20 bp, Artificial
  CRISPR gRNA sequence
aagggttgagggtgttgtta

SEQ ID NO: 206685 - DNA, 20 bp, Artificial
  CRISPR gRNA sequence
agggtgttgttaaagtatct

SEQ ID NO: 206686 - DNA, 20 bp, Artificial
  CRISPR gRNA sequence
gggtgttgttaaagtatctt

SEQ ID NO: 206687 - DNA, 20 bp, Artificial
  CRISPR gRNA sequence
ttgttaaagtatcttaggca

SEQ ID NO: 206688 - DNA, 20 bp, Artificial
  CRISPR gRNA sequence
tgttaaagtatcttaggcaa

SEQ ID NO: 206689 - DNA, 20 bp, Artificial
  CRISPR gRNA sequence
ttaaagtatcttaggcaaag

SEQ ID NO: 206690 - DNA, 20 bp, Artificial
  CRISPR gRNA sequence
aaggagtgcacatttgcatt

SEQ ID NO: 206691 - DNA, 20 bp, Artificial
  CRISPR gRNA sequence
gtgcacatttgcatttagaa

SEQ ID NO: 206692 - DNA, 20 bp, Artificial
  CRISPR gRNA sequence
tgcatttagaacagttattt

SEQ ID NO: 206693 - DNA, 20 bp, Artificial
  CRISPR gRNA sequence
gcatttagaacagttatttt

SEQ ID NO: 206694 - DNA, 20 bp, Artificial
  CRISPR gRNA sequence
aacagttattttgggaactg

SEQ ID NO: 206695 - DNA, 20 bp, Artificial
  CRISPR gRNA sequence
gggaactgtagaaaatacat

SEQ ID NO: 206696 - DNA, 20 bp, Artificial
  CRISPR gRNA sequence
ggaactgtagaaaatacatc

SEQ ID NO: 206697 - DNA, 20 bp, Artificial
  CRISPR gRNA sequence
gaactgtagaaaatacatca

SEQ ID NO: 206698 - DNA, 20 bp, Artificial
  CRISPR gRNA sequence
tgtagaaaatacatcagggc

SEQ ID NO: 206699 - DNA, 20 bp, Artificial
  CRISPR gRNA sequence
gtagaaaatacatcagggcc

SEQ ID NO: 206700 - DNA, 20 bp, Artificial
  CRISPR gRNA sequence
aaaatacatcagggccagga

SEQ ID NO: 206701 - DNA, 20 bp, Artificial
  CRISPR gRNA sequence
aatacatcagggccaggatg

SEQ ID NO: 206702 - DNA, 20 bp, Artificial
  CRISPR gRNA sequence
ggccaggatggagaaacctt

SEQ ID NO: 206703 - DNA, 20 bp, Artificial
  CRISPR gRNA sequence
gccaggatggagaaaccttg

SEQ ID NO: 206704 - DNA, 20 bp, Artificial
  CRISPR gRNA sequence
ggatggagaaaccttgagga

SEQ ID NO: 206705 - DNA, 20 bp, Artificial
  CRISPR gRNA sequence
atggagaaaccttgaggatg

SEQ ID NO: 206706 - DNA, 20 bp, Artificial
  CRISPR gRNA sequence
tggagaaaccttgaggatgg

SEQ ID NO: 206707 - DNA, 20 bp, Artificial
  CRISPR gRNA sequence
agaaaccttgaggatggagg

SEQ ID NO: 206708 - DNA, 20 bp, Artificial
  CRISPR gRNA sequence
gaaaccttgaggatggaggc

SEQ ID NO: 206709 - DNA, 20 bp, Artificial
  CRISPR gRNA sequence
aaaccttgaggatggaggca

SEQ ID NO: 206710 - DNA, 20 bp, Artificial
  CRISPR gRNA sequence
accttgaggatggaggcagg

SEQ ID NO: 206711 - DNA, 20 bp, Artificial
  CRISPR gRNA sequence
tgaggatggaggcagggagc

SEQ ID NO: 206712 - DNA, 20 bp, Artificial
  CRISPR gRNA sequence
gatggaggcagggagctggt

SEQ ID NO: 206713 - DNA, 20 bp, Artificial
  CRISPR gRNA sequence
ggaggcagggagctggttag

SEQ ID NO: 206714 - DNA, 20 bp, Artificial
  CRISPR gRNA sequence
gaggcagggagctggttaga

SEQ ID NO: 206715 - DNA, 20 bp, Artificial
  CRISPR gRNA sequence
aggcagggagctggttagaa

SEQ ID NO: 206716 - DNA, 20 bp, Artificial
  CRISPR gRNA sequence
gggagctggttagaagggta

SEQ ID NO: 206717 - DNA, 20 bp, Artificial
  CRISPR gRNA sequence
agctggttagaagggtatgg

SEQ ID NO: 206718 - DNA, 20 bp, Artificial
  CRISPR gRNA sequence
tggttagaagggtatggcag

SEQ ID NO: 206719 - DNA, 20 bp, Artificial
  CRISPR gRNA sequence
gaagggtatggcagtagttc

SEQ ID NO: 206720 - DNA, 20 bp, Artificial
  CRISPR gRNA sequence
aagggtatggcagtagttcg

SEQ ID NO: 206721 - DNA, 20 bp, Artificial
  CRISPR gRNA sequence
agggtatggcagtagttcga

SEQ ID NO: 206722 - DNA, 20 bp, Artificial
  CRISPR gRNA sequence
gggtatggcagtagttcgag

SEQ ID NO: 206723 - DNA, 20 bp, Artificial
  CRISPR gRNA sequence
ggtatggcagtagttcgagg

SEQ ID NO: 206724 - DNA, 20 bp, Artificial
  CRISPR gRNA sequence
gtatggcagtagttcgaggg

SEQ ID NO: 206725 - DNA, 20 bp, Artificial
  CRISPR gRNA sequence
atggcagtagttcgaggggg

SEQ ID NO: 206726 - DNA, 20 bp, Artificial
  CRISPR gRNA sequence
tggcagtagttcgagggggg

SEQ ID NO: 206727 - DNA, 20 bp, Artificial
  CRISPR gRNA sequence
gtagttcgaggggggaggat

SEQ ID NO: 206728 - DNA, 20 bp, Artificial
  CRISPR gRNA sequence
tgtctaattcattcattcaa

SEQ ID NO: 206729 - DNA, 20 bp, Artificial
  CRISPR gRNA sequence
ttcattcattcaacagacat

SEQ ID NO: 206730 - DNA, 20 bp, Artificial
  CRISPR gRNA sequence
cattcaacagacattggatt

SEQ ID NO: 206731 - DNA, 20 bp, Artificial
  CRISPR gRNA sequence
attcaacagacattggattt

SEQ ID NO: 206732 - DNA, 20 bp, Artificial
  CRISPR gRNA sequence
tggatttaggaactattaat

SEQ ID NO: 206733 - DNA, 20 bp, Artificial
  CRISPR gRNA sequence
ggatttaggaactattaatt

SEQ ID NO: 206734 - DNA, 20 bp, Artificial
  CRISPR gRNA sequence
ttaattaggttgaacctact

SEQ ID NO: 206735 - DNA, 20 bp, Artificial
  CRISPR gRNA sequence
aacctactaagaattctcca

SEQ ID NO: 206736 - DNA, 20 bp, Artificial
  CRISPR gRNA sequence
actaagaattctccatggct

SEQ ID NO: 206737 - DNA, 20 bp, Artificial
  CRISPR gRNA sequence
ctaagaattctccatggcta

SEQ ID NO: 206738 - DNA, 20 bp, Artificial
  CRISPR gRNA sequence
aagaattctccatggctaag

SEQ ID NO: 206739 - DNA, 20 bp, Artificial
  CRISPR gRNA sequence
gaattctccatggctaagga

SEQ ID NO: 206740 - DNA, 20 bp, Artificial
  CRISPR gRNA sequence
aattctccatggctaaggag

SEQ ID NO: 206741 - DNA, 20 bp, Artificial
  CRISPR gRNA sequence
attctccatggctaaggaga

SEQ ID NO: 206742 - DNA, 20 bp, Artificial
  CRISPR gRNA sequence
tctccatggctaaggagagg

SEQ ID NO: 206743 - DNA, 20 bp, Artificial
  CRISPR gRNA sequence
gagtaatctaatgtgattct

SEQ ID NO: 206744 - DNA, 20 bp, Artificial
  CRISPR gRNA sequence
agtaatctaatgtgattctt

SEQ ID NO: 206745 - DNA, 20 bp, Artificial
  CRISPR gRNA sequence
tctaatgtgattcttaggtc

SEQ ID NO: 206746 - DNA, 20 bp, Artificial
  CRISPR gRNA sequence
ctaatgtgattcttaggtcc

SEQ ID NO: 206747 - DNA, 20 bp, Artificial
  CRISPR gRNA sequence
gtgattcttaggtccaggtc

SEQ ID NO: 206748 - DNA, 20 bp, Artificial
  CRISPR gRNA sequence
taggtccaggtctggttcac

SEQ ID NO: 206749 - DNA, 20 bp, Artificial
  CRISPR gRNA sequence
gtccaggtctggttcactgg

SEQ ID NO: 206750 - DNA, 20 bp, Artificial
  CRISPR gRNA sequence
tctggttcactggtagatga

SEQ ID NO: 206751 - DNA, 20 bp, Artificial
  CRISPR gRNA sequence
gtagatgatagaaaatactt

SEQ ID NO: 206752 - DNA, 20 bp, Artificial
  CRISPR gRNA sequence
tgatagaaaatactttagca

SEQ ID NO: 206753 - DNA, 20 bp, Artificial
  CRISPR gRNA sequence
aatactttagcaaagtgatt

SEQ ID NO: 206754 - DNA, 20 bp, Artificial
  CRISPR gRNA sequence
atactttagcaaagtgattt

SEQ ID NO: 206755 - DNA, 20 bp, Artificial
  CRISPR gRNA sequence
ttagcaaagtgatttaggct

SEQ ID NO: 206756 - DNA, 20 bp, Artificial
  CRISPR gRNA sequence
tagcaaagtgatttaggctg

SEQ ID NO: 206757 - DNA, 20 bp, Artificial
  CRISPR gRNA sequence
agcaaagtgatttaggctga

SEQ ID NO: 206758 - DNA, 20 bp, Artificial
  CRISPR gRNA sequence
aagtgatttaggctgagggt

SEQ ID NO: 206759 - DNA, 20 bp, Artificial
  CRISPR gRNA sequence
tgatttaggctgagggtaag

SEQ ID NO: 206760 - DNA, 20 bp, Artificial
  CRISPR gRNA sequence
tttaggctgagggtaagaag

SEQ ID NO: 206761 - DNA, 20 bp, Artificial
  CRISPR gRNA sequence
ttaggctgagggtaagaagt

SEQ ID NO: 206762 - DNA, 20 bp, Artificial
  CRISPR gRNA sequence
taggctgagggtaagaagtg

SEQ ID NO: 206763 - DNA, 20 bp, Artificial
  CRISPR gRNA sequence
aggctgagggtaagaagtgg

SEQ ID NO: 206764 - DNA, 20 bp, Artificial
  CRISPR gRNA sequence
ggtaagaagtgggggtacgt

SEQ ID NO: 206765 - DNA, 20 bp, Artificial
  CRISPR gRNA sequence
agtgggggtacgtaagtttt

SEQ ID NO: 206766 - DNA, 20 bp, Artificial
  CRISPR gRNA sequence
ttttggacatactgactttg

SEQ ID NO: 206767 - DNA, 20 bp, Artificial
  CRISPR gRNA sequence
gaagtaactgtattacatcc

SEQ ID NO: 206768 - DNA, 20 bp, Artificial
  CRISPR gRNA sequence
gtaactgtattacatccaag

SEQ ID NO: 206769 - DNA, 20 bp, Artificial
  CRISPR gRNA sequence
actgtattacatccaagtgg

SEQ ID NO: 206770 - DNA, 20 bp, Artificial
  CRISPR gRNA sequence
tacatccaagtggaagtgca

SEQ ID NO: 206771 - DNA, 20 bp, Artificial
  CRISPR gRNA sequence
atccaagtggaagtgcacag

SEQ ID NO: 206772 - DNA, 20 bp, Artificial
  CRISPR gRNA sequence
aagtggaagtgcacagcaga

SEQ ID NO: 206773 - DNA, 20 bp, Artificial
  CRISPR gRNA sequence
ggaagtgcacagcagacagt

SEQ ID NO: 206774 - DNA, 20 bp, Artificial
  CRISPR gRNA sequence
agttggctgtccaacatctg

SEQ ID NO: 206775 - DNA, 20 bp, Artificial
  CRISPR gRNA sequence
gctgtccaacatctgcagtt

SEQ ID NO: 206776 - DNA, 20 bp, Artificial
  CRISPR gRNA sequence
gtccaacatctgcagtttag

SEQ ID NO: 206777 - DNA, 20 bp, Artificial
  CRISPR gRNA sequence
aacatctgcagtttagaaga

SEQ ID NO: 206778 - DNA, 20 bp, Artificial
  CRISPR gRNA sequence
acatctgcagtttagaagaa

SEQ ID NO: 206779 - DNA, 20 bp, Artificial
  CRISPR gRNA sequence
tctgcagtttagaagaaagg

SEQ ID NO: 206780 - DNA, 20 bp, Artificial
  CRISPR gRNA sequence
aagaaaggcagtgcatgatt

SEQ ID NO: 206781 - DNA, 20 bp, Artificial
  CRISPR gRNA sequence
tgattcagttttttatttaa

SEQ ID NO: 206782 - DNA, 20 bp, Artificial
  CRISPR gRNA sequence
gttttttatttaaaagtttg

SEQ ID NO: 206783 - DNA, 20 bp, Artificial
  CRISPR gRNA sequence
ttttttatttaaaagtttgc

SEQ ID NO: 206784 - DNA, 20 bp, Artificial
  CRISPR gRNA sequence
tatttaaaagtttgcaggtg

SEQ ID NO: 206785 - DNA, 20 bp, Artificial
  CRISPR gRNA sequence
tttgcaggtgaagaaaacca

SEQ ID NO: 206786 - DNA, 20 bp, Artificial
  CRISPR gRNA sequence
ttgcaggtgaagaaaaccat

SEQ ID NO: 206787 - DNA, 20 bp, Artificial
  CRISPR gRNA sequence
gcaggtgaagaaaaccatgg

SEQ ID NO: 206788 - DNA, 20 bp, Artificial
  CRISPR gRNA sequence
gtgaagaaaaccatgggagt

SEQ ID NO: 206789 - DNA, 20 bp, Artificial
  CRISPR gRNA sequence
tgaagaaaaccatgggagtc

SEQ ID NO: 206790 - DNA, 20 bp, Artificial
  CRISPR gRNA sequence
gaagaaaaccatgggagtca

SEQ ID NO: 206791 - DNA, 20 bp, Artificial
  CRISPR gRNA sequence
atgggagtcagggaaaatac

SEQ ID NO: 206792 - DNA, 20 bp, Artificial
  CRISPR gRNA sequence
tgggagtcagggaaaatact

SEQ ID NO: 206793 - DNA, 20 bp, Artificial
  CRISPR gRNA sequence
gggagtcagggaaaatacta

SEQ ID NO: 206794 - DNA, 20 bp, Artificial
  CRISPR gRNA sequence
ggagtcagggaaaatactag

SEQ ID NO: 206795 - DNA, 20 bp, Artificial
  CRISPR gRNA sequence
gagtcagggaaaatactagg

SEQ ID NO: 206796 - DNA, 20 bp, Artificial
  CRISPR gRNA sequence
tcagggaaaatactaggggg

SEQ ID NO: 206797 - DNA, 20 bp, Artificial
  CRISPR gRNA sequence
agggaaaatactagggggca

SEQ ID NO: 206798 - DNA, 20 bp, Artificial
  CRISPR gRNA sequence
gggaaaatactagggggcag

SEQ ID NO: 206799 - DNA, 20 bp, Artificial
  CRISPR gRNA sequence
ggaaaatactagggggcaga

SEQ ID NO: 206800 - DNA, 20 bp, Artificial
  CRISPR gRNA sequence
ggcagagggtactgaatctg

SEQ ID NO: 206801 - DNA, 20 bp, Artificial
  CRISPR gRNA sequence
ggtactgaatctgaagccct

SEQ ID NO: 206802 - DNA, 20 bp, Artificial
  CRISPR gRNA sequence
gtactgaatctgaagccctt

SEQ ID NO: 206803 - DNA, 20 bp, Artificial
  CRISPR gRNA sequence
tactgaatctgaagccctta

SEQ ID NO: 206804 - DNA, 20 bp, Artificial
  CRISPR gRNA sequence
cccttagggacactaacatt

SEQ ID NO: 206805 - DNA, 20 bp, Artificial
  CRISPR gRNA sequence
gggacactaacatttagtgt

SEQ ID NO: 206806 - DNA, 20 bp, Artificial
  CRISPR gRNA sequence
actaacatttagtgtgagtc

SEQ ID NO: 206807 - DNA, 20 bp, Artificial
  CRISPR gRNA sequence
ctaacatttagtgtgagtca

SEQ ID NO: 206808 - DNA, 20 bp, Artificial
  CRISPR gRNA sequence
atttagtgtgagtcaaggaa

SEQ ID NO: 206809 - DNA, 20 bp, Artificial
  CRISPR gRNA sequence
tcaaggaatagatttcaaca

SEQ ID NO: 206810 - DNA, 20 bp, Artificial
  CRISPR gRNA sequence
ggaatagatttcaacaaaga

SEQ ID NO: 206811 - DNA, 20 bp, Artificial
  CRISPR gRNA sequence
tttcaacaaagaaagcaaac

SEQ ID NO: 206812 - DNA, 20 bp, Artificial
  CRISPR gRNA sequence
ttcaacaaagaaagcaaact

SEQ ID NO: 206813 - DNA, 20 bp, Artificial
  CRISPR gRNA sequence
acaaagaaagcaaactagga

SEQ ID NO: 206814 - DNA, 20 bp, Artificial
  CRISPR gRNA sequence
caaagaaagcaaactaggat

SEQ ID NO: 206815 - DNA, 20 bp, Artificial
  CRISPR gRNA sequence
aaagaaagcaaactaggatg

SEQ ID NO: 206816 - DNA, 20 bp, Artificial
  CRISPR gRNA sequence
gaaagcaaactaggatgggg

SEQ ID NO: 206817 - DNA, 20 bp, Artificial
  CRISPR gRNA sequence
aaactaggatggggtggaca

SEQ ID NO: 206818 - DNA, 20 bp, Artificial
  CRISPR gRNA sequence
ctaggatggggtggacaaag

SEQ ID NO: 206819 - DNA, 20 bp, Artificial
  CRISPR gRNA sequence
taggatggggtggacaaagc

SEQ ID NO: 206820 - DNA, 20 bp, Artificial
  CRISPR gRNA sequence
ggatggggtggacaaagcag

SEQ ID NO: 206821 - DNA, 20 bp, Artificial
  CRISPR gRNA sequence
gatggggtggacaaagcagg

SEQ ID NO: 206822 - DNA, 20 bp, Artificial
  CRISPR gRNA sequence
agcaggaggaaattcgtaat

SEQ ID NO: 206823 - DNA, 20 bp, Artificial
  CRISPR gRNA sequence
gcaggaggaaattcgtaatc

SEQ ID NO: 206824 - DNA, 20 bp, Artificial
  CRISPR gRNA sequence
aggaggaaattcgtaatcag

SEQ ID NO: 206825 - DNA, 20 bp, Artificial
  CRISPR gRNA sequence
ttcgtaatcaggagatacca

SEQ ID NO: 206826 - DNA, 20 bp, Artificial
  CRISPR gRNA sequence
cgtaatcaggagataccatg

SEQ ID NO: 206827 - DNA, 20 bp, Artificial
  CRISPR gRNA sequence
gtaatcaggagataccatgg

SEQ ID NO: 206828 - DNA, 20 bp, Artificial
  CRISPR gRNA sequence
caggagataccatggaggcc

SEQ ID NO: 206829 - DNA, 20 bp, Artificial
  CRISPR gRNA sequence
ggagataccatggaggccaa

SEQ ID NO: 206830 - DNA, 20 bp, Artificial
  CRISPR gRNA sequence
agataccatggaggccaaga

SEQ ID NO: 206831 - DNA, 20 bp, Artificial
  CRISPR gRNA sequence
taccatggaggccaagagag

SEQ ID NO: 206832 - DNA, 20 bp, Artificial
  CRISPR gRNA sequence
ccatggaggccaagagagaa

SEQ ID NO: 206833 - DNA, 20 bp, Artificial
  CRISPR gRNA sequence
ggaggccaagagagaagagc

SEQ ID NO: 206834 - DNA, 20 bp, Artificial
  CRISPR gRNA sequence
gccaagagagaagagcaaga

SEQ ID NO: 206835 - DNA, 20 bp, Artificial
  CRISPR gRNA sequence
caagagagaagagcaagaaa

SEQ ID NO: 206836 - DNA, 20 bp, Artificial
  CRISPR gRNA sequence
gcaagaaagagactgcccac

SEQ ID NO: 206837 - DNA, 20 bp, Artificial
  CRISPR gRNA sequence
aagagactgcccactggctc

SEQ ID NO: 206838 - DNA, 20 bp, Artificial
  CRISPR gRNA sequence
gcccactggctcaagaactg

SEQ ID NO: 206839 - DNA, 20 bp, Artificial
  CRISPR gRNA sequence
ctggctcaagaactgtggaa

SEQ ID NO: 206840 - DNA, 20 bp, Artificial
  CRISPR gRNA sequence
tcaagaactgtggaaaagtc

SEQ ID NO: 206841 - DNA, 20 bp, Artificial
  CRISPR gRNA sequence
gaactgtggaaaagtcaaga

SEQ ID NO: 206842 - DNA, 20 bp, Artificial
  CRISPR gRNA sequence
tgtggaaaagtcaagacaga

SEQ ID NO: 206843 - DNA, 20 bp, Artificial
  CRISPR gRNA sequence
atgcatatttgatttttcac

SEQ ID NO: 206844 - DNA, 20 bp, Artificial
  CRISPR gRNA sequence
tgcatatttgatttttcaca

SEQ ID NO: 206845 - DNA, 20 bp, Artificial
  CRISPR gRNA sequence
gcatatttgatttttcacaa

SEQ ID NO: 206846 - DNA, 20 bp, Artificial
  CRISPR gRNA sequence
tttgatttttcacaagggat

SEQ ID NO: 206847 - DNA, 20 bp, Artificial
  CRISPR gRNA sequence
gatttttcacaagggattgg

SEQ ID NO: 206848 - DNA, 20 bp, Artificial
  CRISPR gRNA sequence
caagggattggtggtgactt

SEQ ID NO: 206849 - DNA, 20 bp, Artificial
  CRISPR gRNA sequence
ggattggtggtgactttggc

SEQ ID NO: 206850 - DNA, 20 bp, Artificial
  CRISPR gRNA sequence
attggtggtgactttggcaa

SEQ ID NO: 206851 - DNA, 20 bp, Artificial
  CRISPR gRNA sequence
ggtgactttggcaagagctg

SEQ ID NO: 206852 - DNA, 20 bp, Artificial
  CRISPR gRNA sequence
tggcaagagctgtagtaatg

SEQ ID NO: 206853 - DNA, 20 bp, Artificial
  CRISPR gRNA sequence
caagagctgtagtaatgaag

SEQ ID NO: 206854 - DNA, 20 bp, Artificial
  CRISPR gRNA sequence
gagctgtagtaatgaagaag

SEQ ID NO: 206855 - DNA, 20 bp, Artificial
  CRISPR gRNA sequence
agctgtagtaatgaagaagt

SEQ ID NO: 206856 - DNA, 20 bp, Artificial
  CRISPR gRNA sequence
gctgtagtaatgaagaagta

SEQ ID NO: 206857 - DNA, 20 bp, Artificial
  CRISPR gRNA sequence
ctgtagtaatgaagaagtag

SEQ ID NO: 206858 - DNA, 20 bp, Artificial
  CRISPR gRNA sequence
aatgaagaagtaggggtgaa

SEQ ID NO: 206859 - DNA, 20 bp, Artificial
  CRISPR gRNA sequence
atgaagaagtaggggtgaat

SEQ ID NO: 206860 - DNA, 20 bp, Artificial
  CRISPR gRNA sequence
aagaagtaggggtgaatggg

SEQ ID NO: 206861 - DNA, 20 bp, Artificial
  CRISPR gRNA sequence
gaagtaggggtgaatgggtg

SEQ ID NO: 206862 - DNA, 20 bp, Artificial
  CRISPR gRNA sequence
aagtaggggtgaatgggtgg

SEQ ID NO: 206863 - DNA, 20 bp, Artificial
  CRISPR gRNA sequence
aatgggtggaggccacgtaa

SEQ ID NO: 206864 - DNA, 20 bp, Artificial
  CRISPR gRNA sequence
ggaggccacgtaacagattt

SEQ ID NO: 206865 - DNA, 20 bp, Artificial
  CRISPR gRNA sequence
gaggccacgtaacagattta

SEQ ID NO: 206866 - DNA, 20 bp, Artificial
  CRISPR gRNA sequence
ggccacgtaacagatttaag

SEQ ID NO: 206867 - DNA, 20 bp, Artificial
  CRISPR gRNA sequence
aacagatttaaggagtgaat

SEQ ID NO: 206868 - DNA, 20 bp, Artificial
  CRISPR gRNA sequence
agatttaaggagtgaattgg

SEQ ID NO: 206869 - DNA, 20 bp, Artificial
  CRISPR gRNA sequence
ttaaggagtgaattggaagt

SEQ ID NO: 206870 - DNA, 20 bp, Artificial
  CRISPR gRNA sequence
taaggagtgaattggaagtg

SEQ ID NO: 206871 - DNA, 20 bp, Artificial
  CRISPR gRNA sequence
tggaagtgaggaaatgctta

SEQ ID NO: 206872 - DNA, 20 bp, Artificial
  CRISPR gRNA sequence
atgcttatagattgttaatt

SEQ ID NO: 206873 - DNA, 20 bp, Artificial
  CRISPR gRNA sequence
tgcttatagattgttaattt

SEQ ID NO: 206874 - DNA, 20 bp, Artificial
  CRISPR gRNA sequence
agattgttaatttgggatgc

SEQ ID NO: 206875 - DNA, 20 bp, Artificial
  CRISPR gRNA sequence
gattgttaatttgggatgct

SEQ ID NO: 206876 - DNA, 20 bp, Artificial
  CRISPR gRNA sequence
attgttaatttgggatgcta

SEQ ID NO: 206877 - DNA, 20 bp, Artificial
  CRISPR gRNA sequence
tgttaatttgggatgctagg

SEQ ID NO: 206878 - DNA, 20 bp, Artificial
  CRISPR gRNA sequence
ttaatttgggatgctaggga

SEQ ID NO: 206879 - DNA, 20 bp, Artificial
  CRISPR gRNA sequence
aatttgggatgctagggaga

SEQ ID NO: 206880 - DNA, 20 bp, Artificial
  CRISPR gRNA sequence
tgggatgctagggagagaga

SEQ ID NO: 206881 - DNA, 20 bp, Artificial
  CRISPR gRNA sequence
gctagggagagagaaagtat

SEQ ID NO: 206882 - DNA, 20 bp, Artificial
  CRISPR gRNA sequence
ctagggagagagaaagtatg

SEQ ID NO: 206883 - DNA, 20 bp, Artificial
  CRISPR gRNA sequence
tagggagagagaaagtatga

SEQ ID NO: 206884 - DNA, 20 bp, Artificial
  CRISPR gRNA sequence
aagtatgagggatttttttt

SEQ ID NO: 206885 - DNA, 20 bp, Artificial
  CRISPR gRNA sequence
atgagggattttttttaagt

SEQ ID NO: 206886 - DNA, 20 bp, Artificial
  CRISPR gRNA sequence
ttttaagttggcaaatattc

SEQ ID NO: 206887 - DNA, 20 bp, Artificial
  CRISPR gRNA sequence
aaatattcaagcaattttta

SEQ ID NO: 206888 - DNA, 20 bp, Artificial
  CRISPR gRNA sequence
caaaaacaacaccttgtaaa

SEQ ID NO: 206889 - DNA, 20 bp, Artificial
  CRISPR gRNA sequence
acaacaccttgtaaatggaa

SEQ ID NO: 206890 - DNA, 20 bp, Artificial
  CRISPR gRNA sequence
caacaccttgtaaatggaat

SEQ ID NO: 206891 - DNA, 20 bp, Artificial
  CRISPR gRNA sequence
aacaccttgtaaatggaatg

SEQ ID NO: 206892 - DNA, 20 bp, Artificial
  CRISPR gRNA sequence
acaccttgtaaatggaatgg

SEQ ID NO: 206893 - DNA, 20 bp, Artificial
  CRISPR gRNA sequence
tgtaaatggaatgggggatg

SEQ ID NO: 206894 - DNA, 20 bp, Artificial
  CRISPR gRNA sequence
gtaaatggaatgggggatgt

SEQ ID NO: 206895 - DNA, 20 bp, Artificial
  CRISPR gRNA sequence
aaatggaatgggggatgtgg

SEQ ID NO: 206896 - DNA, 20 bp, Artificial
  CRISPR gRNA sequence
aatggaatgggggatgtggg

SEQ ID NO: 206897 - DNA, 20 bp, Artificial
  CRISPR gRNA sequence
tgggaggctgataatcaact

SEQ ID NO: 206898 - DNA, 20 bp, Artificial
  CRISPR gRNA sequence
gggaggctgataatcaacta

SEQ ID NO: 206899 - DNA, 20 bp, Artificial
  CRISPR gRNA sequence
ggctgataatcaactaagga

SEQ ID NO: 206900 - DNA, 20 bp, Artificial
  CRISPR gRNA sequence
atcaactaaggaaagtcgtt

SEQ ID NO: 206901 - DNA, 20 bp, Artificial
  CRISPR gRNA sequence
tcaactaaggaaagtcgttg

SEQ ID NO: 206902 - DNA, 20 bp, Artificial
  CRISPR gRNA sequence
aactaaggaaagtcgttgag

SEQ ID NO: 206903 - DNA, 20 bp, Artificial
  CRISPR gRNA sequence
aaagtcgttgaggagactga

SEQ ID NO: 206904 - DNA, 20 bp, Artificial
  CRISPR gRNA sequence
aagtcgttgaggagactgat

SEQ ID NO: 206905 - DNA, 20 bp, Artificial
  CRISPR gRNA sequence
gttgaggagactgatgggta

SEQ ID NO: 206906 - DNA, 20 bp, Artificial
  CRISPR gRNA sequence
tgaggagactgatgggtatg

SEQ ID NO: 206907 - DNA, 20 bp, Artificial
  CRISPR gRNA sequence
gaggagactgatgggtatgg

SEQ ID NO: 206908 - DNA, 20 bp, Artificial
  CRISPR gRNA sequence
gagactgatgggtatggagg

SEQ ID NO: 206909 - DNA, 20 bp, Artificial
  CRISPR gRNA sequence
gatgggtatggaggcagaaa

SEQ ID NO: 206910 - DNA, 20 bp, Artificial
  CRISPR gRNA sequence
atggaggcagaaatggaaac

SEQ ID NO: 206911 - DNA, 20 bp, Artificial
  CRISPR gRNA sequence
cagaaatggaaactagcttt

SEQ ID NO: 206912 - DNA, 20 bp, Artificial
  CRISPR gRNA sequence
agaaatggaaactagctttc

SEQ ID NO: 206913 - DNA, 20 bp, Artificial
  CRISPR gRNA sequence
ggaaactagctttcaggtga

SEQ ID NO: 206914 - DNA, 20 bp, Artificial
  CRISPR gRNA sequence
gaaactagctttcaggtgat

SEQ ID NO: 206915 - DNA, 20 bp, Artificial
  CRISPR gRNA sequence
tcaggtgatgggattcattt

SEQ ID NO: 206916 - DNA, 20 bp, Artificial
  CRISPR gRNA sequence
tgatgggattcatttcagaa

SEQ ID NO: 206917 - DNA, 20 bp, Artificial
  CRISPR gRNA sequence
gatgggattcatttcagaaa

SEQ ID NO: 206918 - DNA, 20 bp, Artificial
  CRISPR gRNA sequence
gggattcatttcagaaaagg

SEQ ID NO: 206919 - DNA, 20 bp, Artificial
  CRISPR gRNA sequence
aaggaagcaaaaaaaaaaaa

SEQ ID NO: 206920 - DNA, 20 bp, Artificial
  CRISPR gRNA sequence
aggaagcaaaaaaaaaaaaa

SEQ ID NO: 206921 - DNA, 20 bp, Artificial
  CRISPR gRNA sequence
gcaaaaaaaaaaaaaaggtg

SEQ ID NO: 206922 - DNA, 20 bp, Artificial
  CRISPR gRNA sequence
aaaaaaaaaaaaggtgtgga

SEQ ID NO: 206923 - DNA, 20 bp, Artificial
  CRISPR gRNA sequence
aaaaaaaaggtgtggatagt

SEQ ID NO: 206924 - DNA, 20 bp, Artificial
  CRISPR gRNA sequence
aaaaaaaggtgtggatagtt

SEQ ID NO: 206925 - DNA, 20 bp, Artificial
  CRISPR gRNA sequence
aaaaaaggtgtggatagttg

SEQ ID NO: 206926 - DNA, 20 bp, Artificial
  CRISPR gRNA sequence
ggtgtggatagttggggtta

SEQ ID NO: 206927 - DNA, 20 bp, Artificial
  CRISPR gRNA sequence
gtgtggatagttggggttac

SEQ ID NO: 206928 - DNA, 20 bp, Artificial
  CRISPR gRNA sequence
tggatagttggggttacagg

SEQ ID NO: 206929 - DNA, 20 bp, Artificial
  CRISPR gRNA sequence
ggatagttggggttacaggt

SEQ ID NO: 206930 - DNA, 20 bp, Artificial
  CRISPR gRNA sequence
tggggttacaggtaggttta

SEQ ID NO: 206931 - DNA, 20 bp, Artificial
  CRISPR gRNA sequence
ggggttacaggtaggtttat

SEQ ID NO: 206932 - DNA, 20 bp, Artificial
  CRISPR gRNA sequence
gggttacaggtaggtttata

SEQ ID NO: 206933 - DNA, 20 bp, Artificial
  CRISPR gRNA sequence
ttacaggtaggtttataggg

SEQ ID NO: 206934 - DNA, 20 bp, Artificial
  CRISPR gRNA sequence
tacaggtaggtttataggga

SEQ ID NO: 206935 - DNA, 20 bp, Artificial
  CRISPR gRNA sequence
caggtaggtttatagggaag

SEQ ID NO: 206936 - DNA, 20 bp, Artificial
  CRISPR gRNA sequence
ggtttatagggaaggagtat

SEQ ID NO: 206937 - DNA, 20 bp, Artificial
  CRISPR gRNA sequence
ttatagggaaggagtattgg

SEQ ID NO: 206938 - DNA, 20 bp, Artificial
  CRISPR gRNA sequence
ggaaggagtattggaagctt

SEQ ID NO: 206939 - DNA, 20 bp, Artificial
  CRISPR gRNA sequence
gaaggagtattggaagcttc

SEQ ID NO: 206940 - DNA, 20 bp, Artificial
  CRISPR gRNA sequence
agcttcaggattctcctctg

SEQ ID NO: 206941 - DNA, 20 bp, Artificial
  CRISPR gRNA sequence
gcttcaggattctcctctga

SEQ ID NO: 206942 - DNA, 20 bp, Artificial
  CRISPR gRNA sequence
ggattctcctctgaaggttt

SEQ ID NO: 206943 - DNA, 20 bp, Artificial
  CRISPR gRNA sequence
tgaaggtttcagtttgtatt

SEQ ID NO: 206944 - DNA, 20 bp, Artificial
  CRISPR gRNA sequence
tttcagtttgtattaagaaa

SEQ ID NO: 206945 - DNA, 20 bp, Artificial
  CRISPR gRNA sequence
ttcagtttgtattaagaaat

SEQ ID NO: 206946 - DNA, 20 bp, Artificial
  CRISPR gRNA sequence
tcagtttgtattaagaaata

SEQ ID NO: 206947 - DNA, 20 bp, Artificial
  CRISPR gRNA sequence
agtttgtattaagaaatagg

SEQ ID NO: 206948 - DNA, 20 bp, Artificial
  CRISPR gRNA sequence
tttgtattaagaaataggga

SEQ ID NO: 206949 - DNA, 20 bp, Artificial
  CRISPR gRNA sequence
tgtattaagaaatagggaga

SEQ ID NO: 206950 - DNA, 20 bp, Artificial
  CRISPR gRNA sequence
gtattaagaaatagggagag

SEQ ID NO: 206951 - DNA, 20 bp, Artificial
  CRISPR gRNA sequence
aaatagggagagaggactgt

SEQ ID NO: 206952 - DNA, 20 bp, Artificial
  CRISPR gRNA sequence
atagggagagaggactgttg

SEQ ID NO: 206953 - DNA, 20 bp, Artificial
  CRISPR gRNA sequence
agggagagaggactgttgga

SEQ ID NO: 206954 - DNA, 20 bp, Artificial
  CRISPR gRNA sequence
gagaggactgttggagagta

SEQ ID NO: 206955 - DNA, 20 bp, Artificial
  CRISPR gRNA sequence
agaggactgttggagagtat

SEQ ID NO: 206956 - DNA, 20 bp, Artificial
  CRISPR gRNA sequence
ctgttggagagtatgggata

SEQ ID NO: 206957 - DNA, 20 bp, Artificial
  CRISPR gRNA sequence
tgttggagagtatgggataa

SEQ ID NO: 206958 - DNA, 20 bp, Artificial
  CRISPR gRNA sequence
gttggagagtatgggataaa

SEQ ID NO: 206959 - DNA, 20 bp, Artificial
  CRISPR gRNA sequence
ggagagtatgggataaaggg

SEQ ID NO: 206960 - DNA, 20 bp, Artificial
  CRISPR gRNA sequence
gagtatgggataaagggcag

SEQ ID NO: 206961 - DNA, 20 bp, Artificial
  CRISPR gRNA sequence
agtatgggataaagggcaga

SEQ ID NO: 206962 - DNA, 20 bp, Artificial
  CRISPR gRNA sequence
gtatgggataaagggcagaa

SEQ ID NO: 206963 - DNA, 20 bp, Artificial
  CRISPR gRNA sequence
atgggataaagggcagaagg

SEQ ID NO: 206964 - DNA, 20 bp, Artificial
  CRISPR gRNA sequence
agggcagaagggagtaattt

SEQ ID NO: 206965 - DNA, 20 bp, Artificial
  CRISPR gRNA sequence
ggcagaagggagtaatttaa

SEQ ID NO: 206966 - DNA, 20 bp, Artificial
  CRISPR gRNA sequence
gtaatttaagagttgttaaa

SEQ ID NO: 206967 - DNA, 20 bp, Artificial
  CRISPR gRNA sequence
atttaagagttgttaaaaag

SEQ ID NO: 206968 - DNA, 20 bp, Artificial
  CRISPR gRNA sequence
tttacatgaaatatgtaaaa

SEQ ID NO: 206969 - DNA, 20 bp, Artificial
  CRISPR gRNA sequence
atgaaatatgtaaaatggta

SEQ ID NO: 206970 - DNA, 20 bp, Artificial
  CRISPR gRNA sequence
atgtaaaatggtaaagattg

SEQ ID NO: 206971 - DNA, 20 bp, Artificial
  CRISPR gRNA sequence
tgtaaaatggtaaagattga

SEQ ID NO: 206972 - DNA, 20 bp, Artificial
  CRISPR gRNA sequence
aatggtaaagattgaaggcc

SEQ ID NO: 206973 - DNA, 20 bp, Artificial
  CRISPR gRNA sequence
tggtaaagattgaaggcccg

SEQ ID NO: 206974 - DNA, 20 bp, Artificial
  CRISPR gRNA sequence
ggtaaagattgaaggcccgg

SEQ ID NO: 206975 - DNA, 20 bp, Artificial
  CRISPR gRNA sequence
taaagattgaaggcccggag

SEQ ID NO: 206976 - DNA, 20 bp, Artificial
  CRISPR gRNA sequence
agattgaaggcccggaggag

SEQ ID NO: 206977 - DNA, 20 bp, Artificial
  CRISPR gRNA sequence
gattgaaggcccggaggagc

SEQ ID NO: 206978 - DNA, 20 bp, Artificial
  CRISPR gRNA sequence
attgaaggcccggaggagca

SEQ ID NO: 206979 - DNA, 20 bp, Artificial
  CRISPR gRNA sequence
attcttctgtttttgcctat

SEQ ID NO: 206980 - DNA, 20 bp, Artificial
  CRISPR gRNA sequence
attagcaacatgaattttct

SEQ ID NO: 206981 - DNA, 20 bp, Artificial
  CRISPR gRNA sequence
gaattttcttagaaatctgt

SEQ ID NO: 206982 - DNA, 20 bp, Artificial
  CRISPR gRNA sequence
ttactcttctgcccatccat

SEQ ID NO: 206983 - DNA, 20 bp, Artificial
  CRISPR gRNA sequence
tactcttctgcccatccata

SEQ ID NO: 206984 - DNA, 20 bp, Artificial
  CRISPR gRNA sequence
ccataaggacgttgtccatg

SEQ ID NO: 206985 - DNA, 20 bp, Artificial
  CRISPR gRNA sequence
aggacgttgtccatgcagaa

SEQ ID NO: 206986 - DNA, 20 bp, Artificial
  CRISPR gRNA sequence
atacttatcatcgcccattt

SEQ ID NO: 206987 - DNA, 20 bp, Artificial
  CRISPR gRNA sequence
atcgcccatttgagaattgt

SEQ ID NO: 206988 - DNA, 20 bp, Artificial
  CRISPR gRNA sequence
tgagaattgtaagctcctaa

SEQ ID NO: 206989 - DNA, 20 bp, Artificial
  CRISPR gRNA sequence
cctatcacaatatttcatca

SEQ ID NO: 206990 - DNA, 20 bp, Artificial
  CRISPR gRNA sequence
ctatcacaatatttcatcac

SEQ ID NO: 206991 - DNA, 20 bp, Artificial
  CRISPR gRNA sequence
cttgtgtgctgtgaccacca

SEQ ID NO: 206992 - DNA, 20 bp, Artificial
  CRISPR gRNA sequence
tgctgtgaccaccatggatt

SEQ ID NO: 206993 - DNA, 20 bp, Artificial
  CRISPR gRNA sequence
gagtcttctctgccactaca

SEQ ID NO: 206994 - DNA, 20 bp, Artificial
  CRISPR gRNA sequence
gccactacaaagctcttttc

SEQ ID NO: 206995 - DNA, 20 bp, Artificial
  CRISPR gRNA sequence
tcttttctagactatgatat

SEQ ID NO: 206996 - DNA, 20 bp, Artificial
  CRISPR gRNA sequence
ttctagactatgatatgaga

SEQ ID NO: 206997 - DNA, 20 bp, Artificial
  CRISPR gRNA sequence
gactatgatatgagatggtt

SEQ ID NO: 206998 - DNA, 20 bp, Artificial
  CRISPR gRNA sequence
actatgatatgagatggttt

SEQ ID NO: 206999 - DNA, 20 bp, Artificial
  CRISPR gRNA sequence
tatgagatggtttgggctga

SEQ ID NO: 207000 - DNA, 20 bp, Artificial
  CRISPR gRNA sequence
tatattcaccaatacttgta

SEQ ID NO: 207001 - DNA, 20 bp, Artificial
  CRISPR gRNA sequence
atacttgtacagttccaatg

SEQ ID NO: 207002 - DNA, 20 bp, Artificial
  CRISPR gRNA sequence
tacttgtacagttccaatga

SEQ ID NO: 207003 - DNA, 20 bp, Artificial
  CRISPR gRNA sequence
acagttccaatgaaggtttc

SEQ ID NO: 207004 - DNA, 20 bp, Artificial
  CRISPR gRNA sequence
ggtttcaagtctaatacttt

SEQ ID NO: 207005 - DNA, 20 bp, Artificial
  CRISPR gRNA sequence
tgctaatttatctataactc

SEQ ID NO: 207006 - DNA, 20 bp, Artificial
  CRISPR gRNA sequence
tataactctggcattactct

SEQ ID NO: 207007 - DNA, 20 bp, Artificial
  CRISPR gRNA sequence
ttgtctgctgctatctgatt

SEQ ID NO: 207008 - DNA, 20 bp, Artificial
  CRISPR gRNA sequence
tatctgatttagactgctat

SEQ ID NO: 207009 - DNA, 20 bp, Artificial
  CRISPR gRNA sequence
ataagcatatcttgtttatt

SEQ ID NO: 207010 - DNA, 20 bp, Artificial
  CRISPR gRNA sequence
aagcatatcttgtttattca

SEQ ID NO: 207011 - DNA, 20 bp, Artificial
  CRISPR gRNA sequence
tttgctctctacattttaaa

SEQ ID NO: 207012 - DNA, 20 bp, Artificial
  CRISPR gRNA sequence
tcttcactttgctgttttat

SEQ ID NO: 207013 - DNA, 20 bp, Artificial
  CRISPR gRNA sequence
tcactttgctgttttatgag

SEQ ID NO: 207014 - DNA, 20 bp, Artificial
  CRISPR gRNA sequence
cactttgctgttttatgaga

SEQ ID NO: 207015 - DNA, 20 bp, Artificial
  CRISPR gRNA sequence
actttgctgttttatgagaa

SEQ ID NO: 207016 - DNA, 20 bp, Artificial
  CRISPR gRNA sequence
tttgctgttttatgagaagg

SEQ ID NO: 207017 - DNA, 20 bp, Artificial
  CRISPR gRNA sequence
gctgttttatgagaagggag

SEQ ID NO: 207018 - DNA, 20 bp, Artificial
  CRISPR gRNA sequence
ctgttttatgagaagggagt

SEQ ID NO: 207019 - DNA, 20 bp, Artificial
  CRISPR gRNA sequence
tatgagaagggagtaggcaa

SEQ ID NO: 207020 - DNA, 20 bp, Artificial
  CRISPR gRNA sequence
atgagaagggagtaggcaaa

SEQ ID NO: 207021 - DNA, 20 bp, Artificial
  CRISPR gRNA sequence
aaaaggaaaaaaccccaaat

SEQ ID NO: 207022 - DNA, 20 bp, Artificial
  CRISPR gRNA sequence
ggaaaaaaccccaaatcaga

SEQ ID NO: 207023 - DNA, 20 bp, Artificial
  CRISPR gRNA sequence
cagacagttttactacttaa

SEQ ID NO: 207024 - DNA, 20 bp, Artificial
  CRISPR gRNA sequence
agttttttaatgcatcttta

SEQ ID NO: 207025 - DNA, 20 bp, Artificial
  CRISPR gRNA sequence
ttttttaatgcatctttata

SEQ ID NO: 207026 - DNA, 20 bp, Artificial
  CRISPR gRNA sequence
atgcatctttatagagattg

SEQ ID NO: 207027 - DNA, 20 bp, Artificial
  CRISPR gRNA sequence
ctttatagagattgaagttg

SEQ ID NO: 207028 - DNA, 20 bp, Artificial
  CRISPR gRNA sequence
gagattgaagttgtagttaa

SEQ ID NO: 207029 - DNA, 20 bp, Artificial
  CRISPR gRNA sequence
ttgaagttgtagttaacagc

SEQ ID NO: 207030 - DNA, 20 bp, Artificial
  CRISPR gRNA sequence
gaagttgtagttaacagcta

SEQ ID NO: 207031 - DNA, 20 bp, Artificial
  CRISPR gRNA sequence
aacagctagagtgatatttt

SEQ ID NO: 207032 - DNA, 20 bp, Artificial
  CRISPR gRNA sequence
tgcccttatttattaattac

SEQ ID NO: 207033 - DNA, 20 bp, Artificial
  CRISPR gRNA sequence
atttattaattactagtgca

SEQ ID NO: 207034 - DNA, 20 bp, Artificial
  CRISPR gRNA sequence
tttattaattactagtgcaa

SEQ ID NO: 207035 - DNA, 20 bp, Artificial
  CRISPR gRNA sequence
tgcaaaggttattcaaattg

SEQ ID NO: 207036 - DNA, 20 bp, Artificial
  CRISPR gRNA sequence
tattcaaattgtggtttatc

SEQ ID NO: 207037 - DNA, 20 bp, Artificial
  CRISPR gRNA sequence
attcaaattgtggtttatcc

SEQ ID NO: 207038 - DNA, 20 bp, Artificial
  CRISPR gRNA sequence
tttactgttatttttactaa

SEQ ID NO: 207039 - DNA, 20 bp, Artificial
  CRISPR gRNA sequence
ttattctacttaaattgctt

SEQ ID NO: 207040 - DNA, 20 bp, Artificial
  CRISPR gRNA sequence
ttttattgtaacaaataatg

SEQ ID NO: 207041 - DNA, 20 bp, Artificial
  CRISPR gRNA sequence
tctaaacatatgttatgaaa

SEQ ID NO: 207042 - DNA, 20 bp, Artificial
  CRISPR gRNA sequence
aaacatatgttatgaaatgg

SEQ ID NO: 207043 - DNA, 20 bp, Artificial
  CRISPR gRNA sequence
acttcttacttacttaatta

SEQ ID NO: 207044 - DNA, 20 bp, Artificial
  CRISPR gRNA sequence
ttaattaaagcctttgcaaa

SEQ ID NO: 207045 - DNA, 20 bp, Artificial
  CRISPR gRNA sequence
agcctttgcaaaaagtttca

SEQ ID NO: 207046 - DNA, 20 bp, Artificial
  CRISPR gRNA sequence
gcctttgcaaaaagtttcat

SEQ ID NO: 207047 - DNA, 20 bp, Artificial
  CRISPR gRNA sequence
aaaagtttcataggatgact

SEQ ID NO: 207048 - DNA, 20 bp, Artificial
  CRISPR gRNA sequence
cattcgtacctctttttttt

SEQ ID NO: 207049 - DNA, 20 bp, Artificial
  CRISPR gRNA sequence
ttttaagaataatctcttga

SEQ ID NO: 207050 - DNA, 20 bp, Artificial
  CRISPR gRNA sequence
tataaaatgaacatgtgtca

SEQ ID NO: 207051 - DNA, 20 bp, Artificial
  CRISPR gRNA sequence
tatttcactaattaattaac

SEQ ID NO: 207052 - DNA, 20 bp, Artificial
  CRISPR gRNA sequence
taattaattaacaagcaaac

SEQ ID NO: 207053 - DNA, 20 bp, Artificial
  CRISPR gRNA sequence
taattaacaagcaaactagc

SEQ ID NO: 207054 - DNA, 20 bp, Artificial
  CRISPR gRNA sequence
ttaacaagcaaactagcaag

SEQ ID NO: 207055 - DNA, 20 bp, Artificial
  CRISPR gRNA sequence
taacaagcaaactagcaaga

SEQ ID NO: 207056 - DNA, 20 bp, Artificial
  CRISPR gRNA sequence
agaaggcaaaacccttttaa

SEQ ID NO: 207057 - DNA, 20 bp, Artificial
  CRISPR gRNA sequence
aaacccttttaaaagaaaat

SEQ ID NO: 207058 - DNA, 20 bp, Artificial
  CRISPR gRNA sequence
ttaaaagaaaattggaaaaa

SEQ ID NO: 207059 - DNA, 20 bp, Artificial
  CRISPR gRNA sequence
tggaaaaacagacacattta

SEQ ID NO: 207060 - DNA, 20 bp, Artificial
  CRISPR gRNA sequence
ggaaaaacagacacatttat

SEQ ID NO: 207061 - DNA, 20 bp, Artificial
  CRISPR gRNA sequence
agacacatttataggcaatc

SEQ ID NO: 207062 - DNA, 20 bp, Artificial
  CRISPR gRNA sequence
tttgctaataaatgcaaaat

SEQ ID NO: 207063 - DNA, 20 bp, Artificial
  CRISPR gRNA sequence
gcaaaattggtcaatatcct

SEQ ID NO: 207064 - DNA, 20 bp, Artificial
  CRISPR gRNA sequence
caaaattggtcaatatcctc

SEQ ID NO: 207065 - DNA, 20 bp, Artificial
  CRISPR gRNA sequence
aaaattggtcaatatcctca

SEQ ID NO: 207066 - DNA, 20 bp, Artificial
  CRISPR gRNA sequence
attggtcaatatcctcaggg

SEQ ID NO: 207067 - DNA, 20 bp, Artificial
  CRISPR gRNA sequence
atcctcagggcagtaaaatg

SEQ ID NO: 207068 - DNA, 20 bp, Artificial
  CRISPR gRNA sequence
ggcagtaaaatgtagtcttt

SEQ ID NO: 207069 - DNA, 20 bp, Artificial
  CRISPR gRNA sequence
tttggaatcctctcttccac

SEQ ID NO: 207070 - DNA, 20 bp, Artificial
  CRISPR gRNA sequence
ttggaatcctctcttccacc

SEQ ID NO: 207071 - DNA, 20 bp, Artificial
  CRISPR gRNA sequence
gaatcctctcttccaccagg

SEQ ID NO: 207072 - DNA, 20 bp, Artificial
  CRISPR gRNA sequence
caccaggtggaaatcaattg

SEQ ID NO: 207073 - DNA, 20 bp, Artificial
  CRISPR gRNA sequence
gtggaaatcaattgcagaac

SEQ ID NO: 207074 - DNA, 20 bp, Artificial
  CRISPR gRNA sequence
aagatttatttttatctgta

SEQ ID NO: 207075 - DNA, 20 bp, Artificial
  CRISPR gRNA sequence
tttatttttatctgtatgga

SEQ ID NO: 207076 - DNA, 20 bp, Artificial
  CRISPR gRNA sequence
caatccatttgaattactct

SEQ ID NO: 207077 - DNA, 20 bp, Artificial
  CRISPR gRNA sequence
caacttatgaaactgtaaaa

SEQ ID NO: 207078 - DNA, 20 bp, Artificial
  CRISPR gRNA sequence
tatgaaactgtaaaacagcc

SEQ ID NO: 207079 - DNA, 20 bp, Artificial
  CRISPR gRNA sequence
actgtaaaacagcccagtca

SEQ ID NO: 207080 - DNA, 20 bp, Artificial
  CRISPR gRNA sequence
taaaacagcccagtcaaagt

SEQ ID NO: 207081 - DNA, 20 bp, Artificial
  CRISPR gRNA sequence
agcccagtcaaagtcagtga

SEQ ID NO: 207082 - DNA, 20 bp, Artificial
  CRISPR gRNA sequence
gcccagtcaaagtcagtgaa

SEQ ID NO: 207083 - DNA, 20 bp, Artificial
  CRISPR gRNA sequence
gtcaaagtcagtgaaaggca

SEQ ID NO: 207084 - DNA, 20 bp, Artificial
  CRISPR gRNA sequence
tcaaagtcagtgaaaggcac

SEQ ID NO: 207085 - DNA, 20 bp, Artificial
  CRISPR gRNA sequence
gtgaaaggcacaggcttcta

SEQ ID NO: 207086 - DNA, 20 bp, Artificial
  CRISPR gRNA sequence
gaaaggcacaggcttctata

SEQ ID NO: 207087 - DNA, 20 bp, Artificial
  CRISPR gRNA sequence
ggcacaggcttctatagagt

SEQ ID NO: 207088 - DNA, 20 bp, Artificial
  CRISPR gRNA sequence
tatagagtcagataattcca

SEQ ID NO: 207089 - DNA, 20 bp, Artificial
  CRISPR gRNA sequence
gataattccaaagcgtctgt

SEQ ID NO: 207090 - DNA, 20 bp, Artificial
  CRISPR gRNA sequence
agcgtctgttagacattgcc

SEQ ID NO: 207091 - DNA, 20 bp, Artificial
  CRISPR gRNA sequence
attgcccagcacttgactga

SEQ ID NO: 207092 - DNA, 20 bp, Artificial
  CRISPR gRNA sequence
ttgcccagcacttgactgaa

SEQ ID NO: 207093 - DNA, 20 bp, Artificial
  CRISPR gRNA sequence
cacttgactgaaaggatacc

SEQ ID NO: 207094 - DNA, 20 bp, Artificial
  CRISPR gRNA sequence
ttgactgaaaggatacccag

SEQ ID NO: 207095 - DNA, 20 bp, Artificial
  CRISPR gRNA sequence
ttcacccctttattcttctc

SEQ ID NO: 207096 - DNA, 20 bp, Artificial
  CRISPR gRNA sequence
atactatgtcctctctccct

SEQ ID NO: 207097 - DNA, 20 bp, Artificial
  CRISPR gRNA sequence
ctccctcagtgtttctctct

SEQ ID NO: 207098 - DNA, 20 bp, Artificial
  CRISPR gRNA sequence
tccctcagtgtttctctctc

SEQ ID NO: 207099 - DNA, 20 bp, Artificial
  CRISPR gRNA sequence
ccctcagtgtttctctctca

SEQ ID NO: 207100 - DNA, 20 bp, Artificial
  CRISPR gRNA sequence
cctcagtgtttctctctcag

SEQ ID NO: 207101 - DNA, 20 bp, Artificial
  CRISPR gRNA sequence
ggaaataattcacaattcca

SEQ ID NO: 207102 - DNA, 20 bp, Artificial
  CRISPR gRNA sequence
ttcacaattccaaagtttta

SEQ ID NO: 207103 - DNA, 20 bp, Artificial
  CRISPR gRNA sequence
caaagttttaaagaatgcaa

SEQ ID NO: 207104 - DNA, 20 bp, Artificial
  CRISPR gRNA sequence
agttttaaagaatgcaacgg

SEQ ID NO: 207105 - DNA, 20 bp, Artificial
  CRISPR gRNA sequence
taaagaatgcaacggaagtc

SEQ ID NO: 207106 - DNA, 20 bp, Artificial
  CRISPR gRNA sequence
aaagaatgcaacggaagtcc

SEQ ID NO: 207107 - DNA, 20 bp, Artificial
  CRISPR gRNA sequence
cggaagtccaggttttgcct

SEQ ID NO: 207108 - DNA, 20 bp, Artificial
  CRISPR gRNA sequence
ggaagtccaggttttgcctt

SEQ ID NO: 207109 - DNA, 20 bp, Artificial
  CRISPR gRNA sequence
aggttttgccttgggcttcc

SEQ ID NO: 207110 - DNA, 20 bp, Artificial
  CRISPR gRNA sequence
gccttgggcttcctagtatt

SEQ ID NO: 207111 - DNA, 20 bp, Artificial
  CRISPR gRNA sequence
ccttgggcttcctagtattt

SEQ ID NO: 207112 - DNA, 20 bp, Artificial
  CRISPR gRNA sequence
tgggcttcctagtatttggg

SEQ ID NO: 207113 - DNA, 20 bp, Artificial
  CRISPR gRNA sequence
cttcctagtatttgggtggc

SEQ ID NO: 207114 - DNA, 20 bp, Artificial
  CRISPR gRNA sequence
tatttgggtggctagaaatg

SEQ ID NO: 207115 - DNA, 20 bp, Artificial
  CRISPR gRNA sequence
tggctagaaatgtagaaaac

SEQ ID NO: 207116 - DNA, 20 bp, Artificial
  CRISPR gRNA sequence
ggctagaaatgtagaaaact

SEQ ID NO: 207117 - DNA, 20 bp, Artificial
  CRISPR gRNA sequence
tagaaatgtagaaaactggg

SEQ ID NO: 207118 - DNA, 20 bp, Artificial
  CRISPR gRNA sequence
gaaatgtagaaaactgggaa

SEQ ID NO: 207119 - DNA, 20 bp, Artificial
  CRISPR gRNA sequence
aaatgtagaaaactgggaag

SEQ ID NO: 207120 - DNA, 20 bp, Artificial
  CRISPR gRNA sequence
gtagaaaactgggaagaggt

SEQ ID NO: 207121 - DNA, 20 bp, Artificial
  CRISPR gRNA sequence
aactgggaagaggtgagctg

SEQ ID NO: 207122 - DNA, 20 bp, Artificial
  CRISPR gRNA sequence
agctgtggatgcccacaata

SEQ ID NO: 207123 - DNA, 20 bp, Artificial
  CRISPR gRNA sequence
gctgtggatgcccacaatat

SEQ ID NO: 207124 - DNA, 20 bp, Artificial
  CRISPR gRNA sequence
ggatgcccacaatataggtt

SEQ ID NO: 207125 - DNA, 20 bp, Artificial
  CRISPR gRNA sequence
aggttcagactgcaatttcc

SEQ ID NO: 207126 - DNA, 20 bp, Artificial
  CRISPR gRNA sequence
ttcccagaaatataacaatt

SEQ ID NO: 207127 - DNA, 20 bp, Artificial
  CRISPR gRNA sequence
agaaatataacaatttggac

SEQ ID NO: 207128 - DNA, 20 bp, Artificial
  CRISPR gRNA sequence
ataacaatttggactagtca

SEQ ID NO: 207129 - DNA, 20 bp, Artificial
  CRISPR gRNA sequence
aacaatttggactagtcaaa

SEQ ID NO: 207130 - DNA, 20 bp, Artificial
  CRISPR gRNA sequence
acaatttggactagtcaaag

SEQ ID NO: 207131 - DNA, 20 bp, Artificial
  CRISPR gRNA sequence
caatttggactagtcaaaga

SEQ ID NO: 207132 - DNA, 20 bp, Artificial
  CRISPR gRNA sequence
atatcattacattaaaatgc

SEQ ID NO: 207133 - DNA, 20 bp, Artificial
  CRISPR gRNA sequence
cattaaaatgccagattatc

SEQ ID NO: 207134 - DNA, 20 bp, Artificial
  CRISPR gRNA sequence
gccagattatctagttttta

SEQ ID NO: 207135 - DNA, 20 bp, Artificial
  CRISPR gRNA sequence
agtatcaccctacattttta

SEQ ID NO: 207136 - DNA, 20 bp, Artificial
  CRISPR gRNA sequence
caccctacatttttacagca

SEQ ID NO: 207137 - DNA, 20 bp, Artificial
  CRISPR gRNA sequence
ttttacagcatagtattgtt

SEQ ID NO: 207138 - DNA, 20 bp, Artificial
  CRISPR gRNA sequence
ttacagcatagtattgttta

SEQ ID NO: 207139 - DNA, 20 bp, Artificial
  CRISPR gRNA sequence
acagcatagtattgtttaga

SEQ ID NO: 207140 - DNA, 20 bp, Artificial
  CRISPR gRNA sequence
ttccatgttaatgctcaaca

SEQ ID NO: 207141 - DNA, 20 bp, Artificial
  CRISPR gRNA sequence
atgctcaacacagttctgtg

SEQ ID NO: 207142 - DNA, 20 bp, Artificial
  CRISPR gRNA sequence
ctcaacacagttctgtgaag

SEQ ID NO: 207143 - DNA, 20 bp, Artificial
  CRISPR gRNA sequence
cacagttctgtgaagtagcc

SEQ ID NO: 207144 - DNA, 20 bp, Artificial
  CRISPR gRNA sequence
tgtttttgatcctcctactt

SEQ ID NO: 207145 - DNA, 20 bp, Artificial
  CRISPR gRNA sequence
tttttgatcctcctacttaa

SEQ ID NO: 207146 - DNA, 20 bp, Artificial
  CRISPR gRNA sequence
cttaagagatcctcctattt

SEQ ID NO: 207147 - DNA, 20 bp, Artificial
  CRISPR gRNA sequence
taagagatcctcctatttta

SEQ ID NO: 207148 - DNA, 20 bp, Artificial
  CRISPR gRNA sequence
agagatcctcctattttaga

SEQ ID NO: 207149 - DNA, 20 bp, Artificial
  CRISPR gRNA sequence
cctattttagagagtaaacc

SEQ ID NO: 207150 - DNA, 20 bp, Artificial
  CRISPR gRNA sequence
ctattttagagagtaaacca

SEQ ID NO: 207151 - DNA, 20 bp, Artificial
  CRISPR gRNA sequence
ttagagagtaaaccaaggca

SEQ ID NO: 207152 - DNA, 20 bp, Artificial
  CRISPR gRNA sequence
gagtaaaccaaggcatagaa

SEQ ID NO: 207153 - DNA, 20 bp, Artificial
  CRISPR gRNA sequence
aaaccaaggcatagaaaagt

SEQ ID NO: 207154 - DNA, 20 bp, Artificial
  CRISPR gRNA sequence
catagaaaagtgagttgctt

SEQ ID NO: 207155 - DNA, 20 bp, Artificial
  CRISPR gRNA sequence
atagaaaagtgagttgctta

SEQ ID NO: 207156 - DNA, 20 bp, Artificial
  CRISPR gRNA sequence
gaaaagtgagttgcttaagg

SEQ ID NO: 207157 - DNA, 20 bp, Artificial
  CRISPR gRNA sequence
gcttaaggcagcatattaaa

SEQ ID NO: 207158 - DNA, 20 bp, Artificial
  CRISPR gRNA sequence
cttaaggcagcatattaaaa

SEQ ID NO: 207159 - DNA, 20 bp, Artificial
  CRISPR gRNA sequence
ttaaggcagcatattaaaaa

SEQ ID NO: 207160 - DNA, 20 bp, Artificial
  CRISPR gRNA sequence
taaggcagcatattaaaaag

SEQ ID NO: 207161 - DNA, 20 bp, Artificial
  CRISPR gRNA sequence
ggcagcatattaaaaagggg

SEQ ID NO: 207162 - DNA, 20 bp, Artificial
  CRISPR gRNA sequence
atattaaaaaggggcagaaa

SEQ ID NO: 207163 - DNA, 20 bp, Artificial
  CRISPR gRNA sequence
gcagaaatagtatttttact

SEQ ID NO: 207164 - DNA, 20 bp, Artificial
  CRISPR gRNA sequence
cagaaatagtatttttactc

SEQ ID NO: 207165 - DNA, 20 bp, Artificial
  CRISPR gRNA sequence
caggtgttttgaacattgtc

SEQ ID NO: 207166 - DNA, 20 bp, Artificial
  CRISPR gRNA sequence
attgtccagtacctatattc

SEQ ID NO: 207167 - DNA, 20 bp, Artificial
  CRISPR gRNA sequence
gcatccttgcattcaattca

SEQ ID NO: 207168 - DNA, 20 bp, Artificial
  CRISPR gRNA sequence
catccttgcattcaattcat

SEQ ID NO: 207169 - DNA, 20 bp, Artificial
  CRISPR gRNA sequence
atccttgcattcaattcatg

SEQ ID NO: 207170 - DNA, 20 bp, Artificial
  CRISPR gRNA sequence
caattcatggggtatttatt

SEQ ID NO: 207171 - DNA, 20 bp, Artificial
  CRISPR gRNA sequence
gggtatttattgagtaaaca

SEQ ID NO: 207172 - DNA, 20 bp, Artificial
  CRISPR gRNA sequence
taaacatagtgttcttacaa

SEQ ID NO: 207173 - DNA, 20 bp, Artificial
  CRISPR gRNA sequence
tatgcctctgatttttattc

SEQ ID NO: 207174 - DNA, 20 bp, Artificial
  CRISPR gRNA sequence
gatttttattccagtttatg

SEQ ID NO: 207175 - DNA, 20 bp, Artificial
  CRISPR gRNA sequence
ttttattccagtttatgtag

SEQ ID NO: 207176 - DNA, 20 bp, Artificial
  CRISPR gRNA sequence
tttatgtagaagtaaatctt

SEQ ID NO: 207177 - DNA, 20 bp, Artificial
  CRISPR gRNA sequence
ttaagtgtgaactattaaca

SEQ ID NO: 207178 - DNA, 20 bp, Artificial
  CRISPR gRNA sequence
gatattttatttatatttgt

SEQ ID NO: 207179 - DNA, 20 bp, Artificial
  CRISPR gRNA sequence
tttgtttttgtttatgtttt

SEQ ID NO: 207180 - DNA, 20 bp, Artificial
  CRISPR gRNA sequence
ttgtttttgtttatgttttg

SEQ ID NO: 207181 - DNA, 20 bp, Artificial
  CRISPR gRNA sequence
tgtttttgtttatgttttga

SEQ ID NO: 207182 - DNA, 20 bp, Artificial
  CRISPR gRNA sequence
gtttttgtttatgttttgag

SEQ ID NO: 207183 - DNA, 20 bp, Artificial
  CRISPR gRNA sequence
tttgtttatgttttgagggg

SEQ ID NO: 207184 - DNA, 20 bp, Artificial
  CRISPR gRNA sequence
ttgtttatgttttgagggga

SEQ ID NO: 207185 - DNA, 20 bp, Artificial
  CRISPR gRNA sequence
tatgttttgaggggaaggcc

SEQ ID NO: 207186 - DNA, 20 bp, Artificial
  CRISPR gRNA sequence
gttttgaggggaaggccaag

SEQ ID NO: 207187 - DNA, 20 bp, Artificial
  CRISPR gRNA sequence
gggaaggccaagtagctact

SEQ ID NO: 207188 - DNA, 20 bp, Artificial
  CRISPR gRNA sequence
ggaaggccaagtagctactt

SEQ ID NO: 207189 - DNA, 20 bp, Artificial
  CRISPR gRNA sequence
ccaagtagctacttaggtaa

SEQ ID NO: 207190 - DNA, 20 bp, Artificial
  CRISPR gRNA sequence
aagtagctacttaggtaaaa

SEQ ID NO: 207191 - DNA, 20 bp, Artificial
  CRISPR gRNA sequence
acttaggtaaaagagttgct

SEQ ID NO: 207192 - DNA, 20 bp, Artificial
  CRISPR gRNA sequence
taggtaaaagagttgctgag

SEQ ID NO: 207193 - DNA, 20 bp, Artificial
  CRISPR gRNA sequence
aaagagttgctgagtggctg

SEQ ID NO: 207194 - DNA, 20 bp, Artificial
  CRISPR gRNA sequence
tgctgagtggctgaagaata

SEQ ID NO: 207195 - DNA, 20 bp, Artificial
  CRISPR gRNA sequence
tgagtggctgaagaatatgg

SEQ ID NO: 207196 - DNA, 20 bp, Artificial
  CRISPR gRNA sequence
ctacacattcttgtacattt

SEQ ID NO: 207197 - DNA, 20 bp, Artificial
  CRISPR gRNA sequence
gtacattttagttgaacaat

SEQ ID NO: 207198 - DNA, 20 bp, Artificial
  CRISPR gRNA sequence
agtgattacatttatttacc

SEQ ID NO: 207199 - DNA, 20 bp, Artificial
  CRISPR gRNA sequence
ttacccagtgcctcttctat

SEQ ID NO: 207200 - DNA, 20 bp, Artificial
  CRISPR gRNA sequence
tacccagtgcctcttctata

SEQ ID NO: 207201 - DNA, 20 bp, Artificial
  CRISPR gRNA sequence
ctcttctataaggcaacaac

SEQ ID NO: 207202 - DNA, 20 bp, Artificial
  CRISPR gRNA sequence
ttctataaggcaacaactgg

SEQ ID NO: 207203 - DNA, 20 bp, Artificial
  CRISPR gRNA sequence
aactggtagtttatcctatt

SEQ ID NO: 207204 - DNA, 20 bp, Artificial
  CRISPR gRNA sequence
tggtagtttatcctattgag

SEQ ID NO: 207205 - DNA, 20 bp, Artificial
  CRISPR gRNA sequence
gtttatcctattgagaagcg

SEQ ID NO: 207206 - DNA, 20 bp, Artificial
  CRISPR gRNA sequence
atcctattgagaagcgtaga

SEQ ID NO: 207207 - DNA, 20 bp, Artificial
  CRISPR gRNA sequence
tcctattgagaagcgtagat

SEQ ID NO: 207208 - DNA, 20 bp, Artificial
  CRISPR gRNA sequence
agcgtagataggatgcttat

SEQ ID NO: 207209 - DNA, 20 bp, Artificial
  CRISPR gRNA sequence
gtagataggatgcttattag

SEQ ID NO: 207210 - DNA, 20 bp, Artificial
  CRISPR gRNA sequence
ttattagcagtaactgctct

SEQ ID NO: 207211 - DNA, 20 bp, Artificial
  CRISPR gRNA sequence
gtttcaacttgcatcttact

SEQ ID NO: 207212 - DNA, 20 bp, Artificial
  CRISPR gRNA sequence
ttagctttttcaccgttttg

SEQ ID NO: 207213 - DNA, 20 bp, Artificial
  CRISPR gRNA sequence
ttcaccgttttgtggtttct

SEQ ID NO: 207214 - DNA, 20 bp, Artificial
  CRISPR gRNA sequence
caccgttttgtggtttcttg

SEQ ID NO: 207215 - DNA, 20 bp, Artificial
  CRISPR gRNA sequence
accgttttgtggtttcttgg

SEQ ID NO: 207216 - DNA, 20 bp, Artificial
  CRISPR gRNA sequence
gttttgtggtttcttggagg

SEQ ID NO: 207217 - DNA, 20 bp, Artificial
  CRISPR gRNA sequence
gaatacccataatatacatt

SEQ ID NO: 207218 - DNA, 20 bp, Artificial
  CRISPR gRNA sequence
atacccataatatacatttg

SEQ ID NO: 207219 - DNA, 20 bp, Artificial
  CRISPR gRNA sequence
atttggagactgttgttctg

SEQ ID NO: 207220 - DNA, 20 bp, Artificial
  CRISPR gRNA sequence
tctgtagtgtcaatgaaatg

SEQ ID NO: 207221 - DNA, 20 bp, Artificial
  CRISPR gRNA sequence
ctgtagtgtcaatgaaatgt

SEQ ID NO: 207222 - DNA, 20 bp, Artificial
  CRISPR gRNA sequence
tgtagtgtcaatgaaatgtg

SEQ ID NO: 207223 - DNA, 20 bp, Artificial
  CRISPR gRNA sequence
gtagtgtcaatgaaatgtgg

SEQ ID NO: 207224 - DNA, 20 bp, Artificial
  CRISPR gRNA sequence
gtgtcaatgaaatgtggggg

SEQ ID NO: 207225 - DNA, 20 bp, Artificial
  CRISPR gRNA sequence
tgtcaatgaaatgtgggggt

SEQ ID NO: 207226 - DNA, 20 bp, Artificial
  CRISPR gRNA sequence
ggggtgggaaaatgtcattc

SEQ ID NO: 207227 - DNA, 20 bp, Artificial
  CRISPR gRNA sequence
ttgctgcctatattttgcta

SEQ ID NO: 207228 - DNA, 20 bp, Artificial
  CRISPR gRNA sequence
tgctgcctatattttgctat

SEQ ID NO: 207229 - DNA, 20 bp, Artificial
  CRISPR gRNA sequence
gcctatattttgctatggga

SEQ ID NO: 207230 - DNA, 20 bp, Artificial
  CRISPR gRNA sequence
tatattttgctatgggaaag

SEQ ID NO: 207231 - DNA, 20 bp, Artificial
  CRISPR gRNA sequence
ttgctatgggaaagtagcca

SEQ ID NO: 207232 - DNA, 20 bp, Artificial
  CRISPR gRNA sequence
aatgttttttttttcctcat

SEQ ID NO: 207233 - DNA, 20 bp, Artificial
  CRISPR gRNA sequence
tttttcctcattagtatttt

SEQ ID NO: 207234 - DNA, 20 bp, Artificial
  CRISPR gRNA sequence
tattttaagattttccatcc

SEQ ID NO: 207235 - DNA, 20 bp, Artificial
  CRISPR gRNA sequence
tttaagattttccatcctag

SEQ ID NO: 207236 - DNA, 20 bp, Artificial
  CRISPR gRNA sequence
agattttccatcctagtgga

SEQ ID NO: 207237 - DNA, 20 bp, Artificial
  CRISPR gRNA sequence
cctatttactttgtatatta

SEQ ID NO: 207238 - DNA, 20 bp, Artificial
  CRISPR gRNA sequence
ttactttgtatattaaagta

SEQ ID NO: 207239 - DNA, 20 bp, Artificial
  CRISPR gRNA sequence
ctttgtatattaaagtacag

SEQ ID NO: 207240 - DNA, 20 bp, Artificial
  CRISPR gRNA sequence
gtagaacctgccactttttt

SEQ ID NO: 207241 - DNA, 20 bp, Artificial
  CRISPR gRNA sequence
tgccactttttttggaaatg

SEQ ID NO: 207242 - DNA, 20 bp, Artificial
  CRISPR gRNA sequence
tttttttggaaatgcagcat

SEQ ID NO: 207243 - DNA, 20 bp, Artificial
  CRISPR gRNA sequence
ttttttggaaatgcagcata

SEQ ID NO: 207244 - DNA, 20 bp, Artificial
  CRISPR gRNA sequence
ggaaatgcagcataaggata

SEQ ID NO: 207245 - DNA, 20 bp, Artificial
  CRISPR gRNA sequence
gataaagataaatttcatat

SEQ ID NO: 207246 - DNA, 20 bp, Artificial
  CRISPR gRNA sequence
agataaatttcatatcagtt

SEQ ID NO: 207247 - DNA, 20 bp, Artificial
  CRISPR gRNA sequence
aaatttcatatcagttcagc

SEQ ID NO: 207248 - DNA, 20 bp, Artificial
  CRISPR gRNA sequence
tcagttcagcaagttctatt

SEQ ID NO: 207249 - DNA, 20 bp, Artificial
  CRISPR gRNA sequence
gttcagcaagttctatttag

SEQ ID NO: 207250 - DNA, 20 bp, Artificial
  CRISPR gRNA sequence
ttctatttagcagtgtgttg

SEQ ID NO: 207251 - DNA, 20 bp, Artificial
  CRISPR gRNA sequence
tttagcagtgtgttgaagtt

SEQ ID NO: 207252 - DNA, 20 bp, Artificial
  CRISPR gRNA sequence
ttgagactgaataaaatatt

SEQ ID NO: 207253 - DNA, 20 bp, Artificial
  CRISPR gRNA sequence
actgaataaaatatttggtt

SEQ ID NO: 207254 - DNA, 20 bp, Artificial
  CRISPR gRNA sequence
gttcaaaattttaccttgat

SEQ ID NO: 207255 - DNA, 20 bp, Artificial
  CRISPR gRNA sequence
ttcaaaattttaccttgata

SEQ ID NO: 207256 - DNA, 20 bp, Artificial
  CRISPR gRNA sequence
caatatttttctacatatat

SEQ ID NO: 207257 - DNA, 20 bp, Artificial
  CRISPR gRNA sequence
tatttttctacatatatcag

SEQ ID NO: 207258 - DNA, 20 bp, Artificial
  CRISPR gRNA sequence
atttttctacatatatcagt

SEQ ID NO: 207259 - DNA, 20 bp, Artificial
  CRISPR gRNA sequence
tttctacatatatcagtagg

SEQ ID NO: 207260 - DNA, 20 bp, Artificial
  CRISPR gRNA sequence
aggcagtaatgattacttca

SEQ ID NO: 207261 - DNA, 20 bp, Artificial
  CRISPR gRNA sequence
tgattacttcaaagcttcca

SEQ ID NO: 207262 - DNA, 20 bp, Artificial
  CRISPR gRNA sequence
tacttcaaagcttccaaagc

SEQ ID NO: 207263 - DNA, 20 bp, Artificial
  CRISPR gRNA sequence
tacacctgcatgttccaaca

SEQ ID NO: 207264 - DNA, 20 bp, Artificial
  CRISPR gRNA sequence
tagttgctgaatttattccc

SEQ ID NO: 207265 - DNA, 20 bp, Artificial
  CRISPR gRNA sequence
aatgtatactttgtattatt

SEQ ID NO: 207266 - DNA, 20 bp, Artificial
  CRISPR gRNA sequence
tgtattattgagaatgaata

SEQ ID NO: 207267 - DNA, 20 bp, Artificial
  CRISPR gRNA sequence
tattgagaatgaataaagaa

SEQ ID NO: 207268 - DNA, 20 bp, Artificial
  CRISPR gRNA sequence
aaagtcataatgatgccttc

SEQ ID NO: 207269 - DNA, 20 bp, Artificial
  CRISPR gRNA sequence
atgatgccttccagctgtgc

SEQ ID NO: 207270 - DNA, 20 bp, Artificial
  CRISPR gRNA sequence
tgtttgcatatttcacctaa

SEQ ID NO: 207271 - DNA, 20 bp, Artificial
  CRISPR gRNA sequence
gtttgcatatttcacctaat

SEQ ID NO: 207272 - DNA, 20 bp, Artificial
  CRISPR gRNA sequence
cattgctatactgtttactt

SEQ ID NO: 207273 - DNA, 20 bp, Artificial
  CRISPR gRNA sequence
ctgtttacttaagtgaacaa

SEQ ID NO: 207274 - DNA, 20 bp, Artificial
  CRISPR gRNA sequence
gaaatgttgctgtttatctt

SEQ ID NO: 207275 - DNA, 20 bp, Artificial
  CRISPR gRNA sequence
aaatgttgctgtttatctta

SEQ ID NO: 207276 - DNA, 20 bp, Artificial
  CRISPR gRNA sequence
taaggatttgtaacatgcct

SEQ ID NO: 207277 - DNA, 20 bp, Artificial
  CRISPR gRNA sequence
gtaacatgcctaagatctta

SEQ ID NO: 207278 - DNA, 20 bp, Artificial
  CRISPR gRNA sequence
atgcctaagatcttacagta

SEQ ID NO: 207279 - DNA, 20 bp, Artificial
  CRISPR gRNA sequence
acatttttctttttcctttc

SEQ ID NO: 207280 - DNA, 20 bp, Artificial
  CRISPR gRNA sequence
catttttctttttcctttcc

SEQ ID NO: 207281 - DNA, 20 bp, Artificial
  CRISPR gRNA sequence
ttctttttcctttccaggat

SEQ ID NO: 207282 - DNA, 20 bp, Artificial
  CRISPR gRNA sequence
tttcctttccaggatcagct

SEQ ID NO: 207283 - DNA, 20 bp, Artificial
  CRISPR gRNA sequence
atttaataaaacaaaatctg

SEQ ID NO: 207284 - DNA, 20 bp, Artificial
  CRISPR gRNA sequence
tccatgctttgttactaata

SEQ ID NO: 207285 - DNA, 20 bp, Artificial
  CRISPR gRNA sequence
catgctttgttactaatatg

SEQ ID NO: 207286 - DNA, 20 bp, Artificial
  CRISPR gRNA sequence
atgctttgttactaatatgg

SEQ ID NO: 207287 - DNA, 20 bp, Artificial
  CRISPR gRNA sequence
ggaggcacaaaacactactg

SEQ ID NO: 207288 - DNA, 20 bp, Artificial
  CRISPR gRNA sequence
acactactgaagtatacgta

SEQ ID NO: 207289 - DNA, 20 bp, Artificial
  CRISPR gRNA sequence
ctactgaagtatacgtaaag

SEQ ID NO: 207290 - DNA, 20 bp, Artificial
  CRISPR gRNA sequence
atacgtaaagtggaaattta

SEQ ID NO: 207291 - DNA, 20 bp, Artificial
  CRISPR gRNA sequence
tacgtaaagtggaaatttaa

SEQ ID NO: 207292 - DNA, 20 bp, Artificial
  CRISPR gRNA sequence
gtaaagtggaaatttaaagg

SEQ ID NO: 207293 - DNA, 20 bp, Artificial
  CRISPR gRNA sequence
aaagtggaaatttaaaggaa

SEQ ID NO: 207294 - DNA, 20 bp, Artificial
  CRISPR gRNA sequence
agagatatttacacctttga

SEQ ID NO: 207295 - DNA, 20 bp, Artificial
  CRISPR gRNA sequence
agatatttacacctttgatg

SEQ ID NO: 207296 - DNA, 20 bp, Artificial
  CRISPR gRNA sequence
cctttgatggagctctaaac

SEQ ID NO: 207297 - DNA, 20 bp, Artificial
  CRISPR gRNA sequence
tccactgtccccactgactt

SEQ ID NO: 207298 - DNA, 20 bp, Artificial
  CRISPR gRNA sequence
actgtccccactgactttag

SEQ ID NO: 207299 - DNA, 20 bp, Artificial
  CRISPR gRNA sequence
ctttagtagtgcaaaaattg

SEQ ID NO: 207300 - DNA, 20 bp, Artificial
  CRISPR gRNA sequence
tgaagtctcacaattactaa

SEQ ID NO: 207301 - DNA, 20 bp, Artificial
  CRISPR gRNA sequence
gaagtctcacaattactaaa

SEQ ID NO: 207302 - DNA, 20 bp, Artificial
  CRISPR gRNA sequence
agtctcacaattactaaaag

SEQ ID NO: 207303 - DNA, 20 bp, Artificial
  CRISPR gRNA sequence
taaaaggagatgcctctttg

SEQ ID NO: 207304 - DNA, 20 bp, Artificial
  CRISPR gRNA sequence
aggagatgcctctttgaaga

SEQ ID NO: 207305 - DNA, 20 bp, Artificial
  CRISPR gRNA sequence
atgcctctttgaagatggat

SEQ ID NO: 207306 - DNA, 20 bp, Artificial
  CRISPR gRNA sequence
gcctctttgaagatggataa

SEQ ID NO: 207307 - DNA, 20 bp, Artificial
  CRISPR gRNA sequence
gagtgatgctgtctcacaca

SEQ ID NO: 207308 - DNA, 20 bp, Artificial
  CRISPR gRNA sequence
agtgatgctgtctcacacac

SEQ ID NO: 207309 - DNA, 20 bp, Artificial
  CRISPR gRNA sequence
cacaggaaactacacttgtg

SEQ ID NO: 207310 - DNA, 20 bp, Artificial
  CRISPR gRNA sequence
aaactacacttgtgaagtaa

SEQ ID NO: 207311 - DNA, 20 bp, Artificial
  CRISPR gRNA sequence
tgtgaagtaacagaattaac

SEQ ID NO: 207312 - DNA, 20 bp, Artificial
  CRISPR gRNA sequence
tgaagtaacagaattaacca

SEQ ID NO: 207313 - DNA, 20 bp, Artificial
  CRISPR gRNA sequence
agtaacagaattaaccagag

SEQ ID NO: 207314 - DNA, 20 bp, Artificial
  CRISPR gRNA sequence
gtaacagaattaaccagaga

SEQ ID NO: 207315 - DNA, 20 bp, Artificial
  CRISPR gRNA sequence
gagaaggtgaaacgatcatc

SEQ ID NO: 207316 - DNA, 20 bp, Artificial
  CRISPR gRNA sequence
atcgagctaaaatatcgtgt

SEQ ID NO: 207317 - DNA, 20 bp, Artificial
  CRISPR gRNA sequence
agctaaaatatcgtgttggt

SEQ ID NO: 207318 - DNA, 20 bp, Artificial
  CRISPR gRNA sequence
tgttggtaagacttctatga

SEQ ID NO: 207319 - DNA, 20 bp, Artificial
  CRISPR gRNA sequence
gcttctttttttatttgtcc

SEQ ID NO: 207320 - DNA, 20 bp, Artificial
  CRISPR gRNA sequence
gtgcaacctgatcctctttc

SEQ ID NO: 207321 - DNA, 20 bp, Artificial
  CRISPR gRNA sequence
gcaacctgatcctctttcga

SEQ ID NO: 207322 - DNA, 20 bp, Artificial
  CRISPR gRNA sequence
caacctgatcctctttcgag

SEQ ID NO: 207323 - DNA, 20 bp, Artificial
  CRISPR gRNA sequence
acctgatcctctttcgagag

SEQ ID NO: 207324 - DNA, 20 bp, Artificial
  CRISPR gRNA sequence
cctgatcctctttcgagagg

SEQ ID NO: 207325 - DNA, 20 bp, Artificial
  CRISPR gRNA sequence
tctttcgagaggaggccaaa

SEQ ID NO: 207326 - DNA, 20 bp, Artificial
  CRISPR gRNA sequence
ctttcgagaggaggccaaat

SEQ ID NO: 207327 - DNA, 20 bp, Artificial
  CRISPR gRNA sequence
tttcgagaggaggccaaatg

SEQ ID NO: 207328 - DNA, 20 bp, Artificial
  CRISPR gRNA sequence
gagaggaggccaaatgggga

SEQ ID NO: 207329 - DNA, 20 bp, Artificial
  CRISPR gRNA sequence
agaggaggccaaatggggat

SEQ ID NO: 207330 - DNA, 20 bp, Artificial
  CRISPR gRNA sequence
aggtactcctttgaatcaaa

SEQ ID NO: 207331 - DNA, 20 bp, Artificial
  CRISPR gRNA sequence
tactcctttgaatcaaaaag

SEQ ID NO: 207332 - DNA, 20 bp, Artificial
  CRISPR gRNA sequence
actcctttgaatcaaaaagc

SEQ ID NO: 207333 - DNA, 20 bp, Artificial
  CRISPR gRNA sequence
ataaatgttgatgtaatgtt

SEQ ID NO: 207334 - DNA, 20 bp, Artificial
  CRISPR gRNA sequence
atgttgatgtaatgtttagc

SEQ ID NO: 207335 - DNA, 20 bp, Artificial
  CRISPR gRNA sequence
atgtaatgtttagcaagttt

SEQ ID NO: 207336 - DNA, 20 bp, Artificial
  CRISPR gRNA sequence
atttgttaatctactcttca

SEQ ID NO: 207337 - DNA, 20 bp, Artificial
  CRISPR gRNA sequence
ttgttaatttgtatattgtg

SEQ ID NO: 207338 - DNA, 20 bp, Artificial
  CRISPR gRNA sequence
ttgtgtggttctcaaacttt

SEQ ID NO: 207339 - DNA, 20 bp, Artificial
  CRISPR gRNA sequence
ggttctcaaacttttggtct

SEQ ID NO: 207340 - DNA, 20 bp, Artificial
  CRISPR gRNA sequence
gttctcaaacttttggtcta

SEQ ID NO: 207341 - DNA, 20 bp, Artificial
  CRISPR gRNA sequence
ggtctaaggaccattttatt

SEQ ID NO: 207342 - DNA, 20 bp, Artificial
  CRISPR gRNA sequence
gaccattttatttggctgat

SEQ ID NO: 207343 - DNA, 20 bp, Artificial
  CRISPR gRNA sequence
tttatttggctgattggtcc

SEQ ID NO: 207344 - DNA, 20 bp, Artificial
  CRISPR gRNA sequence
ttatttggctgattggtcct

SEQ ID NO: 207345 - DNA, 20 bp, Artificial
  CRISPR gRNA sequence
tatttggctgattggtcctg

SEQ ID NO: 207346 - DNA, 20 bp, Artificial
  CRISPR gRNA sequence
atttctgtttgctgccatcc

SEQ ID NO: 207347 - DNA, 20 bp, Artificial
  CRISPR gRNA sequence
ctttcctgtgactaattttc

SEQ ID NO: 207348 - DNA, 20 bp, Artificial
  CRISPR gRNA sequence
caagtctctttccaattatt

SEQ ID NO: 207349 - DNA, 20 bp, Artificial
  CRISPR gRNA sequence
tttaaccttacactttgacc

SEQ ID NO: 207350 - DNA, 20 bp, Artificial
  CRISPR gRNA sequence
ttaaccttacactttgacca

SEQ ID NO: 207351 - DNA, 20 bp, Artificial
  CRISPR gRNA sequence
taaccttacactttgaccaa

SEQ ID NO: 207352 - DNA, 20 bp, Artificial
  CRISPR gRNA sequence
cactttgaccaagggatgac

SEQ ID NO: 207353 - DNA, 20 bp, Artificial
  CRISPR gRNA sequence
gaccaagggatgacaagtcc

SEQ ID NO: 207354 - DNA, 20 bp, Artificial
  CRISPR gRNA sequence
agtcccagccatgctccctc

SEQ ID NO: 207355 - DNA, 20 bp, Artificial
  CRISPR gRNA sequence
tcccagccatgctccctctg

SEQ ID NO: 207356 - DNA, 20 bp, Artificial
  CRISPR gRNA sequence
ccagccatgctccctctgga

SEQ ID NO: 207357 - DNA, 20 bp, Artificial
  CRISPR gRNA sequence
catgctccctctggagagaa

SEQ ID NO: 207358 - DNA, 20 bp, Artificial
  CRISPR gRNA sequence
tgctccctctggagagaata

SEQ ID NO: 207359 - DNA, 20 bp, Artificial
  CRISPR gRNA sequence
gctccctctggagagaatag

SEQ ID NO: 207360 - DNA, 20 bp, Artificial
  CRISPR gRNA sequence
tccctctggagagaatagag

SEQ ID NO: 207361 - DNA, 20 bp, Artificial
  CRISPR gRNA sequence
cctctggagagaatagagga

SEQ ID NO: 207362 - DNA, 20 bp, Artificial
  CRISPR gRNA sequence
tggagagaatagaggagagt

SEQ ID NO: 207363 - DNA, 20 bp, Artificial
  CRISPR gRNA sequence
ggagagaatagaggagagtc

SEQ ID NO: 207364 - DNA, 20 bp, Artificial
  CRISPR gRNA sequence
agagaatagaggagagtcag

SEQ ID NO: 207365 - DNA, 20 bp, Artificial
  CRISPR gRNA sequence
gagattaaatcacgttatca

SEQ ID NO: 207366 - DNA, 20 bp, Artificial
  CRISPR gRNA sequence
gttatcatggatgatttctt

SEQ ID NO: 207367 - DNA, 20 bp, Artificial
  CRISPR gRNA sequence
ttcttcagattttctgtgct

SEQ ID NO: 207368 - DNA, 20 bp, Artificial
  CRISPR gRNA sequence
ttctgtgcttagccttactt

SEQ ID NO: 207369 - DNA, 20 bp, Artificial
  CRISPR gRNA sequence
tactttggtcttctttttgt

SEQ ID NO: 207370 - DNA, 20 bp, Artificial
  CRISPR gRNA sequence
ctttttgttggccaaaatat

SEQ ID NO: 207371 - DNA, 20 bp, Artificial
  CRISPR gRNA sequence
ttttgttggccaaaatatga

SEQ ID NO: 207372 - DNA, 20 bp, Artificial
  CRISPR gRNA sequence
tggccaaaatatgagagaac

SEQ ID NO: 207373 - DNA, 20 bp, Artificial
  CRISPR gRNA sequence
gccaaaatatgagagaacta

SEQ ID NO: 207374 - DNA, 20 bp, Artificial
  CRISPR gRNA sequence
caaattcatttattcaaatt

SEQ ID NO: 207375 - DNA, 20 bp, Artificial
  CRISPR gRNA sequence
ttcaaattcagacttgatga

SEQ ID NO: 207376 - DNA, 20 bp, Artificial
  CRISPR gRNA sequence
tgccctttttatcacaaact

SEQ ID NO: 207377 - DNA, 20 bp, Artificial
  CRISPR gRNA sequence
gccctttttatcacaaactt

SEQ ID NO: 207378 - DNA, 20 bp, Artificial
  CRISPR gRNA sequence
tatcacaaacttgggttgct

SEQ ID NO: 207379 - DNA, 20 bp, Artificial
  CRISPR gRNA sequence
atcacaaacttgggttgctg

SEQ ID NO: 207380 - DNA, 20 bp, Artificial
  CRISPR gRNA sequence
aaacttgggttgctgaggtg

SEQ ID NO: 207381 - DNA, 20 bp, Artificial
  CRISPR gRNA sequence
cttgggttgctgaggtgtag

SEQ ID NO: 207382 - DNA, 20 bp, Artificial
  CRISPR gRNA sequence
ttgggttgctgaggtgtaga

SEQ ID NO: 207383 - DNA, 20 bp, Artificial
  CRISPR gRNA sequence
ggttgctgaggtgtagaagg

SEQ ID NO: 207384 - DNA, 20 bp, Artificial
  CRISPR gRNA sequence
ggtgtagaaggtagtaaaat

SEQ ID NO: 207385 - DNA, 20 bp, Artificial
  CRISPR gRNA sequence
gaaggtagtaaaattagctg

SEQ ID NO: 207386 - DNA, 20 bp, Artificial
  CRISPR gRNA sequence
gtaaaattagctgaagtaaa

SEQ ID NO: 207387 - DNA, 20 bp, Artificial
  CRISPR gRNA sequence
cttgctgtttcctgctgtgc

SEQ ID NO: 207388 - DNA, 20 bp, Artificial
  CRISPR gRNA sequence
tgtttcctgctgtgctagct

SEQ ID NO: 207389 - DNA, 20 bp, Artificial
  CRISPR gRNA sequence
tgagttcttcaaccccatat

SEQ ID NO: 207390 - DNA, 20 bp, Artificial
  CRISPR gRNA sequence
tctgttttgaaatctctatt

SEQ ID NO: 207391 - DNA, 20 bp, Artificial
  CRISPR gRNA sequence
acctgtcatattaccgatca

SEQ ID NO: 207392 - DNA, 20 bp, Artificial
  CRISPR gRNA sequence
tcatggcttaaccacatttt

SEQ ID NO: 207393 - DNA, 20 bp, Artificial
  CRISPR gRNA sequence
cattttgagaaccttaactc

SEQ ID NO: 207394 - DNA, 20 bp, Artificial
  CRISPR gRNA sequence
ttgagaaccttaactctaga

SEQ ID NO: 207395 - DNA, 20 bp, Artificial
  CRISPR gRNA sequence
tgagaaccttaactctagat

SEQ ID NO: 207396 - DNA, 20 bp, Artificial
  CRISPR gRNA sequence
accttaactctagataggtt

SEQ ID NO: 207397 - DNA, 20 bp, Artificial
  CRISPR gRNA sequence
tagataggttcagttctgtt

SEQ ID NO: 207398 - DNA, 20 bp, Artificial
  CRISPR gRNA sequence
taggttcagttctgttcagt

SEQ ID NO: 207399 - DNA, 20 bp, Artificial
  CRISPR gRNA sequence
agttggatcaactatttgcc

SEQ ID NO: 207400 - DNA, 20 bp, Artificial
  CRISPR gRNA sequence
tttataaaataatctactac

SEQ ID NO: 207401 - DNA, 20 bp, Artificial
  CRISPR gRNA sequence
aaaataatctactaccagat

SEQ ID NO: 207402 - DNA, 20 bp, Artificial
  CRISPR gRNA sequence
aaataatctactaccagatt

SEQ ID NO: 207403 - DNA, 20 bp, Artificial
  CRISPR gRNA sequence
atctactaccagattaggaa

SEQ ID NO: 207404 - DNA, 20 bp, Artificial
  CRISPR gRNA sequence
tctactaccagattaggaat

SEQ ID NO: 207405 - DNA, 20 bp, Artificial
  CRISPR gRNA sequence
ctactaccagattaggaatg

SEQ ID NO: 207406 - DNA, 20 bp, Artificial
  CRISPR gRNA sequence
cagattaggaatggggtgtt

SEQ ID NO: 207407 - DNA, 20 bp, Artificial
  CRISPR gRNA sequence
tgaaatgtttgcacattact

SEQ ID NO: 207408 - DNA, 20 bp, Artificial
  CRISPR gRNA sequence
gaaatgtttgcacattactt

SEQ ID NO: 207409 - DNA, 20 bp, Artificial
  CRISPR gRNA sequence
tttgcacattacttaggatt

SEQ ID NO: 207410 - DNA, 20 bp, Artificial
  CRISPR gRNA sequence
cattacttaggattgagaat

SEQ ID NO: 207411 - DNA, 20 bp, Artificial
  CRISPR gRNA sequence
attacttaggattgagaatc

SEQ ID NO: 207412 - DNA, 20 bp, Artificial
  CRISPR gRNA sequence
tacttaggattgagaatcag

SEQ ID NO: 207413 - DNA, 20 bp, Artificial
  CRISPR gRNA sequence
acttaggattgagaatcagg

SEQ ID NO: 207414 - DNA, 20 bp, Artificial
  CRISPR gRNA sequence
gattgagaatcaggaggtct

SEQ ID NO: 207415 - DNA, 20 bp, Artificial
  CRISPR gRNA sequence
gaatcaggaggtctgagtta

SEQ ID NO: 207416 - DNA, 20 bp, Artificial
  CRISPR gRNA sequence
tctgagttacagcccctgtt

SEQ ID NO: 207417 - DNA, 20 bp, Artificial
  CRISPR gRNA sequence
ctattcacctgtgtgatctt

SEQ ID NO: 207418 - DNA, 20 bp, Artificial
  CRISPR gRNA sequence
ttcacctgtgtgatcttgag

SEQ ID NO: 207419 - DNA, 20 bp, Artificial
  CRISPR gRNA sequence
tcacctgtgtgatcttgaga

SEQ ID NO: 207420 - DNA, 20 bp, Artificial
  CRISPR gRNA sequence
tcttgagaaggtgcttaacc

SEQ ID NO: 207421 - DNA, 20 bp, Artificial
  CRISPR gRNA sequence
gaaggtgcttaaccgagtcc

SEQ ID NO: 207422 - DNA, 20 bp, Artificial
  CRISPR gRNA sequence
aagttacctcatgtccgaaa

SEQ ID NO: 207423 - DNA, 20 bp, Artificial
  CRISPR gRNA sequence
gttacctcatgtccgaaatg

SEQ ID NO: 207424 - DNA, 20 bp, Artificial
  CRISPR gRNA sequence
gtccgaaatggagatgacaa

SEQ ID NO: 207425 - DNA, 20 bp, Artificial
  CRISPR gRNA sequence
acttgcttttatgtattcta

SEQ ID NO: 207426 - DNA, 20 bp, Artificial
  CRISPR gRNA sequence
tatgtattctacagtctaat

SEQ ID NO: 207427 - DNA, 20 bp, Artificial
  CRISPR gRNA sequence
agtctaatgagcataaacca

SEQ ID NO: 207428 - DNA, 20 bp, Artificial
  CRISPR gRNA sequence
ccaaagtgtgttgtaaatgt

SEQ ID NO: 207429 - DNA, 20 bp, Artificial
  CRISPR gRNA sequence
gtaaatgttagttgttttcc

SEQ ID NO: 207430 - DNA, 20 bp, Artificial
  CRISPR gRNA sequence
taaatgttagttgttttcct

SEQ ID NO: 207431 - DNA, 20 bp, Artificial
  CRISPR gRNA sequence
cctgggatgtttattttatg

SEQ ID NO: 207432 - DNA, 20 bp, Artificial
  CRISPR gRNA sequence
ggatgtttattttatgaagt

SEQ ID NO: 207433 - DNA, 20 bp, Artificial
  CRISPR gRNA sequence
gatgtttattttatgaagta

SEQ ID NO: 207434 - DNA, 20 bp, Artificial
  CRISPR gRNA sequence
attttatgaagtaaggtatc

SEQ ID NO: 207435 - DNA, 20 bp, Artificial
  CRISPR gRNA sequence
agtaaggtatcaagttgttg

SEQ ID NO: 207436 - DNA, 20 bp, Artificial
  CRISPR gRNA sequence
aggtatcaagttgttgaagt

SEQ ID NO: 207437 - DNA, 20 bp, Artificial
  CRISPR gRNA sequence
tcaagttgttgaagttagcc

SEQ ID NO: 207438 - DNA, 20 bp, Artificial
  CRISPR gRNA sequence
aagttgttgaagttagccta

SEQ ID NO: 207439 - DNA, 20 bp, Artificial
  CRISPR gRNA sequence
aagttagcctagagcattgt

SEQ ID NO: 207440 - DNA, 20 bp, Artificial
  CRISPR gRNA sequence
gttagcctagagcattgtga

SEQ ID NO: 207441 - DNA, 20 bp, Artificial
  CRISPR gRNA sequence
ttagcctagagcattgtgag

SEQ ID NO: 207442 - DNA, 20 bp, Artificial
  CRISPR gRNA sequence
tagcctagagcattgtgaga

SEQ ID NO: 207443 - DNA, 20 bp, Artificial
  CRISPR gRNA sequence
ttgtgagagggatttgtgtg

SEQ ID NO: 207444 - DNA, 20 bp, Artificial
  CRISPR gRNA sequence
gagagggatttgtgtgcagt

SEQ ID NO: 207445 - DNA, 20 bp, Artificial
  CRISPR gRNA sequence
agagggatttgtgtgcagtg

SEQ ID NO: 207446 - DNA, 20 bp, Artificial
  CRISPR gRNA sequence
gatttgtgtgcagtgaggaa

SEQ ID NO: 207447 - DNA, 20 bp, Artificial
  CRISPR gRNA sequence
atttgtgtgcagtgaggaat

SEQ ID NO: 207448 - DNA, 20 bp, Artificial
  CRISPR gRNA sequence
gtgtgcagtgaggaatgggc

SEQ ID NO: 207449 - DNA, 20 bp, Artificial
  CRISPR gRNA sequence
tgtgcagtgaggaatgggca

SEQ ID NO: 207450 - DNA, 20 bp, Artificial
  CRISPR gRNA sequence
gtgcagtgaggaatgggcaa

SEQ ID NO: 207451 - DNA, 20 bp, Artificial
  CRISPR gRNA sequence
agtgaggaatgggcaaggga

SEQ ID NO: 207452 - DNA, 20 bp, Artificial
  CRISPR gRNA sequence
aatgggcaagggatggctcc

SEQ ID NO: 207453 - DNA, 20 bp, Artificial
  CRISPR gRNA sequence
gggcaagggatggctccgag

SEQ ID NO: 207454 - DNA, 20 bp, Artificial
  CRISPR gRNA sequence
ggcaagggatggctccgagt

SEQ ID NO: 207455 - DNA, 20 bp, Artificial
  CRISPR gRNA sequence
agggatggctccgagtaggc

SEQ ID NO: 207456 - DNA, 20 bp, Artificial
  CRISPR gRNA sequence
gggatggctccgagtaggca

SEQ ID NO: 207457 - DNA, 20 bp, Artificial
  CRISPR gRNA sequence
gatggctccgagtaggcaag

SEQ ID NO: 207458 - DNA, 20 bp, Artificial
  CRISPR gRNA sequence
agtaggcaaggagaatttga

SEQ ID NO: 207459 - DNA, 20 bp, Artificial
  CRISPR gRNA sequence
gtaggcaaggagaatttgaa

SEQ ID NO: 207460 - DNA, 20 bp, Artificial
  CRISPR gRNA sequence
atttgaaaggtctttctgct

SEQ ID NO: 207461 - DNA, 20 bp, Artificial
  CRISPR gRNA sequence
cagaaatctctcttacattg

SEQ ID NO: 207462 - DNA, 20 bp, Artificial
  CRISPR gRNA sequence
ttttactattgatattaatt

SEQ ID NO: 207463 - DNA, 20 bp, Artificial
  CRISPR gRNA sequence
tttactattgatattaattt

SEQ ID NO: 207464 - DNA, 20 bp, Artificial
  CRISPR gRNA sequence
tattgatattaatttgggca

SEQ ID NO: 207465 - DNA, 20 bp, Artificial
  CRISPR gRNA sequence
attgatattaatttgggcaa

SEQ ID NO: 207466 - DNA, 20 bp, Artificial
  CRISPR gRNA sequence
tgatattaatttgggcaaag

SEQ ID NO: 207467 - DNA, 20 bp, Artificial
  CRISPR gRNA sequence
gagctttttttgttgttgtt

SEQ ID NO: 207468 - DNA, 20 bp, Artificial
  CRISPR gRNA sequence
tgttaagtatacctttaatg

SEQ ID NO: 207469 - DNA, 20 bp, Artificial
  CRISPR gRNA sequence
gttaagtatacctttaatga

SEQ ID NO: 207470 - DNA, 20 bp, Artificial
  CRISPR gRNA sequence
ttaagtatacctttaatgaa

SEQ ID NO: 207471 - DNA, 20 bp, Artificial
  CRISPR gRNA sequence
cctttaatgaagggtgtaat

SEQ ID NO: 207472 - DNA, 20 bp, Artificial
  CRISPR gRNA sequence
taatgaagggtgtaatcagt

SEQ ID NO: 207473 - DNA, 20 bp, Artificial
  CRISPR gRNA sequence
tcatatccactgcaactaac

SEQ ID NO: 207474 - DNA, 20 bp, Artificial
  CRISPR gRNA sequence
ccactgcaactaactggtat

SEQ ID NO: 207475 - DNA, 20 bp, Artificial
  CRISPR gRNA sequence
gtattagatcatctaatacc

SEQ ID NO: 207476 - DNA, 20 bp, Artificial
  CRISPR gRNA sequence
tacctagttgaaatttttct

SEQ ID NO: 207477 - DNA, 20 bp, Artificial
  CRISPR gRNA sequence
acctagttgaaatttttctg

SEQ ID NO: 207478 - DNA, 20 bp, Artificial
  CRISPR gRNA sequence
tgaggtaatgtacaattttg

SEQ ID NO: 207479 - DNA, 20 bp, Artificial
  CRISPR gRNA sequence
gtacaattttgtggaaatga

SEQ ID NO: 207480 - DNA, 20 bp, Artificial
  CRISPR gRNA sequence
ttttgtggaaatgaaagaat

SEQ ID NO: 207481 - DNA, 20 bp, Artificial
  CRISPR gRNA sequence
ggaaatgaaagaataagata

SEQ ID NO: 207482 - DNA, 20 bp, Artificial
  CRISPR gRNA sequence
gaaatgaaagaataagatat

SEQ ID NO: 207483 - DNA, 20 bp, Artificial
  CRISPR gRNA sequence
aaatgaaagaataagatatg

SEQ ID NO: 207484 - DNA, 20 bp, Artificial
  CRISPR gRNA sequence
aatgaaagaataagatatgg

SEQ ID NO: 207485 - DNA, 20 bp, Artificial
  CRISPR gRNA sequence
aagaataagatatgggggaa

SEQ ID NO: 207486 - DNA, 20 bp, Artificial
  CRISPR gRNA sequence
tatgggggaacagtaacttt

SEQ ID NO: 207487 - DNA, 20 bp, Artificial
  CRISPR gRNA sequence
atgggggaacagtaactttt

SEQ ID NO: 207488 - DNA, 20 bp, Artificial
  CRISPR gRNA sequence
tgggggaacagtaacttttg

SEQ ID NO: 207489 - DNA, 20 bp, Artificial
  CRISPR gRNA sequence
gggggaacagtaacttttgg

SEQ ID NO: 207490 - DNA, 20 bp, Artificial
  CRISPR gRNA sequence
ggggaacagtaacttttggg

SEQ ID NO: 207491 - DNA, 20 bp, Artificial
  CRISPR gRNA sequence
gtaacttttggggggtaatg

SEQ ID NO: 207492 - DNA, 20 bp, Artificial
  CRISPR gRNA sequence
taacttttggggggtaatgc

SEQ ID NO: 207493 - DNA, 20 bp, Artificial
  CRISPR gRNA sequence
ggggggtaatgcaggtcact

SEQ ID NO: 207494 - DNA, 20 bp, Artificial
  CRISPR gRNA sequence
ggggtaatgcaggtcactga

SEQ ID NO: 207495 - DNA, 20 bp, Artificial
  CRISPR gRNA sequence
gggtaatgcaggtcactgag

SEQ ID NO: 207496 - DNA, 20 bp, Artificial
  CRISPR gRNA sequence
caggtcactgagaggtaaac

SEQ ID NO: 207497 - DNA, 20 bp, Artificial
  CRISPR gRNA sequence
aactggaaaactcaaaatat

SEQ ID NO: 207498 - DNA, 20 bp, Artificial
  CRISPR gRNA sequence
actcaaaatatgagatttga

SEQ ID NO: 207499 - DNA, 20 bp, Artificial
  CRISPR gRNA sequence
ctcaaaatatgagatttgaa

SEQ ID NO: 207500 - DNA, 20 bp, Artificial
  CRISPR gRNA sequence
aaatatgagatttgaaaggc

SEQ ID NO: 207501 - DNA, 20 bp, Artificial
  CRISPR gRNA sequence
tatgagatttgaaaggccag

SEQ ID NO: 207502 - DNA, 20 bp, Artificial
  CRISPR gRNA sequence
aaaggccagaagatgaaatg

SEQ ID NO: 207503 - DNA, 20 bp, Artificial
  CRISPR gRNA sequence
gccagaagatgaaatgaaga

SEQ ID NO: 207504 - DNA, 20 bp, Artificial
  CRISPR gRNA sequence
agaagatgaaatgaagatgg

SEQ ID NO: 207505 - DNA, 20 bp, Artificial
  CRISPR gRNA sequence
aagatgaaatgaagatggaa

SEQ ID NO: 207506 - DNA, 20 bp, Artificial
  CRISPR gRNA sequence
tgaaatgaagatggaagaga

SEQ ID NO: 207507 - DNA, 20 bp, Artificial
  CRISPR gRNA sequence
gaaatgaagatggaagagaa

SEQ ID NO: 207508 - DNA, 20 bp, Artificial
  CRISPR gRNA sequence
gatggaagagaaaggaatgc

SEQ ID NO: 207509 - DNA, 20 bp, Artificial
  CRISPR gRNA sequence
atggaagagaaaggaatgcc

SEQ ID NO: 207510 - DNA, 20 bp, Artificial
  CRISPR gRNA sequence
agaaaggaatgccaggatct

SEQ ID NO: 207511 - DNA, 20 bp, Artificial
  CRISPR gRNA sequence
gccaggatctgagataaaaa

SEQ ID NO: 207512 - DNA, 20 bp, Artificial
  CRISPR gRNA sequence
attattttgcgtgtgattga

SEQ ID NO: 207513 - DNA, 20 bp, Artificial
  CRISPR gRNA sequence
taccctataaaaataaaaac

SEQ ID NO: 207514 - DNA, 20 bp, Artificial
  CRISPR gRNA sequence
aataaaaactagacttattt

SEQ ID NO: 207515 - DNA, 20 bp, Artificial
  CRISPR gRNA sequence
ataaaaactagacttatttt

SEQ ID NO: 207516 - DNA, 20 bp, Artificial
  CRISPR gRNA sequence
aaaaactagacttattttgg

SEQ ID NO: 207517 - DNA, 20 bp, Artificial
  CRISPR gRNA sequence
cttattttgggagccattaa

SEQ ID NO: 207518 - DNA, 20 bp, Artificial
  CRISPR gRNA sequence
ttattttgggagccattaaa

SEQ ID NO: 207519 - DNA, 20 bp, Artificial
  CRISPR gRNA sequence
attttgggagccattaaaag

SEQ ID NO: 207520 - DNA, 20 bp, Artificial
  CRISPR gRNA sequence
tgggagccattaaaaggaga

SEQ ID NO: 207521 - DNA, 20 bp, Artificial
  CRISPR gRNA sequence
gagaaagtattgttttatta

SEQ ID NO: 207522 - DNA, 20 bp, Artificial
  CRISPR gRNA sequence
gaaagtattgttttattata

SEQ ID NO: 207523 - DNA, 20 bp, Artificial
  CRISPR gRNA sequence
ttgttttattatagagaatg

SEQ ID NO: 207524 - DNA, 20 bp, Artificial
  CRISPR gRNA sequence
gagaatgtagaaaattctac

SEQ ID NO: 207525 - DNA, 20 bp, Artificial
  CRISPR gRNA sequence
gaatgtagaaaattctacca

SEQ ID NO: 207526 - DNA, 20 bp, Artificial
  CRISPR gRNA sequence
aatgtagaaaattctaccag

SEQ ID NO: 207527 - DNA, 20 bp, Artificial
  CRISPR gRNA sequence
gaaaattctaccagaggttt

SEQ ID NO: 207528 - DNA, 20 bp, Artificial
  CRISPR gRNA sequence
taccagaggtttgagacatt

SEQ ID NO: 207529 - DNA, 20 bp, Artificial
  CRISPR gRNA sequence
ttgaaataattattgattta

SEQ ID NO: 207530 - DNA, 20 bp, Artificial
  CRISPR gRNA sequence
tgaaataattattgatttac

SEQ ID NO: 207531 - DNA, 20 bp, Artificial
  CRISPR gRNA sequence
ttgatttacaggacgattca

SEQ ID NO: 207532 - DNA, 20 bp, Artificial
  CRISPR gRNA sequence
tttacaggacgattcaaaga

SEQ ID NO: 207533 - DNA, 20 bp, Artificial
  CRISPR gRNA sequence
tacaggacgattcaaagata

SEQ ID NO: 207534 - DNA, 20 bp, Artificial
  CRISPR gRNA sequence
caggacgattcaaagataga

SEQ ID NO: 207535 - DNA, 20 bp, Artificial
  CRISPR gRNA sequence
gcttccatgtgcccttcacc

SEQ ID NO: 207536 - DNA, 20 bp, Artificial
  CRISPR gRNA sequence
ccttcacccagtccccccaa

SEQ ID NO: 207537 - DNA, 20 bp, Artificial
  CRISPR gRNA sequence
atgtgacacaatatgaaaat

SEQ ID NO: 207538 - DNA, 20 bp, Artificial
  CRISPR gRNA sequence
tgtgacacaatatgaaaatc

SEQ ID NO: 207539 - DNA, 20 bp, Artificial
  CRISPR gRNA sequence
gacacaatatgaaaatcagg

SEQ ID NO: 207540 - DNA, 20 bp, Artificial
  CRISPR gRNA sequence
gaaaatcaggaagttcacaa

SEQ ID NO: 207541 - DNA, 20 bp, Artificial
  CRISPR gRNA sequence
tcaggaagttcacaatggtg

SEQ ID NO: 207542 - DNA, 20 bp, Artificial
  CRISPR gRNA sequence
aatggtgcagtgtgtgttaa

SEQ ID NO: 207543 - DNA, 20 bp, Artificial
  CRISPR gRNA sequence
tgcgtaactacctacacaat

SEQ ID NO: 207544 - DNA, 20 bp, Artificial
  CRISPR gRNA sequence
gcgtaactacctacacaatc

SEQ ID NO: 207545 - DNA, 20 bp, Artificial
  CRISPR gRNA sequence
ctacctacacaatcaggaca

SEQ ID NO: 207546 - DNA, 20 bp, Artificial
  CRISPR gRNA sequence
tccctcatgcttattcttac

SEQ ID NO: 207547 - DNA, 20 bp, Artificial
  CRISPR gRNA sequence
acctcccactgtccctaacc

SEQ ID NO: 207548 - DNA, 20 bp, Artificial
  CRISPR gRNA sequence
cccactgtccctaacctggc

SEQ ID NO: 207549 - DNA, 20 bp, Artificial
  CRISPR gRNA sequence
tttcaacaatgctatataaa

SEQ ID NO: 207550 - DNA, 20 bp, Artificial
  CRISPR gRNA sequence
ctatataaatggaatgatac

SEQ ID NO: 207551 - DNA, 20 bp, Artificial
  CRISPR gRNA sequence
gatacaagatgtgacctttt

SEQ ID NO: 207552 - DNA, 20 bp, Artificial
  CRISPR gRNA sequence
acaagatgtgaccttttgag

SEQ ID NO: 207553 - DNA, 20 bp, Artificial
  CRISPR gRNA sequence
caagatgtgaccttttgaga

SEQ ID NO: 207554 - DNA, 20 bp, Artificial
  CRISPR gRNA sequence
aagatgtgaccttttgagaa

SEQ ID NO: 207555 - DNA, 20 bp, Artificial
  CRISPR gRNA sequence
ttgagaagggctttttcact

SEQ ID NO: 207556 - DNA, 20 bp, Artificial
  CRISPR gRNA sequence
tcactaagcacaatgccctt

SEQ ID NO: 207557 - DNA, 20 bp, Artificial
  CRISPR gRNA sequence
aatgcccttgagatctatcc

SEQ ID NO: 207558 - DNA, 20 bp, Artificial
  CRISPR gRNA sequence
caagtttttgcatctatcaa

SEQ ID NO: 207559 - DNA, 20 bp, Artificial
  CRISPR gRNA sequence
tccttacttttttttttgct

SEQ ID NO: 207560 - DNA, 20 bp, Artificial
  CRISPR gRNA sequence
ttacttttttttttgctgag

SEQ ID NO: 207561 - DNA, 20 bp, Artificial
  CRISPR gRNA sequence
cttttttttttgctgagtag

SEQ ID NO: 207562 - DNA, 20 bp, Artificial
  CRISPR gRNA sequence
ttttgctgagtagtagtcca

SEQ ID NO: 207563 - DNA, 20 bp, Artificial
  CRISPR gRNA sequence
tccatagtatgaatatatca

SEQ ID NO: 207564 - DNA, 20 bp, Artificial
  CRISPR gRNA sequence
tttgtttaaccacttaccta

SEQ ID NO: 207565 - DNA, 20 bp, Artificial
  CRISPR gRNA sequence
gtttaaccacttacctatag

SEQ ID NO: 207566 - DNA, 20 bp, Artificial
  CRISPR gRNA sequence
tttaaccacttacctatagt

SEQ ID NO: 207567 - DNA, 20 bp, Artificial
  CRISPR gRNA sequence
ttacctatagtaggacattt

SEQ ID NO: 207568 - DNA, 20 bp, Artificial
  CRISPR gRNA sequence
aggacattttggttgtttcc

SEQ ID NO: 207569 - DNA, 20 bp, Artificial
  CRISPR gRNA sequence
attttggttgtttccaagtt

SEQ ID NO: 207570 - DNA, 20 bp, Artificial
  CRISPR gRNA sequence
ttttggttgtttccaagttt

SEQ ID NO: 207571 - DNA, 20 bp, Artificial
  CRISPR gRNA sequence
ctgctctgaacaattgtgta

SEQ ID NO: 207572 - DNA, 20 bp, Artificial
  CRISPR gRNA sequence
tgctctgaacaattgtgtac

SEQ ID NO: 207573 - DNA, 20 bp, Artificial
  CRISPR gRNA sequence
attgtgtacaggttcttgtg

SEQ ID NO: 207574 - DNA, 20 bp, Artificial
  CRISPR gRNA sequence
tacaggttcttgtgtagaca

SEQ ID NO: 207575 - DNA, 20 bp, Artificial
  CRISPR gRNA sequence
agacacagttttcatttctc

SEQ ID NO: 207576 - DNA, 20 bp, Artificial
  CRISPR gRNA sequence
gacacagttttcatttctct

SEQ ID NO: 207577 - DNA, 20 bp, Artificial
  CRISPR gRNA sequence
atttctctgggataaatgct

SEQ ID NO: 207578 - DNA, 20 bp, Artificial
  CRISPR gRNA sequence
tctctgggataaatgctcag

SEQ ID NO: 207579 - DNA, 20 bp, Artificial
  CRISPR gRNA sequence
gggataaatgctcagaagta

SEQ ID NO: 207580 - DNA, 20 bp, Artificial
  CRISPR gRNA sequence
atgctcagaagtatggttac

SEQ ID NO: 207581 - DNA, 20 bp, Artificial
  CRISPR gRNA sequence
tgctcagaagtatggttact

SEQ ID NO: 207582 - DNA, 20 bp, Artificial
  CRISPR gRNA sequence
agtatggttactgggctgta

SEQ ID NO: 207583 - DNA, 20 bp, Artificial
  CRISPR gRNA sequence
tggttactgggctgtatggt

SEQ ID NO: 207584 - DNA, 20 bp, Artificial
  CRISPR gRNA sequence
ctgtatggtaagtatatgct

SEQ ID NO: 207585 - DNA, 20 bp, Artificial
  CRISPR gRNA sequence
aagtatatgcttagttttta

SEQ ID NO: 207586 - DNA, 20 bp, Artificial
  CRISPR gRNA sequence
ttagtttttaaagaaactgc

SEQ ID NO: 207587 - DNA, 20 bp, Artificial
  CRISPR gRNA sequence
aagaaactgccagacttttc

SEQ ID NO: 207588 - DNA, 20 bp, Artificial
  CRISPR gRNA sequence
gaaactgccagacttttcca

SEQ ID NO: 207589 - DNA, 20 bp, Artificial
  CRISPR gRNA sequence
actgccagacttttccagag

SEQ ID NO: 207590 - DNA, 20 bp, Artificial
  CRISPR gRNA sequence
tacatttccatcaacaatgt

SEQ ID NO: 207591 - DNA, 20 bp, Artificial
  CRISPR gRNA sequence
catttccatcaacaatgtaa

SEQ ID NO: 207592 - DNA, 20 bp, Artificial
  CRISPR gRNA sequence
tcaacaatgtaagagtgatc

SEQ ID NO: 207593 - DNA, 20 bp, Artificial
  CRISPR gRNA sequence
tggtttctccacatcctcac

SEQ ID NO: 207594 - DNA, 20 bp, Artificial
  CRISPR gRNA sequence
tccacatcctcaccagtatc

SEQ ID NO: 207595 - DNA, 20 bp, Artificial
  CRISPR gRNA sequence
aacaacaaacaaacaaaaac

SEQ ID NO: 207596 - DNA, 20 bp, Artificial
  CRISPR gRNA sequence
acaaacaaaaaccagttaaa

SEQ ID NO: 207597 - DNA, 20 bp, Artificial
  CRISPR gRNA sequence
taaaaagttatctgcacaaa

SEQ ID NO: 207598 - DNA, 20 bp, Artificial
  CRISPR gRNA sequence
aaaaagttatctgcacaaaa

SEQ ID NO: 207599 - DNA, 20 bp, Artificial
  CRISPR gRNA sequence
atctgcacaaaaaggttaaa

SEQ ID NO: 207600 - DNA, 20 bp, Artificial
  CRISPR gRNA sequence
tctgcacaaaaaggttaaat

SEQ ID NO: 207601 - DNA, 20 bp, Artificial
  CRISPR gRNA sequence
ctgcacaaaaaggttaaatg

SEQ ID NO: 207602 - DNA, 20 bp, Artificial
  CRISPR gRNA sequence
cacaaaaaggttaaatgggg

SEQ ID NO: 207603 - DNA, 20 bp, Artificial
  CRISPR gRNA sequence
acaaaaaggttaaatggggc

SEQ ID NO: 207604 - DNA, 20 bp, Artificial
  CRISPR gRNA sequence
atggggcaggactcttacta

SEQ ID NO: 207605 - DNA, 20 bp, Artificial
  CRISPR gRNA sequence
ggggcaggactcttactatg

SEQ ID NO: 207606 - DNA, 20 bp, Artificial
  CRISPR gRNA sequence
ggactcttactatggagtat

SEQ ID NO: 207607 - DNA, 20 bp, Artificial
  CRISPR gRNA sequence
agtataagttcttttctaat

SEQ ID NO: 207608 - DNA, 20 bp, Artificial
  CRISPR gRNA sequence
ataagaatacttacttgtca

SEQ ID NO: 207609 - DNA, 20 bp, Artificial
  CRISPR gRNA sequence
acttacttgtcacggacttt

SEQ ID NO: 207610 - DNA, 20 bp, Artificial
  CRISPR gRNA sequence
cttacttgtcacggactttg

SEQ ID NO: 207611 - DNA, 20 bp, Artificial
  CRISPR gRNA sequence
gtcacggactttgaggattt

SEQ ID NO: 207612 - DNA, 20 bp, Artificial
  CRISPR gRNA sequence
gactttgaggatttaagcat

SEQ ID NO: 207613 - DNA, 20 bp, Artificial
  CRISPR gRNA sequence
tgtcgtgatttttgcaaata

SEQ ID NO: 207614 - DNA, 20 bp, Artificial
  CRISPR gRNA sequence
gtcgtgatttttgcaaatac

SEQ ID NO: 207615 - DNA, 20 bp, Artificial
  CRISPR gRNA sequence
ttgcaaatacaggcataaat

SEQ ID NO: 207616 - DNA, 20 bp, Artificial
  CRISPR gRNA sequence
atacaggcataaatgagaaa

SEQ ID NO: 207617 - DNA, 20 bp, Artificial
  CRISPR gRNA sequence
gagaaacagaatttgctcaa

SEQ ID NO: 207618 - DNA, 20 bp, Artificial
  CRISPR gRNA sequence
gaaacagaatttgctcaata

SEQ ID NO: 207619 - DNA, 20 bp, Artificial
  CRISPR gRNA sequence
acagaatttgctcaatagag

SEQ ID NO: 207620 - DNA, 20 bp, Artificial
  CRISPR gRNA sequence
gagaagtgaattctacttaa

SEQ ID NO: 207621 - DNA, 20 bp, Artificial
  CRISPR gRNA sequence
gaattctacttaatagaatg

SEQ ID NO: 207622 - DNA, 20 bp, Artificial
  CRISPR gRNA sequence
acttaatagaatgcagataa

SEQ ID NO: 207623 - DNA, 20 bp, Artificial
  CRISPR gRNA sequence
ttgtgcctttttaaattttt

SEQ ID NO: 207624 - DNA, 20 bp, Artificial
  CRISPR gRNA sequence
gtgcctttttaaattttttg

SEQ ID NO: 207625 - DNA, 20 bp, Artificial
  CRISPR gRNA sequence
tgcctttttaaattttttgg

SEQ ID NO: 207626 - DNA, 20 bp, Artificial
  CRISPR gRNA sequence
ttttaaattttttggaggac

SEQ ID NO: 207627 - DNA, 20 bp, Artificial
  CRISPR gRNA sequence
tttaaattttttggaggact

SEQ ID NO: 207628 - DNA, 20 bp, Artificial
  CRISPR gRNA sequence
gaggactaggactgaataca

SEQ ID NO: 207629 - DNA, 20 bp, Artificial
  CRISPR gRNA sequence
tgaatacatggaaacactat

SEQ ID NO: 207630 - DNA, 20 bp, Artificial
  CRISPR gRNA sequence
catggaaacactataagata

SEQ ID NO: 207631 - DNA, 20 bp, Artificial
  CRISPR gRNA sequence
ctctgtgcctatgtatgata

SEQ ID NO: 207632 - DNA, 20 bp, Artificial
  CRISPR gRNA sequence
ctatgtatgatatagtccat

SEQ ID NO: 207633 - DNA, 20 bp, Artificial
  CRISPR gRNA sequence
tgtatgatatagtccattag

SEQ ID NO: 207634 - DNA, 20 bp, Artificial
  CRISPR gRNA sequence
gtatgatatagtccattaga

SEQ ID NO: 207635 - DNA, 20 bp, Artificial
  CRISPR gRNA sequence
atgatatagtccattagaag

SEQ ID NO: 207636 - DNA, 20 bp, Artificial
  CRISPR gRNA sequence
tagtccattagaaggagcac

SEQ ID NO: 207637 - DNA, 20 bp, Artificial
  CRISPR gRNA sequence
aggagcactggacttgaaat

SEQ ID NO: 207638 - DNA, 20 bp, Artificial
  CRISPR gRNA sequence
gcactggacttgaaattaga

SEQ ID NO: 207639 - DNA, 20 bp, Artificial
  CRISPR gRNA sequence
gaaattagaaagctgttttc

SEQ ID NO: 207640 - DNA, 20 bp, Artificial
  CRISPR gRNA sequence
ttctagacttcactgtttaa

SEQ ID NO: 207641 - DNA, 20 bp, Artificial
  CRISPR gRNA sequence
acttcactgtttaatagctt

SEQ ID NO: 207642 - DNA, 20 bp, Artificial
  CRISPR gRNA sequence
actgtttaatagcttaagaa

SEQ ID NO: 207643 - DNA, 20 bp, Artificial
  CRISPR gRNA sequence
tttaatagcttaagaaaagt

SEQ ID NO: 207644 - DNA, 20 bp, Artificial
  CRISPR gRNA sequence
tctgtccctcaaattcttct

SEQ ID NO: 207645 - DNA, 20 bp, Artificial
  CRISPR gRNA sequence
ccctcaaattcttcttagta

SEQ ID NO: 207646 - DNA, 20 bp, Artificial
  CRISPR gRNA sequence
aaattcttcttagtacagta

SEQ ID NO: 207647 - DNA, 20 bp, Artificial
  CRISPR gRNA sequence
tcttcttagtacagtaaaga

SEQ ID NO: 207648 - DNA, 20 bp, Artificial
  CRISPR gRNA sequence
taaagatggcatcaccatca

SEQ ID NO: 207649 - DNA, 20 bp, Artificial
  CRISPR gRNA sequence
tcaccatcatggaaatgttt

SEQ ID NO: 207650 - DNA, 20 bp, Artificial
  CRISPR gRNA sequence
ttacttaacaaaattttact

SEQ ID NO: 207651 - DNA, 20 bp, Artificial
  CRISPR gRNA sequence
actaagtgcctaccatgtgc

SEQ ID NO: 207652 - DNA, 20 bp, Artificial
  CRISPR gRNA sequence
ccatgtgccagtcaccgtac

SEQ ID NO: 207653 - DNA, 20 bp, Artificial
  CRISPR gRNA sequence
catgtgccagtcaccgtact

SEQ ID NO: 207654 - DNA, 20 bp, Artificial
  CRISPR gRNA sequence
agtcaccgtactaggcatca

SEQ ID NO: 207655 - DNA, 20 bp, Artificial
  CRISPR gRNA sequence
tcacagattctgtgatgaat

SEQ ID NO: 207656 - DNA, 20 bp, Artificial
  CRISPR gRNA sequence
aagacattattgctgatttc

SEQ ID NO: 207657 - DNA, 20 bp, Artificial
  CRISPR gRNA sequence
agacattattgctgatttca

SEQ ID NO: 207658 - DNA, 20 bp, Artificial
  CRISPR gRNA sequence
cattattgctgatttcaagg

SEQ ID NO: 207659 - DNA, 20 bp, Artificial
  CRISPR gRNA sequence
tattgctgatttcaaggaag

SEQ ID NO: 207660 - DNA, 20 bp, Artificial
  CRISPR gRNA sequence
tgatttcaaggaagtggttg

SEQ ID NO: 207661 - DNA, 20 bp, Artificial
  CRISPR gRNA sequence
gtggttgcagtacaaatatg

SEQ ID NO: 207662 - DNA, 20 bp, Artificial
  CRISPR gRNA sequence
ggttgcagtacaaatatgaa

SEQ ID NO: 207663 - DNA, 20 bp, Artificial
  CRISPR gRNA sequence
cagtacaaatatgaagagtg

SEQ ID NO: 207664 - DNA, 20 bp, Artificial
  CRISPR gRNA sequence
atgtgccacatactttatgt

SEQ ID NO: 207665 - DNA, 20 bp, Artificial
  CRISPR gRNA sequence
tcgtgtcctgttatcctctc

SEQ ID NO: 207666 - DNA, 20 bp, Artificial
  CRISPR gRNA sequence
tgttatcctctcaagaactc

SEQ ID NO: 207667 - DNA, 20 bp, Artificial
  CRISPR gRNA sequence
gttatcctctcaagaactct

SEQ ID NO: 207668 - DNA, 20 bp, Artificial
  CRISPR gRNA sequence
tatcctctcaagaactctag

SEQ ID NO: 207669 - DNA, 20 bp, Artificial
  CRISPR gRNA sequence
ctctcaagaactctaggaga

SEQ ID NO: 207670 - DNA, 20 bp, Artificial
  CRISPR gRNA sequence
caagaactctaggagataga

SEQ ID NO: 207671 - DNA, 20 bp, Artificial
  CRISPR gRNA sequence
agaactctaggagatagatg

SEQ ID NO: 207672 - DNA, 20 bp, Artificial
  CRISPR gRNA sequence
agttcttaccatttaacaaa

SEQ ID NO: 207673 - DNA, 20 bp, Artificial
  CRISPR gRNA sequence
gttcttaccatttaacaaat

SEQ ID NO: 207674 - DNA, 20 bp, Artificial
  CRISPR gRNA sequence
ttcttaccatttaacaaata

SEQ ID NO: 207675 - DNA, 20 bp, Artificial
  CRISPR gRNA sequence
ttaccatttaacaaataggg

SEQ ID NO: 207676 - DNA, 20 bp, Artificial
  CRISPR gRNA sequence
tttaacaaatagggaagcaa

SEQ ID NO: 207677 - DNA, 20 bp, Artificial
  CRISPR gRNA sequence
taacaaatagggaagcaaaa

SEQ ID NO: 207678 - DNA, 20 bp, Artificial
  CRISPR gRNA sequence
tagggaagcaaaagagattc

SEQ ID NO: 207679 - DNA, 20 bp, Artificial
  CRISPR gRNA sequence
agggaagcaaaagagattca

SEQ ID NO: 207680 - DNA, 20 bp, Artificial
  CRISPR gRNA sequence
agagattcaaggtattgttc

SEQ ID NO: 207681 - DNA, 20 bp, Artificial
  CRISPR gRNA sequence
gagattcaaggtattgttca

SEQ ID NO: 207682 - DNA, 20 bp, Artificial
  CRISPR gRNA sequence
ttcaaggtattgttcaaggt

SEQ ID NO: 207683 - DNA, 20 bp, Artificial
  CRISPR gRNA sequence
caaggtattgttcaaggtca

SEQ ID NO: 207684 - DNA, 20 bp, Artificial
  CRISPR gRNA sequence
attgttcaaggtcagagtaa

SEQ ID NO: 207685 - DNA, 20 bp, Artificial
  CRISPR gRNA sequence
tcaaggtcagagtaatagcc

SEQ ID NO: 207686 - DNA, 20 bp, Artificial
  CRISPR gRNA sequence
taatagccaagaattaaacc

SEQ ID NO: 207687 - DNA, 20 bp, Artificial
  CRISPR gRNA sequence
gaattaaacctagatctctt

SEQ ID NO: 207688 - DNA, 20 bp, Artificial
  CRISPR gRNA sequence
atctctttggcatcaaaacc

SEQ ID NO: 207689 - DNA, 20 bp, Artificial
  CRISPR gRNA sequence
atttttaccaccgtaatatg

SEQ ID NO: 207690 - DNA, 20 bp, Artificial
  CRISPR gRNA sequence
taaatactgaatgcaaatac

SEQ ID NO: 207691 - DNA, 20 bp, Artificial
  CRISPR gRNA sequence
cattaatatttctgttctat

SEQ ID NO: 207692 - DNA, 20 bp, Artificial
  CRISPR gRNA sequence
tacaaaaacttgaaaactta

SEQ ID NO: 207693 - DNA, 20 bp, Artificial
  CRISPR gRNA sequence
cttaaagtttatttttctct

SEQ ID NO: 207694 - DNA, 20 bp, Artificial
  CRISPR gRNA sequence
tttatttttctctaagctat

SEQ ID NO: 207695 - DNA, 20 bp, Artificial
  CRISPR gRNA sequence
tatttttctctaagctatta

SEQ ID NO: 207696 - DNA, 20 bp, Artificial
  CRISPR gRNA sequence
taagctattagagttttgtt

SEQ ID NO: 207697 - DNA, 20 bp, Artificial
  CRISPR gRNA sequence
ctattagagttttgtttaga

SEQ ID NO: 207698 - DNA, 20 bp, Artificial
  CRISPR gRNA sequence
tattagagttttgtttagaa

SEQ ID NO: 207699 - DNA, 20 bp, Artificial
  CRISPR gRNA sequence
agagttttgtttagaaaggt

SEQ ID NO: 207700 - DNA, 20 bp, Artificial
  CRISPR gRNA sequence
ttgtttagaaaggtcagttc

SEQ ID NO: 207701 - DNA, 20 bp, Artificial
  CRISPR gRNA sequence
aaaggtcagttcaagttccg

SEQ ID NO: 207702 - DNA, 20 bp, Artificial
  CRISPR gRNA sequence
gccaattccattattatcaa

SEQ ID NO: 207703 - DNA, 20 bp, Artificial
  CRISPR gRNA sequence
ccaattccattattatcaac

SEQ ID NO: 207704 - DNA, 20 bp, Artificial
  CRISPR gRNA sequence
attattatcaacaggacata

SEQ ID NO: 207705 - DNA, 20 bp, Artificial
  CRISPR gRNA sequence
catatggtctgtttataatg

SEQ ID NO: 207706 - DNA, 20 bp, Artificial
  CRISPR gRNA sequence
ctgtttataatgaagacatg

SEQ ID NO: 207707 - DNA, 20 bp, Artificial
  CRISPR gRNA sequence
tgtttataatgaagacatga

SEQ ID NO: 207708 - DNA, 20 bp, Artificial
  CRISPR gRNA sequence
tgaagacatgaaggcattgc

SEQ ID NO: 207709 - DNA, 20 bp, Artificial
  CRISPR gRNA sequence
gcattgcaagatctttgtat

SEQ ID NO: 207710 - DNA, 20 bp, Artificial
  CRISPR gRNA sequence
agatctttgtattagttttc

SEQ ID NO: 207711 - DNA, 20 bp, Artificial
  CRISPR gRNA sequence
ctgcataacaactacaaata

SEQ ID NO: 207712 - DNA, 20 bp, Artificial
  CRISPR gRNA sequence
cataacaactacaaatatag

SEQ ID NO: 207713 - DNA, 20 bp, Artificial
  CRISPR gRNA sequence
ttaaaacactacccattttt

SEQ ID NO: 207714 - DNA, 20 bp, Artificial
  CRISPR gRNA sequence
actacccattttttagctca

SEQ ID NO: 207715 - DNA, 20 bp, Artificial
  CRISPR gRNA sequence
ttttttagctcaaagttttg

SEQ ID NO: 207716 - DNA, 20 bp, Artificial
  CRISPR gRNA sequence
tttttagctcaaagttttgt

SEQ ID NO: 207717 - DNA, 20 bp, Artificial
  CRISPR gRNA sequence
ttagctcaaagttttgtagg

SEQ ID NO: 207718 - DNA, 20 bp, Artificial
  CRISPR gRNA sequence
ctcaaagttttgtaggtggc

SEQ ID NO: 207719 - DNA, 20 bp, Artificial
  CRISPR gRNA sequence
agttttgtaggtggcaagcc

SEQ ID NO: 207720 - DNA, 20 bp, Artificial
  CRISPR gRNA sequence
gtaggtggcaagcctggtca

SEQ ID NO: 207721 - DNA, 20 bp, Artificial
  CRISPR gRNA sequence
aagcctggtcatggcatgac

SEQ ID NO: 207722 - DNA, 20 bp, Artificial
  CRISPR gRNA sequence
agcctggtcatggcatgact

SEQ ID NO: 207723 - DNA, 20 bp, Artificial
  CRISPR gRNA sequence
atgactgggttctctgatca

SEQ ID NO: 207724 - DNA, 20 bp, Artificial
  CRISPR gRNA sequence
ttctctgatcaaagtcttaa

SEQ ID NO: 207725 - DNA, 20 bp, Artificial
  CRISPR gRNA sequence
agtcttaaaagactaaaatc

SEQ ID NO: 207726 - DNA, 20 bp, Artificial
  CRISPR gRNA sequence
gtcttaaaagactaaaatca

SEQ ID NO: 207727 - DNA, 20 bp, Artificial
  CRISPR gRNA sequence
actaaaatcaaggtgttgcc

SEQ ID NO: 207728 - DNA, 20 bp, Artificial
  CRISPR gRNA sequence
ctaaaatcaaggtgttgccc

SEQ ID NO: 207729 - DNA, 20 bp, Artificial
  CRISPR gRNA sequence
taaaatcaaggtgttgccca

SEQ ID NO: 207730 - DNA, 20 bp, Artificial
  CRISPR gRNA sequence
tgcccagggcatactttatt

SEQ ID NO: 207731 - DNA, 20 bp, Artificial
  CRISPR gRNA sequence
cccagggcatactttatttg

SEQ ID NO: 207732 - DNA, 20 bp, Artificial
  CRISPR gRNA sequence
ggcatactttatttggagtt

SEQ ID NO: 207733 - DNA, 20 bp, Artificial
  CRISPR gRNA sequence
gcatactttatttggagttt

SEQ ID NO: 207734 - DNA, 20 bp, Artificial
  CRISPR gRNA sequence
catactttatttggagtttg

SEQ ID NO: 207735 - DNA, 20 bp, Artificial
  CRISPR gRNA sequence
tggagtttggggtcttgttc

SEQ ID NO: 207736 - DNA, 20 bp, Artificial
  CRISPR gRNA sequence
ggagtttggggtcttgttct

SEQ ID NO: 207737 - DNA, 20 bp, Artificial
  CRISPR gRNA sequence
ctaggctcacataattgtga

SEQ ID NO: 207738 - DNA, 20 bp, Artificial
  CRISPR gRNA sequence
attcaattccttgtgattgt

SEQ ID NO: 207739 - DNA, 20 bp, Artificial
  CRISPR gRNA sequence
attccttgtgattgtaagac

SEQ ID NO: 207740 - DNA, 20 bp, Artificial
  CRISPR gRNA sequence
ttccttgtgattgtaagact

SEQ ID NO: 207741 - DNA, 20 bp, Artificial
  CRISPR gRNA sequence
tccttgtgattgtaagactg

SEQ ID NO: 207742 - DNA, 20 bp, Artificial
  CRISPR gRNA sequence
ggggtccctgtttctttgct

SEQ ID NO: 207743 - DNA, 20 bp, Artificial
  CRISPR gRNA sequence
ttctttgctaagtatctgcc

SEQ ID NO: 207744 - DNA, 20 bp, Artificial
  CRISPR gRNA sequence
tctttgctaagtatctgcca

SEQ ID NO: 207745 - DNA, 20 bp, Artificial
  CRISPR gRNA sequence
aagtatctgccaaggaattg

SEQ ID NO: 207746 - DNA, 20 bp, Artificial
  CRISPR gRNA sequence
tatctgccaaggaattgtag

SEQ ID NO: 207747 - DNA, 20 bp, Artificial
  CRISPR gRNA sequence
caaggaattgtagcagctcc

SEQ ID NO: 207748 - DNA, 20 bp, Artificial
  CRISPR gRNA sequence
aggaattgtagcagctccta

SEQ ID NO: 207749 - DNA, 20 bp, Artificial
  CRISPR gRNA sequence
tgccctcatttcttgcccca

SEQ ID NO: 207750 - DNA, 20 bp, Artificial
  CRISPR gRNA sequence
catggccccttgcatattta

SEQ ID NO: 207751 - DNA, 20 bp, Artificial
  CRISPR gRNA sequence
gccccttgcatatttaaagc

SEQ ID NO: 207752 - DNA, 20 bp, Artificial
  CRISPR gRNA sequence
ttgcatatttaaagccagca

SEQ ID NO: 207753 - DNA, 20 bp, Artificial
  CRISPR gRNA sequence
tgcatatttaaagccagcaa

SEQ ID NO: 207754 - DNA, 20 bp, Artificial
  CRISPR gRNA sequence
catatttaaagccagcaaag

SEQ ID NO: 207755 - DNA, 20 bp, Artificial
  CRISPR gRNA sequence
ttgaatccctctcacatatt

SEQ ID NO: 207756 - DNA, 20 bp, Artificial
  CRISPR gRNA sequence
acatattgagtttattttgc

SEQ ID NO: 207757 - DNA, 20 bp, Artificial
  CRISPR gRNA sequence
catattgagtttattttgcc

SEQ ID NO: 207758 - DNA, 20 bp, Artificial
  CRISPR gRNA sequence
attgagtttattttgccagg

SEQ ID NO: 207759 - DNA, 20 bp, Artificial
  CRISPR gRNA sequence
ttattttgccaggaagaacc

SEQ ID NO: 207760 - DNA, 20 bp, Artificial
  CRISPR gRNA sequence
ggaagaacccagaccctttt

SEQ ID NO: 207761 - DNA, 20 bp, Artificial
  CRISPR gRNA sequence
aagaacccagacccttttaa

SEQ ID NO: 207762 - DNA, 20 bp, Artificial
  CRISPR gRNA sequence
gacccttttaagagaccact

SEQ ID NO: 207763 - DNA, 20 bp, Artificial
  CRISPR gRNA sequence
cttttaagagaccacttggt

SEQ ID NO: 207764 - DNA, 20 bp, Artificial
  CRISPR gRNA sequence
ttttaagagaccacttggtt

SEQ ID NO: 207765 - DNA, 20 bp, Artificial
  CRISPR gRNA sequence
aagagaccacttggttaggt

SEQ ID NO: 207766 - DNA, 20 bp, Artificial
  CRISPR gRNA sequence
aaaataatctctctttctta

SEQ ID NO: 207767 - DNA, 20 bp, Artificial
  CRISPR gRNA sequence
taatctctctttcttaaagt

SEQ ID NO: 207768 - DNA, 20 bp, Artificial
  CRISPR gRNA sequence
tttcttaaagtcagctgatt

SEQ ID NO: 207769 - DNA, 20 bp, Artificial
  CRISPR gRNA sequence
ttcttaaagtcagctgattt

SEQ ID NO: 207770 - DNA, 20 bp, Artificial
  CRISPR gRNA sequence
atttgggatcttaattacat

SEQ ID NO: 207771 - DNA, 20 bp, Artificial
  CRISPR gRNA sequence
atcagcaaactcccttttgc

SEQ ID NO: 207772 - DNA, 20 bp, Artificial
  CRISPR gRNA sequence
tcagcaaactcccttttgct

SEQ ID NO: 207773 - DNA, 20 bp, Artificial
  CRISPR gRNA sequence
aatgaaatccaatacattca

SEQ ID NO: 207774 - DNA, 20 bp, Artificial
  CRISPR gRNA sequence
atccaatacattcacagtcc

SEQ ID NO: 207775 - DNA, 20 bp, Artificial
  CRISPR gRNA sequence
agtcctagtctcccacacac

SEQ ID NO: 207776 - DNA, 20 bp, Artificial
  CRISPR gRNA sequence
gtcctagtctcccacacaca

SEQ ID NO: 207777 - DNA, 20 bp, Artificial
  CRISPR gRNA sequence
tcctagtctcccacacacaa

SEQ ID NO: 207778 - DNA, 20 bp, Artificial
  CRISPR gRNA sequence
cctagtctcccacacacaag

SEQ ID NO: 207779 - DNA, 20 bp, Artificial
  CRISPR gRNA sequence
tagtctcccacacacaaggg

SEQ ID NO: 207780 - DNA, 20 bp, Artificial
  CRISPR gRNA sequence
agtctcccacacacaagggg

SEQ ID NO: 207781 - DNA, 20 bp, Artificial
  CRISPR gRNA sequence
gtctcccacacacaagggga

SEQ ID NO: 207782 - DNA, 20 bp, Artificial
  CRISPR gRNA sequence
acaaggggagggaattataa

SEQ ID NO: 207783 - DNA, 20 bp, Artificial
  CRISPR gRNA sequence
agggaattataaaagatgca

SEQ ID NO: 207784 - DNA, 20 bp, Artificial
  CRISPR gRNA sequence
aattataaaagatgcatggc

SEQ ID NO: 207785 - DNA, 20 bp, Artificial
  CRISPR gRNA sequence
attataaaagatgcatggct

SEQ ID NO: 207786 - DNA, 20 bp, Artificial
  CRISPR gRNA sequence
ttataaaagatgcatggcta

SEQ ID NO: 207787 - DNA, 20 bp, Artificial
  CRISPR gRNA sequence
taaaagatgcatggctaggg

SEQ ID NO: 207788 - DNA, 20 bp, Artificial
  CRISPR gRNA sequence
aaaagatgcatggctagggc

SEQ ID NO: 207789 - DNA, 20 bp, Artificial
  CRISPR gRNA sequence
aaagatgcatggctagggca

SEQ ID NO: 207790 - DNA, 20 bp, Artificial
  CRISPR gRNA sequence
aagatgcatggctagggcag

SEQ ID NO: 207791 - DNA, 20 bp, Artificial
  CRISPR gRNA sequence
catggctagggcaggggttt

SEQ ID NO: 207792 - DNA, 20 bp, Artificial
  CRISPR gRNA sequence
atggctagggcaggggtttt

SEQ ID NO: 207793 - DNA, 20 bp, Artificial
  CRISPR gRNA sequence
caggggttttgggaccacct

SEQ ID NO: 207794 - DNA, 20 bp, Artificial
  CRISPR gRNA sequence
ttgggaccaccttagaattc

SEQ ID NO: 207795 - DNA, 20 bp, Artificial
  CRISPR gRNA sequence
tgggaccaccttagaattct

SEQ ID NO: 207796 - DNA, 20 bp, Artificial
  CRISPR gRNA sequence
gggtttgattaaataaataa

SEQ ID NO: 207797 - DNA, 20 bp, Artificial
  CRISPR gRNA sequence
ggtttgattaaataaataat

SEQ ID NO: 207798 - DNA, 20 bp, Artificial
  CRISPR gRNA sequence
ttaaataaataatgggactg

SEQ ID NO: 207799 - DNA, 20 bp, Artificial
  CRISPR gRNA sequence
taaataatgggactgtagcc

SEQ ID NO: 207800 - DNA, 20 bp, Artificial
  CRISPR gRNA sequence
taatgggactgtagcctagc

SEQ ID NO: 207801 - DNA, 20 bp, Artificial
  CRISPR gRNA sequence
agcctagcaagtcgacacat

SEQ ID NO: 207802 - DNA, 20 bp, Artificial
  CRISPR gRNA sequence
agcaagtcgacacatcagaa

SEQ ID NO: 207803 - DNA, 20 bp, Artificial
  CRISPR gRNA sequence
catcacaatcctgaaacatc

SEQ ID NO: 207804 - DNA, 20 bp, Artificial
  CRISPR gRNA sequence
tgaaacatcaagtaaaaatt

SEQ ID NO: 207805 - DNA, 20 bp, Artificial
  CRISPR gRNA sequence
taaaaatttggtttgcattt

SEQ ID NO: 207806 - DNA, 20 bp, Artificial
  CRISPR gRNA sequence
aaaaatttggtttgcatttt

SEQ ID NO: 207807 - DNA, 20 bp, Artificial
  CRISPR gRNA sequence
taggattgtaaatgttactg

SEQ ID NO: 207808 - DNA, 20 bp, Artificial
  CRISPR gRNA sequence
gtgtgtgtgtgtgtgtaacc

SEQ ID NO: 207809 - DNA, 20 bp, Artificial
  CRISPR gRNA sequence
cctggtgttccctatgtttg

SEQ ID NO: 207810 - DNA, 20 bp, Artificial
  CRISPR gRNA sequence
ctggtgttccctatgtttgt

SEQ ID NO: 207811 - DNA, 20 bp, Artificial
  CRISPR gRNA sequence
ggtgttccctatgtttgtgg

SEQ ID NO: 207812 - DNA, 20 bp, Artificial
  CRISPR gRNA sequence
cctatgtttgtgggagtttg

SEQ ID NO: 207813 - DNA, 20 bp, Artificial
  CRISPR gRNA sequence
ctatgtttgtgggagtttga

SEQ ID NO: 207814 - DNA, 20 bp, Artificial
  CRISPR gRNA sequence
atgtttgtgggagtttgaag

SEQ ID NO: 207815 - DNA, 20 bp, Artificial
  CRISPR gRNA sequence
tgaaggagacactttgttga

SEQ ID NO: 207816 - DNA, 20 bp, Artificial
  CRISPR gRNA sequence
gaaggagacactttgttgat

SEQ ID NO: 207817 - DNA, 20 bp, Artificial
  CRISPR gRNA sequence
agacactttgttgataggaa

SEQ ID NO: 207818 - DNA, 20 bp, Artificial
  CRISPR gRNA sequence
gaatggtgtcttcacttttt

SEQ ID NO: 207819 - DNA, 20 bp, Artificial
  CRISPR gRNA sequence
aatggtgtcttcactttttt

SEQ ID NO: 207820 - DNA, 20 bp, Artificial
  CRISPR gRNA sequence
taggttgtctcatttttgta

SEQ ID NO: 207821 - DNA, 20 bp, Artificial
  CRISPR gRNA sequence
tctcatttttgtacagtgat

SEQ ID NO: 207822 - DNA, 20 bp, Artificial
  CRISPR gRNA sequence
tgtacagtgataagacaaat

SEQ ID NO: 207823 - DNA, 20 bp, Artificial
  CRISPR gRNA sequence
gtacagtgataagacaaatg

SEQ ID NO: 207824 - DNA, 20 bp, Artificial
  CRISPR gRNA sequence
tgataagacaaatgaggtcc

SEQ ID NO: 207825 - DNA, 20 bp, Artificial
  CRISPR gRNA sequence
gataagacaaatgaggtcct

SEQ ID NO: 207826 - DNA, 20 bp, Artificial
  CRISPR gRNA sequence
cctgggttttaataacactt

SEQ ID NO: 207827 - DNA, 20 bp, Artificial
  CRISPR gRNA sequence
ttaataacacttcagcttga

SEQ ID NO: 207828 - DNA, 20 bp, Artificial
  CRISPR gRNA sequence
tcacttctttgcctttccac

SEQ ID NO: 207829 - DNA, 20 bp, Artificial
  CRISPR gRNA sequence
ttctttgcctttccactagc

SEQ ID NO: 207830 - DNA, 20 bp, Artificial
  CRISPR gRNA sequence
tttgcctttccactagcaag

SEQ ID NO: 207831 - DNA, 20 bp, Artificial
  CRISPR gRNA sequence
tagcaagaagttcattttcg

SEQ ID NO: 207832 - DNA, 20 bp, Artificial
  CRISPR gRNA sequence
caagaagttcattttcgtgg

SEQ ID NO: 207833 - DNA, 20 bp, Artificial
  CRISPR gRNA sequence
tggaagccattctgcctgtc

SEQ ID NO: 207834 - DNA, 20 bp, Artificial
  CRISPR gRNA sequence
ggaagccattctgcctgtcc

SEQ ID NO: 207835 - DNA, 20 bp, Artificial
  CRISPR gRNA sequence
cattctgcctgtccaggaat

SEQ ID NO: 207836 - DNA, 20 bp, Artificial
  CRISPR gRNA sequence
ttctgcctgtccaggaattg

SEQ ID NO: 207837 - DNA, 20 bp, Artificial
  CRISPR gRNA sequence
tctgcctgtccaggaattgg

SEQ ID NO: 207838 - DNA, 20 bp, Artificial
  CRISPR gRNA sequence
tgcctgtccaggaattggag

SEQ ID NO: 207839 - DNA, 20 bp, Artificial
  CRISPR gRNA sequence
cctgtccaggaattggagga

SEQ ID NO: 207840 - DNA, 20 bp, Artificial
  CRISPR gRNA sequence
caggaattggaggagagtga

SEQ ID NO: 207841 - DNA, 20 bp, Artificial
  CRISPR gRNA sequence
ttggaggagagtgatagaca

SEQ ID NO: 207842 - DNA, 20 bp, Artificial
  CRISPR gRNA sequence
agagtgatagacacagttgt

SEQ ID NO: 207843 - DNA, 20 bp, Artificial
  CRISPR gRNA sequence
atagacacagttgtcagcca

SEQ ID NO: 207844 - DNA, 20 bp, Artificial
  CRISPR gRNA sequence
cacagttgtcagccatagct

SEQ ID NO: 207845 - DNA, 20 bp, Artificial
  CRISPR gRNA sequence
acagttgtcagccatagctt

SEQ ID NO: 207846 - DNA, 20 bp, Artificial
  CRISPR gRNA sequence
gttgtcagccatagcttggg

SEQ ID NO: 207847 - DNA, 20 bp, Artificial
  CRISPR gRNA sequence
agccatagcttgggtagaat

SEQ ID NO: 207848 - DNA, 20 bp, Artificial
  CRISPR gRNA sequence
gccatagcttgggtagaata

SEQ ID NO: 207849 - DNA, 20 bp, Artificial
  CRISPR gRNA sequence
aataaggatgtgaatgtcct

SEQ ID NO: 207850 - DNA, 20 bp, Artificial
  CRISPR gRNA sequence
tatctttattaatcttgtga

SEQ ID NO: 207851 - DNA, 20 bp, Artificial
  CRISPR gRNA sequence
aaaatatctgacattgttct

SEQ ID NO: 207852 - DNA, 20 bp, Artificial
  CRISPR gRNA sequence
cattgttcttagtccatttt

SEQ ID NO: 207853 - DNA, 20 bp, Artificial
  CRISPR gRNA sequence
ttaagcttaatttatgttct

SEQ ID NO: 207854 - DNA, 20 bp, Artificial
  CRISPR gRNA sequence
agcttaatttatgttcttag

SEQ ID NO: 207855 - DNA, 20 bp, Artificial
  CRISPR gRNA sequence
aatttatgttcttagtggca

SEQ ID NO: 207856 - DNA, 20 bp, Artificial
  CRISPR gRNA sequence
ttcttagtggcatagaaatt

SEQ ID NO: 207857 - DNA, 20 bp, Artificial
  CRISPR gRNA sequence
cttagtggcatagaaattca

SEQ ID NO: 207858 - DNA, 20 bp, Artificial
  CRISPR gRNA sequence
gcatagaaattcagagctga

SEQ ID NO: 207859 - DNA, 20 bp, Artificial
  CRISPR gRNA sequence
tagaaattcagagctgaaag

SEQ ID NO: 207860 - DNA, 20 bp, Artificial
  CRISPR gRNA sequence
tcatgtctcactctcccctt

SEQ ID NO: 207861 - DNA, 20 bp, Artificial
  CRISPR gRNA sequence
catgtctcactctccccttg

SEQ ID NO: 207862 - DNA, 20 bp, Artificial
  CRISPR gRNA sequence
tcactctccccttgaggaac

SEQ ID NO: 207863 - DNA, 20 bp, Artificial
  CRISPR gRNA sequence
actctccccttgaggaacaa

SEQ ID NO: 207864 - DNA, 20 bp, Artificial
  CRISPR gRNA sequence
caagagttaacgtcatctga

SEQ ID NO: 207865 - DNA, 20 bp, Artificial
  CRISPR gRNA sequence
gtactaccataacaaatcaa

SEQ ID NO: 207866 - DNA, 20 bp, Artificial
  CRISPR gRNA sequence
ataacaaatcaatagcttaa

SEQ ID NO: 207867 - DNA, 20 bp, Artificial
  CRISPR gRNA sequence
taacaaatcaatagcttaat

SEQ ID NO: 207868 - DNA, 20 bp, Artificial
  CRISPR gRNA sequence
caatagcttaataggcatat

SEQ ID NO: 207869 - DNA, 20 bp, Artificial
  CRISPR gRNA sequence
tagcttaataggcatataag

SEQ ID NO: 207870 - DNA, 20 bp, Artificial
  CRISPR gRNA sequence
agtggctttatataaaatgt

SEQ ID NO: 207871 - DNA, 20 bp, Artificial
  CRISPR gRNA sequence
aaatgttggtttttttcccc

SEQ ID NO: 207872 - DNA, 20 bp, Artificial
  CRISPR gRNA sequence
gtttttttcccccagcatct

SEQ ID NO: 207873 - DNA, 20 bp, Artificial
  CRISPR gRNA sequence
ttttcccccagcatctcagt

SEQ ID NO: 207874 - DNA, 20 bp, Artificial
  CRISPR gRNA sequence
cttttcccactgtaacaaat

SEQ ID NO: 207875 - DNA, 20 bp, Artificial
  CRISPR gRNA sequence
tttcccactgtaacaaatta

SEQ ID NO: 207876 - DNA, 20 bp, Artificial
  CRISPR gRNA sequence
tcccactgtaacaaattaga

SEQ ID NO: 207877 - DNA, 20 bp, Artificial
  CRISPR gRNA sequence
ccactgtaacaaattagaga

SEQ ID NO: 207878 - DNA, 20 bp, Artificial
  CRISPR gRNA sequence
cactgtaacaaattagagag

SEQ ID NO: 207879 - DNA, 20 bp, Artificial
  CRISPR gRNA sequence
ctgtaacaaattagagagag

SEQ ID NO: 207880 - DNA, 20 bp, Artificial
  CRISPR gRNA sequence
tgtaacaaattagagagagg

SEQ ID NO: 207881 - DNA, 20 bp, Artificial
  CRISPR gRNA sequence
gagaggaggaacatgttcat

SEQ ID NO: 207882 - DNA, 20 bp, Artificial
  CRISPR gRNA sequence
aacatgttcatcagtgactg

SEQ ID NO: 207883 - DNA, 20 bp, Artificial
  CRISPR gRNA sequence
cagtgactgtagttcaaata

SEQ ID NO: 207884 - DNA, 20 bp, Artificial
  CRISPR gRNA sequence
tgactgtagttcaaatacag

SEQ ID NO: 207885 - DNA, 20 bp, Artificial
  CRISPR gRNA sequence
tcaaatacagcagaaatgtg

SEQ ID NO: 207886 - DNA, 20 bp, Artificial
  CRISPR gRNA sequence
aatacagcagaaatgtgcag

SEQ ID NO: 207887 - DNA, 20 bp, Artificial
  CRISPR gRNA sequence
tgcagcagtgatttcaaact

SEQ ID NO: 207888 - DNA, 20 bp, Artificial
  CRISPR gRNA sequence
cagcagtgatttcaaactga

SEQ ID NO: 207889 - DNA, 20 bp, Artificial
  CRISPR gRNA sequence
atttcaaactgagagaatcc

SEQ ID NO: 207890 - DNA, 20 bp, Artificial
  CRISPR gRNA sequence
cccccacccgccccacatat

SEQ ID NO: 207891 - DNA, 20 bp, Artificial
  CRISPR gRNA sequence
ccccacccgccccacatatc

SEQ ID NO: 207892 - DNA, 20 bp, Artificial
  CRISPR gRNA sequence
cccacccgccccacatatca

SEQ ID NO: 207893 - DNA, 20 bp, Artificial
  CRISPR gRNA sequence
cagggaacaatttaaaatcc

SEQ ID NO: 207894 - DNA, 20 bp, Artificial
  CRISPR gRNA sequence
taaaatcctggcacaataat

SEQ ID NO: 207895 - DNA, 20 bp, Artificial
  CRISPR gRNA sequence
aatcctggcacaataatgag

SEQ ID NO: 207896 - DNA, 20 bp, Artificial
  CRISPR gRNA sequence
atcctggcacaataatgaga

SEQ ID NO: 207897 - DNA, 20 bp, Artificial
  CRISPR gRNA sequence
tcctggcacaataatgagaa

SEQ ID NO: 207898 - DNA, 20 bp, Artificial
  CRISPR gRNA sequence
ctggcacaataatgagaagg

SEQ ID NO: 207899 - DNA, 20 bp, Artificial
  CRISPR gRNA sequence
ggcacaataatgagaaggga

SEQ ID NO: 207900 - DNA, 20 bp, Artificial
  CRISPR gRNA sequence
agggagagtgacaaactgat

SEQ ID NO: 207901 - DNA, 20 bp, Artificial
  CRISPR gRNA sequence
agtgacaaactgataagttc

SEQ ID NO: 207902 - DNA, 20 bp, Artificial
  CRISPR gRNA sequence
caaactgataagttccagtt

SEQ ID NO: 207903 - DNA, 20 bp, Artificial
  CRISPR gRNA sequence
agttccagttaagaatcact

SEQ ID NO: 207904 - DNA, 20 bp, Artificial
  CRISPR gRNA sequence
ccagttaagaatcacttaga

SEQ ID NO: 207905 - DNA, 20 bp, Artificial
  CRISPR gRNA sequence
cagttaagaatcacttagac

SEQ ID NO: 207906 - DNA, 20 bp, Artificial
  CRISPR gRNA sequence
taagaatcacttagacaggc

SEQ ID NO: 207907 - DNA, 20 bp, Artificial
  CRISPR gRNA sequence
aagaatcacttagacaggcc

SEQ ID NO: 207908 - DNA, 20 bp, Artificial
  CRISPR gRNA sequence
tcacttagacaggccaggtg

SEQ ID NO: 207909 - DNA, 20 bp, Artificial
  CRISPR gRNA sequence
cttagacaggccaggtgtgg

SEQ ID NO: 207910 - DNA, 20 bp, Artificial
  CRISPR gRNA sequence
gcagcccacgcctgtaatac

SEQ ID NO: 207911 - DNA, 20 bp, Artificial
  CRISPR gRNA sequence
cgcctgtaataccagcactt

SEQ ID NO: 207912 - DNA, 20 bp, Artificial
  CRISPR gRNA sequence
gcctgtaataccagcacttt

SEQ ID NO: 207913 - DNA, 20 bp, Artificial
  CRISPR gRNA sequence
ctgtaataccagcactttgg

SEQ ID NO: 207914 - DNA, 20 bp, Artificial
  CRISPR gRNA sequence
tgtaataccagcactttggg

SEQ ID NO: 207915 - DNA, 20 bp, Artificial
  CRISPR gRNA sequence
taccagcactttgggaggct

SEQ ID NO: 207916 - DNA, 20 bp, Artificial
  CRISPR gRNA sequence
accagcactttgggaggctg

SEQ ID NO: 207917 - DNA, 20 bp, Artificial
  CRISPR gRNA sequence
agcactttgggaggctgagg

SEQ ID NO: 207918 - DNA, 20 bp, Artificial
  CRISPR gRNA sequence
gcactttgggaggctgaggc

SEQ ID NO: 207919 - DNA, 20 bp, Artificial
  CRISPR gRNA sequence
ctttgggaggctgaggcagg

SEQ ID NO: 207920 - DNA, 20 bp, Artificial
  CRISPR gRNA sequence
ctgaggcaggtggatcacct

SEQ ID NO: 207921 - DNA, 20 bp, Artificial
  CRISPR gRNA sequence
tgaggcaggtggatcacctg

SEQ ID NO: 207922 - DNA, 20 bp, Artificial
  CRISPR gRNA sequence
gcaggtggatcacctgaggt

SEQ ID NO: 207923 - DNA, 20 bp, Artificial
  CRISPR gRNA sequence
caggtggatcacctgaggtc

SEQ ID NO: 207924 - DNA, 20 bp, Artificial
  CRISPR gRNA sequence
tcacctgaggtcaggaattt

SEQ ID NO: 207925 - DNA, 20 bp, Artificial
  CRISPR gRNA sequence
tgaggtcaggaatttgagac

SEQ ID NO: 207926 - DNA, 20 bp, Artificial
  CRISPR gRNA sequence
tcaggaatttgagaccagcc

SEQ ID NO: 207927 - DNA, 20 bp, Artificial
  CRISPR gRNA sequence
tctaccaaaattacaaaatt

SEQ ID NO: 207928 - DNA, 20 bp, Artificial
  CRISPR gRNA sequence
ccaaaattacaaaatttagc

SEQ ID NO: 207929 - DNA, 20 bp, Artificial
  CRISPR gRNA sequence
caaaattacaaaatttagct

SEQ ID NO: 207930 - DNA, 20 bp, Artificial
  CRISPR gRNA sequence
ttacaaaatttagctgggca

SEQ ID NO: 207931 - DNA, 20 bp, Artificial
  CRISPR gRNA sequence
caaaatttagctgggcatgg

SEQ ID NO: 207932 - DNA, 20 bp, Artificial
  CRISPR gRNA sequence
gtggcgcctgcctataatcc

SEQ ID NO: 207933 - DNA, 20 bp, Artificial
  CRISPR gRNA sequence
tgcctataatcccagctact

SEQ ID NO: 207934 - DNA, 20 bp, Artificial
  CRISPR gRNA sequence
gcctataatcccagctactt

SEQ ID NO: 207935 - DNA, 20 bp, Artificial
  CRISPR gRNA sequence
ctataatcccagctacttgg

SEQ ID NO: 207936 - DNA, 20 bp, Artificial
  CRISPR gRNA sequence
tataatcccagctacttggg

SEQ ID NO: 207937 - DNA, 20 bp, Artificial
  CRISPR gRNA sequence
tcccagctacttgggaggct

SEQ ID NO: 207938 - DNA, 20 bp, Artificial
  CRISPR gRNA sequence
agctacttgggaggctgaga

SEQ ID NO: 207939 - DNA, 20 bp, Artificial
  CRISPR gRNA sequence
gctacttgggaggctgagac

SEQ ID NO: 207940 - DNA, 20 bp, Artificial
  CRISPR gRNA sequence
tacttgggaggctgagacag

SEQ ID NO: 207941 - DNA, 20 bp, Artificial
  CRISPR gRNA sequence
acaggagaattgcttgaacc

SEQ ID NO: 207942 - DNA, 20 bp, Artificial
  CRISPR gRNA sequence
caggagaattgcttgaaccc

SEQ ID NO: 207943 - DNA, 20 bp, Artificial
  CRISPR gRNA sequence
ggagaattgcttgaacccgg

SEQ ID NO: 207944 - DNA, 20 bp, Artificial
  CRISPR gRNA sequence
gagaattgcttgaacccggg

SEQ ID NO: 207945 - DNA, 20 bp, Artificial
  CRISPR gRNA sequence
aattgcttgaacccgggagg

SEQ ID NO: 207946 - DNA, 20 bp, Artificial
  CRISPR gRNA sequence
ttgcttgaacccgggaggtg

SEQ ID NO: 207947 - DNA, 20 bp, Artificial
  CRISPR gRNA sequence
tgcttgaacccgggaggtgg

SEQ ID NO: 207948 - DNA, 20 bp, Artificial
  CRISPR gRNA sequence
aacccgggaggtggaggttg

SEQ ID NO: 207949 - DNA, 20 bp, Artificial
  CRISPR gRNA sequence
cgggaggtggaggttgcagt

SEQ ID NO: 207950 - DNA, 20 bp, Artificial
  CRISPR gRNA sequence
ggtggaggttgcagtgagct

SEQ ID NO: 207951 - DNA, 20 bp, Artificial
  CRISPR gRNA sequence
gagaccacaccactgcactc

SEQ ID NO: 207952 - DNA, 20 bp, Artificial
  CRISPR gRNA sequence
cacaccactgcactccagcc

SEQ ID NO: 207953 - DNA, 20 bp, Artificial
  CRISPR gRNA sequence
acaccactgcactccagcct

SEQ ID NO: 207954 - DNA, 20 bp, Artificial
  CRISPR gRNA sequence
ctgcactccagcctgggcaa

SEQ ID NO: 207955 - DNA, 20 bp, Artificial
  CRISPR gRNA sequence
gcactccagcctgggcaaca

SEQ ID NO: 207956 - DNA, 20 bp, Artificial
  CRISPR gRNA sequence
tccagcctgggcaacagagt

SEQ ID NO: 207957 - DNA, 20 bp, Artificial
  CRISPR gRNA sequence
catctcaaaaataaaaaaaa

SEQ ID NO: 207958 - DNA, 20 bp, Artificial
  CRISPR gRNA sequence
ataaaaaaaaaagaatcact

SEQ ID NO: 207959 - DNA, 20 bp, Artificial
  CRISPR gRNA sequence
aaaaaaaagaatcacttaga

SEQ ID NO: 207960 - DNA, 20 bp, Artificial
  CRISPR gRNA sequence
ctcatatttcttgtttcaca

SEQ ID NO: 207961 - DNA, 20 bp, Artificial
  CRISPR gRNA sequence
ttcttgtttcacatagaatc

SEQ ID NO: 207962 - DNA, 20 bp, Artificial
  CRISPR gRNA sequence
tcttgtttcacatagaatct

SEQ ID NO: 207963 - DNA, 20 bp, Artificial
  CRISPR gRNA sequence
ttgtttcacatagaatctgg

SEQ ID NO: 207964 - DNA, 20 bp, Artificial
  CRISPR gRNA sequence
catagaatctgggagtcatc

SEQ ID NO: 207965 - DNA, 20 bp, Artificial
  CRISPR gRNA sequence
agaatctgggagtcatcaag

SEQ ID NO: 207966 - DNA, 20 bp, Artificial
  CRISPR gRNA sequence
ggagtcatcaagtagtcatc

SEQ ID NO: 207967 - DNA, 20 bp, Artificial
  CRISPR gRNA sequence
aattatttctatcacacccc

SEQ ID NO: 207968 - DNA, 20 bp, Artificial
  CRISPR gRNA sequence
tatttctatcacaccccaag

SEQ ID NO: 207969 - DNA, 20 bp, Artificial
  CRISPR gRNA sequence
tctatcacaccccaagtagc

SEQ ID NO: 207970 - DNA, 20 bp, Artificial
  CRISPR gRNA sequence
accccaagtagctggcgatt

SEQ ID NO: 207971 - DNA, 20 bp, Artificial
  CRISPR gRNA sequence
cgattcagattttttactga

SEQ ID NO: 207972 - DNA, 20 bp, Artificial
  CRISPR gRNA sequence
tactgaaagcttgacatgat

SEQ ID NO: 207973 - DNA, 20 bp, Artificial
  CRISPR gRNA sequence
gatgagacattattacttcc

SEQ ID NO: 207974 - DNA, 20 bp, Artificial
  CRISPR gRNA sequence
tgagacattattacttccca

SEQ ID NO: 207975 - DNA, 20 bp, Artificial
  CRISPR gRNA sequence
gagacattattacttcccag

SEQ ID NO: 207976 - DNA, 20 bp, Artificial
  CRISPR gRNA sequence
tattacttcccagaggatct

SEQ ID NO: 207977 - DNA, 20 bp, Artificial
  CRISPR gRNA sequence
agaggatcttggtctgttat

SEQ ID NO: 207978 - DNA, 20 bp, Artificial
  CRISPR gRNA sequence
gaggatcttggtctgttatc

SEQ ID NO: 207979 - DNA, 20 bp, Artificial
  CRISPR gRNA sequence
ggtctgttatcaggcaattt

SEQ ID NO: 207980 - DNA, 20 bp, Artificial
  CRISPR gRNA sequence
tttcagttcttccttaaatc

SEQ ID NO: 207981 - DNA, 20 bp, Artificial
  CRISPR gRNA sequence
ttgctactattctcactcac

SEQ ID NO: 207982 - DNA, 20 bp, Artificial
  CRISPR gRNA sequence
tgctactattctcactcact

SEQ ID NO: 207983 - DNA, 20 bp, Artificial
  CRISPR gRNA sequence
ctactattctcactcactgg

SEQ ID NO: 207984 - DNA, 20 bp, Artificial
  CRISPR gRNA sequence
tactattctcactcactggg

SEQ ID NO: 207985 - DNA, 20 bp, Artificial
  CRISPR gRNA sequence
actattctcactcactggga

SEQ ID NO: 207986 - DNA, 20 bp, Artificial
  CRISPR gRNA sequence
ctcactcactgggagggctg

SEQ ID NO: 207987 - DNA, 20 bp, Artificial
  CRISPR gRNA sequence
agggctgtagtatttctctc

SEQ ID NO: 207988 - DNA, 20 bp, Artificial
  CRISPR gRNA sequence
gatgaaaatctctgttcttt

SEQ ID NO: 207989 - DNA, 20 bp, Artificial
  CRISPR gRNA sequence
gttcttttagccattgctca

SEQ ID NO: 207990 - DNA, 20 bp, Artificial
  CRISPR gRNA sequence
ttagccattgctcatggttt

SEQ ID NO: 207991 - DNA, 20 bp, Artificial
  CRISPR gRNA sequence
tagccattgctcatggtttc

SEQ ID NO: 207992 - DNA, 20 bp, Artificial
  CRISPR gRNA sequence
tggtttcgggatccccattc

SEQ ID NO: 207993 - DNA, 20 bp, Artificial
  CRISPR gRNA sequence
ccattctagtcatcttcctt

SEQ ID NO: 207994 - DNA, 20 bp, Artificial
  CRISPR gRNA sequence
attctagtcatcttcctttg

SEQ ID NO: 207995 - DNA, 20 bp, Artificial
  CRISPR gRNA sequence
cctttggagcaattccctgt

SEQ ID NO: 207996 - DNA, 20 bp, Artificial
  CRISPR gRNA sequence
gttagatcttcaaatgtgat

SEQ ID NO: 207997 - DNA, 20 bp, Artificial
  CRISPR gRNA sequence
caaatgtgatgagtaaaact

SEQ ID NO: 207998 - DNA, 20 bp, Artificial
  CRISPR gRNA sequence
gtgatgagtaaaactgagct

SEQ ID NO: 207999 - DNA, 20 bp, Artificial
  CRISPR gRNA sequence
tgatgagtaaaactgagctc

SEQ ID NO: 208000 - DNA, 20 bp, Artificial
  CRISPR gRNA sequence
gagctcaggactgcgtttgt

SEQ ID NO: 208001 - DNA, 20 bp, Artificial
  CRISPR gRNA sequence
ctgctgctgtaactttctga

SEQ ID NO: 208002 - DNA, 20 bp, Artificial
  CRISPR gRNA sequence
tgctgctgtaactttctgac

SEQ ID NO: 208003 - DNA, 20 bp, Artificial
  CRISPR gRNA sequence
cctgtaatccattctccatg

SEQ ID NO: 208004 - DNA, 20 bp, Artificial
  CRISPR gRNA sequence
cattctccatgtggctgcca

SEQ ID NO: 208005 - DNA, 20 bp, Artificial
  CRISPR gRNA sequence
tctccatgtggctgccaaag

SEQ ID NO: 208006 - DNA, 20 bp, Artificial
  CRISPR gRNA sequence
tgccaaagaagatttgaaat

SEQ ID NO: 208007 - DNA, 20 bp, Artificial
  CRISPR gRNA sequence
aaagaagatttgaaataagt

SEQ ID NO: 208008 - DNA, 20 bp, Artificial
  CRISPR gRNA sequence
aagaagatttgaaataagtc

SEQ ID NO: 208009 - DNA, 20 bp, Artificial
  CRISPR gRNA sequence
ttatttttcttccctattta

SEQ ID NO: 208010 - DNA, 20 bp, Artificial
  CRISPR gRNA sequence
cttccctatttaaagccttc

SEQ ID NO: 208011 - DNA, 20 bp, Artificial
  CRISPR gRNA sequence
cagccgcttgtcattgctct

SEQ ID NO: 208012 - DNA, 20 bp, Artificial
  CRISPR gRNA sequence
aaaatccaaactctcccaac

SEQ ID NO: 208013 - DNA, 20 bp, Artificial
  CRISPR gRNA sequence
aactctcccaacaagctttt

SEQ ID NO: 208014 - DNA, 20 bp, Artificial
  CRISPR gRNA sequence
caagcttttaagactctaca

SEQ ID NO: 208015 - DNA, 20 bp, Artificial
  CRISPR gRNA sequence
gactctacatggtcttgccc

SEQ ID NO: 208016 - DNA, 20 bp, Artificial
  CRISPR gRNA sequence
ttgatctcatcactgaattc

SEQ ID NO: 208017 - DNA, 20 bp, Artificial
  CRISPR gRNA sequence
tcactgaattccagtcacaa

SEQ ID NO: 208018 - DNA, 20 bp, Artificial
  CRISPR gRNA sequence
cagtcacaatggccatcctt

SEQ ID NO: 208019 - DNA, 20 bp, Artificial
  CRISPR gRNA sequence
ggccatcctttggtttctca

SEQ ID NO: 208020 - DNA, 20 bp, Artificial
  CRISPR gRNA sequence
tctcaaagttgccgttcctt

SEQ ID NO: 208021 - DNA, 20 bp, Artificial
  CRISPR gRNA sequence
tcctccctgtcttcacaatg

SEQ ID NO: 208022 - DNA, 20 bp, Artificial
  CRISPR gRNA sequence
cctccctgtcttcacaatgt

SEQ ID NO: 208023 - DNA, 20 bp, Artificial
  CRISPR gRNA sequence
atgtaggctccttcccatcc

SEQ ID NO: 208024 - DNA, 20 bp, Artificial
  CRISPR gRNA sequence
tgtaggctccttcccatcct

SEQ ID NO: 208025 - DNA, 20 bp, Artificial
  CRISPR gRNA sequence
gctccttcccatcctaggct

SEQ ID NO: 208026 - DNA, 20 bp, Artificial
  CRISPR gRNA sequence
cttagtttcgttcctctccc

SEQ ID NO: 208027 - DNA, 20 bp, Artificial
  CRISPR gRNA sequence
tagtttcgttcctctcccta

SEQ ID NO: 208028 - DNA, 20 bp, Artificial
  CRISPR gRNA sequence
agtttcgttcctctccctag

SEQ ID NO: 208029 - DNA, 20 bp, Artificial
  CRISPR gRNA sequence
gaggcctttccttactgcct

SEQ ID NO: 208030 - DNA, 20 bp, Artificial
  CRISPR gRNA sequence
cttctcccactctgcacact

SEQ ID NO: 208031 - DNA, 20 bp, Artificial
  CRISPR gRNA sequence
ttctcccactctgcacactc

SEQ ID NO: 208032 - DNA, 20 bp, Artificial
  CRISPR gRNA sequence
tctcccactctgcacactca

SEQ ID NO: 208033 - DNA, 20 bp, Artificial
  CRISPR gRNA sequence
tcctctgcattgttcactgc

SEQ ID NO: 208034 - DNA, 20 bp, Artificial
  CRISPR gRNA sequence
attgttcactgctggccttc

SEQ ID NO: 208035 - DNA, 20 bp, Artificial
  CRISPR gRNA sequence
tgttcactgctggccttcaa

SEQ ID NO: 208036 - DNA, 20 bp, Artificial
  CRISPR gRNA sequence
actgctggccttcaagagcc

SEQ ID NO: 208037 - DNA, 20 bp, Artificial
  CRISPR gRNA sequence
tgctggccttcaagagccta

SEQ ID NO: 208038 - DNA, 20 bp, Artificial
  CRISPR gRNA sequence
gctggccttcaagagcctag

SEQ ID NO: 208039 - DNA, 20 bp, Artificial
  CRISPR gRNA sequence
tggccttcaagagcctagag

SEQ ID NO: 208040 - DNA, 20 bp, Artificial
  CRISPR gRNA sequence
cctagaggagttcctcccca

SEQ ID NO: 208041 - DNA, 20 bp, Artificial
  CRISPR gRNA sequence
agaggagttcctccccatgg

SEQ ID NO: 208042 - DNA, 20 bp, Artificial
  CRISPR gRNA sequence
gaggagttcctccccatggt

SEQ ID NO: 208043 - DNA, 20 bp, Artificial
  CRISPR gRNA sequence
ccccatggtgggctttcaat

SEQ ID NO: 208044 - DNA, 20 bp, Artificial
  CRISPR gRNA sequence
gggctttcaataagtgtttg

SEQ ID NO: 208045 - DNA, 20 bp, Artificial
  CRISPR gRNA sequence
tcaataagtgtttgtggaat

SEQ ID NO: 208046 - DNA, 20 bp, Artificial
  CRISPR gRNA sequence
ttgtggaataagtgaaaaat

SEQ ID NO: 208047 - DNA, 20 bp, Artificial
  CRISPR gRNA sequence
tggaataagtgaaaaatgag

SEQ ID NO: 208048 - DNA, 20 bp, Artificial
  CRISPR gRNA sequence
tgaaaaatgagtggtcacac

SEQ ID NO: 208049 - DNA, 20 bp, Artificial
  CRISPR gRNA sequence
gaaaaatgagtggtcacacc

SEQ ID NO: 208050 - DNA, 20 bp, Artificial
  CRISPR gRNA sequence
tcctaaaattttgttgtgta

SEQ ID NO: 208051 - DNA, 20 bp, Artificial
  CRISPR gRNA sequence
cctaaaattttgttgtgtat

SEQ ID NO: 208052 - DNA, 20 bp, Artificial
  CRISPR gRNA sequence
ctaaaattttgttgtgtata

SEQ ID NO: 208053 - DNA, 20 bp, Artificial
  CRISPR gRNA sequence
taaaattttgttgtgtatag

SEQ ID NO: 208054 - DNA, 20 bp, Artificial
  CRISPR gRNA sequence
aattttgttgtgtatagggg

SEQ ID NO: 208055 - DNA, 20 bp, Artificial
  CRISPR gRNA sequence
attttgttgtgtataggggc

SEQ ID NO: 208056 - DNA, 20 bp, Artificial
  CRISPR gRNA sequence
ttttgttgtgtataggggca

SEQ ID NO: 208057 - DNA, 20 bp, Artificial
  CRISPR gRNA sequence
ataggggcagggaccaatga

SEQ ID NO: 208058 - DNA, 20 bp, Artificial
  CRISPR gRNA sequence
atgaaagaacatttcattgt

SEQ ID NO: 208059 - DNA, 20 bp, Artificial
  CRISPR gRNA sequence
tgtcagctcatcttgactat

SEQ ID NO: 208060 - DNA, 20 bp, Artificial
  CRISPR gRNA sequence
gctcatcttgactatgagat

SEQ ID NO: 208061 - DNA, 20 bp, Artificial
  CRISPR gRNA sequence
ttgactatgagatcagatat

SEQ ID NO: 208062 - DNA, 20 bp, Artificial
  CRISPR gRNA sequence
cagatattggctatattttg

SEQ ID NO: 208063 - DNA, 20 bp, Artificial
  CRISPR gRNA sequence
agatattggctatattttga

SEQ ID NO: 208064 - DNA, 20 bp, Artificial
  CRISPR gRNA sequence
tattggctatattttgaagg

SEQ ID NO: 208065 - DNA, 20 bp, Artificial
  CRISPR gRNA sequence
ttggctatattttgaaggta

SEQ ID NO: 208066 - DNA, 20 bp, Artificial
  CRISPR gRNA sequence
ctatattttgaaggtagagt

SEQ ID NO: 208067 - DNA, 20 bp, Artificial
  CRISPR gRNA sequence
tattttgaaggtagagtcag

SEQ ID NO: 208068 - DNA, 20 bp, Artificial
  CRISPR gRNA sequence
attttgaaggtagagtcagc

SEQ ID NO: 208069 - DNA, 20 bp, Artificial
  CRISPR gRNA sequence
agcaggatttgctgtttaac

SEQ ID NO: 208070 - DNA, 20 bp, Artificial
  CRISPR gRNA sequence
caggatttgctgtttaacta

SEQ ID NO: 208071 - DNA, 20 bp, Artificial
  CRISPR gRNA sequence
gatttgctgtttaactagag

SEQ ID NO: 208072 - DNA, 20 bp, Artificial
  CRISPR gRNA sequence
atttgctgtttaactagagt

SEQ ID NO: 208073 - DNA, 20 bp, Artificial
  CRISPR gRNA sequence
tgtttaactagagtgggatg

SEQ ID NO: 208074 - DNA, 20 bp, Artificial
  CRISPR gRNA sequence
gtttaactagagtgggatgt

SEQ ID NO: 208075 - DNA, 20 bp, Artificial
  CRISPR gRNA sequence
ttaactagagtgggatgtgg

SEQ ID NO: 208076 - DNA, 20 bp, Artificial
  CRISPR gRNA sequence
gagtgggatgtgggagaaat

SEQ ID NO: 208077 - DNA, 20 bp, Artificial
  CRISPR gRNA sequence
agtgggatgtgggagaaatc

SEQ ID NO: 208078 - DNA, 20 bp, Artificial
  CRISPR gRNA sequence
gtgggatgtgggagaaatca

SEQ ID NO: 208079 - DNA, 20 bp, Artificial
  CRISPR gRNA sequence
gggatgtgggagaaatcagg

SEQ ID NO: 208080 - DNA, 20 bp, Artificial
  CRISPR gRNA sequence
tgtgggagaaatcagggagt

SEQ ID NO: 208081 - DNA, 20 bp, Artificial
  CRISPR gRNA sequence
gtgggagaaatcagggagtc

SEQ ID NO: 208082 - DNA, 20 bp, Artificial
  CRISPR gRNA sequence
agggagtcaggtataactcc

SEQ ID NO: 208083 - DNA, 20 bp, Artificial
  CRISPR gRNA sequence
gggagtcaggtataactcca

SEQ ID NO: 208084 - DNA, 20 bp, Artificial
  CRISPR gRNA sequence
aggtataactccaaggtttt

SEQ ID NO: 208085 - DNA, 20 bp, Artificial
  CRISPR gRNA sequence
actccaaggttttcagcctc

SEQ ID NO: 208086 - DNA, 20 bp, Artificial
  CRISPR gRNA sequence
ttttcagcctcaagcaactg

SEQ ID NO: 208087 - DNA, 20 bp, Artificial
  CRISPR gRNA sequence
gcctcaagcaactgaagaaa

SEQ ID NO: 208088 - DNA, 20 bp, Artificial
  CRISPR gRNA sequence
cctcaagcaactgaagaaat

SEQ ID NO: 208089 - DNA, 20 bp, Artificial
  CRISPR gRNA sequence
ctcaagcaactgaagaaatg

SEQ ID NO: 208090 - DNA, 20 bp, Artificial
  CRISPR gRNA sequence
ggggtcaccacgactgaaat

SEQ ID NO: 208091 - DNA, 20 bp, Artificial
  CRISPR gRNA sequence
gggtcaccacgactgaaatg

SEQ ID NO: 208092 - DNA, 20 bp, Artificial
  CRISPR gRNA sequence
acgactgaaatgaggaaaat

SEQ ID NO: 208093 - DNA, 20 bp, Artificial
  CRISPR gRNA sequence
gactgaaatgaggaaaatga

SEQ ID NO: 208094 - DNA, 20 bp, Artificial
  CRISPR gRNA sequence
actgaaatgaggaaaatgag

SEQ ID NO: 208095 - DNA, 20 bp, Artificial
  CRISPR gRNA sequence
ctgaaatgaggaaaatgaga

SEQ ID NO: 208096 - DNA, 20 bp, Artificial
  CRISPR gRNA sequence
tgaaatgaggaaaatgagag

SEQ ID NO: 208097 - DNA, 20 bp, Artificial
  CRISPR gRNA sequence
gaaatgaggaaaatgagagg

SEQ ID NO: 208098 - DNA, 20 bp, Artificial
  CRISPR gRNA sequence
aatgaggaaaatgagagggg

SEQ ID NO: 208099 - DNA, 20 bp, Artificial
  CRISPR gRNA sequence
ggaaaatgagagggggagtt

SEQ ID NO: 208100 - DNA, 20 bp, Artificial
  CRISPR gRNA sequence
aaatgagagggggagtttag

SEQ ID NO: 208101 - DNA, 20 bp, Artificial
  CRISPR gRNA sequence
aatgagagggggagtttagt

SEQ ID NO: 208102 - DNA, 20 bp, Artificial
  CRISPR gRNA sequence
atgagagggggagtttagtg

SEQ ID NO: 208103 - DNA, 20 bp, Artificial
  CRISPR gRNA sequence
tgagagggggagtttagtgg

SEQ ID NO: 208104 - DNA, 20 bp, Artificial
  CRISPR gRNA sequence
agggggagtttagtggggga

SEQ ID NO: 208105 - DNA, 20 bp, Artificial
  CRISPR gRNA sequence
gggggagtttagtgggggat

SEQ ID NO: 208106 - DNA, 20 bp, Artificial
  CRISPR gRNA sequence
ggggagtttagtgggggatg

SEQ ID NO: 208107 - DNA, 20 bp, Artificial
  CRISPR gRNA sequence
ggatggggtgatgaaaatat

SEQ ID NO: 208108 - DNA, 20 bp, Artificial
  CRISPR gRNA sequence
gatggggtgatgaaaatatc

SEQ ID NO: 208109 - DNA, 20 bp, Artificial
  CRISPR gRNA sequence
gaaaatatcaggattcattg

SEQ ID NO: 208110 - DNA, 20 bp, Artificial
  CRISPR gRNA sequence
gattcattgtggaacatgaa

SEQ ID NO: 208111 - DNA, 20 bp, Artificial
  CRISPR gRNA sequence
attgtggaacatgaacagtt

SEQ ID NO: 208112 - DNA, 20 bp, Artificial
  CRISPR gRNA sequence
tgaacagttaagattaactg

SEQ ID NO: 208113 - DNA, 20 bp, Artificial
  CRISPR gRNA sequence
aacagttaagattaactgaa

SEQ ID NO: 208114 - DNA, 20 bp, Artificial
  CRISPR gRNA sequence
agcctgaattcactgttcct

SEQ ID NO: 208115 - DNA, 20 bp, Artificial
  CRISPR gRNA sequence
tcctcagtttctacaactat

SEQ ID NO: 208116 - DNA, 20 bp, Artificial
  CRISPR gRNA sequence
cctcagtttctacaactata

SEQ ID NO: 208117 - DNA, 20 bp, Artificial
  CRISPR gRNA sequence
tcagtttctacaactataag

SEQ ID NO: 208118 - DNA, 20 bp, Artificial
  CRISPR gRNA sequence
cagtttctacaactataagg

SEQ ID NO: 208119 - DNA, 20 bp, Artificial
  CRISPR gRNA sequence
agtttctacaactataagga

SEQ ID NO: 208120 - DNA, 20 bp, Artificial
  CRISPR gRNA sequence
gtttctacaactataaggag

SEQ ID NO: 208121 - DNA, 20 bp, Artificial
  CRISPR gRNA sequence
atttctcacatcataattgt

SEQ ID NO: 208122 - DNA, 20 bp, Artificial
  CRISPR gRNA sequence
tttctcacatcataattgtg

SEQ ID NO: 208123 - DNA, 20 bp, Artificial
  CRISPR gRNA sequence
catcataattgtgaggattt

SEQ ID NO: 208124 - DNA, 20 bp, Artificial
  CRISPR gRNA sequence
atcataattgtgaggatttg

SEQ ID NO: 208125 - DNA, 20 bp, Artificial
  CRISPR gRNA sequence
cataattgtgaggatttgag

SEQ ID NO: 208126 - DNA, 20 bp, Artificial
  CRISPR gRNA sequence
ttgtgaggatttgaggagtt

SEQ ID NO: 208127 - DNA, 20 bp, Artificial
  CRISPR gRNA sequence
tgtgaggatttgaggagttg

SEQ ID NO: 208128 - DNA, 20 bp, Artificial
  CRISPR gRNA sequence
aggtacacaattaaaaacaa

SEQ ID NO: 208129 - DNA, 20 bp, Artificial
  CRISPR gRNA sequence
cacaattaaaaacaaaagca

SEQ ID NO: 208130 - DNA, 20 bp, Artificial
  CRISPR gRNA sequence
acaattaaaaacaaaagcac

SEQ ID NO: 208131 - DNA, 20 bp, Artificial
  CRISPR gRNA sequence
caattaaaaacaaaagcaca

SEQ ID NO: 208132 - DNA, 20 bp, Artificial
  CRISPR gRNA sequence
aattaaaaacaaaagcacag

SEQ ID NO: 208133 - DNA, 20 bp, Artificial
  CRISPR gRNA sequence
taaaaacaaaagcacagggg

SEQ ID NO: 208134 - DNA, 20 bp, Artificial
  CRISPR gRNA sequence
aacaaaagcacaggggaagt

SEQ ID NO: 208135 - DNA, 20 bp, Artificial
  CRISPR gRNA sequence
acaaaagcacaggggaagta

SEQ ID NO: 208136 - DNA, 20 bp, Artificial
  CRISPR gRNA sequence
taaggaaaaatacatcaatt

SEQ ID NO: 208137 - DNA, 20 bp, Artificial
  CRISPR gRNA sequence
aaaaatacatcaattaagca

SEQ ID NO: 208138 - DNA, 20 bp, Artificial
  CRISPR gRNA sequence
catcaattaagcatggctat

SEQ ID NO: 208139 - DNA, 20 bp, Artificial
  CRISPR gRNA sequence
agcatggctattagaccata

SEQ ID NO: 208140 - DNA, 20 bp, Artificial
  CRISPR gRNA sequence
tacagccttaccaaatccat

SEQ ID NO: 208141 - DNA, 20 bp, Artificial
  CRISPR gRNA sequence
acagccttaccaaatccatt

SEQ ID NO: 208142 - DNA, 20 bp, Artificial
  CRISPR gRNA sequence
cagccttaccaaatccattg

SEQ ID NO: 208143 - DNA, 20 bp, Artificial
  CRISPR gRNA sequence
ttaccaaatccattggggat

SEQ ID NO: 208144 - DNA, 20 bp, Artificial
  CRISPR gRNA sequence
gggattagatacaaaaatcc

SEQ ID NO: 208145 - DNA, 20 bp, Artificial
  CRISPR gRNA sequence
tgatctccaaaattttttcc

SEQ ID NO: 208146 - DNA, 20 bp, Artificial
  CRISPR gRNA sequence
tctccaaaattttttcctgg

SEQ ID NO: 208147 - DNA, 20 bp, Artificial
  CRISPR gRNA sequence
ctccaaaattttttcctggt

SEQ ID NO: 208148 - DNA, 20 bp, Artificial
  CRISPR gRNA sequence
tccaaaattttttcctggta

SEQ ID NO: 208149 - DNA, 20 bp, Artificial
  CRISPR gRNA sequence
attttttcctggtagggttt

SEQ ID NO: 208150 - DNA, 20 bp, Artificial
  CRISPR gRNA sequence
ttttttcctggtagggtttt

SEQ ID NO: 208151 - DNA, 20 bp, Artificial
  CRISPR gRNA sequence
tagggttttaggctatactg

SEQ ID NO: 208152 - DNA, 20 bp, Artificial
  CRISPR gRNA sequence
atactgaagtgacttttctt

SEQ ID NO: 208153 - DNA, 20 bp, Artificial
  CRISPR gRNA sequence
aagtgacttttctttggcat

SEQ ID NO: 208154 - DNA, 20 bp, Artificial
  CRISPR gRNA sequence
tgacttttctttggcataag

SEQ ID NO: 208155 - DNA, 20 bp, Artificial
  CRISPR gRNA sequence
ctttggcataagaagatatt

SEQ ID NO: 208156 - DNA, 20 bp, Artificial
  CRISPR gRNA sequence
taagaagatattcagttata

SEQ ID NO: 208157 - DNA, 20 bp, Artificial
  CRISPR gRNA sequence
aagatattcagttatacagt

SEQ ID NO: 208158 - DNA, 20 bp, Artificial
  CRISPR gRNA sequence
cagttatacagttggaaata

SEQ ID NO: 208159 - DNA, 20 bp, Artificial
  CRISPR gRNA sequence
agttatacagttggaaataa

SEQ ID NO: 208160 - DNA, 20 bp, Artificial
  CRISPR gRNA sequence
tggaaataaaggtattgatt

SEQ ID NO: 208161 - DNA, 20 bp, Artificial
  CRISPR gRNA sequence
gaaataaaggtattgatttg

SEQ ID NO: 208162 - DNA, 20 bp, Artificial
  CRISPR gRNA sequence
gagtatccaaaaacatctct

SEQ ID NO: 208163 - DNA, 20 bp, Artificial
  CRISPR gRNA sequence
tatccaaaaacatctctcag

SEQ ID NO: 208164 - DNA, 20 bp, Artificial
  CRISPR gRNA sequence
tccaaaaacatctctcagta

SEQ ID NO: 208165 - DNA, 20 bp, Artificial
  CRISPR gRNA sequence
tcagtagagatccacaacca

SEQ ID NO: 208166 - DNA, 20 bp, Artificial
  CRISPR gRNA sequence
gtagagatccacaaccaaag

SEQ ID NO: 208167 - DNA, 20 bp, Artificial
  CRISPR gRNA sequence
aaccaaagaagcataaaaaa

SEQ ID NO: 208168 - DNA, 20 bp, Artificial
  CRISPR gRNA sequence
atgaccattgcaaccctcaa

SEQ ID NO: 208169 - DNA, 20 bp, Artificial
  CRISPR gRNA sequence
aaccctcaacagcaaacata

SEQ ID NO: 208170 - DNA, 20 bp, Artificial
  CRISPR gRNA sequence
ccctcaacagcaaacatatg

SEQ ID NO: 208171 - DNA, 20 bp, Artificial
  CRISPR gRNA sequence
tatggagtctctactacata

SEQ ID NO: 208172 - DNA, 20 bp, Artificial
  CRISPR gRNA sequence
tggagtctctactacatata

SEQ ID NO: 208173 - DNA, 20 bp, Artificial
  CRISPR gRNA sequence
ggagtctctactacatatag

SEQ ID NO: 208174 - DNA, 20 bp, Artificial
  CRISPR gRNA sequence
ctacatatagaggaaaatgc

SEQ ID NO: 208175 - DNA, 20 bp, Artificial
  CRISPR gRNA sequence
ggaaaatgctagattctgaa

SEQ ID NO: 208176 - DNA, 20 bp, Artificial
  CRISPR gRNA sequence
aaaagctaatatctataaaa

SEQ ID NO: 208177 - DNA, 20 bp, Artificial
  CRISPR gRNA sequence
aagctaatatctataaaaca

SEQ ID NO: 208178 - DNA, 20 bp, Artificial
  CRISPR gRNA sequence
tttatgatgttgttatattc

SEQ ID NO: 208179 - DNA, 20 bp, Artificial
  CRISPR gRNA sequence
ttatgatgttgttatattct

SEQ ID NO: 208180 - DNA, 20 bp, Artificial
  CRISPR gRNA sequence
tatgatgttgttatattctg

SEQ ID NO: 208181 - DNA, 20 bp, Artificial
  CRISPR gRNA sequence
tatattctggggattgatgt

SEQ ID NO: 208182 - DNA, 20 bp, Artificial
  CRISPR gRNA sequence
gattgatgtaagcattttac

SEQ ID NO: 208183 - DNA, 20 bp, Artificial
  CRISPR gRNA sequence
attgatgtaagcattttacc

SEQ ID NO: 208184 - DNA, 20 bp, Artificial
  CRISPR gRNA sequence
cattttaccaggacttatta

SEQ ID NO: 208185 - DNA, 20 bp, Artificial
  CRISPR gRNA sequence
aggacttattatagcattat

SEQ ID NO: 208186 - DNA, 20 bp, Artificial
  CRISPR gRNA sequence
tagcattataagcttaacac

SEQ ID NO: 208187 - DNA, 20 bp, Artificial
  CRISPR gRNA sequence
agcttaacacaagaaatatg

SEQ ID NO: 208188 - DNA, 20 bp, Artificial
  CRISPR gRNA sequence
gaaatatgtggctatcatta

SEQ ID NO: 208189 - DNA, 20 bp, Artificial
  CRISPR gRNA sequence
aatatgtggctatcattatg

SEQ ID NO: 208190 - DNA, 20 bp, Artificial
  CRISPR gRNA sequence
tggctatcattatggagtga

SEQ ID NO: 208191 - DNA, 20 bp, Artificial
  CRISPR gRNA sequence
ggctatcattatggagtgaa

SEQ ID NO: 208192 - DNA, 20 bp, Artificial
  CRISPR gRNA sequence
atcattatggagtgaaaggc

SEQ ID NO: 208193 - DNA, 20 bp, Artificial
  CRISPR gRNA sequence
aaattcctcacctgtgacct

SEQ ID NO: 208194 - DNA, 20 bp, Artificial
  CRISPR gRNA sequence
attcctcacctgtgacctga

SEQ ID NO: 208195 - DNA, 20 bp, Artificial
  CRISPR gRNA sequence
ctcacctgtgacctgagaga

SEQ ID NO: 208196 - DNA, 20 bp, Artificial
  CRISPR gRNA sequence
gtgacctgagagatagtgcg

SEQ ID NO: 208197 - DNA, 20 bp, Artificial
  CRISPR gRNA sequence
acctgagagatagtgcgtgg

SEQ ID NO: 208198 - DNA, 20 bp, Artificial
  CRISPR gRNA sequence
tagtgcgtggtagaatttga

SEQ ID NO: 208199 - DNA, 20 bp, Artificial
  CRISPR gRNA sequence
tgcgtggtagaatttgaaag

SEQ ID NO: 208200 - DNA, 20 bp, Artificial
  CRISPR gRNA sequence
tttgaaagaagtgttgattt

SEQ ID NO: 208201 - DNA, 20 bp, Artificial
  CRISPR gRNA sequence
tgaaagaagtgttgatttca

SEQ ID NO: 208202 - DNA, 20 bp, Artificial
  CRISPR gRNA sequence
gaaagaagtgttgatttcag

SEQ ID NO: 208203 - DNA, 20 bp, Artificial
  CRISPR gRNA sequence
tgttgatttcagaggaatgc

SEQ ID NO: 208204 - DNA, 20 bp, Artificial
  CRISPR gRNA sequence
gaggaatgctagtgcttgct

SEQ ID NO: 208205 - DNA, 20 bp, Artificial
  CRISPR gRNA sequence
aggaatgctagtgcttgctt

SEQ ID NO: 208206 - DNA, 20 bp, Artificial
  CRISPR gRNA sequence
ggaatgctagtgcttgctta

SEQ ID NO: 208207 - DNA, 20 bp, Artificial
  CRISPR gRNA sequence
atgctagtgcttgcttaggg

SEQ ID NO: 208208 - DNA, 20 bp, Artificial
  CRISPR gRNA sequence
tgcttgcttagggcagtatt

SEQ ID NO: 208209 - DNA, 20 bp, Artificial
  CRISPR gRNA sequence
ttgcttagggcagtattcag

SEQ ID NO: 208210 - DNA, 20 bp, Artificial
  CRISPR gRNA sequence
gaagaactcttccaatcaca

SEQ ID NO: 208211 - DNA, 20 bp, Artificial
  CRISPR gRNA sequence
caatcacacagccccttgta

SEQ ID NO: 208212 - DNA, 20 bp, Artificial
  CRISPR gRNA sequence
aatcacacagccccttgtac

SEQ ID NO: 208213 - DNA, 20 bp, Artificial
  CRISPR gRNA sequence
ccccttgtacaggcaaactc

SEQ ID NO: 208214 - DNA, 20 bp, Artificial
  CRISPR gRNA sequence
ggcaaactccggaatacttt

SEQ ID NO: 208215 - DNA, 20 bp, Artificial
  CRISPR gRNA sequence
atactttcagtacatttact

SEQ ID NO: 208216 - DNA, 20 bp, Artificial
  CRISPR gRNA sequence
catttacttggctttattgt

SEQ ID NO: 208217 - DNA, 20 bp, Artificial
  CRISPR gRNA sequence
tttacttggctttattgtta

SEQ ID NO: 208218 - DNA, 20 bp, Artificial
  CRISPR gRNA sequence
acttggctttattgttagag

SEQ ID NO: 208219 - DNA, 20 bp, Artificial
  CRISPR gRNA sequence
ttgttagagcagaaacttca

SEQ ID NO: 208220 - DNA, 20 bp, Artificial
  CRISPR gRNA sequence
aaacttcacagctaaaatta

SEQ ID NO: 208221 - DNA, 20 bp, Artificial
  CRISPR gRNA sequence
cacagctaaaattatggtct

SEQ ID NO: 208222 - DNA, 20 bp, Artificial
  CRISPR gRNA sequence
acagctaaaattatggtctt

SEQ ID NO: 208223 - DNA, 20 bp, Artificial
  CRISPR gRNA sequence
cagctaaaattatggtctta

SEQ ID NO: 208224 - DNA, 20 bp, Artificial
  CRISPR gRNA sequence
agctaaaattatggtcttag

SEQ ID NO: 208225 - DNA, 20 bp, Artificial
  CRISPR gRNA sequence
ttatggtcttaggggtttat

SEQ ID NO: 208226 - DNA, 20 bp, Artificial
  CRISPR gRNA sequence
caattaaacttaatttttaa

SEQ ID NO: 208227 - DNA, 20 bp, Artificial
  CRISPR gRNA sequence
gttctcacaaatcttatttg

SEQ ID NO: 208228 - DNA, 20 bp, Artificial
  CRISPR gRNA sequence
atatcttaatttcctttata

SEQ ID NO: 208229 - DNA, 20 bp, Artificial
  CRISPR gRNA sequence
tatcttaatttcctttatat

SEQ ID NO: 208230 - DNA, 20 bp, Artificial
  CRISPR gRNA sequence
tttcctttatataggatatg

SEQ ID NO: 208231 - DNA, 20 bp, Artificial
  CRISPR gRNA sequence
tggatatatttttatgataa

SEQ ID NO: 208232 - DNA, 20 bp, Artificial
  CRISPR gRNA sequence
acatgtgaccaacttaataa

SEQ ID NO: 208233 - DNA, 20 bp, Artificial
  CRISPR gRNA sequence
acagcttcgttaatatccta

SEQ ID NO: 208234 - DNA, 20 bp, Artificial
  CRISPR gRNA sequence
catcttactttacatataaa

SEQ ID NO: 208235 - DNA, 20 bp, Artificial
  CRISPR gRNA sequence
acatataaacagtccttctg

SEQ ID NO: 208236 - DNA, 20 bp, Artificial
  CRISPR gRNA sequence
ttctgaagcctaattatgca

SEQ ID NO: 208237 - DNA, 20 bp, Artificial
  CRISPR gRNA sequence
taattatgcatggataattg

SEQ ID NO: 208238 - DNA, 20 bp, Artificial
  CRISPR gRNA sequence
attatgcatggataattgca

SEQ ID NO: 208239 - DNA, 20 bp, Artificial
  CRISPR gRNA sequence
tgcatggataattgcagagt

SEQ ID NO: 208240 - DNA, 20 bp, Artificial
  CRISPR gRNA sequence
ggataattgcagagtgagtt

SEQ ID NO: 208241 - DNA, 20 bp, Artificial
  CRISPR gRNA sequence
gataattgcagagtgagttt

SEQ ID NO: 208242 - DNA, 20 bp, Artificial
  CRISPR gRNA sequence
ttgcagagtgagtttgggaa

SEQ ID NO: 208243 - DNA, 20 bp, Artificial
  CRISPR gRNA sequence
gagtttgggaaaagaccaac

SEQ ID NO: 208244 - DNA, 20 bp, Artificial
  CRISPR gRNA sequence
agtttgggaaaagaccaacc

SEQ ID NO: 208245 - DNA, 20 bp, Artificial
  CRISPR gRNA sequence
ctctccattttaaccacaat

SEQ ID NO: 208246 - DNA, 20 bp, Artificial
  CRISPR gRNA sequence
tccattttaaccacaatgag

SEQ ID NO: 208247 - DNA, 20 bp, Artificial
  CRISPR gRNA sequence
cattttaaccacaatgagaa

SEQ ID NO: 208248 - DNA, 20 bp, Artificial
  CRISPR gRNA sequence
ttttaaccacaatgagaaga

SEQ ID NO: 208249 - DNA, 20 bp, Artificial
  CRISPR gRNA sequence
cacaatgagaagagagtacc

SEQ ID NO: 208250 - DNA, 20 bp, Artificial
  CRISPR gRNA sequence
aatgagaagagagtacctag

SEQ ID NO: 208251 - DNA, 20 bp, Artificial
  CRISPR gRNA sequence
agtggtgcatcttcctcgct

SEQ ID NO: 208252 - DNA, 20 bp, Artificial
  CRISPR gRNA sequence
gtggtgcatcttcctcgctt

SEQ ID NO: 208253 - DNA, 20 bp, Artificial
  CRISPR gRNA sequence
cttcctcgcttaggttccct

SEQ ID NO: 208254 - DNA, 20 bp, Artificial
  CRISPR gRNA sequence
gttccctgagtctgtcttta

SEQ ID NO: 208255 - DNA, 20 bp, Artificial
  CRISPR gRNA sequence
ttccctgagtctgtctttac

SEQ ID NO: 208256 - DNA, 20 bp, Artificial
  CRISPR gRNA sequence
cctgagtctgtctttacagg

SEQ ID NO: 208257 - DNA, 20 bp, Artificial
  CRISPR gRNA sequence
gaagacttcattgttacttg

SEQ ID NO: 208258 - DNA, 20 bp, Artificial
  CRISPR gRNA sequence
aagacttcattgttacttga

SEQ ID NO: 208259 - DNA, 20 bp, Artificial
  CRISPR gRNA sequence
gttacttgaaggtacattct

SEQ ID NO: 208260 - DNA, 20 bp, Artificial
  CRISPR gRNA sequence
ttcttggaactttacacacc

SEQ ID NO: 208261 - DNA, 20 bp, Artificial
  CRISPR gRNA sequence
acatgaatacatacttattt

SEQ ID NO: 208262 - DNA, 20 bp, Artificial
  CRISPR gRNA sequence
catacttattttagttaact

SEQ ID NO: 208263 - DNA, 20 bp, Artificial
  CRISPR gRNA sequence
attttagttaactgagtact

SEQ ID NO: 208264 - DNA, 20 bp, Artificial
  CRISPR gRNA sequence
tagttaactgagtacttagt

SEQ ID NO: 208265 - DNA, 20 bp, Artificial
  CRISPR gRNA sequence
ctgagtacttagtgagtgct

SEQ ID NO: 208266 - DNA, 20 bp, Artificial
  CRISPR gRNA sequence
tgagtgctaagctttgtttt

SEQ ID NO: 208267 - DNA, 20 bp, Artificial
  CRISPR gRNA sequence
tgttttaagccctttgcatg

SEQ ID NO: 208268 - DNA, 20 bp, Artificial
  CRISPR gRNA sequence
tagtttattaactttgttaa

SEQ ID NO: 208269 - DNA, 20 bp, Artificial
  CRISPR gRNA sequence
aactttgttaatagttacaa

SEQ ID NO: 208270 - DNA, 20 bp, Artificial
  CRISPR gRNA sequence
aatagttacaacagtccttc

SEQ ID NO: 208271 - DNA, 20 bp, Artificial
  CRISPR gRNA sequence
atacatgtactgtgttatac

SEQ ID NO: 208272 - DNA, 20 bp, Artificial
  CRISPR gRNA sequence
actgtgttatactagtgtaa

SEQ ID NO: 208273 - DNA, 20 bp, Artificial
  CRISPR gRNA sequence
gttatactagtgtaacagtt

SEQ ID NO: 208274 - DNA, 20 bp, Artificial
  CRISPR gRNA sequence
ttatactagtgtaacagttg

SEQ ID NO: 208275 - DNA, 20 bp, Artificial
  CRISPR gRNA sequence
tgtaacagttgaggacacca

SEQ ID NO: 208276 - DNA, 20 bp, Artificial
  CRISPR gRNA sequence
gttgaggacaccaaagaaca

SEQ ID NO: 208277 - DNA, 20 bp, Artificial
  CRISPR gRNA sequence
tgaggacaccaaagaacaaa

SEQ ID NO: 208278 - DNA, 20 bp, Artificial
  CRISPR gRNA sequence
gaggacaccaaagaacaaag

SEQ ID NO: 208279 - DNA, 20 bp, Artificial
  CRISPR gRNA sequence
aacaaagaggtgttgacacg

SEQ ID NO: 208280 - DNA, 20 bp, Artificial
  CRISPR gRNA sequence
gaggtgttgacacgtggtca

SEQ ID NO: 208281 - DNA, 20 bp, Artificial
  CRISPR gRNA sequence
gacacgtggtcacggttcca

SEQ ID NO: 208282 - DNA, 20 bp, Artificial
  CRISPR gRNA sequence
cacgtggtcacggttccata

SEQ ID NO: 208283 - DNA, 20 bp, Artificial
  CRISPR gRNA sequence
tcacggttccatagagtgtt

SEQ ID NO: 208284 - DNA, 20 bp, Artificial
  CRISPR gRNA sequence
ggttccatagagtgttaagt

SEQ ID NO: 208285 - DNA, 20 bp, Artificial
  CRISPR gRNA sequence
ttccatagagtgttaagtta

SEQ ID NO: 208286 - DNA, 20 bp, Artificial
  CRISPR gRNA sequence
atagagtgttaagttagagt

SEQ ID NO: 208287 - DNA, 20 bp, Artificial
  CRISPR gRNA sequence
tagagtgttaagttagagtt

SEQ ID NO: 208288 - DNA, 20 bp, Artificial
  CRISPR gRNA sequence
ttagagttgggttcaaaccc

SEQ ID NO: 208289 - DNA, 20 bp, Artificial
  CRISPR gRNA sequence
gagttgggttcaaaccctgg

SEQ ID NO: 208290 - DNA, 20 bp, Artificial
  CRISPR gRNA sequence
gggttcaaaccctggcagtg

SEQ ID NO: 208291 - DNA, 20 bp, Artificial
  CRISPR gRNA sequence
aaaccctggcagtgtggcca

SEQ ID NO: 208292 - DNA, 20 bp, Artificial
  CRISPR gRNA sequence
accctggcagtgtggccaca

SEQ ID NO: 208293 - DNA, 20 bp, Artificial
  CRISPR gRNA sequence
tggccacagagccttgttct

SEQ ID NO: 208294 - DNA, 20 bp, Artificial
  CRISPR gRNA sequence
tacctcctcccgtgaaacat

SEQ ID NO: 208295 - DNA, 20 bp, Artificial
  CRISPR gRNA sequence
gtgaaacataagaaaaatgt

SEQ ID NO: 208296 - DNA, 20 bp, Artificial
  CRISPR gRNA sequence
gaaaaatgtgagaaatgctt

SEQ ID NO: 208297 - DNA, 20 bp, Artificial
  CRISPR gRNA sequence
aatgtgagaaatgcttaagt

SEQ ID NO: 208298 - DNA, 20 bp, Artificial
  CRISPR gRNA sequence
gagaaatgcttaagtaagtg

SEQ ID NO: 208299 - DNA, 20 bp, Artificial
  CRISPR gRNA sequence
ttcataaataaaatttacat

SEQ ID NO: 208300 - DNA, 20 bp, Artificial
  CRISPR gRNA sequence
aaataaatacatgtaaaaat

SEQ ID NO: 208301 - DNA, 20 bp, Artificial
  CRISPR gRNA sequence
aataaatacatgtaaaaata

SEQ ID NO: 208302 - DNA, 20 bp, Artificial
  CRISPR gRNA sequence
tacatgtaaaaataaggcca

SEQ ID NO: 208303 - DNA, 20 bp, Artificial
  CRISPR gRNA sequence
ttttttccatctctataata

SEQ ID NO: 208304 - DNA, 20 bp, Artificial
  CRISPR gRNA sequence
ctataataaagcatgtatta

SEQ ID NO: 208305 - DNA, 20 bp, Artificial
  CRISPR gRNA sequence
aagcatgtattatagaccat

SEQ ID NO: 208306 - DNA, 20 bp, Artificial
  CRISPR gRNA sequence
catgtattatagaccattag

SEQ ID NO: 208307 - DNA, 20 bp, Artificial
  CRISPR gRNA sequence
tagaccattagcagaattta

SEQ ID NO: 208308 - DNA, 20 bp, Artificial
  CRISPR gRNA sequence
tagcagaatttaaagtgtta

SEQ ID NO: 208309 - DNA, 20 bp, Artificial
  CRISPR gRNA sequence
acttttgttttcttcttccc

SEQ ID NO: 208310 - DNA, 20 bp, Artificial
  CRISPR gRNA sequence
tttcttcttccccagtttca

SEQ ID NO: 208311 - DNA, 20 bp, Artificial
  CRISPR gRNA sequence
tttttgctatactcctgttc

SEQ ID NO: 208312 - DNA, 20 bp, Artificial
  CRISPR gRNA sequence
ttttgctatactcctgttct

SEQ ID NO: 208313 - DNA, 20 bp, Artificial
  CRISPR gRNA sequence
tttgctatactcctgttctg

SEQ ID NO: 208314 - DNA, 20 bp, Artificial
  CRISPR gRNA sequence
ctatactcctgttctgggga

SEQ ID NO: 208315 - DNA, 20 bp, Artificial
  CRISPR gRNA sequence
ctcctgttctggggacagtt

SEQ ID NO: 208316 - DNA, 20 bp, Artificial
  CRISPR gRNA sequence
tggggacagtttggtattaa

SEQ ID NO: 208317 - DNA, 20 bp, Artificial
  CRISPR gRNA sequence
gacagtttggtattaaaagt

SEQ ID NO: 208318 - DNA, 20 bp, Artificial
  CRISPR gRNA sequence
tctacttttcatttatgttt

SEQ ID NO: 208319 - DNA, 20 bp, Artificial
  CRISPR gRNA sequence
tttatgtttcagtgatgata

SEQ ID NO: 208320 - DNA, 20 bp, Artificial
  CRISPR gRNA sequence
gatgatatagttatttctac

SEQ ID NO: 208321 - DNA, 20 bp, Artificial
  CRISPR gRNA sequence
ttatttctacgagacattgt

SEQ ID NO: 208322 - DNA, 20 bp, Artificial
  CRISPR gRNA sequence
cattgtcagcgaaatattta

SEQ ID NO: 208323 - DNA, 20 bp, Artificial
  CRISPR gRNA sequence
cgaaatatttaaagttgtac

SEQ ID NO: 208324 - DNA, 20 bp, Artificial
  CRISPR gRNA sequence
gaaatatttaaagttgtact

SEQ ID NO: 208325 - DNA, 20 bp, Artificial
  CRISPR gRNA sequence
atttaaagttgtactaggaa

SEQ ID NO: 208326 - DNA, 20 bp, Artificial
  CRISPR gRNA sequence
agtgctattatgataaatat

SEQ ID NO: 208327 - DNA, 20 bp, Artificial
  CRISPR gRNA sequence
gtatgtaatttgaatactac

SEQ ID NO: 208328 - DNA, 20 bp, Artificial
  CRISPR gRNA sequence
gaatactactagtctccttg

SEQ ID NO: 208329 - DNA, 20 bp, Artificial
  CRISPR gRNA sequence
ttgtcgcccacattttgctg

SEQ ID NO: 208330 - DNA, 20 bp, Artificial
  CRISPR gRNA sequence
gcagttcacttttaattcct

SEQ ID NO: 208331 - DNA, 20 bp, Artificial
  CRISPR gRNA sequence
gttcacttttaattcctaag

SEQ ID NO: 208332 - DNA, 20 bp, Artificial
  CRISPR gRNA sequence
ttcacttttaattcctaaga

SEQ ID NO: 208333 - DNA, 20 bp, Artificial
  CRISPR gRNA sequence
ctaagaaggttgttttcact

SEQ ID NO: 208334 - DNA, 20 bp, Artificial
  CRISPR gRNA sequence
tggtgtttttttaatctctt

SEQ ID NO: 208335 - DNA, 20 bp, Artificial
  CRISPR gRNA sequence
tttaatctcttaagaatgaa

SEQ ID NO: 208336 - DNA, 20 bp, Artificial
  CRISPR gRNA sequence
aatctcttaagaatgaatag

SEQ ID NO: 208337 - DNA, 20 bp, Artificial
  CRISPR gRNA sequence
atctcttaagaatgaatagt

SEQ ID NO: 208338 - DNA, 20 bp, Artificial
  CRISPR gRNA sequence
agaatgaatagtaggaatat

SEQ ID NO: 208339 - DNA, 20 bp, Artificial
  CRISPR gRNA sequence
atgtcacattttaatattca

SEQ ID NO: 208340 - DNA, 20 bp, Artificial
  CRISPR gRNA sequence
ctacacacacattatgttat

SEQ ID NO: 208341 - DNA, 20 bp, Artificial
  CRISPR gRNA sequence
tacacacacattatgttatt

SEQ ID NO: 208342 - DNA, 20 bp, Artificial
  CRISPR gRNA sequence
acattatgttattaggtaaa

SEQ ID NO: 208343 - DNA, 20 bp, Artificial
  CRISPR gRNA sequence
cattatgttattaggtaaac

SEQ ID NO: 208344 - DNA, 20 bp, Artificial
  CRISPR gRNA sequence
tatgttattaggtaaacagg

SEQ ID NO: 208345 - DNA, 20 bp, Artificial
  CRISPR gRNA sequence
attaggtaaacaggtggtga

SEQ ID NO: 208346 - DNA, 20 bp, Artificial
  CRISPR gRNA sequence
caggtggtgacagcctgcat

SEQ ID NO: 208347 - DNA, 20 bp, Artificial
  CRISPR gRNA sequence
tgacagcctgcattagtttt

SEQ ID NO: 208348 - DNA, 20 bp, Artificial
  CRISPR gRNA sequence
gacagcctgcattagtttta

SEQ ID NO: 208349 - DNA, 20 bp, Artificial
  CRISPR gRNA sequence
agcctgcattagttttaagg

SEQ ID NO: 208350 - DNA, 20 bp, Artificial
  CRISPR gRNA sequence
gcctgcattagttttaaggt

SEQ ID NO: 208351 - DNA, 20 bp, Artificial
  CRISPR gRNA sequence
taaggtaggacgttatactt

SEQ ID NO: 208352 - DNA, 20 bp, Artificial
  CRISPR gRNA sequence
aggtaggacgttatactttg

SEQ ID NO: 208353 - DNA, 20 bp, Artificial
  CRISPR gRNA sequence
acgttatactttggagcatt

SEQ ID NO: 208354 - DNA, 20 bp, Artificial
  CRISPR gRNA sequence
ttcccctctttttattttcc

SEQ ID NO: 208355 - DNA, 20 bp, Artificial
  CRISPR gRNA sequence
tgtgtacacgtgttcaccct

SEQ ID NO: 208356 - DNA, 20 bp, Artificial
  CRISPR gRNA sequence
acacgtgttcacccttggaa

SEQ ID NO: 208357 - DNA, 20 bp, Artificial
  CRISPR gRNA sequence
tgttcacccttggaaaagtc

SEQ ID NO: 208358 - DNA, 20 bp, Artificial
  CRISPR gRNA sequence
cacccttggaaaagtccagt

SEQ ID NO: 208359 - DNA, 20 bp, Artificial
  CRISPR gRNA sequence
gttttgtcatcctctgcgtg

SEQ ID NO: 208360 - DNA, 20 bp, Artificial
  CRISPR gRNA sequence
atcctctgcgtgcagttctg

SEQ ID NO: 208361 - DNA, 20 bp, Artificial
  CRISPR gRNA sequence
gtgcagttctgcagcctcta

SEQ ID NO: 208362 - DNA, 20 bp, Artificial
  CRISPR gRNA sequence
cagttctgcagcctctaaag

SEQ ID NO: 208363 - DNA, 20 bp, Artificial
  CRISPR gRNA sequence
ttctgcagcctctaaagaag

SEQ ID NO: 208364 - DNA, 20 bp, Artificial
  CRISPR gRNA sequence
gcctctaaagaagcagccac

SEQ ID NO: 208365 - DNA, 20 bp, Artificial
  CRISPR gRNA sequence
ctctaaagaagcagccacca

SEQ ID NO: 208366 - DNA, 20 bp, Artificial
  CRISPR gRNA sequence
ctaaagaagcagccaccaga

SEQ ID NO: 208367 - DNA, 20 bp, Artificial
  CRISPR gRNA sequence
agaagcagccaccagagagt

SEQ ID NO: 208368 - DNA, 20 bp, Artificial
  CRISPR gRNA sequence
gaagcagccaccagagagtt

SEQ ID NO: 208369 - DNA, 20 bp, Artificial
  CRISPR gRNA sequence
ttgatcttgctttcctataa

SEQ ID NO: 208370 - DNA, 20 bp, Artificial
  CRISPR gRNA sequence
tcctataatagtaacgtaac

SEQ ID NO: 208371 - DNA, 20 bp, Artificial
  CRISPR gRNA sequence
gtaacgtaaccagacttctg

SEQ ID NO: 208372 - DNA, 20 bp, Artificial
  CRISPR gRNA sequence
taacgtaaccagacttctga

SEQ ID NO: 208373 - DNA, 20 bp, Artificial
  CRISPR gRNA sequence
cgtaaccagacttctgaagg

SEQ ID NO: 208374 - DNA, 20 bp, Artificial
  CRISPR gRNA sequence
ggcagatcttgatgctgcat

SEQ ID NO: 208375 - DNA, 20 bp, Artificial
  CRISPR gRNA sequence
tcttgatgctgcattagatt

SEQ ID NO: 208376 - DNA, 20 bp, Artificial
  CRISPR gRNA sequence
tagatttagcttcaacaaca

SEQ ID NO: 208377 - DNA, 20 bp, Artificial
  CRISPR gRNA sequence
caacacagaattgtcattac

SEQ ID NO: 208378 - DNA, 20 bp, Artificial
  CRISPR gRNA sequence
aacacagaattgtcattact

SEQ ID NO: 208379 - DNA, 20 bp, Artificial
  CRISPR gRNA sequence
aattgtcattactaggcaaa

SEQ ID NO: 208380 - DNA, 20 bp, Artificial
  CRISPR gRNA sequence
attgtcattactaggcaaat

SEQ ID NO: 208381 - DNA, 20 bp, Artificial
  CRISPR gRNA sequence
caaataggtaatatgcatta

SEQ ID NO: 208382 - DNA, 20 bp, Artificial
  CRISPR gRNA sequence
tcaaccatattttcatattt

SEQ ID NO: 208383 - DNA, 20 bp, Artificial
  CRISPR gRNA sequence
catattttcatattttggta

SEQ ID NO: 208384 - DNA, 20 bp, Artificial
  CRISPR gRNA sequence
gaaaatttacaaaattaatg

SEQ ID NO: 208385 - DNA, 20 bp, Artificial
  CRISPR gRNA sequence
tacaaaattaatgaagttct

SEQ ID NO: 208386 - DNA, 20 bp, Artificial
  CRISPR gRNA sequence
acaaaattaatgaagttctg

SEQ ID NO: 208387 - DNA, 20 bp, Artificial
  CRISPR gRNA sequence
ttaatgaagttctgaggtga

SEQ ID NO: 208388 - DNA, 20 bp, Artificial
  CRISPR gRNA sequence
aggtgacagtctaaactttt

SEQ ID NO: 208389 - DNA, 20 bp, Artificial
  CRISPR gRNA sequence
cttttaagctttttaaatac

SEQ ID NO: 208390 - DNA, 20 bp, Artificial
  CRISPR gRNA sequence
atttattccttctttccttg

SEQ ID NO: 208391 - DNA, 20 bp, Artificial
  CRISPR gRNA sequence
tctttccttgtagcatcctg

SEQ ID NO: 208392 - DNA, 20 bp, Artificial
  CRISPR gRNA sequence
ccttgtagcatcctgaagac

SEQ ID NO: 208393 - DNA, 20 bp, Artificial
  CRISPR gRNA sequence
agaccagtaaacatttatat

SEQ ID NO: 208394 - DNA, 20 bp, Artificial
  CRISPR gRNA sequence
cagtaaacatttatataagc

SEQ ID NO: 208395 - DNA, 20 bp, Artificial
  CRISPR gRNA sequence
agtaaacatttatataagca

SEQ ID NO: 208396 - DNA, 20 bp, Artificial
  CRISPR gRNA sequence
tgcaacctttaaacacacaa

SEQ ID NO: 208397 - DNA, 20 bp, Artificial
  CRISPR gRNA sequence
acctttaaacacacaaaagc

SEQ ID NO: 208398 - DNA, 20 bp, Artificial
  CRISPR gRNA sequence
caaaagctagtaaactattg

SEQ ID NO: 208399 - DNA, 20 bp, Artificial
  CRISPR gRNA sequence
aagctagtaaactattgcag

SEQ ID NO: 208400 - DNA, 20 bp, Artificial
  CRISPR gRNA sequence
ttatgaattttacttttact

SEQ ID NO: 208401 - DNA, 20 bp, Artificial
  CRISPR gRNA sequence
tgaattttacttttactcag

SEQ ID NO: 208402 - DNA, 20 bp, Artificial
  CRISPR gRNA sequence
ttacttttactcagcagttt

SEQ ID NO: 208403 - DNA, 20 bp, Artificial
  CRISPR gRNA sequence
gtttaagctgtctatatcta

SEQ ID NO: 208404 - DNA, 20 bp, Artificial
  CRISPR gRNA sequence
taagctgtctatatctatgg

SEQ ID NO: 208405 - DNA, 20 bp, Artificial
  CRISPR gRNA sequence
tctatggtggtgtataaaca

SEQ ID NO: 208406 - DNA, 20 bp, Artificial
  CRISPR gRNA sequence
atggtggtgtataaacatgg

SEQ ID NO: 208407 - DNA, 20 bp, Artificial
  CRISPR gRNA sequence
tggtggtgtataaacatgga

SEQ ID NO: 208408 - DNA, 20 bp, Artificial
  CRISPR gRNA sequence
ggtggtgtataaacatggaa

SEQ ID NO: 208409 - DNA, 20 bp, Artificial
  CRISPR gRNA sequence
tggtgtataaacatggaagg

SEQ ID NO: 208410 - DNA, 20 bp, Artificial
  CRISPR gRNA sequence
actgattgattatatgtttt

SEQ ID NO: 208411 - DNA, 20 bp, Artificial
  CRISPR gRNA sequence
tatgttttaagcgcttttct

SEQ ID NO: 208412 - DNA, 20 bp, Artificial
  CRISPR gRNA sequence
taagcgcttttctcagtgta

SEQ ID NO: 208413 - DNA, 20 bp, Artificial
  CRISPR gRNA sequence
tttctcagtgtatggcattc

SEQ ID NO: 208414 - DNA, 20 bp, Artificial
  CRISPR gRNA sequence
tatggcattctggaaatgct

SEQ ID NO: 208415 - DNA, 20 bp, Artificial
  CRISPR gRNA sequence
ctggaaatgcttagtgattt

SEQ ID NO: 208416 - DNA, 20 bp, Artificial
  CRISPR gRNA sequence
tgttctcaacttttgtctga

SEQ ID NO: 208417 - DNA, 20 bp, Artificial
  CRISPR gRNA sequence
gttctcaacttttgtctgaa

SEQ ID NO: 208418 - DNA, 20 bp, Artificial
  CRISPR gRNA sequence
acttttgtctgaaaggaaaa

SEQ ID NO: 208419 - DNA, 20 bp, Artificial
  CRISPR gRNA sequence
cttttgtctgaaaggaaaaa

SEQ ID NO: 208420 - DNA, 20 bp, Artificial
  CRISPR gRNA sequence
ttttgtctgaaaggaaaaaa

SEQ ID NO: 208421 - DNA, 20 bp, Artificial
  CRISPR gRNA sequence
tttgtctgaaaggaaaaaag

SEQ ID NO: 208422 - DNA, 20 bp, Artificial
  CRISPR gRNA sequence
ttgtctgaaaggaaaaaagg

SEQ ID NO: 208423 - DNA, 20 bp, Artificial
  CRISPR gRNA sequence
tctgaaaggaaaaaaggggg

SEQ ID NO: 208424 - DNA, 20 bp, Artificial
  CRISPR gRNA sequence
aaaggaaaaaagggggaaga

SEQ ID NO: 208425 - DNA, 20 bp, Artificial
  CRISPR gRNA sequence
aaggaaaaaagggggaagaa

SEQ ID NO: 208426 - DNA, 20 bp, Artificial
  CRISPR gRNA sequence
aggaaaaaagggggaagaaa

SEQ ID NO: 208427 - DNA, 20 bp, Artificial
  CRISPR gRNA sequence
ggaaaaaagggggaagaaag

SEQ ID NO: 208428 - DNA, 20 bp, Artificial
  CRISPR gRNA sequence
aaaaagggggaagaaagggg

SEQ ID NO: 208429 - DNA, 20 bp, Artificial
  CRISPR gRNA sequence
aagggggaagaaaggggtgg

SEQ ID NO: 208430 - DNA, 20 bp, Artificial
  CRISPR gRNA sequence
ggggaagaaaggggtggcag

SEQ ID NO: 208431 - DNA, 20 bp, Artificial
  CRISPR gRNA sequence
gggtggcagtggcaactgtc

SEQ ID NO: 208432 - DNA, 20 bp, Artificial
  CRISPR gRNA sequence
attttataacttttactttc

SEQ ID NO: 208433 - DNA, 20 bp, Artificial
  CRISPR gRNA sequence
tataacttttactttcaaga

SEQ ID NO: 208434 - DNA, 20 bp, Artificial
  CRISPR gRNA sequence
tttactttcaagatagtgtc

SEQ ID NO: 208435 - DNA, 20 bp, Artificial
  CRISPR gRNA sequence
gatagtgtctagacttcttt

SEQ ID NO: 208436 - DNA, 20 bp, Artificial
  CRISPR gRNA sequence
gaaattttcttataatctct

SEQ ID NO: 208437 - DNA, 20 bp, Artificial
  CRISPR gRNA sequence
atctcttagttttttatgtc

SEQ ID NO: 208438 - DNA, 20 bp, Artificial
  CRISPR gRNA sequence
ttagttttttatgtcaagaa

SEQ ID NO: 208439 - DNA, 20 bp, Artificial
  CRISPR gRNA sequence
tagttttttatgtcaagaaa

SEQ ID NO: 208440 - DNA, 20 bp, Artificial
  CRISPR gRNA sequence
ttttatgtcaagaaaaggac

SEQ ID NO: 208441 - DNA, 20 bp, Artificial
  CRISPR gRNA sequence
tgtcaagaaaaggactggtg

SEQ ID NO: 208442 - DNA, 20 bp, Artificial
  CRISPR gRNA sequence
aaaaggactggtgtagcatt

SEQ ID NO: 208443 - DNA, 20 bp, Artificial
  CRISPR gRNA sequence
tgtagcattaagacctattc

SEQ ID NO: 208444 - DNA, 20 bp, Artificial
  CRISPR gRNA sequence
tattctggcatcaatgatat

SEQ ID NO: 208445 - DNA, 20 bp, Artificial
  CRISPR gRNA sequence
attctggcatcaatgatatt

SEQ ID NO: 208446 - DNA, 20 bp, Artificial
  CRISPR gRNA sequence
ttctggcatcaatgatatta

SEQ ID NO: 208447 - DNA, 20 bp, Artificial
  CRISPR gRNA sequence
ggcatcaatgatattaggga

SEQ ID NO: 208448 - DNA, 20 bp, Artificial
  CRISPR gRNA sequence
gggaaagcttttaaccatat

SEQ ID NO: 208449 - DNA, 20 bp, Artificial
  CRISPR gRNA sequence
aaagcttttaaccatattgg

SEQ ID NO: 208450 - DNA, 20 bp, Artificial
  CRISPR gRNA sequence
agcttttaaccatattggca

SEQ ID NO: 208451 - DNA, 20 bp, Artificial
  CRISPR gRNA sequence
tttaaccatattggcagagc

SEQ ID NO: 208452 - DNA, 20 bp, Artificial
  CRISPR gRNA sequence
tattggcagagccagacttt

SEQ ID NO: 208453 - DNA, 20 bp, Artificial
  CRISPR gRNA sequence
attggcagagccagacttta

SEQ ID NO: 208454 - DNA, 20 bp, Artificial
  CRISPR gRNA sequence
ttggcagagccagactttaa

SEQ ID NO: 208455 - DNA, 20 bp, Artificial
  CRISPR gRNA sequence
agagccagactttaagggct

SEQ ID NO: 208456 - DNA, 20 bp, Artificial
  CRISPR gRNA sequence
aagggctaagtcatatgact

SEQ ID NO: 208457 - DNA, 20 bp, Artificial
  CRISPR gRNA sequence
agggctaagtcatatgactt

SEQ ID NO: 208458 - DNA, 20 bp, Artificial
  CRISPR gRNA sequence
gctaagtcatatgacttggg

SEQ ID NO: 208459 - DNA, 20 bp, Artificial
  CRISPR gRNA sequence
ctaagtcatatgacttgggc

SEQ ID NO: 208460 - DNA, 20 bp, Artificial
  CRISPR gRNA sequence
taagtcatatgacttgggca

SEQ ID NO: 208461 - DNA, 20 bp, Artificial
  CRISPR gRNA sequence
catatgacttgggcagggaa

SEQ ID NO: 208462 - DNA, 20 bp, Artificial
  CRISPR gRNA sequence
gcagggaacagcctttttca

SEQ ID NO: 208463 - DNA, 20 bp, Artificial
  CRISPR gRNA sequence
gatcatgaaattatttcaca

SEQ ID NO: 208464 - DNA, 20 bp, Artificial
  CRISPR gRNA sequence
ttcacatagtgcgatttttt

SEQ ID NO: 208465 - DNA, 20 bp, Artificial
  CRISPR gRNA sequence
atagtgcgattttttgagtt

SEQ ID NO: 208466 - DNA, 20 bp, Artificial
  CRISPR gRNA sequence
attttttgagtttggcttga

SEQ ID NO: 208467 - DNA, 20 bp, Artificial
  CRISPR gRNA sequence
ttgatggatgtttgctgatc

SEQ ID NO: 208468 - DNA, 20 bp, Artificial
  CRISPR gRNA sequence
gctgatccagacgttatcat

SEQ ID NO: 208469 - DNA, 20 bp, Artificial
  CRISPR gRNA sequence
atcattggtgacattatttt

SEQ ID NO: 208470 - DNA, 20 bp, Artificial
  CRISPR gRNA sequence
ttatttttagtgaaatgaac

SEQ ID NO: 208471 - DNA, 20 bp, Artificial
  CRISPR gRNA sequence
tatttttagtgaaatgaacc

SEQ ID NO: 208472 - DNA, 20 bp, Artificial
  CRISPR gRNA sequence
tttttagtgaaatgaaccag

SEQ ID NO: 208473 - DNA, 20 bp, Artificial
  CRISPR gRNA sequence
tagtgaaatgaaccaggagt

SEQ ID NO: 208474 - DNA, 20 bp, Artificial
  CRISPR gRNA sequence
ggagtgagtttgttcactgt

SEQ ID NO: 208475 - DNA, 20 bp, Artificial
  CRISPR gRNA sequence
tggctgtatttttacaaaat

SEQ ID NO: 208476 - DNA, 20 bp, Artificial
  CRISPR gRNA sequence
atattttttctgacttaaaa

SEQ ID NO: 208477 - DNA, 20 bp, Artificial
  CRISPR gRNA sequence
aaaagtcatacatatcactt

SEQ ID NO: 208478 - DNA, 20 bp, Artificial
  CRISPR gRNA sequence
actttagaacacctcgtaca

SEQ ID NO: 208479 - DNA, 20 bp, Artificial
  CRISPR gRNA sequence
ttagaacacctcgtacaaag

SEQ ID NO: 208480 - DNA, 20 bp, Artificial
  CRISPR gRNA sequence
tagaacacctcgtacaaagt

SEQ ID NO: 208481 - DNA, 20 bp, Artificial
  CRISPR gRNA sequence
agaacacctcgtacaaagta

SEQ ID NO: 208482 - DNA, 20 bp, Artificial
  CRISPR gRNA sequence
aacacctcgtacaaagtagg

SEQ ID NO: 208483 - DNA, 20 bp, Artificial
  CRISPR gRNA sequence
aaaaaaaaaaaactcatctg

SEQ ID NO: 208484 - DNA, 20 bp, Artificial
  CRISPR gRNA sequence
tcatctgtagtccccaaacc

SEQ ID NO: 208485 - DNA, 20 bp, Artificial
  CRISPR gRNA sequence
caaacctagaaataaactat

SEQ ID NO: 208486 - DNA, 20 bp, Artificial
  CRISPR gRNA sequence
aataaactattggtatattc

SEQ ID NO: 208487 - DNA, 20 bp, Artificial
  CRISPR gRNA sequence
tgttatcttttttttaaaaa

SEQ ID NO: 208488 - DNA, 20 bp, Artificial
  CRISPR gRNA sequence
gttatcttttttttaaaaaa

SEQ ID NO: 208489 - DNA, 20 bp, Artificial
  CRISPR gRNA sequence
taaaaaaaggtaaccataaa

SEQ ID NO: 208490 - DNA, 20 bp, Artificial
  CRISPR gRNA sequence
taaccataaatggactcgta

SEQ ID NO: 208491 - DNA, 20 bp, Artificial
  CRISPR gRNA sequence
ctgatgttcccccatgtctt

SEQ ID NO: 208492 - DNA, 20 bp, Artificial
  CRISPR gRNA sequence
tgtcttcagaaatcttgtta

SEQ ID NO: 208493 - DNA, 20 bp, Artificial
  CRISPR gRNA sequence
ctgcctgtgttctacttttg

SEQ ID NO: 208494 - DNA, 20 bp, Artificial
  CRISPR gRNA sequence
ttacttaactctcatcttga

SEQ ID NO: 208495 - DNA, 20 bp, Artificial
  CRISPR gRNA sequence
ctctcatcttgatggatttt

SEQ ID NO: 208496 - DNA, 20 bp, Artificial
  CRISPR gRNA sequence
tctcatcttgatggatttta

SEQ ID NO: 208497 - DNA, 20 bp, Artificial
  CRISPR gRNA sequence
ctatgaaaataactctgcta

SEQ ID NO: 208498 - DNA, 20 bp, Artificial
  CRISPR gRNA sequence
ataactctgctaaagatatg

SEQ ID NO: 208499 - DNA, 20 bp, Artificial
  CRISPR gRNA sequence
tctgctaaagatatgaagcc

SEQ ID NO: 208500 - DNA, 20 bp, Artificial
  CRISPR gRNA sequence
aaagatatgaagcctggaat

SEQ ID NO: 208501 - DNA, 20 bp, Artificial
  CRISPR gRNA sequence
gatatgaagcctggaattgg

SEQ ID NO: 208502 - DNA, 20 bp, Artificial
  CRISPR gRNA sequence
tatgaagcctggaattggca

SEQ ID NO: 208503 - DNA, 20 bp, Artificial
  CRISPR gRNA sequence
ggaattggcagagatatttt

SEQ ID NO: 208504 - DNA, 20 bp, Artificial
  CRISPR gRNA sequence
gcagagatattttaagactc

SEQ ID NO: 208505 - DNA, 20 bp, Artificial
  CRISPR gRNA sequence
ttaagactctagatacatac

SEQ ID NO: 208506 - DNA, 20 bp, Artificial
  CRISPR gRNA sequence
catactggcaaaatgttttc

SEQ ID NO: 208507 - DNA, 20 bp, Artificial
  CRISPR gRNA sequence
gtttgtatcaactactattg

SEQ ID NO: 208508 - DNA, 20 bp, Artificial
  CRISPR gRNA sequence
tatcaactactattgcagat

SEQ ID NO: 208509 - DNA, 20 bp, Artificial
  CRISPR gRNA sequence
agaatacctgtctttcacct

SEQ ID NO: 208510 - DNA, 20 bp, Artificial
  CRISPR gRNA sequence
taaaatctctgcaaatttga

SEQ ID NO: 208511 - DNA, 20 bp, Artificial
  CRISPR gRNA sequence
aaaatctctgcaaatttgat

SEQ ID NO: 208512 - DNA, 20 bp, Artificial
  CRISPR gRNA sequence
tgcaaatttgatgggtgaaa

SEQ ID NO: 208513 - DNA, 20 bp, Artificial
  CRISPR gRNA sequence
tgtaattgtaatttttgtgt

SEQ ID NO: 208514 - DNA, 20 bp, Artificial
  CRISPR gRNA sequence
attgtaatttttgtgttagt

SEQ ID NO: 208515 - DNA, 20 bp, Artificial
  CRISPR gRNA sequence
ttgtaatttttgtgttagta

SEQ ID NO: 208516 - DNA, 20 bp, Artificial
  CRISPR gRNA sequence
taatttttgtgttagtaagg

SEQ ID NO: 208517 - DNA, 20 bp, Artificial
  CRISPR gRNA sequence
cttttttatattttttgtac

SEQ ID NO: 208518 - DNA, 20 bp, Artificial
  CRISPR gRNA sequence
ttttgtactggtcatatttt

SEQ ID NO: 208519 - DNA, 20 bp, Artificial
  CRISPR gRNA sequence
tttgtactggtcatatttta

SEQ ID NO: 208520 - DNA, 20 bp, Artificial
  CRISPR gRNA sequence
ggaacgtgcttataaaccta

SEQ ID NO: 208521 - DNA, 20 bp, Artificial
  CRISPR gRNA sequence
ataaacctaaagaaatattt

SEQ ID NO: 208522 - DNA, 20 bp, Artificial
  CRISPR gRNA sequence
aacctaaagaaatattttgg

SEQ ID NO: 208523 - DNA, 20 bp, Artificial
  CRISPR gRNA sequence
acctaaagaaatattttggt

SEQ ID NO: 208524 - DNA, 20 bp, Artificial
  CRISPR gRNA sequence
ttggtgggaattttttgttt

SEQ ID NO: 208525 - DNA, 20 bp, Artificial
  CRISPR gRNA sequence
tgttttggctcatcttgaaa

SEQ ID NO: 208526 - DNA, 20 bp, Artificial
  CRISPR gRNA sequence
gttttggctcatcttgaaac

SEQ ID NO: 208527 - DNA, 20 bp, Artificial
  CRISPR gRNA sequence
ttggctcatcttgaaacagg

SEQ ID NO: 208528 - DNA, 20 bp, Artificial
  CRISPR gRNA sequence
tagatgtgtgtgtatgtgca

SEQ ID NO: 208529 - DNA, 20 bp, Artificial
  CRISPR gRNA sequence
atgtgtgtgtatgtgcatgg

SEQ ID NO: 208530 - DNA, 20 bp, Artificial
  CRISPR gRNA sequence
gtgtgtgtatgtgcatggaa

SEQ ID NO: 208531 - DNA, 20 bp, Artificial
  CRISPR gRNA sequence
tgtgtgtatgtgcatggaag

SEQ ID NO: 208532 - DNA, 20 bp, Artificial
  CRISPR gRNA sequence
atgtctatacatgattcacc

SEQ ID NO: 208533 - DNA, 20 bp, Artificial
  CRISPR gRNA sequence
ccagcctgcgctcacattta

SEQ ID NO: 208534 - DNA, 20 bp, Artificial
  CRISPR gRNA sequence
cagcctgcgctcacatttaa

SEQ ID NO: 208535 - DNA, 20 bp, Artificial
  CRISPR gRNA sequence
tttaaaggtgttgatgataa

SEQ ID NO: 208536 - DNA, 20 bp, Artificial
  CRISPR gRNA sequence
aaaggtgttgatgataatag

SEQ ID NO: 208537 - DNA, 20 bp, Artificial
  CRISPR gRNA sequence
taatagtagctaaccatttg

SEQ ID NO: 208538 - DNA, 20 bp, Artificial
  CRISPR gRNA sequence
atagtagctaaccatttgtg

SEQ ID NO: 208539 - DNA, 20 bp, Artificial
  CRISPR gRNA sequence
ggagctcttgctctgcttga

SEQ ID NO: 208540 - DNA, 20 bp, Artificial
  CRISPR gRNA sequence
gagctcttgctctgcttgac

SEQ ID NO: 208541 - DNA, 20 bp, Artificial
  CRISPR gRNA sequence
tgcttgacaggttctgtgca

SEQ ID NO: 208542 - DNA, 20 bp, Artificial
  CRISPR gRNA sequence
gaaatgacatttatttctcc

SEQ ID NO: 208543 - DNA, 20 bp, Artificial
  CRISPR gRNA sequence
tatttctcccagaaactcta

SEQ ID NO: 208544 - DNA, 20 bp, Artificial
  CRISPR gRNA sequence
atttctcccagaaactctat

SEQ ID NO: 208545 - DNA, 20 bp, Artificial
  CRISPR gRNA sequence
tcccagaaactctatgggca

SEQ ID NO: 208546 - DNA, 20 bp, Artificial
  CRISPR gRNA sequence
ctgttgttattcccgttttg

SEQ ID NO: 208547 - DNA, 20 bp, Artificial
  CRISPR gRNA sequence
gttattcccgttttgtagat

SEQ ID NO: 208548 - DNA, 20 bp, Artificial
  CRISPR gRNA sequence
cccgttttgtagataagaaa

SEQ ID NO: 208549 - DNA, 20 bp, Artificial
  CRISPR gRNA sequence
ccgttttgtagataagaaac

SEQ ID NO: 208550 - DNA, 20 bp, Artificial
  CRISPR gRNA sequence
ttgtagataagaaacaggca

SEQ ID NO: 208551 - DNA, 20 bp, Artificial
  CRISPR gRNA sequence
agataagaaacaggcacaga

SEQ ID NO: 208552 - DNA, 20 bp, Artificial
  CRISPR gRNA sequence
agaaacaggcacagatagat

SEQ ID NO: 208553 - DNA, 20 bp, Artificial
  CRISPR gRNA sequence
gaaacaggcacagatagatt

SEQ ID NO: 208554 - DNA, 20 bp, Artificial
  CRISPR gRNA sequence
gcaatttgcccgcaatcacc

SEQ ID NO: 208555 - DNA, 20 bp, Artificial
  CRISPR gRNA sequence
atcacccagccgtttcctga

SEQ ID NO: 208556 - DNA, 20 bp, Artificial
  CRISPR gRNA sequence
cagccgtttcctgatagtac

SEQ ID NO: 208557 - DNA, 20 bp, Artificial
  CRISPR gRNA sequence
agccgtttcctgatagtact

SEQ ID NO: 208558 - DNA, 20 bp, Artificial
  CRISPR gRNA sequence
gatagtactgggatttgaac

SEQ ID NO: 208559 - DNA, 20 bp, Artificial
  CRISPR gRNA sequence
ccccgttttgcatttatttt

SEQ ID NO: 208560 - DNA, 20 bp, Artificial
  CRISPR gRNA sequence
cccgttttgcatttattttg

SEQ ID NO: 208561 - DNA, 20 bp, Artificial
  CRISPR gRNA sequence
ttgaggattttatttccatg

SEQ ID NO: 208562 - DNA, 20 bp, Artificial
  CRISPR gRNA sequence
tgaggattttatttccatga

SEQ ID NO: 208563 - DNA, 20 bp, Artificial
  CRISPR gRNA sequence
gaggattttatttccatgaa

SEQ ID NO: 208564 - DNA, 20 bp, Artificial
  CRISPR gRNA sequence
tgaagggtgaacctatatct

SEQ ID NO: 208565 - DNA, 20 bp, Artificial
  CRISPR gRNA sequence
atatctaagcacataatact

SEQ ID NO: 208566 - DNA, 20 bp, Artificial
  CRISPR gRNA sequence
tctaagcacataatactgag

SEQ ID NO: 208567 - DNA, 20 bp, Artificial
  CRISPR gRNA sequence
actgagtagctaaaacttat

SEQ ID NO: 208568 - DNA, 20 bp, Artificial
  CRISPR gRNA sequence
ctgagtagctaaaacttatt

SEQ ID NO: 208569 - DNA, 20 bp, Artificial
  CRISPR gRNA sequence
gagtagctaaaacttattag

SEQ ID NO: 208570 - DNA, 20 bp, Artificial
  CRISPR gRNA sequence
gtagctaaaacttattagga

SEQ ID NO: 208571 - DNA, 20 bp, Artificial
  CRISPR gRNA sequence
gctaaaacttattaggagag

SEQ ID NO: 208572 - DNA, 20 bp, Artificial
  CRISPR gRNA sequence
ttacttattctgcaaatacc

SEQ ID NO: 208573 - DNA, 20 bp, Artificial
  CRISPR gRNA sequence
attctgcaaatacctagtga

SEQ ID NO: 208574 - DNA, 20 bp, Artificial
  CRISPR gRNA sequence
ttctgcaaatacctagtgac

SEQ ID NO: 208575 - DNA, 20 bp, Artificial
  CRISPR gRNA sequence
tctgcaaatacctagtgaca

SEQ ID NO: 208576 - DNA, 20 bp, Artificial
  CRISPR gRNA sequence
acagggtgcctactgattgc

SEQ ID NO: 208577 - DNA, 20 bp, Artificial
  CRISPR gRNA sequence
cctactgattgctggacacc

SEQ ID NO: 208578 - DNA, 20 bp, Artificial
  CRISPR gRNA sequence
caagctacatgcctgaaatg

SEQ ID NO: 208579 - DNA, 20 bp, Artificial
  CRISPR gRNA sequence
aagctacatgcctgaaatgt

SEQ ID NO: 208580 - DNA, 20 bp, Artificial
  CRISPR gRNA sequence
gtgtgatgtgcatattgccc

SEQ ID NO: 208581 - DNA, 20 bp, Artificial
  CRISPR gRNA sequence
tgcatattgccctggttttg

SEQ ID NO: 208582 - DNA, 20 bp, Artificial
  CRISPR gRNA sequence
gttttgtagcacccacattt

SEQ ID NO: 208583 - DNA, 20 bp, Artificial
  CRISPR gRNA sequence
tgtagcacccacatttaagc

SEQ ID NO: 208584 - DNA, 20 bp, Artificial
  CRISPR gRNA sequence
gtagcacccacatttaagcc

SEQ ID NO: 208585 - DNA, 20 bp, Artificial
  CRISPR gRNA sequence
tagcacccacatttaagcca

SEQ ID NO: 208586 - DNA, 20 bp, Artificial
  CRISPR gRNA sequence
gcacccacatttaagccagg

SEQ ID NO: 208587 - DNA, 20 bp, Artificial
  CRISPR gRNA sequence
ccatgccttgtcacatcttt

SEQ ID NO: 208588 - DNA, 20 bp, Artificial
  CRISPR gRNA sequence
gccttgtcacatctttgaga

SEQ ID NO: 208589 - DNA, 20 bp, Artificial
  CRISPR gRNA sequence
tcacatctttgagatagtca

SEQ ID NO: 208590 - DNA, 20 bp, Artificial
  CRISPR gRNA sequence
tccaaatctaacttttctgt

SEQ ID NO: 208591 - DNA, 20 bp, Artificial
  CRISPR gRNA sequence
tctgttagtgcctctgttga

SEQ ID NO: 208592 - DNA, 20 bp, Artificial
  CRISPR gRNA sequence
agtgcctctgttgatggcct

SEQ ID NO: 208593 - DNA, 20 bp, Artificial
  CRISPR gRNA sequence
ggcctgagcattccaccaaa

SEQ ID NO: 208594 - DNA, 20 bp, Artificial
  CRISPR gRNA sequence
agcattccaccaaatagaaa

SEQ ID NO: 208595 - DNA, 20 bp, Artificial
  CRISPR gRNA sequence
ttccaccaaatagaaataga

SEQ ID NO: 208596 - DNA, 20 bp, Artificial
  CRISPR gRNA sequence
acctctattctccacctgct

SEQ ID NO: 208597 - DNA, 20 bp, Artificial
  CRISPR gRNA sequence
ctgcttagatgtatattttt

SEQ ID NO: 208598 - DNA, 20 bp, Artificial
  CRISPR gRNA sequence
gatgtatattttttagaatc

SEQ ID NO: 208599 - DNA, 20 bp, Artificial
  CRISPR gRNA sequence
atattttttagaatccagta

SEQ ID NO: 208600 - DNA, 20 bp, Artificial
  CRISPR gRNA sequence
ccagtatggtaaatcttcta

SEQ ID NO: 208601 - DNA, 20 bp, Artificial
  CRISPR gRNA sequence
ctaaagcattcataataact

SEQ ID NO: 208602 - DNA, 20 bp, Artificial
  CRISPR gRNA sequence
gacccatgacttttatttta

SEQ ID NO: 208603 - DNA, 20 bp, Artificial
  CRISPR gRNA sequence
acttttattttatagatttc

SEQ ID NO: 208604 - DNA, 20 bp, Artificial
  CRISPR gRNA sequence
cttttcctgattaccattta

SEQ ID NO: 208605 - DNA, 20 bp, Artificial
  CRISPR gRNA sequence
taccatttatggtctgtact

SEQ ID NO: 208606 - DNA, 20 bp, Artificial
  CRISPR gRNA sequence
ttatggtctgtacttggcta

SEQ ID NO: 208607 - DNA, 20 bp, Artificial
  CRISPR gRNA sequence
tatggtctgtacttggctac

SEQ ID NO: 208608 - DNA, 20 bp, Artificial
  CRISPR gRNA sequence
atggtctgtacttggctaca

SEQ ID NO: 208609 - DNA, 20 bp, Artificial
  CRISPR gRNA sequence
tggtctgtacttggctacag

SEQ ID NO: 208610 - DNA, 20 bp, Artificial
  CRISPR gRNA sequence
tggctacaggggatttctct

SEQ ID NO: 208611 - DNA, 20 bp, Artificial
  CRISPR gRNA sequence
ctacaggggatttctctcag

SEQ ID NO: 208612 - DNA, 20 bp, Artificial
  CRISPR gRNA sequence
atttctctcagtggtttttc

SEQ ID NO: 208613 - DNA, 20 bp, Artificial
  CRISPR gRNA sequence
gtttttccagctctgcatgt

SEQ ID NO: 208614 - DNA, 20 bp, Artificial
  CRISPR gRNA sequence
gctctgcatgtgagtctttg

SEQ ID NO: 208615 - DNA, 20 bp, Artificial
  CRISPR gRNA sequence
catgtgagtctttgtggtcc

SEQ ID NO: 208616 - DNA, 20 bp, Artificial
  CRISPR gRNA sequence
tttgtggtccaagacaaacc

SEQ ID NO: 208617 - DNA, 20 bp, Artificial
  CRISPR gRNA sequence
agacaaacctggacctttac

SEQ ID NO: 208618 - DNA, 20 bp, Artificial
  CRISPR gRNA sequence
gacaaacctggacctttacc

SEQ ID NO: 208619 - DNA, 20 bp, Artificial
  CRISPR gRNA sequence
cctttaccaggctaaacttt

SEQ ID NO: 208620 - DNA, 20 bp, Artificial
  CRISPR gRNA sequence
accaggctaaactttcagta

SEQ ID NO: 208621 - DNA, 20 bp, Artificial
  CRISPR gRNA sequence
ggctaaactttcagtaaaga

SEQ ID NO: 208622 - DNA, 20 bp, Artificial
  CRISPR gRNA sequence
taaactttcagtaaagacag

SEQ ID NO: 208623 - DNA, 20 bp, Artificial
  CRISPR gRNA sequence
aaactttcagtaaagacagc

SEQ ID NO: 208624 - DNA, 20 bp, Artificial
  CRISPR gRNA sequence
tgccctcatttgctcactct

SEQ ID NO: 208625 - DNA, 20 bp, Artificial
  CRISPR gRNA sequence
gccctcatttgctcactctg

SEQ ID NO: 208626 - DNA, 20 bp, Artificial
  CRISPR gRNA sequence
cctcatttgctcactctgag

SEQ ID NO: 208627 - DNA, 20 bp, Artificial
  CRISPR gRNA sequence
atttgctcactctgaggaga

SEQ ID NO: 208628 - DNA, 20 bp, Artificial
  CRISPR gRNA sequence
ttgctcactctgaggagaaa

SEQ ID NO: 208629 - DNA, 20 bp, Artificial
  CRISPR gRNA sequence
gagaaagagtttctttatac

SEQ ID NO: 208630 - DNA, 20 bp, Artificial
  CRISPR gRNA sequence
gaaagagtttctttatacca

SEQ ID NO: 208631 - DNA, 20 bp, Artificial
  CRISPR gRNA sequence
ataccagagctgtatcttga

SEQ ID NO: 208632 - DNA, 20 bp, Artificial
  CRISPR gRNA sequence
ctgtatcttgaaagatgtct

SEQ ID NO: 208633 - DNA, 20 bp, Artificial
  CRISPR gRNA sequence
tgtatcttgaaagatgtctc

SEQ ID NO: 208634 - DNA, 20 bp, Artificial
  CRISPR gRNA sequence
aagatgtctcaggatgccat

SEQ ID NO: 208635 - DNA, 20 bp, Artificial
  CRISPR gRNA sequence
aggatgccattggtcctact

SEQ ID NO: 208636 - DNA, 20 bp, Artificial
  CRISPR gRNA sequence
ggatgccattggtcctactg

SEQ ID NO: 208637 - DNA, 20 bp, Artificial
  CRISPR gRNA sequence
tgccattggtcctactgagg

SEQ ID NO: 208638 - DNA, 20 bp, Artificial
  CRISPR gRNA sequence
cattggtcctactgaggaag

SEQ ID NO: 208639 - DNA, 20 bp, Artificial
  CRISPR gRNA sequence
tcctactgaggaagaagcct

SEQ ID NO: 208640 - DNA, 20 bp, Artificial
  CRISPR gRNA sequence
tactgaggaagaagcctgag

SEQ ID NO: 208641 - DNA, 20 bp, Artificial
  CRISPR gRNA sequence
tgagaagactcttaaactcc

SEQ ID NO: 208642 - DNA, 20 bp, Artificial
  CRISPR gRNA sequence
agaagactcttaaactccca

SEQ ID NO: 208643 - DNA, 20 bp, Artificial
  CRISPR gRNA sequence
actcttaaactcccagagcc

SEQ ID NO: 208644 - DNA, 20 bp, Artificial
  CRISPR gRNA sequence
ttaaactcccagagcccagc

SEQ ID NO: 208645 - DNA, 20 bp, Artificial
  CRISPR gRNA sequence
cccagagcccagccagcact

SEQ ID NO: 208646 - DNA, 20 bp, Artificial
  CRISPR gRNA sequence
gagcccagccagcacttggt

SEQ ID NO: 208647 - DNA, 20 bp, Artificial
  CRISPR gRNA sequence
agccagcacttggtgagccc

SEQ ID NO: 208648 - DNA, 20 bp, Artificial
  CRISPR gRNA sequence
gagccctggaccacgtttca

SEQ ID NO: 208649 - DNA, 20 bp, Artificial
  CRISPR gRNA sequence
tggaccacgtttcaaagata

SEQ ID NO: 208650 - DNA, 20 bp, Artificial
  CRISPR gRNA sequence
ggaccacgtttcaaagataa

SEQ ID NO: 208651 - DNA, 20 bp, Artificial
  CRISPR gRNA sequence
tcaaagataaaggcctctta

SEQ ID NO: 208652 - DNA, 20 bp, Artificial
  CRISPR gRNA sequence
caaagataaaggcctcttac

SEQ ID NO: 208653 - DNA, 20 bp, Artificial
  CRISPR gRNA sequence
aaagataaaggcctcttaca

SEQ ID NO: 208654 - DNA, 20 bp, Artificial
  CRISPR gRNA sequence
ttcctaaataccttcacctt

SEQ ID NO: 208655 - DNA, 20 bp, Artificial
  CRISPR gRNA sequence
aaataccttcacctttagct

SEQ ID NO: 208656 - DNA, 20 bp, Artificial
  CRISPR gRNA sequence
cctttagcttagctttaact

SEQ ID NO: 208657 - DNA, 20 bp, Artificial
  CRISPR gRNA sequence
ctttagcttagctttaactt

SEQ ID NO: 208658 - DNA, 20 bp, Artificial
  CRISPR gRNA sequence
gctttaacttaggaactttt

SEQ ID NO: 208659 - DNA, 20 bp, Artificial
  CRISPR gRNA sequence
ttaacttaggaacttttaag

SEQ ID NO: 208660 - DNA, 20 bp, Artificial
  CRISPR gRNA sequence
ttaagcagaatctctatgct

SEQ ID NO: 208661 - DNA, 20 bp, Artificial
  CRISPR gRNA sequence
gaatctctatgcttagcaaa

SEQ ID NO: 208662 - DNA, 20 bp, Artificial
  CRISPR gRNA sequence
tctatgcttagcaaacagct

SEQ ID NO: 208663 - DNA, 20 bp, Artificial
  CRISPR gRNA sequence
tatgcttagcaaacagctca

SEQ ID NO: 208664 - DNA, 20 bp, Artificial
  CRISPR gRNA sequence
gcaaacagctcagagattgc

SEQ ID NO: 208665 - DNA, 20 bp, Artificial
  CRISPR gRNA sequence
gattgctagaatcaaacacc

SEQ ID NO: 208666 - DNA, 20 bp, Artificial
  CRISPR gRNA sequence
attgctagaatcaaacacca

SEQ ID NO: 208667 - DNA, 20 bp, Artificial
  CRISPR gRNA sequence
aaacaccaaggcttaactga

SEQ ID NO: 208668 - DNA, 20 bp, Artificial
  CRISPR gRNA sequence
taactgatagtattgaattt

SEQ ID NO: 208669 - DNA, 20 bp, Artificial
  CRISPR gRNA sequence
ctgaaaactacaccaactca

SEQ ID NO: 208670 - DNA, 20 bp, Artificial
  CRISPR gRNA sequence
ttgccactctactgacaatt

SEQ ID NO: 208671 - DNA, 20 bp, Artificial
  CRISPR gRNA sequence
tctactgacaattaagttcc

SEQ ID NO: 208672 - DNA, 20 bp, Artificial
  CRISPR gRNA sequence
ttaagttcctggctgatttt

SEQ ID NO: 208673 - DNA, 20 bp, Artificial
  CRISPR gRNA sequence
taagttcctggctgattttc

SEQ ID NO: 208674 - DNA, 20 bp, Artificial
  CRISPR gRNA sequence
tctcactctgatatcatttt

SEQ ID NO: 208675 - DNA, 20 bp, Artificial
  CRISPR gRNA sequence
cattttaagtgctgtccacc

SEQ ID NO: 208676 - DNA, 20 bp, Artificial
  CRISPR gRNA sequence
gtgctgtccacctagtcctc

SEQ ID NO: 208677 - DNA, 20 bp, Artificial
  CRISPR gRNA sequence
acctagtcctccagttcctg

SEQ ID NO: 208678 - DNA, 20 bp, Artificial
  CRISPR gRNA sequence
cctagtcctccagttcctgc

SEQ ID NO: 208679 - DNA, 20 bp, Artificial
  CRISPR gRNA sequence
cctccagttcctgcaggatt

SEQ ID NO: 208680 - DNA, 20 bp, Artificial
  CRISPR gRNA sequence
ctccagttcctgcaggatta

SEQ ID NO: 208681 - DNA, 20 bp, Artificial
  CRISPR gRNA sequence
ttaaggtccaactgtatgta

SEQ ID NO: 208682 - DNA, 20 bp, Artificial
  CRISPR gRNA sequence
tccaactgtatgtaaagaac

SEQ ID NO: 208683 - DNA, 20 bp, Artificial
  CRISPR gRNA sequence
ctaacattttgaaattcttt

SEQ ID NO: 208684 - DNA, 20 bp, Artificial
  CRISPR gRNA sequence
cattttgaaattctttgaga

SEQ ID NO: 208685 - DNA, 20 bp, Artificial
  CRISPR gRNA sequence
attttgaaattctttgagat

SEQ ID NO: 208686 - DNA, 20 bp, Artificial
  CRISPR gRNA sequence
ctttgtaactttgttttata

SEQ ID NO: 208687 - DNA, 20 bp, Artificial
  CRISPR gRNA sequence
tttgtaactttgttttatac

SEQ ID NO: 208688 - DNA, 20 bp, Artificial
  CRISPR gRNA sequence
ttgttttatacaggcaatac

SEQ ID NO: 208689 - DNA, 20 bp, Artificial
  CRISPR gRNA sequence
ctggcttcgcacaaaaccgc

SEQ ID NO: 208690 - DNA, 20 bp, Artificial
  CRISPR gRNA sequence
gaccataaacatgaccatgt

SEQ ID NO: 208691 - DNA, 20 bp, Artificial
  CRISPR gRNA sequence
aaaacaatcttcatgatgaa

SEQ ID NO: 208692 - DNA, 20 bp, Artificial
  CRISPR gRNA sequence
aaacaatcttcatgatgaat

SEQ ID NO: 208693 - DNA, 20 bp, Artificial
  CRISPR gRNA sequence
tctgttattatcaataacaa

SEQ ID NO: 208694 - DNA, 20 bp, Artificial
  CRISPR gRNA sequence
attatcaataacaacggcat

SEQ ID NO: 208695 - DNA, 20 bp, Artificial
  CRISPR gRNA sequence
ttatcaataacaacggcatt

SEQ ID NO: 208696 - DNA, 20 bp, Artificial
  CRISPR gRNA sequence
cggcattgggaaatgaaaaa

SEQ ID NO: 208697 - DNA, 20 bp, Artificial
  CRISPR gRNA sequence
ttgggaaatgaaaaatagta

SEQ ID NO: 208698 - DNA, 20 bp, Artificial
  CRISPR gRNA sequence
gaaatgaaaaatagtaaagc

SEQ ID NO: 208699 - DNA, 20 bp, Artificial
  CRISPR gRNA sequence
aaaatagtaaagctagtatt

SEQ ID NO: 208700 - DNA, 20 bp, Artificial
  CRISPR gRNA sequence
taaagctagtatttagtatg

SEQ ID NO: 208701 - DNA, 20 bp, Artificial
  CRISPR gRNA sequence
tatgtggtaaattaaatcat

SEQ ID NO: 208702 - DNA, 20 bp, Artificial
  CRISPR gRNA sequence
attaaatcattagaaacatc

SEQ ID NO: 208703 - DNA, 20 bp, Artificial
  CRISPR gRNA sequence
attagaaacatcgagaatga

SEQ ID NO: 208704 - DNA, 20 bp, Artificial
  CRISPR gRNA sequence
gagaatgaaagtgtgttatc

SEQ ID NO: 208705 - DNA, 20 bp, Artificial
  CRISPR gRNA sequence
gaatgaaagtgtgttatcaa

SEQ ID NO: 208706 - DNA, 20 bp, Artificial
  CRISPR gRNA sequence
tgaaagtgtgttatcaagag

SEQ ID NO: 208707 - DNA, 20 bp, Artificial
  CRISPR gRNA sequence
gtgttcttcttgcataactt

SEQ ID NO: 208708 - DNA, 20 bp, Artificial
  CRISPR gRNA sequence
ttcttgcataactttggata

SEQ ID NO: 208709 - DNA, 20 bp, Artificial
  CRISPR gRNA sequence
cttgcataactttggataca

SEQ ID NO: 208710 - DNA, 20 bp, Artificial
  CRISPR gRNA sequence
cataactttggatacagagc

SEQ ID NO: 208711 - DNA, 20 bp, Artificial
  CRISPR gRNA sequence
cagagcaagcatcttctcta

SEQ ID NO: 208712 - DNA, 20 bp, Artificial
  CRISPR gRNA sequence
caagcatcttctctatggct

SEQ ID NO: 208713 - DNA, 20 bp, Artificial
  CRISPR gRNA sequence
gaattgtcatacccctttct

SEQ ID NO: 208714 - DNA, 20 bp, Artificial
  CRISPR gRNA sequence
gtcatacccctttctaagtt

SEQ ID NO: 208715 - DNA, 20 bp, Artificial
  CRISPR gRNA sequence
acccctttctaagtttggat

SEQ ID NO: 208716 - DNA, 20 bp, Artificial
  CRISPR gRNA sequence
ttgcactctcaatgtcatga

SEQ ID NO: 208717 - DNA, 20 bp, Artificial
  CRISPR gRNA sequence
aatgtttttttgaatgttta

SEQ ID NO: 208718 - DNA, 20 bp, Artificial
  CRISPR gRNA sequence
tttaaagtttattttattgc

SEQ ID NO: 208719 - DNA, 20 bp, Artificial
  CRISPR gRNA sequence
ttattgccagtcacttcctc

SEQ ID NO: 208720 - DNA, 20 bp, Artificial
  CRISPR gRNA sequence
tattgccagtcacttcctct

SEQ ID NO: 208721 - DNA, 20 bp, Artificial
  CRISPR gRNA sequence
ctcactttcctcatttatat

SEQ ID NO: 208722 - DNA, 20 bp, Artificial
  CRISPR gRNA sequence
ctttcctcatttatatcagt

SEQ ID NO: 208723 - DNA, 20 bp, Artificial
  CRISPR gRNA sequence
tcagtaagtccaccttcgct

SEQ ID NO: 208724 - DNA, 20 bp, Artificial
  CRISPR gRNA sequence
ccaccttcgctgagttcttc

SEQ ID NO: 208725 - DNA, 20 bp, Artificial
  CRISPR gRNA sequence
agttcttctggcttcatctc

SEQ ID NO: 208726 - DNA, 20 bp, Artificial
  CRISPR gRNA sequence
ttcttctggcttcatctcta

SEQ ID NO: 208727 - DNA, 20 bp, Artificial
  CRISPR gRNA sequence
ctctagagtttcttgcattg

SEQ ID NO: 208728 - DNA, 20 bp, Artificial
  CRISPR gRNA sequence
aatgtcgacattcgcacaat

SEQ ID NO: 208729 - DNA, 20 bp, Artificial
  CRISPR gRNA sequence
ttcttctcttactccattta

SEQ ID NO: 208730 - DNA, 20 bp, Artificial
  CRISPR gRNA sequence
gtctattcaaatttcactcc

SEQ ID NO: 208731 - DNA, 20 bp, Artificial
  CRISPR gRNA sequence
atttcactcctagcatttgt

SEQ ID NO: 208732 - DNA, 20 bp, Artificial
  CRISPR gRNA sequence
actctttcatctttcttgcc

SEQ ID NO: 208733 - DNA, 20 bp, Artificial
  CRISPR gRNA sequence
atccattataaaatgtcaca

SEQ ID NO: 208734 - DNA, 20 bp, Artificial
  CRISPR gRNA sequence
tccattataaaatgtcacat

SEQ ID NO: 208735 - DNA, 20 bp, Artificial
  CRISPR gRNA sequence
atgtcacatgggtttatcac

SEQ ID NO: 208736 - DNA, 20 bp, Artificial
  CRISPR gRNA sequence
tgtcacatgggtttatcact

SEQ ID NO: 208737 - DNA, 20 bp, Artificial
  CRISPR gRNA sequence
tgggtttatcactgggaaac

SEQ ID NO: 208738 - DNA, 20 bp, Artificial
  CRISPR gRNA sequence
gggtttatcactgggaaaca

SEQ ID NO: 208739 - DNA, 20 bp, Artificial
  CRISPR gRNA sequence
gtttatcactgggaaacaag

SEQ ID NO: 208740 - DNA, 20 bp, Artificial
  CRISPR gRNA sequence
tttatcactgggaaacaagg

SEQ ID NO: 208741 - DNA, 20 bp, Artificial
  CRISPR gRNA sequence
tctgtgcatgacctaaatat

SEQ ID NO: 208742 - DNA, 20 bp, Artificial
  CRISPR gRNA sequence
tgacctaaatatcagatgta

SEQ ID NO: 208743 - DNA, 20 bp, Artificial
  CRISPR gRNA sequence
aatatcagatgtacagtgac

SEQ ID NO: 208744 - DNA, 20 bp, Artificial
  CRISPR gRNA sequence
gtacagtgactagtcaccaa

SEQ ID NO: 208745 - DNA, 20 bp, Artificial
  CRISPR gRNA sequence
tagtcaccaacagtcttcaa

SEQ ID NO: 208746 - DNA, 20 bp, Artificial
  CRISPR gRNA sequence
tcaccaacagtcttcaaaag

SEQ ID NO: 208747 - DNA, 20 bp, Artificial
  CRISPR gRNA sequence
agtcttcaaaagaagtgaca

SEQ ID NO: 208748 - DNA, 20 bp, Artificial
  CRISPR gRNA sequence
tggttgatcactgatcatga

SEQ ID NO: 208749 - DNA, 20 bp, Artificial
  CRISPR gRNA sequence
ggttgatcactgatcatgat

SEQ ID NO: 208750 - DNA, 20 bp, Artificial
  CRISPR gRNA sequence
tgggacatctgctatttaca

SEQ ID NO: 208751 - DNA, 20 bp, Artificial
  CRISPR gRNA sequence
acatagttatttttgaactg

SEQ ID NO: 208752 - DNA, 20 bp, Artificial
  CRISPR gRNA sequence
ttatttttgaactgaagaaa

SEQ ID NO: 208753 - DNA, 20 bp, Artificial
  CRISPR gRNA sequence
tttttgaactgaagaaatag

SEQ ID NO: 208754 - DNA, 20 bp, Artificial
  CRISPR gRNA sequence
gaactgaagaaatagcagtg

SEQ ID NO: 208755 - DNA, 20 bp, Artificial
  CRISPR gRNA sequence
cagtgaagttgtactttatg

SEQ ID NO: 208756 - DNA, 20 bp, Artificial
  CRISPR gRNA sequence
ttgtactttatgcagttact

SEQ ID NO: 208757 - DNA, 20 bp, Artificial
  CRISPR gRNA sequence
gttactcagttaatatattg

SEQ ID NO: 208758 - DNA, 20 bp, Artificial
  CRISPR gRNA sequence
atattgtggtaattgaaatt

SEQ ID NO: 208759 - DNA, 20 bp, Artificial
  CRISPR gRNA sequence
ttgaaatttggactgtttat

SEQ ID NO: 208760 - DNA, 20 bp, Artificial
  CRISPR gRNA sequence
tgaaatttggactgtttatg

SEQ ID NO: 208761 - DNA, 20 bp, Artificial
  CRISPR gRNA sequence
gaaatttggactgtttatga

SEQ ID NO: 208762 - DNA, 20 bp, Artificial
  CRISPR gRNA sequence
ggatttatttgattaaacca

SEQ ID NO: 208763 - DNA, 20 bp, Artificial
  CRISPR gRNA sequence
tttgattaaaccatggtaac

SEQ ID NO: 208764 - DNA, 20 bp, Artificial
  CRISPR gRNA sequence
atggtaactggaattcatat

SEQ ID NO: 208765 - DNA, 20 bp, Artificial
  CRISPR gRNA sequence
aactggaattcatatcagaa

SEQ ID NO: 208766 - DNA, 20 bp, Artificial
  CRISPR gRNA sequence
attcatatcagaatagtgca

SEQ ID NO: 208767 - DNA, 20 bp, Artificial
  CRISPR gRNA sequence
atatcagaatagtgcaaagt

SEQ ID NO: 208768 - DNA, 20 bp, Artificial
  CRISPR gRNA sequence
tatcagaatagtgcaaagtg

SEQ ID NO: 208769 - DNA, 20 bp, Artificial
  CRISPR gRNA sequence
ccaaatttaaaactgtattc

SEQ ID NO: 208770 - DNA, 20 bp, Artificial
  CRISPR gRNA sequence
caaatttaaaactgtattct

SEQ ID NO: 208771 - DNA, 20 bp, Artificial
  CRISPR gRNA sequence
ccctgctcaaaattactcca

SEQ ID NO: 208772 - DNA, 20 bp, Artificial
  CRISPR gRNA sequence
ctgctcaaaattactccaca

SEQ ID NO: 208773 - DNA, 20 bp, Artificial
  CRISPR gRNA sequence
aaattactccacagagattt

SEQ ID NO: 208774 - DNA, 20 bp, Artificial
  CRISPR gRNA sequence
ctccacagagattttggtta

SEQ ID NO: 208775 - DNA, 20 bp, Artificial
  CRISPR gRNA sequence
cagagattttggttacggct

SEQ ID NO: 208776 - DNA, 20 bp, Artificial
  CRISPR gRNA sequence
gttacggctcagatgtcttt

SEQ ID NO: 208777 - DNA, 20 bp, Artificial
  CRISPR gRNA sequence
acggctcagatgtctttgag

SEQ ID NO: 208778 - DNA, 20 bp, Artificial
  CRISPR gRNA sequence
tctttgagtagatgttcctg

SEQ ID NO: 208779 - DNA, 20 bp, Artificial
  CRISPR gRNA sequence
gttcctgtagaaatcattgt

SEQ ID NO: 208780 - DNA, 20 bp, Artificial
  CRISPR gRNA sequence
aaatcattgttagaaaattc

SEQ ID NO: 208781 - DNA, 20 bp, Artificial
  CRISPR gRNA sequence
aatcattgttagaaaattca

SEQ ID NO: 208782 - DNA, 20 bp, Artificial
  CRISPR gRNA sequence
gttagaaaattcaaggaaaa

SEQ ID NO: 208783 - DNA, 20 bp, Artificial
  CRISPR gRNA sequence
agttctcattacactacctt

SEQ ID NO: 208784 - DNA, 20 bp, Artificial
  CRISPR gRNA sequence
cactaccttgagatcctacc

SEQ ID NO: 208785 - DNA, 20 bp, Artificial
  CRISPR gRNA sequence
tgagatcctaccaagtcctt

SEQ ID NO: 208786 - DNA, 20 bp, Artificial
  CRISPR gRNA sequence
aagtccttgagttttgactt

SEQ ID NO: 208787 - DNA, 20 bp, Artificial
  CRISPR gRNA sequence
agtccttgagttttgacttg

SEQ ID NO: 208788 - DNA, 20 bp, Artificial
  CRISPR gRNA sequence
cttgagttttgacttgagga

SEQ ID NO: 208789 - DNA, 20 bp, Artificial
  CRISPR gRNA sequence
tgaggacagcttaataatga

SEQ ID NO: 208790 - DNA, 20 bp, Artificial
  CRISPR gRNA sequence
gcttaataatgaaagtaatt

SEQ ID NO: 208791 - DNA, 20 bp, Artificial
  CRISPR gRNA sequence
tgaaagtaattcagccatga

SEQ ID NO: 208792 - DNA, 20 bp, Artificial
  CRISPR gRNA sequence
catgaaagcatatttaaaat

SEQ ID NO: 208793 - DNA, 20 bp, Artificial
  CRISPR gRNA sequence
agcatatttaaaataagtaa

SEQ ID NO: 208794 - DNA, 20 bp, Artificial
  CRISPR gRNA sequence
atttaaaataagtaatggaa

SEQ ID NO: 208795 - DNA, 20 bp, Artificial
  CRISPR gRNA sequence
tttaaaataagtaatggaac

SEQ ID NO: 208796 - DNA, 20 bp, Artificial
  CRISPR gRNA sequence
tggaacaggaaatttcttca

SEQ ID NO: 208797 - DNA, 20 bp, Artificial
  CRISPR gRNA sequence
caggaaatttcttcatagat

SEQ ID NO: 208798 - DNA, 20 bp, Artificial
  CRISPR gRNA sequence
ttagaaaaattattctgaaa

SEQ ID NO: 208799 - DNA, 20 bp, Artificial
  CRISPR gRNA sequence
aaaattattctgaaaaagtg

SEQ ID NO: 208800 - DNA, 20 bp, Artificial
  CRISPR gRNA sequence
attctgaaaaagtgaagaca

SEQ ID NO: 208801 - DNA, 20 bp, Artificial
  CRISPR gRNA sequence
agtgaagacatagcctatct

SEQ ID NO: 208802 - DNA, 20 bp, Artificial
  CRISPR gRNA sequence
agacatagcctatcttggac

SEQ ID NO: 208803 - DNA, 20 bp, Artificial
  CRISPR gRNA sequence
gacatagcctatcttggact

SEQ ID NO: 208804 - DNA, 20 bp, Artificial
  CRISPR gRNA sequence
ggactaggaaatttccatcc

SEQ ID NO: 208805 - DNA, 20 bp, Artificial
  CRISPR gRNA sequence
taggaaatttccatccaaga

SEQ ID NO: 208806 - DNA, 20 bp, Artificial
  CRISPR gRNA sequence
atacaataaatattatcaca

SEQ ID NO: 208807 - DNA, 20 bp, Artificial
  CRISPR gRNA sequence
caaagaatcattctgtgacc

SEQ ID NO: 208808 - DNA, 20 bp, Artificial
  CRISPR gRNA sequence
tcattctgtgacctggttga

SEQ ID NO: 208809 - DNA, 20 bp, Artificial
  CRISPR gRNA sequence
gtgacctggttgatggcccc

SEQ ID NO: 208810 - DNA, 20 bp, Artificial
  CRISPR gRNA sequence
ggttgatggcccctggtaat

SEQ ID NO: 208811 - DNA, 20 bp, Artificial
  CRISPR gRNA sequence
ggtaataagactttgttatt

SEQ ID NO: 208812 - DNA, 20 bp, Artificial
  CRISPR gRNA sequence
tttttttttttttttttttt

SEQ ID NO: 208813 - DNA, 20 bp, Artificial
  CRISPR gRNA sequence
ttttttttttttttttgaga

SEQ ID NO: 208814 - DNA, 20 bp, Artificial
  CRISPR gRNA sequence
ttttttttttttttgagacg

SEQ ID NO: 208815 - DNA, 20 bp, Artificial
  CRISPR gRNA sequence
cggagtctcgctctgttgcc

SEQ ID NO: 208816 - DNA, 20 bp, Artificial
  CRISPR gRNA sequence
ggagtctcgctctgttgccc

SEQ ID NO: 208817 - DNA, 20 bp, Artificial
  CRISPR gRNA sequence
tctcgctctgttgcccaggc

SEQ ID NO: 208818 - DNA, 20 bp, Artificial
  CRISPR gRNA sequence
tcgctctgttgcccaggctg

SEQ ID NO: 208819 - DNA, 20 bp, Artificial
  CRISPR gRNA sequence
ctgttgcccaggctggagtg

SEQ ID NO: 208820 - DNA, 20 bp, Artificial
  CRISPR gRNA sequence
ttgcccaggctggagtgcag

SEQ ID NO: 208821 - DNA, 20 bp, Artificial
  CRISPR gRNA sequence
ggagtgcagtggcgtgatct

SEQ ID NO: 208822 - DNA, 20 bp, Artificial
  CRISPR gRNA sequence
tcactgcaacctccgcctcc

SEQ ID NO: 208823 - DNA, 20 bp, Artificial
  CRISPR gRNA sequence
cactgcaacctccgcctccc

SEQ ID NO: 208824 - DNA, 20 bp, Artificial
  CRISPR gRNA sequence
aacctccgcctcccaggttc

SEQ ID NO: 208825 - DNA, 20 bp, Artificial
  CRISPR gRNA sequence
ttcaagcgattcttctgtct

SEQ ID NO: 208826 - DNA, 20 bp, Artificial
  CRISPR gRNA sequence
ttcttctgtctcagcctccc

SEQ ID NO: 208827 - DNA, 20 bp, Artificial
  CRISPR gRNA sequence
ttctgtctcagcctcccgag

SEQ ID NO: 208828 - DNA, 20 bp, Artificial
  CRISPR gRNA sequence
ctcagcctcccgagtagcta

SEQ ID NO: 208829 - DNA, 20 bp, Artificial
  CRISPR gRNA sequence
tcagcctcccgagtagctac

SEQ ID NO: 208830 - DNA, 20 bp, Artificial
  CRISPR gRNA sequence
cccgagtagctacaggctac

SEQ ID NO: 208831 - DNA, 20 bp, Artificial
  CRISPR gRNA sequence
ctggcgtgcaccaccatgcc

SEQ ID NO: 208832 - DNA, 20 bp, Artificial
  CRISPR gRNA sequence
tggcgtgcaccaccatgcct

SEQ ID NO: 208833 - DNA, 20 bp, Artificial
  CRISPR gRNA sequence
ctgggtaatttttgtatttt

SEQ ID NO: 208834 - DNA, 20 bp, Artificial
  CRISPR gRNA sequence
ggtaatttttgtatttttag

SEQ ID NO: 208835 - DNA, 20 bp, Artificial
  CRISPR gRNA sequence
ttttgtatttttagtagtga

SEQ ID NO: 208836 - DNA, 20 bp, Artificial
  CRISPR gRNA sequence
tttgtatttttagtagtgat

SEQ ID NO: 208837 - DNA, 20 bp, Artificial
  CRISPR gRNA sequence
ttgtatttttagtagtgatg

SEQ ID NO: 208838 - DNA, 20 bp, Artificial
  CRISPR gRNA sequence
gtgatggggtttcaccatat

SEQ ID NO: 208839 - DNA, 20 bp, Artificial
  CRISPR gRNA sequence
tggggtttcaccatattggc

SEQ ID NO: 208840 - DNA, 20 bp, Artificial
  CRISPR gRNA sequence
ggggtttcaccatattggcc

SEQ ID NO: 208841 - DNA, 20 bp, Artificial
  CRISPR gRNA sequence
tttcaccatattggccaggc

SEQ ID NO: 208842 - DNA, 20 bp, Artificial
  CRISPR gRNA sequence
acctcgtgatccgtctgtct

SEQ ID NO: 208843 - DNA, 20 bp, Artificial
  CRISPR gRNA sequence
ccgtctgtctcggcctccca

SEQ ID NO: 208844 - DNA, 20 bp, Artificial
  CRISPR gRNA sequence
tctcggcctcccaaagtgct

SEQ ID NO: 208845 - DNA, 20 bp, Artificial
  CRISPR gRNA sequence
ctcccaaagtgctgagatta

SEQ ID NO: 208846 - DNA, 20 bp, Artificial
  CRISPR gRNA sequence
tcccaaagtgctgagattac

SEQ ID NO: 208847 - DNA, 20 bp, Artificial
  CRISPR gRNA sequence
agtgctgagattacaggcat

SEQ ID NO: 208848 - DNA, 20 bp, Artificial
  CRISPR gRNA sequence
caggcattagccaccatgca

SEQ ID NO: 208849 - DNA, 20 bp, Artificial
  CRISPR gRNA sequence
ccaccatgcatggcccctta

SEQ ID NO: 208850 - DNA, 20 bp, Artificial
  CRISPR gRNA sequence
gttcaataatcttgaactcc

SEQ ID NO: 208851 - DNA, 20 bp, Artificial
  CRISPR gRNA sequence
gaactcccagtgctttccct

SEQ ID NO: 208852 - DNA, 20 bp, Artificial
  CRISPR gRNA sequence
cttatgtgctgattttattg

SEQ ID NO: 208853 - DNA, 20 bp, Artificial
  CRISPR gRNA sequence
ttatgtgctgattttattgt

SEQ ID NO: 208854 - DNA, 20 bp, Artificial
  CRISPR gRNA sequence
atgtgctgattttattgtag

SEQ ID NO: 208855 - DNA, 20 bp, Artificial
  CRISPR gRNA sequence
tgtgctgattttattgtagg

SEQ ID NO: 208856 - DNA, 20 bp, Artificial
  CRISPR gRNA sequence
ggaggaattgaacaaatcta

SEQ ID NO: 208857 - DNA, 20 bp, Artificial
  CRISPR gRNA sequence
aattgaacaaatctatagct

SEQ ID NO: 208858 - DNA, 20 bp, Artificial
  CRISPR gRNA sequence
ctcagcattttactcttttg

SEQ ID NO: 208859 - DNA, 20 bp, Artificial
  CRISPR gRNA sequence
cccttgaccctttccaaatc

SEQ ID NO: 208860 - DNA, 20 bp, Artificial
  CRISPR gRNA sequence
tcaaaaattgtgaaatccac

SEQ ID NO: 208861 - DNA, 20 bp, Artificial
  CRISPR gRNA sequence
caaaaattgtgaaatccaca

SEQ ID NO: 208862 - DNA, 20 bp, Artificial
  CRISPR gRNA sequence
aaattgtgaaatccacaagg

SEQ ID NO: 208863 - DNA, 20 bp, Artificial
  CRISPR gRNA sequence
aattgtgaaatccacaaggc

SEQ ID NO: 208864 - DNA, 20 bp, Artificial
  CRISPR gRNA sequence
attgtgaaatccacaaggca

SEQ ID NO: 208865 - DNA, 20 bp, Artificial
  CRISPR gRNA sequence
tgaaatccacaaggcaggga

SEQ ID NO: 208866 - DNA, 20 bp, Artificial
  CRISPR gRNA sequence
ggaaagttgataatgaaaaa

SEQ ID NO: 208867 - DNA, 20 bp, Artificial
  CRISPR gRNA sequence
gaaagttgataatgaaaaaa

SEQ ID NO: 208868 - DNA, 20 bp, Artificial
  CRISPR gRNA sequence
agttgataatgaaaaaaagg

SEQ ID NO: 208869 - DNA, 20 bp, Artificial
  CRISPR gRNA sequence
ataatgaaaaaaaggaagtt

SEQ ID NO: 208870 - DNA, 20 bp, Artificial
  CRISPR gRNA sequence
aaaaaggaagtttggtctgt

SEQ ID NO: 208871 - DNA, 20 bp, Artificial
  CRISPR gRNA sequence
tctttcatcttttatgttca

SEQ ID NO: 208872 - DNA, 20 bp, Artificial
  CRISPR gRNA sequence
ttcaaagtacttgatgcaca

SEQ ID NO: 208873 - DNA, 20 bp, Artificial
  CRISPR gRNA sequence
agtacttgatgcacaaagcc

SEQ ID NO: 208874 - DNA, 20 bp, Artificial
  CRISPR gRNA sequence
actcttttatctctgtccta

SEQ ID NO: 208875 - DNA, 20 bp, Artificial
  CRISPR gRNA sequence
ctgtcctatagactgatgtc

SEQ ID NO: 208876 - DNA, 20 bp, Artificial
  CRISPR gRNA sequence
cctatagactgatgtctagt

SEQ ID NO: 208877 - DNA, 20 bp, Artificial
  CRISPR gRNA sequence
ttgtgacaaaattgtttcat

SEQ ID NO: 208878 - DNA, 20 bp, Artificial
  CRISPR gRNA sequence
gtgacaaaattgtttcatta

SEQ ID NO: 208879 - DNA, 20 bp, Artificial
  CRISPR gRNA sequence
caaaattgtttcattagagc

SEQ ID NO: 208880 - DNA, 20 bp, Artificial
  CRISPR gRNA sequence
attgtttcattagagcaagt

SEQ ID NO: 208881 - DNA, 20 bp, Artificial
  CRISPR gRNA sequence
tttcattagagcaagttgga

SEQ ID NO: 208882 - DNA, 20 bp, Artificial
  CRISPR gRNA sequence
agagcaagttggatagtgta

SEQ ID NO: 208883 - DNA, 20 bp, Artificial
  CRISPR gRNA sequence
agcaagttggatagtgtatg

SEQ ID NO: 208884 - DNA, 20 bp, Artificial
  CRISPR gRNA sequence
gatttaacttgtcttctgtc

SEQ ID NO: 208885 - DNA, 20 bp, Artificial
  CRISPR gRNA sequence
ctgtcaagtaattttataat

SEQ ID NO: 208886 - DNA, 20 bp, Artificial
  CRISPR gRNA sequence
tattaatgttcatttttttc

SEQ ID NO: 208887 - DNA, 20 bp, Artificial
  CRISPR gRNA sequence
tgttcatttttttccagtac

SEQ ID NO: 208888 - DNA, 20 bp, Artificial
  CRISPR gRNA sequence
tttttttccagtaccagttt

SEQ ID NO: 208889 - DNA, 20 bp, Artificial
  CRISPR gRNA sequence
ttttccagtaccagtttcag

SEQ ID NO: 208890 - DNA, 20 bp, Artificial
  CRISPR gRNA sequence
tatgcatgtgtgtgttaaat

SEQ ID NO: 208891 - DNA, 20 bp, Artificial
  CRISPR gRNA sequence
tgtgtgttaaataagtgtat

SEQ ID NO: 208892 - DNA, 20 bp, Artificial
  CRISPR gRNA sequence
tgtattagatacttgaaaaa

SEQ ID NO: 208893 - DNA, 20 bp, Artificial
  CRISPR gRNA sequence
aaattgtaattttatgtgta

SEQ ID NO: 208894 - DNA, 20 bp, Artificial
  CRISPR gRNA sequence
aattgtaattttatgtgtaa

SEQ ID NO: 208895 - DNA, 20 bp, Artificial
  CRISPR gRNA sequence
ctgaaaacaatattcattta

SEQ ID NO: 208896 - DNA, 20 bp, Artificial
  CRISPR gRNA sequence
aatattcatttacagctcaa

SEQ ID NO: 208897 - DNA, 20 bp, Artificial
  CRISPR gRNA sequence
atattctaaaattactttcc

SEQ ID NO: 208898 - DNA, 20 bp, Artificial
  CRISPR gRNA sequence
attctaaaattactttccta

SEQ ID NO: 208899 - DNA, 20 bp, Artificial
  CRISPR gRNA sequence
aattactttcctagagttat

SEQ ID NO: 208900 - DNA, 20 bp, Artificial
  CRISPR gRNA sequence
ttcctagagttatcagaaaa

SEQ ID NO: 208901 - DNA, 20 bp, Artificial
  CRISPR gRNA sequence
ctttctttatgatttattct

SEQ ID NO: 208902 - DNA, 20 bp, Artificial
  CRISPR gRNA sequence
attcttagtctgatacgcat

SEQ ID NO: 208903 - DNA, 20 bp, Artificial
  CRISPR gRNA sequence
tagtctgatacgcatcagcc

SEQ ID NO: 208904 - DNA, 20 bp, Artificial
  CRISPR gRNA sequence
ctgatacgcatcagcctggt

SEQ ID NO: 208905 - DNA, 20 bp, Artificial
  CRISPR gRNA sequence
cactccaaatgtcatgtctt

SEQ ID NO: 208906 - DNA, 20 bp, Artificial
  CRISPR gRNA sequence
actccaaatgtcatgtcttt

SEQ ID NO: 208907 - DNA, 20 bp, Artificial
  CRISPR gRNA sequence
ccaaatgtcatgtctttggg

SEQ ID NO: 208908 - DNA, 20 bp, Artificial
  CRISPR gRNA sequence
caaatgtcatgtctttgggc

SEQ ID NO: 208909 - DNA, 20 bp, Artificial
  CRISPR gRNA sequence
ttgggcaggcattaaattct

SEQ ID NO: 208910 - DNA, 20 bp, Artificial
  CRISPR gRNA sequence
tgggcaggcattaaattctt

SEQ ID NO: 208911 - DNA, 20 bp, Artificial
  CRISPR gRNA sequence
ggcattaaattcttgggttt

SEQ ID NO: 208912 - DNA, 20 bp, Artificial
  CRISPR gRNA sequence
gcattaaattcttgggtttt

SEQ ID NO: 208913 - DNA, 20 bp, Artificial
  CRISPR gRNA sequence
tcttgggttttgggttttgt

SEQ ID NO: 208914 - DNA, 20 bp, Artificial
  CRISPR gRNA sequence
gggttttgggttttgttgga

SEQ ID NO: 208915 - DNA, 20 bp, Artificial
  CRISPR gRNA sequence
gggttttgttggatggactg

SEQ ID NO: 208916 - DNA, 20 bp, Artificial
  CRISPR gRNA sequence
ggatggactgcagtctgtgt

SEQ ID NO: 208917 - DNA, 20 bp, Artificial
  CRISPR gRNA sequence
gcagtctgtgtgagcctata

SEQ ID NO: 208918 - DNA, 20 bp, Artificial
  CRISPR gRNA sequence
cagtctgtgtgagcctatat

SEQ ID NO: 208919 - DNA, 20 bp, Artificial
  CRISPR gRNA sequence
ctatatgggtgtgtcaaatc

SEQ ID NO: 208920 - DNA, 20 bp, Artificial
  CRISPR gRNA sequence
ggtgtgtcaaatccagtctt

SEQ ID NO: 208921 - DNA, 20 bp, Artificial
  CRISPR gRNA sequence
gtgtgtcaaatccagtcttt

SEQ ID NO: 208922 - DNA, 20 bp, Artificial
  CRISPR gRNA sequence
tgtgtcaaatccagtctttg

SEQ ID NO: 208923 - DNA, 20 bp, Artificial
  CRISPR gRNA sequence
atccagtctttggggtgtca

SEQ ID NO: 208924 - DNA, 20 bp, Artificial
  CRISPR gRNA sequence
tttggggtgtcatggaaact

SEQ ID NO: 208925 - DNA, 20 bp, Artificial
  CRISPR gRNA sequence
gtcatggaaacttagcatga

SEQ ID NO: 208926 - DNA, 20 bp, Artificial
  CRISPR gRNA sequence
atagacttgattttatcccc

SEQ ID NO: 208927 - DNA, 20 bp, Artificial
  CRISPR gRNA sequence
attttatccccaagttgact

SEQ ID NO: 208928 - DNA, 20 bp, Artificial
  CRISPR gRNA sequence
agttgacttggtaatttcat

SEQ ID NO: 208929 - DNA, 20 bp, Artificial
  CRISPR gRNA sequence
gtaatttcattagatttcat

SEQ ID NO: 208930 - DNA, 20 bp, Artificial
  CRISPR gRNA sequence
atcttgtatgtgctgtctat

SEQ ID NO: 208931 - DNA, 20 bp, Artificial
  CRISPR gRNA sequence
ctgtctattggtcacaaaat

SEQ ID NO: 208932 - DNA, 20 bp, Artificial
  CRISPR gRNA sequence
ttcttgtccattcataacat

SEQ ID NO: 208933 - DNA, 20 bp, Artificial
  CRISPR gRNA sequence
cataacattagctgtttttt

SEQ ID NO: 208934 - DNA, 20 bp, Artificial
  CRISPR gRNA sequence
ataacattagctgttttttc

SEQ ID NO: 208935 - DNA, 20 bp, Artificial
  CRISPR gRNA sequence
acattagctgttttttcagg

SEQ ID NO: 208936 - DNA, 20 bp, Artificial
  CRISPR gRNA sequence
tagctgttttttcaggtggc

SEQ ID NO: 208937 - DNA, 20 bp, Artificial
  CRISPR gRNA sequence
gctgttttttcaggtggcta

SEQ ID NO: 208938 - DNA, 20 bp, Artificial
  CRISPR gRNA sequence
ctgttttttcaggtggctag

SEQ ID NO: 208939 - DNA, 20 bp, Artificial
  CRISPR gRNA sequence
tgttttttcaggtggctaga

SEQ ID NO: 208940 - DNA, 20 bp, Artificial
  CRISPR gRNA sequence
cttcatctgcatgaatttga

SEQ ID NO: 208941 - DNA, 20 bp, Artificial
  CRISPR gRNA sequence
tttgaaagattaaatgcata

SEQ ID NO: 208942 - DNA, 20 bp, Artificial
  CRISPR gRNA sequence
ttgaaagattaaatgcataa

SEQ ID NO: 208943 - DNA, 20 bp, Artificial
  CRISPR gRNA sequence
aatgcataaaggaattttct

SEQ ID NO: 208944 - DNA, 20 bp, Artificial
  CRISPR gRNA sequence
tgcataaaggaattttctta

SEQ ID NO: 208945 - DNA, 20 bp, Artificial
  CRISPR gRNA sequence
ataaaggaattttcttagag

SEQ ID NO: 208946 - DNA, 20 bp, Artificial
  CRISPR gRNA sequence
aaaggaattttcttagagta

SEQ ID NO: 208947 - DNA, 20 bp, Artificial
  CRISPR gRNA sequence
ggaattttcttagagtagag

SEQ ID NO: 208948 - DNA, 20 bp, Artificial
  CRISPR gRNA sequence
gaattttcttagagtagagt

SEQ ID NO: 208949 - DNA, 20 bp, Artificial
  CRISPR gRNA sequence
gccttcaccatctctttaac

SEQ ID NO: 208950 - DNA, 20 bp, Artificial
  CRISPR gRNA sequence
ccttcaccatctctttaact

SEQ ID NO: 208951 - DNA, 20 bp, Artificial
  CRISPR gRNA sequence
caccatctctttaactggga

SEQ ID NO: 208952 - DNA, 20 bp, Artificial
  CRISPR gRNA sequence
catctctttaactgggaaag

SEQ ID NO: 208953 - DNA, 20 bp, Artificial
  CRISPR gRNA sequence
tttaactgggaaagaagttt

SEQ ID NO: 208954 - DNA, 20 bp, Artificial
  CRISPR gRNA sequence
ttaactgggaaagaagtttt

SEQ ID NO: 208955 - DNA, 20 bp, Artificial
  CRISPR gRNA sequence
aactgggaaagaagttttgg

SEQ ID NO: 208956 - DNA, 20 bp, Artificial
  CRISPR gRNA sequence
aaacacacacactcacccat

SEQ ID NO: 208957 - DNA, 20 bp, Artificial
  CRISPR gRNA sequence
acactcacccattagaatgt

SEQ ID NO: 208958 - DNA, 20 bp, Artificial
  CRISPR gRNA sequence
cactcacccattagaatgta

SEQ ID NO: 208959 - DNA, 20 bp, Artificial
  CRISPR gRNA sequence
actcacccattagaatgtaa

SEQ ID NO: 208960 - DNA, 20 bp, Artificial
  CRISPR gRNA sequence
cattagaatgtaagggcctt

SEQ ID NO: 208961 - DNA, 20 bp, Artificial
  CRISPR gRNA sequence
attagaatgtaagggccttg

SEQ ID NO: 208962 - DNA, 20 bp, Artificial
  CRISPR gRNA sequence
agaatgtaagggccttgagg

SEQ ID NO: 208963 - DNA, 20 bp, Artificial
  CRISPR gRNA sequence
gaatgtaagggccttgaggc

SEQ ID NO: 208964 - DNA, 20 bp, Artificial
  CRISPR gRNA sequence
ttgcttttcgtgttcactgt

SEQ ID NO: 208965 - DNA, 20 bp, Artificial
  CRISPR gRNA sequence
tcgtgttcactgtcagcatt

SEQ ID NO: 208966 - DNA, 20 bp, Artificial
  CRISPR gRNA sequence
ttcactgtcagcatttagaa

SEQ ID NO: 208967 - DNA, 20 bp, Artificial
  CRISPR gRNA sequence
gtcagcatttagaatagtga

SEQ ID NO: 208968 - DNA, 20 bp, Artificial
  CRISPR gRNA sequence
ttagaatagtgatagtcata

SEQ ID NO: 208969 - DNA, 20 bp, Artificial
  CRISPR gRNA sequence
aatagtgatagtcatataga

SEQ ID NO: 208970 - DNA, 20 bp, Artificial
  CRISPR gRNA sequence
gtgatagtcatatagatgga

SEQ ID NO: 208971 - DNA, 20 bp, Artificial
  CRISPR gRNA sequence
caatcaattattgtcaaata

SEQ ID NO: 208972 - DNA, 20 bp, Artificial
  CRISPR gRNA sequence
aatctacttgttccttgatt

SEQ ID NO: 208973 - DNA, 20 bp, Artificial
  CRISPR gRNA sequence
acttgttccttgatttagac

SEQ ID NO: 208974 - DNA, 20 bp, Artificial
  CRISPR gRNA sequence
tccttgatttagactagcaa

SEQ ID NO: 208975 - DNA, 20 bp, Artificial
  CRISPR gRNA sequence
ccttgatttagactagcaaa

SEQ ID NO: 208976 - DNA, 20 bp, Artificial
  CRISPR gRNA sequence
cttgatttagactagcaaaa

SEQ ID NO: 208977 - DNA, 20 bp, Artificial
  CRISPR gRNA sequence
ttgatttagactagcaaaag

SEQ ID NO: 208978 - DNA, 20 bp, Artificial
  CRISPR gRNA sequence
tttagactagcaaaaggggc

SEQ ID NO: 208979 - DNA, 20 bp, Artificial
  CRISPR gRNA sequence
caaaaggggctggtacattg

SEQ ID NO: 208980 - DNA, 20 bp, Artificial
  CRISPR gRNA sequence
aaaaggggctggtacattgt

SEQ ID NO: 208981 - DNA, 20 bp, Artificial
  CRISPR gRNA sequence
gctggtacattgtaggtaca

SEQ ID NO: 208982 - DNA, 20 bp, Artificial
  CRISPR gRNA sequence
aggtacacagtaaatatttg

SEQ ID NO: 208983 - DNA, 20 bp, Artificial
  CRISPR gRNA sequence
cacagtaaatatttgtagaa

SEQ ID NO: 208984 - DNA, 20 bp, Artificial
  CRISPR gRNA sequence
agatgaatgaaccaacccaa

SEQ ID NO: 208985 - DNA, 20 bp, Artificial
  CRISPR gRNA sequence
aaccaacccaacagatttct

SEQ ID NO: 208986 - DNA, 20 bp, Artificial
  CRISPR gRNA sequence
caacccaacagatttcttag

SEQ ID NO: 208987 - DNA, 20 bp, Artificial
  CRISPR gRNA sequence
cccaacagatttcttagaag

SEQ ID NO: 208988 - DNA, 20 bp, Artificial
  CRISPR gRNA sequence
tcttagaagtagcctgcttt

SEQ ID NO: 208989 - DNA, 20 bp, Artificial
  CRISPR gRNA sequence
tttggttactaattatttta

SEQ ID NO: 208990 - DNA, 20 bp, Artificial
  CRISPR gRNA sequence
ttattttatagaacatataa

SEQ ID NO: 208991 - DNA, 20 bp, Artificial
  CRISPR gRNA sequence
gaacatataaaagaaaattt

SEQ ID NO: 208992 - DNA, 20 bp, Artificial
  CRISPR gRNA sequence
atattgtctcccctgatact

SEQ ID NO: 208993 - DNA, 20 bp, Artificial
  CRISPR gRNA sequence
gatacttggtattcctgtgt

SEQ ID NO: 208994 - DNA, 20 bp, Artificial
  CRISPR gRNA sequence
atacttggtattcctgtgtc

SEQ ID NO: 208995 - DNA, 20 bp, Artificial
  CRISPR gRNA sequence
tggtattcctgtgtcaggct

SEQ ID NO: 208996 - DNA, 20 bp, Artificial
  CRISPR gRNA sequence
cctgtgtcaggctgagcact

SEQ ID NO: 208997 - DNA, 20 bp, Artificial
  CRISPR gRNA sequence
ctgtgtcaggctgagcacta

SEQ ID NO: 208998 - DNA, 20 bp, Artificial
  CRISPR gRNA sequence
aaggttatacattttttgtt

SEQ ID NO: 208999 - DNA, 20 bp, Artificial
  CRISPR gRNA sequence
tttattttgtgtattgattt

SEQ ID NO: 209000 - DNA, 20 bp, Artificial
  CRISPR gRNA sequence
attttgtgtattgatttcag

SEQ ID NO: 209001 - DNA, 20 bp, Artificial
  CRISPR gRNA sequence
tgtattgatttcagtagttg

SEQ ID NO: 209002 - DNA, 20 bp, Artificial
  CRISPR gRNA sequence
tgatttcagtagttgtagct

SEQ ID NO: 209003 - DNA, 20 bp, Artificial
  CRISPR gRNA sequence
gatttcagtagttgtagctg

SEQ ID NO: 209004 - DNA, 20 bp, Artificial
  CRISPR gRNA sequence
atttcagtagttgtagctga

SEQ ID NO: 209005 - DNA, 20 bp, Artificial
  CRISPR gRNA sequence
tgtagctgagggtaatcctt

SEQ ID NO: 209006 - DNA, 20 bp, Artificial
  CRISPR gRNA sequence
tagctgagggtaatccttaa

SEQ ID NO: 209007 - DNA, 20 bp, Artificial
  CRISPR gRNA sequence
gggtaatccttaagagcatg

SEQ ID NO: 209008 - DNA, 20 bp, Artificial
  CRISPR gRNA sequence
tgcagattttaaaaattaca

SEQ ID NO: 209009 - DNA, 20 bp, Artificial
  CRISPR gRNA sequence
attacatagattgccttgcc

SEQ ID NO: 209010 - DNA, 20 bp, Artificial
  CRISPR gRNA sequence
tgccttgccaagccgtctga

SEQ ID NO: 209011 - DNA, 20 bp, Artificial
  CRISPR gRNA sequence
aagccgtctgaaagtcatac

SEQ ID NO: 209012 - DNA, 20 bp, Artificial
  CRISPR gRNA sequence
gtcatactagaaaatttgat

SEQ ID NO: 209013 - DNA, 20 bp, Artificial
  CRISPR gRNA sequence
catactagaaaatttgataa

SEQ ID NO: 209014 - DNA, 20 bp, Artificial
  CRISPR gRNA sequence
cctgctgttaacaacacatt

SEQ ID NO: 209015 - DNA, 20 bp, Artificial
  CRISPR gRNA sequence
gttatttttatcttaatgct

SEQ ID NO: 209016 - DNA, 20 bp, Artificial
  CRISPR gRNA sequence
atttttatcttaatgctaag

SEQ ID NO: 209017 - DNA, 20 bp, Artificial
  CRISPR gRNA sequence
ttttatcttaatgctaagtg

SEQ ID NO: 209018 - DNA, 20 bp, Artificial
  CRISPR gRNA sequence
ttttgatacattcaataaat

SEQ ID NO: 209019 - DNA, 20 bp, Artificial
  CRISPR gRNA sequence
tttgatacattcaataaata

SEQ ID NO: 209020 - DNA, 20 bp, Artificial
  CRISPR gRNA sequence
aaggataaatccacttactg

SEQ ID NO: 209021 - DNA, 20 bp, Artificial
  CRISPR gRNA sequence
aggataaatccacttactga

SEQ ID NO: 209022 - DNA, 20 bp, Artificial
  CRISPR gRNA sequence
aaatccacttactgaaggac

SEQ ID NO: 209023 - DNA, 20 bp, Artificial
  CRISPR gRNA sequence
cacttactgaaggacaagaa

SEQ ID NO: 209024 - DNA, 20 bp, Artificial
  CRISPR gRNA sequence
aaggacaagaaaagatcaat

SEQ ID NO: 209025 - DNA, 20 bp, Artificial
  CRISPR gRNA sequence
ggacaagaaaagatcaataa

SEQ ID NO: 209026 - DNA, 20 bp, Artificial
  CRISPR gRNA sequence
aagatcaataagagatcctt

SEQ ID NO: 209027 - DNA, 20 bp, Artificial
  CRISPR gRNA sequence
agatcaataagagatccttg

SEQ ID NO: 209028 - DNA, 20 bp, Artificial
  CRISPR gRNA sequence
taagagatccttgaggttat

SEQ ID NO: 209029 - DNA, 20 bp, Artificial
  CRISPR gRNA sequence
aagagatccttgaggttatt

SEQ ID NO: 209030 - DNA, 20 bp, Artificial
  CRISPR gRNA sequence
cttgaggttattgggttcta

SEQ ID NO: 209031 - DNA, 20 bp, Artificial
  CRISPR gRNA sequence
ccttgccctttcactatact

SEQ ID NO: 209032 - DNA, 20 bp, Artificial
  CRISPR gRNA sequence
atactgagaaatttgacgac

SEQ ID NO: 209033 - DNA, 20 bp, Artificial
  CRISPR gRNA sequence
tactgagaaatttgacgact

SEQ ID NO: 209034 - DNA, 20 bp, Artificial
  CRISPR gRNA sequence
gagaaatttgacgactgggc

SEQ ID NO: 209035 - DNA, 20 bp, Artificial
  CRISPR gRNA sequence
ttgacgactgggctagcaac

SEQ ID NO: 209036 - DNA, 20 bp, Artificial
  CRISPR gRNA sequence
acaagatacctaccccacat

SEQ ID NO: 209037 - DNA, 20 bp, Artificial
  CRISPR gRNA sequence
tacctaccccacattagctg

SEQ ID NO: 209038 - DNA, 20 bp, Artificial
  CRISPR gRNA sequence
ctgctgaaatgtgaccatgt

SEQ ID NO: 209039 - DNA, 20 bp, Artificial
  CRISPR gRNA sequence
gaaatgtgaccatgtgagca

SEQ ID NO: 209040 - DNA, 20 bp, Artificial
  CRISPR gRNA sequence
accatgtgagcaaagaaaat

SEQ ID NO: 209041 - DNA, 20 bp, Artificial
  CRISPR gRNA sequence
gagcaaagaaaatgagccaa

SEQ ID NO: 209042 - DNA, 20 bp, Artificial
  CRISPR gRNA sequence
gccaaaagaaactctttctg

SEQ ID NO: 209043 - DNA, 20 bp, Artificial
  CRISPR gRNA sequence
ctctttctgaagattcactg

SEQ ID NO: 209044 - DNA, 20 bp, Artificial
  CRISPR gRNA sequence
aagattcactgaagaaaacc

SEQ ID NO: 209045 - DNA, 20 bp, Artificial
  CRISPR gRNA sequence
gattcactgaagaaaacctg

SEQ ID NO: 209046 - DNA, 20 bp, Artificial
  CRISPR gRNA sequence
acctggagatactctttcat

SEQ ID NO: 209047 - DNA, 20 bp, Artificial
  CRISPR gRNA sequence
tggagatactctttcattag

SEQ ID NO: 209048 - DNA, 20 bp, Artificial
  CRISPR gRNA sequence
tctttcattagtagacccca

SEQ ID NO: 209049 - DNA, 20 bp, Artificial
  CRISPR gRNA sequence
tttcattagtagaccccaca

SEQ ID NO: 209050 - DNA, 20 bp, Artificial
  CRISPR gRNA sequence
attagtagaccccacagaga

SEQ ID NO: 209051 - DNA, 20 bp, Artificial
  CRISPR gRNA sequence
ttagtagaccccacagagac

SEQ ID NO: 209052 - DNA, 20 bp, Artificial
  CRISPR gRNA sequence
gtagaccccacagagacagg

SEQ ID NO: 209053 - DNA, 20 bp, Artificial
  CRISPR gRNA sequence
agaccccacagagacaggtg

SEQ ID NO: 209054 - DNA, 20 bp, Artificial
  CRISPR gRNA sequence
caggtggagtgtccgttatc

SEQ ID NO: 209055 - DNA, 20 bp, Artificial
  CRISPR gRNA sequence
tgtccgttatccagaatgcc

SEQ ID NO: 209056 - DNA, 20 bp, Artificial
  CRISPR gRNA sequence
gtccgttatccagaatgcct

SEQ ID NO: 209057 - DNA, 20 bp, Artificial
  CRISPR gRNA sequence
ttatccagaatgcctgggac

SEQ ID NO: 209058 - DNA, 20 bp, Artificial
  CRISPR gRNA sequence
tccagaatgcctgggaccag

SEQ ID NO: 209059 - DNA, 20 bp, Artificial
  CRISPR gRNA sequence
gcctgggaccagaagtgttt

SEQ ID NO: 209060 - DNA, 20 bp, Artificial
  CRISPR gRNA sequence
accagaagtgttttggattt

SEQ ID NO: 209061 - DNA, 20 bp, Artificial
  CRISPR gRNA sequence
atttcagattttttcacact

SEQ ID NO: 209062 - DNA, 20 bp, Artificial
  CRISPR gRNA sequence
tttcagattttttcacactt

SEQ ID NO: 209063 - DNA, 20 bp, Artificial
  CRISPR gRNA sequence
tcctcaacatgtgtatttgt

SEQ ID NO: 209064 - DNA, 20 bp, Artificial
  CRISPR gRNA sequence
acatgtgtatttgttggaaa

SEQ ID NO: 209065 - DNA, 20 bp, Artificial
  CRISPR gRNA sequence
tggaaatggctacttaattt

SEQ ID NO: 209066 - DNA, 20 bp, Artificial
  CRISPR gRNA sequence
ggaaatggctacttaattta

SEQ ID NO: 209067 - DNA, 20 bp, Artificial
  CRISPR gRNA sequence
tggctacttaatttaaggaa

SEQ ID NO: 209068 - DNA, 20 bp, Artificial
  CRISPR gRNA sequence
cttaatttaaggaaaagttt

SEQ ID NO: 209069 - DNA, 20 bp, Artificial
  CRISPR gRNA sequence
ttaatttaaggaaaagttta

SEQ ID NO: 209070 - DNA, 20 bp, Artificial
  CRISPR gRNA sequence
atttaaggaaaagtttaagg

SEQ ID NO: 209071 - DNA, 20 bp, Artificial
  CRISPR gRNA sequence
aggaaaagtttaaggtggcc

SEQ ID NO: 209072 - DNA, 20 bp, Artificial
  CRISPR gRNA sequence
tttaaggtggcctggaaaat

SEQ ID NO: 209073 - DNA, 20 bp, Artificial
  CRISPR gRNA sequence
aaggtggcctggaaaataag

SEQ ID NO: 209074 - DNA, 20 bp, Artificial
  CRISPR gRNA sequence
gtggcctggaaaataagtag

SEQ ID NO: 209075 - DNA, 20 bp, Artificial
  CRISPR gRNA sequence
gtagtagttgaactaatcaa

SEQ ID NO: 209076 - DNA, 20 bp, Artificial
  CRISPR gRNA sequence
tagtagttgaactaatcaac

SEQ ID NO: 209077 - DNA, 20 bp, Artificial
  CRISPR gRNA sequence
ccaaaactactttcaatata

SEQ ID NO: 209078 - DNA, 20 bp, Artificial
  CRISPR gRNA sequence
atatagtgtacttatactca

SEQ ID NO: 209079 - DNA, 20 bp, Artificial
  CRISPR gRNA sequence
atagtgtacttatactcaaa

SEQ ID NO: 209080 - DNA, 20 bp, Artificial
  CRISPR gRNA sequence
agtgtacttatactcaaaga

SEQ ID NO: 209081 - DNA, 20 bp, Artificial
  CRISPR gRNA sequence
tacttatactcaaagagaga

SEQ ID NO: 209082 - DNA, 20 bp, Artificial
  CRISPR gRNA sequence
aagagagacggaccatttta

SEQ ID NO: 209083 - DNA, 20 bp, Artificial
  CRISPR gRNA sequence
agagacggaccattttatgg

SEQ ID NO: 209084 - DNA, 20 bp, Artificial
  CRISPR gRNA sequence
ttatggtggaaccctgtcta

SEQ ID NO: 209085 - DNA, 20 bp, Artificial
  CRISPR gRNA sequence
tggtggaaccctgtctatgg

SEQ ID NO: 209086 - DNA, 20 bp, Artificial
  CRISPR gRNA sequence
tgcactgttttctcctataa

SEQ ID NO: 209087 - DNA, 20 bp, Artificial
  CRISPR gRNA sequence
tctcctataacagctcttct

SEQ ID NO: 209088 - DNA, 20 bp, Artificial
  CRISPR gRNA sequence
taacagctcttctaagcctt

SEQ ID NO: 209089 - DNA, 20 bp, Artificial
  CRISPR gRNA sequence
acagctcttctaagccttaa

SEQ ID NO: 209090 - DNA, 20 bp, Artificial
  CRISPR gRNA sequence
cagctcttctaagccttaag

SEQ ID NO: 209091 - DNA, 20 bp, Artificial
  CRISPR gRNA sequence
taagaggataaattttatat

SEQ ID NO: 209092 - DNA, 20 bp, Artificial
  CRISPR gRNA sequence
ttcaaactcttatttttgtt

SEQ ID NO: 209093 - DNA, 20 bp, Artificial
  CRISPR gRNA sequence
aaactcttatttttgttaag

SEQ ID NO: 209094 - DNA, 20 bp, Artificial
  CRISPR gRNA sequence
aactcttatttttgttaaga

SEQ ID NO: 209095 - DNA, 20 bp, Artificial
  CRISPR gRNA sequence
atttttgttaagaaggatgt

SEQ ID NO: 209096 - DNA, 20 bp, Artificial
  CRISPR gRNA sequence
ttaagaaggatgtaagtcac

SEQ ID NO: 209097 - DNA, 20 bp, Artificial
  CRISPR gRNA sequence
taagaaggatgtaagtcacc

SEQ ID NO: 209098 - DNA, 20 bp, Artificial
  CRISPR gRNA sequence
aggatgtaagtcaccaggca

SEQ ID NO: 209099 - DNA, 20 bp, Artificial
  CRISPR gRNA sequence
atgtaagtcaccaggcatgg

SEQ ID NO: 209100 - DNA, 20 bp, Artificial
  CRISPR gRNA sequence
gtggctcacacctgtaatcc

SEQ ID NO: 209101 - DNA, 20 bp, Artificial
  CRISPR gRNA sequence
cacctgtaatcccagcactt

SEQ ID NO: 209102 - DNA, 20 bp, Artificial
  CRISPR gRNA sequence
acctgtaatcccagcacttt

SEQ ID NO: 209103 - DNA, 20 bp, Artificial
  CRISPR gRNA sequence
ctgtaatcccagcactttgg

SEQ ID NO: 209104 - DNA, 20 bp, Artificial
  CRISPR gRNA sequence
tgtaatcccagcactttggg

SEQ ID NO: 209105 - DNA, 20 bp, Artificial
  CRISPR gRNA sequence
cccagcactttgggaggccg

SEQ ID NO: 209106 - DNA, 20 bp, Artificial
  CRISPR gRNA sequence
agcactttgggaggccgtgg

SEQ ID NO: 209107 - DNA, 20 bp, Artificial
  CRISPR gRNA sequence
gcactttgggaggccgtggc

SEQ ID NO: 209108 - DNA, 20 bp, Artificial
  CRISPR gRNA sequence
ctttgggaggccgtggcagg

SEQ ID NO: 209109 - DNA, 20 bp, Artificial
  CRISPR gRNA sequence
ggccgtggcaggtggatcat

SEQ ID NO: 209110 - DNA, 20 bp, Artificial
  CRISPR gRNA sequence
gccgtggcaggtggatcatg

SEQ ID NO: 209111 - DNA, 20 bp, Artificial
  CRISPR gRNA sequence
tggcaggtggatcatgaggt

SEQ ID NO: 209112 - DNA, 20 bp, Artificial
  CRISPR gRNA sequence
ggcaggtggatcatgaggta

SEQ ID NO: 209113 - DNA, 20 bp, Artificial
  CRISPR gRNA sequence
caggtggatcatgaggtaag

SEQ ID NO: 209114 - DNA, 20 bp, Artificial
  CRISPR gRNA sequence
gatcatgaggtaaggagctc

SEQ ID NO: 209115 - DNA, 20 bp, Artificial
  CRISPR gRNA sequence
tgaggtaaggagctcgagat

SEQ ID NO: 209116 - DNA, 20 bp, Artificial
  CRISPR gRNA sequence
taaggagctcgagatcagcc

SEQ ID NO: 209117 - DNA, 20 bp, Artificial
  CRISPR gRNA sequence
tctactaaaaaaaaaaaaaa

SEQ ID NO: 209118 - DNA, 20 bp, Artificial
  CRISPR gRNA sequence
aaaaaaaagaattcaaaaat

SEQ ID NO: 209119 - DNA, 20 bp, Artificial
  CRISPR gRNA sequence
aaaagaattcaaaaattagc

SEQ ID NO: 209120 - DNA, 20 bp, Artificial
  CRISPR gRNA sequence
aaagaattcaaaaattagcc

SEQ ID NO: 209121 - DNA, 20 bp, Artificial
  CRISPR gRNA sequence
attcaaaaattagccaggcc

SEQ ID NO: 209122 - DNA, 20 bp, Artificial
  CRISPR gRNA sequence
caaaaattagccaggcctgg

SEQ ID NO: 209123 - DNA, 20 bp, Artificial
  CRISPR gRNA sequence
ggcctggtggcgcatgcctg

SEQ ID NO: 209124 - DNA, 20 bp, Artificial
  CRISPR gRNA sequence
gtggcgcatgcctgtagtcc

SEQ ID NO: 209125 - DNA, 20 bp, Artificial
  CRISPR gRNA sequence
tgcctgtagtcccagctact

SEQ ID NO: 209126 - DNA, 20 bp, Artificial
  CRISPR gRNA sequence
gcctgtagtcccagctactc

SEQ ID NO: 209127 - DNA, 20 bp, Artificial
  CRISPR gRNA sequence
ctgtagtcccagctactcgg

SEQ ID NO: 209128 - DNA, 20 bp, Artificial
  CRISPR gRNA sequence
tgtagtcccagctactcggg

SEQ ID NO: 209129 - DNA, 20 bp, Artificial
  CRISPR gRNA sequence
tcccagctactcgggaggct

SEQ ID NO: 209130 - DNA, 20 bp, Artificial
  CRISPR gRNA sequence
cccagctactcgggaggctg

SEQ ID NO: 209131 - DNA, 20 bp, Artificial
  CRISPR gRNA sequence
agctactcgggaggctgagg

SEQ ID NO: 209132 - DNA, 20 bp, Artificial
  CRISPR gRNA sequence
gctactcgggaggctgaggc

SEQ ID NO: 209133 - DNA, 20 bp, Artificial
  CRISPR gRNA sequence
tactcgggaggctgaggcag

SEQ ID NO: 209134 - DNA, 20 bp, Artificial
  CRISPR gRNA sequence
ggcaggagaatcattgaacc

SEQ ID NO: 209135 - DNA, 20 bp, Artificial
  CRISPR gRNA sequence
gcaggagaatcattgaacct

SEQ ID NO: 209136 - DNA, 20 bp, Artificial
  CRISPR gRNA sequence
aggagaatcattgaacctgg

SEQ ID NO: 209137 - DNA, 20 bp, Artificial
  CRISPR gRNA sequence
ggagaatcattgaacctggg

SEQ ID NO: 209138 - DNA, 20 bp, Artificial
  CRISPR gRNA sequence
gaatcattgaacctgggagg

SEQ ID NO: 209139 - DNA, 20 bp, Artificial
  CRISPR gRNA sequence
atcattgaacctgggaggca

SEQ ID NO: 209140 - DNA, 20 bp, Artificial
  CRISPR gRNA sequence
aacctgggaggcagagtttg

SEQ ID NO: 209141 - DNA, 20 bp, Artificial
  CRISPR gRNA sequence
tgggaggcagagtttgcagt

SEQ ID NO: 209142 - DNA, 20 bp, Artificial
  CRISPR gRNA sequence
ggcagagtttgcagtgagcc

SEQ ID NO: 209143 - DNA, 20 bp, Artificial
  CRISPR gRNA sequence
gagattgtgccactgcactc

SEQ ID NO: 209144 - DNA, 20 bp, Artificial
  CRISPR gRNA sequence
tgtgccactgcactccagcc

SEQ ID NO: 209145 - DNA, 20 bp, Artificial
  CRISPR gRNA sequence
gtgccactgcactccagcct

SEQ ID NO: 209146 - DNA, 20 bp, Artificial
  CRISPR gRNA sequence
ctgcactccagcctgggtaa

SEQ ID NO: 209147 - DNA, 20 bp, Artificial
  CRISPR gRNA sequence
gcactccagcctgggtaacg

SEQ ID NO: 209148 - DNA, 20 bp, Artificial
  CRISPR gRNA sequence
tccagcctgggtaacggagt

SEQ ID NO: 209149 - DNA, 20 bp, Artificial
  CRISPR gRNA sequence
cagcctgggtaacggagtga

SEQ ID NO: 209150 - DNA, 20 bp, Artificial
  CRISPR gRNA sequence
tgtctccaaaaaaaaaaaaa

SEQ ID NO: 209151 - DNA, 20 bp, Artificial
  CRISPR gRNA sequence
ccaaaaaaaaaaaaaaagaa

SEQ ID NO: 209152 - DNA, 20 bp, Artificial
  CRISPR gRNA sequence
aaaaaaaaaaagaaaagaaa

SEQ ID NO: 209153 - DNA, 20 bp, Artificial
  CRISPR gRNA sequence
agaaaagaaaaagaaaaata

SEQ ID NO: 209154 - DNA, 20 bp, Artificial
  CRISPR gRNA sequence
aaagaaaaagaaaaatatag

SEQ ID NO: 209155 - DNA, 20 bp, Artificial
  CRISPR gRNA sequence
gaaaaagaaaaatatagaag

SEQ ID NO: 209156 - DNA, 20 bp, Artificial
  CRISPR gRNA sequence
aaaatatagaagaagaacat

SEQ ID NO: 209157 - DNA, 20 bp, Artificial
  CRISPR gRNA sequence
atgaaattatactgtactct

SEQ ID NO: 209158 - DNA, 20 bp, Artificial
  CRISPR gRNA sequence
tgaaattatactgtactcta

SEQ ID NO: 209159 - DNA, 20 bp, Artificial
  CRISPR gRNA sequence
aaattcttgttgcttgatct

SEQ ID NO: 209160 - DNA, 20 bp, Artificial
  CRISPR gRNA sequence
ttcttgttgcttgatcttag

SEQ ID NO: 209161 - DNA, 20 bp, Artificial
  CRISPR gRNA sequence
tttatgcattgacttaaacc

SEQ ID NO: 209162 - DNA, 20 bp, Artificial
  CRISPR gRNA sequence
atgcattgacttaaacctgg

SEQ ID NO: 209163 - DNA, 20 bp, Artificial
  CRISPR gRNA sequence
gcattgacttaaacctggaa

SEQ ID NO: 209164 - DNA, 20 bp, Artificial
  CRISPR gRNA sequence
atgaatgtttgattgactgt

SEQ ID NO: 209165 - DNA, 20 bp, Artificial
  CRISPR gRNA sequence
tgaatgtttgattgactgtg

SEQ ID NO: 209166 - DNA, 20 bp, Artificial
  CRISPR gRNA sequence
actgtgaggtgcatttgaaa

SEQ ID NO: 209167 - DNA, 20 bp, Artificial
  CRISPR gRNA sequence
ttctactttataaccctttg

SEQ ID NO: 209168 - DNA, 20 bp, Artificial
  CRISPR gRNA sequence
taaccctttgcagaactttc

SEQ ID NO: 209169 - DNA, 20 bp, Artificial
  CRISPR gRNA sequence
cagaactttcaagctctatt

SEQ ID NO: 209170 - DNA, 20 bp, Artificial
  CRISPR gRNA sequence
tatttagataacaatatata

SEQ ID NO: 209171 - DNA, 20 bp, Artificial
  CRISPR gRNA sequence
atttagataacaatatatat

SEQ ID NO: 209172 - DNA, 20 bp, Artificial
  CRISPR gRNA sequence
caatatatatgggattaaaa

SEQ ID NO: 209173 - DNA, 20 bp, Artificial
  CRISPR gRNA sequence
tggaaaatgtgacatatgtc

SEQ ID NO: 209174 - DNA, 20 bp, Artificial
  CRISPR gRNA sequence
gaaaatgtgacatatgtcta

SEQ ID NO: 209175 - DNA, 20 bp, Artificial
  CRISPR gRNA sequence
atgtgacatatgtctagaga

SEQ ID NO: 209176 - DNA, 20 bp, Artificial
  CRISPR gRNA sequence
ccttttgtgacttatacact

SEQ ID NO: 209177 - DNA, 20 bp, Artificial
  CRISPR gRNA sequence
ttatacactcagtttcattc

SEQ ID NO: 209178 - DNA, 20 bp, Artificial
  CRISPR gRNA sequence
acactcagtttcattctagc

SEQ ID NO: 209179 - DNA, 20 bp, Artificial
  CRISPR gRNA sequence
tttcattctagccagcattt

SEQ ID NO: 209180 - DNA, 20 bp, Artificial
  CRISPR gRNA sequence
ttctagccagcatttgagcc

SEQ ID NO: 209181 - DNA, 20 bp, Artificial
  CRISPR gRNA sequence
cagcatttgagcctagaaaa

SEQ ID NO: 209182 - DNA, 20 bp, Artificial
  CRISPR gRNA sequence
agcatttgagcctagaaaat

SEQ ID NO: 209183 - DNA, 20 bp, Artificial
  CRISPR gRNA sequence
gcatttgagcctagaaaata

SEQ ID NO: 209184 - DNA, 20 bp, Artificial
  CRISPR gRNA sequence
tttgagcctagaaaataggg

SEQ ID NO: 209185 - DNA, 20 bp, Artificial
  CRISPR gRNA sequence
atgaaaactctgtgccttat

SEQ ID NO: 209186 - DNA, 20 bp, Artificial
  CRISPR gRNA sequence
aaaactctgtgccttataag

SEQ ID NO: 209187 - DNA, 20 bp, Artificial
  CRISPR gRNA sequence
aaactctgtgccttataaga

SEQ ID NO: 209188 - DNA, 20 bp, Artificial
  CRISPR gRNA sequence
tctgtgccttataagaaggc

SEQ ID NO: 209189 - DNA, 20 bp, Artificial
  CRISPR gRNA sequence
ctgtgccttataagaaggca

SEQ ID NO: 209190 - DNA, 20 bp, Artificial
  CRISPR gRNA sequence
aagaaggcaaggctatgact

SEQ ID NO: 209191 - DNA, 20 bp, Artificial
  CRISPR gRNA sequence
gcaaggctatgactgagtat

SEQ ID NO: 209192 - DNA, 20 bp, Artificial
  CRISPR gRNA sequence
tgactgagtattagacacat

SEQ ID NO: 209193 - DNA, 20 bp, Artificial
  CRISPR gRNA sequence
gagtattagacacataagtc

SEQ ID NO: 209194 - DNA, 20 bp, Artificial
  CRISPR gRNA sequence
agtattagacacataagtcc

SEQ ID NO: 209195 - DNA, 20 bp, Artificial
  CRISPR gRNA sequence
gtattagacacataagtcca

SEQ ID NO: 209196 - DNA, 20 bp, Artificial
  CRISPR gRNA sequence
tagacacataagtccagggc

SEQ ID NO: 209197 - DNA, 20 bp, Artificial
  CRISPR gRNA sequence
agacacataagtccagggct

SEQ ID NO: 209198 - DNA, 20 bp, Artificial
  CRISPR gRNA sequence
cacataagtccagggctggg

SEQ ID NO: 209199 - DNA, 20 bp, Artificial
  CRISPR gRNA sequence
ataagtccagggctgggcgg

SEQ ID NO: 209200 - DNA, 20 bp, Artificial
  CRISPR gRNA sequence
taatgaatcaaataaaaact

SEQ ID NO: 209201 - DNA, 20 bp, Artificial
  CRISPR gRNA sequence
aatgaatcaaataaaaactt

SEQ ID NO: 209202 - DNA, 20 bp, Artificial
  CRISPR gRNA sequence
atgaatcaaataaaaacttg

SEQ ID NO: 209203 - DNA, 20 bp, Artificial
  CRISPR gRNA sequence
aaaacttggggaacttgcca

SEQ ID NO: 209204 - DNA, 20 bp, Artificial
  CRISPR gRNA sequence
aaacttggggaacttgccat

SEQ ID NO: 209205 - DNA, 20 bp, Artificial
  CRISPR gRNA sequence
aggatgttttctgattaata

SEQ ID NO: 209206 - DNA, 20 bp, Artificial
  CRISPR gRNA sequence
ggatgttttctgattaatat

SEQ ID NO: 209207 - DNA, 20 bp, Artificial
  CRISPR gRNA sequence
tttctcttctctgattaatg

SEQ ID NO: 209208 - DNA, 20 bp, Artificial
  CRISPR gRNA sequence
tctctgattaatgtggattt

SEQ ID NO: 209209 - DNA, 20 bp, Artificial
  CRISPR gRNA sequence
tgaaatccacattaataaat

SEQ ID NO: 209210 - DNA, 20 bp, Artificial
  CRISPR gRNA sequence
taaattggttatttattgct

SEQ ID NO: 209211 - DNA, 20 bp, Artificial
  CRISPR gRNA sequence
aaattggttatttattgctt

SEQ ID NO: 209212 - DNA, 20 bp, Artificial
  CRISPR gRNA sequence
ttaggacttatctccccata

SEQ ID NO: 209213 - DNA, 20 bp, Artificial
  CRISPR gRNA sequence
aggacttatctccccataaa

SEQ ID NO: 209214 - DNA, 20 bp, Artificial
  CRISPR gRNA sequence
cccataaagagactaaaatt

SEQ ID NO: 209215 - DNA, 20 bp, Artificial
  CRISPR gRNA sequence
ccataaagagactaaaattg

SEQ ID NO: 209216 - DNA, 20 bp, Artificial
  CRISPR gRNA sequence
aaaattgaggttataaatta

SEQ ID NO: 209217 - DNA, 20 bp, Artificial
  CRISPR gRNA sequence
aaattgaggttataaattat

SEQ ID NO: 209218 - DNA, 20 bp, Artificial
  CRISPR gRNA sequence
ttgaggttataaattatggg

SEQ ID NO: 209219 - DNA, 20 bp, Artificial
  CRISPR gRNA sequence
ggttataaattatgggtaga

SEQ ID NO: 209220 - DNA, 20 bp, Artificial
  CRISPR gRNA sequence
ttatgggtagatagaaattc

SEQ ID NO: 209221 - DNA, 20 bp, Artificial
  CRISPR gRNA sequence
atagaaattccagaaatatt

SEQ ID NO: 209222 - DNA, 20 bp, Artificial
  CRISPR gRNA sequence
tagaaattccagaaatattt

SEQ ID NO: 209223 - DNA, 20 bp, Artificial
  CRISPR gRNA sequence
cctgtcatataccttaaaca

SEQ ID NO: 209224 - DNA, 20 bp, Artificial
  CRISPR gRNA sequence
agatttttatcacaatcatt

SEQ ID NO: 209225 - DNA, 20 bp, Artificial
  CRISPR gRNA sequence
gatttttatcacaatcattt

SEQ ID NO: 209226 - DNA, 20 bp, Artificial
  CRISPR gRNA sequence
atttttatcacaatcattta

SEQ ID NO: 209227 - DNA, 20 bp, Artificial
  CRISPR gRNA sequence
tttttatcacaatcatttag

SEQ ID NO: 209228 - DNA, 20 bp, Artificial
  CRISPR gRNA sequence
ttatttaatgtttgtcactg

SEQ ID NO: 209229 - DNA, 20 bp, Artificial
  CRISPR gRNA sequence
tttaatgtttgtcactgtag

SEQ ID NO: 209230 - DNA, 20 bp, Artificial
  CRISPR gRNA sequence
aaatattttccccttcatga

SEQ ID NO: 209231 - DNA, 20 bp, Artificial
  CRISPR gRNA sequence
ccaccaattgattactgtca

SEQ ID NO: 209232 - DNA, 20 bp, Artificial
  CRISPR gRNA sequence
accaattgattactgtcatg

SEQ ID NO: 209233 - DNA, 20 bp, Artificial
  CRISPR gRNA sequence
tcatggagactatctctatg

SEQ ID NO: 209234 - DNA, 20 bp, Artificial
  CRISPR gRNA sequence
atctctatgtggatgacaca

SEQ ID NO: 209235 - DNA, 20 bp, Artificial
  CRISPR gRNA sequence
tctatgtggatgacacacag

SEQ ID NO: 209236 - DNA, 20 bp, Artificial
  CRISPR gRNA sequence
cgctgtttctttccgctact

SEQ ID NO: 209237 - DNA, 20 bp, Artificial
  CRISPR gRNA sequence
tccgctactcagtttgcttt

SEQ ID NO: 209238 - DNA, 20 bp, Artificial
  CRISPR gRNA sequence
ccgctactcagtttgctttt

SEQ ID NO: 209239 - DNA, 20 bp, Artificial
  CRISPR gRNA sequence
gttgccttaaacaacttcct

SEQ ID NO: 209240 - DNA, 20 bp, Artificial
  CRISPR gRNA sequence
caatattaaccaaaatttaa

SEQ ID NO: 209241 - DNA, 20 bp, Artificial
  CRISPR gRNA sequence
aaatttaaaagattcatata

SEQ ID NO: 209242 - DNA, 20 bp, Artificial
  CRISPR gRNA sequence
aaaagattcatatatagtaa

SEQ ID NO: 209243 - DNA, 20 bp, Artificial
  CRISPR gRNA sequence
agtaaaagaactaatattcg

SEQ ID NO: 209244 - DNA, 20 bp, Artificial
  CRISPR gRNA sequence
attgacccattccattcttt

SEQ ID NO: 209245 - DNA, 20 bp, Artificial
  CRISPR gRNA sequence
tgacccattccattctttca

SEQ ID NO: 209246 - DNA, 20 bp, Artificial
  CRISPR gRNA sequence
cccattccattctttcagag

SEQ ID NO: 209247 - DNA, 20 bp, Artificial
  CRISPR gRNA sequence
ccattccattctttcagaga

SEQ ID NO: 209248 - DNA, 20 bp, Artificial
  CRISPR gRNA sequence
cattctttcagagaaggtat

SEQ ID NO: 209249 - DNA, 20 bp, Artificial
  CRISPR gRNA sequence
agaaggtatgagatacttga

SEQ ID NO: 209250 - DNA, 20 bp, Artificial
  CRISPR gRNA sequence
aggtatgagatacttgacag

SEQ ID NO: 209251 - DNA, 20 bp, Artificial
  CRISPR gRNA sequence
gtatgagatacttgacagtg

SEQ ID NO: 209252 - DNA, 20 bp, Artificial
  CRISPR gRNA sequence
gagatacttgacagtggagc

SEQ ID NO: 209253 - DNA, 20 bp, Artificial
  CRISPR gRNA sequence
atacttgacagtggagctag

SEQ ID NO: 209254 - DNA, 20 bp, Artificial
  CRISPR gRNA sequence
cttgacagtggagctagcag

SEQ ID NO: 209255 - DNA, 20 bp, Artificial
  CRISPR gRNA sequence
catgtatgatgaatcccatt

SEQ ID NO: 209256 - DNA, 20 bp, Artificial
  CRISPR gRNA sequence
tgaatcccattgagtctttg

SEQ ID NO: 209257 - DNA, 20 bp, Artificial
  CRISPR gRNA sequence
atattttaattgaacaattt

SEQ ID NO: 209258 - DNA, 20 bp, Artificial
  CRISPR gRNA sequence
tttaagctttttttcttcat

SEQ ID NO: 209259 - DNA, 20 bp, Artificial
  CRISPR gRNA sequence
ttaagctttttttcttcatc

SEQ ID NO: 209260 - DNA, 20 bp, Artificial
  CRISPR gRNA sequence
tttcttcatcaggatttcac

SEQ ID NO: 209261 - DNA, 20 bp, Artificial
  CRISPR gRNA sequence
ttcttcatcaggatttcaca

SEQ ID NO: 209262 - DNA, 20 bp, Artificial
  CRISPR gRNA sequence
tcttcatcaggatttcacaa

SEQ ID NO: 209263 - DNA, 20 bp, Artificial
  CRISPR gRNA sequence
tcacaagggtgtaatctgcc

SEQ ID NO: 209264 - DNA, 20 bp, Artificial
  CRISPR gRNA sequence
ttttttcaaaacaaaataac

SEQ ID NO: 209265 - DNA, 20 bp, Artificial
  CRISPR gRNA sequence
aaacaaaataactagatttc

SEQ ID NO: 209266 - DNA, 20 bp, Artificial
  CRISPR gRNA sequence
attgtttactaattttttat

SEQ ID NO: 209267 - DNA, 20 bp, Artificial
  CRISPR gRNA sequence
ttgtttactaattttttata

SEQ ID NO: 209268 - DNA, 20 bp, Artificial
  CRISPR gRNA sequence
tttactaattttttataagg

SEQ ID NO: 209269 - DNA, 20 bp, Artificial
  CRISPR gRNA sequence
ttactaattttttataaggt

SEQ ID NO: 209270 - DNA, 20 bp, Artificial
  CRISPR gRNA sequence
attaacccattatttcccat

SEQ ID NO: 209271 - DNA, 20 bp, Artificial
  CRISPR gRNA sequence
cccattagtattatgtacat

SEQ ID NO: 209272 - DNA, 20 bp, Artificial
  CRISPR gRNA sequence
atcagtgttgtgttgtcact

SEQ ID NO: 209273 - DNA, 20 bp, Artificial
  CRISPR gRNA sequence
cagtgttgtgttgtcacttg

SEQ ID NO: 209274 - DNA, 20 bp, Artificial
  CRISPR gRNA sequence
tgttgtgttgtcacttggag

SEQ ID NO: 209275 - DNA, 20 bp, Artificial
  CRISPR gRNA sequence
cttggagtggttttgctcat

SEQ ID NO: 209276 - DNA, 20 bp, Artificial
  CRISPR gRNA sequence
ttggagtggttttgctcatc

SEQ ID NO: 209277 - DNA, 20 bp, Artificial
  CRISPR gRNA sequence
tggagtggttttgctcatcg

SEQ ID NO: 209278 - DNA, 20 bp, Artificial
  CRISPR gRNA sequence
ggagtggttttgctcatcgg

SEQ ID NO: 209279 - DNA, 20 bp, Artificial
  CRISPR gRNA sequence
gcattgacaatgtctgaaaa

SEQ ID NO: 209280 - DNA, 20 bp, Artificial
  CRISPR gRNA sequence
aacagtttgattaacataac

SEQ ID NO: 209281 - DNA, 20 bp, Artificial
  CRISPR gRNA sequence
tgattaacataactggcatc

SEQ ID NO: 209282 - DNA, 20 bp, Artificial
  CRISPR gRNA sequence
cataactggcatctagttac

SEQ ID NO: 209283 - DNA, 20 bp, Artificial
  CRISPR gRNA sequence
ggcatctagttactagcatc

SEQ ID NO: 209284 - DNA, 20 bp, Artificial
  CRISPR gRNA sequence
agttactagcatctagtatg

SEQ ID NO: 209285 - DNA, 20 bp, Artificial
  CRISPR gRNA sequence
ttactagcatctagtatgta

SEQ ID NO: 209286 - DNA, 20 bp, Artificial
  CRISPR gRNA sequence
tactagcatctagtatgtag

SEQ ID NO: 209287 - DNA, 20 bp, Artificial
  CRISPR gRNA sequence
agcatctagtatgtagaggc

SEQ ID NO: 209288 - DNA, 20 bp, Artificial
  CRISPR gRNA sequence
gcatctagtatgtagaggcc

SEQ ID NO: 209289 - DNA, 20 bp, Artificial
  CRISPR gRNA sequence
catctagtatgtagaggcca

SEQ ID NO: 209290 - DNA, 20 bp, Artificial
  CRISPR gRNA sequence
cctcaacattctatattatg

SEQ ID NO: 209291 - DNA, 20 bp, Artificial
  CRISPR gRNA sequence
tcaacattctatattatgca

SEQ ID NO: 209292 - DNA, 20 bp, Artificial
  CRISPR gRNA sequence
acattctatattatgcagag

SEQ ID NO: 209293 - DNA, 20 bp, Artificial
  CRISPR gRNA sequence
cctccccccaaaaacttatc

SEQ ID NO: 209294 - DNA, 20 bp, Artificial
  CRISPR gRNA sequence
acttatctagctcaatttat

SEQ ID NO: 209295 - DNA, 20 bp, Artificial
  CRISPR gRNA sequence
ttattagtaatacatcaacc

SEQ ID NO: 209296 - DNA, 20 bp, Artificial
  CRISPR gRNA sequence
tagtaatacatcaaccgaga

SEQ ID NO: 209297 - DNA, 20 bp, Artificial
  CRISPR gRNA sequence
aaccgagaaagactgatgta

SEQ ID NO: 209298 - DNA, 20 bp, Artificial
  CRISPR gRNA sequence
atgtatagaacctcatttgt

SEQ ID NO: 209299 - DNA, 20 bp, Artificial
  CRISPR gRNA sequence
tagaacctcatttgttagtg

SEQ ID NO: 209300 - DNA, 20 bp, Artificial
  CRISPR gRNA sequence
agaacctcatttgttagtgt

SEQ ID NO: 209301 - DNA, 20 bp, Artificial
  CRISPR gRNA sequence
atttgttagtgtaggaaaat

SEQ ID NO: 209302 - DNA, 20 bp, Artificial
  CRISPR gRNA sequence
tttgttagtgtaggaaaata

SEQ ID NO: 209303 - DNA, 20 bp, Artificial
  CRISPR gRNA sequence
cgttatccatttgcttatga

SEQ ID NO: 209304 - DNA, 20 bp, Artificial
  CRISPR gRNA sequence
ttatccatttgcttatgaaa

SEQ ID NO: 209305 - DNA, 20 bp, Artificial
  CRISPR gRNA sequence
tttgcttatgaaagagatgt

SEQ ID NO: 209306 - DNA, 20 bp, Artificial
  CRISPR gRNA sequence
ttgcttatgaaagagatgtg

SEQ ID NO: 209307 - DNA, 20 bp, Artificial
  CRISPR gRNA sequence
tgaggtgacttgatgatatt

SEQ ID NO: 209308 - DNA, 20 bp, Artificial
  CRISPR gRNA sequence
gaggtgacttgatgatatta

SEQ ID NO: 209309 - DNA, 20 bp, Artificial
  CRISPR gRNA sequence
ggtgacttgatgatattaag

SEQ ID NO: 209310 - DNA, 20 bp, Artificial
  CRISPR gRNA sequence
attaaggagttgttcctcat

SEQ ID NO: 209311 - DNA, 20 bp, Artificial
  CRISPR gRNA sequence
cctcataagttattacatta

SEQ ID NO: 209312 - DNA, 20 bp, Artificial
  CRISPR gRNA sequence
ttacattatagtacttctgt

SEQ ID NO: 209313 - DNA, 20 bp, Artificial
  CRISPR gRNA sequence
agtttgtctctgtaccttac

SEQ ID NO: 209314 - DNA, 20 bp, Artificial
  CRISPR gRNA sequence
taccttacaagttattaaaa

SEQ ID NO: 209315 - DNA, 20 bp, Artificial
  CRISPR gRNA sequence
aaatggcttcacttgtgatt

SEQ ID NO: 209316 - DNA, 20 bp, Artificial
  CRISPR gRNA sequence
attctttgtttttctttttt

SEQ ID NO: 209317 - DNA, 20 bp, Artificial
  CRISPR gRNA sequence
cttttttaagcacttaaata

SEQ ID NO: 209318 - DNA, 20 bp, Artificial
  CRISPR gRNA sequence
taagcacttaaatatagatc

SEQ ID NO: 209319 - DNA, 20 bp, Artificial
  CRISPR gRNA sequence
gcacttaaatatagatccgg

SEQ ID NO: 209320 - DNA, 20 bp, Artificial
  CRISPR gRNA sequence
taaatatagatccggtggta

SEQ ID NO: 209321 - DNA, 20 bp, Artificial
  CRISPR gRNA sequence
atagatccggtggtatggat

SEQ ID NO: 209322 - DNA, 20 bp, Artificial
  CRISPR gRNA sequence
acaattgctttacttgttgc

SEQ ID NO: 209323 - DNA, 20 bp, Artificial
  CRISPR gRNA sequence
tgctttacttgttgctggac

SEQ ID NO: 209324 - DNA, 20 bp, Artificial
  CRISPR gRNA sequence
atcactgtcattgtcattgt

SEQ ID NO: 209325 - DNA, 20 bp, Artificial
  CRISPR gRNA sequence
cactgtcattgtcattgttg

SEQ ID NO: 209326 - DNA, 20 bp, Artificial
  CRISPR gRNA sequence
tggagccattcttttcgtcc

SEQ ID NO: 209327 - DNA, 20 bp, Artificial
  CRISPR gRNA sequence
ggagccattcttttcgtccc

SEQ ID NO: 209328 - DNA, 20 bp, Artificial
  CRISPR gRNA sequence
ccattcttttcgtcccaggt

SEQ ID NO: 209329 - DNA, 20 bp, Artificial
  CRISPR gRNA sequence
ttcgtcccaggtaagatgtg

SEQ ID NO: 209330 - DNA, 20 bp, Artificial
  CRISPR gRNA sequence
caggtaagatgtgcagttcc

SEQ ID NO: 209331 - DNA, 20 bp, Artificial
  CRISPR gRNA sequence
aggtaagatgtgcagttcct

SEQ ID NO: 209332 - DNA, 20 bp, Artificial
  CRISPR gRNA sequence
taagatgtgcagttcctagg

SEQ ID NO: 209333 - DNA, 20 bp, Artificial
  CRISPR gRNA sequence
aagatgtgcagttcctaggc

SEQ ID NO: 209334 - DNA, 20 bp, Artificial
  CRISPR gRNA sequence
gcagttcctaggcaggaacg

SEQ ID NO: 209335 - DNA, 20 bp, Artificial
  CRISPR gRNA sequence
cagttcctaggcaggaacgc

SEQ ID NO: 209336 - DNA, 20 bp, Artificial
  CRISPR gRNA sequence
gttcctaggcaggaacgcag

SEQ ID NO: 209337 - DNA, 20 bp, Artificial
  CRISPR gRNA sequence
ttcctaggcaggaacgcagg

SEQ ID NO: 209338 - DNA, 20 bp, Artificial
  CRISPR gRNA sequence
ctaggcaggaacgcaggagg

SEQ ID NO: 209339 - DNA, 20 bp, Artificial
  CRISPR gRNA sequence
caggaacgcaggaggtagat

SEQ ID NO: 209340 - DNA, 20 bp, Artificial
  CRISPR gRNA sequence
gaggtagatgagtgcattcc

SEQ ID NO: 209341 - DNA, 20 bp, Artificial
  CRISPR gRNA sequence
aggtagatgagtgcattcca

SEQ ID NO: 209342 - DNA, 20 bp, Artificial
  CRISPR gRNA sequence
agatgagtgcattccaaggt

SEQ ID NO: 209343 - DNA, 20 bp, Artificial
  CRISPR gRNA sequence
gatgagtgcattccaaggtg

SEQ ID NO: 209344 - DNA, 20 bp, Artificial
  CRISPR gRNA sequence
tgagtgcattccaaggtgag

SEQ ID NO: 209345 - DNA, 20 bp, Artificial
  CRISPR gRNA sequence
gagtgcattccaaggtgagg

SEQ ID NO: 209346 - DNA, 20 bp, Artificial
  CRISPR gRNA sequence
agtgcattccaaggtgagga

SEQ ID NO: 209347 - DNA, 20 bp, Artificial
  CRISPR gRNA sequence
caaggtgaggagggctgcat

SEQ ID NO: 209348 - DNA, 20 bp, Artificial
  CRISPR gRNA sequence
ggagggctgcattagtttcc

SEQ ID NO: 209349 - DNA, 20 bp, Artificial
  CRISPR gRNA sequence
gagggctgcattagtttcct

SEQ ID NO: 209350 - DNA, 20 bp, Artificial
  CRISPR gRNA sequence
agggctgcattagtttccta

SEQ ID NO: 209351 - DNA, 20 bp, Artificial
  CRISPR gRNA sequence
cattagtttcctagggctgt

SEQ ID NO: 209352 - DNA, 20 bp, Artificial
  CRISPR gRNA sequence
gtttcctagggctgttggaa

SEQ ID NO: 209353 - DNA, 20 bp, Artificial
  CRISPR gRNA sequence
tggaacagatgaccacaaac

SEQ ID NO: 209354 - DNA, 20 bp, Artificial
  CRISPR gRNA sequence
ggaacagatgaccacaaact

SEQ ID NO: 209355 - DNA, 20 bp, Artificial
  CRISPR gRNA sequence
acagatgaccacaaactggg

SEQ ID NO: 209356 - DNA, 20 bp, Artificial
  CRISPR gRNA sequence
aaactgggtggcttaaacaa

SEQ ID NO: 209357 - DNA, 20 bp, Artificial
  CRISPR gRNA sequence
tagcaattccctttccatgc

SEQ ID NO: 209358 - DNA, 20 bp, Artificial
  CRISPR gRNA sequence
gcaattccctttccatgctg

SEQ ID NO: 209359 - DNA, 20 bp, Artificial
  CRISPR gRNA sequence
caattccctttccatgctgg

SEQ ID NO: 209360 - DNA, 20 bp, Artificial
  CRISPR gRNA sequence
ctttccatgctggaggccat

SEQ ID NO: 209361 - DNA, 20 bp, Artificial
  CRISPR gRNA sequence
ggaggccataagtctgaaat

SEQ ID NO: 209362 - DNA, 20 bp, Artificial
  CRISPR gRNA sequence
gaggccataagtctgaaatc

SEQ ID NO: 209363 - DNA, 20 bp, Artificial
  CRISPR gRNA sequence
gtctgaaatcaggacgtcat

SEQ ID NO: 209364 - DNA, 20 bp, Artificial
  CRISPR gRNA sequence
tctgaaatcaggacgtcatc

SEQ ID NO: 209365 - DNA, 20 bp, Artificial
  CRISPR gRNA sequence
ctgaaatcaggacgtcatca

SEQ ID NO: 209366 - DNA, 20 bp, Artificial
  CRISPR gRNA sequence
tcagggccacactccctctc

SEQ ID NO: 209367 - DNA, 20 bp, Artificial
  CRISPR gRNA sequence
cagggccacactccctctca

SEQ ID NO: 209368 - DNA, 20 bp, Artificial
  CRISPR gRNA sequence
cactccctctcaaggctgta

SEQ ID NO: 209369 - DNA, 20 bp, Artificial
  CRISPR gRNA sequence
tccctctcaaggctgtatgg

SEQ ID NO: 209370 - DNA, 20 bp, Artificial
  CRISPR gRNA sequence
gtatggaagaatccatttct

SEQ ID NO: 209371 - DNA, 20 bp, Artificial
  CRISPR gRNA sequence
aatccatttcttggctcttc

SEQ ID NO: 209372 - DNA, 20 bp, Artificial
  CRISPR gRNA sequence
ttcttggctcttctagcttc

SEQ ID NO: 209373 - DNA, 20 bp, Artificial
  CRISPR gRNA sequence
ctagcttctggaatttgctg

SEQ ID NO: 209374 - DNA, 20 bp, Artificial
  CRISPR gRNA sequence
tggaatttgctgaagaatga

SEQ ID NO: 209375 - DNA, 20 bp, Artificial
  CRISPR gRNA sequence
tgacagtgtttatcattcct

SEQ ID NO: 209376 - DNA, 20 bp, Artificial
  CRISPR gRNA sequence
gtttatcattccttagtttg

SEQ ID NO: 209377 - DNA, 20 bp, Artificial
  CRISPR gRNA sequence
tatcattccttagtttgcgg

SEQ ID NO: 209378 - DNA, 20 bp, Artificial
  CRISPR gRNA sequence
aactccaccctctgcctctc

SEQ ID NO: 209379 - DNA, 20 bp, Artificial
  CRISPR gRNA sequence
tgtttttgttaaatctccct

SEQ ID NO: 209380 - DNA, 20 bp, Artificial
  CRISPR gRNA sequence
tccctcagcctctctcttat

SEQ ID NO: 209381 - DNA, 20 bp, Artificial
  CRISPR gRNA sequence
cttatgagcacatttgtcat

SEQ ID NO: 209382 - DNA, 20 bp, Artificial
  CRISPR gRNA sequence
agcacatttgtcattggaat

SEQ ID NO: 209383 - DNA, 20 bp, Artificial
  CRISPR gRNA sequence
cacatttgtcattggaatta

SEQ ID NO: 209384 - DNA, 20 bp, Artificial
  CRISPR gRNA sequence
tagagcccactcatataatc

SEQ ID NO: 209385 - DNA, 20 bp, Artificial
  CRISPR gRNA sequence
agagcccactcatataatcc

SEQ ID NO: 209386 - DNA, 20 bp, Artificial
  CRISPR gRNA sequence
gagcccactcatataatcca

SEQ ID NO: 209387 - DNA, 20 bp, Artificial
  CRISPR gRNA sequence
ccactcatataatccagggt

SEQ ID NO: 209388 - DNA, 20 bp, Artificial
  CRISPR gRNA sequence
ccagggtaagctcctccttt

SEQ ID NO: 209389 - DNA, 20 bp, Artificial
  CRISPR gRNA sequence
atatcttttgccatataatg

SEQ ID NO: 209390 - DNA, 20 bp, Artificial
  CRISPR gRNA sequence
tattcactcttttgctgtat

SEQ ID NO: 209391 - DNA, 20 bp, Artificial
  CRISPR gRNA sequence
attcactcttttgctgtatt

SEQ ID NO: 209392 - DNA, 20 bp, Artificial
  CRISPR gRNA sequence
gctgtattaggtaatattca

SEQ ID NO: 209393 - DNA, 20 bp, Artificial
  CRISPR gRNA sequence
ctgtattaggtaatattcac

SEQ ID NO: 209394 - DNA, 20 bp, Artificial
  CRISPR gRNA sequence
taggtaatattcacaggttt

SEQ ID NO: 209395 - DNA, 20 bp, Artificial
  CRISPR gRNA sequence
aggtaatattcacaggtttt

SEQ ID NO: 209396 - DNA, 20 bp, Artificial
  CRISPR gRNA sequence
ggtaatattcacaggtttta

SEQ ID NO: 209397 - DNA, 20 bp, Artificial
  CRISPR gRNA sequence
tattcacaggttttagggat

SEQ ID NO: 209398 - DNA, 20 bp, Artificial
  CRISPR gRNA sequence
attcacaggttttagggatt

SEQ ID NO: 209399 - DNA, 20 bp, Artificial
  CRISPR gRNA sequence
tcacaggttttagggattag

SEQ ID NO: 209400 - DNA, 20 bp, Artificial
  CRISPR gRNA sequence
cacaggttttagggattagg

SEQ ID NO: 209401 - DNA, 20 bp, Artificial
  CRISPR gRNA sequence
aggttttagggattaggagg

SEQ ID NO: 209402 - DNA, 20 bp, Artificial
  CRISPR gRNA sequence
ttaggaggtagaaataattt

SEQ ID NO: 209403 - DNA, 20 bp, Artificial
  CRISPR gRNA sequence
taggaggtagaaataatttt

SEQ ID NO: 209404 - DNA, 20 bp, Artificial
  CRISPR gRNA sequence
aggaggtagaaataatttta

SEQ ID NO: 209405 - DNA, 20 bp, Artificial
  CRISPR gRNA sequence
ggccatcattcaactcacta

SEQ ID NO: 209406 - DNA, 20 bp, Artificial
  CRISPR gRNA sequence
ccatcattcaactcactaca

SEQ ID NO: 209407 - DNA, 20 bp, Artificial
  CRISPR gRNA sequence
catcattcaactcactacag

SEQ ID NO: 209408 - DNA, 20 bp, Artificial
  CRISPR gRNA sequence
actacagaggcaaacttcat

SEQ ID NO: 209409 - DNA, 20 bp, Artificial
  CRISPR gRNA sequence
agaggcaaacttcattggcc

SEQ ID NO: 209410 - DNA, 20 bp, Artificial
  CRISPR gRNA sequence
cttcattggccaagacatga

SEQ ID NO: 209411 - DNA, 20 bp, Artificial
  CRISPR gRNA sequence
cattggccaagacatgaaag

SEQ ID NO: 209412 - DNA, 20 bp, Artificial
  CRISPR gRNA sequence
acatgaaagtagaatgaatg

SEQ ID NO: 209413 - DNA, 20 bp, Artificial
  CRISPR gRNA sequence
catgaaagtagaatgaatgt

SEQ ID NO: 209414 - DNA, 20 bp, Artificial
  CRISPR gRNA sequence
gtagaatgaatgtgggaacc

SEQ ID NO: 209415 - DNA, 20 bp, Artificial
  CRISPR gRNA sequence
atgaatgtgggaaccaagtc

SEQ ID NO: 209416 - DNA, 20 bp, Artificial
  CRISPR gRNA sequence
tgggaaccaagtctggaaat

SEQ ID NO: 209417 - DNA, 20 bp, Artificial
  CRISPR gRNA sequence
gaaccaagtctggaaattgg

SEQ ID NO: 209418 - DNA, 20 bp, Artificial
  CRISPR gRNA sequence
tggaaattggcagttgcatt

SEQ ID NO: 209419 - DNA, 20 bp, Artificial
  CRISPR gRNA sequence
gaaattggcagttgcatttg

SEQ ID NO: 209420 - DNA, 20 bp, Artificial
  CRISPR gRNA sequence
aaattggcagttgcatttgg

SEQ ID NO: 209421 - DNA, 20 bp, Artificial
  CRISPR gRNA sequence
tggcagttgcatttggagga

SEQ ID NO: 209422 - DNA, 20 bp, Artificial
  CRISPR gRNA sequence
ggcagttgcatttggaggat

SEQ ID NO: 209423 - DNA, 20 bp, Artificial
  CRISPR gRNA sequence
catttggaggatgggaatgt

SEQ ID NO: 209424 - DNA, 20 bp, Artificial
  CRISPR gRNA sequence
ttggaggatgggaatgtgag

SEQ ID NO: 209425 - DNA, 20 bp, Artificial
  CRISPR gRNA sequence
tggaggatgggaatgtgagt

SEQ ID NO: 209426 - DNA, 20 bp, Artificial
  CRISPR gRNA sequence
tgggaatgtgagtgggaaat

SEQ ID NO: 209427 - DNA, 20 bp, Artificial
  CRISPR gRNA sequence
gggaatgtgagtgggaaatg

SEQ ID NO: 209428 - DNA, 20 bp, Artificial
  CRISPR gRNA sequence
gagtgggaaatgaggatatg

SEQ ID NO: 209429 - DNA, 20 bp, Artificial
  CRISPR gRNA sequence
gaggatatgtagcacatgta

SEQ ID NO: 209430 - DNA, 20 bp, Artificial
  CRISPR gRNA sequence
tatgtagcacatgtaaagaa

SEQ ID NO: 209431 - DNA, 20 bp, Artificial
  CRISPR gRNA sequence
agcacatgtaaagaaaagca

SEQ ID NO: 209432 - DNA, 20 bp, Artificial
  CRISPR gRNA sequence
gcacatgtaaagaaaagcaa

SEQ ID NO: 209433 - DNA, 20 bp, Artificial
  CRISPR gRNA sequence
catgtaaagaaaagcaaagg

SEQ ID NO: 209434 - DNA, 20 bp, Artificial
  CRISPR gRNA sequence
atgtaaagaaaagcaaagga

SEQ ID NO: 209435 - DNA, 20 bp, Artificial
  CRISPR gRNA sequence
aaagaaaagcaaaggaaggc

SEQ ID NO: 209436 - DNA, 20 bp, Artificial
  CRISPR gRNA sequence
aagaaaagcaaaggaaggct

SEQ ID NO: 209437 - DNA, 20 bp, Artificial
  CRISPR gRNA sequence
gggactcaacctaataacta

SEQ ID NO: 209438 - DNA, 20 bp, Artificial
  CRISPR gRNA sequence
ctatagcacaccatcgtttg

SEQ ID NO: 209439 - DNA, 20 bp, Artificial
  CRISPR gRNA sequence
atagcacaccatcgtttgtg

SEQ ID NO: 209440 - DNA, 20 bp, Artificial
  CRISPR gRNA sequence
gcacaccatcgtttgtggag

SEQ ID NO: 209441 - DNA, 20 bp, Artificial
  CRISPR gRNA sequence
atcgtttgtggagaagaatg

SEQ ID NO: 209442 - DNA, 20 bp, Artificial
  CRISPR gRNA sequence
ttgtggagaagaatgcagtg

SEQ ID NO: 209443 - DNA, 20 bp, Artificial
  CRISPR gRNA sequence
tgtggagaagaatgcagtgc

SEQ ID NO: 209444 - DNA, 20 bp, Artificial
  CRISPR gRNA sequence
tgcagtgcaggtgtaatatt

SEQ ID NO: 209445 - DNA, 20 bp, Artificial
  CRISPR gRNA sequence
gcagtgcaggtgtaatattt

SEQ ID NO: 209446 - DNA, 20 bp, Artificial
  CRISPR gRNA sequence
aggtgtaatatttaggaaca

SEQ ID NO: 209447 - DNA, 20 bp, Artificial
  CRISPR gRNA sequence
ggtgtaatatttaggaacat

SEQ ID NO: 209448 - DNA, 20 bp, Artificial
  CRISPR gRNA sequence
aatatttaggaacatgggct

SEQ ID NO: 209449 - DNA, 20 bp, Artificial
  CRISPR gRNA sequence
atttaggaacatgggcttgg

SEQ ID NO: 209450 - DNA, 20 bp, Artificial
  CRISPR gRNA sequence
catgggcttggcagctctat

SEQ ID NO: 209451 - DNA, 20 bp, Artificial
  CRISPR gRNA sequence
ggcagctctattggtatctg

SEQ ID NO: 209452 - DNA, 20 bp, Artificial
  CRISPR gRNA sequence
gctctattggtatctgaagt

SEQ ID NO: 209453 - DNA, 20 bp, Artificial
  CRISPR gRNA sequence
attggtatctgaagttagtg

SEQ ID NO: 209454 - DNA, 20 bp, Artificial
  CRISPR gRNA sequence
gtatctgaagttagtgaaga

SEQ ID NO: 209455 - DNA, 20 bp, Artificial
  CRISPR gRNA sequence
tctgaagttagtgaagacag

SEQ ID NO: 209456 - DNA, 20 bp, Artificial
  CRISPR gRNA sequence
ctgaagttagtgaagacagc

SEQ ID NO: 209457 - DNA, 20 bp, Artificial
  CRISPR gRNA sequence
aagttagtgaagacagcagg

SEQ ID NO: 209458 - DNA, 20 bp, Artificial
  CRISPR gRNA sequence
ttagtgaagacagcaggaag

SEQ ID NO: 209459 - DNA, 20 bp, Artificial
  CRISPR gRNA sequence
tagtgaagacagcaggaaga

SEQ ID NO: 209460 - DNA, 20 bp, Artificial
  CRISPR gRNA sequence
gtgaagacagcaggaagaag

SEQ ID NO: 209461 - DNA, 20 bp, Artificial
  CRISPR gRNA sequence
tgaagacagcaggaagaagg

SEQ ID NO: 209462 - DNA, 20 bp, Artificial
  CRISPR gRNA sequence
caggaagaaggaggtgaatt

SEQ ID NO: 209463 - DNA, 20 bp, Artificial
  CRISPR gRNA sequence
gaagaaggaggtgaattcag

SEQ ID NO: 209464 - DNA, 20 bp, Artificial
  CRISPR gRNA sequence
tgaattcagaagacaacttg

SEQ ID NO: 209465 - DNA, 20 bp, Artificial
  CRISPR gRNA sequence
gaattcagaagacaacttga

SEQ ID NO: 209466 - DNA, 20 bp, Artificial
  CRISPR gRNA sequence
aggaacaattgatttgactt

SEQ ID NO: 209467 - DNA, 20 bp, Artificial
  CRISPR gRNA sequence
ggaacaattgatttgacttt

SEQ ID NO: 209468 - DNA, 20 bp, Artificial
  CRISPR gRNA sequence
gaacaattgatttgactttg

SEQ ID NO: 209469 - DNA, 20 bp, Artificial
  CRISPR gRNA sequence
actttggggcatactgaata

SEQ ID NO: 209470 - DNA, 20 bp, Artificial
  CRISPR gRNA sequence
ttggggcatactgaatacag

SEQ ID NO: 209471 - DNA, 20 bp, Artificial
  CRISPR gRNA sequence
catactgaatacagcagatg

SEQ ID NO: 209472 - DNA, 20 bp, Artificial
  CRISPR gRNA sequence
atactgaatacagcagatga

SEQ ID NO: 209473 - DNA, 20 bp, Artificial
  CRISPR gRNA sequence
tactgaatacagcagatgaa

SEQ ID NO: 209474 - DNA, 20 bp, Artificial
  CRISPR gRNA sequence
aatacagcagatgaagggaa

SEQ ID NO: 209475 - DNA, 20 bp, Artificial
  CRISPR gRNA sequence
gcagatgaagggaacagtaa

SEQ ID NO: 209476 - DNA, 20 bp, Artificial
  CRISPR gRNA sequence
aacagtaaaagatgaataca

SEQ ID NO: 209477 - DNA, 20 bp, Artificial
  CRISPR gRNA sequence
atgaatacacagtttctcac

SEQ ID NO: 209478 - DNA, 20 bp, Artificial
  CRISPR gRNA sequence
ctcactggaattctgtaaac

SEQ ID NO: 209479 - DNA, 20 bp, Artificial
  CRISPR gRNA sequence
tggaattctgtaaactagtt

SEQ ID NO: 209480 - DNA, 20 bp, Artificial
  CRISPR gRNA sequence
aattctgtaaactagttaag

SEQ ID NO: 209481 - DNA, 20 bp, Artificial
  CRISPR gRNA sequence
attctgtaaactagttaaga

SEQ ID NO: 209482 - DNA, 20 bp, Artificial
  CRISPR gRNA sequence
tctgtaaactagttaagaag

SEQ ID NO: 209483 - DNA, 20 bp, Artificial
  CRISPR gRNA sequence
ctgtaaactagttaagaagg

SEQ ID NO: 209484 - DNA, 20 bp, Artificial
  CRISPR gRNA sequence
taaactagttaagaaggagg

SEQ ID NO: 209485 - DNA, 20 bp, Artificial
  CRISPR gRNA sequence
aactagttaagaaggaggca

SEQ ID NO: 209486 - DNA, 20 bp, Artificial
  CRISPR gRNA sequence
gaaggaggcagagccaattc

SEQ ID NO: 209487 - DNA, 20 bp, Artificial
  CRISPR gRNA sequence
aaggaggcagagccaattca

SEQ ID NO: 209488 - DNA, 20 bp, Artificial
  CRISPR gRNA sequence
gcagagccaattcaaggttt

SEQ ID NO: 209489 - DNA, 20 bp, Artificial
  CRISPR gRNA sequence
catgttgaaacttaaatgtt

SEQ ID NO: 209490 - DNA, 20 bp, Artificial
  CRISPR gRNA sequence
gaaacttaaatgttgagatt

SEQ ID NO: 209491 - DNA, 20 bp, Artificial
  CRISPR gRNA sequence
tgttgagatttagatgtctt

SEQ ID NO: 209492 - DNA, 20 bp, Artificial
  CRISPR gRNA sequence
agatttagatgtcttaagtt

SEQ ID NO: 209493 - DNA, 20 bp, Artificial
  CRISPR gRNA sequence
gtttggtcttaatcaaaaaa

SEQ ID NO: 209494 - DNA, 20 bp, Artificial
  CRISPR gRNA sequence
aatagtcactaattttgtgt

SEQ ID NO: 209495 - DNA, 20 bp, Artificial
  CRISPR gRNA sequence
atagtcactaattttgtgtg

SEQ ID NO: 209496 - DNA, 20 bp, Artificial
  CRISPR gRNA sequence
ctaattttgtgtgaggtttt

SEQ ID NO: 209497 - DNA, 20 bp, Artificial
  CRISPR gRNA sequence
taattttgtgtgaggttttc

SEQ ID NO: 209498 - DNA, 20 bp, Artificial
  CRISPR gRNA sequence
aattttgtgtgaggttttca

SEQ ID NO: 209499 - DNA, 20 bp, Artificial
  CRISPR gRNA sequence
gtatatttttaaaattttca

SEQ ID NO: 209500 - DNA, 20 bp, Artificial
  CRISPR gRNA sequence
ttaaaattttcacagttgtc

SEQ ID NO: 209501 - DNA, 20 bp, Artificial
  CRISPR gRNA sequence
attttcacagttgtcaagca

SEQ ID NO: 209502 - DNA, 20 bp, Artificial
  CRISPR gRNA sequence
cagttgtcaagcacagaatt

SEQ ID NO: 209503 - DNA, 20 bp, Artificial
  CRISPR gRNA sequence
gtcaagcacagaatttagat

SEQ ID NO: 209504 - DNA, 20 bp, Artificial
  CRISPR gRNA sequence
tttagattagtacatttaaa

SEQ ID NO: 209505 - DNA, 20 bp, Artificial
  CRISPR gRNA sequence
tagtacatttaaaaagtatg

SEQ ID NO: 209506 - DNA, 20 bp, Artificial
  CRISPR gRNA sequence
agtacatttaaaaagtatgt

SEQ ID NO: 209507 - DNA, 20 bp, Artificial
  CRISPR gRNA sequence
taaatgtttttatttattga

SEQ ID NO: 209508 - DNA, 20 bp, Artificial
  CRISPR gRNA sequence
aaatgtttttatttattgac

SEQ ID NO: 209509 - DNA, 20 bp, Artificial
  CRISPR gRNA sequence
tgacaggtgaatattcatta

SEQ ID NO: 209510 - DNA, 20 bp, Artificial
  CRISPR gRNA sequence
tattcattaaagaatgctac

SEQ ID NO: 209511 - DNA, 20 bp, Artificial
  CRISPR gRNA sequence
ttaaagaatgctactggcct

SEQ ID NO: 209512 - DNA, 20 bp, Artificial
  CRISPR gRNA sequence
tggtttaattgtgacttcta

SEQ ID NO: 209513 - DNA, 20 bp, Artificial
  CRISPR gRNA sequence
ggtttaattgtgacttctac

SEQ ID NO: 209514 - DNA, 20 bp, Artificial
  CRISPR gRNA sequence
gtttaattgtgacttctaca

SEQ ID NO: 209515 - DNA, 20 bp, Artificial
  CRISPR gRNA sequence
ttacttcactactatgtgtt

SEQ ID NO: 209516 - DNA, 20 bp, Artificial
  CRISPR gRNA sequence
tcactactatgtgtttagta

SEQ ID NO: 209517 - DNA, 20 bp, Artificial
  CRISPR gRNA sequence
cactactatgtgtttagtac

SEQ ID NO: 209518 - DNA, 20 bp, Artificial
  CRISPR gRNA sequence
actatgtgtttagtacaggt

SEQ ID NO: 209519 - DNA, 20 bp, Artificial
  CRISPR gRNA sequence
caggtgagttttcattgtta

SEQ ID NO: 209520 - DNA, 20 bp, Artificial
  CRISPR gRNA sequence
tacctttttcatttacaaaa

SEQ ID NO: 209521 - DNA, 20 bp, Artificial
  CRISPR gRNA sequence
ctttttcatttacaaaacag

SEQ ID NO: 209522 - DNA, 20 bp, Artificial
  CRISPR gRNA sequence
catttacaaaacagcagttt

SEQ ID NO: 209523 - DNA, 20 bp, Artificial
  CRISPR gRNA sequence
taaattttttacaactcaat

SEQ ID NO: 209524 - DNA, 20 bp, Artificial
  CRISPR gRNA sequence
aattttttacaactcaataa

SEQ ID NO: 209525 - DNA, 20 bp, Artificial
  CRISPR gRNA sequence
tttttacaactcaataagag

SEQ ID NO: 209526 - DNA, 20 bp, Artificial
  CRISPR gRNA sequence
ttttacaactcaataagagt

SEQ ID NO: 209527 - DNA, 20 bp, Artificial
  CRISPR gRNA sequence
aataagagtaggtttattaa

SEQ ID NO: 209528 - DNA, 20 bp, Artificial
  CRISPR gRNA sequence
aagatttttcatgctattct

SEQ ID NO: 209529 - DNA, 20 bp, Artificial
  CRISPR gRNA sequence
ttcccattcatattaatttt

SEQ ID NO: 209530 - DNA, 20 bp, Artificial
  CRISPR gRNA sequence
tcccattcatattaatttta

SEQ ID NO: 209531 - DNA, 20 bp, Artificial
  CRISPR gRNA sequence
tattaattttaaggttattc

SEQ ID NO: 209532 - DNA, 20 bp, Artificial
  CRISPR gRNA sequence
attaattttaaggttattct

SEQ ID NO: 209533 - DNA, 20 bp, Artificial
  CRISPR gRNA sequence
attttaaggttattctaggt

SEQ ID NO: 209534 - DNA, 20 bp, Artificial
  CRISPR gRNA sequence
taggttagctgttttgtaaa

SEQ ID NO: 209535 - DNA, 20 bp, Artificial
  CRISPR gRNA sequence
catatgtatttgatgccaat

SEQ ID NO: 209536 - DNA, 20 bp, Artificial
  CRISPR gRNA sequence
ttattttcatattctaattt

SEQ ID NO: 209537 - DNA, 20 bp, Artificial
  CRISPR gRNA sequence
attctaatttcagttttttg

SEQ ID NO: 209538 - DNA, 20 bp, Artificial
  CRISPR gRNA sequence
tttcagttttttgaagttat

SEQ ID NO: 209539 - DNA, 20 bp, Artificial
  CRISPR gRNA sequence
cagttttttgaagttataag

SEQ ID NO: 209540 - DNA, 20 bp, Artificial
  CRISPR gRNA sequence
ttataagtggatgttaaacg

SEQ ID NO: 209541 - DNA, 20 bp, Artificial
  CRISPR gRNA sequence
agtctttctcttcttttgct

SEQ ID NO: 209542 - DNA, 20 bp, Artificial
  CRISPR gRNA sequence
taagcttctgcttctgcatt

SEQ ID NO: 209543 - DNA, 20 bp, Artificial
  CRISPR gRNA sequence
gcttctgcttctgcattaag

SEQ ID NO: 209544 - DNA, 20 bp, Artificial
  CRISPR gRNA sequence
tgcttctgcattaagaagac

SEQ ID NO: 209545 - DNA, 20 bp, Artificial
  CRISPR gRNA sequence
agaagactggttctataaaa

SEQ ID NO: 209546 - DNA, 20 bp, Artificial
  CRISPR gRNA sequence
atggaattatgaatcacaaa

SEQ ID NO: 209547 - DNA, 20 bp, Artificial
  CRISPR gRNA sequence
gaattatgaatcacaaatag

SEQ ID NO: 209548 - DNA, 20 bp, Artificial
  CRISPR gRNA sequence
aacatatttgttttaattat

SEQ ID NO: 209549 - DNA, 20 bp, Artificial
  CRISPR gRNA sequence
attagcaaaccttaatactg

SEQ ID NO: 209550 - DNA, 20 bp, Artificial
  CRISPR gRNA sequence
aaccttaatactgtagtttt

SEQ ID NO: 209551 - DNA, 20 bp, Artificial
  CRISPR gRNA sequence
ccttaatactgtagttttaa

SEQ ID NO: 209552 - DNA, 20 bp, Artificial
  CRISPR gRNA sequence
aatactgtagttttaagaga

SEQ ID NO: 209553 - DNA, 20 bp, Artificial
  CRISPR gRNA sequence
tgtagttttaagagatggta

SEQ ID NO: 209554 - DNA, 20 bp, Artificial
  CRISPR gRNA sequence
atggaaatccaaactataat

SEQ ID NO: 209555 - DNA, 20 bp, Artificial
  CRISPR gRNA sequence
tcattttcactgcattttga

SEQ ID NO: 209556 - DNA, 20 bp, Artificial
  CRISPR gRNA sequence
ttttcactgcattttgaaag

SEQ ID NO: 209557 - DNA, 20 bp, Artificial
  CRISPR gRNA sequence
aagtagatcactaccatatt

SEQ ID NO: 209558 - DNA, 20 bp, Artificial
  CRISPR gRNA sequence
atatttagttattactatta

SEQ ID NO: 209559 - DNA, 20 bp, Artificial
  CRISPR gRNA sequence
atttagttattactattaaa

SEQ ID NO: 209560 - DNA, 20 bp, Artificial
  CRISPR gRNA sequence
aaagagtcacatttaacact

SEQ ID NO: 209561 - DNA, 20 bp, Artificial
  CRISPR gRNA sequence
tcacatttaacacttggtct

SEQ ID NO: 209562 - DNA, 20 bp, Artificial
  CRISPR gRNA sequence
acatttaacacttggtctta

SEQ ID NO: 209563 - DNA, 20 bp, Artificial
  CRISPR gRNA sequence
ttggtcttagagcctatctc

SEQ ID NO: 209564 - DNA, 20 bp, Artificial
  CRISPR gRNA sequence
atctctggctcgttgtacat

SEQ ID NO: 209565 - DNA, 20 bp, Artificial
  CRISPR gRNA sequence
ctggctcgttgtacattgga

SEQ ID NO: 209566 - DNA, 20 bp, Artificial
  CRISPR gRNA sequence
tggctcgttgtacattggaa

SEQ ID NO: 209567 - DNA, 20 bp, Artificial
  CRISPR gRNA sequence
gttgtacattggaaaggtat

SEQ ID NO: 209568 - DNA, 20 bp, Artificial
  CRISPR gRNA sequence
gtttgttataaaatgacatc

SEQ ID NO: 209569 - DNA, 20 bp, Artificial
  CRISPR gRNA sequence
ttgttataaaatgacatcta

SEQ ID NO: 209570 - DNA, 20 bp, Artificial
  CRISPR gRNA sequence
tataaaatgacatctagaga

SEQ ID NO: 209571 - DNA, 20 bp, Artificial
  CRISPR gRNA sequence
taaaatgacatctagagata

SEQ ID NO: 209572 - DNA, 20 bp, Artificial
  CRISPR gRNA sequence
aaatgacatctagagataga

SEQ ID NO: 209573 - DNA, 20 bp, Artificial
  CRISPR gRNA sequence
gatagagagcatgatgttta

SEQ ID NO: 209574 - DNA, 20 bp, Artificial
  CRISPR gRNA sequence
gagagcatgatgtttacagt

SEQ ID NO: 209575 - DNA, 20 bp, Artificial
  CRISPR gRNA sequence
agagcatgatgtttacagtc

SEQ ID NO: 209576 - DNA, 20 bp, Artificial
  CRISPR gRNA sequence
acagtcaggtatttgcataa

SEQ ID NO: 209577 - DNA, 20 bp, Artificial
  CRISPR gRNA sequence
tatttgcataatggttccct

SEQ ID NO: 209578 - DNA, 20 bp, Artificial
  CRISPR gRNA sequence
tgcataatggttccctcagc

SEQ ID NO: 209579 - DNA, 20 bp, Artificial
  CRISPR gRNA sequence
cataatggttccctcagcaa

SEQ ID NO: 209580 - DNA, 20 bp, Artificial
  CRISPR gRNA sequence
agagcaattccatgtgcatg

SEQ ID NO: 209581 - DNA, 20 bp, Artificial
  CRISPR gRNA sequence
agcaattccatgtgcatgtg

SEQ ID NO: 209582 - DNA, 20 bp, Artificial
  CRISPR gRNA sequence
aattccatgtgcatgtggag

SEQ ID NO: 209583 - DNA, 20 bp, Artificial
  CRISPR gRNA sequence
tgtggagaagacattcataa

SEQ ID NO: 209584 - DNA, 20 bp, Artificial
  CRISPR gRNA sequence
attcatattgtaaaatgcac

SEQ ID NO: 209585 - DNA, 20 bp, Artificial
  CRISPR gRNA sequence
tattgtaaaatgcacaagtg

SEQ ID NO: 209586 - DNA, 20 bp, Artificial
  CRISPR gRNA sequence
aaaatgcacaagtgtggtaa

SEQ ID NO: 209587 - DNA, 20 bp, Artificial
  CRISPR gRNA sequence
atgcacaagtgtggtaaaag

SEQ ID NO: 209588 - DNA, 20 bp, Artificial
  CRISPR gRNA sequence
ggtaaaagcagcattgttct

SEQ ID NO: 209589 - DNA, 20 bp, Artificial
  CRISPR gRNA sequence
agcagcattgttctaagatt

SEQ ID NO: 209590 - DNA, 20 bp, Artificial
  CRISPR gRNA sequence
gcagcattgttctaagattt

SEQ ID NO: 209591 - DNA, 20 bp, Artificial
  CRISPR gRNA sequence
cagcattgttctaagattta

SEQ ID NO: 209592 - DNA, 20 bp, Artificial
  CRISPR gRNA sequence
agatttagggtaaaaacttc

SEQ ID NO: 209593 - DNA, 20 bp, Artificial
  CRISPR gRNA sequence
tagggtaaaaacttccagtc

SEQ ID NO: 209594 - DNA, 20 bp, Artificial
  CRISPR gRNA sequence
taaaaacttccagtccagct

SEQ ID NO: 209595 - DNA, 20 bp, Artificial
  CRISPR gRNA sequence
ttagctgactgtgaaaatta

SEQ ID NO: 209596 - DNA, 20 bp, Artificial
  CRISPR gRNA sequence
tagctgactgtgaaaattaa

SEQ ID NO: 209597 - DNA, 20 bp, Artificial
  CRISPR gRNA sequence
ggctgccgaatgtgtgaatt

SEQ ID NO: 209598 - DNA, 20 bp, Artificial
  CRISPR gRNA sequence
ctgccgaatgtgtgaatttg

SEQ ID NO: 209599 - DNA, 20 bp, Artificial
  CRISPR gRNA sequence
tttggagctgactacttgtg

SEQ ID NO: 209600 - DNA, 20 bp, Artificial
  CRISPR gRNA sequence
ggagctgactacttgtgtgg

SEQ ID NO: 209601 - DNA, 20 bp, Artificial
  CRISPR gRNA sequence
gagctgactacttgtgtgga

SEQ ID NO: 209602 - DNA, 20 bp, Artificial
  CRISPR gRNA sequence
agctgactacttgtgtggaa

SEQ ID NO: 209603 - DNA, 20 bp, Artificial
  CRISPR gRNA sequence
gactacttgtgtggaagggt

SEQ ID NO: 209604 - DNA, 20 bp, Artificial
  CRISPR gRNA sequence
tgtggaagggttagatcact

SEQ ID NO: 209605 - DNA, 20 bp, Artificial
  CRISPR gRNA sequence
taccgtcaaacaatgaactc

SEQ ID NO: 209606 - DNA, 20 bp, Artificial
  CRISPR gRNA sequence
ccgtcaaacaatgaactcca

SEQ ID NO: 209607 - DNA, 20 bp, Artificial
  CRISPR gRNA sequence
caaacaatgaactccagagt

SEQ ID NO: 209608 - DNA, 20 bp, Artificial
  CRISPR gRNA sequence
tgaactccagagtcagtctt

SEQ ID NO: 209609 - DNA, 20 bp, Artificial
  CRISPR gRNA sequence
ccagagtcagtctttggtct

SEQ ID NO: 209610 - DNA, 20 bp, Artificial
  CRISPR gRNA sequence
cagagtcagtctttggtctt

SEQ ID NO: 209611 - DNA, 20 bp, Artificial
  CRISPR gRNA sequence
gagtcagtctttggtcttag

SEQ ID NO: 209612 - DNA, 20 bp, Artificial
  CRISPR gRNA sequence
tccctgattataccaaatgc

SEQ ID NO: 209613 - DNA, 20 bp, Artificial
  CRISPR gRNA sequence
ctgattataccaaatgcaag

SEQ ID NO: 209614 - DNA, 20 bp, Artificial
  CRISPR gRNA sequence
attataccaaatgcaagtgg

SEQ ID NO: 209615 - DNA, 20 bp, Artificial
  CRISPR gRNA sequence
ttacatccttttccttcctc

SEQ ID NO: 209616 - DNA, 20 bp, Artificial
  CRISPR gRNA sequence
cttttccttcctccagcgat

SEQ ID NO: 209617 - DNA, 20 bp, Artificial
  CRISPR gRNA sequence
ctccttcgtcattgccatat

SEQ ID NO: 209618 - DNA, 20 bp, Artificial
  CRISPR gRNA sequence
tcattgccatattggttatt

SEQ ID NO: 209619 - DNA, 20 bp, Artificial
  CRISPR gRNA sequence
cattgccatattggttattc

SEQ ID NO: 209620 - DNA, 20 bp, Artificial
  CRISPR gRNA sequence
catattggttattcaggtga

SEQ ID NO: 209621 - DNA, 20 bp, Artificial
  CRISPR gRNA sequence
gatagcctatatcctcgctg

SEQ ID NO: 209622 - DNA, 20 bp, Artificial
  CRISPR gRNA sequence
gcctatatcctcgctgtggt

SEQ ID NO: 209623 - DNA, 20 bp, Artificial
  CRISPR gRNA sequence
atcctcgctgtggttggact

SEQ ID NO: 209624 - DNA, 20 bp, Artificial
  CRISPR gRNA sequence
tggactgagtctctgtattg

SEQ ID NO: 209625 - DNA, 20 bp, Artificial
  CRISPR gRNA sequence
ggactgagtctctgtattgc

SEQ ID NO: 209626 - DNA, 20 bp, Artificial
  CRISPR gRNA sequence
tgagtctctgtattgcgggt

SEQ ID NO: 209627 - DNA, 20 bp, Artificial
  CRISPR gRNA sequence
agtctctgtattgcgggtaa

SEQ ID NO: 209628 - DNA, 20 bp, Artificial
  CRISPR gRNA sequence
gggtaagagtcatctttctg

SEQ ID NO: 209629 - DNA, 20 bp, Artificial
  CRISPR gRNA sequence
atctttctgtagacctaatt

SEQ ID NO: 209630 - DNA, 20 bp, Artificial
  CRISPR gRNA sequence
tctttctgtagacctaattt

SEQ ID NO: 209631 - DNA, 20 bp, Artificial
  CRISPR gRNA sequence
gacctaatttgggttacttt

SEQ ID NO: 209632 - DNA, 20 bp, Artificial
  CRISPR gRNA sequence
taatttgggttacttttgga

SEQ ID NO: 209633 - DNA, 20 bp, Artificial
  CRISPR gRNA sequence
atttgggttacttttggaca

SEQ ID NO: 209634 - DNA, 20 bp, Artificial
  CRISPR gRNA sequence
tctctctttttaaaaatata

SEQ ID NO: 209635 - DNA, 20 bp, Artificial
  CRISPR gRNA sequence
atagacttgatttttttttt

SEQ ID NO: 209636 - DNA, 20 bp, Artificial
  CRISPR gRNA sequence
cttgatttttttttttagtg

SEQ ID NO: 209637 - DNA, 20 bp, Artificial
  CRISPR gRNA sequence
tttttttttagtgcagtttt

SEQ ID NO: 209638 - DNA, 20 bp, Artificial
  CRISPR gRNA sequence
ttagtgcagtttttggttca

SEQ ID NO: 209639 - DNA, 20 bp, Artificial
  CRISPR gRNA sequence
ttttggttcatggcaaaatt

SEQ ID NO: 209640 - DNA, 20 bp, Artificial
  CRISPR gRNA sequence
tggttcatggcaaaattgag

SEQ ID NO: 209641 - DNA, 20 bp, Artificial
  CRISPR gRNA sequence
tcatggcaaaattgagtgga

SEQ ID NO: 209642 - DNA, 20 bp, Artificial
  CRISPR gRNA sequence
gagtggaaagtacattcaca

SEQ ID NO: 209643 - DNA, 20 bp, Artificial
  CRISPR gRNA sequence
ttcacatggatatttttatg

SEQ ID NO: 209644 - DNA, 20 bp, Artificial
  CRISPR gRNA sequence
ggatatttttatgtggacat

SEQ ID NO: 209645 - DNA, 20 bp, Artificial
  CRISPR gRNA sequence
cataagttttcaattccatt

SEQ ID NO: 209646 - DNA, 20 bp, Artificial
  CRISPR gRNA sequence
ataagttttcaattccattt

SEQ ID NO: 209647 - DNA, 20 bp, Artificial
  CRISPR gRNA sequence
attccatttgggcaaatacc

SEQ ID NO: 209648 - DNA, 20 bp, Artificial
  CRISPR gRNA sequence
ttccatttgggcaaatacca

SEQ ID NO: 209649 - DNA, 20 bp, Artificial
  CRISPR gRNA sequence
ccatttgggcaaataccaag

SEQ ID NO: 209650 - DNA, 20 bp, Artificial
  CRISPR gRNA sequence
aataccaaggagtgcaatta

SEQ ID NO: 209651 - DNA, 20 bp, Artificial
  CRISPR gRNA sequence
ataccaaggagtgcaattac

SEQ ID NO: 209652 - DNA, 20 bp, Artificial
  CRISPR gRNA sequence
agtgcaattacgggactgta

SEQ ID NO: 209653 - DNA, 20 bp, Artificial
  CRISPR gRNA sequence
tgcaattacgggactgtaaa

SEQ ID NO: 209654 - DNA, 20 bp, Artificial
  CRISPR gRNA sequence
ccaaactctctgtatcaaaa

SEQ ID NO: 209655 - DNA, 20 bp, Artificial
  CRISPR gRNA sequence
tattatcaccaccaataaat

SEQ ID NO: 209656 - DNA, 20 bp, Artificial
  CRISPR gRNA sequence
ttatcaccaccaataaataa

SEQ ID NO: 209657 - DNA, 20 bp, Artificial
  CRISPR gRNA sequence
ttgttcattcatatacttga

SEQ ID NO: 209658 - DNA, 20 bp, Artificial
  CRISPR gRNA sequence
ttcatatacttgacagcatt

SEQ ID NO: 209659 - DNA, 20 bp, Artificial
  CRISPR gRNA sequence
ttgacagcatttagcattct

SEQ ID NO: 209660 - DNA, 20 bp, Artificial
  CRISPR gRNA sequence
tttaaacttccaatttaccc

SEQ ID NO: 209661 - DNA, 20 bp, Artificial
  CRISPR gRNA sequence
aaacttccaatttaccccag

SEQ ID NO: 209662 - DNA, 20 bp, Artificial
  CRISPR gRNA sequence
ccaatttaccccagtggtaa

SEQ ID NO: 209663 - DNA, 20 bp, Artificial
  CRISPR gRNA sequence
gtgctttcctcctcgctaca

SEQ ID NO: 209664 - DNA, 20 bp, Artificial
  CRISPR gRNA sequence
cctcctcgctacaaagatat

SEQ ID NO: 209665 - DNA, 20 bp, Artificial
  CRISPR gRNA sequence
aaagatattagctgtatata

SEQ ID NO: 209666 - DNA, 20 bp, Artificial
  CRISPR gRNA sequence
tattagctgtatatatggct

SEQ ID NO: 209667 - DNA, 20 bp, Artificial
  CRISPR gRNA sequence
tagctgtatatatggcttgg

SEQ ID NO: 209668 - DNA, 20 bp, Artificial
  CRISPR gRNA sequence
ggcttggtggctgattgttc

SEQ ID NO: 209669 - DNA, 20 bp, Artificial
  CRISPR gRNA sequence
aactgatatgcctgtatttg

SEQ ID NO: 209670 - DNA, 20 bp, Artificial
  CRISPR gRNA sequence
tgatatgcctgtatttgtgg

SEQ ID NO: 209671 - DNA, 20 bp, Artificial
  CRISPR gRNA sequence
atatgcctgtatttgtggaa

SEQ ID NO: 209672 - DNA, 20 bp, Artificial
  CRISPR gRNA sequence
ggaagagcttttaaaataac

SEQ ID NO: 209673 - DNA, 20 bp, Artificial
  CRISPR gRNA sequence
gaagagcttttaaaataact

SEQ ID NO: 209674 - DNA, 20 bp, Artificial
  CRISPR gRNA sequence
taaaataactgggctcaaat

SEQ ID NO: 209675 - DNA, 20 bp, Artificial
  CRISPR gRNA sequence
ataactgggctcaaattggt

SEQ ID NO: 209676 - DNA, 20 bp, Artificial
  CRISPR gRNA sequence
aactgggctcaaattggttg

SEQ ID NO: 209677 - DNA, 20 bp, Artificial
  CRISPR gRNA sequence
gctcaaattggttggagcct

SEQ ID NO: 209678 - DNA, 20 bp, Artificial
  CRISPR gRNA sequence
gagccttagacttgaaacac

SEQ ID NO: 209679 - DNA, 20 bp, Artificial
  CRISPR gRNA sequence
ttcccatttcttgatatgat

SEQ ID NO: 209680 - DNA, 20 bp, Artificial
  CRISPR gRNA sequence
tcccatttcttgatatgata

SEQ ID NO: 209681 - DNA, 20 bp, Artificial
  CRISPR gRNA sequence
gataaggtatgtgttatgca

SEQ ID NO: 209682 - DNA, 20 bp, Artificial
  CRISPR gRNA sequence
ataaggtatgtgttatgcaa

SEQ ID NO: 209683 - DNA, 20 bp, Artificial
  CRISPR gRNA sequence
aaggtatgtgttatgcaaag

SEQ ID NO: 209684 - DNA, 20 bp, Artificial
  CRISPR gRNA sequence
aggtatgtgttatgcaaagg

SEQ ID NO: 209685 - DNA, 20 bp, Artificial
  CRISPR gRNA sequence
ggtatgtgttatgcaaagga

SEQ ID NO: 209686 - DNA, 20 bp, Artificial
  CRISPR gRNA sequence
tttgttcttctaataatttt

SEQ ID NO: 209687 - DNA, 20 bp, Artificial
  CRISPR gRNA sequence
ataattttgagtcattttac

SEQ ID NO: 209688 - DNA, 20 bp, Artificial
  CRISPR gRNA sequence
tttgagtcattttactggtt

SEQ ID NO: 209689 - DNA, 20 bp, Artificial
  CRISPR gRNA sequence
gttaagttaataaacatata

SEQ ID NO: 209690 - DNA, 20 bp, Artificial
  CRISPR gRNA sequence
aatttttgttttttgatcgt

SEQ ID NO: 209691 - DNA, 20 bp, Artificial
  CRISPR gRNA sequence
agaataactctcttaaaact

SEQ ID NO: 209692 - DNA, 20 bp, Artificial
  CRISPR gRNA sequence
gaataactctcttaaaactt

SEQ ID NO: 209693 - DNA, 20 bp, Artificial
  CRISPR gRNA sequence
ttgggattattactgttttt

SEQ ID NO: 209694 - DNA, 20 bp, Artificial
  CRISPR gRNA sequence
gattattactgttttttagt

SEQ ID NO: 209695 - DNA, 20 bp, Artificial
  CRISPR gRNA sequence
tttcatatgcttttctaata

SEQ ID NO: 209696 - DNA, 20 bp, Artificial
  CRISPR gRNA sequence
cagaattttatttgttttta

SEQ ID NO: 209697 - DNA, 20 bp, Artificial
  CRISPR gRNA sequence
acagcgtgtataccaatgca

SEQ ID NO: 209698 - DNA, 20 bp, Artificial
  CRISPR gRNA sequence
gcatggccctcttctgattt

SEQ ID NO: 209699 - DNA, 20 bp, Artificial
  CRISPR gRNA sequence
catggccctcttctgatttc

SEQ ID NO: 209700 - DNA, 20 bp, Artificial
  CRISPR gRNA sequence
cctcttctgatttcaggttt

SEQ ID NO: 209701 - DNA, 20 bp, Artificial
  CRISPR gRNA sequence
gatttcaggtttgagtatct

SEQ ID NO: 209702 - DNA, 20 bp, Artificial
  CRISPR gRNA sequence
aggtttgagtatcttagctc

SEQ ID NO: 209703 - DNA, 20 bp, Artificial
  CRISPR gRNA sequence
ttagctctagcacaattact

SEQ ID NO: 209704 - DNA, 20 bp, Artificial
  CRISPR gRNA sequence
tctagcacaattacttggac

SEQ ID NO: 209705 - DNA, 20 bp, Artificial
  CRISPR gRNA sequence
actagtttatatgaaatttg

SEQ ID NO: 209706 - DNA, 20 bp, Artificial
  CRISPR gRNA sequence
ctagtttatatgaaatttgt

SEQ ID NO: 209707 - DNA, 20 bp, Artificial
  CRISPR gRNA sequence
tttatatgaaatttgtgggt

SEQ ID NO: 209708 - DNA, 20 bp, Artificial
  CRISPR gRNA sequence
ttaacctatgccaataattt

SEQ ID NO: 209709 - DNA, 20 bp, Artificial
  CRISPR gRNA sequence
ataatttcagatatatcact

SEQ ID NO: 209710 - DNA, 20 bp, Artificial
  CRISPR gRNA sequence
atcacttagaaaatgctttt

SEQ ID NO: 209711 - DNA, 20 bp, Artificial
  CRISPR gRNA sequence
tgctttttagtttgttcttc

SEQ ID NO: 209712 - DNA, 20 bp, Artificial
  CRISPR gRNA sequence
tttagtttgttcttccagtt

SEQ ID NO: 209713 - DNA, 20 bp, Artificial
  CRISPR gRNA sequence
ttagtttgttcttccagttt

SEQ ID NO: 209714 - DNA, 20 bp, Artificial
  CRISPR gRNA sequence
tccagtttaggaccaaaaat

SEQ ID NO: 209715 - DNA, 20 bp, Artificial
  CRISPR gRNA sequence
caaaaatgagaaaatacaat

SEQ ID NO: 209716 - DNA, 20 bp, Artificial
  CRISPR gRNA sequence
aaaatgagaaaatacaattg

SEQ ID NO: 209717 - DNA, 20 bp, Artificial
  CRISPR gRNA sequence
aaatacaattggagtgattc

SEQ ID NO: 209718 - DNA, 20 bp, Artificial
  CRISPR gRNA sequence
aatacaattggagtgattcg

SEQ ID NO: 209719 - DNA, 20 bp, Artificial
  CRISPR gRNA sequence
gagtgattcgaggataatta

SEQ ID NO: 209720 - DNA, 20 bp, Artificial
  CRISPR gRNA sequence
gtgattcgaggataattaaa

SEQ ID NO: 209721 - DNA, 20 bp, Artificial
  CRISPR gRNA sequence
tgattcgaggataattaaag

SEQ ID NO: 209722 - DNA, 20 bp, Artificial
  CRISPR gRNA sequence
gattcgaggataattaaaga

SEQ ID NO: 209723 - DNA, 20 bp, Artificial
  CRISPR gRNA sequence
tcgaggataattaaagaggg

SEQ ID NO: 209724 - DNA, 20 bp, Artificial
  CRISPR gRNA sequence
aggataattaaagagggtag

SEQ ID NO: 209725 - DNA, 20 bp, Artificial
  CRISPR gRNA sequence
taaagagggtagaagacata

SEQ ID NO: 209726 - DNA, 20 bp, Artificial
  CRISPR gRNA sequence
aaagagggtagaagacatat

SEQ ID NO: 209727 - DNA, 20 bp, Artificial
  CRISPR gRNA sequence
tagaagacatataggatttt

SEQ ID NO: 209728 - DNA, 20 bp, Artificial
  CRISPR gRNA sequence
agacatataggatttttagt

SEQ ID NO: 209729 - DNA, 20 bp, Artificial
  CRISPR gRNA sequence
ggatttttagttggttcttc

SEQ ID NO: 209730 - DNA, 20 bp, Artificial
  CRISPR gRNA sequence
ttagttggttcttccagttt

SEQ ID NO: 209731 - DNA, 20 bp, Artificial
  CRISPR gRNA sequence
tggttcttccagtttaagac

SEQ ID NO: 209732 - DNA, 20 bp, Artificial
  CRISPR gRNA sequence
ttcttccagtttaagaccag

SEQ ID NO: 209733 - DNA, 20 bp, Artificial
  CRISPR gRNA sequence
tccagtttaagaccagaagt

SEQ ID NO: 209734 - DNA, 20 bp, Artificial
  CRISPR gRNA sequence
cagaagtcagaaaatacaat

SEQ ID NO: 209735 - DNA, 20 bp, Artificial
  CRISPR gRNA sequence
aaatacaattggaatgattt

SEQ ID NO: 209736 - DNA, 20 bp, Artificial
  CRISPR gRNA sequence
aatacaattggaatgatttg

SEQ ID NO: 209737 - DNA, 20 bp, Artificial
  CRISPR gRNA sequence
atacaattggaatgatttga

SEQ ID NO: 209738 - DNA, 20 bp, Artificial
  CRISPR gRNA sequence
gaatgatttgagggtaatta

SEQ ID NO: 209739 - DNA, 20 bp, Artificial
  CRISPR gRNA sequence
atgatttgagggtaattaaa

SEQ ID NO: 209740 - DNA, 20 bp, Artificial
  CRISPR gRNA sequence
tgatttgagggtaattaaag

SEQ ID NO: 209741 - DNA, 20 bp, Artificial
  CRISPR gRNA sequence
gatttgagggtaattaaaga

SEQ ID NO: 209742 - DNA, 20 bp, Artificial
  CRISPR gRNA sequence
ttgagggtaattaaagaggg

SEQ ID NO: 209743 - DNA, 20 bp, Artificial
  CRISPR gRNA sequence
agggtaattaaagagggtag

SEQ ID NO: 209744 - DNA, 20 bp, Artificial
  CRISPR gRNA sequence
taaagagggtagaagacata

SEQ ID NO: 209745 - DNA, 20 bp, Artificial
  CRISPR gRNA sequence
aaagagggtagaagacatat

SEQ ID NO: 209746 - DNA, 20 bp, Artificial
  CRISPR gRNA sequence
atataggattaatgaaaatt

SEQ ID NO: 209747 - DNA, 20 bp, Artificial
  CRISPR gRNA sequence
taatgaaaatttggtttcca

SEQ ID NO: 209748 - DNA, 20 bp, Artificial
  CRISPR gRNA sequence
tgaaaatttggtttccaaag

SEQ ID NO: 209749 - DNA, 20 bp, Artificial
  CRISPR gRNA sequence
ttggtttccaaagtagttta

SEQ ID NO: 209750 - DNA, 20 bp, Artificial
  CRISPR gRNA sequence
tggtttccaaagtagtttaa

SEQ ID NO: 209751 - DNA, 20 bp, Artificial
  CRISPR gRNA sequence
caaagtagtttaaaggaaaa

SEQ ID NO: 209752 - DNA, 20 bp, Artificial
  CRISPR gRNA sequence
aggaaaatggctttatctat

SEQ ID NO: 209753 - DNA, 20 bp, Artificial
  CRISPR gRNA sequence
aatgtgtacctttttatact

SEQ ID NO: 209754 - DNA, 20 bp, Artificial
  CRISPR gRNA sequence
tacctttttatactaagtaa

SEQ ID NO: 209755 - DNA, 20 bp, Artificial
  CRISPR gRNA sequence
acctttttatactaagtaaa

SEQ ID NO: 209756 - DNA, 20 bp, Artificial
  CRISPR gRNA sequence
cctttttatactaagtaaaa

SEQ ID NO: 209757 - DNA, 20 bp, Artificial
  CRISPR gRNA sequence
ctttttatactaagtaaaag

SEQ ID NO: 209758 - DNA, 20 bp, Artificial
  CRISPR gRNA sequence
ttttatactaagtaaaaggg

SEQ ID NO: 209759 - DNA, 20 bp, Artificial
  CRISPR gRNA sequence
ttatactaagtaaaagggga

SEQ ID NO: 209760 - DNA, 20 bp, Artificial
  CRISPR gRNA sequence
gtaaaaggggagagatcttt

SEQ ID NO: 209761 - DNA, 20 bp, Artificial
  CRISPR gRNA sequence
taaaaggggagagatctttg

SEQ ID NO: 209762 - DNA, 20 bp, Artificial
  CRISPR gRNA sequence
gatctttgaggatccatttt

SEQ ID NO: 209763 - DNA, 20 bp, Artificial
  CRISPR gRNA sequence
tgaggatccattttaagtaa

SEQ ID NO: 209764 - DNA, 20 bp, Artificial
  CRISPR gRNA sequence
atccattttaagtaatagaa

SEQ ID NO: 209765 - DNA, 20 bp, Artificial
  CRISPR gRNA sequence
tccattttaagtaatagaat

SEQ ID NO: 209766 - DNA, 20 bp, Artificial
  CRISPR gRNA sequence
aataggatttttaattgttc

SEQ ID NO: 209767 - DNA, 20 bp, Artificial
  CRISPR gRNA sequence
ttgttccagtgtttctgtga

SEQ ID NO: 209768 - DNA, 20 bp, Artificial
  CRISPR gRNA sequence
gttccagtgtttctgtgata

SEQ ID NO: 209769 - DNA, 20 bp, Artificial
  CRISPR gRNA sequence
tgtgatagagctgtcctgca

SEQ ID NO: 209770 - DNA, 20 bp, Artificial
  CRISPR gRNA sequence
gtcacttgctctttttcttg

SEQ ID NO: 209771 - DNA, 20 bp, Artificial
  CRISPR gRNA sequence
tgctctttttcttgcagaca

SEQ ID NO: 209772 - DNA, 20 bp, Artificial
  CRISPR gRNA sequence
tcttgcagacatagacaccc

SEQ ID NO: 209773 - DNA, 20 bp, Artificial
  CRISPR gRNA sequence
gcagacatagacaccccaga

SEQ ID NO: 209774 - DNA, 20 bp, Artificial
  CRISPR gRNA sequence
cagacatagacaccccagac

SEQ ID NO: 209775 - DNA, 20 bp, Artificial
  CRISPR gRNA sequence
ctatcaattttgttcattta

SEQ ID NO: 209776 - DNA, 20 bp, Artificial
  CRISPR gRNA sequence
atcaattttgttcatttaaa

SEQ ID NO: 209777 - DNA, 20 bp, Artificial
  CRISPR gRNA sequence
aattttgttcatttaaagag

SEQ ID NO: 209778 - DNA, 20 bp, Artificial
  CRISPR gRNA sequence
tctaatgcatgactttaaaa

SEQ ID NO: 209779 - DNA, 20 bp, Artificial
  CRISPR gRNA sequence
gcatgactttaaaacagttc

SEQ ID NO: 209780 - DNA, 20 bp, Artificial
  CRISPR gRNA sequence
accaatataatgaaaacatt

SEQ ID NO: 209781 - DNA, 20 bp, Artificial
  CRISPR gRNA sequence
aaacattgagtttcaaaatt

SEQ ID NO: 209782 - DNA, 20 bp, Artificial
  CRISPR gRNA sequence
aacattgagtttcaaaattt

SEQ ID NO: 209783 - DNA, 20 bp, Artificial
  CRISPR gRNA sequence
ctccttttaaaatcaattat

SEQ ID NO: 209784 - DNA, 20 bp, Artificial
  CRISPR gRNA sequence
ttttaaaatcaattattagt

SEQ ID NO: 209785 - DNA, 20 bp, Artificial
  CRISPR gRNA sequence
aaatcaattattagtaagta

SEQ ID NO: 209786 - DNA, 20 bp, Artificial
  CRISPR gRNA sequence
tatttaatctgccaattttc

SEQ ID NO: 209787 - DNA, 20 bp, Artificial
  CRISPR gRNA sequence
ataaattcttattttttatt

SEQ ID NO: 209788 - DNA, 20 bp, Artificial
  CRISPR gRNA sequence
tttattgagatatatgtaca

SEQ ID NO: 209789 - DNA, 20 bp, Artificial
  CRISPR gRNA sequence
tattgagatatatgtacaca

SEQ ID NO: 209790 - DNA, 20 bp, Artificial
  CRISPR gRNA sequence
ttgagatatatgtacacaga

SEQ ID NO: 209791 - DNA, 20 bp, Artificial
  CRISPR gRNA sequence
aaactaatgttatcttacct

SEQ ID NO: 209792 - DNA, 20 bp, Artificial
  CRISPR gRNA sequence
atgttatcttacctaagctc

SEQ ID NO: 209793 - DNA, 20 bp, Artificial
  CRISPR gRNA sequence
cccaataatgtaatttatat

SEQ ID NO: 209794 - DNA, 20 bp, Artificial
  CRISPR gRNA sequence
ccacctatcaaaataatcaa

SEQ ID NO: 209795 - DNA, 20 bp, Artificial
  CRISPR gRNA sequence
aatcaaaagttataaattaa

SEQ ID NO: 209796 - DNA, 20 bp, Artificial
  CRISPR gRNA sequence
tcaaaagttataaattaatg

SEQ ID NO: 209797 - DNA, 20 bp, Artificial
  CRISPR gRNA sequence
aaattaatggagtaaaaaaa

SEQ ID NO: 209798 - DNA, 20 bp, Artificial
  CRISPR gRNA sequence
atagtgtttctgctttgctt

SEQ ID NO: 209799 - DNA, 20 bp, Artificial
  CRISPR gRNA sequence
tagtgtttctgctttgcttt

SEQ ID NO: 209800 - DNA, 20 bp, Artificial
  CRISPR gRNA sequence
atacgaaacttgaattgtta

SEQ ID NO: 209801 - DNA, 20 bp, Artificial
  CRISPR gRNA sequence
ttctcatatgactcacataa

SEQ ID NO: 209802 - DNA, 20 bp, Artificial
  CRISPR gRNA sequence
ttacctttatttctgaactt

SEQ ID NO: 209803 - DNA, 20 bp, Artificial
  CRISPR gRNA sequence
tttctttaattaatgcttat

SEQ ID NO: 209804 - DNA, 20 bp, Artificial
  CRISPR gRNA sequence
aactaaaatctgcgtatcct

SEQ ID NO: 209805 - DNA, 20 bp, Artificial
  CRISPR gRNA sequence
tctgcgtatccttagcatat

SEQ ID NO: 209806 - DNA, 20 bp, Artificial
  CRISPR gRNA sequence
tccttagcatatgagttcat

SEQ ID NO: 209807 - DNA, 20 bp, Artificial
  CRISPR gRNA sequence
gcatatgagttcataagtct

SEQ ID NO: 209808 - DNA, 20 bp, Artificial
  CRISPR gRNA sequence
cataatgccataaaatacaa

SEQ ID NO: 209809 - DNA, 20 bp, Artificial
  CRISPR gRNA sequence
taatgccataaaatacaatg

SEQ ID NO: 209810 - DNA, 20 bp, Artificial
  CRISPR gRNA sequence
aaatacaatggagacatcta

SEQ ID NO: 209811 - DNA, 20 bp, Artificial
  CRISPR gRNA sequence
tacaatggagacatctaaag

SEQ ID NO: 209812 - DNA, 20 bp, Artificial
  CRISPR gRNA sequence
tggagacatctaaagcagaa

SEQ ID NO: 209813 - DNA, 20 bp, Artificial
  CRISPR gRNA sequence
aaagcagaatggaattcatg

SEQ ID NO: 209814 - DNA, 20 bp, Artificial
  CRISPR gRNA sequence
gcagaatggaattcatgtgg

SEQ ID NO: 209815 - DNA, 20 bp, Artificial
  CRISPR gRNA sequence
tggaattcatgtggtagcta

SEQ ID NO: 209816 - DNA, 20 bp, Artificial
  CRISPR gRNA sequence
acagtgaacatcttgaatgt

SEQ ID NO: 209817 - DNA, 20 bp, Artificial
  CRISPR gRNA sequence
tcttccaatcaccatgtgtc

SEQ ID NO: 209818 - DNA, 20 bp, Artificial
  CRISPR gRNA sequence
aatcaccatgtgtctggttc

SEQ ID NO: 209819 - DNA, 20 bp, Artificial
  CRISPR gRNA sequence
caccatgtgtctggttctgg

SEQ ID NO: 209820 - DNA, 20 bp, Artificial
  CRISPR gRNA sequence
gttctggaagatgacactcc

SEQ ID NO: 209821 - DNA, 20 bp, Artificial
  CRISPR gRNA sequence
gttgctccccacaaatgcct

SEQ ID NO: 209822 - DNA, 20 bp, Artificial
  CRISPR gRNA sequence
tccccacaaatgcctgagaa

SEQ ID NO: 209823 - DNA, 20 bp, Artificial
  CRISPR gRNA sequence
tgagaatagtgtgtgatttg

SEQ ID NO: 209824 - DNA, 20 bp, Artificial
  CRISPR gRNA sequence
ttgcagtatccatacaactc

SEQ ID NO: 209825 - DNA, 20 bp, Artificial
  CRISPR gRNA sequence
gtatccatacaactctggtg

SEQ ID NO: 209826 - DNA, 20 bp, Artificial
  CRISPR gRNA sequence
tccatacaactctggtgaag

SEQ ID NO: 209827 - DNA, 20 bp, Artificial
  CRISPR gRNA sequence
caactctggtgaagtagtat

SEQ ID NO: 209828 - DNA, 20 bp, Artificial
  CRISPR gRNA sequence
gaagtagtatgagatacctt

SEQ ID NO: 209829 - DNA, 20 bp, Artificial
  CRISPR gRNA sequence
tatgagatacctttggctga

SEQ ID NO: 209830 - DNA, 20 bp, Artificial
  CRISPR gRNA sequence
atgagatacctttggctgac

SEQ ID NO: 209831 - DNA, 20 bp, Artificial
  CRISPR gRNA sequence
agatacctttggctgacggg

SEQ ID NO: 209832 - DNA, 20 bp, Artificial
  CRISPR gRNA sequence
cttattttttcctcactatc

SEQ ID NO: 209833 - DNA, 20 bp, Artificial
  CRISPR gRNA sequence
ttattttttcctcactatct

SEQ ID NO: 209834 - DNA, 20 bp, Artificial
  CRISPR gRNA sequence
caccccatgccttccatatc

SEQ ID NO: 209835 - DNA, 20 bp, Artificial
  CRISPR gRNA sequence
catgccttccatatctagca

SEQ ID NO: 209836 - DNA, 20 bp, Artificial
  CRISPR gRNA sequence
atctagcatagaatgatctt

SEQ ID NO: 209837 - DNA, 20 bp, Artificial
  CRISPR gRNA sequence
gcatagaatgatcttcagta

SEQ ID NO: 209838 - DNA, 20 bp, Artificial
  CRISPR gRNA sequence
atgatcttcagtacagttgc

SEQ ID NO: 209839 - DNA, 20 bp, Artificial
  CRISPR gRNA sequence
atcttcagtacagttgccag

SEQ ID NO: 209840 - DNA, 20 bp, Artificial
  CRISPR gRNA sequence
tcttcagtacagttgccagc

SEQ ID NO: 209841 - DNA, 20 bp, Artificial
  CRISPR gRNA sequence
agtacagttgccagcaggtc

SEQ ID NO: 209842 - DNA, 20 bp, Artificial
  CRISPR gRNA sequence
aggtctggtgacaatgtctc

SEQ ID NO: 209843 - DNA, 20 bp, Artificial
  CRISPR gRNA sequence
tctggtgacaatgtctcaag

SEQ ID NO: 209844 - DNA, 20 bp, Artificial
  CRISPR gRNA sequence
acaatgtctcaagtggaact

SEQ ID NO: 209845 - DNA, 20 bp, Artificial
  CRISPR gRNA sequence
tccatcacttacgttcctcc

SEQ ID NO: 209846 - DNA, 20 bp, Artificial
  CRISPR gRNA sequence
aaaatgacttaaatcttgac

SEQ ID NO: 209847 - DNA, 20 bp, Artificial
  CRISPR gRNA sequence
aaattattttttctttgtca

SEQ ID NO: 209848 - DNA, 20 bp, Artificial
  CRISPR gRNA sequence
aattattttttctttgtcat

SEQ ID NO: 209849 - DNA, 20 bp, Artificial
  CRISPR gRNA sequence
attttttctttgtcataggt

SEQ ID NO: 209850 - DNA, 20 bp, Artificial
  CRISPR gRNA sequence
tttgtcataggttagcatat

SEQ ID NO: 209851 - DNA, 20 bp, Artificial
  CRISPR gRNA sequence
tatgctatatgtttaaaatt

SEQ ID NO: 209852 - DNA, 20 bp, Artificial
  CRISPR gRNA sequence
atttagtgcaattttattga

SEQ ID NO: 209853 - DNA, 20 bp, Artificial
  CRISPR gRNA sequence
tagtgtcctaattttattga

SEQ ID NO: 209854 - DNA, 20 bp, Artificial
  CRISPR gRNA sequence
taaatcaacttgtctgatgc

SEQ ID NO: 209855 - DNA, 20 bp, Artificial
  CRISPR gRNA sequence
aaatcaacttgtctgatgcc

SEQ ID NO: 209856 - DNA, 20 bp, Artificial
  CRISPR gRNA sequence
aatcaacttgtctgatgcca

SEQ ID NO: 209857 - DNA, 20 bp, Artificial
  CRISPR gRNA sequence
acttgtctgatgccagggtt

SEQ ID NO: 209858 - DNA, 20 bp, Artificial
  CRISPR gRNA sequence
ttgtctgatgccagggttca

SEQ ID NO: 209859 - DNA, 20 bp, Artificial
  CRISPR gRNA sequence
tgtctgatgccagggttcag

SEQ ID NO: 209860 - DNA, 20 bp, Artificial
  CRISPR gRNA sequence
gtctgatgccagggttcaga

SEQ ID NO: 209861 - DNA, 20 bp, Artificial
  CRISPR gRNA sequence
agggttcagagggacaccta

SEQ ID NO: 209862 - DNA, 20 bp, Artificial
  CRISPR gRNA sequence
ttcagagggacacctacagt

SEQ ID NO: 209863 - DNA, 20 bp, Artificial
  CRISPR gRNA sequence
ggacacctacagtcagttga

SEQ ID NO: 209864 - DNA, 20 bp, Artificial
  CRISPR gRNA sequence
gacacctacagtcagttgaa

SEQ ID NO: 209865 - DNA, 20 bp, Artificial
  CRISPR gRNA sequence
cctacagtcagttgaaaggc

SEQ ID NO: 209866 - DNA, 20 bp, Artificial
  CRISPR gRNA sequence
acagtcagttgaaaggcaag

SEQ ID NO: 209867 - DNA, 20 bp, Artificial
  CRISPR gRNA sequence
agtcagttgaaaggcaagaa

SEQ ID NO: 209868 - DNA, 20 bp, Artificial
  CRISPR gRNA sequence
gttgaaaggcaagaagagac

SEQ ID NO: 209869 - DNA, 20 bp, Artificial
  CRISPR gRNA sequence
ttgaaaggcaagaagagaca

SEQ ID NO: 209870 - DNA, 20 bp, Artificial
  CRISPR gRNA sequence
aggcaagaagagacaaggta

SEQ ID NO: 209871 - DNA, 20 bp, Artificial
  CRISPR gRNA sequence
ggcaagaagagacaaggtac

SEQ ID NO: 209872 - DNA, 20 bp, Artificial
  CRISPR gRNA sequence
agaagagacaaggtacagga

SEQ ID NO: 209873 - DNA, 20 bp, Artificial
  CRISPR gRNA sequence
ggtacaggaaagttgctctt

SEQ ID NO: 209874 - DNA, 20 bp, Artificial
  CRISPR gRNA sequence
aagttgctctttagataaca

SEQ ID NO: 209875 - DNA, 20 bp, Artificial
  CRISPR gRNA sequence
ttgctctttagataacatgg

SEQ ID NO: 209876 - DNA, 20 bp, Artificial
  CRISPR gRNA sequence
ctttagataacatggtagac

SEQ ID NO: 209877 - DNA, 20 bp, Artificial
  CRISPR gRNA sequence
tttagataacatggtagact

SEQ ID NO: 209878 - DNA, 20 bp, Artificial
  CRISPR gRNA sequence
tagataacatggtagactag

SEQ ID NO: 209879 - DNA, 20 bp, Artificial
  CRISPR gRNA sequence
agataacatggtagactagg

SEQ ID NO: 209880 - DNA, 20 bp, Artificial
  CRISPR gRNA sequence
gactaggaggaacattaata

SEQ ID NO: 209881 - DNA, 20 bp, Artificial
  CRISPR gRNA sequence
atctgaatctatgtaacatt

SEQ ID NO: 209882 - DNA, 20 bp, Artificial
  CRISPR gRNA sequence
tctgaatctatgtaacatta

SEQ ID NO: 209883 - DNA, 20 bp, Artificial
  CRISPR gRNA sequence
aacattaaggttgcaaattt

SEQ ID NO: 209884 - DNA, 20 bp, Artificial
  CRISPR gRNA sequence
gcaaatttgagcgtttatat

SEQ ID NO: 209885 - DNA, 20 bp, Artificial
  CRISPR gRNA sequence
caaatttgagcgtttatatt

SEQ ID NO: 209886 - DNA, 20 bp, Artificial
  CRISPR gRNA sequence
atttgagcgtttatattagg

SEQ ID NO: 209887 - DNA, 20 bp, Artificial
  CRISPR gRNA sequence
tattaggaagttaaaatttt

SEQ ID NO: 209888 - DNA, 20 bp, Artificial
  CRISPR gRNA sequence
tcattgcacgtgttctgttt

SEQ ID NO: 209889 - DNA, 20 bp, Artificial
  CRISPR gRNA sequence
gcacgtgttctgttttagaa

SEQ ID NO: 209890 - DNA, 20 bp, Artificial
  CRISPR gRNA sequence
aatgcaataaaatcctcaaa

SEQ ID NO: 209891 - DNA, 20 bp, Artificial
  CRISPR gRNA sequence
cctcaaatagttaaaaatcc

SEQ ID NO: 209892 - DNA, 20 bp, Artificial
  CRISPR gRNA sequence
aaaatccaagctttctcttc

SEQ ID NO: 209893 - DNA, 20 bp, Artificial
  CRISPR gRNA sequence
atccaagctttctcttcaag

SEQ ID NO: 209894 - DNA, 20 bp, Artificial
  CRISPR gRNA sequence
caagctttctcttcaagaag

SEQ ID NO: 209895 - DNA, 20 bp, Artificial
  CRISPR gRNA sequence
gaagaagttaatgtcgctat

SEQ ID NO: 209896 - DNA, 20 bp, Artificial
  CRISPR gRNA sequence
tatttccaactttaaatttg

SEQ ID NO: 209897 - DNA, 20 bp, Artificial
  CRISPR gRNA sequence
agccttaatttgctatttta

SEQ ID NO: 209898 - DNA, 20 bp, Artificial
  CRISPR gRNA sequence
ccttaatttgctattttaaa

SEQ ID NO: 209899 - DNA, 20 bp, Artificial
  CRISPR gRNA sequence
taatttgctattttaaagag

SEQ ID NO: 209900 - DNA, 20 bp, Artificial
  CRISPR gRNA sequence
aatttgctattttaaagagt

SEQ ID NO: 209901 - DNA, 20 bp, Artificial
  CRISPR gRNA sequence
ctttctacaactttctgtga

SEQ ID NO: 209902 - DNA, 20 bp, Artificial
  CRISPR gRNA sequence
ttgtattttttttcttttat

SEQ ID NO: 209903 - DNA, 20 bp, Artificial
  CRISPR gRNA sequence
tattttttttcttttattgg

SEQ ID NO: 209904 - DNA, 20 bp, Artificial
  CRISPR gRNA sequence
tggaagcattttaattttat

SEQ ID NO: 209905 - DNA, 20 bp, Artificial
  CRISPR gRNA sequence
gcattttaattttataagat

SEQ ID NO: 209906 - DNA, 20 bp, Artificial
  CRISPR gRNA sequence
taattttataagatgagaaa

SEQ ID NO: 209907 - DNA, 20 bp, Artificial
  CRISPR gRNA sequence
aattttataagatgagaaaa

SEQ ID NO: 209908 - DNA, 20 bp, Artificial
  CRISPR gRNA sequence
tataagatgagaaaaaggac

SEQ ID NO: 209909 - DNA, 20 bp, Artificial
  CRISPR gRNA sequence
ataagatgagaaaaaggact

SEQ ID NO: 209910 - DNA, 20 bp, Artificial
  CRISPR gRNA sequence
ggcacaataacttaatgtga

SEQ ID NO: 209911 - DNA, 20 bp, Artificial
  CRISPR gRNA sequence
aataacttaatgtgaaagca

SEQ ID NO: 209912 - DNA, 20 bp, Artificial
  CRISPR gRNA sequence
cttaatgtgaaagcatagaa

SEQ ID NO: 209913 - DNA, 20 bp, Artificial
  CRISPR gRNA sequence
gaaagcatagaaaagattac

SEQ ID NO: 209914 - DNA, 20 bp, Artificial
  CRISPR gRNA sequence
gaacctaaccaaactcacta

SEQ ID NO: 209915 - DNA, 20 bp, Artificial
  CRISPR gRNA sequence
ctaaccaaactcactaaagt

SEQ ID NO: 209916 - DNA, 20 bp, Artificial
  CRISPR gRNA sequence
taaccaaactcactaaagtt

SEQ ID NO: 209917 - DNA, 20 bp, Artificial
  CRISPR gRNA sequence
aaagttgggcttgttgtttg

SEQ ID NO: 209918 - DNA, 20 bp, Artificial
  CRISPR gRNA sequence
agttgggcttgttgtttgta

SEQ ID NO: 209919 - DNA, 20 bp, Artificial
  CRISPR gRNA sequence
gagaacgtttatataattat

SEQ ID NO: 209920 - DNA, 20 bp, Artificial
  CRISPR gRNA sequence
agaacgtttatataattata

SEQ ID NO: 209921 - DNA, 20 bp, Artificial
  CRISPR gRNA sequence
tcaatactttctcattttta

SEQ ID NO: 209922 - DNA, 20 bp, Artificial
  CRISPR gRNA sequence
ctcatttttaaagccattac

SEQ ID NO: 209923 - DNA, 20 bp, Artificial
  CRISPR gRNA sequence
tttttaaagccattaccagt

SEQ ID NO: 209924 - DNA, 20 bp, Artificial
  CRISPR gRNA sequence
attaccagttagttcaatat

SEQ ID NO: 209925 - DNA, 20 bp, Artificial
  CRISPR gRNA sequence
ttaccagttagttcaatata

SEQ ID NO: 209926 - DNA, 20 bp, Artificial
  CRISPR gRNA sequence
taccagttagttcaatataa

SEQ ID NO: 209927 - DNA, 20 bp, Artificial
  CRISPR gRNA sequence
tagttcaatataagggcata

SEQ ID NO: 209928 - DNA, 20 bp, Artificial
  CRISPR gRNA sequence
tgttttgatacaaatcaatc

SEQ ID NO: 209929 - DNA, 20 bp, Artificial
  CRISPR gRNA sequence
tttgatacaaatcaatctgg

SEQ ID NO: 209930 - DNA, 20 bp, Artificial
  CRISPR gRNA sequence
gatacaaatcaatctggtag

SEQ ID NO: 209931 - DNA, 20 bp, Artificial
  CRISPR gRNA sequence
caaatcaatctggtagcagt

SEQ ID NO: 209932 - DNA, 20 bp, Artificial
  CRISPR gRNA sequence
ccatatttaccacaacatcc

SEQ ID NO: 209933 - DNA, 20 bp, Artificial
  CRISPR gRNA sequence
ccacaacatcccagatattt

SEQ ID NO: 209934 - DNA, 20 bp, Artificial
  CRISPR gRNA sequence
ccagatattttagaatgatg

SEQ ID NO: 209935 - DNA, 20 bp, Artificial
  CRISPR gRNA sequence
attttagaatgatgcagatg

SEQ ID NO: 209936 - DNA, 20 bp, Artificial
  CRISPR gRNA sequence
gcagatgcagaatatatacg

SEQ ID NO: 209937 - DNA, 20 bp, Artificial
  CRISPR gRNA sequence
gtagaatttatatctatgta

SEQ ID NO: 209938 - DNA, 20 bp, Artificial
  CRISPR gRNA sequence
tctatgtatagatacaaatt

SEQ ID NO: 209939 - DNA, 20 bp, Artificial
  CRISPR gRNA sequence
gatattttcttgttcaattt

SEQ ID NO: 209940 - DNA, 20 bp, Artificial
  CRISPR gRNA sequence
atattttcttgttcaattta

SEQ ID NO: 209941 - DNA, 20 bp, Artificial
  CRISPR gRNA sequence
attttcttgttcaatttaag

SEQ ID NO: 209942 - DNA, 20 bp, Artificial
  CRISPR gRNA sequence
tttcttgttcaatttaagga

SEQ ID NO: 209943 - DNA, 20 bp, Artificial
  CRISPR gRNA sequence
ttcttgttcaatttaaggag

SEQ ID NO: 209944 - DNA, 20 bp, Artificial
  CRISPR gRNA sequence
aatttaaggagaggtaaatt

SEQ ID NO: 209945 - DNA, 20 bp, Artificial
  CRISPR gRNA sequence
agaggtaaatttggtatcaa

SEQ ID NO: 209946 - DNA, 20 bp, Artificial
  CRISPR gRNA sequence
tttctgaaaaatttaaaccc

SEQ ID NO: 209947 - DNA, 20 bp, Artificial
  CRISPR gRNA sequence
aaaccctggaaatgtattta

SEQ ID NO: 209948 - DNA, 20 bp, Artificial
  CRISPR gRNA sequence
ctggaaatgtatttatggca

SEQ ID NO: 209949 - DNA, 20 bp, Artificial
  CRISPR gRNA sequence
ggaaatgtatttatggcatg

SEQ ID NO: 209950 - DNA, 20 bp, Artificial
  CRISPR gRNA sequence
atgtatttatggcatggagt

SEQ ID NO: 209951 - DNA, 20 bp, Artificial
  CRISPR gRNA sequence
tggcatggagtcagatgttt

SEQ ID NO: 209952 - DNA, 20 bp, Artificial
  CRISPR gRNA sequence
ggcatggagtcagatgtttc

SEQ ID NO: 209953 - DNA, 20 bp, Artificial
  CRISPR gRNA sequence
gcatggagtcagatgtttca

SEQ ID NO: 209954 - DNA, 20 bp, Artificial
  CRISPR gRNA sequence
atggagtcagatgtttcagg

SEQ ID NO: 209955 - DNA, 20 bp, Artificial
  CRISPR gRNA sequence
ggagtcagatgtttcaggga

SEQ ID NO: 209956 - DNA, 20 bp, Artificial
  CRISPR gRNA sequence
gtcagatgtttcagggagag

SEQ ID NO: 209957 - DNA, 20 bp, Artificial
  CRISPR gRNA sequence
cagggagagaagaacaaatc

SEQ ID NO: 209958 - DNA, 20 bp, Artificial
  CRISPR gRNA sequence
ggagagaagaacaaatcaag

SEQ ID NO: 209959 - DNA, 20 bp, Artificial
  CRISPR gRNA sequence
aacaaatcaagaagcattgc

SEQ ID NO: 209960 - DNA, 20 bp, Artificial
  CRISPR gRNA sequence
gcattgcaagtatgctcata

SEQ ID NO: 209961 - DNA, 20 bp, Artificial
  CRISPR gRNA sequence
tatgctcatatggaatgctt

SEQ ID NO: 209962 - DNA, 20 bp, Artificial
  CRISPR gRNA sequence
atgctcatatggaatgctta

SEQ ID NO: 209963 - DNA, 20 bp, Artificial
  CRISPR gRNA sequence
tatggaatgcttaaggcttg

SEQ ID NO: 209964 - DNA, 20 bp, Artificial
  CRISPR gRNA sequence
ggttaaaaaatatatatata

SEQ ID NO: 209965 - DNA, 20 bp, Artificial
  CRISPR gRNA sequence
atatatggctgtcaatgtct

SEQ ID NO: 209966 - DNA, 20 bp, Artificial
  CRISPR gRNA sequence
tatatggctgtcaatgtctt

SEQ ID NO: 209967 - DNA, 20 bp, Artificial
  CRISPR gRNA sequence
ctgtcaatgtcttaggctca

SEQ ID NO: 209968 - DNA, 20 bp, Artificial
  CRISPR gRNA sequence
tcaatgtcttaggctcatgg

SEQ ID NO: 209969 - DNA, 20 bp, Artificial
  CRISPR gRNA sequence
atgtcttaggctcatggtag

SEQ ID NO: 209970 - DNA, 20 bp, Artificial
  CRISPR gRNA sequence
tcttaggctcatggtagcag

SEQ ID NO: 209971 - DNA, 20 bp, Artificial
  CRISPR gRNA sequence
gtaataattcttttgtcaca

SEQ ID NO: 209972 - DNA, 20 bp, Artificial
  CRISPR gRNA sequence
taataattcttttgtcacat

SEQ ID NO: 209973 - DNA, 20 bp, Artificial
  CRISPR gRNA sequence
cacatgggttatatccatat

SEQ ID NO: 209974 - DNA, 20 bp, Artificial
  CRISPR gRNA sequence
catgggttatatccatattg

SEQ ID NO: 209975 - DNA, 20 bp, Artificial
  CRISPR gRNA sequence
tgggttatatccatattgga

SEQ ID NO: 209976 - DNA, 20 bp, Artificial
  CRISPR gRNA sequence
catattggagagaattaact

SEQ ID NO: 209977 - DNA, 20 bp, Artificial
  CRISPR gRNA sequence
atattggagagaattaactc

SEQ ID NO: 209978 - DNA, 20 bp, Artificial
  CRISPR gRNA sequence
aaattaacttgtacactgtt

SEQ ID NO: 209979 - DNA, 20 bp, Artificial
  CRISPR gRNA sequence
ctgtttggttttataatatt

SEQ ID NO: 209980 - DNA, 20 bp, Artificial
  CRISPR gRNA sequence
gtttggttttataatattta

SEQ ID NO: 209981 - DNA, 20 bp, Artificial
  CRISPR gRNA sequence
tttggttttataatatttag

SEQ ID NO: 209982 - DNA, 20 bp, Artificial
  CRISPR gRNA sequence
ttggttttataatatttaga

SEQ ID NO: 209983 - DNA, 20 bp, Artificial
  CRISPR gRNA sequence
aactgactgatgtccctttg

SEQ ID NO: 209984 - DNA, 20 bp, Artificial
  CRISPR gRNA sequence
cttcataaatcttttttttt

SEQ ID NO: 209985 - DNA, 20 bp, Artificial
  CRISPR gRNA sequence
taaatctttttttttcagaa

SEQ ID NO: 209986 - DNA, 20 bp, Artificial
  CRISPR gRNA sequence
aaatctttttttttcagaat

SEQ ID NO: 209987 - DNA, 20 bp, Artificial
  CRISPR gRNA sequence
ctttttttttcagaatgggc

SEQ ID NO: 209988 - DNA, 20 bp, Artificial
  CRISPR gRNA sequence
cagccaactgtgacatccct

SEQ ID NO: 209989 - DNA, 20 bp, Artificial
  CRISPR gRNA sequence
aactgtgacatcccttggat

SEQ ID NO: 209990 - DNA, 20 bp, Artificial
  CRISPR gRNA sequence
ctgtgacatcccttggatcg

SEQ ID NO: 209991 - DNA, 20 bp, Artificial
  CRISPR gRNA sequence
catcccttggatcggagatt

SEQ ID NO: 209992 - DNA, 20 bp, Artificial
  CRISPR gRNA sequence
ttggatcggagatttagaac

SEQ ID NO: 209993 - DNA, 20 bp, Artificial
  CRISPR gRNA sequence
atcggagatttagaactaga

SEQ ID NO: 209994 - DNA, 20 bp, Artificial
  CRISPR gRNA sequence
aagtattctttctacattat

SEQ ID NO: 209995 - DNA, 20 bp, Artificial
  CRISPR gRNA sequence
agtattctttctacattatt

SEQ ID NO: 209996 - DNA, 20 bp, Artificial
  CRISPR gRNA sequence
gtattctttctacattatta

SEQ ID NO: 209997 - DNA, 20 bp, Artificial
  CRISPR gRNA sequence
ttctttctacattattaggg

SEQ ID NO: 209998 - DNA, 20 bp, Artificial
  CRISPR gRNA sequence
tctacattattagggaagaa

SEQ ID NO: 209999 - DNA, 20 bp, Artificial
  CRISPR gRNA sequence
ctacattattagggaagaaa

SEQ ID NO: 210000 - DNA, 20 bp, Artificial
  CRISPR gRNA sequence
acattattagggaagaaaag

SEQ ID NO: 210001 - DNA, 20 bp, Artificial
  CRISPR gRNA sequence
agggaagaaaaggagttact

SEQ ID NO: 210002 - DNA, 20 bp, Artificial
  CRISPR gRNA sequence
gaagaaaaggagttacttgg

SEQ ID NO: 210003 - DNA, 20 bp, Artificial
  CRISPR gRNA sequence
aaaaggagttacttggcggt

SEQ ID NO: 210004 - DNA, 20 bp, Artificial
  CRISPR gRNA sequence
attttgttttgttttgtttt

SEQ ID NO: 210005 - DNA, 20 bp, Artificial
  CRISPR gRNA sequence
tttgttttgttttgttttta

SEQ ID NO: 210006 - DNA, 20 bp, Artificial
  CRISPR gRNA sequence
ttttgttttgtttttagaga

SEQ ID NO: 210007 - DNA, 20 bp, Artificial
  CRISPR gRNA sequence
tttgttttgtttttagagac

SEQ ID NO: 210008 - DNA, 20 bp, Artificial
  CRISPR gRNA sequence
ttgttttgtttttagagaca

SEQ ID NO: 210009 - DNA, 20 bp, Artificial
  CRISPR gRNA sequence
cagggtctcattatgttgac

SEQ ID NO: 210010 - DNA, 20 bp, Artificial
  CRISPR gRNA sequence
agggtctcattatgttgacc

SEQ ID NO: 210011 - DNA, 20 bp, Artificial
  CRISPR gRNA sequence
tctcattatgttgaccaggc

SEQ ID NO: 210012 - DNA, 20 bp, Artificial
  CRISPR gRNA sequence
atgttgaccaggctggcctc

SEQ ID NO: 210013 - DNA, 20 bp, Artificial
  CRISPR gRNA sequence
ccaggctggcctcgagctcc

SEQ ID NO: 210014 - DNA, 20 bp, Artificial
  CRISPR gRNA sequence
caggctggcctcgagctcct

SEQ ID NO: 210015 - DNA, 20 bp, Artificial
  CRISPR gRNA sequence
ggcctcgagctcctgggctc

SEQ ID NO: 210016 - DNA, 20 bp, Artificial
  CRISPR gRNA sequence
ctcaagcaatgctcccacct

SEQ ID NO: 210017 - DNA, 20 bp, Artificial
  CRISPR gRNA sequence
tgctcccacctcagcctccc

SEQ ID NO: 210018 - DNA, 20 bp, Artificial
  CRISPR gRNA sequence
tcccacctcagcctcccaag

SEQ ID NO: 210019 - DNA, 20 bp, Artificial
  CRISPR gRNA sequence
acctcagcctcccaagtagc

SEQ ID NO: 210020 - DNA, 20 bp, Artificial
  CRISPR gRNA sequence
cctcagcctcccaagtagct

SEQ ID NO: 210021 - DNA, 20 bp, Artificial
  CRISPR gRNA sequence
ctcccaagtagctgggacta

SEQ ID NO: 210022 - DNA, 20 bp, Artificial
  CRISPR gRNA sequence
tcccaagtagctgggactac

SEQ ID NO: 210023 - DNA, 20 bp, Artificial
  CRISPR gRNA sequence
caggcatgtgccactacacc

SEQ ID NO: 210024 - DNA, 20 bp, Artificial
  CRISPR gRNA sequence
gcatgtgccactacacctgg

SEQ ID NO: 210025 - DNA, 20 bp, Artificial
  CRISPR gRNA sequence
attctgataaatacatttat

SEQ ID NO: 210026 - DNA, 20 bp, Artificial
  CRISPR gRNA sequence
ctgaacttccatattaccat

SEQ ID NO: 210027 - DNA, 20 bp, Artificial
  CRISPR gRNA sequence
ccatattaccatcagaaatt

SEQ ID NO: 210028 - DNA, 20 bp, Artificial
  CRISPR gRNA sequence
attaccatcagaaatttaga

SEQ ID NO: 210029 - DNA, 20 bp, Artificial
  CRISPR gRNA sequence
cagaaatttagatagttgtt

SEQ ID NO: 210030 - DNA, 20 bp, Artificial
  CRISPR gRNA sequence
tttagttctctttttctttg

SEQ ID NO: 210031 - DNA, 20 bp, Artificial
  CRISPR gRNA sequence
ctctttttctttgtagaaca

SEQ ID NO: 210032 - DNA, 20 bp, Artificial
  CRISPR gRNA sequence
tctttgtagaacatagatat

SEQ ID NO: 210033 - DNA, 20 bp, Artificial
  CRISPR gRNA sequence
ctttgtagaacatagatata

SEQ ID NO: 210034 - DNA, 20 bp, Artificial
  CRISPR gRNA sequence
tagaacatagatataaggca

SEQ ID NO: 210035 - DNA, 20 bp, Artificial
  CRISPR gRNA sequence
tataaggcatggtttcattg

SEQ ID NO: 210036 - DNA, 20 bp, Artificial
  CRISPR gRNA sequence
aggcatggtttcattgaagt

SEQ ID NO: 210037 - DNA, 20 bp, Artificial
  CRISPR gRNA sequence
tatcctgatgttcccaaata

SEQ ID NO: 210038 - DNA, 20 bp, Artificial
  CRISPR gRNA sequence
taaagctctgtatttctgct

SEQ ID NO: 210039 - DNA, 20 bp, Artificial
  CRISPR gRNA sequence
tgtatttctgcttagtttat

SEQ ID NO: 210040 - DNA, 20 bp, Artificial
  CRISPR gRNA sequence
gtatttctgcttagtttatt

SEQ ID NO: 210041 - DNA, 20 bp, Artificial
  CRISPR gRNA sequence
tatttctgcttagtttattg

SEQ ID NO: 210042 - DNA, 20 bp, Artificial
  CRISPR gRNA sequence
tttctgcttagtttattggg

SEQ ID NO: 210043 - DNA, 20 bp, Artificial
  CRISPR gRNA sequence
ttctgcttagtttattgggg

SEQ ID NO: 210044 - DNA, 20 bp, Artificial
  CRISPR gRNA sequence
attggggaggctgctaaatg

SEQ ID NO: 210045 - DNA, 20 bp, Artificial
  CRISPR gRNA sequence
ttaccctgttctactttaaa

SEQ ID NO: 210046 - DNA, 20 bp, Artificial
  CRISPR gRNA sequence
accctgttctactttaaaaa

SEQ ID NO: 210047 - DNA, 20 bp, Artificial
  CRISPR gRNA sequence
ccctgttctactttaaaaag

SEQ ID NO: 210048 - DNA, 20 bp, Artificial
  CRISPR gRNA sequence
gttctactttaaaaagaggt

SEQ ID NO: 210049 - DNA, 20 bp, Artificial
  CRISPR gRNA sequence
aaagaggttggcttcttgtt

SEQ ID NO: 210050 - DNA, 20 bp, Artificial
  CRISPR gRNA sequence
ttggcttcttgtttggatac

SEQ ID NO: 210051 - DNA, 20 bp, Artificial
  CRISPR gRNA sequence
tggcttcttgtttggataca

SEQ ID NO: 210052 - DNA, 20 bp, Artificial
  CRISPR gRNA sequence
cttgtttggatacaaggacc

SEQ ID NO: 210053 - DNA, 20 bp, Artificial
  CRISPR gRNA sequence
caaggaccaagtcactcccc

SEQ ID NO: 210054 - DNA, 20 bp, Artificial
  CRISPR gRNA sequence
aaggaccaagtcactccccc

SEQ ID NO: 210055 - DNA, 20 bp, Artificial
  CRISPR gRNA sequence
cactcccccaggttcctcca

SEQ ID NO: 210056 - DNA, 20 bp, Artificial
  CRISPR gRNA sequence
cccccaggttcctccacagt

SEQ ID NO: 210057 - DNA, 20 bp, Artificial
  CRISPR gRNA sequence
ccccaggttcctccacagta

SEQ ID NO: 210058 - DNA, 20 bp, Artificial
  CRISPR gRNA sequence
cccaggttcctccacagtaa

SEQ ID NO: 210059 - DNA, 20 bp, Artificial
  CRISPR gRNA sequence
caggttcctccacagtaagg

SEQ ID NO: 210060 - DNA, 20 bp, Artificial
  CRISPR gRNA sequence
aggttcctccacagtaaggg

SEQ ID NO: 210061 - DNA, 20 bp, Artificial
  CRISPR gRNA sequence
cagtaagggaggcctattta

SEQ ID NO: 210062 - DNA, 20 bp, Artificial
  CRISPR gRNA sequence
ggcctatttaaagccgccca

SEQ ID NO: 210063 - DNA, 20 bp, Artificial
  CRISPR gRNA sequence
aaagccgcccatggcactaa

SEQ ID NO: 210064 - DNA, 20 bp, Artificial
  CRISPR gRNA sequence
cccatggcactaacagaaac

SEQ ID NO: 210065 - DNA, 20 bp, Artificial
  CRISPR gRNA sequence
aacagaaactggactcctat

SEQ ID NO: 210066 - DNA, 20 bp, Artificial
  CRISPR gRNA sequence
aaactggactcctatgagct

SEQ ID NO: 210067 - DNA, 20 bp, Artificial
  CRISPR gRNA sequence
tatgagctcagatacataac

SEQ ID NO: 210068 - DNA, 20 bp, Artificial
  CRISPR gRNA sequence
atgagctcagatacataact

SEQ ID NO: 210069 - DNA, 20 bp, Artificial
  CRISPR gRNA sequence
agatacataactgggcctca

SEQ ID NO: 210070 - DNA, 20 bp, Artificial
  CRISPR gRNA sequence
gatacataactgggcctcac

SEQ ID NO: 210071 - DNA, 20 bp, Artificial
  CRISPR gRNA sequence
atacataactgggcctcaca

SEQ ID NO: 210072 - DNA, 20 bp, Artificial
  CRISPR gRNA sequence
tacataactgggcctcacag

SEQ ID NO: 210073 - DNA, 20 bp, Artificial
  CRISPR gRNA sequence
ataactgggcctcacagggg

SEQ ID NO: 210074 - DNA, 20 bp, Artificial
  CRISPR gRNA sequence
taactgggcctcacaggggt

SEQ ID NO: 210075 - DNA, 20 bp, Artificial
  CRISPR gRNA sequence
tgggcctcacaggggtggga

SEQ ID NO: 210076 - DNA, 20 bp, Artificial
  CRISPR gRNA sequence
cacaggggtgggacagtatg

SEQ ID NO: 210077 - DNA, 20 bp, Artificial
  CRISPR gRNA sequence
gggtgggacagtatgtagtc

SEQ ID NO: 210078 - DNA, 20 bp, Artificial
  CRISPR gRNA sequence
ggtgggacagtatgtagtct

SEQ ID NO: 210079 - DNA, 20 bp, Artificial
  CRISPR gRNA sequence
acagtatgtagtctaggaat

SEQ ID NO: 210080 - DNA, 20 bp, Artificial
  CRISPR gRNA sequence
gtatgtagtctaggaattgg

SEQ ID NO: 210081 - DNA, 20 bp, Artificial
  CRISPR gRNA sequence
tatgtagtctaggaattgga

SEQ ID NO: 210082 - DNA, 20 bp, Artificial
  CRISPR gRNA sequence
gaaggatccattccatatca

SEQ ID NO: 210083 - DNA, 20 bp, Artificial
  CRISPR gRNA sequence
cattccatatcaaagaactg

SEQ ID NO: 210084 - DNA, 20 bp, Artificial
  CRISPR gRNA sequence
gaagcatcgtgttgccctct

SEQ ID NO: 210085 - DNA, 20 bp, Artificial
  CRISPR gRNA sequence
gcatcgtgttgccctctcag

SEQ ID NO: 210086 - DNA, 20 bp, Artificial
  CRISPR gRNA sequence
cgtgttgccctctcagcagc

SEQ ID NO: 210087 - DNA, 20 bp, Artificial
  CRISPR gRNA sequence
tgttgccctctcagcagcaa

SEQ ID NO: 210088 - DNA, 20 bp, Artificial
  CRISPR gRNA sequence
gccctctcagcagcaagagt

SEQ ID NO: 210089 - DNA, 20 bp, Artificial
  CRISPR gRNA sequence
ccctctcagcagcaagagta

SEQ ID NO: 210090 - DNA, 20 bp, Artificial
  CRISPR gRNA sequence
gagtaaggtgatgcccctgt

SEQ ID NO: 210091 - DNA, 20 bp, Artificial
  CRISPR gRNA sequence
ggtgatgcccctgtcagtta

SEQ ID NO: 210092 - DNA, 20 bp, Artificial
  CRISPR gRNA sequence
ccctgtcagttatagttcct

SEQ ID NO: 210093 - DNA, 20 bp, Artificial
  CRISPR gRNA sequence
gtctttgattctttgcctat

SEQ ID NO: 210094 - DNA, 20 bp, Artificial
  CRISPR gRNA sequence
ttgattctttgcctattagc

SEQ ID NO: 210095 - DNA, 20 bp, Artificial
  CRISPR gRNA sequence
ttctttgcctattagccagc

SEQ ID NO: 210096 - DNA, 20 bp, Artificial
  CRISPR gRNA sequence
atcctattcatgccttctca

SEQ ID NO: 210097 - DNA, 20 bp, Artificial
  CRISPR gRNA sequence
cagacaacttttcttaccta

SEQ ID NO: 210098 - DNA, 20 bp, Artificial
  CRISPR gRNA sequence
acttttcttacctacagctt

SEQ ID NO: 210099 - DNA, 20 bp, Artificial
  CRISPR gRNA sequence
ccttcccatcaccaactttc

SEQ ID NO: 210100 - DNA, 20 bp, Artificial
  CRISPR gRNA sequence
cttcccatcaccaactttct

SEQ ID NO: 210101 - DNA, 20 bp, Artificial
  CRISPR gRNA sequence
ggtttttttctgtttcttct

SEQ ID NO: 210102 - DNA, 20 bp, Artificial
  CRISPR gRNA sequence
tttttttctgtttcttctta

SEQ ID NO: 210103 - DNA, 20 bp, Artificial
  CRISPR gRNA sequence
ttctgtttcttcttagagtc

SEQ ID NO: 210104 - DNA, 20 bp, Artificial
  CRISPR gRNA sequence
tgtttcttcttagagtccag

SEQ ID NO: 210105 - DNA, 20 bp, Artificial
  CRISPR gRNA sequence
ttcttcttagagtccagtgg

SEQ ID NO: 210106 - DNA, 20 bp, Artificial
  CRISPR gRNA sequence
tcttcttagagtccagtggc

SEQ ID NO: 210107 - DNA, 20 bp, Artificial
  CRISPR gRNA sequence
cttcttagagtccagtggca

SEQ ID NO: 210108 - DNA, 20 bp, Artificial
  CRISPR gRNA sequence
tcttagagtccagtggcagg

SEQ ID NO: 210109 - DNA, 20 bp, Artificial
  CRISPR gRNA sequence
agtggcagggagaaacttgt

SEQ ID NO: 210110 - DNA, 20 bp, Artificial
  CRISPR gRNA sequence
cagggagaaacttgtcagtc

SEQ ID NO: 210111 - DNA, 20 bp, Artificial
  CRISPR gRNA sequence
tgttgccatttttcctgttt

SEQ ID NO: 210112 - DNA, 20 bp, Artificial
  CRISPR gRNA sequence
gccatttttcctgtttgaga

SEQ ID NO: 210113 - DNA, 20 bp, Artificial
  CRISPR gRNA sequence
cctgtttgagaaagactcac

SEQ ID NO: 210114 - DNA, 20 bp, Artificial
  CRISPR gRNA sequence
gagaaagactcaccagcttt

SEQ ID NO: 210115 - DNA, 20 bp, Artificial
  CRISPR gRNA sequence
aagactcaccagcttttggc

SEQ ID NO: 210116 - DNA, 20 bp, Artificial
  CRISPR gRNA sequence
accagcttttggctggctca

SEQ ID NO: 210117 - DNA, 20 bp, Artificial
  CRISPR gRNA sequence
cttttggctggctcacagat

SEQ ID NO: 210118 - DNA, 20 bp, Artificial
  CRISPR gRNA sequence
gctcacagattggctttcct

SEQ ID NO: 210119 - DNA, 20 bp, Artificial
  CRISPR gRNA sequence
ctcacagattggctttcctt

SEQ ID NO: 210120 - DNA, 20 bp, Artificial
  CRISPR gRNA sequence
cagattggctttccttgggt

SEQ ID NO: 210121 - DNA, 20 bp, Artificial
  CRISPR gRNA sequence
agattggctttccttgggtc

SEQ ID NO: 210122 - DNA, 20 bp, Artificial
  CRISPR gRNA sequence
ggacccacccttttccctgc

SEQ ID NO: 210123 - DNA, 20 bp, Artificial
  CRISPR gRNA sequence
acccttttccctgccagctt

SEQ ID NO: 210124 - DNA, 20 bp, Artificial
  CRISPR gRNA sequence
cttttccctgccagctttgg

SEQ ID NO: 210125 - DNA, 20 bp, Artificial
  CRISPR gRNA sequence
tgccagctttggaagcttga

SEQ ID NO: 210126 - DNA, 20 bp, Artificial
  CRISPR gRNA sequence
ttggaagcttgacagaattc

SEQ ID NO: 210127 - DNA, 20 bp, Artificial
  CRISPR gRNA sequence
cttgacagaattcgagtgtg

SEQ ID NO: 210128 - DNA, 20 bp, Artificial
  CRISPR gRNA sequence
gacagaattcgagtgtgcag

SEQ ID NO: 210129 - DNA, 20 bp, Artificial
  CRISPR gRNA sequence
agaattcgagtgtgcagtgg

SEQ ID NO: 210130 - DNA, 20 bp, Artificial
  CRISPR gRNA sequence
gtgcagtggtggtaaataaa

SEQ ID NO: 210131 - DNA, 20 bp, Artificial
  CRISPR gRNA sequence
agtggtggtaaataaatagt

SEQ ID NO: 210132 - DNA, 20 bp, Artificial
  CRISPR gRNA sequence
gtggtggtaaataaatagta

SEQ ID NO: 210133 - DNA, 20 bp, Artificial
  CRISPR gRNA sequence
taaataaatagtaaggaaca

SEQ ID NO: 210134 - DNA, 20 bp, Artificial
  CRISPR gRNA sequence
aataaatagtaaggaacaca

SEQ ID NO: 210135 - DNA, 20 bp, Artificial
  CRISPR gRNA sequence
aaatagtaaggaacacagag

SEQ ID NO: 210136 - DNA, 20 bp, Artificial
  CRISPR gRNA sequence
taaggaacacagagcagtcc

SEQ ID NO: 210137 - DNA, 20 bp, Artificial
  CRISPR gRNA sequence
aggaacacagagcagtcctg

SEQ ID NO: 210138 - DNA, 20 bp, Artificial
  CRISPR gRNA sequence
ggaacacagagcagtcctgg

SEQ ID NO: 210139 - DNA, 20 bp, Artificial
  CRISPR gRNA sequence
gcgtgcctccatctgctgat

SEQ ID NO: 210140 - DNA, 20 bp, Artificial
  CRISPR gRNA sequence
catctgctgatgagaaaatc

SEQ ID NO: 210141 - DNA, 20 bp, Artificial
  CRISPR gRNA sequence
gaaaatccagtgctgtcatc

SEQ ID NO: 210142 - DNA, 20 bp, Artificial
  CRISPR gRNA sequence
tccagtgctgtcatccagcc

SEQ ID NO: 210143 - DNA, 20 bp, Artificial
  CRISPR gRNA sequence
ccagtgctgtcatccagccc

SEQ ID NO: 210144 - DNA, 20 bp, Artificial
  CRISPR gRNA sequence
ctgtcatccagcccaggtcc

SEQ ID NO: 210145 - DNA, 20 bp, Artificial
  CRISPR gRNA sequence
tcatccagcccaggtcccag

SEQ ID NO: 210146 - DNA, 20 bp, Artificial
  CRISPR gRNA sequence
cagcccaggtcccagcggaa

SEQ ID NO: 210147 - DNA, 20 bp, Artificial
  CRISPR gRNA sequence
agcccaggtcccagcggaat

SEQ ID NO: 210148 - DNA, 20 bp, Artificial
  CRISPR gRNA sequence
gcggaatgggcctctctgtt

SEQ ID NO: 210149 - DNA, 20 bp, Artificial
  CRISPR gRNA sequence
gaatgggcctctctgttcag

SEQ ID NO: 210150 - DNA, 20 bp, Artificial
  CRISPR gRNA sequence
aatgggcctctctgttcagt

SEQ ID NO: 210151 - DNA, 20 bp, Artificial
  CRISPR gRNA sequence
agtaggatccccctcctgct

SEQ ID NO: 210152 - DNA, 20 bp, Artificial
  CRISPR gRNA sequence
aggatccccctcctgctgag

SEQ ID NO: 210153 - DNA, 20 bp, Artificial
  CRISPR gRNA sequence
ccctcctgctgagtggttca

SEQ ID NO: 210154 - DNA, 20 bp, Artificial
  CRISPR gRNA sequence
gttcaacgcttttccatctg

SEQ ID NO: 210155 - DNA, 20 bp, Artificial
  CRISPR gRNA sequence
ttcaacgcttttccatctgt

SEQ ID NO: 210156 - DNA, 20 bp, Artificial
  CRISPR gRNA sequence
tctgtatttatttgtttttt

SEQ ID NO: 210157 - DNA, 20 bp, Artificial
  CRISPR gRNA sequence
ctgtatttatttgttttttt

SEQ ID NO: 210158 - DNA, 20 bp, Artificial
  CRISPR gRNA sequence
tttgggtttttttatttttt

SEQ ID NO: 210159 - DNA, 20 bp, Artificial
  CRISPR gRNA sequence
ggtttttttattttttgaga

SEQ ID NO: 210160 - DNA, 20 bp, Artificial
  CRISPR gRNA sequence
tttttttattttttgagatg

SEQ ID NO: 210161 - DNA, 20 bp, Artificial
  CRISPR gRNA sequence
tggagtctcgctctgtcgcc

SEQ ID NO: 210162 - DNA, 20 bp, Artificial
  CRISPR gRNA sequence
ggagtctcgctctgtcgccc

SEQ ID NO: 210163 - DNA, 20 bp, Artificial
  CRISPR gRNA sequence
tctcgctctgtcgcccaggc

SEQ ID NO: 210164 - DNA, 20 bp, Artificial
  CRISPR gRNA sequence
tcgctctgtcgcccaggctg

SEQ ID NO: 210165 - DNA, 20 bp, Artificial
  CRISPR gRNA sequence
ctgtcgcccaggctggagtg

SEQ ID NO: 210166 - DNA, 20 bp, Artificial
  CRISPR gRNA sequence
tcgcccaggctggagtgcag

SEQ ID NO: 210167 - DNA, 20 bp, Artificial
  CRISPR gRNA sequence
ggagtgcagtggcacgaccc

SEQ ID NO: 210168 - DNA, 20 bp, Artificial
  CRISPR gRNA sequence
ggcacgaccccagctcgctg

SEQ ID NO: 210169 - DNA, 20 bp, Artificial
  CRISPR gRNA sequence
tcgctgcagcctctgcctcc

SEQ ID NO: 210170 - DNA, 20 bp, Artificial
  CRISPR gRNA sequence
cgctgcagcctctgcctccc

SEQ ID NO: 210171 - DNA, 20 bp, Artificial
  CRISPR gRNA sequence
cagcctctgcctcccaggac

SEQ ID NO: 210172 - DNA, 20 bp, Artificial
  CRISPR gRNA sequence
agcctctgcctcccaggacg

SEQ ID NO: 210173 - DNA, 20 bp, Artificial
  CRISPR gRNA sequence
gcctctgcctcccaggacga

SEQ ID NO: 210174 - DNA, 20 bp, Artificial
  CRISPR gRNA sequence
ctctgcctcccaggacgagg

SEQ ID NO: 210175 - DNA, 20 bp, Artificial
  CRISPR gRNA sequence
cgagggagatcctcccacct

SEQ ID NO: 210176 - DNA, 20 bp, Artificial
  CRISPR gRNA sequence
tcccacctcagccttccacg

SEQ ID NO: 210177 - DNA, 20 bp, Artificial
  CRISPR gRNA sequence
acctcagccttccacgtagc

SEQ ID NO: 210178 - DNA, 20 bp, Artificial
  CRISPR gRNA sequence
cctcagccttccacgtagct

SEQ ID NO: 210179 - DNA, 20 bp, Artificial
  CRISPR gRNA sequence
cttccacgtagctgggacta

SEQ ID NO: 210180 - DNA, 20 bp, Artificial
  CRISPR gRNA sequence
ttccacgtagctgggactac

SEQ ID NO: 210181 - DNA, 20 bp, Artificial
  CRISPR gRNA sequence
gggactacaggcatgcacca

SEQ ID NO: 210182 - DNA, 20 bp, Artificial
  CRISPR gRNA sequence
ggactacaggcatgcaccac

SEQ ID NO: 210183 - DNA, 20 bp, Artificial
  CRISPR gRNA sequence
acaggcatgcaccaccacgc

SEQ ID NO: 210184 - DNA, 20 bp, Artificial
  CRISPR gRNA sequence
ccagctaatttttgtatttt

SEQ ID NO: 210185 - DNA, 20 bp, Artificial
  CRISPR gRNA sequence
gctaatttttgtatttttgg

SEQ ID NO: 210186 - DNA, 20 bp, Artificial
  CRISPR gRNA sequence
taatttttgtatttttggta

SEQ ID NO: 210187 - DNA, 20 bp, Artificial
  CRISPR gRNA sequence
ttttgtatttttggtagaga

SEQ ID NO: 210188 - DNA, 20 bp, Artificial
  CRISPR gRNA sequence
tttgtatttttggtagagac

SEQ ID NO: 210189 - DNA, 20 bp, Artificial
  CRISPR gRNA sequence
ttgtatttttggtagagaca

SEQ ID NO: 210190 - DNA, 20 bp, Artificial
  CRISPR gRNA sequence
cagggttgcatcatgttgcc

SEQ ID NO: 210191 - DNA, 20 bp, Artificial
  CRISPR gRNA sequence
agggttgcatcatgttgccc

SEQ ID NO: 210192 - DNA, 20 bp, Artificial
  CRISPR gRNA sequence
ttgcatcatgttgcccaggc

SEQ ID NO: 210193 - DNA, 20 bp, Artificial
  CRISPR gRNA sequence
caggctggtcttgaatgcct

SEQ ID NO: 210194 - DNA, 20 bp, Artificial
  CRISPR gRNA sequence
ggtcttgaatgcctgagctc

SEQ ID NO: 210195 - DNA, 20 bp, Artificial
  CRISPR gRNA sequence
ctcaagcaatctatttgcct

SEQ ID NO: 210196 - DNA, 20 bp, Artificial
  CRISPR gRNA sequence
ctatttgccttggcctccca

SEQ ID NO: 210197 - DNA, 20 bp, Artificial
  CRISPR gRNA sequence
gccttggcctcccaaagtgc

SEQ ID NO: 210198 - DNA, 20 bp, Artificial
  CRISPR gRNA sequence
ccttggcctcccaaagtgct

SEQ ID NO: 210199 - DNA, 20 bp, Artificial
  CRISPR gRNA sequence
ctcccaaagtgctgggatta

SEQ ID NO: 210200 - DNA, 20 bp, Artificial
  CRISPR gRNA sequence
tcccaaagtgctgggattac

SEQ ID NO: 210201 - DNA, 20 bp, Artificial
  CRISPR gRNA sequence
agtgctgggattacaggcat

SEQ ID NO: 210202 - DNA, 20 bp, Artificial
  CRISPR gRNA sequence
attacaggcatgagccacca

SEQ ID NO: 210203 - DNA, 20 bp, Artificial
  CRISPR gRNA sequence
caggcatgagccaccacggc

SEQ ID NO: 210204 - DNA, 20 bp, Artificial
  CRISPR gRNA sequence
ttctcatttgttttttttat

SEQ ID NO: 210205 - DNA, 20 bp, Artificial
  CRISPR gRNA sequence
tctcatttgttttttttata

SEQ ID NO: 210206 - DNA, 20 bp, Artificial
  CRISPR gRNA sequence
catttgttttttttataagg

SEQ ID NO: 210207 - DNA, 20 bp, Artificial
  CRISPR gRNA sequence
tctcttcttccctccccaac

SEQ ID NO: 210208 - DNA, 20 bp, Artificial
  CRISPR gRNA sequence
ctcttcttccctccccaact

SEQ ID NO: 210209 - DNA, 20 bp, Artificial
  CRISPR gRNA sequence
tcttcttccctccccaacta

SEQ ID NO: 210210 - DNA, 20 bp, Artificial
  CRISPR gRNA sequence
acttcattaatgaatccatt

SEQ ID NO: 210211 - DNA, 20 bp, Artificial
  CRISPR gRNA sequence
tcattaatgaatccatttgg

SEQ ID NO: 210212 - DNA, 20 bp, Artificial
  CRISPR gRNA sequence
ttaatgaatccatttggaag

SEQ ID NO: 210213 - DNA, 20 bp, Artificial
  CRISPR gRNA sequence
tccatttggaagcagtgaaa

SEQ ID NO: 210214 - DNA, 20 bp, Artificial
  CRISPR gRNA sequence
ccatttggaagcagtgaaaa

SEQ ID NO: 210215 - DNA, 20 bp, Artificial
  CRISPR gRNA sequence
aagcagtgaaaaaggcaact

SEQ ID NO: 210216 - DNA, 20 bp, Artificial
  CRISPR gRNA sequence
agtgaaaaaggcaactcaga

SEQ ID NO: 210217 - DNA, 20 bp, Artificial
  CRISPR gRNA sequence
aaaaggcaactcagaaagct

SEQ ID NO: 210218 - DNA, 20 bp, Artificial
  CRISPR gRNA sequence
aggcaactcagaaagctaag

SEQ ID NO: 210219 - DNA, 20 bp, Artificial
  CRISPR gRNA sequence
ctcagaaagctaagaagaaa

SEQ ID NO: 210220 - DNA, 20 bp, Artificial
  CRISPR gRNA sequence
gaaagctaagaagaaataga

SEQ ID NO: 210221 - DNA, 20 bp, Artificial
  CRISPR gRNA sequence
aagctaagaagaaatagata

SEQ ID NO: 210222 - DNA, 20 bp, Artificial
  CRISPR gRNA sequence
agctaagaagaaatagatag

SEQ ID NO: 210223 - DNA, 20 bp, Artificial
  CRISPR gRNA sequence
gaaatagatagaggaatact

SEQ ID NO: 210224 - DNA, 20 bp, Artificial
  CRISPR gRNA sequence
aatagatagaggaatactca

SEQ ID NO: 210225 - DNA, 20 bp, Artificial
  CRISPR gRNA sequence
aggaatactcagagctatct

SEQ ID NO: 210226 - DNA, 20 bp, Artificial
  CRISPR gRNA sequence
agctatctgagtattttctt

SEQ ID NO: 210227 - DNA, 20 bp, Artificial
  CRISPR gRNA sequence
gagtattttctttagtttgt

SEQ ID NO: 210228 - DNA, 20 bp, Artificial
  CRISPR gRNA sequence
tctttagtttgttagctctt

SEQ ID NO: 210229 - DNA, 20 bp, Artificial
  CRISPR gRNA sequence
tttagtttgttagctctttg

SEQ ID NO: 210230 - DNA, 20 bp, Artificial
  CRISPR gRNA sequence
gctctttggagctttgaaac

SEQ ID NO: 210231 - DNA, 20 bp, Artificial
  CRISPR gRNA sequence
tttggagctttgaaactgga

SEQ ID NO: 210232 - DNA, 20 bp, Artificial
  CRISPR gRNA sequence
gctttgaaactggaaagacc

SEQ ID NO: 210233 - DNA, 20 bp, Artificial
  CRISPR gRNA sequence
ctttgaaactggaaagaccc

SEQ ID NO: 210234 - DNA, 20 bp, Artificial
  CRISPR gRNA sequence
tttgaaactggaaagaccca

SEQ ID NO: 210235 - DNA, 20 bp, Artificial
  CRISPR gRNA sequence
tgaaactggaaagacccagg

SEQ ID NO: 210236 - DNA, 20 bp, Artificial
  CRISPR gRNA sequence
gaaagacccagggagtgatg

SEQ ID NO: 210237 - DNA, 20 bp, Artificial
  CRISPR gRNA sequence
aagacccagggagtgatgtg

SEQ ID NO: 210238 - DNA, 20 bp, Artificial
  CRISPR gRNA sequence
cccagggagtgatgtggaga

SEQ ID NO: 210239 - DNA, 20 bp, Artificial
  CRISPR gRNA sequence
cagggagtgatgtggagaaa

SEQ ID NO: 210240 - DNA, 20 bp, Artificial
  CRISPR gRNA sequence
gtgatgtggagaaagagact

SEQ ID NO: 210241 - DNA, 20 bp, Artificial
  CRISPR gRNA sequence
gagaaagagactgagcttgt

SEQ ID NO: 210242 - DNA, 20 bp, Artificial
  CRISPR gRNA sequence
gagactgagcttgtaagaca

SEQ ID NO: 210243 - DNA, 20 bp, Artificial
  CRISPR gRNA sequence
agactgagcttgtaagacac

SEQ ID NO: 210244 - DNA, 20 bp, Artificial
  CRISPR gRNA sequence
actgagcttgtaagacacag

SEQ ID NO: 210245 - DNA, 20 bp, Artificial
  CRISPR gRNA sequence
gagcttgtaagacacaggag

SEQ ID NO: 210246 - DNA, 20 bp, Artificial
  CRISPR gRNA sequence
ttgtaagacacaggagcagt

SEQ ID NO: 210247 - DNA, 20 bp, Artificial
  CRISPR gRNA sequence
agacacaggagcagtgagct

SEQ ID NO: 210248 - DNA, 20 bp, Artificial
  CRISPR gRNA sequence
gacacaggagcagtgagcta

SEQ ID NO: 210249 - DNA, 20 bp, Artificial
  CRISPR gRNA sequence
acacaggagcagtgagctaa

SEQ ID NO: 210250 - DNA, 20 bp, Artificial
  CRISPR gRNA sequence
acaggagcagtgagctaagg

SEQ ID NO: 210251 - DNA, 20 bp, Artificial
  CRISPR gRNA sequence
gagcagtgagctaagggaga

SEQ ID NO: 210252 - DNA, 20 bp, Artificial
  CRISPR gRNA sequence
gcagtgagctaagggagatg

SEQ ID NO: 210253 - DNA, 20 bp, Artificial
  CRISPR gRNA sequence
gtgagctaagggagatggag

SEQ ID NO: 210254 - DNA, 20 bp, Artificial
  CRISPR gRNA sequence
agctaagggagatggagtag

SEQ ID NO: 210255 - DNA, 20 bp, Artificial
  CRISPR gRNA sequence
gctaagggagatggagtagt

SEQ ID NO: 210256 - DNA, 20 bp, Artificial
  CRISPR gRNA sequence
ctaagggagatggagtagtg

SEQ ID NO: 210257 - DNA, 20 bp, Artificial
  CRISPR gRNA sequence
ggagtagtggggacaaattc

SEQ ID NO: 210258 - DNA, 20 bp, Artificial
  CRISPR gRNA sequence
ggcacattctgtctacactc

SEQ ID NO: 210259 - DNA, 20 bp, Artificial
  CRISPR gRNA sequence
gcacattctgtctacactct

SEQ ID NO: 210260 - DNA, 20 bp, Artificial
  CRISPR gRNA sequence
cattctgtctacactctggg

SEQ ID NO: 210261 - DNA, 20 bp, Artificial
  CRISPR gRNA sequence
ctgtctacactctgggtaga

SEQ ID NO: 210262 - DNA, 20 bp, Artificial
  CRISPR gRNA sequence
gtctacactctgggtagata

SEQ ID NO: 210263 - DNA, 20 bp, Artificial
  CRISPR gRNA sequence
tctacactctgggtagatag

SEQ ID NO: 210264 - DNA, 20 bp, Artificial
  CRISPR gRNA sequence
tacactctgggtagatagag

SEQ ID NO: 210265 - DNA, 20 bp, Artificial
  CRISPR gRNA sequence
acactctgggtagatagagg

SEQ ID NO: 210266 - DNA, 20 bp, Artificial
  CRISPR gRNA sequence
cactctgggtagatagagga

SEQ ID NO: 210267 - DNA, 20 bp, Artificial
  CRISPR gRNA sequence
ctctgggtagatagaggagg

SEQ ID NO: 210268 - DNA, 20 bp, Artificial
  CRISPR gRNA sequence
tctgggtagatagaggaggg

SEQ ID NO: 210269 - DNA, 20 bp, Artificial
  CRISPR gRNA sequence
ggtagatagaggagggagga

SEQ ID NO: 210270 - DNA, 20 bp, Artificial
  CRISPR gRNA sequence
tagatagaggagggaggatg

SEQ ID NO: 210271 - DNA, 20 bp, Artificial
  CRISPR gRNA sequence
gagggaggatggagcaccca

SEQ ID NO: 210272 - DNA, 20 bp, Artificial
  CRISPR gRNA sequence
ggaggatggagcacccatgg

SEQ ID NO: 210273 - DNA, 20 bp, Artificial
  CRISPR gRNA sequence
gaggatggagcacccatggt

SEQ ID NO: 210274 - DNA, 20 bp, Artificial
  CRISPR gRNA sequence
aggatggagcacccatggtg

SEQ ID NO: 210275 - DNA, 20 bp, Artificial
  CRISPR gRNA sequence
ggatggagcacccatggtgg

SEQ ID NO: 210276 - DNA, 20 bp, Artificial
  CRISPR gRNA sequence
cacccatggtgggggtatgt

SEQ ID NO: 210277 - DNA, 20 bp, Artificial
  CRISPR gRNA sequence
tggtgggggtatgttggtga

SEQ ID NO: 210278 - DNA, 20 bp, Artificial
  CRISPR gRNA sequence
tggtgacagcattttcccac

SEQ ID NO: 210279 - DNA, 20 bp, Artificial
  CRISPR gRNA sequence
gacagcattttcccaccagc

SEQ ID NO: 210280 - DNA, 20 bp, Artificial
  CRISPR gRNA sequence
ttcccaccagccagtgtaac

SEQ ID NO: 210281 - DNA, 20 bp, Artificial
  CRISPR gRNA sequence
ccaccagccagtgtaacaag

SEQ ID NO: 210282 - DNA, 20 bp, Artificial
  CRISPR gRNA sequence
agtgtaacaagtggctgatt

SEQ ID NO: 210283 - DNA, 20 bp, Artificial
  CRISPR gRNA sequence
gtgtaacaagtggctgattt

SEQ ID NO: 210284 - DNA, 20 bp, Artificial
  CRISPR gRNA sequence
tgtaacaagtggctgatttg

SEQ ID NO: 210285 - DNA, 20 bp, Artificial
  CRISPR gRNA sequence
gtaacaagtggctgatttgg

SEQ ID NO: 210286 - DNA, 20 bp, Artificial
  CRISPR gRNA sequence
caagtggctgatttggggga

SEQ ID NO: 210287 - DNA, 20 bp, Artificial
  CRISPR gRNA sequence
tggctgatttgggggaaaga

SEQ ID NO: 210288 - DNA, 20 bp, Artificial
  CRISPR gRNA sequence
gaaagatggcataaacaaat

SEQ ID NO: 210289 - DNA, 20 bp, Artificial
  CRISPR gRNA sequence
aagatggcataaacaaatga

SEQ ID NO: 210290 - DNA, 20 bp, Artificial
  CRISPR gRNA sequence
aatgtgtttactatttgatg

SEQ ID NO: 210291 - DNA, 20 bp, Artificial
  CRISPR gRNA sequence
tgtttactatttgatgtaga

SEQ ID NO: 210292 - DNA, 20 bp, Artificial
  CRISPR gRNA sequence
gtttactatttgatgtagat

SEQ ID NO: 210293 - DNA, 20 bp, Artificial
  CRISPR gRNA sequence
atttgcttcatttttcaaat

SEQ ID NO: 210294 - DNA, 20 bp, Artificial
  CRISPR gRNA sequence
tcaaatcagtgtatataatc

SEQ ID NO: 210295 - DNA, 20 bp, Artificial
  CRISPR gRNA sequence
tgtatataatcaagaatatt

SEQ ID NO: 210296 - DNA, 20 bp, Artificial
  CRISPR gRNA sequence
gaatattcagcatgtttgaa

SEQ ID NO: 210297 - DNA, 20 bp, Artificial
  CRISPR gRNA sequence
agcatgtttgaatagactgt

SEQ ID NO: 210298 - DNA, 20 bp, Artificial
  CRISPR gRNA sequence
catgtttgaatagactgtca

SEQ ID NO: 210299 - DNA, 20 bp, Artificial
  CRISPR gRNA sequence
tttgaatagactgtcagagc

SEQ ID NO: 210300 - DNA, 20 bp, Artificial
  CRISPR gRNA sequence
aactctttcattaacatctc

SEQ ID NO: 210301 - DNA, 20 bp, Artificial
  CRISPR gRNA sequence
attaacatctctggcacctt

SEQ ID NO: 210302 - DNA, 20 bp, Artificial
  CRISPR gRNA sequence
atctctggcacctttagttt

SEQ ID NO: 210303 - DNA, 20 bp, Artificial
  CRISPR gRNA sequence
ttaaacattaccaaatgcct

SEQ ID NO: 210304 - DNA, 20 bp, Artificial
  CRISPR gRNA sequence
ttcttatttgttatttatat

SEQ ID NO: 210305 - DNA, 20 bp, Artificial
  CRISPR gRNA sequence
tatttatatcagcttccaat

SEQ ID NO: 210306 - DNA, 20 bp, Artificial
  CRISPR gRNA sequence
ttatatcagcttccaatcag

SEQ ID NO: 210307 - DNA, 20 bp, Artificial
  CRISPR gRNA sequence
cagaagactatacaacctcc

SEQ ID NO: 210308 - DNA, 20 bp, Artificial
  CRISPR gRNA sequence
agaagactatacaacctcct

SEQ ID NO: 210309 - DNA, 20 bp, Artificial
  CRISPR gRNA sequence
gaagactatacaacctccta

SEQ ID NO: 210310 - DNA, 20 bp, Artificial
  CRISPR gRNA sequence
actatacaacctcctagggt

SEQ ID NO: 210311 - DNA, 20 bp, Artificial
  CRISPR gRNA sequence
caacctcctagggtaagtta

SEQ ID NO: 210312 - DNA, 20 bp, Artificial
  CRISPR gRNA sequence
tgaattgtgaatgatcattt

SEQ ID NO: 210313 - DNA, 20 bp, Artificial
  CRISPR gRNA sequence
gaattgtgaatgatcatttg

SEQ ID NO: 210314 - DNA, 20 bp, Artificial
  CRISPR gRNA sequence
aattgtgaatgatcatttga

SEQ ID NO: 210315 - DNA, 20 bp, Artificial
  CRISPR gRNA sequence
tgaatgatcatttgagggat

SEQ ID NO: 210316 - DNA, 20 bp, Artificial
  CRISPR gRNA sequence
atcatttgagggattagact

SEQ ID NO: 210317 - DNA, 20 bp, Artificial
  CRISPR gRNA sequence
tcatttgagggattagactg

SEQ ID NO: 210318 - DNA, 20 bp, Artificial
  CRISPR gRNA sequence
agggattagactgaggaact

SEQ ID NO: 210319 - DNA, 20 bp, Artificial
  CRISPR gRNA sequence
gactgaggaacttggtaatt

SEQ ID NO: 210320 - DNA, 20 bp, Artificial
  CRISPR gRNA sequence
gttttgtctcacgtcaaatt

SEQ ID NO: 210321 - DNA, 20 bp, Artificial
  CRISPR gRNA sequence
tttgtctcacgtcaaattaa

SEQ ID NO: 210322 - DNA, 20 bp, Artificial
  CRISPR gRNA sequence
gtcaaattaagagaatgttg

SEQ ID NO: 210323 - DNA, 20 bp, Artificial
  CRISPR gRNA sequence
ttgcatgacctttgcatgaa

SEQ ID NO: 210324 - DNA, 20 bp, Artificial
  CRISPR gRNA sequence
tgcatgacctttgcatgaat

SEQ ID NO: 210325 - DNA, 20 bp, Artificial
  CRISPR gRNA sequence
gacctttgcatgaatgggtc

SEQ ID NO: 210326 - DNA, 20 bp, Artificial
  CRISPR gRNA sequence
tctattttaaaacctgtgtt

SEQ ID NO: 210327 - DNA, 20 bp, Artificial
  CRISPR gRNA sequence
aaacctgtgtttggtcattt

SEQ ID NO: 210328 - DNA, 20 bp, Artificial
  CRISPR gRNA sequence
tttggtcattttagtgtcaa

SEQ ID NO: 210329 - DNA, 20 bp, Artificial
  CRISPR gRNA sequence
ttggtcattttagtgtcaat

SEQ ID NO: 210330 - DNA, 20 bp, Artificial
  CRISPR gRNA sequence
tcattttagtgtcaatggga

SEQ ID NO: 210331 - DNA, 20 bp, Artificial
  CRISPR gRNA sequence
gatggaataaatgatttctt

SEQ ID NO: 210332 - DNA, 20 bp, Artificial
  CRISPR gRNA sequence
tgacttctcacacccaaaac

SEQ ID NO: 210333 - DNA, 20 bp, Artificial
  CRISPR gRNA sequence
ttctcacacccaaaactgga

SEQ ID NO: 210334 - DNA, 20 bp, Artificial
  CRISPR gRNA sequence
tcacacccaaaactggaaag

SEQ ID NO: 210335 - DNA, 20 bp, Artificial
  CRISPR gRNA sequence
cacacccaaaactggaaagt

SEQ ID NO: 210336 - DNA, 20 bp, Artificial
  CRISPR gRNA sequence
aaactggaaagtaggaataa

SEQ ID NO: 210337 - DNA, 20 bp, Artificial
  CRISPR gRNA sequence
ggctatattatctctgcaat

SEQ ID NO: 210338 - DNA, 20 bp, Artificial
  CRISPR gRNA sequence
tatattatctctgcaatcag

SEQ ID NO: 210339 - DNA, 20 bp, Artificial
  CRISPR gRNA sequence
atattatctctgcaatcaga

SEQ ID NO: 210340 - DNA, 20 bp, Artificial
  CRISPR gRNA sequence
ttatctctgcaatcagaagg

SEQ ID NO: 210341 - DNA, 20 bp, Artificial
  CRISPR gRNA sequence
caatatatcacctcacctgt

SEQ ID NO: 210342 - DNA, 20 bp, Artificial
  CRISPR gRNA sequence
acctcacctgttggattcat

SEQ ID NO: 210343 - DNA, 20 bp, Artificial
  CRISPR gRNA sequence
attcattggatgtgcataca

SEQ ID NO: 210344 - DNA, 20 bp, Artificial
  CRISPR gRNA sequence
catacacagaatgacaattt

SEQ ID NO: 210345 - DNA, 20 bp, Artificial
  CRISPR gRNA sequence
atacacagaatgacaatttc

SEQ ID NO: 210346 - DNA, 20 bp, Artificial
  CRISPR gRNA sequence
acaatttcaggcttaaaaat

SEQ ID NO: 210347 - DNA, 20 bp, Artificial
  CRISPR gRNA sequence
caatttcaggcttaaaaatg

SEQ ID NO: 210348 - DNA, 20 bp, Artificial
  CRISPR gRNA sequence
atttcaggcttaaaaatgag

SEQ ID NO: 210349 - DNA, 20 bp, Artificial
  CRISPR gRNA sequence
aatgaggagaaatctatact

SEQ ID NO: 210350 - DNA, 20 bp, Artificial
  CRISPR gRNA sequence
tattgctgaaaacatctgtt

SEQ ID NO: 210351 - DNA, 20 bp, Artificial
  CRISPR gRNA sequence
ttgctgaaaacatctgttcg

SEQ ID NO: 210352 - DNA, 20 bp, Artificial
  CRISPR gRNA sequence
tttcccttaaaactgtgctt

SEQ ID NO: 210353 - DNA, 20 bp, Artificial
  CRISPR gRNA sequence
ttcccttaaaactgtgctta

SEQ ID NO: 210354 - DNA, 20 bp, Artificial
  CRISPR gRNA sequence
cttaaggtttcattgtacct

SEQ ID NO: 210355 - DNA, 20 bp, Artificial
  CRISPR gRNA sequence
tgtaccttagataccttatt

SEQ ID NO: 210356 - DNA, 20 bp, Artificial
  CRISPR gRNA sequence
gataccttattaagccatct

SEQ ID NO: 210357 - DNA, 20 bp, Artificial
  CRISPR gRNA sequence
ataccttattaagccatctg

SEQ ID NO: 210358 - DNA, 20 bp, Artificial
  CRISPR gRNA sequence
aagccatctgaggaaattgc

SEQ ID NO: 210359 - DNA, 20 bp, Artificial
  CRISPR gRNA sequence
catctgaggaaattgcaaga

SEQ ID NO: 210360 - DNA, 20 bp, Artificial
  CRISPR gRNA sequence
atctgaggaaattgcaagaa

SEQ ID NO: 210361 - DNA, 20 bp, Artificial
  CRISPR gRNA sequence
ctgaggaaattgcaagaaag

SEQ ID NO: 210362 - DNA, 20 bp, Artificial
  CRISPR gRNA sequence
ttgcaagaaaggagtaattt

SEQ ID NO: 210363 - DNA, 20 bp, Artificial
  CRISPR gRNA sequence
tgcaagaaaggagtaatttt

SEQ ID NO: 210364 - DNA, 20 bp, Artificial
  CRISPR gRNA sequence
caagaaaggagtaattttag

SEQ ID NO: 210365 - DNA, 20 bp, Artificial
  CRISPR gRNA sequence
aagaaaggagtaattttagg

SEQ ID NO: 210366 - DNA, 20 bp, Artificial
  CRISPR gRNA sequence
agaaaggagtaattttagga

SEQ ID NO: 210367 - DNA, 20 bp, Artificial
  CRISPR gRNA sequence
attttaggagggcataaatg

SEQ ID NO: 210368 - DNA, 20 bp, Artificial
  CRISPR gRNA sequence
tttaggagggcataaatgaa

SEQ ID NO: 210369 - DNA, 20 bp, Artificial
  CRISPR gRNA sequence
gagggcataaatgaagagaa

SEQ ID NO: 210370 - DNA, 20 bp, Artificial
  CRISPR gRNA sequence
gaaaagcatatttataaaca

SEQ ID NO: 210371 - DNA, 20 bp, Artificial
  CRISPR gRNA sequence
ttataaacatagacttatca

SEQ ID NO: 210372 - DNA, 20 bp, Artificial
  CRISPR gRNA sequence
acatagacttatcacagtga

SEQ ID NO: 210373 - DNA, 20 bp, Artificial
  CRISPR gRNA sequence
catagacttatcacagtgac

SEQ ID NO: 210374 - DNA, 20 bp, Artificial
  CRISPR gRNA sequence
cttatcacagtgacaggccc

SEQ ID NO: 210375 - DNA, 20 bp, Artificial
  CRISPR gRNA sequence
tatcacagtgacaggcccaa

SEQ ID NO: 210376 - DNA, 20 bp, Artificial
  CRISPR gRNA sequence
atcacagtgacaggcccaag

SEQ ID NO: 210377 - DNA, 20 bp, Artificial
  CRISPR gRNA sequence
caggcccaagaggtatgttg

SEQ ID NO: 210378 - DNA, 20 bp, Artificial
  CRISPR gRNA sequence
aagaggtatgttgtggacat

SEQ ID NO: 210379 - DNA, 20 bp, Artificial
  CRISPR gRNA sequence
tatgttgtggacataagctc

SEQ ID NO: 210380 - DNA, 20 bp, Artificial
  CRISPR gRNA sequence
ttgtggacataagctctgga

SEQ ID NO: 210381 - DNA, 20 bp, Artificial
  CRISPR gRNA sequence
tgtggacataagctctggaa

SEQ ID NO: 210382 - DNA, 20 bp, Artificial
  CRISPR gRNA sequence
ggaaaggattatattgtact

SEQ ID NO: 210383 - DNA, 20 bp, Artificial
  CRISPR gRNA sequence
ttgtacttagcttcctataa

SEQ ID NO: 210384 - DNA, 20 bp, Artificial
  CRISPR gRNA sequence
gtacttagcttcctataacg

SEQ ID NO: 210385 - DNA, 20 bp, Artificial
  CRISPR gRNA sequence
ttcctataacggagtgatga

SEQ ID NO: 210386 - DNA, 20 bp, Artificial
  CRISPR gRNA sequence
ggagtgatgatagatgtatc

SEQ ID NO: 210387 - DNA, 20 bp, Artificial
  CRISPR gRNA sequence
tagatgtatctggaatgcca

SEQ ID NO: 210388 - DNA, 20 bp, Artificial
  CRISPR gRNA sequence
gatgtatctggaatgccaaa

SEQ ID NO: 210389 - DNA, 20 bp, Artificial
  CRISPR gRNA sequence
tgtatctggaatgccaaaga

SEQ ID NO: 210390 - DNA, 20 bp, Artificial
  CRISPR gRNA sequence
caaagagagtcttctgtctg

SEQ ID NO: 210391 - DNA, 20 bp, Artificial
  CRISPR gRNA sequence
gagagtcttctgtctgtggc

SEQ ID NO: 210392 - DNA, 20 bp, Artificial
  CRISPR gRNA sequence
gagtcttctgtctgtggccg

SEQ ID NO: 210393 - DNA, 20 bp, Artificial
  CRISPR gRNA sequence
agtcttctgtctgtggccgg

SEQ ID NO: 210394 - DNA, 20 bp, Artificial
  CRISPR gRNA sequence
cttctgtctgtggccggagg

SEQ ID NO: 210395 - DNA, 20 bp, Artificial
  CRISPR gRNA sequence
tctgtctgtggccggaggta

SEQ ID NO: 210396 - DNA, 20 bp, Artificial
  CRISPR gRNA sequence
ctgtctgtggccggaggtag

SEQ ID NO: 210397 - DNA, 20 bp, Artificial
  CRISPR gRNA sequence
tagaggtcacatatgcttct

SEQ ID NO: 210398 - DNA, 20 bp, Artificial
  CRISPR gRNA sequence
catatgcttctaagtctgac

SEQ ID NO: 210399 - DNA, 20 bp, Artificial
  CRISPR gRNA sequence
gacaagcctcattgtgccta

SEQ ID NO: 210400 - DNA, 20 bp, Artificial
  CRISPR gRNA sequence
acaagcctcattgtgcctaa

SEQ ID NO: 210401 - DNA, 20 bp, Artificial
  CRISPR gRNA sequence
caagcctcattgtgcctaaa

SEQ ID NO: 210402 - DNA, 20 bp, Artificial
  CRISPR gRNA sequence
gcctcattgtgcctaaaggg

SEQ ID NO: 210403 - DNA, 20 bp, Artificial
  CRISPR gRNA sequence
cctcattgtgcctaaagggc

SEQ ID NO: 210404 - DNA, 20 bp, Artificial
  CRISPR gRNA sequence
cattgtgcctaaagggcagg

SEQ ID NO: 210405 - DNA, 20 bp, Artificial
  CRISPR gRNA sequence
attgtgcctaaagggcaggt

SEQ ID NO: 210406 - DNA, 20 bp, Artificial
  CRISPR gRNA sequence
ttgtgcctaaagggcaggtg

SEQ ID NO: 210407 - DNA, 20 bp, Artificial
  CRISPR gRNA sequence
tgcctaaagggcaggtgggg

SEQ ID NO: 210408 - DNA, 20 bp, Artificial
  CRISPR gRNA sequence
gcctaaagggcaggtggggc

SEQ ID NO: 210409 - DNA, 20 bp, Artificial
  CRISPR gRNA sequence
gcgggtatgtgtgtctacca

SEQ ID NO: 210410 - DNA, 20 bp, Artificial
  CRISPR gRNA sequence
cgggtatgtgtgtctaccac

SEQ ID NO: 210411 - DNA, 20 bp, Artificial
  CRISPR gRNA sequence
gggtatgtgtgtctaccaca

SEQ ID NO: 210412 - DNA, 20 bp, Artificial
  CRISPR gRNA sequence
ggtatgtgtgtctaccacag

SEQ ID NO: 210413 - DNA, 20 bp, Artificial
  CRISPR gRNA sequence
tctaccacaggggtatattc

SEQ ID NO: 210414 - DNA, 20 bp, Artificial
  CRISPR gRNA sequence
ccacaggggtatattctaga

SEQ ID NO: 210415 - DNA, 20 bp, Artificial
  CRISPR gRNA sequence
ggggtatattctagaaagat

SEQ ID NO: 210416 - DNA, 20 bp, Artificial
  CRISPR gRNA sequence
ttctagaaagattggtgcca

SEQ ID NO: 210417 - DNA, 20 bp, Artificial
  CRISPR gRNA sequence
gattggtgccatagctatgt

SEQ ID NO: 210418 - DNA, 20 bp, Artificial
  CRISPR gRNA sequence
gccatagctatgttggtcac

SEQ ID NO: 210419 - DNA, 20 bp, Artificial
  CRISPR gRNA sequence
catagctatgttggtcacaa

SEQ ID NO: 210420 - DNA, 20 bp, Artificial
  CRISPR gRNA sequence
atagctatgttggtcacaag

SEQ ID NO: 210421 - DNA, 20 bp, Artificial
  CRISPR gRNA sequence
ctatgttggtcacaagaggc

SEQ ID NO: 210422 - DNA, 20 bp, Artificial
  CRISPR gRNA sequence
caagaggccagcaacttaac

SEQ ID NO: 210423 - DNA, 20 bp, Artificial
  CRISPR gRNA sequence
tcctaacacattttctttcc

SEQ ID NO: 210424 - DNA, 20 bp, Artificial
  CRISPR gRNA sequence
cattttctttcccagttact

SEQ ID NO: 210425 - DNA, 20 bp, Artificial
  CRISPR gRNA sequence
agttcaatttgcgatactta

SEQ ID NO: 210426 - DNA, 20 bp, Artificial
  CRISPR gRNA sequence
tgcttgcactttcatatttt

SEQ ID NO: 210427 - DNA, 20 bp, Artificial
  CRISPR gRNA sequence
ttgcactttcatatttttag

SEQ ID NO: 210428 - DNA, 20 bp, Artificial
  CRISPR gRNA sequence
actttcatatttttagaagt

SEQ ID NO: 210429 - DNA, 20 bp, Artificial
  CRISPR gRNA sequence
tttagaagttagaatttctt

SEQ ID NO: 210430 - DNA, 20 bp, Artificial
  CRISPR gRNA sequence
aagttagaatttcttgagct

SEQ ID NO: 210431 - DNA, 20 bp, Artificial
  CRISPR gRNA sequence
gttagaatttcttgagctga

SEQ ID NO: 210432 - DNA, 20 bp, Artificial
  CRISPR gRNA sequence
agaatttcttgagctgagag

SEQ ID NO: 210433 - DNA, 20 bp, Artificial
  CRISPR gRNA sequence
ttcttgagctgagagtggtg

SEQ ID NO: 210434 - DNA, 20 bp, Artificial
  CRISPR gRNA sequence
ttgagctgagagtggtgaag

SEQ ID NO: 210435 - DNA, 20 bp, Artificial
  CRISPR gRNA sequence
tgagctgagagtggtgaagt

SEQ ID NO: 210436 - DNA, 20 bp, Artificial
  CRISPR gRNA sequence
gtgaagtgggaaattctgtt

SEQ ID NO: 210437 - DNA, 20 bp, Artificial
  CRISPR gRNA sequence
ctgtttagaaaaataatatt

SEQ ID NO: 210438 - DNA, 20 bp, Artificial
  CRISPR gRNA sequence
gtttagaaaaataatattaa

SEQ ID NO: 210439 - DNA, 20 bp, Artificial
  CRISPR gRNA sequence
ataatattaagagaataata

SEQ ID NO: 210440 - DNA, 20 bp, Artificial
  CRISPR gRNA sequence
attaaactattaacccgact

SEQ ID NO: 210441 - DNA, 20 bp, Artificial
  CRISPR gRNA sequence
aactattaacccgacttggc

SEQ ID NO: 210442 - DNA, 20 bp, Artificial
  CRISPR gRNA sequence
aagctttgctttaacattta

SEQ ID NO: 210443 - DNA, 20 bp, Artificial
  CRISPR gRNA sequence
agctttgctttaacatttac

SEQ ID NO: 210444 - DNA, 20 bp, Artificial
  CRISPR gRNA sequence
ttttcttttttttttgactg

SEQ ID NO: 210445 - DNA, 20 bp, Artificial
  CRISPR gRNA sequence
tttcttttttttttgactgt

SEQ ID NO: 210446 - DNA, 20 bp, Artificial
  CRISPR gRNA sequence
ttactacgtaatttaaatat

SEQ ID NO: 210447 - DNA, 20 bp, Artificial
  CRISPR gRNA sequence
atttaaatattagcatatat

SEQ ID NO: 210448 - DNA, 20 bp, Artificial
  CRISPR gRNA sequence
aatatattttaaatattttt

SEQ ID NO: 210449 - DNA, 20 bp, Artificial
  CRISPR gRNA sequence
tattttaaatatttttcaga

SEQ ID NO: 210450 - DNA, 20 bp, Artificial
  CRISPR gRNA sequence
aaatatttttcagaaagctg

SEQ ID NO: 210451 - DNA, 20 bp, Artificial
  CRISPR gRNA sequence
atatttttcagaaagctgta

SEQ ID NO: 210452 - DNA, 20 bp, Artificial
  CRISPR gRNA sequence
tatttttcagaaagctgtag

SEQ ID NO: 210453 - DNA, 20 bp, Artificial
  CRISPR gRNA sequence
gctgtagaggaaccccttaa

SEQ ID NO: 210454 - DNA, 20 bp, Artificial
  CRISPR gRNA sequence
aggaaccccttaatggtatg

SEQ ID NO: 210455 - DNA, 20 bp, Artificial
  CRISPR gRNA sequence
tttcactcttaatcctttac

SEQ ID NO: 210456 - DNA, 20 bp, Artificial
  CRISPR gRNA sequence
taccagatcataatttgatc

SEQ ID NO: 210457 - DNA, 20 bp, Artificial
  CRISPR gRNA sequence
atttgatctggcccgcaaaa

SEQ ID NO: 210458 - DNA, 20 bp, Artificial
  CRISPR gRNA sequence
gatctggcccgcaaaacagt

SEQ ID NO: 210459 - DNA, 20 bp, Artificial
  CRISPR gRNA sequence
agaatgccctgtctatgcct

SEQ ID NO: 210460 - DNA, 20 bp, Artificial
  CRISPR gRNA sequence
gaatgccctgtctatgcctt

SEQ ID NO: 210461 - DNA, 20 bp, Artificial
  CRISPR gRNA sequence
tgccctgtctatgccttagg

SEQ ID NO: 210462 - DNA, 20 bp, Artificial
  CRISPR gRNA sequence
tctatgccttaggaagaatc

SEQ ID NO: 210463 - DNA, 20 bp, Artificial
  CRISPR gRNA sequence
ctatgccttaggaagaatct

SEQ ID NO: 210464 - DNA, 20 bp, Artificial
  CRISPR gRNA sequence
ttcctctttttttctttcct

SEQ ID NO: 210465 - DNA, 20 bp, Artificial
  CRISPR gRNA sequence
tctactcttgattattcatc

SEQ ID NO: 210466 - DNA, 20 bp, Artificial
  CRISPR gRNA sequence
tgattattcatcaagaatta

SEQ ID NO: 210467 - DNA, 20 bp, Artificial
  CRISPR gRNA sequence
gattattcatcaagaattat

SEQ ID NO: 210468 - DNA, 20 bp, Artificial
  CRISPR gRNA sequence
attcatcaagaattatgggc

SEQ ID NO: 210469 - DNA, 20 bp, Artificial
  CRISPR gRNA sequence
ttcatcaagaattatgggct

SEQ ID NO: 210470 - DNA, 20 bp, Artificial
  CRISPR gRNA sequence
caagaattatgggctgggtg

SEQ ID NO: 210471 - DNA, 20 bp, Artificial
  CRISPR gRNA sequence
gaattatgggctgggtgcgg

SEQ ID NO: 210472 - DNA, 20 bp, Artificial
  CRISPR gRNA sequence
gtggctcacgcttgcgatcc

SEQ ID NO: 210473 - DNA, 20 bp, Artificial
  CRISPR gRNA sequence
cgcttgcgatcccggcacct

SEQ ID NO: 210474 - DNA, 20 bp, Artificial
  CRISPR gRNA sequence
gcttgcgatcccggcacctt

SEQ ID NO: 210475 - DNA, 20 bp, Artificial
  CRISPR gRNA sequence
ttgcgatcccggcaccttgg

SEQ ID NO: 210476 - DNA, 20 bp, Artificial
  CRISPR gRNA sequence
tgcgatcccggcaccttggg

SEQ ID NO: 210477 - DNA, 20 bp, Artificial
  CRISPR gRNA sequence
tcccggcaccttgggaggcc

SEQ ID NO: 210478 - DNA, 20 bp, Artificial
  CRISPR gRNA sequence
cccggcaccttgggaggcca

SEQ ID NO: 210479 - DNA, 20 bp, Artificial
  CRISPR gRNA sequence
ggcaccttgggaggccaagg

SEQ ID NO: 210480 - DNA, 20 bp, Artificial
  CRISPR gRNA sequence
gcaccttgggaggccaaggc

SEQ ID NO: 210481 - DNA, 20 bp, Artificial
  CRISPR gRNA sequence
ccttgggaggccaaggcggg

SEQ ID NO: 210482 - DNA, 20 bp, Artificial
  CRISPR gRNA sequence
ggccaaggcgggcagatcac

SEQ ID NO: 210483 - DNA, 20 bp, Artificial
  CRISPR gRNA sequence
gccaaggcgggcagatcacg

SEQ ID NO: 210484 - DNA, 20 bp, Artificial
  CRISPR gRNA sequence
ggcgggcagatcacgaggtc

SEQ ID NO: 210485 - DNA, 20 bp, Artificial
  CRISPR gRNA sequence
cgggcagatcacgaggtcaa

SEQ ID NO: 210486 - DNA, 20 bp, Artificial
  CRISPR gRNA sequence
gatcacgaggtcaagagatt

SEQ ID NO: 210487 - DNA, 20 bp, Artificial
  CRISPR gRNA sequence
tcaagagattgagaccatcc

SEQ ID NO: 210488 - DNA, 20 bp, Artificial
  CRISPR gRNA sequence
ctgaaaatacaaaaattacc

SEQ ID NO: 210489 - DNA, 20 bp, Artificial
  CRISPR gRNA sequence
tgaaaatacaaaaattacct

SEQ ID NO: 210490 - DNA, 20 bp, Artificial
  CRISPR gRNA sequence
atacaaaaattacctgggca

SEQ ID NO: 210491 - DNA, 20 bp, Artificial
  CRISPR gRNA sequence
caaaaattacctgggcatgg

SEQ ID NO: 210492 - DNA, 20 bp, Artificial
  CRISPR gRNA sequence
ggcatggtggtgtgtatctg

SEQ ID NO: 210493 - DNA, 20 bp, Artificial
  CRISPR gRNA sequence
gtggtgtgtatctgcagtcc

SEQ ID NO: 210494 - DNA, 20 bp, Artificial
  CRISPR gRNA sequence
tatctgcagtcccagctact

SEQ ID NO: 210495 - DNA, 20 bp, Artificial
  CRISPR gRNA sequence
atctgcagtcccagctactc

SEQ ID NO: 210496 - DNA, 20 bp, Artificial
  CRISPR gRNA sequence
ctgcagtcccagctactcgg

SEQ ID NO: 210497 - DNA, 20 bp, Artificial
  CRISPR gRNA sequence
tgcagtcccagctactcggg

SEQ ID NO: 210498 - DNA, 20 bp, Artificial
  CRISPR gRNA sequence
tcccagctactcgggaggct

SEQ ID NO: 210499 - DNA, 20 bp, Artificial
  CRISPR gRNA sequence
cccagctactcgggaggctg

SEQ ID NO: 210500 - DNA, 20 bp, Artificial
  CRISPR gRNA sequence
agctactcgggaggctgagg

SEQ ID NO: 210501 - DNA, 20 bp, Artificial
  CRISPR gRNA sequence
gctactcgggaggctgaggc

SEQ ID NO: 210502 - DNA, 20 bp, Artificial
  CRISPR gRNA sequence
tactcgggaggctgaggcag

SEQ ID NO: 210503 - DNA, 20 bp, Artificial
  CRISPR gRNA sequence
gcaggagaattgcttgaacc

SEQ ID NO: 210504 - DNA, 20 bp, Artificial
  CRISPR gRNA sequence
ggagaattgcttgaacccgg

SEQ ID NO: 210505 - DNA, 20 bp, Artificial
  CRISPR gRNA sequence
gagaattgcttgaacccgga

SEQ ID NO: 210506 - DNA, 20 bp, Artificial
  CRISPR gRNA sequence
aattgcttgaacccggaagg

SEQ ID NO: 210507 - DNA, 20 bp, Artificial
  CRISPR gRNA sequence
aacccggaaggcagatgttg

SEQ ID NO: 210508 - DNA, 20 bp, Artificial
  CRISPR gRNA sequence
cggaaggcagatgttgcagt

SEQ ID NO: 210509 - DNA, 20 bp, Artificial
  CRISPR gRNA sequence
ggcagatgttgcagtgagtt

SEQ ID NO: 210510 - DNA, 20 bp, Artificial
  CRISPR gRNA sequence
gagatcatgccaccgcactc

SEQ ID NO: 210511 - DNA, 20 bp, Artificial
  CRISPR gRNA sequence
catgccaccgcactccagcc

SEQ ID NO: 210512 - DNA, 20 bp, Artificial
  CRISPR gRNA sequence
accgcactccagcctggtga

SEQ ID NO: 210513 - DNA, 20 bp, Artificial
  CRISPR gRNA sequence
cgcactccagcctggtgaca

SEQ ID NO: 210514 - DNA, 20 bp, Artificial
  CRISPR gRNA sequence
ctccagcctggtgacagagt

SEQ ID NO: 210515 - DNA, 20 bp, Artificial
  CRISPR gRNA sequence
ctgtctcaaaaaaaataaaa

SEQ ID NO: 210516 - DNA, 20 bp, Artificial
  CRISPR gRNA sequence
ttttataatattctcaccac

SEQ ID NO: 210517 - DNA, 20 bp, Artificial
  CRISPR gRNA sequence
tttataatattctcaccact

SEQ ID NO: 210518 - DNA, 20 bp, Artificial
  CRISPR gRNA sequence
aaatgcactattctgtgtct

SEQ ID NO: 210519 - DNA, 20 bp, Artificial
  CRISPR gRNA sequence
tgcactattctgtgtctaag

SEQ ID NO: 210520 - DNA, 20 bp, Artificial
  CRISPR gRNA sequence
agtagctgcttaccttaacc

SEQ ID NO: 210521 - DNA, 20 bp, Artificial
  CRISPR gRNA sequence
taccttaaccaagtgatatt

SEQ ID NO: 210522 - DNA, 20 bp, Artificial
  CRISPR gRNA sequence
accttaaccaagtgatattt

SEQ ID NO: 210523 - DNA, 20 bp, Artificial
  CRISPR gRNA sequence
taaccaagtgatatttgggc

SEQ ID NO: 210524 - DNA, 20 bp, Artificial
  CRISPR gRNA sequence
aaccaagtgatatttgggca

SEQ ID NO: 210525 - DNA, 20 bp, Artificial
  CRISPR gRNA sequence
accaagtgatatttgggcaa

SEQ ID NO: 210526 - DNA, 20 bp, Artificial
  CRISPR gRNA sequence
ccaagtgatatttgggcaag

SEQ ID NO: 210527 - DNA, 20 bp, Artificial
  CRISPR gRNA sequence
ggatcgttgccttttgctac

SEQ ID NO: 210528 - DNA, 20 bp, Artificial
  CRISPR gRNA sequence
gttgccttttgctactggtt

SEQ ID NO: 210529 - DNA, 20 bp, Artificial
  CRISPR gRNA sequence
ttttgctactggttgagacg

SEQ ID NO: 210530 - DNA, 20 bp, Artificial
  CRISPR gRNA sequence
ctactggttgagacgaagca

SEQ ID NO: 210531 - DNA, 20 bp, Artificial
  CRISPR gRNA sequence
agacgaagcatggcaccccc

SEQ ID NO: 210532 - DNA, 20 bp, Artificial
  CRISPR gRNA sequence
cgaagcatggcaccccctag

SEQ ID NO: 210533 - DNA, 20 bp, Artificial
  CRISPR gRNA sequence
aagcatggcaccccctagta

SEQ ID NO: 210534 - DNA, 20 bp, Artificial
  CRISPR gRNA sequence
catggcaccccctagtagag

SEQ ID NO: 210535 - DNA, 20 bp, Artificial
  CRISPR gRNA sequence
atggcaccccctagtagaga

SEQ ID NO: 210536 - DNA, 20 bp, Artificial
  CRISPR gRNA sequence
aatttgtgatgtacacattt

SEQ ID NO: 210537 - DNA, 20 bp, Artificial
  CRISPR gRNA sequence
tgtgatgtacacattttaga

SEQ ID NO: 210538 - DNA, 20 bp, Artificial
  CRISPR gRNA sequence
gtacacattttagaaagata

SEQ ID NO: 210539 - DNA, 20 bp, Artificial
  CRISPR gRNA sequence
tacacattttagaaagatac

SEQ ID NO: 210540 - DNA, 20 bp, Artificial
  CRISPR gRNA sequence
aaagatacaggctattgcca

SEQ ID NO: 210541 - DNA, 20 bp, Artificial
  CRISPR gRNA sequence
agatacaggctattgccaca

SEQ ID NO: 210542 - DNA, 20 bp, Artificial
  CRISPR gRNA sequence
acaggctattgccacagaga

SEQ ID NO: 210543 - DNA, 20 bp, Artificial
  CRISPR gRNA sequence
attttctttctttgtaaacc

SEQ ID NO: 210544 - DNA, 20 bp, Artificial
  CRISPR gRNA sequence
ctagatctgatttcccaact

SEQ ID NO: 210545 - DNA, 20 bp, Artificial
  CRISPR gRNA sequence
tgtttcctttgtgaatgctg

SEQ ID NO: 210546 - DNA, 20 bp, Artificial
  CRISPR gRNA sequence
gtttcctttgtgaatgctgt

SEQ ID NO: 210547 - DNA, 20 bp, Artificial
  CRISPR gRNA sequence
aatgctgtgggtatgatcca

SEQ ID NO: 210548 - DNA, 20 bp, Artificial
  CRISPR gRNA sequence
ctgtgggtatgatccacaga

SEQ ID NO: 210549 - DNA, 20 bp, Artificial
  CRISPR gRNA sequence
tgtgggtatgatccacagaa

SEQ ID NO: 210550 - DNA, 20 bp, Artificial
  CRISPR gRNA sequence
aaggctacataatgaaatga

SEQ ID NO: 210551 - DNA, 20 bp, Artificial
  CRISPR gRNA sequence
tgatagctttacaattaatt

SEQ ID NO: 210552 - DNA, 20 bp, Artificial
  CRISPR gRNA sequence
ctttacaattaatttggctg

SEQ ID NO: 210553 - DNA, 20 bp, Artificial
  CRISPR gRNA sequence
ttacaattaatttggctgta

SEQ ID NO: 210554 - DNA, 20 bp, Artificial
  CRISPR gRNA sequence
ttaatttggctgtagagttg

SEQ ID NO: 210555 - DNA, 20 bp, Artificial
  CRISPR gRNA sequence
ttggctgtagagttgtagac

SEQ ID NO: 210556 - DNA, 20 bp, Artificial
  CRISPR gRNA sequence
ctgtagagttgtagactagt

SEQ ID NO: 210557 - DNA, 20 bp, Artificial
  CRISPR gRNA sequence
tcattgcatatttgtttatt

SEQ ID NO: 210558 - DNA, 20 bp, Artificial
  CRISPR gRNA sequence
ttagaaatgatttccaattg

SEQ ID NO: 210559 - DNA, 20 bp, Artificial
  CRISPR gRNA sequence
aacctcactaactgcctgct

SEQ ID NO: 210560 - DNA, 20 bp, Artificial
  CRISPR gRNA sequence
gcttggcttgttactaatcc

SEQ ID NO: 210561 - DNA, 20 bp, Artificial
  CRISPR gRNA sequence
gttactaatcctagcattca

SEQ ID NO: 210562 - DNA, 20 bp, Artificial
  CRISPR gRNA sequence
cctagcattcaaagaatcaa

SEQ ID NO: 210563 - DNA, 20 bp, Artificial
  CRISPR gRNA sequence
ctagcattcaaagaatcaaa

SEQ ID NO: 210564 - DNA, 20 bp, Artificial
  CRISPR gRNA sequence
tcaaaaggaatgatgaatga

SEQ ID NO: 210565 - DNA, 20 bp, Artificial
  CRISPR gRNA sequence
aaggaatgatgaatgatggt

SEQ ID NO: 210566 - DNA, 20 bp, Artificial
  CRISPR gRNA sequence
taaaatgcacttaataatta

SEQ ID NO: 210567 - DNA, 20 bp, Artificial
  CRISPR gRNA sequence
tgcacttaataattatagat

SEQ ID NO: 210568 - DNA, 20 bp, Artificial
  CRISPR gRNA sequence
attatagatcagttaaaaca

SEQ ID NO: 210569 - DNA, 20 bp, Artificial
  CRISPR gRNA sequence
atcagttaaaacatggacat

SEQ ID NO: 210570 - DNA, 20 bp, Artificial
  CRISPR gRNA sequence
atggacattggaaaacaaaa

SEQ ID NO: 210571 - DNA, 20 bp, Artificial
  CRISPR gRNA sequence
aaaaaagcttcttgaaaatg

SEQ ID NO: 210572 - DNA, 20 bp, Artificial
  CRISPR gRNA sequence
ttgaaaatgtggctcttttt

SEQ ID NO: 210573 - DNA, 20 bp, Artificial
  CRISPR gRNA sequence
atgtggctcttttttagtaa

SEQ ID NO: 210574 - DNA, 20 bp, Artificial
  CRISPR gRNA sequence
tgtggctcttttttagtaaa

SEQ ID NO: 210575 - DNA, 20 bp, Artificial
  CRISPR gRNA sequence
gtggctcttttttagtaaaa

SEQ ID NO: 210576 - DNA, 20 bp, Artificial
  CRISPR gRNA sequence
tttagtaaaagggacactgt

SEQ ID NO: 210577 - DNA, 20 bp, Artificial
  CRISPR gRNA sequence
agggacactgtcagatgata

SEQ ID NO: 210578 - DNA, 20 bp, Artificial
  CRISPR gRNA sequence
gggacactgtcagatgataa

SEQ ID NO: 210579 - DNA, 20 bp, Artificial
  CRISPR gRNA sequence
aactactactgtaaaaactg

SEQ ID NO: 210580 - DNA, 20 bp, Artificial
  CRISPR gRNA sequence
actactactgtaaaaactgt

SEQ ID NO: 210581 - DNA, 20 bp, Artificial
  CRISPR gRNA sequence
ctactactgtaaaaactgta

SEQ ID NO: 210582 - DNA, 20 bp, Artificial
  CRISPR gRNA sequence
aactgtagggtgtcacgaat

SEQ ID NO: 210583 - DNA, 20 bp, Artificial
  CRISPR gRNA sequence
gggtgtcacgaatcagactc

SEQ ID NO: 210584 - DNA, 20 bp, Artificial
  CRISPR gRNA sequence
cgaatcagactccagtcata

SEQ ID NO: 210585 - DNA, 20 bp, Artificial
  CRISPR gRNA sequence
gactccagtcatatggctcc

SEQ ID NO: 210586 - DNA, 20 bp, Artificial
  CRISPR gRNA sequence
cagtcatatggctcccagca

SEQ ID NO: 210587 - DNA, 20 bp, Artificial
  CRISPR gRNA sequence
gtcatatggctcccagcaaa

SEQ ID NO: 210588 - DNA, 20 bp, Artificial
  CRISPR gRNA sequence
actttttgtaaaatgttttt

SEQ ID NO: 210589 - DNA, 20 bp, Artificial
  CRISPR gRNA sequence
tgtttttcagattccgtgtc

SEQ ID NO: 210590 - DNA, 20 bp, Artificial
  CRISPR gRNA sequence
tgtctggtgactgtaacttt

SEQ ID NO: 210591 - DNA, 20 bp, Artificial
  CRISPR gRNA sequence
aactttaagatgccttttat

SEQ ID NO: 210592 - DNA, 20 bp, Artificial
  CRISPR gRNA sequence
actttaagatgccttttata

SEQ ID NO: 210593 - DNA, 20 bp, Artificial
  CRISPR gRNA sequence
tataaggcacataaataatc

SEQ ID NO: 210594 - DNA, 20 bp, Artificial
  CRISPR gRNA sequence
acaaatctttatcattttga

SEQ ID NO: 210595 - DNA, 20 bp, Artificial
  CRISPR gRNA sequence
aaatctttatcattttgaca

SEQ ID NO: 210596 - DNA, 20 bp, Artificial
  CRISPR gRNA sequence
agtttcttttatgcttgtgt

SEQ ID NO: 210597 - DNA, 20 bp, Artificial
  CRISPR gRNA sequence
attttgttgcatttaaccca

SEQ ID NO: 210598 - DNA, 20 bp, Artificial
  CRISPR gRNA sequence
ttttgttgcatttaacccat

SEQ ID NO: 210599 - DNA, 20 bp, Artificial
  CRISPR gRNA sequence
tttgttgcatttaacccatg

SEQ ID NO: 210600 - DNA, 20 bp, Artificial
  CRISPR gRNA sequence
aacatctctgcttttccaat

SEQ ID NO: 210601 - DNA, 20 bp, Artificial
  CRISPR gRNA sequence
acatctctgcttttccaatc

SEQ ID NO: 210602 - DNA, 20 bp, Artificial
  CRISPR gRNA sequence
atctctgcttttccaatcag

SEQ ID NO: 210603 - DNA, 20 bp, Artificial
  CRISPR gRNA sequence
tgcttttccaatcaggagct

SEQ ID NO: 210604 - DNA, 20 bp, Artificial
  CRISPR gRNA sequence
ggagcttggttctaaccttt

SEQ ID NO: 210605 - DNA, 20 bp, Artificial
  CRISPR gRNA sequence
gagcttggttctaacctttt

SEQ ID NO: 210606 - DNA, 20 bp, Artificial
  CRISPR gRNA sequence
gcttggttctaaccttttgg

SEQ ID NO: 210607 - DNA, 20 bp, Artificial
  CRISPR gRNA sequence
aaccttttgggagatgatta

SEQ ID NO: 210608 - DNA, 20 bp, Artificial
  CRISPR gRNA sequence
ccttttgggagatgattaaa

SEQ ID NO: 210609 - DNA, 20 bp, Artificial
  CRISPR gRNA sequence
ttttgggagatgattaaaga

SEQ ID NO: 210610 - DNA, 20 bp, Artificial
  CRISPR gRNA sequence
ttgggagatgattaaagaga

SEQ ID NO: 210611 - DNA, 20 bp, Artificial
  CRISPR gRNA sequence
tgggagatgattaaagagag

SEQ ID NO: 210612 - DNA, 20 bp, Artificial
  CRISPR gRNA sequence
gatgattaaagagagaggtt

SEQ ID NO: 210613 - DNA, 20 bp, Artificial
  CRISPR gRNA sequence
tgattaaagagagaggttga

SEQ ID NO: 210614 - DNA, 20 bp, Artificial
  CRISPR gRNA sequence
attaaagagagaggttgaga

SEQ ID NO: 210615 - DNA, 20 bp, Artificial
  CRISPR gRNA sequence
taaagagagaggttgagaga

SEQ ID NO: 210616 - DNA, 20 bp, Artificial
  CRISPR gRNA sequence
aagagagaggttgagagaga

SEQ ID NO: 210617 - DNA, 20 bp, Artificial
  CRISPR gRNA sequence
gagagaggttgagagagaga

SEQ ID NO: 210618 - DNA, 20 bp, Artificial
  CRISPR gRNA sequence
gagaggttgagagagagaga

SEQ ID NO: 210619 - DNA, 20 bp, Artificial
  CRISPR gRNA sequence
gaggttgagagagagagaga

SEQ ID NO: 210620 - DNA, 20 bp, Artificial
  CRISPR gRNA sequence
ggttgagagagagagagaga

SEQ ID NO: 210621 - DNA, 20 bp, Artificial
  CRISPR gRNA sequence
ttgagagagagagagagaga

SEQ ID NO: 210622 - DNA, 20 bp, Artificial
  CRISPR gRNA sequence
gagagagagagagagagaga

SEQ ID NO: 210623 - DNA, 20 bp, Artificial
  CRISPR gRNA sequence
gagagagagagagagagaga

SEQ ID NO: 210624 - DNA, 20 bp, Artificial
  CRISPR gRNA sequence
gagagagagagagagagaga

SEQ ID NO: 210625 - DNA, 20 bp, Artificial
  CRISPR gRNA sequence
gagagagagagagagagaga

SEQ ID NO: 210626 - DNA, 20 bp, Artificial
  CRISPR gRNA sequence
gagagagagagagagagaga

SEQ ID NO: 210627 - DNA, 20 bp, Artificial
  CRISPR gRNA sequence
gagagagagagagagagaga

SEQ ID NO: 210628 - DNA, 20 bp, Artificial
  CRISPR gRNA sequence
gagagagagagagagagaga

SEQ ID NO: 210629 - DNA, 20 bp, Artificial
  CRISPR gRNA sequence
gagagagagagagagagaga

SEQ ID NO: 210630 - DNA, 20 bp, Artificial
  CRISPR gRNA sequence
gagagagagagagagagaga

SEQ ID NO: 210631 - DNA, 20 bp, Artificial
  CRISPR gRNA sequence
gagagagagagagagagaga

SEQ ID NO: 210632 - DNA, 20 bp, Artificial
  CRISPR gRNA sequence
gagagagagagagagagaga

SEQ ID NO: 210633 - DNA, 20 bp, Artificial
  CRISPR gRNA sequence
gagagagagagagagagaga

SEQ ID NO: 210634 - DNA, 20 bp, Artificial
  CRISPR gRNA sequence
gagagagagagagagagaga

SEQ ID NO: 210635 - DNA, 20 bp, Artificial
  CRISPR gRNA sequence
gagagagagagagagagaga

SEQ ID NO: 210636 - DNA, 20 bp, Artificial
  CRISPR gRNA sequence
agagagagatgtttcgtcct

SEQ ID NO: 210637 - DNA, 20 bp, Artificial
  CRISPR gRNA sequence
tttgcttccatttttttttt

SEQ ID NO: 210638 - DNA, 20 bp, Artificial
  CRISPR gRNA sequence
cattttttttttaagaactc

SEQ ID NO: 210639 - DNA, 20 bp, Artificial
  CRISPR gRNA sequence
attttttttttaagaactct

SEQ ID NO: 210640 - DNA, 20 bp, Artificial
  CRISPR gRNA sequence
ctaataacttctaatcttta

SEQ ID NO: 210641 - DNA, 20 bp, Artificial
  CRISPR gRNA sequence
aatctttatagaatatttca

SEQ ID NO: 210642 - DNA, 20 bp, Artificial
  CRISPR gRNA sequence
aagaaatatatttgttctta

SEQ ID NO: 210643 - DNA, 20 bp, Artificial
  CRISPR gRNA sequence
tatttgttcttaaagataca

SEQ ID NO: 210644 - DNA, 20 bp, Artificial
  CRISPR gRNA sequence
atttgttcttaaagatacat

SEQ ID NO: 210645 - DNA, 20 bp, Artificial
  CRISPR gRNA sequence
tcttaaagatacataggttt

SEQ ID NO: 210646 - DNA, 20 bp, Artificial
  CRISPR gRNA sequence
atacataggtttgagatatt

SEQ ID NO: 210647 - DNA, 20 bp, Artificial
  CRISPR gRNA sequence
tttgagatattgagtgctac

SEQ ID NO: 210648 - DNA, 20 bp, Artificial
  CRISPR gRNA sequence
agtgctacaagcatttattt

SEQ ID NO: 210649 - DNA, 20 bp, Artificial
  CRISPR gRNA sequence
cttaacatattatgattcct

SEQ ID NO: 210650 - DNA, 20 bp, Artificial
  CRISPR gRNA sequence
ttatgattcctcagttttgt

SEQ ID NO: 210651 - DNA, 20 bp, Artificial
  CRISPR gRNA sequence
tcctcagttttgttggcatt

SEQ ID NO: 210652 - DNA, 20 bp, Artificial
  CRISPR gRNA sequence
tgatatttataatcactcct

SEQ ID NO: 210653 - DNA, 20 bp, Artificial
  CRISPR gRNA sequence
tcactcctcggtcatgtaaa

SEQ ID NO: 210654 - DNA, 20 bp, Artificial
  CRISPR gRNA sequence
ctttatattttactgtttta

SEQ ID NO: 210655 - DNA, 20 bp, Artificial
  CRISPR gRNA sequence
accttacctgccctcttctg

SEQ ID NO: 210656 - DNA, 20 bp, Artificial
  CRISPR gRNA sequence
acctgccctcttctgtagca

SEQ ID NO: 210657 - DNA, 20 bp, Artificial
  CRISPR gRNA sequence
ccctcttctgtagcaaagtg

SEQ ID NO: 210658 - DNA, 20 bp, Artificial
  CRISPR gRNA sequence
gcaaagtgcagcatttaact

SEQ ID NO: 210659 - DNA, 20 bp, Artificial
  CRISPR gRNA sequence
caaagtgcagcatttaactc

SEQ ID NO: 210660 - DNA, 20 bp, Artificial
  CRISPR gRNA sequence
agtgcagcatttaactcagg

SEQ ID NO: 210661 - DNA, 20 bp, Artificial
  CRISPR gRNA sequence
caggaagctatattcccccc

SEQ ID NO: 210662 - DNA, 20 bp, Artificial
  CRISPR gRNA sequence
agtgtcattaatatttgcat

SEQ ID NO: 210663 - DNA, 20 bp, Artificial
  CRISPR gRNA sequence
gcataagattaaaaacactc

SEQ ID NO: 210664 - DNA, 20 bp, Artificial
  CRISPR gRNA sequence
aagattaaaaacactccagt

SEQ ID NO: 210665 - DNA, 20 bp, Artificial
  CRISPR gRNA sequence
ttaaaaacactccagtcggc

SEQ ID NO: 210666 - DNA, 20 bp, Artificial
  CRISPR gRNA sequence
taaaaacactccagtcggcc

SEQ ID NO: 210667 - DNA, 20 bp, Artificial
  CRISPR gRNA sequence
acactccagtcggccgggcg

SEQ ID NO: 210668 - DNA, 20 bp, Artificial
  CRISPR gRNA sequence
ctccagtcggccgggcgcgg

SEQ ID NO: 210669 - DNA, 20 bp, Artificial
  CRISPR gRNA sequence
gtggctcacgcctgtaatcc

SEQ ID NO: 210670 - DNA, 20 bp, Artificial
  CRISPR gRNA sequence
cgcctgtaatcccagcactt

SEQ ID NO: 210671 - DNA, 20 bp, Artificial
  CRISPR gRNA sequence
gcctgtaatcccagcacttt

SEQ ID NO: 210672 - DNA, 20 bp, Artificial
  CRISPR gRNA sequence
ctgtaatcccagcactttgg

SEQ ID NO: 210673 - DNA, 20 bp, Artificial
  CRISPR gRNA sequence
tgtaatcccagcactttggg

SEQ ID NO: 210674 - DNA, 20 bp, Artificial
  CRISPR gRNA sequence
tcccagcactttgggaggcc

SEQ ID NO: 210675 - DNA, 20 bp, Artificial
  CRISPR gRNA sequence
cccagcactttgggaggccg

SEQ ID NO: 210676 - DNA, 20 bp, Artificial
  CRISPR gRNA sequence
agcactttgggaggccgagg

SEQ ID NO: 210677 - DNA, 20 bp, Artificial
  CRISPR gRNA sequence
gcactttgggaggccgaggc

SEQ ID NO: 210678 - DNA, 20 bp, Artificial
  CRISPR gRNA sequence
ctttgggaggccgaggcggg

SEQ ID NO: 210679 - DNA, 20 bp, Artificial
  CRISPR gRNA sequence
ggccgaggcgggcggatcac

SEQ ID NO: 210680 - DNA, 20 bp, Artificial
  CRISPR gRNA sequence
gccgaggcgggcggatcaca

SEQ ID NO: 210681 - DNA, 20 bp, Artificial
  CRISPR gRNA sequence
aggcgggcggatcacaaggt

SEQ ID NO: 210682 - DNA, 20 bp, Artificial
  CRISPR gRNA sequence
ggcgggcggatcacaaggtc

SEQ ID NO: 210683 - DNA, 20 bp, Artificial
  CRISPR gRNA sequence
cgggcggatcacaaggtcag

SEQ ID NO: 210684 - DNA, 20 bp, Artificial
  CRISPR gRNA sequence
gatcacaaggtcaggagatc

SEQ ID NO: 210685 - DNA, 20 bp, Artificial
  CRISPR gRNA sequence
tcaggagatcgagaccatcc

SEQ ID NO: 210686 - DNA, 20 bp, Artificial
  CRISPR gRNA sequence
cgagaccatcctggctaaca

SEQ ID NO: 210687 - DNA, 20 bp, Artificial
  CRISPR gRNA sequence
ctactaaaactacaaaaaat

SEQ ID NO: 210688 - DNA, 20 bp, Artificial
  CRISPR gRNA sequence
taaaactacaaaaaattagc

SEQ ID NO: 210689 - DNA, 20 bp, Artificial
  CRISPR gRNA sequence
aaaactacaaaaaattagcc

SEQ ID NO: 210690 - DNA, 20 bp, Artificial
  CRISPR gRNA sequence
tacaaaaaattagccgggca

SEQ ID NO: 210691 - DNA, 20 bp, Artificial
  CRISPR gRNA sequence
aaaaaattagccgggcatgg

SEQ ID NO: 210692 - DNA, 20 bp, Artificial
  CRISPR gRNA sequence
aaattagccgggcatggtgg

SEQ ID NO: 210693 - DNA, 20 bp, Artificial
  CRISPR gRNA sequence
aattagccgggcatggtggc

SEQ ID NO: 210694 - DNA, 20 bp, Artificial
  CRISPR gRNA sequence
ggcatggtggcgggcacctg

SEQ ID NO: 210695 - DNA, 20 bp, Artificial
  CRISPR gRNA sequence
gtggcgggcacctgtggtcc

SEQ ID NO: 210696 - DNA, 20 bp, Artificial
  CRISPR gRNA sequence
cacctgtggtcccagctact

SEQ ID NO: 210697 - DNA, 20 bp, Artificial
  CRISPR gRNA sequence
acctgtggtcccagctactt

SEQ ID NO: 210698 - DNA, 20 bp, Artificial
  CRISPR gRNA sequence
ctgtggtcccagctacttgg

SEQ ID NO: 210699 - DNA, 20 bp, Artificial
  CRISPR gRNA sequence
tgtggtcccagctacttggg

SEQ ID NO: 210700 - DNA, 20 bp, Artificial
  CRISPR gRNA sequence
tcccagctacttgggaggct

SEQ ID NO: 210701 - DNA, 20 bp, Artificial
  CRISPR gRNA sequence
cccagctacttgggaggctg

SEQ ID NO: 210702 - DNA, 20 bp, Artificial
  CRISPR gRNA sequence
agctacttgggaggctgagg

SEQ ID NO: 210703 - DNA, 20 bp, Artificial
  CRISPR gRNA sequence
gctacttgggaggctgaggc

SEQ ID NO: 210704 - DNA, 20 bp, Artificial
  CRISPR gRNA sequence
tacttgggaggctgaggcag

SEQ ID NO: 210705 - DNA, 20 bp, Artificial
  CRISPR gRNA sequence
gggaggctgaggcaggagaa

SEQ ID NO: 210706 - DNA, 20 bp, Artificial
  CRISPR gRNA sequence
gcaggagaatggcgtgaacc

SEQ ID NO: 210707 - DNA, 20 bp, Artificial
  CRISPR gRNA sequence
caggagaatggcgtgaaccc

SEQ ID NO: 210708 - DNA, 20 bp, Artificial
  CRISPR gRNA sequence
ggagaatggcgtgaacccgg

SEQ ID NO: 210709 - DNA, 20 bp, Artificial
  CRISPR gRNA sequence
gagaatggcgtgaacccggg

SEQ ID NO: 210710 - DNA, 20 bp, Artificial
  CRISPR gRNA sequence
aatggcgtgaacccgggagg

SEQ ID NO: 210711 - DNA, 20 bp, Artificial
  CRISPR gRNA sequence
tggcgtgaacccgggaggca

SEQ ID NO: 210712 - DNA, 20 bp, Artificial
  CRISPR gRNA sequence
aacccgggaggcagagcttg

SEQ ID NO: 210713 - DNA, 20 bp, Artificial
  CRISPR gRNA sequence
cgggaggcagagcttgcagt

SEQ ID NO: 210714 - DNA, 20 bp, Artificial
  CRISPR gRNA sequence
ggcagagcttgcagtgagcc

SEQ ID NO: 210715 - DNA, 20 bp, Artificial
  CRISPR gRNA sequence
aagatcgtgccactacactc

SEQ ID NO: 210716 - DNA, 20 bp, Artificial
  CRISPR gRNA sequence
cgtgccactacactccagcc

SEQ ID NO: 210717 - DNA, 20 bp, Artificial
  CRISPR gRNA sequence
gtgccactacactccagcct

SEQ ID NO: 210718 - DNA, 20 bp, Artificial
  CRISPR gRNA sequence
ctacactccagcctgggtga

SEQ ID NO: 210719 - DNA, 20 bp, Artificial
  CRISPR gRNA sequence
acactccagcctgggtgaca

SEQ ID NO: 210720 - DNA, 20 bp, Artificial
  CRISPR gRNA sequence
tccagcctgggtgacagagc

SEQ ID NO: 210721 - DNA, 20 bp, Artificial
  CRISPR gRNA sequence
acagagcaagactccgtctc

SEQ ID NO: 210722 - DNA, 20 bp, Artificial
  CRISPR gRNA sequence
aaaaaaaaaaaaaaacactc

SEQ ID NO: 210723 - DNA, 20 bp, Artificial
  CRISPR gRNA sequence
aaaacactccagtcatgcat

SEQ ID NO: 210724 - DNA, 20 bp, Artificial
  CRISPR gRNA sequence
cagtcatgcattggtgaaca

SEQ ID NO: 210725 - DNA, 20 bp, Artificial
  CRISPR gRNA sequence
agtttaaaacaacgtgtatt

SEQ ID NO: 210726 - DNA, 20 bp, Artificial
  CRISPR gRNA sequence
aaaacaacgtgtattcagca

SEQ ID NO: 210727 - DNA, 20 bp, Artificial
  CRISPR gRNA sequence
aacaacgtgtattcagcatg

SEQ ID NO: 210728 - DNA, 20 bp, Artificial
  CRISPR gRNA sequence
gtgtattcagcatggagtca

SEQ ID NO: 210729 - DNA, 20 bp, Artificial
  CRISPR gRNA sequence
acttttgtatgtttgtgtca

SEQ ID NO: 210730 - DNA, 20 bp, Artificial
  CRISPR gRNA sequence
gtttgtgtcacagcctttaa

SEQ ID NO: 210731 - DNA, 20 bp, Artificial
  CRISPR gRNA sequence
aaaagcatgtcttgttatat

SEQ ID NO: 210732 - DNA, 20 bp, Artificial
  CRISPR gRNA sequence
aagccattaccctcctaaaa

SEQ ID NO: 210733 - DNA, 20 bp, Artificial
  CRISPR gRNA sequence
taccctcctaaaaaagacta

SEQ ID NO: 210734 - DNA, 20 bp, Artificial
  CRISPR gRNA sequence
ctaaaaaagactatagttca

SEQ ID NO: 210735 - DNA, 20 bp, Artificial
  CRISPR gRNA sequence
taaaaaagactatagttcac

SEQ ID NO: 210736 - DNA, 20 bp, Artificial
  CRISPR gRNA sequence
agactatagttcacaggaat

SEQ ID NO: 210737 - DNA, 20 bp, Artificial
  CRISPR gRNA sequence
agttcacaggaataagttaa

SEQ ID NO: 210738 - DNA, 20 bp, Artificial
  CRISPR gRNA sequence
ataacaaaacataaaatgac

SEQ ID NO: 210739 - DNA, 20 bp, Artificial
  CRISPR gRNA sequence
aaacataaaatgactagtac

SEQ ID NO: 210740 - DNA, 20 bp, Artificial
  CRISPR gRNA sequence
aacataaaatgactagtacc

SEQ ID NO: 210741 - DNA, 20 bp, Artificial
  CRISPR gRNA sequence
agtaccaggaattgtgacca

SEQ ID NO: 210742 - DNA, 20 bp, Artificial
  CRISPR gRNA sequence
attgtgaccatggtttgttc

SEQ ID NO: 210743 - DNA, 20 bp, Artificial
  CRISPR gRNA sequence
atggtttgttctggtaactg

SEQ ID NO: 210744 - DNA, 20 bp, Artificial
  CRISPR gRNA sequence
ttgttctggtaactgtggca

SEQ ID NO: 210745 - DNA, 20 bp, Artificial
  CRISPR gRNA sequence
ctggtaactgtggcatggca

SEQ ID NO: 210746 - DNA, 20 bp, Artificial
  CRISPR gRNA sequence
tggcatggcatggtttgttc

SEQ ID NO: 210747 - DNA, 20 bp, Artificial
  CRISPR gRNA sequence
ggcatggcatggtttgttcc

SEQ ID NO: 210748 - DNA, 20 bp, Artificial
  CRISPR gRNA sequence
atggtttgttccaggaattg

SEQ ID NO: 210749 - DNA, 20 bp, Artificial
  CRISPR gRNA sequence
ttgttccaggaattgtggca

SEQ ID NO: 210750 - DNA, 20 bp, Artificial
  CRISPR gRNA sequence
ctatgtcctttccttttcct

SEQ ID NO: 210751 - DNA, 20 bp, Artificial
  CRISPR gRNA sequence
tgtcctttccttttccttgg

SEQ ID NO: 210752 - DNA, 20 bp, Artificial
  CRISPR gRNA sequence
ttggtggtgtcattgttctg

SEQ ID NO: 210753 - DNA, 20 bp, Artificial
  CRISPR gRNA sequence
cattgttctgtagctgtatg

SEQ ID NO: 210754 - DNA, 20 bp, Artificial
  CRISPR gRNA sequence
actaaacttttctccatttt

SEQ ID NO: 210755 - DNA, 20 bp, Artificial
  CRISPR gRNA sequence
ctaaacttttctccattttc

SEQ ID NO: 210756 - DNA, 20 bp, Artificial
  CRISPR gRNA sequence
acttttctccattttcagga

SEQ ID NO: 210757 - DNA, 20 bp, Artificial
  CRISPR gRNA sequence
cattttcaggaaagcaatct

SEQ ID NO: 210758 - DNA, 20 bp, Artificial
  CRISPR gRNA sequence
gaaagcaatctaagaatctt

SEQ ID NO: 210759 - DNA, 20 bp, Artificial
  CRISPR gRNA sequence
ttcctttgttaatttctctt

SEQ ID NO: 210760 - DNA, 20 bp, Artificial
  CRISPR gRNA sequence
acttttttaaactactgcat

SEQ ID NO: 210761 - DNA, 20 bp, Artificial
  CRISPR gRNA sequence
cttttttaaactactgcatc

SEQ ID NO: 210762 - DNA, 20 bp, Artificial
  CRISPR gRNA sequence
catcaggaaatattgtaaaa

SEQ ID NO: 210763 - DNA, 20 bp, Artificial
  CRISPR gRNA sequence
tgaaatctacgatgatcttc

SEQ ID NO: 210764 - DNA, 20 bp, Artificial
  CRISPR gRNA sequence
ctcttaattttgctaatatt

SEQ ID NO: 210765 - DNA, 20 bp, Artificial
  CRISPR gRNA sequence
tttgctaatattcagctgat

SEQ ID NO: 210766 - DNA, 20 bp, Artificial
  CRISPR gRNA sequence
gaatttgtttttaaaatgtc

SEQ ID NO: 210767 - DNA, 20 bp, Artificial
  CRISPR gRNA sequence
ttgtttttaaaatgtctggc

SEQ ID NO: 210768 - DNA, 20 bp, Artificial
  CRISPR gRNA sequence
tttttaaaatgtctggctgg

SEQ ID NO: 210769 - DNA, 20 bp, Artificial
  CRISPR gRNA sequence
ttttaaaatgtctggctggt

SEQ ID NO: 210770 - DNA, 20 bp, Artificial
  CRISPR gRNA sequence
tgacaactgcttattgctta

SEQ ID NO: 210771 - DNA, 20 bp, Artificial
  CRISPR gRNA sequence
tgtctgccttgtcaatgaat

SEQ ID NO: 210772 - DNA, 20 bp, Artificial
  CRISPR gRNA sequence
gtctgccttgtcaatgaatg

SEQ ID NO: 210773 - DNA, 20 bp, Artificial
  CRISPR gRNA sequence
ccttgtcaatgaatgaggtt

SEQ ID NO: 210774 - DNA, 20 bp, Artificial
  CRISPR gRNA sequence
cttgtcaatgaatgaggttc

SEQ ID NO: 210775 - DNA, 20 bp, Artificial
  CRISPR gRNA sequence
ttgtcaatgaatgaggttca

SEQ ID NO: 210776 - DNA, 20 bp, Artificial
  CRISPR gRNA sequence
atgaggttcagggtgcttcc

SEQ ID NO: 210777 - DNA, 20 bp, Artificial
  CRISPR gRNA sequence
tgaggttcagggtgcttcct

SEQ ID NO: 210778 - DNA, 20 bp, Artificial
  CRISPR gRNA sequence
gaggttcagggtgcttccta

SEQ ID NO: 210779 - DNA, 20 bp, Artificial
  CRISPR gRNA sequence
tcagggtgcttcctagggat

SEQ ID NO: 210780 - DNA, 20 bp, Artificial
  CRISPR gRNA sequence
agggtgcttcctagggatca

SEQ ID NO: 210781 - DNA, 20 bp, Artificial
  CRISPR gRNA sequence
tgcttcctagggatcagagt

SEQ ID NO: 210782 - DNA, 20 bp, Artificial
  CRISPR gRNA sequence
ccatttttctctttcatcta

SEQ ID NO: 210783 - DNA, 20 bp, Artificial
  CRISPR gRNA sequence
ctctttcatctacagctgat

SEQ ID NO: 210784 - DNA, 20 bp, Artificial
  CRISPR gRNA sequence
tacttacattaaatgaatga

SEQ ID NO: 210785 - DNA, 20 bp, Artificial
  CRISPR gRNA sequence
cttacattaaatgaatgatg

SEQ ID NO: 210786 - DNA, 20 bp, Artificial
  CRISPR gRNA sequence
aaatgaatgatggagatcca

SEQ ID NO: 210787 - DNA, 20 bp, Artificial
  CRISPR gRNA sequence
gagatccaaagtgaatatta

SEQ ID NO: 210788 - DNA, 20 bp, Artificial
  CRISPR gRNA sequence
aatattatagaatattattc

SEQ ID NO: 210789 - DNA, 20 bp, Artificial
  CRISPR gRNA sequence
atattatagaatattattct

SEQ ID NO: 210790 - DNA, 20 bp, Artificial
  CRISPR gRNA sequence
tttgaaaaatcaacatctct

SEQ ID NO: 210791 - DNA, 20 bp, Artificial
  CRISPR gRNA sequence
aacatctcttggcttttcct

SEQ ID NO: 210792 - DNA, 20 bp, Artificial
  CRISPR gRNA sequence
tggcttttcctcagccaacc

SEQ ID NO: 210793 - DNA, 20 bp, Artificial
  CRISPR gRNA sequence
tcctcagccaacccagcaaa

SEQ ID NO: 210794 - DNA, 20 bp, Artificial
  CRISPR gRNA sequence
ctcagccaacccagcaaaca

SEQ ID NO: 210795 - DNA, 20 bp, Artificial
  CRISPR gRNA sequence
acccagcaaacagagattat

SEQ ID NO: 210796 - DNA, 20 bp, Artificial
  CRISPR gRNA sequence
gttgattttttactttcatt

SEQ ID NO: 210797 - DNA, 20 bp, Artificial
  CRISPR gRNA sequence
tttttactttcatttggcat

SEQ ID NO: 210798 - DNA, 20 bp, Artificial
  CRISPR gRNA sequence
tttttcttactgaaattaaa

SEQ ID NO: 210799 - DNA, 20 bp, Artificial
  CRISPR gRNA sequence
ttttcttactgaaattaaaa

SEQ ID NO: 210800 - DNA, 20 bp, Artificial
  CRISPR gRNA sequence
aaaaaggctaatgatttgcc

SEQ ID NO: 210801 - DNA, 20 bp, Artificial
  CRISPR gRNA sequence
gtttctgtctctgacctttg

SEQ ID NO: 210802 - DNA, 20 bp, Artificial
  CRISPR gRNA sequence
tttctgtctctgacctttgc

SEQ ID NO: 210803 - DNA, 20 bp, Artificial
  CRISPR gRNA sequence
aggtctattttcttaatttt

SEQ ID NO: 210804 - DNA, 20 bp, Artificial
  CRISPR gRNA sequence
ttaatgtgtcaactttttaa

SEQ ID NO: 210805 - DNA, 20 bp, Artificial
  CRISPR gRNA sequence
tgtgtcaactttttaatgga

SEQ ID NO: 210806 - DNA, 20 bp, Artificial
  CRISPR gRNA sequence
actttttaatggatagaaaa

SEQ ID NO: 210807 - DNA, 20 bp, Artificial
  CRISPR gRNA sequence
ggatagaaaatagacacgaa

SEQ ID NO: 210808 - DNA, 20 bp, Artificial
  CRISPR gRNA sequence
gtgttcatttttcaattttc

SEQ ID NO: 210809 - DNA, 20 bp, Artificial
  CRISPR gRNA sequence
tcaattttccagaataactg

SEQ ID NO: 210810 - DNA, 20 bp, Artificial
  CRISPR gRNA sequence
tttccagaataactgaagtg

SEQ ID NO: 210811 - DNA, 20 bp, Artificial
  CRISPR gRNA sequence
gaataactgaagtgaagtga

SEQ ID NO: 210812 - DNA, 20 bp, Artificial
  CRISPR gRNA sequence
tgaagtgatggactccgatt

SEQ ID NO: 210813 - DNA, 20 bp, Artificial
  CRISPR gRNA sequence
aagtgatggactccgatttg

SEQ ID NO: 210814 - DNA, 20 bp, Artificial
  CRISPR gRNA sequence
gtgatggactccgatttgga

SEQ ID NO: 210815 - DNA, 20 bp, Artificial
  CRISPR gRNA sequence
atggactccgatttggagag

SEQ ID NO: 210816 - DNA, 20 bp, Artificial
  CRISPR gRNA sequence
actccgatttggagagtagt

SEQ ID NO: 210817 - DNA, 20 bp, Artificial
  CRISPR gRNA sequence
tggagagtagtaagacgtga

SEQ ID NO: 210818 - DNA, 20 bp, Artificial
  CRISPR gRNA sequence
ggagagtagtaagacgtgaa

SEQ ID NO: 210819 - DNA, 20 bp, Artificial
  CRISPR gRNA sequence
aaaggaatacacttgtgttt

SEQ ID NO: 210820 - DNA, 20 bp, Artificial
  CRISPR gRNA sequence
acacttgtgtttaagcacca

SEQ ID NO: 210821 - DNA, 20 bp, Artificial
  CRISPR gRNA sequence
tggccttgatgattcactgt

SEQ ID NO: 210822 - DNA, 20 bp, Artificial
  CRISPR gRNA sequence
ggccttgatgattcactgtt

SEQ ID NO: 210823 - DNA, 20 bp, Artificial
  CRISPR gRNA sequence
gccttgatgattcactgttg

SEQ ID NO: 210824 - DNA, 20 bp, Artificial
  CRISPR gRNA sequence
cttgatgattcactgttggg

SEQ ID NO: 210825 - DNA, 20 bp, Artificial
  CRISPR gRNA sequence
gatgattcactgttggggag

SEQ ID NO: 210826 - DNA, 20 bp, Artificial
  CRISPR gRNA sequence
cactgttggggagaagaaac

SEQ ID NO: 210827 - DNA, 20 bp, Artificial
  CRISPR gRNA sequence
ttggggagaagaaacaagaa

SEQ ID NO: 210828 - DNA, 20 bp, Artificial
  CRISPR gRNA sequence
gaagaaacaagaaaagtaac

SEQ ID NO: 210829 - DNA, 20 bp, Artificial
  CRISPR gRNA sequence
agtaactggttgtcacctat

SEQ ID NO: 210830 - DNA, 20 bp, Artificial
  CRISPR gRNA sequence
tgagacccttacgtgattgt

SEQ ID NO: 210831 - DNA, 20 bp, Artificial
  CRISPR gRNA sequence
cccttacgtgattgttagtt

SEQ ID NO: 210832 - DNA, 20 bp, Artificial
  CRISPR gRNA sequence
gttagttaagtttttattca

SEQ ID NO: 210833 - DNA, 20 bp, Artificial
  CRISPR gRNA sequence
agttaagtttttattcaaag

SEQ ID NO: 210834 - DNA, 20 bp, Artificial
  CRISPR gRNA sequence
tattcaaagcagctgtaatt

SEQ ID NO: 210835 - DNA, 20 bp, Artificial
  CRISPR gRNA sequence
tctatgttgtttgcccaatt

SEQ ID NO: 210836 - DNA, 20 bp, Artificial
  CRISPR gRNA sequence
ttgtttgcccaattgagatc

SEQ ID NO: 210837 - DNA, 20 bp, Artificial
  CRISPR gRNA sequence
tgttgttatttttaatcaat

SEQ ID NO: 210838 - DNA, 20 bp, Artificial
  CRISPR gRNA sequence
gttgttatttttaatcaatt

SEQ ID NO: 210839 - DNA, 20 bp, Artificial
  CRISPR gRNA sequence
ttgttatttttaatcaatta

SEQ ID NO: 210840 - DNA, 20 bp, Artificial
  CRISPR gRNA sequence
tgttatttttaatcaattag

SEQ ID NO: 210841 - DNA, 20 bp, Artificial
  CRISPR gRNA sequence
ttttaatcaattaggggcaa

SEQ ID NO: 210842 - DNA, 20 bp, Artificial
  CRISPR gRNA sequence
taatcaattaggggcaatag

SEQ ID NO: 210843 - DNA, 20 bp, Artificial
  CRISPR gRNA sequence
aattaggggcaatagtagaa

SEQ ID NO: 210844 - DNA, 20 bp, Artificial
  CRISPR gRNA sequence
tagtagaatggacaatttcc

SEQ ID NO: 210845 - DNA, 20 bp, Artificial
  CRISPR gRNA sequence
tttccaagaatgatgccttt

SEQ ID NO: 210846 - DNA, 20 bp, Artificial
  CRISPR gRNA sequence
ttccaagaatgatgcctttc

SEQ ID NO: 210847 - DNA, 20 bp, Artificial
  CRISPR gRNA sequence
gaatgatgcctttcaggtcc

SEQ ID NO: 210848 - DNA, 20 bp, Artificial
  CRISPR gRNA sequence
aatgatgcctttcaggtcct

SEQ ID NO: 210849 - DNA, 20 bp, Artificial
  CRISPR gRNA sequence
atgatgcctttcaggtccta

SEQ ID NO: 210850 - DNA, 20 bp, Artificial
  CRISPR gRNA sequence
ctttcaggtcctagggcctc

SEQ ID NO: 210851 - DNA, 20 bp, Artificial
  CRISPR gRNA sequence
gtcctagggcctctggcctc

SEQ ID NO: 210852 - DNA, 20 bp, Artificial
  CRISPR gRNA sequence
tcctagggcctctggcctct

SEQ ID NO: 210853 - DNA, 20 bp, Artificial
  CRISPR gRNA sequence
gcctctggcctctaggtaac

SEQ ID NO: 210854 - DNA, 20 bp, Artificial
  CRISPR gRNA sequence
tctaggtaaccagtttaaat

SEQ ID NO: 210855 - DNA, 20 bp, Artificial
  CRISPR gRNA sequence
gtaaccagtttaaattggtt

SEQ ID NO: 210856 - DNA, 20 bp, Artificial
  CRISPR gRNA sequence
taaccagtttaaattggttc

SEQ ID NO: 210857 - DNA, 20 bp, Artificial
  CRISPR gRNA sequence
aaccagtttaaattggttca

SEQ ID NO: 210858 - DNA, 20 bp, Artificial
  CRISPR gRNA sequence
ggttcagggtgataactact

SEQ ID NO: 210859 - DNA, 20 bp, Artificial
  CRISPR gRNA sequence
ataactacttagcactgccc

SEQ ID NO: 210860 - DNA, 20 bp, Artificial
  CRISPR gRNA sequence
gcactgccctggtgattacc

SEQ ID NO: 210861 - DNA, 20 bp, Artificial
  CRISPR gRNA sequence
actgccctggtgattaccca

SEQ ID NO: 210862 - DNA, 20 bp, Artificial
  CRISPR gRNA sequence
ccagagatatctatgaaaac

SEQ ID NO: 210863 - DNA, 20 bp, Artificial
  CRISPR gRNA sequence
gagatatctatgaaaaccag

SEQ ID NO: 210864 - DNA, 20 bp, Artificial
  CRISPR gRNA sequence
ccatcaaacctttgccaact

SEQ ID NO: 210865 - DNA, 20 bp, Artificial
  CRISPR gRNA sequence
catcaaacctttgccaactc

SEQ ID NO: 210866 - DNA, 20 bp, Artificial
  CRISPR gRNA sequence
cctttgccaactcaggttca

SEQ ID NO: 210867 - DNA, 20 bp, Artificial
  CRISPR gRNA sequence
ttgccaactcaggttcacag

SEQ ID NO: 210868 - DNA, 20 bp, Artificial
  CRISPR gRNA sequence
actcaggttcacagcagctt

SEQ ID NO: 210869 - DNA, 20 bp, Artificial
  CRISPR gRNA sequence
ctcaggttcacagcagcttt

SEQ ID NO: 210870 - DNA, 20 bp, Artificial
  CRISPR gRNA sequence
aggttcacagcagctttggg

SEQ ID NO: 210871 - DNA, 20 bp, Artificial
  CRISPR gRNA sequence
acagcagctttgggcagtta

SEQ ID NO: 210872 - DNA, 20 bp, Artificial
  CRISPR gRNA sequence
gcagctttgggcagttatgg

SEQ ID NO: 210873 - DNA, 20 bp, Artificial
  CRISPR gRNA sequence
tttgggcagttatggcagta

SEQ ID NO: 210874 - DNA, 20 bp, Artificial
  CRISPR gRNA sequence
cagttatggcagtatggcat

SEQ ID NO: 210875 - DNA, 20 bp, Artificial
  CRISPR gRNA sequence
atggcagtatggcattagct

SEQ ID NO: 210876 - DNA, 20 bp, Artificial
  CRISPR gRNA sequence
ggcagtatggcattagctga

SEQ ID NO: 210877 - DNA, 20 bp, Artificial
  CRISPR gRNA sequence
gcagtatggcattagctgag

SEQ ID NO: 210878 - DNA, 20 bp, Artificial
  CRISPR gRNA sequence
tgagaggtgtctgccacttc

SEQ ID NO: 210879 - DNA, 20 bp, Artificial
  CRISPR gRNA sequence
gagaggtgtctgccacttct

SEQ ID NO: 210880 - DNA, 20 bp, Artificial
  CRISPR gRNA sequence
gtctgccacttctgggtcaa

SEQ ID NO: 210881 - DNA, 20 bp, Artificial
  CRISPR gRNA sequence
ggtcaatggaataataaatt

SEQ ID NO: 210882 - DNA, 20 bp, Artificial
  CRISPR gRNA sequence
atggaataataaattaagta

SEQ ID NO: 210883 - DNA, 20 bp, Artificial
  CRISPR gRNA sequence
tggaataataaattaagtac

SEQ ID NO: 210884 - DNA, 20 bp, Artificial
  CRISPR gRNA sequence
aataataaattaagtacagg

SEQ ID NO: 210885 - DNA, 20 bp, Artificial
  CRISPR gRNA sequence
ataataaattaagtacaggc

SEQ ID NO: 210886 - DNA, 20 bp, Artificial
  CRISPR gRNA sequence
attaagtacaggcaggaatt

SEQ ID NO: 210887 - DNA, 20 bp, Artificial
  CRISPR gRNA sequence
agtacaggcaggaatttggt

SEQ ID NO: 210888 - DNA, 20 bp, Artificial
  CRISPR gRNA sequence
gtacaggcaggaatttggtt

SEQ ID NO: 210889 - DNA, 20 bp, Artificial
  CRISPR gRNA sequence
acaggcaggaatttggttgg

SEQ ID NO: 210890 - DNA, 20 bp, Artificial
  CRISPR gRNA sequence
tccgtatgatgtgatattga

SEQ ID NO: 210891 - DNA, 20 bp, Artificial
  CRISPR gRNA sequence
cgtatgatgtgatattgatg

SEQ ID NO: 210892 - DNA, 20 bp, Artificial
  CRISPR gRNA sequence
tgatgtgatattgatggaga

SEQ ID NO: 210893 - DNA, 20 bp, Artificial
  CRISPR gRNA sequence
tgtgatattgatggagatag

SEQ ID NO: 210894 - DNA, 20 bp, Artificial
  CRISPR gRNA sequence
gagatagtggtcctcattct

SEQ ID NO: 210895 - DNA, 20 bp, Artificial
  CRISPR gRNA sequence
agatagtggtcctcattctt

SEQ ID NO: 210896 - DNA, 20 bp, Artificial
  CRISPR gRNA sequence
gatagtggtcctcattcttg

SEQ ID NO: 210897 - DNA, 20 bp, Artificial
  CRISPR gRNA sequence
atagtggtcctcattcttgg

SEQ ID NO: 210898 - DNA, 20 bp, Artificial
  CRISPR gRNA sequence
cacattcccccttcaacaaa

SEQ ID NO: 210899 - DNA, 20 bp, Artificial
  CRISPR gRNA sequence
cccttcaacaaacagtgtaa

SEQ ID NO: 210900 - DNA, 20 bp, Artificial
  CRISPR gRNA sequence
ccttcaacaaacagtgtaac

SEQ ID NO: 210901 - DNA, 20 bp, Artificial
  CRISPR gRNA sequence
acagtgtaacaggtccttcc

SEQ ID NO: 210902 - DNA, 20 bp, Artificial
  CRISPR gRNA sequence
taacaggtccttcccagatt

SEQ ID NO: 210903 - DNA, 20 bp, Artificial
  CRISPR gRNA sequence
aacaggtccttcccagattt

SEQ ID NO: 210904 - DNA, 20 bp, Artificial
  CRISPR gRNA sequence
acaggtccttcccagattta

SEQ ID NO: 210905 - DNA, 20 bp, Artificial
  CRISPR gRNA sequence
atttagggtacttttattga

SEQ ID NO: 210906 - DNA, 20 bp, Artificial
  CRISPR gRNA sequence
gttacttgcttctgctgtac

SEQ ID NO: 210907 - DNA, 20 bp, Artificial
  CRISPR gRNA sequence
tgcttctgctgtacaagatg

SEQ ID NO: 210908 - DNA, 20 bp, Artificial
  CRISPR gRNA sequence
ccttttctcctctttgaaca

SEQ ID NO: 210909 - DNA, 20 bp, Artificial
  CRISPR gRNA sequence
tctcctctttgaacatggtc

SEQ ID NO: 210910 - DNA, 20 bp, Artificial
  CRISPR gRNA sequence
ttgaacatggtctagtgaca

SEQ ID NO: 210911 - DNA, 20 bp, Artificial
  CRISPR gRNA sequence
aacatggtctagtgacacgg

SEQ ID NO: 210912 - DNA, 20 bp, Artificial
  CRISPR gRNA sequence
gtctagtgacacggtagcac

SEQ ID NO: 210913 - DNA, 20 bp, Artificial
  CRISPR gRNA sequence
tgacacggtagcaccagttg

SEQ ID NO: 210914 - DNA, 20 bp, Artificial
  CRISPR gRNA sequence
gacacggtagcaccagttgc

SEQ ID NO: 210915 - DNA, 20 bp, Artificial
  CRISPR gRNA sequence
acggtagcaccagttgcagg

SEQ ID NO: 210916 - DNA, 20 bp, Artificial
  CRISPR gRNA sequence
cggtagcaccagttgcagga

SEQ ID NO: 210917 - DNA, 20 bp, Artificial
  CRISPR gRNA sequence
gtagcaccagttgcaggaag

SEQ ID NO: 210918 - DNA, 20 bp, Artificial
  CRISPR gRNA sequence
caccagttgcaggaaggagc

SEQ ID NO: 210919 - DNA, 20 bp, Artificial
  CRISPR gRNA sequence
gaaggagccagacttgttct

SEQ ID NO: 210920 - DNA, 20 bp, Artificial
  CRISPR gRNA sequence
aggagccagacttgttctca

SEQ ID NO: 210921 - DNA, 20 bp, Artificial
  CRISPR gRNA sequence
agcactgtgttcacactttt

SEQ ID NO: 210922 - DNA, 20 bp, Artificial
  CRISPR gRNA sequence
ttcacacttttcagcaaaaa

SEQ ID NO: 210923 - DNA, 20 bp, Artificial
  CRISPR gRNA sequence
cttttcagcaaaaatagcta

SEQ ID NO: 210924 - DNA, 20 bp, Artificial
  CRISPR gRNA sequence
tattcccttcctctgatttg

SEQ ID NO: 210925 - DNA, 20 bp, Artificial
  CRISPR gRNA sequence
attcccttcctctgatttga

SEQ ID NO: 210926 - DNA, 20 bp, Artificial
  CRISPR gRNA sequence
gatttgaaggcaaaaatcta

SEQ ID NO: 210927 - DNA, 20 bp, Artificial
  CRISPR gRNA sequence
tcttcacttcttttctgatc

SEQ ID NO: 210928 - DNA, 20 bp, Artificial
  CRISPR gRNA sequence
cttcacttcttttctgatct

SEQ ID NO: 210929 - DNA, 20 bp, Artificial
  CRISPR gRNA sequence
ttcacttcttttctgatctg

SEQ ID NO: 210930 - DNA, 20 bp, Artificial
  CRISPR gRNA sequence
tctgatctggggcatgaaaa

SEQ ID NO: 210931 - DNA, 20 bp, Artificial
  CRISPR gRNA sequence
atctggggcatgaaaaaagc

SEQ ID NO: 210932 - DNA, 20 bp, Artificial
  CRISPR gRNA sequence
aagattgaaatttgaactat

SEQ ID NO: 210933 - DNA, 20 bp, Artificial
  CRISPR gRNA sequence
tgaactatgagtctcctgca

SEQ ID NO: 210934 - DNA, 20 bp, Artificial
  CRISPR gRNA sequence
aacaaaatgtgtgtcaccat

SEQ ID NO: 210935 - DNA, 20 bp, Artificial
  CRISPR gRNA sequence
acaaaatgtgtgtcaccatc

SEQ ID NO: 210936 - DNA, 20 bp, Artificial
  CRISPR gRNA sequence
gtgtgtcaccatcaggccaa

SEQ ID NO: 210937 - DNA, 20 bp, Artificial
  CRISPR gRNA sequence
tgtgtcaccatcaggccaac

SEQ ID NO: 210938 - DNA, 20 bp, Artificial
  CRISPR gRNA sequence
tcaccatcaggccaacaggc

SEQ ID NO: 210939 - DNA, 20 bp, Artificial
  CRISPR gRNA sequence
ccaacaggccagcccttgaa

SEQ ID NO: 210940 - DNA, 20 bp, Artificial
  CRISPR gRNA sequence
caacaggccagcccttgaat

SEQ ID NO: 210941 - DNA, 20 bp, Artificial
  CRISPR gRNA sequence
aacaggccagcccttgaatg

SEQ ID NO: 210942 - DNA, 20 bp, Artificial
  CRISPR gRNA sequence
cattcatcaccttcctcctg

SEQ ID NO: 210943 - DNA, 20 bp, Artificial
  CRISPR gRNA sequence
ccccttcccctatgattgaa

SEQ ID NO: 210944 - DNA, 20 bp, Artificial
  CRISPR gRNA sequence
aaaacccacatttcctatcc

SEQ ID NO: 210945 - DNA, 20 bp, Artificial
  CRISPR gRNA sequence
cccacatttcctatcctggt

SEQ ID NO: 210946 - DNA, 20 bp, Artificial
  CRISPR gRNA sequence
acatttcctatcctggttag

SEQ ID NO: 210947 - DNA, 20 bp, Artificial
  CRISPR gRNA sequence
gaagaaaattaatgttctga

SEQ ID NO: 210948 - DNA, 20 bp, Artificial
  CRISPR gRNA sequence
ttctgacagttgtgatcgcc

SEQ ID NO: 210949 - DNA, 20 bp, Artificial
  CRISPR gRNA sequence
ctgacagttgtgatcgcctg

SEQ ID NO: 210950 - DNA, 20 bp, Artificial
  CRISPR gRNA sequence
gtgatcgcctggagtacttt

SEQ ID NO: 210951 - DNA, 20 bp, Artificial
  CRISPR gRNA sequence
ctggagtacttttagacttt

SEQ ID NO: 210952 - DNA, 20 bp, Artificial
  CRISPR gRNA sequence
attcgttttttacctgtttg

SEQ ID NO: 210953 - DNA, 20 bp, Artificial
  CRISPR gRNA sequence
gtttgtatgtgcatacgtat

SEQ ID NO: 210954 - DNA, 20 bp, Artificial
  CRISPR gRNA sequence
gtatgtgcatacgtatgaga

SEQ ID NO: 210955 - DNA, 20 bp, Artificial
  CRISPR gRNA sequence
tatgtgcatacgtatgagat

SEQ ID NO: 210956 - DNA, 20 bp, Artificial
  CRISPR gRNA sequence
aggcacatgcatcttctgta

SEQ ID NO: 210957 - DNA, 20 bp, Artificial
  CRISPR gRNA sequence
atgcatcttctgtatggaca

SEQ ID NO: 210958 - DNA, 20 bp, Artificial
  CRISPR gRNA sequence
tgcatcttctgtatggacaa

SEQ ID NO: 210959 - DNA, 20 bp, Artificial
  CRISPR gRNA sequence
atcttctgtatggacaaagg

SEQ ID NO: 210960 - DNA, 20 bp, Artificial
  CRISPR gRNA sequence
tcttctgtatggacaaaggt

SEQ ID NO: 210961 - DNA, 20 bp, Artificial
  CRISPR gRNA sequence
cttctgtatggacaaaggtg

SEQ ID NO: 210962 - DNA, 20 bp, Artificial
  CRISPR gRNA sequence
ggacaaaggtggggtaccta

SEQ ID NO: 210963 - DNA, 20 bp, Artificial
  CRISPR gRNA sequence
gacaaaggtggggtacctac

SEQ ID NO: 210964 - DNA, 20 bp, Artificial
  CRISPR gRNA sequence
caaaggtggggtacctacag

SEQ ID NO: 210965 - DNA, 20 bp, Artificial
  CRISPR gRNA sequence
aaggtggggtacctacagga

SEQ ID NO: 210966 - DNA, 20 bp, Artificial
  CRISPR gRNA sequence
ggggtacctacaggagagca

SEQ ID NO: 210967 - DNA, 20 bp, Artificial
  CRISPR gRNA sequence
gggtacctacaggagagcaa

SEQ ID NO: 210968 - DNA, 20 bp, Artificial
  CRISPR gRNA sequence
aaaggttaattttgtgcttt

SEQ ID NO: 210969 - DNA, 20 bp, Artificial
  CRISPR gRNA sequence
agtaaaaacatttaaataca

SEQ ID NO: 210970 - DNA, 20 bp, Artificial
  CRISPR gRNA sequence
ttaaatacaaagttctttat

SEQ ID NO: 210971 - DNA, 20 bp, Artificial
  CRISPR gRNA sequence
taaatacaaagttctttatt

SEQ ID NO: 210972 - DNA, 20 bp, Artificial
  CRISPR gRNA sequence
atacaaagttctttattggg

SEQ ID NO: 210973 - DNA, 20 bp, Artificial
  CRISPR gRNA sequence
cttaaaacttttaaaacttc

SEQ ID NO: 210974 - DNA, 20 bp, Artificial
  CRISPR gRNA sequence
ttaaaacttttaaaacttct

SEQ ID NO: 210975 - DNA, 20 bp, Artificial
  CRISPR gRNA sequence
attcttcctgtttgtgtaat

SEQ ID NO: 210976 - DNA, 20 bp, Artificial
  CRISPR gRNA sequence
taataagatattcatatttg

SEQ ID NO: 210977 - DNA, 20 bp, Artificial
  CRISPR gRNA sequence
atttgtagttgcattaataa

SEQ ID NO: 210978 - DNA, 20 bp, Artificial
  CRISPR gRNA sequence
cattaataatagttatttct

SEQ ID NO: 210979 - DNA, 20 bp, Artificial
  CRISPR gRNA sequence
atagttatttcttagtccat

SEQ ID NO: 210980 - DNA, 20 bp, Artificial
  CRISPR gRNA sequence
ttgattgtcatatttcatgt

SEQ ID NO: 210981 - DNA, 20 bp, Artificial
  CRISPR gRNA sequence
tgattgtcatatttcatgtt

SEQ ID NO: 210982 - DNA, 20 bp, Artificial
  CRISPR gRNA sequence
tcatatttcatgttgggacc

SEQ ID NO: 210983 - DNA, 20 bp, Artificial
  CRISPR gRNA sequence
tatttcatgttgggaccaag

SEQ ID NO: 210984 - DNA, 20 bp, Artificial
  CRISPR gRNA sequence
gggaccaagtagtttgccca

SEQ ID NO: 210985 - DNA, 20 bp, Artificial
  CRISPR gRNA sequence
acctaaatttatgacctgct

SEQ ID NO: 210986 - DNA, 20 bp, Artificial
  CRISPR gRNA sequence
cctaaatttatgacctgctg

SEQ ID NO: 210987 - DNA, 20 bp, Artificial
  CRISPR gRNA sequence
tatgacctgctgaggcctct

SEQ ID NO: 210988 - DNA, 20 bp, Artificial
  CRISPR gRNA sequence
ctgaggcctctcagaaaact

SEQ ID NO: 210989 - DNA, 20 bp, Artificial
  CRISPR gRNA sequence
tctcagaaaactgagcatac

SEQ ID NO: 210990 - DNA, 20 bp, Artificial
  CRISPR gRNA sequence
agaaaactgagcatactagc

SEQ ID NO: 210991 - DNA, 20 bp, Artificial
  CRISPR gRNA sequence
aactgagcatactagcaaga

SEQ ID NO: 210992 - DNA, 20 bp, Artificial
  CRISPR gRNA sequence
tatattcttccttgattgtg

SEQ ID NO: 210993 - DNA, 20 bp, Artificial
  CRISPR gRNA sequence
gtccaaaataataacatata

SEQ ID NO: 210994 - DNA, 20 bp, Artificial
  CRISPR gRNA sequence
ccaaaataataacatatata

SEQ ID NO: 210995 - DNA, 20 bp, Artificial
  CRISPR gRNA sequence
caaaataataacatatatag

SEQ ID NO: 210996 - DNA, 20 bp, Artificial
  CRISPR gRNA sequence
aaaataataacatatataga

SEQ ID NO: 210997 - DNA, 20 bp, Artificial
  CRISPR gRNA sequence
aataataacatatatagagg

SEQ ID NO: 210998 - DNA, 20 bp, Artificial
  CRISPR gRNA sequence
attcctttatacaaatctga

SEQ ID NO: 210999 - DNA, 20 bp, Artificial
  CRISPR gRNA sequence
tacaaatctgatggctcctg

SEQ ID NO: 211000 - DNA, 20 bp, Artificial
  CRISPR gRNA sequence
atatttacattttgctaacc

SEQ ID NO: 211001 - DNA, 20 bp, Artificial
  CRISPR gRNA sequence
tagtttgttactttaaaaat

SEQ ID NO: 211002 - DNA, 20 bp, Artificial
  CRISPR gRNA sequence
ttaaaaatcagttttgatga

SEQ ID NO: 211003 - DNA, 20 bp, Artificial
  CRISPR gRNA sequence
taaaaatcagttttgatgaa

SEQ ID NO: 211004 - DNA, 20 bp, Artificial
  CRISPR gRNA sequence
aaaatcagttttgatgaaag

SEQ ID NO: 211005 - DNA, 20 bp, Artificial
  CRISPR gRNA sequence
aaatcagttttgatgaaagg

SEQ ID NO: 211006 - DNA, 20 bp, Artificial
  CRISPR gRNA sequence
aatcagttttgatgaaagga

SEQ ID NO: 211007 - DNA, 20 bp, Artificial
  CRISPR gRNA sequence
gttttgatgaaaggagggaa

SEQ ID NO: 211008 - DNA, 20 bp, Artificial
  CRISPR gRNA sequence
ttgatgaaaggagggaaaag

SEQ ID NO: 211009 - DNA, 20 bp, Artificial
  CRISPR gRNA sequence
tgaaaggagggaaaagcaga

SEQ ID NO: 211010 - DNA, 20 bp, Artificial
  CRISPR gRNA sequence
aaaagcagatggacttgaaa

SEQ ID NO: 211011 - DNA, 20 bp, Artificial
  CRISPR gRNA sequence
gatggacttgaaaaagatcc

SEQ ID NO: 211012 - DNA, 20 bp, Artificial
  CRISPR gRNA sequence
aaaaagatccaagctcctat

SEQ ID NO: 211013 - DNA, 20 bp, Artificial
  CRISPR gRNA sequence
gatccaagctcctattagaa

SEQ ID NO: 211014 - DNA, 20 bp, Artificial
  CRISPR gRNA sequence
atccaagctcctattagaaa

SEQ ID NO: 211015 - DNA, 20 bp, Artificial
  CRISPR gRNA sequence
aaaaggtatgaaaatcttta

SEQ ID NO: 211016 - DNA, 20 bp, Artificial
  CRISPR gRNA sequence
gtaaaattttttataaacta

SEQ ID NO: 211017 - DNA, 20 bp, Artificial
  CRISPR gRNA sequence
aagttgtaccttttaatatg

SEQ ID NO: 211018 - DNA, 20 bp, Artificial
  CRISPR gRNA sequence
gtagtaaactctcatttatt

SEQ ID NO: 211019 - DNA, 20 bp, Artificial
  CRISPR gRNA sequence
tagtaaactctcatttattt

SEQ ID NO: 211020 - DNA, 20 bp, Artificial
  CRISPR gRNA sequence
agtaaactctcatttatttg

SEQ ID NO: 211021 - DNA, 20 bp, Artificial
  CRISPR gRNA sequence
atttatttggggttcgctct

SEQ ID NO: 211022 - DNA, 20 bp, Artificial
  CRISPR gRNA sequence
tttaatgctgcctgcctttt

SEQ ID NO: 211023 - DNA, 20 bp, Artificial
  CRISPR gRNA sequence
ttaatgctgcctgccttttg

SEQ ID NO: 211024 - DNA, 20 bp, Artificial
  CRISPR gRNA sequence
ttttgaggcattcactgccc

SEQ ID NO: 211025 - DNA, 20 bp, Artificial
  CRISPR gRNA sequence
actgccctagacaatgccac

SEQ ID NO: 211026 - DNA, 20 bp, Artificial
  CRISPR gRNA sequence
tgccctagacaatgccacca

SEQ ID NO: 211027 - DNA, 20 bp, Artificial
  CRISPR gRNA sequence
ctagacaatgccaccagaga

SEQ ID NO: 211028 - DNA, 20 bp, Artificial
  CRISPR gRNA sequence
gacaatgccaccagagatag

SEQ ID NO: 211029 - DNA, 20 bp, Artificial
  CRISPR gRNA sequence
acaatgccaccagagatagt

SEQ ID NO: 211030 - DNA, 20 bp, Artificial
  CRISPR gRNA sequence
caatgccaccagagatagtg

SEQ ID NO: 211031 - DNA, 20 bp, Artificial
  CRISPR gRNA sequence
aatgccaccagagatagtgg

SEQ ID NO: 211032 - DNA, 20 bp, Artificial
  CRISPR gRNA sequence
agagatagtgggggaaatgc

SEQ ID NO: 211033 - DNA, 20 bp, Artificial
  CRISPR gRNA sequence
aaaccaactcttgctctcac

SEQ ID NO: 211034 - DNA, 20 bp, Artificial
  CRISPR gRNA sequence
ctcttgctctcactagttgt

SEQ ID NO: 211035 - DNA, 20 bp, Artificial
  CRISPR gRNA sequence
tcactagttgtcagcttctc

SEQ ID NO: 211036 - DNA, 20 bp, Artificial
  CRISPR gRNA sequence
agttgtcagcttctctggat

SEQ ID NO: 211037 - DNA, 20 bp, Artificial
  CRISPR gRNA sequence
cttctctggataagtgacca

SEQ ID NO: 211038 - DNA, 20 bp, Artificial
  CRISPR gRNA sequence
ctctggataagtgaccacag

SEQ ID NO: 211039 - DNA, 20 bp, Artificial
  CRISPR gRNA sequence
tggataagtgaccacagaag

SEQ ID NO: 211040 - DNA, 20 bp, Artificial
  CRISPR gRNA sequence
ggataagtgaccacagaagc

SEQ ID NO: 211041 - DNA, 20 bp, Artificial
  CRISPR gRNA sequence
ataagtgaccacagaagcag

SEQ ID NO: 211042 - DNA, 20 bp, Artificial
  CRISPR gRNA sequence
gaagcaggagtcctcctgct

SEQ ID NO: 211043 - DNA, 20 bp, Artificial
  CRISPR gRNA sequence
aagcaggagtcctcctgctt

SEQ ID NO: 211044 - DNA, 20 bp, Artificial
  CRISPR gRNA sequence
tcctcctgcttgggcatcat

SEQ ID NO: 211045 - DNA, 20 bp, Artificial
  CRISPR gRNA sequence
cctcctgcttgggcatcatt

SEQ ID NO: 211046 - DNA, 20 bp, Artificial
  CRISPR gRNA sequence
ctgcttgggcatcattgggc

SEQ ID NO: 211047 - DNA, 20 bp, Artificial
  CRISPR gRNA sequence
ccagttccttctctttaaat

SEQ ID NO: 211048 - DNA, 20 bp, Artificial
  CRISPR gRNA sequence
tctttaaatcagatttgtaa

SEQ ID NO: 211049 - DNA, 20 bp, Artificial
  CRISPR gRNA sequence
atcacatcacatttaaattg

SEQ ID NO: 211050 - DNA, 20 bp, Artificial
  CRISPR gRNA sequence
catcacatttaaattgcaga

SEQ ID NO: 211051 - DNA, 20 bp, Artificial
  CRISPR gRNA sequence
tgctttttactccctgatcc

SEQ ID NO: 211052 - DNA, 20 bp, Artificial
  CRISPR gRNA sequence
ctgctgttgactcttccatt

SEQ ID NO: 211053 - DNA, 20 bp, Artificial
  CRISPR gRNA sequence
ttatttattgtgtgttctca

SEQ ID NO: 211054 - DNA, 20 bp, Artificial
  CRISPR gRNA sequence
cttttctgcaacaacctttc

SEQ ID NO: 211055 - DNA, 20 bp, Artificial
  CRISPR gRNA sequence
cttcaaaacattctcctttg

SEQ ID NO: 211056 - DNA, 20 bp, Artificial
  CRISPR gRNA sequence
gcagttcctcttcatctgtg

SEQ ID NO: 211057 - DNA, 20 bp, Artificial
  CRISPR gRNA sequence
ctcttaacttaccattccta

SEQ ID NO: 211058 - DNA, 20 bp, Artificial
  CRISPR gRNA sequence
gtactttatgcatctctgct

SEQ ID NO: 211059 - DNA, 20 bp, Artificial
  CRISPR gRNA sequence
gcatctctgcttagttctat

SEQ ID NO: 211060 - DNA, 20 bp, Artificial
  CRISPR gRNA sequence
gcttagttctattagttttt

SEQ ID NO: 211061 - DNA, 20 bp, Artificial
  CRISPR gRNA sequence
tgattttaaaattccttcta

SEQ ID NO: 211062 - DNA, 20 bp, Artificial
  CRISPR gRNA sequence
tttaaaattccttctatagc

SEQ ID NO: 211063 - DNA, 20 bp, Artificial
  CRISPR gRNA sequence
taaaattccttctatagcta

SEQ ID NO: 211064 - DNA, 20 bp, Artificial
  CRISPR gRNA sequence
tctttcattctctcttcctg

SEQ ID NO: 211065 - DNA, 20 bp, Artificial
  CRISPR gRNA sequence
ctgcagtgttttgcatacat

SEQ ID NO: 211066 - DNA, 20 bp, Artificial
  CRISPR gRNA sequence
cagtgttttgcatacatcag

SEQ ID NO: 211067 - DNA, 20 bp, Artificial
  CRISPR gRNA sequence
gttttgcatacatcagaagc

SEQ ID NO: 211068 - DNA, 20 bp, Artificial
  CRISPR gRNA sequence
ttttgcatacatcagaagct

SEQ ID NO: 211069 - DNA, 20 bp, Artificial
  CRISPR gRNA sequence
acatcagaagctaggtacat

SEQ ID NO: 211070 - DNA, 20 bp, Artificial
  CRISPR gRNA sequence
ggtacataagttaaatgatt

SEQ ID NO: 211071 - DNA, 20 bp, Artificial
  CRISPR gRNA sequence
tacataagttaaatgattga

SEQ ID NO: 211072 - DNA, 20 bp, Artificial
  CRISPR gRNA sequence
taagttaaatgattgagagt

SEQ ID NO: 211073 - DNA, 20 bp, Artificial
  CRISPR gRNA sequence
gattgagagttggctgtatt

SEQ ID NO: 211074 - DNA, 20 bp, Artificial
  CRISPR gRNA sequence
ttagatttatcactttttaa

SEQ ID NO: 211075 - DNA, 20 bp, Artificial
  CRISPR gRNA sequence
tagatttatcactttttaat

SEQ ID NO: 211076 - DNA, 20 bp, Artificial
  CRISPR gRNA sequence
agatttatcactttttaata

SEQ ID NO: 211077 - DNA, 20 bp, Artificial
  CRISPR gRNA sequence
ttatcactttttaatagggt

SEQ ID NO: 211078 - DNA, 20 bp, Artificial
  CRISPR gRNA sequence
ctttttaatagggtgagctt

SEQ ID NO: 211079 - DNA, 20 bp, Artificial
  CRISPR gRNA sequence
ttttaatagggtgagcttga

SEQ ID NO: 211080 - DNA, 20 bp, Artificial
  CRISPR gRNA sequence
acatgctctaaaaaccttca

SEQ ID NO: 211081 - DNA, 20 bp, Artificial
  CRISPR gRNA sequence
catgctctaaaaaccttcaa

SEQ ID NO: 211082 - DNA, 20 bp, Artificial
  CRISPR gRNA sequence
aaaggtgattatttttctcc

SEQ ID NO: 211083 - DNA, 20 bp, Artificial
  CRISPR gRNA sequence
tatttttctcctggaaactc

SEQ ID NO: 211084 - DNA, 20 bp, Artificial
  CRISPR gRNA sequence
atttttctcctggaaactcc

SEQ ID NO: 211085 - DNA, 20 bp, Artificial
  CRISPR gRNA sequence
tccattctgtttaaatccct

SEQ ID NO: 211086 - DNA, 20 bp, Artificial
  CRISPR gRNA sequence
gtttaaatccctaagaatgt

SEQ ID NO: 211087 - DNA, 20 bp, Artificial
  CRISPR gRNA sequence
gaatgtcagaattaaaataa

SEQ ID NO: 211088 - DNA, 20 bp, Artificial
  CRISPR gRNA sequence
aatgtcagaattaaaataac

SEQ ID NO: 211089 - DNA, 20 bp, Artificial
  CRISPR gRNA sequence
atgtcagaattaaaataaca

SEQ ID NO: 211090 - DNA, 20 bp, Artificial
  CRISPR gRNA sequence
taacagggctatcccgtaat

SEQ ID NO: 211091 - DNA, 20 bp, Artificial
  CRISPR gRNA sequence
attggaaatatttctttttt

SEQ ID NO: 211092 - DNA, 20 bp, Artificial
  CRISPR gRNA sequence
ttggaaatatttcttttttc

SEQ ID NO: 211093 - DNA, 20 bp, Artificial
  CRISPR gRNA sequence
tttcttttttcaggatgcta

SEQ ID NO: 211094 - DNA, 20 bp, Artificial
  CRISPR gRNA sequence
tcaggatgctatagtcaatt

SEQ ID NO: 211095 - DNA, 20 bp, Artificial
  CRISPR gRNA sequence
gatgctatagtcaatttagt

SEQ ID NO: 211096 - DNA, 20 bp, Artificial
  CRISPR gRNA sequence
aattgttatttgcactaaca

SEQ ID NO: 211097 - DNA, 20 bp, Artificial
  CRISPR gRNA sequence
aacaaagctcaaaacacgat

SEQ ID NO: 211098 - DNA, 20 bp, Artificial
  CRISPR gRNA sequence
ataagtttactcctccatct

SEQ ID NO: 211099 - DNA, 20 bp, Artificial
  CRISPR gRNA sequence
ccatctcagtaataaaaatt

SEQ ID NO: 211100 - DNA, 20 bp, Artificial
  CRISPR gRNA sequence
ttaagctgtaatcaaccttc

SEQ ID NO: 211101 - DNA, 20 bp, Artificial
  CRISPR gRNA sequence
taagctgtaatcaaccttct

SEQ ID NO: 211102 - DNA, 20 bp, Artificial
  CRISPR gRNA sequence
aggtttctcttgtcttaaaa

SEQ ID NO: 211103 - DNA, 20 bp, Artificial
  CRISPR gRNA sequence
ggtttctcttgtcttaaaat

SEQ ID NO: 211104 - DNA, 20 bp, Artificial
  CRISPR gRNA sequence
ttaaaatgggtattcaaaaa

SEQ ID NO: 211105 - DNA, 20 bp, Artificial
  CRISPR gRNA sequence
taaaatgggtattcaaaaat

SEQ ID NO: 211106 - DNA, 20 bp, Artificial
  CRISPR gRNA sequence
aaaatgggtattcaaaaatg

SEQ ID NO: 211107 - DNA, 20 bp, Artificial
  CRISPR gRNA sequence
tattcaaaaatggggatctg

SEQ ID NO: 211108 - DNA, 20 bp, Artificial
  CRISPR gRNA sequence
ggggatctgtggtgtatgta

SEQ ID NO: 211109 - DNA, 20 bp, Artificial
  CRISPR gRNA sequence
ctccttaatttacctgttgt

SEQ ID NO: 211110 - DNA, 20 bp, Artificial
  CRISPR gRNA sequence
atttacctgttgttggaaac

SEQ ID NO: 211111 - DNA, 20 bp, Artificial
  CRISPR gRNA sequence
ttacctgttgttggaaactg

SEQ ID NO: 211112 - DNA, 20 bp, Artificial
  CRISPR gRNA sequence
gaaactggagaaatgattgt

SEQ ID NO: 211113 - DNA, 20 bp, Artificial
  CRISPR gRNA sequence
aaactggagaaatgattgtc

SEQ ID NO: 211114 - DNA, 20 bp, Artificial
  CRISPR gRNA sequence
attttttattgtattttatt

SEQ ID NO: 211115 - DNA, 20 bp, Artificial
  CRISPR gRNA sequence
ttattgtattttatttggtt

SEQ ID NO: 211116 - DNA, 20 bp, Artificial
  CRISPR gRNA sequence
tattgtattttatttggttg

SEQ ID NO: 211117 - DNA, 20 bp, Artificial
  CRISPR gRNA sequence
attgtattttatttggttga

SEQ ID NO: 211118 - DNA, 20 bp, Artificial
  CRISPR gRNA sequence
ttgagggatttttttataaa

SEQ ID NO: 211119 - DNA, 20 bp, Artificial
  CRISPR gRNA sequence
tactaactgccatcacctgc

SEQ ID NO: 211120 - DNA, 20 bp, Artificial
  CRISPR gRNA sequence
actaactgccatcacctgct

SEQ ID NO: 211121 - DNA, 20 bp, Artificial
  CRISPR gRNA sequence
ctaactgccatcacctgctg

SEQ ID NO: 211122 - DNA, 20 bp, Artificial
  CRISPR gRNA sequence
cacctgctggggtcctttgt

SEQ ID NO: 211123 - DNA, 20 bp, Artificial
  CRISPR gRNA sequence
acctgctggggtcctttgtt

SEQ ID NO: 211124 - DNA, 20 bp, Artificial
  CRISPR gRNA sequence
gtcctttgttaggtcatttt

SEQ ID NO: 211125 - DNA, 20 bp, Artificial
  CRISPR gRNA sequence
aggtcattttcagtgactaa

SEQ ID NO: 211126 - DNA, 20 bp, Artificial
  CRISPR gRNA sequence
ggtcattttcagtgactaat

SEQ ID NO: 211127 - DNA, 20 bp, Artificial
  CRISPR gRNA sequence
gtcattttcagtgactaata

SEQ ID NO: 211128 - DNA, 20 bp, Artificial
  CRISPR gRNA sequence
agtgactaatagggataatc

SEQ ID NO: 211129 - DNA, 20 bp, Artificial
  CRISPR gRNA sequence
gtgactaatagggataatcc

SEQ ID NO: 211130 - DNA, 20 bp, Artificial
  CRISPR gRNA sequence
ggataatccaggtaactttg

SEQ ID NO: 211131 - DNA, 20 bp, Artificial
  CRISPR gRNA sequence
ataatccaggtaactttgaa

SEQ ID NO: 211132 - DNA, 20 bp, Artificial
  CRISPR gRNA sequence
ccaggtaactttgaagagat

SEQ ID NO: 211133 - DNA, 20 bp, Artificial
  CRISPR gRNA sequence
ggtaactttgaagagatgag

SEQ ID NO: 211134 - DNA, 20 bp, Artificial
  CRISPR gRNA sequence
actttgaagagatgagcagt

SEQ ID NO: 211135 - DNA, 20 bp, Artificial
  CRISPR gRNA sequence
agagatgagcagtgagtgac

SEQ ID NO: 211136 - DNA, 20 bp, Artificial
  CRISPR gRNA sequence
gagatgagcagtgagtgacc

SEQ ID NO: 211137 - DNA, 20 bp, Artificial
  CRISPR gRNA sequence
atgagcagtgagtgaccagg

SEQ ID NO: 211138 - DNA, 20 bp, Artificial
  CRISPR gRNA sequence
ccaggcagtttttctgcctt

SEQ ID NO: 211139 - DNA, 20 bp, Artificial
  CRISPR gRNA sequence
ttttctgcctttagctttga

SEQ ID NO: 211140 - DNA, 20 bp, Artificial
  CRISPR gRNA sequence
agctttgacagttcttaatt

SEQ ID NO: 211141 - DNA, 20 bp, Artificial
  CRISPR gRNA sequence
gttcttaattaagatcattg

SEQ ID NO: 211142 - DNA, 20 bp, Artificial
  CRISPR gRNA sequence
taattaagatcattgaagac

SEQ ID NO: 211143 - DNA, 20 bp, Artificial
  CRISPR gRNA sequence
aaatttctctttttgaaaaa

SEQ ID NO: 211144 - DNA, 20 bp, Artificial
  CRISPR gRNA sequence
ttctctttttgaaaaaaaga

SEQ ID NO: 211145 - DNA, 20 bp, Artificial
  CRISPR gRNA sequence
aaaaagaaagcatttgtact

SEQ ID NO: 211146 - DNA, 20 bp, Artificial
  CRISPR gRNA sequence
tttgtactaagctcctctgt

SEQ ID NO: 211147 - DNA, 20 bp, Artificial
  CRISPR gRNA sequence
gacaacatcttaaatcttaa

SEQ ID NO: 211148 - DNA, 20 bp, Artificial
  CRISPR gRNA sequence
aaaagtgttgttatcatgac

SEQ ID NO: 211149 - DNA, 20 bp, Artificial
  CRISPR gRNA sequence
gtgttgttatcatgactggt

SEQ ID NO: 211150 - DNA, 20 bp, Artificial
  CRISPR gRNA sequence
gttgttatcatgactggtga

SEQ ID NO: 211151 - DNA, 20 bp, Artificial
  CRISPR gRNA sequence
gttatcatgactggtgagag

SEQ ID NO: 211152 - DNA, 20 bp, Artificial
  CRISPR gRNA sequence
aacattttgtttttattaaa

SEQ ID NO: 211153 - DNA, 20 bp, Artificial
  CRISPR gRNA sequence
cattttgtttttattaaatg

SEQ ID NO: 211154 - DNA, 20 bp, Artificial
  CRISPR gRNA sequence
aatggagcattatttacaaa

SEQ ID NO: 211155 - DNA, 20 bp, Artificial
  CRISPR gRNA sequence
atttacaaaaagccattgtt

SEQ ID NO: 211156 - DNA, 20 bp, Artificial
  CRISPR gRNA sequence
aaaaagccattgttgagaat

SEQ ID NO: 211157 - DNA, 20 bp, Artificial
  CRISPR gRNA sequence
tctattaaccattctaaata

SEQ ID NO: 211158 - DNA, 20 bp, Artificial
  CRISPR gRNA sequence
tattaaccattctaaataaa

SEQ ID NO: 211159 - DNA, 20 bp, Artificial
  CRISPR gRNA sequence
attctaaataaagagaactc

SEQ ID NO: 211160 - DNA, 20 bp, Artificial
  CRISPR gRNA sequence
actccagtgttgctatgtgc

SEQ ID NO: 211161 - DNA, 20 bp, Artificial
  CRISPR gRNA sequence
ctatgtgcaagatcctctct

SEQ ID NO: 211162 - DNA, 20 bp, Artificial
  CRISPR gRNA sequence
atgtgcaagatcctctcttg

SEQ ID NO: 211163 - DNA, 20 bp, Artificial
  CRISPR gRNA sequence
tctcttggagcttttttgca

SEQ ID NO: 211164 - DNA, 20 bp, Artificial
  CRISPR gRNA sequence
gcttttttgcatagcaatta

SEQ ID NO: 211165 - DNA, 20 bp, Artificial
  CRISPR gRNA sequence
cttttttgcatagcaattaa

SEQ ID NO: 211166 - DNA, 20 bp, Artificial
  CRISPR gRNA sequence
attaaaggtgtgctatttgt

SEQ ID NO: 211167 - DNA, 20 bp, Artificial
  CRISPR gRNA sequence
aaaggtgtgctatttgtcag

SEQ ID NO: 211168 - DNA, 20 bp, Artificial
  CRISPR gRNA sequence
tgtcagtagccatttttttg

SEQ ID NO: 211169 - DNA, 20 bp, Artificial
  CRISPR gRNA sequence
catttttttgcagtgatttg

SEQ ID NO: 211170 - DNA, 20 bp, Artificial
  CRISPR gRNA sequence
ttgcagtgatttgaagacca

SEQ ID NO: 211171 - DNA, 20 bp, Artificial
  CRISPR gRNA sequence
tgaagaccaaagttgtttta

SEQ ID NO: 211172 - DNA, 20 bp, Artificial
  CRISPR gRNA sequence
ttacagctgtgttaccgtta

SEQ ID NO: 211173 - DNA, 20 bp, Artificial
  CRISPR gRNA sequence
tacagctgtgttaccgttaa

SEQ ID NO: 211174 - DNA, 20 bp, Artificial
  CRISPR gRNA sequence
aatcaatttatcactgttta

SEQ ID NO: 211175 - DNA, 20 bp, Artificial
  CRISPR gRNA sequence
gaatatctgcaatctttgcc

SEQ ID NO: 211176 - DNA, 20 bp, Artificial
  CRISPR gRNA sequence
aatatctgcaatctttgcca

SEQ ID NO: 211177 - DNA, 20 bp, Artificial
  CRISPR gRNA sequence
tatacttaataaaacatttt

SEQ ID NO: 211178 - DNA, 20 bp, Artificial
  CRISPR gRNA sequence
aacattttaagctattttgt

SEQ ID NO: 211179 - DNA, 20 bp, Artificial
  CRISPR gRNA sequence
acattttaagctattttgtt

SEQ ID NO: 211180 - DNA, 20 bp, Artificial
  CRISPR gRNA sequence
ggctatttctattgctgcta

SEQ ID NO: 211181 - DNA, 20 bp, Artificial
  CRISPR gRNA sequence
tatttctattgctgctacag

SEQ ID NO: 211182 - DNA, 20 bp, Artificial
  CRISPR gRNA sequence
ttgctgctacagcagaccac

SEQ ID NO: 211183 - DNA, 20 bp, Artificial
  CRISPR gRNA sequence
taatttattaatgtattttt

SEQ ID NO: 211184 - DNA, 20 bp, Artificial
  CRISPR gRNA sequence
tttttaagttgcttatattc

SEQ ID NO: 211185 - DNA, 20 bp, Artificial
  CRISPR gRNA sequence
ttttaagttgcttatattct

SEQ ID NO: 211186 - DNA, 20 bp, Artificial
  CRISPR gRNA sequence
atattctaggtaacaatgta

SEQ ID NO: 211187 - DNA, 20 bp, Artificial
  CRISPR gRNA sequence
atattaattatgaatttttt

SEQ ID NO: 211188 - DNA, 20 bp, Artificial
  CRISPR gRNA sequence
ttttgagtataatacccaat

SEQ ID NO: 211189 - DNA, 20 bp, Artificial
  CRISPR gRNA sequence
atacccaataagcttttaat

SEQ ID NO: 211190 - DNA, 20 bp, Artificial
  CRISPR gRNA sequence
acccaataagcttttaatta

SEQ ID NO: 211191 - DNA, 20 bp, Artificial
  CRISPR gRNA sequence
caataagcttttaattagag

SEQ ID NO: 211192 - DNA, 20 bp, Artificial
  CRISPR gRNA sequence
ataagcttttaattagagca

SEQ ID NO: 211193 - DNA, 20 bp, Artificial
  CRISPR gRNA sequence
tagagcagagttttaattaa

SEQ ID NO: 211194 - DNA, 20 bp, Artificial
  CRISPR gRNA sequence
tttaattaaaagttttaaat

SEQ ID NO: 211195 - DNA, 20 bp, Artificial
  CRISPR gRNA sequence
ttattttttaattttctcca

SEQ ID NO: 211196 - DNA, 20 bp, Artificial
  CRISPR gRNA sequence
ttttaattttctccatggtg

SEQ ID NO: 211197 - DNA, 20 bp, Artificial
  CRISPR gRNA sequence
gtgcagtgaaaacatcacat

SEQ ID NO: 211198 - DNA, 20 bp, Artificial
  CRISPR gRNA sequence
agtgaaaacatcacatgaga

SEQ ID NO: 211199 - DNA, 20 bp, Artificial
  CRISPR gRNA sequence
gaaaacatcacatgagaaag

SEQ ID NO: 211200 - DNA, 20 bp, Artificial
  CRISPR gRNA sequence
aaaacatcacatgagaaagc

SEQ ID NO: 211201 - DNA, 20 bp, Artificial
  CRISPR gRNA sequence
aacatcacatgagaaagcag

SEQ ID NO: 211202 - DNA, 20 bp, Artificial
  CRISPR gRNA sequence
acatgagaaagcaggagacc

SEQ ID NO: 211203 - DNA, 20 bp, Artificial
  CRISPR gRNA sequence
catgagaaagcaggagacct

SEQ ID NO: 211204 - DNA, 20 bp, Artificial
  CRISPR gRNA sequence
aaagcaggagacctgggtgc

SEQ ID NO: 211205 - DNA, 20 bp, Artificial
  CRISPR gRNA sequence
ggagacctgggtgctagtcc

SEQ ID NO: 211206 - DNA, 20 bp, Artificial
  CRISPR gRNA sequence
ctgctctaattaaaagctta

SEQ ID NO: 211207 - DNA, 20 bp, Artificial
  CRISPR gRNA sequence
tcattctttacattgttacc

SEQ ID NO: 211208 - DNA, 20 bp, Artificial
  CRISPR gRNA sequence
attaagtatatataatatta

SEQ ID NO: 211209 - DNA, 20 bp, Artificial
  CRISPR gRNA sequence
tatgcaaaaaagctccaaga

SEQ ID NO: 211210 - DNA, 20 bp, Artificial
  CRISPR gRNA sequence
gatcttgcacatagcaacac

SEQ ID NO: 211211 - DNA, 20 bp, Artificial
  CRISPR gRNA sequence
acactggagttctctttatt

SEQ ID NO: 211212 - DNA, 20 bp, Artificial
  CRISPR gRNA sequence
taatagatatttatacgatg

SEQ ID NO: 211213 - DNA, 20 bp, Artificial
  CRISPR gRNA sequence
gctcatctcttcaaagttac

SEQ ID NO: 211214 - DNA, 20 bp, Artificial
  CRISPR gRNA sequence
ttccaacaacaggtaaatta

SEQ ID NO: 211215 - DNA, 20 bp, Artificial
  CRISPR gRNA sequence
tacaccacagatccccattt

SEQ ID NO: 211216 - DNA, 20 bp, Artificial
  CRISPR gRNA sequence
aatttttattactgagatgg

SEQ ID NO: 211217 - DNA, 20 bp, Artificial
  CRISPR gRNA sequence
aaaagaaatatttccaatta

SEQ ID NO: 211218 - DNA, 20 bp, Artificial
  CRISPR gRNA sequence
attttaattctgacattctt

SEQ ID NO: 211219 - DNA, 20 bp, Artificial
  CRISPR gRNA sequence
gacattcttagggatttaaa

SEQ ID NO: 211220 - DNA, 20 bp, Artificial
  CRISPR gRNA sequence
ggatttaaacagaatggacc

SEQ ID NO: 211221 - DNA, 20 bp, Artificial
  CRISPR gRNA sequence
tgcaaaacactgcaggaaga

SEQ ID NO: 211222 - DNA, 20 bp, Artificial
  CRISPR gRNA sequence
agaaaagctctagctataga

SEQ ID NO: 211223 - DNA, 20 bp, Artificial
  CRISPR gRNA sequence
agagatgcataaagtactat

SEQ ID NO: 211224 - DNA, 20 bp, Artificial
  CRISPR gRNA sequence
gatgaagaggaactgcaaag

SEQ ID NO: 211225 - DNA, 20 bp, Artificial
  CRISPR gRNA sequence
gttttgaaggagaagacaaa

SEQ ID NO: 211226 - DNA, 20 bp, Artificial
  CRISPR gRNA sequence
agaacacacaataaataaaa

SEQ ID NO: 211227 - DNA, 20 bp, Artificial
  CRISPR gRNA sequence
caataaataaaactgaatgg

SEQ ID NO: 211228 - DNA, 20 bp, Artificial
  CRISPR gRNA sequence
gaagagtcaacagcagaaac

SEQ ID NO: 211229 - DNA, 20 bp, Artificial
  CRISPR gRNA sequence
aacagcagaaactgggatca

SEQ ID NO: 211230 - DNA, 20 bp, Artificial
  CRISPR gRNA sequence
gcaatttaaatgtgatgtga

SEQ ID NO: 211231 - DNA, 20 bp, Artificial
  CRISPR gRNA sequence
agctgacaactagtgagagc

SEQ ID NO: 211232 - DNA, 20 bp, Artificial
  CRISPR gRNA sequence
tggtggcattgtctagggca

SEQ ID NO: 211233 - DNA, 20 bp, Artificial
  CRISPR gRNA sequence
gcagcattaaagagaacaca

SEQ ID NO: 211234 - DNA, 20 bp, Artificial
  CRISPR gRNA sequence
cattaaagagaacacaatgg

SEQ ID NO: 211235 - DNA, 20 bp, Artificial
  CRISPR gRNA sequence
agagcgaaccccaaataaat

SEQ ID NO: 211236 - DNA, 20 bp, Artificial
  CRISPR gRNA sequence
ataccttttctaataggagc

SEQ ID NO: 211237 - DNA, 20 bp, Artificial
  CRISPR gRNA sequence
gagccatcagatttgtataa

SEQ ID NO: 211238 - DNA, 20 bp, Artificial
  CRISPR gRNA sequence
ggacagctacacaatcaagg

SEQ ID NO: 211239 - DNA, 20 bp, Artificial
  CRISPR gRNA sequence
ttattaatgcaactacaaat

SEQ ID NO: 211240 - DNA, 20 bp, Artificial
  CRISPR gRNA sequence
tatcttattacacaaacagg

SEQ ID NO: 211241 - DNA, 20 bp, Artificial
  CRISPR gRNA sequence
ggaagaattacgtattttta

SEQ ID NO: 211242 - DNA, 20 bp, Artificial
  CRISPR gRNA sequence
catccacaaacaggtaaaaa

SEQ ID NO: 211243 - DNA, 20 bp, Artificial
  CRISPR gRNA sequence
aacattaattttcttctaac

SEQ ID NO: 211244 - DNA, 20 bp, Artificial
  CRISPR gRNA sequence
ttctaaccaggataggaaat

SEQ ID NO: 211245 - DNA, 20 bp, Artificial
  CRISPR gRNA sequence
cttttcaatcataggggaag

SEQ ID NO: 211246 - DNA, 20 bp, Artificial
  CRISPR gRNA sequence
aggactacaggaggaaggtg

SEQ ID NO: 211247 - DNA, 20 bp, Artificial
  CRISPR gRNA sequence
ttgccttcaaatcagaggaa

SEQ ID NO: 211248 - DNA, 20 bp, Artificial
  CRISPR gRNA sequence
caagtaacaggaggacaaga

SEQ ID NO: 211249 - DNA, 20 bp, Artificial
  CRISPR gRNA sequence
gaggacaagacagggtttca

SEQ ID NO: 211250 - DNA, 20 bp, Artificial
  CRISPR gRNA sequence
acagggtttcaaggggttat

SEQ ID NO: 211251 - DNA, 20 bp, Artificial
  CRISPR gRNA sequence
gttacactgtttgttgaagg

SEQ ID NO: 211252 - DNA, 20 bp, Artificial
  CRISPR gRNA sequence
gtttgttgaagggggaatgt

SEQ ID NO: 211253 - DNA, 20 bp, Artificial
  CRISPR gRNA sequence
atgtgggaatggcaaccccc

SEQ ID NO: 211254 - DNA, 20 bp, Artificial
  CRISPR gRNA sequence
tgcccaaagctgctgtgaac

SEQ ID NO: 211255 - DNA, 20 bp, Artificial
  CRISPR gRNA sequence
actggttttcatagatatct

SEQ ID NO: 211256 - DNA, 20 bp, Artificial
  CRISPR gRNA sequence
ttaaaaataacaacaaaaaa

SEQ ID NO: 211257 - DNA, 20 bp, Artificial
  CRISPR gRNA sequence
ttaactaaattacagctgct

SEQ ID NO: 211258 - DNA, 20 bp, Artificial
  CRISPR gRNA sequence
aacttaactaacaatcacgt

SEQ ID NO: 211259 - DNA, 20 bp, Artificial
  CRISPR gRNA sequence
cttgtttcttctccccaaca

SEQ ID NO: 211260 - DNA, 20 bp, Artificial
  CRISPR gRNA sequence
cgtcttactactctccaaat

SEQ ID NO: 211261 - DNA, 20 bp, Artificial
  CRISPR gRNA sequence
aaatgaaagtaaaaaatcaa

SEQ ID NO: 211262 - DNA, 20 bp, Artificial
  CRISPR gRNA sequence
agtctgataatctctgtttg

SEQ ID NO: 211263 - DNA, 20 bp, Artificial
  CRISPR gRNA sequence
aaagcaaaagatgttgatcc

SEQ ID NO: 211264 - DNA, 20 bp, Artificial
  CRISPR gRNA sequence
aatattctataatattcact

SEQ ID NO: 211265 - DNA, 20 bp, Artificial
  CRISPR gRNA sequence
taaaaacaaattctgatcag

SEQ ID NO: 211266 - DNA, 20 bp, Artificial
  CRISPR gRNA sequence
ctgaatattagcaaaattaa

SEQ ID NO: 211267 - DNA, 20 bp, Artificial
  CRISPR gRNA sequence
aaaaaaaaaaaataggacat

SEQ ID NO: 211268 - DNA, 20 bp, Artificial
  CRISPR gRNA sequence
tgaactatagtcttttttag

SEQ ID NO: 211269 - DNA, 20 bp, Artificial
  CRISPR gRNA sequence
gtgacacaaacatacaaaag

SEQ ID NO: 211270 - DNA, 20 bp, Artificial
  CRISPR gRNA sequence
gatcattctgtgactccatg

SEQ ID NO: 211271 - DNA, 20 bp, Artificial
  CRISPR gRNA sequence
tttgttcaccaatgcatgac

SEQ ID NO: 211272 - DNA, 20 bp, Artificial
  CRISPR gRNA sequence
tttttttttttttcttgaga

SEQ ID NO: 211273 - DNA, 20 bp, Artificial
  CRISPR gRNA sequence
tcttgctctgtcacccaggc

SEQ ID NO: 211274 - DNA, 20 bp, Artificial
  CRISPR gRNA sequence
ctcactgcaagctctgcctc

SEQ ID NO: 211275 - DNA, 20 bp, Artificial
  CRISPR gRNA sequence
ttttgtagttttagtagaga

SEQ ID NO: 211276 - DNA, 20 bp, Artificial
  CRISPR gRNA sequence
cggggtttcaccgtgttagc

SEQ ID NO: 211277 - DNA, 20 bp, Artificial
  CRISPR gRNA sequence
gcctcggcctcccaaagtgc

SEQ ID NO: 211278 - DNA, 20 bp, Artificial
  CRISPR gRNA sequence
agccaccgcgcccggccgac

SEQ ID NO: 211279 - DNA, 20 bp, Artificial
  CRISPR gRNA sequence
aaatattaatgacacttggg

SEQ ID NO: 211280 - DNA, 20 bp, Artificial
  CRISPR gRNA sequence
cttggggggaatatagcttc

SEQ ID NO: 211281 - DNA, 20 bp, Artificial
  CRISPR gRNA sequence
gcaaactatttacatgaccg

SEQ ID NO: 211282 - DNA, 20 bp, Artificial
  CRISPR gRNA sequence
actaaatgccaacaaaactg

SEQ ID NO: 211283 - DNA, 20 bp, Artificial
  CRISPR gRNA sequence
aagattagaagttattagcc

SEQ ID NO: 211284 - DNA, 20 bp, Artificial
  CRISPR gRNA sequence
agcagagatgttaagtcccc

SEQ ID NO: 211285 - DNA, 20 bp, Artificial
  CRISPR gRNA sequence
aaagttacagtcaccagaca

SEQ ID NO: 211286 - DNA, 20 bp, Artificial
  CRISPR gRNA sequence
tttgctgggagccatatgac

SEQ ID NO: 211287 - DNA, 20 bp, Artificial
  CRISPR gRNA sequence
tcatcattccttttgattct

SEQ ID NO: 211288 - DNA, 20 bp, Artificial
  CRISPR gRNA sequence
ccttttgattctttgaatgc

SEQ ID NO: 211289 - DNA, 20 bp, Artificial
  CRISPR gRNA sequence
tttcattatgtagcctttct

SEQ ID NO: 211290 - DNA, 20 bp, Artificial
  CRISPR gRNA sequence
catcacaaattggaagtaat

SEQ ID NO: 211291 - DNA, 20 bp, Artificial
  CRISPR gRNA sequence
attgggatccttctctacta

SEQ ID NO: 211292 - DNA, 20 bp, Artificial
  CRISPR gRNA sequence
ggtaagcagctacttagaca

SEQ ID NO: 211293 - DNA, 20 bp, Artificial
  CRISPR gRNA sequence
agtgcatttttcccagtggt

SEQ ID NO: 211294 - DNA, 20 bp, Artificial
  CRISPR gRNA sequence
cttttttattttttttgaga

SEQ ID NO: 211295 - DNA, 20 bp, Artificial
  CRISPR gRNA sequence
gtctcactctgtcaccaggc

SEQ ID NO: 211296 - DNA, 20 bp, Artificial
  CRISPR gRNA sequence
ctcactgcaacatctgcctt

SEQ ID NO: 211297 - DNA, 20 bp, Artificial
  CRISPR gRNA sequence
aattctcctgcctcagcctc

SEQ ID NO: 211298 - DNA, 20 bp, Artificial
  CRISPR gRNA sequence
ttttgtattttcagtagaga

SEQ ID NO: 211299 - DNA, 20 bp, Artificial
  CRISPR gRNA sequence
cagggtttcaacatgttggc

SEQ ID NO: 211300 - DNA, 20 bp, Artificial
  CRISPR gRNA sequence
gccttggcctcccaaggtgc

SEQ ID NO: 211301 - DNA, 20 bp, Artificial
  CRISPR gRNA sequence
cacccagcccataattcttg

SEQ ID NO: 211302 - DNA, 20 bp, Artificial
  CRISPR gRNA sequence
ataattcttgatgaataatc

SEQ ID NO: 211303 - DNA, 20 bp, Artificial
  CRISPR gRNA sequence
gatcaaattatgatctggta

SEQ ID NO: 211304 - DNA, 20 bp, Artificial
  CRISPR gRNA sequence
ttatgatctggtaaaggatt

SEQ ID NO: 211305 - DNA, 20 bp, Artificial
  CRISPR gRNA sequence
gaaataaccacataccatta

SEQ ID NO: 211306 - DNA, 20 bp, Artificial
  CRISPR gRNA sequence
ttaaagcaaagcttgccaag

SEQ ID NO: 211307 - DNA, 20 bp, Artificial
  CRISPR gRNA sequence
cttaatattatttttctaaa

SEQ ID NO: 211308 - DNA, 20 bp, Artificial
  CRISPR gRNA sequence
gcaagcataaatagcaacaa

SEQ ID NO: 211309 - DNA, 20 bp, Artificial
  CRISPR gRNA sequence
gtgaagaggtggaagcaaaa

SEQ ID NO: 211310 - DNA, 20 bp, Artificial
  CRISPR gRNA sequence
aactgggaaagaaaatgtgt

SEQ ID NO: 211311 - DNA, 20 bp, Artificial
  CRISPR gRNA sequence
agctatggcaccaatctttc

SEQ ID NO: 211312 - DNA, 20 bp, Artificial
  CRISPR gRNA sequence
tataaaacatttgtatggga

SEQ ID NO: 211313 - DNA, 20 bp, Artificial
  CRISPR gRNA sequence
aacatttgtatgggagagga

SEQ ID NO: 211314 - DNA, 20 bp, Artificial
  CRISPR gRNA sequence
attctgtgtatgcacatcca

SEQ ID NO: 211315 - DNA, 20 bp, Artificial
  CRISPR gRNA sequence
caacaggtgaggtgatatat

SEQ ID NO: 211316 - DNA, 20 bp, Artificial
  CRISPR gRNA sequence
attattcctactttccagtt

SEQ ID NO: 211317 - DNA, 20 bp, Artificial
  CRISPR gRNA sequence
agctgatataaataacaaat

SEQ ID NO: 211318 - DNA, 20 bp, Artificial
  CRISPR gRNA sequence
ggtgccagagatgttaatga

SEQ ID NO: 211319 - DNA, 20 bp, Artificial
  CRISPR gRNA sequence
tgacagtctattcaaacatg

SEQ ID NO: 211320 - DNA, 20 bp, Artificial
  CRISPR gRNA sequence
gtcaccaacatacccccacc

SEQ ID NO: 211321 - DNA, 20 bp, Artificial
  CRISPR gRNA sequence
tcctccctcctctatctacc

SEQ ID NO: 211322 - DNA, 20 bp, Artificial
  CRISPR gRNA sequence
ctatctacccagagtgtaga

SEQ ID NO: 211323 - DNA, 20 bp, Artificial
  CRISPR gRNA sequence
agagtgtagacagaatgtgc

SEQ ID NO: 211324 - DNA, 20 bp, Artificial
  CRISPR gRNA sequence
ctctttctccacatcactcc

SEQ ID NO: 211325 - DNA, 20 bp, Artificial
  CRISPR gRNA sequence
aagaaaatactcagatagct

SEQ ID NO: 211326 - DNA, 20 bp, Artificial
  CRISPR gRNA sequence
atctatttcttcttagcttt

SEQ ID NO: 211327 - DNA, 20 bp, Artificial
  CRISPR gRNA sequence
gcctttttcactgcttccaa

SEQ ID NO: 211328 - DNA, 20 bp, Artificial
  CRISPR gRNA sequence
ggattcattaatgaagttga

SEQ ID NO: 211329 - DNA, 20 bp, Artificial
  CRISPR gRNA sequence
gcaaagtgacgaaagggaaa

SEQ ID NO: 211330 - DNA, 20 bp, Artificial
  CRISPR gRNA sequence
tacgtggaaggctgaggtgg

SEQ ID NO: 211331 - DNA, 20 bp, Artificial
  CRISPR gRNA sequence
aggcagaggctgcagcgagc

SEQ ID NO: 211332 - DNA, 20 bp, Artificial
  CRISPR gRNA sequence
cccaaaaaaacaaataaata

SEQ ID NO: 211333 - DNA, 20 bp, Artificial
  CRISPR gRNA sequence
aaaacaaataaatacagaat

SEQ ID NO: 211334 - DNA, 20 bp, Artificial
  CRISPR gRNA sequence
catgaaccactcagcaggag

SEQ ID NO: 211335 - DNA, 20 bp, Artificial
  CRISPR gRNA sequence
ccattccgctgggacctggg

SEQ ID NO: 211336 - DNA, 20 bp, Artificial
  CRISPR gRNA sequence
acctgggctggatgacagca

SEQ ID NO: 211337 - DNA, 20 bp, Artificial
  CRISPR gRNA sequence
tatttaccaccactgcacac

SEQ ID NO: 211338 - DNA, 20 bp, Artificial
  CRISPR gRNA sequence
cttccaaagctggcagggaa

SEQ ID NO: 211339 - DNA, 20 bp, Artificial
  CRISPR gRNA sequence
caaagctggcagggaaaagg

SEQ ID NO: 211340 - DNA, 20 bp, Artificial
  CRISPR gRNA sequence
tgtgagccagccaaaagctg

SEQ ID NO: 211341 - DNA, 20 bp, Artificial
  CRISPR gRNA sequence
aaaagaaacagaaaggagac

SEQ ID NO: 211342 - DNA, 20 bp, Artificial
  CRISPR gRNA sequence
gaaacagaaaggagacaagg

SEQ ID NO: 211343 - DNA, 20 bp, Artificial
  CRISPR gRNA sequence
aaagttgtctgtgagaaggc

SEQ ID NO: 211344 - DNA, 20 bp, Artificial
  CRISPR gRNA sequence
tgtctgtgagaaggcatgaa

SEQ ID NO: 211345 - DNA, 20 bp, Artificial
  CRISPR gRNA sequence
aaaaacagtggcataaacaa

SEQ ID NO: 211346 - DNA, 20 bp, Artificial
  CRISPR gRNA sequence
agctagctggctaataggca

SEQ ID NO: 211347 - DNA, 20 bp, Artificial
  CRISPR gRNA sequence
gatgcttcagttctttgata

SEQ ID NO: 211348 - DNA, 20 bp, Artificial
  CRISPR gRNA sequence
cttcagttctttgatatgga

SEQ ID NO: 211349 - DNA, 20 bp, Artificial
  CRISPR gRNA sequence
agttatgtatctgagctcat

SEQ ID NO: 211350 - DNA, 20 bp, Artificial
  CRISPR gRNA sequence
cttactgtggaggaacctgg

SEQ ID NO: 211351 - DNA, 20 bp, Artificial
  CRISPR gRNA sequence
aacctctttttaaagtagaa

SEQ ID NO: 211352 - DNA, 20 bp, Artificial
  CRISPR gRNA sequence
ttaaagtagaacagggtaaa

SEQ ID NO: 211353 - DNA, 20 bp, Artificial
  CRISPR gRNA sequence
tagaacagggtaaaatgggt

SEQ ID NO: 211354 - DNA, 20 bp, Artificial
  CRISPR gRNA sequence
agagctttatttgggaacat

SEQ ID NO: 211355 - DNA, 20 bp, Artificial
  CRISPR gRNA sequence
gaagttcagagataaggttt

SEQ ID NO: 211356 - DNA, 20 bp, Artificial
  CRISPR gRNA sequence
gagctcataaatgtatttat

SEQ ID NO: 211357 - DNA, 20 bp, Artificial
  CRISPR gRNA sequence
aaaaacaaaacaaaacaaaa

SEQ ID NO: 211358 - DNA, 20 bp, Artificial
  CRISPR gRNA sequence
ttcttccctaataatgtaga

SEQ ID NO: 211359 - DNA, 20 bp, Artificial
  CRISPR gRNA sequence
agttctaaatctccgatcca

SEQ ID NO: 211360 - DNA, 20 bp, Artificial
  CRISPR gRNA sequence
ctgaaaaaaaaagatttatg

SEQ ID NO: 211361 - DNA, 20 bp, Artificial
  CRISPR gRNA sequence
agtgtacaagttaatttcac

SEQ ID NO: 211362 - DNA, 20 bp, Artificial
  CRISPR gRNA sequence
ctgagttaattctctccaat

SEQ ID NO: 211363 - DNA, 20 bp, Artificial
  CRISPR gRNA sequence
ggatataacccatgtgacaa

SEQ ID NO: 211364 - DNA, 20 bp, Artificial
  CRISPR gRNA sequence
ccatgccataaatacatttc

SEQ ID NO: 211365 - DNA, 20 bp, Artificial
  CRISPR gRNA sequence
taaattgaacaagaaaatat

SEQ ID NO: 211366 - DNA, 20 bp, Artificial
  CRISPR gRNA sequence
ctgcatcattctaaaatatc

SEQ ID NO: 211367 - DNA, 20 bp, Artificial
  CRISPR gRNA sequence
aaacaacaagcccaacttta

SEQ ID NO: 211368 - DNA, 20 bp, Artificial
  CRISPR gRNA sequence
cttcttcttgaagagaaagc

SEQ ID NO: 211369 - DNA, 20 bp, Artificial
  CRISPR gRNA sequence
gcttggatttttaactattt

SEQ ID NO: 211370 - DNA, 20 bp, Artificial
  CRISPR gRNA sequence
tctaaaacagaacacgtgca

SEQ ID NO: 211371 - DNA, 20 bp, Artificial
  CRISPR gRNA sequence
gttgatttaaaaagttaatt

SEQ ID NO: 211372 - DNA, 20 bp, Artificial
  CRISPR gRNA sequence
atgacaaagaaaaaataatt

SEQ ID NO: 211373 - DNA, 20 bp, Artificial
  CRISPR gRNA sequence
gtaagtgatggagaaggcag

SEQ ID NO: 211374 - DNA, 20 bp, Artificial
  CRISPR gRNA sequence
tatgctagatatggaaggca

SEQ ID NO: 211375 - DNA, 20 bp, Artificial
  CRISPR gRNA sequence
tggaaggcatggggtggcat

SEQ ID NO: 211376 - DNA, 20 bp, Artificial
  CRISPR gRNA sequence
ggtatctcatactacttcac

SEQ ID NO: 211377 - DNA, 20 bp, Artificial
  CRISPR gRNA sequence
tactacttcaccagagttgt

SEQ ID NO: 211378 - DNA, 20 bp, Artificial
  CRISPR gRNA sequence
ttgtggggagcaacaaaacc

SEQ ID NO: 211379 - DNA, 20 bp, Artificial
  CRISPR gRNA sequence
attggaagatgtaacaaaaa

SEQ ID NO: 211380 - DNA, 20 bp, Artificial
  CRISPR gRNA sequence
atgttcactgtagctaccac

SEQ ID NO: 211381 - DNA, 20 bp, Artificial
  CRISPR gRNA sequence
gacttatgaactcatatgct

SEQ ID NO: 211382 - DNA, 20 bp, Artificial
  CRISPR gRNA sequence
gcattaattaaagaaagaca

SEQ ID NO: 211383 - DNA, 20 bp, Artificial
  CRISPR gRNA sequence
gaaagacacagaatatatga

SEQ ID NO: 211384 - DNA, 20 bp, Artificial
  CRISPR gRNA sequence
acacagaatatatgacagaa

SEQ ID NO: 211385 - DNA, 20 bp, Artificial
  CRISPR gRNA sequence
aagttttttgaaactattat

SEQ ID NO: 211386 - DNA, 20 bp, Artificial
  CRISPR gRNA sequence
gattattttgataggtggtt

SEQ ID NO: 211387 - DNA, 20 bp, Artificial
  CRISPR gRNA sequence
catatatctcaataaaaaat

SEQ ID NO: 211388 - DNA, 20 bp, Artificial
  CRISPR gRNA sequence
tactaataattgattttaaa

SEQ ID NO: 211389 - DNA, 20 bp, Artificial
  CRISPR gRNA sequence
atgaacaaaattgatagatt

SEQ ID NO: 211390 - DNA, 20 bp, Artificial
  CRISPR gRNA sequence
tgtgaattttaattcctgtc

SEQ ID NO: 211391 - DNA, 20 bp, Artificial
  CRISPR gRNA sequence
atcctattctattacttaaa

SEQ ID NO: 211392 - DNA, 20 bp, Artificial
  CRISPR gRNA sequence
tctaccctctttaattatcc

SEQ ID NO: 211393 - DNA, 20 bp, Artificial
  CRISPR gRNA sequence
gtaataatcccaagttttaa

SEQ ID NO: 211394 - DNA, 20 bp, Artificial
  CRISPR gRNA sequence
acaaatacaggcatatcagt

SEQ ID NO: 211395 - DNA, 20 bp, Artificial
  CRISPR gRNA sequence
gaggaaagcactattaccac

SEQ ID NO: 211396 - DNA, 20 bp, Artificial
  CRISPR gRNA sequence
gaagtttaaaaagaaaagct

SEQ ID NO: 211397 - DNA, 20 bp, Artificial
  CRISPR gRNA sequence
tgctaaatgctgtcaagtat

SEQ ID NO: 211398 - DNA, 20 bp, Artificial
  CRISPR gRNA sequence
ggtacagctattttgataca

SEQ ID NO: 211399 - DNA, 20 bp, Artificial
  CRISPR gRNA sequence
ctccttggtatttgcccaaa

SEQ ID NO: 211400 - DNA, 20 bp, Artificial
  CRISPR gRNA sequence
gtccacataaaaatatccat

SEQ ID NO: 211401 - DNA, 20 bp, Artificial
  CRISPR gRNA sequence
agactcagtccaaccacagc

SEQ ID NO: 211402 - DNA, 20 bp, Artificial
  CRISPR gRNA sequence
gcgaggatataggctatcac

SEQ ID NO: 211403 - DNA, 20 bp, Artificial
  CRISPR gRNA sequence
ccaatcgctggaggaaggaa

SEQ ID NO: 211404 - DNA, 20 bp, Artificial
  CRISPR gRNA sequence
ggatgtaacagaagcatgtc

SEQ ID NO: 211405 - DNA, 20 bp, Artificial
  CRISPR gRNA sequence
cacttgcatttggtataatc

SEQ ID NO: 211406 - DNA, 20 bp, Artificial
  CRISPR gRNA sequence
ctaagaccaaagactgactc

SEQ ID NO: 211407 - DNA, 20 bp, Artificial
  CRISPR gRNA sequence
acacttgtgcattttacaat

SEQ ID NO: 211408 - DNA, 20 bp, Artificial
  CRISPR gRNA sequence
ttacaatatgaatggctatt

SEQ ID NO: 211409 - DNA, 20 bp, Artificial
  CRISPR gRNA sequence
atgtcttctccacatgcaca

SEQ ID NO: 211410 - DNA, 20 bp, Artificial
  CRISPR gRNA sequence
aaaatgatactgattatagt

SEQ ID NO: 211411 - DNA, 20 bp, Artificial
  CRISPR gRNA sequence
taacttcaaaaaactgaaat

SEQ ID NO: 211412 - DNA, 20 bp, Artificial
  CRISPR gRNA sequence
tttttacaaaacagctaacc

SEQ ID NO: 211413 - DNA, 20 bp, Artificial
  CRISPR gRNA sequence
agaataaccttaaaattaat

SEQ ID NO: 211414 - DNA, 20 bp, Artificial
  CRISPR gRNA sequence
atgaatgggaaaatgtcact

SEQ ID NO: 211415 - DNA, 20 bp, Artificial
  CRISPR gRNA sequence
ttttaataaacctactctta

SEQ ID NO: 211416 - DNA, 20 bp, Artificial
  CRISPR gRNA sequence
aaggccagtagcattcttta

SEQ ID NO: 211417 - DNA, 20 bp, Artificial
  CRISPR gRNA sequence
agtttcaacatgctgaaacc

SEQ ID NO: 211418 - DNA, 20 bp, Artificial
  CRISPR gRNA sequence
cctccttcttaactagttta

SEQ ID NO: 211419 - DNA, 20 bp, Artificial
  CRISPR gRNA sequence
ttgttccttcaagttgtctt

SEQ ID NO: 211420 - DNA, 20 bp, Artificial
  CRISPR gRNA sequence
ggtgtgctatagttattagg

SEQ ID NO: 211421 - DNA, 20 bp, Artificial
  CRISPR gRNA sequence
caatgaagtttgcctctgta

SEQ ID NO: 211422 - DNA, 20 bp, Artificial
  CRISPR gRNA sequence
aagtttgcctctgtagtgag

SEQ ID NO: 211423 - DNA, 20 bp, Artificial
  CRISPR gRNA sequence
cctcctaatccctaaaacct

SEQ ID NO: 211424 - DNA, 20 bp, Artificial
  CRISPR gRNA sequence
aatattacctaatacagcaa

SEQ ID NO: 211425 - DNA, 20 bp, Artificial
  CRISPR gRNA sequence
ttacctaatacagcaaaaga

SEQ ID NO: 211426 - DNA, 20 bp, Artificial
  CRISPR gRNA sequence
gcaaaagatatgatgaagtt

SEQ ID NO: 211427 - DNA, 20 bp, Artificial
  CRISPR gRNA sequence
tctgaaaggaggagcttacc

SEQ ID NO: 211428 - DNA, 20 bp, Artificial
  CRISPR gRNA sequence
aggagcttaccctggattat

SEQ ID NO: 211429 - DNA, 20 bp, Artificial
  CRISPR gRNA sequence
gcaatgtgaccagagaggca

SEQ ID NO: 211430 - DNA, 20 bp, Artificial
  CRISPR gRNA sequence
gtgaccagagaggcagaggg

SEQ ID NO: 211431 - DNA, 20 bp, Artificial
  CRISPR gRNA sequence
agttatgctgccgcaaacta

SEQ ID NO: 211432 - DNA, 20 bp, Artificial
  CRISPR gRNA sequence
gaagctagaagagccaagaa

SEQ ID NO: 211433 - DNA, 20 bp, Artificial
  CRISPR gRNA sequence
tcttccatacagccttgaga

SEQ ID NO: 211434 - DNA, 20 bp, Artificial
  CRISPR gRNA sequence
tatggcctccagcatggaaa

SEQ ID NO: 211435 - DNA, 20 bp, Artificial
  CRISPR gRNA sequence
taatgcagccctcctcacct

SEQ ID NO: 211436 - DNA, 20 bp, Artificial
  CRISPR gRNA sequence
cacatcttacctgggacgaa

SEQ ID NO: 211437 - DNA, 20 bp, Artificial
  CRISPR gRNA sequence
ttgttttctcatccatacca

SEQ ID NO: 211438 - DNA, 20 bp, Artificial
  CRISPR gRNA sequence
gtgcttaaaaaagaaaaaca

SEQ ID NO: 211439 - DNA, 20 bp, Artificial
  CRISPR gRNA sequence
cacatctctttcataagcaa

SEQ ID NO: 211440 - DNA, 20 bp, Artificial
  CRISPR gRNA sequence
aacgtcacggcagtataaat

SEQ ID NO: 211441 - DNA, 20 bp, Artificial
  CRISPR gRNA sequence
cggcagtataaatatggatg

SEQ ID NO: 211442 - DNA, 20 bp, Artificial
  CRISPR gRNA sequence
ggacactgctctgcataata

SEQ ID NO: 211443 - DNA, 20 bp, Artificial
  CRISPR gRNA sequence
cataatactaatgggaaata

SEQ ID NO: 211444 - DNA, 20 bp, Artificial
  CRISPR gRNA sequence
attaacaatattgagaaaaa

SEQ ID NO: 211445 - DNA, 20 bp, Artificial
  CRISPR gRNA sequence
ttttgttttgaaaaaaatga

SEQ ID NO: 211446 - DNA, 20 bp, Artificial
  CRISPR gRNA sequence
aataaactgcaaagactcaa

SEQ ID NO: 211447 - DNA, 20 bp, Artificial
  CRISPR gRNA sequence
gtatctcataccttctctga

SEQ ID NO: 211448 - DNA, 20 bp, Artificial
  CRISPR gRNA sequence
tcataccttctctgaaagaa

SEQ ID NO: 211449 - DNA, 20 bp, Artificial
  CRISPR gRNA sequence
accttctctgaaagaatgga

SEQ ID NO: 211450 - DNA, 20 bp, Artificial
  CRISPR gRNA sequence
agaatggaatgggtcaatct

SEQ ID NO: 211451 - DNA, 20 bp, Artificial
  CRISPR gRNA sequence
tattagttcttttactatat

SEQ ID NO: 211452 - DNA, 20 bp, Artificial
  CRISPR gRNA sequence
taaggcaacctaaaagcaaa

SEQ ID NO: 211453 - DNA, 20 bp, Artificial
  CRISPR gRNA sequence
gacaggtacctaaatatttc

SEQ ID NO: 211454 - DNA, 20 bp, Artificial
  CRISPR gRNA sequence
taaataaccaatttattaat

SEQ ID NO: 211455 - DNA, 20 bp, Artificial
  CRISPR gRNA sequence
tgtggatttcagttacacag

SEQ ID NO: 211456 - DNA, 20 bp, Artificial
  CRISPR gRNA sequence
ccttgccttcttataaggca

SEQ ID NO: 211457 - DNA, 20 bp, Artificial
  CRISPR gRNA sequence
ttctaggctcaaatgctggc

SEQ ID NO: 211458 - DNA, 20 bp, Artificial
  CRISPR gRNA sequence
aaatgctggctagaatgaaa

SEQ ID NO: 211459 - DNA, 20 bp, Artificial
  CRISPR gRNA sequence
tagagcttgaaagttctgca

SEQ ID NO: 211460 - DNA, 20 bp, Artificial
  CRISPR gRNA sequence
agctactaagatcaagcaac

SEQ ID NO: 211461 - DNA, 20 bp, Artificial
  CRISPR gRNA sequence
caagcaacaagaatttgcct

SEQ ID NO: 211462 - DNA, 20 bp, Artificial
  CRISPR gRNA sequence
tttttttttttttttggaga

SEQ ID NO: 211463 - DNA, 20 bp, Artificial
  CRISPR gRNA sequence
tctcactccgttacccaggc

SEQ ID NO: 211464 - DNA, 20 bp, Artificial
  CRISPR gRNA sequence
gattctcctgcctcagcctc

SEQ ID NO: 211465 - DNA, 20 bp, Artificial
  CRISPR gRNA sequence
ccaccaggcctggctaattt

SEQ ID NO: 211466 - DNA, 20 bp, Artificial
  CRISPR gRNA sequence
ttttttttttttagtagaga

SEQ ID NO: 211467 - DNA, 20 bp, Artificial
  CRISPR gRNA sequence
gccacggcctcccaaagtgc

SEQ ID NO: 211468 - DNA, 20 bp, Artificial
  CRISPR gRNA sequence
acatccttcttaacaaaaat

SEQ ID NO: 211469 - DNA, 20 bp, Artificial
  CRISPR gRNA sequence
ttcttaacaaaaataagagt

SEQ ID NO: 211470 - DNA, 20 bp, Artificial
  CRISPR gRNA sequence
tcacaaaatactaccataga

SEQ ID NO: 211471 - DNA, 20 bp, Artificial
  CRISPR gRNA sequence
ataaaatggtccgtctctct

SEQ ID NO: 211472 - DNA, 20 bp, Artificial
  CRISPR gRNA sequence
ttccaacaaatacacatgtt

SEQ ID NO: 211473 - DNA, 20 bp, Artificial
  CRISPR gRNA sequence
cacttctggtcccaggcatt

SEQ ID NO: 211474 - DNA, 20 bp, Artificial
  CRISPR gRNA sequence
ggacactccacctgtctctg

SEQ ID NO: 211475 - DNA, 20 bp, Artificial
  CRISPR gRNA sequence
tctgtggggtctactaatga

SEQ ID NO: 211476 - DNA, 20 bp, Artificial
  CRISPR gRNA sequence
gtatctccaggttttcttca

SEQ ID NO: 211477 - DNA, 20 bp, Artificial
  CRISPR gRNA sequence
ttcttcagtgaatcttcaga

SEQ ID NO: 211478 - DNA, 20 bp, Artificial
  CRISPR gRNA sequence
agcaggtaccacagctaatg

SEQ ID NO: 211479 - DNA, 20 bp, Artificial
  CRISPR gRNA sequence
ctcagtatagtgaaagggca

SEQ ID NO: 211480 - DNA, 20 bp, Artificial
  CRISPR gRNA sequence
ccatagaacccaataacctc

SEQ ID NO: 211481 - DNA, 20 bp, Artificial
  CRISPR gRNA sequence
cttttcttgtccttcagtaa

SEQ ID NO: 211482 - DNA, 20 bp, Artificial
  CRISPR gRNA sequence
agtggatttatccttattta

SEQ ID NO: 211483 - DNA, 20 bp, Artificial
  CRISPR gRNA sequence
tttaaaatctgcatgctctt

SEQ ID NO: 211484 - DNA, 20 bp, Artificial
  CRISPR gRNA sequence
cttagtgctcagcctgacac

SEQ ID NO: 211485 - DNA, 20 bp, Artificial
  CRISPR gRNA sequence
ggctacttctaagaaatctg

SEQ ID NO: 211486 - DNA, 20 bp, Artificial
  CRISPR gRNA sequence
ctcaaggcccttacattcta

SEQ ID NO: 211487 - DNA, 20 bp, Artificial
  CRISPR gRNA sequence
aggcccttacattctaatgg

SEQ ID NO: 211488 - DNA, 20 bp, Artificial
  CRISPR gRNA sequence
gtgtgtgtgtttgaggggag

SEQ ID NO: 211489 - DNA, 20 bp, Artificial
  CRISPR gRNA sequence
gtgtttgaggggaggggggt

SEQ ID NO: 211490 - DNA, 20 bp, Artificial
  CRISPR gRNA sequence
aggggaggggggtgtgagtg

SEQ ID NO: 211491 - DNA, 20 bp, Artificial
  CRISPR gRNA sequence
ctgaaaaaacagctaatgtt

SEQ ID NO: 211492 - DNA, 20 bp, Artificial
  CRISPR gRNA sequence
tgaaattaccaagtcaactt

SEQ ID NO: 211493 - DNA, 20 bp, Artificial
  CRISPR gRNA sequence
tttccatgacaccccaaaga

SEQ ID NO: 211494 - DNA, 20 bp, Artificial
  CRISPR gRNA sequence
tccaacaaaacccaaaaccc

SEQ ID NO: 211495 - DNA, 20 bp, Artificial
  CRISPR gRNA sequence
ctgcccaaagacatgacatt

SEQ ID NO: 211496 - DNA, 20 bp, Artificial
  CRISPR gRNA sequence
aggctgatgcgtatcagact

SEQ ID NO: 211497 - DNA, 20 bp, Artificial
  CRISPR gRNA sequence
agaataaatcataaagaaag

SEQ ID NO: 211498 - DNA, 20 bp, Artificial
  CRISPR gRNA sequence
taactctaggaaagtaattt

SEQ ID NO: 211499 - DNA, 20 bp, Artificial
  CRISPR gRNA sequence
tggtgtctgttgagctgtaa

SEQ ID NO: 211500 - DNA, 20 bp, Artificial
  CRISPR gRNA sequence
aatgaatattgttttcagtg

SEQ ID NO: 211501 - DNA, 20 bp, Artificial
  CRISPR gRNA sequence
aatgaaacaattttgtcaca

SEQ ID NO: 211502 - DNA, 20 bp, Artificial
  CRISPR gRNA sequence
agtctataggacagagataa

SEQ ID NO: 211503 - DNA, 20 bp, Artificial
  CRISPR gRNA sequence
gaacataaaagatgaaagaa

SEQ ID NO: 211504 - DNA, 20 bp, Artificial
  CRISPR gRNA sequence
ttatcaactttccctgcctt

SEQ ID NO: 211505 - DNA, 20 bp, Artificial
  CRISPR gRNA sequence
ccttgtggatttcacaattt

SEQ ID NO: 211506 - DNA, 20 bp, Artificial
  CRISPR gRNA sequence
tatggagaaggttgtgatgt

SEQ ID NO: 211507 - DNA, 20 bp, Artificial
  CRISPR gRNA sequence
ttgtgatgtctggatttgga

SEQ ID NO: 211508 - DNA, 20 bp, Artificial
  CRISPR gRNA sequence
tctggatttggaaagggtca

SEQ ID NO: 211509 - DNA, 20 bp, Artificial
  CRISPR gRNA sequence
gggtcaagggatttctacaa

SEQ ID NO: 211510 - DNA, 20 bp, Artificial
  CRISPR gRNA sequence
ataagcacattatttaataa

SEQ ID NO: 211511 - DNA, 20 bp, Artificial
  CRISPR gRNA sequence
caggaccaagggaaagcact

SEQ ID NO: 211512 - DNA, 20 bp, Artificial
  CRISPR gRNA sequence
gggagttcaagattattgaa

SEQ ID NO: 211513 - DNA, 20 bp, Artificial
  CRISPR gRNA sequence
actttgggaggccgagacag

SEQ ID NO: 211514 - DNA, 20 bp, Artificial
  CRISPR gRNA sequence
gacagacggatcacgaggtc

SEQ ID NO: 211515 - DNA, 20 bp, Artificial
  CRISPR gRNA sequence
tactcgggaggctgagacag

SEQ ID NO: 211516 - DNA, 20 bp, Artificial
  CRISPR gRNA sequence
aaaaaaaaaaaaaaaaaaaa

SEQ ID NO: 211517 - DNA, 20 bp, Artificial
  CRISPR gRNA sequence
aggggccatcaaccaggtca

SEQ ID NO: 211518 - DNA, 20 bp, Artificial
  CRISPR gRNA sequence
ttattgtatattttactttc

SEQ ID NO: 211519 - DNA, 20 bp, Artificial
  CRISPR gRNA sequence
aggctatgtcttcacttttt

SEQ ID NO: 211520 - DNA, 20 bp, Artificial
  CRISPR gRNA sequence
ttttaaatatgctttcatgg

SEQ ID NO: 211521 - DNA, 20 bp, Artificial
  CRISPR gRNA sequence
gtcaaaactcaaggacttgg

SEQ ID NO: 211522 - DNA, 20 bp, Artificial
  CRISPR gRNA sequence
tgtaatgagaacttttttcc

SEQ ID NO: 211523 - DNA, 20 bp, Artificial
  CRISPR gRNA sequence
agccgtaaccaaaatctctg

SEQ ID NO: 211524 - DNA, 20 bp, Artificial
  CRISPR gRNA sequence
aaaaaaaaattaaagatgcc

SEQ ID NO: 211525 - DNA, 20 bp, Artificial
  CRISPR gRNA sequence
ctagaatacagttttaaatt

SEQ ID NO: 211526 - DNA, 20 bp, Artificial
  CRISPR gRNA sequence
tcactttgcactattctgat

SEQ ID NO: 211527 - DNA, 20 bp, Artificial
  CRISPR gRNA sequence
caattaccacaatatattaa

SEQ ID NO: 211528 - DNA, 20 bp, Artificial
  CRISPR gRNA sequence
catgcacagacagcaaagta

SEQ ID NO: 211529 - DNA, 20 bp, Artificial
  CRISPR gRNA sequence
aacccatgtgacattttata

SEQ ID NO: 211530 - DNA, 20 bp, Artificial
  CRISPR gRNA sequence
aaactaggcaagaaagatga

SEQ ID NO: 211531 - DNA, 20 bp, Artificial
  CRISPR gRNA sequence
aataaaaactgacaaatgct

SEQ ID NO: 211532 - DNA, 20 bp, Artificial
  CRISPR gRNA sequence
acaaatgctaggagtgaaat

SEQ ID NO: 211533 - DNA, 20 bp, Artificial
  CRISPR gRNA sequence
aaatttgaatagaccataaa

SEQ ID NO: 211534 - DNA, 20 bp, Artificial
  CRISPR gRNA sequence
gagaagaaatagctgattgt

SEQ ID NO: 211535 - DNA, 20 bp, Artificial
  CRISPR gRNA sequence
atataaatgaggaaagtgag

SEQ ID NO: 211536 - DNA, 20 bp, Artificial
  CRISPR gRNA sequence
agtgaggaggatgtaacaaa

SEQ ID NO: 211537 - DNA, 20 bp, Artificial
  CRISPR gRNA sequence
aacattcaaaaaaacattaa

SEQ ID NO: 211538 - DNA, 20 bp, Artificial
  CRISPR gRNA sequence
aggaattctttcatgacatt

SEQ ID NO: 211539 - DNA, 20 bp, Artificial
  CRISPR gRNA sequence
ttcatgacattgagagtgca

SEQ ID NO: 211540 - DNA, 20 bp, Artificial
  CRISPR gRNA sequence
aaaccgatccaaacttagaa

SEQ ID NO: 211541 - DNA, 20 bp, Artificial
  CRISPR gRNA sequence
gccgttgttattgataataa

SEQ ID NO: 211542 - DNA, 20 bp, Artificial
  CRISPR gRNA sequence
tcatcatgaagattgttttg

SEQ ID NO: 211543 - DNA, 20 bp, Artificial
  CRISPR gRNA sequence
gaacagataggcctatctca

SEQ ID NO: 211544 - DNA, 20 bp, Artificial
  CRISPR gRNA sequence
gacagcacttaaaatgatat

SEQ ID NO: 211545 - DNA, 20 bp, Artificial
  CRISPR gRNA sequence
atgatatcagagtgagaaag

SEQ ID NO: 211546 - DNA, 20 bp, Artificial
  CRISPR gRNA sequence
gccaggaacttaattgtcag

SEQ ID NO: 211547 - DNA, 20 bp, Artificial
  CRISPR gRNA sequence
tgtcagtagagtggcaaact

SEQ ID NO: 211548 - DNA, 20 bp, Artificial
  CRISPR gRNA sequence
ccaagtgctggctgggctct

SEQ ID NO: 211549 - DNA, 20 bp, Artificial
  CRISPR gRNA sequence
tggctgggctctgggagttt

SEQ ID NO: 211550 - DNA, 20 bp, Artificial
  CRISPR gRNA sequence
ataaagaaactctttctcct

SEQ ID NO: 211551 - DNA, 20 bp, Artificial
  CRISPR gRNA sequence
aaatctataaaataaaagtc

SEQ ID NO: 211552 - DNA, 20 bp, Artificial
  CRISPR gRNA sequence
ataaaataaaagtcatgggt

SEQ ID NO: 211553 - DNA, 20 bp, Artificial
  CRISPR gRNA sequence
agtcatgggtctgagttatt

SEQ ID NO: 211554 - DNA, 20 bp, Artificial
  CRISPR gRNA sequence
gctttagaagatttaccata

SEQ ID NO: 211555 - DNA, 20 bp, Artificial
  CRISPR gRNA sequence
aatatacatctaagcaggtg

SEQ ID NO: 211556 - DNA, 20 bp, Artificial
  CRISPR gRNA sequence
tgctttctatttctatttgg

SEQ ID NO: 211557 - DNA, 20 bp, Artificial
  CRISPR gRNA sequence
cactaacagaaaagttagat

SEQ ID NO: 211558 - DNA, 20 bp, Artificial
  CRISPR gRNA sequence
ctcaaagatgtgacaaggca

SEQ ID NO: 211559 - DNA, 20 bp, Artificial
  CRISPR gRNA sequence
cgtgtctccctggcttaaat

SEQ ID NO: 211560 - DNA, 20 bp, Artificial
  CRISPR gRNA sequence
accctgtcactaggtatttg

SEQ ID NO: 211561 - DNA, 20 bp, Artificial
  CRISPR gRNA sequence
ccagtactatcaggaaacgg

SEQ ID NO: 211562 - DNA, 20 bp, Artificial
  CRISPR gRNA sequence
ctgtttcttatctacaaaac

SEQ ID NO: 211563 - DNA, 20 bp, Artificial
  CRISPR gRNA sequence
aacaacagtgtctatgccca

SEQ ID NO: 211564 - DNA, 20 bp, Artificial
  CRISPR gRNA sequence
aataaatgtcatttcagata

SEQ ID NO: 211565 - DNA, 20 bp, Artificial
  CRISPR gRNA sequence
cctttaaatgtgagcgcagg

SEQ ID NO: 211566 - DNA, 20 bp, Artificial
  CRISPR gRNA sequence
taaatgtgagcgcaggctgg

SEQ ID NO: 211567 - DNA, 20 bp, Artificial
  CRISPR gRNA sequence
agattttagcgttataatat

SEQ ID NO: 211568 - DNA, 20 bp, Artificial
  CRISPR gRNA sequence
acattttgccagtatgtatc

SEQ ID NO: 211569 - DNA, 20 bp, Artificial
  CRISPR gRNA sequence
tccaggcttcatatctttag

SEQ ID NO: 211570 - DNA, 20 bp, Artificial
  CRISPR gRNA sequence
tccttaaaatccatcaagat

SEQ ID NO: 211571 - DNA, 20 bp, Artificial
  CRISPR gRNA sequence
cgtacaagcatataagctgt

SEQ ID NO: 211572 - DNA, 20 bp, Artificial
  CRISPR gRNA sequence
ttaaaaaaaagataacaaaa

SEQ ID NO: 211573 - DNA, 20 bp, Artificial
  CRISPR gRNA sequence
aagggaaacaggaaattcac

SEQ ID NO: 211574 - DNA, 20 bp, Artificial
  CRISPR gRNA sequence
tctaggtttggggactacag

SEQ ID NO: 211575 - DNA, 20 bp, Artificial
  CRISPR gRNA sequence
aatgtcaccaatgataacgt

SEQ ID NO: 211576 - DNA, 20 bp, Artificial
  CRISPR gRNA sequence
ttccctaatatcattgatgc

SEQ ID NO: 211577 - DNA, 20 bp, Artificial
  CRISPR gRNA sequence
ctgaaatcactaagcatttc

SEQ ID NO: 211578 - DNA, 20 bp, Artificial
  CRISPR gRNA sequence
gatatagacagcttaaactg

SEQ ID NO: 211579 - DNA, 20 bp, Artificial
  CRISPR gRNA sequence
ttttgtgtgtttaaaggttg

SEQ ID NO: 211580 - DNA, 20 bp, Artificial
  CRISPR gRNA sequence
tataaatgtttactggtctt

SEQ ID NO: 211581 - DNA, 20 bp, Artificial
  CRISPR gRNA sequence
caggatgctacaaggaaaga

SEQ ID NO: 211582 - DNA, 20 bp, Artificial
  CRISPR gRNA sequence
aggctgcagaactgcacgca

SEQ ID NO: 211583 - DNA, 20 bp, Artificial
  CRISPR gRNA sequence
agttccgactggacttttcc

SEQ ID NO: 211584 - DNA, 20 bp, Artificial
  CRISPR gRNA sequence
aactgggaaaataaaaagag

SEQ ID NO: 211585 - DNA, 20 bp, Artificial
  CRISPR gRNA sequence
aatgtgtgtgtagatgttct

SEQ ID NO: 211586 - DNA, 20 bp, Artificial
  CRISPR gRNA sequence
tgtgaatattaaaatgtgac

SEQ ID NO: 211587 - DNA, 20 bp, Artificial
  CRISPR gRNA sequence
caagtgaaaacaaccttctt

SEQ ID NO: 211588 - DNA, 20 bp, Artificial
  CRISPR gRNA sequence
taccaaactgtccccagaac

SEQ ID NO: 211589 - DNA, 20 bp, Artificial
  CRISPR gRNA sequence
aaaattgggaaaataacaat

SEQ ID NO: 211590 - DNA, 20 bp, Artificial
  CRISPR gRNA sequence
tacttatgtaaattttattt

SEQ ID NO: 211591 - DNA, 20 bp, Artificial
  CRISPR gRNA sequence
aggctctgtggccacactgc

SEQ ID NO: 211592 - DNA, 20 bp, Artificial
  CRISPR gRNA sequence
aataagtatgtattcatgtg

SEQ ID NO: 211593 - DNA, 20 bp, Artificial
  CRISPR gRNA sequence
tgtattcatgtgttgagtgg

SEQ ID NO: 211594 - DNA, 20 bp, Artificial
  CRISPR gRNA sequence
ggctgggtgtgtaaagttcc

SEQ ID NO: 211595 - DNA, 20 bp, Artificial
  CRISPR gRNA sequence
ctgtttatatgtaaagtaag

SEQ ID NO: 211596 - DNA, 20 bp, Artificial
  CRISPR gRNA sequence
taaagtaagatgagtggctt

SEQ ID NO: 211597 - DNA, 20 bp, Artificial
  CRISPR gRNA sequence
taaatgtactgaaagtattc

SEQ ID NO: 211598 - DNA, 20 bp, Artificial
  CRISPR gRNA sequence
acaaggggctgtgtgattgg

SEQ ID NO: 211599 - DNA, 20 bp, Artificial
  CRISPR gRNA sequence
gtgtgattggaagagttctt

SEQ ID NO: 211600 - DNA, 20 bp, Artificial
  CRISPR gRNA sequence
tatctctcaggtcacaggtg

SEQ ID NO: 211601 - DNA, 20 bp, Artificial
  CRISPR gRNA sequence
aaaatgcttacatcaatccc

SEQ ID NO: 211602 - DNA, 20 bp, Artificial
  CRISPR gRNA sequence
ttttatagatattagctttt

SEQ ID NO: 211603 - DNA, 20 bp, Artificial
  CRISPR gRNA sequence
gactccatatgtttgctgtt

SEQ ID NO: 211604 - DNA, 20 bp, Artificial
  CRISPR gRNA sequence
aatggtcataagacagtttt

SEQ ID NO: 211605 - DNA, 20 bp, Artificial
  CRISPR gRNA sequence
gtcataagacagttttgcga

SEQ ID NO: 211606 - DNA, 20 bp, Artificial
  CRISPR gRNA sequence
ttttttatgcttctttggtt

SEQ ID NO: 211607 - DNA, 20 bp, Artificial
  CRISPR gRNA sequence
atctctactgagagatgttt

SEQ ID NO: 211608 - DNA, 20 bp, Artificial
  CRISPR gRNA sequence
ctttatttccaactgtataa

SEQ ID NO: 211609 - DNA, 20 bp, Artificial
  CRISPR gRNA sequence
aaaaattttggagatcatgc

SEQ ID NO: 211610 - DNA, 20 bp, Artificial
  CRISPR gRNA sequence
atttttgtatctaatcccca

SEQ ID NO: 211611 - DNA, 20 bp, Artificial
  CRISPR gRNA sequence
gttgtagaaactgaggaaca

SEQ ID NO: 211612 - DNA, 20 bp, Artificial
  CRISPR gRNA sequence
ttaactgttcatgttccaca

SEQ ID NO: 211613 - DNA, 20 bp, Artificial
  CRISPR gRNA sequence
ttgcttgaggctgaaaacct

SEQ ID NO: 211614 - DNA, 20 bp, Artificial
  CRISPR gRNA sequence
ccctatacacaacaaaattt

SEQ ID NO: 211615 - DNA, 20 bp, Artificial
  CRISPR gRNA sequence
aaaattttaggatatattaa

SEQ ID NO: 211616 - DNA, 20 bp, Artificial
  CRISPR gRNA sequence
attaatatattaatattaat

SEQ ID NO: 211617 - DNA, 20 bp, Artificial
  CRISPR gRNA sequence
agtgaacaatgcagaggacc

SEQ ID NO: 211618 - DNA, 20 bp, Artificial
  CRISPR gRNA sequence
tgcagaggaccctgagtgtg

SEQ ID NO: 211619 - DNA, 20 bp, Artificial
  CRISPR gRNA sequence
gagaggaacgaaactaagcc

SEQ ID NO: 211620 - DNA, 20 bp, Artificial
  CRISPR gRNA sequence
acggcaactttgagaaacca

SEQ ID NO: 211621 - DNA, 20 bp, Artificial
  CRISPR gRNA sequence
caaaggatggccattgtgac

SEQ ID NO: 211622 - DNA, 20 bp, Artificial
  CRISPR gRNA sequence
cagtgatgagatcaaatggg

SEQ ID NO: 211623 - DNA, 20 bp, Artificial
  CRISPR gRNA sequence
tttgctggggcaagaccatg

SEQ ID NO: 211624 - DNA, 20 bp, Artificial
  CRISPR gRNA sequence
gagtcttaaaagcttgttgg

SEQ ID NO: 211625 - DNA, 20 bp, Artificial
  CRISPR gRNA sequence
taaaagcttgttgggagagt

SEQ ID NO: 211626 - DNA, 20 bp, Artificial
  CRISPR gRNA sequence
tcttctttggcagccacatg

SEQ ID NO: 211627 - DNA, 20 bp, Artificial
  CRISPR gRNA sequence
ctttggcagccacatggaga

SEQ ID NO: 211628 - DNA, 20 bp, Artificial
  CRISPR gRNA sequence
agcagtcatttggaagggag

SEQ ID NO: 211629 - DNA, 20 bp, Artificial
  CRISPR gRNA sequence
tcacatttgaagatctaaca

SEQ ID NO: 211630 - DNA, 20 bp, Artificial
  CRISPR gRNA sequence
ttgctccaaaggaagatgac

SEQ ID NO: 211631 - DNA, 20 bp, Artificial
  CRISPR gRNA sequence
caaaggaagatgactagaat

SEQ ID NO: 211632 - DNA, 20 bp, Artificial
  CRISPR gRNA sequence
gaaatactacagccctccca

SEQ ID NO: 211633 - DNA, 20 bp, Artificial
  CRISPR gRNA sequence
ctacagccctcccagtgagt

SEQ ID NO: 211634 - DNA, 20 bp, Artificial
  CRISPR gRNA sequence
tcaagctttcagtaaaaaat

SEQ ID NO: 211635 - DNA, 20 bp, Artificial
  CRISPR gRNA sequence
aatctgaatcgccagctact

SEQ ID NO: 211636 - DNA, 20 bp, Artificial
  CRISPR gRNA sequence
ttttttttttatttttgaga

SEQ ID NO: 211637 - DNA, 20 bp, Artificial
  CRISPR gRNA sequence
tctcactctgttgcccaggc

SEQ ID NO: 211638 - DNA, 20 bp, Artificial
  CRISPR gRNA sequence
ctcactgcaacctccacctc

SEQ ID NO: 211639 - DNA, 20 bp, Artificial
  CRISPR gRNA sequence
gtctcagcctcccaagtagc

SEQ ID NO: 211640 - DNA, 20 bp, Artificial
  CRISPR gRNA sequence
ttttgtaattttggtagaga

SEQ ID NO: 211641 - DNA, 20 bp, Artificial
  CRISPR gRNA sequence
ctcccttctcattattgtgc

SEQ ID NO: 211642 - DNA, 20 bp, Artificial
  CRISPR gRNA sequence
attgttccctgatatgtggg

SEQ ID NO: 211643 - DNA, 20 bp, Artificial
  CRISPR gRNA sequence
acacaatggagaagggcatc

SEQ ID NO: 211644 - DNA, 20 bp, Artificial
  CRISPR gRNA sequence
tgttacagtgggaaaagttt

SEQ ID NO: 211645 - DNA, 20 bp, Artificial
  CRISPR gRNA sequence
tgggaaaagtttgaggatca

SEQ ID NO: 211646 - DNA, 20 bp, Artificial
  CRISPR gRNA sequence
taactcttgttcctcaaggg

SEQ ID NO: 211647 - DNA, 20 bp, Artificial
  CRISPR gRNA sequence
acatgatacttctttcagct

SEQ ID NO: 211648 - DNA, 20 bp, Artificial
  CRISPR gRNA sequence
tcctccaattcctggacagg

SEQ ID NO: 211649 - DNA, 20 bp, Artificial
  CRISPR gRNA sequence
aggcaaagaagtgatattac

SEQ ID NO: 211650 - DNA, 20 bp, Artificial
  CRISPR gRNA sequence
atattacaagggtgtagtca

SEQ ID NO: 211651 - DNA, 20 bp, Artificial
  CRISPR gRNA sequence
caaatttttacttgatgttt

SEQ ID NO: 211652 - DNA, 20 bp, Artificial
  CRISPR gRNA sequence
attatttatttaatcaaacc

SEQ ID NO: 211653 - DNA, 20 bp, Artificial
  CRISPR gRNA sequence
gtgtgtgggagactaggact

SEQ ID NO: 211654 - DNA, 20 bp, Artificial
  CRISPR gRNA sequence
agactaggactgtgaatgta

SEQ ID NO: 211655 - DNA, 20 bp, Artificial
  CRISPR gRNA sequence
gattatatcacccagcaaaa

SEQ ID NO: 211656 - DNA, 20 bp, Artificial
  CRISPR gRNA sequence
ctaaccaagtggtctcttaa

SEQ ID NO: 211657 - DNA, 20 bp, Artificial
  CRISPR gRNA sequence
aagtggtctcttaaaagggt

SEQ ID NO: 211658 - DNA, 20 bp, Artificial
  CRISPR gRNA sequence
aaataaactcaatatgtgag

SEQ ID NO: 211659 - DNA, 20 bp, Artificial
  CRISPR gRNA sequence
accccagtcttacaatcaca

SEQ ID NO: 211660 - DNA, 20 bp, Artificial
  CRISPR gRNA sequence
agtcttacaatcacaaggaa

SEQ ID NO: 211661 - DNA, 20 bp, Artificial
  CRISPR gRNA sequence
acaaaactttgagctaaaaa

SEQ ID NO: 211662 - DNA, 20 bp, Artificial
  CRISPR gRNA sequence
atatgtcctgttgataataa

SEQ ID NO: 211663 - DNA, 20 bp, Artificial
  CRISPR gRNA sequence
atattacggtggtaaaaata

SEQ ID NO: 211664 - DNA, 20 bp, Artificial
  CRISPR gRNA sequence
ctctgaccttgaacaatacc

SEQ ID NO: 211665 - DNA, 20 bp, Artificial
  CRISPR gRNA sequence
taagaactccatctatctcc

SEQ ID NO: 211666 - DNA, 20 bp, Artificial
  CRISPR gRNA sequence
ctatctcctagagttcttga

SEQ ID NO: 211667 - DNA, 20 bp, Artificial
  CRISPR gRNA sequence
caataatgtcttattcatca

SEQ ID NO: 211668 - DNA, 20 bp, Artificial
  CRISPR gRNA sequence
gccatctttactgtactaag

SEQ ID NO: 211669 - DNA, 20 bp, Artificial
  CRISPR gRNA sequence
gaatttgagggacagatagg

SEQ ID NO: 211670 - DNA, 20 bp, Artificial
  CRISPR gRNA sequence
aaaaaatttaaaaaggcaca

SEQ ID NO: 211671 - DNA, 20 bp, Artificial
  CRISPR gRNA sequence
attatctgcattctattaag

SEQ ID NO: 211672 - DNA, 20 bp, Artificial
  CRISPR gRNA sequence
aagaacttatactccatagt

SEQ ID NO: 211673 - DNA, 20 bp, Artificial
  CRISPR gRNA sequence
tagtggcaccagatactggt

SEQ ID NO: 211674 - DNA, 20 bp, Artificial
  CRISPR gRNA sequence
ctattgatagatgcaaaaac

SEQ ID NO: 211675 - DNA, 20 bp, Artificial
  CRISPR gRNA sequence
gaggtggcggtatgactagt

SEQ ID NO: 211676 - DNA, 20 bp, Artificial
  CRISPR gRNA sequence
tgagggagatgtttgttatg

SEQ ID NO: 211677 - DNA, 20 bp, Artificial
  CRISPR gRNA sequence
agaggaaaccattgggggga

SEQ ID NO: 211678 - DNA, 20 bp, Artificial
  CRISPR gRNA sequence
cacatggaagctctctatct

SEQ ID NO: 211679 - DNA, 20 bp, Artificial
  CRISPR gRNA sequence
aattatttcaaaaaattaaa

SEQ ID NO: 211680 - DNA, 20 bp, Artificial
  CRISPR gRNA sequence
caaatgtctcaaacctctgg

SEQ ID NO: 211681 - DNA, 20 bp, Artificial
  CRISPR gRNA sequence
aagtctagtttttattttta

SEQ ID NO: 211682 - DNA, 20 bp, Artificial
  CRISPR gRNA sequence
ggcctttcaaatctcatatt

SEQ ID NO: 211683 - DNA, 20 bp, Artificial
  CRISPR gRNA sequence
tctaataccagttagttgca

SEQ ID NO: 211684 - DNA, 20 bp, Artificial
  CRISPR gRNA sequence
ggtttatgctcattagactg

SEQ ID NO: 211685 - DNA, 20 bp, Artificial
  CRISPR gRNA sequence
accttctcaagatcacacag

SEQ ID NO: 211686 - DNA, 20 bp, Artificial
  CRISPR gRNA sequence
tgaacagaactgaacctatc

SEQ ID NO: 211687 - DNA, 20 bp, Artificial
  CRISPR gRNA sequence
acagaaagaacatactcata

SEQ ID NO: 211688 - DNA, 20 bp, Artificial
  CRISPR gRNA sequence
caagtttgtgataaaaaggg

SEQ ID NO: 211689 - DNA, 20 bp, Artificial
  CRISPR gRNA sequence
tcatggtgctatcatcaagt

SEQ ID NO: 211690 - DNA, 20 bp, Artificial
  CRISPR gRNA sequence
tgctatcatcaagtctgaat

SEQ ID NO: 211691 - DNA, 20 bp, Artificial
  CRISPR gRNA sequence
tcaagtctgaatttgaataa

SEQ ID NO: 211692 - DNA, 20 bp, Artificial
  CRISPR gRNA sequence
ctgaatttgaataaatgaat

SEQ ID NO: 211693 - DNA, 20 bp, Artificial
  CRISPR gRNA sequence
aaaacacaaaaaacagaagg

SEQ ID NO: 211694 - DNA, 20 bp, Artificial
  CRISPR gRNA sequence
agtcacaggaaagaaagcac

SEQ ID NO: 211695 - DNA, 20 bp, Artificial
  CRISPR gRNA sequence
gatggcagcaaacagaaatg

SEQ ID NO: 211696 - DNA, 20 bp, Artificial
  CRISPR gRNA sequence
agtaaatgtgttttaccatg

SEQ ID NO: 211697 - DNA, 20 bp, Artificial
  CRISPR gRNA sequence
atgaagagtagattaacaaa

SEQ ID NO: 211698 - DNA, 20 bp, Artificial
  CRISPR gRNA sequence
cagcctgctttttgattcaa

SEQ ID NO: 211699 - DNA, 20 bp, Artificial
  CRISPR gRNA sequence
catttggcctcctctcgaaa

SEQ ID NO: 211700 - DNA, 20 bp, Artificial
  CRISPR gRNA sequence
tccatattagtaacaaagca

SEQ ID NO: 211701 - DNA, 20 bp, Artificial
  CRISPR gRNA sequence
cgacagtgtcattacaaaac

SEQ ID NO: 211702 - DNA, 20 bp, Artificial
  CRISPR gRNA sequence
gtatacattacatgcatctt

SEQ ID NO: 211703 - DNA, 20 bp, Artificial
  CRISPR gRNA sequence
actttaatatacaaagtaaa

SEQ ID NO: 211704 - DNA, 20 bp, Artificial
  CRISPR gRNA sequence
taatatacaaagtaaatagg

SEQ ID NO: 211705 - DNA, 20 bp, Artificial
  CRISPR gRNA sequence
atcaaatcatatctttccac

SEQ ID NO: 211706 - DNA, 20 bp, Artificial
  CRISPR gRNA sequence
cagcaatagacattttgtat

SEQ ID NO: 211707 - DNA, 20 bp, Artificial
  CRISPR gRNA sequence
agacattttgtatgggagtc

SEQ ID NO: 211708 - DNA, 20 bp, Artificial
  CRISPR gRNA sequence
acagtctccaaatgtatatt

SEQ ID NO: 211709 - DNA, 20 bp, Artificial
  CRISPR gRNA sequence
atcctatctacgcttctcaa

SEQ ID NO: 211710 - DNA, 20 bp, Artificial
  CRISPR gRNA sequence
gttgccttatagaagaggca

SEQ ID NO: 211711 - DNA, 20 bp, Artificial
  CRISPR gRNA sequence
attgttcaactaaaatgtac

SEQ ID NO: 211712 - DNA, 20 bp, Artificial
  CRISPR gRNA sequence
taaaatgtacaagaatgtgt

SEQ ID NO: 211713 - DNA, 20 bp, Artificial
  CRISPR gRNA sequence
agatttacttctacataaac

SEQ ID NO: 211714 - DNA, 20 bp, Artificial
  CRISPR gRNA sequence
tggaataaaaatcagaggca

SEQ ID NO: 211715 - DNA, 20 bp, Artificial
  CRISPR gRNA sequence
gtttactcaataaatacccc

SEQ ID NO: 211716 - DNA, 20 bp, Artificial
  CRISPR gRNA sequence
ctcaataaataccccatgaa

SEQ ID NO: 211717 - DNA, 20 bp, Artificial
  CRISPR gRNA sequence
ataccccatgaattgaatgc

SEQ ID NO: 211718 - DNA, 20 bp, Artificial
  CRISPR gRNA sequence
ttgaatgcaaggatgcatac

SEQ ID NO: 211719 - DNA, 20 bp, Artificial
  CRISPR gRNA sequence
ctggacaatgttcaaaacac

SEQ ID NO: 211720 - DNA, 20 bp, Artificial
  CRISPR gRNA sequence
tggtttactctctaaaatag

SEQ ID NO: 211721 - DNA, 20 bp, Artificial
  CRISPR gRNA sequence
taggaggatctcttaagtag

SEQ ID NO: 211722 - DNA, 20 bp, Artificial
  CRISPR gRNA sequence
aatactatgctgtaaaaatg

SEQ ID NO: 211723 - DNA, 20 bp, Artificial
  CRISPR gRNA sequence
cgttgcattctttaaaactt

SEQ ID NO: 211724 - DNA, 20 bp, Artificial
  CRISPR gRNA sequence
ttctttaaaactttggaatt

SEQ ID NO: 211725 - DNA, 20 bp, Artificial
  CRISPR gRNA sequence
gaggacatagtataccagag

SEQ ID NO: 211726 - DNA, 20 bp, Artificial
  CRISPR gRNA sequence
agtataccagagaagaataa

SEQ ID NO: 211727 - DNA, 20 bp, Artificial
  CRISPR gRNA sequence
aatatggtgaagattttgaa

SEQ ID NO: 211728 - DNA, 20 bp, Artificial
  CRISPR gRNA sequence
tgaaagggatacaaagacta

SEQ ID NO: 211729 - DNA, 20 bp, Artificial
  CRISPR gRNA sequence
gcaatgtctaacagacgctt

SEQ ID NO: 211730 - DNA, 20 bp, Artificial
  CRISPR gRNA sequence
ttcataagttgtagaaaact

SEQ ID NO: 211731 - DNA, 20 bp, Artificial
  CRISPR gRNA sequence
gaaaactgagagtaattcaa

SEQ ID NO: 211732 - DNA, 20 bp, Artificial
  CRISPR gRNA sequence
gatttccacctggtggaaga

SEQ ID NO: 211733 - DNA, 20 bp, Artificial
  CRISPR gRNA sequence
agactacattttactgccct

SEQ ID NO: 211734 - DNA, 20 bp, Artificial
  CRISPR gRNA sequence
tttttccaattttcttttaa

SEQ ID NO: 211735 - DNA, 20 bp, Artificial
  CRISPR gRNA sequence
catgttcattttatatttgt

SEQ ID NO: 211736 - DNA, 20 bp, Artificial
  CRISPR gRNA sequence
tattcttaaaaaaaagaggt

SEQ ID NO: 211737 - DNA, 20 bp, Artificial
  CRISPR gRNA sequence
catttcataacatatgttta

SEQ ID NO: 211738 - DNA, 20 bp, Artificial
  CRISPR gRNA sequence
tcataacatatgtttagaga

SEQ ID NO: 211739 - DNA, 20 bp, Artificial
  CRISPR gRNA sequence
tttagagaatgaattttcaa

SEQ ID NO: 211740 - DNA, 20 bp, Artificial
  CRISPR gRNA sequence
tatagctgaagcaatttaag

SEQ ID NO: 211741 - DNA, 20 bp, Artificial
  CRISPR gRNA sequence
aaaataacagtaaaattgac

SEQ ID NO: 211742 - DNA, 20 bp, Artificial
  CRISPR gRNA sequence
tgacctggataaaccacaat

SEQ ID NO: 211743 - DNA, 20 bp, Artificial
  CRISPR gRNA sequence
agtagtaaaactgtctgatt

SEQ ID NO: 211744 - DNA, 20 bp, Artificial
  CRISPR gRNA sequence
aagaaacacagataattaac

SEQ ID NO: 211745 - DNA, 20 bp, Artificial
  CRISPR gRNA sequence
ttaacatgaataagaaaact

SEQ ID NO: 211746 - DNA, 20 bp, Artificial
  CRISPR gRNA sequence
agcagcagacaaatgtaacc

SEQ ID NO: 211747 - DNA, 20 bp, Artificial
  CRISPR gRNA sequence
aatgtaaccaagagtaatgc

SEQ ID NO: 211748 - DNA, 20 bp, Artificial
  CRISPR gRNA sequence
ttggaactgtacaagtattg

SEQ ID NO: 211749 - DNA, 20 bp, Artificial
  CRISPR gRNA sequence
aaatgcaatcaacatttgtc

SEQ ID NO: 211750 - DNA, 20 bp, Artificial
  CRISPR gRNA sequence
cctgtgatgaaatattgtga

SEQ ID NO: 211751 - DNA, 20 bp, Artificial
  CRISPR gRNA sequence
gaaatattgtgataggatgt

SEQ ID NO: 211752 - DNA, 20 bp, Artificial
  CRISPR gRNA sequence
tctgcatggacaacgtcctt

SEQ ID NO: 211753 - DNA, 20 bp, Artificial
  CRISPR gRNA sequence
acgtccttatggatgggcag

SEQ ID NO: 211754 - DNA, 20 bp, Artificial
  CRISPR gRNA sequence
ttgctaataggcaaaaacag

SEQ ID NO: 211755 - DNA, 20 bp, Artificial
  CRISPR gRNA sequence
acaaactgaaaccttcagag

SEQ ID NO: 211756 - DNA, 20 bp, Artificial
  CRISPR gRNA sequence
tttttgcttccttttctgaa

SEQ ID NO: 211757 - DNA, 20 bp, Artificial
  CRISPR gRNA sequence
tgtgtgtctttaaaaattgc

SEQ ID NO: 211758 - DNA, 20 bp, Artificial
  CRISPR gRNA sequence
ctccatggtatctcctgatt

SEQ ID NO: 211759 - DNA, 20 bp, Artificial
  CRISPR gRNA sequence
gcaaacttttaaataaaaaa

SEQ ID NO: 211760 - DNA, 20 bp, Artificial
  CRISPR gRNA sequence
tgtctgctgtgcacttccac

SEQ ID NO: 211761 - DNA, 20 bp, Artificial
  CRISPR gRNA sequence
agtgaaccagacctggacct

SEQ ID NO: 211762 - DNA, 20 bp, Artificial
  CRISPR gRNA sequence
actccctctccttagccatg

SEQ ID NO: 211763 - DNA, 20 bp, Artificial
  CRISPR gRNA sequence
gttcctaaatccaatgtctg

SEQ ID NO: 211764 - DNA, 20 bp, Artificial
  CRISPR gRNA sequence
ctaaatccaatgtctgttga

SEQ ID NO: 211765 - DNA, 20 bp, Artificial
  CRISPR gRNA sequence
atccaatgtctgttgaatga

SEQ ID NO: 211766 - DNA, 20 bp, Artificial
  CRISPR gRNA sequence
aaattctaagtacattagca

SEQ ID NO: 211767 - DNA, 20 bp, Artificial
  CRISPR gRNA sequence
tgttatacactattacccca

SEQ ID NO: 211768 - DNA, 20 bp, Artificial
  CRISPR gRNA sequence
ctattaccccactgagtaca

SEQ ID NO: 211769 - DNA, 20 bp, Artificial
  CRISPR gRNA sequence
atagttaagtgcacacatta

SEQ ID NO: 211770 - DNA, 20 bp, Artificial
  CRISPR gRNA sequence
ctcttcctactaaagcacag

SEQ ID NO: 211771 - DNA, 20 bp, Artificial
  CRISPR gRNA sequence
ctgtcttcatttggtatcct

SEQ ID NO: 211772 - DNA, 20 bp, Artificial
  CRISPR gRNA sequence
ggtatcctaagaatctaaca

SEQ ID NO: 211773 - DNA, 20 bp, Artificial
  CRISPR gRNA sequence
ctaacacagggtccagaaag

SEQ ID NO: 211774 - DNA, 20 bp, Artificial
  CRISPR gRNA sequence
taggattcaataccttcctt

SEQ ID NO: 211775 - DNA, 20 bp, Artificial
  CRISPR gRNA sequence
atctcaagtcacttgtatgg

SEQ ID NO: 211776 - DNA, 20 bp, Artificial
  CRISPR gRNA sequence
aaaagttccttaaaaatcac

SEQ ID NO: 211777 - DNA, 20 bp, Artificial
  CRISPR gRNA sequence
aaaatcacaagaatgtgtct

SEQ ID NO: 211778 - DNA, 20 bp, Artificial
  CRISPR gRNA sequence
gtctatgaatgatcttccta

SEQ ID NO: 211779 - DNA, 20 bp, Artificial
  CRISPR gRNA sequence
cctagagggtgatgtttaaa

SEQ ID NO: 211780 - DNA, 20 bp, Artificial
  CRISPR gRNA sequence
gatgtttaaactgggtctta

SEQ ID NO: 211781 - DNA, 20 bp, Artificial
  CRISPR gRNA sequence
tttaaactgggtcttaaagg

SEQ ID NO: 211782 - DNA, 20 bp, Artificial
  CRISPR gRNA sequence
ctgggtcttaaaggatgagt

SEQ ID NO: 211783 - DNA, 20 bp, Artificial
  CRISPR gRNA sequence
gaaagaaggggctttctagg

SEQ ID NO: 211784 - DNA, 20 bp, Artificial
  CRISPR gRNA sequence
aaagtgaagaactgaaagca

SEQ ID NO: 211785 - DNA, 20 bp, Artificial
  CRISPR gRNA sequence
aggaaatgaggttggaaaag

SEQ ID NO: 211786 - DNA, 20 bp, Artificial
  CRISPR gRNA sequence
aaaaattctaaagggcttcc

SEQ ID NO: 211787 - DNA, 20 bp, Artificial
  CRISPR gRNA sequence
gggcttccttgaatgtcatg

SEQ ID NO: 211788 - DNA, 20 bp, Artificial
  CRISPR gRNA sequence
aagaggcttaaatatttggg

SEQ ID NO: 211789 - DNA, 20 bp, Artificial
  CRISPR gRNA sequence
ttttgttttattttttaata

SEQ ID NO: 211790 - DNA, 20 bp, Artificial
  CRISPR gRNA sequence
atgtgtgcaagctacgggga

SEQ ID NO: 211791 - DNA, 20 bp, Artificial
  CRISPR gRNA sequence
agatctaagatgcaagactg

SEQ ID NO: 211792 - DNA, 20 bp, Artificial
  CRISPR gRNA sequence
gttgtcctttcgttggaaaa

SEQ ID NO: 211793 - DNA, 20 bp, Artificial
  CRISPR gRNA sequence
gagtaggttttcttctgaag

SEQ ID NO: 211794 - DNA, 20 bp, Artificial
  CRISPR gRNA sequence
tctgaagctggatgacggaa

SEQ ID NO: 211795 - DNA, 20 bp, Artificial
  CRISPR gRNA sequence
aatggtgggagggaagcaga

SEQ ID NO: 211796 - DNA, 20 bp, Artificial
  CRISPR gRNA sequence
cacaccactattttttgcag

SEQ ID NO: 211797 - DNA, 20 bp, Artificial
  CRISPR gRNA sequence
taggaagttaattatctgct

SEQ ID NO: 211798 - DNA, 20 bp, Artificial
  CRISPR gRNA sequence
aagttaattatctgctggga

SEQ ID NO: 211799 - DNA, 20 bp, Artificial
  CRISPR gRNA sequence
tctgctgggaatggatgttc

SEQ ID NO: 211800 - DNA, 20 bp, Artificial
  CRISPR gRNA sequence
tgggaatggatgttcaggaa

SEQ ID NO: 211801 - DNA, 20 bp, Artificial
  CRISPR gRNA sequence
tagtgtctggcttgaagaac

SEQ ID NO: 211802 - DNA, 20 bp, Artificial
  CRISPR gRNA sequence
aactggagtctctagctaca

SEQ ID NO: 211803 - DNA, 20 bp, Artificial
  CRISPR gRNA sequence
tacactgggttacgtacaaa

SEQ ID NO: 211804 - DNA, 20 bp, Artificial
  CRISPR gRNA sequence
tggacactaaaataaaggtc

SEQ ID NO: 211805 - DNA, 20 bp, Artificial
  CRISPR gRNA sequence
actaaaataaaggtctgggg

SEQ ID NO: 211806 - DNA, 20 bp, Artificial
  CRISPR gRNA sequence
aataaaggtctggggtagag

SEQ ID NO: 211807 - DNA, 20 bp, Artificial
  CRISPR gRNA sequence
gacccaacgcaatcccccta

SEQ ID NO: 211808 - DNA, 20 bp, Artificial
  CRISPR gRNA sequence
gaatttaaaagtggccttat

SEQ ID NO: 211809 - DNA, 20 bp, Artificial
  CRISPR gRNA sequence
aagaatggaagaggccaact

SEQ ID NO: 211810 - DNA, 20 bp, Artificial
  CRISPR gRNA sequence
agtttaaagtcaataacatc

SEQ ID NO: 211811 - DNA, 20 bp, Artificial
  CRISPR gRNA sequence
caagcacctaagtaccatga

SEQ ID NO: 211812 - DNA, 20 bp, Artificial
  CRISPR gRNA sequence
tgcacattaattctcctaat

SEQ ID NO: 211813 - DNA, 20 bp, Artificial
  CRISPR gRNA sequence
accatgagattgaccagatt

SEQ ID NO: 211814 - DNA, 20 bp, Artificial
  CRISPR gRNA sequence
gagtcttatgcaactgctcc

SEQ ID NO: 211815 - DNA, 20 bp, Artificial
  CRISPR gRNA sequence
atgcaactgctccatggatt

SEQ ID NO: 211816 - DNA, 20 bp, Artificial
  CRISPR gRNA sequence
ttggaatgaaatattcagag

SEQ ID NO: 211817 - DNA, 20 bp, Artificial
  CRISPR gRNA sequence
ttgtcttagtctaggtatat

SEQ ID NO: 211818 - DNA, 20 bp, Artificial
  CRISPR gRNA sequence
gtatatcagaatcaaatttc

SEQ ID NO: 211819 - DNA, 20 bp, Artificial
  CRISPR gRNA sequence
ttttctactttagtactaca

SEQ ID NO: 211820 - DNA, 20 bp, Artificial
  CRISPR gRNA sequence
tgcctatatactagctatag

SEQ ID NO: 211821 - DNA, 20 bp, Artificial
  CRISPR gRNA sequence
tgaaatgcaaatctagtttt

SEQ ID NO: 211822 - DNA, 20 bp, Artificial
  CRISPR gRNA sequence
tgcgaatatgcgtgattatt

SEQ ID NO: 211823 - DNA, 20 bp, Artificial
  CRISPR gRNA sequence
atgcgtgattattttggatt

SEQ ID NO: 211824 - DNA, 20 bp, Artificial
  CRISPR gRNA sequence
acaactcattttgaacaaag

SEQ ID NO: 211825 - DNA, 20 bp, Artificial
  CRISPR gRNA sequence
taaacaaagtataattgtac

SEQ ID NO: 211826 - DNA, 20 bp, Artificial
  CRISPR gRNA sequence
taattgtacatgagtggggg

SEQ ID NO: 211827 - DNA, 20 bp, Artificial
  CRISPR gRNA sequence
gtacatgagtgggggcagag

SEQ ID NO: 211828 - DNA, 20 bp, Artificial
  CRISPR gRNA sequence
tttgcctgtaattgcatgaa

SEQ ID NO: 211829 - DNA, 20 bp, Artificial
  CRISPR gRNA sequence
caaaggccactaacactgta

SEQ ID NO: 211830 - DNA, 20 bp, Artificial
  CRISPR gRNA sequence
aaaatcaaacttcaatacaa

SEQ ID NO: 211831 - DNA, 20 bp, Artificial
  CRISPR gRNA sequence
aaaataaaatactataaatt

SEQ ID NO: 211832 - DNA, 20 bp, Artificial
  CRISPR gRNA sequence
attctgaattcgatgactct

SEQ ID NO: 211833 - DNA, 20 bp, Artificial
  CRISPR gRNA sequence
cacattaaaattgtgtgtaa

SEQ ID NO: 211834 - DNA, 20 bp, Artificial
  CRISPR gRNA sequence
ctttttactttttaggcagt

SEQ ID NO: 211835 - DNA, 20 bp, Artificial
  CRISPR gRNA sequence
accatttagataacggagac

SEQ ID NO: 211836 - DNA, 20 bp, Artificial
  CRISPR gRNA sequence
ggattcacagtcccaacatc

SEQ ID NO: 211837 - DNA, 20 bp, Artificial
  CRISPR gRNA sequence
ggctaataatcagtttaaaa

SEQ ID NO: 211838 - DNA, 20 bp, Artificial
  CRISPR gRNA sequence
atcgaattaatttagcattc

SEQ ID NO: 211839 - DNA, 20 bp, Artificial
  CRISPR gRNA sequence
tgctgtcactggtgctcaag

SEQ ID NO: 211840 - DNA, 20 bp, Artificial
  CRISPR gRNA sequence
actggtgctcaagctgaatt

SEQ ID NO: 211841 - DNA, 20 bp, Artificial
  CRISPR gRNA sequence
aaaagttcacaaaaggctct

SEQ ID NO: 211842 - DNA, 20 bp, Artificial
  CRISPR gRNA sequence
caggcactcactgtagagct

SEQ ID NO: 211843 - DNA, 20 bp, Artificial
  CRISPR gRNA sequence
acacgttttacaaaagcgaa

SEQ ID NO: 211844 - DNA, 20 bp, Artificial
  CRISPR gRNA sequence
cgaaatggattccaaaagct

SEQ ID NO: 211845 - DNA, 20 bp, Artificial
  CRISPR gRNA sequence
ggattccaaaagctcggggt

SEQ ID NO: 211846 - DNA, 20 bp, Artificial
  CRISPR gRNA sequence
aaagctcggggtgggggtgg

SEQ ID NO: 211847 - DNA, 20 bp, Artificial
  CRISPR gRNA sequence
aaaaacttcaacgtacaatt

SEQ ID NO: 211848 - DNA, 20 bp, Artificial
  CRISPR gRNA sequence
gcaagtggctgatggggcgt

SEQ ID NO: 211849 - DNA, 20 bp, Artificial
  CRISPR gRNA sequence
cgtgagggtcacgagaaagg

SEQ ID NO: 211850 - DNA, 20 bp, Artificial
  CRISPR gRNA sequence
gtttccagcaagcttatttt

SEQ ID NO: 211851 - DNA, 20 bp, Artificial
  CRISPR gRNA sequence
cggccggaagattcttctga

SEQ ID NO: 211852 - DNA, 20 bp, Artificial
  CRISPR gRNA sequence
aagattcttctgattgaatg

SEQ ID NO: 211853 - DNA, 20 bp, Artificial
  CRISPR gRNA sequence
tctaagcactgagaagggag

SEQ ID NO: 211854 - DNA, 20 bp, Artificial
  CRISPR gRNA sequence
gggagaggggtgcgaaagaa

SEQ ID NO: 211855 - DNA, 20 bp, Artificial
  CRISPR gRNA sequence
tttgcgcgaggtgcgcggtt

SEQ ID NO: 211856 - DNA, 20 bp, Artificial
  CRISPR gRNA sequence
gtgcatttggagatggagaa

SEQ ID NO: 211857 - DNA, 20 bp, Artificial
  CRISPR gRNA sequence
gcacttcgggcgctcagggc

SEQ ID NO: 211858 - DNA, 20 bp, Artificial
  CRISPR gRNA sequence
ccacatctccgcgcccgccg

SEQ ID NO: 211859 - DNA, 20 bp, Artificial
  CRISPR gRNA sequence
gcagcggttgcggggcgggg

SEQ ID NO: 211860 - DNA, 20 bp, Artificial
  CRISPR gRNA sequence
gcggccgtgcagcctgggca

SEQ ID NO: 211861 - DNA, 20 bp, Artificial
  CRISPR gRNA sequence
gctgggctcggcgtgctgcg

SEQ ID NO: 211862 - DNA, 20 bp, Artificial
  CRISPR gRNA sequence
cagcccggcggcgccctgaa

SEQ ID NO: 211863 - DNA, 20 bp, Artificial
  CRISPR gRNA sequence
agacgtgggagggccccacg

SEQ ID NO: 211864 - DNA, 20 bp, Artificial
  CRISPR gRNA sequence
ccctggtcgtcttcttcccc

SEQ ID NO: 211865 - DNA, 20 bp, Artificial
  CRISPR gRNA sequence
ggcaaggggctgcagctgct

SEQ ID NO: 211866 - DNA, 20 bp, Artificial
  CRISPR gRNA sequence
tctcagtgcttagacgcatt

SEQ ID NO: 211867 - DNA, 20 bp, Artificial
  CRISPR gRNA sequence
gcatttggggttgagggagg

SEQ ID NO: 211868 - DNA, 20 bp, Artificial
  CRISPR gRNA sequence
ttttggcgaagtcggtgaga

SEQ ID NO: 211869 - DNA, 20 bp, Artificial
  CRISPR gRNA sequence
tcaactcagcattcaatcag

SEQ ID NO: 211870 - DNA, 20 bp, Artificial
  CRISPR gRNA sequence
tccagtcaaaacatgtgcag

SEQ ID NO: 211871 - DNA, 20 bp, Artificial
  CRISPR gRNA sequence
tcaaaacatgtgcagcagaa

SEQ ID NO: 211872 - DNA, 20 bp, Artificial
  CRISPR gRNA sequence
ccacccccaccccgagcttt

SEQ ID NO: 211873 - DNA, 20 bp, Artificial
  CRISPR gRNA sequence
tcgtctgtaaaaactgagca

SEQ ID NO: 211874 - DNA, 20 bp, Artificial
  CRISPR gRNA sequence
gaaacattcgtagctctaca

SEQ ID NO: 211875 - DNA, 20 bp, Artificial
  CRISPR gRNA sequence
ttgtgaacttttataagatt

SEQ ID NO: 211876 - DNA, 20 bp, Artificial
  CRISPR gRNA sequence
agcaattgttacatttattc

SEQ ID NO: 211877 - DNA, 20 bp, Artificial
  CRISPR gRNA sequence
ttcctccctccccgagcatc

SEQ ID NO: 211878 - DNA, 20 bp, Artificial
  CRISPR gRNA sequence
gcatcctggatgttgggact

SEQ ID NO: 211879 - DNA, 20 bp, Artificial
  CRISPR gRNA sequence
atcacgtagtttagaactgt

SEQ ID NO: 211880 - DNA, 20 bp, Artificial
  CRISPR gRNA sequence
agaactgttggaatggtact

SEQ ID NO: 211881 - DNA, 20 bp, Artificial
  CRISPR gRNA sequence
tggaatggtactttgagtga

SEQ ID NO: 211882 - DNA, 20 bp, Artificial
  CRISPR gRNA sequence
tacacacaattttaatgtgt

SEQ ID NO: 211883 - DNA, 20 bp, Artificial
  CRISPR gRNA sequence
ttttaatgtgttcgaatccc

SEQ ID NO: 211884 - DNA, 20 bp, Artificial
  CRISPR gRNA sequence
tgttcgaatccctagagtca

SEQ ID NO: 211885 - DNA, 20 bp, Artificial
  CRISPR gRNA sequence
atccctagagtcatcgaatt

SEQ ID NO: 211886 - DNA, 20 bp, Artificial
  CRISPR gRNA sequence
aaaatacaggcattatgcag

SEQ ID NO: 211887 - DNA, 20 bp, Artificial
  CRISPR gRNA sequence
gttaagtgtggactgtaaaa

SEQ ID NO: 211888 - DNA, 20 bp, Artificial
  CRISPR gRNA sequence
cacataggtagttataaacc

SEQ ID NO: 211889 - DNA, 20 bp, Artificial
  CRISPR gRNA sequence
agggtttgagagactgactt

SEQ ID NO: 211890 - DNA, 20 bp, Artificial
  CRISPR gRNA sequence
gagagactgactttagaatc

SEQ ID NO: 211891 - DNA, 20 bp, Artificial
  CRISPR gRNA sequence
gactgactttagaatctaga

SEQ ID NO: 211892 - DNA, 20 bp, Artificial
  CRISPR gRNA sequence
ctagaatgagtaagaaagtg

SEQ ID NO: 211893 - DNA, 20 bp, Artificial
  CRISPR gRNA sequence
agtttcgttaattaagcccc

SEQ ID NO: 211894 - DNA, 20 bp, Artificial
  CRISPR gRNA sequence
aatggtatgcaagatgtgaa

SEQ ID NO: 211895 - DNA, 20 bp, Artificial
  CRISPR gRNA sequence
gtgaactgtcttttcagtgg

SEQ ID NO: 211896 - DNA, 20 bp, Artificial
  CRISPR gRNA sequence
atgattcctctttgttcaaa

SEQ ID NO: 211897 - DNA, 20 bp, Artificial
  CRISPR gRNA sequence
agttgtttttttttttaaat

SEQ ID NO: 211898 - DNA, 20 bp, Artificial
  CRISPR gRNA sequence
aataaaaatgttttctctta

SEQ ID NO: 211899 - DNA, 20 bp, Artificial
  CRISPR gRNA sequence
cagatgttttatctttgtca

SEQ ID NO: 211900 - DNA, 20 bp, Artificial
  CRISPR gRNA sequence
ctagatttgcatttcatagt

SEQ ID NO: 211901 - DNA, 20 bp, Artificial
  CRISPR gRNA sequence
ctgattttaataatatcgtc

SEQ ID NO: 211902 - DNA, 20 bp, Artificial
  CRISPR gRNA sequence
tcttctgtgataaaaagaac

SEQ ID NO: 211903 - DNA, 20 bp, Artificial
  CRISPR gRNA sequence
aaagaacaagaataatagtg

SEQ ID NO: 211904 - DNA, 20 bp, Artificial
  CRISPR gRNA sequence
atatacctagactaagacaa

SEQ ID NO: 211905 - DNA, 20 bp, Artificial
  CRISPR gRNA sequence
ctagactaagacaatagaat

SEQ ID NO: 211906 - DNA, 20 bp, Artificial
  CRISPR gRNA sequence
aaatcaagctacacccacct

SEQ ID NO: 211907 - DNA, 20 bp, Artificial
  CRISPR gRNA sequence
tggagcagttgcataagact

SEQ ID NO: 211908 - DNA, 20 bp, Artificial
  CRISPR gRNA sequence
tggtttgagattcagattag

SEQ ID NO: 211909 - DNA, 20 bp, Artificial
  CRISPR gRNA sequence
aggagaattaatgtgcatat

SEQ ID NO: 211910 - DNA, 20 bp, Artificial
  CRISPR gRNA sequence
gtaggttaaaaggtaaagca

SEQ ID NO: 211911 - DNA, 20 bp, Artificial
  CRISPR gRNA sequence
agatgtagtatatagacagt

SEQ ID NO: 211912 - DNA, 20 bp, Artificial
  CRISPR gRNA sequence
tgcttgttaaggccataatt

SEQ ID NO: 211913 - DNA, 20 bp, Artificial
  CRISPR gRNA sequence
gccacttttaaattcattag

SEQ ID NO: 211914 - DNA, 20 bp, Artificial
  CRISPR gRNA sequence
aattcattagggggattgcg

SEQ ID NO: 211915 - DNA, 20 bp, Artificial
  CRISPR gRNA sequence
ttctaaggggcaaaagtagg

SEQ ID NO: 211916 - DNA, 20 bp, Artificial
  CRISPR gRNA sequence
cactgccaaatttattgtaa

SEQ ID NO: 211917 - DNA, 20 bp, Artificial
  CRISPR gRNA sequence
actattgcagtagtctgtta

SEQ ID NO: 211918 - DNA, 20 bp, Artificial
  CRISPR gRNA sequence
tttttttaatgaaattaaat

SEQ ID NO: 211919 - DNA, 20 bp, Artificial
  CRISPR gRNA sequence
tgacattcaaggaagccctt

SEQ ID NO: 211920 - DNA, 20 bp, Artificial
  CRISPR gRNA sequence
atttttagatttttcttcta

SEQ ID NO: 211921 - DNA, 20 bp, Artificial
  CRISPR gRNA sequence
ttacattcacaaggaaggta

SEQ ID NO: 211922 - DNA, 20 bp, Artificial
  CRISPR gRNA sequence
tggaccctgtgttagattct

SEQ ID NO: 211923 - DNA, 20 bp, Artificial
  CRISPR gRNA sequence
atgggagcaataaggagggg

SEQ ID NO: 211924 - DNA, 20 bp, Artificial
  CRISPR gRNA sequence
taaggaggggaagaatacaa

SEQ ID NO: 211925 - DNA, 20 bp, Artificial
  CRISPR gRNA sequence
caaactgtagctgccattta

SEQ ID NO: 211926 - DNA, 20 bp, Artificial
  CRISPR gRNA sequence
acagctaagaagtacatgag

SEQ ID NO: 211927 - DNA, 20 bp, Artificial
  CRISPR gRNA sequence
acatgaggtgaatcttaaac

SEQ ID NO: 211928 - DNA, 20 bp, Artificial
  CRISPR gRNA sequence
tatacaccctatgtactcag

SEQ ID NO: 211929 - DNA, 20 bp, Artificial
  CRISPR gRNA sequence
aacagtatgtgctaaggcat

SEQ ID NO: 211930 - DNA, 20 bp, Artificial
  CRISPR gRNA sequence
atgtgctaaggcatggggat

SEQ ID NO: 211931 - DNA, 20 bp, Artificial
  CRISPR gRNA sequence
agagtgcatttgcatagtca

SEQ ID NO: 211932 - DNA, 20 bp, Artificial
  CRISPR gRNA sequence
ggagcttagtgtggaaatga

SEQ ID NO: 211933 - DNA, 20 bp, Artificial
  CRISPR gRNA sequence
gtacaggaggtggggctgga

SEQ ID NO: 211934 - DNA, 20 bp, Artificial
  CRISPR gRNA sequence
gtattccatgctaatgtact

SEQ ID NO: 211935 - DNA, 20 bp, Artificial
  CRISPR gRNA sequence
tacttagaatttagcctgaa

SEQ ID NO: 211936 - DNA, 20 bp, Artificial
  CRISPR gRNA sequence
aatttagcctgaaaagggtt

SEQ ID NO: 211937 - DNA, 20 bp, Artificial
  CRISPR gRNA sequence
tgttaaagtatcttaggcaa

SEQ ID NO: 211938 - DNA, 20 bp, Artificial
  CRISPR gRNA sequence
tgtagaaaatacatcagggc

SEQ ID NO: 211939 - DNA, 20 bp, Artificial
  CRISPR gRNA sequence
ggccaggatggagaaacctt

SEQ ID NO: 211940 - DNA, 20 bp, Artificial
  CRISPR gRNA sequence
ggaggcagggagctggttag

SEQ ID NO: 211941 - DNA, 20 bp, Artificial
  CRISPR gRNA sequence
atggcagtagttcgaggggg

SEQ ID NO: 211942 - DNA, 20 bp, Artificial
  CRISPR gRNA sequence
cagtagttcgaggggggagg

SEQ ID NO: 211943 - DNA, 20 bp, Artificial
  CRISPR gRNA sequence
attcattcattcaacagaca

SEQ ID NO: 211944 - DNA, 20 bp, Artificial
  CRISPR gRNA sequence
ttaattaggttgaacctact

SEQ ID NO: 211945 - DNA, 20 bp, Artificial
  CRISPR gRNA sequence
attctccatggctaaggaga

SEQ ID NO: 211946 - DNA, 20 bp, Artificial
  CRISPR gRNA sequence
ttagcaaagtgatttaggct

SEQ ID NO: 211947 - DNA, 20 bp, Artificial
  CRISPR gRNA sequence
ttaggctgagggtaagaagt

SEQ ID NO: 211948 - DNA, 20 bp, Artificial
  CRISPR gRNA sequence
ttgcaggtgaagaaaaccat

SEQ ID NO: 211949 - DNA, 20 bp, Artificial
  CRISPR gRNA sequence
agggaaaatactagggggca

SEQ ID NO: 211950 - DNA, 20 bp, Artificial
  CRISPR gRNA sequence
atactagggggcagagggta

SEQ ID NO: 211951 - DNA, 20 bp, Artificial
  CRISPR gRNA sequence
tagggacactaacatttagt

SEQ ID NO: 211952 - DNA, 20 bp, Artificial
  CRISPR gRNA sequence
ctaacatttagtgtgagtca

SEQ ID NO: 211953 - DNA, 20 bp, Artificial
  CRISPR gRNA sequence
tttcaacaaagaaagcaaac

SEQ ID NO: 211954 - DNA, 20 bp, Artificial
  CRISPR gRNA sequence
acaaagaaagcaaactagga

SEQ ID NO: 211955 - DNA, 20 bp, Artificial
  CRISPR gRNA sequence
tgcatatttgatttttcaca

SEQ ID NO: 211956 - DNA, 20 bp, Artificial
  CRISPR gRNA sequence
agctgtagtaatgaagaagt

SEQ ID NO: 211957 - DNA, 20 bp, Artificial
  CRISPR gRNA sequence
gtagtaatgaagaagtaggg

SEQ ID NO: 211958 - DNA, 20 bp, Artificial
  CRISPR gRNA sequence
taatgaagaagtaggggtga

SEQ ID NO: 211959 - DNA, 20 bp, Artificial
  CRISPR gRNA sequence
gaggccacgtaacagattta

SEQ ID NO: 211960 - DNA, 20 bp, Artificial
  CRISPR gRNA sequence
ccacgtaacagatttaagga

SEQ ID NO: 211961 - DNA, 20 bp, Artificial
  CRISPR gRNA sequence
atgcttatagattgttaatt

SEQ ID NO: 211962 - DNA, 20 bp, Artificial
  CRISPR gRNA sequence
ctagggagagagaaagtatg

SEQ ID NO: 211963 - DNA, 20 bp, Artificial
  CRISPR gRNA sequence
caaaaacaacaccttgtaaa

SEQ ID NO: 211964 - DNA, 20 bp, Artificial
  CRISPR gRNA sequence
aacaccttgtaaatggaatg

SEQ ID NO: 211965 - DNA, 20 bp, Artificial
  CRISPR gRNA sequence
gaaagtcgttgaggagactg

SEQ ID NO: 211966 - DNA, 20 bp, Artificial
  CRISPR gRNA sequence
ggaaactagctttcaggtga

SEQ ID NO: 211967 - DNA, 20 bp, Artificial
  CRISPR gRNA sequence
agcaaaaaaaaaaaaaaggt

SEQ ID NO: 211968 - DNA, 20 bp, Artificial
  CRISPR gRNA sequence
aaaaaaaaggtgtggatagt

SEQ ID NO: 211969 - DNA, 20 bp, Artificial
  CRISPR gRNA sequence
tacaggtaggtttataggga

SEQ ID NO: 211970 - DNA, 20 bp, Artificial
  CRISPR gRNA sequence
ggaaggagtattggaagctt

SEQ ID NO: 211971 - DNA, 20 bp, Artificial
  CRISPR gRNA sequence
atagggagagaggactgttg

SEQ ID NO: 211972 - DNA, 20 bp, Artificial
  CRISPR gRNA sequence
gagaggactgttggagagta

SEQ ID NO: 211973 - DNA, 20 bp, Artificial
  CRISPR gRNA sequence
gtatgggataaagggcagaa

SEQ ID NO: 211974 - DNA, 20 bp, Artificial
  CRISPR gRNA sequence
agggcagaagggagtaattt

SEQ ID NO: 211975 - DNA, 20 bp, Artificial
  CRISPR gRNA sequence
tgtttttgcctattagcaac

SEQ ID NO: 211976 - DNA, 20 bp, Artificial
  CRISPR gRNA sequence
atacttatcatcgcccattt

SEQ ID NO: 211977 - DNA, 20 bp, Artificial
  CRISPR gRNA sequence
acttgtgtgctgtgaccacc

SEQ ID NO: 211978 - DNA, 20 bp, Artificial
  CRISPR gRNA sequence
tgtgctgtgaccaccatgga

SEQ ID NO: 211979 - DNA, 20 bp, Artificial
  CRISPR gRNA sequence
ataagcatatcttgtttatt

SEQ ID NO: 211980 - DNA, 20 bp, Artificial
  CRISPR gRNA sequence
actttgctgttttatgagaa

SEQ ID NO: 211981 - DNA, 20 bp, Artificial
  CRISPR gRNA sequence
ttgaagttgtagttaacagc

SEQ ID NO: 211982 - DNA, 20 bp, Artificial
  CRISPR gRNA sequence
taaacatatgttatgaaatg

SEQ ID NO: 211983 - DNA, 20 bp, Artificial
  CRISPR gRNA sequence
agcctttgcaaaaagtttca

SEQ ID NO: 211984 - DNA, 20 bp, Artificial
  CRISPR gRNA sequence
caaaaagtttcataggatga

SEQ ID NO: 211985 - DNA, 20 bp, Artificial
  CRISPR gRNA sequence
cattcgtacctctttttttt

SEQ ID NO: 211986 - DNA, 20 bp, Artificial
  CRISPR gRNA sequence
agacacatttataggcaatc

SEQ ID NO: 211987 - DNA, 20 bp, Artificial
  CRISPR gRNA sequence
aggcaatcaagaatgcctaa

SEQ ID NO: 211988 - DNA, 20 bp, Artificial
  CRISPR gRNA sequence
ggcagtaaaatgtagtcttt

SEQ ID NO: 211989 - DNA, 20 bp, Artificial
  CRISPR gRNA sequence
ctgtatggacagcaatccat

SEQ ID NO: 211990 - DNA, 20 bp, Artificial
  CRISPR gRNA sequence
gtgaaaggcacaggcttcta

SEQ ID NO: 211991 - DNA, 20 bp, Artificial
  CRISPR gRNA sequence
attgcccagcacttgactga

SEQ ID NO: 211992 - DNA, 20 bp, Artificial
  CRISPR gRNA sequence
ttcacaattccaaagtttta

SEQ ID NO: 211993 - DNA, 20 bp, Artificial
  CRISPR gRNA sequence
tgccttgggcttcctagtat

SEQ ID NO: 211994 - DNA, 20 bp, Artificial
  CRISPR gRNA sequence
aaactgggaagaggtgagct

SEQ ID NO: 211995 - DNA, 20 bp, Artificial
  CRISPR gRNA sequence
taagagatcctcctatttta

SEQ ID NO: 211996 - DNA, 20 bp, Artificial
  CRISPR gRNA sequence
gtaaaccaaggcatagaaaa

SEQ ID NO: 211997 - DNA, 20 bp, Artificial
  CRISPR gRNA sequence
gcatccttgcattcaattca

SEQ ID NO: 211998 - DNA, 20 bp, Artificial
  CRISPR gRNA sequence
ttcaattcatggggtattta

SEQ ID NO: 211999 - DNA, 20 bp, Artificial
  CRISPR gRNA sequence
ccaagtagctacttaggtaa

SEQ ID NO: 212000 - DNA, 20 bp, Artificial
  CRISPR gRNA sequence
ctacttaggtaaaagagttg

SEQ ID NO: 212001 - DNA, 20 bp, Artificial
  CRISPR gRNA sequence
aaagagttgctgagtggctg

SEQ ID NO: 212002 - DNA, 20 bp, Artificial
  CRISPR gRNA sequence
ttgtacattttagttgaaca

SEQ ID NO: 212003 - DNA, 20 bp, Artificial
  CRISPR gRNA sequence
atcctattgagaagcgtaga

SEQ ID NO: 212004 - DNA, 20 bp, Artificial
  CRISPR gRNA sequence
gttttgtggtttcttggagg

SEQ ID NO: 212005 - DNA, 20 bp, Artificial
  CRISPR gRNA sequence
ctgtagtgtcaatgaaatgt

SEQ ID NO: 212006 - DNA, 20 bp, Artificial
  CRISPR gRNA sequence
tttttttggaaatgcagcat

SEQ ID NO: 212007 - DNA, 20 bp, Artificial
  CRISPR gRNA sequence
gcagtgtgttgaagttgaga

SEQ ID NO: 212008 - DNA, 20 bp, Artificial
  CRISPR gRNA sequence
tgcatgttccaacatagttg

SEQ ID NO: 212009 - DNA, 20 bp, Artificial
  CRISPR gRNA sequence
aatgtatactttgtattatt

SEQ ID NO: 212010 - DNA, 20 bp, Artificial
  CRISPR gRNA sequence
tatactttgtattattgaga

SEQ ID NO: 212011 - DNA, 20 bp, Artificial
  CRISPR gRNA sequence
gaaatgttgctgtttatctt

SEQ ID NO: 212012 - DNA, 20 bp, Artificial
  CRISPR gRNA sequence
acatttttctttttcctttc

SEQ ID NO: 212013 - DNA, 20 bp, Artificial
  CRISPR gRNA sequence
atttaataaaacaaaatctg

SEQ ID NO: 212014 - DNA, 20 bp, Artificial
  CRISPR gRNA sequence
aaggagatgcctctttgaag

SEQ ID NO: 212015 - DNA, 20 bp, Artificial
  CRISPR gRNA sequence
atgcctctttgaagatggat

SEQ ID NO: 212016 - DNA, 20 bp, Artificial
  CRISPR gRNA sequence
aaactacacttgtgaagtaa

SEQ ID NO: 212017 - DNA, 20 bp, Artificial
  CRISPR gRNA sequence
ctttcgagaggaggccaaat

SEQ ID NO: 212018 - DNA, 20 bp, Artificial
  CRISPR gRNA sequence
aaatggggataggtactcct

SEQ ID NO: 212019 - DNA, 20 bp, Artificial
  CRISPR gRNA sequence
tttatttggctgattggtcc

SEQ ID NO: 212020 - DNA, 20 bp, Artificial
  CRISPR gRNA sequence
ttaaccttacactttgacca

SEQ ID NO: 212021 - DNA, 20 bp, Artificial
  CRISPR gRNA sequence
ccagccatgctccctctgga

SEQ ID NO: 212022 - DNA, 20 bp, Artificial
  CRISPR gRNA sequence
tccctctggagagaatagag

SEQ ID NO: 212023 - DNA, 20 bp, Artificial
  CRISPR gRNA sequence
ggagattaaatcacgttatc

SEQ ID NO: 212024 - DNA, 20 bp, Artificial
  CRISPR gRNA sequence
ctgccctttttatcacaaac

SEQ ID NO: 212025 - DNA, 20 bp, Artificial
  CRISPR gRNA sequence
gctgtttcctgctgtgctag

SEQ ID NO: 212026 - DNA, 20 bp, Artificial
  CRISPR gRNA sequence
gctgagttcttcaaccccat

SEQ ID NO: 212027 - DNA, 20 bp, Artificial
  CRISPR gRNA sequence
tctgttttgaaatctctatt

SEQ ID NO: 212028 - DNA, 20 bp, Artificial
  CRISPR gRNA sequence
ataggttcagttctgttcag

SEQ ID NO: 212029 - DNA, 20 bp, Artificial
  CRISPR gRNA sequence
aaataatctactaccagatt

SEQ ID NO: 212030 - DNA, 20 bp, Artificial
  CRISPR gRNA sequence
atctactaccagattaggaa

SEQ ID NO: 212031 - DNA, 20 bp, Artificial
  CRISPR gRNA sequence
tgaaatgtttgcacattact

SEQ ID NO: 212032 - DNA, 20 bp, Artificial
  CRISPR gRNA sequence
tttgcacattacttaggatt

SEQ ID NO: 212033 - DNA, 20 bp, Artificial
  CRISPR gRNA sequence
aggattgagaatcaggaggt

SEQ ID NO: 212034 - DNA, 20 bp, Artificial
  CRISPR gRNA sequence
gatcttgagaaggtgcttaa

SEQ ID NO: 212035 - DNA, 20 bp, Artificial
  CRISPR gRNA sequence
gtaaatgttagttgttttcc

SEQ ID NO: 212036 - DNA, 20 bp, Artificial
  CRISPR gRNA sequence
ttagcctagagcattgtgag

SEQ ID NO: 212037 - DNA, 20 bp, Artificial
  CRISPR gRNA sequence
agagggatttgtgtgcagtg

SEQ ID NO: 212038 - DNA, 20 bp, Artificial
  CRISPR gRNA sequence
tgtgcagtgaggaatgggca

SEQ ID NO: 212039 - DNA, 20 bp, Artificial
  CRISPR gRNA sequence
ggaatgggcaagggatggct

SEQ ID NO: 212040 - DNA, 20 bp, Artificial
  CRISPR gRNA sequence
gatggctccgagtaggcaag

SEQ ID NO: 212041 - DNA, 20 bp, Artificial
  CRISPR gRNA sequence
tgttaagtatacctttaatg

SEQ ID NO: 212042 - DNA, 20 bp, Artificial
  CRISPR gRNA sequence
gtacaattttgtggaaatga

SEQ ID NO: 212043 - DNA, 20 bp, Artificial
  CRISPR gRNA sequence
tgggggaacagtaacttttg

SEQ ID NO: 212044 - DNA, 20 bp, Artificial
  CRISPR gRNA sequence
gaaatgaagatggaagagaa

SEQ ID NO: 212045 - DNA, 20 bp, Artificial
  CRISPR gRNA sequence
gatggaagagaaaggaatgc

SEQ ID NO: 212046 - DNA, 20 bp, Artificial
  CRISPR gRNA sequence
gaaagtattgttttattata

SEQ ID NO: 212047 - DNA, 20 bp, Artificial
  CRISPR gRNA sequence
tttcaacaatgctatataaa

SEQ ID NO: 212048 - DNA, 20 bp, Artificial
  CRISPR gRNA sequence
tttccttacttttttttttg

SEQ ID NO: 212049 - DNA, 20 bp, Artificial
  CRISPR gRNA sequence
gctgagtagtagtccatagt

SEQ ID NO: 212050 - DNA, 20 bp, Artificial
  CRISPR gRNA sequence
agacacagttttcatttctc

SEQ ID NO: 212051 - DNA, 20 bp, Artificial
  CRISPR gRNA sequence
aagaaactgccagacttttc

SEQ ID NO: 212052 - DNA, 20 bp, Artificial
  CRISPR gRNA sequence
tacatttccatcaacaatgt

SEQ ID NO: 212053 - DNA, 20 bp, Artificial
  CRISPR gRNA sequence
atggggcaggactcttacta

SEQ ID NO: 212054 - DNA, 20 bp, Artificial
  CRISPR gRNA sequence
agtataagttcttttctaat

SEQ ID NO: 212055 - DNA, 20 bp, Artificial
  CRISPR gRNA sequence
acttacttgtcacggacttt

SEQ ID NO: 212056 - DNA, 20 bp, Artificial
  CRISPR gRNA sequence
atacaggcataaatgagaaa

SEQ ID NO: 212057 - DNA, 20 bp, Artificial
  CRISPR gRNA sequence
agaatttgctcaatagagaa

SEQ ID NO: 212058 - DNA, 20 bp, Artificial
  CRISPR gRNA sequence
gagaagtgaattctacttaa

SEQ ID NO: 212059 - DNA, 20 bp, Artificial
  CRISPR gRNA sequence
aattttttggaggactagga

SEQ ID NO: 212060 - DNA, 20 bp, Artificial
  CRISPR gRNA sequence
gtttaatagcttaagaaaag

SEQ ID NO: 212061 - DNA, 20 bp, Artificial
  CRISPR gRNA sequence
taggcatcacagattctgtg

SEQ ID NO: 212062 - DNA, 20 bp, Artificial
  CRISPR gRNA sequence
gtggttgcagtacaaatatg

SEQ ID NO: 212063 - DNA, 20 bp, Artificial
  CRISPR gRNA sequence
caagaactctaggagataga

SEQ ID NO: 212064 - DNA, 20 bp, Artificial
  CRISPR gRNA sequence
ttcaaggtattgttcaaggt

SEQ ID NO: 212065 - DNA, 20 bp, Artificial
  CRISPR gRNA sequence
tcaaggtcagagtaatagcc

SEQ ID NO: 212066 - DNA, 20 bp, Artificial
  CRISPR gRNA sequence
accttgtaaataactaaata

SEQ ID NO: 212067 - DNA, 20 bp, Artificial
  CRISPR gRNA sequence
tttatttttctctaagctat

SEQ ID NO: 212068 - DNA, 20 bp, Artificial
  CRISPR gRNA sequence
caagcctggtcatggcatga

SEQ ID NO: 212069 - DNA, 20 bp, Artificial
  CRISPR gRNA sequence
tgcccagggcatactttatt

SEQ ID NO: 212070 - DNA, 20 bp, Artificial
  CRISPR gRNA sequence
ggcatactttatttggagtt

SEQ ID NO: 212071 - DNA, 20 bp, Artificial
  CRISPR gRNA sequence
ctaggctcacataattgtga

SEQ ID NO: 212072 - DNA, 20 bp, Artificial
  CRISPR gRNA sequence
attccttgtgattgtaagac

SEQ ID NO: 212073 - DNA, 20 bp, Artificial
  CRISPR gRNA sequence
tctttgctaagtatctgcca

SEQ ID NO: 212074 - DNA, 20 bp, Artificial
  CRISPR gRNA sequence
catatttaaagccagcaaag

SEQ ID NO: 212075 - DNA, 20 bp, Artificial
  CRISPR gRNA sequence
aaaggagaatcttcctcttg

SEQ ID NO: 212076 - DNA, 20 bp, Artificial
  CRISPR gRNA sequence
tgttgaatccctctcacata

SEQ ID NO: 212077 - DNA, 20 bp, Artificial
  CRISPR gRNA sequence
tttcttaaagtcagctgatt

SEQ ID NO: 212078 - DNA, 20 bp, Artificial
  CRISPR gRNA sequence
catcagcaaactcccttttg

SEQ ID NO: 212079 - DNA, 20 bp, Artificial
  CRISPR gRNA sequence
gtctcccacacacaagggga

SEQ ID NO: 212080 - DNA, 20 bp, Artificial
  CRISPR gRNA sequence
aaaagatgcatggctagggc

SEQ ID NO: 212081 - DNA, 20 bp, Artificial
  CRISPR gRNA sequence
caggggttttgggaccacct

SEQ ID NO: 212082 - DNA, 20 bp, Artificial
  CRISPR gRNA sequence
tttgggaccaccttagaatt

SEQ ID NO: 212083 - DNA, 20 bp, Artificial
  CRISPR gRNA sequence
taaaaatttggtttgcattt

SEQ ID NO: 212084 - DNA, 20 bp, Artificial
  CRISPR gRNA sequence
ctggtgttccctatgtttgt

SEQ ID NO: 212085 - DNA, 20 bp, Artificial
  CRISPR gRNA sequence
gaaggagacactttgttgat

SEQ ID NO: 212086 - DNA, 20 bp, Artificial
  CRISPR gRNA sequence
gtgataagacaaatgaggtc

SEQ ID NO: 212087 - DNA, 20 bp, Artificial
  CRISPR gRNA sequence
ggaagccattctgcctgtcc

SEQ ID NO: 212088 - DNA, 20 bp, Artificial
  CRISPR gRNA sequence
tgcctgtccaggaattggag

SEQ ID NO: 212089 - DNA, 20 bp, Artificial
  CRISPR gRNA sequence
acacagttgtcagccatagc

SEQ ID NO: 212090 - DNA, 20 bp, Artificial
  CRISPR gRNA sequence
gttgtcagccatagcttggg

SEQ ID NO: 212091 - DNA, 20 bp, Artificial
  CRISPR gRNA sequence
agccatagcttgggtagaat

SEQ ID NO: 212092 - DNA, 20 bp, Artificial
  CRISPR gRNA sequence
agcttgggtagaataaggat

SEQ ID NO: 212093 - DNA, 20 bp, Artificial
  CRISPR gRNA sequence
tcactctccccttgaggaac

SEQ ID NO: 212094 - DNA, 20 bp, Artificial
  CRISPR gRNA sequence
cagcagtgatttcaaactga

SEQ ID NO: 212095 - DNA, 20 bp, Artificial
  CRISPR gRNA sequence
gatttcaaactgagagaatc

SEQ ID NO: 212096 - DNA, 20 bp, Artificial
  CRISPR gRNA sequence
ctggcacaataatgagaagg

SEQ ID NO: 212097 - DNA, 20 bp, Artificial
  CRISPR gRNA sequence
caaactgataagttccagtt

SEQ ID NO: 212098 - DNA, 20 bp, Artificial
  CRISPR gRNA sequence
actttgggaggctgaggcag

SEQ ID NO: 212099 - DNA, 20 bp, Artificial
  CRISPR gRNA sequence
caggtggatcacctgaggtc

SEQ ID NO: 212100 - DNA, 20 bp, Artificial
  CRISPR gRNA sequence
tacttgggaggctgagacag

SEQ ID NO: 212101 - DNA, 20 bp, Artificial
  CRISPR gRNA sequence
ctgcactccagcctgggcaa

SEQ ID NO: 212102 - DNA, 20 bp, Artificial
  CRISPR gRNA sequence
catctcaaaaataaaaaaaa

SEQ ID NO: 212103 - DNA, 20 bp, Artificial
  CRISPR gRNA sequence
ctcatatttcttgtttcaca

SEQ ID NO: 212104 - DNA, 20 bp, Artificial
  CRISPR gRNA sequence
tcttgtttcacatagaatct

SEQ ID NO: 212105 - DNA, 20 bp, Artificial
  CRISPR gRNA sequence
tctatctcatcatctaattt

SEQ ID NO: 212106 - DNA, 20 bp, Artificial
  CRISPR gRNA sequence
tgagacattattacttccca

SEQ ID NO: 212107 - DNA, 20 bp, Artificial
  CRISPR gRNA sequence
ttagccattgctcatggttt

SEQ ID NO: 212108 - DNA, 20 bp, Artificial
  CRISPR gRNA sequence
ctgttagatcttcaaatgtg

SEQ ID NO: 212109 - DNA, 20 bp, Artificial
  CRISPR gRNA sequence
cagccgcttgtcattgctct

SEQ ID NO: 212110 - DNA, 20 bp, Artificial
  CRISPR gRNA sequence
cttcccatttgatctcatca

SEQ ID NO: 212111 - DNA, 20 bp, Artificial
  CRISPR gRNA sequence
cttctcccactctgcacact

SEQ ID NO: 212112 - DNA, 20 bp, Artificial
  CRISPR gRNA sequence
gctggccttcaagagcctag

SEQ ID NO: 212113 - DNA, 20 bp, Artificial
  CRISPR gRNA sequence
gggctttcaataagtgtttg

SEQ ID NO: 212114 - DNA, 20 bp, Artificial
  CRISPR gRNA sequence
gtttgtggaataagtgaaaa

SEQ ID NO: 212115 - DNA, 20 bp, Artificial
  CRISPR gRNA sequence
tgaaaaatgagtggtcacac

SEQ ID NO: 212116 - DNA, 20 bp, Artificial
  CRISPR gRNA sequence
aatgagtggtcacaccagga

SEQ ID NO: 212117 - DNA, 20 bp, Artificial
  CRISPR gRNA sequence
tattggctatattttgaagg

SEQ ID NO: 212118 - DNA, 20 bp, Artificial
  CRISPR gRNA sequence
tattttgaaggtagagtcag

SEQ ID NO: 212119 - DNA, 20 bp, Artificial
  CRISPR gRNA sequence
agcaggatttgctgtttaac

SEQ ID NO: 212120 - DNA, 20 bp, Artificial
  CRISPR gRNA sequence
gatttgctgtttaactagag

SEQ ID NO: 212121 - DNA, 20 bp, Artificial
  CRISPR gRNA sequence
gtgggatgtgggagaaatca

SEQ ID NO: 212122 - DNA, 20 bp, Artificial
  CRISPR gRNA sequence
gcctcaagcaactgaagaaa

SEQ ID NO: 212123 - DNA, 20 bp, Artificial
  CRISPR gRNA sequence
gaaatgaggaaaatgagagg

SEQ ID NO: 212124 - DNA, 20 bp, Artificial
  CRISPR gRNA sequence
atgagagggggagtttagtg

SEQ ID NO: 212125 - DNA, 20 bp, Artificial
  CRISPR gRNA sequence
agggggagtttagtggggga

SEQ ID NO: 212126 - DNA, 20 bp, Artificial
  CRISPR gRNA sequence
ggatggggtgatgaaaatat

SEQ ID NO: 212127 - DNA, 20 bp, Artificial
  CRISPR gRNA sequence
gttaagattaactgaagagc

SEQ ID NO: 212128 - DNA, 20 bp, Artificial
  CRISPR gRNA sequence
cagtttctacaactataagg

SEQ ID NO: 212129 - DNA, 20 bp, Artificial
  CRISPR gRNA sequence
atttctcacatcataattgt

SEQ ID NO: 212130 - DNA, 20 bp, Artificial
  CRISPR gRNA sequence
atcataattgtgaggatttg

SEQ ID NO: 212131 - DNA, 20 bp, Artificial
  CRISPR gRNA sequence
acagccttaccaaatccatt

SEQ ID NO: 212132 - DNA, 20 bp, Artificial
  CRISPR gRNA sequence
tctccaaaattttttcctgg

SEQ ID NO: 212133 - DNA, 20 bp, Artificial
  CRISPR gRNA sequence
tggaaataaaggtattgatt

SEQ ID NO: 212134 - DNA, 20 bp, Artificial
  CRISPR gRNA sequence
aaccctcaacagcaaacata

SEQ ID NO: 212135 - DNA, 20 bp, Artificial
  CRISPR gRNA sequence
aaaagctaatatctataaaa

SEQ ID NO: 212136 - DNA, 20 bp, Artificial
  CRISPR gRNA sequence
ttatgatgttgttatattct

SEQ ID NO: 212137 - DNA, 20 bp, Artificial
  CRISPR gRNA sequence
gaaatatgtggctatcatta

SEQ ID NO: 212138 - DNA, 20 bp, Artificial
  CRISPR gRNA sequence
acctgagagatagtgcgtgg

SEQ ID NO: 212139 - DNA, 20 bp, Artificial
  CRISPR gRNA sequence
gaaagaagtgttgatttcag

SEQ ID NO: 212140 - DNA, 20 bp, Artificial
  CRISPR gRNA sequence
ccccttgtacaggcaaactc

SEQ ID NO: 212141 - DNA, 20 bp, Artificial
  CRISPR gRNA sequence
acagctaaaattatggtctt

SEQ ID NO: 212142 - DNA, 20 bp, Artificial
  CRISPR gRNA sequence
atatcttaatttcctttata

SEQ ID NO: 212143 - DNA, 20 bp, Artificial
  CRISPR gRNA sequence
atttcctttatataggatat

SEQ ID NO: 212144 - DNA, 20 bp, Artificial
  CRISPR gRNA sequence
cttctgaagcctaattatgc

SEQ ID NO: 212145 - DNA, 20 bp, Artificial
  CRISPR gRNA sequence
taattatgcatggataattg

SEQ ID NO: 212146 - DNA, 20 bp, Artificial
  CRISPR gRNA sequence
tatgcatggataattgcaga

SEQ ID NO: 212147 - DNA, 20 bp, Artificial
  CRISPR gRNA sequence
cattttaaccacaatgagaa

SEQ ID NO: 212148 - DNA, 20 bp, Artificial
  CRISPR gRNA sequence
atcttcctcgcttaggttcc

SEQ ID NO: 212149 - DNA, 20 bp, Artificial
  CRISPR gRNA sequence
cacacccagccactcaacac

SEQ ID NO: 212150 - DNA, 20 bp, Artificial
  CRISPR gRNA sequence
tacatacttattttagttaa

SEQ ID NO: 212151 - DNA, 20 bp, Artificial
  CRISPR gRNA sequence
tttagttaactgagtactta

SEQ ID NO: 212152 - DNA, 20 bp, Artificial
  CRISPR gRNA sequence
gacacgtggtcacggttcca

SEQ ID NO: 212153 - DNA, 20 bp, Artificial
  CRISPR gRNA sequence
ggttccatagagtgttaagt

SEQ ID NO: 212154 - DNA, 20 bp, Artificial
  CRISPR gRNA sequence
catagagtgttaagttagag

SEQ ID NO: 212155 - DNA, 20 bp, Artificial
  CRISPR gRNA sequence
catgtattatagaccattag

SEQ ID NO: 212156 - DNA, 20 bp, Artificial
  CRISPR gRNA sequence
aaagtgctattatgataaat

SEQ ID NO: 212157 - DNA, 20 bp, Artificial
  CRISPR gRNA sequence
gataaatatgagtatgtaat

SEQ ID NO: 212158 - DNA, 20 bp, Artificial
  CRISPR gRNA sequence
tggtgtttttttaatctctt

SEQ ID NO: 212159 - DNA, 20 bp, Artificial
  CRISPR gRNA sequence
gtttttttaatctcttaaga

SEQ ID NO: 212160 - DNA, 20 bp, Artificial
  CRISPR gRNA sequence
atctcttaagaatgaatagt

SEQ ID NO: 212161 - DNA, 20 bp, Artificial
  CRISPR gRNA sequence
ctctaaagaagcagccacca

SEQ ID NO: 212162 - DNA, 20 bp, Artificial
  CRISPR gRNA sequence
tagatttagcttcaacaaca

SEQ ID NO: 212163 - DNA, 20 bp, Artificial
  CRISPR gRNA sequence
agtaaacatttatataagca

SEQ ID NO: 212164 - DNA, 20 bp, Artificial
  CRISPR gRNA sequence
aaagctagtaaactattgca

SEQ ID NO: 212165 - DNA, 20 bp, Artificial
  CRISPR gRNA sequence
attgccctgttgtatatttt

SEQ ID NO: 212166 - DNA, 20 bp, Artificial
  CRISPR gRNA sequence
aaggaaaaaagggggaagaa

SEQ ID NO: 212167 - DNA, 20 bp, Artificial
  CRISPR gRNA sequence
atttcacatagtgcgatttt

SEQ ID NO: 212168 - DNA, 20 bp, Artificial
  CRISPR gRNA sequence
gattttttgagtttggcttg

SEQ ID NO: 212169 - DNA, 20 bp, Artificial
  CRISPR gRNA sequence
tatttttagtgaaatgaacc

SEQ ID NO: 212170 - DNA, 20 bp, Artificial
  CRISPR gRNA sequence
tttagtgaaatgaaccagga

SEQ ID NO: 212171 - DNA, 20 bp, Artificial
  CRISPR gRNA sequence
agaacacctcgtacaaagta

SEQ ID NO: 212172 - DNA, 20 bp, Artificial
  CRISPR gRNA sequence
taaactattggtatattctg

SEQ ID NO: 212173 - DNA, 20 bp, Artificial
  CRISPR gRNA sequence
gctgcctgtgttctactttt

SEQ ID NO: 212174 - DNA, 20 bp, Artificial
  CRISPR gRNA sequence
tttacttaactctcatcttg

SEQ ID NO: 212175 - DNA, 20 bp, Artificial
  CRISPR gRNA sequence
ctctcatcttgatggatttt

SEQ ID NO: 212176 - DNA, 20 bp, Artificial
  CRISPR gRNA sequence
tctgctaaagatatgaagcc

SEQ ID NO: 212177 - DNA, 20 bp, Artificial
  CRISPR gRNA sequence
tatcaactactattgcagat

SEQ ID NO: 212178 - DNA, 20 bp, Artificial
  CRISPR gRNA sequence
ctaaaatctctgcaaatttg

SEQ ID NO: 212179 - DNA, 20 bp, Artificial
  CRISPR gRNA sequence
taatttttgtgttagtaagg

SEQ ID NO: 212180 - DNA, 20 bp, Artificial
  CRISPR gRNA sequence
acctaaagaaatattttggt

SEQ ID NO: 212181 - DNA, 20 bp, Artificial
  CRISPR gRNA sequence
cagccgtttcctgatagtac

SEQ ID NO: 212182 - DNA, 20 bp, Artificial
  CRISPR gRNA sequence
ccccgttttgcatttatttt

SEQ ID NO: 212183 - DNA, 20 bp, Artificial
  CRISPR gRNA sequence
ttgaggattttatttccatg

SEQ ID NO: 212184 - DNA, 20 bp, Artificial
  CRISPR gRNA sequence
ctatatctaagcacataata

SEQ ID NO: 212185 - DNA, 20 bp, Artificial
  CRISPR gRNA sequence
gctaaaacttattaggagag

SEQ ID NO: 212186 - DNA, 20 bp, Artificial
  CRISPR gRNA sequence
attctgcaaatacctagtga

SEQ ID NO: 212187 - DNA, 20 bp, Artificial
  CRISPR gRNA sequence
ccaagctacatgcctgaaat

SEQ ID NO: 212188 - DNA, 20 bp, Artificial
  CRISPR gRNA sequence
cacatttaagccagggagac

SEQ ID NO: 212189 - DNA, 20 bp, Artificial
  CRISPR gRNA sequence
gtcacatctttgagatagtc

SEQ ID NO: 212190 - DNA, 20 bp, Artificial
  CRISPR gRNA sequence
ctgcttagatgtatattttt

SEQ ID NO: 212191 - DNA, 20 bp, Artificial
  CRISPR gRNA sequence
atggtctgtacttggctaca

SEQ ID NO: 212192 - DNA, 20 bp, Artificial
  CRISPR gRNA sequence
tggtttttccagctctgcat

SEQ ID NO: 212193 - DNA, 20 bp, Artificial
  CRISPR gRNA sequence
atttgctcactctgaggaga

SEQ ID NO: 212194 - DNA, 20 bp, Artificial
  CRISPR gRNA sequence
ctgtatcttgaaagatgtct

SEQ ID NO: 212195 - DNA, 20 bp, Artificial
  CRISPR gRNA sequence
ttaacttaggaacttttaag

SEQ ID NO: 212196 - DNA, 20 bp, Artificial
  CRISPR gRNA sequence
gcaaacagctcagagattgc

SEQ ID NO: 212197 - DNA, 20 bp, Artificial
  CRISPR gRNA sequence
ccaaggcttaactgatagta

SEQ ID NO: 212198 - DNA, 20 bp, Artificial
  CRISPR gRNA sequence
ttaagttcctggctgatttt

SEQ ID NO: 212199 - DNA, 20 bp, Artificial
  CRISPR gRNA sequence
acctagtcctccagttcctg

SEQ ID NO: 212200 - DNA, 20 bp, Artificial
  CRISPR gRNA sequence
tctgcaaaacaatcttcatg

SEQ ID NO: 212201 - DNA, 20 bp, Artificial
  CRISPR gRNA sequence
attaaatcattagaaacatc

SEQ ID NO: 212202 - DNA, 20 bp, Artificial
  CRISPR gRNA sequence
gagaatgaaagtgtgttatc

SEQ ID NO: 212203 - DNA, 20 bp, Artificial
  CRISPR gRNA sequence
tgtgttcttcttgcataact

SEQ ID NO: 212204 - DNA, 20 bp, Artificial
  CRISPR gRNA sequence
agcatcttctctatggcttg

SEQ ID NO: 212205 - DNA, 20 bp, Artificial
  CRISPR gRNA sequence
tgtcatacccctttctaagt

SEQ ID NO: 212206 - DNA, 20 bp, Artificial
  CRISPR gRNA sequence
ttgcactctcaatgtcatga

SEQ ID NO: 212207 - DNA, 20 bp, Artificial
  CRISPR gRNA sequence
agaattcctttaatgttttt

SEQ ID NO: 212208 - DNA, 20 bp, Artificial
  CRISPR gRNA sequence
tatcagtaagtccaccttcg

SEQ ID NO: 212209 - DNA, 20 bp, Artificial
  CRISPR gRNA sequence
agttcttctggcttcatctc

SEQ ID NO: 212210 - DNA, 20 bp, Artificial
  CRISPR gRNA sequence
tatccattataaaatgtcac

SEQ ID NO: 212211 - DNA, 20 bp, Artificial
  CRISPR gRNA sequence
tgaaatttggactgtttatg

SEQ ID NO: 212212 - DNA, 20 bp, Artificial
  CRISPR gRNA sequence
tttgattaaaccatggtaac

SEQ ID NO: 212213 - DNA, 20 bp, Artificial
  CRISPR gRNA sequence
atggtaactggaattcatat

SEQ ID NO: 212214 - DNA, 20 bp, Artificial
  CRISPR gRNA sequence
tggttacggctcagatgtct

SEQ ID NO: 212215 - DNA, 20 bp, Artificial
  CRISPR gRNA sequence
cttgagatcctaccaagtcc

SEQ ID NO: 212216 - DNA, 20 bp, Artificial
  CRISPR gRNA sequence
atacaataaatattatcaca

SEQ ID NO: 212217 - DNA, 20 bp, Artificial
  CRISPR gRNA sequence
actttgttattaagtttact

SEQ ID NO: 212218 - DNA, 20 bp, Artificial
  CRISPR gRNA sequence
ttttttttttttttttgaga

SEQ ID NO: 212219 - DNA, 20 bp, Artificial
  CRISPR gRNA sequence
tctcgctctgttgcccaggc

SEQ ID NO: 212220 - DNA, 20 bp, Artificial
  CRISPR gRNA sequence
gattcttctgtctcagcctc

SEQ ID NO: 212221 - DNA, 20 bp, Artificial
  CRISPR gRNA sequence
actggcgtgcaccaccatgc

SEQ ID NO: 212222 - DNA, 20 bp, Artificial
  CRISPR gRNA sequence
ttttgtatttttagtagtga

SEQ ID NO: 212223 - DNA, 20 bp, Artificial
  CRISPR gRNA sequence
accatgcatggccccttaca

SEQ ID NO: 212224 - DNA, 20 bp, Artificial
  CRISPR gRNA sequence
tgtgctgattttattgtagg

SEQ ID NO: 212225 - DNA, 20 bp, Artificial
  CRISPR gRNA sequence
aattgtttcattagagcaag

SEQ ID NO: 212226 - DNA, 20 bp, Artificial
  CRISPR gRNA sequence
atattctaaaattactttcc

SEQ ID NO: 212227 - DNA, 20 bp, Artificial
  CRISPR gRNA sequence
tttgggcaggcattaaattc

SEQ ID NO: 212228 - DNA, 20 bp, Artificial
  CRISPR gRNA sequence
aggcattaaattcttgggtt

SEQ ID NO: 212229 - DNA, 20 bp, Artificial
  CRISPR gRNA sequence
ttcttgggttttgggttttg

SEQ ID NO: 212230 - DNA, 20 bp, Artificial
  CRISPR gRNA sequence
tgcagtctgtgtgagcctat

SEQ ID NO: 212231 - DNA, 20 bp, Artificial
  CRISPR gRNA sequence
ggtgtgtcaaatccagtctt

SEQ ID NO: 212232 - DNA, 20 bp, Artificial
  CRISPR gRNA sequence
catgtcattgcttcatctgc

SEQ ID NO: 212233 - DNA, 20 bp, Artificial
  CRISPR gRNA sequence
ttgaaagattaaatgcataa

SEQ ID NO: 212234 - DNA, 20 bp, Artificial
  CRISPR gRNA sequence
aatgcataaaggaattttct

SEQ ID NO: 212235 - DNA, 20 bp, Artificial
  CRISPR gRNA sequence
ataaaggaattttcttagag

SEQ ID NO: 212236 - DNA, 20 bp, Artificial
  CRISPR gRNA sequence
ttaactgggaaagaagtttt

SEQ ID NO: 212237 - DNA, 20 bp, Artificial
  CRISPR gRNA sequence
aaacacacacactcacccat

SEQ ID NO: 212238 - DNA, 20 bp, Artificial
  CRISPR gRNA sequence
tcgtgttcactgtcagcatt

SEQ ID NO: 212239 - DNA, 20 bp, Artificial
  CRISPR gRNA sequence
gaatagtgatagtcatatag

SEQ ID NO: 212240 - DNA, 20 bp, Artificial
  CRISPR gRNA sequence
agtaaatatttgtagaacag

SEQ ID NO: 212241 - DNA, 20 bp, Artificial
  CRISPR gRNA sequence
gaacatataaaagaaaattt

SEQ ID NO: 212242 - DNA, 20 bp, Artificial
  CRISPR gRNA sequence
tgatttcagtagttgtagct

SEQ ID NO: 212243 - DNA, 20 bp, Artificial
  CRISPR gRNA sequence
agcctgctgttaacaacaca

SEQ ID NO: 212244 - DNA, 20 bp, Artificial
  CRISPR gRNA sequence
ttttatcttaatgctaagtg

SEQ ID NO: 212245 - DNA, 20 bp, Artificial
  CRISPR gRNA sequence
aatgctaagtggagaattac

SEQ ID NO: 212246 - DNA, 20 bp, Artificial
  CRISPR gRNA sequence
ttttgatacattcaataaat

SEQ ID NO: 212247 - DNA, 20 bp, Artificial
  CRISPR gRNA sequence
ataagagatccttgaggtta

SEQ ID NO: 212248 - DNA, 20 bp, Artificial
  CRISPR gRNA sequence
gtagaccccacagagacagg

SEQ ID NO: 212249 - DNA, 20 bp, Artificial
  CRISPR gRNA sequence
caggtggagtgtccgttatc

SEQ ID NO: 212250 - DNA, 20 bp, Artificial
  CRISPR gRNA sequence
tgcctgggaccagaagtgtt

SEQ ID NO: 212251 - DNA, 20 bp, Artificial
  CRISPR gRNA sequence
atttcagattttttcacact

SEQ ID NO: 212252 - DNA, 20 bp, Artificial
  CRISPR gRNA sequence
acagctcttctaagccttaa

SEQ ID NO: 212253 - DNA, 20 bp, Artificial
  CRISPR gRNA sequence
aaactcttatttttgttaag

SEQ ID NO: 212254 - DNA, 20 bp, Artificial
  CRISPR gRNA sequence
actttgggaggccgtggcag

SEQ ID NO: 212255 - DNA, 20 bp, Artificial
  CRISPR gRNA sequence
tctactaaaaaaaaaaaaaa

SEQ ID NO: 212256 - DNA, 20 bp, Artificial
  CRISPR gRNA sequence
tactcgggaggctgaggcag

SEQ ID NO: 212257 - DNA, 20 bp, Artificial
  CRISPR gRNA sequence
gaatcattgaacctgggagg

SEQ ID NO: 212258 - DNA, 20 bp, Artificial
  CRISPR gRNA sequence
ttgtgccactgcactccagc

SEQ ID NO: 212259 - DNA, 20 bp, Artificial
  CRISPR gRNA sequence
ctgcactccagcctgggtaa

SEQ ID NO: 212260 - DNA, 20 bp, Artificial
  CRISPR gRNA sequence
atgcattgacttaaacctgg

SEQ ID NO: 212261 - DNA, 20 bp, Artificial
  CRISPR gRNA sequence
taaacctggaagagtttctt

SEQ ID NO: 212262 - DNA, 20 bp, Artificial
  CRISPR gRNA sequence
tatttagataacaatatata

SEQ ID NO: 212263 - DNA, 20 bp, Artificial
  CRISPR gRNA sequence
ataagaaggcaaggctatga

SEQ ID NO: 212264 - DNA, 20 bp, Artificial
  CRISPR gRNA sequence
tccagggctgggcggaagta

SEQ ID NO: 212265 - DNA, 20 bp, Artificial
  CRISPR gRNA sequence
aaaacttggggaacttgcca

SEQ ID NO: 212266 - DNA, 20 bp, Artificial
  CRISPR gRNA sequence
taggatgttttctgattaat

SEQ ID NO: 212267 - DNA, 20 bp, Artificial
  CRISPR gRNA sequence
gtttctcttctctgattaat

SEQ ID NO: 212268 - DNA, 20 bp, Artificial
  CRISPR gRNA sequence
taaaattgaggttataaatt

SEQ ID NO: 212269 - DNA, 20 bp, Artificial
  CRISPR gRNA sequence
gtcatggagactatctctat

SEQ ID NO: 212270 - DNA, 20 bp, Artificial
  CRISPR gRNA sequence
cagaaacaataacatgtatg

SEQ ID NO: 212271 - DNA, 20 bp, Artificial
  CRISPR gRNA sequence
aacatgtatgatgaatccca

SEQ ID NO: 212272 - DNA, 20 bp, Artificial
  CRISPR gRNA sequence
tttaagctttttttcttcat

SEQ ID NO: 212273 - DNA, 20 bp, Artificial
  CRISPR gRNA sequence
tttcttcatcaggatttcac

SEQ ID NO: 212274 - DNA, 20 bp, Artificial
  CRISPR gRNA sequence
atcagtgttgtgttgtcact

SEQ ID NO: 212275 - DNA, 20 bp, Artificial
  CRISPR gRNA sequence
gcatctagtatgtagaggcc

SEQ ID NO: 212276 - DNA, 20 bp, Artificial
  CRISPR gRNA sequence
gaggtgacttgatgatatta

SEQ ID NO: 212277 - DNA, 20 bp, Artificial
  CRISPR gRNA sequence
taaaatggcttcacttgtga

SEQ ID NO: 212278 - DNA, 20 bp, Artificial
  CRISPR gRNA sequence
ttaaatatagatccggtggt

SEQ ID NO: 212279 - DNA, 20 bp, Artificial
  CRISPR gRNA sequence
ggcaggaacgcaggaggtag

SEQ ID NO: 212280 - DNA, 20 bp, Artificial
  CRISPR gRNA sequence
ttggaacagatgaccacaaa

SEQ ID NO: 212281 - DNA, 20 bp, Artificial
  CRISPR gRNA sequence
tccctctcaaggctgtatgg

SEQ ID NO: 212282 - DNA, 20 bp, Artificial
  CRISPR gRNA sequence
ttcttggctcttctagcttc

SEQ ID NO: 212283 - DNA, 20 bp, Artificial
  CRISPR gRNA sequence
ctagcttctggaatttgctg

SEQ ID NO: 212284 - DNA, 20 bp, Artificial
  CRISPR gRNA sequence
cttatgagcacatttgtcat

SEQ ID NO: 212285 - DNA, 20 bp, Artificial
  CRISPR gRNA sequence
tagagcccactcatataatc

SEQ ID NO: 212286 - DNA, 20 bp, Artificial
  CRISPR gRNA sequence
aggtaatattcacaggtttt

SEQ ID NO: 212287 - DNA, 20 bp, Artificial
  CRISPR gRNA sequence
cattggccaagacatgaaag

SEQ ID NO: 212288 - DNA, 20 bp, Artificial
  CRISPR gRNA sequence
ggccaagacatgaaagtaga

SEQ ID NO: 212289 - DNA, 20 bp, Artificial
  CRISPR gRNA sequence
gaaattggcagttgcatttg

SEQ ID NO: 212290 - DNA, 20 bp, Artificial
  CRISPR gRNA sequence
ggcagttgcatttggaggat

SEQ ID NO: 212291 - DNA, 20 bp, Artificial
  CRISPR gRNA sequence
tgcatttggaggatgggaat

SEQ ID NO: 212292 - DNA, 20 bp, Artificial
  CRISPR gRNA sequence
tgggaatgtgagtgggaaat

SEQ ID NO: 212293 - DNA, 20 bp, Artificial
  CRISPR gRNA sequence
gcacaccatcgtttgtggag

SEQ ID NO: 212294 - DNA, 20 bp, Artificial
  CRISPR gRNA sequence
aagacagcaggaagaaggag

SEQ ID NO: 212295 - DNA, 20 bp, Artificial
  CRISPR gRNA sequence
tgatttgactttggggcata

SEQ ID NO: 212296 - DNA, 20 bp, Artificial
  CRISPR gRNA sequence
gatgaagggaacagtaaaag

SEQ ID NO: 212297 - DNA, 20 bp, Artificial
  CRISPR gRNA sequence
atgaatacacagtttctcac

SEQ ID NO: 212298 - DNA, 20 bp, Artificial
  CRISPR gRNA sequence
attttcacagttgtcaagca

SEQ ID NO: 212299 - DNA, 20 bp, Artificial
  CRISPR gRNA sequence
atgtttttatttattgacag

SEQ ID NO: 212300 - DNA, 20 bp, Artificial
  CRISPR gRNA sequence
tgacaggtgaatattcatta

SEQ ID NO: 212301 - DNA, 20 bp, Artificial
  CRISPR gRNA sequence
ggtttaattgtgacttctac

SEQ ID NO: 212302 - DNA, 20 bp, Artificial
  CRISPR gRNA sequence
ctactatgtgtttagtacag

SEQ ID NO: 212303 - DNA, 20 bp, Artificial
  CRISPR gRNA sequence
taaattttttacaactcaat

SEQ ID NO: 212304 - DNA, 20 bp, Artificial
  CRISPR gRNA sequence
tcagttttttgaagttataa

SEQ ID NO: 212305 - DNA, 20 bp, Artificial
  CRISPR gRNA sequence
agaagactggttctataaaa

SEQ ID NO: 212306 - DNA, 20 bp, Artificial
  CRISPR gRNA sequence
tggttctataaaatggaatt

SEQ ID NO: 212307 - DNA, 20 bp, Artificial
  CRISPR gRNA sequence
atatttagttattactatta

SEQ ID NO: 212308 - DNA, 20 bp, Artificial
  CRISPR gRNA sequence
agcagcattgttctaagatt

SEQ ID NO: 212309 - DNA, 20 bp, Artificial
  CRISPR gRNA sequence
actgtgaaaattaaaggctg

SEQ ID NO: 212310 - DNA, 20 bp, Artificial
  CRISPR gRNA sequence
aattaaaggctgccgaatgt

SEQ ID NO: 212311 - DNA, 20 bp, Artificial
  CRISPR gRNA sequence
ggagctgactacttgtgtgg

SEQ ID NO: 212312 - DNA, 20 bp, Artificial
  CRISPR gRNA sequence
tgtgtggaagggttagatca

SEQ ID NO: 212313 - DNA, 20 bp, Artificial
  CRISPR gRNA sequence
taccgtcaaacaatgaactc

SEQ ID NO: 212314 - DNA, 20 bp, Artificial
  CRISPR gRNA sequence
ccttttccttcctccagcga

SEQ ID NO: 212315 - DNA, 20 bp, Artificial
  CRISPR gRNA sequence
atatcctcgctgtggttgga

SEQ ID NO: 212316 - DNA, 20 bp, Artificial
  CRISPR gRNA sequence
ttggactgagtctctgtatt

SEQ ID NO: 212317 - DNA, 20 bp, Artificial
  CRISPR gRNA sequence
tgagtctctgtattgcgggt

SEQ ID NO: 212318 - DNA, 20 bp, Artificial
  CRISPR gRNA sequence
catctttctgtagacctaat

SEQ ID NO: 212319 - DNA, 20 bp, Artificial
  CRISPR gRNA sequence
gtttttggttcatggcaaaa

SEQ ID NO: 212320 - DNA, 20 bp, Artificial
  CRISPR gRNA sequence
tgagtggaaagtacattcac

SEQ ID NO: 212321 - DNA, 20 bp, Artificial
  CRISPR gRNA sequence
ttccatttgggcaaatacca

SEQ ID NO: 212322 - DNA, 20 bp, Artificial
  CRISPR gRNA sequence
agtgcaattacgggactgta

SEQ ID NO: 212323 - DNA, 20 bp, Artificial
  CRISPR gRNA sequence
tattatcaccaccaataaat

SEQ ID NO: 212324 - DNA, 20 bp, Artificial
  CRISPR gRNA sequence
gctttgttcttctaataatt

SEQ ID NO: 212325 - DNA, 20 bp, Artificial
  CRISPR gRNA sequence
ggttaagttaataaacatat

SEQ ID NO: 212326 - DNA, 20 bp, Artificial
  CRISPR gRNA sequence
aatttttgttttttgatcgt

SEQ ID NO: 212327 - DNA, 20 bp, Artificial
  CRISPR gRNA sequence
agaataactctcttaaaact

SEQ ID NO: 212328 - DNA, 20 bp, Artificial
  CRISPR gRNA sequence
tttcatatgcttttctaata

SEQ ID NO: 212329 - DNA, 20 bp, Artificial
  CRISPR gRNA sequence
gccctcttctgatttcaggt

SEQ ID NO: 212330 - DNA, 20 bp, Artificial
  CRISPR gRNA sequence
gactagtttatatgaaattt

SEQ ID NO: 212331 - DNA, 20 bp, Artificial
  CRISPR gRNA sequence
caaaaatgagaaaatacaat

SEQ ID NO: 212332 - DNA, 20 bp, Artificial
  CRISPR gRNA sequence
aaatacaattggagtgattc

SEQ ID NO: 212333 - DNA, 20 bp, Artificial
  CRISPR gRNA sequence
gtgattcgaggataattaaa

SEQ ID NO: 212334 - DNA, 20 bp, Artificial
  CRISPR gRNA sequence
taaagagggtagaagacata

SEQ ID NO: 212335 - DNA, 20 bp, Artificial
  CRISPR gRNA sequence
cagaagtcagaaaatacaat

SEQ ID NO: 212336 - DNA, 20 bp, Artificial
  CRISPR gRNA sequence
aaatacaattggaatgattt

SEQ ID NO: 212337 - DNA, 20 bp, Artificial
  CRISPR gRNA sequence
atgatttgagggtaattaaa

SEQ ID NO: 212338 - DNA, 20 bp, Artificial
  CRISPR gRNA sequence
taaagagggtagaagacata

SEQ ID NO: 212339 - DNA, 20 bp, Artificial
  CRISPR gRNA sequence
aggaaaatggctttatctat

SEQ ID NO: 212340 - DNA, 20 bp, Artificial
  CRISPR gRNA sequence
gtaaaaggggagagatcttt

SEQ ID NO: 212341 - DNA, 20 bp, Artificial
  CRISPR gRNA sequence
tgaggatccattttaagtaa

SEQ ID NO: 212342 - DNA, 20 bp, Artificial
  CRISPR gRNA sequence
atccattttaagtaatagaa

SEQ ID NO: 212343 - DNA, 20 bp, Artificial
  CRISPR gRNA sequence
cagacatagacaccccagac

SEQ ID NO: 212344 - DNA, 20 bp, Artificial
  CRISPR gRNA sequence
aaaccaatataatgaaaaca

SEQ ID NO: 212345 - DNA, 20 bp, Artificial
  CRISPR gRNA sequence
aaatcaattattagtaagta

SEQ ID NO: 212346 - DNA, 20 bp, Artificial
  CRISPR gRNA sequence
aatcaaaagttataaattaa

SEQ ID NO: 212347 - DNA, 20 bp, Artificial
  CRISPR gRNA sequence
tctaaaacttaatacgaaac

SEQ ID NO: 212348 - DNA, 20 bp, Artificial
  CRISPR gRNA sequence
tggttcttgatgattgttaa

SEQ ID NO: 212349 - DNA, 20 bp, Artificial
  CRISPR gRNA sequence
aatctgcgtatccttagcat

SEQ ID NO: 212350 - DNA, 20 bp, Artificial
  CRISPR gRNA sequence
tacaatggagacatctaaag

SEQ ID NO: 212351 - DNA, 20 bp, Artificial
  CRISPR gRNA sequence
tggagacatctaaagcagaa

SEQ ID NO: 212352 - DNA, 20 bp, Artificial
  CRISPR gRNA sequence
tggtagctacagtgaacatc

SEQ ID NO: 212353 - DNA, 20 bp, Artificial
  CRISPR gRNA sequence
gttgctccccacaaatgcct

SEQ ID NO: 212354 - DNA, 20 bp, Artificial
  CRISPR gRNA sequence
tcttattttttcctcactat

SEQ ID NO: 212355 - DNA, 20 bp, Artificial
  CRISPR gRNA sequence
catgccttccatatctagca

SEQ ID NO: 212356 - DNA, 20 bp, Artificial
  CRISPR gRNA sequence
taaatcaacttgtctgatgc

SEQ ID NO: 212357 - DNA, 20 bp, Artificial
  CRISPR gRNA sequence
tataatctgactgtgtaaat

SEQ ID NO: 212358 - DNA, 20 bp, Artificial
  CRISPR gRNA sequence
agccttaatttgctatttta

SEQ ID NO: 212359 - DNA, 20 bp, Artificial
  CRISPR gRNA sequence
gagaacgtttatataattat

SEQ ID NO: 212360 - DNA, 20 bp, Artificial
  CRISPR gRNA sequence
ccacaacatcccagatattt

SEQ ID NO: 212361 - DNA, 20 bp, Artificial
  CRISPR gRNA sequence
attttagaatgatgcagatg

SEQ ID NO: 212362 - DNA, 20 bp, Artificial
  CRISPR gRNA sequence
gcagatgcagaatatatacg

SEQ ID NO: 212363 - DNA, 20 bp, Artificial
  CRISPR gRNA sequence
ctggaaatgtatttatggca

SEQ ID NO: 212364 - DNA, 20 bp, Artificial
  CRISPR gRNA sequence
gcattgcaagtatgctcata

SEQ ID NO: 212365 - DNA, 20 bp, Artificial
  CRISPR gRNA sequence
cgtaataattcttttgtcac

SEQ ID NO: 212366 - DNA, 20 bp, Artificial
  CRISPR gRNA sequence
tgggttatatccatattgga

SEQ ID NO: 212367 - DNA, 20 bp, Artificial
  CRISPR gRNA sequence
tttggttttataatatttag

SEQ ID NO: 212368 - DNA, 20 bp, Artificial
  CRISPR gRNA sequence
cttcataaatcttttttttt

SEQ ID NO: 212369 - DNA, 20 bp, Artificial
  CRISPR gRNA sequence
ccagccaactgtgacatccc

SEQ ID NO: 212370 - DNA, 20 bp, Artificial
  CRISPR gRNA sequence
ctacattattagggaagaaa

SEQ ID NO: 212371 - DNA, 20 bp, Artificial
  CRISPR gRNA sequence
ttttgttttgtttttagaga

SEQ ID NO: 212372 - DNA, 20 bp, Artificial
  CRISPR gRNA sequence
aaaagaggttggcttcttgt

SEQ ID NO: 212373 - DNA, 20 bp, Artificial
  CRISPR gRNA sequence
gatacataactgggcctcac

SEQ ID NO: 212374 - DNA, 20 bp, Artificial
  CRISPR gRNA sequence
ggtgggacagtatgtagtct

SEQ ID NO: 212375 - DNA, 20 bp, Artificial
  CRISPR gRNA sequence
gtatgtagtctaggaattgg

SEQ ID NO: 212376 - DNA, 20 bp, Artificial
  CRISPR gRNA sequence
cgtgttgccctctcagcagc

SEQ ID NO: 212377 - DNA, 20 bp, Artificial
  CRISPR gRNA sequence
gcccctgtcagttatagttc

SEQ ID NO: 212378 - DNA, 20 bp, Artificial
  CRISPR gRNA sequence
cccttcccatcaccaacttt

SEQ ID NO: 212379 - DNA, 20 bp, Artificial
  CRISPR gRNA sequence
ggtttttttctgtttcttct

SEQ ID NO: 212380 - DNA, 20 bp, Artificial
  CRISPR gRNA sequence
ggctcacagattggctttcc

SEQ ID NO: 212381 - DNA, 20 bp, Artificial
  CRISPR gRNA sequence
tgccagctttggaagcttga

SEQ ID NO: 212382 - DNA, 20 bp, Artificial
  CRISPR gRNA sequence
ctttggaagcttgacagaat

SEQ ID NO: 212383 - DNA, 20 bp, Artificial
  CRISPR gRNA sequence
tcatccagcccaggtcccag

SEQ ID NO: 212384 - DNA, 20 bp, Artificial
  CRISPR gRNA sequence
gaatgggcctctctgttcag

SEQ ID NO: 212385 - DNA, 20 bp, Artificial
  CRISPR gRNA sequence
tcagtaggatccccctcctg

SEQ ID NO: 212386 - DNA, 20 bp, Artificial
  CRISPR gRNA sequence
gttcaacgcttttccatctg

SEQ ID NO: 212387 - DNA, 20 bp, Artificial
  CRISPR gRNA sequence
ttctgtatttatttgttttt

SEQ ID NO: 212388 - DNA, 20 bp, Artificial
  CRISPR gRNA sequence
ggtttttttattttttgaga

SEQ ID NO: 212389 - DNA, 20 bp, Artificial
  CRISPR gRNA sequence
tctcgctctgtcgcccaggc

SEQ ID NO: 212390 - DNA, 20 bp, Artificial
  CRISPR gRNA sequence
ttttgtatttttggtagaga

SEQ ID NO: 212391 - DNA, 20 bp, Artificial
  CRISPR gRNA sequence
tcatgttgcccaggctggtc

SEQ ID NO: 212392 - DNA, 20 bp, Artificial
  CRISPR gRNA sequence
gccttggcctcccaaagtgc

SEQ ID NO: 212393 - DNA, 20 bp, Artificial
  CRISPR gRNA sequence
tctcttcttccctccccaac

SEQ ID NO: 212394 - DNA, 20 bp, Artificial
  CRISPR gRNA sequence
gtattccttcaacttcatta

SEQ ID NO: 212395 - DNA, 20 bp, Artificial
  CRISPR gRNA sequence
agctaagaagaaatagatag

SEQ ID NO: 212396 - DNA, 20 bp, Artificial
  CRISPR gRNA sequence
agaggaatactcagagctat

SEQ ID NO: 212397 - DNA, 20 bp, Artificial
  CRISPR gRNA sequence
tttgaaactggaaagaccca

SEQ ID NO: 212398 - DNA, 20 bp, Artificial
  CRISPR gRNA sequence
gagcagtgagctaagggaga

SEQ ID NO: 212399 - DNA, 20 bp, Artificial
  CRISPR gRNA sequence
tggcacattctgtctacact

SEQ ID NO: 212400 - DNA, 20 bp, Artificial
  CRISPR gRNA sequence
ctctgggtagatagaggagg

SEQ ID NO: 212401 - DNA, 20 bp, Artificial
  CRISPR gRNA sequence
gaggatggagcacccatggt

SEQ ID NO: 212402 - DNA, 20 bp, Artificial
  CRISPR gRNA sequence
aagatggcataaacaaatga

SEQ ID NO: 212403 - DNA, 20 bp, Artificial
  CRISPR gRNA sequence
gtgtttactatttgatgtag

SEQ ID NO: 212404 - DNA, 20 bp, Artificial
  CRISPR gRNA sequence
tcaaatcagtgtatataatc

SEQ ID NO: 212405 - DNA, 20 bp, Artificial
  CRISPR gRNA sequence
atcaagaatattcagcatgt

SEQ ID NO: 212406 - DNA, 20 bp, Artificial
  CRISPR gRNA sequence
cagaagactatacaacctcc

SEQ ID NO: 212407 - DNA, 20 bp, Artificial
  CRISPR gRNA sequence
ggtaagttaaagtttattaa

SEQ ID NO: 212408 - DNA, 20 bp, Artificial
  CRISPR gRNA sequence
taaagtttattaaatgaatt

SEQ ID NO: 212409 - DNA, 20 bp, Artificial
  CRISPR gRNA sequence
gaattgtgaatgatcatttg

SEQ ID NO: 212410 - DNA, 20 bp, Artificial
  CRISPR gRNA sequence
tttgtctcacgtcaaattaa

SEQ ID NO: 212411 - DNA, 20 bp, Artificial
  CRISPR gRNA sequence
agtcattgcatgacctttgc

SEQ ID NO: 212412 - DNA, 20 bp, Artificial
  CRISPR gRNA sequence
attgcatgacctttgcatga

SEQ ID NO: 212413 - DNA, 20 bp, Artificial
  CRISPR gRNA sequence
tttggtcattttagtgtcaa

SEQ ID NO: 212414 - DNA, 20 bp, Artificial
  CRISPR gRNA sequence
tcattttagtgtcaatggga

SEQ ID NO: 212415 - DNA, 20 bp, Artificial
  CRISPR gRNA sequence
cacacccaaaactggaaagt

SEQ ID NO: 212416 - DNA, 20 bp, Artificial
  CRISPR gRNA sequence
ccaatatatcacctcacctg

SEQ ID NO: 212417 - DNA, 20 bp, Artificial
  CRISPR gRNA sequence
cacctcacctgttggattca

SEQ ID NO: 212418 - DNA, 20 bp, Artificial
  CRISPR gRNA sequence
attcattggatgtgcataca

SEQ ID NO: 212419 - DNA, 20 bp, Artificial
  CRISPR gRNA sequence
tattgctgaaaacatctgtt

SEQ ID NO: 212420 - DNA, 20 bp, Artificial
  CRISPR gRNA sequence
atctgaggaaattgcaagaa

SEQ ID NO: 212421 - DNA, 20 bp, Artificial
  CRISPR gRNA sequence
ttgtggacataagctctgga

SEQ ID NO: 212422 - DNA, 20 bp, Artificial
  CRISPR gRNA sequence
ttgtacttagcttcctataa

SEQ ID NO: 212423 - DNA, 20 bp, Artificial
  CRISPR gRNA sequence
ggagtgatgatagatgtatc

SEQ ID NO: 212424 - DNA, 20 bp, Artificial
  CRISPR gRNA sequence
gatgtatctggaatgccaaa

SEQ ID NO: 212425 - DNA, 20 bp, Artificial
  CRISPR gRNA sequence
gtgcctaaagggcaggtggg

SEQ ID NO: 212426 - DNA, 20 bp, Artificial
  CRISPR gRNA sequence
cgggtatgtgtgtctaccac

SEQ ID NO: 212427 - DNA, 20 bp, Artificial
  CRISPR gRNA sequence
ccagcaacttaactggacct

SEQ ID NO: 212428 - DNA, 20 bp, Artificial
  CRISPR gRNA sequence
cacattttctttcccagtta

SEQ ID NO: 212429 - DNA, 20 bp, Artificial
  CRISPR gRNA sequence
actttcatatttttagaagt

SEQ ID NO: 212430 - DNA, 20 bp, Artificial
  CRISPR gRNA sequence
aagttagaatttcttgagct

SEQ ID NO: 212431 - DNA, 20 bp, Artificial
  CRISPR gRNA sequence
gtttagaaaaataatattaa

SEQ ID NO: 212432 - DNA, 20 bp, Artificial
  CRISPR gRNA sequence
ttttcttttttttttgactg

SEQ ID NO: 212433 - DNA, 20 bp, Artificial
  CRISPR gRNA sequence
gatctggcccgcaaaacagt

SEQ ID NO: 212434 - DNA, 20 bp, Artificial
  CRISPR gRNA sequence
tgccctgtctatgccttagg

SEQ ID NO: 212435 - DNA, 20 bp, Artificial
  CRISPR gRNA sequence
tctactcttgattattcatc

SEQ ID NO: 212436 - DNA, 20 bp, Artificial
  CRISPR gRNA sequence
tattcatcaagaattatggg

SEQ ID NO: 212437 - DNA, 20 bp, Artificial
  CRISPR gRNA sequence
tactcgggaggctgaggcag

SEQ ID NO: 212438 - DNA, 20 bp, Artificial
  CRISPR gRNA sequence
cccggaaggcagatgttgca

SEQ ID NO: 212439 - DNA, 20 bp, Artificial
  CRISPR gRNA sequence
accgcactccagcctggtga

SEQ ID NO: 212440 - DNA, 20 bp, Artificial
  CRISPR gRNA sequence
ctgtctcaaaaaaaataaaa

SEQ ID NO: 212441 - DNA, 20 bp, Artificial
  CRISPR gRNA sequence
aaaaaaaataaaaaagaatt

SEQ ID NO: 212442 - DNA, 20 bp, Artificial
  CRISPR gRNA sequence
accaagtgatatttgggcaa

SEQ ID NO: 212443 - DNA, 20 bp, Artificial
  CRISPR gRNA sequence
catggcaccccctagtagag

SEQ ID NO: 212444 - DNA, 20 bp, Artificial
  CRISPR gRNA sequence
caactaagtctgtttccttt

SEQ ID NO: 212445 - DNA, 20 bp, Artificial
  CRISPR gRNA sequence
ctgtttcctttgtgaatgct

SEQ ID NO: 212446 - DNA, 20 bp, Artificial
  CRISPR gRNA sequence
ctttacaattaatttggctg

SEQ ID NO: 212447 - DNA, 20 bp, Artificial
  CRISPR gRNA sequence
gttactaatcctagcattca

SEQ ID NO: 212448 - DNA, 20 bp, Artificial
  CRISPR gRNA sequence
ctagcattcaaagaatcaaa

SEQ ID NO: 212449 - DNA, 20 bp, Artificial
  CRISPR gRNA sequence
tcaaagaatcaaaaggaatg

SEQ ID NO: 212450 - DNA, 20 bp, Artificial
  CRISPR gRNA sequence
aactactactgtaaaaactg

SEQ ID NO: 212451 - DNA, 20 bp, Artificial
  CRISPR gRNA sequence
tgtaaaaactgtagggtgtc

SEQ ID NO: 212452 - DNA, 20 bp, Artificial
  CRISPR gRNA sequence
acaaatctttatcattttga

SEQ ID NO: 212453 - DNA, 20 bp, Artificial
  CRISPR gRNA sequence
ctaataacttctaatcttta

SEQ ID NO: 212454 - DNA, 20 bp, Artificial
  CRISPR gRNA sequence
agatacataggtttgagata

SEQ ID NO: 212455 - DNA, 20 bp, Artificial
  CRISPR gRNA sequence
actttgggaggccgaggcgg

SEQ ID NO: 212456 - DNA, 20 bp, Artificial
  CRISPR gRNA sequence
tacttgggaggctgaggcag

SEQ ID NO: 212457 - DNA, 20 bp, Artificial
  CRISPR gRNA sequence
tcgtgccactacactccagc

SEQ ID NO: 212458 - DNA, 20 bp, Artificial
  CRISPR gRNA sequence
aaaacaacgtgtattcagca

SEQ ID NO: 212459 - DNA, 20 bp, Artificial
  CRISPR gRNA sequence
gtgtattcagcatggagtca

SEQ ID NO: 212460 - DNA, 20 bp, Artificial
  CRISPR gRNA sequence
taaaaaagactatagttcac

SEQ ID NO: 212461 - DNA, 20 bp, Artificial
  CRISPR gRNA sequence
aacataaaatgactagtacc

SEQ ID NO: 212462 - DNA, 20 bp, Artificial
  CRISPR gRNA sequence
ggcatggcatggtttgttcc

SEQ ID NO: 212463 - DNA, 20 bp, Artificial
  CRISPR gRNA sequence
cattttcaggaaagcaatct

SEQ ID NO: 212464 - DNA, 20 bp, Artificial
  CRISPR gRNA sequence
aggaaagcaatctaagaatc

SEQ ID NO: 212465 - DNA, 20 bp, Artificial
  CRISPR gRNA sequence
tattgtaaaacagttttgcc

SEQ ID NO: 212466 - DNA, 20 bp, Artificial
  CRISPR gRNA sequence
tttgctaatattcagctgat

SEQ ID NO: 212467 - DNA, 20 bp, Artificial
  CRISPR gRNA sequence
gtttttaaaatgtctggctg

SEQ ID NO: 212468 - DNA, 20 bp, Artificial
  CRISPR gRNA sequence
acagtatgtctgccttgtca

SEQ ID NO: 212469 - DNA, 20 bp, Artificial
  CRISPR gRNA sequence
ccttgtcaatgaatgaggtt

SEQ ID NO: 212470 - DNA, 20 bp, Artificial
  CRISPR gRNA sequence
tgaggttcagggtgcttcct

SEQ ID NO: 212471 - DNA, 20 bp, Artificial
  CRISPR gRNA sequence
tcagggtgcttcctagggat

SEQ ID NO: 212472 - DNA, 20 bp, Artificial
  CRISPR gRNA sequence
gtttattttacttacattaa

SEQ ID NO: 212473 - DNA, 20 bp, Artificial
  CRISPR gRNA sequence
atgaatgatggagatccaaa

SEQ ID NO: 212474 - DNA, 20 bp, Artificial
  CRISPR gRNA sequence
gagatccaaagtgaatatta

SEQ ID NO: 212475 - DNA, 20 bp, Artificial
  CRISPR gRNA sequence
aatattatagaatattattc

SEQ ID NO: 212476 - DNA, 20 bp, Artificial
  CRISPR gRNA sequence
tttaatgtgtcaacttttta

SEQ ID NO: 212477 - DNA, 20 bp, Artificial
  CRISPR gRNA sequence
ttaatggatagaaaatagac

SEQ ID NO: 212478 - DNA, 20 bp, Artificial
  CRISPR gRNA sequence
gtgttcatttttcaattttc

SEQ ID NO: 212479 - DNA, 20 bp, Artificial
  CRISPR gRNA sequence
aagtgatggactccgatttg

SEQ ID NO: 212480 - DNA, 20 bp, Artificial
  CRISPR gRNA sequence
ggagagtagtaagacgtgaa

SEQ ID NO: 212481 - DNA, 20 bp, Artificial
  CRISPR gRNA sequence
taatcaattaggggcaatag

SEQ ID NO: 212482 - DNA, 20 bp, Artificial
  CRISPR gRNA sequence
tagtagaatggacaatttcc

SEQ ID NO: 212483 - DNA, 20 bp, Artificial
  CRISPR gRNA sequence
gtaaccagtttaaattggtt

SEQ ID NO: 212484 - DNA, 20 bp, Artificial
  CRISPR gRNA sequence
ctgagaggtgtctgccactt

SEQ ID NO: 212485 - DNA, 20 bp, Artificial
  CRISPR gRNA sequence
gtctgccacttctgggtcaa

SEQ ID NO: 212486 - DNA, 20 bp, Artificial
  CRISPR gRNA sequence
ataataaattaagtacaggc

SEQ ID NO: 212487 - DNA, 20 bp, Artificial
  CRISPR gRNA sequence
agatagtggtcctcattctt

SEQ ID NO: 212488 - DNA, 20 bp, Artificial
  CRISPR gRNA sequence
taacaggtccttcccagatt

SEQ ID NO: 212489 - DNA, 20 bp, Artificial
  CRISPR gRNA sequence
gatttagggtacttttattg

SEQ ID NO: 212490 - DNA, 20 bp, Artificial
  CRISPR gRNA sequence
gcaagattgaaatttgaact

SEQ ID NO: 212491 - DNA, 20 bp, Artificial
  CRISPR gRNA sequence
tcaggccaacaggccagccc

SEQ ID NO: 212492 - DNA, 20 bp, Artificial
  CRISPR gRNA sequence
caacaggccagcccttgaat

SEQ ID NO: 212493 - DNA, 20 bp, Artificial
  CRISPR gRNA sequence
ttctgacagttgtgatcgcc

SEQ ID NO: 212494 - DNA, 20 bp, Artificial
  CRISPR gRNA sequence
cattcgttttttacctgttt

SEQ ID NO: 212495 - DNA, 20 bp, Artificial
  CRISPR gRNA sequence
atcttctgtatggacaaagg

SEQ ID NO: 212496 - DNA, 20 bp, Artificial
  CRISPR gRNA sequence
tttaaatacaaagttcttta

SEQ ID NO: 212497 - DNA, 20 bp, Artificial
  CRISPR gRNA sequence
atacaaagttctttattggg

SEQ ID NO: 212498 - DNA, 20 bp, Artificial
  CRISPR gRNA sequence
gtagtaaactctcatttatt

SEQ ID NO: 212499 - DNA, 20 bp, Artificial
  CRISPR gRNA sequence
catttatttggggttcgctc

SEQ ID NO: 212500 - DNA, 20 bp, Artificial
  CRISPR gRNA sequence
ctcactagttgtcagcttct

SEQ ID NO: 212501 - DNA, 20 bp, Artificial
  CRISPR gRNA sequence
ggataagtgaccacagaagc

SEQ ID NO: 212502 - DNA, 20 bp, Artificial
  CRISPR gRNA sequence
ggtacataagttaaatgatt

SEQ ID NO: 212503 - DNA, 20 bp, Artificial
  CRISPR gRNA sequence
ttagatttatcactttttaa

SEQ ID NO: 212504 - DNA, 20 bp, Artificial
  CRISPR gRNA sequence
ctttttaatagggtgagctt

SEQ ID NO: 212505 - DNA, 20 bp, Artificial
  CRISPR gRNA sequence
tccattctgtttaaatccct

SEQ ID NO: 212506 - DNA, 20 bp, Artificial
  CRISPR gRNA sequence
gtttaaatccctaagaatgt

SEQ ID NO: 212507 - DNA, 20 bp, Artificial
  CRISPR gRNA sequence
attggaaatatttctttttt

SEQ ID NO: 212508 - DNA, 20 bp, Artificial
  CRISPR gRNA sequence
taggtttctcttgtcttaaa

SEQ ID NO: 212509 - DNA, 20 bp, Artificial
  CRISPR gRNA sequence
taaaatgggtattcaaaaat

SEQ ID NO: 212510 - DNA, 20 bp, Artificial
  CRISPR gRNA sequence
tattgtattttatttggttg

SEQ ID NO: 212511 - DNA, 20 bp, Artificial
  CRISPR gRNA sequence
tactaactgccatcacctgc

SEQ ID NO: 212512 - DNA, 20 bp, Artificial
  CRISPR gRNA sequence
ggtcattttcagtgactaat

SEQ ID NO: 212513 - DNA, 20 bp, Artificial
  CRISPR gRNA sequence
taactttgaagagatgagca

SEQ ID NO: 212514 - DNA, 20 bp, Artificial
  CRISPR gRNA sequence
atttacaaaaagccattgtt

SEQ ID NO: 212515 - DNA, 20 bp, Artificial
  CRISPR gRNA sequence
atttatcactgtttaaagct

SEQ ID NO: 212516 - DNA, 20 bp, Artificial
  CRISPR gRNA sequence
atattctaggtaacaatgta

SEQ ID NO: 212517 - DNA, 20 bp, Artificial
  CRISPR gRNA sequence
aatgatttaaaatattaatt

SEQ ID NO: 212518 - DNA, 20 bp, Artificial
  CRISPR gRNA sequence
aaatattaattatgaatttt

SEQ ID NO: 212519 - DNA, 20 bp, Artificial
  CRISPR gRNA sequence
caataagcttttaattagag

SEQ ID NO: 212520 - DNA, 20 bp, Artificial
  CRISPR gRNA sequence
cacatgagaaagcaggagac

SEQ ID NO: 212521 - DNA, 20 bp, Artificial
  CRISPR gRNA sequence
ccaggactagcacccaggtc

SEQ ID NO: 212522 - DNA, 20 bp, Artificial
  CRISPR gRNA sequence
aggtctcctgctttctcatg

SEQ ID NO: 212523 - DNA, 20 bp, Artificial
  CRISPR gRNA sequence
aataattatgaaacacattg

SEQ ID NO: 212524 - DNA, 20 bp, Artificial
  CRISPR gRNA sequence
attaaaactctgctctaatt

SEQ ID NO: 212525 - DNA, 20 bp, Artificial
  CRISPR gRNA sequence
ataaattaaatttttcagaa

SEQ ID NO: 212526 - DNA, 20 bp, Artificial
  CRISPR gRNA sequence
caatagaaatagcccaacaa

SEQ ID NO: 212527 - DNA, 20 bp, Artificial
  CRISPR gRNA sequence
tagcccaacaaaatagctta

SEQ ID NO: 212528 - DNA, 20 bp, Artificial
  CRISPR gRNA sequence
acagggtaatatttacaaag

SEQ ID NO: 212529 - DNA, 20 bp, Artificial
  CRISPR gRNA sequence
taaataaaaaagtaccttgg

SEQ ID NO: 212530 - DNA, 20 bp, Artificial
  CRISPR gRNA sequence
tggcaaagattgcagatatt

SEQ ID NO: 212531 - DNA, 20 bp, Artificial
  CRISPR gRNA sequence
caaagctttaaacagtgata

SEQ ID NO: 212532 - DNA, 20 bp, Artificial
  CRISPR gRNA sequence
tgtgggatctaattctcaac

SEQ ID NO: 212533 - DNA, 20 bp, Artificial
  CRISPR gRNA sequence
tgctccatttaataaaaaca

SEQ ID NO: 212534 - DNA, 20 bp, Artificial
  CRISPR gRNA sequence
cagtcatgataacaacactt

SEQ ID NO: 212535 - DNA, 20 bp, Artificial
  CRISPR gRNA sequence
tttaagatgttgtcttacag

SEQ ID NO: 212536 - DNA, 20 bp, Artificial
  CRISPR gRNA sequence
cttacagaggagcttagtac

SEQ ID NO: 212537 - DNA, 20 bp, Artificial
  CRISPR gRNA sequence
tgctcatctcttcaaagtta

SEQ ID NO: 212538 - DNA, 20 bp, Artificial
  CRISPR gRNA sequence
ttaaaatatgacacaagtaa

SEQ ID NO: 212539 - DNA, 20 bp, Artificial
  CRISPR gRNA sequence
ggttgcccgacaatcatttc

SEQ ID NO: 212540 - DNA, 20 bp, Artificial
  CRISPR gRNA sequence
caacaggtaaattaaggagt

SEQ ID NO: 212541 - DNA, 20 bp, Artificial
  CRISPR gRNA sequence
aagacaagagaaacctagaa

SEQ ID NO: 212542 - DNA, 20 bp, Artificial
  CRISPR gRNA sequence
gagaaacctagaaggttgat

SEQ ID NO: 212543 - DNA, 20 bp, Artificial
  CRISPR gRNA sequence
gagatggaggagtaaactta

SEQ ID NO: 212544 - DNA, 20 bp, Artificial
  CRISPR gRNA sequence
aggagtaaacttatcgtgtt

SEQ ID NO: 212545 - DNA, 20 bp, Artificial
  CRISPR gRNA sequence
tattttaattctgacattct

SEQ ID NO: 212546 - DNA, 20 bp, Artificial
  CRISPR gRNA sequence
ggatttaaacagaatggacc

SEQ ID NO: 212547 - DNA, 20 bp, Artificial
  CRISPR gRNA sequence
ggagaaaaataatcaccttt

SEQ ID NO: 212548 - DNA, 20 bp, Artificial
  CRISPR gRNA sequence
tcaatcatttaacttatgta

SEQ ID NO: 212549 - DNA, 20 bp, Artificial
  CRISPR gRNA sequence
tgaagaggaactgcaaagga

SEQ ID NO: 212550 - DNA, 20 bp, Artificial
  CRISPR gRNA sequence
gaatttgggagccattacaa

SEQ ID NO: 212551 - DNA, 20 bp, Artificial
  CRISPR gRNA sequence
tgatgcccaagcaggaggac

SEQ ID NO: 212552 - DNA, 20 bp, Artificial
  CRISPR gRNA sequence
gacaactagtgagagcaaga

SEQ ID NO: 212553 - DNA, 20 bp, Artificial
  CRISPR gRNA sequence
agagcgaaccccaaataaat

SEQ ID NO: 212554 - DNA, 20 bp, Artificial
  CRISPR gRNA sequence
tacatattaaaaggtacaac

SEQ ID NO: 212555 - DNA, 20 bp, Artificial
  CRISPR gRNA sequence
gtttataaaaaattttacta

SEQ ID NO: 212556 - DNA, 20 bp, Artificial
  CRISPR gRNA sequence
attttcataccttttctaat

SEQ ID NO: 212557 - DNA, 20 bp, Artificial
  CRISPR gRNA sequence
cttggatctttttcaagtcc

SEQ ID NO: 212558 - DNA, 20 bp, Artificial
  CRISPR gRNA sequence
cttttccctcctttcatcaa

SEQ ID NO: 212559 - DNA, 20 bp, Artificial
  CRISPR gRNA sequence
gaaaaagtgctgcaggagcc

SEQ ID NO: 212560 - DNA, 20 bp, Artificial
  CRISPR gRNA sequence
agagctgtcttgctagtatg

SEQ ID NO: 212561 - DNA, 20 bp, Artificial
  CRISPR gRNA sequence
ggcctcagcaggtcataaat

SEQ ID NO: 212562 - DNA, 20 bp, Artificial
  CRISPR gRNA sequence
aaaagcgtggcaaattacct

SEQ ID NO: 212563 - DNA, 20 bp, Artificial
  CRISPR gRNA sequence
gcaaattacctagaagtttt

SEQ ID NO: 212564 - DNA, 20 bp, Artificial
  CRISPR gRNA sequence
caataaagaactttgtattt

SEQ ID NO: 212565 - DNA, 20 bp, Artificial
  CRISPR gRNA sequence
ttctaaccaggataggaaat

SEQ ID NO: 212566 - DNA, 20 bp, Artificial
  CRISPR gRNA sequence
accaggataggaaatgtggg

SEQ ID NO: 212567 - DNA, 20 bp, Artificial
  CRISPR gRNA sequence
gactacaggaggaaggtgat

SEQ ID NO: 212568 - DNA, 20 bp, Artificial
  CRISPR gRNA sequence
actcatagttcaaatttcaa

SEQ ID NO: 212569 - DNA, 20 bp, Artificial
  CRISPR gRNA sequence
gaaaagaagtgaagaaacac

SEQ ID NO: 212570 - DNA, 20 bp, Artificial
  CRISPR gRNA sequence
caagtaacaggaggacaaga

SEQ ID NO: 212571 - DNA, 20 bp, Artificial
  CRISPR gRNA sequence
aatctgggaaggacctgtta

SEQ ID NO: 212572 - DNA, 20 bp, Artificial
  CRISPR gRNA sequence
tgctgtgaacctgagttggc

SEQ ID NO: 212573 - DNA, 20 bp, Artificial
  CRISPR gRNA sequence
gcaaaggtttgatggaagcc

SEQ ID NO: 212574 - DNA, 20 bp, Artificial
  CRISPR gRNA sequence
tccattctactattgcccct

SEQ ID NO: 212575 - DNA, 20 bp, Artificial
  CRISPR gRNA sequence
tattttattaactaaattac

SEQ ID NO: 212576 - DNA, 20 bp, Artificial
  CRISPR gRNA sequence
aggtgacaaccagttacttt

SEQ ID NO: 212577 - DNA, 20 bp, Artificial
  CRISPR gRNA sequence
acagtgaatcatcaaggcca

SEQ ID NO: 212578 - DNA, 20 bp, Artificial
  CRISPR gRNA sequence
taaaaagttgacacattaaa

SEQ ID NO: 212579 - DNA, 20 bp, Artificial
  CRISPR gRNA sequence
aatcaacagagtctgataat

SEQ ID NO: 212580 - DNA, 20 bp, Artificial
  CRISPR gRNA sequence
gctgaggaaaagccaagaga

SEQ ID NO: 212581 - DNA, 20 bp, Artificial
  CRISPR gRNA sequence
aagagaatcttgaagatcat

SEQ ID NO: 212582 - DNA, 20 bp, Artificial
  CRISPR gRNA sequence
atcacaaatattcaaggcaa

SEQ ID NO: 212583 - DNA, 20 bp, Artificial
  CRISPR gRNA sequence
tttacaatatttcctgatgc

SEQ ID NO: 212584 - DNA, 20 bp, Artificial
  CRISPR gRNA sequence
attaacaaaggaagaggcac

SEQ ID NO: 212585 - DNA, 20 bp, Artificial
  CRISPR gRNA sequence
aggaagaggcactcaagatt

SEQ ID NO: 212586 - DNA, 20 bp, Artificial
  CRISPR gRNA sequence
agaggcactcaagattctta

SEQ ID NO: 212587 - DNA, 20 bp, Artificial
  CRISPR gRNA sequence
ttgctttcctgaaaatggag

SEQ ID NO: 212588 - DNA, 20 bp, Artificial
  CRISPR gRNA sequence
ttcctgaaaatggagaaaag

SEQ ID NO: 212589 - DNA, 20 bp, Artificial
  CRISPR gRNA sequence
aattcctggtactagtcatt

SEQ ID NO: 212590 - DNA, 20 bp, Artificial
  CRISPR gRNA sequence
atagtcttttttaggagggt

SEQ ID NO: 212591 - DNA, 20 bp, Artificial
  CRISPR gRNA sequence
gtaatggcttatataacaag

SEQ ID NO: 212592 - DNA, 20 bp, Artificial
  CRISPR gRNA sequence
gtgactccatgctgaataca

SEQ ID NO: 212593 - DNA, 20 bp, Artificial
  CRISPR gRNA sequence
tgttcaccaatgcatgactg

SEQ ID NO: 212594 - DNA, 20 bp, Artificial
  CRISPR gRNA sequence
accatgcccggctaattttt

SEQ ID NO: 212595 - DNA, 20 bp, Artificial
  CRISPR gRNA sequence
ttttgtagttttagtagaga

SEQ ID NO: 212596 - DNA, 20 bp, Artificial
  CRISPR gRNA sequence
cgcctcggcctcccaaagtg

SEQ ID NO: 212597 - DNA, 20 bp, Artificial
  CRISPR gRNA sequence
ccaccgcgcccggccgactg

SEQ ID NO: 212598 - DNA, 20 bp, Artificial
  CRISPR gRNA sequence
ttaatgacacttggggggaa

SEQ ID NO: 212599 - DNA, 20 bp, Artificial
  CRISPR gRNA sequence
aaactatttacatgaccgag

SEQ ID NO: 212600 - DNA, 20 bp, Artificial
  CRISPR gRNA sequence
tgttaaggtaaaaccaaaat

SEQ ID NO: 212601 - DNA, 20 bp, Artificial
  CRISPR gRNA sequence
tatttctttgaaatattcta

SEQ ID NO: 212602 - DNA, 20 bp, Artificial
  CRISPR gRNA sequence
ccaaaaggttagaaccaagc

SEQ ID NO: 212603 - DNA, 20 bp, Artificial
  CRISPR gRNA sequence
aagaaactctgtcaaaatga

SEQ ID NO: 212604 - DNA, 20 bp, Artificial
  CRISPR gRNA sequence
tcaaaatgataaagatttgt

SEQ ID NO: 212605 - DNA, 20 bp, Artificial
  CRISPR gRNA sequence
ctgggagccatatgactgga

SEQ ID NO: 212606 - DNA, 20 bp, Artificial
  CRISPR gRNA sequence
gagtctgattcgtgacaccc

SEQ ID NO: 212607 - DNA, 20 bp, Artificial
  CRISPR gRNA sequence
caccctacagtttttacagt

SEQ ID NO: 212608 - DNA, 20 bp, Artificial
  CRISPR gRNA sequence
agttttgcaatttttagcaa

SEQ ID NO: 212609 - DNA, 20 bp, Artificial
  CRISPR gRNA sequence
aaaaaagagccacattttca

SEQ ID NO: 212610 - DNA, 20 bp, Artificial
  CRISPR gRNA sequence
gccacattttcaagaagctt

SEQ ID NO: 212611 - DNA, 20 bp, Artificial
  CRISPR gRNA sequence
gcttttttgttttccaatgt

SEQ ID NO: 212612 - DNA, 20 bp, Artificial
  CRISPR gRNA sequence
ttaccatcattcatcattcc

SEQ ID NO: 212613 - DNA, 20 bp, Artificial
  CRISPR gRNA sequence
tccttttgattctttgaatg

SEQ ID NO: 212614 - DNA, 20 bp, Artificial
  CRISPR gRNA sequence
acttagttgggaaatcagat

SEQ ID NO: 212615 - DNA, 20 bp, Artificial
  CRISPR gRNA sequence
gtttacaaagaaagaaaatg

SEQ ID NO: 212616 - DNA, 20 bp, Artificial
  CRISPR gRNA sequence
tccttctctactagggggtg

SEQ ID NO: 212617 - DNA, 20 bp, Artificial
  CRISPR gRNA sequence
ttttgtattttcagtagaga

SEQ ID NO: 212618 - DNA, 20 bp, Artificial
  CRISPR gRNA sequence
agaaaaaaagaggaaaaaaa

SEQ ID NO: 212619 - DNA, 20 bp, Artificial
  CRISPR gRNA sequence
aggcatagacagggcattct

SEQ ID NO: 212620 - DNA, 20 bp, Artificial
  CRISPR gRNA sequence
agatcaaattatgatctggt

SEQ ID NO: 212621 - DNA, 20 bp, Artificial
  CRISPR gRNA sequence
ataccattaaggggttcctc

SEQ ID NO: 212622 - DNA, 20 bp, Artificial
  CRISPR gRNA sequence
taagcctgtaaatgttaaag

SEQ ID NO: 212623 - DNA, 20 bp, Artificial
  CRISPR gRNA sequence
aaagcttgccaagtcgggtt

SEQ ID NO: 212624 - DNA, 20 bp, Artificial
  CRISPR gRNA sequence
taactgggaaagaaaatgtg

SEQ ID NO: 212625 - DNA, 20 bp, Artificial
  CRISPR gRNA sequence
cacctgccctttaggcacaa

SEQ ID NO: 212626 - DNA, 20 bp, Artificial
  CRISPR gRNA sequence
aagtacaatataatcctttc

SEQ ID NO: 212627 - DNA, 20 bp, Artificial
  CRISPR gRNA sequence
ggcctgtcactgtgataagt

SEQ ID NO: 212628 - DNA, 20 bp, Artificial
  CRISPR gRNA sequence
tgataagtctatgtttataa

SEQ ID NO: 212629 - DNA, 20 bp, Artificial
  CRISPR gRNA sequence
cctttcttgcaatttcctca

SEQ ID NO: 212630 - DNA, 20 bp, Artificial
  CRISPR gRNA sequence
aggtacaatgaaaccttaag

SEQ ID NO: 212631 - DNA, 20 bp, Artificial
  CRISPR gRNA sequence
aagcacagttttaagggaaa

SEQ ID NO: 212632 - DNA, 20 bp, Artificial
  CRISPR gRNA sequence
atcgaatcataactccgaac

SEQ ID NO: 212633 - DNA, 20 bp, Artificial
  CRISPR gRNA sequence
agcaatatttacatttattt

SEQ ID NO: 212634 - DNA, 20 bp, Artificial
  CRISPR gRNA sequence
tatcagtgatgtcaacttag

SEQ ID NO: 212635 - DNA, 20 bp, Artificial
  CRISPR gRNA sequence
aggtgaggtgatatattgga

SEQ ID NO: 212636 - DNA, 20 bp, Artificial
  CRISPR gRNA sequence
atatattggaatcagcttcc

SEQ ID NO: 212637 - DNA, 20 bp, Artificial
  CRISPR gRNA sequence
tatagccattattcctactt

SEQ ID NO: 212638 - DNA, 20 bp, Artificial
  CRISPR gRNA sequence
tgacactaaaatgaccaaac

SEQ ID NO: 212639 - DNA, 20 bp, Artificial
  CRISPR gRNA sequence
ccctaggaggttgtatagtc

SEQ ID NO: 212640 - DNA, 20 bp, Artificial
  CRISPR gRNA sequence
aaataaactaaggcatttgg

SEQ ID NO: 212641 - DNA, 20 bp, Artificial
  CRISPR gRNA sequence
tattcaaacatgctgaatat

SEQ ID NO: 212642 - DNA, 20 bp, Artificial
  CRISPR gRNA sequence
tgaatattcttgattatata

SEQ ID NO: 212643 - DNA, 20 bp, Artificial
  CRISPR gRNA sequence
aatagtaaacacattctctc

SEQ ID NO: 212644 - DNA, 20 bp, Artificial
  CRISPR gRNA sequence
cacatcactccctgggtctt

SEQ ID NO: 212645 - DNA, 20 bp, Artificial
  CRISPR gRNA sequence
tattcctctatctatttctt

SEQ ID NO: 212646 - DNA, 20 bp, Artificial
  CRISPR gRNA sequence
gctttctgagttgccttttt

SEQ ID NO: 212647 - DNA, 20 bp, Artificial
  CRISPR gRNA sequence
tgcctttttcactgcttcca

SEQ ID NO: 212648 - DNA, 20 bp, Artificial
  CRISPR gRNA sequence
tagttggggagggaagaaga

SEQ ID NO: 212649 - DNA, 20 bp, Artificial
  CRISPR gRNA sequence
cactttgggaggccaaggca

SEQ ID NO: 212650 - DNA, 20 bp, Artificial
  CRISPR gRNA sequence
ttgggaggccaaggcaaata

SEQ ID NO: 212651 - DNA, 20 bp, Artificial
  CRISPR gRNA sequence
gacctgggctggatgacagc

SEQ ID NO: 212652 - DNA, 20 bp, Artificial
  CRISPR gRNA sequence
cactgcacactcgaattctg

SEQ ID NO: 212653 - DNA, 20 bp, Artificial
  CRISPR gRNA sequence
aatggcaacagactggactg

SEQ ID NO: 212654 - DNA, 20 bp, Artificial
  CRISPR gRNA sequence
ttgctgctgagagggcaaca

SEQ ID NO: 212655 - DNA, 20 bp, Artificial
  CRISPR gRNA sequence
tgtatctgagctcataggag

SEQ ID NO: 212656 - DNA, 20 bp, Artificial
  CRISPR gRNA sequence
cagtttctgttagtgccatg

SEQ ID NO: 212657 - DNA, 20 bp, Artificial
  CRISPR gRNA sequence
caataaactaagcagaaata

SEQ ID NO: 212658 - DNA, 20 bp, Artificial
  CRISPR gRNA sequence
gtaatatggaagttcagaga

SEQ ID NO: 212659 - DNA, 20 bp, Artificial
  CRISPR gRNA sequence
ttgggaggctgaggtgggag

SEQ ID NO: 212660 - DNA, 20 bp, Artificial
  CRISPR gRNA sequence
ggctggcccattctgaaaaa

SEQ ID NO: 212661 - DNA, 20 bp, Artificial
  CRISPR gRNA sequence
cccatgtgacaaaagaatta

SEQ ID NO: 212662 - DNA, 20 bp, Artificial
  CRISPR gRNA sequence
attccatatgagcatacttg

SEQ ID NO: 212663 - DNA, 20 bp, Artificial
  CRISPR gRNA sequence
atgagcatacttgcaatgct

SEQ ID NO: 212664 - DNA, 20 bp, Artificial
  CRISPR gRNA sequence
ccatgccataaatacatttc

SEQ ID NO: 212665 - DNA, 20 bp, Artificial
  CRISPR gRNA sequence
taaatatggtacttactgct

SEQ ID NO: 212666 - DNA, 20 bp, Artificial
  CRISPR gRNA sequence
tatggtacttactgctacca

SEQ ID NO: 212667 - DNA, 20 bp, Artificial
  CRISPR gRNA sequence
cttatattgaactaactggt

SEQ ID NO: 212668 - DNA, 20 bp, Artificial
  CRISPR gRNA sequence
aaacaacaagcccaacttta

SEQ ID NO: 212669 - DNA, 20 bp, Artificial
  CRISPR gRNA sequence
ttaggttcttgtaatctttt

SEQ ID NO: 212670 - DNA, 20 bp, Artificial
  CRISPR gRNA sequence
tttctcatcttataaaatta

SEQ ID NO: 212671 - DNA, 20 bp, Artificial
  CRISPR gRNA sequence
ataaaagaaaaaaaatacaa

SEQ ID NO: 212672 - DNA, 20 bp, Artificial
  CRISPR gRNA sequence
cattaacttcttcttgaaga

SEQ ID NO: 212673 - DNA, 20 bp, Artificial
  CRISPR gRNA sequence
acttcttcttgaagagaaag

SEQ ID NO: 212674 - DNA, 20 bp, Artificial
  CRISPR gRNA sequence
agcttggatttttaactatt

SEQ ID NO: 212675 - DNA, 20 bp, Artificial
  CRISPR gRNA sequence
tttaaatcaaaacacaatca

SEQ ID NO: 212676 - DNA, 20 bp, Artificial
  CRISPR gRNA sequence
aatttgcaaccttaatgtta

SEQ ID NO: 212677 - DNA, 20 bp, Artificial
  CRISPR gRNA sequence
caaccttaatgttacataga

SEQ ID NO: 212678 - DNA, 20 bp, Artificial
  CRISPR gRNA sequence
catagattcagatttacaca

SEQ ID NO: 212679 - DNA, 20 bp, Artificial
  CRISPR gRNA sequence
ctgaaccctggcatcagaca

SEQ ID NO: 212680 - DNA, 20 bp, Artificial
  CRISPR gRNA sequence
aaaataatttggggtacttg

SEQ ID NO: 212681 - DNA, 20 bp, Artificial
  CRISPR gRNA sequence
aacagtgacaggtacagtac

SEQ ID NO: 212682 - DNA, 20 bp, Artificial
  CRISPR gRNA sequence
aggtacagtacagtggtttc

SEQ ID NO: 212683 - DNA, 20 bp, Artificial
  CRISPR gRNA sequence
ttaaggaggtggcagataga

SEQ ID NO: 212684 - DNA, 20 bp, Artificial
  CRISPR gRNA sequence
atcttccagaaccagacaca

SEQ ID NO: 212685 - DNA, 20 bp, Artificial
  CRISPR gRNA sequence
tagctaccacatgaattcca

SEQ ID NO: 212686 - DNA, 20 bp, Artificial
  CRISPR gRNA sequence
gaactcatatgctaaggata

SEQ ID NO: 212687 - DNA, 20 bp, Artificial
  CRISPR gRNA sequence
caaagttcagaaataaaggt

SEQ ID NO: 212688 - DNA, 20 bp, Artificial
  CRISPR gRNA sequence
aattatttgactataacaat

SEQ ID NO: 212689 - DNA, 20 bp, Artificial
  CRISPR gRNA sequence
ataacaattcaagtttcgta

SEQ ID NO: 212690 - DNA, 20 bp, Artificial
  CRISPR gRNA sequence
agttttagaaacacatacag

SEQ ID NO: 212691 - DNA, 20 bp, Artificial
  CRISPR gRNA sequence
ttactccattaatttataac

SEQ ID NO: 212692 - DNA, 20 bp, Artificial
  CRISPR gRNA sequence
attttgataggtggttaaga

SEQ ID NO: 212693 - DNA, 20 bp, Artificial
  CRISPR gRNA sequence
attacattattgggaacatc

SEQ ID NO: 212694 - DNA, 20 bp, Artificial
  CRISPR gRNA sequence
ttgagcttaggtaagataac

SEQ ID NO: 212695 - DNA, 20 bp, Artificial
  CRISPR gRNA sequence
agaaatgttacttgaaaatt

SEQ ID NO: 212696 - DNA, 20 bp, Artificial
  CRISPR gRNA sequence
taaattccatacttactaat

SEQ ID NO: 212697 - DNA, 20 bp, Artificial
  CRISPR gRNA sequence
aaagcctaaattttgaaact

SEQ ID NO: 212698 - DNA, 20 bp, Artificial
  CRISPR gRNA sequence
aaactcaatgttttcattat

SEQ ID NO: 212699 - DNA, 20 bp, Artificial
  CRISPR gRNA sequence
attatattggttttaactag

SEQ ID NO: 212700 - DNA, 20 bp, Artificial
  CRISPR gRNA sequence
ctctttaaatgaacaaaatt

SEQ ID NO: 212701 - DNA, 20 bp, Artificial
  CRISPR gRNA sequence
attggcataggttaatgaaa

SEQ ID NO: 212702 - DNA, 20 bp, Artificial
  CRISPR gRNA sequence
actaaaaaacagtaataatc

SEQ ID NO: 212703 - DNA, 20 bp, Artificial
  CRISPR gRNA sequence
aaaaaacaaaaattatccat

SEQ ID NO: 212704 - DNA, 20 bp, Artificial
  CRISPR gRNA sequence
tcatatcaagaaatgggaac

SEQ ID NO: 212705 - DNA, 20 bp, Artificial
  CRISPR gRNA sequence
tcttccacaaatacaggcat

SEQ ID NO: 212706 - DNA, 20 bp, Artificial
  CRISPR gRNA sequence
tattaccactggggtaaatt

SEQ ID NO: 212707 - DNA, 20 bp, Artificial
  CRISPR gRNA sequence
ggtacagctattttgataca

SEQ ID NO: 212708 - DNA, 20 bp, Artificial
  CRISPR gRNA sequence
tattttgatacagagagttt

SEQ ID NO: 212709 - DNA, 20 bp, Artificial
  CRISPR gRNA sequence
caaagactgactctggagtt

SEQ ID NO: 212710 - DNA, 20 bp, Artificial
  CRISPR gRNA sequence
acagtcagctaagctggact

SEQ ID NO: 212711 - DNA, 20 bp, Artificial
  CRISPR gRNA sequence
taccctaaatcttagaacaa

SEQ ID NO: 212712 - DNA, 20 bp, Artificial
  CRISPR gRNA sequence
tcaaaatgcagtgaaaatga

SEQ ID NO: 212713 - DNA, 20 bp, Artificial
  CRISPR gRNA sequence
gcagtgaaaatgatactgat

SEQ ID NO: 212714 - DNA, 20 bp, Artificial
  CRISPR gRNA sequence
gaaaatgatactgattatag

SEQ ID NO: 212715 - DNA, 20 bp, Artificial
  CRISPR gRNA sequence
atctcttaaaactacagtat

SEQ ID NO: 212716 - DNA, 20 bp, Artificial
  CRISPR gRNA sequence
tttgctaataattaaaacaa

SEQ ID NO: 212717 - DNA, 20 bp, Artificial
  CRISPR gRNA sequence
aacaaatatgtttctactat

SEQ ID NO: 212718 - DNA, 20 bp, Artificial
  CRISPR gRNA sequence
agtcttcttaatgcagaagc

SEQ ID NO: 212719 - DNA, 20 bp, Artificial
  CRISPR gRNA sequence
ttagcaaaagaagagaaaga

SEQ ID NO: 212720 - DNA, 20 bp, Artificial
  CRISPR gRNA sequence
tatggcataatttaaaatta

SEQ ID NO: 212721 - DNA, 20 bp, Artificial
  CRISPR gRNA sequence
atgagcattttcaccaaaac

SEQ ID NO: 212722 - DNA, 20 bp, Artificial
  CRISPR gRNA sequence
taaatgtactaatctaaatt

SEQ ID NO: 212723 - DNA, 20 bp, Artificial
  CRISPR gRNA sequence
actgtgaaaattttaaaaat

SEQ ID NO: 212724 - DNA, 20 bp, Artificial
  CRISPR gRNA sequence
acacaaaattagtgactatt

SEQ ID NO: 212725 - DNA, 20 bp, Artificial
  CRISPR gRNA sequence
agacatctaaatctcaacat

SEQ ID NO: 212726 - DNA, 20 bp, Artificial
  CRISPR gRNA sequence
ttggctctgcctccttctta

SEQ ID NO: 212727 - DNA, 20 bp, Artificial
  CRISPR gRNA sequence
taggttgagtcccagccttc

SEQ ID NO: 212728 - DNA, 20 bp, Artificial
  CRISPR gRNA sequence
tactttcatgtcttggccaa

SEQ ID NO: 212729 - DNA, 20 bp, Artificial
  CRISPR gRNA sequence
gaagttaaggatctgaaagg

SEQ ID NO: 212730 - DNA, 20 bp, Artificial
  CRISPR gRNA sequence
atctgaaaggaggagcttac

SEQ ID NO: 212731 - DNA, 20 bp, Artificial
  CRISPR gRNA sequence
gctcataagagagaggctga

SEQ ID NO: 212732 - DNA, 20 bp, Artificial
  CRISPR gRNA sequence
agaagctagaagagccaaga

SEQ ID NO: 212733 - DNA, 20 bp, Artificial
  CRISPR gRNA sequence
ggagtgtggccctgatgacg

SEQ ID NO: 212734 - DNA, 20 bp, Artificial
  CRISPR gRNA sequence
cagcatggaaagggaattgc

SEQ ID NO: 212735 - DNA, 20 bp, Artificial
  CRISPR gRNA sequence
aattgctattgtttaagcca

SEQ ID NO: 212736 - DNA, 20 bp, Artificial
  CRISPR gRNA sequence
agtccagcaacaagtaaagc

SEQ ID NO: 212737 - DNA, 20 bp, Artificial
  CRISPR gRNA sequence
ataccaccggatctatattt

SEQ ID NO: 212738 - DNA, 20 bp, Artificial
  CRISPR gRNA sequence
ttactaataaattgagctag

SEQ ID NO: 212739 - DNA, 20 bp, Artificial
  CRISPR gRNA sequence
gatgccagttatgttaatca

SEQ ID NO: 212740 - DNA, 20 bp, Artificial
  CRISPR gRNA sequence
acaatctggaaatctagtta

SEQ ID NO: 212741 - DNA, 20 bp, Artificial
  CRISPR gRNA sequence
aaaatgacagaataaaactg

SEQ ID NO: 212742 - DNA, 20 bp, Artificial
  CRISPR gRNA sequence
gtgaaatcctgatgaagaaa

SEQ ID NO: 212743 - DNA, 20 bp, Artificial
  CRISPR gRNA sequence
aaataaactgcaaagactca

SEQ ID NO: 212744 - DNA, 20 bp, Artificial
  CRISPR gRNA sequence
atgggattcatcatacatgt

SEQ ID NO: 212745 - DNA, 20 bp, Artificial
  CRISPR gRNA sequence
taaattttggttaatattga

SEQ ID NO: 212746 - DNA, 20 bp, Artificial
  CRISPR gRNA sequence
gttgattttttcaccaagga

SEQ ID NO: 212747 - DNA, 20 bp, Artificial
  CRISPR gRNA sequence
gagtagcggaaagaaacagc

SEQ ID NO: 212748 - DNA, 20 bp, Artificial
  CRISPR gRNA sequence
tttaaatgttatatttagca

SEQ ID NO: 212749 - DNA, 20 bp, Artificial
  CRISPR gRNA sequence
aaagcaataaataagcccct

SEQ ID NO: 212750 - DNA, 20 bp, Artificial
  CRISPR gRNA sequence
taaatgattgtgataaaaat

SEQ ID NO: 212751 - DNA, 20 bp, Artificial
  CRISPR gRNA sequence
ataaataaccaatttattaa

SEQ ID NO: 212752 - DNA, 20 bp, Artificial
  CRISPR gRNA sequence
aacatcctatggcaagttcc

SEQ ID NO: 212753 - DNA, 20 bp, Artificial
  CRISPR gRNA sequence
ggcaagttccccaagttttt

SEQ ID NO: 212754 - DNA, 20 bp, Artificial
  CRISPR gRNA sequence
ccttgccttcttataaggca

SEQ ID NO: 212755 - DNA, 20 bp, Artificial
  CRISPR gRNA sequence
catatatattgttatctaaa

SEQ ID NO: 212756 - DNA, 20 bp, Artificial
  CRISPR gRNA sequence
gcaaagggttataaagtaga

SEQ ID NO: 212757 - DNA, 20 bp, Artificial
  CRISPR gRNA sequence
aacattcataagaaactctt

SEQ ID NO: 212758 - DNA, 20 bp, Artificial
  CRISPR gRNA sequence
caaactctgcctcccaggtt

SEQ ID NO: 212759 - DNA, 20 bp, Artificial
  CRISPR gRNA sequence
ttttttttttttagtagaga

SEQ ID NO: 212760 - DNA, 20 bp, Artificial
  CRISPR gRNA sequence
tgccacggcctcccaaagtg

SEQ ID NO: 212761 - DNA, 20 bp, Artificial
  CRISPR gRNA sequence
acatccttcttaacaaaaat

SEQ ID NO: 212762 - DNA, 20 bp, Artificial
  CRISPR gRNA sequence
tcatataaaatttatcctct

SEQ ID NO: 212763 - DNA, 20 bp, Artificial
  CRISPR gRNA sequence
taagtacactatatattgaa

SEQ ID NO: 212764 - DNA, 20 bp, Artificial
  CRISPR gRNA sequence
ttgaaagtagttttggttcc

SEQ ID NO: 212765 - DNA, 20 bp, Artificial
  CRISPR gRNA sequence
ctactaatgaaagagtatct

SEQ ID NO: 212766 - DNA, 20 bp, Artificial
  CRISPR gRNA sequence
ttcttcagtgaatcttcaga

SEQ ID NO: 212767 - DNA, 20 bp, Artificial
  CRISPR gRNA sequence
tcttttcttgtccttcagta

SEQ ID NO: 212768 - DNA, 20 bp, Artificial
  CRISPR gRNA sequence
attttctagtatgactttca

SEQ ID NO: 212769 - DNA, 20 bp, Artificial
  CRISPR gRNA sequence
ttttaaaatctgcatgctct

SEQ ID NO: 212770 - DNA, 20 bp, Artificial
  CRISPR gRNA sequence
catgagaaataacagtaatt

SEQ ID NO: 212771 - DNA, 20 bp, Artificial
  CRISPR gRNA sequence
ctagtctaaatcaaggaaca

SEQ ID NO: 212772 - DNA, 20 bp, Artificial
  CRISPR gRNA sequence
agattactttatttgacaat

SEQ ID NO: 212773 - DNA, 20 bp, Artificial
  CRISPR gRNA sequence
acattctaatgggtgagtgt

SEQ ID NO: 212774 - DNA, 20 bp, Artificial
  CRISPR gRNA sequence
ctaatgttatgaatggacaa

SEQ ID NO: 212775 - DNA, 20 bp, Artificial
  CRISPR gRNA sequence
tatgaatggacaagaaggtt

SEQ ID NO: 212776 - DNA, 20 bp, Artificial
  CRISPR gRNA sequence
ataaaatcaagtctatcatg

SEQ ID NO: 212777 - DNA, 20 bp, Artificial
  CRISPR gRNA sequence
gtttccatgacaccccaaag

SEQ ID NO: 212778 - DNA, 20 bp, Artificial
  CRISPR gRNA sequence
gcccaaagacatgacatttg

SEQ ID NO: 212779 - DNA, 20 bp, Artificial
  CRISPR gRNA sequence
gtaagtaagcagagagacag

SEQ ID NO: 212780 - DNA, 20 bp, Artificial
  CRISPR gRNA sequence
agaataaatcataaagaaag

SEQ ID NO: 212781 - DNA, 20 bp, Artificial
  CRISPR gRNA sequence
taaatcataaagaaagatgg

SEQ ID NO: 212782 - DNA, 20 bp, Artificial
  CRISPR gRNA sequence
gtttgatttcattattacag

SEQ ID NO: 212783 - DNA, 20 bp, Artificial
  CRISPR gRNA sequence
tctgttgagctgtaaatgaa

SEQ ID NO: 212784 - DNA, 20 bp, Artificial
  CRISPR gRNA sequence
aattacaatttcatttttta

SEQ ID NO: 212785 - DNA, 20 bp, Artificial
  CRISPR gRNA sequence
acacacatgcatacacaaat

SEQ ID NO: 212786 - DNA, 20 bp, Artificial
  CRISPR gRNA sequence
taggacagagataaaagagt

SEQ ID NO: 212787 - DNA, 20 bp, Artificial
  CRISPR gRNA sequence
attatcaactttccctgcct

SEQ ID NO: 212788 - DNA, 20 bp, Artificial
  CRISPR gRNA sequence
atatggagaaggttgtgatg

SEQ ID NO: 212789 - DNA, 20 bp, Artificial
  CRISPR gRNA sequence
gtctggatttggaaagggtc

SEQ ID NO: 212790 - DNA, 20 bp, Artificial
  CRISPR gRNA sequence
aaaagagtaaaatgctgagc

SEQ ID NO: 212791 - DNA, 20 bp, Artificial
  CRISPR gRNA sequence
caagggaaagcactgggagt

SEQ ID NO: 212792 - DNA, 20 bp, Artificial
  CRISPR gRNA sequence
tcgggaggctgagacagaag

SEQ ID NO: 212793 - DNA, 20 bp, Artificial
  CRISPR gRNA sequence
gggccatcaaccaggtcaca

SEQ ID NO: 212794 - DNA, 20 bp, Artificial
  CRISPR gRNA sequence
tgttccattacttattttaa

SEQ ID NO: 212795 - DNA, 20 bp, Artificial
  CRISPR gRNA sequence
tttttccttgaattttctaa

SEQ ID NO: 212796 - DNA, 20 bp, Artificial
  CRISPR gRNA sequence
aaaattaaagatgcctagaa

SEQ ID NO: 212797 - DNA, 20 bp, Artificial
  CRISPR gRNA sequence
ctgatatgaattccagttac

SEQ ID NO: 212798 - DNA, 20 bp, Artificial
  CRISPR gRNA sequence
catgcacagacagcaaagta

SEQ ID NO: 212799 - DNA, 20 bp, Artificial
  CRISPR gRNA sequence
agtatggagttttgttacct

SEQ ID NO: 212800 - DNA, 20 bp, Artificial
  CRISPR gRNA sequence
aatggagtaagagaagaaat

SEQ ID NO: 212801 - DNA, 20 bp, Artificial
  CRISPR gRNA sequence
aattcaccaagccatagaga

SEQ ID NO: 212802 - DNA, 20 bp, Artificial
  CRISPR gRNA sequence
tgataacacactttcattct

SEQ ID NO: 212803 - DNA, 20 bp, Artificial
  CRISPR gRNA sequence
actttcattctcgatgtttc

SEQ ID NO: 212804 - DNA, 20 bp, Artificial
  CRISPR gRNA sequence
taatttaccacatactaaat

SEQ ID NO: 212805 - DNA, 20 bp, Artificial
  CRISPR gRNA sequence
gccgttgttattgataataa

SEQ ID NO: 212806 - DNA, 20 bp, Artificial
  CRISPR gRNA sequence
attgataataacagagtttt

SEQ ID NO: 212807 - DNA, 20 bp, Artificial
  CRISPR gRNA sequence
aggtcatggaacaatataat

SEQ ID NO: 212808 - DNA, 20 bp, Artificial
  CRISPR gRNA sequence
atagtttttcccattcatca

SEQ ID NO: 212809 - DNA, 20 bp, Artificial
  CRISPR gRNA sequence
tttttcccattcatcatgaa

SEQ ID NO: 212810 - DNA, 20 bp, Artificial
  CRISPR gRNA sequence
tgaagattgttttgcagaat

SEQ ID NO: 212811 - DNA, 20 bp, Artificial
  CRISPR gRNA sequence
cagaatttcagcttacatgg

SEQ ID NO: 212812 - DNA, 20 bp, Artificial
  CRISPR gRNA sequence
catggtcatgtttatggtct

SEQ ID NO: 212813 - DNA, 20 bp, Artificial
  CRISPR gRNA sequence
agtggcaaactgtgagttgg

SEQ ID NO: 212814 - DNA, 20 bp, Artificial
  CRISPR gRNA sequence
caatactatcagttaagcct

SEQ ID NO: 212815 - DNA, 20 bp, Artificial
  CRISPR gRNA sequence
actatcagttaagccttggt

SEQ ID NO: 212816 - DNA, 20 bp, Artificial
  CRISPR gRNA sequence
tttgattctagcaatctctg

SEQ ID NO: 212817 - DNA, 20 bp, Artificial
  CRISPR gRNA sequence
tctgagctgtttgctaagca

SEQ ID NO: 212818 - DNA, 20 bp, Artificial
  CRISPR gRNA sequence
ctgtttgctaagcatagaga

SEQ ID NO: 212819 - DNA, 20 bp, Artificial
  CRISPR gRNA sequence
ccaagtgctggctgggctct

SEQ ID NO: 212820 - DNA, 20 bp, Artificial
  CRISPR gRNA sequence
ctgggagtttaagagtcttc

SEQ ID NO: 212821 - DNA, 20 bp, Artificial
  CRISPR gRNA sequence
cataacctgctgtctttact

SEQ ID NO: 212822 - DNA, 20 bp, Artificial
  CRISPR gRNA sequence
aagtttagcctggtaaaggt

SEQ ID NO: 212823 - DNA, 20 bp, Artificial
  CRISPR gRNA sequence
tcatgggtctgagttattat

SEQ ID NO: 212824 - DNA, 20 bp, Artificial
  CRISPR gRNA sequence
tgagttattatgaatgcttt

SEQ ID NO: 212825 - DNA, 20 bp, Artificial
  CRISPR gRNA sequence
tgctttagaagatttaccat

SEQ ID NO: 212826 - DNA, 20 bp, Artificial
  CRISPR gRNA sequence
tctaagcaggtggagaatag

SEQ ID NO: 212827 - DNA, 20 bp, Artificial
  CRISPR gRNA sequence
acagaggcactaacagaaaa

SEQ ID NO: 212828 - DNA, 20 bp, Artificial
  CRISPR gRNA sequence
tgcacatacattcgtgtctc

SEQ ID NO: 212829 - DNA, 20 bp, Artificial
  CRISPR gRNA sequence
tcacacccacatttcaggca

SEQ ID NO: 212830 - DNA, 20 bp, Artificial
  CRISPR gRNA sequence
gtcaacattctgctctccta

SEQ ID NO: 212831 - DNA, 20 bp, Artificial
  CRISPR gRNA sequence
agttttagctactcagtatt

SEQ ID NO: 212832 - DNA, 20 bp, Artificial
  CRISPR gRNA sequence
agtactatcaggaaacggct

SEQ ID NO: 212833 - DNA, 20 bp, Artificial
  CRISPR gRNA sequence
aaattgcctaatctatctgt

SEQ ID NO: 212834 - DNA, 20 bp, Artificial
  CRISPR gRNA sequence
aacaacagtgtctatgccca

SEQ ID NO: 212835 - DNA, 20 bp, Artificial
  CRISPR gRNA sequence
atgcacatacacacacatct

SEQ ID NO: 212836 - DNA, 20 bp, Artificial
  CRISPR gRNA sequence
attcccaccaaaatatttct

SEQ ID NO: 212837 - DNA, 20 bp, Artificial
  CRISPR gRNA sequence
caaaaattacaattacaata

SEQ ID NO: 212838 - DNA, 20 bp, Artificial
  CRISPR gRNA sequence
tttttcacccatcaaatttg

SEQ ID NO: 212839 - DNA, 20 bp, Artificial
  CRISPR gRNA sequence
tctgcaatagtagttgatac

SEQ ID NO: 212840 - DNA, 20 bp, Artificial
  CRISPR gRNA sequence
ttaaaatatctctgccaatt

SEQ ID NO: 212841 - DNA, 20 bp, Artificial
  CRISPR gRNA sequence
gtagaacacaggcagctata

SEQ ID NO: 212842 - DNA, 20 bp, Artificial
  CRISPR gRNA sequence
gaaattcaccagaatatacc

SEQ ID NO: 212843 - DNA, 20 bp, Artificial
  CRISPR gRNA sequence
aatataccaatagtttattt

SEQ ID NO: 212844 - DNA, 20 bp, Artificial
  CRISPR gRNA sequence
tctaggtttggggactacag

SEQ ID NO: 212845 - DNA, 20 bp, Artificial
  CRISPR gRNA sequence
ctggctctgccaatatggtt

SEQ ID NO: 212846 - DNA, 20 bp, Artificial
  CRISPR gRNA sequence
ttttcttgacataaaaaact

SEQ ID NO: 212847 - DNA, 20 bp, Artificial
  CRISPR gRNA sequence
agaatgccatacactgagaa

SEQ ID NO: 212848 - DNA, 20 bp, Artificial
  CRISPR gRNA sequence
atcaatcagtcatctccctt

SEQ ID NO: 212849 - DNA, 20 bp, Artificial
  CRISPR gRNA sequence
tatacaccaccatagatata

SEQ ID NO: 212850 - DNA, 20 bp, Artificial
  CRISPR gRNA sequence
acaacagggcaatccactgc

SEQ ID NO: 212851 - DNA, 20 bp, Artificial
  CRISPR gRNA sequence
gcaatccactgcaatagttt

SEQ ID NO: 212852 - DNA, 20 bp, Artificial
  CRISPR gRNA sequence
gcaatagtttactagctttt

SEQ ID NO: 212853 - DNA, 20 bp, Artificial
  CRISPR gRNA sequence
ttaaataagcagtatttatt

SEQ ID NO: 212854 - DNA, 20 bp, Artificial
  CRISPR gRNA sequence
tatttattccttgcttatat

SEQ ID NO: 212855 - DNA, 20 bp, Artificial
  CRISPR gRNA sequence
aggaataaatcttgtattta

SEQ ID NO: 212856 - DNA, 20 bp, Artificial
  CRISPR gRNA sequence
atcttgtatttaaaaagctt

SEQ ID NO: 212857 - DNA, 20 bp, Artificial
  CRISPR gRNA sequence
ttaccaaaatatgaaaatat

SEQ ID NO: 212858 - DNA, 20 bp, Artificial
  CRISPR gRNA sequence
aaagaacctaactctctggt

SEQ ID NO: 212859 - DNA, 20 bp, Artificial
  CRISPR gRNA sequence
aactaatgcaggctgtcacc

SEQ ID NO: 212860 - DNA, 20 bp, Artificial
  CRISPR gRNA sequence
tgtgaatattaaaatgtgac

SEQ ID NO: 212861 - DNA, 20 bp, Artificial
  CRISPR gRNA sequence
tattcctactattcattctt

SEQ ID NO: 212862 - DNA, 20 bp, Artificial
  CRISPR gRNA sequence
ttctgctaatggtctataat

SEQ ID NO: 212863 - DNA, 20 bp, Artificial
  CRISPR gRNA sequence
aagcatttctcacatttttc

SEQ ID NO: 212864 - DNA, 20 bp, Artificial
  CRISPR gRNA sequence
aggctctgtggccacactgc

SEQ ID NO: 212865 - DNA, 20 bp, Artificial
  CRISPR gRNA sequence
aagttaataaactacatgca

SEQ ID NO: 212866 - DNA, 20 bp, Artificial
  CRISPR gRNA sequence
tacatgcaaagggcttaaaa

SEQ ID NO: 212867 - DNA, 20 bp, Artificial
  CRISPR gRNA sequence
ctgcaattatccatgcataa

SEQ ID NO: 212868 - DNA, 20 bp, Artificial
  CRISPR gRNA sequence
gcataattaggcttcagaag

SEQ ID NO: 212869 - DNA, 20 bp, Artificial
  CRISPR gRNA sequence
tttatatgtaaagtaagatg

SEQ ID NO: 212870 - DNA, 20 bp, Artificial
  CRISPR gRNA sequence
ttaagatattaagacttcaa

SEQ ID NO: 212871 - DNA, 20 bp, Artificial
  CRISPR gRNA sequence
tttgtgagaacttttaaaaa

SEQ ID NO: 212872 - DNA, 20 bp, Artificial
  CRISPR gRNA sequence
taagaccataattttagctg

SEQ ID NO: 212873 - DNA, 20 bp, Artificial
  CRISPR gRNA sequence
taaatgtactgaaagtattc

SEQ ID NO: 212874 - DNA, 20 bp, Artificial
  CRISPR gRNA sequence
gtttgcctgtacaaggggct

SEQ ID NO: 212875 - DNA, 20 bp, Artificial
  CRISPR gRNA sequence
atagccacatatttcttgtg

SEQ ID NO: 212876 - DNA, 20 bp, Artificial
  CRISPR gRNA sequence
tgctataataagtcctggta

SEQ ID NO: 212877 - DNA, 20 bp, Artificial
  CRISPR gRNA sequence
gaatataacaacatcataaa

SEQ ID NO: 212878 - DNA, 20 bp, Artificial
  CRISPR gRNA sequence
ataaactctgttttatagat

SEQ ID NO: 212879 - DNA, 20 bp, Artificial
  CRISPR gRNA sequence
ctatatgtagtagagactcc

SEQ ID NO: 212880 - DNA, 20 bp, Artificial
  CRISPR gRNA sequence
gagggttgcaatggtcataa

SEQ ID NO: 212881 - DNA, 20 bp, Artificial
  CRISPR gRNA sequence
agtgaatggaagactttttt

SEQ ID NO: 212882 - DNA, 20 bp, Artificial
  CRISPR gRNA sequence
ggttgtggatctctactgag

SEQ ID NO: 212883 - DNA, 20 bp, Artificial
  CRISPR gRNA sequence
ccaggaaaaaattttggaga

SEQ ID NO: 212884 - DNA, 20 bp, Artificial
  CRISPR gRNA sequence
aaaaaattttggagatcatg

SEQ ID NO: 212885 - DNA, 20 bp, Artificial
  CRISPR gRNA sequence
gatttttgtatctaatcccc

SEQ ID NO: 212886 - DNA, 20 bp, Artificial
  CRISPR gRNA sequence
aaggctgtatggtctaatag

SEQ ID NO: 212887 - DNA, 20 bp, Artificial
  CRISPR gRNA sequence
tgtatttttccttacttccc

SEQ ID NO: 212888 - DNA, 20 bp, Artificial
  CRISPR gRNA sequence
tttccttacttcccctgtgc

SEQ ID NO: 212889 - DNA, 20 bp, Artificial
  CRISPR gRNA sequence
cgtggtgaccccatttcttc

SEQ ID NO: 212890 - DNA, 20 bp, Artificial
  CRISPR gRNA sequence
ccttggagttatacctgact

SEQ ID NO: 212891 - DNA, 20 bp, Artificial
  CRISPR gRNA sequence
cagtgatgagatcaaatggg

SEQ ID NO: 212892 - DNA, 20 bp, Artificial
  CRISPR gRNA sequence
gcaagaccatgtagagtctt

SEQ ID NO: 212893 - DNA, 20 bp, Artificial
  CRISPR gRNA sequence
gagtcttaaaagcttgttgg

SEQ ID NO: 212894 - DNA, 20 bp, Artificial
  CRISPR gRNA sequence
ttaaaagcttgttgggagag

SEQ ID NO: 212895 - DNA, 20 bp, Artificial
  CRISPR gRNA sequence
agagcaatgacaagcggctg

SEQ ID NO: 212896 - DNA, 20 bp, Artificial
  CRISPR gRNA sequence
tctttggcagccacatggag

SEQ ID NO: 212897 - DNA, 20 bp, Artificial
  CRISPR gRNA sequence
ccaacaaacgcagtcctgag

SEQ ID NO: 212898 - DNA, 20 bp, Artificial
  CRISPR gRNA sequence
atgagcaatggctaaaagaa

SEQ ID NO: 212899 - DNA, 20 bp, Artificial
  CRISPR gRNA sequence
cccagtgagtgagaatagta

SEQ ID NO: 212900 - DNA, 20 bp, Artificial
  CRISPR gRNA sequence
gagtgagaatagtagcaagt

SEQ ID NO: 212901 - DNA, 20 bp, Artificial
  CRISPR gRNA sequence
gagaatagtagcaagtttta

SEQ ID NO: 212902 - DNA, 20 bp, Artificial
  CRISPR gRNA sequence
agtaataatgtctcatcatg

SEQ ID NO: 212903 - DNA, 20 bp, Artificial
  CRISPR gRNA sequence
tagatgactacttgatgact

SEQ ID NO: 212904 - DNA, 20 bp, Artificial
  CRISPR gRNA sequence
agacatttcaatgacagaga

SEQ ID NO: 212905 - DNA, 20 bp, Artificial
  CRISPR gRNA sequence
cagaacaaaaaatactgtct

SEQ ID NO: 212906 - DNA, 20 bp, Artificial
  CRISPR gRNA sequence
tgtctcagcctcccaagtag

SEQ ID NO: 212907 - DNA, 20 bp, Artificial
  CRISPR gRNA sequence
ttttgtaattttggtagaga

SEQ ID NO: 212908 - DNA, 20 bp, Artificial
  CRISPR gRNA sequence
ctgccacacctggcctgtct

SEQ ID NO: 212909 - DNA, 20 bp, Artificial
  CRISPR gRNA sequence
gtgattcttaactggaactt

SEQ ID NO: 212910 - DNA, 20 bp, Artificial
  CRISPR gRNA sequence
tctcccttctcattattgtg

SEQ ID NO: 212911 - DNA, 20 bp, Artificial
  CRISPR gRNA sequence
cacacaatggagaagggcat

SEQ ID NO: 212912 - DNA, 20 bp, Artificial
  CRISPR gRNA sequence
agaagggcatccaggattct

SEQ ID NO: 212913 - DNA, 20 bp, Artificial
  CRISPR gRNA sequence
ctctaatttgttacagtggg

SEQ ID NO: 212914 - DNA, 20 bp, Artificial
  CRISPR gRNA sequence
cacttatatgcctattaagc

SEQ ID NO: 212915 - DNA, 20 bp, Artificial
  CRISPR gRNA sequence
tatgccactaagaacataaa

SEQ ID NO: 212916 - DNA, 20 bp, Artificial
  CRISPR gRNA sequence
atgtcagatatttttccatc

SEQ ID NO: 212917 - DNA, 20 bp, Artificial
  CRISPR gRNA sequence
tccaattcctggacaggcag

SEQ ID NO: 212918 - DNA, 20 bp, Artificial
  CRISPR gRNA sequence
caagggtgtagtcaatgaat

SEQ ID NO: 212919 - DNA, 20 bp, Artificial
  CRISPR gRNA sequence
tcaatgaataagtgtttaat

SEQ ID NO: 212920 - DNA, 20 bp, Artificial
  CRISPR gRNA sequence
atgcaaaccaaatttttact

SEQ ID NO: 212921 - DNA, 20 bp, Artificial
  CRISPR gRNA sequence
ccaaatttttacttgatgtt

SEQ ID NO: 212922 - DNA, 20 bp, Artificial
  CRISPR gRNA sequence
acttgatgtttcaggattgt

SEQ ID NO: 212923 - DNA, 20 bp, Artificial
  CRISPR gRNA sequence
gagactaggactgtgaatgt

SEQ ID NO: 212924 - DNA, 20 bp, Artificial
  CRISPR gRNA sequence
gaatgtattggatttcattt

SEQ ID NO: 212925 - DNA, 20 bp, Artificial
  CRISPR gRNA sequence
gattatatcacccagcaaaa

SEQ ID NO: 212926 - DNA, 20 bp, Artificial
  CRISPR gRNA sequence
aatcagctgactttaagaaa

SEQ ID NO: 212927 - DNA, 20 bp, Artificial
  CRISPR gRNA sequence
aaaataaactcaatatgtga

SEQ ID NO: 212928 - DNA, 20 bp, Artificial
  CRISPR gRNA sequence
gtgagagggattcaacaaga

SEQ ID NO: 212929 - DNA, 20 bp, Artificial
  CRISPR gRNA sequence
caagaggaagattctccttt

SEQ ID NO: 212930 - DNA, 20 bp, Artificial
  CRISPR gRNA sequence
aaagtatgccctgggcaaca

SEQ ID NO: 212931 - DNA, 20 bp, Artificial
  CRISPR gRNA sequence
agaacccagtcatgccatga

SEQ ID NO: 212932 - DNA, 20 bp, Artificial
  CRISPR gRNA sequence
actttgagctaaaaaatggg

SEQ ID NO: 212933 - DNA, 20 bp, Artificial
  CRISPR gRNA sequence
acctttctaaacaaaactct

SEQ ID NO: 212934 - DNA, 20 bp, Artificial
  CRISPR gRNA sequence
agcttagagaaaaataaact

SEQ ID NO: 212935 - DNA, 20 bp, Artificial
  CRISPR gRNA sequence
gaaaaataaactttaagttt

SEQ ID NO: 212936 - DNA, 20 bp, Artificial
  CRISPR gRNA sequence
agaaatattaatgataaatt

SEQ ID NO: 212937 - DNA, 20 bp, Artificial
  CRISPR gRNA sequence
tcagtatttagttatttaca

SEQ ID NO: 212938 - DNA, 20 bp, Artificial
  CRISPR gRNA sequence
atattacggtggtaaaaata

SEQ ID NO: 212939 - DNA, 20 bp, Artificial
  CRISPR gRNA sequence
ggttttgatgccaaagagat

SEQ ID NO: 212940 - DNA, 20 bp, Artificial
  CRISPR gRNA sequence
tgaacaataccttgaatctc

SEQ ID NO: 212941 - DNA, 20 bp, Artificial
  CRISPR gRNA sequence
gaatttgagggacagatagg

SEQ ID NO: 212942 - DNA, 20 bp, Artificial
  CRISPR gRNA sequence
ttaaacagtgaagtctagaa

SEQ ID NO: 212943 - DNA, 20 bp, Artificial
  CRISPR gRNA sequence
gtatataaaactatatctta

SEQ ID NO: 212944 - DNA, 20 bp, Artificial
  CRISPR gRNA sequence
tcacttctctattgagcaaa

SEQ ID NO: 212945 - DNA, 20 bp, Artificial
  CRISPR gRNA sequence
aaaaatcacgacatagtaaa

SEQ ID NO: 212946 - DNA, 20 bp, Artificial
  CRISPR gRNA sequence
gacatagtaaaaatggtttc

SEQ ID NO: 212947 - DNA, 20 bp, Artificial
  CRISPR gRNA sequence
tttgtgcagataacttttta

SEQ ID NO: 212948 - DNA, 20 bp, Artificial
  CRISPR gRNA sequence
cagataactttttaactggt

SEQ ID NO: 212949 - DNA, 20 bp, Artificial
  CRISPR gRNA sequence
taactttttaactggttttt

SEQ ID NO: 212950 - DNA, 20 bp, Artificial
  CRISPR gRNA sequence
ttaactggtttttgtttgtt

SEQ ID NO: 212951 - DNA, 20 bp, Artificial
  CRISPR gRNA sequence
tagccactctggaaaagtct

SEQ ID NO: 212952 - DNA, 20 bp, Artificial
  CRISPR gRNA sequence
acctgtacacaattgttcag

SEQ ID NO: 212953 - DNA, 20 bp, Artificial
  CRISPR gRNA sequence
ttggatagatctcaagggca

SEQ ID NO: 212954 - DNA, 20 bp, Artificial
  CRISPR gRNA sequence
tatagatatggaggacaaat

SEQ ID NO: 212955 - DNA, 20 bp, Artificial
  CRISPR gRNA sequence
agtaagaataagcatgaggg

SEQ ID NO: 212956 - DNA, 20 bp, Artificial
  CRISPR gRNA sequence
ttatgatggataggtctatg

SEQ ID NO: 212957 - DNA, 20 bp, Artificial
  CRISPR gRNA sequence
acactgcaccattgtgaact

SEQ ID NO: 212958 - DNA, 20 bp, Artificial
  CRISPR gRNA sequence
ttaatggctcccaaaataag

SEQ ID NO: 212959 - DNA, 20 bp, Artificial
  CRISPR gRNA sequence
caatcacacgcaaaataata

SEQ ID NO: 212960 - DNA, 20 bp, Artificial
  CRISPR gRNA sequence
ggcctttcaaatctcatatt

SEQ ID NO: 212961 - DNA, 20 bp, Artificial
  CRISPR gRNA sequence
aaatctcatattttgagttt

SEQ ID NO: 212962 - DNA, 20 bp, Artificial
  CRISPR gRNA sequence
tagttgcagtggatatgact

SEQ ID NO: 212963 - DNA, 20 bp, Artificial
  CRISPR gRNA sequence
tagtaaaagctacaatgtaa

SEQ ID NO: 212964 - DNA, 20 bp, Artificial
  CRISPR gRNA sequence
aactaacatttacaacacac

SEQ ID NO: 212965 - DNA, 20 bp, Artificial
  CRISPR gRNA sequence
caggggctgtaactcagacc

SEQ ID NO: 212966 - DNA, 20 bp, Artificial
  CRISPR gRNA sequence
caccccattcctaatctggt

SEQ ID NO: 212967 - DNA, 20 bp, Artificial
  CRISPR gRNA sequence
atatgacaggtaattctaaa

SEQ ID NO: 212968 - DNA, 20 bp, Artificial
  CRISPR gRNA sequence
accttctacacctcagcaac

SEQ ID NO: 212969 - DNA, 20 bp, Artificial
  CRISPR gRNA sequence
tgaagaaatcatccatgata

SEQ ID NO: 212970 - DNA, 20 bp, Artificial
  CRISPR gRNA sequence
aataaaatggtccttagacc

SEQ ID NO: 212971 - DNA, 20 bp, Artificial
  CRISPR gRNA sequence
taatacaaattaaatagtaa

SEQ ID NO: 212972 - DNA, 20 bp, Artificial
  CRISPR gRNA sequence
aaatgtgttttaccatgaag

SEQ ID NO: 212973 - DNA, 20 bp, Artificial
  CRISPR gRNA sequence
atcaacatttattaataaca

SEQ ID NO: 212974 - DNA, 20 bp, Artificial
  CRISPR gRNA sequence
tttattaataacagcctgct

SEQ ID NO: 212975 - DNA, 20 bp, Artificial
  CRISPR gRNA sequence
gcaccaggacaaataaaaaa

SEQ ID NO: 212976 - DNA, 20 bp, Artificial
  CRISPR gRNA sequence
acacgatattttagctcgat

SEQ ID NO: 212977 - DNA, 20 bp, Artificial
  CRISPR gRNA sequence
taattctgttacttcacaag

SEQ ID NO: 212978 - DNA, 20 bp, Artificial
  CRISPR gRNA sequence
aaagtcagtggggacagtgg

SEQ ID NO: 212979 - DNA, 20 bp, Artificial
  CRISPR gRNA sequence
ccactttacgtatacttcag

SEQ ID NO: 212980 - DNA, 20 bp, Artificial
  CRISPR gRNA sequence
tcattacaaaacgtgaattc

SEQ ID NO: 212981 - DNA, 20 bp, Artificial
  CRISPR gRNA sequence
caaaacgtgaattctacaga

SEQ ID NO: 212982 - DNA, 20 bp, Artificial
  CRISPR gRNA sequence
atcctggaaaggaaaaagaa

SEQ ID NO: 212983 - DNA, 20 bp, Artificial
  CRISPR gRNA sequence
tggaacatgcaggtgtagta

SEQ ID NO: 212984 - DNA, 20 bp, Artificial
  CRISPR gRNA sequence
caggtgtagtatctggcttt

SEQ ID NO: 212985 - DNA, 20 bp, Artificial
  CRISPR gRNA sequence
actgctaataagcatcctat

SEQ ID NO: 212986 - DNA, 20 bp, Artificial
  CRISPR gRNA sequence
actttgttaatagttcacac

SEQ ID NO: 212987 - DNA, 20 bp, Artificial
  CRISPR gRNA sequence
gaataaaaatcagaggcata

SEQ ID NO: 212988 - DNA, 20 bp, Artificial
  CRISPR gRNA sequence
atgtttctattgtaagaaca

SEQ ID NO: 212989 - DNA, 20 bp, Artificial
  CRISPR gRNA sequence
agcaactcacttttctatgc

SEQ ID NO: 212990 - DNA, 20 bp, Artificial
  CRISPR gRNA sequence
gcatccacagctcacctctt

SEQ ID NO: 212991 - DNA, 20 bp, Artificial
  CRISPR gRNA sequence
gaaagtatcagaaaatatgg

SEQ ID NO: 212992 - DNA, 20 bp, Artificial
  CRISPR gRNA sequence
agtgctgggcaatgtctaac

SEQ ID NO: 212993 - DNA, 20 bp, Artificial
  CRISPR gRNA sequence
cctttcactgactttgactg

SEQ ID NO: 212994 - DNA, 20 bp, Artificial
  CRISPR gRNA sequence
tgactttgactgggctgttt

SEQ ID NO: 212995 - DNA, 20 bp, Artificial
  CRISPR gRNA sequence
agaaaactgagagtaattca

SEQ ID NO: 212996 - DNA, 20 bp, Artificial
  CRISPR gRNA sequence
aaaaataaatcttgttctgc

SEQ ID NO: 212997 - DNA, 20 bp, Artificial
  CRISPR gRNA sequence
tgatttccacctggtggaag

SEQ ID NO: 212998 - DNA, 20 bp, Artificial
  CRISPR gRNA sequence
tagcaaattcatttaggcat

SEQ ID NO: 212999 - DNA, 20 bp, Artificial
  CRISPR gRNA sequence
tcttgattgcctataaatgt

SEQ ID NO: 213000 - DNA, 20 bp, Artificial
  CRISPR gRNA sequence
tttttccaattttcttttaa

SEQ ID NO: 213001 - DNA, 20 bp, Artificial
  CRISPR gRNA sequence
taaaagggttttgccttctt

SEQ ID NO: 213002 - DNA, 20 bp, Artificial
  CRISPR gRNA sequence
agggttttgccttcttgcta

SEQ ID NO: 213003 - DNA, 20 bp, Artificial
  CRISPR gRNA sequence
cattttatatttgtatgaat

SEQ ID NO: 213004 - DNA, 20 bp, Artificial
  CRISPR gRNA sequence
tgaatcatggtttgactttc

SEQ ID NO: 213005 - DNA, 20 bp, Artificial
  CRISPR gRNA sequence
catcctatgaaactttttgc

SEQ ID NO: 213006 - DNA, 20 bp, Artificial
  CRISPR gRNA sequence
acaatccaccatttcataac

SEQ ID NO: 213007 - DNA, 20 bp, Artificial
  CRISPR gRNA sequence
aactattaagtagtaaaact

SEQ ID NO: 213008 - DNA, 20 bp, Artificial
  CRISPR gRNA sequence
agtagtaaaactgtctgatt

SEQ ID NO: 213009 - DNA, 20 bp, Artificial
  CRISPR gRNA sequence
gaaaactctgaataaacaag

SEQ ID NO: 213010 - DNA, 20 bp, Artificial
  CRISPR gRNA sequence
aattagcaaataaaatggga

SEQ ID NO: 213011 - DNA, 20 bp, Artificial
  CRISPR gRNA sequence
tctcatatcatagtctagaa

SEQ ID NO: 213012 - DNA, 20 bp, Artificial
  CRISPR gRNA sequence
aaatatagttattatctttt

SEQ ID NO: 213013 - DNA, 20 bp, Artificial
  CRISPR gRNA sequence
ggcagaagagtaattggtct

SEQ ID NO: 213014 - DNA, 20 bp, Artificial
  CRISPR gRNA sequence
tttacatatttcatgtaaat

SEQ ID NO: 213015 - DNA, 20 bp, Artificial
  CRISPR gRNA sequence
aaaccttcagaggagaatcc

SEQ ID NO: 213016 - DNA, 20 bp, Artificial
  CRISPR gRNA sequence
tatccacacctttttttttt

SEQ ID NO: 213017 - DNA, 20 bp, Artificial
  CRISPR gRNA sequence
atgaatcccatcacctgaaa

SEQ ID NO: 213018 - DNA, 20 bp, Artificial
  CRISPR gRNA sequence
tctcctcaacgactttcctt

SEQ ID NO: 213019 - DNA, 20 bp, Artificial
  CRISPR gRNA sequence
cccccattccatttacaagg

SEQ ID NO: 213020 - DNA, 20 bp, Artificial
  CRISPR gRNA sequence
tttttgtgtgtgtctttaaa

SEQ ID NO: 213021 - DNA, 20 bp, Artificial
  CRISPR gRNA sequence
ctcttggcctccatggtatc

SEQ ID NO: 213022 - DNA, 20 bp, Artificial
  CRISPR gRNA sequence
tctcctgattacgaatttcc

SEQ ID NO: 213023 - DNA, 20 bp, Artificial
  CRISPR gRNA sequence
tcctgctttgtccaccccat

SEQ ID NO: 213024 - DNA, 20 bp, Artificial
  CRISPR gRNA sequence
gctttgtccaccccatccta

SEQ ID NO: 213025 - DNA, 20 bp, Artificial
  CRISPR gRNA sequence
cactaaatgttagtgtccct

SEQ ID NO: 213026 - DNA, 20 bp, Artificial
  CRISPR gRNA sequence
atgttagtgtccctaagggc

SEQ ID NO: 213027 - DNA, 20 bp, Artificial
  CRISPR gRNA sequence
ctagtattttccctgactcc

SEQ ID NO: 213028 - DNA, 20 bp, Artificial
  CRISPR gRNA sequence
gacctggacctaagaatcac

SEQ ID NO: 213029 - DNA, 20 bp, Artificial
  CRISPR gRNA sequence
cagctccctgcctccatcct

SEQ ID NO: 213030 - DNA, 20 bp, Artificial
  CRISPR gRNA sequence
gcacacattaaggggtcgac

SEQ ID NO: 213031 - DNA, 20 bp, Artificial
  CRISPR gRNA sequence
attaaggggtcgaccctagt

SEQ ID NO: 213032 - DNA, 20 bp, Artificial
  CRISPR gRNA sequence
caagttacttacctctgctc

SEQ ID NO: 213033 - DNA, 20 bp, Artificial
  CRISPR gRNA sequence
tatacctcatagagatattg

SEQ ID NO: 213034 - DNA, 20 bp, Artificial
  CRISPR gRNA sequence
tgttaagatttaataagata

SEQ ID NO: 213035 - DNA, 20 bp, Artificial
  CRISPR gRNA sequence
agtactcaataaatggcagc

SEQ ID NO: 213036 - DNA, 20 bp, Artificial
  CRISPR gRNA sequence
tctaacacagggtccagaaa

SEQ ID NO: 213037 - DNA, 20 bp, Artificial
  CRISPR gRNA sequence
ataccttccttgtgaatgta

SEQ ID NO: 213038 - DNA, 20 bp, Artificial
  CRISPR gRNA sequence
ctaaaaatcatgtgggagaa

SEQ ID NO: 213039 - DNA, 20 bp, Artificial
  CRISPR gRNA sequence
tgtatttcaagagaacctgc

SEQ ID NO: 213040 - DNA, 20 bp, Artificial
  CRISPR gRNA sequence
actgcttctcacttgtatag

SEQ ID NO: 213041 - DNA, 20 bp, Artificial
  CRISPR gRNA sequence
tgaatgatcttcctagaggg

SEQ ID NO: 213042 - DNA, 20 bp, Artificial
  CRISPR gRNA sequence
taagaatgttatgggaaaga

SEQ ID NO: 213043 - DNA, 20 bp, Artificial
  CRISPR gRNA sequence
gatgaataagaaaaattcta

SEQ ID NO: 213044 - DNA, 20 bp, Artificial
  CRISPR gRNA sequence
gggcttccttgaatgtcatg

SEQ ID NO: 213045 - DNA, 20 bp, Artificial
  CRISPR gRNA sequence
acataaacaactgtaaacca

SEQ ID NO: 213046 - DNA, 20 bp, Artificial
  CRISPR gRNA sequence
gtaggctaattatagagaaa

SEQ ID NO: 213047 - DNA, 20 bp, Artificial
  CRISPR gRNA sequence
ctagtgagatctgatgcaca

SEQ ID NO: 213048 - DNA, 20 bp, Artificial
  CRISPR gRNA sequence
gagaaatgagagagaaacaa

SEQ ID NO: 213049 - DNA, 20 bp, Artificial
  CRISPR gRNA sequence
acttaaaatatattaagtgg

SEQ ID NO: 213050 - DNA, 20 bp, Artificial
  CRISPR gRNA sequence
ggcaaggacattttggttct

SEQ ID NO: 213051 - DNA, 20 bp, Artificial
  CRISPR gRNA sequence
acattttggttcttgaggtt

SEQ ID NO: 213052 - DNA, 20 bp, Artificial
  CRISPR gRNA sequence
tcctttcgttggaaaagtga

SEQ ID NO: 213053 - DNA, 20 bp, Artificial
  CRISPR gRNA sequence
ggttatctaagatgttatag

SEQ ID NO: 213054 - DNA, 20 bp, Artificial
  CRISPR gRNA sequence
tttgccccttagaactagtg

SEQ ID NO: 213055 - DNA, 20 bp, Artificial
  CRISPR gRNA sequence
cttagaattaaaaagggcag

SEQ ID NO: 213056 - DNA, 20 bp, Artificial
  CRISPR gRNA sequence
aaatttgtctatatgccaaa

SEQ ID NO: 213057 - DNA, 20 bp, Artificial
  CRISPR gRNA sequence
atgccaaagagggctttgca

SEQ ID NO: 213058 - DNA, 20 bp, Artificial
  CRISPR gRNA sequence
ggtgtgtagtataggctcat

SEQ ID NO: 213059 - DNA, 20 bp, Artificial
  CRISPR gRNA sequence
acttgcttgaaatggaaaaa

SEQ ID NO: 213060 - DNA, 20 bp, Artificial
  CRISPR gRNA sequence
ggccttgaactagccaaacc

SEQ ID NO: 213061 - DNA, 20 bp, Artificial
  CRISPR gRNA sequence
cctaatctgaatctcaaacc

SEQ ID NO: 213062 - DNA, 20 bp, Artificial
  CRISPR gRNA sequence
aatctcaaaccatgagattg

SEQ ID NO: 213063 - DNA, 20 bp, Artificial
  CRISPR gRNA sequence
tgagtcttatgcaactgctc

SEQ ID NO: 213064 - DNA, 20 bp, Artificial
  CRISPR gRNA sequence
atgaaatattcagaggtggg

SEQ ID NO: 213065 - DNA, 20 bp, Artificial
  CRISPR gRNA sequence
aatattcagaggtgggtgta

SEQ ID NO: 213066 - DNA, 20 bp, Artificial
  CRISPR gRNA sequence
agaggtgggtgtagcttgat

SEQ ID NO: 213067 - DNA, 20 bp, Artificial
  CRISPR gRNA sequence
ataatcgtaaagaggaaaaa

SEQ ID NO: 213068 - DNA, 20 bp, Artificial
  CRISPR gRNA sequence
ttttctactttagtactaca

SEQ ID NO: 213069 - DNA, 20 bp, Artificial
  CRISPR gRNA sequence
gagataagatatgaaaatag

SEQ ID NO: 213070 - DNA, 20 bp, Artificial
  CRISPR gRNA sequence
gcagaaacctaagacaggga

SEQ ID NO: 213071 - DNA, 20 bp, Artificial
  CRISPR gRNA sequence
ttcatactatgaaatgcaaa

SEQ ID NO: 213072 - DNA, 20 bp, Artificial
  CRISPR gRNA sequence
aaatctagttttgcgaatat

SEQ ID NO: 213073 - DNA, 20 bp, Artificial
  CRISPR gRNA sequence
ttgcgaatatgcgtgattat

SEQ ID NO: 213074 - DNA, 20 bp, Artificial
  CRISPR gRNA sequence
ctaatggtaggcatttagtg

SEQ ID NO: 213075 - DNA, 20 bp, Artificial
  CRISPR gRNA sequence
attttatttaatcatatgta

SEQ ID NO: 213076 - DNA, 20 bp, Artificial
  CRISPR gRNA sequence
caacaccatcattatttatt

SEQ ID NO: 213077 - DNA, 20 bp, Artificial
  CRISPR gRNA sequence
tgcataccattaaggtgcct

SEQ ID NO: 213078 - DNA, 20 bp, Artificial
  CRISPR gRNA sequence
tagagggtgccaggaaaggt

SEQ ID NO: 213079 - DNA, 20 bp, Artificial
  CRISPR gRNA sequence
caggaaaggtccctgattcc

SEQ ID NO: 213080 - DNA, 20 bp, Artificial
  CRISPR gRNA sequence
tccatcactttcttactcat

SEQ ID NO: 213081 - DNA, 20 bp, Artificial
  CRISPR gRNA sequence
taaagtcagtctctcaaacc

SEQ ID NO: 213082 - DNA, 20 bp, Artificial
  CRISPR gRNA sequence
atattttataacaaatacta

SEQ ID NO: 213083 - DNA, 20 bp, Artificial
  CRISPR gRNA sequence
tcaactgcataatgcctgta

SEQ ID NO: 213084 - DNA, 20 bp, Artificial
  CRISPR gRNA sequence
aattctgaattcgatgactc

SEQ ID NO: 213085 - DNA, 20 bp, Artificial
  CRISPR gRNA sequence
cattccaacagttctaaact

SEQ ID NO: 213086 - DNA, 20 bp, Artificial
  CRISPR gRNA sequence
acgtgatttaaatctaacct

SEQ ID NO: 213087 - DNA, 20 bp, Artificial
  CRISPR gRNA sequence
tacctgttttaaaaatagta

SEQ ID NO: 213088 - DNA, 20 bp, Artificial
  CRISPR gRNA sequence
tttatactttttacttttta

SEQ ID NO: 213089 - DNA, 20 bp, Artificial
  CRISPR gRNA sequence
gaaggcgttctgaaattatt

SEQ ID NO: 213090 - DNA, 20 bp, Artificial
  CRISPR gRNA sequence
aaccatttagataacggaga

SEQ ID NO: 213091 - DNA, 20 bp, Artificial
  CRISPR gRNA sequence
acggcacaccgaggctaata

SEQ ID NO: 213092 - DNA, 20 bp, Artificial
  CRISPR gRNA sequence
ggcactcactgtagagctac

SEQ ID NO: 213093 - DNA, 20 bp, Artificial
  CRISPR gRNA sequence
acgaatgtttctattccttg

SEQ ID NO: 213094 - DNA, 20 bp, Artificial
  CRISPR gRNA sequence
tcagtttttacagacgaagc

SEQ ID NO: 213095 - DNA, 20 bp, Artificial
  CRISPR gRNA sequence
cacacgttttacaaaagcga

SEQ ID NO: 213096 - DNA, 20 bp, Artificial
  CRISPR gRNA sequence
accaaatcccattctgctgc

SEQ ID NO: 213097 - DNA, 20 bp, Artificial
  CRISPR gRNA sequence
tcttcctatttcaggcgaaa

SEQ ID NO: 213098 - DNA, 20 bp, Artificial
  CRISPR gRNA sequence
cgtgagggtcacgagaaagg

SEQ ID NO: 213099 - DNA, 20 bp, Artificial
  CRISPR gRNA sequence
cgagaaaggaagagtttcca

SEQ ID NO: 213100 - DNA, 20 bp, Artificial
  CRISPR gRNA sequence
agtttccagcaagcttattt

SEQ ID NO: 213101 - DNA, 20 bp, Artificial
  CRISPR gRNA sequence
acagcaaaaattacacggcc

SEQ ID NO: 213102 - DNA, 20 bp, Artificial
  CRISPR gRNA sequence
attacacggccggaagattc

SEQ ID NO: 213103 - DNA, 20 bp, Artificial
  CRISPR gRNA sequence
gttaatttttgcgcgaggtg

SEQ ID NO: 213104 - DNA, 20 bp, Artificial
  CRISPR gRNA sequence
aagggaggaagaaggggggc

SEQ ID NO: 213105 - DNA, 20 bp, Artificial
  CRISPR gRNA sequence
gccgcgcgcacgcgcgctcc

SEQ ID NO: 213106 - DNA, 20 bp, Artificial
  CRISPR gRNA sequence
gctcccagccctgcggctgc

SEQ ID NO: 213107 - DNA, 20 bp, Artificial
  CRISPR gRNA sequence
ttcgcacccctctcccttct

SEQ ID NO: 213108 - DNA, 20 bp, Artificial
  CRISPR gRNA sequence
ttttggcgaagtcggtgaga

SEQ ID NO: 213109 - DNA, 20 bp, Artificial
  CRISPR gRNA sequence
agtcggtgagaaggggtttc

SEQ ID NO: 213110 - DNA, 20 bp, Artificial
  CRISPR gRNA sequence
agaggacgtaaaggacacaa

SEQ ID NO: 213111 - DNA, 20 bp, Artificial
  CRISPR gRNA sequence
tccggccgtgtaatttttgc

SEQ ID NO: 213112 - DNA, 20 bp, Artificial
  CRISPR gRNA sequence
tgtcgtttttaatcctaaaa

SEQ ID NO: 213113 - DNA, 20 bp, Artificial
  CRISPR gRNA sequence
atacattctaaattgtacgt

SEQ ID NO: 213114 - DNA, 20 bp, Artificial
  CRISPR gRNA sequence
tttcccactttatttggggg

SEQ ID NO: 213115 - DNA, 20 bp, Artificial
  CRISPR gRNA sequence
gggaaccgttttaaaagtaa

SEQ ID NO: 213116 - DNA, 20 bp, Artificial
  CRISPR gRNA sequence
gtcaaaacatgtgcagcaga

SEQ ID NO: 213117 - DNA, 20 bp, Artificial
  CRISPR gRNA sequence
atgtgcagcagaatgggatt

SEQ ID NO: 213118 - DNA, 20 bp, Artificial
  CRISPR gRNA sequence
tccacccccccacccccacc

SEQ ID NO: 213119 - DNA, 20 bp, Artificial
  CRISPR gRNA sequence
ccccgagcttttggaatcca

SEQ ID NO: 213120 - DNA, 20 bp, Artificial
  CRISPR gRNA sequence
ccatttcgcttttgtaaaac

SEQ ID NO: 213121 - DNA, 20 bp, Artificial
  CRISPR gRNA sequence
agagccttttgtgaactttt

SEQ ID NO: 213122 - DNA, 20 bp, Artificial
  CRISPR gRNA sequence
aacttttataagattcagaa

SEQ ID NO: 213123 - DNA, 20 bp, Artificial
  CRISPR gRNA sequence
tattctagaatgctaaatta

SEQ ID NO: 213124 - DNA, 20 bp, Artificial
  CRISPR gRNA sequence
gctaaattaattcgatttta

SEQ ID NO: 213125 - DNA, 20 bp, Artificial
  CRISPR gRNA sequence
agcctcggtgtgccgttcct

SEQ ID NO: 213126 - DNA, 20 bp, Artificial
  CRISPR gRNA sequence
tttccaagatgcccttaagt

SEQ ID NO: 213127 - DNA, 20 bp, Artificial
  CRISPR gRNA sequence
gttatctaaatggttgatgt

SEQ ID NO: 213128 - DNA, 20 bp, Artificial
  CRISPR gRNA sequence
gatgttagtgtttcctgtca

SEQ ID NO: 213129 - DNA, 20 bp, Artificial
  CRISPR gRNA sequence
gtttcctgtcatcacgttta

SEQ ID NO: 213130 - DNA, 20 bp, Artificial
  CRISPR gRNA sequence
tatcattatagctaaaataa

SEQ ID NO: 213131 - DNA, 20 bp, Artificial
  CRISPR gRNA sequence
actatttttaaaacaggtag

SEQ ID NO: 213132 - DNA, 20 bp, Artificial
  CRISPR gRNA sequence
ggtaggttagatttaaatca

SEQ ID NO: 213133 - DNA, 20 bp, Artificial
  CRISPR gRNA sequence
ttggaatggtactttgagtg

SEQ ID NO: 213134 - DNA, 20 bp, Artificial
  CRISPR gRNA sequence
gttaatatcatgtaattagc

SEQ ID NO: 213135 - DNA, 20 bp, Artificial
  CRISPR gRNA sequence
aggatagtatttgttataaa

SEQ ID NO: 213136 - DNA, 20 bp, Artificial
  CRISPR gRNA sequence
gttataaaatatgtttttgt

SEQ ID NO: 213137 - DNA, 20 bp, Artificial
  CRISPR gRNA sequence
gtttttgtatgtgtttaata

SEQ ID NO: 213138 - DNA, 20 bp, Artificial
  CRISPR gRNA sequence
cacataggtagttataaacc

SEQ ID NO: 213139 - DNA, 20 bp, Artificial
  CRISPR gRNA sequence
atctgtacattcatttgtat

SEQ ID NO: 213140 - DNA, 20 bp, Artificial
  CRISPR gRNA sequence
gtacattcatttgtattgaa

SEQ ID NO: 213141 - DNA, 20 bp, Artificial
  CRISPR gRNA sequence
tcatttgtattgaagtttga

SEQ ID NO: 213142 - DNA, 20 bp, Artificial
  CRISPR gRNA sequence
tattgaagtttgattttgct

SEQ ID NO: 213143 - DNA, 20 bp, Artificial
  CRISPR gRNA sequence
cccactcatgtacaattata

SEQ ID NO: 213144 - DNA, 20 bp, Artificial
  CRISPR gRNA sequence
ttatactttgtttaaaagtg

SEQ ID NO: 213145 - DNA, 20 bp, Artificial
  CRISPR gRNA sequence
gaactgtcttttcagtggtt

SEQ ID NO: 213146 - DNA, 20 bp, Artificial
  CRISPR gRNA sequence
attcctctttgttcaaaatg

SEQ ID NO: 213147 - DNA, 20 bp, Artificial
  CRISPR gRNA sequence
ttttttttaaatcagggtac

SEQ ID NO: 213148 - DNA, 20 bp, Artificial
  CRISPR gRNA sequence
tcgtctaagtctagtagtaa

SEQ ID NO: 213149 - DNA, 20 bp, Artificial
  CRISPR gRNA sequence
ctaagtctagtagtaatttg

SEQ ID NO: 213150 - DNA, 20 bp, Artificial
  CRISPR gRNA sequence
aatttggcttgtttaaataa

SEQ ID NO: 213151 - DNA, 20 bp, Artificial
  CRISPR gRNA sequence
ccgccccagcagtctagagg

SEQ ID NO: 213152 - DNA, 20 bp, Artificial
  CRISPR gRNA sequence
acacttgctcatgctgtcat

SEQ ID NO: 213153 - DNA, 20 bp, Artificial
  CRISPR gRNA sequence
gctgtcatctgtgttttggc

SEQ ID NO: 213154 - DNA, 20 bp, Artificial
  CRISPR gRNA sequence
ctttgtcactgagttgttca

SEQ ID NO: 213155 - DNA, 20 bp, Artificial
  CRISPR gRNA sequence
taatcacgcatattcgcaaa

SEQ ID NO: 213156 - DNA, 20 bp, Artificial
  CRISPR gRNA sequence
agctatagctagtatatagg

SEQ ID NO: 213157 - DNA, 20 bp, Artificial
  CRISPR gRNA sequence
tttcaatcactttccctgtc

SEQ ID NO: 213158 - DNA, 20 bp, Artificial
  CRISPR gRNA sequence
ttttcatatcttatctctca

SEQ ID NO: 213159 - DNA, 20 bp, Artificial
  CRISPR gRNA sequence
aacaagaataatagtgtagg

SEQ ID NO: 213160 - DNA, 20 bp, Artificial
  CRISPR gRNA sequence
aaatacagagcacccaggaa

SEQ ID NO: 213161 - DNA, 20 bp, Artificial
  CRISPR gRNA sequence
ctagactaagacaatagaat

SEQ ID NO: 213162 - DNA, 20 bp, Artificial
  CRISPR gRNA sequence
agaatctgggtttttcctct

SEQ ID NO: 213163 - DNA, 20 bp, Artificial
  CRISPR gRNA sequence
actcagaatctggtcaatct

SEQ ID NO: 213164 - DNA, 20 bp, Artificial
  CRISPR gRNA sequence
aatctggtcaatctcatggt

SEQ ID NO: 213165 - DNA, 20 bp, Artificial
  CRISPR gRNA sequence
gtcaatctcatggtttgaga

SEQ ID NO: 213166 - DNA, 20 bp, Artificial
  CRISPR gRNA sequence
gtaggttaaaaggtaaagca

SEQ ID NO: 213167 - DNA, 20 bp, Artificial
  CRISPR gRNA sequence
tgagcctatactacacacca

SEQ ID NO: 213168 - DNA, 20 bp, Artificial
  CRISPR gRNA sequence
gtatatagacagtagggata

SEQ ID NO: 213169 - DNA, 20 bp, Artificial
  CRISPR gRNA sequence
tttattccctcatggtactt

SEQ ID NO: 213170 - DNA, 20 bp, Artificial
  CRISPR gRNA sequence
ggccacttttaaattcatta

SEQ ID NO: 213171 - DNA, 20 bp, Artificial
  CRISPR gRNA sequence
gttctaaggggcaaaagtag

SEQ ID NO: 213172 - DNA, 20 bp, Artificial
  CRISPR gRNA sequence
taaggggcaaaagtaggtag

SEQ ID NO: 213173 - DNA, 20 bp, Artificial
  CRISPR gRNA sequence
catgtgtctttactgatgat

SEQ ID NO: 213174 - DNA, 20 bp, Artificial
  CRISPR gRNA sequence
tactgcaaaaaatagtggtg

SEQ ID NO: 213175 - DNA, 20 bp, Artificial
  CRISPR gRNA sequence
tggtgtgtggtttggactcc

SEQ ID NO: 213176 - DNA, 20 bp, Artificial
  CRISPR gRNA sequence
cgtctcattctcttccgtca

SEQ ID NO: 213177 - DNA, 20 bp, Artificial
  CRISPR gRNA sequence
ctctccattgactccttccc

SEQ ID NO: 213178 - DNA, 20 bp, Artificial
  CRISPR gRNA sequence
acattgtcagttgttgcctt

SEQ ID NO: 213179 - DNA, 20 bp, Artificial
  CRISPR gRNA sequence
actgccacttaatatatttt

SEQ ID NO: 213180 - DNA, 20 bp, Artificial
  CRISPR gRNA sequence
ttaagtgcttgataaagcca

SEQ ID NO: 213181 - DNA, 20 bp, Artificial
  CRISPR gRNA sequence
aattttcccctctttatctc

SEQ ID NO: 213182 - DNA, 20 bp, Artificial
  CRISPR gRNA sequence
tgcttcccacaactaacttc

SEQ ID NO: 213183 - DNA, 20 bp, Artificial
  CRISPR gRNA sequence
actaacttctgttgattact

SEQ ID NO: 213184 - DNA, 20 bp, Artificial
  CRISPR gRNA sequence
tccttcctttacactgctgt

SEQ ID NO: 213185 - DNA, 20 bp, Artificial
  CRISPR gRNA sequence
ttttaatgaaattaaatctg

SEQ ID NO: 213186 - DNA, 20 bp, Artificial
  CRISPR gRNA sequence
attaaatctgagtggtttac

SEQ ID NO: 213187 - DNA, 20 bp, Artificial
  CRISPR gRNA sequence
tagagctcacctaaataatt

SEQ ID NO: 213188 - DNA, 20 bp, Artificial
  CRISPR gRNA sequence
ttcttactcatcctttaaga

SEQ ID NO: 213189 - DNA, 20 bp, Artificial
  CRISPR gRNA sequence
gatcattcatagacacattc

SEQ ID NO: 213190 - DNA, 20 bp, Artificial
  CRISPR gRNA sequence
tatccaaccatacaagtgac

SEQ ID NO: 213191 - DNA, 20 bp, Artificial
  CRISPR gRNA sequence
tgagattttccatgaaaata

SEQ ID NO: 213192 - DNA, 20 bp, Artificial
  CRISPR gRNA sequence
ttccatgaaaatatgcagct

SEQ ID NO: 213193 - DNA, 20 bp, Artificial
  CRISPR gRNA sequence
agaaaaatctatcttctccc

SEQ ID NO: 213194 - DNA, 20 bp, Artificial
  CRISPR gRNA sequence
ctatcttctcccacatgatt

SEQ ID NO: 213195 - DNA, 20 bp, Artificial
  CRISPR gRNA sequence
tcctactttctggaccctgt

SEQ ID NO: 213196 - DNA, 20 bp, Artificial
  CRISPR gRNA sequence
agtaatggtagggaagggga

SEQ ID NO: 213197 - DNA, 20 bp, Artificial
  CRISPR gRNA sequence
aacaagattgaacaactcaa

SEQ ID NO: 213198 - DNA, 20 bp, Artificial
  CRISPR gRNA sequence
tataacagttaagaggctat

SEQ ID NO: 213199 - DNA, 20 bp, Artificial
  CRISPR gRNA sequence
atggaattgcaataacgtca

SEQ ID NO: 213200 - DNA, 20 bp, Artificial
  CRISPR gRNA sequence
tgcaataacgtcattatgat

SEQ ID NO: 213201 - DNA, 20 bp, Artificial
  CRISPR gRNA sequence
ctggaaaggatcttgaagga

SEQ ID NO: 213202 - DNA, 20 bp, Artificial
  CRISPR gRNA sequence
aattcattcattcaacagac

SEQ ID NO: 213203 - DNA, 20 bp, Artificial
  CRISPR gRNA sequence
taaggagagggagtaatcta

SEQ ID NO: 213204 - DNA, 20 bp, Artificial
  CRISPR gRNA sequence
tgatagaaaatactttagca

SEQ ID NO: 213205 - DNA, 20 bp, Artificial
  CRISPR gRNA sequence
agggtaagaagtgggggtac

SEQ ID NO: 213206 - DNA, 20 bp, Artificial
  CRISPR gRNA sequence
acagttggctgtccaacatc

SEQ ID NO: 213207 - DNA, 20 bp, Artificial
  CRISPR gRNA sequence
cagtttagaagaaaggcagt

SEQ ID NO: 213208 - DNA, 20 bp, Artificial
  CRISPR gRNA sequence
agaagaaaggcagtgcatga

SEQ ID NO: 213209 - DNA, 20 bp, Artificial
  CRISPR gRNA sequence
catgattcagttttttattt

SEQ ID NO: 213210 - DNA, 20 bp, Artificial
  CRISPR gRNA sequence
acatttagtgtgagtcaagg

SEQ ID NO: 213211 - DNA, 20 bp, Artificial
  CRISPR gRNA sequence
acagaaagtgaaccatgcat

SEQ ID NO: 213212 - DNA, 20 bp, Artificial
  CRISPR gRNA sequence
atgcatatttgatttttcac

SEQ ID NO: 213213 - DNA, 20 bp, Artificial
  CRISPR gRNA sequence
tgaatgggtggaggccacgt

SEQ ID NO: 213214 - DNA, 20 bp, Artificial
  CRISPR gRNA sequence
ggagtgaattggaagtgagg

SEQ ID NO: 213215 - DNA, 20 bp, Artificial
  CRISPR gRNA sequence
attggaagtgaggaaatgct

SEQ ID NO: 213216 - DNA, 20 bp, Artificial
  CRISPR gRNA sequence
gctagggagagagaaagtat

SEQ ID NO: 213217 - DNA, 20 bp, Artificial
  CRISPR gRNA sequence
gtatggaggcagaaatggaa

SEQ ID NO: 213218 - DNA, 20 bp, Artificial
  CRISPR gRNA sequence
tggaaactagctttcaggtg

SEQ ID NO: 213219 - DNA, 20 bp, Artificial
  CRISPR gRNA sequence
gtggatagttggggttacag

SEQ ID NO: 213220 - DNA, 20 bp, Artificial
  CRISPR gRNA sequence
gtttatagggaaggagtatt

SEQ ID NO: 213221 - DNA, 20 bp, Artificial
  CRISPR gRNA sequence
gggaaggagtattggaagct

SEQ ID NO: 213222 - DNA, 20 bp, Artificial
  CRISPR gRNA sequence
aagcttcaggattctcctct

SEQ ID NO: 213223 - DNA, 20 bp, Artificial
  CRISPR gRNA sequence
caggattctcctctgaaggt

SEQ ID NO: 213224 - DNA, 20 bp, Artificial
  CRISPR gRNA sequence
acatgaaatatgtaaaatgg

SEQ ID NO: 213225 - DNA, 20 bp, Artificial
  CRISPR gRNA sequence
gagcagggactatgacattc

SEQ ID NO: 213226 - DNA, 20 bp, Artificial
  CRISPR gRNA sequence
cacaggtaattcttgacaaa

SEQ ID NO: 213227 - DNA, 20 bp, Artificial
  CRISPR gRNA sequence
aacttgtgtgctgtgaccac

SEQ ID NO: 213228 - DNA, 20 bp, Artificial
  CRISPR gRNA sequence
ttttctagactatgatatga

SEQ ID NO: 213229 - DNA, 20 bp, Artificial
  CRISPR gRNA sequence
aatacttgtacagttccaat

SEQ ID NO: 213230 - DNA, 20 bp, Artificial
  CRISPR gRNA sequence
ggttacatttgtctgctgct

SEQ ID NO: 213231 - DNA, 20 bp, Artificial
  CRISPR gRNA sequence
tttagactgctataagcata

SEQ ID NO: 213232 - DNA, 20 bp, Artificial
  CRISPR gRNA sequence
ataagcatatcttgtttatt

SEQ ID NO: 213233 - DNA, 20 bp, Artificial
  CRISPR gRNA sequence
ttcttattcatgttaattat

SEQ ID NO: 213234 - DNA, 20 bp, Artificial
  CRISPR gRNA sequence
tatttgctctctacatttta

SEQ ID NO: 213235 - DNA, 20 bp, Artificial
  CRISPR gRNA sequence
tttaaatagtttcttcactt

SEQ ID NO: 213236 - DNA, 20 bp, Artificial
  CRISPR gRNA sequence
aaggaaaaaaccccaaatca

SEQ ID NO: 213237 - DNA, 20 bp, Artificial
  CRISPR gRNA sequence
atcagacagttttactactt

SEQ ID NO: 213238 - DNA, 20 bp, Artificial
  CRISPR gRNA sequence
agttttttaatgcatcttta

SEQ ID NO: 213239 - DNA, 20 bp, Artificial
  CRISPR gRNA sequence
agtgcaaaggttattcaaat

SEQ ID NO: 213240 - DNA, 20 bp, Artificial
  CRISPR gRNA sequence
aatagcatttattctactta

SEQ ID NO: 213241 - DNA, 20 bp, Artificial
  CRISPR gRNA sequence
cttaaattgcttcagctata

SEQ ID NO: 213242 - DNA, 20 bp, Artificial
  CRISPR gRNA sequence
aacaaataatgcagtataat

SEQ ID NO: 213243 - DNA, 20 bp, Artificial
  CRISPR gRNA sequence
ctaaacatatgttatgaaat

SEQ ID NO: 213244 - DNA, 20 bp, Artificial
  CRISPR gRNA sequence
acttaattaaagcctttgca

SEQ ID NO: 213245 - DNA, 20 bp, Artificial
  CRISPR gRNA sequence
ataatctcttgaaagtcaaa

SEQ ID NO: 213246 - DNA, 20 bp, Artificial
  CRISPR gRNA sequence
aatataaaatgaacatgtgt

SEQ ID NO: 213247 - DNA, 20 bp, Artificial
  CRISPR gRNA sequence
aggtggaaatcaattgcaga

SEQ ID NO: 213248 - DNA, 20 bp, Artificial
  CRISPR gRNA sequence
agcaatccatttgaattact

SEQ ID NO: 213249 - DNA, 20 bp, Artificial
  CRISPR gRNA sequence
agtcaaagtcagtgaaaggc

SEQ ID NO: 213250 - DNA, 20 bp, Artificial
  CRISPR gRNA sequence
atactatgtcctctctccct

SEQ ID NO: 213251 - DNA, 20 bp, Artificial
  CRISPR gRNA sequence
ggggaaataattcacaattc

SEQ ID NO: 213252 - DNA, 20 bp, Artificial
  CRISPR gRNA sequence
ttaaagaatgcaacggaagt

SEQ ID NO: 213253 - DNA, 20 bp, Artificial
  CRISPR gRNA sequence
acggaagtccaggttttgcc

SEQ ID NO: 213254 - DNA, 20 bp, Artificial
  CRISPR gRNA sequence
ccatatcattacattaaaat

SEQ ID NO: 213255 - DNA, 20 bp, Artificial
  CRISPR gRNA sequence
tacattaaaatgccagatta

SEQ ID NO: 213256 - DNA, 20 bp, Artificial
  CRISPR gRNA sequence
cctacatttttacagcatag

SEQ ID NO: 213257 - DNA, 20 bp, Artificial
  CRISPR gRNA sequence
tgtttagagagcacttgccg

SEQ ID NO: 213258 - DNA, 20 bp, Artificial
  CRISPR gRNA sequence
cacagttctgtgaagtagcc

SEQ ID NO: 213259 - DNA, 20 bp, Artificial
  CRISPR gRNA sequence
gttctgtgaagtagcccggt

SEQ ID NO: 213260 - DNA, 20 bp, Artificial
  CRISPR gRNA sequence
aaccaaggcatagaaaagtg

SEQ ID NO: 213261 - DNA, 20 bp, Artificial
  CRISPR gRNA sequence
cagaaatagtatttttactc

SEQ ID NO: 213262 - DNA, 20 bp, Artificial
  CRISPR gRNA sequence
acaatagaaacattctatgc

SEQ ID NO: 213263 - DNA, 20 bp, Artificial
  CRISPR gRNA sequence
tctatgcctctgatttttat

SEQ ID NO: 213264 - DNA, 20 bp, Artificial
  CRISPR gRNA sequence
tatttatatttgttagtaat

SEQ ID NO: 213265 - DNA, 20 bp, Artificial
  CRISPR gRNA sequence
atatttgttagtaatttgtg

SEQ ID NO: 213266 - DNA, 20 bp, Artificial
  CRISPR gRNA sequence
gttagtaatttgtgttttgt

SEQ ID NO: 213267 - DNA, 20 bp, Artificial
  CRISPR gRNA sequence
aatttgtgttttgtttttgt

SEQ ID NO: 213268 - DNA, 20 bp, Artificial
  CRISPR gRNA sequence
gtacattttagttgaacaat

SEQ ID NO: 213269 - DNA, 20 bp, Artificial
  CRISPR gRNA sequence
tcttctataaggcaacaact

SEQ ID NO: 213270 - DNA, 20 bp, Artificial
  CRISPR gRNA sequence
cctattgagaagcgtagata

SEQ ID NO: 213271 - DNA, 20 bp, Artificial
  CRISPR gRNA sequence
gcttattagcagtaactgct

SEQ ID NO: 213272 - DNA, 20 bp, Artificial
  CRISPR gRNA sequence
tggtttcaacttgcatctta

SEQ ID NO: 213273 - DNA, 20 bp, Artificial
  CRISPR gRNA sequence
tgcatcttacttagcttttt

SEQ ID NO: 213274 - DNA, 20 bp, Artificial
  CRISPR gRNA sequence
acttagctttttcaccgttt

SEQ ID NO: 213275 - DNA, 20 bp, Artificial
  CRISPR gRNA sequence
tatgggaaagtagccacaga

SEQ ID NO: 213276 - DNA, 20 bp, Artificial
  CRISPR gRNA sequence
tttttttcctcattagtatt

SEQ ID NO: 213277 - DNA, 20 bp, Artificial
  CRISPR gRNA sequence
ttttccatcctagtggaaag

SEQ ID NO: 213278 - DNA, 20 bp, Artificial
  CRISPR gRNA sequence
catcctagtggaaagatatg

SEQ ID NO: 213279 - DNA, 20 bp, Artificial
  CRISPR gRNA sequence
agttgagactgaataaaata

SEQ ID NO: 213280 - DNA, 20 bp, Artificial
  CRISPR gRNA sequence
agactgaataaaatatttgg

SEQ ID NO: 213281 - DNA, 20 bp, Artificial
  CRISPR gRNA sequence
ctacatatatcagtaggcag

SEQ ID NO: 213282 - DNA, 20 bp, Artificial
  CRISPR gRNA sequence
gtaggcagtaatgattactt

SEQ ID NO: 213283 - DNA, 20 bp, Artificial
  CRISPR gRNA sequence
caagttaatattaaaatata

SEQ ID NO: 213284 - DNA, 20 bp, Artificial
  CRISPR gRNA sequence
ataggtcttcttcattgcta

SEQ ID NO: 213285 - DNA, 20 bp, Artificial
  CRISPR gRNA sequence
taagtgaacaatggaaatgt

SEQ ID NO: 213286 - DNA, 20 bp, Artificial
  CRISPR gRNA sequence
ggaaatgttgctgtttatct

SEQ ID NO: 213287 - DNA, 20 bp, Artificial
  CRISPR gRNA sequence
taaaacaaaatctgtagaat

SEQ ID NO: 213288 - DNA, 20 bp, Artificial
  CRISPR gRNA sequence
gtaatgacactgtcgtcatt

SEQ ID NO: 213289 - DNA, 20 bp, Artificial
  CRISPR gRNA sequence
cgtgttggtaagacttctat

SEQ ID NO: 213290 - DNA, 20 bp, Artificial
  CRISPR gRNA sequence
gttattaataaatgttgatg

SEQ ID NO: 213291 - DNA, 20 bp, Artificial
  CRISPR gRNA sequence
aaatgttgatgtaatgttta

SEQ ID NO: 213292 - DNA, 20 bp, Artificial
  CRISPR gRNA sequence
tgatgtaatgtttagcaagt

SEQ ID NO: 213293 - DNA, 20 bp, Artificial
  CRISPR gRNA sequence
aatgtttagcaagtttaaga

SEQ ID NO: 213294 - DNA, 20 bp, Artificial
  CRISPR gRNA sequence
gtctaaggaccattttattt

SEQ ID NO: 213295 - DNA, 20 bp, Artificial
  CRISPR gRNA sequence
tggggtaatgtactcttcat

SEQ ID NO: 213296 - DNA, 20 bp, Artificial
  CRISPR gRNA sequence
atttctgtttgctgccatcc

SEQ ID NO: 213297 - DNA, 20 bp, Artificial
  CRISPR gRNA sequence
ctctttccaattattcagcc

SEQ ID NO: 213298 - DNA, 20 bp, Artificial
  CRISPR gRNA sequence
attattcagccttctgtttt

SEQ ID NO: 213299 - DNA, 20 bp, Artificial
  CRISPR gRNA sequence
ggagagaatagaggagagtc

SEQ ID NO: 213300 - DNA, 20 bp, Artificial
  CRISPR gRNA sequence
agattaaatcacgttatcat

SEQ ID NO: 213301 - DNA, 20 bp, Artificial
  CRISPR gRNA sequence
acgttatcatggatgatttc

SEQ ID NO: 213302 - DNA, 20 bp, Artificial
  CRISPR gRNA sequence
ggatgatttcttcagatttt

SEQ ID NO: 213303 - DNA, 20 bp, Artificial
  CRISPR gRNA sequence
tggccaaaatatgagagaac

SEQ ID NO: 213304 - DNA, 20 bp, Artificial
  CRISPR gRNA sequence
attcagacttgatgatagca

SEQ ID NO: 213305 - DNA, 20 bp, Artificial
  CRISPR gRNA sequence
agtaaatagtctcctctcct

SEQ ID NO: 213306 - DNA, 20 bp, Artificial
  CRISPR gRNA sequence
accccatatgagtatgttct

SEQ ID NO: 213307 - DNA, 20 bp, Artificial
  CRISPR gRNA sequence
ttacctgtcatattaccgat

SEQ ID NO: 213308 - DNA, 20 bp, Artificial
  CRISPR gRNA sequence
tcagttggatcaactatttg

SEQ ID NO: 213309 - DNA, 20 bp, Artificial
  CRISPR gRNA sequence
cttttataaaataatctact

SEQ ID NO: 213310 - DNA, 20 bp, Artificial
  CRISPR gRNA sequence
ctactaccagattaggaatg

SEQ ID NO: 213311 - DNA, 20 bp, Artificial
  CRISPR gRNA sequence
accagattaggaatggggtg

SEQ ID NO: 213312 - DNA, 20 bp, Artificial
  CRISPR gRNA sequence
atggggtgtttggtttgatg

SEQ ID NO: 213313 - DNA, 20 bp, Artificial
  CRISPR gRNA sequence
atgaaatgtttgcacattac

SEQ ID NO: 213314 - DNA, 20 bp, Artificial
  CRISPR gRNA sequence
tcacctgtgtgatcttgaga

SEQ ID NO: 213315 - DNA, 20 bp, Artificial
  CRISPR gRNA sequence
aaatggagatgacaatagat

SEQ ID NO: 213316 - DNA, 20 bp, Artificial
  CRISPR gRNA sequence
caaagtgtgttgtaaatgtt

SEQ ID NO: 213317 - DNA, 20 bp, Artificial
  CRISPR gRNA sequence
aaatgttagttgttttcctg

SEQ ID NO: 213318 - DNA, 20 bp, Artificial
  CRISPR gRNA sequence
gttagcctagagcattgtga

SEQ ID NO: 213319 - DNA, 20 bp, Artificial
  CRISPR gRNA sequence
ctcagaaatctctcttacat

SEQ ID NO: 213320 - DNA, 20 bp, Artificial
  CRISPR gRNA sequence
attgatattaatttgggcaa

SEQ ID NO: 213321 - DNA, 20 bp, Artificial
  CRISPR gRNA sequence
taaactggaaaactcaaaat

SEQ ID NO: 213322 - DNA, 20 bp, Artificial
  CRISPR gRNA sequence
atgccaggatctgagataaa

SEQ ID NO: 213323 - DNA, 20 bp, Artificial
  CRISPR gRNA sequence
aaaacagtttattattttgc

SEQ ID NO: 213324 - DNA, 20 bp, Artificial
  CRISPR gRNA sequence
tattttgcgtgtgattgaaa

SEQ ID NO: 213325 - DNA, 20 bp, Artificial
  CRISPR gRNA sequence
tgattgaaagactgttttat

SEQ ID NO: 213326 - DNA, 20 bp, Artificial
  CRISPR gRNA sequence
gagccattaaaaggagaaag

SEQ ID NO: 213327 - DNA, 20 bp, Artificial
  CRISPR gRNA sequence
agaatgtagaaaattctacc

SEQ ID NO: 213328 - DNA, 20 bp, Artificial
  CRISPR gRNA sequence
tctaccagaggtttgagaca

SEQ ID NO: 213329 - DNA, 20 bp, Artificial
  CRISPR gRNA sequence
ttttaattttttgaaataat

SEQ ID NO: 213330 - DNA, 20 bp, Artificial
  CRISPR gRNA sequence
gaaataattattgatttaca

SEQ ID NO: 213331 - DNA, 20 bp, Artificial
  CRISPR gRNA sequence
tacaggacgattcaaagata

SEQ ID NO: 213332 - DNA, 20 bp, Artificial
  CRISPR gRNA sequence
gcccttcacccagtcccccc

SEQ ID NO: 213333 - DNA, 20 bp, Artificial
  CRISPR gRNA sequence
tggttcgctctcattttatc

SEQ ID NO: 213334 - DNA, 20 bp, Artificial
  CRISPR gRNA sequence
catcataacaaacatctccc

SEQ ID NO: 213335 - DNA, 20 bp, Artificial
  CRISPR gRNA sequence
acaagatgtgaccttttgag

SEQ ID NO: 213336 - DNA, 20 bp, Artificial
  CRISPR gRNA sequence
acaatgcccttgagatctat

SEQ ID NO: 213337 - DNA, 20 bp, Artificial
  CRISPR gRNA sequence
agtccatagtatgaatatat

SEQ ID NO: 213338 - DNA, 20 bp, Artificial
  CRISPR gRNA sequence
catagtatgaatatatcaca

SEQ ID NO: 213339 - DNA, 20 bp, Artificial
  CRISPR gRNA sequence
tacctatagtaggacatttt

SEQ ID NO: 213340 - DNA, 20 bp, Artificial
  CRISPR gRNA sequence
gtaggacattttggttgttt

SEQ ID NO: 213341 - DNA, 20 bp, Artificial
  CRISPR gRNA sequence
tgtacaggttcttgtgtaga

SEQ ID NO: 213342 - DNA, 20 bp, Artificial
  CRISPR gRNA sequence
tactgggctgtatggtaagt

SEQ ID NO: 213343 - DNA, 20 bp, Artificial
  CRISPR gRNA sequence
ggctgtatggtaagtatatg

SEQ ID NO: 213344 - DNA, 20 bp, Artificial
  CRISPR gRNA sequence
catcaacaatgtaagagtga

SEQ ID NO: 213345 - DNA, 20 bp, Artificial
  CRISPR gRNA sequence
tacttacttgtcacggactt

SEQ ID NO: 213346 - DNA, 20 bp, Artificial
  CRISPR gRNA sequence
tagaaaccatttttactatg

SEQ ID NO: 213347 - DNA, 20 bp, Artificial
  CRISPR gRNA sequence
tacatggaaacactataaga

SEQ ID NO: 213348 - DNA, 20 bp, Artificial
  CRISPR gRNA sequence
cactggacttgaaattagaa

SEQ ID NO: 213349 - DNA, 20 bp, Artificial
  CRISPR gRNA sequence
gaaagctgttttctagactt

SEQ ID NO: 213350 - DNA, 20 bp, Artificial
  CRISPR gRNA sequence
ttttctagacttcactgttt

SEQ ID NO: 213351 - DNA, 20 bp, Artificial
  CRISPR gRNA sequence
agatggcatcaccatcatgg

SEQ ID NO: 213352 - DNA, 20 bp, Artificial
  CRISPR gRNA sequence
ccagtcaccgtactaggcat

SEQ ID NO: 213353 - DNA, 20 bp, Artificial
  CRISPR gRNA sequence
tgtgatgaataagacattat

SEQ ID NO: 213354 - DNA, 20 bp, Artificial
  CRISPR gRNA sequence
tttaacaaatagggaagcaa

SEQ ID NO: 213355 - DNA, 20 bp, Artificial
  CRISPR gRNA sequence
aatacaaaaacttgaaaact

SEQ ID NO: 213356 - DNA, 20 bp, Artificial
  CRISPR gRNA sequence
tttatttttctctaagctat

SEQ ID NO: 213357 - DNA, 20 bp, Artificial
  CRISPR gRNA sequence
ttttctctaagctattagag

SEQ ID NO: 213358 - DNA, 20 bp, Artificial
  CRISPR gRNA sequence
tattatcaacaggacatatg

SEQ ID NO: 213359 - DNA, 20 bp, Artificial
  CRISPR gRNA sequence
aggcattgcaagatctttgt

SEQ ID NO: 213360 - DNA, 20 bp, Artificial
  CRISPR gRNA sequence
tgcataacaactacaaatat

SEQ ID NO: 213361 - DNA, 20 bp, Artificial
  CRISPR gRNA sequence
acactacccattttttagct

SEQ ID NO: 213362 - DNA, 20 bp, Artificial
  CRISPR gRNA sequence
tgcccagggcatactttatt

SEQ ID NO: 213363 - DNA, 20 bp, Artificial
  CRISPR gRNA sequence
ttgtgacagaattcaattcc

SEQ ID NO: 213364 - DNA, 20 bp, Artificial
  CRISPR gRNA sequence
tgtgattgtaagactggggt

SEQ ID NO: 213365 - DNA, 20 bp, Artificial
  CRISPR gRNA sequence
caaggaattgtagcagctcc

SEQ ID NO: 213366 - DNA, 20 bp, Artificial
  CRISPR gRNA sequence
tgttgaatccctctcacata

SEQ ID NO: 213367 - DNA, 20 bp, Artificial
  CRISPR gRNA sequence
aatctctctttcttaaagtc

SEQ ID NO: 213368 - DNA, 20 bp, Artificial
  CRISPR gRNA sequence
aaaagatgcatggctagggc

SEQ ID NO: 213369 - DNA, 20 bp, Artificial
  CRISPR gRNA sequence
tttgggaccaccttagaatt

SEQ ID NO: 213370 - DNA, 20 bp, Artificial
  CRISPR gRNA sequence
ggaccaccttagaattctgg

SEQ ID NO: 213371 - DNA, 20 bp, Artificial
  CRISPR gRNA sequence
cctgaaacatcaagtaaaaa

SEQ ID NO: 213372 - DNA, 20 bp, Artificial
  CRISPR gRNA sequence
gtaaaaatttggtttgcatt

SEQ ID NO: 213373 - DNA, 20 bp, Artificial
  CRISPR gRNA sequence
tgtgtgtaacctggtgttcc

SEQ ID NO: 213374 - DNA, 20 bp, Artificial
  CRISPR gRNA sequence
ctggtgttccctatgtttgt

SEQ ID NO: 213375 - DNA, 20 bp, Artificial
  CRISPR gRNA sequence
gtgataagacaaatgaggtc

SEQ ID NO: 213376 - DNA, 20 bp, Artificial
  CRISPR gRNA sequence
gtcctgggttttaataacac

SEQ ID NO: 213377 - DNA, 20 bp, Artificial
  CRISPR gRNA sequence
tgatagacacagttgtcagc

SEQ ID NO: 213378 - DNA, 20 bp, Artificial
  CRISPR gRNA sequence
agaataaggatgtgaatgtc

SEQ ID NO: 213379 - DNA, 20 bp, Artificial
  CRISPR gRNA sequence
gacattgttcttagtccatt

SEQ ID NO: 213380 - DNA, 20 bp, Artificial
  CRISPR gRNA sequence
cagtactaccataacaaatc

SEQ ID NO: 213381 - DNA, 20 bp, Artificial
  CRISPR gRNA sequence
aatagcttaataggcatata

SEQ ID NO: 213382 - DNA, 20 bp, Artificial
  CRISPR gRNA sequence
taagtggctttatataaaat

SEQ ID NO: 213383 - DNA, 20 bp, Artificial
  CRISPR gRNA sequence
aatacagcagaaatgtgcag

SEQ ID NO: 213384 - DNA, 20 bp, Artificial
  CRISPR gRNA sequence
ttgggaggctgagacaggag

SEQ ID NO: 213385 - DNA, 20 bp, Artificial
  CRISPR gRNA sequence
tcattgaaatgtctcatatt

SEQ ID NO: 213386 - DNA, 20 bp, Artificial
  CRISPR gRNA sequence
tctatcacaccccaagtagc

SEQ ID NO: 213387 - DNA, 20 bp, Artificial
  CRISPR gRNA sequence
acaccccaagtagctggcga

SEQ ID NO: 213388 - DNA, 20 bp, Artificial
  CRISPR gRNA sequence
ggcgattcagattttttact

SEQ ID NO: 213389 - DNA, 20 bp, Artificial
  CRISPR gRNA sequence
ggagggctgtagtatttctc

SEQ ID NO: 213390 - DNA, 20 bp, Artificial
  CRISPR gRNA sequence
ctgttcttttagccattgct

SEQ ID NO: 213391 - DNA, 20 bp, Artificial
  CRISPR gRNA sequence
gagtaaaactgagctcagga

SEQ ID NO: 213392 - DNA, 20 bp, Artificial
  CRISPR gRNA sequence
tgctgtaactttctgacagg

SEQ ID NO: 213393 - DNA, 20 bp, Artificial
  CRISPR gRNA sequence
attctccatgtggctgccaa

SEQ ID NO: 213394 - DNA, 20 bp, Artificial
  CRISPR gRNA sequence
ttccctatttaaagccttcc

SEQ ID NO: 213395 - DNA, 20 bp, Artificial
  CRISPR gRNA sequence
ataaaatccaaactctccca

SEQ ID NO: 213396 - DNA, 20 bp, Artificial
  CRISPR gRNA sequence
tccagtcacaatggccatcc

SEQ ID NO: 213397 - DNA, 20 bp, Artificial
  CRISPR gRNA sequence
aatgtaggctccttcccatc

SEQ ID NO: 213398 - DNA, 20 bp, Artificial
  CRISPR gRNA sequence
aggctccttcccatcctagg

SEQ ID NO: 213399 - DNA, 20 bp, Artificial
  CRISPR gRNA sequence
tagaggcctttccttactgc

SEQ ID NO: 213400 - DNA, 20 bp, Artificial
  CRISPR gRNA sequence
tagaggagttcctccccatg

SEQ ID NO: 213401 - DNA, 20 bp, Artificial
  CRISPR gRNA sequence
ccccatggtgggctttcaat

SEQ ID NO: 213402 - DNA, 20 bp, Artificial
  CRISPR gRNA sequence
atattttgaaggtagagtca

SEQ ID NO: 213403 - DNA, 20 bp, Artificial
  CRISPR gRNA sequence
aaggtagagtcagcaggatt

SEQ ID NO: 213404 - DNA, 20 bp, Artificial
  CRISPR gRNA sequence
cagggagtcaggtataactc

SEQ ID NO: 213405 - DNA, 20 bp, Artificial
  CRISPR gRNA sequence
gaaatgaggaaaatgagagg

SEQ ID NO: 213406 - DNA, 20 bp, Artificial
  CRISPR gRNA sequence
gggatggggtgatgaaaata

SEQ ID NO: 213407 - DNA, 20 bp, Artificial
  CRISPR gRNA sequence
tcattgtggaacatgaacag

SEQ ID NO: 213408 - DNA, 20 bp, Artificial
  CRISPR gRNA sequence
agagcctgaattcactgttc

SEQ ID NO: 213409 - DNA, 20 bp, Artificial
  CRISPR gRNA sequence
aatttctcacatcataattg

SEQ ID NO: 213410 - DNA, 20 bp, Artificial
  CRISPR gRNA sequence
tacagccttaccaaatccat

SEQ ID NO: 213411 - DNA, 20 bp, Artificial
  CRISPR gRNA sequence
tctccaaaattttttcctgg

SEQ ID NO: 213412 - DNA, 20 bp, Artificial
  CRISPR gRNA sequence
tatacagttggaaataaagg

SEQ ID NO: 213413 - DNA, 20 bp, Artificial
  CRISPR gRNA sequence
tactacatatagaggaaaat

SEQ ID NO: 213414 - DNA, 20 bp, Artificial
  CRISPR gRNA sequence
aaaagctaatatctataaaa

SEQ ID NO: 213415 - DNA, 20 bp, Artificial
  CRISPR gRNA sequence
tttatgatgttgttatattc

SEQ ID NO: 213416 - DNA, 20 bp, Artificial
  CRISPR gRNA sequence
ccaggacttattatagcatt

SEQ ID NO: 213417 - DNA, 20 bp, Artificial
  CRISPR gRNA sequence
gtggtagaatttgaaagaag

SEQ ID NO: 213418 - DNA, 20 bp, Artificial
  CRISPR gRNA sequence
tgttgatttcagaggaatgc

SEQ ID NO: 213419 - DNA, 20 bp, Artificial
  CRISPR gRNA sequence
gatttcagaggaatgctagt

SEQ ID NO: 213420 - DNA, 20 bp, Artificial
  CRISPR gRNA sequence
gaatactttcagtacattta

SEQ ID NO: 213421 - DNA, 20 bp, Artificial
  CRISPR gRNA sequence
acagctaaaattatggtctt

SEQ ID NO: 213422 - DNA, 20 bp, Artificial
  CRISPR gRNA sequence
taacatgtgaccaacttaat

SEQ ID NO: 213423 - DNA, 20 bp, Artificial
  CRISPR gRNA sequence
tatgcatggataattgcaga

SEQ ID NO: 213424 - DNA, 20 bp, Artificial
  CRISPR gRNA sequence
agtacctagtggtgcatctt

SEQ ID NO: 213425 - DNA, 20 bp, Artificial
  CRISPR gRNA sequence
aactgagtacttagtgagtg

SEQ ID NO: 213426 - DNA, 20 bp, Artificial
  CRISPR gRNA sequence
agtacttagtgagtgctaag

SEQ ID NO: 213427 - DNA, 20 bp, Artificial
  CRISPR gRNA sequence
tttgttttaagccctttgca

SEQ ID NO: 213428 - DNA, 20 bp, Artificial
  CRISPR gRNA sequence
aaacataagaaaaatgtgag

SEQ ID NO: 213429 - DNA, 20 bp, Artificial
  CRISPR gRNA sequence
gtgagaaatgcttaagtaag

SEQ ID NO: 213430 - DNA, 20 bp, Artificial
  CRISPR gRNA sequence
acataagtacattatgtgta

SEQ ID NO: 213431 - DNA, 20 bp, Artificial
  CRISPR gRNA sequence
aatacatgtaaaaataaggc

SEQ ID NO: 213432 - DNA, 20 bp, Artificial
  CRISPR gRNA sequence
tagtaaatattaattgtgac

SEQ ID NO: 213433 - DNA, 20 bp, Artificial
  CRISPR gRNA sequence
tgacttttgttttcttcttc

SEQ ID NO: 213434 - DNA, 20 bp, Artificial
  CRISPR gRNA sequence
gttttcttcttccccagttt

SEQ ID NO: 213435 - DNA, 20 bp, Artificial
  CRISPR gRNA sequence
tgctatactcctgttctggg

SEQ ID NO: 213436 - DNA, 20 bp, Artificial
  CRISPR gRNA sequence
gtattatttctacttttcat

SEQ ID NO: 213437 - DNA, 20 bp, Artificial
  CRISPR gRNA sequence
tcacttttaattcctaagaa

SEQ ID NO: 213438 - DNA, 20 bp, Artificial
  CRISPR gRNA sequence
ctaagaaggttgttttcact

SEQ ID NO: 213439 - DNA, 20 bp, Artificial
  CRISPR gRNA sequence
aacaggtggtgacagcctgc

SEQ ID NO: 213440 - DNA, 20 bp, Artificial
  CRISPR gRNA sequence
ggacgttatactttggagca

SEQ ID NO: 213441 - DNA, 20 bp, Artificial
  CRISPR gRNA sequence
gattcccctctttttatttt

SEQ ID NO: 213442 - DNA, 20 bp, Artificial
  CRISPR gRNA sequence
cccctctttttattttccca

SEQ ID NO: 213443 - DNA, 20 bp, Artificial
  CRISPR gRNA sequence
ttggaaaagtccagtcggaa

SEQ ID NO: 213444 - DNA, 20 bp, Artificial
  CRISPR gRNA sequence
cagagagttaggttctttga

SEQ ID NO: 213445 - DNA, 20 bp, Artificial
  CRISPR gRNA sequence
aaggcagatcttgatgctgc

SEQ ID NO: 213446 - DNA, 20 bp, Artificial
  CRISPR gRNA sequence
gatcttgatgctgcattaga

SEQ ID NO: 213447 - DNA, 20 bp, Artificial
  CRISPR gRNA sequence
taggtaatatgcattacggt

SEQ ID NO: 213448 - DNA, 20 bp, Artificial
  CRISPR gRNA sequence
tgaggtgacagtctaaactt

SEQ ID NO: 213449 - DNA, 20 bp, Artificial
  CRISPR gRNA sequence
aacttttaagctttttaaat

SEQ ID NO: 213450 - DNA, 20 bp, Artificial
  CRISPR gRNA sequence
ttatataagcaaggaataaa

SEQ ID NO: 213451 - DNA, 20 bp, Artificial
  CRISPR gRNA sequence
aaaagctagtaaactattgc

SEQ ID NO: 213452 - DNA, 20 bp, Artificial
  CRISPR gRNA sequence
tatgaattttacttttactc

SEQ ID NO: 213453 - DNA, 20 bp, Artificial
  CRISPR gRNA sequence
tataaacatggaagggagat

SEQ ID NO: 213454 - DNA, 20 bp, Artificial
  CRISPR gRNA sequence
aacatggaagggagatgact

SEQ ID NO: 213455 - DNA, 20 bp, Artificial
  CRISPR gRNA sequence
agggagatgactgattgatt

SEQ ID NO: 213456 - DNA, 20 bp, Artificial
  CRISPR gRNA sequence
actgattgattatatgtttt

SEQ ID NO: 213457 - DNA, 20 bp, Artificial
  CRISPR gRNA sequence
ctcagtgtatggcattctgg

SEQ ID NO: 213458 - DNA, 20 bp, Artificial
  CRISPR gRNA sequence
tatggcattctggaaatgct

SEQ ID NO: 213459 - DNA, 20 bp, Artificial
  CRISPR gRNA sequence
tggaaattttcttataatct

SEQ ID NO: 213460 - DNA, 20 bp, Artificial
  CRISPR gRNA sequence
ctggcatcaatgatattagg

SEQ ID NO: 213461 - DNA, 20 bp, Artificial
  CRISPR gRNA sequence
tcatgaaattatttcacata

SEQ ID NO: 213462 - DNA, 20 bp, Artificial
  CRISPR gRNA sequence
atttcacatagtgcgatttt

SEQ ID NO: 213463 - DNA, 20 bp, Artificial
  CRISPR gRNA sequence
acatagtgcgattttttgag

SEQ ID NO: 213464 - DNA, 20 bp, Artificial
  CRISPR gRNA sequence
ttttttgagtttggcttgat

SEQ ID NO: 213465 - DNA, 20 bp, Artificial
  CRISPR gRNA sequence
tttagtgaaatgaaccagga

SEQ ID NO: 213466 - DNA, 20 bp, Artificial
  CRISPR gRNA sequence
gttggctgtatttttacaaa

SEQ ID NO: 213467 - DNA, 20 bp, Artificial
  CRISPR gRNA sequence
ttggtatattctggtgaatt

SEQ ID NO: 213468 - DNA, 20 bp, Artificial
  CRISPR gRNA sequence
ggtaaccataaatggactcg

SEQ ID NO: 213469 - DNA, 20 bp, Artificial
  CRISPR gRNA sequence
taaatggactcgtacagctt

SEQ ID NO: 213470 - DNA, 20 bp, Artificial
  CRISPR gRNA sequence
atttacttaactctcatctt

SEQ ID NO: 213471 - DNA, 20 bp, Artificial
  CRISPR gRNA sequence
ctcatcttgatggattttaa

SEQ ID NO: 213472 - DNA, 20 bp, Artificial
  CRISPR gRNA sequence
actctagatacatactggca

SEQ ID NO: 213473 - DNA, 20 bp, Artificial
  CRISPR gRNA sequence
actggcaaaatgttttccag

SEQ ID NO: 213474 - DNA, 20 bp, Artificial
  CRISPR gRNA sequence
tactggtcatattttaagga

SEQ ID NO: 213475 - DNA, 20 bp, Artificial
  CRISPR gRNA sequence
gaaatattttggtgggaatt

SEQ ID NO: 213476 - DNA, 20 bp, Artificial
  CRISPR gRNA sequence
catggaagaggtatgtctat

SEQ ID NO: 213477 - DNA, 20 bp, Artificial
  CRISPR gRNA sequence
aaccatttgtggagctcttg

SEQ ID NO: 213478 - DNA, 20 bp, Artificial
  CRISPR gRNA sequence
ggcatagacactgttgttat

SEQ ID NO: 213479 - DNA, 20 bp, Artificial
  CRISPR gRNA sequence
gtagataagaaacaggcaca

SEQ ID NO: 213480 - DNA, 20 bp, Artificial
  CRISPR gRNA sequence
caatttgcccgcaatcaccc

SEQ ID NO: 213481 - DNA, 20 bp, Artificial
  CRISPR gRNA sequence
ccagccgtttcctgatagta

SEQ ID NO: 213482 - DNA, 20 bp, Artificial
  CRISPR gRNA sequence
agtactgggatttgaactag

SEQ ID NO: 213483 - DNA, 20 bp, Artificial
  CRISPR gRNA sequence
accactgcactgtactgcct

SEQ ID NO: 213484 - DNA, 20 bp, Artificial
  CRISPR gRNA sequence
tccccgttttgcatttattt

SEQ ID NO: 213485 - DNA, 20 bp, Artificial
  CRISPR gRNA sequence
attaggagagcagaatgttg

SEQ ID NO: 213486 - DNA, 20 bp, Artificial
  CRISPR gRNA sequence
gagagcagaatgttgacctg

SEQ ID NO: 213487 - DNA, 20 bp, Artificial
  CRISPR gRNA sequence
atacctagtgacagggtgcc

SEQ ID NO: 213488 - DNA, 20 bp, Artificial
  CRISPR gRNA sequence
gggtgtgatgtgcatattgc

SEQ ID NO: 213489 - DNA, 20 bp, Artificial
  CRISPR gRNA sequence
agaaagcacctctattctcc

SEQ ID NO: 213490 - DNA, 20 bp, Artificial
  CRISPR gRNA sequence
cagacccatgacttttattt

SEQ ID NO: 213491 - DNA, 20 bp, Artificial
  CRISPR gRNA sequence
tttattttatagatttctag

SEQ ID NO: 213492 - DNA, 20 bp, Artificial
  CRISPR gRNA sequence
ttctagttctgcttaacttt

SEQ ID NO: 213493 - DNA, 20 bp, Artificial
  CRISPR gRNA sequence
tatggtctgtacttggctac

SEQ ID NO: 213494 - DNA, 20 bp, Artificial
  CRISPR gRNA sequence
ggctacaggggatttctctc

SEQ ID NO: 213495 - DNA, 20 bp, Artificial
  CRISPR gRNA sequence
atttgctcactctgaggaga

SEQ ID NO: 213496 - DNA, 20 bp, Artificial
  CRISPR gRNA sequence
agcacttggtgagccctgga

SEQ ID NO: 213497 - DNA, 20 bp, Artificial
  CRISPR gRNA sequence
tgttcctaaataccttcacc

SEQ ID NO: 213498 - DNA, 20 bp, Artificial
  CRISPR gRNA sequence
ctaaataccttcacctttag

SEQ ID NO: 213499 - DNA, 20 bp, Artificial
  CRISPR gRNA sequence
ggaacttttaagcagaatct

SEQ ID NO: 213500 - DNA, 20 bp, Artificial
  CRISPR gRNA sequence
tctatgcttagcaaacagct

SEQ ID NO: 213501 - DNA, 20 bp, Artificial
  CRISPR gRNA sequence
agattgctagaatcaaacac

SEQ ID NO: 213502 - DNA, 20 bp, Artificial
  CRISPR gRNA sequence
aactgatagtattgaatttc

SEQ ID NO: 213503 - DNA, 20 bp, Artificial
  CRISPR gRNA sequence
atagtattgaatttcagacg

SEQ ID NO: 213504 - DNA, 20 bp, Artificial
  CRISPR gRNA sequence
ttctgaaaactacaccaact

SEQ ID NO: 213505 - DNA, 20 bp, Artificial
  CRISPR gRNA sequence
ctactgacaattaagttcct

SEQ ID NO: 213506 - DNA, 20 bp, Artificial
  CRISPR gRNA sequence
attaagttcctggctgattt

SEQ ID NO: 213507 - DNA, 20 bp, Artificial
  CRISPR gRNA sequence
cacctagtcctccagttcct

SEQ ID NO: 213508 - DNA, 20 bp, Artificial
  CRISPR gRNA sequence
ttctttctttgcctttgtaa

SEQ ID NO: 213509 - DNA, 20 bp, Artificial
  CRISPR gRNA sequence
ctttgttttatacaggcaat

SEQ ID NO: 213510 - DNA, 20 bp, Artificial
  CRISPR gRNA sequence
aatgaaagtgtgttatcaag

SEQ ID NO: 213511 - DNA, 20 bp, Artificial
  CRISPR gRNA sequence
tacagagcaagcatcttctc

SEQ ID NO: 213512 - DNA, 20 bp, Artificial
  CRISPR gRNA sequence
gtgaattgtcataccccttt

SEQ ID NO: 213513 - DNA, 20 bp, Artificial
  CRISPR gRNA sequence
atacccctttctaagtttgg

SEQ ID NO: 213514 - DNA, 20 bp, Artificial
  CRISPR gRNA sequence
tctaagtttggatcggtttc

SEQ ID NO: 213515 - DNA, 20 bp, Artificial
  CRISPR gRNA sequence
atgtcatgaaagaattcctt

SEQ ID NO: 213516 - DNA, 20 bp, Artificial
  CRISPR gRNA sequence
aattcctttaatgttttttt

SEQ ID NO: 213517 - DNA, 20 bp, Artificial
  CRISPR gRNA sequence
ttaatgtttttttgaatgtt

SEQ ID NO: 213518 - DNA, 20 bp, Artificial
  CRISPR gRNA sequence
gtccaccttcgctgagttct

SEQ ID NO: 213519 - DNA, 20 bp, Artificial
  CRISPR gRNA sequence
agttcttctggcttcatctc

SEQ ID NO: 213520 - DNA, 20 bp, Artificial
  CRISPR gRNA sequence
aaatttcactcctagcattt

SEQ ID NO: 213521 - DNA, 20 bp, Artificial
  CRISPR gRNA sequence
ttactctttcatctttcttg

SEQ ID NO: 213522 - DNA, 20 bp, Artificial
  CRISPR gRNA sequence
ctttcttgcctagtttcctc

SEQ ID NO: 213523 - DNA, 20 bp, Artificial
  CRISPR gRNA sequence
tatccattataaaatgtcac

SEQ ID NO: 213524 - DNA, 20 bp, Artificial
  CRISPR gRNA sequence
attgtggtaattgaaatttg

SEQ ID NO: 213525 - DNA, 20 bp, Artificial
  CRISPR gRNA sequence
ttgaaatttggactgtttat

SEQ ID NO: 213526 - DNA, 20 bp, Artificial
  CRISPR gRNA sequence
ggactgtttatgagggattt

SEQ ID NO: 213527 - DNA, 20 bp, Artificial
  CRISPR gRNA sequence
tgcaaagtgaggactgctgt

SEQ ID NO: 213528 - DNA, 20 bp, Artificial
  CRISPR gRNA sequence
ccctgctcaaaattactcca

SEQ ID NO: 213529 - DNA, 20 bp, Artificial
  CRISPR gRNA sequence
cttgagatcctaccaagtcc

SEQ ID NO: 213530 - DNA, 20 bp, Artificial
  CRISPR gRNA sequence
tccttgagttttgacttgag

SEQ ID NO: 213531 - DNA, 20 bp, Artificial
  CRISPR gRNA sequence
aatggaacaggaaatttctt

SEQ ID NO: 213532 - DNA, 20 bp, Artificial
  CRISPR gRNA sequence
ctggtaataagactttgtta

SEQ ID NO: 213533 - DNA, 20 bp, Artificial
  CRISPR gRNA sequence
aacctccgcctcccaggttc

SEQ ID NO: 213534 - DNA, 20 bp, Artificial
  CRISPR gRNA sequence
ttttgtatttttagtagtga

SEQ ID NO: 213535 - DNA, 20 bp, Artificial
  CRISPR gRNA sequence
tgtctcggcctcccaaagtg

SEQ ID NO: 213536 - DNA, 20 bp, Artificial
  CRISPR gRNA sequence
gttcaataatcttgaactcc

SEQ ID NO: 213537 - DNA, 20 bp, Artificial
  CRISPR gRNA sequence
tcacattctgttattaaata

SEQ ID NO: 213538 - DNA, 20 bp, Artificial
  CRISPR gRNA sequence
tattaaataatgtgcttatg

SEQ ID NO: 213539 - DNA, 20 bp, Artificial
  CRISPR gRNA sequence
aaagttgataatgaaaaaaa

SEQ ID NO: 213540 - DNA, 20 bp, Artificial
  CRISPR gRNA sequence
gtcagtattcattgtgacaa

SEQ ID NO: 213541 - DNA, 20 bp, Artificial
  CRISPR gRNA sequence
agagcaagttggatagtgta

SEQ ID NO: 213542 - DNA, 20 bp, Artificial
  CRISPR gRNA sequence
agtgtatggagattattata

SEQ ID NO: 213543 - DNA, 20 bp, Artificial
  CRISPR gRNA sequence
aatgttcatttttttccagt

SEQ ID NO: 213544 - DNA, 20 bp, Artificial
  CRISPR gRNA sequence
ttttttccagtaccagtttc

SEQ ID NO: 213545 - DNA, 20 bp, Artificial
  CRISPR gRNA sequence
tttatgtgtaaaggtgtctg

SEQ ID NO: 213546 - DNA, 20 bp, Artificial
  CRISPR gRNA sequence
gaaatcaaacccatctttct

SEQ ID NO: 213547 - DNA, 20 bp, Artificial
  CRISPR gRNA sequence
cctggtaagccttcctgtct

SEQ ID NO: 213548 - DNA, 20 bp, Artificial
  CRISPR gRNA sequence
tttgggcaggcattaaattc

SEQ ID NO: 213549 - DNA, 20 bp, Artificial
  CRISPR gRNA sequence
aggcattaaattcttgggtt

SEQ ID NO: 213550 - DNA, 20 bp, Artificial
  CRISPR gRNA sequence
atggaaacttagcatgatag

SEQ ID NO: 213551 - DNA, 20 bp, Artificial
  CRISPR gRNA sequence
caagttgacttggtaatttc

SEQ ID NO: 213552 - DNA, 20 bp, Artificial
  CRISPR gRNA sequence
tcttgtccattcataacatt

SEQ ID NO: 213553 - DNA, 20 bp, Artificial
  CRISPR gRNA sequence
aggtggctagagggacatgt

SEQ ID NO: 213554 - DNA, 20 bp, Artificial
  CRISPR gRNA sequence
tgcttcatctgcatgaattt

SEQ ID NO: 213555 - DNA, 20 bp, Artificial
  CRISPR gRNA sequence
accatctctttaactgggaa

SEQ ID NO: 213556 - DNA, 20 bp, Artificial
  CRISPR gRNA sequence
taagggccttgaggcaggcc

SEQ ID NO: 213557 - DNA, 20 bp, Artificial
  CRISPR gRNA sequence
ggccttgaggcaggccttgt

SEQ ID NO: 213558 - DNA, 20 bp, Artificial
  CRISPR gRNA sequence
aataaagtaatctacttgtt

SEQ ID NO: 213559 - DNA, 20 bp, Artificial
  CRISPR gRNA sequence
acagatgaatgaaccaaccc

SEQ ID NO: 213560 - DNA, 20 bp, Artificial
  CRISPR gRNA sequence
caacagatttcttagaagta

SEQ ID NO: 213561 - DNA, 20 bp, Artificial
  CRISPR gRNA sequence
ctcatgtactttattttgtg

SEQ ID NO: 213562 - DNA, 20 bp, Artificial
  CRISPR gRNA sequence
gagggtaatccttaagagca

SEQ ID NO: 213563 - DNA, 20 bp, Artificial
  CRISPR gRNA sequence
catgcagattttaaaaatta

SEQ ID NO: 213564 - DNA, 20 bp, Artificial
  CRISPR gRNA sequence
tttattttttttgctgcatt

SEQ ID NO: 213565 - DNA, 20 bp, Artificial
  CRISPR gRNA sequence
gagccaaaagaaactctttc

SEQ ID NO: 213566 - DNA, 20 bp, Artificial
  CRISPR gRNA sequence
tccagaatgcctgggaccag

SEQ ID NO: 213567 - DNA, 20 bp, Artificial
  CRISPR gRNA sequence
atgcctgggaccagaagtgt

SEQ ID NO: 213568 - DNA, 20 bp, Artificial
  CRISPR gRNA sequence
ggaccagaagtgttttggat

SEQ ID NO: 213569 - DNA, 20 bp, Artificial
  CRISPR gRNA sequence
aatggctacttaatttaagg

SEQ ID NO: 213570 - DNA, 20 bp, Artificial
  CRISPR gRNA sequence
ctgtctatggtagtattttg

SEQ ID NO: 213571 - DNA, 20 bp, Artificial
  CRISPR gRNA sequence
tgatgttttatttttgttgc

SEQ ID NO: 213572 - DNA, 20 bp, Artificial
  CRISPR gRNA sequence
atttttgttgctattgtttg

SEQ ID NO: 213573 - DNA, 20 bp, Artificial
  CRISPR gRNA sequence
cttaagaggataaattttat

SEQ ID NO: 213574 - DNA, 20 bp, Artificial
  CRISPR gRNA sequence
gaatcattgaacctgggagg

SEQ ID NO: 213575 - DNA, 20 bp, Artificial
  CRISPR gRNA sequence
gaggcagagtttgcagtgag

SEQ ID NO: 213576 - DNA, 20 bp, Artificial
  CRISPR gRNA sequence
tgtactctaaggcaaattct

SEQ ID NO: 213577 - DNA, 20 bp, Artificial
  CRISPR gRNA sequence
aattcttgttgcttgatctt

SEQ ID NO: 213578 - DNA, 20 bp, Artificial
  CRISPR gRNA sequence
atgcattgacttaaacctgg

SEQ ID NO: 213579 - DNA, 20 bp, Artificial
  CRISPR gRNA sequence
aacctggaagagtttcttat

SEQ ID NO: 213580 - DNA, 20 bp, Artificial
  CRISPR gRNA sequence
tggaagagtttcttatgaat

SEQ ID NO: 213581 - DNA, 20 bp, Artificial
  CRISPR gRNA sequence
tgactgtgaggtgcatttga

SEQ ID NO: 213582 - DNA, 20 bp, Artificial
  CRISPR gRNA sequence
ctatttagataacaatatat

SEQ ID NO: 213583 - DNA, 20 bp, Artificial
  CRISPR gRNA sequence
tgccttttgtgacttataca

SEQ ID NO: 213584 - DNA, 20 bp, Artificial
  CRISPR gRNA sequence
aacttggggaacttgccata

SEQ ID NO: 213585 - DNA, 20 bp, Artificial
  CRISPR gRNA sequence
ggaacttgccataggatgtt

SEQ ID NO: 213586 - DNA, 20 bp, Artificial
  CRISPR gRNA sequence
taggatgttttctgattaat

SEQ ID NO: 213587 - DNA, 20 bp, Artificial
  CRISPR gRNA sequence
gattaatatgggtttctctt

SEQ ID NO: 213588 - DNA, 20 bp, Artificial
  CRISPR gRNA sequence
ggtttctcttctctgattaa

SEQ ID NO: 213589 - DNA, 20 bp, Artificial
  CRISPR gRNA sequence
acattaataaattggttatt

SEQ ID NO: 213590 - DNA, 20 bp, Artificial
  CRISPR gRNA sequence
tacctgtcatataccttaaa

SEQ ID NO: 213591 - DNA, 20 bp, Artificial
  CRISPR gRNA sequence
gatttttatcacaatcattt

SEQ ID NO: 213592 - DNA, 20 bp, Artificial
  CRISPR gRNA sequence
caatcatttaggggcttatt

SEQ ID NO: 213593 - DNA, 20 bp, Artificial
  CRISPR gRNA sequence
tttattgcttttactttatt

SEQ ID NO: 213594 - DNA, 20 bp, Artificial
  CRISPR gRNA sequence
tccccttcatgacagccacc

SEQ ID NO: 213595 - DNA, 20 bp, Artificial
  CRISPR gRNA sequence
acagcagcatttcaatcaca

SEQ ID NO: 213596 - DNA, 20 bp, Artificial
  CRISPR gRNA sequence
cacgctgtttctttccgcta

SEQ ID NO: 213597 - DNA, 20 bp, Artificial
  CRISPR gRNA sequence
ctgtttctttccgctactca

SEQ ID NO: 213598 - DNA, 20 bp, Artificial
  CRISPR gRNA sequence
ttcaatattaaccaaaattt

SEQ ID NO: 213599 - DNA, 20 bp, Artificial
  CRISPR gRNA sequence
atagtaaaagaactaatatt

SEQ ID NO: 213600 - DNA, 20 bp, Artificial
  CRISPR gRNA sequence
gatgaatcccattgagtctt

SEQ ID NO: 213601 - DNA, 20 bp, Artificial
  CRISPR gRNA sequence
aaatattttaattgaacaat

SEQ ID NO: 213602 - DNA, 20 bp, Artificial
  CRISPR gRNA sequence
atttaagctttttttcttca

SEQ ID NO: 213603 - DNA, 20 bp, Artificial
  CRISPR gRNA sequence
tttcacaagggtgtaatctg

SEQ ID NO: 213604 - DNA, 20 bp, Artificial
  CRISPR gRNA sequence
atttttttcaaaacaaaata

SEQ ID NO: 213605 - DNA, 20 bp, Artificial
  CRISPR gRNA sequence
caaaacaaaataactagatt

SEQ ID NO: 213606 - DNA, 20 bp, Artificial
  CRISPR gRNA sequence
acaaaataactagatttcca

SEQ ID NO: 213607 - DNA, 20 bp, Artificial
  CRISPR gRNA sequence
agtgttgtgttgtcacttgg

SEQ ID NO: 213608 - DNA, 20 bp, Artificial
  CRISPR gRNA sequence
gggcattgacaatgtctgaa

SEQ ID NO: 213609 - DNA, 20 bp, Artificial
  CRISPR gRNA sequence
attgacaatgtctgaaaaca

SEQ ID NO: 213610 - DNA, 20 bp, Artificial
  CRISPR gRNA sequence
atactgccgtgacgttatcc

SEQ ID NO: 213611 - DNA, 20 bp, Artificial
  CRISPR gRNA sequence
tattacattatagtacttct

SEQ ID NO: 213612 - DNA, 20 bp, Artificial
  CRISPR gRNA sequence
tgtaccttacaagttattaa

SEQ ID NO: 213613 - DNA, 20 bp, Artificial
  CRISPR gRNA sequence
agttattaaaatggcttcac

SEQ ID NO: 213614 - DNA, 20 bp, Artificial
  CRISPR gRNA sequence
gtgattgagttcatataatt

SEQ ID NO: 213615 - DNA, 20 bp, Artificial
  CRISPR gRNA sequence
ggtggtatggatgagaaaac

SEQ ID NO: 213616 - DNA, 20 bp, Artificial
  CRISPR gRNA sequence
tccaaggtgaggagggctgc

SEQ ID NO: 213617 - DNA, 20 bp, Artificial
  CRISPR gRNA sequence
gaacagatgaccacaaactg

SEQ ID NO: 213618 - DNA, 20 bp, Artificial
  CRISPR gRNA sequence
agaatccatttcttggctct

SEQ ID NO: 213619 - DNA, 20 bp, Artificial
  CRISPR gRNA sequence
tggaatttgctgaagaatga

SEQ ID NO: 213620 - DNA, 20 bp, Artificial
  CRISPR gRNA sequence
aatgacagtgtttatcattc

SEQ ID NO: 213621 - DNA, 20 bp, Artificial
  CRISPR gRNA sequence
cttcctctatgtctttgcct

SEQ ID NO: 213622 - DNA, 20 bp, Artificial
  CRISPR gRNA sequence
tgctgtattaggtaatattc

SEQ ID NO: 213623 - DNA, 20 bp, Artificial
  CRISPR gRNA sequence
taggtaatattcacaggttt

SEQ ID NO: 213624 - DNA, 20 bp, Artificial
  CRISPR gRNA sequence
acctaataactatagcacac

SEQ ID NO: 213625 - DNA, 20 bp, Artificial
  CRISPR gRNA sequence
caggtgtaatatttaggaac

SEQ ID NO: 213626 - DNA, 20 bp, Artificial
  CRISPR gRNA sequence
agaagacaacttgaaggaac

SEQ ID NO: 213627 - DNA, 20 bp, Artificial
  CRISPR gRNA sequence
ggaacagtaaaagatgaata

SEQ ID NO: 213628 - DNA, 20 bp, Artificial
  CRISPR gRNA sequence
agaaggaggcagagccaatt

SEQ ID NO: 213629 - DNA, 20 bp, Artificial
  CRISPR gRNA sequence
agcatgttgaaacttaaatg

SEQ ID NO: 213630 - DNA, 20 bp, Artificial
  CRISPR gRNA sequence
aatgttgagatttagatgtc

SEQ ID NO: 213631 - DNA, 20 bp, Artificial
  CRISPR gRNA sequence
aaatagtcactaattttgtg

SEQ ID NO: 213632 - DNA, 20 bp, Artificial
  CRISPR gRNA sequence
cacagttgtcaagcacagaa

SEQ ID NO: 213633 - DNA, 20 bp, Artificial
  CRISPR gRNA sequence
agtatgtaggaaaatatttt

SEQ ID NO: 213634 - DNA, 20 bp, Artificial
  CRISPR gRNA sequence
cattaaagaatgctactggc

SEQ ID NO: 213635 - DNA, 20 bp, Artificial
  CRISPR gRNA sequence
attaatattacttcactact

SEQ ID NO: 213636 - DNA, 20 bp, Artificial
  CRISPR gRNA sequence
ctactatgtgtttagtacag

SEQ ID NO: 213637 - DNA, 20 bp, Artificial
  CRISPR gRNA sequence
ggtgagttttcattgttaca

SEQ ID NO: 213638 - DNA, 20 bp, Artificial
  CRISPR gRNA sequence
acctttttcatttacaaaac

SEQ ID NO: 213639 - DNA, 20 bp, Artificial
  CRISPR gRNA sequence
ttttttacaactcaataaga

SEQ ID NO: 213640 - DNA, 20 bp, Artificial
  CRISPR gRNA sequence
tcaataagagtaggtttatt

SEQ ID NO: 213641 - DNA, 20 bp, Artificial
  CRISPR gRNA sequence
ttttaaggttattctaggtt

SEQ ID NO: 213642 - DNA, 20 bp, Artificial
  CRISPR gRNA sequence
aattatgccatataacttct

SEQ ID NO: 213643 - DNA, 20 bp, Artificial
  CRISPR gRNA sequence
gattattttcatattctaat

SEQ ID NO: 213644 - DNA, 20 bp, Artificial
  CRISPR gRNA sequence
gcagtctttctcttcttttg

SEQ ID NO: 213645 - DNA, 20 bp, Artificial
  CRISPR gRNA sequence
tttctcttcttttgctaagc

SEQ ID NO: 213646 - DNA, 20 bp, Artificial
  CRISPR gRNA sequence
atcacaaatagtagaaacat

SEQ ID NO: 213647 - DNA, 20 bp, Artificial
  CRISPR gRNA sequence
ttattagcaaaccttaatac

SEQ ID NO: 213648 - DNA, 20 bp, Artificial
  CRISPR gRNA sequence
tcgttgtacattggaaaggt

SEQ ID NO: 213649 - DNA, 20 bp, Artificial
  CRISPR gRNA sequence
acatctagagatagagagca

SEQ ID NO: 213650 - DNA, 20 bp, Artificial
  CRISPR gRNA sequence
gtggtaaaagcagcattgtt

SEQ ID NO: 213651 - DNA, 20 bp, Artificial
  CRISPR gRNA sequence
tttagggtaaaaacttccag

SEQ ID NO: 213652 - DNA, 20 bp, Artificial
  CRISPR gRNA sequence
agtctttggtcttaggagat

SEQ ID NO: 213653 - DNA, 20 bp, Artificial
  CRISPR gRNA sequence
taccaaatgcaagtggaagt

SEQ ID NO: 213654 - DNA, 20 bp, Artificial
  CRISPR gRNA sequence
ttgctttttaaatactcttg

SEQ ID NO: 213655 - DNA, 20 bp, Artificial
  CRISPR gRNA sequence
ttacatccttttccttcctc

SEQ ID NO: 213656 - DNA, 20 bp, Artificial
  CRISPR gRNA sequence
tccttttccttcctccagcg

SEQ ID NO: 213657 - DNA, 20 bp, Artificial
  CRISPR gRNA sequence
ctctttttaaaaatatatag

SEQ ID NO: 213658 - DNA, 20 bp, Artificial
  CRISPR gRNA sequence
gacttgatttttttttttag

SEQ ID NO: 213659 - DNA, 20 bp, Artificial
  CRISPR gRNA sequence
atggatatttttatgtggac

SEQ ID NO: 213660 - DNA, 20 bp, Artificial
  CRISPR gRNA sequence
tattatcaccaccaataaat

SEQ ID NO: 213661 - DNA, 20 bp, Artificial
  CRISPR gRNA sequence
acttgacagcatttagcatt

SEQ ID NO: 213662 - DNA, 20 bp, Artificial
  CRISPR gRNA sequence
ccaatttaccccagtggtaa

SEQ ID NO: 213663 - DNA, 20 bp, Artificial
  CRISPR gRNA sequence
acaaagatattagctgtata

SEQ ID NO: 213664 - DNA, 20 bp, Artificial
  CRISPR gRNA sequence
agctgtatatatggcttggt

SEQ ID NO: 213665 - DNA, 20 bp, Artificial
  CRISPR gRNA sequence
tgatatgcctgtatttgtgg

SEQ ID NO: 213666 - DNA, 20 bp, Artificial
  CRISPR gRNA sequence
aaggtatgtgttatgcaaag

SEQ ID NO: 213667 - DNA, 20 bp, Artificial
  CRISPR gRNA sequence
aataaacatatatggataat

SEQ ID NO: 213668 - DNA, 20 bp, Artificial
  CRISPR gRNA sequence
tagaataactctcttaaaac

SEQ ID NO: 213669 - DNA, 20 bp, Artificial
  CRISPR gRNA sequence
ctcttaaaacttgggattat

SEQ ID NO: 213670 - DNA, 20 bp, Artificial
  CRISPR gRNA sequence
gttttttagtaagttatttc

SEQ ID NO: 213671 - DNA, 20 bp, Artificial
  CRISPR gRNA sequence
cttttctaatacagaatttt

SEQ ID NO: 213672 - DNA, 20 bp, Artificial
  CRISPR gRNA sequence
tataccaatgcatggccctc

SEQ ID NO: 213673 - DNA, 20 bp, Artificial
  CRISPR gRNA sequence
tgcatggccctcttctgatt

SEQ ID NO: 213674 - DNA, 20 bp, Artificial
  CRISPR gRNA sequence
gctctagcacaattacttgg

SEQ ID NO: 213675 - DNA, 20 bp, Artificial
  CRISPR gRNA sequence
tttcagatatatcacttaga

SEQ ID NO: 213676 - DNA, 20 bp, Artificial
  CRISPR gRNA sequence
atatcacttagaaaatgctt

SEQ ID NO: 213677 - DNA, 20 bp, Artificial
  CRISPR gRNA sequence
aatgctttttagtttgttct

SEQ ID NO: 213678 - DNA, 20 bp, Artificial
  CRISPR gRNA sequence
aaaatgagaaaatacaattg

SEQ ID NO: 213679 - DNA, 20 bp, Artificial
  CRISPR gRNA sequence
ttaaagagggtagaagacat

SEQ ID NO: 213680 - DNA, 20 bp, Artificial
  CRISPR gRNA sequence
taggatttttagttggttct

SEQ ID NO: 213681 - DNA, 20 bp, Artificial
  CRISPR gRNA sequence
gaagtcagaaaatacaattg

SEQ ID NO: 213682 - DNA, 20 bp, Artificial
  CRISPR gRNA sequence
ttaaagagggtagaagacat

SEQ ID NO: 213683 - DNA, 20 bp, Artificial
  CRISPR gRNA sequence
acatataggattaatgaaaa

SEQ ID NO: 213684 - DNA, 20 bp, Artificial
  CRISPR gRNA sequence
aatgaaaatttggtttccaa

SEQ ID NO: 213685 - DNA, 20 bp, Artificial
  CRISPR gRNA sequence
tccaaagtagtttaaaggaa

SEQ ID NO: 213686 - DNA, 20 bp, Artificial
  CRISPR gRNA sequence
gatccattttaagtaataga

SEQ ID NO: 213687 - DNA, 20 bp, Artificial
  CRISPR gRNA sequence
aataggatttttaattgttc

SEQ ID NO: 213688 - DNA, 20 bp, Artificial
  CRISPR gRNA sequence
gatagagctgtcctgcacag

SEQ ID NO: 213689 - DNA, 20 bp, Artificial
  CRISPR gRNA sequence
gagctgtcctgcacagacct

SEQ ID NO: 213690 - DNA, 20 bp, Artificial
  CRISPR gRNA sequence
aaaccaatataatgaaaaca

SEQ ID NO: 213691 - DNA, 20 bp, Artificial
  CRISPR gRNA sequence
aaaacattgagtttcaaaat

SEQ ID NO: 213692 - DNA, 20 bp, Artificial
  CRISPR gRNA sequence
agtaagtatggaatttactt

SEQ ID NO: 213693 - DNA, 20 bp, Artificial
  CRISPR gRNA sequence
ttcccaataatgtaatttat

SEQ ID NO: 213694 - DNA, 20 bp, Artificial
  CRISPR gRNA sequence
ataatgtaatttatattagt

SEQ ID NO: 213695 - DNA, 20 bp, Artificial
  CRISPR gRNA sequence
aaattaatggagtaaaaaaa

SEQ ID NO: 213696 - DNA, 20 bp, Artificial
  CRISPR gRNA sequence
atggagtaaaaaaatagtgt

SEQ ID NO: 213697 - DNA, 20 bp, Artificial
  CRISPR gRNA sequence
gtaaaaaaatagtgtttctg

SEQ ID NO: 213698 - DNA, 20 bp, Artificial
  CRISPR gRNA sequence
ctttaggtaaactttgctgt

SEQ ID NO: 213699 - DNA, 20 bp, Artificial
  CRISPR gRNA sequence
atttctcatatgactcacat

SEQ ID NO: 213700 - DNA, 20 bp, Artificial
  CRISPR gRNA sequence
tatttctgaactttggttct

SEQ ID NO: 213701 - DNA, 20 bp, Artificial
  CRISPR gRNA sequence
attctgtgtctttctttaat

SEQ ID NO: 213702 - DNA, 20 bp, Artificial
  CRISPR gRNA sequence
tggttctggaagatgacact

SEQ ID NO: 213703 - DNA, 20 bp, Artificial
  CRISPR gRNA sequence
cacaaatgcctgagaatagt

SEQ ID NO: 213704 - DNA, 20 bp, Artificial
  CRISPR gRNA sequence
tatatgctaaaatttatgct

SEQ ID NO: 213705 - DNA, 20 bp, Artificial
  CRISPR gRNA sequence
tagactaggaggaacattaa

SEQ ID NO: 213706 - DNA, 20 bp, Artificial
  CRISPR gRNA sequence
ctaggaggaacattaatatg

SEQ ID NO: 213707 - DNA, 20 bp, Artificial
  CRISPR gRNA sequence
aacattaaggttgcaaattt

SEQ ID NO: 213708 - DNA, 20 bp, Artificial
  CRISPR gRNA sequence
atttttactcattgcacgtg

SEQ ID NO: 213709 - DNA, 20 bp, Artificial
  CRISPR gRNA sequence
tgttctgttttagaaaagcc

SEQ ID NO: 213710 - DNA, 20 bp, Artificial
  CRISPR gRNA sequence
gttttagaaaagcctaatga

SEQ ID NO: 213711 - DNA, 20 bp, Artificial
  CRISPR gRNA sequence
agaaaagcctaatgattgtg

SEQ ID NO: 213712 - DNA, 20 bp, Artificial
  CRISPR gRNA sequence
atcctcaaatagttaaaaat

SEQ ID NO: 213713 - DNA, 20 bp, Artificial
  CRISPR gRNA sequence
aagaagaagttaatgtcgct

SEQ ID NO: 213714 - DNA, 20 bp, Artificial
  CRISPR gRNA sequence
aacttaatgtgaaagcatag

SEQ ID NO: 213715 - DNA, 20 bp, Artificial
  CRISPR gRNA sequence
cctaaccaaactcactaaag

SEQ ID NO: 213716 - DNA, 20 bp, Artificial
  CRISPR gRNA sequence
aaactcactaaagttgggct

SEQ ID NO: 213717 - DNA, 20 bp, Artificial
  CRISPR gRNA sequence
ttgggcttgttgtttgtaga

SEQ ID NO: 213718 - DNA, 20 bp, Artificial
  CRISPR gRNA sequence
tagttcaatataagggcata

SEQ ID NO: 213719 - DNA, 20 bp, Artificial
  CRISPR gRNA sequence
aaatttggtatcaatagaaa

SEQ ID NO: 213720 - DNA, 20 bp, Artificial
  CRISPR gRNA sequence
tgtatttatggcatggagtc

SEQ ID NO: 213721 - DNA, 20 bp, Artificial
  CRISPR gRNA sequence
attgcaagtatgctcatatg

SEQ ID NO: 213722 - DNA, 20 bp, Artificial
  CRISPR gRNA sequence
gtatgctcatatggaatgct

SEQ ID NO: 213723 - DNA, 20 bp, Artificial
  CRISPR gRNA sequence
tcaggtgaaattaacttgta

SEQ ID NO: 213724 - DNA, 20 bp, Artificial
  CRISPR gRNA sequence
tgaaattaacttgtacactg

SEQ ID NO: 213725 - DNA, 20 bp, Artificial
  CRISPR gRNA sequence
aactgtgacatcccttggat

SEQ ID NO: 213726 - DNA, 20 bp, Artificial
  CRISPR gRNA sequence
tggcggttagcaatattcta

SEQ ID NO: 213727 - DNA, 20 bp, Artificial
  CRISPR gRNA sequence
gttagcaatattctattttg

SEQ ID NO: 213728 - DNA, 20 bp, Artificial
  CRISPR gRNA sequence
caatattctattttgttttg

SEQ ID NO: 213729 - DNA, 20 bp, Artificial
  CRISPR gRNA sequence
gcatgtgccactacacctgg

SEQ ID NO: 213730 - DNA, 20 bp, Artificial
  CRISPR gRNA sequence
ttaccatcagaaatttagat

SEQ ID NO: 213731 - DNA, 20 bp, Artificial
  CRISPR gRNA sequence
tgtagaacatagatataagg

SEQ ID NO: 213732 - DNA, 20 bp, Artificial
  CRISPR gRNA sequence
tcccaaataaagctctgtat

SEQ ID NO: 213733 - DNA, 20 bp, Artificial
  CRISPR gRNA sequence
aataaagctctgtatttctg

SEQ ID NO: 213734 - DNA, 20 bp, Artificial
  CRISPR gRNA sequence
ctgttctactttaaaaagag

SEQ ID NO: 213735 - DNA, 20 bp, Artificial
  CRISPR gRNA sequence
actttaaaaagaggttggct

SEQ ID NO: 213736 - DNA, 20 bp, Artificial
  CRISPR gRNA sequence
tagttcctgagttcctctgt

SEQ ID NO: 213737 - DNA, 20 bp, Artificial
  CRISPR gRNA sequence
attagccagctagctcaccc

SEQ ID NO: 213738 - DNA, 20 bp, Artificial
  CRISPR gRNA sequence
gctcaccctcttgtttatgc

SEQ ID NO: 213739 - DNA, 20 bp, Artificial
  CRISPR gRNA sequence
cacagacaacttttcttacc

SEQ ID NO: 213740 - DNA, 20 bp, Artificial
  CRISPR gRNA sequence
tggactcatccttgtctcct

SEQ ID NO: 213741 - DNA, 20 bp, Artificial
  CRISPR gRNA sequence
cccttcccatcaccaacttt

SEQ ID NO: 213742 - DNA, 20 bp, Artificial
  CRISPR gRNA sequence
caccaactttctgggttttt

SEQ ID NO: 213743 - DNA, 20 bp, Artificial
  CRISPR gRNA sequence
gtccagtctgttgccatttt

SEQ ID NO: 213744 - DNA, 20 bp, Artificial
  CRISPR gRNA sequence
ttcctgtttgagaaagactc

SEQ ID NO: 213745 - DNA, 20 bp, Artificial
  CRISPR gRNA sequence
tcaccagcttttggctggct

SEQ ID NO: 213746 - DNA, 20 bp, Artificial
  CRISPR gRNA sequence
agcttttggctggctcacag

SEQ ID NO: 213747 - DNA, 20 bp, Artificial
  CRISPR gRNA sequence
caggacccacccttttccct

SEQ ID NO: 213748 - DNA, 20 bp, Artificial
  CRISPR gRNA sequence
cccttttccctgccagcttt

SEQ ID NO: 213749 - DNA, 20 bp, Artificial
  CRISPR gRNA sequence
ctcctgctgagtggttcatg

SEQ ID NO: 213750 - DNA, 20 bp, Artificial
  CRISPR gRNA sequence
gttcatggcatgtttctgtt

SEQ ID NO: 213751 - DNA, 20 bp, Artificial
  CRISPR gRNA sequence
tgttcaacgcttttccatct

SEQ ID NO: 213752 - DNA, 20 bp, Artificial
  CRISPR gRNA sequence
aggattcttattctgtattt

SEQ ID NO: 213753 - DNA, 20 bp, Artificial
  CRISPR gRNA sequence
ttctgtatttatttgttttt

SEQ ID NO: 213754 - DNA, 20 bp, Artificial
  CRISPR gRNA sequence
tgccttggcctcccaaagtg

SEQ ID NO: 213755 - DNA, 20 bp, Artificial
  CRISPR gRNA sequence
ccaccacggccagccttctc

SEQ ID NO: 213756 - DNA, 20 bp, Artificial
  CRISPR gRNA sequence
agagctatctgagtattttc

SEQ ID NO: 213757 - DNA, 20 bp, Artificial
  CRISPR gRNA sequence
tctttagtttgttagctctt

SEQ ID NO: 213758 - DNA, 20 bp, Artificial
  CRISPR gRNA sequence
gagtgatgtggagaaagaga

SEQ ID NO: 213759 - DNA, 20 bp, Artificial
  CRISPR gRNA sequence
caccagccagtgtaacaagt

SEQ ID NO: 213760 - DNA, 20 bp, Artificial
  CRISPR gRNA sequence
tggcataaacaaatgagaga

SEQ ID NO: 213761 - DNA, 20 bp, Artificial
  CRISPR gRNA sequence
ctatttgatgtagatgggtt

SEQ ID NO: 213762 - DNA, 20 bp, Artificial
  CRISPR gRNA sequence
tatataatcaagaatattca

SEQ ID NO: 213763 - DNA, 20 bp, Artificial
  CRISPR gRNA sequence
tcattaacatctctggcacc

SEQ ID NO: 213764 - DNA, 20 bp, Artificial
  CRISPR gRNA sequence
aattaaacattaccaaatgc

SEQ ID NO: 213765 - DNA, 20 bp, Artificial
  CRISPR gRNA sequence
tattcttatttgttatttat

SEQ ID NO: 213766 - DNA, 20 bp, Artificial
  CRISPR gRNA sequence
tacaacctcctagggtaagt

SEQ ID NO: 213767 - DNA, 20 bp, Artificial
  CRISPR gRNA sequence
tgaattgtgaatgatcattt

SEQ ID NO: 213768 - DNA, 20 bp, Artificial
  CRISPR gRNA sequence
ggtaattgagatattttgct

SEQ ID NO: 213769 - DNA, 20 bp, Artificial
  CRISPR gRNA sequence
gtccagttctattttaaaac

SEQ ID NO: 213770 - DNA, 20 bp, Artificial
  CRISPR gRNA sequence
tagtgtcaatgggatggaat

SEQ ID NO: 213771 - DNA, 20 bp, Artificial
  CRISPR gRNA sequence
gggatggaataaatgatttc

SEQ ID NO: 213772 - DNA, 20 bp, Artificial
  CRISPR gRNA sequence
tatctctgcaatcagaagga

SEQ ID NO: 213773 - DNA, 20 bp, Artificial
  CRISPR gRNA sequence
tccaatatatcacctcacct

SEQ ID NO: 213774 - DNA, 20 bp, Artificial
  CRISPR gRNA sequence
gcatacacagaatgacaatt

SEQ ID NO: 213775 - DNA, 20 bp, Artificial
  CRISPR gRNA sequence
ctgaaaacatctgttcggag

SEQ ID NO: 213776 - DNA, 20 bp, Artificial
  CRISPR gRNA sequence
gattcgatcctctcccatac

SEQ ID NO: 213777 - DNA, 20 bp, Artificial
  CRISPR gRNA sequence
aaacattttttcccttaaaa

SEQ ID NO: 213778 - DNA, 20 bp, Artificial
  CRISPR gRNA sequence
ttttcccttaaaactgtgct

SEQ ID NO: 213779 - DNA, 20 bp, Artificial
  CRISPR gRNA sequence
gttgtggacataagctctgg

SEQ ID NO: 213780 - DNA, 20 bp, Artificial
  CRISPR gRNA sequence
ctggaaaggattatattgta

SEQ ID NO: 213781 - DNA, 20 bp, Artificial
  CRISPR gRNA sequence
tggccggaggtagaggtcac

SEQ ID NO: 213782 - DNA, 20 bp, Artificial
  CRISPR gRNA sequence
taccacaggggtatattcta

SEQ ID NO: 213783 - DNA, 20 bp, Artificial
  CRISPR gRNA sequence
gttcaatttgcgatacttaa

SEQ ID NO: 213784 - DNA, 20 bp, Artificial
  CRISPR gRNA sequence
tttgcgatacttaaagatga

SEQ ID NO: 213785 - DNA, 20 bp, Artificial
  CRISPR gRNA sequence
gatacttaaagatgattctg

SEQ ID NO: 213786 - DNA, 20 bp, Artificial
  CRISPR gRNA sequence
atttattctgttgttgctat

SEQ ID NO: 213787 - DNA, 20 bp, Artificial
  CRISPR gRNA sequence
gagagtggtgaagtgggaaa

SEQ ID NO: 213788 - DNA, 20 bp, Artificial
  CRISPR gRNA sequence
taaactattaacccgacttg

SEQ ID NO: 213789 - DNA, 20 bp, Artificial
  CRISPR gRNA sequence
tattaacccgacttggcaag

SEQ ID NO: 213790 - DNA, 20 bp, Artificial
  CRISPR gRNA sequence
caagctttgctttaacattt

SEQ ID NO: 213791 - DNA, 20 bp, Artificial
  CRISPR gRNA sequence
taacatttacaggcttattt

SEQ ID NO: 213792 - DNA, 20 bp, Artificial
  CRISPR gRNA sequence
tttacaggcttatttcgttg

SEQ ID NO: 213793 - DNA, 20 bp, Artificial
  CRISPR gRNA sequence
tttttcttttttttttgact

SEQ ID NO: 213794 - DNA, 20 bp, Artificial
  CRISPR gRNA sequence
ttttttttgactgtaggatt

SEQ ID NO: 213795 - DNA, 20 bp, Artificial
  CRISPR gRNA sequence
taatttaaatattagcatat

SEQ ID NO: 213796 - DNA, 20 bp, Artificial
  CRISPR gRNA sequence
gtctatgccttaggaagaat

SEQ ID NO: 213797 - DNA, 20 bp, Artificial
  CRISPR gRNA sequence
tctttccttggcatctctac

SEQ ID NO: 213798 - DNA, 20 bp, Artificial
  CRISPR gRNA sequence
tatgggctgggtgcggtggc

SEQ ID NO: 213799 - DNA, 20 bp, Artificial
  CRISPR gRNA sequence
ggcgggcagatcacgaggtc

SEQ ID NO: 213800 - DNA, 20 bp, Artificial
  CRISPR gRNA sequence
tcgggaggctgaggcaggag

SEQ ID NO: 213801 - DNA, 20 bp, Artificial
  CRISPR gRNA sequence
gcactattctgtgtctaagt

SEQ ID NO: 213802 - DNA, 20 bp, Artificial
  CRISPR gRNA sequence
ttctttctttgtaaacctag

SEQ ID NO: 213803 - DNA, 20 bp, Artificial
  CRISPR gRNA sequence
agatctgatttcccaactaa

SEQ ID NO: 213804 - DNA, 20 bp, Artificial
  CRISPR gRNA sequence
gaaaggctacataatgaaat

SEQ ID NO: 213805 - DNA, 20 bp, Artificial
  CRISPR gRNA sequence
tagttagcatatcattgcat

SEQ ID NO: 213806 - DNA, 20 bp, Artificial
  CRISPR gRNA sequence
ttgcatatttgtttatttag

SEQ ID NO: 213807 - DNA, 20 bp, Artificial
  CRISPR gRNA sequence
attgtggaacctcactaact

SEQ ID NO: 213808 - DNA, 20 bp, Artificial
  CRISPR gRNA sequence
ggaacctcactaactgcctg

SEQ ID NO: 213809 - DNA, 20 bp, Artificial
  CRISPR gRNA sequence
acatggacattggaaaacaa

SEQ ID NO: 213810 - DNA, 20 bp, Artificial
  CRISPR gRNA sequence
agaaattaccactttttgta

SEQ ID NO: 213811 - DNA, 20 bp, Artificial
  CRISPR gRNA sequence
ccactttttgtaaaatgttt

SEQ ID NO: 213812 - DNA, 20 bp, Artificial
  CRISPR gRNA sequence
acaaatctttatcattttga

SEQ ID NO: 213813 - DNA, 20 bp, Artificial
  CRISPR gRNA sequence
tcattttgacagagtttctt

SEQ ID NO: 213814 - DNA, 20 bp, Artificial
  CRISPR gRNA sequence
agtttcttttatgcttgtgt

SEQ ID NO: 213815 - DNA, 20 bp, Artificial
  CRISPR gRNA sequence
aacccatggggacttaacat

SEQ ID NO: 213816 - DNA, 20 bp, Artificial
  CRISPR gRNA sequence
acatctctgcttttccaatc

SEQ ID NO: 213817 - DNA, 20 bp, Artificial
  CRISPR gRNA sequence
cttggttctaaccttttggg

SEQ ID NO: 213818 - DNA, 20 bp, Artificial
  CRISPR gRNA sequence
agagagagagagagagagag

SEQ ID NO: 213819 - DNA, 20 bp, Artificial
  CRISPR gRNA sequence
agagagagagatgtttcgtc

SEQ ID NO: 213820 - DNA, 20 bp, Artificial
  CRISPR gRNA sequence
agagatgtttcgtcctcagc

SEQ ID NO: 213821 - DNA, 20 bp, Artificial
  CRISPR gRNA sequence
atatttgttcttaaagatac

SEQ ID NO: 213822 - DNA, 20 bp, Artificial
  CRISPR gRNA sequence
tgagtgctacaagcatttat

SEQ ID NO: 213823 - DNA, 20 bp, Artificial
  CRISPR gRNA sequence
tttggttttaccttaacata

SEQ ID NO: 213824 - DNA, 20 bp, Artificial
  CRISPR gRNA sequence
accttaacatattatgattc

SEQ ID NO: 213825 - DNA, 20 bp, Artificial
  CRISPR gRNA sequence
gttttgttggcatttagtaa

SEQ ID NO: 213826 - DNA, 20 bp, Artificial
  CRISPR gRNA sequence
ttggcatttagtaattatgt

SEQ ID NO: 213827 - DNA, 20 bp, Artificial
  CRISPR gRNA sequence
aatcactcctcggtcatgta

SEQ ID NO: 213828 - DNA, 20 bp, Artificial
  CRISPR gRNA sequence
actcctcggtcatgtaaata

SEQ ID NO: 213829 - DNA, 20 bp, Artificial
  CRISPR gRNA sequence
aaatagtttgctttatattt

SEQ ID NO: 213830 - DNA, 20 bp, Artificial
  CRISPR gRNA sequence
caagtgtcattaatatttgc

SEQ ID NO: 213831 - DNA, 20 bp, Artificial
  CRISPR gRNA sequence
aatggcgtgaacccgggagg

SEQ ID NO: 213832 - DNA, 20 bp, Artificial
  CRISPR gRNA sequence
tccagtcatgcattggtgaa

SEQ ID NO: 213833 - DNA, 20 bp, Artificial
  CRISPR gRNA sequence
cacagaatgatcctactttt

SEQ ID NO: 213834 - DNA, 20 bp, Artificial
  CRISPR gRNA sequence
ctagtaccaggaattgtgac

SEQ ID NO: 213835 - DNA, 20 bp, Artificial
  CRISPR gRNA sequence
ttctggtaactgtggcatgg

SEQ ID NO: 213836 - DNA, 20 bp, Artificial
  CRISPR gRNA sequence
gtttgttccaggaattgtgg

SEQ ID NO: 213837 - DNA, 20 bp, Artificial
  CRISPR gRNA sequence
ggaattgtggcatggtttgt

SEQ ID NO: 213838 - DNA, 20 bp, Artificial
  CRISPR gRNA sequence
tgcatcaggaaatattgtaa

SEQ ID NO: 213839 - DNA, 20 bp, Artificial
  CRISPR gRNA sequence
gatgaaatctacgatgatct

SEQ ID NO: 213840 - DNA, 20 bp, Artificial
  CRISPR gRNA sequence
ctaatattcagctgatcaga

SEQ ID NO: 213841 - DNA, 20 bp, Artificial
  CRISPR gRNA sequence
ggtgggtacttcccactgac

SEQ ID NO: 213842 - DNA, 20 bp, Artificial
  CRISPR gRNA sequence
acttcccactgacaactgct

SEQ ID NO: 213843 - DNA, 20 bp, Artificial
  CRISPR gRNA sequence
ttgtcaatgaatgaggttca

SEQ ID NO: 213844 - DNA, 20 bp, Artificial
  CRISPR gRNA sequence
tctttcatctacagctgatc

SEQ ID NO: 213845 - DNA, 20 bp, Artificial
  CRISPR gRNA sequence
attattctaggatcaacatc

SEQ ID NO: 213846 - DNA, 20 bp, Artificial
  CRISPR gRNA sequence
gctttgaaaaatcaacatct

SEQ ID NO: 213847 - DNA, 20 bp, Artificial
  CRISPR gRNA sequence
tcctcagccaacccagcaaa

SEQ ID NO: 213848 - DNA, 20 bp, Artificial
  CRISPR gRNA sequence
aaacagagattatcagactc

SEQ ID NO: 213849 - DNA, 20 bp, Artificial
  CRISPR gRNA sequence
cttactgaaattaaaaaggc

SEQ ID NO: 213850 - DNA, 20 bp, Artificial
  CRISPR gRNA sequence
ttaaaaaggctaatgatttg

SEQ ID NO: 213851 - DNA, 20 bp, Artificial
  CRISPR gRNA sequence
ggatagaaaatagacacgaa

SEQ ID NO: 213852 - DNA, 20 bp, Artificial
  CRISPR gRNA sequence
aactgaagtgaagtgatgga

SEQ ID NO: 213853 - DNA, 20 bp, Artificial
  CRISPR gRNA sequence
aagacgtgaaaggaatacac

SEQ ID NO: 213854 - DNA, 20 bp, Artificial
  CRISPR gRNA sequence
gtgtttaagcaccatggcct

SEQ ID NO: 213855 - DNA, 20 bp, Artificial
  CRISPR gRNA sequence
ttgtcacctatgagaccctt

SEQ ID NO: 213856 - DNA, 20 bp, Artificial
  CRISPR gRNA sequence
gacccttacgtgattgttag

SEQ ID NO: 213857 - DNA, 20 bp, Artificial
  CRISPR gRNA sequence
aataaaataattatgatcta

SEQ ID NO: 213858 - DNA, 20 bp, Artificial
  CRISPR gRNA sequence
tgttgtttgcccaattgaga

SEQ ID NO: 213859 - DNA, 20 bp, Artificial
  CRISPR gRNA sequence
gggcctctggcctctaggta

SEQ ID NO: 213860 - DNA, 20 bp, Artificial
  CRISPR gRNA sequence
ataactacttagcactgccc

SEQ ID NO: 213861 - DNA, 20 bp, Artificial
  CRISPR gRNA sequence
cagagatatctatgaaaacc

SEQ ID NO: 213862 - DNA, 20 bp, Artificial
  CRISPR gRNA sequence
ctttgccaactcaggttcac

SEQ ID NO: 213863 - DNA, 20 bp, Artificial
  CRISPR gRNA sequence
aaacagtgtaacaggtcctt

SEQ ID NO: 213864 - DNA, 20 bp, Artificial
  CRISPR gRNA sequence
tagggtacttttattgatgg

SEQ ID NO: 213865 - DNA, 20 bp, Artificial
  CRISPR gRNA sequence
ccctgtcttgtcctcctgtt

SEQ ID NO: 213866 - DNA, 20 bp, Artificial
  CRISPR gRNA sequence
gtaacatatgtattcccttc

SEQ ID NO: 213867 - DNA, 20 bp, Artificial
  CRISPR gRNA sequence
gatttgaaggcaaaaatcta

SEQ ID NO: 213868 - DNA, 20 bp, Artificial
  CRISPR gRNA sequence
tgatctggggcatgaaaaaa

SEQ ID NO: 213869 - DNA, 20 bp, Artificial
  CRISPR gRNA sequence
ccaacaggccagcccttgaa

SEQ ID NO: 213870 - DNA, 20 bp, Artificial
  CRISPR gRNA sequence
tgcctcgtactccccttccc

SEQ ID NO: 213871 - DNA, 20 bp, Artificial
  CRISPR gRNA sequence
agtacttttagacttttagc

SEQ ID NO: 213872 - DNA, 20 bp, Artificial
  CRISPR gRNA sequence
acttttagcattcgtttttt

SEQ ID NO: 213873 - DNA, 20 bp, Artificial
  CRISPR gRNA sequence
ttttttacctgtttgtggat

SEQ ID NO: 213874 - DNA, 20 bp, Artificial
  CRISPR gRNA sequence
caggagagcaaaggttaatt

SEQ ID NO: 213875 - DNA, 20 bp, Artificial
  CRISPR gRNA sequence
taaaacttctaggtaatttg

SEQ ID NO: 213876 - DNA, 20 bp, Artificial
  CRISPR gRNA sequence
ctgtaaaaatacgtaattct

SEQ ID NO: 213877 - DNA, 20 bp, Artificial
  CRISPR gRNA sequence
cgtgtgcctcttttatgcca

SEQ ID NO: 213878 - DNA, 20 bp, Artificial
  CRISPR gRNA sequence
catatttcatgttgggacca

SEQ ID NO: 213879 - DNA, 20 bp, Artificial
  CRISPR gRNA sequence
atacacacatgtatattctt

SEQ ID NO: 213880 - DNA, 20 bp, Artificial
  CRISPR gRNA sequence
aaatatttacattttgctaa

SEQ ID NO: 213881 - DNA, 20 bp, Artificial
  CRISPR gRNA sequence
cctagtttgttactttaaaa

SEQ ID NO: 213882 - DNA, 20 bp, Artificial
  CRISPR gRNA sequence
aactcttgctctcactagtt

SEQ ID NO: 213883 - DNA, 20 bp, Artificial
  CRISPR gRNA sequence
gaccacagaagcaggagtcc

SEQ ID NO: 213884 - DNA, 20 bp, Artificial
  CRISPR gRNA sequence
ggccagttccttctctttaa

SEQ ID NO: 213885 - DNA, 20 bp, Artificial
  CRISPR gRNA sequence
catcacatttaaattgcaga

SEQ ID NO: 213886 - DNA, 20 bp, Artificial
  CRISPR gRNA sequence
cagtgttttgcacatcatgt

SEQ ID NO: 213887 - DNA, 20 bp, Artificial
  CRISPR gRNA sequence
tgtatctgttttgtcccata

SEQ ID NO: 213888 - DNA, 20 bp, Artificial
  CRISPR gRNA sequence
tatgctttttactccctgat

SEQ ID NO: 213889 - DNA, 20 bp, Artificial
  CRISPR gRNA sequence
ttctgctgttgactcttcca

SEQ ID NO: 213890 - DNA, 20 bp, Artificial
  CRISPR gRNA sequence
tcctatagtactttatgcat

SEQ ID NO: 213891 - DNA, 20 bp, Artificial
  CRISPR gRNA sequence
atgcatctctgcttagttct

SEQ ID NO: 213892 - DNA, 20 bp, Artificial
  CRISPR gRNA sequence
ttttttggccttgctcttct

SEQ ID NO: 213893 - DNA, 20 bp, Artificial
  CRISPR gRNA sequence
tttaaaattccttctatagc

SEQ ID NO: 213894 - DNA, 20 bp, Artificial
  CRISPR gRNA sequence
tctttcattctctcttcctg

SEQ ID NO: 213895 - DNA, 20 bp, Artificial
  CRISPR gRNA sequence
agaagctaggtacataagtt

SEQ ID NO: 213896 - DNA, 20 bp, Artificial
  CRISPR gRNA sequence
atgattgagagttggctgta

SEQ ID NO: 213897 - DNA, 20 bp, Artificial
  CRISPR gRNA sequence
atttatcactttttaatagg

SEQ ID NO: 213898 - DNA, 20 bp, Artificial
  CRISPR gRNA sequence
ctttttaatagggtgagctt

SEQ ID NO: 213899 - DNA, 20 bp, Artificial
  CRISPR gRNA sequence
agcttgagagttttctttct

SEQ ID NO: 213900 - DNA, 20 bp, Artificial
  CRISPR gRNA sequence
tctttctttctgtttttttt

SEQ ID NO: 213901 - DNA, 20 bp, Artificial
  CRISPR gRNA sequence
catgctctaaaaaccttcaa

SEQ ID NO: 213902 - DNA, 20 bp, Artificial
  CRISPR gRNA sequence
tcctggaaactccaggtcca

SEQ ID NO: 213903 - DNA, 20 bp, Artificial
  CRISPR gRNA sequence
ctaacaaagctcaaaacacg

SEQ ID NO: 213904 - DNA, 20 bp, Artificial
  CRISPR gRNA sequence
attaagctgtaatcaacctt

SEQ ID NO: 213905 - DNA, 20 bp, Artificial
  CRISPR gRNA sequence
cctgttgttggaaactggag

SEQ ID NO: 213906 - DNA, 20 bp, Artificial
  CRISPR gRNA sequence
tggagaaatgattgtcgggc

SEQ ID NO: 213907 - DNA, 20 bp, Artificial
  CRISPR gRNA sequence
ttattgtattttatttggtt

SEQ ID NO: 213908 - DNA, 20 bp, Artificial
  CRISPR gRNA sequence
ggttgagggatttttttata

SEQ ID NO: 213909 - DNA, 20 bp, Artificial
  CRISPR gRNA sequence
agatgagcagtgagtgacca

SEQ ID NO: 213910 - DNA, 20 bp, Artificial
  CRISPR gRNA sequence
gaccaggcagtttttctgcc

SEQ ID NO: 213911 - DNA, 20 bp, Artificial
  CRISPR gRNA sequence
cttaattaagatcattgaag

SEQ ID NO: 213912 - DNA, 20 bp, Artificial
  CRISPR gRNA sequence
actggtgagagaagaaaaca

SEQ ID NO: 213913 - DNA, 20 bp, Artificial
  CRISPR gRNA sequence
ctatgtgcaagatcctctct

SEQ ID NO: 213914 - DNA, 20 bp, Artificial
  CRISPR gRNA sequence
tgtcagtagccatttttttg

SEQ ID NO: 213915 - DNA, 20 bp, Artificial
  CRISPR gRNA sequence
tgcagtgatttgaagaccaa

SEQ ID NO: 213916 - DNA, 20 bp, Artificial
  CRISPR gRNA sequence
tttacagctgtgttaccgtt

SEQ ID NO: 213917 - DNA, 20 bp, Artificial
  CRISPR gRNA sequence
tatgtattaaatcaatttat

SEQ ID NO: 213918 - DNA, 20 bp, Artificial
  CRISPR gRNA sequence
taaatcaatttatcactgtt

SEQ ID NO: 213919 - DNA, 20 bp, Artificial
  CRISPR gRNA sequence
aatttattaatgtattttta

SEQ ID NO: 213920 - DNA, 20 bp, Artificial
  CRISPR gRNA sequence
attctaggtaacaatgtaaa

SEQ ID NO: 213921 - DNA, 20 bp, Artificial
  CRISPR gRNA sequence
ttttttgagtataataccca

SEQ ID NO: 213922 - DNA, 20 bp, Artificial
  CRISPR gRNA sequence
caataagcttttaattagag

SEQ ID NO: 213923 - DNA, 20 bp, Artificial
  CRISPR gRNA sequence
attagagcagagttttaatt

SEQ ID NO: 213924 - DNA, 20 bp, Artificial
  CRISPR gRNA sequence
aaaagttttaaatcagtcca

SEQ ID NO: 213925 - DNA, 20 bp, Artificial
  CRISPR gRNA sequence
tgatgttttcactgcaccat

SEQ ID NO: 213926 - DNA, 20 bp, Artificial
  CRISPR gRNA sequence
atcattctttacattgttac

SEQ ID NO: 213927 - DNA, 20 bp, Artificial
  CRISPR gRNA sequence
acattaataaattaaatttt

SEQ ID NO: 213928 - DNA, 20 bp, Artificial
  CRISPR gRNA sequence
tgtggtctgctgtagcagca

SEQ ID NO: 213929 - DNA, 20 bp, Artificial
  CRISPR gRNA sequence
aacactggagttctctttat

SEQ ID NO: 213930 - DNA, 20 bp, Artificial
  CRISPR gRNA sequence
atgctttctttttttcaaaa

SEQ ID NO: 213931 - DNA, 20 bp, Artificial
  CRISPR gRNA sequence
ttttcaaaaagagaaattta

SEQ ID NO: 213932 - DNA, 20 bp, Artificial
  CRISPR gRNA sequence
aagaactgtcaaagctaaag

SEQ ID NO: 213933 - DNA, 20 bp, Artificial
  CRISPR gRNA sequence
tgaatacccattttaagaca

SEQ ID NO: 213934 - DNA, 20 bp, Artificial
  CRISPR gRNA sequence
ttgactatagcatcctgaaa

SEQ ID NO: 213935 - DNA, 20 bp, Artificial
  CRISPR gRNA sequence
tgacattcttagggatttaa

SEQ ID NO: 213936 - DNA, 20 bp, Artificial
  CRISPR gRNA sequence
gaatggacctggagtttcca

SEQ ID NO: 213937 - DNA, 20 bp, Artificial
  CRISPR gRNA sequence
aaaaaaaacaaaaaaaaaaa

SEQ ID NO: 213938 - DNA, 20 bp, Artificial
  CRISPR gRNA sequence
aaaacaaaaaaaaaaaacag

SEQ ID NO: 213939 - DNA, 20 bp, Artificial
  CRISPR gRNA sequence
caaaaaaaaaaaacagaaag

SEQ ID NO: 213940 - DNA, 20 bp, Artificial
  CRISPR gRNA sequence
atgcaaaacactgcaggaag

SEQ ID NO: 213941 - DNA, 20 bp, Artificial
  CRISPR gRNA sequence
cactgcaggaagagagaatg

SEQ ID NO: 213942 - DNA, 20 bp, Artificial
  CRISPR gRNA sequence
gcaggaagagagaatgaaag

SEQ ID NO: 213943 - DNA, 20 bp, Artificial
  CRISPR gRNA sequence
agatgaagaggaactgcaaa

SEQ ID NO: 213944 - DNA, 20 bp, Artificial
  CRISPR gRNA sequence
tgttttgaaggagaagacaa

SEQ ID NO: 213945 - DNA, 20 bp, Artificial
  CRISPR gRNA sequence
aagtagctggaaaggttgtt

SEQ ID NO: 213946 - DNA, 20 bp, Artificial
  CRISPR gRNA sequence
actgaatggaagagtcaaca

SEQ ID NO: 213947 - DNA, 20 bp, Artificial
  CRISPR gRNA sequence
tggacagctacacaatcaag

SEQ ID NO: 213948 - DNA, 20 bp, Artificial
  CRISPR gRNA sequence
cacgggaacatctgatggac

SEQ ID NO: 213949 - DNA, 20 bp, Artificial
  CRISPR gRNA sequence
atatcttattacacaaacag

SEQ ID NO: 213950 - DNA, 20 bp, Artificial
  CRISPR gRNA sequence
tgcttttttcatgccccaga

SEQ ID NO: 213951 - DNA, 20 bp, Artificial
  CRISPR gRNA sequence
ccccagatcagaaaagaagt

SEQ ID NO: 213952 - DNA, 20 bp, Artificial
  CRISPR gRNA sequence
cactagaccatgttcaaaga

SEQ ID NO: 213953 - DNA, 20 bp, Artificial
  CRISPR gRNA sequence
aatgtgggaatggcaacccc

SEQ ID NO: 213954 - DNA, 20 bp, Artificial
  CRISPR gRNA sequence
gatatatagtatctaaaaat

SEQ ID NO: 213955 - DNA, 20 bp, Artificial
  CRISPR gRNA sequence
tagacctgcaaaggtcagag

SEQ ID NO: 213956 - DNA, 20 bp, Artificial
  CRISPR gRNA sequence
attagcctttttaatttcag

SEQ ID NO: 213957 - DNA, 20 bp, Artificial
  CRISPR gRNA sequence
caaagcaaaagatgttgatc

SEQ ID NO: 213958 - DNA, 20 bp, Artificial
  CRISPR gRNA sequence
tctgatcagctgtagatgaa

SEQ ID NO: 213959 - DNA, 20 bp, Artificial
  CRISPR gRNA sequence
gctgaatattagcaaaatta

SEQ ID NO: 213960 - DNA, 20 bp, Artificial
  CRISPR gRNA sequence
tttaaaaaagtcacatctta

SEQ ID NO: 213961 - DNA, 20 bp, Artificial
  CRISPR gRNA sequence
tagattgctttcctgaaaat

SEQ ID NO: 213962 - DNA, 20 bp, Artificial
  CRISPR gRNA sequence
accaaggaaaaggaaaggac

SEQ ID NO: 213963 - DNA, 20 bp, Artificial
  CRISPR gRNA sequence
taaaaaaaaaaaataggaca

SEQ ID NO: 213964 - DNA, 20 bp, Artificial
  CRISPR gRNA sequence
aaatcaccaacacaagcata

SEQ ID NO: 213965 - DNA, 20 bp, Artificial
  CRISPR gRNA sequence
tagatttaagttgtatacat

SEQ ID NO: 213966 - DNA, 20 bp, Artificial
  CRISPR gRNA sequence
gaaatcagatctaggtttac

SEQ ID NO: 213967 - DNA, 20 bp, Artificial
  CRISPR gRNA sequence
tcagatctaggtttacaaag

SEQ ID NO: 213968 - DNA, 20 bp, Artificial
  CRISPR gRNA sequence
aggtaagcagctacttagac

SEQ ID NO: 213969 - DNA, 20 bp, Artificial
  CRISPR gRNA sequence
tagtgcatttttcccagtgg

SEQ ID NO: 213970 - DNA, 20 bp, Artificial
  CRISPR gRNA sequence
caagagtagagatgccaagg

SEQ ID NO: 213971 - DNA, 20 bp, Artificial
  CRISPR gRNA sequence
aaatcctacagtcaaaaaaa

SEQ ID NO: 213972 - DNA, 20 bp, Artificial
  CRISPR gRNA sequence
tcttaatattatttttctaa

SEQ ID NO: 213973 - DNA, 20 bp, Artificial
  CRISPR gRNA sequence
ccacttcaccactctcagct

SEQ ID NO: 213974 - DNA, 20 bp, Artificial
  CRISPR gRNA sequence
tgcaagcataaatagcaaca

SEQ ID NO: 213975 - DNA, 20 bp, Artificial
  CRISPR gRNA sequence
agtgaagaggtggaagcaaa

SEQ ID NO: 213976 - DNA, 20 bp, Artificial
  CRISPR gRNA sequence
aattgaactcagtaactggg

SEQ ID NO: 213977 - DNA, 20 bp, Artificial
  CRISPR gRNA sequence
tagctatggcaccaatcttt

SEQ ID NO: 213978 - DNA, 20 bp, Artificial
  CRISPR gRNA sequence
gtgagaagtcagtacaatct

SEQ ID NO: 213979 - DNA, 20 bp, Artificial
  CRISPR gRNA sequence
aagctgatataaataacaaa

SEQ ID NO: 213980 - DNA, 20 bp, Artificial
  CRISPR gRNA sequence
tctatctacccagagtgtag

SEQ ID NO: 213981 - DNA, 20 bp, Artificial
  CRISPR gRNA sequence
cagagtgtagacagaatgtg

SEQ ID NO: 213982 - DNA, 20 bp, Artificial
  CRISPR gRNA sequence
ctccaaagagctaacaaact

SEQ ID NO: 213983 - DNA, 20 bp, Artificial
  CRISPR gRNA sequence
agcaaagtgacgaaagggaa

SEQ ID NO: 213984 - DNA, 20 bp, Artificial
  CRISPR gRNA sequence
acccaaaaaaacaaataaat

SEQ ID NO: 213985 - DNA, 20 bp, Artificial
  CRISPR gRNA sequence
aaaaacaaataaatacagaa

SEQ ID NO: 213986 - DNA, 20 bp, Artificial
  CRISPR gRNA sequence
tacagatggaaaagcgttga

SEQ ID NO: 213987 - DNA, 20 bp, Artificial
  CRISPR gRNA sequence
tccctgccactggactctaa

SEQ ID NO: 213988 - DNA, 20 bp, Artificial
  CRISPR gRNA sequence
ccactggactctaagaagaa

SEQ ID NO: 213989 - DNA, 20 bp, Artificial
  CRISPR gRNA sequence
aagaagaaacagaaaaaaac

SEQ ID NO: 213990 - DNA, 20 bp, Artificial
  CRISPR gRNA sequence
tgatgggaagggaaagtgaa

SEQ ID NO: 213991 - DNA, 20 bp, Artificial
  CRISPR gRNA sequence
gaagggaaagtgaaaaagaa

SEQ ID NO: 213992 - DNA, 20 bp, Artificial
  CRISPR gRNA sequence
gatgagtccaaagctgtagg

SEQ ID NO: 213993 - DNA, 20 bp, Artificial
  CRISPR gRNA sequence
gagctagctggctaataggc

SEQ ID NO: 213994 - DNA, 20 bp, Artificial
  CRISPR gRNA sequence
cagcctccccaataaactaa

SEQ ID NO: 213995 - DNA, 20 bp, Artificial
  CRISPR gRNA sequence
gccttatatctatgttctac

SEQ ID NO: 213996 - DNA, 20 bp, Artificial
  CRISPR gRNA sequence
tgagctcataaatgtattta

SEQ ID NO: 213997 - DNA, 20 bp, Artificial
  CRISPR gRNA sequence
taaaaacaaaacaaaacaaa

SEQ ID NO: 213998 - DNA, 20 bp, Artificial
  CRISPR gRNA sequence
tccttttcttccctaataat

SEQ ID NO: 213999 - DNA, 20 bp, Artificial
  CRISPR gRNA sequence
tttcttccctaataatgtag

SEQ ID NO: 214000 - DNA, 20 bp, Artificial
  CRISPR gRNA sequence
tctgaaaaaaaaagatttat

SEQ ID NO: 214001 - DNA, 20 bp, Artificial
  CRISPR gRNA sequence
tggatataacccatgtgaca

SEQ ID NO: 214002 - DNA, 20 bp, Artificial
  CRISPR gRNA sequence
atttccagggtttaaatttt

SEQ ID NO: 214003 - DNA, 20 bp, Artificial
  CRISPR gRNA sequence
ttacctctccttaaattgaa

SEQ ID NO: 214004 - DNA, 20 bp, Artificial
  CRISPR gRNA sequence
actggtaatggctttaaaaa

SEQ ID NO: 214005 - DNA, 20 bp, Artificial
  CRISPR gRNA sequence
aaattaaaatgcttccaata

SEQ ID NO: 214006 - DNA, 20 bp, Artificial
  CRISPR gRNA sequence
acagtttaaaaagttaaaaa

SEQ ID NO: 214007 - DNA, 20 bp, Artificial
  CRISPR gRNA sequence
agaaagtgaaagtcactttc

SEQ ID NO: 214008 - DNA, 20 bp, Artificial
  CRISPR gRNA sequence
agtcactttcacagaaagtt

SEQ ID NO: 214009 - DNA, 20 bp, Artificial
  CRISPR gRNA sequence
cgacattaacttcttcttga

SEQ ID NO: 214010 - DNA, 20 bp, Artificial
  CRISPR gRNA sequence
cttatatgctaacctatgac

SEQ ID NO: 214011 - DNA, 20 bp, Artificial
  CRISPR gRNA sequence
gattggaagatgtaacaaaa

SEQ ID NO: 214012 - DNA, 20 bp, Artificial
  CRISPR gRNA sequence
tggcattatgtggtataaaa

SEQ ID NO: 214013 - DNA, 20 bp, Artificial
  CRISPR gRNA sequence
ttatctaataagcattaatt

SEQ ID NO: 214014 - DNA, 20 bp, Artificial
  CRISPR gRNA sequence
agcattaattaaagaaagac

SEQ ID NO: 214015 - DNA, 20 bp, Artificial
  CRISPR gRNA sequence
agaaagacacagaatatatg

SEQ ID NO: 214016 - DNA, 20 bp, Artificial
  CRISPR gRNA sequence
caatcatcaagaaccaaagt

SEQ ID NO: 214017 - DNA, 20 bp, Artificial
  CRISPR gRNA sequence
aaactattatgtgagtcata

SEQ ID NO: 214018 - DNA, 20 bp, Artificial
  CRISPR gRNA sequence
ttcaagtttcgtattaagtt

SEQ ID NO: 214019 - DNA, 20 bp, Artificial
  CRISPR gRNA sequence
caaagtttacctaaagcaaa

SEQ ID NO: 214020 - DNA, 20 bp, Artificial
  CRISPR gRNA sequence
acatatatctcaataaaaaa

SEQ ID NO: 214021 - DNA, 20 bp, Artificial
  CRISPR gRNA sequence
aataaaaaataagaatttat

SEQ ID NO: 214022 - DNA, 20 bp, Artificial
  CRISPR gRNA sequence
tggcagattaaatatacaag

SEQ ID NO: 214023 - DNA, 20 bp, Artificial
  CRISPR gRNA sequence
gtctggggtgtctatgtctg

SEQ ID NO: 214024 - DNA, 20 bp, Artificial
  CRISPR gRNA sequence
ctgtgcaggacagctctatc

SEQ ID NO: 214025 - DNA, 20 bp, Artificial
  CRISPR gRNA sequence
aaaacaaataaaattctgta

SEQ ID NO: 214026 - DNA, 20 bp, Artificial
  CRISPR gRNA sequence
taacacataccttatcatat

SEQ ID NO: 214027 - DNA, 20 bp, Artificial
  CRISPR gRNA sequence
ggggtaaattggaagtttaa

SEQ ID NO: 214028 - DNA, 20 bp, Artificial
  CRISPR gRNA sequence
ggaagtttaaaaagaaaagc

SEQ ID NO: 214029 - DNA, 20 bp, Artificial
  CRISPR gRNA sequence
gtctatatatttttaaaaag

SEQ ID NO: 214030 - DNA, 20 bp, Artificial
  CRISPR gRNA sequence
atatatttttaaaaagagag

SEQ ID NO: 214031 - DNA, 20 bp, Artificial
  CRISPR gRNA sequence
ttttaaaaagagagaaagaa

SEQ ID NO: 214032 - DNA, 20 bp, Artificial
  CRISPR gRNA sequence
aagtaacccaaattaggtct

SEQ ID NO: 214033 - DNA, 20 bp, Artificial
  CRISPR gRNA sequence
agcagaagcttagcaaaaga

SEQ ID NO: 214034 - DNA, 20 bp, Artificial
  CRISPR gRNA sequence
ataacttcaaaaaactgaaa

SEQ ID NO: 214035 - DNA, 20 bp, Artificial
  CRISPR gRNA sequence
ctttttacaaaacagctaac

SEQ ID NO: 214036 - DNA, 20 bp, Artificial
  CRISPR gRNA sequence
tatgaatgggaaaatgtcac

SEQ ID NO: 214037 - DNA, 20 bp, Artificial
  CRISPR gRNA sequence
gcctccttcttaactagttt

SEQ ID NO: 214038 - DNA, 20 bp, Artificial
  CRISPR gRNA sequence
actagtttacagaattccag

SEQ ID NO: 214039 - DNA, 20 bp, Artificial
  CRISPR gRNA sequence
attccagaagctagaagagc

SEQ ID NO: 214040 - DNA, 20 bp, Artificial
  CRISPR gRNA sequence
gcacatcttacctgggacga

SEQ ID NO: 214041 - DNA, 20 bp, Artificial
  CRISPR gRNA sequence
tctatatttaagtgcttaaa

SEQ ID NO: 214042 - DNA, 20 bp, Artificial
  CRISPR gRNA sequence
agtgcttaaaaaagaaaaac

SEQ ID NO: 214043 - DNA, 20 bp, Artificial
  CRISPR gRNA sequence
gggacactgctctgcataat

SEQ ID NO: 214044 - DNA, 20 bp, Artificial
  CRISPR gRNA sequence
aatgggttaattaacaatat

SEQ ID NO: 214045 - DNA, 20 bp, Artificial
  CRISPR gRNA sequence
aattaacaatattgagaaaa

SEQ ID NO: 214046 - DNA, 20 bp, Artificial
  CRISPR gRNA sequence
attttgttttgaaaaaaatg

SEQ ID NO: 214047 - DNA, 20 bp, Artificial
  CRISPR gRNA sequence
cacccttgtgaaatcctgat

SEQ ID NO: 214048 - DNA, 20 bp, Artificial
  CRISPR gRNA sequence
agtatctcataccttctctg

SEQ ID NO: 214049 - DNA, 20 bp, Artificial
  CRISPR gRNA sequence
aaaagcaaactgagtagcgg

SEQ ID NO: 214050 - DNA, 20 bp, Artificial
  CRISPR gRNA sequence
aaatccacattaatcagaga

SEQ ID NO: 214051 - DNA, 20 bp, Artificial
  CRISPR gRNA sequence
agaagagaaacccatattaa

SEQ ID NO: 214052 - DNA, 20 bp, Artificial
  CRISPR gRNA sequence
tttctaggctcaaatgctgg

SEQ ID NO: 214053 - DNA, 20 bp, Artificial
  CRISPR gRNA sequence
aagtcacaaaaggcacatac

SEQ ID NO: 214054 - DNA, 20 bp, Artificial
  CRISPR gRNA sequence
cacagtcaatcaaacattca

SEQ ID NO: 214055 - DNA, 20 bp, Artificial
  CRISPR gRNA sequence
aagctactaagatcaagcaa

SEQ ID NO: 214056 - DNA, 20 bp, Artificial
  CRISPR gRNA sequence
ggcttagaagagctgttata

SEQ ID NO: 214057 - DNA, 20 bp, Artificial
  CRISPR gRNA sequence
aggttttcttcagtgaatct

SEQ ID NO: 214058 - DNA, 20 bp, Artificial
  CRISPR gRNA sequence
aatacacaaaataaagtaca

SEQ ID NO: 214059 - DNA, 20 bp, Artificial
  CRISPR gRNA sequence
aaccaaaagcaggctacttc

SEQ ID NO: 214060 - DNA, 20 bp, Artificial
  CRISPR gRNA sequence
ggtgaaggcctactctactc

SEQ ID NO: 214061 - DNA, 20 bp, Artificial
  CRISPR gRNA sequence
atccaacaaaacccaaaacc

SEQ ID NO: 214062 - DNA, 20 bp, Artificial
  CRISPR gRNA sequence
caggctgatgcgtatcagac

SEQ ID NO: 214063 - DNA, 20 bp, Artificial
  CRISPR gRNA sequence
tcagactaagaataaatcat

SEQ ID NO: 214064 - DNA, 20 bp, Artificial
  CRISPR gRNA sequence
ataactctaggaaagtaatt

SEQ ID NO: 214065 - DNA, 20 bp, Artificial
  CRISPR gRNA sequence
aaatgaatattgttttcagt

SEQ ID NO: 214066 - DNA, 20 bp, Artificial
  CRISPR gRNA sequence
cataagcacattatttaata

SEQ ID NO: 214067 - DNA, 20 bp, Artificial
  CRISPR gRNA sequence
tgggagttcaagattattga

SEQ ID NO: 214068 - DNA, 20 bp, Artificial
  CRISPR gRNA sequence
ctactcgggaggctgagaca

SEQ ID NO: 214069 - DNA, 20 bp, Artificial
  CRISPR gRNA sequence
aaaaaaaaaaaaaaaaaaaa

SEQ ID NO: 214070 - DNA, 20 bp, Artificial
  CRISPR gRNA sequence
caggggccatcaaccaggtc

SEQ ID NO: 214071 - DNA, 20 bp, Artificial
  CRISPR gRNA sequence
taggctatgtcttcactttt

SEQ ID NO: 214072 - DNA, 20 bp, Artificial
  CRISPR gRNA sequence
gaataatttttctaatctat

SEQ ID NO: 214073 - DNA, 20 bp, Artificial
  CRISPR gRNA sequence
aaaaaaaaaattaaagatgc

SEQ ID NO: 214074 - DNA, 20 bp, Artificial
  CRISPR gRNA sequence
aatcaaaagaggaaactagg

SEQ ID NO: 214075 - DNA, 20 bp, Artificial
  CRISPR gRNA sequence
ggcaagaaagatgaaagagt

SEQ ID NO: 214076 - DNA, 20 bp, Artificial
  CRISPR gRNA sequence
agaccataaatggagtaaga

SEQ ID NO: 214077 - DNA, 20 bp, Artificial
  CRISPR gRNA sequence
atgtcgacattactgcaatg

SEQ ID NO: 214078 - DNA, 20 bp, Artificial
  CRISPR gRNA sequence
aagtgaggaggatgtaacaa

SEQ ID NO: 214079 - DNA, 20 bp, Artificial
  CRISPR gRNA sequence
agagtgcaaaggataaaacg

SEQ ID NO: 214080 - DNA, 20 bp, Artificial
  CRISPR gRNA sequence
cggtagaaaccgatccaaac

SEQ ID NO: 214081 - DNA, 20 bp, Artificial
  CRISPR gRNA sequence
ttcatcatgaagattgtttt

SEQ ID NO: 214082 - DNA, 20 bp, Artificial
  CRISPR gRNA sequence
taaaacaaagttacaaaggc

SEQ ID NO: 214083 - DNA, 20 bp, Artificial
  CRISPR gRNA sequence
agaacagataggcctatctc

SEQ ID NO: 214084 - DNA, 20 bp, Artificial
  CRISPR gRNA sequence
cacttaaaatgatatcagag

SEQ ID NO: 214085 - DNA, 20 bp, Artificial
  CRISPR gRNA sequence
aatgatatcagagtgagaaa

SEQ ID NO: 214086 - DNA, 20 bp, Artificial
  CRISPR gRNA sequence
tcaagatacagctctggtat

SEQ ID NO: 214087 - DNA, 20 bp, Artificial
  CRISPR gRNA sequence
cagagctggaaaaaccactg

SEQ ID NO: 214088 - DNA, 20 bp, Artificial
  CRISPR gRNA sequence
tcaggaaaagttaagcagaa

SEQ ID NO: 214089 - DNA, 20 bp, Artificial
  CRISPR gRNA sequence
aaatatacatctaagcaggt

SEQ ID NO: 214090 - DNA, 20 bp, Artificial
  CRISPR gRNA sequence
ggccatcaacagaggcacta

SEQ ID NO: 214091 - DNA, 20 bp, Artificial
  CRISPR gRNA sequence
caccctgtcactaggtattt

SEQ ID NO: 214092 - DNA, 20 bp, Artificial
  CRISPR gRNA sequence
ctatgcccatagagtttctg

SEQ ID NO: 214093 - DNA, 20 bp, Artificial
  CRISPR gRNA sequence
gagattttagcgttataata

SEQ ID NO: 214094 - DNA, 20 bp, Artificial
  CRISPR gRNA sequence
aaaaaagataacaaaaatga

SEQ ID NO: 214095 - DNA, 20 bp, Artificial
  CRISPR gRNA sequence
acaaaaatgaatagaaaaag

SEQ ID NO: 214096 - DNA, 20 bp, Artificial
  CRISPR gRNA sequence
aaagggaaacaggaaattca

SEQ ID NO: 214097 - DNA, 20 bp, Artificial
  CRISPR gRNA sequence
atatgtatgacttttttaag

SEQ ID NO: 214098 - DNA, 20 bp, Artificial
  CRISPR gRNA sequence
tttccctaatatcattgatg

SEQ ID NO: 214099 - DNA, 20 bp, Artificial
  CRISPR gRNA sequence
cataaaaaactaagagatta

SEQ ID NO: 214100 - DNA, 20 bp, Artificial
  CRISPR gRNA sequence
tctgaaatcactaagcattt

SEQ ID NO: 214101 - DNA, 20 bp, Artificial
  CRISPR gRNA sequence
atttccagaatgccatacac

SEQ ID NO: 214102 - DNA, 20 bp, Artificial
  CRISPR gRNA sequence
cttttgtgtgtttaaaggtt

SEQ ID NO: 214103 - DNA, 20 bp, Artificial
  CRISPR gRNA sequence
aagggtgaacacgtgtacac

SEQ ID NO: 214104 - DNA, 20 bp, Artificial
  CRISPR gRNA sequence
tatttcgctgacaatgtctc

SEQ ID NO: 214105 - DNA, 20 bp, Artificial
  CRISPR gRNA sequence
cactgaaacataaatgaaaa

SEQ ID NO: 214106 - DNA, 20 bp, Artificial
  CRISPR gRNA sequence
aaaaattgggaaaataacaa

SEQ ID NO: 214107 - DNA, 20 bp, Artificial
  CRISPR gRNA sequence
caataagaatattttcattt

SEQ ID NO: 214108 - DNA, 20 bp, Artificial
  CRISPR gRNA sequence
aaaaccatgaaactggggaa

SEQ ID NO: 214109 - DNA, 20 bp, Artificial
  CRISPR gRNA sequence
tggctgggtgtgtaaagttc

SEQ ID NO: 214110 - DNA, 20 bp, Artificial
  CRISPR gRNA sequence
taaaatgcttacatcaatcc

SEQ ID NO: 214111 - DNA, 20 bp, Artificial
  CRISPR gRNA sequence
gttttatagatattagcttt

SEQ ID NO: 214112 - DNA, 20 bp, Artificial
  CRISPR gRNA sequence
actgaatatcttcttatgcc

SEQ ID NO: 214113 - DNA, 20 bp, Artificial
  CRISPR gRNA sequence
aaatcctcacaattatgatg

SEQ ID NO: 214114 - DNA, 20 bp, Artificial
  CRISPR gRNA sequence
attaacccctccttatagtt

SEQ ID NO: 214115 - DNA, 20 bp, Artificial
  CRISPR gRNA sequence
caaaattttaggatatatta

SEQ ID NO: 214116 - DNA, 20 bp, Artificial
  CRISPR gRNA sequence
tgccaaaggaacggcaactt

SEQ ID NO: 214117 - DNA, 20 bp, Artificial
  CRISPR gRNA sequence
gctggaaggctttaaatagg

SEQ ID NO: 214118 - DNA, 20 bp, Artificial
  CRISPR gRNA sequence
atcttctttggcagccacat

SEQ ID NO: 214119 - DNA, 20 bp, Artificial
  CRISPR gRNA sequence
ttacagggaagcaggacctg

SEQ ID NO: 214120 - DNA, 20 bp, Artificial
  CRISPR gRNA sequence
attgctccaaaggaagatga

SEQ ID NO: 214121 - DNA, 20 bp, Artificial
  CRISPR gRNA sequence
cacagagaggtataaacttg

SEQ ID NO: 214122 - DNA, 20 bp, Artificial
  CRISPR gRNA sequence
actacagccctcccagtgag

SEQ ID NO: 214123 - DNA, 20 bp, Artificial
  CRISPR gRNA sequence
cgccagctacttggggtgtg

SEQ ID NO: 214124 - DNA, 20 bp, Artificial
  CRISPR gRNA sequence
ctcccagattctatgtgaaa

SEQ ID NO: 214125 - DNA, 20 bp, Artificial
  CRISPR gRNA sequence
ctcctccaattcctggacag

SEQ ID NO: 214126 - DNA, 20 bp, Artificial
  CRISPR gRNA sequence
cattatttatttaatcaaac

SEQ ID NO: 214127 - DNA, 20 bp, Artificial
  CRISPR gRNA sequence
gatcccaaatcagctgactt

SEQ ID NO: 214128 - DNA, 20 bp, Artificial
  CRISPR gRNA sequence
atatgcaaggggccatgggg

SEQ ID NO: 214129 - DNA, 20 bp, Artificial
  CRISPR gRNA sequence
ttccttggcagatacttagc

SEQ ID NO: 214130 - DNA, 20 bp, Artificial
  CRISPR gRNA sequence
tttgtagttgttatgcagca

SEQ ID NO: 214131 - DNA, 20 bp, Artificial
  CRISPR gRNA sequence
aaacaaaactctaatagctt

SEQ ID NO: 214132 - DNA, 20 bp, Artificial
  CRISPR gRNA sequence
gtttttgtattgctaataga

SEQ ID NO: 214133 - DNA, 20 bp, Artificial
  CRISPR gRNA sequence
gcaataatgtcttattcatc

SEQ ID NO: 214134 - DNA, 20 bp, Artificial
  CRISPR gRNA sequence
tgccatctttactgtactaa

SEQ ID NO: 214135 - DNA, 20 bp, Artificial
  CRISPR gRNA sequence
aagctattaaacagtgaagt

SEQ ID NO: 214136 - DNA, 20 bp, Artificial
  CRISPR gRNA sequence
caaaaaatttaaaaaggcac

SEQ ID NO: 214137 - DNA, 20 bp, Artificial
  CRISPR gRNA sequence
tattatctgcattctattaa

SEQ ID NO: 214138 - DNA, 20 bp, Artificial
  CRISPR gRNA sequence
gtgacaagtaagtattctta

SEQ ID NO: 214139 - DNA, 20 bp, Artificial
  CRISPR gRNA sequence
ccagatactggtgaggatgt

SEQ ID NO: 214140 - DNA, 20 bp, Artificial
  CRISPR gRNA sequence
tacttctgagcatttatccc

SEQ ID NO: 214141 - DNA, 20 bp, Artificial
  CRISPR gRNA sequence
ggaggtggcggtatgactag

SEQ ID NO: 214142 - DNA, 20 bp, Artificial
  CRISPR gRNA sequence
ccaaatgtctcaaacctctg

SEQ ID NO: 214143 - DNA, 20 bp, Artificial
  CRISPR gRNA sequence
ccacaaaattgtacattacc

SEQ ID NO: 214144 - DNA, 20 bp, Artificial
  CRISPR gRNA sequence
aatgtaagagagatttctga

SEQ ID NO: 214145 - DNA, 20 bp, Artificial
  CRISPR gRNA sequence
tggtttatgctcattagact

SEQ ID NO: 214146 - DNA, 20 bp, Artificial
  CRISPR gRNA sequence
ttctaaatagagatttcaaa

SEQ ID NO: 214147 - DNA, 20 bp, Artificial
  CRISPR gRNA sequence
ccaagtttgtgataaaaagg

SEQ ID NO: 214148 - DNA, 20 bp, Artificial
  CRISPR gRNA sequence
agaccaaagtaaggctaagc

SEQ ID NO: 214149 - DNA, 20 bp, Artificial
  CRISPR gRNA sequence
aggctaagcacagaaaatct

SEQ ID NO: 214150 - DNA, 20 bp, Artificial
  CRISPR gRNA sequence
acttgaaaattagtcacagg

SEQ ID NO: 214151 - DNA, 20 bp, Artificial
  CRISPR gRNA sequence
aagcacttggatggcagcaa

SEQ ID NO: 214152 - DNA, 20 bp, Artificial
  CRISPR gRNA sequence
agagtagattaacaaatagg

SEQ ID NO: 214153 - DNA, 20 bp, Artificial
  CRISPR gRNA sequence
gagctgatcctggaaaggaa

SEQ ID NO: 214154 - DNA, 20 bp, Artificial
  CRISPR gRNA sequence
attactgcctactgatatat

SEQ ID NO: 214155 - DNA, 20 bp, Artificial
  CRISPR gRNA sequence
ttatcaaggtaaaattttga

SEQ ID NO: 214156 - DNA, 20 bp, Artificial
  CRISPR gRNA sequence
tattatgggtattcttcctc

SEQ ID NO: 214157 - DNA, 20 bp, Artificial
  CRISPR gRNA sequence
cattgttcaactaaaatgta

SEQ ID NO: 214158 - DNA, 20 bp, Artificial
  CRISPR gRNA sequence
ctggaataaaaatcagaggc

SEQ ID NO: 214159 - DNA, 20 bp, Artificial
  CRISPR gRNA sequence
tgtgaattatttcccctgag

SEQ ID NO: 214160 - DNA, 20 bp, Artificial
  CRISPR gRNA sequence
agaggacatagtataccaga

SEQ ID NO: 214161 - DNA, 20 bp, Artificial
  CRISPR gRNA sequence
attataaaggaaggaaagta

SEQ ID NO: 214162 - DNA, 20 bp, Artificial
  CRISPR gRNA sequence
gttttacagtttcataagtt

SEQ ID NO: 214163 - DNA, 20 bp, Artificial
  CRISPR gRNA sequence
ccatttcataacatatgttt

SEQ ID NO: 214164 - DNA, 20 bp, Artificial
  CRISPR gRNA sequence
gaatgaattttcaaaggaat

SEQ ID NO: 214165 - DNA, 20 bp, Artificial
  CRISPR gRNA sequence
ttatagctgaagcaatttaa

SEQ ID NO: 214166 - DNA, 20 bp, Artificial
  CRISPR gRNA sequence
ttctcataaaacagcaaagt

SEQ ID NO: 214167 - DNA, 20 bp, Artificial
  CRISPR gRNA sequence
ttaaaatgtagagagcaaat

SEQ ID NO: 214168 - DNA, 20 bp, Artificial
  CRISPR gRNA sequence
acacagataattaacatgaa

SEQ ID NO: 214169 - DNA, 20 bp, Artificial
  CRISPR gRNA sequence
aaaccatctcatatcatagt

SEQ ID NO: 214170 - DNA, 20 bp, Artificial
  CRISPR gRNA sequence
tcacagcacacaagttcagg

SEQ ID NO: 214171 - DNA, 20 bp, Artificial
  CRISPR gRNA sequence
aaaatgcaatcaacatttgt

SEQ ID NO: 214172 - DNA, 20 bp, Artificial
  CRISPR gRNA sequence
taattggtcttacagatttc

SEQ ID NO: 214173 - DNA, 20 bp, Artificial
  CRISPR gRNA sequence
gttgctaataggcaaaaaca

SEQ ID NO: 214174 - DNA, 20 bp, Artificial
  CRISPR gRNA sequence
tacaaactgaaaccttcaga

SEQ ID NO: 214175 - DNA, 20 bp, Artificial
  CRISPR gRNA sequence
cagtgaaccagacctggacc

SEQ ID NO: 214176 - DNA, 20 bp, Artificial
  CRISPR gRNA sequence
tactccctctccttagccat

SEQ ID NO: 214177 - DNA, 20 bp, Artificial
  CRISPR gRNA sequence
cttaactgatctctccaggc

SEQ ID NO: 214178 - DNA, 20 bp, Artificial
  CRISPR gRNA sequence
actgtcttcatttggtatcc

SEQ ID NO: 214179 - DNA, 20 bp, Artificial
  CRISPR gRNA sequence
ctaagaatctaacacagggt

SEQ ID NO: 214180 - DNA, 20 bp, Artificial
  CRISPR gRNA sequence
tttaaagtataaattccata

SEQ ID NO: 214181 - DNA, 20 bp, Artificial
  CRISPR gRNA sequence
caagtcacttgtatggttgg

SEQ ID NO: 214182 - DNA, 20 bp, Artificial
  CRISPR gRNA sequence
gaaaagttccttaaaaatca

SEQ ID NO: 214183 - DNA, 20 bp, Artificial
  CRISPR gRNA sequence
actgggtcttaaaggatgag

SEQ ID NO: 214184 - DNA, 20 bp, Artificial
  CRISPR gRNA sequence
agtaacgtgtacagccagat

SEQ ID NO: 214185 - DNA, 20 bp, Artificial
  CRISPR gRNA sequence
gaaagtgaagaactgaaagc

SEQ ID NO: 214186 - DNA, 20 bp, Artificial
  CRISPR gRNA sequence
atgaggttggaaaagatgaa

SEQ ID NO: 214187 - DNA, 20 bp, Artificial
  CRISPR gRNA sequence
actgagggcagcaagggaaa

SEQ ID NO: 214188 - DNA, 20 bp, Artificial
  CRISPR gRNA sequence
ttagatggtaggctaattat

SEQ ID NO: 214189 - DNA, 20 bp, Artificial
  CRISPR gRNA sequence
aaagaggcttaaatatttgg

SEQ ID NO: 214190 - DNA, 20 bp, Artificial
  CRISPR gRNA sequence
gatctgatgcacactatgtt

SEQ ID NO: 214191 - DNA, 20 bp, Artificial
  CRISPR gRNA sequence
cactatgtttgagaaatgag

SEQ ID NO: 214192 - DNA, 20 bp, Artificial
  CRISPR gRNA sequence
ttacaataaatttggcagtg

SEQ ID NO: 214193 - DNA, 20 bp, Artificial
  CRISPR gRNA sequence
aagatctaagatgcaagact

SEQ ID NO: 214194 - DNA, 20 bp, Artificial
  CRISPR gRNA sequence
ttctgaagctggatgacgga

SEQ ID NO: 214195 - DNA, 20 bp, Artificial
  CRISPR gRNA sequence
atcatcagtaaagacacatg

SEQ ID NO: 214196 - DNA, 20 bp, Artificial
  CRISPR gRNA sequence
tgaatttaaaagtggcctta

SEQ ID NO: 214197 - DNA, 20 bp, Artificial
  CRISPR gRNA sequence
taagaatggaagaggccaac

SEQ ID NO: 214198 - DNA, 20 bp, Artificial
  CRISPR gRNA sequence
cagtttaaagtcaataacat

SEQ ID NO: 214199 - DNA, 20 bp, Artificial
  CRISPR gRNA sequence
attgtcttagtctaggtata

SEQ ID NO: 214200 - DNA, 20 bp, Artificial
  CRISPR gRNA sequence
ttcttgttctttttatcaca

SEQ ID NO: 214201 - DNA, 20 bp, Artificial
  CRISPR gRNA sequence
ctgagagataagatatgaaa

SEQ ID NO: 214202 - DNA, 20 bp, Artificial
  CRISPR gRNA sequence
tatcttgtataaaaaggtag

SEQ ID NO: 214203 - DNA, 20 bp, Artificial
  CRISPR gRNA sequence
tatgcgtgattattttggat

SEQ ID NO: 214204 - DNA, 20 bp, Artificial
  CRISPR gRNA sequence
taaaaataatatattcttta

SEQ ID NO: 214205 - DNA, 20 bp, Artificial
  CRISPR gRNA sequence
aatcgaattaatttagcatt

SEQ ID NO: 214206 - DNA, 20 bp, Artificial
  CRISPR gRNA sequence
gaaaaacttcaacgtacaat

SEQ ID NO: 214207 - DNA, 20 bp, Artificial
  CRISPR gRNA sequence
ctgatggggcgtgagggtca

SEQ ID NO: 214208 - DNA, 20 bp, Artificial
  CRISPR gRNA sequence
gttcatgtgggaggcaaacg

SEQ ID NO: 214209 - DNA, 20 bp, Artificial
  CRISPR gRNA sequence
ctcgcgcaaaaattaactag

SEQ ID NO: 214210 - DNA, 20 bp, Artificial
  CRISPR gRNA sequence
ttcaactcagcattcaatca

SEQ ID NO: 214211 - DNA, 20 bp, Artificial
  CRISPR gRNA sequence
ctccagtcaaaacatgtgca

SEQ ID NO: 214212 - DNA, 20 bp, Artificial
  CRISPR gRNA sequence
ctgtaaaaactgagcaagga

SEQ ID NO: 214213 - DNA, 20 bp, Artificial
  CRISPR gRNA sequence
tttgtgaacttttataagat

SEQ ID NO: 214214 - DNA, 20 bp, Artificial
  CRISPR gRNA sequence
cagcaattgttacatttatt

SEQ ID NO: 214215 - DNA, 20 bp, Artificial
  CRISPR gRNA sequence
aatccctagagtcatcgaat

SEQ ID NO: 214216 - DNA, 20 bp, Artificial
  CRISPR gRNA sequence
agcttcaaaaggacatgtat

SEQ ID NO: 214217 - DNA, 20 bp, Artificial
  CRISPR gRNA sequence
aagggtttgagagactgact

SEQ ID NO: 214218 - DNA, 20 bp, Artificial
  CRISPR gRNA sequence
tgagagactgactttagaat

SEQ ID NO: 214219 - DNA, 20 bp, Artificial
  CRISPR gRNA sequence
actttagaatctagaatgag

SEQ ID NO: 214220 - DNA, 20 bp, Artificial
  CRISPR gRNA sequence
aaataaaaatgttttctctt

SEQ ID NO: 214221 - DNA, 20 bp, Artificial
  CRISPR gRNA sequence
ttcttctgtgataaaaagaa

SEQ ID NO: 214222 - DNA, 20 bp, Artificial
  CRISPR gRNA sequence
aaactcattgtagtactaaa

SEQ ID NO: 214223 - DNA, 20 bp, Artificial
  CRISPR gRNA sequence
gatatacctagactaagaca

SEQ ID NO: 214224 - DNA, 20 bp, Artificial
  CRISPR gRNA sequence
tacgattatacagtgttgaa

SEQ ID NO: 214225 - DNA, 20 bp, Artificial
  CRISPR gRNA sequence
atggagcagttgcataagac

SEQ ID NO: 214226 - DNA, 20 bp, Artificial
  CRISPR gRNA sequence
atggtttgagattcagatta

SEQ ID NO: 214227 - DNA, 20 bp, Artificial
  CRISPR gRNA sequence
tcttccgtcatccagcttca

SEQ ID NO: 214228 - DNA, 20 bp, Artificial
  CRISPR gRNA sequence
acactgccaaatttattgta

SEQ ID NO: 214229 - DNA, 20 bp, Artificial
  CRISPR gRNA sequence
atgacattcaaggaagccct

SEQ ID NO: 214230 - DNA, 20 bp, Artificial
  CRISPR gRNA sequence
ggctgtacacgttactctgc

SEQ ID NO: 214231 - DNA, 20 bp, Artificial
  CRISPR gRNA sequence
gcaggttctcttgaaataca

SEQ ID NO: 214232 - DNA, 20 bp, Artificial
  CRISPR gRNA sequence
aatgggagcaataaggaggg

SEQ ID NO: 214233 - DNA, 20 bp, Artificial
  CRISPR gRNA sequence
tgtattccatgctaatgtac

SEQ ID NO: 214234 - DNA, 20 bp, Artificial
  CRISPR gRNA sequence
gaacagttattttgggaact

SEQ ID NO: 214235 - DNA, 20 bp, Artificial
  CRISPR gRNA sequence
aaatacatcagggccaggat

SEQ ID NO: 214236 - DNA, 20 bp, Artificial
  CRISPR gRNA sequence
attaattaggttgaacctac

SEQ ID NO: 214237 - DNA, 20 bp, Artificial
  CRISPR gRNA sequence
gtctggttcactggtagatg

SEQ ID NO: 214238 - DNA, 20 bp, Artificial
  CRISPR gRNA sequence
tgtccaacatctgcagttta

SEQ ID NO: 214239 - DNA, 20 bp, Artificial
  CRISPR gRNA sequence
ttatttaaaagtttgcaggt

SEQ ID NO: 214240 - DNA, 20 bp, Artificial
  CRISPR gRNA sequence
gtcaaggaatagatttcaac

SEQ ID NO: 214241 - DNA, 20 bp, Artificial
  CRISPR gRNA sequence
tggaggccaagagagaagag

SEQ ID NO: 214242 - DNA, 20 bp, Artificial
  CRISPR gRNA sequence
agaactgtggaaaagtcaag

SEQ ID NO: 214243 - DNA, 20 bp, Artificial
  CRISPR gRNA sequence
taatttgggatgctagggag

SEQ ID NO: 214244 - DNA, 20 bp, Artificial
  CRISPR gRNA sequence
ggagactgatgggtatggag

SEQ ID NO: 214245 - DNA, 20 bp, Artificial
  CRISPR gRNA sequence
ttcaggtgatgggattcatt

SEQ ID NO: 214246 - DNA, 20 bp, Artificial
  CRISPR gRNA sequence
ctgaaggtttcagtttgtat

SEQ ID NO: 214247 - DNA, 20 bp, Artificial
  CRISPR gRNA sequence
tattagcaacatgaattttc

SEQ ID NO: 214248 - DNA, 20 bp, Artificial
  CRISPR gRNA sequence
tccataaggacgttgtccat

SEQ ID NO: 214249 - DNA, 20 bp, Artificial
  CRISPR gRNA sequence
tatacttatcatcgcccatt

SEQ ID NO: 214250 - DNA, 20 bp, Artificial
  CRISPR gRNA sequence
tcattcgtacctcttttttt

SEQ ID NO: 214251 - DNA, 20 bp, Artificial
  CRISPR gRNA sequence
aagaaggcaaaaccctttta

SEQ ID NO: 214252 - DNA, 20 bp, Artificial
  CRISPR gRNA sequence
cagacacatttataggcaat

SEQ ID NO: 214253 - DNA, 20 bp, Artificial
  CRISPR gRNA sequence
attcacaattccaaagtttt

SEQ ID NO: 214254 - DNA, 20 bp, Artificial
  CRISPR gRNA sequence
gcttcctagtatttgggtgg

SEQ ID NO: 214255 - DNA, 20 bp, Artificial
  CRISPR gRNA sequence
gtatttgggtggctagaaat

SEQ ID NO: 214256 - DNA, 20 bp, Artificial
  CRISPR gRNA sequence
taggttcagactgcaatttc

SEQ ID NO: 214257 - DNA, 20 bp, Artificial
  CRISPR gRNA sequence
tttagagagtaaaccaaggc

SEQ ID NO: 214258 - DNA, 20 bp, Artificial
  CRISPR gRNA sequence
aggcagcatattaaaaaggg

SEQ ID NO: 214259 - DNA, 20 bp, Artificial
  CRISPR gRNA sequence
gtaaacatagtgttcttaca

SEQ ID NO: 214260 - DNA, 20 bp, Artificial
  CRISPR gRNA sequence
aaaagagttgctgagtggct

SEQ ID NO: 214261 - DNA, 20 bp, Artificial
  CRISPR gRNA sequence
cgttttgtggtttcttggag

SEQ ID NO: 214262 - DNA, 20 bp, Artificial
  CRISPR gRNA sequence
taatgtatactttgtattat

SEQ ID NO: 214263 - DNA, 20 bp, Artificial
  CRISPR gRNA sequence
ttgtattattgagaatgaat

SEQ ID NO: 214264 - DNA, 20 bp, Artificial
  CRISPR gRNA sequence
tatttaataaaacaaaatct

SEQ ID NO: 214265 - DNA, 20 bp, Artificial
  CRISPR gRNA sequence
gaaactacacttgtgaagta

SEQ ID NO: 214266 - DNA, 20 bp, Artificial
  CRISPR gRNA sequence
cccagccatgctccctctgg

SEQ ID NO: 214267 - DNA, 20 bp, Artificial
  CRISPR gRNA sequence
ttctgttttgaaatctctat

SEQ ID NO: 214268 - DNA, 20 bp, Artificial
  CRISPR gRNA sequence
gtttgcacattacttaggat

SEQ ID NO: 214269 - DNA, 20 bp, Artificial
  CRISPR gRNA sequence
ggatggctccgagtaggcaa

SEQ ID NO: 214270 - DNA, 20 bp, Artificial
  CRISPR gRNA sequence
aatttgaaaggtctttctgc

SEQ ID NO: 214271 - DNA, 20 bp, Artificial
  CRISPR gRNA sequence
tgtacaattttgtggaaatg

SEQ ID NO: 214272 - DNA, 20 bp, Artificial
  CRISPR gRNA sequence
gaagatgaaatgaagatgga

SEQ ID NO: 214273 - DNA, 20 bp, Artificial
  CRISPR gRNA sequence
tattttgggagccattaaaa

SEQ ID NO: 214274 - DNA, 20 bp, Artificial
  CRISPR gRNA sequence
agaaagtattgttttattat

SEQ ID NO: 214275 - DNA, 20 bp, Artificial
  CRISPR gRNA sequence
attgttttattatagagaat

SEQ ID NO: 214276 - DNA, 20 bp, Artificial
  CRISPR gRNA sequence
taagtatatgcttagttttt

SEQ ID NO: 214277 - DNA, 20 bp, Artificial
  CRISPR gRNA sequence
gagtataagttcttttctaa

SEQ ID NO: 214278 - DNA, 20 bp, Artificial
  CRISPR gRNA sequence
ggactttgaggatttaagca

SEQ ID NO: 214279 - DNA, 20 bp, Artificial
  CRISPR gRNA sequence
tttgcaaatacaggcataaa

SEQ ID NO: 214280 - DNA, 20 bp, Artificial
  CRISPR gRNA sequence
aatacaggcataaatgagaa

SEQ ID NO: 214281 - DNA, 20 bp, Artificial
  CRISPR gRNA sequence
agagaagtgaattctactta

SEQ ID NO: 214282 - DNA, 20 bp, Artificial
  CRISPR gRNA sequence
aaggagcactggacttgaaa

SEQ ID NO: 214283 - DNA, 20 bp, Artificial
  CRISPR gRNA sequence
gacttcactgtttaatagct

SEQ ID NO: 214284 - DNA, 20 bp, Artificial
  CRISPR gRNA sequence
ttcaaggtcagagtaatagc

SEQ ID NO: 214285 - DNA, 20 bp, Artificial
  CRISPR gRNA sequence
ctaagctattagagttttgt

SEQ ID NO: 214286 - DNA, 20 bp, Artificial
  CRISPR gRNA sequence
tctaggctcacataattgtg

SEQ ID NO: 214287 - DNA, 20 bp, Artificial
  CRISPR gRNA sequence
gcatatttaaagccagcaaa

SEQ ID NO: 214288 - DNA, 20 bp, Artificial
  CRISPR gRNA sequence
gcaggggttttgggaccacc

SEQ ID NO: 214289 - DNA, 20 bp, Artificial
  CRISPR gRNA sequence
tagcctagcaagtcgacaca

SEQ ID NO: 214290 - DNA, 20 bp, Artificial
  CRISPR gRNA sequence
agttgtcagccatagcttgg

SEQ ID NO: 214291 - DNA, 20 bp, Artificial
  CRISPR gRNA sequence
taatttatgttcttagtggc

SEQ ID NO: 214292 - DNA, 20 bp, Artificial
  CRISPR gRNA sequence
gtgactgtagttcaaataca

SEQ ID NO: 214293 - DNA, 20 bp, Artificial
  CRISPR gRNA sequence
gcagcagtgatttcaaactg

SEQ ID NO: 214294 - DNA, 20 bp, Artificial
  CRISPR gRNA sequence
acaaactgataagttccagt

SEQ ID NO: 214295 - DNA, 20 bp, Artificial
  CRISPR gRNA sequence
ctacttgggaggctgagaca

SEQ ID NO: 214296 - DNA, 20 bp, Artificial
  CRISPR gRNA sequence
ccatctcaaaaataaaaaaa

SEQ ID NO: 214297 - DNA, 20 bp, Artificial
  CRISPR gRNA sequence
tctcatatttcttgtttcac

SEQ ID NO: 214298 - DNA, 20 bp, Artificial
  CRISPR gRNA sequence
ccagccgcttgtcattgctc

SEQ ID NO: 214299 - DNA, 20 bp, Artificial
  CRISPR gRNA sequence
tttaactagagtgggatgtg

SEQ ID NO: 214300 - DNA, 20 bp, Artificial
  CRISPR gRNA sequence
gttttcagcctcaagcaact

SEQ ID NO: 214301 - DNA, 20 bp, Artificial
  CRISPR gRNA sequence
atagcattataagcttaaca

SEQ ID NO: 214302 - DNA, 20 bp, Artificial
  CRISPR gRNA sequence
gacctgagagatagtgcgtg

SEQ ID NO: 214303 - DNA, 20 bp, Artificial
  CRISPR gRNA sequence
tacttggctttattgttaga

SEQ ID NO: 214304 - DNA, 20 bp, Artificial
  CRISPR gRNA sequence
ctacctcctcccgtgaaaca

SEQ ID NO: 214305 - DNA, 20 bp, Artificial
  CRISPR gRNA sequence
cgtgaaacataagaaaaatg

SEQ ID NO: 214306 - DNA, 20 bp, Artificial
  CRISPR gRNA sequence
gcatgtattatagaccatta

SEQ ID NO: 214307 - DNA, 20 bp, Artificial
  CRISPR gRNA sequence
ttggtgtttttttaatctct

SEQ ID NO: 214308 - DNA, 20 bp, Artificial
  CRISPR gRNA sequence
ttagatttagcttcaacaac

SEQ ID NO: 214309 - DNA, 20 bp, Artificial
  CRISPR gRNA sequence
ccatattttcatattttggt

SEQ ID NO: 214310 - DNA, 20 bp, Artificial
  CRISPR gRNA sequence
tctggaaatgcttagtgatt

SEQ ID NO: 214311 - DNA, 20 bp, Artificial
  CRISPR gRNA sequence
gtctgaaaggaaaaaagggg

SEQ ID NO: 214312 - DNA, 20 bp, Artificial
  CRISPR gRNA sequence
aatctcttagttttttatgt

SEQ ID NO: 214313 - DNA, 20 bp, Artificial
  CRISPR gRNA sequence
ctcatctgtagtccccaaac

SEQ ID NO: 214314 - DNA, 20 bp, Artificial
  CRISPR gRNA sequence
tctgatgttcccccatgtct

SEQ ID NO: 214315 - DNA, 20 bp, Artificial
  CRISPR gRNA sequence
acatactggcaaaatgtttt

SEQ ID NO: 214316 - DNA, 20 bp, Artificial
  CRISPR gRNA sequence
gtatcaactactattgcaga

SEQ ID NO: 214317 - DNA, 20 bp, Artificial
  CRISPR gRNA sequence
aggaacgtgcttataaacct

SEQ ID NO: 214318 - DNA, 20 bp, Artificial
  CRISPR gRNA sequence
tgaaatgacatttatttctc

SEQ ID NO: 214319 - DNA, 20 bp, Artificial
  CRISPR gRNA sequence
tgttattcccgttttgtaga

SEQ ID NO: 214320 - DNA, 20 bp, Artificial
  CRISPR gRNA sequence
agctaaaacttattaggaga

SEQ ID NO: 214321 - DNA, 20 bp, Artificial
  CRISPR gRNA sequence
tggcctgagcattccaccaa

SEQ ID NO: 214322 - DNA, 20 bp, Artificial
  CRISPR gRNA sequence
gagcattccaccaaatagaa

SEQ ID NO: 214323 - DNA, 20 bp, Artificial
  CRISPR gRNA sequence
cctgcttagatgtatatttt

SEQ ID NO: 214324 - DNA, 20 bp, Artificial
  CRISPR gRNA sequence
ccctcatttgctcactctga

SEQ ID NO: 214325 - DNA, 20 bp, Artificial
  CRISPR gRNA sequence
tttaacttaggaacttttaa

SEQ ID NO: 214326 - DNA, 20 bp, Artificial
  CRISPR gRNA sequence
agcaaacagctcagagattg

SEQ ID NO: 214327 - DNA, 20 bp, Artificial
  CRISPR gRNA sequence
gtatgtggtaaattaaatca

SEQ ID NO: 214328 - DNA, 20 bp, Artificial
  CRISPR gRNA sequence
aattaaatcattagaaacat

SEQ ID NO: 214329 - DNA, 20 bp, Artificial
  CRISPR gRNA sequence
tttgcactctcaatgtcatg

SEQ ID NO: 214330 - DNA, 20 bp, Artificial
  CRISPR gRNA sequence
tacatagttatttttgaact

SEQ ID NO: 214331 - DNA, 20 bp, Artificial
  CRISPR gRNA sequence
catggtaactggaattcata

SEQ ID NO: 214332 - DNA, 20 bp, Artificial
  CRISPR gRNA sequence
gtctttgagtagatgttcct

SEQ ID NO: 214333 - DNA, 20 bp, Artificial
  CRISPR gRNA sequence
tgttcctgtagaaatcattg

SEQ ID NO: 214334 - DNA, 20 bp, Artificial
  CRISPR gRNA sequence
acaggaaatttcttcataga

SEQ ID NO: 214335 - DNA, 20 bp, Artificial
  CRISPR gRNA sequence
tggactaggaaatttccatc

SEQ ID NO: 214336 - DNA, 20 bp, Artificial
  CRISPR gRNA sequence
tatacaataaatattatcac

SEQ ID NO: 214337 - DNA, 20 bp, Artificial
  CRISPR gRNA sequence
gctcagcattttactctttt

SEQ ID NO: 214338 - DNA, 20 bp, Artificial
  CRISPR gRNA sequence
aaattactttcctagagtta

SEQ ID NO: 214339 - DNA, 20 bp, Artificial
  CRISPR gRNA sequence
gctgtctattggtcacaaaa

SEQ ID NO: 214340 - DNA, 20 bp, Artificial
  CRISPR gRNA sequence
caaacacacacactcaccca

SEQ ID NO: 214341 - DNA, 20 bp, Artificial
  CRISPR gRNA sequence
ttcgtgttcactgtcagcat

SEQ ID NO: 214342 - DNA, 20 bp, Artificial
  CRISPR gRNA sequence
attattttatagaacatata

SEQ ID NO: 214343 - DNA, 20 bp, Artificial
  CRISPR gRNA sequence
agaacatataaaagaaaatt

SEQ ID NO: 214344 - DNA, 20 bp, Artificial
  CRISPR gRNA sequence
caagccgtctgaaagtcata

SEQ ID NO: 214345 - DNA, 20 bp, Artificial
  CRISPR gRNA sequence
tttttatcttaatgctaagt

SEQ ID NO: 214346 - DNA, 20 bp, Artificial
  CRISPR gRNA sequence
taaatccacttactgaagga

SEQ ID NO: 214347 - DNA, 20 bp, Artificial
  CRISPR gRNA sequence
tccttgccctttcactatac

SEQ ID NO: 214348 - DNA, 20 bp, Artificial
  CRISPR gRNA sequence
tgaaatgtgaccatgtgagc

SEQ ID NO: 214349 - DNA, 20 bp, Artificial
  CRISPR gRNA sequence
tgagcaaagaaaatgagcca

SEQ ID NO: 214350 - DNA, 20 bp, Artificial
  CRISPR gRNA sequence
actctttctgaagattcact

SEQ ID NO: 214351 - DNA, 20 bp, Artificial
  CRISPR gRNA sequence
acaggtggagtgtccgttat

SEQ ID NO: 214352 - DNA, 20 bp, Artificial
  CRISPR gRNA sequence
ctctactaaaaaaaaaaaaa

SEQ ID NO: 214353 - DNA, 20 bp, Artificial
  CRISPR gRNA sequence
ctactcgggaggctgaggca

SEQ ID NO: 214354 - DNA, 20 bp, Artificial
  CRISPR gRNA sequence
ctgtctccaaaaaaaaaaaa

SEQ ID NO: 214355 - DNA, 20 bp, Artificial
  CRISPR gRNA sequence
tccaaaaaaaaaaaaaaaga

SEQ ID NO: 214356 - DNA, 20 bp, Artificial
  CRISPR gRNA sequence
aaaaaaaaaaaagaaaagaa

SEQ ID NO: 214357 - DNA, 20 bp, Artificial
  CRISPR gRNA sequence
ggaaaatgtgacatatgtct

SEQ ID NO: 214358 - DNA, 20 bp, Artificial
  CRISPR gRNA sequence
attctagccagcatttgagc

SEQ ID NO: 214359 - DNA, 20 bp, Artificial
  CRISPR gRNA sequence
aggttataaattatgggtag

SEQ ID NO: 214360 - DNA, 20 bp, Artificial
  CRISPR gRNA sequence
attatgggtagatagaaatt

SEQ ID NO: 214361 - DNA, 20 bp, Artificial
  CRISPR gRNA sequence
atttaatgtttgtcactgta

SEQ ID NO: 214362 - DNA, 20 bp, Artificial
  CRISPR gRNA sequence
acttgacagtggagctagca

SEQ ID NO: 214363 - DNA, 20 bp, Artificial
  CRISPR gRNA sequence
tttattagtaatacatcaac

SEQ ID NO: 214364 - DNA, 20 bp, Artificial
  CRISPR gRNA sequence
tatagatccggtggtatgga

SEQ ID NO: 214365 - DNA, 20 bp, Artificial
  CRISPR gRNA sequence
ctccctctcaaggctgtatg

SEQ ID NO: 214366 - DNA, 20 bp, Artificial
  CRISPR gRNA sequence
tctagcttctggaatttgct

SEQ ID NO: 214367 - DNA, 20 bp, Artificial
  CRISPR gRNA sequence
caggttttagggattaggag

SEQ ID NO: 214368 - DNA, 20 bp, Artificial
  CRISPR gRNA sequence
tcattggccaagacatgaaa

SEQ ID NO: 214369 - DNA, 20 bp, Artificial
  CRISPR gRNA sequence
tgaggatatgtagcacatgt

SEQ ID NO: 214370 - DNA, 20 bp, Artificial
  CRISPR gRNA sequence
agcacaccatcgtttgtgga

SEQ ID NO: 214371 - DNA, 20 bp, Artificial
  CRISPR gRNA sequence
aattttcacagttgtcaagc

SEQ ID NO: 214372 - DNA, 20 bp, Artificial
  CRISPR gRNA sequence
ttgacaggtgaatattcatt

SEQ ID NO: 214373 - DNA, 20 bp, Artificial
  CRISPR gRNA sequence
ggaattatgaatcacaaata

SEQ ID NO: 214374 - DNA, 20 bp, Artificial
  CRISPR gRNA sequence
taatttttgttttttgatcg

SEQ ID NO: 214375 - DNA, 20 bp, Artificial
  CRISPR gRNA sequence
atttcatatgcttttctaat

SEQ ID NO: 214376 - DNA, 20 bp, Artificial
  CRISPR gRNA sequence
aataatttcagatatatcac

SEQ ID NO: 214377 - DNA, 20 bp, Artificial
  CRISPR gRNA sequence
ttccagtttaggaccaaaaa

SEQ ID NO: 214378 - DNA, 20 bp, Artificial
  CRISPR gRNA sequence
ttccagtttaagaccagaag

SEQ ID NO: 214379 - DNA, 20 bp, Artificial
  CRISPR gRNA sequence
aaggaaaatggctttatcta

SEQ ID NO: 214380 - DNA, 20 bp, Artificial
  CRISPR gRNA sequence
ttgaggatccattttaagta

SEQ ID NO: 214381 - DNA, 20 bp, Artificial
  CRISPR gRNA sequence
atacaatggagacatctaaa

SEQ ID NO: 214382 - DNA, 20 bp, Artificial
  CRISPR gRNA sequence
tgttgctccccacaaatgcc

SEQ ID NO: 214383 - DNA, 20 bp, Artificial
  CRISPR gRNA sequence
ccatgccttccatatctagc

SEQ ID NO: 214384 - DNA, 20 bp, Artificial
  CRISPR gRNA sequence
ctcattgcacgtgttctgtt

SEQ ID NO: 214385 - DNA, 20 bp, Artificial
  CRISPR gRNA sequence
agcattttaattttataaga

SEQ ID NO: 214386 - DNA, 20 bp, Artificial
  CRISPR gRNA sequence
caataacttaatgtgaaagc

SEQ ID NO: 214387 - DNA, 20 bp, Artificial
  CRISPR gRNA sequence
accacaacatcccagatatt

SEQ ID NO: 214388 - DNA, 20 bp, Artificial
  CRISPR gRNA sequence
tattttagaatgatgcagat

SEQ ID NO: 214389 - DNA, 20 bp, Artificial
  CRISPR gRNA sequence
tgcagatgcagaatatatac

SEQ ID NO: 214390 - DNA, 20 bp, Artificial
  CRISPR gRNA sequence
gagaggtaaatttggtatca

SEQ ID NO: 214391 - DNA, 20 bp, Artificial
  CRISPR gRNA sequence
gtcttaggctcatggtagca

SEQ ID NO: 214392 - DNA, 20 bp, Artificial
  CRISPR gRNA sequence
atgggttatatccatattgg

SEQ ID NO: 214393 - DNA, 20 bp, Artificial
  CRISPR gRNA sequence
tcttcataaatctttttttt

SEQ ID NO: 214394 - DNA, 20 bp, Artificial
  CRISPR gRNA sequence
cttggatcggagatttagaa

SEQ ID NO: 214395 - DNA, 20 bp, Artificial
  CRISPR gRNA sequence
attctttctacattattagg

SEQ ID NO: 214396 - DNA, 20 bp, Artificial
  CRISPR gRNA sequence
tctgaacttccatattacca

SEQ ID NO: 214397 - DNA, 20 bp, Artificial
  CRISPR gRNA sequence
taaagccgcccatggcacta

SEQ ID NO: 214398 - DNA, 20 bp, Artificial
  CRISPR gRNA sequence
ttcttagagtccagtggcag

SEQ ID NO: 214399 - DNA, 20 bp, Artificial
  CRISPR gRNA sequence
ctgttgccatttttcctgtt

SEQ ID NO: 214400 - DNA, 20 bp, Artificial
  CRISPR gRNA sequence
ctgccagctttggaagcttg

SEQ ID NO: 214401 - DNA, 20 bp, Artificial
  CRISPR gRNA sequence
ggcgtgcctccatctgctga

SEQ ID NO: 214402 - DNA, 20 bp, Artificial
  CRISPR gRNA sequence
gaagcagtgaaaaaggcaac

SEQ ID NO: 214403 - DNA, 20 bp, Artificial
  CRISPR gRNA sequence
aaggcaactcagaaagctaa

SEQ ID NO: 214404 - DNA, 20 bp, Artificial
  CRISPR gRNA sequence
aaagacccagggagtgatgt

SEQ ID NO: 214405 - DNA, 20 bp, Artificial
  CRISPR gRNA sequence
aaagatggcataaacaaatg

SEQ ID NO: 214406 - DNA, 20 bp, Artificial
  CRISPR gRNA sequence
ttcaaatcagtgtatataat

SEQ ID NO: 214407 - DNA, 20 bp, Artificial
  CRISPR gRNA sequence
ttttgtctcacgtcaaatta

SEQ ID NO: 214408 - DNA, 20 bp, Artificial
  CRISPR gRNA sequence
gattcattggatgtgcatac

SEQ ID NO: 214409 - DNA, 20 bp, Artificial
  CRISPR gRNA sequence
aatttcaggcttaaaaatga

SEQ ID NO: 214410 - DNA, 20 bp, Artificial
  CRISPR gRNA sequence
taagccatctgaggaaattg

SEQ ID NO: 214411 - DNA, 20 bp, Artificial
  CRISPR gRNA sequence
ttttaggagggcataaatga

SEQ ID NO: 214412 - DNA, 20 bp, Artificial
  CRISPR gRNA sequence
gtctaccacaggggtatatt

SEQ ID NO: 214413 - DNA, 20 bp, Artificial
  CRISPR gRNA sequence
cactttcatatttttagaag

SEQ ID NO: 214414 - DNA, 20 bp, Artificial
  CRISPR gRNA sequence
ggtgaagtgggaaattctgt

SEQ ID NO: 214415 - DNA, 20 bp, Artificial
  CRISPR gRNA sequence
tgtttagaaaaataatatta

SEQ ID NO: 214416 - DNA, 20 bp, Artificial
  CRISPR gRNA sequence
aaatatattttaaatatttt

SEQ ID NO: 214417 - DNA, 20 bp, Artificial
  CRISPR gRNA sequence
tgatctggcccgcaaaacag

SEQ ID NO: 214418 - DNA, 20 bp, Artificial
  CRISPR gRNA sequence
atgccctgtctatgccttag

SEQ ID NO: 214419 - DNA, 20 bp, Artificial
  CRISPR gRNA sequence
ctctactcttgattattcat

SEQ ID NO: 214420 - DNA, 20 bp, Artificial
  CRISPR gRNA sequence
ctactcgggaggctgaggca

SEQ ID NO: 214421 - DNA, 20 bp, Artificial
  CRISPR gRNA sequence
tctgtctcaaaaaaaataaa

SEQ ID NO: 214422 - DNA, 20 bp, Artificial
  CRISPR gRNA sequence
caatttgtgatgtacacatt

SEQ ID NO: 214423 - DNA, 20 bp, Artificial
  CRISPR gRNA sequence
gaatgctgtgggtatgatcc

SEQ ID NO: 214424 - DNA, 20 bp, Artificial
  CRISPR gRNA sequence
atcattgcatatttgtttat

SEQ ID NO: 214425 - DNA, 20 bp, Artificial
  CRISPR gRNA sequence
tgttactaatcctagcattc

SEQ ID NO: 214426 - DNA, 20 bp, Artificial
  CRISPR gRNA sequence
agtcatatggctcccagcaa

SEQ ID NO: 214427 - DNA, 20 bp, Artificial
  CRISPR gRNA sequence
gctaataacttctaatcttt

SEQ ID NO: 214428 - DNA, 20 bp, Artificial
  CRISPR gRNA sequence
taatctttatagaatatttc

SEQ ID NO: 214429 - DNA, 20 bp, Artificial
  CRISPR gRNA sequence
ctacttgggaggctgaggca

SEQ ID NO: 214430 - DNA, 20 bp, Artificial
  CRISPR gRNA sequence
gacagagcaagactccgtct

SEQ ID NO: 214431 - DNA, 20 bp, Artificial
  CRISPR gRNA sequence
cgtgtattcagcatggagtc

SEQ ID NO: 214432 - DNA, 20 bp, Artificial
  CRISPR gRNA sequence
tcattgttctgtagctgtat

SEQ ID NO: 214433 - DNA, 20 bp, Artificial
  CRISPR gRNA sequence
ccattttcaggaaagcaatc

SEQ ID NO: 214434 - DNA, 20 bp, Artificial
  CRISPR gRNA sequence
ttttgctaatattcagctga

SEQ ID NO: 214435 - DNA, 20 bp, Artificial
  CRISPR gRNA sequence
ggagatccaaagtgaatatt

SEQ ID NO: 214436 - DNA, 20 bp, Artificial
  CRISPR gRNA sequence
atgtgtcaactttttaatgg

SEQ ID NO: 214437 - DNA, 20 bp, Artificial
  CRISPR gRNA sequence
tgtgttcatttttcaatttt

SEQ ID NO: 214438 - DNA, 20 bp, Artificial
  CRISPR gRNA sequence
tgatgattcactgttgggga

SEQ ID NO: 214439 - DNA, 20 bp, Artificial
  CRISPR gRNA sequence
tcactgttggggagaagaaa

SEQ ID NO: 214440 - DNA, 20 bp, Artificial
  CRISPR gRNA sequence
ttaatcaattaggggcaata

SEQ ID NO: 214441 - DNA, 20 bp, Artificial
  CRISPR gRNA sequence
atagtagaatggacaatttc

SEQ ID NO: 214442 - DNA, 20 bp, Artificial
  CRISPR gRNA sequence
cacatttcctatcctggtta

SEQ ID NO: 214443 - DNA, 20 bp, Artificial
  CRISPR gRNA sequence
ttatgacctgctgaggcctc

SEQ ID NO: 214444 - DNA, 20 bp, Artificial
  CRISPR gRNA sequence
gaaaaagatccaagctccta

SEQ ID NO: 214445 - DNA, 20 bp, Artificial
  CRISPR gRNA sequence
gtccattctgtttaaatccc

SEQ ID NO: 214446 - DNA, 20 bp, Artificial
  CRISPR gRNA sequence
tgtttaaatccctaagaatg

SEQ ID NO: 214447 - DNA, 20 bp, Artificial
  CRISPR gRNA sequence
tttacctgttgttggaaact

SEQ ID NO: 214448 - DNA, 20 bp, Artificial
  CRISPR gRNA sequence
taaatttctctttttgaaaa

SEQ ID NO: 214449 - DNA, 20 bp, Artificial
  CRISPR gRNA sequence
tgttatcatgactggtgaga

SEQ ID NO: 214450 - DNA, 20 bp, Artificial
  CRISPR gRNA sequence
tatttacaaaaagccattgt

SEQ ID NO: 214451 - DNA, 20 bp, Artificial
  CRISPR gRNA sequence
tatattctaggtaacaatgt

SEQ ID NO: 214452 - DNA, 20 bp, Artificial
  CRISPR gRNA sequence
ggtgcagtgaaaacatcaca

SEQ ID NO: 214453 - DNA, 20 bp, Artificial
  CRISPR gRNA sequence
tgaaacacattggactgatt

SEQ ID NO: 214454 - DNA, 20 bp, Artificial
  CRISPR gRNA sequence
actgatttaaaacttttaat

SEQ ID NO: 214455 - DNA, 20 bp, Artificial
  CRISPR gRNA sequence
gatttaatacatataaaaaa

SEQ ID NO: 214456 - DNA, 20 bp, Artificial
  CRISPR gRNA sequence
ctttaacggtaacacagctg

SEQ ID NO: 214457 - DNA, 20 bp, Artificial
  CRISPR gRNA sequence
taaataatgctccatttaat

SEQ ID NO: 214458 - DNA, 20 bp, Artificial
  CRISPR gRNA sequence
actgtcaaagctaaaggcag

SEQ ID NO: 214459 - DNA, 20 bp, Artificial
  CRISPR gRNA sequence
attttaaaatatgacacaag

SEQ ID NO: 214460 - DNA, 20 bp, Artificial
  CRISPR gRNA sequence
aaaaaaaaaaaaaaaaaaaa

SEQ ID NO: 214461 - DNA, 20 bp, Artificial
  CRISPR gRNA sequence
aaaaaaaaaaaacaaaaaaa

SEQ ID NO: 214462 - DNA, 20 bp, Artificial
  CRISPR gRNA sequence
aaaaaaaaaacagaaagaaa

SEQ ID NO: 214463 - DNA, 20 bp, Artificial
  CRISPR gRNA sequence
tacctagcttctgatgtatg

SEQ ID NO: 214464 - DNA, 20 bp, Artificial
  CRISPR gRNA sequence
caaggagaagagcaaggcca

SEQ ID NO: 214465 - DNA, 20 bp, Artificial
  CRISPR gRNA sequence
ctgtgagaacacacaataaa

SEQ ID NO: 214466 - DNA, 20 bp, Artificial
  CRISPR gRNA sequence
gtaaaaagcatattatggga

SEQ ID NO: 214467 - DNA, 20 bp, Artificial
  CRISPR gRNA sequence
caaaacagatacatgatgtg

SEQ ID NO: 214468 - DNA, 20 bp, Artificial
  CRISPR gRNA sequence
ctgcttttccctcctttcat

SEQ ID NO: 214469 - DNA, 20 bp, Artificial
  CRISPR gRNA sequence
cacacatccacaaacaggta

SEQ ID NO: 214470 - DNA, 20 bp, Artificial
  CRISPR gRNA sequence
aggggttatgtgaataaaag

SEQ ID NO: 214471 - DNA, 20 bp, Artificial
  CRISPR gRNA sequence
attgattaaaaataacaaca

SEQ ID NO: 214472 - DNA, 20 bp, Artificial
  CRISPR gRNA sequence
aaattacagctgctttgaat

SEQ ID NO: 214473 - DNA, 20 bp, Artificial
  CRISPR gRNA sequence
acccaccagccagacatttt

SEQ ID NO: 214474 - DNA, 20 bp, Artificial
  CRISPR gRNA sequence
ttcatcacaaatattcaagg

SEQ ID NO: 214475 - DNA, 20 bp, Artificial
  CRISPR gRNA sequence
gcaggtaaggtcacagactt

SEQ ID NO: 214476 - DNA, 20 bp, Artificial
  CRISPR gRNA sequence
aagacattttttgataagat

SEQ ID NO: 214477 - DNA, 20 bp, Artificial
  CRISPR gRNA sequence
acataattactaaatgccaa

SEQ ID NO: 214478 - DNA, 20 bp, Artificial
  CRISPR gRNA sequence
ggaatcataatatgttaagg

SEQ ID NO: 214479 - DNA, 20 bp, Artificial
  CRISPR gRNA sequence
gtcaccagacacggaatctg

SEQ ID NO: 214480 - DNA, 20 bp, Artificial
  CRISPR gRNA sequence
aggaaagaaaaaaagaggaa

SEQ ID NO: 214481 - DNA, 20 bp, Artificial
  CRISPR gRNA sequence
tatgtcatgtcattttatag

SEQ ID NO: 214482 - DNA, 20 bp, Artificial
  CRISPR gRNA sequence
ctacagtcaaaaaaaaaaga

SEQ ID NO: 214483 - DNA, 20 bp, Artificial
  CRISPR gRNA sequence
gtcaaaaaaaaaagaaaaaa

SEQ ID NO: 214484 - DNA, 20 bp, Artificial
  CRISPR gRNA sequence
acacagtgaagaggtggaag

SEQ ID NO: 214485 - DNA, 20 bp, Artificial
  CRISPR gRNA sequence
tttaagggaaaaaatgttta

SEQ ID NO: 214486 - DNA, 20 bp, Artificial
  CRISPR gRNA sequence
tctcttaatttgacgtgaga

SEQ ID NO: 214487 - DNA, 20 bp, Artificial
  CRISPR gRNA sequence
taagataaaatgttcagggc

SEQ ID NO: 214488 - DNA, 20 bp, Artificial
  CRISPR gRNA sequence
agagatagcttccttataaa

SEQ ID NO: 214489 - DNA, 20 bp, Artificial
  CRISPR gRNA sequence
gactccatctcaaaaaataa

SEQ ID NO: 214490 - DNA, 20 bp, Artificial
  CRISPR gRNA sequence
caaaaaataaaaaaacccaa

SEQ ID NO: 214491 - DNA, 20 bp, Artificial
  CRISPR gRNA sequence
gactctaagaagaaacagaa

SEQ ID NO: 214492 - DNA, 20 bp, Artificial
  CRISPR gRNA sequence
gagaaggcatgaataggata

SEQ ID NO: 214493 - DNA, 20 bp, Artificial
  CRISPR gRNA sequence
cataatgagaccctgtctct

SEQ ID NO: 214494 - DNA, 20 bp, Artificial
  CRISPR gRNA sequence
tgagaccctgtctctaaaaa

SEQ ID NO: 214495 - DNA, 20 bp, Artificial
  CRISPR gRNA sequence
ccctgtctctaaaaacaaaa

SEQ ID NO: 214496 - DNA, 20 bp, Artificial
  CRISPR gRNA sequence
tgtgatccctctaaatatta

SEQ ID NO: 214497 - DNA, 20 bp, Artificial
  CRISPR gRNA sequence
gctaccagattgatttgtat

SEQ ID NO: 214498 - DNA, 20 bp, Artificial
  CRISPR gRNA sequence
ggattttattgcatttaaat

SEQ ID NO: 214499 - DNA, 20 bp, Artificial
  CRISPR gRNA sequence
acacaatcattaggcttttc

SEQ ID NO: 214500 - DNA, 20 bp, Artificial
  CRISPR gRNA sequence
caggcatttgtggggagcaa

SEQ ID NO: 214501 - DNA, 20 bp, Artificial
  CRISPR gRNA sequence
ataaaaatataattttttta

SEQ ID NO: 214502 - DNA, 20 bp, Artificial
  CRISPR gRNA sequence
tgcattggtatacacgctgt

SEQ ID NO: 214503 - DNA, 20 bp, Artificial
  CRISPR gRNA sequence
gcatatgaaataacttacta

SEQ ID NO: 214504 - DNA, 20 bp, Artificial
  CRISPR gRNA sequence
gagagttattctaacgatca

SEQ ID NO: 214505 - DNA, 20 bp, Artificial
  CRISPR gRNA sequence
tgtcaagtatatgaatgaac

SEQ ID NO: 214506 - DNA, 20 bp, Artificial
  CRISPR gRNA sequence
gtatttgcccaaatggaatt

SEQ ID NO: 214507 - DNA, 20 bp, Artificial
  CRISPR gRNA sequence
actcaattttgccatgaacc

SEQ ID NO: 214508 - DNA, 20 bp, Artificial
  CRISPR gRNA sequence
tggatttccataccatctct

SEQ ID NO: 214509 - DNA, 20 bp, Artificial
  CRISPR gRNA sequence
tattaaggtttgctaataat

SEQ ID NO: 214510 - DNA, 20 bp, Artificial
  CRISPR gRNA sequence
aacatccacttataacttca

SEQ ID NO: 214511 - DNA, 20 bp, Artificial
  CRISPR gRNA sequence
catatgaaagtcacttttta

SEQ ID NO: 214512 - DNA, 20 bp, Artificial
  CRISPR gRNA sequence
atttatatgagcattttcac

SEQ ID NO: 214513 - DNA, 20 bp, Artificial
  CRISPR gRNA sequence
caaaatcatactgtaacaat

SEQ ID NO: 214514 - DNA, 20 bp, Artificial
  CRISPR gRNA sequence
atattcacctgtcaataaat

SEQ ID NO: 214515 - DNA, 20 bp, Artificial
  CRISPR gRNA sequence
ttaaaaatatacgtttccct

SEQ ID NO: 214516 - DNA, 20 bp, Artificial
  CRISPR gRNA sequence
tatttctacctcctaatccc

SEQ ID NO: 214517 - DNA, 20 bp, Artificial
  CRISPR gRNA sequence
gaggctgagggagatttaac

SEQ ID NO: 214518 - DNA, 20 bp, Artificial
  CRISPR gRNA sequence
tatttaagtgcttaaaaaag

SEQ ID NO: 214519 - DNA, 20 bp, Artificial
  CRISPR gRNA sequence
ttgtcaatgcccccgatgag

SEQ ID NO: 214520 - DNA, 20 bp, Artificial
  CRISPR gRNA sequence
ttttgaaaaaaatgacagaa

SEQ ID NO: 214521 - DNA, 20 bp, Artificial
  CRISPR gRNA sequence
agagaaacccatattaatca

SEQ ID NO: 214522 - DNA, 20 bp, Artificial
  CRISPR gRNA sequence
ttagaagagctgttatagga

SEQ ID NO: 214523 - DNA, 20 bp, Artificial
  CRISPR gRNA sequence
gcaaacaatagcaacaaaaa

SEQ ID NO: 214524 - DNA, 20 bp, Artificial
  CRISPR gRNA sequence
gtgtgaaaaaatctgaaatc

SEQ ID NO: 214525 - DNA, 20 bp, Artificial
  CRISPR gRNA sequence
tccttatttattgaatgtat

SEQ ID NO: 214526 - DNA, 20 bp, Artificial
  CRISPR gRNA sequence
agtgatgagtatgttactcc

SEQ ID NO: 214527 - DNA, 20 bp, Artificial
  CRISPR gRNA sequence
atgtccctctagccacctga

SEQ ID NO: 214528 - DNA, 20 bp, Artificial
  CRISPR gRNA sequence
acagactgcagtccatccaa

SEQ ID NO: 214529 - DNA, 20 bp, Artificial
  CRISPR gRNA sequence
gcagtccatccaacaaaacc

SEQ ID NO: 214530 - DNA, 20 bp, Artificial
  CRISPR gRNA sequence
ttattaagctgtcctcaagt

SEQ ID NO: 214531 - DNA, 20 bp, Artificial
  CRISPR gRNA sequence
agatgaaagagtaaagaaat

SEQ ID NO: 214532 - DNA, 20 bp, Artificial
  CRISPR gRNA sequence
aataaactttaaacattcaa

SEQ ID NO: 214533 - DNA, 20 bp, Artificial
  CRISPR gRNA sequence
gacattgagagtgcaaagga

SEQ ID NO: 214534 - DNA, 20 bp, Artificial
  CRISPR gRNA sequence
cgaagccagtattgcctgta

SEQ ID NO: 214535 - DNA, 20 bp, Artificial
  CRISPR gRNA sequence
agactcacatgcagagctgg

SEQ ID NO: 214536 - DNA, 20 bp, Artificial
  CRISPR gRNA sequence
tggcttaaatgtgggtgcta

SEQ ID NO: 214537 - DNA, 20 bp, Artificial
  CRISPR gRNA sequence
taaaatcctcaaaataaatg

SEQ ID NO: 214538 - DNA, 20 bp, Artificial
  CRISPR gRNA sequence
ctgtgcctgtttcttatcta

SEQ ID NO: 214539 - DNA, 20 bp, Artificial
  CRISPR gRNA sequence
ctacctgtttcaagatgagc

SEQ ID NO: 214540 - DNA, 20 bp, Artificial
  CRISPR gRNA sequence
agttgatacaaacgtttctg

SEQ ID NO: 214541 - DNA, 20 bp, Artificial
  CRISPR gRNA sequence
ccagtccttttcttgacata

SEQ ID NO: 214542 - DNA, 20 bp, Artificial
  CRISPR gRNA sequence
catacactgagaaaagcgct

SEQ ID NO: 214543 - DNA, 20 bp, Artificial
  CRISPR gRNA sequence
gaactgcacgcagaggatga

SEQ ID NO: 214544 - DNA, 20 bp, Artificial
  CRISPR gRNA sequence
caaagtataacgtcctacct

SEQ ID NO: 214545 - DNA, 20 bp, Artificial
  CRISPR gRNA sequence
attcattcttaagagattaa

SEQ ID NO: 214546 - DNA, 20 bp, Artificial
  CRISPR gRNA sequence
agattaaaaaaacaccaagt

SEQ ID NO: 214547 - DNA, 20 bp, Artificial
  CRISPR gRNA sequence
taagaatattttcatttgga

SEQ ID NO: 214548 - DNA, 20 bp, Artificial
  CRISPR gRNA sequence
accatgaaactggggaagaa

SEQ ID NO: 214549 - DNA, 20 bp, Artificial
  CRISPR gRNA sequence
ttatagagatggaaaaaaat

SEQ ID NO: 214550 - DNA, 20 bp, Artificial
  CRISPR gRNA sequence
tatacatacacacatataca

SEQ ID NO: 214551 - DNA, 20 bp, Artificial
  CRISPR gRNA sequence
tgtaaattttatttatgaat

SEQ ID NO: 214552 - DNA, 20 bp, Artificial
  CRISPR gRNA sequence
taaactacatgcaaagggct

SEQ ID NO: 214553 - DNA, 20 bp, Artificial
  CRISPR gRNA sequence
aaagtcacttcagtatagcc

SEQ ID NO: 214554 - DNA, 20 bp, Artificial
  CRISPR gRNA sequence
ttcttcagttgcttgaggct

SEQ ID NO: 214555 - DNA, 20 bp, Artificial
  CRISPR gRNA sequence
caactgagatgctgggggaa

SEQ ID NO: 214556 - DNA, 20 bp, Artificial
  CRISPR gRNA sequence
ctttcaagctgaagtgttat

SEQ ID NO: 214557 - DNA, 20 bp, Artificial
  CRISPR gRNA sequence
ccagaattctaaggtggtcc

SEQ ID NO: 214558 - DNA, 20 bp, Artificial
  CRISPR gRNA sequence
atgaccaggcttgccaccta

SEQ ID NO: 214559 - DNA, 20 bp, Artificial
  CRISPR gRNA sequence
gtagttgttatgcagcacta

SEQ ID NO: 214560 - DNA, 20 bp, Artificial
  CRISPR gRNA sequence
cttgaactgacctttctaaa

SEQ ID NO: 214561 - DNA, 20 bp, Artificial
  CRISPR gRNA sequence
ctattaaacagtgaagtcta

SEQ ID NO: 214562 - DNA, 20 bp, Artificial
  CRISPR gRNA sequence
tacataggcacagaggtata

SEQ ID NO: 214563 - DNA, 20 bp, Artificial
  CRISPR gRNA sequence
aaaagtctggcagtttcttt

SEQ ID NO: 214564 - DNA, 20 bp, Artificial
  CRISPR gRNA sequence
agcatttatcccagagaaat

SEQ ID NO: 214565 - DNA, 20 bp, Artificial
  CRISPR gRNA sequence
aaagaactattgatagatgc

SEQ ID NO: 214566 - DNA, 20 bp, Artificial
  CRISPR gRNA sequence
attttctacattctctataa

SEQ ID NO: 214567 - DNA, 20 bp, Artificial
  CRISPR gRNA sequence
gggtattttgcaaacaaaga

SEQ ID NO: 214568 - DNA, 20 bp, Artificial
  CRISPR gRNA sequence
tcataaaataaacatcccag

SEQ ID NO: 214569 - DNA, 20 bp, Artificial
  CRISPR gRNA sequence
gtaattctaaatagagattt

SEQ ID NO: 214570 - DNA, 20 bp, Artificial
  CRISPR gRNA sequence
aaaaaaaaaaaaaaaaaaaa

SEQ ID NO: 214571 - DNA, 20 bp, Artificial
  CRISPR gRNA sequence
aaaaaaaaaaaaaaaacaca

SEQ ID NO: 214572 - DNA, 20 bp, Artificial
  CRISPR gRNA sequence
gaatgacgacagtgtcatta

SEQ ID NO: 214573 - DNA, 20 bp, Artificial
  CRISPR gRNA sequence
tcaaggtaaaattttgaaca

SEQ ID NO: 214574 - DNA, 20 bp, Artificial
  CRISPR gRNA sequence
aaaatactaatgaggaaaaa

SEQ ID NO: 214575 - DNA, 20 bp, Artificial
  CRISPR gRNA sequence
attcttcctccaagaaacca

SEQ ID NO: 214576 - DNA, 20 bp, Artificial
  CRISPR gRNA sequence
tagctacttggccttcccct

SEQ ID NO: 214577 - DNA, 20 bp, Artificial
  CRISPR gRNA sequence
cttcccctcaaaacataaac

SEQ ID NO: 214578 - DNA, 20 bp, Artificial
  CRISPR gRNA sequence
cctcaaaacataaacaaaaa

SEQ ID NO: 214579 - DNA, 20 bp, Artificial
  CRISPR gRNA sequence
tataggtactggacaatgtt

SEQ ID NO: 214580 - DNA, 20 bp, Artificial
  CRISPR gRNA sequence
atctcttaagtaggaggatc

SEQ ID NO: 214581 - DNA, 20 bp, Artificial
  CRISPR gRNA sequence
ctgtgttgagcattaacatg

SEQ ID NO: 214582 - DNA, 20 bp, Artificial
  CRISPR gRNA sequence
aaaatgtagggtgatactat

SEQ ID NO: 214583 - DNA, 20 bp, Artificial
  CRISPR gRNA sequence
aaatactaggaagcccaagg

SEQ ID NO: 214584 - DNA, 20 bp, Artificial
  CRISPR gRNA sequence
tggacttccgttgcattctt

SEQ ID NO: 214585 - DNA, 20 bp, Artificial
  CRISPR gRNA sequence
ttacagtttcataagttgta

SEQ ID NO: 214586 - DNA, 20 bp, Artificial
  CRISPR gRNA sequence
actgcattatttgttacaat

SEQ ID NO: 214587 - DNA, 20 bp, Artificial
  CRISPR gRNA sequence
atctctataaagatgcatta

SEQ ID NO: 214588 - DNA, 20 bp, Artificial
  CRISPR gRNA sequence
attaaaaaactattaagtag

SEQ ID NO: 214589 - DNA, 20 bp, Artificial
  CRISPR gRNA sequence
ttttgcctactcccttctca

SEQ ID NO: 214590 - DNA, 20 bp, Artificial
  CRISPR gRNA sequence
cagataattaacatgaataa

SEQ ID NO: 214591 - DNA, 20 bp, Artificial
  CRISPR gRNA sequence
aattcatgttgctaataggc

SEQ ID NO: 214592 - DNA, 20 bp, Artificial
  CRISPR gRNA sequence
cacctgcaaacttttaaata

SEQ ID NO: 214593 - DNA, 20 bp, Artificial
  CRISPR gRNA sequence
acttcaaagtcagtatgtcc

SEQ ID NO: 214594 - DNA, 20 bp, Artificial
  CRISPR gRNA sequence
agatttaatttcattaaaaa

SEQ ID NO: 214595 - DNA, 20 bp, Artificial
  CRISPR gRNA sequence
gaacaactggagagaagacc

SEQ ID NO: 214596 - DNA, 20 bp, Artificial
  CRISPR gRNA sequence
cctaagtaccatgagggaat

SEQ ID NO: 214597 - DNA, 20 bp, Artificial
  CRISPR gRNA sequence
actgtataatcgtaaagagg

SEQ ID NO: 214598 - DNA, 20 bp, Artificial
  CRISPR gRNA sequence
tagtactacaatgagtttaa

SEQ ID NO: 214599 - DNA, 20 bp, Artificial
  CRISPR gRNA sequence
gaacaactcagtgacaaaga

SEQ ID NO: 214600 - DNA, 20 bp, Artificial
  CRISPR gRNA sequence
gacaaagataaaacatctgc

SEQ ID NO: 214601 - DNA, 20 bp, Artificial
  CRISPR gRNA sequence
gcatttagtgtaatgcttta

SEQ ID NO: 214602 - DNA, 20 bp, Artificial
  CRISPR gRNA sequence
aaataatatattctttaaga

SEQ ID NO: 214603 - DNA, 20 bp, Artificial
  CRISPR gRNA sequence
atgtaccctgatttaaaaaa

SEQ ID NO: 214604 - DNA, 20 bp, Artificial
  CRISPR gRNA sequence
gctatatattaaacacatac

SEQ ID NO: 214605 - DNA, 20 bp, Artificial
  CRISPR gRNA sequence
gtggaggttctttggcgtcg

SEQ ID NO: 214606 - DNA, 20 bp, Artificial
  CRISPR gRNA sequence
actgtcttcctatttcaggc

SEQ ID NO: 214607 - DNA, 20 bp, Artificial
  CRISPR gRNA sequence
ggcgaaaaccagattacttt

SEQ ID NO: 214608 - DNA, 20 bp, Artificial
  CRISPR gRNA sequence
gttcccccaaataaagtggg

SEQ ID NO: 214609 - DNA, 20 bp, Artificial
  CRISPR gRNA sequence
gcaagcttatttttaggatt

SEQ ID NO: 214610 - DNA, 20 bp, Artificial
  CRISPR gRNA sequence
ggaagacagtaacctccagt

SEQ ID NO: 214611 - DNA, 20 bp, Artificial
  CRISPR gRNA sequence
tggaatccatttcgcttttg

SEQ ID NO: 214612 - DNA, 20 bp, Artificial
  CRISPR gRNA sequence
aaaacgtgtgcttcgtctgt

SEQ ID NO: 214613 - DNA, 20 bp, Artificial
  CRISPR gRNA sequence
tataaaccatatactatttt

SEQ ID NO: 214614 - DNA, 20 bp, Artificial
  CRISPR gRNA sequence
gttgtgttaagtgtggactg

SEQ ID NO: 214615 - DNA, 20 bp, Artificial
  CRISPR gRNA sequence
ggtatttattagctagcaaa

SEQ ID NO: 214616 - DNA, 20 bp, Artificial
  CRISPR gRNA sequence
aaaataatcacgcatattcg

SEQ ID NO: 214617 - DNA, 20 bp, Artificial
  CRISPR gRNA sequence
ttggctagttcaaggcctgt

SEQ ID NO: 214618 - DNA, 20 bp, Artificial
  CRISPR gRNA sequence
tccgtcatccagcttcagaa

SEQ ID NO: 214619 - DNA, 20 bp, Artificial
  CRISPR gRNA sequence
ttttaccccatattaaaaaa

SEQ ID NO: 214620 - DNA, 20 bp, Artificial
  CRISPR gRNA sequence
ccatattaaaaaataaaaca

SEQ ID NO: 214621 - DNA, 20 bp, Artificial
  CRISPR gRNA sequence
gtatatgtgaaaggtgatac

SEQ ID NO: 214622 - DNA, 20 bp, Artificial
  CRISPR gRNA sequence
tttaaaagtttgcaggtgaa

SEQ ID NO: 214623 - DNA, 20 bp, Artificial
  CRISPR gRNA sequence
caatttttaaagacacacac

SEQ ID NO: 214624 - DNA, 20 bp, Artificial
  CRISPR gRNA sequence
gaagggagtaggcaaaagga

SEQ ID NO: 214625 - DNA, 20 bp, Artificial
  CRISPR gRNA sequence
caagcaaactagcaagaagg

SEQ ID NO: 214626 - DNA, 20 bp, Artificial
  CRISPR gRNA sequence
cccttttaaaagaaaattgg

SEQ ID NO: 214627 - DNA, 20 bp, Artificial
  CRISPR gRNA sequence
ttctacaacttatgaaactg

SEQ ID NO: 214628 - DNA, 20 bp, Artificial
  CRISPR gRNA sequence
tttgggtggctagaaatgta

SEQ ID NO: 214629 - DNA, 20 bp, Artificial
  CRISPR gRNA sequence
tcagctcagctactatttaa

SEQ ID NO: 214630 - DNA, 20 bp, Artificial
  CRISPR gRNA sequence
ttgttactaatatggaggca

SEQ ID NO: 214631 - DNA, 20 bp, Artificial
  CRISPR gRNA sequence
tgttaatctactcttcatgg

SEQ ID NO: 214632 - DNA, 20 bp, Artificial
  CRISPR gRNA sequence
ggtcactgagaggtaaactg

SEQ ID NO: 214633 - DNA, 20 bp, Artificial
  CRISPR gRNA sequence
ggaatgccaggatctgagat

SEQ ID NO: 214634 - DNA, 20 bp, Artificial
  CRISPR gRNA sequence
gcaaaataccctataaaaat

SEQ ID NO: 214635 - DNA, 20 bp, Artificial
  CRISPR gRNA sequence
tgtaaccatttttaactgaa

SEQ ID NO: 214636 - DNA, 20 bp, Artificial
  CRISPR gRNA sequence
gaaaaaaacaacaaacaaac

SEQ ID NO: 214637 - DNA, 20 bp, Artificial
  CRISPR gRNA sequence
agcttaagaaaagttggata

SEQ ID NO: 214638 - DNA, 20 bp, Artificial
  CRISPR gRNA sequence
aacctagatctctttggcat

SEQ ID NO: 214639 - DNA, 20 bp, Artificial
  CRISPR gRNA sequence
ccgtaatatgtggttcatgt

SEQ ID NO: 214640 - DNA, 20 bp, Artificial
  CRISPR gRNA sequence
ttctgttctattagcaatac

SEQ ID NO: 214641 - DNA, 20 bp, Artificial
  CRISPR gRNA sequence
tattagcaatacaaaaactt

SEQ ID NO: 214642 - DNA, 20 bp, Artificial
  CRISPR gRNA sequence
caactacaaatatagcagct

SEQ ID NO: 214643 - DNA, 20 bp, Artificial
  CRISPR gRNA sequence
gaccagcctggccaacatga

SEQ ID NO: 214644 - DNA, 20 bp, Artificial
  CRISPR gRNA sequence
agttcttccttaaatcaagc

SEQ ID NO: 214645 - DNA, 20 bp, Artificial
  CRISPR gRNA sequence
agatcttcaaatgtgatgag

SEQ ID NO: 214646 - DNA, 20 bp, Artificial
  CRISPR gRNA sequence
aggagttgaggtacacaatt

SEQ ID NO: 214647 - DNA, 20 bp, Artificial
  CRISPR gRNA sequence
ggtattgatttggagtatcc

SEQ ID NO: 214648 - DNA, 20 bp, Artificial
  CRISPR gRNA sequence
aaaagtcttccattcactcg

SEQ ID NO: 214649 - DNA, 20 bp, Artificial
  CRISPR gRNA sequence
ttctgaaaagctaatatcta

SEQ ID NO: 214650 - DNA, 20 bp, Artificial
  CRISPR gRNA sequence
gttatttaaaaaaaaaaaaa

SEQ ID NO: 214651 - DNA, 20 bp, Artificial
  CRISPR gRNA sequence
agcacataatactgagtagc

SEQ ID NO: 214652 - DNA, 20 bp, Artificial
  CRISPR gRNA sequence
agacgctttgtttgtgttct

SEQ ID NO: 214653 - DNA, 20 bp, Artificial
  CRISPR gRNA sequence
caggcaatactggcttcgca

SEQ ID NO: 214654 - DNA, 20 bp, Artificial
  CRISPR gRNA sequence
ccatgtaagctgaaattctg

SEQ ID NO: 214655 - DNA, 20 bp, Artificial
  CRISPR gRNA sequence
caatcttcatgatgaatggg

SEQ ID NO: 214656 - DNA, 20 bp, Artificial
  CRISPR gRNA sequence
tttaaaattttttttgttgt

SEQ ID NO: 214657 - DNA, 20 bp, Artificial
  CRISPR gRNA sequence
ttttttgttgttaaaacctt

SEQ ID NO: 214658 - DNA, 20 bp, Artificial
  CRISPR gRNA sequence
actgggaaacaaggaggtaa

SEQ ID NO: 214659 - DNA, 20 bp, Artificial
  CRISPR gRNA sequence
gctgtacttgattccaaatt

SEQ ID NO: 214660 - DNA, 20 bp, Artificial
  CRISPR gRNA sequence
gatgtgctttattctgcact

SEQ ID NO: 214661 - DNA, 20 bp, Artificial
  CRISPR gRNA sequence
ttactttcctagagttatca

SEQ ID NO: 214662 - DNA, 20 bp, Artificial
  CRISPR gRNA sequence
gtctattggtcacaaaatca

SEQ ID NO: 214663 - DNA, 20 bp, Artificial
  CRISPR gRNA sequence
ctttctgaagattcactgaa

SEQ ID NO: 214664 - DNA, 20 bp, Artificial
  CRISPR gRNA sequence
ttgaactaatcaacaggaac

SEQ ID NO: 214665 - DNA, 20 bp, Artificial
  CRISPR gRNA sequence
ctagaaaatagggaagttat

SEQ ID NO: 214666 - DNA, 20 bp, Artificial
  CRISPR gRNA sequence
gcggaagtaatgaatcaaat

SEQ ID NO: 214667 - DNA, 20 bp, Artificial
  CRISPR gRNA sequence
gtttgtcactgtagaagaaa

SEQ ID NO: 214668 - DNA, 20 bp, Artificial
  CRISPR gRNA sequence
ttttattctgtcattttttt

SEQ ID NO: 214669 - DNA, 20 bp, Artificial
  CRISPR gRNA sequence
cgggggcattgacaatgtct

SEQ ID NO: 214670 - DNA, 20 bp, Artificial
  CRISPR gRNA sequence
gcagtgtcccccctcccccc

SEQ ID NO: 214671 - DNA, 20 bp, Artificial
  CRISPR gRNA sequence
agatccggtggtatggatga

SEQ ID NO: 214672 - DNA, 20 bp, Artificial
  CRISPR gRNA sequence
ttgtctacctttttcattta

SEQ ID NO: 214673 - DNA, 20 bp, Artificial
  CRISPR gRNA sequence
attgttctaagatttagggt

SEQ ID NO: 214674 - DNA, 20 bp, Artificial
  CRISPR gRNA sequence
gatcgttagaataactctct

SEQ ID NO: 214675 - DNA, 20 bp, Artificial
  CRISPR gRNA sequence
tgacctctaatgcatgactt

SEQ ID NO: 214676 - DNA, 20 bp, Artificial
  CRISPR gRNA sequence
gactttaaaacagttctagt

SEQ ID NO: 214677 - DNA, 20 bp, Artificial
  CRISPR gRNA sequence
ctagttaaaaccaatataat

SEQ ID NO: 214678 - DNA, 20 bp, Artificial
  CRISPR gRNA sequence
aaaattatatttttatgaaa

SEQ ID NO: 214679 - DNA, 20 bp, Artificial
  CRISPR gRNA sequence
aactttgctgtatgtgtttc

SEQ ID NO: 214680 - DNA, 20 bp, Artificial
  CRISPR gRNA sequence
tgactcacataatagtttca

SEQ ID NO: 214681 - DNA, 20 bp, Artificial
  CRISPR gRNA sequence
tgagctcaaaaatgtaactc

SEQ ID NO: 214682 - DNA, 20 bp, Artificial
  CRISPR gRNA sequence
gaatgggtccagttctattt

SEQ ID NO: 214683 - DNA, 20 bp, Artificial
  CRISPR gRNA sequence
ttgtactgacttctcacacc

SEQ ID NO: 214684 - DNA, 20 bp, Artificial
  CRISPR gRNA sequence
aaataaatgtaaatattgct

SEQ ID NO: 214685 - DNA, 20 bp, Artificial
  CRISPR gRNA sequence
tttataaacattttttccct

SEQ ID NO: 214686 - DNA, 20 bp, Artificial
  CRISPR gRNA sequence
tcataatttgatctggcccg

SEQ ID NO: 214687 - DNA, 20 bp, Artificial
  CRISPR gRNA sequence
ctattgccacagagatagac

SEQ ID NO: 214688 - DNA, 20 bp, Artificial
  CRISPR gRNA sequence
cttaataattatagatcagt

SEQ ID NO: 214689 - DNA, 20 bp, Artificial
  CRISPR gRNA sequence
cagttaaaacatggacattg

SEQ ID NO: 214690 - DNA, 20 bp, Artificial
  CRISPR gRNA sequence
atctactttgctaaaaattg

SEQ ID NO: 214691 - DNA, 20 bp, Artificial
  CRISPR gRNA sequence
aattgcaaaactactactgt

SEQ ID NO: 214692 - DNA, 20 bp, Artificial
  CRISPR gRNA sequence
attaatatttgcataagatt

SEQ ID NO: 214693 - DNA, 20 bp, Artificial
  CRISPR gRNA sequence
cggtgaaaccccgtctctac

SEQ ID NO: 214694 - DNA, 20 bp, Artificial
  CRISPR gRNA sequence
aaaaaaaaaaaaaaaaaaaa

SEQ ID NO: 214695 - DNA, 20 bp, Artificial
  CRISPR gRNA sequence
atgcattggtgaacaaagtt

SEQ ID NO: 214696 - DNA, 20 bp, Artificial
  CRISPR gRNA sequence
gaataagttaaaagacataa

SEQ ID NO: 214697 - DNA, 20 bp, Artificial
  CRISPR gRNA sequence
tactgcatcaggaaatattg

SEQ ID NO: 214698 - DNA, 20 bp, Artificial
  CRISPR gRNA sequence
gattacccagagatatctat

SEQ ID NO: 214699 - DNA, 20 bp, Artificial
  CRISPR gRNA sequence
ccctatgattgaaaagtaaa

SEQ ID NO: 214700 - DNA, 20 bp, Artificial
  CRISPR gRNA sequence
gttaattttgtgcttttagt

SEQ ID NO: 214701 - DNA, 20 bp, Artificial
  CRISPR gRNA sequence
gatgcaaatatttgatcact

SEQ ID NO: 214702 - DNA, 20 bp, Artificial
  CRISPR gRNA sequence
atttgatcacttaaaacttt

SEQ ID NO: 214703 - DNA, 20 bp, Artificial
  CRISPR gRNA sequence
tgacctgctgaggcctctca

SEQ ID NO: 214704 - DNA, 20 bp, Artificial
  CRISPR gRNA sequence
attctatttgtcttctcctt

SEQ ID NO: 214705 - DNA, 20 bp, Artificial
  CRISPR gRNA sequence
tgactaatttcacatgctct

SEQ ID NO: 214706 - DNA, 20 bp, Artificial
  CRISPR gRNA sequence
ttatttgcactaacaaagct

SEQ ID NO: 214707 - DNA, 20 bp, Artificial
  CRISPR gRNA sequence
tatcatgactggtgagagaa

SEQ ID NO: 214708 - DNA, 20 bp, Artificial
  CRISPR gRNA sequence
aggtacttttttatttaaaa

SEQ ID NO: 214709 - DNA, 20 bp, Artificial
  CRISPR gRNA sequence
gtaatattatatatacttaa

SEQ ID NO: 214710 - DNA, 20 bp, Artificial
  CRISPR gRNA sequence
aattttctccatggtgcagt

SEQ ID NO: 214711 - DNA, 20 bp, Artificial
  CRISPR gRNA sequence
gcacccaggtctcctgcttt

SEQ ID NO: 214712 - DNA, 20 bp, Artificial
  CRISPR gRNA sequence
ctgctttctcatgtgatgtt

SEQ ID NO: 214713 - DNA, 20 bp, Artificial
  CRISPR gRNA sequence
ctttctcatgtgatgttttc

SEQ ID NO: 214714 - DNA, 20 bp, Artificial
  CRISPR gRNA sequence
tctcatgtgatgttttcact

SEQ ID NO: 214715 - DNA, 20 bp, Artificial
  CRISPR gRNA sequence
ctcatgtgatgttttcactg

SEQ ID NO: 214716 - DNA, 20 bp, Artificial
  CRISPR gRNA sequence
tcatgtgatgttttcactgc

SEQ ID NO: 214717 - DNA, 20 bp, Artificial
  CRISPR gRNA sequence
atgtgatgttttcactgcac

SEQ ID NO: 214718 - DNA, 20 bp, Artificial
  CRISPR gRNA sequence
tcactgcaccatggagaaaa

SEQ ID NO: 214719 - DNA, 20 bp, Artificial
  CRISPR gRNA sequence
cactgcaccatggagaaaat

SEQ ID NO: 214720 - DNA, 20 bp, Artificial
  CRISPR gRNA sequence
actgcaccatggagaaaatt

SEQ ID NO: 214721 - DNA, 20 bp, Artificial
  CRISPR gRNA sequence
caccatggagaaaattaaaa

SEQ ID NO: 214722 - DNA, 20 bp, Artificial
  CRISPR gRNA sequence
aaaaataattatgaaacaca

SEQ ID NO: 214723 - DNA, 20 bp, Artificial
  CRISPR gRNA sequence
tgaaacacattggactgatt

SEQ ID NO: 214724 - DNA, 20 bp, Artificial
  CRISPR gRNA sequence
gactgatttaaaacttttaa

SEQ ID NO: 214725 - DNA, 20 bp, Artificial
  CRISPR gRNA sequence
atttaaaacttttaattaaa

SEQ ID NO: 214726 - DNA, 20 bp, Artificial
  CRISPR gRNA sequence
aaaacttttaattaaaactc

SEQ ID NO: 214727 - DNA, 20 bp, Artificial
  CRISPR gRNA sequence
aaacttttaattaaaactct

SEQ ID NO: 214728 - DNA, 20 bp, Artificial
  CRISPR gRNA sequence
ttaattaaaactctgctcta

SEQ ID NO: 214729 - DNA, 20 bp, Artificial
  CRISPR gRNA sequence
taattaaaactctgctctaa

SEQ ID NO: 214730 - DNA, 20 bp, Artificial
  CRISPR gRNA sequence
aattaaaactctgctctaat

SEQ ID NO: 214731 - DNA, 20 bp, Artificial
  CRISPR gRNA sequence
attaaaactctgctctaatt

SEQ ID NO: 214732 - DNA, 20 bp, Artificial
  CRISPR gRNA sequence
aaactctgctctaattaaaa

SEQ ID NO: 214733 - DNA, 20 bp, Artificial
  CRISPR gRNA sequence
tgctctaattaaaagcttat

SEQ ID NO: 214734 - DNA, 20 bp, Artificial
  CRISPR gRNA sequence
ctctaattaaaagcttattg

SEQ ID NO: 214735 - DNA, 20 bp, Artificial
  CRISPR gRNA sequence
taattaaaagcttattgggt

SEQ ID NO: 214736 - DNA, 20 bp, Artificial
  CRISPR gRNA sequence
attaaaagcttattgggtat

SEQ ID NO: 214737 - DNA, 20 bp, Artificial
  CRISPR gRNA sequence
aaagcttattgggtattata

SEQ ID NO: 214738 - DNA, 20 bp, Artificial
  CRISPR gRNA sequence
attgggtattatactcaaaa

SEQ ID NO: 214739 - DNA, 20 bp, Artificial
  CRISPR gRNA sequence
ttgggtattatactcaaaaa

SEQ ID NO: 214740 - DNA, 20 bp, Artificial
  CRISPR gRNA sequence
ggtattatactcaaaaaatt

SEQ ID NO: 214741 - DNA, 20 bp, Artificial
  CRISPR gRNA sequence
tactcaaaaaattcataatt

SEQ ID NO: 214742 - DNA, 20 bp, Artificial
  CRISPR gRNA sequence
aaaaaattcataattaatat

SEQ ID NO: 214743 - DNA, 20 bp, Artificial
  CRISPR gRNA sequence
ataattaatattttaaatca

SEQ ID NO: 214744 - DNA, 20 bp, Artificial
  CRISPR gRNA sequence
atattttaaatcattcttta

SEQ ID NO: 214745 - DNA, 20 bp, Artificial
  CRISPR gRNA sequence
taaatcattctttacattgt

SEQ ID NO: 214746 - DNA, 20 bp, Artificial
  CRISPR gRNA sequence
aaatcattctttacattgtt

SEQ ID NO: 214747 - DNA, 20 bp, Artificial
  CRISPR gRNA sequence
aatcattctttacattgtta

SEQ ID NO: 214748 - DNA, 20 bp, Artificial
  CRISPR gRNA sequence
tttacattgttacctagaat

SEQ ID NO: 214749 - DNA, 20 bp, Artificial
  CRISPR gRNA sequence
tacattgttacctagaatat

SEQ ID NO: 214750 - DNA, 20 bp, Artificial
  CRISPR gRNA sequence
acattgttacctagaatata

SEQ ID NO: 214751 - DNA, 20 bp, Artificial
  CRISPR gRNA sequence
cattgttacctagaatataa

SEQ ID NO: 214752 - DNA, 20 bp, Artificial
  CRISPR gRNA sequence
ttacctagaatataagcaac

SEQ ID NO: 214753 - DNA, 20 bp, Artificial
  CRISPR gRNA sequence
cctagaatataagcaactta

SEQ ID NO: 214754 - DNA, 20 bp, Artificial
  CRISPR gRNA sequence
gaatataagcaacttaaaaa

SEQ ID NO: 214755 - DNA, 20 bp, Artificial
  CRISPR gRNA sequence
aaaaatacattaataaatta

SEQ ID NO: 214756 - DNA, 20 bp, Artificial
  CRISPR gRNA sequence
aaaatacattaataaattaa

SEQ ID NO: 214757 - DNA, 20 bp, Artificial
  CRISPR gRNA sequence
ataaattaaatttttcagaa

SEQ ID NO: 214758 - DNA, 20 bp, Artificial
  CRISPR gRNA sequence
aatttttcagaaatgtgctt

SEQ ID NO: 214759 - DNA, 20 bp, Artificial
  CRISPR gRNA sequence
ttcagaaatgtgcttgtggt

SEQ ID NO: 214760 - DNA, 20 bp, Artificial
  CRISPR gRNA sequence
tcagaaatgtgcttgtggtc

SEQ ID NO: 214761 - DNA, 20 bp, Artificial
  CRISPR gRNA sequence
cagaaatgtgcttgtggtct

SEQ ID NO: 214762 - DNA, 20 bp, Artificial
  CRISPR gRNA sequence
agaaatgtgcttgtggtctg

SEQ ID NO: 214763 - DNA, 20 bp, Artificial
  CRISPR gRNA sequence
gtggtctgctgtagcagcaa

SEQ ID NO: 214764 - DNA, 20 bp, Artificial
  CRISPR gRNA sequence
tggtctgctgtagcagcaat

SEQ ID NO: 214765 - DNA, 20 bp, Artificial
  CRISPR gRNA sequence
ctgtagcagcaatagaaata

SEQ ID NO: 214766 - DNA, 20 bp, Artificial
  CRISPR gRNA sequence
tagcagcaatagaaatagcc

SEQ ID NO: 214767 - DNA, 20 bp, Artificial
  CRISPR gRNA sequence
aaaatgttttattaagtata

SEQ ID NO: 214768 - DNA, 20 bp, Artificial
  CRISPR gRNA sequence
aaatgttttattaagtatat

SEQ ID NO: 214769 - DNA, 20 bp, Artificial
  CRISPR gRNA sequence
tattaagtatatataatatt

SEQ ID NO: 214770 - DNA, 20 bp, Artificial
  CRISPR gRNA sequence
attaagtatatataatatta

SEQ ID NO: 214771 - DNA, 20 bp, Artificial
  CRISPR gRNA sequence
ttaagtatatataatattac

SEQ ID NO: 214772 - DNA, 20 bp, Artificial
  CRISPR gRNA sequence
agtatatataatattacagg

SEQ ID NO: 214773 - DNA, 20 bp, Artificial
  CRISPR gRNA sequence
cagggtaatatttacaaagt

SEQ ID NO: 214774 - DNA, 20 bp, Artificial
  CRISPR gRNA sequence
acaaagttatgttttttttt

SEQ ID NO: 214775 - DNA, 20 bp, Artificial
  CRISPR gRNA sequence
caaagttatgttttttttta

SEQ ID NO: 214776 - DNA, 20 bp, Artificial
  CRISPR gRNA sequence
tgtttttttttaaataaaaa

SEQ ID NO: 214777 - DNA, 20 bp, Artificial
  CRISPR gRNA sequence
ttttttaaataaaaaagtac

SEQ ID NO: 214778 - DNA, 20 bp, Artificial
  CRISPR gRNA sequence
tttttaaataaaaaagtacc

SEQ ID NO: 214779 - DNA, 20 bp, Artificial
  CRISPR gRNA sequence
ttttaaataaaaaagtacct

SEQ ID NO: 214780 - DNA, 20 bp, Artificial
  CRISPR gRNA sequence
tttaaataaaaaagtacctt

SEQ ID NO: 214781 - DNA, 20 bp, Artificial
  CRISPR gRNA sequence
ttaaataaaaaagtaccttg

SEQ ID NO: 214782 - DNA, 20 bp, Artificial
  CRISPR gRNA sequence
taaataaaaaagtaccttgg

SEQ ID NO: 214783 - DNA, 20 bp, Artificial
  CRISPR gRNA sequence
aaataaaaaagtaccttggc

SEQ ID NO: 214784 - DNA, 20 bp, Artificial
  CRISPR gRNA sequence
aataaaaaagtaccttggca

SEQ ID NO: 214785 - DNA, 20 bp, Artificial
  CRISPR gRNA sequence
ggcaaagattgcagatattc

SEQ ID NO: 214786 - DNA, 20 bp, Artificial
  CRISPR gRNA sequence
gcaaagattgcagatattca

SEQ ID NO: 214787 - DNA, 20 bp, Artificial
  CRISPR gRNA sequence
cagatattcaaagctttaaa

SEQ ID NO: 214788 - DNA, 20 bp, Artificial
  CRISPR gRNA sequence
aaagctttaaacagtgataa

SEQ ID NO: 214789 - DNA, 20 bp, Artificial
  CRISPR gRNA sequence
taaacagtgataaattgatt

SEQ ID NO: 214790 - DNA, 20 bp, Artificial
  CRISPR gRNA sequence
aaacagtgataaattgattt

SEQ ID NO: 214791 - DNA, 20 bp, Artificial
  CRISPR gRNA sequence
aacagtgataaattgattta

SEQ ID NO: 214792 - DNA, 20 bp, Artificial
  CRISPR gRNA sequence
atttaatacatataaaaaaa

SEQ ID NO: 214793 - DNA, 20 bp, Artificial
  CRISPR gRNA sequence
aatacatataaaaaaaaaaa

SEQ ID NO: 214794 - DNA, 20 bp, Artificial
  CRISPR gRNA sequence
atacatataaaaaaaaaaac

SEQ ID NO: 214795 - DNA, 20 bp, Artificial
  CRISPR gRNA sequence
taacggtaacacagctgtaa

SEQ ID NO: 214796 - DNA, 20 bp, Artificial
  CRISPR gRNA sequence
aacggtaacacagctgtaaa

SEQ ID NO: 214797 - DNA, 20 bp, Artificial
  CRISPR gRNA sequence
acggtaacacagctgtaaaa

SEQ ID NO: 214798 - DNA, 20 bp, Artificial
  CRISPR gRNA sequence
taaaacaactttggtcttca

SEQ ID NO: 214799 - DNA, 20 bp, Artificial
  CRISPR gRNA sequence
tggtcttcaaatcactgcaa

SEQ ID NO: 214800 - DNA, 20 bp, Artificial
  CRISPR gRNA sequence
ggtcttcaaatcactgcaaa

SEQ ID NO: 214801 - DNA, 20 bp, Artificial
  CRISPR gRNA sequence
gtcttcaaatcactgcaaaa

SEQ ID NO: 214802 - DNA, 20 bp, Artificial
  CRISPR gRNA sequence
caaatcactgcaaaaaaatg

SEQ ID NO: 214803 - DNA, 20 bp, Artificial
  CRISPR gRNA sequence
aaatcactgcaaaaaaatgg

SEQ ID NO: 214804 - DNA, 20 bp, Artificial
  CRISPR gRNA sequence
caaaaaaatggctactgaca

SEQ ID NO: 214805 - DNA, 20 bp, Artificial
  CRISPR gRNA sequence
ctgacaaatagcacaccttt

SEQ ID NO: 214806 - DNA, 20 bp, Artificial
  CRISPR gRNA sequence
acaaatagcacacctttaat

SEQ ID NO: 214807 - DNA, 20 bp, Artificial
  CRISPR gRNA sequence
taattgctatgcaaaaaagc

SEQ ID NO: 214808 - DNA, 20 bp, Artificial
  CRISPR gRNA sequence
aattgctatgcaaaaaagct

SEQ ID NO: 214809 - DNA, 20 bp, Artificial
  CRISPR gRNA sequence
attgctatgcaaaaaagctc

SEQ ID NO: 214810 - DNA, 20 bp, Artificial
  CRISPR gRNA sequence
ctatgcaaaaaagctccaag

SEQ ID NO: 214811 - DNA, 20 bp, Artificial
  CRISPR gRNA sequence
tgcaaaaaagctccaagaga

SEQ ID NO: 214812 - DNA, 20 bp, Artificial
  CRISPR gRNA sequence
caagagaggatcttgcacat

SEQ ID NO: 214813 - DNA, 20 bp, Artificial
  CRISPR gRNA sequence
gcacatagcaacactggagt

SEQ ID NO: 214814 - DNA, 20 bp, Artificial
  CRISPR gRNA sequence
cacatagcaacactggagtt

SEQ ID NO: 214815 - DNA, 20 bp, Artificial
  CRISPR gRNA sequence
gagttctctttatttagaat

SEQ ID NO: 214816 - DNA, 20 bp, Artificial
  CRISPR gRNA sequence
tctttatttagaatggttaa

SEQ ID NO: 214817 - DNA, 20 bp, Artificial
  CRISPR gRNA sequence
tttatttagaatggttaata

SEQ ID NO: 214818 - DNA, 20 bp, Artificial
  CRISPR gRNA sequence
tatttagaatggttaataga

SEQ ID NO: 214819 - DNA, 20 bp, Artificial
  CRISPR gRNA sequence
atttagaatggttaatagat

SEQ ID NO: 214820 - DNA, 20 bp, Artificial
  CRISPR gRNA sequence
tttagaatggttaatagata

SEQ ID NO: 214821 - DNA, 20 bp, Artificial
  CRISPR gRNA sequence
agaatggttaatagatattt

SEQ ID NO: 214822 - DNA, 20 bp, Artificial
  CRISPR gRNA sequence
gaatggttaatagatattta

SEQ ID NO: 214823 - DNA, 20 bp, Artificial
  CRISPR gRNA sequence
atagatatttatacgatgtg

SEQ ID NO: 214824 - DNA, 20 bp, Artificial
  CRISPR gRNA sequence
atacgatgtgggatctaatt

SEQ ID NO: 214825 - DNA, 20 bp, Artificial
  CRISPR gRNA sequence
tacgatgtgggatctaattc

SEQ ID NO: 214826 - DNA, 20 bp, Artificial
  CRISPR gRNA sequence
attctcaacaatggcttttt

SEQ ID NO: 214827 - DNA, 20 bp, Artificial
  CRISPR gRNA sequence
tcaacaatggctttttgtaa

SEQ ID NO: 214828 - DNA, 20 bp, Artificial
  CRISPR gRNA sequence
aacaatggctttttgtaaat

SEQ ID NO: 214829 - DNA, 20 bp, Artificial
  CRISPR gRNA sequence
tttgtaaataatgctccatt

SEQ ID NO: 214830 - DNA, 20 bp, Artificial
  CRISPR gRNA sequence
ttgtaaataatgctccattt

SEQ ID NO: 214831 - DNA, 20 bp, Artificial
  CRISPR gRNA sequence
tgtaaataatgctccattta

SEQ ID NO: 214832 - DNA, 20 bp, Artificial
  CRISPR gRNA sequence
gtaaataatgctccatttaa

SEQ ID NO: 214833 - DNA, 20 bp, Artificial
  CRISPR gRNA sequence
taaataatgctccatttaat

SEQ ID NO: 214834 - DNA, 20 bp, Artificial
  CRISPR gRNA sequence
catttaataaaaacaaaatg

SEQ ID NO: 214835 - DNA, 20 bp, Artificial
  CRISPR gRNA sequence
aataaaaacaaaatgttttc

SEQ ID NO: 214836 - DNA, 20 bp, Artificial
  CRISPR gRNA sequence
ataaaaacaaaatgttttct

SEQ ID NO: 214837 - DNA, 20 bp, Artificial
  CRISPR gRNA sequence
tcttctctcaccagtcatga

SEQ ID NO: 214838 - DNA, 20 bp, Artificial
  CRISPR gRNA sequence
cttctctcaccagtcatgat

SEQ ID NO: 214839 - DNA, 20 bp, Artificial
  CRISPR gRNA sequence
ttctctcaccagtcatgata

SEQ ID NO: 214840 - DNA, 20 bp, Artificial
  CRISPR gRNA sequence
ctctcaccagtcatgataac

SEQ ID NO: 214841 - DNA, 20 bp, Artificial
  CRISPR gRNA sequence
tctcaccagtcatgataaca

SEQ ID NO: 214842 - DNA, 20 bp, Artificial
  CRISPR gRNA sequence
tcaccagtcatgataacaac

SEQ ID NO: 214843 - DNA, 20 bp, Artificial
  CRISPR gRNA sequence
accagtcatgataacaacac

SEQ ID NO: 214844 - DNA, 20 bp, Artificial
  CRISPR gRNA sequence
ttaagatttaagatgttgtc

SEQ ID NO: 214845 - DNA, 20 bp, Artificial
  CRISPR gRNA sequence
taagatttaagatgttgtct

SEQ ID NO: 214846 - DNA, 20 bp, Artificial
  CRISPR gRNA sequence
aagatttaagatgttgtctt

SEQ ID NO: 214847 - DNA, 20 bp, Artificial
  CRISPR gRNA sequence
agatttaagatgttgtctta

SEQ ID NO: 214848 - DNA, 20 bp, Artificial
  CRISPR gRNA sequence
aagatgttgtcttacagagg

SEQ ID NO: 214849 - DNA, 20 bp, Artificial
  CRISPR gRNA sequence
agatgttgtcttacagagga

SEQ ID NO: 214850 - DNA, 20 bp, Artificial
  CRISPR gRNA sequence
tcttacagaggagcttagta

SEQ ID NO: 214851 - DNA, 20 bp, Artificial
  CRISPR gRNA sequence
acagaggagcttagtacaaa

SEQ ID NO: 214852 - DNA, 20 bp, Artificial
  CRISPR gRNA sequence
cagaggagcttagtacaaat

SEQ ID NO: 214853 - DNA, 20 bp, Artificial
  CRISPR gRNA sequence
agtacaaatgctttcttttt

SEQ ID NO: 214854 - DNA, 20 bp, Artificial
  CRISPR gRNA sequence
gtacaaatgctttctttttt

SEQ ID NO: 214855 - DNA, 20 bp, Artificial
  CRISPR gRNA sequence
tctttttttcaaaaagagaa

SEQ ID NO: 214856 - DNA, 20 bp, Artificial
  CRISPR gRNA sequence
ctttttttcaaaaagagaaa

SEQ ID NO: 214857 - DNA, 20 bp, Artificial
  CRISPR gRNA sequence
tttttttcaaaaagagaaat

SEQ ID NO: 214858 - DNA, 20 bp, Artificial
  CRISPR gRNA sequence
tttttcaaaaagagaaattt

SEQ ID NO: 214859 - DNA, 20 bp, Artificial
  CRISPR gRNA sequence
ttttcaaaaagagaaattta

SEQ ID NO: 214860 - DNA, 20 bp, Artificial
  CRISPR gRNA sequence
tttcaaaaagagaaatttat

SEQ ID NO: 214861 - DNA, 20 bp, Artificial
  CRISPR gRNA sequence
ttcaaaaagagaaatttatg

SEQ ID NO: 214862 - DNA, 20 bp, Artificial
  CRISPR gRNA sequence
tcaaaaagagaaatttatga

SEQ ID NO: 214863 - DNA, 20 bp, Artificial
  CRISPR gRNA sequence
caaaaagagaaatttatgag

SEQ ID NO: 214864 - DNA, 20 bp, Artificial
  CRISPR gRNA sequence
aaaaagagaaatttatgaga

SEQ ID NO: 214865 - DNA, 20 bp, Artificial
  CRISPR gRNA sequence
atgagaaagctggtcttcaa

SEQ ID NO: 214866 - DNA, 20 bp, Artificial
  CRISPR gRNA sequence
tgagaaagctggtcttcaat

SEQ ID NO: 214867 - DNA, 20 bp, Artificial
  CRISPR gRNA sequence
gtcttcaatgatcttaatta

SEQ ID NO: 214868 - DNA, 20 bp, Artificial
  CRISPR gRNA sequence
caatgatcttaattaagaac

SEQ ID NO: 214869 - DNA, 20 bp, Artificial
  CRISPR gRNA sequence
aatgatcttaattaagaact

SEQ ID NO: 214870 - DNA, 20 bp, Artificial
  CRISPR gRNA sequence
aattaagaactgtcaaagct

SEQ ID NO: 214871 - DNA, 20 bp, Artificial
  CRISPR gRNA sequence
attaagaactgtcaaagcta

SEQ ID NO: 214872 - DNA, 20 bp, Artificial
  CRISPR gRNA sequence
agaactgtcaaagctaaagg

SEQ ID NO: 214873 - DNA, 20 bp, Artificial
  CRISPR gRNA sequence
tcaaagctaaaggcagaaaa

SEQ ID NO: 214874 - DNA, 20 bp, Artificial
  CRISPR gRNA sequence
aaggcagaaaaactgcctgg

SEQ ID NO: 214875 - DNA, 20 bp, Artificial
  CRISPR gRNA sequence
cctggtcactcactgctcat

SEQ ID NO: 214876 - DNA, 20 bp, Artificial
  CRISPR gRNA sequence
gtcactcactgctcatctct

SEQ ID NO: 214877 - DNA, 20 bp, Artificial
  CRISPR gRNA sequence
actgctcatctcttcaaagt

SEQ ID NO: 214878 - DNA, 20 bp, Artificial
  CRISPR gRNA sequence
ctcatctcttcaaagttacc

SEQ ID NO: 214879 - DNA, 20 bp, Artificial
  CRISPR gRNA sequence
atctcttcaaagttacctgg

SEQ ID NO: 214880 - DNA, 20 bp, Artificial
  CRISPR gRNA sequence
ttcaaagttacctggattat

SEQ ID NO: 214881 - DNA, 20 bp, Artificial
  CRISPR gRNA sequence
caaagttacctggattatcc

SEQ ID NO: 214882 - DNA, 20 bp, Artificial
  CRISPR gRNA sequence
aaagttacctggattatccc

SEQ ID NO: 214883 - DNA, 20 bp, Artificial
  CRISPR gRNA sequence
cctggattatccctattagt

SEQ ID NO: 214884 - DNA, 20 bp, Artificial
  CRISPR gRNA sequence
gattatccctattagtcact

SEQ ID NO: 214885 - DNA, 20 bp, Artificial
  CRISPR gRNA sequence
tccctattagtcactgaaaa

SEQ ID NO: 214886 - DNA, 20 bp, Artificial
  CRISPR gRNA sequence
ttagtcactgaaaatgacct

SEQ ID NO: 214887 - DNA, 20 bp, Artificial
  CRISPR gRNA sequence
gtcactgaaaatgacctaac

SEQ ID NO: 214888 - DNA, 20 bp, Artificial
  CRISPR gRNA sequence
aaaatgacctaacaaaggac

SEQ ID NO: 214889 - DNA, 20 bp, Artificial
  CRISPR gRNA sequence
acaaaggaccccagcaggtg

SEQ ID NO: 214890 - DNA, 20 bp, Artificial
  CRISPR gRNA sequence
gtaattttaaaatatgacac

SEQ ID NO: 214891 - DNA, 20 bp, Artificial
  CRISPR gRNA sequence
taaaatatgacacaagtaaa

SEQ ID NO: 214892 - DNA, 20 bp, Artificial
  CRISPR gRNA sequence
aaaatatgacacaagtaaaa

SEQ ID NO: 214893 - DNA, 20 bp, Artificial
  CRISPR gRNA sequence
aaatatgacacaagtaaaac

SEQ ID NO: 214894 - DNA, 20 bp, Artificial
  CRISPR gRNA sequence
tttataaaaaaatccctcaa

SEQ ID NO: 214895 - DNA, 20 bp, Artificial
  CRISPR gRNA sequence
ataaaaaaatccctcaacca

SEQ ID NO: 214896 - DNA, 20 bp, Artificial
  CRISPR gRNA sequence
taaaaaaatccctcaaccaa

SEQ ID NO: 214897 - DNA, 20 bp, Artificial
  CRISPR gRNA sequence
aaccaaataaaatacaataa

SEQ ID NO: 214898 - DNA, 20 bp, Artificial
  CRISPR gRNA sequence
cccgacaatcatttctccag

SEQ ID NO: 214899 - DNA, 20 bp, Artificial
  CRISPR gRNA sequence
ctccagtttccaacaacagg

SEQ ID NO: 214900 - DNA, 20 bp, Artificial
  CRISPR gRNA sequence
tccagtttccaacaacaggt

SEQ ID NO: 214901 - DNA, 20 bp, Artificial
  CRISPR gRNA sequence
cagtttccaacaacaggtaa

SEQ ID NO: 214902 - DNA, 20 bp, Artificial
  CRISPR gRNA sequence
ccaacaacaggtaaattaag

SEQ ID NO: 214903 - DNA, 20 bp, Artificial
  CRISPR gRNA sequence
caacaacaggtaaattaagg

SEQ ID NO: 214904 - DNA, 20 bp, Artificial
  CRISPR gRNA sequence
aggagtatgtgtttccatac

SEQ ID NO: 214905 - DNA, 20 bp, Artificial
  CRISPR gRNA sequence
ccatacatacaccacagatc

SEQ ID NO: 214906 - DNA, 20 bp, Artificial
  CRISPR gRNA sequence
catacatacaccacagatcc

SEQ ID NO: 214907 - DNA, 20 bp, Artificial
  CRISPR gRNA sequence
ttgaatacccattttaagac

SEQ ID NO: 214908 - DNA, 20 bp, Artificial
  CRISPR gRNA sequence
tgaatacccattttaagaca

SEQ ID NO: 214909 - DNA, 20 bp, Artificial
  CRISPR gRNA sequence
gaatacccattttaagacaa

SEQ ID NO: 214910 - DNA, 20 bp, Artificial
  CRISPR gRNA sequence
aatacccattttaagacaag

SEQ ID NO: 214911 - DNA, 20 bp, Artificial
  CRISPR gRNA sequence
taagacaagagaaacctaga

SEQ ID NO: 214912 - DNA, 20 bp, Artificial
  CRISPR gRNA sequence
aagacaagagaaacctagaa

SEQ ID NO: 214913 - DNA, 20 bp, Artificial
  CRISPR gRNA sequence
agacaagagaaacctagaag

SEQ ID NO: 214914 - DNA, 20 bp, Artificial
  CRISPR gRNA sequence
gaaggttgattacagcttaa

SEQ ID NO: 214915 - DNA, 20 bp, Artificial
  CRISPR gRNA sequence
attacagcttaatttttatt

SEQ ID NO: 214916 - DNA, 20 bp, Artificial
  CRISPR gRNA sequence
cagcttaatttttattactg

SEQ ID NO: 214917 - DNA, 20 bp, Artificial
  CRISPR gRNA sequence
aatttttattactgagatgg

SEQ ID NO: 214918 - DNA, 20 bp, Artificial
  CRISPR gRNA sequence
atttttattactgagatgga

SEQ ID NO: 214919 - DNA, 20 bp, Artificial
  CRISPR gRNA sequence
ttattactgagatggaggag

SEQ ID NO: 214920 - DNA, 20 bp, Artificial
  CRISPR gRNA sequence
tattactgagatggaggagt

SEQ ID NO: 214921 - DNA, 20 bp, Artificial
  CRISPR gRNA sequence
attactgagatggaggagta

SEQ ID NO: 214922 - DNA, 20 bp, Artificial
  CRISPR gRNA sequence
ttactgagatggaggagtaa

SEQ ID NO: 214923 - DNA, 20 bp, Artificial
  CRISPR gRNA sequence
ctgagatggaggagtaaact

SEQ ID NO: 214924 - DNA, 20 bp, Artificial
  CRISPR gRNA sequence
agatggaggagtaaacttat

SEQ ID NO: 214925 - DNA, 20 bp, Artificial
  CRISPR gRNA sequence
atcgtgttttgagctttgtt

SEQ ID NO: 214926 - DNA, 20 bp, Artificial
  CRISPR gRNA sequence
tcgtgttttgagctttgtta

SEQ ID NO: 214927 - DNA, 20 bp, Artificial
  CRISPR gRNA sequence
tgagctttgttagtgcaaat

SEQ ID NO: 214928 - DNA, 20 bp, Artificial
  CRISPR gRNA sequence
gagctttgttagtgcaaata

SEQ ID NO: 214929 - DNA, 20 bp, Artificial
  CRISPR gRNA sequence
agctttgttagtgcaaataa

SEQ ID NO: 214930 - DNA, 20 bp, Artificial
  CRISPR gRNA sequence
tgttagtgcaaataacaatt

SEQ ID NO: 214931 - DNA, 20 bp, Artificial
  CRISPR gRNA sequence
gttagtgcaaataacaattt

SEQ ID NO: 214932 - DNA, 20 bp, Artificial
  CRISPR gRNA sequence
ttagtgcaaataacaatttg

SEQ ID NO: 214933 - DNA, 20 bp, Artificial
  CRISPR gRNA sequence
gtgcaaataacaatttggtg

SEQ ID NO: 214934 - DNA, 20 bp, Artificial
  CRISPR gRNA sequence
ggtggtcacttactaaattg

SEQ ID NO: 214935 - DNA, 20 bp, Artificial
  CRISPR gRNA sequence
gtggtcacttactaaattga

SEQ ID NO: 214936 - DNA, 20 bp, Artificial
  CRISPR gRNA sequence
actaaattgactatagcatc

SEQ ID NO: 214937 - DNA, 20 bp, Artificial
  CRISPR gRNA sequence
ctaaattgactatagcatcc

SEQ ID NO: 214938 - DNA, 20 bp, Artificial
  CRISPR gRNA sequence
aattgactatagcatcctga

SEQ ID NO: 214939 - DNA, 20 bp, Artificial
  CRISPR gRNA sequence
actatagcatcctgaaaaaa

SEQ ID NO: 214940 - DNA, 20 bp, Artificial
  CRISPR gRNA sequence
tagcatcctgaaaaaagaaa

SEQ ID NO: 214941 - DNA, 20 bp, Artificial
  CRISPR gRNA sequence
aaaaaagaaatatttccaat

SEQ ID NO: 214942 - DNA, 20 bp, Artificial
  CRISPR gRNA sequence
ccaattacgggatagccctg

SEQ ID NO: 214943 - DNA, 20 bp, Artificial
  CRISPR gRNA sequence
caattacgggatagccctgt

SEQ ID NO: 214944 - DNA, 20 bp, Artificial
  CRISPR gRNA sequence
cgggatagccctgttatttt

SEQ ID NO: 214945 - DNA, 20 bp, Artificial
  CRISPR gRNA sequence
ttattttaattctgacattc

SEQ ID NO: 214946 - DNA, 20 bp, Artificial
  CRISPR gRNA sequence
ttttaattctgacattctta

SEQ ID NO: 214947 - DNA, 20 bp, Artificial
  CRISPR gRNA sequence
taattctgacattcttaggg

SEQ ID NO: 214948 - DNA, 20 bp, Artificial
  CRISPR gRNA sequence
aattctgacattcttaggga

SEQ ID NO: 214949 - DNA, 20 bp, Artificial
  CRISPR gRNA sequence
attctgacattcttagggat

SEQ ID NO: 214950 - DNA, 20 bp, Artificial
  CRISPR gRNA sequence
tgacattcttagggatttaa

SEQ ID NO: 214951 - DNA, 20 bp, Artificial
  CRISPR gRNA sequence
acattcttagggatttaaac

SEQ ID NO: 214952 - DNA, 20 bp, Artificial
  CRISPR gRNA sequence
ttagggatttaaacagaatg

SEQ ID NO: 214953 - DNA, 20 bp, Artificial
  CRISPR gRNA sequence
agggatttaaacagaatgga

SEQ ID NO: 214954 - DNA, 20 bp, Artificial
  CRISPR gRNA sequence
gggatttaaacagaatggac

SEQ ID NO: 214955 - DNA, 20 bp, Artificial
  CRISPR gRNA sequence
aaacagaatggacctggagt

SEQ ID NO: 214956 - DNA, 20 bp, Artificial
  CRISPR gRNA sequence
aacagaatggacctggagtt

SEQ ID NO: 214957 - DNA, 20 bp, Artificial
  CRISPR gRNA sequence
gagtttccaggagaaaaata

SEQ ID NO: 214958 - DNA, 20 bp, Artificial
  CRISPR gRNA sequence
ccaggagaaaaataatcacc

SEQ ID NO: 214959 - DNA, 20 bp, Artificial
  CRISPR gRNA sequence
caggagaaaaataatcacct

SEQ ID NO: 214960 - DNA, 20 bp, Artificial
  CRISPR gRNA sequence
tgaaggtttttagagcatgt

SEQ ID NO: 214961 - DNA, 20 bp, Artificial
  CRISPR gRNA sequence
gaaggtttttagagcatgtg

SEQ ID NO: 214962 - DNA, 20 bp, Artificial
  CRISPR gRNA sequence
aaggtttttagagcatgtga

SEQ ID NO: 214963 - DNA, 20 bp, Artificial
  CRISPR gRNA sequence
ttagagcatgtgaaattagt

SEQ ID NO: 214964 - DNA, 20 bp, Artificial
  CRISPR gRNA sequence
tagagcatgtgaaattagtc

SEQ ID NO: 214965 - DNA, 20 bp, Artificial
  CRISPR gRNA sequence
agagcatgtgaaattagtca

SEQ ID NO: 214966 - DNA, 20 bp, Artificial
  CRISPR gRNA sequence
gagcatgtgaaattagtcaa

SEQ ID NO: 214967 - DNA, 20 bp, Artificial
  CRISPR gRNA sequence
gtcaaaaaaaaaaaaaaaaa

SEQ ID NO: 214968 - DNA, 20 bp, Artificial
  CRISPR gRNA sequence
tcaagctcaccctattaaaa

SEQ ID NO: 214969 - DNA, 20 bp, Artificial
  CRISPR gRNA sequence
aagctcaccctattaaaaag

SEQ ID NO: 214970 - DNA, 20 bp, Artificial
  CRISPR gRNA sequence
accctattaaaaagtgataa

SEQ ID NO: 214971 - DNA, 20 bp, Artificial
  CRISPR gRNA sequence
ttaaaaagtgataaatctaa

SEQ ID NO: 214972 - DNA, 20 bp, Artificial
  CRISPR gRNA sequence
aaaagtgataaatctaaata

SEQ ID NO: 214973 - DNA, 20 bp, Artificial
  CRISPR gRNA sequence
aatacagccaactctcaatc

SEQ ID NO: 214974 - DNA, 20 bp, Artificial
  CRISPR gRNA sequence
tcaatcatttaacttatgta

SEQ ID NO: 214975 - DNA, 20 bp, Artificial
  CRISPR gRNA sequence
aatcatttaacttatgtacc

SEQ ID NO: 214976 - DNA, 20 bp, Artificial
  CRISPR gRNA sequence
aacttatgtacctagcttct

SEQ ID NO: 214977 - DNA, 20 bp, Artificial
  CRISPR gRNA sequence
acttatgtacctagcttctg

SEQ ID NO: 214978 - DNA, 20 bp, Artificial
  CRISPR gRNA sequence
atgtacctagcttctgatgt

SEQ ID NO: 214979 - DNA, 20 bp, Artificial
  CRISPR gRNA sequence
tgtacctagcttctgatgta

SEQ ID NO: 214980 - DNA, 20 bp, Artificial
  CRISPR gRNA sequence
gcttctgatgtatgcaaaac

SEQ ID NO: 214981 - DNA, 20 bp, Artificial
  CRISPR gRNA sequence
ctgatgtatgcaaaacactg

SEQ ID NO: 214982 - DNA, 20 bp, Artificial
  CRISPR gRNA sequence
tgatgtatgcaaaacactgc

SEQ ID NO: 214983 - DNA, 20 bp, Artificial
  CRISPR gRNA sequence
atgtatgcaaaacactgcag

SEQ ID NO: 214984 - DNA, 20 bp, Artificial
  CRISPR gRNA sequence
caggaagagagaatgaaaga

SEQ ID NO: 214985 - DNA, 20 bp, Artificial
  CRISPR gRNA sequence
tagctatagaaggaatttta

SEQ ID NO: 214986 - DNA, 20 bp, Artificial
  CRISPR gRNA sequence
gctatagaaggaattttaaa

SEQ ID NO: 214987 - DNA, 20 bp, Artificial
  CRISPR gRNA sequence
tagaaggaattttaaaatca

SEQ ID NO: 214988 - DNA, 20 bp, Artificial
  CRISPR gRNA sequence
taaaatcaaggagaagagca

SEQ ID NO: 214989 - DNA, 20 bp, Artificial
  CRISPR gRNA sequence
aaaatcaaggagaagagcaa

SEQ ID NO: 214990 - DNA, 20 bp, Artificial
  CRISPR gRNA sequence
aaatcaaggagaagagcaag

SEQ ID NO: 214991 - DNA, 20 bp, Artificial
  CRISPR gRNA sequence
atagaactaagcagagatgc

SEQ ID NO: 214992 - DNA, 20 bp, Artificial
  CRISPR gRNA sequence
agcagagatgcataaagtac

SEQ ID NO: 214993 - DNA, 20 bp, Artificial
  CRISPR gRNA sequence
taggaatggtaagttaagag

SEQ ID NO: 214994 - DNA, 20 bp, Artificial
  CRISPR gRNA sequence
agagacaaaagagcagctac

SEQ ID NO: 214995 - DNA, 20 bp, Artificial
  CRISPR gRNA sequence
cacagatgaagaggaactgc

SEQ ID NO: 214996 - DNA, 20 bp, Artificial
  CRISPR gRNA sequence
caaaggagaatgttttgaag

SEQ ID NO: 214997 - DNA, 20 bp, Artificial
  CRISPR gRNA sequence
tgaaggagaagacaaataga

SEQ ID NO: 214998 - DNA, 20 bp, Artificial
  CRISPR gRNA sequence
gaaggagaagacaaatagaa

SEQ ID NO: 214999 - DNA, 20 bp, Artificial
  CRISPR gRNA sequence
aaggagaagacaaatagaat

SEQ ID NO: 215000 - DNA, 20 bp, Artificial
  CRISPR gRNA sequence
ggcaaaagtagctggaaagg

SEQ ID NO: 215001 - DNA, 20 bp, Artificial
  CRISPR gRNA sequence
gcaaaagtagctggaaaggt

SEQ ID NO: 215002 - DNA, 20 bp, Artificial
  CRISPR gRNA sequence
gaaaggttgttgcagaaaag

SEQ ID NO: 215003 - DNA, 20 bp, Artificial
  CRISPR gRNA sequence
ttgcagaaaaggacaaatgg

SEQ ID NO: 215004 - DNA, 20 bp, Artificial
  CRISPR gRNA sequence
cagaaaaggacaaatggtgt

SEQ ID NO: 215005 - DNA, 20 bp, Artificial
  CRISPR gRNA sequence
tgagaacacacaataaataa

SEQ ID NO: 215006 - DNA, 20 bp, Artificial
  CRISPR gRNA sequence
aatggaagagtcaacagcag

SEQ ID NO: 215007 - DNA, 20 bp, Artificial
  CRISPR gRNA sequence
ggatcagggagtaaaaagca

SEQ ID NO: 215008 - DNA, 20 bp, Artificial
  CRISPR gRNA sequence
tgggacaaaacagatacatg

SEQ ID NO: 215009 - DNA, 20 bp, Artificial
  CRISPR gRNA sequence
tctgcaatttaaatgtgatg

SEQ ID NO: 215010 - DNA, 20 bp, Artificial
  CRISPR gRNA sequence
caatttaaatgtgatgtgat

SEQ ID NO: 215011 - DNA, 20 bp, Artificial
  CRISPR gRNA sequence
aaatgtgatgtgatggaatt

SEQ ID NO: 215012 - DNA, 20 bp, Artificial
  CRISPR gRNA sequence
aatgtgatgtgatggaattt

SEQ ID NO: 215013 - DNA, 20 bp, Artificial
  CRISPR gRNA sequence
gggagccattacaaatctga

SEQ ID NO: 215014 - DNA, 20 bp, Artificial
  CRISPR gRNA sequence
ggagccattacaaatctgat

SEQ ID NO: 215015 - DNA, 20 bp, Artificial
  CRISPR gRNA sequence
caaatctgatttaaagagaa

SEQ ID NO: 215016 - DNA, 20 bp, Artificial
  CRISPR gRNA sequence
atttaaagagaaggaactgg

SEQ ID NO: 215017 - DNA, 20 bp, Artificial
  CRISPR gRNA sequence
aaagagaaggaactggccca

SEQ ID NO: 215018 - DNA, 20 bp, Artificial
  CRISPR gRNA sequence
aagagaaggaactggcccaa

SEQ ID NO: 215019 - DNA, 20 bp, Artificial
  CRISPR gRNA sequence
gcccaatgatgcccaagcag

SEQ ID NO: 215020 - DNA, 20 bp, Artificial
  CRISPR gRNA sequence
ctgcttctgtggtcacttat

SEQ ID NO: 215021 - DNA, 20 bp, Artificial
  CRISPR gRNA sequence
cttctgtggtcacttatcca

SEQ ID NO: 215022 - DNA, 20 bp, Artificial
  CRISPR gRNA sequence
ctgtggtcacttatccagag

SEQ ID NO: 215023 - DNA, 20 bp, Artificial
  CRISPR gRNA sequence
tgtggtcacttatccagaga

SEQ ID NO: 215024 - DNA, 20 bp, Artificial
  CRISPR gRNA sequence
tggtcacttatccagagaag

SEQ ID NO: 215025 - DNA, 20 bp, Artificial
  CRISPR gRNA sequence
atccagagaagctgacaact

SEQ ID NO: 215026 - DNA, 20 bp, Artificial
  CRISPR gRNA sequence
tccagagaagctgacaacta

SEQ ID NO: 215027 - DNA, 20 bp, Artificial
  CRISPR gRNA sequence
acaactagtgagagcaagag

SEQ ID NO: 215028 - DNA, 20 bp, Artificial
  CRISPR gRNA sequence
gtgagagcaagagttggttt

SEQ ID NO: 215029 - DNA, 20 bp, Artificial
  CRISPR gRNA sequence
gtttcatctggcatttcccc

SEQ ID NO: 215030 - DNA, 20 bp, Artificial
  CRISPR gRNA sequence
catctggcatttcccccact

SEQ ID NO: 215031 - DNA, 20 bp, Artificial
  CRISPR gRNA sequence
atctggcatttcccccacta

SEQ ID NO: 215032 - DNA, 20 bp, Artificial
  CRISPR gRNA sequence
gcatttcccccactatctct

SEQ ID NO: 215033 - DNA, 20 bp, Artificial
  CRISPR gRNA sequence
cccccactatctctggtggc

SEQ ID NO: 215034 - DNA, 20 bp, Artificial
  CRISPR gRNA sequence
ccccactatctctggtggca

SEQ ID NO: 215035 - DNA, 20 bp, Artificial
  CRISPR gRNA sequence
tctctggtggcattgtctag

SEQ ID NO: 215036 - DNA, 20 bp, Artificial
  CRISPR gRNA sequence
tggtggcattgtctagggca

SEQ ID NO: 215037 - DNA, 20 bp, Artificial
  CRISPR gRNA sequence
gtggcattgtctagggcagt

SEQ ID NO: 215038 - DNA, 20 bp, Artificial
  CRISPR gRNA sequence
tctagggcagtgaatgcctc

SEQ ID NO: 215039 - DNA, 20 bp, Artificial
  CRISPR gRNA sequence
gggcagtgaatgcctcaaaa

SEQ ID NO: 215040 - DNA, 20 bp, Artificial
  CRISPR gRNA sequence
aaaaggcaggcagcattaaa

SEQ ID NO: 215041 - DNA, 20 bp, Artificial
  CRISPR gRNA sequence
aagagaacacaatggatgga

SEQ ID NO: 215042 - DNA, 20 bp, Artificial
  CRISPR gRNA sequence
actacatattaaaaggtaca

SEQ ID NO: 215043 - DNA, 20 bp, Artificial
  CRISPR gRNA sequence
ctacatattaaaaggtacaa

SEQ ID NO: 215044 - DNA, 20 bp, Artificial
  CRISPR gRNA sequence
catattaaaaggtacaactt

SEQ ID NO: 215045 - DNA, 20 bp, Artificial
  CRISPR gRNA sequence
aaaggtacaactttagttta

SEQ ID NO: 215046 - DNA, 20 bp, Artificial
  CRISPR gRNA sequence
tagtttataaaaaattttac

SEQ ID NO: 215047 - DNA, 20 bp, Artificial
  CRISPR gRNA sequence
agtttataaaaaattttact

SEQ ID NO: 215048 - DNA, 20 bp, Artificial
  CRISPR gRNA sequence
gtttataaaaaattttacta

SEQ ID NO: 215049 - DNA, 20 bp, Artificial
  CRISPR gRNA sequence
ataaaaaattttactataaa

SEQ ID NO: 215050 - DNA, 20 bp, Artificial
  CRISPR gRNA sequence
taaaaaattttactataaag

SEQ ID NO: 215051 - DNA, 20 bp, Artificial
  CRISPR gRNA sequence
tactataaagattttcatac

SEQ ID NO: 215052 - DNA, 20 bp, Artificial
  CRISPR gRNA sequence
actataaagattttcatacc

SEQ ID NO: 215053 - DNA, 20 bp, Artificial
  CRISPR gRNA sequence
ctataaagattttcatacct

SEQ ID NO: 215054 - DNA, 20 bp, Artificial
  CRISPR gRNA sequence
taaagattttcatacctttt

SEQ ID NO: 215055 - DNA, 20 bp, Artificial
  CRISPR gRNA sequence
tcataccttttctaatagga

SEQ ID NO: 215056 - DNA, 20 bp, Artificial
  CRISPR gRNA sequence
cataccttttctaataggag

SEQ ID NO: 215057 - DNA, 20 bp, Artificial
  CRISPR gRNA sequence
ataccttttctaataggagc

SEQ ID NO: 215058 - DNA, 20 bp, Artificial
  CRISPR gRNA sequence
ttctaataggagcttggatc

SEQ ID NO: 215059 - DNA, 20 bp, Artificial
  CRISPR gRNA sequence
tctaataggagcttggatct

SEQ ID NO: 215060 - DNA, 20 bp, Artificial
  CRISPR gRNA sequence
ctaataggagcttggatctt

SEQ ID NO: 215061 - DNA, 20 bp, Artificial
  CRISPR gRNA sequence
taataggagcttggatcttt

SEQ ID NO: 215062 - DNA, 20 bp, Artificial
  CRISPR gRNA sequence
ataggagcttggatcttttt

SEQ ID NO: 215063 - DNA, 20 bp, Artificial
  CRISPR gRNA sequence
ggatctttttcaagtccatc

SEQ ID NO: 215064 - DNA, 20 bp, Artificial
  CRISPR gRNA sequence
gatctttttcaagtccatct

SEQ ID NO: 215065 - DNA, 20 bp, Artificial
  CRISPR gRNA sequence
tttcaagtccatctgctttt

SEQ ID NO: 215066 - DNA, 20 bp, Artificial
  CRISPR gRNA sequence
ttcaagtccatctgcttttc

SEQ ID NO: 215067 - DNA, 20 bp, Artificial
  CRISPR gRNA sequence
tcaagtccatctgcttttcc

SEQ ID NO: 215068 - DNA, 20 bp, Artificial
  CRISPR gRNA sequence
caagtccatctgcttttccc

SEQ ID NO: 215069 - DNA, 20 bp, Artificial
  CRISPR gRNA sequence
aagtccatctgcttttccct

SEQ ID NO: 215070 - DNA, 20 bp, Artificial
  CRISPR gRNA sequence
cttttccctcctttcatcaa

SEQ ID NO: 215071 - DNA, 20 bp, Artificial
  CRISPR gRNA sequence
ttccctcctttcatcaaaac

SEQ ID NO: 215072 - DNA, 20 bp, Artificial
  CRISPR gRNA sequence
tccctcctttcatcaaaact

SEQ ID NO: 215073 - DNA, 20 bp, Artificial
  CRISPR gRNA sequence
ccctcctttcatcaaaactg

SEQ ID NO: 215074 - DNA, 20 bp, Artificial
  CRISPR gRNA sequence
cctcctttcatcaaaactga

SEQ ID NO: 215075 - DNA, 20 bp, Artificial
  CRISPR gRNA sequence
ctttcatcaaaactgatttt

SEQ ID NO: 215076 - DNA, 20 bp, Artificial
  CRISPR gRNA sequence
tcatcaaaactgatttttaa

SEQ ID NO: 215077 - DNA, 20 bp, Artificial
  CRISPR gRNA sequence
catcaaaactgatttttaaa

SEQ ID NO: 215078 - DNA, 20 bp, Artificial
  CRISPR gRNA sequence
atcaaaactgatttttaaag

SEQ ID NO: 215079 - DNA, 20 bp, Artificial
  CRISPR gRNA sequence
atttttaaagtaacaaacta

SEQ ID NO: 215080 - DNA, 20 bp, Artificial
  CRISPR gRNA sequence
ttaaagtaacaaactaggtt

SEQ ID NO: 215081 - DNA, 20 bp, Artificial
  CRISPR gRNA sequence
taaagtaacaaactaggtta

SEQ ID NO: 215082 - DNA, 20 bp, Artificial
  CRISPR gRNA sequence
aaagtaacaaactaggttag

SEQ ID NO: 215083 - DNA, 20 bp, Artificial
  CRISPR gRNA sequence
aagtaacaaactaggttagc

SEQ ID NO: 215084 - DNA, 20 bp, Artificial
  CRISPR gRNA sequence
ggttagcaaaatgtaaatat

SEQ ID NO: 215085 - DNA, 20 bp, Artificial
  CRISPR gRNA sequence
gcaaaatgtaaatattttca

SEQ ID NO: 215086 - DNA, 20 bp, Artificial
  CRISPR gRNA sequence
tcagaaggaaaaagtgctgc

SEQ ID NO: 215087 - DNA, 20 bp, Artificial
  CRISPR gRNA sequence
cagaaggaaaaagtgctgca

SEQ ID NO: 215088 - DNA, 20 bp, Artificial
  CRISPR gRNA sequence
agaaggaaaaagtgctgcag

SEQ ID NO: 215089 - DNA, 20 bp, Artificial
  CRISPR gRNA sequence
caggagccatcagatttgta

SEQ ID NO: 215090 - DNA, 20 bp, Artificial
  CRISPR gRNA sequence
gtataaaggaatacagctcc

SEQ ID NO: 215091 - DNA, 20 bp, Artificial
  CRISPR gRNA sequence
tataaaggaatacagctccc

SEQ ID NO: 215092 - DNA, 20 bp, Artificial
  CRISPR gRNA sequence
cctctatatatgttattatt

SEQ ID NO: 215093 - DNA, 20 bp, Artificial
  CRISPR gRNA sequence
tatatatgttattattttgg

SEQ ID NO: 215094 - DNA, 20 bp, Artificial
  CRISPR gRNA sequence
tatatgttattattttggac

SEQ ID NO: 215095 - DNA, 20 bp, Artificial
  CRISPR gRNA sequence
ttattttggacagctacaca

SEQ ID NO: 215096 - DNA, 20 bp, Artificial
  CRISPR gRNA sequence
ttttggacagctacacaatc

SEQ ID NO: 215097 - DNA, 20 bp, Artificial
  CRISPR gRNA sequence
tggacagctacacaatcaag

SEQ ID NO: 215098 - DNA, 20 bp, Artificial
  CRISPR gRNA sequence
ggacagctacacaatcaagg

SEQ ID NO: 215099 - DNA, 20 bp, Artificial
  CRISPR gRNA sequence
gacagctacacaatcaagga

SEQ ID NO: 215100 - DNA, 20 bp, Artificial
  CRISPR gRNA sequence
cacaatcaaggaagaatata

SEQ ID NO: 215101 - DNA, 20 bp, Artificial
  CRISPR gRNA sequence
gtgtatacatattttttttt

SEQ ID NO: 215102 - DNA, 20 bp, Artificial
  CRISPR gRNA sequence
tgtatacatatttttttttt

SEQ ID NO: 215103 - DNA, 20 bp, Artificial
  CRISPR gRNA sequence
tttttttcaagaagagctgt

SEQ ID NO: 215104 - DNA, 20 bp, Artificial
  CRISPR gRNA sequence
ttttttcaagaagagctgtc

SEQ ID NO: 215105 - DNA, 20 bp, Artificial
  CRISPR gRNA sequence
tttttcaagaagagctgtct

SEQ ID NO: 215106 - DNA, 20 bp, Artificial
  CRISPR gRNA sequence
ttttcaagaagagctgtctt

SEQ ID NO: 215107 - DNA, 20 bp, Artificial
  CRISPR gRNA sequence
tttcaagaagagctgtcttg

SEQ ID NO: 215108 - DNA, 20 bp, Artificial
  CRISPR gRNA sequence
ttcaagaagagctgtcttgc

SEQ ID NO: 215109 - DNA, 20 bp, Artificial
  CRISPR gRNA sequence
tcaagaagagctgtcttgct

SEQ ID NO: 215110 - DNA, 20 bp, Artificial
  CRISPR gRNA sequence
caagaagagctgtcttgcta

SEQ ID NO: 215111 - DNA, 20 bp, Artificial
  CRISPR gRNA sequence
aagaagagctgtcttgctag

SEQ ID NO: 215112 - DNA, 20 bp, Artificial
  CRISPR gRNA sequence
tcttgctagtatgctcagtt

SEQ ID NO: 215113 - DNA, 20 bp, Artificial
  CRISPR gRNA sequence
gctagtatgctcagttttct

SEQ ID NO: 215114 - DNA, 20 bp, Artificial
  CRISPR gRNA sequence
ctagtatgctcagttttctg

SEQ ID NO: 215115 - DNA, 20 bp, Artificial
  CRISPR gRNA sequence
gtatgctcagttttctgaga

SEQ ID NO: 215116 - DNA, 20 bp, Artificial
  CRISPR gRNA sequence
agttttctgagaggcctcag

SEQ ID NO: 215117 - DNA, 20 bp, Artificial
  CRISPR gRNA sequence
tctgagaggcctcagcaggt

SEQ ID NO: 215118 - DNA, 20 bp, Artificial
  CRISPR gRNA sequence
ctgagaggcctcagcaggtc

SEQ ID NO: 215119 - DNA, 20 bp, Artificial
  CRISPR gRNA sequence
tgagaggcctcagcaggtca

SEQ ID NO: 215120 - DNA, 20 bp, Artificial
  CRISPR gRNA sequence
agaggcctcagcaggtcata

SEQ ID NO: 215121 - DNA, 20 bp, Artificial
  CRISPR gRNA sequence
agcaggtcataaatttaggt

SEQ ID NO: 215122 - DNA, 20 bp, Artificial
  CRISPR gRNA sequence
aggtttgccatgggcaaact

SEQ ID NO: 215123 - DNA, 20 bp, Artificial
  CRISPR gRNA sequence
ggtttgccatgggcaaacta

SEQ ID NO: 215124 - DNA, 20 bp, Artificial
  CRISPR gRNA sequence
gccatgggcaaactacttgg

SEQ ID NO: 215125 - DNA, 20 bp, Artificial
  CRISPR gRNA sequence
ccatgggcaaactacttggt

SEQ ID NO: 215126 - DNA, 20 bp, Artificial
  CRISPR gRNA sequence
cttggtcccaacatgaaata

SEQ ID NO: 215127 - DNA, 20 bp, Artificial
  CRISPR gRNA sequence
ggtcccaacatgaaatatga

SEQ ID NO: 215128 - DNA, 20 bp, Artificial
  CRISPR gRNA sequence
gtcccaacatgaaatatgac

SEQ ID NO: 215129 - DNA, 20 bp, Artificial
  CRISPR gRNA sequence
ggcataaaagaggcacacgg

SEQ ID NO: 215130 - DNA, 20 bp, Artificial
  CRISPR gRNA sequence
gcataaaagaggcacacggg

SEQ ID NO: 215131 - DNA, 20 bp, Artificial
  CRISPR gRNA sequence
atggactaagaaataactat

SEQ ID NO: 215132 - DNA, 20 bp, Artificial
  CRISPR gRNA sequence
agaaataactattattaatg

SEQ ID NO: 215133 - DNA, 20 bp, Artificial
  CRISPR gRNA sequence
ttattaatgcaactacaaat

SEQ ID NO: 215134 - DNA, 20 bp, Artificial
  CRISPR gRNA sequence
ttaatgcaactacaaatatg

SEQ ID NO: 215135 - DNA, 20 bp, Artificial
  CRISPR gRNA sequence
atgcaactacaaatatgaat

SEQ ID NO: 215136 - DNA, 20 bp, Artificial
  CRISPR gRNA sequence
caaatatgaatatcttatta

SEQ ID NO: 215137 - DNA, 20 bp, Artificial
  CRISPR gRNA sequence
attacacaaacaggaagaat

SEQ ID NO: 215138 - DNA, 20 bp, Artificial
  CRISPR gRNA sequence
ttacacaaacaggaagaatt

SEQ ID NO: 215139 - DNA, 20 bp, Artificial
  CRISPR gRNA sequence
cacaaacaggaagaattacg

SEQ ID NO: 215140 - DNA, 20 bp, Artificial
  CRISPR gRNA sequence
cgtatttttacagggtattg

SEQ ID NO: 215141 - DNA, 20 bp, Artificial
  CRISPR gRNA sequence
ttacagggtattggtgagca

SEQ ID NO: 215142 - DNA, 20 bp, Artificial
  CRISPR gRNA sequence
tacagggtattggtgagcag

SEQ ID NO: 215143 - DNA, 20 bp, Artificial
  CRISPR gRNA sequence
acagggtattggtgagcagt

SEQ ID NO: 215144 - DNA, 20 bp, Artificial
  CRISPR gRNA sequence
cagggtattggtgagcagtc

SEQ ID NO: 215145 - DNA, 20 bp, Artificial
  CRISPR gRNA sequence
gtgagcagtcaaaaagcgtg

SEQ ID NO: 215146 - DNA, 20 bp, Artificial
  CRISPR gRNA sequence
cctagaagttttaaaagttt

SEQ ID NO: 215147 - DNA, 20 bp, Artificial
  CRISPR gRNA sequence
gaagttttaaaagttttaag

SEQ ID NO: 215148 - DNA, 20 bp, Artificial
  CRISPR gRNA sequence
taaaagttttaagtgatcaa

SEQ ID NO: 215149 - DNA, 20 bp, Artificial
  CRISPR gRNA sequence
aaaagttttaagtgatcaaa

SEQ ID NO: 215150 - DNA, 20 bp, Artificial
  CRISPR gRNA sequence
aaagttttaagtgatcaaat

SEQ ID NO: 215151 - DNA, 20 bp, Artificial
  CRISPR gRNA sequence
taagtgatcaaatatttgca

SEQ ID NO: 215152 - DNA, 20 bp, Artificial
  CRISPR gRNA sequence
aagtgatcaaatatttgcat

SEQ ID NO: 215153 - DNA, 20 bp, Artificial
  CRISPR gRNA sequence
agtgatcaaatatttgcatc

SEQ ID NO: 215154 - DNA, 20 bp, Artificial
  CRISPR gRNA sequence
gcatcaaatataattccacc

SEQ ID NO: 215155 - DNA, 20 bp, Artificial
  CRISPR gRNA sequence
catcaaatataattccaccc

SEQ ID NO: 215156 - DNA, 20 bp, Artificial
  CRISPR gRNA sequence
cacccaataaagaactttgt

SEQ ID NO: 215157 - DNA, 20 bp, Artificial
  CRISPR gRNA sequence
tgtatttaaatgtttttact

SEQ ID NO: 215158 - DNA, 20 bp, Artificial
  CRISPR gRNA sequence
gtatttaaatgtttttacta

SEQ ID NO: 215159 - DNA, 20 bp, Artificial
  CRISPR gRNA sequence
tatttaaatgtttttactaa

SEQ ID NO: 215160 - DNA, 20 bp, Artificial
  CRISPR gRNA sequence
aaatgtttttactaaaagca

SEQ ID NO: 215161 - DNA, 20 bp, Artificial
  CRISPR gRNA sequence
aatgtttttactaaaagcac

SEQ ID NO: 215162 - DNA, 20 bp, Artificial
  CRISPR gRNA sequence
ttactaaaagcacaaaatta

SEQ ID NO: 215163 - DNA, 20 bp, Artificial
  CRISPR gRNA sequence
tactaaaagcacaaaattaa

SEQ ID NO: 215164 - DNA, 20 bp, Artificial
  CRISPR gRNA sequence
actaaaagcacaaaattaac

SEQ ID NO: 215165 - DNA, 20 bp, Artificial
  CRISPR gRNA sequence
ctaaaagcacaaaattaacc

SEQ ID NO: 215166 - DNA, 20 bp, Artificial
  CRISPR gRNA sequence
aaagcacaaaattaaccttt

SEQ ID NO: 215167 - DNA, 20 bp, Artificial
  CRISPR gRNA sequence
acctttgctctcctgtaggt

SEQ ID NO: 215168 - DNA, 20 bp, Artificial
  CRISPR gRNA sequence
tgctctcctgtaggtacccc

SEQ ID NO: 215169 - DNA, 20 bp, Artificial
  CRISPR gRNA sequence
gctctcctgtaggtacccca

SEQ ID NO: 215170 - DNA, 20 bp, Artificial
  CRISPR gRNA sequence
ctctcctgtaggtaccccac

SEQ ID NO: 215171 - DNA, 20 bp, Artificial
  CRISPR gRNA sequence
tcctgtaggtaccccacctt

SEQ ID NO: 215172 - DNA, 20 bp, Artificial
  CRISPR gRNA sequence
ctgtaggtaccccacctttg

SEQ ID NO: 215173 - DNA, 20 bp, Artificial
  CRISPR gRNA sequence
taggtaccccacctttgtcc

SEQ ID NO: 215174 - DNA, 20 bp, Artificial
  CRISPR gRNA sequence
tgtccatacagaagatgcat

SEQ ID NO: 215175 - DNA, 20 bp, Artificial
  CRISPR gRNA sequence
gtccatacagaagatgcatg

SEQ ID NO: 215176 - DNA, 20 bp, Artificial
  CRISPR gRNA sequence
tccatacagaagatgcatgt

SEQ ID NO: 215177 - DNA, 20 bp, Artificial
  CRISPR gRNA sequence
tctcatacgtatgcacatac

SEQ ID NO: 215178 - DNA, 20 bp, Artificial
  CRISPR gRNA sequence
atacgtatgcacatacaaac

SEQ ID NO: 215179 - DNA, 20 bp, Artificial
  CRISPR gRNA sequence
aaagtctaaaagtactccag

SEQ ID NO: 215180 - DNA, 20 bp, Artificial
  CRISPR gRNA sequence
aaagtactccaggcgatcac

SEQ ID NO: 215181 - DNA, 20 bp, Artificial
  CRISPR gRNA sequence
caggcgatcacaactgtcag

SEQ ID NO: 215182 - DNA, 20 bp, Artificial
  CRISPR gRNA sequence
tcagaacattaattttcttc

SEQ ID NO: 215183 - DNA, 20 bp, Artificial
  CRISPR gRNA sequence
attttcttctaaccaggata

SEQ ID NO: 215184 - DNA, 20 bp, Artificial
  CRISPR gRNA sequence
tcttctaaccaggataggaa

SEQ ID NO: 215185 - DNA, 20 bp, Artificial
  CRISPR gRNA sequence
cttctaaccaggataggaaa

SEQ ID NO: 215186 - DNA, 20 bp, Artificial
  CRISPR gRNA sequence
ttctaaccaggataggaaat

SEQ ID NO: 215187 - DNA, 20 bp, Artificial
  CRISPR gRNA sequence
ctaaccaggataggaaatgt

SEQ ID NO: 215188 - DNA, 20 bp, Artificial
  CRISPR gRNA sequence
taaccaggataggaaatgtg

SEQ ID NO: 215189 - DNA, 20 bp, Artificial
  CRISPR gRNA sequence
accaggataggaaatgtggg

SEQ ID NO: 215190 - DNA, 20 bp, Artificial
  CRISPR gRNA sequence
tgtttacttttcaatcatag

SEQ ID NO: 215191 - DNA, 20 bp, Artificial
  CRISPR gRNA sequence
gtttacttttcaatcatagg

SEQ ID NO: 215192 - DNA, 20 bp, Artificial
  CRISPR gRNA sequence
tttacttttcaatcataggg

SEQ ID NO: 215193 - DNA, 20 bp, Artificial
  CRISPR gRNA sequence
acttttcaatcataggggaa

SEQ ID NO: 215194 - DNA, 20 bp, Artificial
  CRISPR gRNA sequence
cttttcaatcataggggaag

SEQ ID NO: 215195 - DNA, 20 bp, Artificial
  CRISPR gRNA sequence
ttcaatcataggggaagggg

SEQ ID NO: 215196 - DNA, 20 bp, Artificial
  CRISPR gRNA sequence
tcaatcataggggaagggga

SEQ ID NO: 215197 - DNA, 20 bp, Artificial
  CRISPR gRNA sequence
caatcataggggaaggggag

SEQ ID NO: 215198 - DNA, 20 bp, Artificial
  CRISPR gRNA sequence
aatcataggggaaggggagt

SEQ ID NO: 215199 - DNA, 20 bp, Artificial
  CRISPR gRNA sequence
caggaggaaggtgatgaatg

SEQ ID NO: 215200 - DNA, 20 bp, Artificial
  CRISPR gRNA sequence
atcatgcaacatagatacaa

SEQ ID NO: 215201 - DNA, 20 bp, Artificial
  CRISPR gRNA sequence
tcatgcaacatagatacaac

SEQ ID NO: 215202 - DNA, 20 bp, Artificial
  CRISPR gRNA sequence
aagggctggcctgttggcct

SEQ ID NO: 215203 - DNA, 20 bp, Artificial
  CRISPR gRNA sequence
gcctgttggcctgatggtga

SEQ ID NO: 215204 - DNA, 20 bp, Artificial
  CRISPR gRNA sequence
ttggcctgatggtgacacac

SEQ ID NO: 215205 - DNA, 20 bp, Artificial
  CRISPR gRNA sequence
gcctgatggtgacacacatt

SEQ ID NO: 215206 - DNA, 20 bp, Artificial
  CRISPR gRNA sequence
atggtgacacacattttgtt

SEQ ID NO: 215207 - DNA, 20 bp, Artificial
  CRISPR gRNA sequence
tgttgccatgcaggagactc

SEQ ID NO: 215208 - DNA, 20 bp, Artificial
  CRISPR gRNA sequence
gttgccatgcaggagactca

SEQ ID NO: 215209 - DNA, 20 bp, Artificial
  CRISPR gRNA sequence
ttgccatgcaggagactcat

SEQ ID NO: 215210 - DNA, 20 bp, Artificial
  CRISPR gRNA sequence
ccatgcaggagactcatagt

SEQ ID NO: 215211 - DNA, 20 bp, Artificial
  CRISPR gRNA sequence
atagttcaaatttcaatctt

SEQ ID NO: 215212 - DNA, 20 bp, Artificial
  CRISPR gRNA sequence
aaatttcaatcttgcttttt

SEQ ID NO: 215213 - DNA, 20 bp, Artificial
  CRISPR gRNA sequence
caatcttgcttttttcatgc

SEQ ID NO: 215214 - DNA, 20 bp, Artificial
  CRISPR gRNA sequence
aatcttgcttttttcatgcc

SEQ ID NO: 215215 - DNA, 20 bp, Artificial
  CRISPR gRNA sequence
gcttttttcatgccccagat

SEQ ID NO: 215216 - DNA, 20 bp, Artificial
  CRISPR gRNA sequence
cttttttcatgccccagatc

SEQ ID NO: 215217 - DNA, 20 bp, Artificial
  CRISPR gRNA sequence
ttttcatgccccagatcaga

SEQ ID NO: 215218 - DNA, 20 bp, Artificial
  CRISPR gRNA sequence
tttcatgccccagatcagaa

SEQ ID NO: 215219 - DNA, 20 bp, Artificial
  CRISPR gRNA sequence
ttcatgccccagatcagaaa

SEQ ID NO: 215220 - DNA, 20 bp, Artificial
  CRISPR gRNA sequence
tcatgccccagatcagaaaa

SEQ ID NO: 215221 - DNA, 20 bp, Artificial
  CRISPR gRNA sequence
catgccccagatcagaaaag

SEQ ID NO: 215222 - DNA, 20 bp, Artificial
  CRISPR gRNA sequence
atgccccagatcagaaaaga

SEQ ID NO: 215223 - DNA, 20 bp, Artificial
  CRISPR gRNA sequence
tagatttttgccttcaaatc

SEQ ID NO: 215224 - DNA, 20 bp, Artificial
  CRISPR gRNA sequence
ttgccttcaaatcagaggaa

SEQ ID NO: 215225 - DNA, 20 bp, Artificial
  CRISPR gRNA sequence
tgccttcaaatcagaggaag

SEQ ID NO: 215226 - DNA, 20 bp, Artificial
  CRISPR gRNA sequence
gccttcaaatcagaggaagg

SEQ ID NO: 215227 - DNA, 20 bp, Artificial
  CRISPR gRNA sequence
ccttcaaatcagaggaaggg

SEQ ID NO: 215228 - DNA, 20 bp, Artificial
  CRISPR gRNA sequence
caaatcagaggaagggaata

SEQ ID NO: 215229 - DNA, 20 bp, Artificial
  CRISPR gRNA sequence
aaatcagaggaagggaatac

SEQ ID NO: 215230 - DNA, 20 bp, Artificial
  CRISPR gRNA sequence
caaccatagctatttttgct

SEQ ID NO: 215231 - DNA, 20 bp, Artificial
  CRISPR gRNA sequence
tttttgctgaaaagtgtgaa

SEQ ID NO: 215232 - DNA, 20 bp, Artificial
  CRISPR gRNA sequence
ttgctgaaaagtgtgaacac

SEQ ID NO: 215233 - DNA, 20 bp, Artificial
  CRISPR gRNA sequence
tgctgaaaagtgtgaacaca

SEQ ID NO: 215234 - DNA, 20 bp, Artificial
  CRISPR gRNA sequence
gctgaaaagtgtgaacacag

SEQ ID NO: 215235 - DNA, 20 bp, Artificial
  CRISPR gRNA sequence
ctgaaaagtgtgaacacagt

SEQ ID NO: 215236 - DNA, 20 bp, Artificial
  CRISPR gRNA sequence
aaaagtgtgaacacagtgct

SEQ ID NO: 215237 - DNA, 20 bp, Artificial
  CRISPR gRNA sequence
tgagaacaagtctggctcct

SEQ ID NO: 215238 - DNA, 20 bp, Artificial
  CRISPR gRNA sequence
agaacaagtctggctccttc

SEQ ID NO: 215239 - DNA, 20 bp, Artificial
  CRISPR gRNA sequence
gctccttcctgcaactggtg

SEQ ID NO: 215240 - DNA, 20 bp, Artificial
  CRISPR gRNA sequence
cttcctgcaactggtgctac

SEQ ID NO: 215241 - DNA, 20 bp, Artificial
  CRISPR gRNA sequence
cctgcaactggtgctaccgt

SEQ ID NO: 215242 - DNA, 20 bp, Artificial
  CRISPR gRNA sequence
ctgcaactggtgctaccgtg

SEQ ID NO: 215243 - DNA, 20 bp, Artificial
  CRISPR gRNA sequence
caactggtgctaccgtgtca

SEQ ID NO: 215244 - DNA, 20 bp, Artificial
  CRISPR gRNA sequence
gtgctaccgtgtcactagac

SEQ ID NO: 215245 - DNA, 20 bp, Artificial
  CRISPR gRNA sequence
ccgtgtcactagaccatgtt

SEQ ID NO: 215246 - DNA, 20 bp, Artificial
  CRISPR gRNA sequence
gaccatgttcaaagaggaga

SEQ ID NO: 215247 - DNA, 20 bp, Artificial
  CRISPR gRNA sequence
aaagaggagaaaaggtgcta

SEQ ID NO: 215248 - DNA, 20 bp, Artificial
  CRISPR gRNA sequence
catcttgtacagcagaagca

SEQ ID NO: 215249 - DNA, 20 bp, Artificial
  CRISPR gRNA sequence
gtacagcagaagcaagtaac

SEQ ID NO: 215250 - DNA, 20 bp, Artificial
  CRISPR gRNA sequence
tacagcagaagcaagtaaca

SEQ ID NO: 215251 - DNA, 20 bp, Artificial
  CRISPR gRNA sequence
caaggggttatgtgaataaa

SEQ ID NO: 215252 - DNA, 20 bp, Artificial
  CRISPR gRNA sequence
aaggggttatgtgaataaaa

SEQ ID NO: 215253 - DNA, 20 bp, Artificial
  CRISPR gRNA sequence
tgtgaataaaaggaaaacat

SEQ ID NO: 215254 - DNA, 20 bp, Artificial
  CRISPR gRNA sequence
aatctgggaaggacctgtta

SEQ ID NO: 215255 - DNA, 20 bp, Artificial
  CRISPR gRNA sequence
ggaaggacctgttacactgt

SEQ ID NO: 215256 - DNA, 20 bp, Artificial
  CRISPR gRNA sequence
ttacactgtttgttgaaggg

SEQ ID NO: 215257 - DNA, 20 bp, Artificial
  CRISPR gRNA sequence
cactgtttgttgaaggggga

SEQ ID NO: 215258 - DNA, 20 bp, Artificial
  CRISPR gRNA sequence
tttgttgaagggggaatgtg

SEQ ID NO: 215259 - DNA, 20 bp, Artificial
  CRISPR gRNA sequence
gttgaagggggaatgtggga

SEQ ID NO: 215260 - DNA, 20 bp, Artificial
  CRISPR gRNA sequence
ttgaagggggaatgtgggaa

SEQ ID NO: 215261 - DNA, 20 bp, Artificial
  CRISPR gRNA sequence
aagggggaatgtgggaatgg

SEQ ID NO: 215262 - DNA, 20 bp, Artificial
  CRISPR gRNA sequence
tctccatcaatatcacatca

SEQ ID NO: 215263 - DNA, 20 bp, Artificial
  CRISPR gRNA sequence
catcaatatcacatcatacg

SEQ ID NO: 215264 - DNA, 20 bp, Artificial
  CRISPR gRNA sequence
ccaaccaaattcctgcctgt

SEQ ID NO: 215265 - DNA, 20 bp, Artificial
  CRISPR gRNA sequence
ctgcctgtacttaatttatt

SEQ ID NO: 215266 - DNA, 20 bp, Artificial
  CRISPR gRNA sequence
cctgtacttaatttattatt

SEQ ID NO: 215267 - DNA, 20 bp, Artificial
  CRISPR gRNA sequence
tacttaatttattattccat

SEQ ID NO: 215268 - DNA, 20 bp, Artificial
  CRISPR gRNA sequence
aatttattattccattgacc

SEQ ID NO: 215269 - DNA, 20 bp, Artificial
  CRISPR gRNA sequence
atttattattccattgaccc

SEQ ID NO: 215270 - DNA, 20 bp, Artificial
  CRISPR gRNA sequence
attattccattgacccagaa

SEQ ID NO: 215271 - DNA, 20 bp, Artificial
  CRISPR gRNA sequence
ttattccattgacccagaag

SEQ ID NO: 215272 - DNA, 20 bp, Artificial
  CRISPR gRNA sequence
ttccattgacccagaagtgg

SEQ ID NO: 215273 - DNA, 20 bp, Artificial
  CRISPR gRNA sequence
cattgacccagaagtggcag

SEQ ID NO: 215274 - DNA, 20 bp, Artificial
  CRISPR gRNA sequence
acccagaagtggcagacacc

SEQ ID NO: 215275 - DNA, 20 bp, Artificial
  CRISPR gRNA sequence
tcagctaatgccatactgcc

SEQ ID NO: 215276 - DNA, 20 bp, Artificial
  CRISPR gRNA sequence
agctaatgccatactgccat

SEQ ID NO: 215277 - DNA, 20 bp, Artificial
  CRISPR gRNA sequence
atgccatactgccataactg

SEQ ID NO: 215278 - DNA, 20 bp, Artificial
  CRISPR gRNA sequence
ccataactgcccaaagctgc

SEQ ID NO: 215279 - DNA, 20 bp, Artificial
  CRISPR gRNA sequence
cccaaagctgctgtgaacct

SEQ ID NO: 215280 - DNA, 20 bp, Artificial
  CRISPR gRNA sequence
ctgtgaacctgagttggcaa

SEQ ID NO: 215281 - DNA, 20 bp, Artificial
  CRISPR gRNA sequence
tgaacctgagttggcaaagg

SEQ ID NO: 215282 - DNA, 20 bp, Artificial
  CRISPR gRNA sequence
agttggcaaaggtttgatgg

SEQ ID NO: 215283 - DNA, 20 bp, Artificial
  CRISPR gRNA sequence
gcaaaggtttgatggaagcc

SEQ ID NO: 215284 - DNA, 20 bp, Artificial
  CRISPR gRNA sequence
gatggaagccactggttttc

SEQ ID NO: 215285 - DNA, 20 bp, Artificial
  CRISPR gRNA sequence
atggaagccactggttttca

SEQ ID NO: 215286 - DNA, 20 bp, Artificial
  CRISPR gRNA sequence
gttttcatagatatctctgg

SEQ ID NO: 215287 - DNA, 20 bp, Artificial
  CRISPR gRNA sequence
tcatagatatctctgggtaa

SEQ ID NO: 215288 - DNA, 20 bp, Artificial
  CRISPR gRNA sequence
catagatatctctgggtaat

SEQ ID NO: 215289 - DNA, 20 bp, Artificial
  CRISPR gRNA sequence
atagatatctctgggtaatc

SEQ ID NO: 215290 - DNA, 20 bp, Artificial
  CRISPR gRNA sequence
tgggtaatcaccagggcagt

SEQ ID NO: 215291 - DNA, 20 bp, Artificial
  CRISPR gRNA sequence
ggtaatcaccagggcagtgc

SEQ ID NO: 215292 - DNA, 20 bp, Artificial
  CRISPR gRNA sequence
agtagttatcaccctgaacc

SEQ ID NO: 215293 - DNA, 20 bp, Artificial
  CRISPR gRNA sequence
tcaccctgaaccaatttaaa

SEQ ID NO: 215294 - DNA, 20 bp, Artificial
  CRISPR gRNA sequence
aaccaatttaaactggttac

SEQ ID NO: 215295 - DNA, 20 bp, Artificial
  CRISPR gRNA sequence
aaactggttacctagaggcc

SEQ ID NO: 215296 - DNA, 20 bp, Artificial
  CRISPR gRNA sequence
aactggttacctagaggcca

SEQ ID NO: 215297 - DNA, 20 bp, Artificial
  CRISPR gRNA sequence
gttacctagaggccagaggc

SEQ ID NO: 215298 - DNA, 20 bp, Artificial
  CRISPR gRNA sequence
cctagaggccagaggcccta

SEQ ID NO: 215299 - DNA, 20 bp, Artificial
  CRISPR gRNA sequence
gaggccagaggccctaggac

SEQ ID NO: 215300 - DNA, 20 bp, Artificial
  CRISPR gRNA sequence
ggacctgaaaggcatcattc

SEQ ID NO: 215301 - DNA, 20 bp, Artificial
  CRISPR gRNA sequence
aaaggcatcattcttggaaa

SEQ ID NO: 215302 - DNA, 20 bp, Artificial
  CRISPR gRNA sequence
ttggaaattgtccattctac

SEQ ID NO: 215303 - DNA, 20 bp, Artificial
  CRISPR gRNA sequence
ggaaattgtccattctacta

SEQ ID NO: 215304 - DNA, 20 bp, Artificial
  CRISPR gRNA sequence
gaaattgtccattctactat

SEQ ID NO: 215305 - DNA, 20 bp, Artificial
  CRISPR gRNA sequence
tccattctactattgcccct

SEQ ID NO: 215306 - DNA, 20 bp, Artificial
  CRISPR gRNA sequence
tactattgcccctaattgat

SEQ ID NO: 215307 - DNA, 20 bp, Artificial
  CRISPR gRNA sequence
ctattgcccctaattgatta

SEQ ID NO: 215308 - DNA, 20 bp, Artificial
  CRISPR gRNA sequence
ttgcccctaattgattaaaa

SEQ ID NO: 215309 - DNA, 20 bp, Artificial
  CRISPR gRNA sequence
cccctaattgattaaaaata

SEQ ID NO: 215310 - DNA, 20 bp, Artificial
  CRISPR gRNA sequence
attgattaaaaataacaaca

SEQ ID NO: 215311 - DNA, 20 bp, Artificial
  CRISPR gRNA sequence
attaaaaataacaacaaaaa

SEQ ID NO: 215312 - DNA, 20 bp, Artificial
  CRISPR gRNA sequence
aaaataacaacaaaaaactg

SEQ ID NO: 215313 - DNA, 20 bp, Artificial
  CRISPR gRNA sequence
gatctcaattgggcaaacaa

SEQ ID NO: 215314 - DNA, 20 bp, Artificial
  CRISPR gRNA sequence
aattgggcaaacaacataga

SEQ ID NO: 215315 - DNA, 20 bp, Artificial
  CRISPR gRNA sequence
ggcaaacaacatagatcata

SEQ ID NO: 215316 - DNA, 20 bp, Artificial
  CRISPR gRNA sequence
ttttattaactaaattacag

SEQ ID NO: 215317 - DNA, 20 bp, Artificial
  CRISPR gRNA sequence
tattaactaaattacagctg

SEQ ID NO: 215318 - DNA, 20 bp, Artificial
  CRISPR gRNA sequence
attaactaaattacagctgc

SEQ ID NO: 215319 - DNA, 20 bp, Artificial
  CRISPR gRNA sequence
ttaactaaattacagctgct

SEQ ID NO: 215320 - DNA, 20 bp, Artificial
  CRISPR gRNA sequence
actaaattacagctgctttg

SEQ ID NO: 215321 - DNA, 20 bp, Artificial
  CRISPR gRNA sequence
aattacagctgctttgaata

SEQ ID NO: 215322 - DNA, 20 bp, Artificial
  CRISPR gRNA sequence
cagctgctttgaataaaaac

SEQ ID NO: 215323 - DNA, 20 bp, Artificial
  CRISPR gRNA sequence
ctttgaataaaaacttaact

SEQ ID NO: 215324 - DNA, 20 bp, Artificial
  CRISPR gRNA sequence
tgaataaaaacttaactaac

SEQ ID NO: 215325 - DNA, 20 bp, Artificial
  CRISPR gRNA sequence
gaataaaaacttaactaaca

SEQ ID NO: 215326 - DNA, 20 bp, Artificial
  CRISPR gRNA sequence
aataaaaacttaactaacaa

SEQ ID NO: 215327 - DNA, 20 bp, Artificial
  CRISPR gRNA sequence
aactaacaatcacgtaaggg

SEQ ID NO: 215328 - DNA, 20 bp, Artificial
  CRISPR gRNA sequence
actaacaatcacgtaagggt

SEQ ID NO: 215329 - DNA, 20 bp, Artificial
  CRISPR gRNA sequence
acaatcacgtaagggtctca

SEQ ID NO: 215330 - DNA, 20 bp, Artificial
  CRISPR gRNA sequence
ataggtgacaaccagttact

SEQ ID NO: 215331 - DNA, 20 bp, Artificial
  CRISPR gRNA sequence
cttttcttgtttcttctccc

SEQ ID NO: 215332 - DNA, 20 bp, Artificial
  CRISPR gRNA sequence
ttcttgtttcttctccccaa

SEQ ID NO: 215333 - DNA, 20 bp, Artificial
  CRISPR gRNA sequence
tcttgtttcttctccccaac

SEQ ID NO: 215334 - DNA, 20 bp, Artificial
  CRISPR gRNA sequence
cttgtttcttctccccaaca

SEQ ID NO: 215335 - DNA, 20 bp, Artificial
  CRISPR gRNA sequence
ttgtttcttctccccaacag

SEQ ID NO: 215336 - DNA, 20 bp, Artificial
  CRISPR gRNA sequence
gtttcttctccccaacagtg

SEQ ID NO: 215337 - DNA, 20 bp, Artificial
  CRISPR gRNA sequence
tttcttctccccaacagtga

SEQ ID NO: 215338 - DNA, 20 bp, Artificial
  CRISPR gRNA sequence
cttctccccaacagtgaatc

SEQ ID NO: 215339 - DNA, 20 bp, Artificial
  CRISPR gRNA sequence
ttctccccaacagtgaatca

SEQ ID NO: 215340 - DNA, 20 bp, Artificial
  CRISPR gRNA sequence
ctccccaacagtgaatcatc

SEQ ID NO: 215341 - DNA, 20 bp, Artificial
  CRISPR gRNA sequence
tccccaacagtgaatcatca

SEQ ID NO: 215342 - DNA, 20 bp, Artificial
  CRISPR gRNA sequence
cccaacagtgaatcatcaag

SEQ ID NO: 215343 - DNA, 20 bp, Artificial
  CRISPR gRNA sequence
aaacacaagtgtattccttt

SEQ ID NO: 215344 - DNA, 20 bp, Artificial
  CRISPR gRNA sequence
aacacaagtgtattcctttc

SEQ ID NO: 215345 - DNA, 20 bp, Artificial
  CRISPR gRNA sequence
ctttcacgtcttactactct

SEQ ID NO: 215346 - DNA, 20 bp, Artificial
  CRISPR gRNA sequence
tcacgtcttactactctcca

SEQ ID NO: 215347 - DNA, 20 bp, Artificial
  CRISPR gRNA sequence
cacgtcttactactctccaa

SEQ ID NO: 215348 - DNA, 20 bp, Artificial
  CRISPR gRNA sequence
acgtcttactactctccaaa

SEQ ID NO: 215349 - DNA, 20 bp, Artificial
  CRISPR gRNA sequence
actactctccaaatcggagt

SEQ ID NO: 215350 - DNA, 20 bp, Artificial
  CRISPR gRNA sequence
ctactctccaaatcggagtc

SEQ ID NO: 215351 - DNA, 20 bp, Artificial
  CRISPR gRNA sequence
ctctccaaatcggagtccat

SEQ ID NO: 215352 - DNA, 20 bp, Artificial
  CRISPR gRNA sequence
tccaaatcggagtccatcac

SEQ ID NO: 215353 - DNA, 20 bp, Artificial
  CRISPR gRNA sequence
caaatcggagtccatcactt

SEQ ID NO: 215354 - DNA, 20 bp, Artificial
  CRISPR gRNA sequence
cacttcagttattctggaaa

SEQ ID NO: 215355 - DNA, 20 bp, Artificial
  CRISPR gRNA sequence
acttcagttattctggaaaa

SEQ ID NO: 215356 - DNA, 20 bp, Artificial
  CRISPR gRNA sequence
cagttattctggaaaattga

SEQ ID NO: 215357 - DNA, 20 bp, Artificial
  CRISPR gRNA sequence
agttattctggaaaattgaa

SEQ ID NO: 215358 - DNA, 20 bp, Artificial
  CRISPR gRNA sequence
ttctggaaaattgaaaaatg

SEQ ID NO: 215359 - DNA, 20 bp, Artificial
  CRISPR gRNA sequence
tggaaaattgaaaaatgaac

SEQ ID NO: 215360 - DNA, 20 bp, Artificial
  CRISPR gRNA sequence
gaaaattgaaaaatgaacac

SEQ ID NO: 215361 - DNA, 20 bp, Artificial
  CRISPR gRNA sequence
aaaaatgaacacataatcac

SEQ ID NO: 215362 - DNA, 20 bp, Artificial
  CRISPR gRNA sequence
ttcgtgtctattttctatcc

SEQ ID NO: 215363 - DNA, 20 bp, Artificial
  CRISPR gRNA sequence
gtgtctattttctatccatt

SEQ ID NO: 215364 - DNA, 20 bp, Artificial
  CRISPR gRNA sequence
ttttctatccattaaaaagt

SEQ ID NO: 215365 - DNA, 20 bp, Artificial
  CRISPR gRNA sequence
tctatccattaaaaagttga

SEQ ID NO: 215366 - DNA, 20 bp, Artificial
  CRISPR gRNA sequence
ctatccattaaaaagttgac

SEQ ID NO: 215367 - DNA, 20 bp, Artificial
  CRISPR gRNA sequence
tatccattaaaaagttgaca

SEQ ID NO: 215368 - DNA, 20 bp, Artificial
  CRISPR gRNA sequence
tccattaaaaagttgacaca

SEQ ID NO: 215369 - DNA, 20 bp, Artificial
  CRISPR gRNA sequence
aaaagttgacacattaaaaa

SEQ ID NO: 215370 - DNA, 20 bp, Artificial
  CRISPR gRNA sequence
acacattaaaaaaagtttca

SEQ ID NO: 215371 - DNA, 20 bp, Artificial
  CRISPR gRNA sequence
aaaaaagtttcagatatata

SEQ ID NO: 215372 - DNA, 20 bp, Artificial
  CRISPR gRNA sequence
cagatatatagtatctaaaa

SEQ ID NO: 215373 - DNA, 20 bp, Artificial
  CRISPR gRNA sequence
agatatatagtatctaaaaa

SEQ ID NO: 215374 - DNA, 20 bp, Artificial
  CRISPR gRNA sequence
aaaattaagaaaatagacct

SEQ ID NO: 215375 - DNA, 20 bp, Artificial
  CRISPR gRNA sequence
agaaaatagacctgcaaagg

SEQ ID NO: 215376 - DNA, 20 bp, Artificial
  CRISPR gRNA sequence
caaaggtcagagacagaaac

SEQ ID NO: 215377 - DNA, 20 bp, Artificial
  CRISPR gRNA sequence
gcctttttaatttcagtaag

SEQ ID NO: 215378 - DNA, 20 bp, Artificial
  CRISPR gRNA sequence
tttaatttcagtaagaaaaa

SEQ ID NO: 215379 - DNA, 20 bp, Artificial
  CRISPR gRNA sequence
ttaatttcagtaagaaaaag

SEQ ID NO: 215380 - DNA, 20 bp, Artificial
  CRISPR gRNA sequence
taatttcagtaagaaaaagg

SEQ ID NO: 215381 - DNA, 20 bp, Artificial
  CRISPR gRNA sequence
aatttcagtaagaaaaaggc

SEQ ID NO: 215382 - DNA, 20 bp, Artificial
  CRISPR gRNA sequence
atttcagtaagaaaaaggcc

SEQ ID NO: 215383 - DNA, 20 bp, Artificial
  CRISPR gRNA sequence
cagtaagaaaaaggccaatg

SEQ ID NO: 215384 - DNA, 20 bp, Artificial
  CRISPR gRNA sequence
agtaagaaaaaggccaatgc

SEQ ID NO: 215385 - DNA, 20 bp, Artificial
  CRISPR gRNA sequence
ataatctctgtttgctgggt

SEQ ID NO: 215386 - DNA, 20 bp, Artificial
  CRISPR gRNA sequence
tgtttgctgggttggctgag

SEQ ID NO: 215387 - DNA, 20 bp, Artificial
  CRISPR gRNA sequence
tttgctgggttggctgagga

SEQ ID NO: 215388 - DNA, 20 bp, Artificial
  CRISPR gRNA sequence
gctgggttggctgaggaaaa

SEQ ID NO: 215389 - DNA, 20 bp, Artificial
  CRISPR gRNA sequence
ctgggttggctgaggaaaag

SEQ ID NO: 215390 - DNA, 20 bp, Artificial
  CRISPR gRNA sequence
ggttggctgaggaaaagcca

SEQ ID NO: 215391 - DNA, 20 bp, Artificial
  CRISPR gRNA sequence
gctgaggaaaagccaagaga

SEQ ID NO: 215392 - DNA, 20 bp, Artificial
  CRISPR gRNA sequence
aggaaaagccaagagatgtt

SEQ ID NO: 215393 - DNA, 20 bp, Artificial
  CRISPR gRNA sequence
atttttcaaagcaaaagatg

SEQ ID NO: 215394 - DNA, 20 bp, Artificial
  CRISPR gRNA sequence
ttcaaagcaaaagatgttga

SEQ ID NO: 215395 - DNA, 20 bp, Artificial
  CRISPR gRNA sequence
tcaaagcaaaagatgttgat

SEQ ID NO: 215396 - DNA, 20 bp, Artificial
  CRISPR gRNA sequence
caaagcaaaagatgttgatc

SEQ ID NO: 215397 - DNA, 20 bp, Artificial
  CRISPR gRNA sequence
aaagcaaaagatgttgatcc

SEQ ID NO: 215398 - DNA, 20 bp, Artificial
  CRISPR gRNA sequence
atcctagaataatattctat

SEQ ID NO: 215399 - DNA, 20 bp, Artificial
  CRISPR gRNA sequence
gaataatattctataatatt

SEQ ID NO: 215400 - DNA, 20 bp, Artificial
  CRISPR gRNA sequence
tataatattcactttggatc

SEQ ID NO: 215401 - DNA, 20 bp, Artificial
  CRISPR gRNA sequence
taatattcactttggatctc

SEQ ID NO: 215402 - DNA, 20 bp, Artificial
  CRISPR gRNA sequence
actttggatctccatcattc

SEQ ID NO: 215403 - DNA, 20 bp, Artificial
  CRISPR gRNA sequence
tggatctccatcattcattt

SEQ ID NO: 215404 - DNA, 20 bp, Artificial
  CRISPR gRNA sequence
ggatctccatcattcattta

SEQ ID NO: 215405 - DNA, 20 bp, Artificial
  CRISPR gRNA sequence
gatctccatcattcatttaa

SEQ ID NO: 215406 - DNA, 20 bp, Artificial
  CRISPR gRNA sequence
catcattcatttaatgtaag

SEQ ID NO: 215407 - DNA, 20 bp, Artificial
  CRISPR gRNA sequence
atttaatgtaagtaaaataa

SEQ ID NO: 215408 - DNA, 20 bp, Artificial
  CRISPR gRNA sequence
aatgtaagtaaaataaacat

SEQ ID NO: 215409 - DNA, 20 bp, Artificial
  CRISPR gRNA sequence
atgtaagtaaaataaacatc

SEQ ID NO: 215410 - DNA, 20 bp, Artificial
  CRISPR gRNA sequence
atcagctgtagatgaaagag

SEQ ID NO: 215411 - DNA, 20 bp, Artificial
  CRISPR gRNA sequence
tagatgaaagagaaaaatgg

SEQ ID NO: 215412 - DNA, 20 bp, Artificial
  CRISPR gRNA sequence
actctgatccctaggaagca

SEQ ID NO: 215413 - DNA, 20 bp, Artificial
  CRISPR gRNA sequence
tgatccctaggaagcaccct

SEQ ID NO: 215414 - DNA, 20 bp, Artificial
  CRISPR gRNA sequence
atccctaggaagcaccctga

SEQ ID NO: 215415 - DNA, 20 bp, Artificial
  CRISPR gRNA sequence
ggaagcaccctgaacctcat

SEQ ID NO: 215416 - DNA, 20 bp, Artificial
  CRISPR gRNA sequence
aacctcattcattgacaagg

SEQ ID NO: 215417 - DNA, 20 bp, Artificial
  CRISPR gRNA sequence
attcattgacaaggcagaca

SEQ ID NO: 215418 - DNA, 20 bp, Artificial
  CRISPR gRNA sequence
attgacaaggcagacatact

SEQ ID NO: 215419 - DNA, 20 bp, Artificial
  CRISPR gRNA sequence
acaaggcagacatactgtaa

SEQ ID NO: 215420 - DNA, 20 bp, Artificial
  CRISPR gRNA sequence
taagcaataagcagttgtca

SEQ ID NO: 215421 - DNA, 20 bp, Artificial
  CRISPR gRNA sequence
tcagtgggaagtacccacca

SEQ ID NO: 215422 - DNA, 20 bp, Artificial
  CRISPR gRNA sequence
taaaaacaaattctgatcag

SEQ ID NO: 215423 - DNA, 20 bp, Artificial
  CRISPR gRNA sequence
aaaaacaaattctgatcagc

SEQ ID NO: 215424 - DNA, 20 bp, Artificial
  CRISPR gRNA sequence
aaaacaaattctgatcagct

SEQ ID NO: 215425 - DNA, 20 bp, Artificial
  CRISPR gRNA sequence
tgatcagctgaatattagca

SEQ ID NO: 215426 - DNA, 20 bp, Artificial
  CRISPR gRNA sequence
atcagctgaatattagcaaa

SEQ ID NO: 215427 - DNA, 20 bp, Artificial
  CRISPR gRNA sequence
aatattagcaaaattaagag

SEQ ID NO: 215428 - DNA, 20 bp, Artificial
  CRISPR gRNA sequence
gcaaaattaagagaatcttg

SEQ ID NO: 215429 - DNA, 20 bp, Artificial
  CRISPR gRNA sequence
agagaatcttgaagatcatc

SEQ ID NO: 215430 - DNA, 20 bp, Artificial
  CRISPR gRNA sequence
gaagatcatcgtagatttca

SEQ ID NO: 215431 - DNA, 20 bp, Artificial
  CRISPR gRNA sequence
aagatcatcgtagatttcat

SEQ ID NO: 215432 - DNA, 20 bp, Artificial
  CRISPR gRNA sequence
catcacaaatattcaaggca

SEQ ID NO: 215433 - DNA, 20 bp, Artificial
  CRISPR gRNA sequence
atcacaaatattcaaggcaa

SEQ ID NO: 215434 - DNA, 20 bp, Artificial
  CRISPR gRNA sequence
aaggcaaaactgttttacaa

SEQ ID NO: 215435 - DNA, 20 bp, Artificial
  CRISPR gRNA sequence
ttttacaatatttcctgatg

SEQ ID NO: 215436 - DNA, 20 bp, Artificial
  CRISPR gRNA sequence
tacaatatttcctgatgcag

SEQ ID NO: 215437 - DNA, 20 bp, Artificial
  CRISPR gRNA sequence
acaatatttcctgatgcagt

SEQ ID NO: 215438 - DNA, 20 bp, Artificial
  CRISPR gRNA sequence
caatatttcctgatgcagta

SEQ ID NO: 215439 - DNA, 20 bp, Artificial
  CRISPR gRNA sequence
cctgatgcagtagtttaaaa

SEQ ID NO: 215440 - DNA, 20 bp, Artificial
  CRISPR gRNA sequence
ctgatgcagtagtttaaaaa

SEQ ID NO: 215441 - DNA, 20 bp, Artificial
  CRISPR gRNA sequence
atgcagtagtttaaaaaagt

SEQ ID NO: 215442 - DNA, 20 bp, Artificial
  CRISPR gRNA sequence
aaaaaagtcacatcttaaga

SEQ ID NO: 215443 - DNA, 20 bp, Artificial
  CRISPR gRNA sequence
aaaaagtcacatcttaagag

SEQ ID NO: 215444 - DNA, 20 bp, Artificial
  CRISPR gRNA sequence
aagagaaattaacaaaggaa

SEQ ID NO: 215445 - DNA, 20 bp, Artificial
  CRISPR gRNA sequence
agagaaattaacaaaggaag

SEQ ID NO: 215446 - DNA, 20 bp, Artificial
  CRISPR gRNA sequence
acaaaggaagaggcactcaa

SEQ ID NO: 215447 - DNA, 20 bp, Artificial
  CRISPR gRNA sequence
aagattcttagattgctttc

SEQ ID NO: 215448 - DNA, 20 bp, Artificial
  CRISPR gRNA sequence
ttagattgctttcctgaaaa

SEQ ID NO: 215449 - DNA, 20 bp, Artificial
  CRISPR gRNA sequence
agattgctttcctgaaaatg

SEQ ID NO: 215450 - DNA, 20 bp, Artificial
  CRISPR gRNA sequence
gattgctttcctgaaaatgg

SEQ ID NO: 215451 - DNA, 20 bp, Artificial
  CRISPR gRNA sequence
ctttcctgaaaatggagaaa

SEQ ID NO: 215452 - DNA, 20 bp, Artificial
  CRISPR gRNA sequence
tcctgaaaatggagaaaagt

SEQ ID NO: 215453 - DNA, 20 bp, Artificial
  CRISPR gRNA sequence
cctgaaaatggagaaaagtt

SEQ ID NO: 215454 - DNA, 20 bp, Artificial
  CRISPR gRNA sequence
ctgaaaatggagaaaagttt

SEQ ID NO: 215455 - DNA, 20 bp, Artificial
  CRISPR gRNA sequence
aaaatggagaaaagtttagt

SEQ ID NO: 215456 - DNA, 20 bp, Artificial
  CRISPR gRNA sequence
agtttcttcatacagctaca

SEQ ID NO: 215457 - DNA, 20 bp, Artificial
  CRISPR gRNA sequence
gtttcttcatacagctacag

SEQ ID NO: 215458 - DNA, 20 bp, Artificial
  CRISPR gRNA sequence
cttcatacagctacagaaca

SEQ ID NO: 215459 - DNA, 20 bp, Artificial
  CRISPR gRNA sequence
ttcatacagctacagaacaa

SEQ ID NO: 215460 - DNA, 20 bp, Artificial
  CRISPR gRNA sequence
catacagctacagaacaatg

SEQ ID NO: 215461 - DNA, 20 bp, Artificial
  CRISPR gRNA sequence
atacagctacagaacaatga

SEQ ID NO: 215462 - DNA, 20 bp, Artificial
  CRISPR gRNA sequence
cagaacaatgacaccaccaa

SEQ ID NO: 215463 - DNA, 20 bp, Artificial
  CRISPR gRNA sequence
aaaaaaaaaaataggacatc

SEQ ID NO: 215464 - DNA, 20 bp, Artificial
  CRISPR gRNA sequence
ctggaacaaaccatgccatg

SEQ ID NO: 215465 - DNA, 20 bp, Artificial
  CRISPR gRNA sequence
gaacaaaccatgccatgcca

SEQ ID NO: 215466 - DNA, 20 bp, Artificial
  CRISPR gRNA sequence
ccagaacaaaccatggtcac

SEQ ID NO: 215467 - DNA, 20 bp, Artificial
  CRISPR gRNA sequence
ctggtactagtcattttatg

SEQ ID NO: 215468 - DNA, 20 bp, Artificial
  CRISPR gRNA sequence
gtactagtcattttatgttt

SEQ ID NO: 215469 - DNA, 20 bp, Artificial
  CRISPR gRNA sequence
gtcattttatgttttgttat

SEQ ID NO: 215470 - DNA, 20 bp, Artificial
  CRISPR gRNA sequence
tatgttttgttatgtctttt

SEQ ID NO: 215471 - DNA, 20 bp, Artificial
  CRISPR gRNA sequence
atgttttgttatgtctttta

SEQ ID NO: 215472 - DNA, 20 bp, Artificial
  CRISPR gRNA sequence
tgttttgttatgtcttttaa

SEQ ID NO: 215473 - DNA, 20 bp, Artificial
  CRISPR gRNA sequence
tgttatgtcttttaacttat

SEQ ID NO: 215474 - DNA, 20 bp, Artificial
  CRISPR gRNA sequence
gttatgtcttttaacttatt

SEQ ID NO: 215475 - DNA, 20 bp, Artificial
  CRISPR gRNA sequence
ttatgtcttttaacttattc

SEQ ID NO: 215476 - DNA, 20 bp, Artificial
  CRISPR gRNA sequence
tgtcttttaacttattcctg

SEQ ID NO: 215477 - DNA, 20 bp, Artificial
  CRISPR gRNA sequence
ttaacttattcctgtgaact

SEQ ID NO: 215478 - DNA, 20 bp, Artificial
  CRISPR gRNA sequence
taacttattcctgtgaacta

SEQ ID NO: 215479 - DNA, 20 bp, Artificial
  CRISPR gRNA sequence
aacttattcctgtgaactat

SEQ ID NO: 215480 - DNA, 20 bp, Artificial
  CRISPR gRNA sequence
acttattcctgtgaactata

SEQ ID NO: 215481 - DNA, 20 bp, Artificial
  CRISPR gRNA sequence
attcctgtgaactatagtct

SEQ ID NO: 215482 - DNA, 20 bp, Artificial
  CRISPR gRNA sequence
ttcctgtgaactatagtctt

SEQ ID NO: 215483 - DNA, 20 bp, Artificial
  CRISPR gRNA sequence
ctgtgaactatagtcttttt

SEQ ID NO: 215484 - DNA, 20 bp, Artificial
  CRISPR gRNA sequence
tgaactatagtcttttttag

SEQ ID NO: 215485 - DNA, 20 bp, Artificial
  CRISPR gRNA sequence
tagtcttttttaggagggta

SEQ ID NO: 215486 - DNA, 20 bp, Artificial
  CRISPR gRNA sequence
ttttaggagggtaatggctt

SEQ ID NO: 215487 - DNA, 20 bp, Artificial
  CRISPR gRNA sequence
tttaggagggtaatggctta

SEQ ID NO: 215488 - DNA, 20 bp, Artificial
  CRISPR gRNA sequence
ttaggagggtaatggcttat

SEQ ID NO: 215489 - DNA, 20 bp, Artificial
  CRISPR gRNA sequence
taggagggtaatggcttata

SEQ ID NO: 215490 - DNA, 20 bp, Artificial
  CRISPR gRNA sequence
aggagggtaatggcttatat

SEQ ID NO: 215491 - DNA, 20 bp, Artificial
  CRISPR gRNA sequence
ggagggtaatggcttatata

SEQ ID NO: 215492 - DNA, 20 bp, Artificial
  CRISPR gRNA sequence
atataacaagacatgctttt

SEQ ID NO: 215493 - DNA, 20 bp, Artificial
  CRISPR gRNA sequence
tataacaagacatgctttta

SEQ ID NO: 215494 - DNA, 20 bp, Artificial
  CRISPR gRNA sequence
ttaaaggctgtgacacaaac

SEQ ID NO: 215495 - DNA, 20 bp, Artificial
  CRISPR gRNA sequence
taaaggctgtgacacaaaca

SEQ ID NO: 215496 - DNA, 20 bp, Artificial
  CRISPR gRNA sequence
aaaggctgtgacacaaacat

SEQ ID NO: 215497 - DNA, 20 bp, Artificial
  CRISPR gRNA sequence
aaggctgtgacacaaacata

SEQ ID NO: 215498 - DNA, 20 bp, Artificial
  CRISPR gRNA sequence
tgacacaaacatacaaaagt

SEQ ID NO: 215499 - DNA, 20 bp, Artificial
  CRISPR gRNA sequence
tgtgactccatgctgaatac

SEQ ID NO: 215500 - DNA, 20 bp, Artificial
  CRISPR gRNA sequence
tgactccatgctgaatacac

SEQ ID NO: 215501 - DNA, 20 bp, Artificial
  CRISPR gRNA sequence
catgctgaatacacgttgtt

SEQ ID NO: 215502 - DNA, 20 bp, Artificial
  CRISPR gRNA sequence
aatacacgttgttttaaact

SEQ ID NO: 215503 - DNA, 20 bp, Artificial
  CRISPR gRNA sequence
ttttaaactttgttcaccaa

SEQ ID NO: 215504 - DNA, 20 bp, Artificial
  CRISPR gRNA sequence
taaactttgttcaccaatgc

SEQ ID NO: 215505 - DNA, 20 bp, Artificial
  CRISPR gRNA sequence
aaactttgttcaccaatgca

SEQ ID NO: 215506 - DNA, 20 bp, Artificial
  CRISPR gRNA sequence
aactttgttcaccaatgcat

SEQ ID NO: 215507 - DNA, 20 bp, Artificial
  CRISPR gRNA sequence
tgttcaccaatgcatgactg

SEQ ID NO: 215508 - DNA, 20 bp, Artificial
  CRISPR gRNA sequence
gttcaccaatgcatgactgg

SEQ ID NO: 215509 - DNA, 20 bp, Artificial
  CRISPR gRNA sequence
ttcaccaatgcatgactgga

SEQ ID NO: 215510 - DNA, 20 bp, Artificial
  CRISPR gRNA sequence
accaatgcatgactggagtg

SEQ ID NO: 215511 - DNA, 20 bp, Artificial
  CRISPR gRNA sequence
gagtgttttttttttttttt

SEQ ID NO: 215512 - DNA, 20 bp, Artificial
  CRISPR gRNA sequence
tttttttttttttttttttt

SEQ ID NO: 215513 - DNA, 20 bp, Artificial
  CRISPR gRNA sequence
tttttttttttttttttttt

SEQ ID NO: 215514 - DNA, 20 bp, Artificial
  CRISPR gRNA sequence
tttttttttttttttttttt

SEQ ID NO: 215515 - DNA, 20 bp, Artificial
  CRISPR gRNA sequence
tttttttttttttttttttt

SEQ ID NO: 215516 - DNA, 20 bp, Artificial
  CRISPR gRNA sequence
tttttttttttttttttttt

SEQ ID NO: 215517 - DNA, 20 bp, Artificial
  CRISPR gRNA sequence
tttttttttttttttttttt

SEQ ID NO: 215518 - DNA, 20 bp, Artificial
  CRISPR gRNA sequence
tttttttttttttttttttc

SEQ ID NO: 215519 - DNA, 20 bp, Artificial
  CRISPR gRNA sequence
ttttttttttttttttttct

SEQ ID NO: 215520 - DNA, 20 bp, Artificial
  CRISPR gRNA sequence
tttttttttttttttttctt

SEQ ID NO: 215521 - DNA, 20 bp, Artificial
  CRISPR gRNA sequence
ttttttttttttttttcttg

SEQ ID NO: 215522 - DNA, 20 bp, Artificial
  CRISPR gRNA sequence
tttttttttttttttcttga

SEQ ID NO: 215523 - DNA, 20 bp, Artificial
  CRISPR gRNA sequence
ttttttttttttttcttgag

SEQ ID NO: 215524 - DNA, 20 bp, Artificial
  CRISPR gRNA sequence
tttttttttttttcttgaga

SEQ ID NO: 215525 - DNA, 20 bp, Artificial
  CRISPR gRNA sequence
ttttttttttttcttgagac

SEQ ID NO: 215526 - DNA, 20 bp, Artificial
  CRISPR gRNA sequence
tttttttttttcttgagacg

SEQ ID NO: 215527 - DNA, 20 bp, Artificial
  CRISPR gRNA sequence
ttttttttttcttgagacgg

SEQ ID NO: 215528 - DNA, 20 bp, Artificial
  CRISPR gRNA sequence
tttttttttcttgagacgga

SEQ ID NO: 215529 - DNA, 20 bp, Artificial
  CRISPR gRNA sequence
ttttttttcttgagacggag

SEQ ID NO: 215530 - DNA, 20 bp, Artificial
  CRISPR gRNA sequence
tttttttcttgagacggagt

SEQ ID NO: 215531 - DNA, 20 bp, Artificial
  CRISPR gRNA sequence
ttttttcttgagacggagtc

SEQ ID NO: 215532 - DNA, 20 bp, Artificial
  CRISPR gRNA sequence
tttttcttgagacggagtct

SEQ ID NO: 215533 - DNA, 20 bp, Artificial
  CRISPR gRNA sequence
ttttcttgagacggagtctt

SEQ ID NO: 215534 - DNA, 20 bp, Artificial
  CRISPR gRNA sequence
tttcttgagacggagtcttg

SEQ ID NO: 215535 - DNA, 20 bp, Artificial
  CRISPR gRNA sequence
ttcttgagacggagtcttgc

SEQ ID NO: 215536 - DNA, 20 bp, Artificial
  CRISPR gRNA sequence
tcttgagacggagtcttgct

SEQ ID NO: 215537 - DNA, 20 bp, Artificial
  CRISPR gRNA sequence
cttgagacggagtcttgctc

SEQ ID NO: 215538 - DNA, 20 bp, Artificial
  CRISPR gRNA sequence
ttgagacggagtcttgctct

SEQ ID NO: 215539 - DNA, 20 bp, Artificial
  CRISPR gRNA sequence
gagacggagtcttgctctgt

SEQ ID NO: 215540 - DNA, 20 bp, Artificial
  CRISPR gRNA sequence
agacggagtcttgctctgtc

SEQ ID NO: 215541 - DNA, 20 bp, Artificial
  CRISPR gRNA sequence
gctctgtcacccaggctgga

SEQ ID NO: 215542 - DNA, 20 bp, Artificial
  CRISPR gRNA sequence
ctctgtcacccaggctggag

SEQ ID NO: 215543 - DNA, 20 bp, Artificial
  CRISPR gRNA sequence
tgtcacccaggctggagtgt

SEQ ID NO: 215544 - DNA, 20 bp, Artificial
  CRISPR gRNA sequence
tcacccaggctggagtgtag

SEQ ID NO: 215545 - DNA, 20 bp, Artificial
  CRISPR gRNA sequence
gagtgtagtggcacgatctt

SEQ ID NO: 215546 - DNA, 20 bp, Artificial
  CRISPR gRNA sequence
ggctcactgcaagctctgcc

SEQ ID NO: 215547 - DNA, 20 bp, Artificial
  CRISPR gRNA sequence
gctcactgcaagctctgcct

SEQ ID NO: 215548 - DNA, 20 bp, Artificial
  CRISPR gRNA sequence
actgcaagctctgcctcccg

SEQ ID NO: 215549 - DNA, 20 bp, Artificial
  CRISPR gRNA sequence
caagctctgcctcccgggtt

SEQ ID NO: 215550 - DNA, 20 bp, Artificial
  CRISPR gRNA sequence
tgcctcccgggttcacgcca

SEQ ID NO: 215551 - DNA, 20 bp, Artificial
  CRISPR gRNA sequence
cctcccgggttcacgccatt

SEQ ID NO: 215552 - DNA, 20 bp, Artificial
  CRISPR gRNA sequence
ccgggttcacgccattctcc

SEQ ID NO: 215553 - DNA, 20 bp, Artificial
  CRISPR gRNA sequence
acgccattctcctgcctcag

SEQ ID NO: 215554 - DNA, 20 bp, Artificial
  CRISPR gRNA sequence
tcctgcctcagcctcccaag

SEQ ID NO: 215555 - DNA, 20 bp, Artificial
  CRISPR gRNA sequence
ctgcctcagcctcccaagta

SEQ ID NO: 215556 - DNA, 20 bp, Artificial
  CRISPR gRNA sequence
cctcagcctcccaagtagct

SEQ ID NO: 215557 - DNA, 20 bp, Artificial
  CRISPR gRNA sequence
agcctcccaagtagctggga

SEQ ID NO: 215558 - DNA, 20 bp, Artificial
  CRISPR gRNA sequence
ccaagtagctgggaccacag

SEQ ID NO: 215559 - DNA, 20 bp, Artificial
  CRISPR gRNA sequence
ggaccacaggtgcccgccac

SEQ ID NO: 215560 - DNA, 20 bp, Artificial
  CRISPR gRNA sequence
attttttgtagttttagtag

SEQ ID NO: 215561 - DNA, 20 bp, Artificial
  CRISPR gRNA sequence
tttgtagttttagtagagac

SEQ ID NO: 215562 - DNA, 20 bp, Artificial
  CRISPR gRNA sequence
ttgtagttttagtagagacg

SEQ ID NO: 215563 - DNA, 20 bp, Artificial
  CRISPR gRNA sequence
tgtagttttagtagagacgg

SEQ ID NO: 215564 - DNA, 20 bp, Artificial
  CRISPR gRNA sequence
gtagttttagtagagacggg

SEQ ID NO: 215565 - DNA, 20 bp, Artificial
  CRISPR gRNA sequence
tagttttagtagagacgggg

SEQ ID NO: 215566 - DNA, 20 bp, Artificial
  CRISPR gRNA sequence
tagtagagacggggtttcac

SEQ ID NO: 215567 - DNA, 20 bp, Artificial
  CRISPR gRNA sequence
agtagagacggggtttcacc

SEQ ID NO: 215568 - DNA, 20 bp, Artificial
  CRISPR gRNA sequence
gtagagacggggtttcaccg

SEQ ID NO: 215569 - DNA, 20 bp, Artificial
  CRISPR gRNA sequence
caccgtgttagccaggatgg

SEQ ID NO: 215570 - DNA, 20 bp, Artificial
  CRISPR gRNA sequence
accgtgttagccaggatggt

SEQ ID NO: 215571 - DNA, 20 bp, Artificial
  CRISPR gRNA sequence
gccaggatggtctcgatctc

SEQ ID NO: 215572 - DNA, 20 bp, Artificial
  CRISPR gRNA sequence
gatctcctgaccttgtgatc

SEQ ID NO: 215573 - DNA, 20 bp, Artificial
  CRISPR gRNA sequence
ctgaccttgtgatccgcccg

SEQ ID NO: 215574 - DNA, 20 bp, Artificial
  CRISPR gRNA sequence
accttgtgatccgcccgcct

SEQ ID NO: 215575 - DNA, 20 bp, Artificial
  CRISPR gRNA sequence
gtgatccgcccgcctcggcc

SEQ ID NO: 215576 - DNA, 20 bp, Artificial
  CRISPR gRNA sequence
tgatccgcccgcctcggcct

SEQ ID NO: 215577 - DNA, 20 bp, Artificial
  CRISPR gRNA sequence
ggcctcccaaagtgctggga

SEQ ID NO: 215578 - DNA, 20 bp, Artificial
  CRISPR gRNA sequence
ccaaagtgctgggattacag

SEQ ID NO: 215579 - DNA, 20 bp, Artificial
  CRISPR gRNA sequence
ggattacaggcgtgagccac

SEQ ID NO: 215580 - DNA, 20 bp, Artificial
  CRISPR gRNA sequence
caggcgtgagccaccgcgcc

SEQ ID NO: 215581 - DNA, 20 bp, Artificial
  CRISPR gRNA sequence
gagtgtttttaatcttatgc

SEQ ID NO: 215582 - DNA, 20 bp, Artificial
  CRISPR gRNA sequence
ttaatcttatgcaaatatta

SEQ ID NO: 215583 - DNA, 20 bp, Artificial
  CRISPR gRNA sequence
taatcttatgcaaatattaa

SEQ ID NO: 215584 - DNA, 20 bp, Artificial
  CRISPR gRNA sequence
aatcttatgcaaatattaat

SEQ ID NO: 215585 - DNA, 20 bp, Artificial
  CRISPR gRNA sequence
atcttatgcaaatattaatg

SEQ ID NO: 215586 - DNA, 20 bp, Artificial
  CRISPR gRNA sequence
atgcaaatattaatgacact

SEQ ID NO: 215587 - DNA, 20 bp, Artificial
  CRISPR gRNA sequence
tgcaaatattaatgacactt

SEQ ID NO: 215588 - DNA, 20 bp, Artificial
  CRISPR gRNA sequence
atgacacttggggggaatat

SEQ ID NO: 215589 - DNA, 20 bp, Artificial
  CRISPR gRNA sequence
ggggggaatatagcttcctg

SEQ ID NO: 215590 - DNA, 20 bp, Artificial
  CRISPR gRNA sequence
gggggaatatagcttcctga

SEQ ID NO: 215591 - DNA, 20 bp, Artificial
  CRISPR gRNA sequence
cctgagttaaatgctgcact

SEQ ID NO: 215592 - DNA, 20 bp, Artificial
  CRISPR gRNA sequence
ctgagttaaatgctgcactt

SEQ ID NO: 215593 - DNA, 20 bp, Artificial
  CRISPR gRNA sequence
agttaaatgctgcactttgc

SEQ ID NO: 215594 - DNA, 20 bp, Artificial
  CRISPR gRNA sequence
aatgctgcactttgctacag

SEQ ID NO: 215595 - DNA, 20 bp, Artificial
  CRISPR gRNA sequence
cactttgctacagaagaggg

SEQ ID NO: 215596 - DNA, 20 bp, Artificial
  CRISPR gRNA sequence
tgctacagaagagggcaggt

SEQ ID NO: 215597 - DNA, 20 bp, Artificial
  CRISPR gRNA sequence
gctacagaagagggcaggta

SEQ ID NO: 215598 - DNA, 20 bp, Artificial
  CRISPR gRNA sequence
ctacagaagagggcaggtaa

SEQ ID NO: 215599 - DNA, 20 bp, Artificial
  CRISPR gRNA sequence
cagaagagggcaggtaaggt

SEQ ID NO: 215600 - DNA, 20 bp, Artificial
  CRISPR gRNA sequence
taaaacagtaaaatataaag

SEQ ID NO: 215601 - DNA, 20 bp, Artificial
  CRISPR gRNA sequence
aaaacagtaaaatataaagc

SEQ ID NO: 215602 - DNA, 20 bp, Artificial
  CRISPR gRNA sequence
aaacagtaaaatataaagca

SEQ ID NO: 215603 - DNA, 20 bp, Artificial
  CRISPR gRNA sequence
tttacatgaccgaggagtga

SEQ ID NO: 215604 - DNA, 20 bp, Artificial
  CRISPR gRNA sequence
acatgaccgaggagtgatta

SEQ ID NO: 215605 - DNA, 20 bp, Artificial
  CRISPR gRNA sequence
catgaccgaggagtgattat

SEQ ID NO: 215606 - DNA, 20 bp, Artificial
  CRISPR gRNA sequence
taaatatcaaaggtaagaag

SEQ ID NO: 215607 - DNA, 20 bp, Artificial
  CRISPR gRNA sequence
tttgataagataaaaacata

SEQ ID NO: 215608 - DNA, 20 bp, Artificial
  CRISPR gRNA sequence
ttgataagataaaaacataa

SEQ ID NO: 215609 - DNA, 20 bp, Artificial
  CRISPR gRNA sequence
tgataagataaaaacataaa

SEQ ID NO: 215610 - DNA, 20 bp, Artificial
  CRISPR gRNA sequence
gataagataaaaacataaac

SEQ ID NO: 215611 - DNA, 20 bp, Artificial
  CRISPR gRNA sequence
ataagataaaaacataaaca

SEQ ID NO: 215612 - DNA, 20 bp, Artificial
  CRISPR gRNA sequence
ctaaatgccaacaaaactga

SEQ ID NO: 215613 - DNA, 20 bp, Artificial
  CRISPR gRNA sequence
aatgccaacaaaactgagga

SEQ ID NO: 215614 - DNA, 20 bp, Artificial
  CRISPR gRNA sequence
aggaatcataatatgttaag

SEQ ID NO: 215615 - DNA, 20 bp, Artificial
  CRISPR gRNA sequence
aggtaaaaccaaaataaatg

SEQ ID NO: 215616 - DNA, 20 bp, Artificial
  CRISPR gRNA sequence
gtagcactcaatatctcaaa

SEQ ID NO: 215617 - DNA, 20 bp, Artificial
  CRISPR gRNA sequence
tagcactcaatatctcaaac

SEQ ID NO: 215618 - DNA, 20 bp, Artificial
  CRISPR gRNA sequence
aatatctcaaacctatgtat

SEQ ID NO: 215619 - DNA, 20 bp, Artificial
  CRISPR gRNA sequence
aaacctatgtatctttaaga

SEQ ID NO: 215620 - DNA, 20 bp, Artificial
  CRISPR gRNA sequence
tgtatctttaagaacaaata

SEQ ID NO: 215621 - DNA, 20 bp, Artificial
  CRISPR gRNA sequence
taagaacaaatatatttctt

SEQ ID NO: 215622 - DNA, 20 bp, Artificial
  CRISPR gRNA sequence
aagaacaaatatatttcttt

SEQ ID NO: 215623 - DNA, 20 bp, Artificial
  CRISPR gRNA sequence
agaacaaatatatttctttg

SEQ ID NO: 215624 - DNA, 20 bp, Artificial
  CRISPR gRNA sequence
ctttgaaatattctataaag

SEQ ID NO: 215625 - DNA, 20 bp, Artificial
  CRISPR gRNA sequence
tttgaaatattctataaaga

SEQ ID NO: 215626 - DNA, 20 bp, Artificial
  CRISPR gRNA sequence
tgaaatattctataaagatt

SEQ ID NO: 215627 - DNA, 20 bp, Artificial
  CRISPR gRNA sequence
gaaatattctataaagatta

SEQ ID NO: 215628 - DNA, 20 bp, Artificial
  CRISPR gRNA sequence
aaatattctataaagattag

SEQ ID NO: 215629 - DNA, 20 bp, Artificial
  CRISPR gRNA sequence
tataaagattagaagttatt

SEQ ID NO: 215630 - DNA, 20 bp, Artificial
  CRISPR gRNA sequence
taaagattagaagttattag

SEQ ID NO: 215631 - DNA, 20 bp, Artificial
  CRISPR gRNA sequence
gaagttattagcccagagtt

SEQ ID NO: 215632 - DNA, 20 bp, Artificial
  CRISPR gRNA sequence
ttagcccagagttcttaaaa

SEQ ID NO: 215633 - DNA, 20 bp, Artificial
  CRISPR gRNA sequence
gcccagagttcttaaaaaaa

SEQ ID NO: 215634 - DNA, 20 bp, Artificial
  CRISPR gRNA sequence
ttaaaaaaaaaatggaagca

SEQ ID NO: 215635 - DNA, 20 bp, Artificial
  CRISPR gRNA sequence
aaaaaaaaaatggaagcaaa

SEQ ID NO: 215636 - DNA, 20 bp, Artificial
  CRISPR gRNA sequence
aaaaaaaaatggaagcaaaa

SEQ ID NO: 215637 - DNA, 20 bp, Artificial
  CRISPR gRNA sequence
aggacgaaacatctctctct

SEQ ID NO: 215638 - DNA, 20 bp, Artificial
  CRISPR gRNA sequence
tctctctctctctctctctc

SEQ ID NO: 215639 - DNA, 20 bp, Artificial
  CRISPR gRNA sequence
tctctctctctctctctctc

SEQ ID NO: 215640 - DNA, 20 bp, Artificial
  CRISPR gRNA sequence
tctctctctctctctctctc

SEQ ID NO: 215641 - DNA, 20 bp, Artificial
  CRISPR gRNA sequence
tctctctctctctctctctc

SEQ ID NO: 215642 - DNA, 20 bp, Artificial
  CRISPR gRNA sequence
tctctctctctctctctctc

SEQ ID NO: 215643 - DNA, 20 bp, Artificial
  CRISPR gRNA sequence
tctctctctctctctctctc

SEQ ID NO: 215644 - DNA, 20 bp, Artificial
  CRISPR gRNA sequence
tctctctctctctctctctc

SEQ ID NO: 215645 - DNA, 20 bp, Artificial
  CRISPR gRNA sequence
tctctctctctctctctctc

SEQ ID NO: 215646 - DNA, 20 bp, Artificial
  CRISPR gRNA sequence
tctctctctctctctctctc

SEQ ID NO: 215647 - DNA, 20 bp, Artificial
  CRISPR gRNA sequence
tctctctctctctctctctc

SEQ ID NO: 215648 - DNA, 20 bp, Artificial
  CRISPR gRNA sequence
tctctctctctctctctctc

SEQ ID NO: 215649 - DNA, 20 bp, Artificial
  CRISPR gRNA sequence
tctctctctctctctctctc

SEQ ID NO: 215650 - DNA, 20 bp, Artificial
  CRISPR gRNA sequence
tctctctctctctctctctc

SEQ ID NO: 215651 - DNA, 20 bp, Artificial
  CRISPR gRNA sequence
tctctctctctctctctctc

SEQ ID NO: 215652 - DNA, 20 bp, Artificial
  CRISPR gRNA sequence
tctctctctctctctctcaa

SEQ ID NO: 215653 - DNA, 20 bp, Artificial
  CRISPR gRNA sequence
tctctctctctctctcaacc

SEQ ID NO: 215654 - DNA, 20 bp, Artificial
  CRISPR gRNA sequence
tctctctctctctcaacctc

SEQ ID NO: 215655 - DNA, 20 bp, Artificial
  CRISPR gRNA sequence
tctctctctctcaacctctc

SEQ ID NO: 215656 - DNA, 20 bp, Artificial
  CRISPR gRNA sequence
tctctctctcaacctctctc

SEQ ID NO: 215657 - DNA, 20 bp, Artificial
  CRISPR gRNA sequence
tctctctcaacctctctctt

SEQ ID NO: 215658 - DNA, 20 bp, Artificial
  CRISPR gRNA sequence
tctctcaacctctctcttta

SEQ ID NO: 215659 - DNA, 20 bp, Artificial
  CRISPR gRNA sequence
tctcaacctctctctttaat

SEQ ID NO: 215660 - DNA, 20 bp, Artificial
  CRISPR gRNA sequence
tcaacctctctctttaatca

SEQ ID NO: 215661 - DNA, 20 bp, Artificial
  CRISPR gRNA sequence
aacctctctctttaatcatc

SEQ ID NO: 215662 - DNA, 20 bp, Artificial
  CRISPR gRNA sequence
tctctttaatcatctcccaa

SEQ ID NO: 215663 - DNA, 20 bp, Artificial
  CRISPR gRNA sequence
tctttaatcatctcccaaaa

SEQ ID NO: 215664 - DNA, 20 bp, Artificial
  CRISPR gRNA sequence
tttaatcatctcccaaaagg

SEQ ID NO: 215665 - DNA, 20 bp, Artificial
  CRISPR gRNA sequence
taatcatctcccaaaaggtt

SEQ ID NO: 215666 - DNA, 20 bp, Artificial
  CRISPR gRNA sequence
aatcatctcccaaaaggtta

SEQ ID NO: 215667 - DNA, 20 bp, Artificial
  CRISPR gRNA sequence
atcatctcccaaaaggttag

SEQ ID NO: 215668 - DNA, 20 bp, Artificial
  CRISPR gRNA sequence
ccaaaaggttagaaccaagc

SEQ ID NO: 215669 - DNA, 20 bp, Artificial
  CRISPR gRNA sequence
gaaccaagctcctgattgga

SEQ ID NO: 215670 - DNA, 20 bp, Artificial
  CRISPR gRNA sequence
ctgattggaaaagcagagat

SEQ ID NO: 215671 - DNA, 20 bp, Artificial
  CRISPR gRNA sequence
attggaaaagcagagatgtt

SEQ ID NO: 215672 - DNA, 20 bp, Artificial
  CRISPR gRNA sequence
gaaaagcagagatgttaagt

SEQ ID NO: 215673 - DNA, 20 bp, Artificial
  CRISPR gRNA sequence
agtccccatgggttaaatgc

SEQ ID NO: 215674 - DNA, 20 bp, Artificial
  CRISPR gRNA sequence
aatgcaacaaaatcaccaac

SEQ ID NO: 215675 - DNA, 20 bp, Artificial
  CRISPR gRNA sequence
tgtcaaaatgataaagattt

SEQ ID NO: 215676 - DNA, 20 bp, Artificial
  CRISPR gRNA sequence
tcaaaatgataaagatttgt

SEQ ID NO: 215677 - DNA, 20 bp, Artificial
  CRISPR gRNA sequence
gtgccagattatttatgtgc

SEQ ID NO: 215678 - DNA, 20 bp, Artificial
  CRISPR gRNA sequence
tgccagattatttatgtgcc

SEQ ID NO: 215679 - DNA, 20 bp, Artificial
  CRISPR gRNA sequence
tttatgtgccttataaaagg

SEQ ID NO: 215680 - DNA, 20 bp, Artificial
  CRISPR gRNA sequence
atgtgccttataaaaggcat

SEQ ID NO: 215681 - DNA, 20 bp, Artificial
  CRISPR gRNA sequence
tgtgccttataaaaggcatc

SEQ ID NO: 215682 - DNA, 20 bp, Artificial
  CRISPR gRNA sequence
ataaaaggcatcttaaagtt

SEQ ID NO: 215683 - DNA, 20 bp, Artificial
  CRISPR gRNA sequence
taaaaggcatcttaaagtta

SEQ ID NO: 215684 - DNA, 20 bp, Artificial
  CRISPR gRNA sequence
aaagttacagtcaccagaca

SEQ ID NO: 215685 - DNA, 20 bp, Artificial
  CRISPR gRNA sequence
aagttacagtcaccagacac

SEQ ID NO: 215686 - DNA, 20 bp, Artificial
  CRISPR gRNA sequence
cagtcaccagacacggaatc

SEQ ID NO: 215687 - DNA, 20 bp, Artificial
  CRISPR gRNA sequence
aaaaacattttacaaaaagt

SEQ ID NO: 215688 - DNA, 20 bp, Artificial
  CRISPR gRNA sequence
tacaaaaagtggtaatttct

SEQ ID NO: 215689 - DNA, 20 bp, Artificial
  CRISPR gRNA sequence
acaaaaagtggtaatttctc

SEQ ID NO: 215690 - DNA, 20 bp, Artificial
  CRISPR gRNA sequence
caaaaagtggtaatttctct

SEQ ID NO: 215691 - DNA, 20 bp, Artificial
  CRISPR gRNA sequence
ctctttgctgggagccatat

SEQ ID NO: 215692 - DNA, 20 bp, Artificial
  CRISPR gRNA sequence
tctttgctgggagccatatg

SEQ ID NO: 215693 - DNA, 20 bp, Artificial
  CRISPR gRNA sequence
tttgctgggagccatatgac

SEQ ID NO: 215694 - DNA, 20 bp, Artificial
  CRISPR gRNA sequence
tgctgggagccatatgactg

SEQ ID NO: 215695 - DNA, 20 bp, Artificial
  CRISPR gRNA sequence
gctgggagccatatgactgg

SEQ ID NO: 215696 - DNA, 20 bp, Artificial
  CRISPR gRNA sequence
ctgggagccatatgactgga

SEQ ID NO: 215697 - DNA, 20 bp, Artificial
  CRISPR gRNA sequence
ggagccatatgactggagtc

SEQ ID NO: 215698 - DNA, 20 bp, Artificial
  CRISPR gRNA sequence
gagtctgattcgtgacaccc

SEQ ID NO: 215699 - DNA, 20 bp, Artificial
  CRISPR gRNA sequence
attcgtgacaccctacagtt

SEQ ID NO: 215700 - DNA, 20 bp, Artificial
  CRISPR gRNA sequence
gtgacaccctacagttttta

SEQ ID NO: 215701 - DNA, 20 bp, Artificial
  CRISPR gRNA sequence
cagtttttacagtagtagtt

SEQ ID NO: 215702 - DNA, 20 bp, Artificial
  CRISPR gRNA sequence
ttacagtagtagttttgcaa

SEQ ID NO: 215703 - DNA, 20 bp, Artificial
  CRISPR gRNA sequence
tacagtagtagttttgcaat

SEQ ID NO: 215704 - DNA, 20 bp, Artificial
  CRISPR gRNA sequence
acagtagtagttttgcaatt

SEQ ID NO: 215705 - DNA, 20 bp, Artificial
  CRISPR gRNA sequence
cagtagtagttttgcaattt

SEQ ID NO: 215706 - DNA, 20 bp, Artificial
  CRISPR gRNA sequence
tgcaatttttagcaaagtag

SEQ ID NO: 215707 - DNA, 20 bp, Artificial
  CRISPR gRNA sequence
gcaatttttagcaaagtaga

SEQ ID NO: 215708 - DNA, 20 bp, Artificial
  CRISPR gRNA sequence
caatttttagcaaagtagat

SEQ ID NO: 215709 - DNA, 20 bp, Artificial
  CRISPR gRNA sequence
ttagcaaagtagatttaagt

SEQ ID NO: 215710 - DNA, 20 bp, Artificial
  CRISPR gRNA sequence
tagcaaagtagatttaagtt

SEQ ID NO: 215711 - DNA, 20 bp, Artificial
  CRISPR gRNA sequence
agcaaagtagatttaagttg

SEQ ID NO: 215712 - DNA, 20 bp, Artificial
  CRISPR gRNA sequence
gcaaagtagatttaagttgt

SEQ ID NO: 215713 - DNA, 20 bp, Artificial
  CRISPR gRNA sequence
aagttgtatacatcaagaaa

SEQ ID NO: 215714 - DNA, 20 bp, Artificial
  CRISPR gRNA sequence
agttgtatacatcaagaaat

SEQ ID NO: 215715 - DNA, 20 bp, Artificial
  CRISPR gRNA sequence
tatacatcaagaaatgtgaa

SEQ ID NO: 215716 - DNA, 20 bp, Artificial
  CRISPR gRNA sequence
tatcatctgacagtgtccct

SEQ ID NO: 215717 - DNA, 20 bp, Artificial
  CRISPR gRNA sequence
atcatctgacagtgtccctt

SEQ ID NO: 215718 - DNA, 20 bp, Artificial
  CRISPR gRNA sequence
tcatctgacagtgtcccttt

SEQ ID NO: 215719 - DNA, 20 bp, Artificial
  CRISPR gRNA sequence
acagtgtcccttttactaaa

SEQ ID NO: 215720 - DNA, 20 bp, Artificial
  CRISPR gRNA sequence
ttactaaaaaagagccacat

SEQ ID NO: 215721 - DNA, 20 bp, Artificial
  CRISPR gRNA sequence
tactaaaaaagagccacatt

SEQ ID NO: 215722 - DNA, 20 bp, Artificial
  CRISPR gRNA sequence
actaaaaaagagccacattt

SEQ ID NO: 215723 - DNA, 20 bp, Artificial
  CRISPR gRNA sequence
ctaaaaaagagccacatttt

SEQ ID NO: 215724 - DNA, 20 bp, Artificial
  CRISPR gRNA sequence
aaaaagagccacattttcaa

SEQ ID NO: 215725 - DNA, 20 bp, Artificial
  CRISPR gRNA sequence
tcaagaagcttttttgtttt

SEQ ID NO: 215726 - DNA, 20 bp, Artificial
  CRISPR gRNA sequence
caagaagcttttttgttttc

SEQ ID NO: 215727 - DNA, 20 bp, Artificial
  CRISPR gRNA sequence
aagaagcttttttgttttcc

SEQ ID NO: 215728 - DNA, 20 bp, Artificial
  CRISPR gRNA sequence
ttttgttttccaatgtccat

SEQ ID NO: 215729 - DNA, 20 bp, Artificial
  CRISPR gRNA sequence
tttgttttccaatgtccatg

SEQ ID NO: 215730 - DNA, 20 bp, Artificial
  CRISPR gRNA sequence
ttgttttccaatgtccatgt

SEQ ID NO: 215731 - DNA, 20 bp, Artificial
  CRISPR gRNA sequence
tgttttccaatgtccatgtt

SEQ ID NO: 215732 - DNA, 20 bp, Artificial
  CRISPR gRNA sequence
gttttccaatgtccatgttt

SEQ ID NO: 215733 - DNA, 20 bp, Artificial
  CRISPR gRNA sequence
ttttccaatgtccatgtttt

SEQ ID NO: 215734 - DNA, 20 bp, Artificial
  CRISPR gRNA sequence
tccaatgtccatgttttaac

SEQ ID NO: 215735 - DNA, 20 bp, Artificial
  CRISPR gRNA sequence
ccaatgtccatgttttaact

SEQ ID NO: 215736 - DNA, 20 bp, Artificial
  CRISPR gRNA sequence
caatgtccatgttttaactg

SEQ ID NO: 215737 - DNA, 20 bp, Artificial
  CRISPR gRNA sequence
taactgatctataattatta

SEQ ID NO: 215738 - DNA, 20 bp, Artificial
  CRISPR gRNA sequence
aactgatctataattattaa

SEQ ID NO: 215739 - DNA, 20 bp, Artificial
  CRISPR gRNA sequence
actgatctataattattaag

SEQ ID NO: 215740 - DNA, 20 bp, Artificial
  CRISPR gRNA sequence
atctataattattaagtgca

SEQ ID NO: 215741 - DNA, 20 bp, Artificial
  CRISPR gRNA sequence
taattattaagtgcatttta

SEQ ID NO: 215742 - DNA, 20 bp, Artificial
  CRISPR gRNA sequence
ttaagtgcattttatactta

SEQ ID NO: 215743 - DNA, 20 bp, Artificial
  CRISPR gRNA sequence
agtgcattttatacttacca

SEQ ID NO: 215744 - DNA, 20 bp, Artificial
  CRISPR gRNA sequence
tatacttaccatcattcatc

SEQ ID NO: 215745 - DNA, 20 bp, Artificial
  CRISPR gRNA sequence
atacttaccatcattcatca

SEQ ID NO: 215746 - DNA, 20 bp, Artificial
  CRISPR gRNA sequence
tacttaccatcattcatcat

SEQ ID NO: 215747 - DNA, 20 bp, Artificial
  CRISPR gRNA sequence
accatcattcatcattcctt

SEQ ID NO: 215748 - DNA, 20 bp, Artificial
  CRISPR gRNA sequence
ccatcattcatcattccttt

SEQ ID NO: 215749 - DNA, 20 bp, Artificial
  CRISPR gRNA sequence
atcattccttttgattcttt

SEQ ID NO: 215750 - DNA, 20 bp, Artificial
  CRISPR gRNA sequence
cttttgattctttgaatgct

SEQ ID NO: 215751 - DNA, 20 bp, Artificial
  CRISPR gRNA sequence
ttgattctttgaatgctagg

SEQ ID NO: 215752 - DNA, 20 bp, Artificial
  CRISPR gRNA sequence
tgattctttgaatgctagga

SEQ ID NO: 215753 - DNA, 20 bp, Artificial
  CRISPR gRNA sequence
gattctttgaatgctaggat

SEQ ID NO: 215754 - DNA, 20 bp, Artificial
  CRISPR gRNA sequence
attctttgaatgctaggatt

SEQ ID NO: 215755 - DNA, 20 bp, Artificial
  CRISPR gRNA sequence
tttgaatgctaggattagta

SEQ ID NO: 215756 - DNA, 20 bp, Artificial
  CRISPR gRNA sequence
tgaatgctaggattagtaac

SEQ ID NO: 215757 - DNA, 20 bp, Artificial
  CRISPR gRNA sequence
gaatgctaggattagtaaca

SEQ ID NO: 215758 - DNA, 20 bp, Artificial
  CRISPR gRNA sequence
aatgctaggattagtaacaa

SEQ ID NO: 215759 - DNA, 20 bp, Artificial
  CRISPR gRNA sequence
ggattagtaacaagccaagc

SEQ ID NO: 215760 - DNA, 20 bp, Artificial
  CRISPR gRNA sequence
gtaacaagccaagcaggcag

SEQ ID NO: 215761 - DNA, 20 bp, Artificial
  CRISPR gRNA sequence
gtgaggttccacaattggaa

SEQ ID NO: 215762 - DNA, 20 bp, Artificial
  CRISPR gRNA sequence
cacaattggaaatcatttct

SEQ ID NO: 215763 - DNA, 20 bp, Artificial
  CRISPR gRNA sequence
gaaatcatttctaaataaac

SEQ ID NO: 215764 - DNA, 20 bp, Artificial
  CRISPR gRNA sequence
ctaaataaacaaatatgcaa

SEQ ID NO: 215765 - DNA, 20 bp, Artificial
  CRISPR gRNA sequence
taaataaacaaatatgcaat

SEQ ID NO: 215766 - DNA, 20 bp, Artificial
  CRISPR gRNA sequence
aataaacaaatatgcaatga

SEQ ID NO: 215767 - DNA, 20 bp, Artificial
  CRISPR gRNA sequence
actagtctacaactctacag

SEQ ID NO: 215768 - DNA, 20 bp, Artificial
  CRISPR gRNA sequence
gtctacaactctacagccaa

SEQ ID NO: 215769 - DNA, 20 bp, Artificial
  CRISPR gRNA sequence
caactctacagccaaattaa

SEQ ID NO: 215770 - DNA, 20 bp, Artificial
  CRISPR gRNA sequence
tacagccaaattaattgtaa

SEQ ID NO: 215771 - DNA, 20 bp, Artificial
  CRISPR gRNA sequence
cagccaaattaattgtaaag

SEQ ID NO: 215772 - DNA, 20 bp, Artificial
  CRISPR gRNA sequence
attgtaaagctatcatttca

SEQ ID NO: 215773 - DNA, 20 bp, Artificial
  CRISPR gRNA sequence
taaagctatcatttcattat

SEQ ID NO: 215774 - DNA, 20 bp, Artificial
  CRISPR gRNA sequence
tcatttcattatgtagcctt

SEQ ID NO: 215775 - DNA, 20 bp, Artificial
  CRISPR gRNA sequence
cattatgtagcctttctgtg

SEQ ID NO: 215776 - DNA, 20 bp, Artificial
  CRISPR gRNA sequence
attatgtagcctttctgtgg

SEQ ID NO: 215777 - DNA, 20 bp, Artificial
  CRISPR gRNA sequence
tgtagcctttctgtggatca

SEQ ID NO: 215778 - DNA, 20 bp, Artificial
  CRISPR gRNA sequence
tctgtggatcatacccacag

SEQ ID NO: 215779 - DNA, 20 bp, Artificial
  CRISPR gRNA sequence
ctgtggatcatacccacagc

SEQ ID NO: 215780 - DNA, 20 bp, Artificial
  CRISPR gRNA sequence
tgtggatcatacccacagca

SEQ ID NO: 215781 - DNA, 20 bp, Artificial
  CRISPR gRNA sequence
tggatcatacccacagcatt

SEQ ID NO: 215782 - DNA, 20 bp, Artificial
  CRISPR gRNA sequence
acaaaggaaacagacttagt

SEQ ID NO: 215783 - DNA, 20 bp, Artificial
  CRISPR gRNA sequence
agttgggaaatcagatctag

SEQ ID NO: 215784 - DNA, 20 bp, Artificial
  CRISPR gRNA sequence
gttgggaaatcagatctagg

SEQ ID NO: 215785 - DNA, 20 bp, Artificial
  CRISPR gRNA sequence
ggaaatcagatctaggttta

SEQ ID NO: 215786 - DNA, 20 bp, Artificial
  CRISPR gRNA sequence
ggtttacaaagaaagaaaat

SEQ ID NO: 215787 - DNA, 20 bp, Artificial
  CRISPR gRNA sequence
acaaagaaagaaaatgagat

SEQ ID NO: 215788 - DNA, 20 bp, Artificial
  CRISPR gRNA sequence
caaagaaagaaaatgagatg

SEQ ID NO: 215789 - DNA, 20 bp, Artificial
  CRISPR gRNA sequence
tggtctatctctgtggcaat

SEQ ID NO: 215790 - DNA, 20 bp, Artificial
  CRISPR gRNA sequence
ggtctatctctgtggcaata

SEQ ID NO: 215791 - DNA, 20 bp, Artificial
  CRISPR gRNA sequence
gtctatctctgtggcaatag

SEQ ID NO: 215792 - DNA, 20 bp, Artificial
  CRISPR gRNA sequence
tctctgtggcaatagcctgt

SEQ ID NO: 215793 - DNA, 20 bp, Artificial
  CRISPR gRNA sequence
tgtggcaatagcctgtatct

SEQ ID NO: 215794 - DNA, 20 bp, Artificial
  CRISPR gRNA sequence
tggcaatagcctgtatcttt

SEQ ID NO: 215795 - DNA, 20 bp, Artificial
  CRISPR gRNA sequence
tatctttctaaaatgtgtac

SEQ ID NO: 215796 - DNA, 20 bp, Artificial
  CRISPR gRNA sequence
tctaaaatgtgtacatcaca

SEQ ID NO: 215797 - DNA, 20 bp, Artificial
  CRISPR gRNA sequence
ctaaaatgtgtacatcacaa

SEQ ID NO: 215798 - DNA, 20 bp, Artificial
  CRISPR gRNA sequence
taaaatgtgtacatcacaaa

SEQ ID NO: 215799 - DNA, 20 bp, Artificial
  CRISPR gRNA sequence
aaatgtgtacatcacaaatt

SEQ ID NO: 215800 - DNA, 20 bp, Artificial
  CRISPR gRNA sequence
gaagtaattgggatccttct

SEQ ID NO: 215801 - DNA, 20 bp, Artificial
  CRISPR gRNA sequence
ggatccttctctactagggg

SEQ ID NO: 215802 - DNA, 20 bp, Artificial
  CRISPR gRNA sequence
ctctactagggggtgccatg

SEQ ID NO: 215803 - DNA, 20 bp, Artificial
  CRISPR gRNA sequence
tctactagggggtgccatgc

SEQ ID NO: 215804 - DNA, 20 bp, Artificial
  CRISPR gRNA sequence
tactagggggtgccatgctt

SEQ ID NO: 215805 - DNA, 20 bp, Artificial
  CRISPR gRNA sequence
ctagggggtgccatgcttcg

SEQ ID NO: 215806 - DNA, 20 bp, Artificial
  CRISPR gRNA sequence
gggggtgccatgcttcgtct

SEQ ID NO: 215807 - DNA, 20 bp, Artificial
  CRISPR gRNA sequence
cgtctcaaccagtagcaaaa

SEQ ID NO: 215808 - DNA, 20 bp, Artificial
  CRISPR gRNA sequence
gtctcaaccagtagcaaaag

SEQ ID NO: 215809 - DNA, 20 bp, Artificial
  CRISPR gRNA sequence
aaccagtagcaaaaggcaac

SEQ ID NO: 215810 - DNA, 20 bp, Artificial
  CRISPR gRNA sequence
gcccaaatatcacttggtta

SEQ ID NO: 215811 - DNA, 20 bp, Artificial
  CRISPR gRNA sequence
cccaaatatcacttggttaa

SEQ ID NO: 215812 - DNA, 20 bp, Artificial
  CRISPR gRNA sequence
ggttaaggtaagcagctact

SEQ ID NO: 215813 - DNA, 20 bp, Artificial
  CRISPR gRNA sequence
gttaaggtaagcagctactt

SEQ ID NO: 215814 - DNA, 20 bp, Artificial
  CRISPR gRNA sequence
aggtaagcagctacttagac

SEQ ID NO: 215815 - DNA, 20 bp, Artificial
  CRISPR gRNA sequence
cttagacacagaatagtgca

SEQ ID NO: 215816 - DNA, 20 bp, Artificial
  CRISPR gRNA sequence
agacacagaatagtgcattt

SEQ ID NO: 215817 - DNA, 20 bp, Artificial
  CRISPR gRNA sequence
gacacagaatagtgcatttt

SEQ ID NO: 215818 - DNA, 20 bp, Artificial
  CRISPR gRNA sequence
ttcccagtggtgagaatatt

SEQ ID NO: 215819 - DNA, 20 bp, Artificial
  CRISPR gRNA sequence
tcccagtggtgagaatatta

SEQ ID NO: 215820 - DNA, 20 bp, Artificial
  CRISPR gRNA sequence
cccagtggtgagaatattat

SEQ ID NO: 215821 - DNA, 20 bp, Artificial
  CRISPR gRNA sequence
ccagtggtgagaatattata

SEQ ID NO: 215822 - DNA, 20 bp, Artificial
  CRISPR gRNA sequence
taaaagtaatattcataatt

SEQ ID NO: 215823 - DNA, 20 bp, Artificial
  CRISPR gRNA sequence
ataattcttttttatttttt

SEQ ID NO: 215824 - DNA, 20 bp, Artificial
  CRISPR gRNA sequence
ttttttattttttttgagac

SEQ ID NO: 215825 - DNA, 20 bp, Artificial
  CRISPR gRNA sequence
ttttattttttttgagacag

SEQ ID NO: 215826 - DNA, 20 bp, Artificial
  CRISPR gRNA sequence
tttattttttttgagacaga

SEQ ID NO: 215827 - DNA, 20 bp, Artificial
  CRISPR gRNA sequence
ttattttttttgagacagag

SEQ ID NO: 215828 - DNA, 20 bp, Artificial
  CRISPR gRNA sequence
tattttttttgagacagagt

SEQ ID NO: 215829 - DNA, 20 bp, Artificial
  CRISPR gRNA sequence
attttttttgagacagagtc

SEQ ID NO: 215830 - DNA, 20 bp, Artificial
  CRISPR gRNA sequence
ttttttttgagacagagtct

SEQ ID NO: 215831 - DNA, 20 bp, Artificial
  CRISPR gRNA sequence
tttttgagacagagtctcac

SEQ ID NO: 215832 - DNA, 20 bp, Artificial
  CRISPR gRNA sequence
ttttgagacagagtctcact

SEQ ID NO: 215833 - DNA, 20 bp, Artificial
  CRISPR gRNA sequence
tttgagacagagtctcactc

SEQ ID NO: 215834 - DNA, 20 bp, Artificial
  CRISPR gRNA sequence
ttgagacagagtctcactct

SEQ ID NO: 215835 - DNA, 20 bp, Artificial
  CRISPR gRNA sequence
tgagacagagtctcactctg

SEQ ID NO: 215836 - DNA, 20 bp, Artificial
  CRISPR gRNA sequence
gagacagagtctcactctgt

SEQ ID NO: 215837 - DNA, 20 bp, Artificial
  CRISPR gRNA sequence
agacagagtctcactctgtc

SEQ ID NO: 215838 - DNA, 20 bp, Artificial
  CRISPR gRNA sequence
actctgtcaccaggctggag

SEQ ID NO: 215839 - DNA, 20 bp, Artificial
  CRISPR gRNA sequence
tgtcaccaggctggagtgcg

SEQ ID NO: 215840 - DNA, 20 bp, Artificial
  CRISPR gRNA sequence
tcaccaggctggagtgcggt

SEQ ID NO: 215841 - DNA, 20 bp, Artificial
  CRISPR gRNA sequence
gagtgcggtggcatgatctc

SEQ ID NO: 215842 - DNA, 20 bp, Artificial
  CRISPR gRNA sequence
aactcactgcaacatctgcc

SEQ ID NO: 215843 - DNA, 20 bp, Artificial
  CRISPR gRNA sequence
actgcaacatctgccttccg

SEQ ID NO: 215844 - DNA, 20 bp, Artificial
  CRISPR gRNA sequence
caacatctgccttccgggtt

SEQ ID NO: 215845 - DNA, 20 bp, Artificial
  CRISPR gRNA sequence
ccttccgggttcaagcaatt

SEQ ID NO: 215846 - DNA, 20 bp, Artificial
  CRISPR gRNA sequence
ccgggttcaagcaattctcc

SEQ ID NO: 215847 - DNA, 20 bp, Artificial
  CRISPR gRNA sequence
cgggttcaagcaattctcct

SEQ ID NO: 215848 - DNA, 20 bp, Artificial
  CRISPR gRNA sequence
aagcaattctcctgcctcag

SEQ ID NO: 215849 - DNA, 20 bp, Artificial
  CRISPR gRNA sequence
tcctgcctcagcctcccgag

SEQ ID NO: 215850 - DNA, 20 bp, Artificial
  CRISPR gRNA sequence
ctgcctcagcctcccgagta

SEQ ID NO: 215851 - DNA, 20 bp, Artificial
  CRISPR gRNA sequence
cctcagcctcccgagtagct

SEQ ID NO: 215852 - DNA, 20 bp, Artificial
  CRISPR gRNA sequence
agcctcccgagtagctggga

SEQ ID NO: 215853 - DNA, 20 bp, Artificial
  CRISPR gRNA sequence
ccgagtagctgggactgcag

SEQ ID NO: 215854 - DNA, 20 bp, Artificial
  CRISPR gRNA sequence
ggactgcagatacacaccac

SEQ ID NO: 215855 - DNA, 20 bp, Artificial
  CRISPR gRNA sequence
cagatacacaccaccatgcc

SEQ ID NO: 215856 - DNA, 20 bp, Artificial
  CRISPR gRNA sequence
ttgtattttcagtagagaca

SEQ ID NO: 215857 - DNA, 20 bp, Artificial
  CRISPR gRNA sequence
tgtattttcagtagagacag

SEQ ID NO: 215858 - DNA, 20 bp, Artificial
  CRISPR gRNA sequence
gtattttcagtagagacagg

SEQ ID NO: 215859 - DNA, 20 bp, Artificial
  CRISPR gRNA sequence
tattttcagtagagacaggg

SEQ ID NO: 215860 - DNA, 20 bp, Artificial
  CRISPR gRNA sequence
tcagtagagacagggtttca

SEQ ID NO: 215861 - DNA, 20 bp, Artificial
  CRISPR gRNA sequence
cagtagagacagggtttcaa

SEQ ID NO: 215862 - DNA, 20 bp, Artificial
  CRISPR gRNA sequence
agtagagacagggtttcaac

SEQ ID NO: 215863 - DNA, 20 bp, Artificial
  CRISPR gRNA sequence
caacatgttggccaggatgg

SEQ ID NO: 215864 - DNA, 20 bp, Artificial
  CRISPR gRNA sequence
aacatgttggccaggatggt

SEQ ID NO: 215865 - DNA, 20 bp, Artificial
  CRISPR gRNA sequence
gccaggatggtctcaatctc

SEQ ID NO: 215866 - DNA, 20 bp, Artificial
  CRISPR gRNA sequence
aatctcttgacctcgtgatc

SEQ ID NO: 215867 - DNA, 20 bp, Artificial
  CRISPR gRNA sequence
ttgacctcgtgatctgcccg

SEQ ID NO: 215868 - DNA, 20 bp, Artificial
  CRISPR gRNA sequence
gacctcgtgatctgcccgcc

SEQ ID NO: 215869 - DNA, 20 bp, Artificial
  CRISPR gRNA sequence
acctcgtgatctgcccgcct

SEQ ID NO: 215870 - DNA, 20 bp, Artificial
  CRISPR gRNA sequence
gtgatctgcccgccttggcc

SEQ ID NO: 215871 - DNA, 20 bp, Artificial
  CRISPR gRNA sequence
cccgccttggcctcccaagg

SEQ ID NO: 215872 - DNA, 20 bp, Artificial
  CRISPR gRNA sequence
ggcctcccaaggtgccggga

SEQ ID NO: 215873 - DNA, 20 bp, Artificial
  CRISPR gRNA sequence
gcctcccaaggtgccgggat

SEQ ID NO: 215874 - DNA, 20 bp, Artificial
  CRISPR gRNA sequence
ccaaggtgccgggatcgcaa

SEQ ID NO: 215875 - DNA, 20 bp, Artificial
  CRISPR gRNA sequence
ttgatgaataatcaagagta

SEQ ID NO: 215876 - DNA, 20 bp, Artificial
  CRISPR gRNA sequence
gatgaataatcaagagtaga

SEQ ID NO: 215877 - DNA, 20 bp, Artificial
  CRISPR gRNA sequence
atgaataatcaagagtagag

SEQ ID NO: 215878 - DNA, 20 bp, Artificial
  CRISPR gRNA sequence
gattcttcctaaggcataga

SEQ ID NO: 215879 - DNA, 20 bp, Artificial
  CRISPR gRNA sequence
ttcctaaggcatagacaggg

SEQ ID NO: 215880 - DNA, 20 bp, Artificial
  CRISPR gRNA sequence
cctaaggcatagacagggca

SEQ ID NO: 215881 - DNA, 20 bp, Artificial
  CRISPR gRNA sequence
ctaaggcatagacagggcat

SEQ ID NO: 215882 - DNA, 20 bp, Artificial
  CRISPR gRNA sequence
aggcatagacagggcattct

SEQ ID NO: 215883 - DNA, 20 bp, Artificial
  CRISPR gRNA sequence
taactgttttgcgggccaga

SEQ ID NO: 215884 - DNA, 20 bp, Artificial
  CRISPR gRNA sequence
actgttttgcgggccagatc

SEQ ID NO: 215885 - DNA, 20 bp, Artificial
  CRISPR gRNA sequence
ttttgcgggccagatcaaat

SEQ ID NO: 215886 - DNA, 20 bp, Artificial
  CRISPR gRNA sequence
tgcgggccagatcaaattat

SEQ ID NO: 215887 - DNA, 20 bp, Artificial
  CRISPR gRNA sequence
gcgggccagatcaaattatg

SEQ ID NO: 215888 - DNA, 20 bp, Artificial
  CRISPR gRNA sequence
cgggccagatcaaattatga

SEQ ID NO: 215889 - DNA, 20 bp, Artificial
  CRISPR gRNA sequence
tgatctggtaaaggattaag

SEQ ID NO: 215890 - DNA, 20 bp, Artificial
  CRISPR gRNA sequence
gtaaaggattaagagtgaaa

SEQ ID NO: 215891 - DNA, 20 bp, Artificial
  CRISPR gRNA sequence
agagtgaaataaccacatac

SEQ ID NO: 215892 - DNA, 20 bp, Artificial
  CRISPR gRNA sequence
aggggttcctctacagcttt

SEQ ID NO: 215893 - DNA, 20 bp, Artificial
  CRISPR gRNA sequence
ctctacagctttctgaaaaa

SEQ ID NO: 215894 - DNA, 20 bp, Artificial
  CRISPR gRNA sequence
tacagctttctgaaaaatat

SEQ ID NO: 215895 - DNA, 20 bp, Artificial
  CRISPR gRNA sequence
cagctttctgaaaaatattt

SEQ ID NO: 215896 - DNA, 20 bp, Artificial
  CRISPR gRNA sequence
tctgaaaaatatttaaaata

SEQ ID NO: 215897 - DNA, 20 bp, Artificial
  CRISPR gRNA sequence
ctgaaaaatatttaaaatat

SEQ ID NO: 215898 - DNA, 20 bp, Artificial
  CRISPR gRNA sequence
tgaaaaatatttaaaatata

SEQ ID NO: 215899 - DNA, 20 bp, Artificial
  CRISPR gRNA sequence
aaaaatatttaaaatatatt

SEQ ID NO: 215900 - DNA, 20 bp, Artificial
  CRISPR gRNA sequence
aaaatatatttacataaaaa

SEQ ID NO: 215901 - DNA, 20 bp, Artificial
  CRISPR gRNA sequence
aaatatatttacataaaaat

SEQ ID NO: 215902 - DNA, 20 bp, Artificial
  CRISPR gRNA sequence
acataaaaatataatttatg

SEQ ID NO: 215903 - DNA, 20 bp, Artificial
  CRISPR gRNA sequence
cataaaaatataatttatgt

SEQ ID NO: 215904 - DNA, 20 bp, Artificial
  CRISPR gRNA sequence
atgtcatgtcattttatagt

SEQ ID NO: 215905 - DNA, 20 bp, Artificial
  CRISPR gRNA sequence
tgtcatgtcattttatagta

SEQ ID NO: 215906 - DNA, 20 bp, Artificial
  CRISPR gRNA sequence
tatagtaaaacttatatatg

SEQ ID NO: 215907 - DNA, 20 bp, Artificial
  CRISPR gRNA sequence
atagtaaaacttatatatgc

SEQ ID NO: 215908 - DNA, 20 bp, Artificial
  CRISPR gRNA sequence
tagtaaaacttatatatgct

SEQ ID NO: 215909 - DNA, 20 bp, Artificial
  CRISPR gRNA sequence
atatatgctaatatttaaat

SEQ ID NO: 215910 - DNA, 20 bp, Artificial
  CRISPR gRNA sequence
tatatgctaatatttaaatt

SEQ ID NO: 215911 - DNA, 20 bp, Artificial
  CRISPR gRNA sequence
atatttaaattacgtagtaa

SEQ ID NO: 215912 - DNA, 20 bp, Artificial
  CRISPR gRNA sequence
aaattacgtagtaagcagta

SEQ ID NO: 215913 - DNA, 20 bp, Artificial
  CRISPR gRNA sequence
aattacgtagtaagcagtaa

SEQ ID NO: 215914 - DNA, 20 bp, Artificial
  CRISPR gRNA sequence
cgtagtaagcagtaaatcct

SEQ ID NO: 215915 - DNA, 20 bp, Artificial
  CRISPR gRNA sequence
cagtcaaaaaaaaaagaaaa

SEQ ID NO: 215916 - DNA, 20 bp, Artificial
  CRISPR gRNA sequence
taaatgttaaagcaaagctt

SEQ ID NO: 215917 - DNA, 20 bp, Artificial
  CRISPR gRNA sequence
aagcaaagcttgccaagtcg

SEQ ID NO: 215918 - DNA, 20 bp, Artificial
  CRISPR gRNA sequence
gccaagtcgggttaatagtt

SEQ ID NO: 215919 - DNA, 20 bp, Artificial
  CRISPR gRNA sequence
ccaagtcgggttaatagttt

SEQ ID NO: 215920 - DNA, 20 bp, Artificial
  CRISPR gRNA sequence
atagtttaataataactgta

SEQ ID NO: 215921 - DNA, 20 bp, Artificial
  CRISPR gRNA sequence
aataataactgtattattct

SEQ ID NO: 215922 - DNA, 20 bp, Artificial
  CRISPR gRNA sequence
ataataactgtattattctc

SEQ ID NO: 215923 - DNA, 20 bp, Artificial
  CRISPR gRNA sequence
tattattctcttaatattat

SEQ ID NO: 215924 - DNA, 20 bp, Artificial
  CRISPR gRNA sequence
ttctcttaatattatttttc

SEQ ID NO: 215925 - DNA, 20 bp, Artificial
  CRISPR gRNA sequence
tcttaatattatttttctaa

SEQ ID NO: 215926 - DNA, 20 bp, Artificial
  CRISPR gRNA sequence
ttaatattatttttctaaac

SEQ ID NO: 215927 - DNA, 20 bp, Artificial
  CRISPR gRNA sequence
aatattatttttctaaacag

SEQ ID NO: 215928 - DNA, 20 bp, Artificial
  CRISPR gRNA sequence
atattatttttctaaacaga

SEQ ID NO: 215929 - DNA, 20 bp, Artificial
  CRISPR gRNA sequence
tttttctaaacagaatttcc

SEQ ID NO: 215930 - DNA, 20 bp, Artificial
  CRISPR gRNA sequence
ttctaaacagaatttcccac

SEQ ID NO: 215931 - DNA, 20 bp, Artificial
  CRISPR gRNA sequence
tctaaacagaatttcccact

SEQ ID NO: 215932 - DNA, 20 bp, Artificial
  CRISPR gRNA sequence
ctaaacagaatttcccactt

SEQ ID NO: 215933 - DNA, 20 bp, Artificial
  CRISPR gRNA sequence
taaacagaatttcccacttc

SEQ ID NO: 215934 - DNA, 20 bp, Artificial
  CRISPR gRNA sequence
aacagaatttcccacttcac

SEQ ID NO: 215935 - DNA, 20 bp, Artificial
  CRISPR gRNA sequence
cccacttcaccactctcagc

SEQ ID NO: 215936 - DNA, 20 bp, Artificial
  CRISPR gRNA sequence
ccacttcaccactctcagct

SEQ ID NO: 215937 - DNA, 20 bp, Artificial
  CRISPR gRNA sequence
caccactctcagctcaagaa

SEQ ID NO: 215938 - DNA, 20 bp, Artificial
  CRISPR gRNA sequence
accactctcagctcaagaaa

SEQ ID NO: 215939 - DNA, 20 bp, Artificial
  CRISPR gRNA sequence
tcagctcaagaaattctaac

SEQ ID NO: 215940 - DNA, 20 bp, Artificial
  CRISPR gRNA sequence
agctcaagaaattctaactt

SEQ ID NO: 215941 - DNA, 20 bp, Artificial
  CRISPR gRNA sequence
aagaaattctaacttctaaa

SEQ ID NO: 215942 - DNA, 20 bp, Artificial
  CRISPR gRNA sequence
taacttctaaaaatatgaaa

SEQ ID NO: 215943 - DNA, 20 bp, Artificial
  CRISPR gRNA sequence
acttctaaaaatatgaaagt

SEQ ID NO: 215944 - DNA, 20 bp, Artificial
  CRISPR gRNA sequence
ctaaaaatatgaaagtgcaa

SEQ ID NO: 215945 - DNA, 20 bp, Artificial
  CRISPR gRNA sequence
taaaaatatgaaagtgcaag

SEQ ID NO: 215946 - DNA, 20 bp, Artificial
  CRISPR gRNA sequence
aaaatatgaaagtgcaagca

SEQ ID NO: 215947 - DNA, 20 bp, Artificial
  CRISPR gRNA sequence
taagtatcgcaaattgaact

SEQ ID NO: 215948 - DNA, 20 bp, Artificial
  CRISPR gRNA sequence
aagtatcgcaaattgaactc

SEQ ID NO: 215949 - DNA, 20 bp, Artificial
  CRISPR gRNA sequence
agtatcgcaaattgaactca

SEQ ID NO: 215950 - DNA, 20 bp, Artificial
  CRISPR gRNA sequence
aactcagtaactgggaaaga

SEQ ID NO: 215951 - DNA, 20 bp, Artificial
  CRISPR gRNA sequence
agtaactgggaaagaaaatg

SEQ ID NO: 215952 - DNA, 20 bp, Artificial
  CRISPR gRNA sequence
ggaaagaaaatgtgttagga

SEQ ID NO: 215953 - DNA, 20 bp, Artificial
  CRISPR gRNA sequence
ggattcacaggtccagttaa

SEQ ID NO: 215954 - DNA, 20 bp, Artificial
  CRISPR gRNA sequence
acaggtccagttaagttgct

SEQ ID NO: 215955 - DNA, 20 bp, Artificial
  CRISPR gRNA sequence
agttgctggcctcttgtgac

SEQ ID NO: 215956 - DNA, 20 bp, Artificial
  CRISPR gRNA sequence
ctggcctcttgtgaccaaca

SEQ ID NO: 215957 - DNA, 20 bp, Artificial
  CRISPR gRNA sequence
gcctcttgtgaccaacatag

SEQ ID NO: 215958 - DNA, 20 bp, Artificial
  CRISPR gRNA sequence
ttgtgaccaacatagctatg

SEQ ID NO: 215959 - DNA, 20 bp, Artificial
  CRISPR gRNA sequence
gtgaccaacatagctatggc

SEQ ID NO: 215960 - DNA, 20 bp, Artificial
  CRISPR gRNA sequence
tgaccaacatagctatggca

SEQ ID NO: 215961 - DNA, 20 bp, Artificial
  CRISPR gRNA sequence
tggcaccaatctttctagaa

SEQ ID NO: 215962 - DNA, 20 bp, Artificial
  CRISPR gRNA sequence
tctagaatatacccctgtgg

SEQ ID NO: 215963 - DNA, 20 bp, Artificial
  CRISPR gRNA sequence
ctagaatatacccctgtggt

SEQ ID NO: 215964 - DNA, 20 bp, Artificial
  CRISPR gRNA sequence
tagaatatacccctgtggta

SEQ ID NO: 215965 - DNA, 20 bp, Artificial
  CRISPR gRNA sequence
gaatatacccctgtggtaga

SEQ ID NO: 215966 - DNA, 20 bp, Artificial
  CRISPR gRNA sequence
tggtagacacacatacccgc

SEQ ID NO: 215967 - DNA, 20 bp, Artificial
  CRISPR gRNA sequence
ccctttaggcacaatgaggc

SEQ ID NO: 215968 - DNA, 20 bp, Artificial
  CRISPR gRNA sequence
taggcacaatgaggcttgtc

SEQ ID NO: 215969 - DNA, 20 bp, Artificial
  CRISPR gRNA sequence
aggcacaatgaggcttgtca

SEQ ID NO: 215970 - DNA, 20 bp, Artificial
  CRISPR gRNA sequence
ggcacaatgaggcttgtcag

SEQ ID NO: 215971 - DNA, 20 bp, Artificial
  CRISPR gRNA sequence
gtcagacttagaagcatatg

SEQ ID NO: 215972 - DNA, 20 bp, Artificial
  CRISPR gRNA sequence
tcagacttagaagcatatgt

SEQ ID NO: 215973 - DNA, 20 bp, Artificial
  CRISPR gRNA sequence
agaagcatatgtgacctcta

SEQ ID NO: 215974 - DNA, 20 bp, Artificial
  CRISPR gRNA sequence
gaagcatatgtgacctctac

SEQ ID NO: 215975 - DNA, 20 bp, Artificial
  CRISPR gRNA sequence
tacctccggccacagacaga

SEQ ID NO: 215976 - DNA, 20 bp, Artificial
  CRISPR gRNA sequence
cctccggccacagacagaag

SEQ ID NO: 215977 - DNA, 20 bp, Artificial
  CRISPR gRNA sequence
cggccacagacagaagactc

SEQ ID NO: 215978 - DNA, 20 bp, Artificial
  CRISPR gRNA sequence
tctttggcattccagataca

SEQ ID NO: 215979 - DNA, 20 bp, Artificial
  CRISPR gRNA sequence
tttggcattccagatacatc

SEQ ID NO: 215980 - DNA, 20 bp, Artificial
  CRISPR gRNA sequence
tggcattccagatacatcta

SEQ ID NO: 215981 - DNA, 20 bp, Artificial
  CRISPR gRNA sequence
ggcattccagatacatctat

SEQ ID NO: 215982 - DNA, 20 bp, Artificial
  CRISPR gRNA sequence
gcattccagatacatctatc

SEQ ID NO: 215983 - DNA, 20 bp, Artificial
  CRISPR gRNA sequence
cagatacatctatcatcact

SEQ ID NO: 215984 - DNA, 20 bp, Artificial
  CRISPR gRNA sequence
tcatcactccgttataggaa

SEQ ID NO: 215985 - DNA, 20 bp, Artificial
  CRISPR gRNA sequence
cgttataggaagctaagtac

SEQ ID NO: 215986 - DNA, 20 bp, Artificial
  CRISPR gRNA sequence
taggaagctaagtacaatat

SEQ ID NO: 215987 - DNA, 20 bp, Artificial
  CRISPR gRNA sequence
agtacaatataatcctttcc

SEQ ID NO: 215988 - DNA, 20 bp, Artificial
  CRISPR gRNA sequence
tccagagcttatgtccacaa

SEQ ID NO: 215989 - DNA, 20 bp, Artificial
  CRISPR gRNA sequence
ccagagcttatgtccacaac

SEQ ID NO: 215990 - DNA, 20 bp, Artificial
  CRISPR gRNA sequence
cagagcttatgtccacaaca

SEQ ID NO: 215991 - DNA, 20 bp, Artificial
  CRISPR gRNA sequence
atgtccacaacatacctctt

SEQ ID NO: 215992 - DNA, 20 bp, Artificial
  CRISPR gRNA sequence
tgtccacaacatacctcttg

SEQ ID NO: 215993 - DNA, 20 bp, Artificial
  CRISPR gRNA sequence
ttgggcctgtcactgtgata

SEQ ID NO: 215994 - DNA, 20 bp, Artificial
  CRISPR gRNA sequence
gggcctgtcactgtgataag

SEQ ID NO: 215995 - DNA, 20 bp, Artificial
  CRISPR gRNA sequence
ggcctgtcactgtgataagt

SEQ ID NO: 215996 - DNA, 20 bp, Artificial
  CRISPR gRNA sequence
tcactgtgataagtctatgt

SEQ ID NO: 215997 - DNA, 20 bp, Artificial
  CRISPR gRNA sequence
tgataagtctatgtttataa

SEQ ID NO: 215998 - DNA, 20 bp, Artificial
  CRISPR gRNA sequence
tgtttataaatatgcttttc

SEQ ID NO: 215999 - DNA, 20 bp, Artificial
  CRISPR gRNA sequence
ataaatatgcttttctcttc

SEQ ID NO: 216000 - DNA, 20 bp, Artificial
  CRISPR gRNA sequence
taaatatgcttttctcttca

SEQ ID NO: 216001 - DNA, 20 bp, Artificial
  CRISPR gRNA sequence
ttctcttcatttatgccctc

SEQ ID NO: 216002 - DNA, 20 bp, Artificial
  CRISPR gRNA sequence
tctcttcatttatgccctcc

SEQ ID NO: 216003 - DNA, 20 bp, Artificial
  CRISPR gRNA sequence
ctcttcatttatgccctcct

SEQ ID NO: 216004 - DNA, 20 bp, Artificial
  CRISPR gRNA sequence
tcttcatttatgccctccta

SEQ ID NO: 216005 - DNA, 20 bp, Artificial
  CRISPR gRNA sequence
ttcatttatgccctcctaaa

SEQ ID NO: 216006 - DNA, 20 bp, Artificial
  CRISPR gRNA sequence
catttatgccctcctaaaat

SEQ ID NO: 216007 - DNA, 20 bp, Artificial
  CRISPR gRNA sequence
atttatgccctcctaaaatt

SEQ ID NO: 216008 - DNA, 20 bp, Artificial
  CRISPR gRNA sequence
atgccctcctaaaattactc

SEQ ID NO: 216009 - DNA, 20 bp, Artificial
  CRISPR gRNA sequence
tgccctcctaaaattactcc

SEQ ID NO: 216010 - DNA, 20 bp, Artificial
  CRISPR gRNA sequence
ctaaaattactcctttcttg

SEQ ID NO: 216011 - DNA, 20 bp, Artificial
  CRISPR gRNA sequence
aaattactcctttcttgcaa

SEQ ID NO: 216012 - DNA, 20 bp, Artificial
  CRISPR gRNA sequence
ctcctttcttgcaatttcct

SEQ ID NO: 216013 - DNA, 20 bp, Artificial
  CRISPR gRNA sequence
ctttcttgcaatttcctcag

SEQ ID NO: 216014 - DNA, 20 bp, Artificial
  CRISPR gRNA sequence
tcttgcaatttcctcagatg

SEQ ID NO: 216015 - DNA, 20 bp, Artificial
  CRISPR gRNA sequence
cttgcaatttcctcagatgg

SEQ ID NO: 216016 - DNA, 20 bp, Artificial
  CRISPR gRNA sequence
ttgcaatttcctcagatggc

SEQ ID NO: 216017 - DNA, 20 bp, Artificial
  CRISPR gRNA sequence
gcaatttcctcagatggctt

SEQ ID NO: 216018 - DNA, 20 bp, Artificial
  CRISPR gRNA sequence
caatttcctcagatggctta

SEQ ID NO: 216019 - DNA, 20 bp, Artificial
  CRISPR gRNA sequence
cctcagatggcttaataagg

SEQ ID NO: 216020 - DNA, 20 bp, Artificial
  CRISPR gRNA sequence
ctcagatggcttaataaggt

SEQ ID NO: 216021 - DNA, 20 bp, Artificial
  CRISPR gRNA sequence
agatggcttaataaggtatc

SEQ ID NO: 216022 - DNA, 20 bp, Artificial
  CRISPR gRNA sequence
aataaggtatctaaggtaca

SEQ ID NO: 216023 - DNA, 20 bp, Artificial
  CRISPR gRNA sequence
ataaggtatctaaggtacaa

SEQ ID NO: 216024 - DNA, 20 bp, Artificial
  CRISPR gRNA sequence
aggtacaatgaaaccttaag

SEQ ID NO: 216025 - DNA, 20 bp, Artificial
  CRISPR gRNA sequence
aagcacagttttaagggaaa

SEQ ID NO: 216026 - DNA, 20 bp, Artificial
  CRISPR gRNA sequence
agcacagttttaagggaaaa

SEQ ID NO: 216027 - DNA, 20 bp, Artificial
  CRISPR gRNA sequence
taagggaaaaaatgtttata

SEQ ID NO: 216028 - DNA, 20 bp, Artificial
  CRISPR gRNA sequence
aagggaaaaaatgtttataa

SEQ ID NO: 216029 - DNA, 20 bp, Artificial
  CRISPR gRNA sequence
agggaaaaaatgtttataaa

SEQ ID NO: 216030 - DNA, 20 bp, Artificial
  CRISPR gRNA sequence
ataaaacatttgtatgggag

SEQ ID NO: 216031 - DNA, 20 bp, Artificial
  CRISPR gRNA sequence
taaaacatttgtatgggaga

SEQ ID NO: 216032 - DNA, 20 bp, Artificial
  CRISPR gRNA sequence
gtatgggagaggatcgaatc

SEQ ID NO: 216033 - DNA, 20 bp, Artificial
  CRISPR gRNA sequence
tatgggagaggatcgaatca

SEQ ID NO: 216034 - DNA, 20 bp, Artificial
  CRISPR gRNA sequence
cgaacagatgttttcagcaa

SEQ ID NO: 216035 - DNA, 20 bp, Artificial
  CRISPR gRNA sequence
tcagcaatatttacatttat

SEQ ID NO: 216036 - DNA, 20 bp, Artificial
  CRISPR gRNA sequence
cagcaatatttacatttatt

SEQ ID NO: 216037 - DNA, 20 bp, Artificial
  CRISPR gRNA sequence
agcaatatttacatttattt

SEQ ID NO: 216038 - DNA, 20 bp, Artificial
  CRISPR gRNA sequence
acatttattttatagattat

SEQ ID NO: 216039 - DNA, 20 bp, Artificial
  CRISPR gRNA sequence
catttattttatagattata

SEQ ID NO: 216040 - DNA, 20 bp, Artificial
  CRISPR gRNA sequence
attttatagattataattat

SEQ ID NO: 216041 - DNA, 20 bp, Artificial
  CRISPR gRNA sequence
ttttatagattataattatc

SEQ ID NO: 216042 - DNA, 20 bp, Artificial
  CRISPR gRNA sequence
tatagattataattatcagt

SEQ ID NO: 216043 - DNA, 20 bp, Artificial
  CRISPR gRNA sequence
atagattataattatcagtg

SEQ ID NO: 216044 - DNA, 20 bp, Artificial
  CRISPR gRNA sequence
tagattataattatcagtga

SEQ ID NO: 216045 - DNA, 20 bp, Artificial
  CRISPR gRNA sequence
taattatcagtgatgtcaac

SEQ ID NO: 216046 - DNA, 20 bp, Artificial
  CRISPR gRNA sequence
tcagtgatgtcaacttagta

SEQ ID NO: 216047 - DNA, 20 bp, Artificial
  CRISPR gRNA sequence
agtatagatttctcctcatt

SEQ ID NO: 216048 - DNA, 20 bp, Artificial
  CRISPR gRNA sequence
gtatagatttctcctcattt

SEQ ID NO: 216049 - DNA, 20 bp, Artificial
  CRISPR gRNA sequence
ctcctcatttttaagcctga

SEQ ID NO: 216050 - DNA, 20 bp, Artificial
  CRISPR gRNA sequence
tcctcatttttaagcctgaa

SEQ ID NO: 216051 - DNA, 20 bp, Artificial
  CRISPR gRNA sequence
ctcatttttaagcctgaaat

SEQ ID NO: 216052 - DNA, 20 bp, Artificial
  CRISPR gRNA sequence
atttttaagcctgaaattgt

SEQ ID NO: 216053 - DNA, 20 bp, Artificial
  CRISPR gRNA sequence
ttaagcctgaaattgtcatt

SEQ ID NO: 216054 - DNA, 20 bp, Artificial
  CRISPR gRNA sequence
taagcctgaaattgtcattc

SEQ ID NO: 216055 - DNA, 20 bp, Artificial
  CRISPR gRNA sequence
aagcctgaaattgtcattct

SEQ ID NO: 216056 - DNA, 20 bp, Artificial
  CRISPR gRNA sequence
agcctgaaattgtcattctg

SEQ ID NO: 216057 - DNA, 20 bp, Artificial
  CRISPR gRNA sequence
aaattgtcattctgtgtatg

SEQ ID NO: 216058 - DNA, 20 bp, Artificial
  CRISPR gRNA sequence
tcattctgtgtatgcacatc

SEQ ID NO: 216059 - DNA, 20 bp, Artificial
  CRISPR gRNA sequence
tgtgtatgcacatccaatga

SEQ ID NO: 216060 - DNA, 20 bp, Artificial
  CRISPR gRNA sequence
tgtatgcacatccaatgaat

SEQ ID NO: 216061 - DNA, 20 bp, Artificial
  CRISPR gRNA sequence
gaatcagcttccttctgatt

SEQ ID NO: 216062 - DNA, 20 bp, Artificial
  CRISPR gRNA sequence
ccttctgattgcagagataa

SEQ ID NO: 216063 - DNA, 20 bp, Artificial
  CRISPR gRNA sequence
cttctgattgcagagataat

SEQ ID NO: 216064 - DNA, 20 bp, Artificial
  CRISPR gRNA sequence
ctgattgcagagataatata

SEQ ID NO: 216065 - DNA, 20 bp, Artificial
  CRISPR gRNA sequence
tgattgcagagataatatag

SEQ ID NO: 216066 - DNA, 20 bp, Artificial
  CRISPR gRNA sequence
attgcagagataatatagcc

SEQ ID NO: 216067 - DNA, 20 bp, Artificial
  CRISPR gRNA sequence
cagagataatatagccatta

SEQ ID NO: 216068 - DNA, 20 bp, Artificial
  CRISPR gRNA sequence
ttcctactttccagttttgg

SEQ ID NO: 216069 - DNA, 20 bp, Artificial
  CRISPR gRNA sequence
ctactttccagttttgggtg

SEQ ID NO: 216070 - DNA, 20 bp, Artificial
  CRISPR gRNA sequence
ctttccagttttgggtgtga

SEQ ID NO: 216071 - DNA, 20 bp, Artificial
  CRISPR gRNA sequence
tccagttttgggtgtgagaa

SEQ ID NO: 216072 - DNA, 20 bp, Artificial
  CRISPR gRNA sequence
ccagttttgggtgtgagaag

SEQ ID NO: 216073 - DNA, 20 bp, Artificial
  CRISPR gRNA sequence
cagttttgggtgtgagaagt

SEQ ID NO: 216074 - DNA, 20 bp, Artificial
  CRISPR gRNA sequence
tgggtgtgagaagtcagtac

SEQ ID NO: 216075 - DNA, 20 bp, Artificial
  CRISPR gRNA sequence
gggtgtgagaagtcagtaca

SEQ ID NO: 216076 - DNA, 20 bp, Artificial
  CRISPR gRNA sequence
ggtgtgagaagtcagtacaa

SEQ ID NO: 216077 - DNA, 20 bp, Artificial
  CRISPR gRNA sequence
aagaaatcatttattccatc

SEQ ID NO: 216078 - DNA, 20 bp, Artificial
  CRISPR gRNA sequence
agaaatcatttattccatcc

SEQ ID NO: 216079 - DNA, 20 bp, Artificial
  CRISPR gRNA sequence
attccatcccattgacacta

SEQ ID NO: 216080 - DNA, 20 bp, Artificial
  CRISPR gRNA sequence
ttccatcccattgacactaa

SEQ ID NO: 216081 - DNA, 20 bp, Artificial
  CRISPR gRNA sequence
catcccattgacactaaaat

SEQ ID NO: 216082 - DNA, 20 bp, Artificial
  CRISPR gRNA sequence
acactaaaatgaccaaacac

SEQ ID NO: 216083 - DNA, 20 bp, Artificial
  CRISPR gRNA sequence
aaatgaccaaacacaggttt

SEQ ID NO: 216084 - DNA, 20 bp, Artificial
  CRISPR gRNA sequence
taaaatagaactggacccat

SEQ ID NO: 216085 - DNA, 20 bp, Artificial
  CRISPR gRNA sequence
aaaatagaactggacccatt

SEQ ID NO: 216086 - DNA, 20 bp, Artificial
  CRISPR gRNA sequence
aaatagaactggacccattc

SEQ ID NO: 216087 - DNA, 20 bp, Artificial
  CRISPR gRNA sequence
gacccattcatgcaaaggtc

SEQ ID NO: 216088 - DNA, 20 bp, Artificial
  CRISPR gRNA sequence
atgcaaaggtcatgcaatga

SEQ ID NO: 216089 - DNA, 20 bp, Artificial
  CRISPR gRNA sequence
caacattctcttaatttgac

SEQ ID NO: 216090 - DNA, 20 bp, Artificial
  CRISPR gRNA sequence
aacattctcttaatttgacg

SEQ ID NO: 216091 - DNA, 20 bp, Artificial
  CRISPR gRNA sequence
tcttaatttgacgtgagaca

SEQ ID NO: 216092 - DNA, 20 bp, Artificial
  CRISPR gRNA sequence
ttaatttgacgtgagacaaa

SEQ ID NO: 216093 - DNA, 20 bp, Artificial
  CRISPR gRNA sequence
aatttgacgtgagacaaaac

SEQ ID NO: 216094 - DNA, 20 bp, Artificial
  CRISPR gRNA sequence
atttgacgtgagacaaaaca

SEQ ID NO: 216095 - DNA, 20 bp, Artificial
  CRISPR gRNA sequence
gacgtgagacaaaacagata

SEQ ID NO: 216096 - DNA, 20 bp, Artificial
  CRISPR gRNA sequence
acgtgagacaaaacagatag

SEQ ID NO: 216097 - DNA, 20 bp, Artificial
  CRISPR gRNA sequence
aattaccaagttcctcagtc

SEQ ID NO: 216098 - DNA, 20 bp, Artificial
  CRISPR gRNA sequence
ccaagttcctcagtctaatc

SEQ ID NO: 216099 - DNA, 20 bp, Artificial
  CRISPR gRNA sequence
ctcagtctaatccctcaaat

SEQ ID NO: 216100 - DNA, 20 bp, Artificial
  CRISPR gRNA sequence
agtctaatccctcaaatgat

SEQ ID NO: 216101 - DNA, 20 bp, Artificial
  CRISPR gRNA sequence
atccctcaaatgatcattca

SEQ ID NO: 216102 - DNA, 20 bp, Artificial
  CRISPR gRNA sequence
aaatgatcattcacaattca

SEQ ID NO: 216103 - DNA, 20 bp, Artificial
  CRISPR gRNA sequence
acaattcatttaataaactt

SEQ ID NO: 216104 - DNA, 20 bp, Artificial
  CRISPR gRNA sequence
atttaataaactttaactta

SEQ ID NO: 216105 - DNA, 20 bp, Artificial
  CRISPR gRNA sequence
aataaactttaacttaccct

SEQ ID NO: 216106 - DNA, 20 bp, Artificial
  CRISPR gRNA sequence
ataaactttaacttacccta

SEQ ID NO: 216107 - DNA, 20 bp, Artificial
  CRISPR gRNA sequence
taacttaccctaggaggttg

SEQ ID NO: 216108 - DNA, 20 bp, Artificial
  CRISPR gRNA sequence
aacttaccctaggaggttgt

SEQ ID NO: 216109 - DNA, 20 bp, Artificial
  CRISPR gRNA sequence
acttaccctaggaggttgta

SEQ ID NO: 216110 - DNA, 20 bp, Artificial
  CRISPR gRNA sequence
accctaggaggttgtatagt

SEQ ID NO: 216111 - DNA, 20 bp, Artificial
  CRISPR gRNA sequence
ccctaggaggttgtatagtc

SEQ ID NO: 216112 - DNA, 20 bp, Artificial
  CRISPR gRNA sequence
ggaggttgtatagtcttctg

SEQ ID NO: 216113 - DNA, 20 bp, Artificial
  CRISPR gRNA sequence
tatagtcttctgattggaag

SEQ ID NO: 216114 - DNA, 20 bp, Artificial
  CRISPR gRNA sequence
ctgattggaagctgatataa

SEQ ID NO: 216115 - DNA, 20 bp, Artificial
  CRISPR gRNA sequence
tgattggaagctgatataaa

SEQ ID NO: 216116 - DNA, 20 bp, Artificial
  CRISPR gRNA sequence
attggaagctgatataaata

SEQ ID NO: 216117 - DNA, 20 bp, Artificial
  CRISPR gRNA sequence
gaagctgatataaataacaa

SEQ ID NO: 216118 - DNA, 20 bp, Artificial
  CRISPR gRNA sequence
atataaataacaaataagaa

SEQ ID NO: 216119 - DNA, 20 bp, Artificial
  CRISPR gRNA sequence
aataaatgaaataaactaag

SEQ ID NO: 216120 - DNA, 20 bp, Artificial
  CRISPR gRNA sequence
ataaatgaaataaactaagg

SEQ ID NO: 216121 - DNA, 20 bp, Artificial
  CRISPR gRNA sequence
aggcatttggtaatgtttaa

SEQ ID NO: 216122 - DNA, 20 bp, Artificial
  CRISPR gRNA sequence
ggtaatgtttaattttaaga

SEQ ID NO: 216123 - DNA, 20 bp, Artificial
  CRISPR gRNA sequence
gtaatgtttaattttaagat

SEQ ID NO: 216124 - DNA, 20 bp, Artificial
  CRISPR gRNA sequence
aattttaagataaaatgttc

SEQ ID NO: 216125 - DNA, 20 bp, Artificial
  CRISPR gRNA sequence
attttaagataaaatgttca

SEQ ID NO: 216126 - DNA, 20 bp, Artificial
  CRISPR gRNA sequence
taagataaaatgttcagggc

SEQ ID NO: 216127 - DNA, 20 bp, Artificial
  CRISPR gRNA sequence
aagataaaatgttcagggct

SEQ ID NO: 216128 - DNA, 20 bp, Artificial
  CRISPR gRNA sequence
agataaaatgttcagggcta

SEQ ID NO: 216129 - DNA, 20 bp, Artificial
  CRISPR gRNA sequence
agggctaaaactaaaggtgc

SEQ ID NO: 216130 - DNA, 20 bp, Artificial
  CRISPR gRNA sequence
aaactaaaggtgccagagat

SEQ ID NO: 216131 - DNA, 20 bp, Artificial
  CRISPR gRNA sequence
aaggtgccagagatgttaat

SEQ ID NO: 216132 - DNA, 20 bp, Artificial
  CRISPR gRNA sequence
atgaaagagttccagctctg

SEQ ID NO: 216133 - DNA, 20 bp, Artificial
  CRISPR gRNA sequence
cagctctgacagtctattca

SEQ ID NO: 216134 - DNA, 20 bp, Artificial
  CRISPR gRNA sequence
tgacagtctattcaaacatg

SEQ ID NO: 216135 - DNA, 20 bp, Artificial
  CRISPR gRNA sequence
acagtctattcaaacatgct

SEQ ID NO: 216136 - DNA, 20 bp, Artificial
  CRISPR gRNA sequence
ttcaaacatgctgaatattc

SEQ ID NO: 216137 - DNA, 20 bp, Artificial
  CRISPR gRNA sequence
aaacatgctgaatattcttg

SEQ ID NO: 216138 - DNA, 20 bp, Artificial
  CRISPR gRNA sequence
aatattcttgattatataca

SEQ ID NO: 216139 - DNA, 20 bp, Artificial
  CRISPR gRNA sequence
ttgattatatacactgattt

SEQ ID NO: 216140 - DNA, 20 bp, Artificial
  CRISPR gRNA sequence
gattatatacactgatttga

SEQ ID NO: 216141 - DNA, 20 bp, Artificial
  CRISPR gRNA sequence
attatatacactgatttgaa

SEQ ID NO: 216142 - DNA, 20 bp, Artificial
  CRISPR gRNA sequence
tatacactgatttgaaaaat

SEQ ID NO: 216143 - DNA, 20 bp, Artificial
  CRISPR gRNA sequence
atttgaaaaatgaagcaaat

SEQ ID NO: 216144 - DNA, 20 bp, Artificial
  CRISPR gRNA sequence
gaaaaatgaagcaaataacc

SEQ ID NO: 216145 - DNA, 20 bp, Artificial
  CRISPR gRNA sequence
aaaaatgaagcaaataaccc

SEQ ID NO: 216146 - DNA, 20 bp, Artificial
  CRISPR gRNA sequence
catcaaatagtaaacacatt

SEQ ID NO: 216147 - DNA, 20 bp, Artificial
  CRISPR gRNA sequence
tctcatttgtttatgccatc

SEQ ID NO: 216148 - DNA, 20 bp, Artificial
  CRISPR gRNA sequence
tcatttgtttatgccatctt

SEQ ID NO: 216149 - DNA, 20 bp, Artificial
  CRISPR gRNA sequence
atttgtttatgccatctttc

SEQ ID NO: 216150 - DNA, 20 bp, Artificial
  CRISPR gRNA sequence
gtttatgccatctttccccc

SEQ ID NO: 216151 - DNA, 20 bp, Artificial
  CRISPR gRNA sequence
tttatgccatctttccccca

SEQ ID NO: 216152 - DNA, 20 bp, Artificial
  CRISPR gRNA sequence
atgccatctttcccccaaat

SEQ ID NO: 216153 - DNA, 20 bp, Artificial
  CRISPR gRNA sequence
tgccatctttcccccaaatc

SEQ ID NO: 216154 - DNA, 20 bp, Artificial
  CRISPR gRNA sequence
tcccccaaatcagccacttg

SEQ ID NO: 216155 - DNA, 20 bp, Artificial
  CRISPR gRNA sequence
cccccaaatcagccacttgt

SEQ ID NO: 216156 - DNA, 20 bp, Artificial
  CRISPR gRNA sequence
ccccaaatcagccacttgtt

SEQ ID NO: 216157 - DNA, 20 bp, Artificial
  CRISPR gRNA sequence
gttacactggctggtgggaa

SEQ ID NO: 216158 - DNA, 20 bp, Artificial
  CRISPR gRNA sequence
ttacactggctggtgggaaa

SEQ ID NO: 216159 - DNA, 20 bp, Artificial
  CRISPR gRNA sequence
cactggctggtgggaaaatg

SEQ ID NO: 216160 - DNA, 20 bp, Artificial
  CRISPR gRNA sequence
gctggtgggaaaatgctgtc

SEQ ID NO: 216161 - DNA, 20 bp, Artificial
  CRISPR gRNA sequence
gtgggaaaatgctgtcacca

SEQ ID NO: 216162 - DNA, 20 bp, Artificial
  CRISPR gRNA sequence
tcaccaacatacccccacca

SEQ ID NO: 216163 - DNA, 20 bp, Artificial
  CRISPR gRNA sequence
catcctccctcctctatcta

SEQ ID NO: 216164 - DNA, 20 bp, Artificial
  CRISPR gRNA sequence
cctcctctatctacccagag

SEQ ID NO: 216165 - DNA, 20 bp, Artificial
  CRISPR gRNA sequence
ctctatctacccagagtgta

SEQ ID NO: 216166 - DNA, 20 bp, Artificial
  CRISPR gRNA sequence
tatctacccagagtgtagac

SEQ ID NO: 216167 - DNA, 20 bp, Artificial
  CRISPR gRNA sequence
tctacccagagtgtagacag

SEQ ID NO: 216168 - DNA, 20 bp, Artificial
  CRISPR gRNA sequence
cccagagtgtagacagaatg

SEQ ID NO: 216169 - DNA, 20 bp, Artificial
  CRISPR gRNA sequence
gtccccactactccatctcc

SEQ ID NO: 216170 - DNA, 20 bp, Artificial
  CRISPR gRNA sequence
tccccactactccatctccc

SEQ ID NO: 216171 - DNA, 20 bp, Artificial
  CRISPR gRNA sequence
ctccatctcccttagctcac

SEQ ID NO: 216172 - DNA, 20 bp, Artificial
  CRISPR gRNA sequence
catctcccttagctcactgc

SEQ ID NO: 216173 - DNA, 20 bp, Artificial
  CRISPR gRNA sequence
ccttagctcactgctcctgt

SEQ ID NO: 216174 - DNA, 20 bp, Artificial
  CRISPR gRNA sequence
agctcactgctcctgtgtct

SEQ ID NO: 216175 - DNA, 20 bp, Artificial
  CRISPR gRNA sequence
gctcactgctcctgtgtctt

SEQ ID NO: 216176 - DNA, 20 bp, Artificial
  CRISPR gRNA sequence
actgctcctgtgtcttacaa

SEQ ID NO: 216177 - DNA, 20 bp, Artificial
  CRISPR gRNA sequence
ctcctgtgtcttacaagctc

SEQ ID NO: 216178 - DNA, 20 bp, Artificial
  CRISPR gRNA sequence
ctgtgtcttacaagctcagt

SEQ ID NO: 216179 - DNA, 20 bp, Artificial
  CRISPR gRNA sequence
tgtcttacaagctcagtctc

SEQ ID NO: 216180 - DNA, 20 bp, Artificial
  CRISPR gRNA sequence
acaagctcagtctctttctc

SEQ ID NO: 216181 - DNA, 20 bp, Artificial
  CRISPR gRNA sequence
caagctcagtctctttctcc

SEQ ID NO: 216182 - DNA, 20 bp, Artificial
  CRISPR gRNA sequence
agtctctttctccacatcac

SEQ ID NO: 216183 - DNA, 20 bp, Artificial
  CRISPR gRNA sequence
tttctccacatcactccctg

SEQ ID NO: 216184 - DNA, 20 bp, Artificial
  CRISPR gRNA sequence
tctccacatcactccctggg

SEQ ID NO: 216185 - DNA, 20 bp, Artificial
  CRISPR gRNA sequence
ctccacatcactccctgggt

SEQ ID NO: 216186 - DNA, 20 bp, Artificial
  CRISPR gRNA sequence
tccacatcactccctgggtc

SEQ ID NO: 216187 - DNA, 20 bp, Artificial
  CRISPR gRNA sequence
cacatcactccctgggtctt

SEQ ID NO: 216188 - DNA, 20 bp, Artificial
  CRISPR gRNA sequence
cctgggtctttccagtttca

SEQ ID NO: 216189 - DNA, 20 bp, Artificial
  CRISPR gRNA sequence
ggtctttccagtttcaaagc

SEQ ID NO: 216190 - DNA, 20 bp, Artificial
  CRISPR gRNA sequence
tccagtttcaaagctccaaa

SEQ ID NO: 216191 - DNA, 20 bp, Artificial
  CRISPR gRNA sequence
ccagtttcaaagctccaaag

SEQ ID NO: 216192 - DNA, 20 bp, Artificial
  CRISPR gRNA sequence
cagtttcaaagctccaaaga

SEQ ID NO: 216193 - DNA, 20 bp, Artificial
  CRISPR gRNA sequence
caaagctccaaagagctaac

SEQ ID NO: 216194 - DNA, 20 bp, Artificial
  CRISPR gRNA sequence
aaagctccaaagagctaaca

SEQ ID NO: 216195 - DNA, 20 bp, Artificial
  CRISPR gRNA sequence
caaagagctaacaaactaaa

SEQ ID NO: 216196 - DNA, 20 bp, Artificial
  CRISPR gRNA sequence
acaaactaaagaaaatactc

SEQ ID NO: 216197 - DNA, 20 bp, Artificial
  CRISPR gRNA sequence
aagaaaatactcagatagct

SEQ ID NO: 216198 - DNA, 20 bp, Artificial
  CRISPR gRNA sequence
agatagctctgagtattcct

SEQ ID NO: 216199 - DNA, 20 bp, Artificial
  CRISPR gRNA sequence
tgagtattcctctatctatt

SEQ ID NO: 216200 - DNA, 20 bp, Artificial
  CRISPR gRNA sequence
agtattcctctatctatttc

SEQ ID NO: 216201 - DNA, 20 bp, Artificial
  CRISPR gRNA sequence
ctctatctatttcttcttag

SEQ ID NO: 216202 - DNA, 20 bp, Artificial
  CRISPR gRNA sequence
tatctatttcttcttagctt

SEQ ID NO: 216203 - DNA, 20 bp, Artificial
  CRISPR gRNA sequence
tctatttcttcttagctttc

SEQ ID NO: 216204 - DNA, 20 bp, Artificial
  CRISPR gRNA sequence
tttcttcttagctttctgag

SEQ ID NO: 216205 - DNA, 20 bp, Artificial
  CRISPR gRNA sequence
cttcttagctttctgagttg

SEQ ID NO: 216206 - DNA, 20 bp, Artificial
  CRISPR gRNA sequence
ttcttagctttctgagttgc

SEQ ID NO: 216207 - DNA, 20 bp, Artificial
  CRISPR gRNA sequence
cttagctttctgagttgcct

SEQ ID NO: 216208 - DNA, 20 bp, Artificial
  CRISPR gRNA sequence
ttagctttctgagttgcctt

SEQ ID NO: 216209 - DNA, 20 bp, Artificial
  CRISPR gRNA sequence
agctttctgagttgcctttt

SEQ ID NO: 216210 - DNA, 20 bp, Artificial
  CRISPR gRNA sequence
gctttctgagttgccttttt

SEQ ID NO: 216211 - DNA, 20 bp, Artificial
  CRISPR gRNA sequence
tctgagttgcctttttcact

SEQ ID NO: 216212 - DNA, 20 bp, Artificial
  CRISPR gRNA sequence
ctgagttgcctttttcactg

SEQ ID NO: 216213 - DNA, 20 bp, Artificial
  CRISPR gRNA sequence
tgagttgcctttttcactgc

SEQ ID NO: 216214 - DNA, 20 bp, Artificial
  CRISPR gRNA sequence
agttgcctttttcactgctt

SEQ ID NO: 216215 - DNA, 20 bp, Artificial
  CRISPR gRNA sequence
cctttttcactgcttccaaa

SEQ ID NO: 216216 - DNA, 20 bp, Artificial
  CRISPR gRNA sequence
tttcactgcttccaaatgga

SEQ ID NO: 216217 - DNA, 20 bp, Artificial
  CRISPR gRNA sequence
ttcactgcttccaaatggat

SEQ ID NO: 216218 - DNA, 20 bp, Artificial
  CRISPR gRNA sequence
tcactgcttccaaatggatt

SEQ ID NO: 216219 - DNA, 20 bp, Artificial
  CRISPR gRNA sequence
cactgcttccaaatggattc

SEQ ID NO: 216220 - DNA, 20 bp, Artificial
  CRISPR gRNA sequence
actgcttccaaatggattca

SEQ ID NO: 216221 - DNA, 20 bp, Artificial
  CRISPR gRNA sequence
cttccaaatggattcattaa

SEQ ID NO: 216222 - DNA, 20 bp, Artificial
  CRISPR gRNA sequence
ccaaatggattcattaatga

SEQ ID NO: 216223 - DNA, 20 bp, Artificial
  CRISPR gRNA sequence
caaatggattcattaatgaa

SEQ ID NO: 216224 - DNA, 20 bp, Artificial
  CRISPR gRNA sequence
attaatgaagttgaaggaat

SEQ ID NO: 216225 - DNA, 20 bp, Artificial
  CRISPR gRNA sequence
atgaagttgaaggaatacag

SEQ ID NO: 216226 - DNA, 20 bp, Artificial
  CRISPR gRNA sequence
aaggaatacagtacatgagc

SEQ ID NO: 216227 - DNA, 20 bp, Artificial
  CRISPR gRNA sequence
gttggggagggaagaagaga

SEQ ID NO: 216228 - DNA, 20 bp, Artificial
  CRISPR gRNA sequence
gggagggaagaagagatagc

SEQ ID NO: 216229 - DNA, 20 bp, Artificial
  CRISPR gRNA sequence
ccttataaaaaaaacaaatg

SEQ ID NO: 216230 - DNA, 20 bp, Artificial
  CRISPR gRNA sequence
cttataaaaaaaacaaatga

SEQ ID NO: 216231 - DNA, 20 bp, Artificial
  CRISPR gRNA sequence
ataaaaaaaacaaatgagaa

SEQ ID NO: 216232 - DNA, 20 bp, Artificial
  CRISPR gRNA sequence
taaaaaaaacaaatgagaag

SEQ ID NO: 216233 - DNA, 20 bp, Artificial
  CRISPR gRNA sequence
gccgtggtggctcatgcctg

SEQ ID NO: 216234 - DNA, 20 bp, Artificial
  CRISPR gRNA sequence
atgcctgtaatcccagcact

SEQ ID NO: 216235 - DNA, 20 bp, Artificial
  CRISPR gRNA sequence
taatcccagcactttgggag

SEQ ID NO: 216236 - DNA, 20 bp, Artificial
  CRISPR gRNA sequence
tgggaggccaaggcaaatag

SEQ ID NO: 216237 - DNA, 20 bp, Artificial
  CRISPR gRNA sequence
gggaggccaaggcaaataga

SEQ ID NO: 216238 - DNA, 20 bp, Artificial
  CRISPR gRNA sequence
ggaggccaaggcaaatagat

SEQ ID NO: 216239 - DNA, 20 bp, Artificial
  CRISPR gRNA sequence
cttgagctcaggcattcaag

SEQ ID NO: 216240 - DNA, 20 bp, Artificial
  CRISPR gRNA sequence
gagctcaggcattcaagacc

SEQ ID NO: 216241 - DNA, 20 bp, Artificial
  CRISPR gRNA sequence
agctcaggcattcaagacca

SEQ ID NO: 216242 - DNA, 20 bp, Artificial
  CRISPR gRNA sequence
aggcattcaagaccagcctg

SEQ ID NO: 216243 - DNA, 20 bp, Artificial
  CRISPR gRNA sequence
aagaccagcctgggcaacat

SEQ ID NO: 216244 - DNA, 20 bp, Artificial
  CRISPR gRNA sequence
ggcaacatgatgcaaccctg

SEQ ID NO: 216245 - DNA, 20 bp, Artificial
  CRISPR gRNA sequence
tctctaccaaaaatacaaaa

SEQ ID NO: 216246 - DNA, 20 bp, Artificial
  CRISPR gRNA sequence
taccaaaaatacaaaaatta

SEQ ID NO: 216247 - DNA, 20 bp, Artificial
  CRISPR gRNA sequence
ccaaaaatacaaaaattagc

SEQ ID NO: 216248 - DNA, 20 bp, Artificial
  CRISPR gRNA sequence
gctggcgtggtggtgcatgc

SEQ ID NO: 216249 - DNA, 20 bp, Artificial
  CRISPR gRNA sequence
gcgtggtggtgcatgcctgt

SEQ ID NO: 216250 - DNA, 20 bp, Artificial
  CRISPR gRNA sequence
tggtgcatgcctgtagtccc

SEQ ID NO: 216251 - DNA, 20 bp, Artificial
  CRISPR gRNA sequence
tagtcccagctacgtggaag

SEQ ID NO: 216252 - DNA, 20 bp, Artificial
  CRISPR gRNA sequence
cgtggaaggctgaggtggga

SEQ ID NO: 216253 - DNA, 20 bp, Artificial
  CRISPR gRNA sequence
aggtgggaggatctccctcg

SEQ ID NO: 216254 - DNA, 20 bp, Artificial
  CRISPR gRNA sequence
cctcgtcctgggaggcagag

SEQ ID NO: 216255 - DNA, 20 bp, Artificial
  CRISPR gRNA sequence
gtcctgggaggcagaggctg

SEQ ID NO: 216256 - DNA, 20 bp, Artificial
  CRISPR gRNA sequence
ggaggcagaggctgcagcga

SEQ ID NO: 216257 - DNA, 20 bp, Artificial
  CRISPR gRNA sequence
cagcgagctggggtcgtgcc

SEQ ID NO: 216258 - DNA, 20 bp, Artificial
  CRISPR gRNA sequence
gggtcgtgccactgcactcc

SEQ ID NO: 216259 - DNA, 20 bp, Artificial
  CRISPR gRNA sequence
cactccagcctgggcgacag

SEQ ID NO: 216260 - DNA, 20 bp, Artificial
  CRISPR gRNA sequence
cagcctgggcgacagagcga

SEQ ID NO: 216261 - DNA, 20 bp, Artificial
  CRISPR gRNA sequence
ggcgacagagcgagactcca

SEQ ID NO: 216262 - DNA, 20 bp, Artificial
  CRISPR gRNA sequence
catctcaaaaaataaaaaaa

SEQ ID NO: 216263 - DNA, 20 bp, Artificial
  CRISPR gRNA sequence
aaaaaataaaaaaacccaaa

SEQ ID NO: 216264 - DNA, 20 bp, Artificial
  CRISPR gRNA sequence
cagatggaaaagcgttgaac

SEQ ID NO: 216265 - DNA, 20 bp, Artificial
  CRISPR gRNA sequence
aacagaaacatgccatgaac

SEQ ID NO: 216266 - DNA, 20 bp, Artificial
  CRISPR gRNA sequence
agcaggagggggatcctact

SEQ ID NO: 216267 - DNA, 20 bp, Artificial
  CRISPR gRNA sequence
ctgaacagagaggcccattc

SEQ ID NO: 216268 - DNA, 20 bp, Artificial
  CRISPR gRNA sequence
aacagagaggcccattccgc

SEQ ID NO: 216269 - DNA, 20 bp, Artificial
  CRISPR gRNA sequence
cgctgggacctgggctggat

SEQ ID NO: 216270 - DNA, 20 bp, Artificial
  CRISPR gRNA sequence
ggacctgggctggatgacag

SEQ ID NO: 216271 - DNA, 20 bp, Artificial
  CRISPR gRNA sequence
ggctggatgacagcactgga

SEQ ID NO: 216272 - DNA, 20 bp, Artificial
  CRISPR gRNA sequence
gatgacagcactggattttc

SEQ ID NO: 216273 - DNA, 20 bp, Artificial
  CRISPR gRNA sequence
gattttctcatcagcagatg

SEQ ID NO: 216274 - DNA, 20 bp, Artificial
  CRISPR gRNA sequence
tctcatcagcagatggaggc

SEQ ID NO: 216275 - DNA, 20 bp, Artificial
  CRISPR gRNA sequence
ctcatcagcagatggaggca

SEQ ID NO: 216276 - DNA, 20 bp, Artificial
  CRISPR gRNA sequence
tcatcagcagatggaggcac

SEQ ID NO: 216277 - DNA, 20 bp, Artificial
  CRISPR gRNA sequence
atcagcagatggaggcacgc

SEQ ID NO: 216278 - DNA, 20 bp, Artificial
  CRISPR gRNA sequence
caggactgctctgtgttcct

SEQ ID NO: 216279 - DNA, 20 bp, Artificial
  CRISPR gRNA sequence
ctctgtgttccttactattt

SEQ ID NO: 216280 - DNA, 20 bp, Artificial
  CRISPR gRNA sequence
tgtgttccttactatttatt

SEQ ID NO: 216281 - DNA, 20 bp, Artificial
  CRISPR gRNA sequence
tgttccttactatttattta

SEQ ID NO: 216282 - DNA, 20 bp, Artificial
  CRISPR gRNA sequence
cttactatttatttaccacc

SEQ ID NO: 216283 - DNA, 20 bp, Artificial
  CRISPR gRNA sequence
actatttatttaccaccact

SEQ ID NO: 216284 - DNA, 20 bp, Artificial
  CRISPR gRNA sequence
ctatttatttaccaccactg

SEQ ID NO: 216285 - DNA, 20 bp, Artificial
  CRISPR gRNA sequence
tttatttaccaccactgcac

SEQ ID NO: 216286 - DNA, 20 bp, Artificial
  CRISPR gRNA sequence
atttaccaccactgcacact

SEQ ID NO: 216287 - DNA, 20 bp, Artificial
  CRISPR gRNA sequence
tttaccaccactgcacactc

SEQ ID NO: 216288 - DNA, 20 bp, Artificial
  CRISPR gRNA sequence
accaccactgcacactcgaa

SEQ ID NO: 216289 - DNA, 20 bp, Artificial
  CRISPR gRNA sequence
ccaccactgcacactcgaat

SEQ ID NO: 216290 - DNA, 20 bp, Artificial
  CRISPR gRNA sequence
cacactcgaattctgtcaag

SEQ ID NO: 216291 - DNA, 20 bp, Artificial
  CRISPR gRNA sequence
gaattctgtcaagcttccaa

SEQ ID NO: 216292 - DNA, 20 bp, Artificial
  CRISPR gRNA sequence
tgtcaagcttccaaagctgg

SEQ ID NO: 216293 - DNA, 20 bp, Artificial
  CRISPR gRNA sequence
tcaagcttccaaagctggca

SEQ ID NO: 216294 - DNA, 20 bp, Artificial
  CRISPR gRNA sequence
ccaaagctggcagggaaaag

SEQ ID NO: 216295 - DNA, 20 bp, Artificial
  CRISPR gRNA sequence
caaagctggcagggaaaagg

SEQ ID NO: 216296 - DNA, 20 bp, Artificial
  CRISPR gRNA sequence
gcagggaaaagggtgggtcc

SEQ ID NO: 216297 - DNA, 20 bp, Artificial
  CRISPR gRNA sequence
acccaaggaaagccaatctg

SEQ ID NO: 216298 - DNA, 20 bp, Artificial
  CRISPR gRNA sequence
tgagccagccaaaagctggt

SEQ ID NO: 216299 - DNA, 20 bp, Artificial
  CRISPR gRNA sequence
gtgagtctttctcaaacagg

SEQ ID NO: 216300 - DNA, 20 bp, Artificial
  CRISPR gRNA sequence
tctcaaacaggaaaaatggc

SEQ ID NO: 216301 - DNA, 20 bp, Artificial
  CRISPR gRNA sequence
ctcaaacaggaaaaatggca

SEQ ID NO: 216302 - DNA, 20 bp, Artificial
  CRISPR gRNA sequence
tcaaacaggaaaaatggcaa

SEQ ID NO: 216303 - DNA, 20 bp, Artificial
  CRISPR gRNA sequence
aaacaggaaaaatggcaaca

SEQ ID NO: 216304 - DNA, 20 bp, Artificial
  CRISPR gRNA sequence
gactgacaagtttctccctg

SEQ ID NO: 216305 - DNA, 20 bp, Artificial
  CRISPR gRNA sequence
acaagtttctccctgccact

SEQ ID NO: 216306 - DNA, 20 bp, Artificial
  CRISPR gRNA sequence
ctccctgccactggactcta

SEQ ID NO: 216307 - DNA, 20 bp, Artificial
  CRISPR gRNA sequence
tccctgccactggactctaa

SEQ ID NO: 216308 - DNA, 20 bp, Artificial
  CRISPR gRNA sequence
cctgccactggactctaaga

SEQ ID NO: 216309 - DNA, 20 bp, Artificial
  CRISPR gRNA sequence
ccactggactctaagaagaa

SEQ ID NO: 216310 - DNA, 20 bp, Artificial
  CRISPR gRNA sequence
gactctaagaagaaacagaa

SEQ ID NO: 216311 - DNA, 20 bp, Artificial
  CRISPR gRNA sequence
taagaagaaacagaaaaaaa

SEQ ID NO: 216312 - DNA, 20 bp, Artificial
  CRISPR gRNA sequence
agaagaaacagaaaaaaacc

SEQ ID NO: 216313 - DNA, 20 bp, Artificial
  CRISPR gRNA sequence
gtgatgggaagggaaagtga

SEQ ID NO: 216314 - DNA, 20 bp, Artificial
  CRISPR gRNA sequence
taggtaagaaaagttgtctg

SEQ ID NO: 216315 - DNA, 20 bp, Artificial
  CRISPR gRNA sequence
tctgtgagaaggcatgaata

SEQ ID NO: 216316 - DNA, 20 bp, Artificial
  CRISPR gRNA sequence
tgagaaggcatgaataggat

SEQ ID NO: 216317 - DNA, 20 bp, Artificial
  CRISPR gRNA sequence
gctggctaataggcaaagaa

SEQ ID NO: 216318 - DNA, 20 bp, Artificial
  CRISPR gRNA sequence
gctaataggcaaagaatcaa

SEQ ID NO: 216319 - DNA, 20 bp, Artificial
  CRISPR gRNA sequence
ataggcaaagaatcaaagac

SEQ ID NO: 216320 - DNA, 20 bp, Artificial
  CRISPR gRNA sequence
aggaactataactgacaggg

SEQ ID NO: 216321 - DNA, 20 bp, Artificial
  CRISPR gRNA sequence
taactgacaggggcatcacc

SEQ ID NO: 216322 - DNA, 20 bp, Artificial
  CRISPR gRNA sequence
acaggggcatcaccttactc

SEQ ID NO: 216323 - DNA, 20 bp, Artificial
  CRISPR gRNA sequence
actcttgctgctgagagggc

SEQ ID NO: 216324 - DNA, 20 bp, Artificial
  CRISPR gRNA sequence
ctcttgctgctgagagggca

SEQ ID NO: 216325 - DNA, 20 bp, Artificial
  CRISPR gRNA sequence
ttgctgctgagagggcaaca

SEQ ID NO: 216326 - DNA, 20 bp, Artificial
  CRISPR gRNA sequence
gctgctgagagggcaacacg

SEQ ID NO: 216327 - DNA, 20 bp, Artificial
  CRISPR gRNA sequence
ctgctgagagggcaacacga

SEQ ID NO: 216328 - DNA, 20 bp, Artificial
  CRISPR gRNA sequence
ctgagagggcaacacgatgc

SEQ ID NO: 216329 - DNA, 20 bp, Artificial
  CRISPR gRNA sequence
agagggcaacacgatgcttc

SEQ ID NO: 216330 - DNA, 20 bp, Artificial
  CRISPR gRNA sequence
cagttctttgatatggaatg

SEQ ID NO: 216331 - DNA, 20 bp, Artificial
  CRISPR gRNA sequence
agttctttgatatggaatgg

SEQ ID NO: 216332 - DNA, 20 bp, Artificial
  CRISPR gRNA sequence
tttgatatggaatggatcct

SEQ ID NO: 216333 - DNA, 20 bp, Artificial
  CRISPR gRNA sequence
tgatatggaatggatccttc

SEQ ID NO: 216334 - DNA, 20 bp, Artificial
  CRISPR gRNA sequence
gatatggaatggatccttcc

SEQ ID NO: 216335 - DNA, 20 bp, Artificial
  CRISPR gRNA sequence
atatggaatggatccttcca

SEQ ID NO: 216336 - DNA, 20 bp, Artificial
  CRISPR gRNA sequence
ccaattcctagactacatac

SEQ ID NO: 216337 - DNA, 20 bp, Artificial
  CRISPR gRNA sequence
caattcctagactacatact

SEQ ID NO: 216338 - DNA, 20 bp, Artificial
  CRISPR gRNA sequence
ctagactacatactgtccca

SEQ ID NO: 216339 - DNA, 20 bp, Artificial
  CRISPR gRNA sequence
gactacatactgtcccaccc

SEQ ID NO: 216340 - DNA, 20 bp, Artificial
  CRISPR gRNA sequence
catactgtcccacccctgtg

SEQ ID NO: 216341 - DNA, 20 bp, Artificial
  CRISPR gRNA sequence
tcccacccctgtgaggccca

SEQ ID NO: 216342 - DNA, 20 bp, Artificial
  CRISPR gRNA sequence
tgaggcccagttatgtatct

SEQ ID NO: 216343 - DNA, 20 bp, Artificial
  CRISPR gRNA sequence
tgtatctgagctcataggag

SEQ ID NO: 216344 - DNA, 20 bp, Artificial
  CRISPR gRNA sequence
agctcataggagtccagttt

SEQ ID NO: 216345 - DNA, 20 bp, Artificial
  CRISPR gRNA sequence
ataggagtccagtttctgtt

SEQ ID NO: 216346 - DNA, 20 bp, Artificial
  CRISPR gRNA sequence
ctgttagtgccatgggcggc

SEQ ID NO: 216347 - DNA, 20 bp, Artificial
  CRISPR gRNA sequence
tgttagtgccatgggcggct

SEQ ID NO: 216348 - DNA, 20 bp, Artificial
  CRISPR gRNA sequence
ttagtgccatgggcggcttt

SEQ ID NO: 216349 - DNA, 20 bp, Artificial
  CRISPR gRNA sequence
gtgccatgggcggctttaaa

SEQ ID NO: 216350 - DNA, 20 bp, Artificial
  CRISPR gRNA sequence
taaataggcctcccttactg

SEQ ID NO: 216351 - DNA, 20 bp, Artificial
  CRISPR gRNA sequence
aaataggcctcccttactgt

SEQ ID NO: 216352 - DNA, 20 bp, Artificial
  CRISPR gRNA sequence
aataggcctcccttactgtg

SEQ ID NO: 216353 - DNA, 20 bp, Artificial
  CRISPR gRNA sequence
ccttactgtggaggaacctg

SEQ ID NO: 216354 - DNA, 20 bp, Artificial
  CRISPR gRNA sequence
actgtggaggaacctggggg

SEQ ID NO: 216355 - DNA, 20 bp, Artificial
  CRISPR gRNA sequence
ctgtggaggaacctggggga

SEQ ID NO: 216356 - DNA, 20 bp, Artificial
  CRISPR gRNA sequence
tggaggaacctgggggagtg

SEQ ID NO: 216357 - DNA, 20 bp, Artificial
  CRISPR gRNA sequence
ggggagtgacttggtccttg

SEQ ID NO: 216358 - DNA, 20 bp, Artificial
  CRISPR gRNA sequence
ggtccttgtatccaaacaag

SEQ ID NO: 216359 - DNA, 20 bp, Artificial
  CRISPR gRNA sequence
gtccttgtatccaaacaaga

SEQ ID NO: 216360 - DNA, 20 bp, Artificial
  CRISPR gRNA sequence
gtatccaaacaagaagccaa

SEQ ID NO: 216361 - DNA, 20 bp, Artificial
  CRISPR gRNA sequence
tatccaaacaagaagccaac

SEQ ID NO: 216362 - DNA, 20 bp, Artificial
  CRISPR gRNA sequence
tttttaaagtagaacagggt

SEQ ID NO: 216363 - DNA, 20 bp, Artificial
  CRISPR gRNA sequence
tttaaagtagaacagggtaa

SEQ ID NO: 216364 - DNA, 20 bp, Artificial
  CRISPR gRNA sequence
ttaaagtagaacagggtaaa

SEQ ID NO: 216365 - DNA, 20 bp, Artificial
  CRISPR gRNA sequence
taaagtagaacagggtaaaa

SEQ ID NO: 216366 - DNA, 20 bp, Artificial
  CRISPR gRNA sequence
aaagtagaacagggtaaaat

SEQ ID NO: 216367 - DNA, 20 bp, Artificial
  CRISPR gRNA sequence
aagtagaacagggtaaaatg

SEQ ID NO: 216368 - DNA, 20 bp, Artificial
  CRISPR gRNA sequence
ggatgcactacatttagcag

SEQ ID NO: 216369 - DNA, 20 bp, Artificial
  CRISPR gRNA sequence
catttagcagcctccccaat

SEQ ID NO: 216370 - DNA, 20 bp, Artificial
  CRISPR gRNA sequence
agcagcctccccaataaact

SEQ ID NO: 216371 - DNA, 20 bp, Artificial
  CRISPR gRNA sequence
gcagcctccccaataaacta

SEQ ID NO: 216372 - DNA, 20 bp, Artificial
  CRISPR gRNA sequence
cccaataaactaagcagaaa

SEQ ID NO: 216373 - DNA, 20 bp, Artificial
  CRISPR gRNA sequence
agcagaaatacagagcttta

SEQ ID NO: 216374 - DNA, 20 bp, Artificial
  CRISPR gRNA sequence
tatttgggaacatcaggata

SEQ ID NO: 216375 - DNA, 20 bp, Artificial
  CRISPR gRNA sequence
atttgggaacatcaggatag

SEQ ID NO: 216376 - DNA, 20 bp, Artificial
  CRISPR gRNA sequence
tttgggaacatcaggatagt

SEQ ID NO: 216377 - DNA, 20 bp, Artificial
  CRISPR gRNA sequence
gggaacatcaggatagttac

SEQ ID NO: 216378 - DNA, 20 bp, Artificial
  CRISPR gRNA sequence
ggaacatcaggatagttaca

SEQ ID NO: 216379 - DNA, 20 bp, Artificial
  CRISPR gRNA sequence
catgtatatacaactgactt

SEQ ID NO: 216380 - DNA, 20 bp, Artificial
  CRISPR gRNA sequence
acttcaatgaaaccatgcct

SEQ ID NO: 216381 - DNA, 20 bp, Artificial
  CRISPR gRNA sequence
caatgaaaccatgccttata

SEQ ID NO: 216382 - DNA, 20 bp, Artificial
  CRISPR gRNA sequence
aatgaaaccatgccttatat

SEQ ID NO: 216383 - DNA, 20 bp, Artificial
  CRISPR gRNA sequence
atatctatgttctacaaaga

SEQ ID NO: 216384 - DNA, 20 bp, Artificial
  CRISPR gRNA sequence
tatctatgttctacaaagaa

SEQ ID NO: 216385 - DNA, 20 bp, Artificial
  CRISPR gRNA sequence
tgttctacaaagaaaaagag

SEQ ID NO: 216386 - DNA, 20 bp, Artificial
  CRISPR gRNA sequence
tacaaagaaaaagagaacta

SEQ ID NO: 216387 - DNA, 20 bp, Artificial
  CRISPR gRNA sequence
caaagaaaaagagaactaaa

SEQ ID NO: 216388 - DNA, 20 bp, Artificial
  CRISPR gRNA sequence
aacaactatctaaatttctg

SEQ ID NO: 216389 - DNA, 20 bp, Artificial
  CRISPR gRNA sequence
tctaaatttctgatggtaat

SEQ ID NO: 216390 - DNA, 20 bp, Artificial
  CRISPR gRNA sequence
aatttctgatggtaatatgg

SEQ ID NO: 216391 - DNA, 20 bp, Artificial
  CRISPR gRNA sequence
ctgatggtaatatggaagtt

SEQ ID NO: 216392 - DNA, 20 bp, Artificial
  CRISPR gRNA sequence
tgatggtaatatggaagttc

SEQ ID NO: 216393 - DNA, 20 bp, Artificial
  CRISPR gRNA sequence
atggtaatatggaagttcag

SEQ ID NO: 216394 - DNA, 20 bp, Artificial
  CRISPR gRNA sequence
agagataaggttttagagtt

SEQ ID NO: 216395 - DNA, 20 bp, Artificial
  CRISPR gRNA sequence
tagagttacatttttgagct

SEQ ID NO: 216396 - DNA, 20 bp, Artificial
  CRISPR gRNA sequence
agagttacatttttgagctc

SEQ ID NO: 216397 - DNA, 20 bp, Artificial
  CRISPR gRNA sequence
gagttacatttttgagctca

SEQ ID NO: 216398 - DNA, 20 bp, Artificial
  CRISPR gRNA sequence
catttttgagctcataaatg

SEQ ID NO: 216399 - DNA, 20 bp, Artificial
  CRISPR gRNA sequence
ttgagctcataaatgtattt

SEQ ID NO: 216400 - DNA, 20 bp, Artificial
  CRISPR gRNA sequence
tgagctcataaatgtattta

SEQ ID NO: 216401 - DNA, 20 bp, Artificial
  CRISPR gRNA sequence
gagctcataaatgtatttat

SEQ ID NO: 216402 - DNA, 20 bp, Artificial
  CRISPR gRNA sequence
agctcataaatgtatttatc

SEQ ID NO: 216403 - DNA, 20 bp, Artificial
  CRISPR gRNA sequence
ataaatgtatttatcagaat

SEQ ID NO: 216404 - DNA, 20 bp, Artificial
  CRISPR gRNA sequence
atcagaataaacactgccag

SEQ ID NO: 216405 - DNA, 20 bp, Artificial
  CRISPR gRNA sequence
tcagaataaacactgccagg

SEQ ID NO: 216406 - DNA, 20 bp, Artificial
  CRISPR gRNA sequence
ccaggtgtagtggcacatgc

SEQ ID NO: 216407 - DNA, 20 bp, Artificial
  CRISPR gRNA sequence
tagtcccagctacttgggag

SEQ ID NO: 216408 - DNA, 20 bp, Artificial
  CRISPR gRNA sequence
cttgggaggctgaggtggga

SEQ ID NO: 216409 - DNA, 20 bp, Artificial
  CRISPR gRNA sequence
gggaggctgaggtgggagca

SEQ ID NO: 216410 - DNA, 20 bp, Artificial
  CRISPR gRNA sequence
ggaggctgaggtgggagcat

SEQ ID NO: 216411 - DNA, 20 bp, Artificial
  CRISPR gRNA sequence
aggtgggagcattgcttgag

SEQ ID NO: 216412 - DNA, 20 bp, Artificial
  CRISPR gRNA sequence
cttgagcccaggagctcgag

SEQ ID NO: 216413 - DNA, 20 bp, Artificial
  CRISPR gRNA sequence
gagcccaggagctcgaggcc

SEQ ID NO: 216414 - DNA, 20 bp, Artificial
  CRISPR gRNA sequence
agcccaggagctcgaggcca

SEQ ID NO: 216415 - DNA, 20 bp, Artificial
  CRISPR gRNA sequence
gaggccagcctggtcaacat

SEQ ID NO: 216416 - DNA, 20 bp, Artificial
  CRISPR gRNA sequence
gtcaacataatgagaccctg

SEQ ID NO: 216417 - DNA, 20 bp, Artificial
  CRISPR gRNA sequence
tctctaaaaacaaaacaaaa

SEQ ID NO: 216418 - DNA, 20 bp, Artificial
  CRISPR gRNA sequence
taaaaacaaaacaaaacaaa

SEQ ID NO: 216419 - DNA, 20 bp, Artificial
  CRISPR gRNA sequence
aaaacaaaacaaaacaaaat

SEQ ID NO: 216420 - DNA, 20 bp, Artificial
  CRISPR gRNA sequence
ctaaccgccaagtaactcct

SEQ ID NO: 216421 - DNA, 20 bp, Artificial
  CRISPR gRNA sequence
accgccaagtaactcctttt

SEQ ID NO: 216422 - DNA, 20 bp, Artificial
  CRISPR gRNA sequence
cttttcttccctaataatgt

SEQ ID NO: 216423 - DNA, 20 bp, Artificial
  CRISPR gRNA sequence
ttcttccctaataatgtaga

SEQ ID NO: 216424 - DNA, 20 bp, Artificial
  CRISPR gRNA sequence
tcttccctaataatgtagaa

SEQ ID NO: 216425 - DNA, 20 bp, Artificial
  CRISPR gRNA sequence
cttccctaataatgtagaaa

SEQ ID NO: 216426 - DNA, 20 bp, Artificial
  CRISPR gRNA sequence
ttccctaataatgtagaaag

SEQ ID NO: 216427 - DNA, 20 bp, Artificial
  CRISPR gRNA sequence
ccctaataatgtagaaagaa

SEQ ID NO: 216428 - DNA, 20 bp, Artificial
  CRISPR gRNA sequence
cctaataatgtagaaagaat

SEQ ID NO: 216429 - DNA, 20 bp, Artificial
  CRISPR gRNA sequence
ataatgtagaaagaatactt

SEQ ID NO: 216430 - DNA, 20 bp, Artificial
  CRISPR gRNA sequence
tctagttctaaatctccgat

SEQ ID NO: 216431 - DNA, 20 bp, Artificial
  CRISPR gRNA sequence
ctagttctaaatctccgatc

SEQ ID NO: 216432 - DNA, 20 bp, Artificial
  CRISPR gRNA sequence
tagttctaaatctccgatcc

SEQ ID NO: 216433 - DNA, 20 bp, Artificial
  CRISPR gRNA sequence
gttctaaatctccgatccaa

SEQ ID NO: 216434 - DNA, 20 bp, Artificial
  CRISPR gRNA sequence
taaatctccgatccaaggga

SEQ ID NO: 216435 - DNA, 20 bp, Artificial
  CRISPR gRNA sequence
aatctccgatccaagggatg

SEQ ID NO: 216436 - DNA, 20 bp, Artificial
  CRISPR gRNA sequence
cgatccaagggatgtcacag

SEQ ID NO: 216437 - DNA, 20 bp, Artificial
  CRISPR gRNA sequence
gctggcccattctgaaaaaa

SEQ ID NO: 216438 - DNA, 20 bp, Artificial
  CRISPR gRNA sequence
gcccattctgaaaaaaaaag

SEQ ID NO: 216439 - DNA, 20 bp, Artificial
  CRISPR gRNA sequence
tgaaaaaaaaagatttatga

SEQ ID NO: 216440 - DNA, 20 bp, Artificial
  CRISPR gRNA sequence
aaaaaaaaagatttatgaag

SEQ ID NO: 216441 - DNA, 20 bp, Artificial
  CRISPR gRNA sequence
atgaagaatggtacttcaaa

SEQ ID NO: 216442 - DNA, 20 bp, Artificial
  CRISPR gRNA sequence
tgaagaatggtacttcaaag

SEQ ID NO: 216443 - DNA, 20 bp, Artificial
  CRISPR gRNA sequence
caaagggacatcagtcagtt

SEQ ID NO: 216444 - DNA, 20 bp, Artificial
  CRISPR gRNA sequence
aaagggacatcagtcagttg

SEQ ID NO: 216445 - DNA, 20 bp, Artificial
  CRISPR gRNA sequence
tgatccctctaaatattata

SEQ ID NO: 216446 - DNA, 20 bp, Artificial
  CRISPR gRNA sequence
taaatattataaaaccaaac

SEQ ID NO: 216447 - DNA, 20 bp, Artificial
  CRISPR gRNA sequence
aatattataaaaccaaacag

SEQ ID NO: 216448 - DNA, 20 bp, Artificial
  CRISPR gRNA sequence
taaaaccaaacagtgtacaa

SEQ ID NO: 216449 - DNA, 20 bp, Artificial
  CRISPR gRNA sequence
atttcacctgagttaattct

SEQ ID NO: 216450 - DNA, 20 bp, Artificial
  CRISPR gRNA sequence
cacctgagttaattctctcc

SEQ ID NO: 216451 - DNA, 20 bp, Artificial
  CRISPR gRNA sequence
acctgagttaattctctcca

SEQ ID NO: 216452 - DNA, 20 bp, Artificial
  CRISPR gRNA sequence
agttaattctctccaatatg

SEQ ID NO: 216453 - DNA, 20 bp, Artificial
  CRISPR gRNA sequence
attctctccaatatggatat

SEQ ID NO: 216454 - DNA, 20 bp, Artificial
  CRISPR gRNA sequence
tctccaatatggatataacc

SEQ ID NO: 216455 - DNA, 20 bp, Artificial
  CRISPR gRNA sequence
tccaatatggatataaccca

SEQ ID NO: 216456 - DNA, 20 bp, Artificial
  CRISPR gRNA sequence
caatatggatataacccatg

SEQ ID NO: 216457 - DNA, 20 bp, Artificial
  CRISPR gRNA sequence
ttacgatttctgctgctacc

SEQ ID NO: 216458 - DNA, 20 bp, Artificial
  CRISPR gRNA sequence
cgatttctgctgctaccatg

SEQ ID NO: 216459 - DNA, 20 bp, Artificial
  CRISPR gRNA sequence
ctgctgctaccatgagccta

SEQ ID NO: 216460 - DNA, 20 bp, Artificial
  CRISPR gRNA sequence
tgctgctaccatgagcctaa

SEQ ID NO: 216461 - DNA, 20 bp, Artificial
  CRISPR gRNA sequence
ctgctaccatgagcctaaga

SEQ ID NO: 216462 - DNA, 20 bp, Artificial
  CRISPR gRNA sequence
ctaccatgagcctaagacat

SEQ ID NO: 216463 - DNA, 20 bp, Artificial
  CRISPR gRNA sequence
ccatgagcctaagacattga

SEQ ID NO: 216464 - DNA, 20 bp, Artificial
  CRISPR gRNA sequence
agacattgacagccatatat

SEQ ID NO: 216465 - DNA, 20 bp, Artificial
  CRISPR gRNA sequence
acagccatatatatatattt

SEQ ID NO: 216466 - DNA, 20 bp, Artificial
  CRISPR gRNA sequence
tttaaccacaagccttaagc

SEQ ID NO: 216467 - DNA, 20 bp, Artificial
  CRISPR gRNA sequence
ttaaccacaagccttaagca

SEQ ID NO: 216468 - DNA, 20 bp, Artificial
  CRISPR gRNA sequence
taaccacaagccttaagcat

SEQ ID NO: 216469 - DNA, 20 bp, Artificial
  CRISPR gRNA sequence
aaccacaagccttaagcatt

SEQ ID NO: 216470 - DNA, 20 bp, Artificial
  CRISPR gRNA sequence
accacaagccttaagcattc

SEQ ID NO: 216471 - DNA, 20 bp, Artificial
  CRISPR gRNA sequence
aagcattccatatgagcata

SEQ ID NO: 216472 - DNA, 20 bp, Artificial
  CRISPR gRNA sequence
agcattccatatgagcatac

SEQ ID NO: 216473 - DNA, 20 bp, Artificial
  CRISPR gRNA sequence
catatgagcatacttgcaat

SEQ ID NO: 216474 - DNA, 20 bp, Artificial
  CRISPR gRNA sequence
gcaatgcttcttgatttgtt

SEQ ID NO: 216475 - DNA, 20 bp, Artificial
  CRISPR gRNA sequence
caatgcttcttgatttgttc

SEQ ID NO: 216476 - DNA, 20 bp, Artificial
  CRISPR gRNA sequence
cttgatttgttcttctctcc

SEQ ID NO: 216477 - DNA, 20 bp, Artificial
  CRISPR gRNA sequence
ttgatttgttcttctctccc

SEQ ID NO: 216478 - DNA, 20 bp, Artificial
  CRISPR gRNA sequence
gatttgttcttctctccctg

SEQ ID NO: 216479 - DNA, 20 bp, Artificial
  CRISPR gRNA sequence
atttgttcttctctccctga

SEQ ID NO: 216480 - DNA, 20 bp, Artificial
  CRISPR gRNA sequence
gttcttctctccctgaaaca

SEQ ID NO: 216481 - DNA, 20 bp, Artificial
  CRISPR gRNA sequence
ttcttctctccctgaaacat

SEQ ID NO: 216482 - DNA, 20 bp, Artificial
  CRISPR gRNA sequence
ttctctccctgaaacatctg

SEQ ID NO: 216483 - DNA, 20 bp, Artificial
  CRISPR gRNA sequence
ctctccctgaaacatctgac

SEQ ID NO: 216484 - DNA, 20 bp, Artificial
  CRISPR gRNA sequence
tctccctgaaacatctgact

SEQ ID NO: 216485 - DNA, 20 bp, Artificial
  CRISPR gRNA sequence
tccctgaaacatctgactcc

SEQ ID NO: 216486 - DNA, 20 bp, Artificial
  CRISPR gRNA sequence
cctgaaacatctgactccat

SEQ ID NO: 216487 - DNA, 20 bp, Artificial
  CRISPR gRNA sequence
aaacatctgactccatgcca

SEQ ID NO: 216488 - DNA, 20 bp, Artificial
  CRISPR gRNA sequence
actccatgccataaatacat

SEQ ID NO: 216489 - DNA, 20 bp, Artificial
  CRISPR gRNA sequence
catgccataaatacatttcc

SEQ ID NO: 216490 - DNA, 20 bp, Artificial
  CRISPR gRNA sequence
ccagggtttaaatttttcag

SEQ ID NO: 216491 - DNA, 20 bp, Artificial
  CRISPR gRNA sequence
cagggtttaaatttttcaga

SEQ ID NO: 216492 - DNA, 20 bp, Artificial
  CRISPR gRNA sequence
aaatttttcagaaacatttt

SEQ ID NO: 216493 - DNA, 20 bp, Artificial
  CRISPR gRNA sequence
aatttttcagaaacattttt

SEQ ID NO: 216494 - DNA, 20 bp, Artificial
  CRISPR gRNA sequence
ttcagaaacattttttctat

SEQ ID NO: 216495 - DNA, 20 bp, Artificial
  CRISPR gRNA sequence
tcagaaacattttttctatt

SEQ ID NO: 216496 - DNA, 20 bp, Artificial
  CRISPR gRNA sequence
cagaaacattttttctattg

SEQ ID NO: 216497 - DNA, 20 bp, Artificial
  CRISPR gRNA sequence
agaaacattttttctattga

SEQ ID NO: 216498 - DNA, 20 bp, Artificial
  CRISPR gRNA sequence
tttctattgataccaaattt

SEQ ID NO: 216499 - DNA, 20 bp, Artificial
  CRISPR gRNA sequence
ttctattgataccaaattta

SEQ ID NO: 216500 - DNA, 20 bp, Artificial
  CRISPR gRNA sequence
tctattgataccaaatttac

SEQ ID NO: 216501 - DNA, 20 bp, Artificial
  CRISPR gRNA sequence
ctattgataccaaatttacc

SEQ ID NO: 216502 - DNA, 20 bp, Artificial
  CRISPR gRNA sequence
tattgataccaaatttacct

SEQ ID NO: 216503 - DNA, 20 bp, Artificial
  CRISPR gRNA sequence
ttgataccaaatttacctct

SEQ ID NO: 216504 - DNA, 20 bp, Artificial
  CRISPR gRNA sequence
ataccaaatttacctctcct

SEQ ID NO: 216505 - DNA, 20 bp, Artificial
  CRISPR gRNA sequence
acctctccttaaattgaaca

SEQ ID NO: 216506 - DNA, 20 bp, Artificial
  CRISPR gRNA sequence
cctctccttaaattgaacaa

SEQ ID NO: 216507 - DNA, 20 bp, Artificial
  CRISPR gRNA sequence
tccttaaattgaacaagaaa

SEQ ID NO: 216508 - DNA, 20 bp, Artificial
  CRISPR gRNA sequence
cttaaattgaacaagaaaat

SEQ ID NO: 216509 - DNA, 20 bp, Artificial
  CRISPR gRNA sequence
aaattgaacaagaaaatatc

SEQ ID NO: 216510 - DNA, 20 bp, Artificial
  CRISPR gRNA sequence
aattgaacaagaaaatatct

SEQ ID NO: 216511 - DNA, 20 bp, Artificial
  CRISPR gRNA sequence
aacaagaaaatatctgaatt

SEQ ID NO: 216512 - DNA, 20 bp, Artificial
  CRISPR gRNA sequence
aatttgtatctatacataga

SEQ ID NO: 216513 - DNA, 20 bp, Artificial
  CRISPR gRNA sequence
gtatctatacatagatataa

SEQ ID NO: 216514 - DNA, 20 bp, Artificial
  CRISPR gRNA sequence
tatctatacatagatataaa

SEQ ID NO: 216515 - DNA, 20 bp, Artificial
  CRISPR gRNA sequence
tacatagatataaattctac

SEQ ID NO: 216516 - DNA, 20 bp, Artificial
  CRISPR gRNA sequence
tacgtatatattctgcatct

SEQ ID NO: 216517 - DNA, 20 bp, Artificial
  CRISPR gRNA sequence
cgtatatattctgcatctgc

SEQ ID NO: 216518 - DNA, 20 bp, Artificial
  CRISPR gRNA sequence
tgcatctgcatcattctaaa

SEQ ID NO: 216519 - DNA, 20 bp, Artificial
  CRISPR gRNA sequence
catctgcatcattctaaaat

SEQ ID NO: 216520 - DNA, 20 bp, Artificial
  CRISPR gRNA sequence
catcattctaaaatatctgg

SEQ ID NO: 216521 - DNA, 20 bp, Artificial
  CRISPR gRNA sequence
taaaatatctgggatgttgt

SEQ ID NO: 216522 - DNA, 20 bp, Artificial
  CRISPR gRNA sequence
aaatatctgggatgttgtgg

SEQ ID NO: 216523 - DNA, 20 bp, Artificial
  CRISPR gRNA sequence
ggatgttgtggtaaatatgg

SEQ ID NO: 216524 - DNA, 20 bp, Artificial
  CRISPR gRNA sequence
tggtaaatatggtacttact

SEQ ID NO: 216525 - DNA, 20 bp, Artificial
  CRISPR gRNA sequence
actgctaccagattgatttg

SEQ ID NO: 216526 - DNA, 20 bp, Artificial
  CRISPR gRNA sequence
ctgctaccagattgatttgt

SEQ ID NO: 216527 - DNA, 20 bp, Artificial
  CRISPR gRNA sequence
ctaccagattgatttgtatc

SEQ ID NO: 216528 - DNA, 20 bp, Artificial
  CRISPR gRNA sequence
ccagattgatttgtatcaaa

SEQ ID NO: 216529 - DNA, 20 bp, Artificial
  CRISPR gRNA sequence
atttgtatcaaaacactata

SEQ ID NO: 216530 - DNA, 20 bp, Artificial
  CRISPR gRNA sequence
gtatcaaaacactatatgcc

SEQ ID NO: 216531 - DNA, 20 bp, Artificial
  CRISPR gRNA sequence
tatcaaaacactatatgccc

SEQ ID NO: 216532 - DNA, 20 bp, Artificial
  CRISPR gRNA sequence
tatgcccttatattgaacta

SEQ ID NO: 216533 - DNA, 20 bp, Artificial
  CRISPR gRNA sequence
atattgaactaactggtaat

SEQ ID NO: 216534 - DNA, 20 bp, Artificial
  CRISPR gRNA sequence
tattgaactaactggtaatg

SEQ ID NO: 216535 - DNA, 20 bp, Artificial
  CRISPR gRNA sequence
aactaactggtaatggcttt

SEQ ID NO: 216536 - DNA, 20 bp, Artificial
  CRISPR gRNA sequence
actggtaatggctttaaaaa

SEQ ID NO: 216537 - DNA, 20 bp, Artificial
  CRISPR gRNA sequence
gtaatggctttaaaaatgag

SEQ ID NO: 216538 - DNA, 20 bp, Artificial
  CRISPR gRNA sequence
taaaaatgagaaagtattga

SEQ ID NO: 216539 - DNA, 20 bp, Artificial
  CRISPR gRNA sequence
aaaaatgagaaagtattgat

SEQ ID NO: 216540 - DNA, 20 bp, Artificial
  CRISPR gRNA sequence
aaaatgagaaagtattgatc

SEQ ID NO: 216541 - DNA, 20 bp, Artificial
  CRISPR gRNA sequence
atccttataattatataaac

SEQ ID NO: 216542 - DNA, 20 bp, Artificial
  CRISPR gRNA sequence
ataattatataaacgttctc

SEQ ID NO: 216543 - DNA, 20 bp, Artificial
  CRISPR gRNA sequence
taattatataaacgttctct

SEQ ID NO: 216544 - DNA, 20 bp, Artificial
  CRISPR gRNA sequence
tataaacgttctctacaaac

SEQ ID NO: 216545 - DNA, 20 bp, Artificial
  CRISPR gRNA sequence
tctacaaacaacaagcccaa

SEQ ID NO: 216546 - DNA, 20 bp, Artificial
  CRISPR gRNA sequence
tacaaacaacaagcccaact

SEQ ID NO: 216547 - DNA, 20 bp, Artificial
  CRISPR gRNA sequence
caaacaacaagcccaacttt

SEQ ID NO: 216548 - DNA, 20 bp, Artificial
  CRISPR gRNA sequence
tagtgagtttggttaggttc

SEQ ID NO: 216549 - DNA, 20 bp, Artificial
  CRISPR gRNA sequence
agtgagtttggttaggttct

SEQ ID NO: 216550 - DNA, 20 bp, Artificial
  CRISPR gRNA sequence
gtgagtttggttaggttctt

SEQ ID NO: 216551 - DNA, 20 bp, Artificial
  CRISPR gRNA sequence
ggttaggttcttgtaatctt

SEQ ID NO: 216552 - DNA, 20 bp, Artificial
  CRISPR gRNA sequence
gttaggttcttgtaatcttt

SEQ ID NO: 216553 - DNA, 20 bp, Artificial
  CRISPR gRNA sequence
ggttcttgtaatcttttcta

SEQ ID NO: 216554 - DNA, 20 bp, Artificial
  CRISPR gRNA sequence
ttgtaatcttttctatgctt

SEQ ID NO: 216555 - DNA, 20 bp, Artificial
  CRISPR gRNA sequence
gtaatcttttctatgctttc

SEQ ID NO: 216556 - DNA, 20 bp, Artificial
  CRISPR gRNA sequence
taatcttttctatgctttca

SEQ ID NO: 216557 - DNA, 20 bp, Artificial
  CRISPR gRNA sequence
ttctatgctttcacattaag

SEQ ID NO: 216558 - DNA, 20 bp, Artificial
  CRISPR gRNA sequence
tctatgctttcacattaagt

SEQ ID NO: 216559 - DNA, 20 bp, Artificial
  CRISPR gRNA sequence
ctatgctttcacattaagtt

SEQ ID NO: 216560 - DNA, 20 bp, Artificial
  CRISPR gRNA sequence
tatgctttcacattaagtta

SEQ ID NO: 216561 - DNA, 20 bp, Artificial
  CRISPR gRNA sequence
tgctttcacattaagttatt

SEQ ID NO: 216562 - DNA, 20 bp, Artificial
  CRISPR gRNA sequence
tcacattaagttattgtgcc

SEQ ID NO: 216563 - DNA, 20 bp, Artificial
  CRISPR gRNA sequence
cacattaagttattgtgccc

SEQ ID NO: 216564 - DNA, 20 bp, Artificial
  CRISPR gRNA sequence
acattaagttattgtgccca

SEQ ID NO: 216565 - DNA, 20 bp, Artificial
  CRISPR gRNA sequence
agttattgtgcccagtcctt

SEQ ID NO: 216566 - DNA, 20 bp, Artificial
  CRISPR gRNA sequence
ttgtgcccagtcctttttct

SEQ ID NO: 216567 - DNA, 20 bp, Artificial
  CRISPR gRNA sequence
tgcccagtcctttttctcat

SEQ ID NO: 216568 - DNA, 20 bp, Artificial
  CRISPR gRNA sequence
tttctcatcttataaaatta

SEQ ID NO: 216569 - DNA, 20 bp, Artificial
  CRISPR gRNA sequence
ttctcatcttataaaattaa

SEQ ID NO: 216570 - DNA, 20 bp, Artificial
  CRISPR gRNA sequence
tctcatcttataaaattaaa

SEQ ID NO: 216571 - DNA, 20 bp, Artificial
  CRISPR gRNA sequence
ctcatcttataaaattaaaa

SEQ ID NO: 216572 - DNA, 20 bp, Artificial
  CRISPR gRNA sequence
tcatcttataaaattaaaat

SEQ ID NO: 216573 - DNA, 20 bp, Artificial
  CRISPR gRNA sequence
atcttataaaattaaaatgc

SEQ ID NO: 216574 - DNA, 20 bp, Artificial
  CRISPR gRNA sequence
ataaaattaaaatgcttcca

SEQ ID NO: 216575 - DNA, 20 bp, Artificial
  CRISPR gRNA sequence
taaaattaaaatgcttccaa

SEQ ID NO: 216576 - DNA, 20 bp, Artificial
  CRISPR gRNA sequence
aaatgcttccaataaaagaa

SEQ ID NO: 216577 - DNA, 20 bp, Artificial
  CRISPR gRNA sequence
ccaataaaagaaaaaaaata

SEQ ID NO: 216578 - DNA, 20 bp, Artificial
  CRISPR gRNA sequence
caataaaagaaaaaaaatac

SEQ ID NO: 216579 - DNA, 20 bp, Artificial
  CRISPR gRNA sequence
aaaaagttaaaaaatagaaa

SEQ ID NO: 216580 - DNA, 20 bp, Artificial
  CRISPR gRNA sequence
aaaagttaaaaaatagaaag

SEQ ID NO: 216581 - DNA, 20 bp, Artificial
  CRISPR gRNA sequence
aaaaatagaaagtgaaagtc

SEQ ID NO: 216582 - DNA, 20 bp, Artificial
  CRISPR gRNA sequence
tcacagaaagttgtagaaag

SEQ ID NO: 216583 - DNA, 20 bp, Artificial
  CRISPR gRNA sequence
cacagaaagttgtagaaagt

SEQ ID NO: 216584 - DNA, 20 bp, Artificial
  CRISPR gRNA sequence
acagaaagttgtagaaagtg

SEQ ID NO: 216585 - DNA, 20 bp, Artificial
  CRISPR gRNA sequence
tagaaagtgaaaggcctact

SEQ ID NO: 216586 - DNA, 20 bp, Artificial
  CRISPR gRNA sequence
ctctttaaaatagcaaatta

SEQ ID NO: 216587 - DNA, 20 bp, Artificial
  CRISPR gRNA sequence
tttaaaatagcaaattaagg

SEQ ID NO: 216588 - DNA, 20 bp, Artificial
  CRISPR gRNA sequence
taaaatagcaaattaaggct

SEQ ID NO: 216589 - DNA, 20 bp, Artificial
  CRISPR gRNA sequence
aaaatagcaaattaaggcta

SEQ ID NO: 216590 - DNA, 20 bp, Artificial
  CRISPR gRNA sequence
aaatagcaaattaaggctac

SEQ ID NO: 216591 - DNA, 20 bp, Artificial
  CRISPR gRNA sequence
aggctacaaatttaaagttg

SEQ ID NO: 216592 - DNA, 20 bp, Artificial
  CRISPR gRNA sequence
caaatttaaagttggaaata

SEQ ID NO: 216593 - DNA, 20 bp, Artificial
  CRISPR gRNA sequence
aaagttggaaataataaaaa

SEQ ID NO: 216594 - DNA, 20 bp, Artificial
  CRISPR gRNA sequence
aagttggaaataataaaaat

SEQ ID NO: 216595 - DNA, 20 bp, Artificial
  CRISPR gRNA sequence
gaaataataaaaattataaa

SEQ ID NO: 216596 - DNA, 20 bp, Artificial
  CRISPR gRNA sequence
taaaagttaaaaatctcata

SEQ ID NO: 216597 - DNA, 20 bp, Artificial
  CRISPR gRNA sequence
aaaatctcatagcgacatta

SEQ ID NO: 216598 - DNA, 20 bp, Artificial
  CRISPR gRNA sequence
atagcgacattaacttcttc

SEQ ID NO: 216599 - DNA, 20 bp, Artificial
  CRISPR gRNA sequence
acttcttcttgaagagaaag

SEQ ID NO: 216600 - DNA, 20 bp, Artificial
  CRISPR gRNA sequence
cttcttgaagagaaagcttg

SEQ ID NO: 216601 - DNA, 20 bp, Artificial
  CRISPR gRNA sequence
ttcttgaagagaaagcttgg

SEQ ID NO: 216602 - DNA, 20 bp, Artificial
  CRISPR gRNA sequence
cttgaagagaaagcttggat

SEQ ID NO: 216603 - DNA, 20 bp, Artificial
  CRISPR gRNA sequence
ttgaagagaaagcttggatt

SEQ ID NO: 216604 - DNA, 20 bp, Artificial
  CRISPR gRNA sequence
gaagagaaagcttggatttt

SEQ ID NO: 216605 - DNA, 20 bp, Artificial
  CRISPR gRNA sequence
aagagaaagcttggattttt

SEQ ID NO: 216606 - DNA, 20 bp, Artificial
  CRISPR gRNA sequence
ggatttttaactatttgagg

SEQ ID NO: 216607 - DNA, 20 bp, Artificial
  CRISPR gRNA sequence
gatttttaactatttgagga

SEQ ID NO: 216608 - DNA, 20 bp, Artificial
  CRISPR gRNA sequence
ttaactatttgaggatttta

SEQ ID NO: 216609 - DNA, 20 bp, Artificial
  CRISPR gRNA sequence
taactatttgaggattttat

SEQ ID NO: 216610 - DNA, 20 bp, Artificial
  CRISPR gRNA sequence
aactatttgaggattttatt

SEQ ID NO: 216611 - DNA, 20 bp, Artificial
  CRISPR gRNA sequence
actatttgaggattttattg

SEQ ID NO: 216612 - DNA, 20 bp, Artificial
  CRISPR gRNA sequence
tttgaggattttattgcatt

SEQ ID NO: 216613 - DNA, 20 bp, Artificial
  CRISPR gRNA sequence
gaggattttattgcatttaa

SEQ ID NO: 216614 - DNA, 20 bp, Artificial
  CRISPR gRNA sequence
aggattttattgcatttaaa

SEQ ID NO: 216615 - DNA, 20 bp, Artificial
  CRISPR gRNA sequence
tattgcatttaaatcaaaac

SEQ ID NO: 216616 - DNA, 20 bp, Artificial
  CRISPR gRNA sequence
attgcatttaaatcaaaaca

SEQ ID NO: 216617 - DNA, 20 bp, Artificial
  CRISPR gRNA sequence
ttgcatttaaatcaaaacac

SEQ ID NO: 216618 - DNA, 20 bp, Artificial
  CRISPR gRNA sequence
catttaaatcaaaacacaat

SEQ ID NO: 216619 - DNA, 20 bp, Artificial
  CRISPR gRNA sequence
aaatcaaaacacaatcatta

SEQ ID NO: 216620 - DNA, 20 bp, Artificial
  CRISPR gRNA sequence
aatcaaaacacaatcattag

SEQ ID NO: 216621 - DNA, 20 bp, Artificial
  CRISPR gRNA sequence
ggcttttctaaaacagaaca

SEQ ID NO: 216622 - DNA, 20 bp, Artificial
  CRISPR gRNA sequence
ttctaaaacagaacacgtgc

SEQ ID NO: 216623 - DNA, 20 bp, Artificial
  CRISPR gRNA sequence
tctaaaacagaacacgtgca

SEQ ID NO: 216624 - DNA, 20 bp, Artificial
  CRISPR gRNA sequence
ctaaaacagaacacgtgcaa

SEQ ID NO: 216625 - DNA, 20 bp, Artificial
  CRISPR gRNA sequence
taaaacagaacacgtgcaat

SEQ ID NO: 216626 - DNA, 20 bp, Artificial
  CRISPR gRNA sequence
aaacagaacacgtgcaatga

SEQ ID NO: 216627 - DNA, 20 bp, Artificial
  CRISPR gRNA sequence
ttttggagacacttaaaatt

SEQ ID NO: 216628 - DNA, 20 bp, Artificial
  CRISPR gRNA sequence
tggagacacttaaaatttta

SEQ ID NO: 216629 - DNA, 20 bp, Artificial
  CRISPR gRNA sequence
ggagacacttaaaattttaa

SEQ ID NO: 216630 - DNA, 20 bp, Artificial
  CRISPR gRNA sequence
gagacacttaaaattttaac

SEQ ID NO: 216631 - DNA, 20 bp, Artificial
  CRISPR gRNA sequence
aaaattttaacttcctaata

SEQ ID NO: 216632 - DNA, 20 bp, Artificial
  CRISPR gRNA sequence
aaattttaacttcctaatat

SEQ ID NO: 216633 - DNA, 20 bp, Artificial
  CRISPR gRNA sequence
taacttcctaatataaacgc

SEQ ID NO: 216634 - DNA, 20 bp, Artificial
  CRISPR gRNA sequence
aacttcctaatataaacgct

SEQ ID NO: 216635 - DNA, 20 bp, Artificial
  CRISPR gRNA sequence
acttcctaatataaacgctc

SEQ ID NO: 216636 - DNA, 20 bp, Artificial
  CRISPR gRNA sequence
cctaatataaacgctcaaat

SEQ ID NO: 216637 - DNA, 20 bp, Artificial
  CRISPR gRNA sequence
ctaatataaacgctcaaatt

SEQ ID NO: 216638 - DNA, 20 bp, Artificial
  CRISPR gRNA sequence
atataaacgctcaaatttgc

SEQ ID NO: 216639 - DNA, 20 bp, Artificial
  CRISPR gRNA sequence
aaatttgcaaccttaatgtt

SEQ ID NO: 216640 - DNA, 20 bp, Artificial
  CRISPR gRNA sequence
gcaaccttaatgttacatag

SEQ ID NO: 216641 - DNA, 20 bp, Artificial
  CRISPR gRNA sequence
caaccttaatgttacataga

SEQ ID NO: 216642 - DNA, 20 bp, Artificial
  CRISPR gRNA sequence
aatgttacatagattcagat

SEQ ID NO: 216643 - DNA, 20 bp, Artificial
  CRISPR gRNA sequence
atgttacatagattcagatt

SEQ ID NO: 216644 - DNA, 20 bp, Artificial
  CRISPR gRNA sequence
catagattcagatttacaca

SEQ ID NO: 216645 - DNA, 20 bp, Artificial
  CRISPR gRNA sequence
agatttacacagtcagatta

SEQ ID NO: 216646 - DNA, 20 bp, Artificial
  CRISPR gRNA sequence
acacagtcagattatataag

SEQ ID NO: 216647 - DNA, 20 bp, Artificial
  CRISPR gRNA sequence
cacagtcagattatataagc

SEQ ID NO: 216648 - DNA, 20 bp, Artificial
  CRISPR gRNA sequence
tataagcaaaccatattaat

SEQ ID NO: 216649 - DNA, 20 bp, Artificial
  CRISPR gRNA sequence
atgttcctcctagtctacca

SEQ ID NO: 216650 - DNA, 20 bp, Artificial
  CRISPR gRNA sequence
ctcctagtctaccatgttat

SEQ ID NO: 216651 - DNA, 20 bp, Artificial
  CRISPR gRNA sequence
ctagtctaccatgttatcta

SEQ ID NO: 216652 - DNA, 20 bp, Artificial
  CRISPR gRNA sequence
gtctaccatgttatctaaag

SEQ ID NO: 216653 - DNA, 20 bp, Artificial
  CRISPR gRNA sequence
ccatgttatctaaagagcaa

SEQ ID NO: 216654 - DNA, 20 bp, Artificial
  CRISPR gRNA sequence
tctaaagagcaactttcctg

SEQ ID NO: 216655 - DNA, 20 bp, Artificial
  CRISPR gRNA sequence
aagagcaactttcctgtacc

SEQ ID NO: 216656 - DNA, 20 bp, Artificial
  CRISPR gRNA sequence
tcctgtaccttgtctcttct

SEQ ID NO: 216657 - DNA, 20 bp, Artificial
  CRISPR gRNA sequence
cctgtaccttgtctcttctt

SEQ ID NO: 216658 - DNA, 20 bp, Artificial
  CRISPR gRNA sequence
ctgtaccttgtctcttcttg

SEQ ID NO: 216659 - DNA, 20 bp, Artificial
  CRISPR gRNA sequence
taccttgtctcttcttgcct

SEQ ID NO: 216660 - DNA, 20 bp, Artificial
  CRISPR gRNA sequence
gtctcttcttgcctttcaac

SEQ ID NO: 216661 - DNA, 20 bp, Artificial
  CRISPR gRNA sequence
tctcttcttgcctttcaact

SEQ ID NO: 216662 - DNA, 20 bp, Artificial
  CRISPR gRNA sequence
ttcttgcctttcaactgact

SEQ ID NO: 216663 - DNA, 20 bp, Artificial
  CRISPR gRNA sequence
cttgcctttcaactgactgt

SEQ ID NO: 216664 - DNA, 20 bp, Artificial
  CRISPR gRNA sequence
ttgcctttcaactgactgta

SEQ ID NO: 216665 - DNA, 20 bp, Artificial
  CRISPR gRNA sequence
gcctttcaactgactgtagg

SEQ ID NO: 216666 - DNA, 20 bp, Artificial
  CRISPR gRNA sequence
cctttcaactgactgtaggt

SEQ ID NO: 216667 - DNA, 20 bp, Artificial
  CRISPR gRNA sequence
tcaactgactgtaggtgtcc

SEQ ID NO: 216668 - DNA, 20 bp, Artificial
  CRISPR gRNA sequence
caactgactgtaggtgtccc

SEQ ID NO: 216669 - DNA, 20 bp, Artificial
  CRISPR gRNA sequence
aactgactgtaggtgtccct

SEQ ID NO: 216670 - DNA, 20 bp, Artificial
  CRISPR gRNA sequence
actgtaggtgtccctctgaa

SEQ ID NO: 216671 - DNA, 20 bp, Artificial
  CRISPR gRNA sequence
taggtgtccctctgaaccct

SEQ ID NO: 216672 - DNA, 20 bp, Artificial
  CRISPR gRNA sequence
tgaaccctggcatcagacaa

SEQ ID NO: 216673 - DNA, 20 bp, Artificial
  CRISPR gRNA sequence
aaccctggcatcagacaagt

SEQ ID NO: 216674 - DNA, 20 bp, Artificial
  CRISPR gRNA sequence
gcatcagacaagttgattta

SEQ ID NO: 216675 - DNA, 20 bp, Artificial
  CRISPR gRNA sequence
atttaaaaagttaatttagg

SEQ ID NO: 216676 - DNA, 20 bp, Artificial
  CRISPR gRNA sequence
aaaaagttaatttaggatac

SEQ ID NO: 216677 - DNA, 20 bp, Artificial
  CRISPR gRNA sequence
aaaagttaatttaggatact

SEQ ID NO: 216678 - DNA, 20 bp, Artificial
  CRISPR gRNA sequence
atttaggatactatcaataa

SEQ ID NO: 216679 - DNA, 20 bp, Artificial
  CRISPR gRNA sequence
aggatactatcaataaaatt

SEQ ID NO: 216680 - DNA, 20 bp, Artificial
  CRISPR gRNA sequence
ggatactatcaataaaatta

SEQ ID NO: 216681 - DNA, 20 bp, Artificial
  CRISPR gRNA sequence
tcaataaaattaggacacta

SEQ ID NO: 216682 - DNA, 20 bp, Artificial
  CRISPR gRNA sequence
ggacactatcaataaaattg

SEQ ID NO: 216683 - DNA, 20 bp, Artificial
  CRISPR gRNA sequence
tcaataaaattgcactaaat

SEQ ID NO: 216684 - DNA, 20 bp, Artificial
  CRISPR gRNA sequence
cactaaattttaaacatata

SEQ ID NO: 216685 - DNA, 20 bp, Artificial
  CRISPR gRNA sequence
aattttaaacatatagcata

SEQ ID NO: 216686 - DNA, 20 bp, Artificial
  CRISPR gRNA sequence
taaacatatagcataaattt

SEQ ID NO: 216687 - DNA, 20 bp, Artificial
  CRISPR gRNA sequence
aaacatatagcataaatttt

SEQ ID NO: 216688 - DNA, 20 bp, Artificial
  CRISPR gRNA sequence
aacatatagcataaatttta

SEQ ID NO: 216689 - DNA, 20 bp, Artificial
  CRISPR gRNA sequence
tagcatatagtatacttata

SEQ ID NO: 216690 - DNA, 20 bp, Artificial
  CRISPR gRNA sequence
agcatatagtatacttatat

SEQ ID NO: 216691 - DNA, 20 bp, Artificial
  CRISPR gRNA sequence
gcatatagtatacttatatg

SEQ ID NO: 216692 - DNA, 20 bp, Artificial
  CRISPR gRNA sequence
atatgctaacctatgacaaa

SEQ ID NO: 216693 - DNA, 20 bp, Artificial
  CRISPR gRNA sequence
tatgctaacctatgacaaag

SEQ ID NO: 216694 - DNA, 20 bp, Artificial
  CRISPR gRNA sequence
acctatgacaaagaaaaaat

SEQ ID NO: 216695 - DNA, 20 bp, Artificial
  CRISPR gRNA sequence
tgacaaagaaaaaataattt

SEQ ID NO: 216696 - DNA, 20 bp, Artificial
  CRISPR gRNA sequence
ggggtacttgtcaagattta

SEQ ID NO: 216697 - DNA, 20 bp, Artificial
  CRISPR gRNA sequence
gggtacttgtcaagatttaa

SEQ ID NO: 216698 - DNA, 20 bp, Artificial
  CRISPR gRNA sequence
gtcaagatttaagtcatttt

SEQ ID NO: 216699 - DNA, 20 bp, Artificial
  CRISPR gRNA sequence
tcaagatttaagtcatttta

SEQ ID NO: 216700 - DNA, 20 bp, Artificial
  CRISPR gRNA sequence
aagtcattttaattttaatg

SEQ ID NO: 216701 - DNA, 20 bp, Artificial
  CRISPR gRNA sequence
agtcattttaattttaatgt

SEQ ID NO: 216702 - DNA, 20 bp, Artificial
  CRISPR gRNA sequence
taattttaatgtcagaacag

SEQ ID NO: 216703 - DNA, 20 bp, Artificial
  CRISPR gRNA sequence
aattttaatgtcagaacagt

SEQ ID NO: 216704 - DNA, 20 bp, Artificial
  CRISPR gRNA sequence
attttaatgtcagaacagtg

SEQ ID NO: 216705 - DNA, 20 bp, Artificial
  CRISPR gRNA sequence
taatgtcagaacagtgacag

SEQ ID NO: 216706 - DNA, 20 bp, Artificial
  CRISPR gRNA sequence
aatgtcagaacagtgacagg

SEQ ID NO: 216707 - DNA, 20 bp, Artificial
  CRISPR gRNA sequence
atgtcagaacagtgacaggt

SEQ ID NO: 216708 - DNA, 20 bp, Artificial
  CRISPR gRNA sequence
cacaggcttggaggaacgta

SEQ ID NO: 216709 - DNA, 20 bp, Artificial
  CRISPR gRNA sequence
acaggcttggaggaacgtaa

SEQ ID NO: 216710 - DNA, 20 bp, Artificial
  CRISPR gRNA sequence
ggaggaacgtaagtgatgga

SEQ ID NO: 216711 - DNA, 20 bp, Artificial
  CRISPR gRNA sequence
gaggaacgtaagtgatggag

SEQ ID NO: 216712 - DNA, 20 bp, Artificial
  CRISPR gRNA sequence
aggaggtggcagatagacaa

SEQ ID NO: 216713 - DNA, 20 bp, Artificial
  CRISPR gRNA sequence
agttccacttgagacattgt

SEQ ID NO: 216714 - DNA, 20 bp, Artificial
  CRISPR gRNA sequence
gttccacttgagacattgtc

SEQ ID NO: 216715 - DNA, 20 bp, Artificial
  CRISPR gRNA sequence
cacttgagacattgtcacca

SEQ ID NO: 216716 - DNA, 20 bp, Artificial
  CRISPR gRNA sequence
gagacattgtcaccagacct

SEQ ID NO: 216717 - DNA, 20 bp, Artificial
  CRISPR gRNA sequence
agacattgtcaccagacctg

SEQ ID NO: 216718 - DNA, 20 bp, Artificial
  CRISPR gRNA sequence
tcaccagacctgctggcaac

SEQ ID NO: 216719 - DNA, 20 bp, Artificial
  CRISPR gRNA sequence
ctggcaactgtactgaagat

SEQ ID NO: 216720 - DNA, 20 bp, Artificial
  CRISPR gRNA sequence
gcaactgtactgaagatcat

SEQ ID NO: 216721 - DNA, 20 bp, Artificial
  CRISPR gRNA sequence
tactgaagatcattctatgc

SEQ ID NO: 216722 - DNA, 20 bp, Artificial
  CRISPR gRNA sequence
aagatcattctatgctagat

SEQ ID NO: 216723 - DNA, 20 bp, Artificial
  CRISPR gRNA sequence
tatgctagatatggaaggca

SEQ ID NO: 216724 - DNA, 20 bp, Artificial
  CRISPR gRNA sequence
tgctagatatggaaggcatg

SEQ ID NO: 216725 - DNA, 20 bp, Artificial
  CRISPR gRNA sequence
gatatggaaggcatggggtg

SEQ ID NO: 216726 - DNA, 20 bp, Artificial
  CRISPR gRNA sequence
cccgtcagccaaaggtatct

SEQ ID NO: 216727 - DNA, 20 bp, Artificial
  CRISPR gRNA sequence
atactacttcaccagagttg

SEQ ID NO: 216728 - DNA, 20 bp, Artificial
  CRISPR gRNA sequence
cttcaccagagttgtatgga

SEQ ID NO: 216729 - DNA, 20 bp, Artificial
  CRISPR gRNA sequence
caccagagttgtatggatac

SEQ ID NO: 216730 - DNA, 20 bp, Artificial
  CRISPR gRNA sequence
accagagttgtatggatact

SEQ ID NO: 216731 - DNA, 20 bp, Artificial
  CRISPR gRNA sequence
tatggatactgcaaatcaca

SEQ ID NO: 216732 - DNA, 20 bp, Artificial
  CRISPR gRNA sequence
caaatcacacactattctca

SEQ ID NO: 216733 - DNA, 20 bp, Artificial
  CRISPR gRNA sequence
ttctcaggcatttgtgggga

SEQ ID NO: 216734 - DNA, 20 bp, Artificial
  CRISPR gRNA sequence
tcaggcatttgtggggagca

SEQ ID NO: 216735 - DNA, 20 bp, Artificial
  CRISPR gRNA sequence
aggcatttgtggggagcaac

SEQ ID NO: 216736 - DNA, 20 bp, Artificial
  CRISPR gRNA sequence
gtggggagcaacaaaaccag

SEQ ID NO: 216737 - DNA, 20 bp, Artificial
  CRISPR gRNA sequence
tggggagcaacaaaaccagg

SEQ ID NO: 216738 - DNA, 20 bp, Artificial
  CRISPR gRNA sequence
ccagaaccagacacatggtg

SEQ ID NO: 216739 - DNA, 20 bp, Artificial
  CRISPR gRNA sequence
cagaaccagacacatggtga

SEQ ID NO: 216740 - DNA, 20 bp, Artificial
  CRISPR gRNA sequence
gaagatgtaacaaaaataga

SEQ ID NO: 216741 - DNA, 20 bp, Artificial
  CRISPR gRNA sequence
aagatgttcactgtagctac

SEQ ID NO: 216742 - DNA, 20 bp, Artificial
  CRISPR gRNA sequence
actgtagctaccacatgaat

SEQ ID NO: 216743 - DNA, 20 bp, Artificial
  CRISPR gRNA sequence
tagctaccacatgaattcca

SEQ ID NO: 216744 - DNA, 20 bp, Artificial
  CRISPR gRNA sequence
ccacatgaattccattctgc

SEQ ID NO: 216745 - DNA, 20 bp, Artificial
  CRISPR gRNA sequence
cattctgctttagatgtctc

SEQ ID NO: 216746 - DNA, 20 bp, Artificial
  CRISPR gRNA sequence
tgctttagatgtctccattg

SEQ ID NO: 216747 - DNA, 20 bp, Artificial
  CRISPR gRNA sequence
ctttagatgtctccattgta

SEQ ID NO: 216748 - DNA, 20 bp, Artificial
  CRISPR gRNA sequence
tagatgtctccattgtattt

SEQ ID NO: 216749 - DNA, 20 bp, Artificial
  CRISPR gRNA sequence
agatgtctccattgtatttt

SEQ ID NO: 216750 - DNA, 20 bp, Artificial
  CRISPR gRNA sequence
gatgtctccattgtatttta

SEQ ID NO: 216751 - DNA, 20 bp, Artificial
  CRISPR gRNA sequence
cattgtattttatggcatta

SEQ ID NO: 216752 - DNA, 20 bp, Artificial
  CRISPR gRNA sequence
tattttatggcattatgtgg

SEQ ID NO: 216753 - DNA, 20 bp, Artificial
  CRISPR gRNA sequence
tatggcattatgtggtataa

SEQ ID NO: 216754 - DNA, 20 bp, Artificial
  CRISPR gRNA sequence
atggcattatgtggtataaa

SEQ ID NO: 216755 - DNA, 20 bp, Artificial
  CRISPR gRNA sequence
tggcattatgtggtataaaa

SEQ ID NO: 216756 - DNA, 20 bp, Artificial
  CRISPR gRNA sequence
tgtggtataaaattagaaaa

SEQ ID NO: 216757 - DNA, 20 bp, Artificial
  CRISPR gRNA sequence
gaaaatttcattgagcaaca

SEQ ID NO: 216758 - DNA, 20 bp, Artificial
  CRISPR gRNA sequence
cattgagcaacaactaagac

SEQ ID NO: 216759 - DNA, 20 bp, Artificial
  CRISPR gRNA sequence
attgagcaacaactaagact

SEQ ID NO: 216760 - DNA, 20 bp, Artificial
  CRISPR gRNA sequence
agcaacaactaagacttatg

SEQ ID NO: 216761 - DNA, 20 bp, Artificial
  CRISPR gRNA sequence
agacttatgaactcatatgc

SEQ ID NO: 216762 - DNA, 20 bp, Artificial
  CRISPR gRNA sequence
atgaactcatatgctaagga

SEQ ID NO: 216763 - DNA, 20 bp, Artificial
  CRISPR gRNA sequence
tgaactcatatgctaaggat

SEQ ID NO: 216764 - DNA, 20 bp, Artificial
  CRISPR gRNA sequence
atatgctaaggatacgcaga

SEQ ID NO: 216765 - DNA, 20 bp, Artificial
  CRISPR gRNA sequence
aggatacgcagattttagtt

SEQ ID NO: 216766 - DNA, 20 bp, Artificial
  CRISPR gRNA sequence
tagttaagtattttaattat

SEQ ID NO: 216767 - DNA, 20 bp, Artificial
  CRISPR gRNA sequence
agttaagtattttaattatt

SEQ ID NO: 216768 - DNA, 20 bp, Artificial
  CRISPR gRNA sequence
gttaagtattttaattattt

SEQ ID NO: 216769 - DNA, 20 bp, Artificial
  CRISPR gRNA sequence
agtattttaattatttatct

SEQ ID NO: 216770 - DNA, 20 bp, Artificial
  CRISPR gRNA sequence
taattatttatctaataagc

SEQ ID NO: 216771 - DNA, 20 bp, Artificial
  CRISPR gRNA sequence
aattatttatctaataagca

SEQ ID NO: 216772 - DNA, 20 bp, Artificial
  CRISPR gRNA sequence
attatttatctaataagcat

SEQ ID NO: 216773 - DNA, 20 bp, Artificial
  CRISPR gRNA sequence
tttatctaataagcattaat

SEQ ID NO: 216774 - DNA, 20 bp, Artificial
  CRISPR gRNA sequence
atctaataagcattaattaa

SEQ ID NO: 216775 - DNA, 20 bp, Artificial
  CRISPR gRNA sequence
tctaataagcattaattaaa

SEQ ID NO: 216776 - DNA, 20 bp, Artificial
  CRISPR gRNA sequence
ataagcattaattaaagaaa

SEQ ID NO: 216777 - DNA, 20 bp, Artificial
  CRISPR gRNA sequence
attaaagaaagacacagaat

SEQ ID NO: 216778 - DNA, 20 bp, Artificial
  CRISPR gRNA sequence
aagaaagacacagaatatat

SEQ ID NO: 216779 - DNA, 20 bp, Artificial
  CRISPR gRNA sequence
aattcaattaacaatcatca

SEQ ID NO: 216780 - DNA, 20 bp, Artificial
  CRISPR gRNA sequence
aattaacaatcatcaagaac

SEQ ID NO: 216781 - DNA, 20 bp, Artificial
  CRISPR gRNA sequence
acaatcatcaagaaccaaag

SEQ ID NO: 216782 - DNA, 20 bp, Artificial
  CRISPR gRNA sequence
agaaataaaggtaaaagttt

SEQ ID NO: 216783 - DNA, 20 bp, Artificial
  CRISPR gRNA sequence
tttgaaactattatgtgagt

SEQ ID NO: 216784 - DNA, 20 bp, Artificial
  CRISPR gRNA sequence
ttgaaactattatgtgagtc

SEQ ID NO: 216785 - DNA, 20 bp, Artificial
  CRISPR gRNA sequence
tgaaactattatgtgagtca

SEQ ID NO: 216786 - DNA, 20 bp, Artificial
  CRISPR gRNA sequence
gaaactattatgtgagtcat

SEQ ID NO: 216787 - DNA, 20 bp, Artificial
  CRISPR gRNA sequence
aaactattatgtgagtcata

SEQ ID NO: 216788 - DNA, 20 bp, Artificial
  CRISPR gRNA sequence
ttatgtgagtcatatgagaa

SEQ ID NO: 216789 - DNA, 20 bp, Artificial
  CRISPR gRNA sequence
tgtgagtcatatgagaaatt

SEQ ID NO: 216790 - DNA, 20 bp, Artificial
  CRISPR gRNA sequence
tttgactataacaattcaag

SEQ ID NO: 216791 - DNA, 20 bp, Artificial
  CRISPR gRNA sequence
gactataacaattcaagttt

SEQ ID NO: 216792 - DNA, 20 bp, Artificial
  CRISPR gRNA sequence
actataacaattcaagtttc

SEQ ID NO: 216793 - DNA, 20 bp, Artificial
  CRISPR gRNA sequence
taacaattcaagtttcgtat

SEQ ID NO: 216794 - DNA, 20 bp, Artificial
  CRISPR gRNA sequence
aagtttcgtattaagtttta

SEQ ID NO: 216795 - DNA, 20 bp, Artificial
  CRISPR gRNA sequence
cgtattaagttttagaaaca

SEQ ID NO: 216796 - DNA, 20 bp, Artificial
  CRISPR gRNA sequence
gtattaagttttagaaacac

SEQ ID NO: 216797 - DNA, 20 bp, Artificial
  CRISPR gRNA sequence
agttttagaaacacatacag

SEQ ID NO: 216798 - DNA, 20 bp, Artificial
  CRISPR gRNA sequence
tagaaacacatacagcaaag

SEQ ID NO: 216799 - DNA, 20 bp, Artificial
  CRISPR gRNA sequence
agaaacacatacagcaaagt

SEQ ID NO: 216800 - DNA, 20 bp, Artificial
  CRISPR gRNA sequence
gaaacacatacagcaaagtt

SEQ ID NO: 216801 - DNA, 20 bp, Artificial
  CRISPR gRNA sequence
acctaaagcaaagcagaaac

SEQ ID NO: 216802 - DNA, 20 bp, Artificial
  CRISPR gRNA sequence
cctaaagcaaagcagaaaca

SEQ ID NO: 216803 - DNA, 20 bp, Artificial
  CRISPR gRNA sequence
aagcaaagcagaaacactat

SEQ ID NO: 216804 - DNA, 20 bp, Artificial
  CRISPR gRNA sequence
tttttttactccattaattt

SEQ ID NO: 216805 - DNA, 20 bp, Artificial
  CRISPR gRNA sequence
ttttactccattaatttata

SEQ ID NO: 216806 - DNA, 20 bp, Artificial
  CRISPR gRNA sequence
tttactccattaatttataa

SEQ ID NO: 216807 - DNA, 20 bp, Artificial
  CRISPR gRNA sequence
ttactccattaatttataac

SEQ ID NO: 216808 - DNA, 20 bp, Artificial
  CRISPR gRNA sequence
tactccattaatttataact

SEQ ID NO: 216809 - DNA, 20 bp, Artificial
  CRISPR gRNA sequence
actccattaatttataactt

SEQ ID NO: 216810 - DNA, 20 bp, Artificial
  CRISPR gRNA sequence
ctccattaatttataacttt

SEQ ID NO: 216811 - DNA, 20 bp, Artificial
  CRISPR gRNA sequence
cattaatttataacttttga

SEQ ID NO: 216812 - DNA, 20 bp, Artificial
  CRISPR gRNA sequence
atttataacttttgattatt

SEQ ID NO: 216813 - DNA, 20 bp, Artificial
  CRISPR gRNA sequence
ataacttttgattattttga

SEQ ID NO: 216814 - DNA, 20 bp, Artificial
  CRISPR gRNA sequence
taacttttgattattttgat

SEQ ID NO: 216815 - DNA, 20 bp, Artificial
  CRISPR gRNA sequence
ttgattattttgataggtgg

SEQ ID NO: 216816 - DNA, 20 bp, Artificial
  CRISPR gRNA sequence
tgattattttgataggtggt

SEQ ID NO: 216817 - DNA, 20 bp, Artificial
  CRISPR gRNA sequence
gattattttgataggtggtt

SEQ ID NO: 216818 - DNA, 20 bp, Artificial
  CRISPR gRNA sequence
attattttgataggtggtta

SEQ ID NO: 216819 - DNA, 20 bp, Artificial
  CRISPR gRNA sequence
ttttgataggtggttaagag

SEQ ID NO: 216820 - DNA, 20 bp, Artificial
  CRISPR gRNA sequence
tgataggtggttaagagtat

SEQ ID NO: 216821 - DNA, 20 bp, Artificial
  CRISPR gRNA sequence
gataggtggttaagagtatg

SEQ ID NO: 216822 - DNA, 20 bp, Artificial
  CRISPR gRNA sequence
ataggtggttaagagtatgt

SEQ ID NO: 216823 - DNA, 20 bp, Artificial
  CRISPR gRNA sequence
agagtatgttttatttcata

SEQ ID NO: 216824 - DNA, 20 bp, Artificial
  CRISPR gRNA sequence
tatttcataaaaatataatt

SEQ ID NO: 216825 - DNA, 20 bp, Artificial
  CRISPR gRNA sequence
atttcataaaaatataattt

SEQ ID NO: 216826 - DNA, 20 bp, Artificial
  CRISPR gRNA sequence
tttcataaaaatataatttt

SEQ ID NO: 216827 - DNA, 20 bp, Artificial
  CRISPR gRNA sequence
cataaaaatataattttttt

SEQ ID NO: 216828 - DNA, 20 bp, Artificial
  CRISPR gRNA sequence
ataaaaatataattttttta

SEQ ID NO: 216829 - DNA, 20 bp, Artificial
  CRISPR gRNA sequence
ttttaaaaaacggaaactaa

SEQ ID NO: 216830 - DNA, 20 bp, Artificial
  CRISPR gRNA sequence
tttaaaaaacggaaactaat

SEQ ID NO: 216831 - DNA, 20 bp, Artificial
  CRISPR gRNA sequence
ttaaaaaacggaaactaata

SEQ ID NO: 216832 - DNA, 20 bp, Artificial
  CRISPR gRNA sequence
taaaaaacggaaactaatat

SEQ ID NO: 216833 - DNA, 20 bp, Artificial
  CRISPR gRNA sequence
aaaaaacggaaactaatata

SEQ ID NO: 216834 - DNA, 20 bp, Artificial
  CRISPR gRNA sequence
aaaaacggaaactaatataa

SEQ ID NO: 216835 - DNA, 20 bp, Artificial
  CRISPR gRNA sequence
atataaattacattattggg

SEQ ID NO: 216836 - DNA, 20 bp, Artificial
  CRISPR gRNA sequence
cattattgggaacatcttga

SEQ ID NO: 216837 - DNA, 20 bp, Artificial
  CRISPR gRNA sequence
ttgggaacatcttgagctta

SEQ ID NO: 216838 - DNA, 20 bp, Artificial
  CRISPR gRNA sequence
ggaacatcttgagcttaggt

SEQ ID NO: 216839 - DNA, 20 bp, Artificial
  CRISPR gRNA sequence
gagcttaggtaagataacat

SEQ ID NO: 216840 - DNA, 20 bp, Artificial
  CRISPR gRNA sequence
agcttaggtaagataacatt

SEQ ID NO: 216841 - DNA, 20 bp, Artificial
  CRISPR gRNA sequence
aggtaagataacattagttt

SEQ ID NO: 216842 - DNA, 20 bp, Artificial
  CRISPR gRNA sequence
ggtaagataacattagtttc

SEQ ID NO: 216843 - DNA, 20 bp, Artificial
  CRISPR gRNA sequence
gtttcaggcacaattgaaaa

SEQ ID NO: 216844 - DNA, 20 bp, Artificial
  CRISPR gRNA sequence
caggcacaattgaaaatatc

SEQ ID NO: 216845 - DNA, 20 bp, Artificial
  CRISPR gRNA sequence
aggcacaattgaaaatatct

SEQ ID NO: 216846 - DNA, 20 bp, Artificial
  CRISPR gRNA sequence
aaaatatctctctgtgtaca

SEQ ID NO: 216847 - DNA, 20 bp, Artificial
  CRISPR gRNA sequence
tctgtgtacatatatctcaa

SEQ ID NO: 216848 - DNA, 20 bp, Artificial
  CRISPR gRNA sequence
tgtgtacatatatctcaata

SEQ ID NO: 216849 - DNA, 20 bp, Artificial
  CRISPR gRNA sequence
tgtacatatatctcaataaa

SEQ ID NO: 216850 - DNA, 20 bp, Artificial
  CRISPR gRNA sequence
aataaaaaataagaatttat

SEQ ID NO: 216851 - DNA, 20 bp, Artificial
  CRISPR gRNA sequence
atgcagaaatgttacttgaa

SEQ ID NO: 216852 - DNA, 20 bp, Artificial
  CRISPR gRNA sequence
tgcagaaatgttacttgaaa

SEQ ID NO: 216853 - DNA, 20 bp, Artificial
  CRISPR gRNA sequence
cttgaaaattggcagattaa

SEQ ID NO: 216854 - DNA, 20 bp, Artificial
  CRISPR gRNA sequence
gaaaattggcagattaaata

SEQ ID NO: 216855 - DNA, 20 bp, Artificial
  CRISPR gRNA sequence
aaaattggcagattaaatat

SEQ ID NO: 216856 - DNA, 20 bp, Artificial
  CRISPR gRNA sequence
gcagattaaatatacaagtt

SEQ ID NO: 216857 - DNA, 20 bp, Artificial
  CRISPR gRNA sequence
aatatacaagttagaaacaa

SEQ ID NO: 216858 - DNA, 20 bp, Artificial
  CRISPR gRNA sequence
gaaacaatgaagtaaattcc

SEQ ID NO: 216859 - DNA, 20 bp, Artificial
  CRISPR gRNA sequence
catacttactaataattgat

SEQ ID NO: 216860 - DNA, 20 bp, Artificial
  CRISPR gRNA sequence
actaataattgattttaaaa

SEQ ID NO: 216861 - DNA, 20 bp, Artificial
  CRISPR gRNA sequence
ctaataattgattttaaaag

SEQ ID NO: 216862 - DNA, 20 bp, Artificial
  CRISPR gRNA sequence
ataattgattttaaaaggag

SEQ ID NO: 216863 - DNA, 20 bp, Artificial
  CRISPR gRNA sequence
attttaaaaggagtaaaagc

SEQ ID NO: 216864 - DNA, 20 bp, Artificial
  CRISPR gRNA sequence
taaaaggagtaaaagcctaa

SEQ ID NO: 216865 - DNA, 20 bp, Artificial
  CRISPR gRNA sequence
aaaaggagtaaaagcctaaa

SEQ ID NO: 216866 - DNA, 20 bp, Artificial
  CRISPR gRNA sequence
aaaggagtaaaagcctaaat

SEQ ID NO: 216867 - DNA, 20 bp, Artificial
  CRISPR gRNA sequence
aattttgaaactcaatgttt

SEQ ID NO: 216868 - DNA, 20 bp, Artificial
  CRISPR gRNA sequence
tgaaactcaatgttttcatt

SEQ ID NO: 216869 - DNA, 20 bp, Artificial
  CRISPR gRNA sequence
gaaactcaatgttttcatta

SEQ ID NO: 216870 - DNA, 20 bp, Artificial
  CRISPR gRNA sequence
aaactcaatgttttcattat

SEQ ID NO: 216871 - DNA, 20 bp, Artificial
  CRISPR gRNA sequence
aatgttttcattatattggt

SEQ ID NO: 216872 - DNA, 20 bp, Artificial
  CRISPR gRNA sequence
tcattatattggttttaact

SEQ ID NO: 216873 - DNA, 20 bp, Artificial
  CRISPR gRNA sequence
cattatattggttttaacta

SEQ ID NO: 216874 - DNA, 20 bp, Artificial
  CRISPR gRNA sequence
attatattggttttaactag

SEQ ID NO: 216875 - DNA, 20 bp, Artificial
  CRISPR gRNA sequence
tattggttttaactagaact

SEQ ID NO: 216876 - DNA, 20 bp, Artificial
  CRISPR gRNA sequence
gttttaactagaactgtttt

SEQ ID NO: 216877 - DNA, 20 bp, Artificial
  CRISPR gRNA sequence
taactagaactgttttaaag

SEQ ID NO: 216878 - DNA, 20 bp, Artificial
  CRISPR gRNA sequence
aactagaactgttttaaagt

SEQ ID NO: 216879 - DNA, 20 bp, Artificial
  CRISPR gRNA sequence
actagaactgttttaaagtc

SEQ ID NO: 216880 - DNA, 20 bp, Artificial
  CRISPR gRNA sequence
gaactgttttaaagtcatgc

SEQ ID NO: 216881 - DNA, 20 bp, Artificial
  CRISPR gRNA sequence
ttttaaagtcatgcattaga

SEQ ID NO: 216882 - DNA, 20 bp, Artificial
  CRISPR gRNA sequence
taaagtcatgcattagaggt

SEQ ID NO: 216883 - DNA, 20 bp, Artificial
  CRISPR gRNA sequence
aaagtcatgcattagaggtc

SEQ ID NO: 216884 - DNA, 20 bp, Artificial
  CRISPR gRNA sequence
aagtcatgcattagaggtca

SEQ ID NO: 216885 - DNA, 20 bp, Artificial
  CRISPR gRNA sequence
gaggtcactgctctttaaat

SEQ ID NO: 216886 - DNA, 20 bp, Artificial
  CRISPR gRNA sequence
ctctttaaatgaacaaaatt

SEQ ID NO: 216887 - DNA, 20 bp, Artificial
  CRISPR gRNA sequence
tttaaatgaacaaaattgat

SEQ ID NO: 216888 - DNA, 20 bp, Artificial
  CRISPR gRNA sequence
taaatgaacaaaattgatag

SEQ ID NO: 216889 - DNA, 20 bp, Artificial
  CRISPR gRNA sequence
aaatgaacaaaattgataga

SEQ ID NO: 216890 - DNA, 20 bp, Artificial
  CRISPR gRNA sequence
aatgaacaaaattgatagat

SEQ ID NO: 216891 - DNA, 20 bp, Artificial
  CRISPR gRNA sequence
atagattgtgaattttaatt

SEQ ID NO: 216892 - DNA, 20 bp, Artificial
  CRISPR gRNA sequence
tgaattttaattcctgtctg

SEQ ID NO: 216893 - DNA, 20 bp, Artificial
  CRISPR gRNA sequence
taattcctgtctggggtgtc

SEQ ID NO: 216894 - DNA, 20 bp, Artificial
  CRISPR gRNA sequence
aattcctgtctggggtgtct

SEQ ID NO: 216895 - DNA, 20 bp, Artificial
  CRISPR gRNA sequence
attcctgtctggggtgtcta

SEQ ID NO: 216896 - DNA, 20 bp, Artificial
  CRISPR gRNA sequence
ctgtctggggtgtctatgtc

SEQ ID NO: 216897 - DNA, 20 bp, Artificial
  CRISPR gRNA sequence
tctggggtgtctatgtctgc

SEQ ID NO: 216898 - DNA, 20 bp, Artificial
  CRISPR gRNA sequence
gggtgtctatgtctgcaaga

SEQ ID NO: 216899 - DNA, 20 bp, Artificial
  CRISPR gRNA sequence
tgtctgcaagaaaaagagca

SEQ ID NO: 216900 - DNA, 20 bp, Artificial
  CRISPR gRNA sequence
caagaaaaagagcaagtgac

SEQ ID NO: 216901 - DNA, 20 bp, Artificial
  CRISPR gRNA sequence
tgcaggacagctctatcaca

SEQ ID NO: 216902 - DNA, 20 bp, Artificial
  CRISPR gRNA sequence
tatcacagaaacactggaac

SEQ ID NO: 216903 - DNA, 20 bp, Artificial
  CRISPR gRNA sequence
tcacagaaacactggaacaa

SEQ ID NO: 216904 - DNA, 20 bp, Artificial
  CRISPR gRNA sequence
gaacaattaaaaatcctatt

SEQ ID NO: 216905 - DNA, 20 bp, Artificial
  CRISPR gRNA sequence
aaaatcctattctattactt

SEQ ID NO: 216906 - DNA, 20 bp, Artificial
  CRISPR gRNA sequence
ttctattacttaaaatggat

SEQ ID NO: 216907 - DNA, 20 bp, Artificial
  CRISPR gRNA sequence
tattacttaaaatggatcct

SEQ ID NO: 216908 - DNA, 20 bp, Artificial
  CRISPR gRNA sequence
ttacttaaaatggatcctca

SEQ ID NO: 216909 - DNA, 20 bp, Artificial
  CRISPR gRNA sequence
cttaaaatggatcctcaaag

SEQ ID NO: 216910 - DNA, 20 bp, Artificial
  CRISPR gRNA sequence
aaaatggatcctcaaagatc

SEQ ID NO: 216911 - DNA, 20 bp, Artificial
  CRISPR gRNA sequence
aaatggatcctcaaagatct

SEQ ID NO: 216912 - DNA, 20 bp, Artificial
  CRISPR gRNA sequence
aaagatctctccccttttac

SEQ ID NO: 216913 - DNA, 20 bp, Artificial
  CRISPR gRNA sequence
tccccttttacttagtataa

SEQ ID NO: 216914 - DNA, 20 bp, Artificial
  CRISPR gRNA sequence
cccttttacttagtataaaa

SEQ ID NO: 216915 - DNA, 20 bp, Artificial
  CRISPR gRNA sequence
ttacttagtataaaaaggta

SEQ ID NO: 216916 - DNA, 20 bp, Artificial
  CRISPR gRNA sequence
tacttagtataaaaaggtac

SEQ ID NO: 216917 - DNA, 20 bp, Artificial
  CRISPR gRNA sequence
acttagtataaaaaggtaca

SEQ ID NO: 216918 - DNA, 20 bp, Artificial
  CRISPR gRNA sequence
cttagtataaaaaggtacac

SEQ ID NO: 216919 - DNA, 20 bp, Artificial
  CRISPR gRNA sequence
agtataaaaaggtacacatt

SEQ ID NO: 216920 - DNA, 20 bp, Artificial
  CRISPR gRNA sequence
gtataaaaaggtacacattc

SEQ ID NO: 216921 - DNA, 20 bp, Artificial
  CRISPR gRNA sequence
taatagataaagccattttc

SEQ ID NO: 216922 - DNA, 20 bp, Artificial
  CRISPR gRNA sequence
atagataaagccattttcct

SEQ ID NO: 216923 - DNA, 20 bp, Artificial
  CRISPR gRNA sequence
tcctttaaactactttggaa

SEQ ID NO: 216924 - DNA, 20 bp, Artificial
  CRISPR gRNA sequence
cctttaaactactttggaaa

SEQ ID NO: 216925 - DNA, 20 bp, Artificial
  CRISPR gRNA sequence
ctttaaactactttggaaac

SEQ ID NO: 216926 - DNA, 20 bp, Artificial
  CRISPR gRNA sequence
taaactactttggaaaccaa

SEQ ID NO: 216927 - DNA, 20 bp, Artificial
  CRISPR gRNA sequence
aaactactttggaaaccaaa

SEQ ID NO: 216928 - DNA, 20 bp, Artificial
  CRISPR gRNA sequence
aactactttggaaaccaaat

SEQ ID NO: 216929 - DNA, 20 bp, Artificial
  CRISPR gRNA sequence
ctttggaaaccaaattttca

SEQ ID NO: 216930 - DNA, 20 bp, Artificial
  CRISPR gRNA sequence
tggaaaccaaattttcatta

SEQ ID NO: 216931 - DNA, 20 bp, Artificial
  CRISPR gRNA sequence
ggaaaccaaattttcattaa

SEQ ID NO: 216932 - DNA, 20 bp, Artificial
  CRISPR gRNA sequence
gaaaccaaattttcattaat

SEQ ID NO: 216933 - DNA, 20 bp, Artificial
  CRISPR gRNA sequence
tcattaatcctatatgtctt

SEQ ID NO: 216934 - DNA, 20 bp, Artificial
  CRISPR gRNA sequence
cattaatcctatatgtcttc

SEQ ID NO: 216935 - DNA, 20 bp, Artificial
  CRISPR gRNA sequence
attaatcctatatgtcttct

SEQ ID NO: 216936 - DNA, 20 bp, Artificial
  CRISPR gRNA sequence
atcctatatgtcttctaccc

SEQ ID NO: 216937 - DNA, 20 bp, Artificial
  CRISPR gRNA sequence
tatgtcttctaccctcttta

SEQ ID NO: 216938 - DNA, 20 bp, Artificial
  CRISPR gRNA sequence
ctaccctctttaattaccct

SEQ ID NO: 216939 - DNA, 20 bp, Artificial
  CRISPR gRNA sequence
taccctctttaattaccctc

SEQ ID NO: 216940 - DNA, 20 bp, Artificial
  CRISPR gRNA sequence
ccctctttaattaccctcaa

SEQ ID NO: 216941 - DNA, 20 bp, Artificial
  CRISPR gRNA sequence
tttaattaccctcaaatcat

SEQ ID NO: 216942 - DNA, 20 bp, Artificial
  CRISPR gRNA sequence
taattaccctcaaatcattc

SEQ ID NO: 216943 - DNA, 20 bp, Artificial
  CRISPR gRNA sequence
aattaccctcaaatcattcc

SEQ ID NO: 216944 - DNA, 20 bp, Artificial
  CRISPR gRNA sequence
attaccctcaaatcattcca

SEQ ID NO: 216945 - DNA, 20 bp, Artificial
  CRISPR gRNA sequence
ccctcaaatcattccaattg

SEQ ID NO: 216946 - DNA, 20 bp, Artificial
  CRISPR gRNA sequence
aaatcattccaattgtattt

SEQ ID NO: 216947 - DNA, 20 bp, Artificial
  CRISPR gRNA sequence
caattgtattttctgacttc

SEQ ID NO: 216948 - DNA, 20 bp, Artificial
  CRISPR gRNA sequence
tattttctgacttctggtct

SEQ ID NO: 216949 - DNA, 20 bp, Artificial
  CRISPR gRNA sequence
tctgacttctggtcttaaac

SEQ ID NO: 216950 - DNA, 20 bp, Artificial
  CRISPR gRNA sequence
ctgacttctggtcttaaact

SEQ ID NO: 216951 - DNA, 20 bp, Artificial
  CRISPR gRNA sequence
tgacttctggtcttaaactg

SEQ ID NO: 216952 - DNA, 20 bp, Artificial
  CRISPR gRNA sequence
acttctggtcttaaactgga

SEQ ID NO: 216953 - DNA, 20 bp, Artificial
  CRISPR gRNA sequence
ctggtcttaaactggaagaa

SEQ ID NO: 216954 - DNA, 20 bp, Artificial
  CRISPR gRNA sequence
tggtcttaaactggaagaac

SEQ ID NO: 216955 - DNA, 20 bp, Artificial
  CRISPR gRNA sequence
gtcttaaactggaagaacca

SEQ ID NO: 216956 - DNA, 20 bp, Artificial
  CRISPR gRNA sequence
aaactggaagaaccaactaa

SEQ ID NO: 216957 - DNA, 20 bp, Artificial
  CRISPR gRNA sequence
aactggaagaaccaactaaa

SEQ ID NO: 216958 - DNA, 20 bp, Artificial
  CRISPR gRNA sequence
gaagaaccaactaaaaatcc

SEQ ID NO: 216959 - DNA, 20 bp, Artificial
  CRISPR gRNA sequence
aaaatcctatatgtcttcta

SEQ ID NO: 216960 - DNA, 20 bp, Artificial
  CRISPR gRNA sequence
tatgtcttctaccctcttta

SEQ ID NO: 216961 - DNA, 20 bp, Artificial
  CRISPR gRNA sequence
ctaccctctttaattatcct

SEQ ID NO: 216962 - DNA, 20 bp, Artificial
  CRISPR gRNA sequence
taccctctttaattatcctc

SEQ ID NO: 216963 - DNA, 20 bp, Artificial
  CRISPR gRNA sequence
ccctctttaattatcctcga

SEQ ID NO: 216964 - DNA, 20 bp, Artificial
  CRISPR gRNA sequence
tttaattatcctcgaatcac

SEQ ID NO: 216965 - DNA, 20 bp, Artificial
  CRISPR gRNA sequence
taattatcctcgaatcactc

SEQ ID NO: 216966 - DNA, 20 bp, Artificial
  CRISPR gRNA sequence
aattatcctcgaatcactcc

SEQ ID NO: 216967 - DNA, 20 bp, Artificial
  CRISPR gRNA sequence
attatcctcgaatcactcca

SEQ ID NO: 216968 - DNA, 20 bp, Artificial
  CRISPR gRNA sequence
tcctcgaatcactccaattg

SEQ ID NO: 216969 - DNA, 20 bp, Artificial
  CRISPR gRNA sequence
gaatcactccaattgtattt

SEQ ID NO: 216970 - DNA, 20 bp, Artificial
  CRISPR gRNA sequence
caattgtattttctcatttt

SEQ ID NO: 216971 - DNA, 20 bp, Artificial
  CRISPR gRNA sequence
tattttctcatttttggtcc

SEQ ID NO: 216972 - DNA, 20 bp, Artificial
  CRISPR gRNA sequence
tctcatttttggtcctaaac

SEQ ID NO: 216973 - DNA, 20 bp, Artificial
  CRISPR gRNA sequence
ctcatttttggtcctaaact

SEQ ID NO: 216974 - DNA, 20 bp, Artificial
  CRISPR gRNA sequence
tcatttttggtcctaaactg

SEQ ID NO: 216975 - DNA, 20 bp, Artificial
  CRISPR gRNA sequence
atttttggtcctaaactgga

SEQ ID NO: 216976 - DNA, 20 bp, Artificial
  CRISPR gRNA sequence
ttggtcctaaactggaagaa

SEQ ID NO: 216977 - DNA, 20 bp, Artificial
  CRISPR gRNA sequence
tggtcctaaactggaagaac

SEQ ID NO: 216978 - DNA, 20 bp, Artificial
  CRISPR gRNA sequence
ggtcctaaactggaagaaca

SEQ ID NO: 216979 - DNA, 20 bp, Artificial
  CRISPR gRNA sequence
gtcctaaactggaagaacaa

SEQ ID NO: 216980 - DNA, 20 bp, Artificial
  CRISPR gRNA sequence
aactggaagaacaaactaaa

SEQ ID NO: 216981 - DNA, 20 bp, Artificial
  CRISPR gRNA sequence
gaagaacaaactaaaaagca

SEQ ID NO: 216982 - DNA, 20 bp, Artificial
  CRISPR gRNA sequence
aaaagcattttctaagtgat

SEQ ID NO: 216983 - DNA, 20 bp, Artificial
  CRISPR gRNA sequence
tctaagtgatatatctgaaa

SEQ ID NO: 216984 - DNA, 20 bp, Artificial
  CRISPR gRNA sequence
ctaagtgatatatctgaaat

SEQ ID NO: 216985 - DNA, 20 bp, Artificial
  CRISPR gRNA sequence
taagtgatatatctgaaatt

SEQ ID NO: 216986 - DNA, 20 bp, Artificial
  CRISPR gRNA sequence
agtgatatatctgaaattat

SEQ ID NO: 216987 - DNA, 20 bp, Artificial
  CRISPR gRNA sequence
aaattattggcataggttaa

SEQ ID NO: 216988 - DNA, 20 bp, Artificial
  CRISPR gRNA sequence
ttggcataggttaatgaaaa

SEQ ID NO: 216989 - DNA, 20 bp, Artificial
  CRISPR gRNA sequence
gcataggttaatgaaaataa

SEQ ID NO: 216990 - DNA, 20 bp, Artificial
  CRISPR gRNA sequence
atgaaaataagattgactta

SEQ ID NO: 216991 - DNA, 20 bp, Artificial
  CRISPR gRNA sequence
acttacccacaaatttcata

SEQ ID NO: 216992 - DNA, 20 bp, Artificial
  CRISPR gRNA sequence
acccacaaatttcatataaa

SEQ ID NO: 216993 - DNA, 20 bp, Artificial
  CRISPR gRNA sequence
cccacaaatttcatataaac

SEQ ID NO: 216994 - DNA, 20 bp, Artificial
  CRISPR gRNA sequence
catataaactagtccaagta

SEQ ID NO: 216995 - DNA, 20 bp, Artificial
  CRISPR gRNA sequence
atataaactagtccaagtaa

SEQ ID NO: 216996 - DNA, 20 bp, Artificial
  CRISPR gRNA sequence
gtccaagtaattgtgctaga

SEQ ID NO: 216997 - DNA, 20 bp, Artificial
  CRISPR gRNA sequence
tgctagagctaagatactca

SEQ ID NO: 216998 - DNA, 20 bp, Artificial
  CRISPR gRNA sequence
gagctaagatactcaaacct

SEQ ID NO: 216999 - DNA, 20 bp, Artificial
  CRISPR gRNA sequence
agatactcaaacctgaaatc

SEQ ID NO: 217000 - DNA, 20 bp, Artificial
  CRISPR gRNA sequence
aaacctgaaatcagaagagg

SEQ ID NO: 217001 - DNA, 20 bp, Artificial
  CRISPR gRNA sequence
aaatcagaagagggccatgc

SEQ ID NO: 217002 - DNA, 20 bp, Artificial
  CRISPR gRNA sequence
gtatacacgctgtaaaaaca

SEQ ID NO: 217003 - DNA, 20 bp, Artificial
  CRISPR gRNA sequence
taaaaacaaataaaattctg

SEQ ID NO: 217004 - DNA, 20 bp, Artificial
  CRISPR gRNA sequence
tgtattagaaaagcatatga

SEQ ID NO: 217005 - DNA, 20 bp, Artificial
  CRISPR gRNA sequence
tattagaaaagcatatgaaa

SEQ ID NO: 217006 - DNA, 20 bp, Artificial
  CRISPR gRNA sequence
gaaaagcatatgaaataact

SEQ ID NO: 217007 - DNA, 20 bp, Artificial
  CRISPR gRNA sequence
actaaaaaacagtaataatc

SEQ ID NO: 217008 - DNA, 20 bp, Artificial
  CRISPR gRNA sequence
ctaaaaaacagtaataatcc

SEQ ID NO: 217009 - DNA, 20 bp, Artificial
  CRISPR gRNA sequence
aaaaacagtaataatcccaa

SEQ ID NO: 217010 - DNA, 20 bp, Artificial
  CRISPR gRNA sequence
taagagagttattctaacga

SEQ ID NO: 217011 - DNA, 20 bp, Artificial
  CRISPR gRNA sequence
aagagagttattctaacgat

SEQ ID NO: 217012 - DNA, 20 bp, Artificial
  CRISPR gRNA sequence
agagagttattctaacgatc

SEQ ID NO: 217013 - DNA, 20 bp, Artificial
  CRISPR gRNA sequence
ttctaacgatcaaaaaacaa

SEQ ID NO: 217014 - DNA, 20 bp, Artificial
  CRISPR gRNA sequence
taacgatcaaaaaacaaaaa

SEQ ID NO: 217015 - DNA, 20 bp, Artificial
  CRISPR gRNA sequence
acgatcaaaaaacaaaaatt

SEQ ID NO: 217016 - DNA, 20 bp, Artificial
  CRISPR gRNA sequence
tccatatatgtttattaact

SEQ ID NO: 217017 - DNA, 20 bp, Artificial
  CRISPR gRNA sequence
attaacttaaccagtaaaat

SEQ ID NO: 217018 - DNA, 20 bp, Artificial
  CRISPR gRNA sequence
ttaacttaaccagtaaaatg

SEQ ID NO: 217019 - DNA, 20 bp, Artificial
  CRISPR gRNA sequence
acttaaccagtaaaatgact

SEQ ID NO: 217020 - DNA, 20 bp, Artificial
  CRISPR gRNA sequence
aaccagtaaaatgactcaaa

SEQ ID NO: 217021 - DNA, 20 bp, Artificial
  CRISPR gRNA sequence
accagtaaaatgactcaaaa

SEQ ID NO: 217022 - DNA, 20 bp, Artificial
  CRISPR gRNA sequence
aaaattattagaagaacaaa

SEQ ID NO: 217023 - DNA, 20 bp, Artificial
  CRISPR gRNA sequence
ttagaagaacaaagccctcc

SEQ ID NO: 217024 - DNA, 20 bp, Artificial
  CRISPR gRNA sequence
gaagaacaaagccctccttt

SEQ ID NO: 217025 - DNA, 20 bp, Artificial
  CRISPR gRNA sequence
ctttgcataacacatacctt

SEQ ID NO: 217026 - DNA, 20 bp, Artificial
  CRISPR gRNA sequence
tgcataacacataccttatc

SEQ ID NO: 217027 - DNA, 20 bp, Artificial
  CRISPR gRNA sequence
gcataacacataccttatca

SEQ ID NO: 217028 - DNA, 20 bp, Artificial
  CRISPR gRNA sequence
cataacacataccttatcat

SEQ ID NO: 217029 - DNA, 20 bp, Artificial
  CRISPR gRNA sequence
atcatatcaagaaatgggaa

SEQ ID NO: 217030 - DNA, 20 bp, Artificial
  CRISPR gRNA sequence
tcatatcaagaaatgggaac

SEQ ID NO: 217031 - DNA, 20 bp, Artificial
  CRISPR gRNA sequence
gtgtttcaagtctaaggctc

SEQ ID NO: 217032 - DNA, 20 bp, Artificial
  CRISPR gRNA sequence
caagtctaaggctccaacca

SEQ ID NO: 217033 - DNA, 20 bp, Artificial
  CRISPR gRNA sequence
aagtctaaggctccaaccaa

SEQ ID NO: 217034 - DNA, 20 bp, Artificial
  CRISPR gRNA sequence
aggctccaaccaatttgagc

SEQ ID NO: 217035 - DNA, 20 bp, Artificial
  CRISPR gRNA sequence
caaccaatttgagcccagtt

SEQ ID NO: 217036 - DNA, 20 bp, Artificial
  CRISPR gRNA sequence
gagcccagttattttaaaag

SEQ ID NO: 217037 - DNA, 20 bp, Artificial
  CRISPR gRNA sequence
agcccagttattttaaaagc

SEQ ID NO: 217038 - DNA, 20 bp, Artificial
  CRISPR gRNA sequence
ttttaaaagctcttccacaa

SEQ ID NO: 217039 - DNA, 20 bp, Artificial
  CRISPR gRNA sequence
taaaagctcttccacaaata

SEQ ID NO: 217040 - DNA, 20 bp, Artificial
  CRISPR gRNA sequence
aaaagctcttccacaaatac

SEQ ID NO: 217041 - DNA, 20 bp, Artificial
  CRISPR gRNA sequence
aaagctcttccacaaataca

SEQ ID NO: 217042 - DNA, 20 bp, Artificial
  CRISPR gRNA sequence
ttccacaaatacaggcatat

SEQ ID NO: 217043 - DNA, 20 bp, Artificial
  CRISPR gRNA sequence
ccacaaatacaggcatatca

SEQ ID NO: 217044 - DNA, 20 bp, Artificial
  CRISPR gRNA sequence
cacaaatacaggcatatcag

SEQ ID NO: 217045 - DNA, 20 bp, Artificial
  CRISPR gRNA sequence
gggtgctagaacaatcagcc

SEQ ID NO: 217046 - DNA, 20 bp, Artificial
  CRISPR gRNA sequence
ggtgctagaacaatcagcca

SEQ ID NO: 217047 - DNA, 20 bp, Artificial
  CRISPR gRNA sequence
gaacaatcagccaccaagcc

SEQ ID NO: 217048 - DNA, 20 bp, Artificial
  CRISPR gRNA sequence
atatctttgtagcgaggagg

SEQ ID NO: 217049 - DNA, 20 bp, Artificial
  CRISPR gRNA sequence
tgtagcgaggaggaaagcac

SEQ ID NO: 217050 - DNA, 20 bp, Artificial
  CRISPR gRNA sequence
gtagcgaggaggaaagcact

SEQ ID NO: 217051 - DNA, 20 bp, Artificial
  CRISPR gRNA sequence
tagcgaggaggaaagcacta

SEQ ID NO: 217052 - DNA, 20 bp, Artificial
  CRISPR gRNA sequence
ttaccactggggtaaattgg

SEQ ID NO: 217053 - DNA, 20 bp, Artificial
  CRISPR gRNA sequence
ccactggggtaaattggaag

SEQ ID NO: 217054 - DNA, 20 bp, Artificial
  CRISPR gRNA sequence
gggtaaattggaagtttaaa

SEQ ID NO: 217055 - DNA, 20 bp, Artificial
  CRISPR gRNA sequence
gaagtttaaaaagaaaagct

SEQ ID NO: 217056 - DNA, 20 bp, Artificial
  CRISPR gRNA sequence
aaaaagaaaagctcagaatg

SEQ ID NO: 217057 - DNA, 20 bp, Artificial
  CRISPR gRNA sequence
aaaagaaaagctcagaatgc

SEQ ID NO: 217058 - DNA, 20 bp, Artificial
  CRISPR gRNA sequence
agaatgctaaatgctgtcaa

SEQ ID NO: 217059 - DNA, 20 bp, Artificial
  CRISPR gRNA sequence
aatgctgtcaagtatatgaa

SEQ ID NO: 217060 - DNA, 20 bp, Artificial
  CRISPR gRNA sequence
tcaagtatatgaatgaacaa

SEQ ID NO: 217061 - DNA, 20 bp, Artificial
  CRISPR gRNA sequence
ttatttattggtggtgataa

SEQ ID NO: 217062 - DNA, 20 bp, Artificial
  CRISPR gRNA sequence
atttattggtggtgataata

SEQ ID NO: 217063 - DNA, 20 bp, Artificial
  CRISPR gRNA sequence
tttattggtggtgataatac

SEQ ID NO: 217064 - DNA, 20 bp, Artificial
  CRISPR gRNA sequence
attggtggtgataatacaaa

SEQ ID NO: 217065 - DNA, 20 bp, Artificial
  CRISPR gRNA sequence
ttggtggtgataatacaaaa

SEQ ID NO: 217066 - DNA, 20 bp, Artificial
  CRISPR gRNA sequence
gtggtgataatacaaaatgg

SEQ ID NO: 217067 - DNA, 20 bp, Artificial
  CRISPR gRNA sequence
ttttgatacagagagtttgg

SEQ ID NO: 217068 - DNA, 20 bp, Artificial
  CRISPR gRNA sequence
tgatacagagagtttggcag

SEQ ID NO: 217069 - DNA, 20 bp, Artificial
  CRISPR gRNA sequence
gatacagagagtttggcagt

SEQ ID NO: 217070 - DNA, 20 bp, Artificial
  CRISPR gRNA sequence
atacagagagtttggcagtt

SEQ ID NO: 217071 - DNA, 20 bp, Artificial
  CRISPR gRNA sequence
ggcagtttatttcaacatac

SEQ ID NO: 217072 - DNA, 20 bp, Artificial
  CRISPR gRNA sequence
gcagtttatttcaacatact

SEQ ID NO: 217073 - DNA, 20 bp, Artificial
  CRISPR gRNA sequence
atttcaacatactctttaca

SEQ ID NO: 217074 - DNA, 20 bp, Artificial
  CRISPR gRNA sequence
tttcaacatactctttacag

SEQ ID NO: 217075 - DNA, 20 bp, Artificial
  CRISPR gRNA sequence
caacatactctttacagtcc

SEQ ID NO: 217076 - DNA, 20 bp, Artificial
  CRISPR gRNA sequence
aacatactctttacagtccc

SEQ ID NO: 217077 - DNA, 20 bp, Artificial
  CRISPR gRNA sequence
tttacagtcccgtaattgca

SEQ ID NO: 217078 - DNA, 20 bp, Artificial
  CRISPR gRNA sequence
tacagtcccgtaattgcact

SEQ ID NO: 217079 - DNA, 20 bp, Artificial
  CRISPR gRNA sequence
acagtcccgtaattgcactc

SEQ ID NO: 217080 - DNA, 20 bp, Artificial
  CRISPR gRNA sequence
cagtcccgtaattgcactcc

SEQ ID NO: 217081 - DNA, 20 bp, Artificial
  CRISPR gRNA sequence
cactccttggtatttgccca

SEQ ID NO: 217082 - DNA, 20 bp, Artificial
  CRISPR gRNA sequence
cttggtatttgcccaaatgg

SEQ ID NO: 217083 - DNA, 20 bp, Artificial
  CRISPR gRNA sequence
ggtatttgcccaaatggaat

SEQ ID NO: 217084 - DNA, 20 bp, Artificial
  CRISPR gRNA sequence
gtatttgcccaaatggaatt

SEQ ID NO: 217085 - DNA, 20 bp, Artificial
  CRISPR gRNA sequence
gcccaaatggaattgaaaac

SEQ ID NO: 217086 - DNA, 20 bp, Artificial
  CRISPR gRNA sequence
cccaaatggaattgaaaact

SEQ ID NO: 217087 - DNA, 20 bp, Artificial
  CRISPR gRNA sequence
aaaacttatgtccacataaa

SEQ ID NO: 217088 - DNA, 20 bp, Artificial
  CRISPR gRNA sequence
atgtccacataaaaatatcc

SEQ ID NO: 217089 - DNA, 20 bp, Artificial
  CRISPR gRNA sequence
tgtccacataaaaatatcca

SEQ ID NO: 217090 - DNA, 20 bp, Artificial
  CRISPR gRNA sequence
tccactcaattttgccatga

SEQ ID NO: 217091 - DNA, 20 bp, Artificial
  CRISPR gRNA sequence
ccactcaattttgccatgaa

SEQ ID NO: 217092 - DNA, 20 bp, Artificial
  CRISPR gRNA sequence
cactcaattttgccatgaac

SEQ ID NO: 217093 - DNA, 20 bp, Artificial
  CRISPR gRNA sequence
aattttgccatgaaccaaaa

SEQ ID NO: 217094 - DNA, 20 bp, Artificial
  CRISPR gRNA sequence
tgccatgaaccaaaaactgc

SEQ ID NO: 217095 - DNA, 20 bp, Artificial
  CRISPR gRNA sequence
gccatgaaccaaaaactgca

SEQ ID NO: 217096 - DNA, 20 bp, Artificial
  CRISPR gRNA sequence
ccatgaaccaaaaactgcac

SEQ ID NO: 217097 - DNA, 20 bp, Artificial
  CRISPR gRNA sequence
cactaaaaaaaaaaatcaag

SEQ ID NO: 217098 - DNA, 20 bp, Artificial
  CRISPR gRNA sequence
aaaaaaaaaatcaagtctat

SEQ ID NO: 217099 - DNA, 20 bp, Artificial
  CRISPR gRNA sequence
tatatttttaaaaagagaga

SEQ ID NO: 217100 - DNA, 20 bp, Artificial
  CRISPR gRNA sequence
ttaaaaagagagaaagaaaa

SEQ ID NO: 217101 - DNA, 20 bp, Artificial
  CRISPR gRNA sequence
taaaaagagagaaagaaaaa

SEQ ID NO: 217102 - DNA, 20 bp, Artificial
  CRISPR gRNA sequence
aaaaagagagaaagaaaaag

SEQ ID NO: 217103 - DNA, 20 bp, Artificial
  CRISPR gRNA sequence
aaaagagagaaagaaaaaga

SEQ ID NO: 217104 - DNA, 20 bp, Artificial
  CRISPR gRNA sequence
tgtccaaaagtaacccaaat

SEQ ID NO: 217105 - DNA, 20 bp, Artificial
  CRISPR gRNA sequence
tccaaaagtaacccaaatta

SEQ ID NO: 217106 - DNA, 20 bp, Artificial
  CRISPR gRNA sequence
ggtctacagaaagatgactc

SEQ ID NO: 217107 - DNA, 20 bp, Artificial
  CRISPR gRNA sequence
cagaaagatgactcttaccc

SEQ ID NO: 217108 - DNA, 20 bp, Artificial
  CRISPR gRNA sequence
ttacccgcaatacagagact

SEQ ID NO: 217109 - DNA, 20 bp, Artificial
  CRISPR gRNA sequence
acccgcaatacagagactca

SEQ ID NO: 217110 - DNA, 20 bp, Artificial
  CRISPR gRNA sequence
cccgcaatacagagactcag

SEQ ID NO: 217111 - DNA, 20 bp, Artificial
  CRISPR gRNA sequence
agtccaaccacagcgaggat

SEQ ID NO: 217112 - DNA, 20 bp, Artificial
  CRISPR gRNA sequence
tcacctgaataaccaatatg

SEQ ID NO: 217113 - DNA, 20 bp, Artificial
  CRISPR gRNA sequence
aataaccaatatggcaatga

SEQ ID NO: 217114 - DNA, 20 bp, Artificial
  CRISPR gRNA sequence
atccaatcgctggaggaagg

SEQ ID NO: 217115 - DNA, 20 bp, Artificial
  CRISPR gRNA sequence
gaggaaggaaaaggatgtaa

SEQ ID NO: 217116 - DNA, 20 bp, Artificial
  CRISPR gRNA sequence
aaaaagcaataacttccact

SEQ ID NO: 217117 - DNA, 20 bp, Artificial
  CRISPR gRNA sequence
aaaagcaataacttccactt

SEQ ID NO: 217118 - DNA, 20 bp, Artificial
  CRISPR gRNA sequence
ccacttgcatttggtataat

SEQ ID NO: 217119 - DNA, 20 bp, Artificial
  CRISPR gRNA sequence
cacttgcatttggtataatc

SEQ ID NO: 217120 - DNA, 20 bp, Artificial
  CRISPR gRNA sequence
gcatttggtataatcaggga

SEQ ID NO: 217121 - DNA, 20 bp, Artificial
  CRISPR gRNA sequence
catttggtataatcagggat

SEQ ID NO: 217122 - DNA, 20 bp, Artificial
  CRISPR gRNA sequence
ggtataatcagggatctcct

SEQ ID NO: 217123 - DNA, 20 bp, Artificial
  CRISPR gRNA sequence
gtataatcagggatctccta

SEQ ID NO: 217124 - DNA, 20 bp, Artificial
  CRISPR gRNA sequence
ctaagaccaaagactgactc

SEQ ID NO: 217125 - DNA, 20 bp, Artificial
  CRISPR gRNA sequence
agaccaaagactgactctgg

SEQ ID NO: 217126 - DNA, 20 bp, Artificial
  CRISPR gRNA sequence
actctggagttcattgtttg

SEQ ID NO: 217127 - DNA, 20 bp, Artificial
  CRISPR gRNA sequence
tggagttcattgtttgacgg

SEQ ID NO: 217128 - DNA, 20 bp, Artificial
  CRISPR gRNA sequence
gagttcattgtttgacggta

SEQ ID NO: 217129 - DNA, 20 bp, Artificial
  CRISPR gRNA sequence
attgtttgacggtagatgtt

SEQ ID NO: 217130 - DNA, 20 bp, Artificial
  CRISPR gRNA sequence
tttgacggtagatgttaact

SEQ ID NO: 217131 - DNA, 20 bp, Artificial
  CRISPR gRNA sequence
gacggtagatgttaactcag

SEQ ID NO: 217132 - DNA, 20 bp, Artificial
  CRISPR gRNA sequence
acggtagatgttaactcagt

SEQ ID NO: 217133 - DNA, 20 bp, Artificial
  CRISPR gRNA sequence
actcagtgatctaacccttc

SEQ ID NO: 217134 - DNA, 20 bp, Artificial
  CRISPR gRNA sequence
agtgatctaacccttccaca

SEQ ID NO: 217135 - DNA, 20 bp, Artificial
  CRISPR gRNA sequence
acccttccacacaagtagtc

SEQ ID NO: 217136 - DNA, 20 bp, Artificial
  CRISPR gRNA sequence
ccacacaagtagtcagctcc

SEQ ID NO: 217137 - DNA, 20 bp, Artificial
  CRISPR gRNA sequence
cacacaagtagtcagctcca

SEQ ID NO: 217138 - DNA, 20 bp, Artificial
  CRISPR gRNA sequence
caaattcacacattcggcag

SEQ ID NO: 217139 - DNA, 20 bp, Artificial
  CRISPR gRNA sequence
acacattcggcagcctttaa

SEQ ID NO: 217140 - DNA, 20 bp, Artificial
  CRISPR gRNA sequence
ggcagcctttaattttcaca

SEQ ID NO: 217141 - DNA, 20 bp, Artificial
  CRISPR gRNA sequence
taattttcacagtcagctaa

SEQ ID NO: 217142 - DNA, 20 bp, Artificial
  CRISPR gRNA sequence
aattttcacagtcagctaag

SEQ ID NO: 217143 - DNA, 20 bp, Artificial
  CRISPR gRNA sequence
attttcacagtcagctaagc

SEQ ID NO: 217144 - DNA, 20 bp, Artificial
  CRISPR gRNA sequence
tcacagtcagctaagctgga

SEQ ID NO: 217145 - DNA, 20 bp, Artificial
  CRISPR gRNA sequence
cacagtcagctaagctggac

SEQ ID NO: 217146 - DNA, 20 bp, Artificial
  CRISPR gRNA sequence
acagtcagctaagctggact

SEQ ID NO: 217147 - DNA, 20 bp, Artificial
  CRISPR gRNA sequence
agctggactggaagttttta

SEQ ID NO: 217148 - DNA, 20 bp, Artificial
  CRISPR gRNA sequence
gactggaagtttttacccta

SEQ ID NO: 217149 - DNA, 20 bp, Artificial
  CRISPR gRNA sequence
gaagtttttaccctaaatct

SEQ ID NO: 217150 - DNA, 20 bp, Artificial
  CRISPR gRNA sequence
ttaccctaaatcttagaaca

SEQ ID NO: 217151 - DNA, 20 bp, Artificial
  CRISPR gRNA sequence
taccctaaatcttagaacaa

SEQ ID NO: 217152 - DNA, 20 bp, Artificial
  CRISPR gRNA sequence
accctaaatcttagaacaat

SEQ ID NO: 217153 - DNA, 20 bp, Artificial
  CRISPR gRNA sequence
ccctaaatcttagaacaatg

SEQ ID NO: 217154 - DNA, 20 bp, Artificial
  CRISPR gRNA sequence
aatcttagaacaatgctgct

SEQ ID NO: 217155 - DNA, 20 bp, Artificial
  CRISPR gRNA sequence
agaacaatgctgcttttacc

SEQ ID NO: 217156 - DNA, 20 bp, Artificial
  CRISPR gRNA sequence
gaacaatgctgcttttacca

SEQ ID NO: 217157 - DNA, 20 bp, Artificial
  CRISPR gRNA sequence
cttttaccacacttgtgcat

SEQ ID NO: 217158 - DNA, 20 bp, Artificial
  CRISPR gRNA sequence
ttaccacacttgtgcatttt

SEQ ID NO: 217159 - DNA, 20 bp, Artificial
  CRISPR gRNA sequence
taccacacttgtgcatttta

SEQ ID NO: 217160 - DNA, 20 bp, Artificial
  CRISPR gRNA sequence
accacacttgtgcattttac

SEQ ID NO: 217161 - DNA, 20 bp, Artificial
  CRISPR gRNA sequence
ccacacttgtgcattttaca

SEQ ID NO: 217162 - DNA, 20 bp, Artificial
  CRISPR gRNA sequence
gtgcattttacaatatgaat

SEQ ID NO: 217163 - DNA, 20 bp, Artificial
  CRISPR gRNA sequence
tgcattttacaatatgaatg

SEQ ID NO: 217164 - DNA, 20 bp, Artificial
  CRISPR gRNA sequence
tacaatatgaatggctatta

SEQ ID NO: 217165 - DNA, 20 bp, Artificial
  CRISPR gRNA sequence
acaatatgaatggctattat

SEQ ID NO: 217166 - DNA, 20 bp, Artificial
  CRISPR gRNA sequence
caatatgaatggctattatg

SEQ ID NO: 217167 - DNA, 20 bp, Artificial
  CRISPR gRNA sequence
ttatgaatgtcttctccaca

SEQ ID NO: 217168 - DNA, 20 bp, Artificial
  CRISPR gRNA sequence
tgaatgtcttctccacatgc

SEQ ID NO: 217169 - DNA, 20 bp, Artificial
  CRISPR gRNA sequence
ctccacatgcacatggaatt

SEQ ID NO: 217170 - DNA, 20 bp, Artificial
  CRISPR gRNA sequence
tccacatgcacatggaattg

SEQ ID NO: 217171 - DNA, 20 bp, Artificial
  CRISPR gRNA sequence
cacatgcacatggaattgct

SEQ ID NO: 217172 - DNA, 20 bp, Artificial
  CRISPR gRNA sequence
ctcttgctgagggaaccatt

SEQ ID NO: 217173 - DNA, 20 bp, Artificial
  CRISPR gRNA sequence
ttgctgagggaaccattatg

SEQ ID NO: 217174 - DNA, 20 bp, Artificial
  CRISPR gRNA sequence
gctgagggaaccattatgca

SEQ ID NO: 217175 - DNA, 20 bp, Artificial
  CRISPR gRNA sequence
ctgagggaaccattatgcaa

SEQ ID NO: 217176 - DNA, 20 bp, Artificial
  CRISPR gRNA sequence
agggaaccattatgcaaata

SEQ ID NO: 217177 - DNA, 20 bp, Artificial
  CRISPR gRNA sequence
tgcaaatacctgactgtaaa

SEQ ID NO: 217178 - DNA, 20 bp, Artificial
  CRISPR gRNA sequence
actgtaaacatcatgctctc

SEQ ID NO: 217179 - DNA, 20 bp, Artificial
  CRISPR gRNA sequence
taaacatcatgctctctatc

SEQ ID NO: 217180 - DNA, 20 bp, Artificial
  CRISPR gRNA sequence
tctatctctagatgtcattt

SEQ ID NO: 217181 - DNA, 20 bp, Artificial
  CRISPR gRNA sequence
tatctctagatgtcatttta

SEQ ID NO: 217182 - DNA, 20 bp, Artificial
  CRISPR gRNA sequence
tctctagatgtcattttata

SEQ ID NO: 217183 - DNA, 20 bp, Artificial
  CRISPR gRNA sequence
tagatgtcattttataacaa

SEQ ID NO: 217184 - DNA, 20 bp, Artificial
  CRISPR gRNA sequence
gatgtcattttataacaaac

SEQ ID NO: 217185 - DNA, 20 bp, Artificial
  CRISPR gRNA sequence
tataacaaactaataccttt

SEQ ID NO: 217186 - DNA, 20 bp, Artificial
  CRISPR gRNA sequence
ataacaaactaatacctttc

SEQ ID NO: 217187 - DNA, 20 bp, Artificial
  CRISPR gRNA sequence
taacaaactaatacctttcc

SEQ ID NO: 217188 - DNA, 20 bp, Artificial
  CRISPR gRNA sequence
atacctttccaatgtacaac

SEQ ID NO: 217189 - DNA, 20 bp, Artificial
  CRISPR gRNA sequence
tccaatgtacaacgagccag

SEQ ID NO: 217190 - DNA, 20 bp, Artificial
  CRISPR gRNA sequence
ccaatgtacaacgagccaga

SEQ ID NO: 217191 - DNA, 20 bp, Artificial
  CRISPR gRNA sequence
caatgtacaacgagccagag

SEQ ID NO: 217192 - DNA, 20 bp, Artificial
  CRISPR gRNA sequence
taagaccaagtgttaaatgt

SEQ ID NO: 217193 - DNA, 20 bp, Artificial
  CRISPR gRNA sequence
agaccaagtgttaaatgtga

SEQ ID NO: 217194 - DNA, 20 bp, Artificial
  CRISPR gRNA sequence
aatgtgactctttaatagta

SEQ ID NO: 217195 - DNA, 20 bp, Artificial
  CRISPR gRNA sequence
tttaatagtaataactaaat

SEQ ID NO: 217196 - DNA, 20 bp, Artificial
  CRISPR gRNA sequence
taatagtaataactaaatat

SEQ ID NO: 217197 - DNA, 20 bp, Artificial
  CRISPR gRNA sequence
aatagtaataactaaatatg

SEQ ID NO: 217198 - DNA, 20 bp, Artificial
  CRISPR gRNA sequence
atagtaataactaaatatgg

SEQ ID NO: 217199 - DNA, 20 bp, Artificial
  CRISPR gRNA sequence
aatatggtagtgatctactt

SEQ ID NO: 217200 - DNA, 20 bp, Artificial
  CRISPR gRNA sequence
ctttcaaaatgcagtgaaaa

SEQ ID NO: 217201 - DNA, 20 bp, Artificial
  CRISPR gRNA sequence
tcaaaatgcagtgaaaatga

SEQ ID NO: 217202 - DNA, 20 bp, Artificial
  CRISPR gRNA sequence
caaaatgcagtgaaaatgat

SEQ ID NO: 217203 - DNA, 20 bp, Artificial
  CRISPR gRNA sequence
aaaatgcagtgaaaatgata

SEQ ID NO: 217204 - DNA, 20 bp, Artificial
  CRISPR gRNA sequence
attatagtttggatttccat

SEQ ID NO: 217205 - DNA, 20 bp, Artificial
  CRISPR gRNA sequence
tagtttggatttccatacca

SEQ ID NO: 217206 - DNA, 20 bp, Artificial
  CRISPR gRNA sequence
ggatttccataccatctctt

SEQ ID NO: 217207 - DNA, 20 bp, Artificial
  CRISPR gRNA sequence
gatttccataccatctctta

SEQ ID NO: 217208 - DNA, 20 bp, Artificial
  CRISPR gRNA sequence
ccataccatctcttaaaact

SEQ ID NO: 217209 - DNA, 20 bp, Artificial
  CRISPR gRNA sequence
cataccatctcttaaaacta

SEQ ID NO: 217210 - DNA, 20 bp, Artificial
  CRISPR gRNA sequence
ttaaaactacagtattaagg

SEQ ID NO: 217211 - DNA, 20 bp, Artificial
  CRISPR gRNA sequence
aaaactacagtattaaggtt

SEQ ID NO: 217212 - DNA, 20 bp, Artificial
  CRISPR gRNA sequence
aaactacagtattaaggttt

SEQ ID NO: 217213 - DNA, 20 bp, Artificial
  CRISPR gRNA sequence
cagtattaaggtttgctaat

SEQ ID NO: 217214 - DNA, 20 bp, Artificial
  CRISPR gRNA sequence
aggtttgctaataattaaaa

SEQ ID NO: 217215 - DNA, 20 bp, Artificial
  CRISPR gRNA sequence
gctaataattaaaacaaata

SEQ ID NO: 217216 - DNA, 20 bp, Artificial
  CRISPR gRNA sequence
ctaataattaaaacaaatat

SEQ ID NO: 217217 - DNA, 20 bp, Artificial
  CRISPR gRNA sequence
ataattaaaacaaatatgtt

SEQ ID NO: 217218 - DNA, 20 bp, Artificial
  CRISPR gRNA sequence
aaacaaatatgtttctacta

SEQ ID NO: 217219 - DNA, 20 bp, Artificial
  CRISPR gRNA sequence
ctactatttgtgattcataa

SEQ ID NO: 217220 - DNA, 20 bp, Artificial
  CRISPR gRNA sequence
tactatttgtgattcataat

SEQ ID NO: 217221 - DNA, 20 bp, Artificial
  CRISPR gRNA sequence
ctatttgtgattcataattc

SEQ ID NO: 217222 - DNA, 20 bp, Artificial
  CRISPR gRNA sequence
tttgtgattcataattccat

SEQ ID NO: 217223 - DNA, 20 bp, Artificial
  CRISPR gRNA sequence
gtgattcataattccatttt

SEQ ID NO: 217224 - DNA, 20 bp, Artificial
  CRISPR gRNA sequence
tgattcataattccatttta

SEQ ID NO: 217225 - DNA, 20 bp, Artificial
  CRISPR gRNA sequence
ataattccattttatagaac

SEQ ID NO: 217226 - DNA, 20 bp, Artificial
  CRISPR gRNA sequence
cattttatagaaccagtctt

SEQ ID NO: 217227 - DNA, 20 bp, Artificial
  CRISPR gRNA sequence
tatagaaccagtcttcttaa

SEQ ID NO: 217228 - DNA, 20 bp, Artificial
  CRISPR gRNA sequence
atagaaccagtcttcttaat

SEQ ID NO: 217229 - DNA, 20 bp, Artificial
  CRISPR gRNA sequence
tagaaccagtcttcttaatg

SEQ ID NO: 217230 - DNA, 20 bp, Artificial
  CRISPR gRNA sequence
cttaatgcagaagcagaagc

SEQ ID NO: 217231 - DNA, 20 bp, Artificial
  CRISPR gRNA sequence
ttaatgcagaagcagaagct

SEQ ID NO: 217232 - DNA, 20 bp, Artificial
  CRISPR gRNA sequence
aatgcagaagcagaagctta

SEQ ID NO: 217233 - DNA, 20 bp, Artificial
  CRISPR gRNA sequence
atgcagaagcagaagcttag

SEQ ID NO: 217234 - DNA, 20 bp, Artificial
  CRISPR gRNA sequence
agcaaaagaagagaaagact

SEQ ID NO: 217235 - DNA, 20 bp, Artificial
  CRISPR gRNA sequence
gcaaaagaagagaaagactg

SEQ ID NO: 217236 - DNA, 20 bp, Artificial
  CRISPR gRNA sequence
cgtttaacatccacttataa

SEQ ID NO: 217237 - DNA, 20 bp, Artificial
  CRISPR gRNA sequence
aacatccacttataacttca

SEQ ID NO: 217238 - DNA, 20 bp, Artificial
  CRISPR gRNA sequence
acatccacttataacttcaa

SEQ ID NO: 217239 - DNA, 20 bp, Artificial
  CRISPR gRNA sequence
ataacttcaaaaaactgaaa

SEQ ID NO: 217240 - DNA, 20 bp, Artificial
  CRISPR gRNA sequence
taacttcaaaaaactgaaat

SEQ ID NO: 217241 - DNA, 20 bp, Artificial
  CRISPR gRNA sequence
caaaaaactgaaattagaat

SEQ ID NO: 217242 - DNA, 20 bp, Artificial
  CRISPR gRNA sequence
aaaaaactgaaattagaata

SEQ ID NO: 217243 - DNA, 20 bp, Artificial
  CRISPR gRNA sequence
aaattagaatatgaaaataa

SEQ ID NO: 217244 - DNA, 20 bp, Artificial
  CRISPR gRNA sequence
gaatatgaaaataatcatta

SEQ ID NO: 217245 - DNA, 20 bp, Artificial
  CRISPR gRNA sequence
agaagttatatggcataatt

SEQ ID NO: 217246 - DNA, 20 bp, Artificial
  CRISPR gRNA sequence
tatggcataatttaaaatta

SEQ ID NO: 217247 - DNA, 20 bp, Artificial
  CRISPR gRNA sequence
aaaattatgctgattggcat

SEQ ID NO: 217248 - DNA, 20 bp, Artificial
  CRISPR gRNA sequence
aaattatgctgattggcatc

SEQ ID NO: 217249 - DNA, 20 bp, Artificial
  CRISPR gRNA sequence
tgctgattggcatcaaatac

SEQ ID NO: 217250 - DNA, 20 bp, Artificial
  CRISPR gRNA sequence
attggcatcaaatacatatg

SEQ ID NO: 217251 - DNA, 20 bp, Artificial
  CRISPR gRNA sequence
gcatcaaatacatatgaaag

SEQ ID NO: 217252 - DNA, 20 bp, Artificial
  CRISPR gRNA sequence
tttacaaaacagctaaccta

SEQ ID NO: 217253 - DNA, 20 bp, Artificial
  CRISPR gRNA sequence
ttacaaaacagctaacctag

SEQ ID NO: 217254 - DNA, 20 bp, Artificial
  CRISPR gRNA sequence
tacaaaacagctaacctaga

SEQ ID NO: 217255 - DNA, 20 bp, Artificial
  CRISPR gRNA sequence
acaaaacagctaacctagaa

SEQ ID NO: 217256 - DNA, 20 bp, Artificial
  CRISPR gRNA sequence
caaaacagctaacctagaat

SEQ ID NO: 217257 - DNA, 20 bp, Artificial
  CRISPR gRNA sequence
acctagaataaccttaaaat

SEQ ID NO: 217258 - DNA, 20 bp, Artificial
  CRISPR gRNA sequence
gaataaccttaaaattaata

SEQ ID NO: 217259 - DNA, 20 bp, Artificial
  CRISPR gRNA sequence
aaaattaatatgaatgggaa

SEQ ID NO: 217260 - DNA, 20 bp, Artificial
  CRISPR gRNA sequence
aaattaatatgaatgggaaa

SEQ ID NO: 217261 - DNA, 20 bp, Artificial
  CRISPR gRNA sequence
atatgaatgggaaaatgtca

SEQ ID NO: 217262 - DNA, 20 bp, Artificial
  CRISPR gRNA sequence
agaatagcatgaaaaatctt

SEQ ID NO: 217263 - DNA, 20 bp, Artificial
  CRISPR gRNA sequence
ttaataaacctactcttatt

SEQ ID NO: 217264 - DNA, 20 bp, Artificial
  CRISPR gRNA sequence
taataaacctactcttattg

SEQ ID NO: 217265 - DNA, 20 bp, Artificial
  CRISPR gRNA sequence
aataaacctactcttattga

SEQ ID NO: 217266 - DNA, 20 bp, Artificial
  CRISPR gRNA sequence
ataaacctactcttattgag

SEQ ID NO: 217267 - DNA, 20 bp, Artificial
  CRISPR gRNA sequence
ctcttattgagttgtaaaaa

SEQ ID NO: 217268 - DNA, 20 bp, Artificial
  CRISPR gRNA sequence
ttattgagttgtaaaaaatt

SEQ ID NO: 217269 - DNA, 20 bp, Artificial
  CRISPR gRNA sequence
attgagttgtaaaaaattta

SEQ ID NO: 217270 - DNA, 20 bp, Artificial
  CRISPR gRNA sequence
ttgagttgtaaaaaatttat

SEQ ID NO: 217271 - DNA, 20 bp, Artificial
  CRISPR gRNA sequence
agttgtaaaaaatttatatg

SEQ ID NO: 217272 - DNA, 20 bp, Artificial
  CRISPR gRNA sequence
taaaaaatttatatgagcat

SEQ ID NO: 217273 - DNA, 20 bp, Artificial
  CRISPR gRNA sequence
atatgagcattttcaccaaa

SEQ ID NO: 217274 - DNA, 20 bp, Artificial
  CRISPR gRNA sequence
tatgagcattttcaccaaaa

SEQ ID NO: 217275 - DNA, 20 bp, Artificial
  CRISPR gRNA sequence
tcaccaaaactgctgttttg

SEQ ID NO: 217276 - DNA, 20 bp, Artificial
  CRISPR gRNA sequence
caccaaaactgctgttttgt

SEQ ID NO: 217277 - DNA, 20 bp, Artificial
  CRISPR gRNA sequence
accaaaactgctgttttgta

SEQ ID NO: 217278 - DNA, 20 bp, Artificial
  CRISPR gRNA sequence
ctgttttgtaaatgaaaaag

SEQ ID NO: 217279 - DNA, 20 bp, Artificial
  CRISPR gRNA sequence
ttttgtaaatgaaaaaggta

SEQ ID NO: 217280 - DNA, 20 bp, Artificial
  CRISPR gRNA sequence
tgtaaatgaaaaaggtagac

SEQ ID NO: 217281 - DNA, 20 bp, Artificial
  CRISPR gRNA sequence
gtaaatgaaaaaggtagaca

SEQ ID NO: 217282 - DNA, 20 bp, Artificial
  CRISPR gRNA sequence
taaatgaaaaaggtagacaa

SEQ ID NO: 217283 - DNA, 20 bp, Artificial
  CRISPR gRNA sequence
taacaatgaaaactcacctg

SEQ ID NO: 217284 - DNA, 20 bp, Artificial
  CRISPR gRNA sequence
acctgtactaaacacatagt

SEQ ID NO: 217285 - DNA, 20 bp, Artificial
  CRISPR gRNA sequence
tactaaacacatagtagtga

SEQ ID NO: 217286 - DNA, 20 bp, Artificial
  CRISPR gRNA sequence
aacacatagtagtgaagtaa

SEQ ID NO: 217287 - DNA, 20 bp, Artificial
  CRISPR gRNA sequence
atatccctgtagaagtcaca

SEQ ID NO: 217288 - DNA, 20 bp, Artificial
  CRISPR gRNA sequence
tagaagtcacaattaaacca

SEQ ID NO: 217289 - DNA, 20 bp, Artificial
  CRISPR gRNA sequence
aaccaaggccagtagcattc

SEQ ID NO: 217290 - DNA, 20 bp, Artificial
  CRISPR gRNA sequence
tttaatgaatattcacctgt

SEQ ID NO: 217291 - DNA, 20 bp, Artificial
  CRISPR gRNA sequence
taatgaatattcacctgtca

SEQ ID NO: 217292 - DNA, 20 bp, Artificial
  CRISPR gRNA sequence
aatgaatattcacctgtcaa

SEQ ID NO: 217293 - DNA, 20 bp, Artificial
  CRISPR gRNA sequence
atgaatattcacctgtcaat

SEQ ID NO: 217294 - DNA, 20 bp, Artificial
  CRISPR gRNA sequence
acctgtcaataaataaaaac

SEQ ID NO: 217295 - DNA, 20 bp, Artificial
  CRISPR gRNA sequence
tcaataaataaaaacattta

SEQ ID NO: 217296 - DNA, 20 bp, Artificial
  CRISPR gRNA sequence
aaaatattttcctacatact

SEQ ID NO: 217297 - DNA, 20 bp, Artificial
  CRISPR gRNA sequence
aaatattttcctacatactt

SEQ ID NO: 217298 - DNA, 20 bp, Artificial
  CRISPR gRNA sequence
tcctacatactttttaaatg

SEQ ID NO: 217299 - DNA, 20 bp, Artificial
  CRISPR gRNA sequence
cctacatactttttaaatgt

SEQ ID NO: 217300 - DNA, 20 bp, Artificial
  CRISPR gRNA sequence
ctacatactttttaaatgta

SEQ ID NO: 217301 - DNA, 20 bp, Artificial
  CRISPR gRNA sequence
catactttttaaatgtacta

SEQ ID NO: 217302 - DNA, 20 bp, Artificial
  CRISPR gRNA sequence
tttaaatgtactaatctaaa

SEQ ID NO: 217303 - DNA, 20 bp, Artificial
  CRISPR gRNA sequence
ttaaatgtactaatctaaat

SEQ ID NO: 217304 - DNA, 20 bp, Artificial
  CRISPR gRNA sequence
taaatgtactaatctaaatt

SEQ ID NO: 217305 - DNA, 20 bp, Artificial
  CRISPR gRNA sequence
aaatgtactaatctaaattc

SEQ ID NO: 217306 - DNA, 20 bp, Artificial
  CRISPR gRNA sequence
aatgtactaatctaaattct

SEQ ID NO: 217307 - DNA, 20 bp, Artificial
  CRISPR gRNA sequence
atctaaattctgtgcttgac

SEQ ID NO: 217308 - DNA, 20 bp, Artificial
  CRISPR gRNA sequence
aattctgtgcttgacaactg

SEQ ID NO: 217309 - DNA, 20 bp, Artificial
  CRISPR gRNA sequence
tgtgcttgacaactgtgaaa

SEQ ID NO: 217310 - DNA, 20 bp, Artificial
  CRISPR gRNA sequence
tgcttgacaactgtgaaaat

SEQ ID NO: 217311 - DNA, 20 bp, Artificial
  CRISPR gRNA sequence
gacaactgtgaaaattttaa

SEQ ID NO: 217312 - DNA, 20 bp, Artificial
  CRISPR gRNA sequence
acaactgtgaaaattttaaa

SEQ ID NO: 217313 - DNA, 20 bp, Artificial
  CRISPR gRNA sequence
tgaaaattttaaaaatatac

SEQ ID NO: 217314 - DNA, 20 bp, Artificial
  CRISPR gRNA sequence
taaaaatatacgtttccctg

SEQ ID NO: 217315 - DNA, 20 bp, Artificial
  CRISPR gRNA sequence
aaaaatatacgtttccctga

SEQ ID NO: 217316 - DNA, 20 bp, Artificial
  CRISPR gRNA sequence
aaaatatacgtttccctgaa

SEQ ID NO: 217317 - DNA, 20 bp, Artificial
  CRISPR gRNA sequence
ccctgaaaacctcacacaaa

SEQ ID NO: 217318 - DNA, 20 bp, Artificial
  CRISPR gRNA sequence
cctgaaaacctcacacaaaa

SEQ ID NO: 217319 - DNA, 20 bp, Artificial
  CRISPR gRNA sequence
aaaacctcacacaaaattag

SEQ ID NO: 217320 - DNA, 20 bp, Artificial
  CRISPR gRNA sequence
acacaaaattagtgactatt

SEQ ID NO: 217321 - DNA, 20 bp, Artificial
  CRISPR gRNA sequence
gtgactattttttgattaag

SEQ ID NO: 217322 - DNA, 20 bp, Artificial
  CRISPR gRNA sequence
ttttttgattaagaccaaac

SEQ ID NO: 217323 - DNA, 20 bp, Artificial
  CRISPR gRNA sequence
tttgattaagaccaaactta

SEQ ID NO: 217324 - DNA, 20 bp, Artificial
  CRISPR gRNA sequence
ttgattaagaccaaacttaa

SEQ ID NO: 217325 - DNA, 20 bp, Artificial
  CRISPR gRNA sequence
tgattaagaccaaacttaag

SEQ ID NO: 217326 - DNA, 20 bp, Artificial
  CRISPR gRNA sequence
gattaagaccaaacttaaga

SEQ ID NO: 217327 - DNA, 20 bp, Artificial
  CRISPR gRNA sequence
attaagaccaaacttaagac

SEQ ID NO: 217328 - DNA, 20 bp, Artificial
  CRISPR gRNA sequence
agaccaaacttaagacatct

SEQ ID NO: 217329 - DNA, 20 bp, Artificial
  CRISPR gRNA sequence
aagacatctaaatctcaaca

SEQ ID NO: 217330 - DNA, 20 bp, Artificial
  CRISPR gRNA sequence
agacatctaaatctcaacat

SEQ ID NO: 217331 - DNA, 20 bp, Artificial
  CRISPR gRNA sequence
aatctcaacatttaagtttc

SEQ ID NO: 217332 - DNA, 20 bp, Artificial
  CRISPR gRNA sequence
aacatttaagtttcaacatg

SEQ ID NO: 217333 - DNA, 20 bp, Artificial
  CRISPR gRNA sequence
aagtttcaacatgctgaaac

SEQ ID NO: 217334 - DNA, 20 bp, Artificial
  CRISPR gRNA sequence
agtttcaacatgctgaaacc

SEQ ID NO: 217335 - DNA, 20 bp, Artificial
  CRISPR gRNA sequence
caacatgctgaaaccttgaa

SEQ ID NO: 217336 - DNA, 20 bp, Artificial
  CRISPR gRNA sequence
aacatgctgaaaccttgaat

SEQ ID NO: 217337 - DNA, 20 bp, Artificial
  CRISPR gRNA sequence
aaaccttgaattggctctgc

SEQ ID NO: 217338 - DNA, 20 bp, Artificial
  CRISPR gRNA sequence
gaattggctctgcctccttc

SEQ ID NO: 217339 - DNA, 20 bp, Artificial
  CRISPR gRNA sequence
aattggctctgcctccttct

SEQ ID NO: 217340 - DNA, 20 bp, Artificial
  CRISPR gRNA sequence
gctctgcctccttcttaact

SEQ ID NO: 217341 - DNA, 20 bp, Artificial
  CRISPR gRNA sequence
tgcctccttcttaactagtt

SEQ ID NO: 217342 - DNA, 20 bp, Artificial
  CRISPR gRNA sequence
cctccttcttaactagttta

SEQ ID NO: 217343 - DNA, 20 bp, Artificial
  CRISPR gRNA sequence
cttcttaactagtttacaga

SEQ ID NO: 217344 - DNA, 20 bp, Artificial
  CRISPR gRNA sequence
cttaactagtttacagaatt

SEQ ID NO: 217345 - DNA, 20 bp, Artificial
  CRISPR gRNA sequence
ttaactagtttacagaattc

SEQ ID NO: 217346 - DNA, 20 bp, Artificial
  CRISPR gRNA sequence
aactagtttacagaattcca

SEQ ID NO: 217347 - DNA, 20 bp, Artificial
  CRISPR gRNA sequence
actagtttacagaattccag

SEQ ID NO: 217348 - DNA, 20 bp, Artificial
  CRISPR gRNA sequence
gtttacagaattccagtgag

SEQ ID NO: 217349 - DNA, 20 bp, Artificial
  CRISPR gRNA sequence
acagaattccagtgagaaac

SEQ ID NO: 217350 - DNA, 20 bp, Artificial
  CRISPR gRNA sequence
cagaattccagtgagaaact

SEQ ID NO: 217351 - DNA, 20 bp, Artificial
  CRISPR gRNA sequence
cagtgagaaactgtgtattc

SEQ ID NO: 217352 - DNA, 20 bp, Artificial
  CRISPR gRNA sequence
tgtattcatcttttactgtt

SEQ ID NO: 217353 - DNA, 20 bp, Artificial
  CRISPR gRNA sequence
atcttttactgttcccttca

SEQ ID NO: 217354 - DNA, 20 bp, Artificial
  CRISPR gRNA sequence
ttactgttcccttcatctgc

SEQ ID NO: 217355 - DNA, 20 bp, Artificial
  CRISPR gRNA sequence
tactgttcccttcatctgct

SEQ ID NO: 217356 - DNA, 20 bp, Artificial
  CRISPR gRNA sequence
actgttcccttcatctgctg

SEQ ID NO: 217357 - DNA, 20 bp, Artificial
  CRISPR gRNA sequence
ctgttcccttcatctgctgt

SEQ ID NO: 217358 - DNA, 20 bp, Artificial
  CRISPR gRNA sequence
ttcccttcatctgctgtatt

SEQ ID NO: 217359 - DNA, 20 bp, Artificial
  CRISPR gRNA sequence
ccttcatctgctgtattcag

SEQ ID NO: 217360 - DNA, 20 bp, Artificial
  CRISPR gRNA sequence
catctgctgtattcagtatg

SEQ ID NO: 217361 - DNA, 20 bp, Artificial
  CRISPR gRNA sequence
atctgctgtattcagtatgc

SEQ ID NO: 217362 - DNA, 20 bp, Artificial
  CRISPR gRNA sequence
ctgtattcagtatgccccaa

SEQ ID NO: 217363 - DNA, 20 bp, Artificial
  CRISPR gRNA sequence
tattcagtatgccccaaagt

SEQ ID NO: 217364 - DNA, 20 bp, Artificial
  CRISPR gRNA sequence
agtatgccccaaagtcaaat

SEQ ID NO: 217365 - DNA, 20 bp, Artificial
  CRISPR gRNA sequence
ttccttcaagttgtcttctg

SEQ ID NO: 217366 - DNA, 20 bp, Artificial
  CRISPR gRNA sequence
cttcaagttgtcttctgaat

SEQ ID NO: 217367 - DNA, 20 bp, Artificial
  CRISPR gRNA sequence
caagttgtcttctgaattca

SEQ ID NO: 217368 - DNA, 20 bp, Artificial
  CRISPR gRNA sequence
aagttgtcttctgaattcac

SEQ ID NO: 217369 - DNA, 20 bp, Artificial
  CRISPR gRNA sequence
tcttctgaattcacctcctt

SEQ ID NO: 217370 - DNA, 20 bp, Artificial
  CRISPR gRNA sequence
ctgaattcacctccttcttc

SEQ ID NO: 217371 - DNA, 20 bp, Artificial
  CRISPR gRNA sequence
tgaattcacctccttcttcc

SEQ ID NO: 217372 - DNA, 20 bp, Artificial
  CRISPR gRNA sequence
aattcacctccttcttcctg

SEQ ID NO: 217373 - DNA, 20 bp, Artificial
  CRISPR gRNA sequence
acctccttcttcctgctgtc

SEQ ID NO: 217374 - DNA, 20 bp, Artificial
  CRISPR gRNA sequence
cttcttcctgctgtcttcac

SEQ ID NO: 217375 - DNA, 20 bp, Artificial
  CRISPR gRNA sequence
cttcctgctgtcttcactaa

SEQ ID NO: 217376 - DNA, 20 bp, Artificial
  CRISPR gRNA sequence
ttcctgctgtcttcactaac

SEQ ID NO: 217377 - DNA, 20 bp, Artificial
  CRISPR gRNA sequence
cctgctgtcttcactaactt

SEQ ID NO: 217378 - DNA, 20 bp, Artificial
  CRISPR gRNA sequence
ctgctgtcttcactaacttc

SEQ ID NO: 217379 - DNA, 20 bp, Artificial
  CRISPR gRNA sequence
ctgtcttcactaacttcaga

SEQ ID NO: 217380 - DNA, 20 bp, Artificial
  CRISPR gRNA sequence
tcttcactaacttcagatac

SEQ ID NO: 217381 - DNA, 20 bp, Artificial
  CRISPR gRNA sequence
cactaacttcagataccaat

SEQ ID NO: 217382 - DNA, 20 bp, Artificial
  CRISPR gRNA sequence
actaacttcagataccaata

SEQ ID NO: 217383 - DNA, 20 bp, Artificial
  CRISPR gRNA sequence
acttcagataccaatagagc

SEQ ID NO: 217384 - DNA, 20 bp, Artificial
  CRISPR gRNA sequence
cagataccaatagagctgcc

SEQ ID NO: 217385 - DNA, 20 bp, Artificial
  CRISPR gRNA sequence
agataccaatagagctgcca

SEQ ID NO: 217386 - DNA, 20 bp, Artificial
  CRISPR gRNA sequence
ccaagcccatgttcctaaat

SEQ ID NO: 217387 - DNA, 20 bp, Artificial
  CRISPR gRNA sequence
ctaaatattacacctgcact

SEQ ID NO: 217388 - DNA, 20 bp, Artificial
  CRISPR gRNA sequence
aatattacacctgcactgca

SEQ ID NO: 217389 - DNA, 20 bp, Artificial
  CRISPR gRNA sequence
cacctgcactgcattcttct

SEQ ID NO: 217390 - DNA, 20 bp, Artificial
  CRISPR gRNA sequence
cactgcattcttctccacaa

SEQ ID NO: 217391 - DNA, 20 bp, Artificial
  CRISPR gRNA sequence
cattcttctccacaaacgat

SEQ ID NO: 217392 - DNA, 20 bp, Artificial
  CRISPR gRNA sequence
ttctccacaaacgatggtgt

SEQ ID NO: 217393 - DNA, 20 bp, Artificial
  CRISPR gRNA sequence
ctccacaaacgatggtgtgc

SEQ ID NO: 217394 - DNA, 20 bp, Artificial
  CRISPR gRNA sequence
tccacaaacgatggtgtgct

SEQ ID NO: 217395 - DNA, 20 bp, Artificial
  CRISPR gRNA sequence
cacaaacgatggtgtgctat

SEQ ID NO: 217396 - DNA, 20 bp, Artificial
  CRISPR gRNA sequence
tagttattaggttgagtccc

SEQ ID NO: 217397 - DNA, 20 bp, Artificial
  CRISPR gRNA sequence
ttaggttgagtcccagcctt

SEQ ID NO: 217398 - DNA, 20 bp, Artificial
  CRISPR gRNA sequence
ggttgagtcccagccttcct

SEQ ID NO: 217399 - DNA, 20 bp, Artificial
  CRISPR gRNA sequence
agtcccagccttcctttgct

SEQ ID NO: 217400 - DNA, 20 bp, Artificial
  CRISPR gRNA sequence
cctttgcttttctttacatg

SEQ ID NO: 217401 - DNA, 20 bp, Artificial
  CRISPR gRNA sequence
ctttgcttttctttacatgt

SEQ ID NO: 217402 - DNA, 20 bp, Artificial
  CRISPR gRNA sequence
tgcttttctttacatgtgct

SEQ ID NO: 217403 - DNA, 20 bp, Artificial
  CRISPR gRNA sequence
gcttttctttacatgtgcta

SEQ ID NO: 217404 - DNA, 20 bp, Artificial
  CRISPR gRNA sequence
cttttctttacatgtgctac

SEQ ID NO: 217405 - DNA, 20 bp, Artificial
  CRISPR gRNA sequence
ttctttacatgtgctacata

SEQ ID NO: 217406 - DNA, 20 bp, Artificial
  CRISPR gRNA sequence
tctttacatgtgctacatat

SEQ ID NO: 217407 - DNA, 20 bp, Artificial
  CRISPR gRNA sequence
ctttacatgtgctacatatc

SEQ ID NO: 217408 - DNA, 20 bp, Artificial
  CRISPR gRNA sequence
tttacatgtgctacatatcc

SEQ ID NO: 217409 - DNA, 20 bp, Artificial
  CRISPR gRNA sequence
tacatgtgctacatatcctc

SEQ ID NO: 217410 - DNA, 20 bp, Artificial
  CRISPR gRNA sequence
acatgtgctacatatcctca

SEQ ID NO: 217411 - DNA, 20 bp, Artificial
  CRISPR gRNA sequence
catgtgctacatatcctcat

SEQ ID NO: 217412 - DNA, 20 bp, Artificial
  CRISPR gRNA sequence
catatcctcatttcccactc

SEQ ID NO: 217413 - DNA, 20 bp, Artificial
  CRISPR gRNA sequence
atttcccactcacattccca

SEQ ID NO: 217414 - DNA, 20 bp, Artificial
  CRISPR gRNA sequence
cccactcacattcccatcct

SEQ ID NO: 217415 - DNA, 20 bp, Artificial
  CRISPR gRNA sequence
ccactcacattcccatcctc

SEQ ID NO: 217416 - DNA, 20 bp, Artificial
  CRISPR gRNA sequence
acattcccatcctccaaatg

SEQ ID NO: 217417 - DNA, 20 bp, Artificial
  CRISPR gRNA sequence
ccatcctccaaatgcaactg

SEQ ID NO: 217418 - DNA, 20 bp, Artificial
  CRISPR gRNA sequence
caaatgcaactgccaatttc

SEQ ID NO: 217419 - DNA, 20 bp, Artificial
  CRISPR gRNA sequence
ccaatttccagacttggttc

SEQ ID NO: 217420 - DNA, 20 bp, Artificial
  CRISPR gRNA sequence
ccagacttggttcccacatt

SEQ ID NO: 217421 - DNA, 20 bp, Artificial
  CRISPR gRNA sequence
cagacttggttcccacattc

SEQ ID NO: 217422 - DNA, 20 bp, Artificial
  CRISPR gRNA sequence
ggttcccacattcattctac

SEQ ID NO: 217423 - DNA, 20 bp, Artificial
  CRISPR gRNA sequence
gttcccacattcattctact

SEQ ID NO: 217424 - DNA, 20 bp, Artificial
  CRISPR gRNA sequence
ccacattcattctactttca

SEQ ID NO: 217425 - DNA, 20 bp, Artificial
  CRISPR gRNA sequence
attctactttcatgtcttgg

SEQ ID NO: 217426 - DNA, 20 bp, Artificial
  CRISPR gRNA sequence
tactttcatgtcttggccaa

SEQ ID NO: 217427 - DNA, 20 bp, Artificial
  CRISPR gRNA sequence
ctttcatgtcttggccaatg

SEQ ID NO: 217428 - DNA, 20 bp, Artificial
  CRISPR gRNA sequence
tcatgtcttggccaatgaag

SEQ ID NO: 217429 - DNA, 20 bp, Artificial
  CRISPR gRNA sequence
catgtcttggccaatgaagt

SEQ ID NO: 217430 - DNA, 20 bp, Artificial
  CRISPR gRNA sequence
atgtcttggccaatgaagtt

SEQ ID NO: 217431 - DNA, 20 bp, Artificial
  CRISPR gRNA sequence
ggccaatgaagtttgcctct

SEQ ID NO: 217432 - DNA, 20 bp, Artificial
  CRISPR gRNA sequence
gccaatgaagtttgcctctg

SEQ ID NO: 217433 - DNA, 20 bp, Artificial
  CRISPR gRNA sequence
gcctctgtagtgagttgaat

SEQ ID NO: 217434 - DNA, 20 bp, Artificial
  CRISPR gRNA sequence
cctctgtagtgagttgaatg

SEQ ID NO: 217435 - DNA, 20 bp, Artificial
  CRISPR gRNA sequence
tgtagtgagttgaatgatgg

SEQ ID NO: 217436 - DNA, 20 bp, Artificial
  CRISPR gRNA sequence
tagtgagttgaatgatggcc

SEQ ID NO: 217437 - DNA, 20 bp, Artificial
  CRISPR gRNA sequence
aatgatggccctaaaattat

SEQ ID NO: 217438 - DNA, 20 bp, Artificial
  CRISPR gRNA sequence
aaattatttctacctcctaa

SEQ ID NO: 217439 - DNA, 20 bp, Artificial
  CRISPR gRNA sequence
tttctacctcctaatcccta

SEQ ID NO: 217440 - DNA, 20 bp, Artificial
  CRISPR gRNA sequence
ctacctcctaatccctaaaa

SEQ ID NO: 217441 - DNA, 20 bp, Artificial
  CRISPR gRNA sequence
tacctcctaatccctaaaac

SEQ ID NO: 217442 - DNA, 20 bp, Artificial
  CRISPR gRNA sequence
cctcctaatccctaaaacct

SEQ ID NO: 217443 - DNA, 20 bp, Artificial
  CRISPR gRNA sequence
ctaatccctaaaacctgtga

SEQ ID NO: 217444 - DNA, 20 bp, Artificial
  CRISPR gRNA sequence
atccctaaaacctgtgaata

SEQ ID NO: 217445 - DNA, 20 bp, Artificial
  CRISPR gRNA sequence
aaacctgtgaatattaccta

SEQ ID NO: 217446 - DNA, 20 bp, Artificial
  CRISPR gRNA sequence
tgaatattacctaatacagc

SEQ ID NO: 217447 - DNA, 20 bp, Artificial
  CRISPR gRNA sequence
cctaatacagcaaaagagtg

SEQ ID NO: 217448 - DNA, 20 bp, Artificial
  CRISPR gRNA sequence
atacagcaaaagagtgaata

SEQ ID NO: 217449 - DNA, 20 bp, Artificial
  CRISPR gRNA sequence
cattatatggcaaaagatat

SEQ ID NO: 217450 - DNA, 20 bp, Artificial
  CRISPR gRNA sequence
tatggcaaaagatatgatga

SEQ ID NO: 217451 - DNA, 20 bp, Artificial
  CRISPR gRNA sequence
aggatctgaaaggaggagct

SEQ ID NO: 217452 - DNA, 20 bp, Artificial
  CRISPR gRNA sequence
aaaggaggagcttaccctgg

SEQ ID NO: 217453 - DNA, 20 bp, Artificial
  CRISPR gRNA sequence
accctggattatatgagtgg

SEQ ID NO: 217454 - DNA, 20 bp, Artificial
  CRISPR gRNA sequence
ccctggattatatgagtggg

SEQ ID NO: 217455 - DNA, 20 bp, Artificial
  CRISPR gRNA sequence
gattatatgagtgggctcta

SEQ ID NO: 217456 - DNA, 20 bp, Artificial
  CRISPR gRNA sequence
tatgagtgggctctaattcc

SEQ ID NO: 217457 - DNA, 20 bp, Artificial
  CRISPR gRNA sequence
taattccaatgacaaatgtg

SEQ ID NO: 217458 - DNA, 20 bp, Artificial
  CRISPR gRNA sequence
attccaatgacaaatgtgct

SEQ ID NO: 217459 - DNA, 20 bp, Artificial
  CRISPR gRNA sequence
caatgacaaatgtgctcata

SEQ ID NO: 217460 - DNA, 20 bp, Artificial
  CRISPR gRNA sequence
ataagagagaggctgaggga

SEQ ID NO: 217461 - DNA, 20 bp, Artificial
  CRISPR gRNA sequence
agggagatttaacaaaaaca

SEQ ID NO: 217462 - DNA, 20 bp, Artificial
  CRISPR gRNA sequence
aacaaaaacacagaggcaaa

SEQ ID NO: 217463 - DNA, 20 bp, Artificial
  CRISPR gRNA sequence
acaaaaacacagaggcaaag

SEQ ID NO: 217464 - DNA, 20 bp, Artificial
  CRISPR gRNA sequence
tgctgccgcaaactaaggaa

SEQ ID NO: 217465 - DNA, 20 bp, Artificial
  CRISPR gRNA sequence
ccgcaaactaaggaatgata

SEQ ID NO: 217466 - DNA, 20 bp, Artificial
  CRISPR gRNA sequence
aggaatgataaacactgtca

SEQ ID NO: 217467 - DNA, 20 bp, Artificial
  CRISPR gRNA sequence
tcattcttcagcaaattcca

SEQ ID NO: 217468 - DNA, 20 bp, Artificial
  CRISPR gRNA sequence
ttcagcaaattccagaagct

SEQ ID NO: 217469 - DNA, 20 bp, Artificial
  CRISPR gRNA sequence
cagcaaattccagaagctag

SEQ ID NO: 217470 - DNA, 20 bp, Artificial
  CRISPR gRNA sequence
agcaaattccagaagctaga

SEQ ID NO: 217471 - DNA, 20 bp, Artificial
  CRISPR gRNA sequence
cagaagctagaagagccaag

SEQ ID NO: 217472 - DNA, 20 bp, Artificial
  CRISPR gRNA sequence
gaagagccaagaaatggatt

SEQ ID NO: 217473 - DNA, 20 bp, Artificial
  CRISPR gRNA sequence
ttccatacagccttgagagg

SEQ ID NO: 217474 - DNA, 20 bp, Artificial
  CRISPR gRNA sequence
ccatacagccttgagaggga

SEQ ID NO: 217475 - DNA, 20 bp, Artificial
  CRISPR gRNA sequence
catacagccttgagagggag

SEQ ID NO: 217476 - DNA, 20 bp, Artificial
  CRISPR gRNA sequence
gagagggagtgtggccctga

SEQ ID NO: 217477 - DNA, 20 bp, Artificial
  CRISPR gRNA sequence
agagggagtgtggccctgat

SEQ ID NO: 217478 - DNA, 20 bp, Artificial
  CRISPR gRNA sequence
atgacgtcctgatttcagac

SEQ ID NO: 217479 - DNA, 20 bp, Artificial
  CRISPR gRNA sequence
atttcagacttatggcctcc

SEQ ID NO: 217480 - DNA, 20 bp, Artificial
  CRISPR gRNA sequence
cagacttatggcctccagca

SEQ ID NO: 217481 - DNA, 20 bp, Artificial
  CRISPR gRNA sequence
agacttatggcctccagcat

SEQ ID NO: 217482 - DNA, 20 bp, Artificial
  CRISPR gRNA sequence
atggcctccagcatggaaag

SEQ ID NO: 217483 - DNA, 20 bp, Artificial
  CRISPR gRNA sequence
tggcctccagcatggaaagg

SEQ ID NO: 217484 - DNA, 20 bp, Artificial
  CRISPR gRNA sequence
cagcatggaaagggaattgc

SEQ ID NO: 217485 - DNA, 20 bp, Artificial
  CRISPR gRNA sequence
ctattgtttaagccacccag

SEQ ID NO: 217486 - DNA, 20 bp, Artificial
  CRISPR gRNA sequence
ttgtttaagccacccagttt

SEQ ID NO: 217487 - DNA, 20 bp, Artificial
  CRISPR gRNA sequence
tttaagccacccagtttgtg

SEQ ID NO: 217488 - DNA, 20 bp, Artificial
  CRISPR gRNA sequence
aagccacccagtttgtggtc

SEQ ID NO: 217489 - DNA, 20 bp, Artificial
  CRISPR gRNA sequence
agccacccagtttgtggtca

SEQ ID NO: 217490 - DNA, 20 bp, Artificial
  CRISPR gRNA sequence
gtggtcatctgttccaacag

SEQ ID NO: 217491 - DNA, 20 bp, Artificial
  CRISPR gRNA sequence
tggtcatctgttccaacagc

SEQ ID NO: 217492 - DNA, 20 bp, Artificial
  CRISPR gRNA sequence
ttccaacagccctaggaaac

SEQ ID NO: 217493 - DNA, 20 bp, Artificial
  CRISPR gRNA sequence
caacagccctaggaaactaa

SEQ ID NO: 217494 - DNA, 20 bp, Artificial
  CRISPR gRNA sequence
ggaaactaatgcagccctcc

SEQ ID NO: 217495 - DNA, 20 bp, Artificial
  CRISPR gRNA sequence
atgcagccctcctcaccttg

SEQ ID NO: 217496 - DNA, 20 bp, Artificial
  CRISPR gRNA sequence
ctcaccttggaatgcactca

SEQ ID NO: 217497 - DNA, 20 bp, Artificial
  CRISPR gRNA sequence
accttggaatgcactcatct

SEQ ID NO: 217498 - DNA, 20 bp, Artificial
  CRISPR gRNA sequence
ggaatgcactcatctacctc

SEQ ID NO: 217499 - DNA, 20 bp, Artificial
  CRISPR gRNA sequence
gaatgcactcatctacctcc

SEQ ID NO: 217500 - DNA, 20 bp, Artificial
  CRISPR gRNA sequence
atctacctcctgcgttcctg

SEQ ID NO: 217501 - DNA, 20 bp, Artificial
  CRISPR gRNA sequence
cctcctgcgttcctgcctag

SEQ ID NO: 217502 - DNA, 20 bp, Artificial
  CRISPR gRNA sequence
ctgcgttcctgcctaggaac

SEQ ID NO: 217503 - DNA, 20 bp, Artificial
  CRISPR gRNA sequence
cgttcctgcctaggaactgc

SEQ ID NO: 217504 - DNA, 20 bp, Artificial
  CRISPR gRNA sequence
ctgcctaggaactgcacatc

SEQ ID NO: 217505 - DNA, 20 bp, Artificial
  CRISPR gRNA sequence
cctaggaactgcacatctta

SEQ ID NO: 217506 - DNA, 20 bp, Artificial
  CRISPR gRNA sequence
ggaactgcacatcttacctg

SEQ ID NO: 217507 - DNA, 20 bp, Artificial
  CRISPR gRNA sequence
cacatcttacctgggacgaa

SEQ ID NO: 217508 - DNA, 20 bp, Artificial
  CRISPR gRNA sequence
acctgggacgaaaagaatgg

SEQ ID NO: 217509 - DNA, 20 bp, Artificial
  CRISPR gRNA sequence
cctgggacgaaaagaatggc

SEQ ID NO: 217510 - DNA, 20 bp, Artificial
  CRISPR gRNA sequence
ggacgaaaagaatggctcca

SEQ ID NO: 217511 - DNA, 20 bp, Artificial
  CRISPR gRNA sequence
caacaatgacaatgacagtg

SEQ ID NO: 217512 - DNA, 20 bp, Artificial
  CRISPR gRNA sequence
gtccagcaacaagtaaagca

SEQ ID NO: 217513 - DNA, 20 bp, Artificial
  CRISPR gRNA sequence
ttttctcatccataccaccg

SEQ ID NO: 217514 - DNA, 20 bp, Artificial
  CRISPR gRNA sequence
tctcatccataccaccggat

SEQ ID NO: 217515 - DNA, 20 bp, Artificial
  CRISPR gRNA sequence
ctcatccataccaccggatc

SEQ ID NO: 217516 - DNA, 20 bp, Artificial
  CRISPR gRNA sequence
tcatccataccaccggatct

SEQ ID NO: 217517 - DNA, 20 bp, Artificial
  CRISPR gRNA sequence
atccataccaccggatctat

SEQ ID NO: 217518 - DNA, 20 bp, Artificial
  CRISPR gRNA sequence
tatttaagtgcttaaaaaag

SEQ ID NO: 217519 - DNA, 20 bp, Artificial
  CRISPR gRNA sequence
aagtgcttaaaaaagaaaaa

SEQ ID NO: 217520 - DNA, 20 bp, Artificial
  CRISPR gRNA sequence
agtgcttaaaaaagaaaaac

SEQ ID NO: 217521 - DNA, 20 bp, Artificial
  CRISPR gRNA sequence
aaaaaagaaaaacaaagaat

SEQ ID NO: 217522 - DNA, 20 bp, Artificial
  CRISPR gRNA sequence
aaaaagaaaaacaaagaatt

SEQ ID NO: 217523 - DNA, 20 bp, Artificial
  CRISPR gRNA sequence
tatgaactcaatcacaagtg

SEQ ID NO: 217524 - DNA, 20 bp, Artificial
  CRISPR gRNA sequence
aatcacaagtgaagccattt

SEQ ID NO: 217525 - DNA, 20 bp, Artificial
  CRISPR gRNA sequence
taataacttgtaaggtacag

SEQ ID NO: 217526 - DNA, 20 bp, Artificial
  CRISPR gRNA sequence
aataacttgtaaggtacaga

SEQ ID NO: 217527 - DNA, 20 bp, Artificial
  CRISPR gRNA sequence
ataacttgtaaggtacagag

SEQ ID NO: 217528 - DNA, 20 bp, Artificial
  CRISPR gRNA sequence
gtaaggtacagagacaaact

SEQ ID NO: 217529 - DNA, 20 bp, Artificial
  CRISPR gRNA sequence
taaggtacagagacaaactg

SEQ ID NO: 217530 - DNA, 20 bp, Artificial
  CRISPR gRNA sequence
acagaagtactataatgtaa

SEQ ID NO: 217531 - DNA, 20 bp, Artificial
  CRISPR gRNA sequence
taatgtaataacttatgagg

SEQ ID NO: 217532 - DNA, 20 bp, Artificial
  CRISPR gRNA sequence
atgaggaacaactccttaat

SEQ ID NO: 217533 - DNA, 20 bp, Artificial
  CRISPR gRNA sequence
tgaggaacaactccttaata

SEQ ID NO: 217534 - DNA, 20 bp, Artificial
  CRISPR gRNA sequence
cttaatatcatcaagtcacc

SEQ ID NO: 217535 - DNA, 20 bp, Artificial
  CRISPR gRNA sequence
aatatcatcaagtcacctca

SEQ ID NO: 217536 - DNA, 20 bp, Artificial
  CRISPR gRNA sequence
atatcatcaagtcacctcac

SEQ ID NO: 217537 - DNA, 20 bp, Artificial
  CRISPR gRNA sequence
acatctctttcataagcaaa

SEQ ID NO: 217538 - DNA, 20 bp, Artificial
  CRISPR gRNA sequence
tttcataagcaaatggataa

SEQ ID NO: 217539 - DNA, 20 bp, Artificial
  CRISPR gRNA sequence
tcataagcaaatggataacg

SEQ ID NO: 217540 - DNA, 20 bp, Artificial
  CRISPR gRNA sequence
cataagcaaatggataacgt

SEQ ID NO: 217541 - DNA, 20 bp, Artificial
  CRISPR gRNA sequence
ataagcaaatggataacgtc

SEQ ID NO: 217542 - DNA, 20 bp, Artificial
  CRISPR gRNA sequence
ataggtgacaccttattttc

SEQ ID NO: 217543 - DNA, 20 bp, Artificial
  CRISPR gRNA sequence
taggtgacaccttattttcc

SEQ ID NO: 217544 - DNA, 20 bp, Artificial
  CRISPR gRNA sequence
attttcctacactaacaaat

SEQ ID NO: 217545 - DNA, 20 bp, Artificial
  CRISPR gRNA sequence
ttttcctacactaacaaatg

SEQ ID NO: 217546 - DNA, 20 bp, Artificial
  CRISPR gRNA sequence
tcctacactaacaaatgagg

SEQ ID NO: 217547 - DNA, 20 bp, Artificial
  CRISPR gRNA sequence
cctacactaacaaatgaggt

SEQ ID NO: 217548 - DNA, 20 bp, Artificial
  CRISPR gRNA sequence
ctacactaacaaatgaggtt

SEQ ID NO: 217549 - DNA, 20 bp, Artificial
  CRISPR gRNA sequence
cactaacaaatgaggttcta

SEQ ID NO: 217550 - DNA, 20 bp, Artificial
  CRISPR gRNA sequence
acaaatgaggttctatacat

SEQ ID NO: 217551 - DNA, 20 bp, Artificial
  CRISPR gRNA sequence
tatacatcagtctttctcgg

SEQ ID NO: 217552 - DNA, 20 bp, Artificial
  CRISPR gRNA sequence
tacatcagtctttctcggtt

SEQ ID NO: 217553 - DNA, 20 bp, Artificial
  CRISPR gRNA sequence
tctcggttgatgtattacta

SEQ ID NO: 217554 - DNA, 20 bp, Artificial
  CRISPR gRNA sequence
ctcggttgatgtattactaa

SEQ ID NO: 217555 - DNA, 20 bp, Artificial
  CRISPR gRNA sequence
tcggttgatgtattactaat

SEQ ID NO: 217556 - DNA, 20 bp, Artificial
  CRISPR gRNA sequence
ggttgatgtattactaataa

SEQ ID NO: 217557 - DNA, 20 bp, Artificial
  CRISPR gRNA sequence
atgtattactaataaattga

SEQ ID NO: 217558 - DNA, 20 bp, Artificial
  CRISPR gRNA sequence
ctaataaattgagctagata

SEQ ID NO: 217559 - DNA, 20 bp, Artificial
  CRISPR gRNA sequence
ataaattgagctagataagt

SEQ ID NO: 217560 - DNA, 20 bp, Artificial
  CRISPR gRNA sequence
agctagataagtttttgggg

SEQ ID NO: 217561 - DNA, 20 bp, Artificial
  CRISPR gRNA sequence
gataagtttttggggggagg

SEQ ID NO: 217562 - DNA, 20 bp, Artificial
  CRISPR gRNA sequence
ttggggggaggggggacact

SEQ ID NO: 217563 - DNA, 20 bp, Artificial
  CRISPR gRNA sequence
tggggggaggggggacactg

SEQ ID NO: 217564 - DNA, 20 bp, Artificial
  CRISPR gRNA sequence
ggggggaggggggacactgc

SEQ ID NO: 217565 - DNA, 20 bp, Artificial
  CRISPR gRNA sequence
gggggaggggggacactgct

SEQ ID NO: 217566 - DNA, 20 bp, Artificial
  CRISPR gRNA sequence
ctctgcataatatagaatgt

SEQ ID NO: 217567 - DNA, 20 bp, Artificial
  CRISPR gRNA sequence
tgcataatatagaatgttga

SEQ ID NO: 217568 - DNA, 20 bp, Artificial
  CRISPR gRNA sequence
cataatatagaatgttgagg

SEQ ID NO: 217569 - DNA, 20 bp, Artificial
  CRISPR gRNA sequence
aggagcatccctggcctcta

SEQ ID NO: 217570 - DNA, 20 bp, Artificial
  CRISPR gRNA sequence
gcctctacatactagatgct

SEQ ID NO: 217571 - DNA, 20 bp, Artificial
  CRISPR gRNA sequence
tacatactagatgctagtaa

SEQ ID NO: 217572 - DNA, 20 bp, Artificial
  CRISPR gRNA sequence
catactagatgctagtaact

SEQ ID NO: 217573 - DNA, 20 bp, Artificial
  CRISPR gRNA sequence
gatgctagtaactagatgcc

SEQ ID NO: 217574 - DNA, 20 bp, Artificial
  CRISPR gRNA sequence
gtaactagatgccagttatg

SEQ ID NO: 217575 - DNA, 20 bp, Artificial
  CRISPR gRNA sequence
gatgccagttatgttaatca

SEQ ID NO: 217576 - DNA, 20 bp, Artificial
  CRISPR gRNA sequence
tgttaatcaaactgttttca

SEQ ID NO: 217577 - DNA, 20 bp, Artificial
  CRISPR gRNA sequence
atcaaactgttttcagacat

SEQ ID NO: 217578 - DNA, 20 bp, Artificial
  CRISPR gRNA sequence
ttttcagacattgtcaatgc

SEQ ID NO: 217579 - DNA, 20 bp, Artificial
  CRISPR gRNA sequence
tcagacattgtcaatgcccc

SEQ ID NO: 217580 - DNA, 20 bp, Artificial
  CRISPR gRNA sequence
cagacattgtcaatgccccc

SEQ ID NO: 217581 - DNA, 20 bp, Artificial
  CRISPR gRNA sequence
agacattgtcaatgcccccg

SEQ ID NO: 217582 - DNA, 20 bp, Artificial
  CRISPR gRNA sequence
tcaatgcccccgatgagcaa

SEQ ID NO: 217583 - DNA, 20 bp, Artificial
  CRISPR gRNA sequence
caagtgacaacacaacactg

SEQ ID NO: 217584 - DNA, 20 bp, Artificial
  CRISPR gRNA sequence
atgtacataatactaatggg

SEQ ID NO: 217585 - DNA, 20 bp, Artificial
  CRISPR gRNA sequence
atgggaaataatgggttaat

SEQ ID NO: 217586 - DNA, 20 bp, Artificial
  CRISPR gRNA sequence
attaacaatattgagaaaaa

SEQ ID NO: 217587 - DNA, 20 bp, Artificial
  CRISPR gRNA sequence
acaatattgagaaaaagaga

SEQ ID NO: 217588 - DNA, 20 bp, Artificial
  CRISPR gRNA sequence
agaaaaagagaattttgtcc

SEQ ID NO: 217589 - DNA, 20 bp, Artificial
  CRISPR gRNA sequence
tgtcctaccttataaaaaat

SEQ ID NO: 217590 - DNA, 20 bp, Artificial
  CRISPR gRNA sequence
gtcctaccttataaaaaatt

SEQ ID NO: 217591 - DNA, 20 bp, Artificial
  CRISPR gRNA sequence
tcctaccttataaaaaatta

SEQ ID NO: 217592 - DNA, 20 bp, Artificial
  CRISPR gRNA sequence
ccttataaaaaattagtaaa

SEQ ID NO: 217593 - DNA, 20 bp, Artificial
  CRISPR gRNA sequence
ataaaaaattagtaaacaat

SEQ ID NO: 217594 - DNA, 20 bp, Artificial
  CRISPR gRNA sequence
taaaaaattagtaaacaatc

SEQ ID NO: 217595 - DNA, 20 bp, Artificial
  CRISPR gRNA sequence
gtaaacaatctggaaatcta

SEQ ID NO: 217596 - DNA, 20 bp, Artificial
  CRISPR gRNA sequence
gaaatctagttattttgttt

SEQ ID NO: 217597 - DNA, 20 bp, Artificial
  CRISPR gRNA sequence
gttattttgttttgaaaaaa

SEQ ID NO: 217598 - DNA, 20 bp, Artificial
  CRISPR gRNA sequence
ttttgttttgaaaaaaatga

SEQ ID NO: 217599 - DNA, 20 bp, Artificial
  CRISPR gRNA sequence
tgttttgaaaaaaatgacag

SEQ ID NO: 217600 - DNA, 20 bp, Artificial
  CRISPR gRNA sequence
gttttgaaaaaaatgacaga

SEQ ID NO: 217601 - DNA, 20 bp, Artificial
  CRISPR gRNA sequence
ttttgaaaaaaatgacagaa

SEQ ID NO: 217602 - DNA, 20 bp, Artificial
  CRISPR gRNA sequence
tgaaaaaaatgacagaataa

SEQ ID NO: 217603 - DNA, 20 bp, Artificial
  CRISPR gRNA sequence
gaaaaaaatgacagaataaa

SEQ ID NO: 217604 - DNA, 20 bp, Artificial
  CRISPR gRNA sequence
aaaaaaatgacagaataaaa

SEQ ID NO: 217605 - DNA, 20 bp, Artificial
  CRISPR gRNA sequence
ggcagattacacccttgtga

SEQ ID NO: 217606 - DNA, 20 bp, Artificial
  CRISPR gRNA sequence
cacccttgtgaaatcctgat

SEQ ID NO: 217607 - DNA, 20 bp, Artificial
  CRISPR gRNA sequence
gtgaaatcctgatgaagaaa

SEQ ID NO: 217608 - DNA, 20 bp, Artificial
  CRISPR gRNA sequence
tgaaatcctgatgaagaaaa

SEQ ID NO: 217609 - DNA, 20 bp, Artificial
  CRISPR gRNA sequence
atgaagaaaaaaagcttaaa

SEQ ID NO: 217610 - DNA, 20 bp, Artificial
  CRISPR gRNA sequence
aaattgttcaattaaaatat

SEQ ID NO: 217611 - DNA, 20 bp, Artificial
  CRISPR gRNA sequence
aattgttcaattaaaatatt

SEQ ID NO: 217612 - DNA, 20 bp, Artificial
  CRISPR gRNA sequence
ttcaattaaaatattttaat

SEQ ID NO: 217613 - DNA, 20 bp, Artificial
  CRISPR gRNA sequence
aattaaaatattttaataaa

SEQ ID NO: 217614 - DNA, 20 bp, Artificial
  CRISPR gRNA sequence
aaatattttaataaaaataa

SEQ ID NO: 217615 - DNA, 20 bp, Artificial
  CRISPR gRNA sequence
taataaaaataaactgcaaa

SEQ ID NO: 217616 - DNA, 20 bp, Artificial
  CRISPR gRNA sequence
aataaaaataaactgcaaag

SEQ ID NO: 217617 - DNA, 20 bp, Artificial
  CRISPR gRNA sequence
ataaaaataaactgcaaaga

SEQ ID NO: 217618 - DNA, 20 bp, Artificial
  CRISPR gRNA sequence
caaagactcaatgggattca

SEQ ID NO: 217619 - DNA, 20 bp, Artificial
  CRISPR gRNA sequence
aatgggattcatcatacatg

SEQ ID NO: 217620 - DNA, 20 bp, Artificial
  CRISPR gRNA sequence
atcatacatgttattgtttc

SEQ ID NO: 217621 - DNA, 20 bp, Artificial
  CRISPR gRNA sequence
ttgtttctgctgctagctcc

SEQ ID NO: 217622 - DNA, 20 bp, Artificial
  CRISPR gRNA sequence
tttctgctgctagctccact

SEQ ID NO: 217623 - DNA, 20 bp, Artificial
  CRISPR gRNA sequence
ctgctgctagctccactgtc

SEQ ID NO: 217624 - DNA, 20 bp, Artificial
  CRISPR gRNA sequence
tgctgctagctccactgtca

SEQ ID NO: 217625 - DNA, 20 bp, Artificial
  CRISPR gRNA sequence
ctgctagctccactgtcaag

SEQ ID NO: 217626 - DNA, 20 bp, Artificial
  CRISPR gRNA sequence
ctagctccactgtcaagtat

SEQ ID NO: 217627 - DNA, 20 bp, Artificial
  CRISPR gRNA sequence
gctccactgtcaagtatctc

SEQ ID NO: 217628 - DNA, 20 bp, Artificial
  CRISPR gRNA sequence
cactgtcaagtatctcatac

SEQ ID NO: 217629 - DNA, 20 bp, Artificial
  CRISPR gRNA sequence
tcaagtatctcataccttct

SEQ ID NO: 217630 - DNA, 20 bp, Artificial
  CRISPR gRNA sequence
ataccttctctgaaagaatg

SEQ ID NO: 217631 - DNA, 20 bp, Artificial
  CRISPR gRNA sequence
ctctgaaagaatggaatggg

SEQ ID NO: 217632 - DNA, 20 bp, Artificial
  CRISPR gRNA sequence
tctgaaagaatggaatgggt

SEQ ID NO: 217633 - DNA, 20 bp, Artificial
  CRISPR gRNA sequence
tgaaagaatggaatgggtca

SEQ ID NO: 217634 - DNA, 20 bp, Artificial
  CRISPR gRNA sequence
aaagaatggaatgggtcaat

SEQ ID NO: 217635 - DNA, 20 bp, Artificial
  CRISPR gRNA sequence
cgaatattagttcttttact

SEQ ID NO: 217636 - DNA, 20 bp, Artificial
  CRISPR gRNA sequence
gttcttttactatatatgaa

SEQ ID NO: 217637 - DNA, 20 bp, Artificial
  CRISPR gRNA sequence
ttttactatatatgaatctt

SEQ ID NO: 217638 - DNA, 20 bp, Artificial
  CRISPR gRNA sequence
ttactatatatgaatctttt

SEQ ID NO: 217639 - DNA, 20 bp, Artificial
  CRISPR gRNA sequence
tactatatatgaatctttta

SEQ ID NO: 217640 - DNA, 20 bp, Artificial
  CRISPR gRNA sequence
actatatatgaatcttttaa

SEQ ID NO: 217641 - DNA, 20 bp, Artificial
  CRISPR gRNA sequence
ctatatatgaatcttttaaa

SEQ ID NO: 217642 - DNA, 20 bp, Artificial
  CRISPR gRNA sequence
tatatgaatcttttaaattt

SEQ ID NO: 217643 - DNA, 20 bp, Artificial
  CRISPR gRNA sequence
ttaaattttggttaatattg

SEQ ID NO: 217644 - DNA, 20 bp, Artificial
  CRISPR gRNA sequence
taaattttggttaatattga

SEQ ID NO: 217645 - DNA, 20 bp, Artificial
  CRISPR gRNA sequence
aaattttggttaatattgaa

SEQ ID NO: 217646 - DNA, 20 bp, Artificial
  CRISPR gRNA sequence
aattttggttaatattgaag

SEQ ID NO: 217647 - DNA, 20 bp, Artificial
  CRISPR gRNA sequence
tggttaatattgaagttgat

SEQ ID NO: 217648 - DNA, 20 bp, Artificial
  CRISPR gRNA sequence
ggttaatattgaagttgatt

SEQ ID NO: 217649 - DNA, 20 bp, Artificial
  CRISPR gRNA sequence
gttaatattgaagttgattt

SEQ ID NO: 217650 - DNA, 20 bp, Artificial
  CRISPR gRNA sequence
atattgaagttgattttttc

SEQ ID NO: 217651 - DNA, 20 bp, Artificial
  CRISPR gRNA sequence
aagttgattttttcaccaag

SEQ ID NO: 217652 - DNA, 20 bp, Artificial
  CRISPR gRNA sequence
attttttcaccaaggaagtt

SEQ ID NO: 217653 - DNA, 20 bp, Artificial
  CRISPR gRNA sequence
tttcaccaaggaagttgttt

SEQ ID NO: 217654 - DNA, 20 bp, Artificial
  CRISPR gRNA sequence
ttcaccaaggaagttgttta

SEQ ID NO: 217655 - DNA, 20 bp, Artificial
  CRISPR gRNA sequence
tcaccaaggaagttgtttaa

SEQ ID NO: 217656 - DNA, 20 bp, Artificial
  CRISPR gRNA sequence
caccaaggaagttgtttaag

SEQ ID NO: 217657 - DNA, 20 bp, Artificial
  CRISPR gRNA sequence
accaaggaagttgtttaagg

SEQ ID NO: 217658 - DNA, 20 bp, Artificial
  CRISPR gRNA sequence
tttaaggcaacctaaaagca

SEQ ID NO: 217659 - DNA, 20 bp, Artificial
  CRISPR gRNA sequence
aaggcaacctaaaagcaaac

SEQ ID NO: 217660 - DNA, 20 bp, Artificial
  CRISPR gRNA sequence
aggcaacctaaaagcaaact

SEQ ID NO: 217661 - DNA, 20 bp, Artificial
  CRISPR gRNA sequence
aaagcaaactgagtagcgga

SEQ ID NO: 217662 - DNA, 20 bp, Artificial
  CRISPR gRNA sequence
agtagcggaaagaaacagcg

SEQ ID NO: 217663 - DNA, 20 bp, Artificial
  CRISPR gRNA sequence
aaatgctgctgtgtgtcatc

SEQ ID NO: 217664 - DNA, 20 bp, Artificial
  CRISPR gRNA sequence
ctgtgtgtcatccacataga

SEQ ID NO: 217665 - DNA, 20 bp, Artificial
  CRISPR gRNA sequence
tgtgtcatccacatagagat

SEQ ID NO: 217666 - DNA, 20 bp, Artificial
  CRISPR gRNA sequence
catgacagtaatcaattggt

SEQ ID NO: 217667 - DNA, 20 bp, Artificial
  CRISPR gRNA sequence
gtggctgtcatgaaggggaa

SEQ ID NO: 217668 - DNA, 20 bp, Artificial
  CRISPR gRNA sequence
tcatgaaggggaaaatattt

SEQ ID NO: 217669 - DNA, 20 bp, Artificial
  CRISPR gRNA sequence
taaatgttatatttagcatt

SEQ ID NO: 217670 - DNA, 20 bp, Artificial
  CRISPR gRNA sequence
aaatgttatatttagcattt

SEQ ID NO: 217671 - DNA, 20 bp, Artificial
  CRISPR gRNA sequence
aatgttatatttagcattta

SEQ ID NO: 217672 - DNA, 20 bp, Artificial
  CRISPR gRNA sequence
tatttagcatttagtttttt

SEQ ID NO: 217673 - DNA, 20 bp, Artificial
  CRISPR gRNA sequence
agcatttagttttttttctt

SEQ ID NO: 217674 - DNA, 20 bp, Artificial
  CRISPR gRNA sequence
gcatttagttttttttcttc

SEQ ID NO: 217675 - DNA, 20 bp, Artificial
  CRISPR gRNA sequence
agttttttttcttctacagt

SEQ ID NO: 217676 - DNA, 20 bp, Artificial
  CRISPR gRNA sequence
gttttttttcttctacagtg

SEQ ID NO: 217677 - DNA, 20 bp, Artificial
  CRISPR gRNA sequence
tttttcttctacagtgacaa

SEQ ID NO: 217678 - DNA, 20 bp, Artificial
  CRISPR gRNA sequence
ttttcttctacagtgacaaa

SEQ ID NO: 217679 - DNA, 20 bp, Artificial
  CRISPR gRNA sequence
tttcttctacagtgacaaac

SEQ ID NO: 217680 - DNA, 20 bp, Artificial
  CRISPR gRNA sequence
ttcttctacagtgacaaaca

SEQ ID NO: 217681 - DNA, 20 bp, Artificial
  CRISPR gRNA sequence
tcttctacagtgacaaacat

SEQ ID NO: 217682 - DNA, 20 bp, Artificial
  CRISPR gRNA sequence
cttctacagtgacaaacatt

SEQ ID NO: 217683 - DNA, 20 bp, Artificial
  CRISPR gRNA sequence
ttctacagtgacaaacatta

SEQ ID NO: 217684 - DNA, 20 bp, Artificial
  CRISPR gRNA sequence
ctacagtgacaaacattaaa

SEQ ID NO: 217685 - DNA, 20 bp, Artificial
  CRISPR gRNA sequence
tacagtgacaaacattaaat

SEQ ID NO: 217686 - DNA, 20 bp, Artificial
  CRISPR gRNA sequence
cagtgacaaacattaaataa

SEQ ID NO: 217687 - DNA, 20 bp, Artificial
  CRISPR gRNA sequence
aataaagtaaaagcaataaa

SEQ ID NO: 217688 - DNA, 20 bp, Artificial
  CRISPR gRNA sequence
aatgattgtgataaaaatct

SEQ ID NO: 217689 - DNA, 20 bp, Artificial
  CRISPR gRNA sequence
tgataaaaatctatgtttaa

SEQ ID NO: 217690 - DNA, 20 bp, Artificial
  CRISPR gRNA sequence
tgtttaaggtatatgacagg

SEQ ID NO: 217691 - DNA, 20 bp, Artificial
  CRISPR gRNA sequence
aaggtatatgacaggtacct

SEQ ID NO: 217692 - DNA, 20 bp, Artificial
  CRISPR gRNA sequence
aggtatatgacaggtaccta

SEQ ID NO: 217693 - DNA, 20 bp, Artificial
  CRISPR gRNA sequence
aatatttctggaatttctat

SEQ ID NO: 217694 - DNA, 20 bp, Artificial
  CRISPR gRNA sequence
ctggaatttctatctaccca

SEQ ID NO: 217695 - DNA, 20 bp, Artificial
  CRISPR gRNA sequence
tggaatttctatctacccat

SEQ ID NO: 217696 - DNA, 20 bp, Artificial
  CRISPR gRNA sequence
gaatttctatctacccataa

SEQ ID NO: 217697 - DNA, 20 bp, Artificial
  CRISPR gRNA sequence
ctatctacccataatttata

SEQ ID NO: 217698 - DNA, 20 bp, Artificial
  CRISPR gRNA sequence
tatctacccataatttataa

SEQ ID NO: 217699 - DNA, 20 bp, Artificial
  CRISPR gRNA sequence
tctacccataatttataacc

SEQ ID NO: 217700 - DNA, 20 bp, Artificial
  CRISPR gRNA sequence
cccataatttataacctcaa

SEQ ID NO: 217701 - DNA, 20 bp, Artificial
  CRISPR gRNA sequence
ataacctcaattttagtctc

SEQ ID NO: 217702 - DNA, 20 bp, Artificial
  CRISPR gRNA sequence
taacctcaattttagtctct

SEQ ID NO: 217703 - DNA, 20 bp, Artificial
  CRISPR gRNA sequence
aattttagtctctttatggg

SEQ ID NO: 217704 - DNA, 20 bp, Artificial
  CRISPR gRNA sequence
tagtctctttatggggagat

SEQ ID NO: 217705 - DNA, 20 bp, Artificial
  CRISPR gRNA sequence
agtctctttatggggagata

SEQ ID NO: 217706 - DNA, 20 bp, Artificial
  CRISPR gRNA sequence
gtctctttatggggagataa

SEQ ID NO: 217707 - DNA, 20 bp, Artificial
  CRISPR gRNA sequence
tttatggggagataagtcct

SEQ ID NO: 217708 - DNA, 20 bp, Artificial
  CRISPR gRNA sequence
tatggggagataagtcctaa

SEQ ID NO: 217709 - DNA, 20 bp, Artificial
  CRISPR gRNA sequence
atggggagataagtcctaag

SEQ ID NO: 217710 - DNA, 20 bp, Artificial
  CRISPR gRNA sequence
tggggagataagtcctaagc

SEQ ID NO: 217711 - DNA, 20 bp, Artificial
  CRISPR gRNA sequence
agcaataaataaccaattta

SEQ ID NO: 217712 - DNA, 20 bp, Artificial
  CRISPR gRNA sequence
attaatgtggatttcagtta

SEQ ID NO: 217713 - DNA, 20 bp, Artificial
  CRISPR gRNA sequence
ttaatgtggatttcagttac

SEQ ID NO: 217714 - DNA, 20 bp, Artificial
  CRISPR gRNA sequence
atgtggatttcagttacaca

SEQ ID NO: 217715 - DNA, 20 bp, Artificial
  CRISPR gRNA sequence
cagttacacagttgagtaac

SEQ ID NO: 217716 - DNA, 20 bp, Artificial
  CRISPR gRNA sequence
agttacacagttgagtaact

SEQ ID NO: 217717 - DNA, 20 bp, Artificial
  CRISPR gRNA sequence
cacagttgagtaactgaaat

SEQ ID NO: 217718 - DNA, 20 bp, Artificial
  CRISPR gRNA sequence
agtaactgaaatccacatta

SEQ ID NO: 217719 - DNA, 20 bp, Artificial
  CRISPR gRNA sequence
aaatccacattaatcagaga

SEQ ID NO: 217720 - DNA, 20 bp, Artificial
  CRISPR gRNA sequence
atcagagaagagaaacccat

SEQ ID NO: 217721 - DNA, 20 bp, Artificial
  CRISPR gRNA sequence
atcagaaaacatcctatggc

SEQ ID NO: 217722 - DNA, 20 bp, Artificial
  CRISPR gRNA sequence
tggcaagttccccaagtttt

SEQ ID NO: 217723 - DNA, 20 bp, Artificial
  CRISPR gRNA sequence
cccaagtttttatttgattc

SEQ ID NO: 217724 - DNA, 20 bp, Artificial
  CRISPR gRNA sequence
ttatttgattcattacttcc

SEQ ID NO: 217725 - DNA, 20 bp, Artificial
  CRISPR gRNA sequence
tatttgattcattacttccg

SEQ ID NO: 217726 - DNA, 20 bp, Artificial
  CRISPR gRNA sequence
atttgattcattacttccgc

SEQ ID NO: 217727 - DNA, 20 bp, Artificial
  CRISPR gRNA sequence
tttgattcattacttccgcc

SEQ ID NO: 217728 - DNA, 20 bp, Artificial
  CRISPR gRNA sequence
gattcattacttccgcccag

SEQ ID NO: 217729 - DNA, 20 bp, Artificial
  CRISPR gRNA sequence
attcattacttccgcccagc

SEQ ID NO: 217730 - DNA, 20 bp, Artificial
  CRISPR gRNA sequence
attacttccgcccagccctg

SEQ ID NO: 217731 - DNA, 20 bp, Artificial
  CRISPR gRNA sequence
cttccgcccagccctggact

SEQ ID NO: 217732 - DNA, 20 bp, Artificial
  CRISPR gRNA sequence
ccgcccagccctggacttat

SEQ ID NO: 217733 - DNA, 20 bp, Artificial
  CRISPR gRNA sequence
cgcccagccctggacttatg

SEQ ID NO: 217734 - DNA, 20 bp, Artificial
  CRISPR gRNA sequence
gacttatgtgtctaatactc

SEQ ID NO: 217735 - DNA, 20 bp, Artificial
  CRISPR gRNA sequence
atgtgtctaatactcagtca

SEQ ID NO: 217736 - DNA, 20 bp, Artificial
  CRISPR gRNA sequence
tgtgtctaatactcagtcat

SEQ ID NO: 217737 - DNA, 20 bp, Artificial
  CRISPR gRNA sequence
atactcagtcatagccttgc

SEQ ID NO: 217738 - DNA, 20 bp, Artificial
  CRISPR gRNA sequence
agtcatagccttgccttctt

SEQ ID NO: 217739 - DNA, 20 bp, Artificial
  CRISPR gRNA sequence
gccttcttataaggcacaga

SEQ ID NO: 217740 - DNA, 20 bp, Artificial
  CRISPR gRNA sequence
ccttcttataaggcacagag

SEQ ID NO: 217741 - DNA, 20 bp, Artificial
  CRISPR gRNA sequence
cttataaggcacagagtttt

SEQ ID NO: 217742 - DNA, 20 bp, Artificial
  CRISPR gRNA sequence
ttataaggcacagagttttc

SEQ ID NO: 217743 - DNA, 20 bp, Artificial
  CRISPR gRNA sequence
ataaggcacagagttttcat

SEQ ID NO: 217744 - DNA, 20 bp, Artificial
  CRISPR gRNA sequence
taaggcacagagttttcata

SEQ ID NO: 217745 - DNA, 20 bp, Artificial
  CRISPR gRNA sequence
tcataacttccctattttct

SEQ ID NO: 217746 - DNA, 20 bp, Artificial
  CRISPR gRNA sequence
cataacttccctattttcta

SEQ ID NO: 217747 - DNA, 20 bp, Artificial
  CRISPR gRNA sequence
ataacttccctattttctag

SEQ ID NO: 217748 - DNA, 20 bp, Artificial
  CRISPR gRNA sequence
ccctattttctaggctcaaa

SEQ ID NO: 217749 - DNA, 20 bp, Artificial
  CRISPR gRNA sequence
cctattttctaggctcaaat

SEQ ID NO: 217750 - DNA, 20 bp, Artificial
  CRISPR gRNA sequence
ttttctaggctcaaatgctg

SEQ ID NO: 217751 - DNA, 20 bp, Artificial
  CRISPR gRNA sequence
tctaggctcaaatgctggct

SEQ ID NO: 217752 - DNA, 20 bp, Artificial
  CRISPR gRNA sequence
ctaggctcaaatgctggcta

SEQ ID NO: 217753 - DNA, 20 bp, Artificial
  CRISPR gRNA sequence
taggctcaaatgctggctag

SEQ ID NO: 217754 - DNA, 20 bp, Artificial
  CRISPR gRNA sequence
ggctcaaatgctggctagaa

SEQ ID NO: 217755 - DNA, 20 bp, Artificial
  CRISPR gRNA sequence
aaatgctggctagaatgaaa

SEQ ID NO: 217756 - DNA, 20 bp, Artificial
  CRISPR gRNA sequence
gctagaatgaaactgagtgt

SEQ ID NO: 217757 - DNA, 20 bp, Artificial
  CRISPR gRNA sequence
gaatgaaactgagtgtataa

SEQ ID NO: 217758 - DNA, 20 bp, Artificial
  CRISPR gRNA sequence
agtgtataagtcacaaaagg

SEQ ID NO: 217759 - DNA, 20 bp, Artificial
  CRISPR gRNA sequence
tctctagacatatgtcacat

SEQ ID NO: 217760 - DNA, 20 bp, Artificial
  CRISPR gRNA sequence
ctctagacatatgtcacatt

SEQ ID NO: 217761 - DNA, 20 bp, Artificial
  CRISPR gRNA sequence
tctagacatatgtcacattt

SEQ ID NO: 217762 - DNA, 20 bp, Artificial
  CRISPR gRNA sequence
tagacatatgtcacattttc

SEQ ID NO: 217763 - DNA, 20 bp, Artificial
  CRISPR gRNA sequence
gacatatgtcacattttcca

SEQ ID NO: 217764 - DNA, 20 bp, Artificial
  CRISPR gRNA sequence
tccattttaatcccatatat

SEQ ID NO: 217765 - DNA, 20 bp, Artificial
  CRISPR gRNA sequence
ccattttaatcccatatata

SEQ ID NO: 217766 - DNA, 20 bp, Artificial
  CRISPR gRNA sequence
cattttaatcccatatatat

SEQ ID NO: 217767 - DNA, 20 bp, Artificial
  CRISPR gRNA sequence
taatcccatatatattgtta

SEQ ID NO: 217768 - DNA, 20 bp, Artificial
  CRISPR gRNA sequence
aatcccatatatattgttat

SEQ ID NO: 217769 - DNA, 20 bp, Artificial
  CRISPR gRNA sequence
atcccatatatattgttatc

SEQ ID NO: 217770 - DNA, 20 bp, Artificial
  CRISPR gRNA sequence
ttatctaaatagagcttgaa

SEQ ID NO: 217771 - DNA, 20 bp, Artificial
  CRISPR gRNA sequence
tctaaatagagcttgaaagt

SEQ ID NO: 217772 - DNA, 20 bp, Artificial
  CRISPR gRNA sequence
aatagagcttgaaagttctg

SEQ ID NO: 217773 - DNA, 20 bp, Artificial
  CRISPR gRNA sequence
gaaagttctgcaaagggtta

SEQ ID NO: 217774 - DNA, 20 bp, Artificial
  CRISPR gRNA sequence
aaagttctgcaaagggttat

SEQ ID NO: 217775 - DNA, 20 bp, Artificial
  CRISPR gRNA sequence
tgcaaagggttataaagtag

SEQ ID NO: 217776 - DNA, 20 bp, Artificial
  CRISPR gRNA sequence
caaagggttataaagtagaa

SEQ ID NO: 217777 - DNA, 20 bp, Artificial
  CRISPR gRNA sequence
taaagtagaagctgtttcaa

SEQ ID NO: 217778 - DNA, 20 bp, Artificial
  CRISPR gRNA sequence
tttcaaatgcacctcacagt

SEQ ID NO: 217779 - DNA, 20 bp, Artificial
  CRISPR gRNA sequence
caaatgcacctcacagtcaa

SEQ ID NO: 217780 - DNA, 20 bp, Artificial
  CRISPR gRNA sequence
aaatgcacctcacagtcaat

SEQ ID NO: 217781 - DNA, 20 bp, Artificial
  CRISPR gRNA sequence
acagtcaatcaaacattcat

SEQ ID NO: 217782 - DNA, 20 bp, Artificial
  CRISPR gRNA sequence
ataagaaactcttccaggtt

SEQ ID NO: 217783 - DNA, 20 bp, Artificial
  CRISPR gRNA sequence
ttccaggtttaagtcaatgc

SEQ ID NO: 217784 - DNA, 20 bp, Artificial
  CRISPR gRNA sequence
ccaggtttaagtcaatgcat

SEQ ID NO: 217785 - DNA, 20 bp, Artificial
  CRISPR gRNA sequence
caggtttaagtcaatgcata

SEQ ID NO: 217786 - DNA, 20 bp, Artificial
  CRISPR gRNA sequence
aagtcaatgcataaaaaagc

SEQ ID NO: 217787 - DNA, 20 bp, Artificial
  CRISPR gRNA sequence
agtcaatgcataaaaaagct

SEQ ID NO: 217788 - DNA, 20 bp, Artificial
  CRISPR gRNA sequence
ctaagatcaagcaacaagaa

SEQ ID NO: 217789 - DNA, 20 bp, Artificial
  CRISPR gRNA sequence
agatcaagcaacaagaattt

SEQ ID NO: 217790 - DNA, 20 bp, Artificial
  CRISPR gRNA sequence
gccttagagtacagtataat

SEQ ID NO: 217791 - DNA, 20 bp, Artificial
  CRISPR gRNA sequence
ccttagagtacagtataatt

SEQ ID NO: 217792 - DNA, 20 bp, Artificial
  CRISPR gRNA sequence
agagtacagtataatttcat

SEQ ID NO: 217793 - DNA, 20 bp, Artificial
  CRISPR gRNA sequence
gagtacagtataatttcatg

SEQ ID NO: 217794 - DNA, 20 bp, Artificial
  CRISPR gRNA sequence
catggaaaaaggttgactta

SEQ ID NO: 217795 - DNA, 20 bp, Artificial
  CRISPR gRNA sequence
atggaaaaaggttgacttat

SEQ ID NO: 217796 - DNA, 20 bp, Artificial
  CRISPR gRNA sequence
acttatgttcttcttctata

SEQ ID NO: 217797 - DNA, 20 bp, Artificial
  CRISPR gRNA sequence
atgttcttcttctatatttt

SEQ ID NO: 217798 - DNA, 20 bp, Artificial
  CRISPR gRNA sequence
tgttcttcttctatattttt

SEQ ID NO: 217799 - DNA, 20 bp, Artificial
  CRISPR gRNA sequence
ttcttctatatttttctttt

SEQ ID NO: 217800 - DNA, 20 bp, Artificial
  CRISPR gRNA sequence
cttctatatttttctttttc

SEQ ID NO: 217801 - DNA, 20 bp, Artificial
  CRISPR gRNA sequence
ttctatatttttctttttct

SEQ ID NO: 217802 - DNA, 20 bp, Artificial
  CRISPR gRNA sequence
ctatatttttctttttcttt

SEQ ID NO: 217803 - DNA, 20 bp, Artificial
  CRISPR gRNA sequence
tatatttttctttttctttt

SEQ ID NO: 217804 - DNA, 20 bp, Artificial
  CRISPR gRNA sequence
tatttttctttttcttttct

SEQ ID NO: 217805 - DNA, 20 bp, Artificial
  CRISPR gRNA sequence
ttctttttcttttctttttt

SEQ ID NO: 217806 - DNA, 20 bp, Artificial
  CRISPR gRNA sequence
tctttttcttttcttttttt

SEQ ID NO: 217807 - DNA, 20 bp, Artificial
  CRISPR gRNA sequence
ctttttcttttctttttttt

SEQ ID NO: 217808 - DNA, 20 bp, Artificial
  CRISPR gRNA sequence
tttttcttttcttttttttt

SEQ ID NO: 217809 - DNA, 20 bp, Artificial
  CRISPR gRNA sequence
tttcttttcttttttttttt

SEQ ID NO: 217810 - DNA, 20 bp, Artificial
  CRISPR gRNA sequence
ttcttttctttttttttttt

SEQ ID NO: 217811 - DNA, 20 bp, Artificial
  CRISPR gRNA sequence
tcttttcttttttttttttt

SEQ ID NO: 217812 - DNA, 20 bp, Artificial
  CRISPR gRNA sequence
cttttctttttttttttttt

SEQ ID NO: 217813 - DNA, 20 bp, Artificial
  CRISPR gRNA sequence
ttttcttttttttttttttt

SEQ ID NO: 217814 - DNA, 20 bp, Artificial
  CRISPR gRNA sequence
ttctttttttttttttttgg

SEQ ID NO: 217815 - DNA, 20 bp, Artificial
  CRISPR gRNA sequence
tctttttttttttttttgga

SEQ ID NO: 217816 - DNA, 20 bp, Artificial
  CRISPR gRNA sequence
ctttttttttttttttggag

SEQ ID NO: 217817 - DNA, 20 bp, Artificial
  CRISPR gRNA sequence
tttttttttttttttggaga

SEQ ID NO: 217818 - DNA, 20 bp, Artificial
  CRISPR gRNA sequence
tttttttttttttggagaca

SEQ ID NO: 217819 - DNA, 20 bp, Artificial
  CRISPR gRNA sequence
ttttttttttttggagacag

SEQ ID NO: 217820 - DNA, 20 bp, Artificial
  CRISPR gRNA sequence
tttttttttttggagacaga

SEQ ID NO: 217821 - DNA, 20 bp, Artificial
  CRISPR gRNA sequence
ttttttttttggagacagag

SEQ ID NO: 217822 - DNA, 20 bp, Artificial
  CRISPR gRNA sequence
tttttttttggagacagagt

SEQ ID NO: 217823 - DNA, 20 bp, Artificial
  CRISPR gRNA sequence
ttttttttggagacagagtc

SEQ ID NO: 217824 - DNA, 20 bp, Artificial
  CRISPR gRNA sequence
tttttttggagacagagtct

SEQ ID NO: 217825 - DNA, 20 bp, Artificial
  CRISPR gRNA sequence
ttttttggagacagagtctc

SEQ ID NO: 217826 - DNA, 20 bp, Artificial
  CRISPR gRNA sequence
tttttggagacagagtctct

SEQ ID NO: 217827 - DNA, 20 bp, Artificial
  CRISPR gRNA sequence
ttttggagacagagtctctc

SEQ ID NO: 217828 - DNA, 20 bp, Artificial
  CRISPR gRNA sequence
tttggagacagagtctctca

SEQ ID NO: 217829 - DNA, 20 bp, Artificial
  CRISPR gRNA sequence
ttggagacagagtctctcac

SEQ ID NO: 217830 - DNA, 20 bp, Artificial
  CRISPR gRNA sequence
tggagacagagtctctcact

SEQ ID NO: 217831 - DNA, 20 bp, Artificial
  CRISPR gRNA sequence
ggagacagagtctctcactc

SEQ ID NO: 217832 - DNA, 20 bp, Artificial
  CRISPR gRNA sequence
gagacagagtctctcactcc

SEQ ID NO: 217833 - DNA, 20 bp, Artificial
  CRISPR gRNA sequence
tcactccgttacccaggctg

SEQ ID NO: 217834 - DNA, 20 bp, Artificial
  CRISPR gRNA sequence
actccgttacccaggctgga

SEQ ID NO: 217835 - DNA, 20 bp, Artificial
  CRISPR gRNA sequence
cgttacccaggctggagtgc

SEQ ID NO: 217836 - DNA, 20 bp, Artificial
  CRISPR gRNA sequence
cccaggctggagtgcagtgg

SEQ ID NO: 217837 - DNA, 20 bp, Artificial
  CRISPR gRNA sequence
gagtgcagtggcacaatctc

SEQ ID NO: 217838 - DNA, 20 bp, Artificial
  CRISPR gRNA sequence
ggctcactgcaaactctgcc

SEQ ID NO: 217839 - DNA, 20 bp, Artificial
  CRISPR gRNA sequence
actgcaaactctgcctccca

SEQ ID NO: 217840 - DNA, 20 bp, Artificial
  CRISPR gRNA sequence
caaactctgcctcccaggtt

SEQ ID NO: 217841 - DNA, 20 bp, Artificial
  CRISPR gRNA sequence
tgcctcccaggttcaatgat

SEQ ID NO: 217842 - DNA, 20 bp, Artificial
  CRISPR gRNA sequence
cctcccaggttcaatgattc

SEQ ID NO: 217843 - DNA, 20 bp, Artificial
  CRISPR gRNA sequence
ccaggttcaatgattctcct

SEQ ID NO: 217844 - DNA, 20 bp, Artificial
  CRISPR gRNA sequence
aatgattctcctgcctcagc

SEQ ID NO: 217845 - DNA, 20 bp, Artificial
  CRISPR gRNA sequence
tcctgcctcagcctcccgag

SEQ ID NO: 217846 - DNA, 20 bp, Artificial
  CRISPR gRNA sequence
ctgcctcagcctcccgagta

SEQ ID NO: 217847 - DNA, 20 bp, Artificial
  CRISPR gRNA sequence
cctcagcctcccgagtagct

SEQ ID NO: 217848 - DNA, 20 bp, Artificial
  CRISPR gRNA sequence
agcctcccgagtagctggga

SEQ ID NO: 217849 - DNA, 20 bp, Artificial
  CRISPR gRNA sequence
ccgagtagctgggactacag

SEQ ID NO: 217850 - DNA, 20 bp, Artificial
  CRISPR gRNA sequence
ggactacaggcatgcgccac

SEQ ID NO: 217851 - DNA, 20 bp, Artificial
  CRISPR gRNA sequence
caggcatgcgccaccaggcc

SEQ ID NO: 217852 - DNA, 20 bp, Artificial
  CRISPR gRNA sequence
gctaatttttgaattctttt

SEQ ID NO: 217853 - DNA, 20 bp, Artificial
  CRISPR gRNA sequence
atttttgaattctttttttt

SEQ ID NO: 217854 - DNA, 20 bp, Artificial
  CRISPR gRNA sequence
ttgaattctttttttttttt

SEQ ID NO: 217855 - DNA, 20 bp, Artificial
  CRISPR gRNA sequence
tgaattcttttttttttttt

SEQ ID NO: 217856 - DNA, 20 bp, Artificial
  CRISPR gRNA sequence
gaattctttttttttttttt

SEQ ID NO: 217857 - DNA, 20 bp, Artificial
  CRISPR gRNA sequence
aattcttttttttttttttt

SEQ ID NO: 217858 - DNA, 20 bp, Artificial
  CRISPR gRNA sequence
ttttttttttttttttagta

SEQ ID NO: 217859 - DNA, 20 bp, Artificial
  CRISPR gRNA sequence
ttttttttttttttagtaga

SEQ ID NO: 217860 - DNA, 20 bp, Artificial
  CRISPR gRNA sequence
tttttttttttttagtagag

SEQ ID NO: 217861 - DNA, 20 bp, Artificial
  CRISPR gRNA sequence
ttttttttttttagtagaga

SEQ ID NO: 217862 - DNA, 20 bp, Artificial
  CRISPR gRNA sequence
tttttttttttagtagagac

SEQ ID NO: 217863 - DNA, 20 bp, Artificial
  CRISPR gRNA sequence
ttttttttttagtagagacg

SEQ ID NO: 217864 - DNA, 20 bp, Artificial
  CRISPR gRNA sequence
tttttttttagtagagacgg

SEQ ID NO: 217865 - DNA, 20 bp, Artificial
  CRISPR gRNA sequence
ttttttttagtagagacggg

SEQ ID NO: 217866 - DNA, 20 bp, Artificial
  CRISPR gRNA sequence
tttttttagtagagacgggg

SEQ ID NO: 217867 - DNA, 20 bp, Artificial
  CRISPR gRNA sequence
ttttttagtagagacggggt

SEQ ID NO: 217868 - DNA, 20 bp, Artificial
  CRISPR gRNA sequence
tttttagtagagacggggtt

SEQ ID NO: 217869 - DNA, 20 bp, Artificial
  CRISPR gRNA sequence
ttttagtagagacggggttt

SEQ ID NO: 217870 - DNA, 20 bp, Artificial
  CRISPR gRNA sequence
tttagtagagacggggtttc

SEQ ID NO: 217871 - DNA, 20 bp, Artificial
  CRISPR gRNA sequence
ttagtagagacggggtttca

SEQ ID NO: 217872 - DNA, 20 bp, Artificial
  CRISPR gRNA sequence
tagtagagacggggtttcac

SEQ ID NO: 217873 - DNA, 20 bp, Artificial
  CRISPR gRNA sequence
agtagagacggggtttcaca

SEQ ID NO: 217874 - DNA, 20 bp, Artificial
  CRISPR gRNA sequence
gtagagacggggtttcacat

SEQ ID NO: 217875 - DNA, 20 bp, Artificial
  CRISPR gRNA sequence
cacattgttggccaggctga

SEQ ID NO: 217876 - DNA, 20 bp, Artificial
  CRISPR gRNA sequence
acattgttggccaggctgat

SEQ ID NO: 217877 - DNA, 20 bp, Artificial
  CRISPR gRNA sequence
ttggccaggctgatctcgag

SEQ ID NO: 217878 - DNA, 20 bp, Artificial
  CRISPR gRNA sequence
gccaggctgatctcgagctc

SEQ ID NO: 217879 - DNA, 20 bp, Artificial
  CRISPR gRNA sequence
atctcgagctccttacctca

SEQ ID NO: 217880 - DNA, 20 bp, Artificial
  CRISPR gRNA sequence
gagctccttacctcatgatc

SEQ ID NO: 217881 - DNA, 20 bp, Artificial
  CRISPR gRNA sequence
cttacctcatgatccacctg

SEQ ID NO: 217882 - DNA, 20 bp, Artificial
  CRISPR gRNA sequence
acctcatgatccacctgcca

SEQ ID NO: 217883 - DNA, 20 bp, Artificial
  CRISPR gRNA sequence
cctcatgatccacctgccac

SEQ ID NO: 217884 - DNA, 20 bp, Artificial
  CRISPR gRNA sequence
atgatccacctgccacggcc

SEQ ID NO: 217885 - DNA, 20 bp, Artificial
  CRISPR gRNA sequence
ccacggcctcccaaagtgct

SEQ ID NO: 217886 - DNA, 20 bp, Artificial
  CRISPR gRNA sequence
ccaaagtgctgggattacag

SEQ ID NO: 217887 - DNA, 20 bp, Artificial
  CRISPR gRNA sequence
ggattacaggtgtgagccac

SEQ ID NO: 217888 - DNA, 20 bp, Artificial
  CRISPR gRNA sequence
caggtgtgagccaccatgcc

SEQ ID NO: 217889 - DNA, 20 bp, Artificial
  CRISPR gRNA sequence
gtgacttacatccttcttaa

SEQ ID NO: 217890 - DNA, 20 bp, Artificial
  CRISPR gRNA sequence
acatccttcttaacaaaaat

SEQ ID NO: 217891 - DNA, 20 bp, Artificial
  CRISPR gRNA sequence
catccttcttaacaaaaata

SEQ ID NO: 217892 - DNA, 20 bp, Artificial
  CRISPR gRNA sequence
cttaacaaaaataagagttt

SEQ ID NO: 217893 - DNA, 20 bp, Artificial
  CRISPR gRNA sequence
ttaacaaaaataagagtttg

SEQ ID NO: 217894 - DNA, 20 bp, Artificial
  CRISPR gRNA sequence
aacaaaaataagagtttgaa

SEQ ID NO: 217895 - DNA, 20 bp, Artificial
  CRISPR gRNA sequence
acaaaaataagagtttgaat

SEQ ID NO: 217896 - DNA, 20 bp, Artificial
  CRISPR gRNA sequence
gaatctcatataaaatttat

SEQ ID NO: 217897 - DNA, 20 bp, Artificial
  CRISPR gRNA sequence
aatctcatataaaatttatc

SEQ ID NO: 217898 - DNA, 20 bp, Artificial
  CRISPR gRNA sequence
atataaaatttatcctctta

SEQ ID NO: 217899 - DNA, 20 bp, Artificial
  CRISPR gRNA sequence
atcctcttaaggcttagaag

SEQ ID NO: 217900 - DNA, 20 bp, Artificial
  CRISPR gRNA sequence
tcctcttaaggcttagaaga

SEQ ID NO: 217901 - DNA, 20 bp, Artificial
  CRISPR gRNA sequence
ttaaggcttagaagagctgt

SEQ ID NO: 217902 - DNA, 20 bp, Artificial
  CRISPR gRNA sequence
aaggcttagaagagctgtta

SEQ ID NO: 217903 - DNA, 20 bp, Artificial
  CRISPR gRNA sequence
aggcttagaagagctgttat

SEQ ID NO: 217904 - DNA, 20 bp, Artificial
  CRISPR gRNA sequence
agaagagctgttataggaga

SEQ ID NO: 217905 - DNA, 20 bp, Artificial
  CRISPR gRNA sequence
gaagagctgttataggagaa

SEQ ID NO: 217906 - DNA, 20 bp, Artificial
  CRISPR gRNA sequence
ttataggagaaaacagtgca

SEQ ID NO: 217907 - DNA, 20 bp, Artificial
  CRISPR gRNA sequence
taggagaaaacagtgcaaac

SEQ ID NO: 217908 - DNA, 20 bp, Artificial
  CRISPR gRNA sequence
ccatagacagggttccacca

SEQ ID NO: 217909 - DNA, 20 bp, Artificial
  CRISPR gRNA sequence
caccataaaatggtccgtct

SEQ ID NO: 217910 - DNA, 20 bp, Artificial
  CRISPR gRNA sequence
tctttgagtataagtacact

SEQ ID NO: 217911 - DNA, 20 bp, Artificial
  CRISPR gRNA sequence
tttgagtataagtacactat

SEQ ID NO: 217912 - DNA, 20 bp, Artificial
  CRISPR gRNA sequence
tgagtataagtacactatat

SEQ ID NO: 217913 - DNA, 20 bp, Artificial
  CRISPR gRNA sequence
gagtataagtacactatata

SEQ ID NO: 217914 - DNA, 20 bp, Artificial
  CRISPR gRNA sequence
agtataagtacactatatat

SEQ ID NO: 217915 - DNA, 20 bp, Artificial
  CRISPR gRNA sequence
tatattgaaagtagttttgg

SEQ ID NO: 217916 - DNA, 20 bp, Artificial
  CRISPR gRNA sequence
aaagtagttttggttcctgt

SEQ ID NO: 217917 - DNA, 20 bp, Artificial
  CRISPR gRNA sequence
tggttcctgttgattagttc

SEQ ID NO: 217918 - DNA, 20 bp, Artificial
  CRISPR gRNA sequence
ggttcctgttgattagttca

SEQ ID NO: 217919 - DNA, 20 bp, Artificial
  CRISPR gRNA sequence
gttcctgttgattagttcaa

SEQ ID NO: 217920 - DNA, 20 bp, Artificial
  CRISPR gRNA sequence
ctgttgattagttcaactac

SEQ ID NO: 217921 - DNA, 20 bp, Artificial
  CRISPR gRNA sequence
ttgattagttcaactactac

SEQ ID NO: 217922 - DNA, 20 bp, Artificial
  CRISPR gRNA sequence
attagttcaactactactta

SEQ ID NO: 217923 - DNA, 20 bp, Artificial
  CRISPR gRNA sequence
gttcaactactacttatttt

SEQ ID NO: 217924 - DNA, 20 bp, Artificial
  CRISPR gRNA sequence
aactactacttattttccag

SEQ ID NO: 217925 - DNA, 20 bp, Artificial
  CRISPR gRNA sequence
ctacttattttccaggccac

SEQ ID NO: 217926 - DNA, 20 bp, Artificial
  CRISPR gRNA sequence
cttattttccaggccacctt

SEQ ID NO: 217927 - DNA, 20 bp, Artificial
  CRISPR gRNA sequence
attttccaggccaccttaaa

SEQ ID NO: 217928 - DNA, 20 bp, Artificial
  CRISPR gRNA sequence
ttttccaggccaccttaaac

SEQ ID NO: 217929 - DNA, 20 bp, Artificial
  CRISPR gRNA sequence
tccaggccaccttaaacttt

SEQ ID NO: 217930 - DNA, 20 bp, Artificial
  CRISPR gRNA sequence
ccaggccaccttaaactttt

SEQ ID NO: 217931 - DNA, 20 bp, Artificial
  CRISPR gRNA sequence
caggccaccttaaacttttc

SEQ ID NO: 217932 - DNA, 20 bp, Artificial
  CRISPR gRNA sequence
aaacttttccttaaattaag

SEQ ID NO: 217933 - DNA, 20 bp, Artificial
  CRISPR gRNA sequence
aacttttccttaaattaagt

SEQ ID NO: 217934 - DNA, 20 bp, Artificial
  CRISPR gRNA sequence
ttccttaaattaagtagcca

SEQ ID NO: 217935 - DNA, 20 bp, Artificial
  CRISPR gRNA sequence
tccttaaattaagtagccat

SEQ ID NO: 217936 - DNA, 20 bp, Artificial
  CRISPR gRNA sequence
ccttaaattaagtagccatt

SEQ ID NO: 217937 - DNA, 20 bp, Artificial
  CRISPR gRNA sequence
cttaaattaagtagccattt

SEQ ID NO: 217938 - DNA, 20 bp, Artificial
  CRISPR gRNA sequence
aaattaagtagccatttcca

SEQ ID NO: 217939 - DNA, 20 bp, Artificial
  CRISPR gRNA sequence
aattaagtagccatttccaa

SEQ ID NO: 217940 - DNA, 20 bp, Artificial
  CRISPR gRNA sequence
agtagccatttccaacaaat

SEQ ID NO: 217941 - DNA, 20 bp, Artificial
  CRISPR gRNA sequence
ccaacaaatacacatgttga

SEQ ID NO: 217942 - DNA, 20 bp, Artificial
  CRISPR gRNA sequence
caacaaatacacatgttgag

SEQ ID NO: 217943 - DNA, 20 bp, Artificial
  CRISPR gRNA sequence
aggatcccaagtgtgaaaaa

SEQ ID NO: 217944 - DNA, 20 bp, Artificial
  CRISPR gRNA sequence
aaatccaaaacacttctggt

SEQ ID NO: 217945 - DNA, 20 bp, Artificial
  CRISPR gRNA sequence
ctggtcccaggcattctgga

SEQ ID NO: 217946 - DNA, 20 bp, Artificial
  CRISPR gRNA sequence
tggtcccaggcattctggat

SEQ ID NO: 217947 - DNA, 20 bp, Artificial
  CRISPR gRNA sequence
gtcccaggcattctggataa

SEQ ID NO: 217948 - DNA, 20 bp, Artificial
  CRISPR gRNA sequence
tggataacggacactccacc

SEQ ID NO: 217949 - DNA, 20 bp, Artificial
  CRISPR gRNA sequence
gataacggacactccacctg

SEQ ID NO: 217950 - DNA, 20 bp, Artificial
  CRISPR gRNA sequence
cacctgtctctgtggggtct

SEQ ID NO: 217951 - DNA, 20 bp, Artificial
  CRISPR gRNA sequence
tctctgtggggtctactaat

SEQ ID NO: 217952 - DNA, 20 bp, Artificial
  CRISPR gRNA sequence
tgtggggtctactaatgaaa

SEQ ID NO: 217953 - DNA, 20 bp, Artificial
  CRISPR gRNA sequence
tggggtctactaatgaaaga

SEQ ID NO: 217954 - DNA, 20 bp, Artificial
  CRISPR gRNA sequence
ctaatgaaagagtatctcca

SEQ ID NO: 217955 - DNA, 20 bp, Artificial
  CRISPR gRNA sequence
atgaaagagtatctccaggt

SEQ ID NO: 217956 - DNA, 20 bp, Artificial
  CRISPR gRNA sequence
caggttttcttcagtgaatc

SEQ ID NO: 217957 - DNA, 20 bp, Artificial
  CRISPR gRNA sequence
tcttcagtgaatcttcagaa

SEQ ID NO: 217958 - DNA, 20 bp, Artificial
  CRISPR gRNA sequence
cttcagtgaatcttcagaaa

SEQ ID NO: 217959 - DNA, 20 bp, Artificial
  CRISPR gRNA sequence
ttcagtgaatcttcagaaag

SEQ ID NO: 217960 - DNA, 20 bp, Artificial
  CRISPR gRNA sequence
cagtgaatcttcagaaagag

SEQ ID NO: 217961 - DNA, 20 bp, Artificial
  CRISPR gRNA sequence
agtgaatcttcagaaagagt

SEQ ID NO: 217962 - DNA, 20 bp, Artificial
  CRISPR gRNA sequence
cagaaagagtttcttttggc

SEQ ID NO: 217963 - DNA, 20 bp, Artificial
  CRISPR gRNA sequence
agaaagagtttcttttggct

SEQ ID NO: 217964 - DNA, 20 bp, Artificial
  CRISPR gRNA sequence
cttttggctcattttctttg

SEQ ID NO: 217965 - DNA, 20 bp, Artificial
  CRISPR gRNA sequence
ttttggctcattttctttgc

SEQ ID NO: 217966 - DNA, 20 bp, Artificial
  CRISPR gRNA sequence
ttggctcattttctttgctc

SEQ ID NO: 217967 - DNA, 20 bp, Artificial
  CRISPR gRNA sequence
tggctcattttctttgctca

SEQ ID NO: 217968 - DNA, 20 bp, Artificial
  CRISPR gRNA sequence
ggctcattttctttgctcac

SEQ ID NO: 217969 - DNA, 20 bp, Artificial
  CRISPR gRNA sequence
gctcattttctttgctcaca

SEQ ID NO: 217970 - DNA, 20 bp, Artificial
  CRISPR gRNA sequence
attttctttgctcacatggt

SEQ ID NO: 217971 - DNA, 20 bp, Artificial
  CRISPR gRNA sequence
tctttgctcacatggtcaca

SEQ ID NO: 217972 - DNA, 20 bp, Artificial
  CRISPR gRNA sequence
ctttgctcacatggtcacat

SEQ ID NO: 217973 - DNA, 20 bp, Artificial
  CRISPR gRNA sequence
tttgctcacatggtcacatt

SEQ ID NO: 217974 - DNA, 20 bp, Artificial
  CRISPR gRNA sequence
tgctcacatggtcacatttc

SEQ ID NO: 217975 - DNA, 20 bp, Artificial
  CRISPR gRNA sequence
gctcacatggtcacatttca

SEQ ID NO: 217976 - DNA, 20 bp, Artificial
  CRISPR gRNA sequence
ctcacatggtcacatttcag

SEQ ID NO: 217977 - DNA, 20 bp, Artificial
  CRISPR gRNA sequence
acatggtcacatttcagcag

SEQ ID NO: 217978 - DNA, 20 bp, Artificial
  CRISPR gRNA sequence
cagcaggtaccacagctaat

SEQ ID NO: 217979 - DNA, 20 bp, Artificial
  CRISPR gRNA sequence
agcaggtaccacagctaatg

SEQ ID NO: 217980 - DNA, 20 bp, Artificial
  CRISPR gRNA sequence
atgtggggtaggtatcttgt

SEQ ID NO: 217981 - DNA, 20 bp, Artificial
  CRISPR gRNA sequence
gttgctagcccagtcgtcaa

SEQ ID NO: 217982 - DNA, 20 bp, Artificial
  CRISPR gRNA sequence
ttgctagcccagtcgtcaaa

SEQ ID NO: 217983 - DNA, 20 bp, Artificial
  CRISPR gRNA sequence
ctagcccagtcgtcaaattt

SEQ ID NO: 217984 - DNA, 20 bp, Artificial
  CRISPR gRNA sequence
gcccagtcgtcaaatttctc

SEQ ID NO: 217985 - DNA, 20 bp, Artificial
  CRISPR gRNA sequence
ctcagtatagtgaaagggca

SEQ ID NO: 217986 - DNA, 20 bp, Artificial
  CRISPR gRNA sequence
tcagtatagtgaaagggcaa

SEQ ID NO: 217987 - DNA, 20 bp, Artificial
  CRISPR gRNA sequence
agtatagtgaaagggcaagg

SEQ ID NO: 217988 - DNA, 20 bp, Artificial
  CRISPR gRNA sequence
gatataatagatgccataga

SEQ ID NO: 217989 - DNA, 20 bp, Artificial
  CRISPR gRNA sequence
atataatagatgccatagaa

SEQ ID NO: 217990 - DNA, 20 bp, Artificial
  CRISPR gRNA sequence
aaggatctcttattgatctt

SEQ ID NO: 217991 - DNA, 20 bp, Artificial
  CRISPR gRNA sequence
ttattgatcttttcttgtcc

SEQ ID NO: 217992 - DNA, 20 bp, Artificial
  CRISPR gRNA sequence
attgatcttttcttgtcctt

SEQ ID NO: 217993 - DNA, 20 bp, Artificial
  CRISPR gRNA sequence
ttgatcttttcttgtccttc

SEQ ID NO: 217994 - DNA, 20 bp, Artificial
  CRISPR gRNA sequence
atcttttcttgtccttcagt

SEQ ID NO: 217995 - DNA, 20 bp, Artificial
  CRISPR gRNA sequence
ttcttgtccttcagtaagtg

SEQ ID NO: 217996 - DNA, 20 bp, Artificial
  CRISPR gRNA sequence
tcttgtccttcagtaagtgg

SEQ ID NO: 217997 - DNA, 20 bp, Artificial
  CRISPR gRNA sequence
cttgtccttcagtaagtgga

SEQ ID NO: 217998 - DNA, 20 bp, Artificial
  CRISPR gRNA sequence
ttgtccttcagtaagtggat

SEQ ID NO: 217999 - DNA, 20 bp, Artificial
  CRISPR gRNA sequence
gtccttcagtaagtggattt

SEQ ID NO: 218000 - DNA, 20 bp, Artificial
  CRISPR gRNA sequence
tccttcagtaagtggattta

SEQ ID NO: 218001 - DNA, 20 bp, Artificial
  CRISPR gRNA sequence
cagtaagtggatttatcctt

SEQ ID NO: 218002 - DNA, 20 bp, Artificial
  CRISPR gRNA sequence
agtaagtggatttatcctta

SEQ ID NO: 218003 - DNA, 20 bp, Artificial
  CRISPR gRNA sequence
atccttatttattgaatgta

SEQ ID NO: 218004 - DNA, 20 bp, Artificial
  CRISPR gRNA sequence
tccttatttattgaatgtat

SEQ ID NO: 218005 - DNA, 20 bp, Artificial
  CRISPR gRNA sequence
atttattgaatgtatcaaaa

SEQ ID NO: 218006 - DNA, 20 bp, Artificial
  CRISPR gRNA sequence
tttattgaatgtatcaaaac

SEQ ID NO: 218007 - DNA, 20 bp, Artificial
  CRISPR gRNA sequence
attgaatgtatcaaaacatt

SEQ ID NO: 218008 - DNA, 20 bp, Artificial
  CRISPR gRNA sequence
ttgaatgtatcaaaacatta

SEQ ID NO: 218009 - DNA, 20 bp, Artificial
  CRISPR gRNA sequence
aatgtatcaaaacattaaat

SEQ ID NO: 218010 - DNA, 20 bp, Artificial
  CRISPR gRNA sequence
aatgcagcaaaaaaaataaa

SEQ ID NO: 218011 - DNA, 20 bp, Artificial
  CRISPR gRNA sequence
aagtaattctccacttagca

SEQ ID NO: 218012 - DNA, 20 bp, Artificial
  CRISPR gRNA sequence
tccacttagcattaagataa

SEQ ID NO: 218013 - DNA, 20 bp, Artificial
  CRISPR gRNA sequence
cacttagcattaagataaaa

SEQ ID NO: 218014 - DNA, 20 bp, Artificial
  CRISPR gRNA sequence
agcattaagataaaaataac

SEQ ID NO: 218015 - DNA, 20 bp, Artificial
  CRISPR gRNA sequence
gcattaagataaaaataact

SEQ ID NO: 218016 - DNA, 20 bp, Artificial
  CRISPR gRNA sequence
agataaaaataactcaatgt

SEQ ID NO: 218017 - DNA, 20 bp, Artificial
  CRISPR gRNA sequence
aatgtgttgttaacagcagg

SEQ ID NO: 218018 - DNA, 20 bp, Artificial
  CRISPR gRNA sequence
ttaacagcaggctcttatca

SEQ ID NO: 218019 - DNA, 20 bp, Artificial
  CRISPR gRNA sequence
acagcaggctcttatcaaat

SEQ ID NO: 218020 - DNA, 20 bp, Artificial
  CRISPR gRNA sequence
ttatcaaattttctagtatg

SEQ ID NO: 218021 - DNA, 20 bp, Artificial
  CRISPR gRNA sequence
atcaaattttctagtatgac

SEQ ID NO: 218022 - DNA, 20 bp, Artificial
  CRISPR gRNA sequence
tcaaattttctagtatgact

SEQ ID NO: 218023 - DNA, 20 bp, Artificial
  CRISPR gRNA sequence
tctagtatgactttcagacg

SEQ ID NO: 218024 - DNA, 20 bp, Artificial
  CRISPR gRNA sequence
ctagtatgactttcagacgg

SEQ ID NO: 218025 - DNA, 20 bp, Artificial
  CRISPR gRNA sequence
tagtatgactttcagacggc

SEQ ID NO: 218026 - DNA, 20 bp, Artificial
  CRISPR gRNA sequence
gtatgactttcagacggctt

SEQ ID NO: 218027 - DNA, 20 bp, Artificial
  CRISPR gRNA sequence
tcagacggcttggcaaggca

SEQ ID NO: 218028 - DNA, 20 bp, Artificial
  CRISPR gRNA sequence
cagacggcttggcaaggcaa

SEQ ID NO: 218029 - DNA, 20 bp, Artificial
  CRISPR gRNA sequence
agacggcttggcaaggcaat

SEQ ID NO: 218030 - DNA, 20 bp, Artificial
  CRISPR gRNA sequence
ggcaaggcaatctatgtaat

SEQ ID NO: 218031 - DNA, 20 bp, Artificial
  CRISPR gRNA sequence
gcaaggcaatctatgtaatt

SEQ ID NO: 218032 - DNA, 20 bp, Artificial
  CRISPR gRNA sequence
tgtaatttttaaaatctgca

SEQ ID NO: 218033 - DNA, 20 bp, Artificial
  CRISPR gRNA sequence
ttaaaatctgcatgctctta

SEQ ID NO: 218034 - DNA, 20 bp, Artificial
  CRISPR gRNA sequence
taaaatctgcatgctcttaa

SEQ ID NO: 218035 - DNA, 20 bp, Artificial
  CRISPR gRNA sequence
aaaatctgcatgctcttaag

SEQ ID NO: 218036 - DNA, 20 bp, Artificial
  CRISPR gRNA sequence
aaatctgcatgctcttaagg

SEQ ID NO: 218037 - DNA, 20 bp, Artificial
  CRISPR gRNA sequence
catgctcttaaggattaccc

SEQ ID NO: 218038 - DNA, 20 bp, Artificial
  CRISPR gRNA sequence
ttaaggattaccctcagcta

SEQ ID NO: 218039 - DNA, 20 bp, Artificial
  CRISPR gRNA sequence
aaggattaccctcagctaca

SEQ ID NO: 218040 - DNA, 20 bp, Artificial
  CRISPR gRNA sequence
aggattaccctcagctacaa

SEQ ID NO: 218041 - DNA, 20 bp, Artificial
  CRISPR gRNA sequence
ccctcagctacaactactga

SEQ ID NO: 218042 - DNA, 20 bp, Artificial
  CRISPR gRNA sequence
agctacaactactgaaatca

SEQ ID NO: 218043 - DNA, 20 bp, Artificial
  CRISPR gRNA sequence
caactactgaaatcaataca

SEQ ID NO: 218044 - DNA, 20 bp, Artificial
  CRISPR gRNA sequence
ctgaaatcaatacacaaaat

SEQ ID NO: 218045 - DNA, 20 bp, Artificial
  CRISPR gRNA sequence
aaatcaatacacaaaataaa

SEQ ID NO: 218046 - DNA, 20 bp, Artificial
  CRISPR gRNA sequence
catgcttaacaaaaaatgta

SEQ ID NO: 218047 - DNA, 20 bp, Artificial
  CRISPR gRNA sequence
aacaaaaaatgtataacctt

SEQ ID NO: 218048 - DNA, 20 bp, Artificial
  CRISPR gRNA sequence
acaaaaaatgtataacctta

SEQ ID NO: 218049 - DNA, 20 bp, Artificial
  CRISPR gRNA sequence
agtgctcagcctgacacagg

SEQ ID NO: 218050 - DNA, 20 bp, Artificial
  CRISPR gRNA sequence
gtgctcagcctgacacagga

SEQ ID NO: 218051 - DNA, 20 bp, Artificial
  CRISPR gRNA sequence
agcctgacacaggaatacca

SEQ ID NO: 218052 - DNA, 20 bp, Artificial
  CRISPR gRNA sequence
acacaggaataccaagtatc

SEQ ID NO: 218053 - DNA, 20 bp, Artificial
  CRISPR gRNA sequence
ttgtgaacaaattaggtatt

SEQ ID NO: 218054 - DNA, 20 bp, Artificial
  CRISPR gRNA sequence
tgtgaacaaattaggtattc

SEQ ID NO: 218055 - DNA, 20 bp, Artificial
  CRISPR gRNA sequence
gtgaacaaattaggtattct

SEQ ID NO: 218056 - DNA, 20 bp, Artificial
  CRISPR gRNA sequence
tgaacaaattaggtattcta

SEQ ID NO: 218057 - DNA, 20 bp, Artificial
  CRISPR gRNA sequence
ggtattctaaaattttcttt

SEQ ID NO: 218058 - DNA, 20 bp, Artificial
  CRISPR gRNA sequence
taaaattttcttttatatgt

SEQ ID NO: 218059 - DNA, 20 bp, Artificial
  CRISPR gRNA sequence
aaattttcttttatatgttc

SEQ ID NO: 218060 - DNA, 20 bp, Artificial
  CRISPR gRNA sequence
tcttttatatgttctataaa

SEQ ID NO: 218061 - DNA, 20 bp, Artificial
  CRISPR gRNA sequence
cttttatatgttctataaaa

SEQ ID NO: 218062 - DNA, 20 bp, Artificial
  CRISPR gRNA sequence
ttttatatgttctataaaat

SEQ ID NO: 218063 - DNA, 20 bp, Artificial
  CRISPR gRNA sequence
ttatatgttctataaaataa

SEQ ID NO: 218064 - DNA, 20 bp, Artificial
  CRISPR gRNA sequence
tatatgttctataaaataat

SEQ ID NO: 218065 - DNA, 20 bp, Artificial
  CRISPR gRNA sequence
atatgttctataaaataatt

SEQ ID NO: 218066 - DNA, 20 bp, Artificial
  CRISPR gRNA sequence
tatgttctataaaataatta

SEQ ID NO: 218067 - DNA, 20 bp, Artificial
  CRISPR gRNA sequence
tataaaataattagtaacca

SEQ ID NO: 218068 - DNA, 20 bp, Artificial
  CRISPR gRNA sequence
taaaataattagtaaccaaa

SEQ ID NO: 218069 - DNA, 20 bp, Artificial
  CRISPR gRNA sequence
gtaaccaaaagcaggctact

SEQ ID NO: 218070 - DNA, 20 bp, Artificial
  CRISPR gRNA sequence
cttctaagaaatctgttggg

SEQ ID NO: 218071 - DNA, 20 bp, Artificial
  CRISPR gRNA sequence
ctaagaaatctgttgggttg

SEQ ID NO: 218072 - DNA, 20 bp, Artificial
  CRISPR gRNA sequence
taagaaatctgttgggttgg

SEQ ID NO: 218073 - DNA, 20 bp, Artificial
  CRISPR gRNA sequence
agaaatctgttgggttggtt

SEQ ID NO: 218074 - DNA, 20 bp, Artificial
  CRISPR gRNA sequence
ttgggttggttcattcatct

SEQ ID NO: 218075 - DNA, 20 bp, Artificial
  CRISPR gRNA sequence
ggttggttcattcatctgtt

SEQ ID NO: 218076 - DNA, 20 bp, Artificial
  CRISPR gRNA sequence
gttcattcatctgttctaca

SEQ ID NO: 218077 - DNA, 20 bp, Artificial
  CRISPR gRNA sequence
attcatctgttctacaaata

SEQ ID NO: 218078 - DNA, 20 bp, Artificial
  CRISPR gRNA sequence
atctgttctacaaatattta

SEQ ID NO: 218079 - DNA, 20 bp, Artificial
  CRISPR gRNA sequence
ttctacaaatatttactgtg

SEQ ID NO: 218080 - DNA, 20 bp, Artificial
  CRISPR gRNA sequence
tacaaatatttactgtgtac

SEQ ID NO: 218081 - DNA, 20 bp, Artificial
  CRISPR gRNA sequence
caaatatttactgtgtacct

SEQ ID NO: 218082 - DNA, 20 bp, Artificial
  CRISPR gRNA sequence
actgtgtacctacaatgtac

SEQ ID NO: 218083 - DNA, 20 bp, Artificial
  CRISPR gRNA sequence
ctgtgtacctacaatgtacc

SEQ ID NO: 218084 - DNA, 20 bp, Artificial
  CRISPR gRNA sequence
tgtacctacaatgtaccagc

SEQ ID NO: 218085 - DNA, 20 bp, Artificial
  CRISPR gRNA sequence
caatgtaccagccccttttg

SEQ ID NO: 218086 - DNA, 20 bp, Artificial
  CRISPR gRNA sequence
ttgctagtctaaatcaagga

SEQ ID NO: 218087 - DNA, 20 bp, Artificial
  CRISPR gRNA sequence
tgctagtctaaatcaaggaa

SEQ ID NO: 218088 - DNA, 20 bp, Artificial
  CRISPR gRNA sequence
gctagtctaaatcaaggaac

SEQ ID NO: 218089 - DNA, 20 bp, Artificial
  CRISPR gRNA sequence
ctagtctaaatcaaggaaca

SEQ ID NO: 218090 - DNA, 20 bp, Artificial
  CRISPR gRNA sequence
gtctaaatcaaggaacaagt

SEQ ID NO: 218091 - DNA, 20 bp, Artificial
  CRISPR gRNA sequence
aatcaaggaacaagtagatt

SEQ ID NO: 218092 - DNA, 20 bp, Artificial
  CRISPR gRNA sequence
ctttatttgacaataattga

SEQ ID NO: 218093 - DNA, 20 bp, Artificial
  CRISPR gRNA sequence
tatttgacaataattgattg

SEQ ID NO: 218094 - DNA, 20 bp, Artificial
  CRISPR gRNA sequence
atttgacaataattgattga

SEQ ID NO: 218095 - DNA, 20 bp, Artificial
  CRISPR gRNA sequence
tttgacaataattgattgag

SEQ ID NO: 218096 - DNA, 20 bp, Artificial
  CRISPR gRNA sequence
gacaataattgattgagcac

SEQ ID NO: 218097 - DNA, 20 bp, Artificial
  CRISPR gRNA sequence
acaataattgattgagcact

SEQ ID NO: 218098 - DNA, 20 bp, Artificial
  CRISPR gRNA sequence
attgagcactatccatctat

SEQ ID NO: 218099 - DNA, 20 bp, Artificial
  CRISPR gRNA sequence
agcactatccatctatatga

SEQ ID NO: 218100 - DNA, 20 bp, Artificial
  CRISPR gRNA sequence
tccatctatatgactatcac

SEQ ID NO: 218101 - DNA, 20 bp, Artificial
  CRISPR gRNA sequence
tatgactatcactattctaa

SEQ ID NO: 218102 - DNA, 20 bp, Artificial
  CRISPR gRNA sequence
tcactattctaaatgctgac

SEQ ID NO: 218103 - DNA, 20 bp, Artificial
  CRISPR gRNA sequence
ttctaaatgctgacagtgaa

SEQ ID NO: 218104 - DNA, 20 bp, Artificial
  CRISPR gRNA sequence
taaatgctgacagtgaacac

SEQ ID NO: 218105 - DNA, 20 bp, Artificial
  CRISPR gRNA sequence
aatgctgacagtgaacacga

SEQ ID NO: 218106 - DNA, 20 bp, Artificial
  CRISPR gRNA sequence
acagtgaacacgaaaagcaa

SEQ ID NO: 218107 - DNA, 20 bp, Artificial
  CRISPR gRNA sequence
cctcaaggcccttacattct

SEQ ID NO: 218108 - DNA, 20 bp, Artificial
  CRISPR gRNA sequence
aaggcccttacattctaatg

SEQ ID NO: 218109 - DNA, 20 bp, Artificial
  CRISPR gRNA sequence
acattctaatgggtgagtgt

SEQ ID NO: 218110 - DNA, 20 bp, Artificial
  CRISPR gRNA sequence
cattctaatgggtgagtgtg

SEQ ID NO: 218111 - DNA, 20 bp, Artificial
  CRISPR gRNA sequence
taatgggtgagtgtgtgtgt

SEQ ID NO: 218112 - DNA, 20 bp, Artificial
  CRISPR gRNA sequence
atgggtgagtgtgtgtgttt

SEQ ID NO: 218113 - DNA, 20 bp, Artificial
  CRISPR gRNA sequence
gaggggaggggggtgtgagt

SEQ ID NO: 218114 - DNA, 20 bp, Artificial
  CRISPR gRNA sequence
aggggaggggggtgtgagtg

SEQ ID NO: 218115 - DNA, 20 bp, Artificial
  CRISPR gRNA sequence
ctcccaaaacttctttccca

SEQ ID NO: 218116 - DNA, 20 bp, Artificial
  CRISPR gRNA sequence
ccaaaacttctttcccagtt

SEQ ID NO: 218117 - DNA, 20 bp, Artificial
  CRISPR gRNA sequence
ctttcccagttaaagagatg

SEQ ID NO: 218118 - DNA, 20 bp, Artificial
  CRISPR gRNA sequence
tttcccagttaaagagatgg

SEQ ID NO: 218119 - DNA, 20 bp, Artificial
  CRISPR gRNA sequence
tcccagttaaagagatggtg

SEQ ID NO: 218120 - DNA, 20 bp, Artificial
  CRISPR gRNA sequence
cccagttaaagagatggtga

SEQ ID NO: 218121 - DNA, 20 bp, Artificial
  CRISPR gRNA sequence
ccagttaaagagatggtgaa

SEQ ID NO: 218122 - DNA, 20 bp, Artificial
  CRISPR gRNA sequence
aagagatggtgaaggcctac

SEQ ID NO: 218123 - DNA, 20 bp, Artificial
  CRISPR gRNA sequence
ctctactctaagaaaattcc

SEQ ID NO: 218124 - DNA, 20 bp, Artificial
  CRISPR gRNA sequence
tactctaagaaaattccttt

SEQ ID NO: 218125 - DNA, 20 bp, Artificial
  CRISPR gRNA sequence
ctctaagaaaattcctttat

SEQ ID NO: 218126 - DNA, 20 bp, Artificial
  CRISPR gRNA sequence
taagaaaattcctttatgca

SEQ ID NO: 218127 - DNA, 20 bp, Artificial
  CRISPR gRNA sequence
agaaaattcctttatgcatt

SEQ ID NO: 218128 - DNA, 20 bp, Artificial
  CRISPR gRNA sequence
ctttatgcatttaatctttc

SEQ ID NO: 218129 - DNA, 20 bp, Artificial
  CRISPR gRNA sequence
tatgcatttaatctttcaaa

SEQ ID NO: 218130 - DNA, 20 bp, Artificial
  CRISPR gRNA sequence
atgcatttaatctttcaaat

SEQ ID NO: 218131 - DNA, 20 bp, Artificial
  CRISPR gRNA sequence
tgcatttaatctttcaaatt

SEQ ID NO: 218132 - DNA, 20 bp, Artificial
  CRISPR gRNA sequence
aatctttcaaattcatgcag

SEQ ID NO: 218133 - DNA, 20 bp, Artificial
  CRISPR gRNA sequence
atctttcaaattcatgcaga

SEQ ID NO: 218134 - DNA, 20 bp, Artificial
  CRISPR gRNA sequence
tcaaattcatgcagatgaag

SEQ ID NO: 218135 - DNA, 20 bp, Artificial
  CRISPR gRNA sequence
caaattcatgcagatgaagc

SEQ ID NO: 218136 - DNA, 20 bp, Artificial
  CRISPR gRNA sequence
aaattcatgcagatgaagca

SEQ ID NO: 218137 - DNA, 20 bp, Artificial
  CRISPR gRNA sequence
atgcagatgaagcaatgaca

SEQ ID NO: 218138 - DNA, 20 bp, Artificial
  CRISPR gRNA sequence
tagccacctgaaaaaacagc

SEQ ID NO: 218139 - DNA, 20 bp, Artificial
  CRISPR gRNA sequence
gccacctgaaaaaacagcta

SEQ ID NO: 218140 - DNA, 20 bp, Artificial
  CRISPR gRNA sequence
aaaaaacagctaatgttatg

SEQ ID NO: 218141 - DNA, 20 bp, Artificial
  CRISPR gRNA sequence
atgttatgaatggacaagaa

SEQ ID NO: 218142 - DNA, 20 bp, Artificial
  CRISPR gRNA sequence
tgaatggacaagaaggtttt

SEQ ID NO: 218143 - DNA, 20 bp, Artificial
  CRISPR gRNA sequence
tctgattttgtgaccaatag

SEQ ID NO: 218144 - DNA, 20 bp, Artificial
  CRISPR gRNA sequence
ctgattttgtgaccaataga

SEQ ID NO: 218145 - DNA, 20 bp, Artificial
  CRISPR gRNA sequence
tgattttgtgaccaatagac

SEQ ID NO: 218146 - DNA, 20 bp, Artificial
  CRISPR gRNA sequence
attttgtgaccaatagacag

SEQ ID NO: 218147 - DNA, 20 bp, Artificial
  CRISPR gRNA sequence
tgtgaccaatagacagcaca

SEQ ID NO: 218148 - DNA, 20 bp, Artificial
  CRISPR gRNA sequence
gtgaccaatagacagcacat

SEQ ID NO: 218149 - DNA, 20 bp, Artificial
  CRISPR gRNA sequence
tgaccaatagacagcacata

SEQ ID NO: 218150 - DNA, 20 bp, Artificial
  CRISPR gRNA sequence
tgactgatgaaatctaatga

SEQ ID NO: 218151 - DNA, 20 bp, Artificial
  CRISPR gRNA sequence
atgaaatctaatgaaattac

SEQ ID NO: 218152 - DNA, 20 bp, Artificial
  CRISPR gRNA sequence
atgaaattaccaagtcaact

SEQ ID NO: 218153 - DNA, 20 bp, Artificial
  CRISPR gRNA sequence
ccaagtcaacttggggataa

SEQ ID NO: 218154 - DNA, 20 bp, Artificial
  CRISPR gRNA sequence
ggggataaaatcaagtctat

SEQ ID NO: 218155 - DNA, 20 bp, Artificial
  CRISPR gRNA sequence
gggataaaatcaagtctatc

SEQ ID NO: 218156 - DNA, 20 bp, Artificial
  CRISPR gRNA sequence
tcatgctaagtttccatgac

SEQ ID NO: 218157 - DNA, 20 bp, Artificial
  CRISPR gRNA sequence
agtttccatgacaccccaaa

SEQ ID NO: 218158 - DNA, 20 bp, Artificial
  CRISPR gRNA sequence
ccatgacaccccaaagactg

SEQ ID NO: 218159 - DNA, 20 bp, Artificial
  CRISPR gRNA sequence
catgacaccccaaagactgg

SEQ ID NO: 218160 - DNA, 20 bp, Artificial
  CRISPR gRNA sequence
gatttgacacacccatatag

SEQ ID NO: 218161 - DNA, 20 bp, Artificial
  CRISPR gRNA sequence
gacacacccatataggctca

SEQ ID NO: 218162 - DNA, 20 bp, Artificial
  CRISPR gRNA sequence
acacacccatataggctcac

SEQ ID NO: 218163 - DNA, 20 bp, Artificial
  CRISPR gRNA sequence
acacagactgcagtccatcc

SEQ ID NO: 218164 - DNA, 20 bp, Artificial
  CRISPR gRNA sequence
cagtccatccaacaaaaccc

SEQ ID NO: 218165 - DNA, 20 bp, Artificial
  CRISPR gRNA sequence
aatgcctgcccaaagacatg

SEQ ID NO: 218166 - DNA, 20 bp, Artificial
  CRISPR gRNA sequence
atgcctgcccaaagacatga

SEQ ID NO: 218167 - DNA, 20 bp, Artificial
  CRISPR gRNA sequence
cccaaagacatgacatttgg

SEQ ID NO: 218168 - DNA, 20 bp, Artificial
  CRISPR gRNA sequence
ggagtgattggtaagtaagc

SEQ ID NO: 218169 - DNA, 20 bp, Artificial
  CRISPR gRNA sequence
gagtgattggtaagtaagca

SEQ ID NO: 218170 - DNA, 20 bp, Artificial
  CRISPR gRNA sequence
gtaagtaagcagagagacag

SEQ ID NO: 218171 - DNA, 20 bp, Artificial
  CRISPR gRNA sequence
accaggctgatgcgtatcag

SEQ ID NO: 218172 - DNA, 20 bp, Artificial
  CRISPR gRNA sequence
ccaggctgatgcgtatcaga

SEQ ID NO: 218173 - DNA, 20 bp, Artificial
  CRISPR gRNA sequence
atgcgtatcagactaagaat

SEQ ID NO: 218174 - DNA, 20 bp, Artificial
  CRISPR gRNA sequence
agaataaatcataaagaaag

SEQ ID NO: 218175 - DNA, 20 bp, Artificial
  CRISPR gRNA sequence
gatttcattattacagtgct

SEQ ID NO: 218176 - DNA, 20 bp, Artificial
  CRISPR gRNA sequence
atttcattattacagtgctg

SEQ ID NO: 218177 - DNA, 20 bp, Artificial
  CRISPR gRNA sequence
cattattacagtgctgtttt

SEQ ID NO: 218178 - DNA, 20 bp, Artificial
  CRISPR gRNA sequence
attattacagtgctgttttc

SEQ ID NO: 218179 - DNA, 20 bp, Artificial
  CRISPR gRNA sequence
ttacagtgctgttttctgat

SEQ ID NO: 218180 - DNA, 20 bp, Artificial
  CRISPR gRNA sequence
cagtgctgttttctgataac

SEQ ID NO: 218181 - DNA, 20 bp, Artificial
  CRISPR gRNA sequence
ttttctgataactctaggaa

SEQ ID NO: 218182 - DNA, 20 bp, Artificial
  CRISPR gRNA sequence
tctgataactctaggaaagt

SEQ ID NO: 218183 - DNA, 20 bp, Artificial
  CRISPR gRNA sequence
ctgataactctaggaaagta

SEQ ID NO: 218184 - DNA, 20 bp, Artificial
  CRISPR gRNA sequence
tgataactctaggaaagtaa

SEQ ID NO: 218185 - DNA, 20 bp, Artificial
  CRISPR gRNA sequence
ataactctaggaaagtaatt

SEQ ID NO: 218186 - DNA, 20 bp, Artificial
  CRISPR gRNA sequence
taggaaagtaattttagaat

SEQ ID NO: 218187 - DNA, 20 bp, Artificial
  CRISPR gRNA sequence
ggaaagtaattttagaatat

SEQ ID NO: 218188 - DNA, 20 bp, Artificial
  CRISPR gRNA sequence
tagaatatatttggtgtctg

SEQ ID NO: 218189 - DNA, 20 bp, Artificial
  CRISPR gRNA sequence
agaatatatttggtgtctgt

SEQ ID NO: 218190 - DNA, 20 bp, Artificial
  CRISPR gRNA sequence
gaatatatttggtgtctgtt

SEQ ID NO: 218191 - DNA, 20 bp, Artificial
  CRISPR gRNA sequence
ggtgtctgttgagctgtaaa

SEQ ID NO: 218192 - DNA, 20 bp, Artificial
  CRISPR gRNA sequence
gtgtctgttgagctgtaaat

SEQ ID NO: 218193 - DNA, 20 bp, Artificial
  CRISPR gRNA sequence
ttgagctgtaaatgaatatt

SEQ ID NO: 218194 - DNA, 20 bp, Artificial
  CRISPR gRNA sequence
agctgtaaatgaatattgtt

SEQ ID NO: 218195 - DNA, 20 bp, Artificial
  CRISPR gRNA sequence
taaatgaatattgttttcag

SEQ ID NO: 218196 - DNA, 20 bp, Artificial
  CRISPR gRNA sequence
ttttcagtgcagaataaagc

SEQ ID NO: 218197 - DNA, 20 bp, Artificial
  CRISPR gRNA sequence
tcagtgcagaataaagcaca

SEQ ID NO: 218198 - DNA, 20 bp, Artificial
  CRISPR gRNA sequence
cagtgcagaataaagcacat

SEQ ID NO: 218199 - DNA, 20 bp, Artificial
  CRISPR gRNA sequence
agtgcagaataaagcacatc

SEQ ID NO: 218200 - DNA, 20 bp, Artificial
  CRISPR gRNA sequence
tacacataaaattacaattt

SEQ ID NO: 218201 - DNA, 20 bp, Artificial
  CRISPR gRNA sequence
acacataaaattacaatttc

SEQ ID NO: 218202 - DNA, 20 bp, Artificial
  CRISPR gRNA sequence
cacataaaattacaatttca

SEQ ID NO: 218203 - DNA, 20 bp, Artificial
  CRISPR gRNA sequence
caatttcattttttaaattg

SEQ ID NO: 218204 - DNA, 20 bp, Artificial
  CRISPR gRNA sequence
cattttttaaattgtttaaa

SEQ ID NO: 218205 - DNA, 20 bp, Artificial
  CRISPR gRNA sequence
attttttaaattgtttaaat

SEQ ID NO: 218206 - DNA, 20 bp, Artificial
  CRISPR gRNA sequence
tttaaattgtttaaatttaa

SEQ ID NO: 218207 - DNA, 20 bp, Artificial
  CRISPR gRNA sequence
ttaaattgtttaaatttaaa

SEQ ID NO: 218208 - DNA, 20 bp, Artificial
  CRISPR gRNA sequence
taaattgtttaaatttaaat

SEQ ID NO: 218209 - DNA, 20 bp, Artificial
  CRISPR gRNA sequence
aaattgtttaaatttaaatt

SEQ ID NO: 218210 - DNA, 20 bp, Artificial
  CRISPR gRNA sequence
aattgtttaaatttaaatta

SEQ ID NO: 218211 - DNA, 20 bp, Artificial
  CRISPR gRNA sequence
tttaaatttaaattactatt

SEQ ID NO: 218212 - DNA, 20 bp, Artificial
  CRISPR gRNA sequence
aaatttaaattactattttt

SEQ ID NO: 218213 - DNA, 20 bp, Artificial
  CRISPR gRNA sequence
aatttaaattactatttttc

SEQ ID NO: 218214 - DNA, 20 bp, Artificial
  CRISPR gRNA sequence
aaattactatttttcaagta

SEQ ID NO: 218215 - DNA, 20 bp, Artificial
  CRISPR gRNA sequence
aattactatttttcaagtat

SEQ ID NO: 218216 - DNA, 20 bp, Artificial
  CRISPR gRNA sequence
ctatttttcaagtatctaat

SEQ ID NO: 218217 - DNA, 20 bp, Artificial
  CRISPR gRNA sequence
tttttcaagtatctaataca

SEQ ID NO: 218218 - DNA, 20 bp, Artificial
  CRISPR gRNA sequence
ttcaagtatctaatacactt

SEQ ID NO: 218219 - DNA, 20 bp, Artificial
  CRISPR gRNA sequence
tcaagtatctaatacactta

SEQ ID NO: 218220 - DNA, 20 bp, Artificial
  CRISPR gRNA sequence
caagtatctaatacacttat

SEQ ID NO: 218221 - DNA, 20 bp, Artificial
  CRISPR gRNA sequence
aagtatctaatacacttatt

SEQ ID NO: 218222 - DNA, 20 bp, Artificial
  CRISPR gRNA sequence
atacacttatttaacacaca

SEQ ID NO: 218223 - DNA, 20 bp, Artificial
  CRISPR gRNA sequence
atttaacacacacatgcata

SEQ ID NO: 218224 - DNA, 20 bp, Artificial
  CRISPR gRNA sequence
tttaacacacacatgcatac

SEQ ID NO: 218225 - DNA, 20 bp, Artificial
  CRISPR gRNA sequence
aacacacacatgcatacaca

SEQ ID NO: 218226 - DNA, 20 bp, Artificial
  CRISPR gRNA sequence
acacacacatgcatacacaa

SEQ ID NO: 218227 - DNA, 20 bp, Artificial
  CRISPR gRNA sequence
ctgaaactggtactggaaaa

SEQ ID NO: 218228 - DNA, 20 bp, Artificial
  CRISPR gRNA sequence
tgaaactggtactggaaaaa

SEQ ID NO: 218229 - DNA, 20 bp, Artificial
  CRISPR gRNA sequence
aaactggtactggaaaaaaa

SEQ ID NO: 218230 - DNA, 20 bp, Artificial
  CRISPR gRNA sequence
gtactggaaaaaaatgaaca

SEQ ID NO: 218231 - DNA, 20 bp, Artificial
  CRISPR gRNA sequence
gaaaaaaatgaacattaata

SEQ ID NO: 218232 - DNA, 20 bp, Artificial
  CRISPR gRNA sequence
ataccaattataaaattact

SEQ ID NO: 218233 - DNA, 20 bp, Artificial
  CRISPR gRNA sequence
taaaattacttgacagaaga

SEQ ID NO: 218234 - DNA, 20 bp, Artificial
  CRISPR gRNA sequence
cttgacagaagacaagttaa

SEQ ID NO: 218235 - DNA, 20 bp, Artificial
  CRISPR gRNA sequence
gacagaagacaagttaaatc

SEQ ID NO: 218236 - DNA, 20 bp, Artificial
  CRISPR gRNA sequence
acagaagacaagttaaatca

SEQ ID NO: 218237 - DNA, 20 bp, Artificial
  CRISPR gRNA sequence
aatcattttataataatctc

SEQ ID NO: 218238 - DNA, 20 bp, Artificial
  CRISPR gRNA sequence
tataataatctccatacact

SEQ ID NO: 218239 - DNA, 20 bp, Artificial
  CRISPR gRNA sequence
ataataatctccatacacta

SEQ ID NO: 218240 - DNA, 20 bp, Artificial
  CRISPR gRNA sequence
taataatctccatacactat

SEQ ID NO: 218241 - DNA, 20 bp, Artificial
  CRISPR gRNA sequence
catacactatccaacttgct

SEQ ID NO: 218242 - DNA, 20 bp, Artificial
  CRISPR gRNA sequence
tccaacttgctctaatgaaa

SEQ ID NO: 218243 - DNA, 20 bp, Artificial
  CRISPR gRNA sequence
gctctaatgaaacaattttg

SEQ ID NO: 218244 - DNA, 20 bp, Artificial
  CRISPR gRNA sequence
ctctaatgaaacaattttgt

SEQ ID NO: 218245 - DNA, 20 bp, Artificial
  CRISPR gRNA sequence
taatgaaacaattttgtcac

SEQ ID NO: 218246 - DNA, 20 bp, Artificial
  CRISPR gRNA sequence
atgaaacaattttgtcacaa

SEQ ID NO: 218247 - DNA, 20 bp, Artificial
  CRISPR gRNA sequence
tgtcacaatgaatactgact

SEQ ID NO: 218248 - DNA, 20 bp, Artificial
  CRISPR gRNA sequence
gtcacaatgaatactgacta

SEQ ID NO: 218249 - DNA, 20 bp, Artificial
  CRISPR gRNA sequence
tcacaatgaatactgactag

SEQ ID NO: 218250 - DNA, 20 bp, Artificial
  CRISPR gRNA sequence
actagacatcagtctatagg

SEQ ID NO: 218251 - DNA, 20 bp, Artificial
  CRISPR gRNA sequence
gacatcagtctataggacag

SEQ ID NO: 218252 - DNA, 20 bp, Artificial
  CRISPR gRNA sequence
taggacagagataaaagagt

SEQ ID NO: 218253 - DNA, 20 bp, Artificial
  CRISPR gRNA sequence
tgtgcatcaagtactttgaa

SEQ ID NO: 218254 - DNA, 20 bp, Artificial
  CRISPR gRNA sequence
gtgcatcaagtactttgaac

SEQ ID NO: 218255 - DNA, 20 bp, Artificial
  CRISPR gRNA sequence
tgcatcaagtactttgaaca

SEQ ID NO: 218256 - DNA, 20 bp, Artificial
  CRISPR gRNA sequence
tgaacataaaagatgaaaga

SEQ ID NO: 218257 - DNA, 20 bp, Artificial
  CRISPR gRNA sequence
gaacataaaagatgaaagaa

SEQ ID NO: 218258 - DNA, 20 bp, Artificial
  CRISPR gRNA sequence
aacataaaagatgaaagaag

SEQ ID NO: 218259 - DNA, 20 bp, Artificial
  CRISPR gRNA sequence
cctttttttcattatcaact

SEQ ID NO: 218260 - DNA, 20 bp, Artificial
  CRISPR gRNA sequence
ctttttttcattatcaactt

SEQ ID NO: 218261 - DNA, 20 bp, Artificial
  CRISPR gRNA sequence
tttttcattatcaactttcc

SEQ ID NO: 218262 - DNA, 20 bp, Artificial
  CRISPR gRNA sequence
ttttcattatcaactttccc

SEQ ID NO: 218263 - DNA, 20 bp, Artificial
  CRISPR gRNA sequence
tttcattatcaactttccct

SEQ ID NO: 218264 - DNA, 20 bp, Artificial
  CRISPR gRNA sequence
ttcattatcaactttccctg

SEQ ID NO: 218265 - DNA, 20 bp, Artificial
  CRISPR gRNA sequence
tcattatcaactttccctgc

SEQ ID NO: 218266 - DNA, 20 bp, Artificial
  CRISPR gRNA sequence
cattatcaactttccctgcc

SEQ ID NO: 218267 - DNA, 20 bp, Artificial
  CRISPR gRNA sequence
attatcaactttccctgcct

SEQ ID NO: 218268 - DNA, 20 bp, Artificial
  CRISPR gRNA sequence
tcaactttccctgccttgtg

SEQ ID NO: 218269 - DNA, 20 bp, Artificial
  CRISPR gRNA sequence
tccctgccttgtggatttca

SEQ ID NO: 218270 - DNA, 20 bp, Artificial
  CRISPR gRNA sequence
ccctgccttgtggatttcac

SEQ ID NO: 218271 - DNA, 20 bp, Artificial
  CRISPR gRNA sequence
cctgccttgtggatttcaca

SEQ ID NO: 218272 - DNA, 20 bp, Artificial
  CRISPR gRNA sequence
ccttgtggatttcacaattt

SEQ ID NO: 218273 - DNA, 20 bp, Artificial
  CRISPR gRNA sequence
gtggatttcacaatttttga

SEQ ID NO: 218274 - DNA, 20 bp, Artificial
  CRISPR gRNA sequence
tggatttcacaatttttgag

SEQ ID NO: 218275 - DNA, 20 bp, Artificial
  CRISPR gRNA sequence
cacaatttttgagtatatgg

SEQ ID NO: 218276 - DNA, 20 bp, Artificial
  CRISPR gRNA sequence
acaatttttgagtatatgga

SEQ ID NO: 218277 - DNA, 20 bp, Artificial
  CRISPR gRNA sequence
ttgagtatatggagaaggtt

SEQ ID NO: 218278 - DNA, 20 bp, Artificial
  CRISPR gRNA sequence
tgagtatatggagaaggttg

SEQ ID NO: 218279 - DNA, 20 bp, Artificial
  CRISPR gRNA sequence
gagtatatggagaaggttgt

SEQ ID NO: 218280 - DNA, 20 bp, Artificial
  CRISPR gRNA sequence
agtatatggagaaggttgtg

SEQ ID NO: 218281 - DNA, 20 bp, Artificial
  CRISPR gRNA sequence
tgatgtctggatttggaaag

SEQ ID NO: 218282 - DNA, 20 bp, Artificial
  CRISPR gRNA sequence
gatttggaaagggtcaaggg

SEQ ID NO: 218283 - DNA, 20 bp, Artificial
  CRISPR gRNA sequence
ggaaagggtcaagggatttc

SEQ ID NO: 218284 - DNA, 20 bp, Artificial
  CRISPR gRNA sequence
gaaagggtcaagggatttct

SEQ ID NO: 218285 - DNA, 20 bp, Artificial
  CRISPR gRNA sequence
ctacaaaagagtaaaatgct

SEQ ID NO: 218286 - DNA, 20 bp, Artificial
  CRISPR gRNA sequence
tacaaaagagtaaaatgctg

SEQ ID NO: 218287 - DNA, 20 bp, Artificial
  CRISPR gRNA sequence
caaaagagtaaaatgctgag

SEQ ID NO: 218288 - DNA, 20 bp, Artificial
  CRISPR gRNA sequence
agctatagatttgttcaatt

SEQ ID NO: 218289 - DNA, 20 bp, Artificial
  CRISPR gRNA sequence
tagatttgttcaattcctcc

SEQ ID NO: 218290 - DNA, 20 bp, Artificial
  CRISPR gRNA sequence
gttcaattcctcctacaata

SEQ ID NO: 218291 - DNA, 20 bp, Artificial
  CRISPR gRNA sequence
ttcaattcctcctacaataa

SEQ ID NO: 218292 - DNA, 20 bp, Artificial
  CRISPR gRNA sequence
aattcctcctacaataaaat

SEQ ID NO: 218293 - DNA, 20 bp, Artificial
  CRISPR gRNA sequence
ctcctacaataaaatcagca

SEQ ID NO: 218294 - DNA, 20 bp, Artificial
  CRISPR gRNA sequence
ctacaataaaatcagcacat

SEQ ID NO: 218295 - DNA, 20 bp, Artificial
  CRISPR gRNA sequence
caataaaatcagcacataag

SEQ ID NO: 218296 - DNA, 20 bp, Artificial
  CRISPR gRNA sequence
tttaataacagaatgtgatc

SEQ ID NO: 218297 - DNA, 20 bp, Artificial
  CRISPR gRNA sequence
aataacagaatgtgatcatt

SEQ ID NO: 218298 - DNA, 20 bp, Artificial
  CRISPR gRNA sequence
ataacagaatgtgatcatta

SEQ ID NO: 218299 - DNA, 20 bp, Artificial
  CRISPR gRNA sequence
tatggacaggaccaagggaa

SEQ ID NO: 218300 - DNA, 20 bp, Artificial
  CRISPR gRNA sequence
ggagttcaagattattgaac

SEQ ID NO: 218301 - DNA, 20 bp, Artificial
  CRISPR gRNA sequence
aagattattgaacagaattc

SEQ ID NO: 218302 - DNA, 20 bp, Artificial
  CRISPR gRNA sequence
ttgaacagaattcactgtaa

SEQ ID NO: 218303 - DNA, 20 bp, Artificial
  CRISPR gRNA sequence
aacagaattcactgtaaggg

SEQ ID NO: 218304 - DNA, 20 bp, Artificial
  CRISPR gRNA sequence
actgtaaggggccatgcatg

SEQ ID NO: 218305 - DNA, 20 bp, Artificial
  CRISPR gRNA sequence
taaggggccatgcatggtgg

SEQ ID NO: 218306 - DNA, 20 bp, Artificial
  CRISPR gRNA sequence
atgcctgtaatctcagcact

SEQ ID NO: 218307 - DNA, 20 bp, Artificial
  CRISPR gRNA sequence
taatctcagcactttgggag

SEQ ID NO: 218308 - DNA, 20 bp, Artificial
  CRISPR gRNA sequence
agcactttgggaggccgaga

SEQ ID NO: 218309 - DNA, 20 bp, Artificial
  CRISPR gRNA sequence
tgggaggccgagacagacgg

SEQ ID NO: 218310 - DNA, 20 bp, Artificial
  CRISPR gRNA sequence
gggaggccgagacagacgga

SEQ ID NO: 218311 - DNA, 20 bp, Artificial
  CRISPR gRNA sequence
ggaggccgagacagacggat

SEQ ID NO: 218312 - DNA, 20 bp, Artificial
  CRISPR gRNA sequence
gagaccagcctggccaatat

SEQ ID NO: 218313 - DNA, 20 bp, Artificial
  CRISPR gRNA sequence
gccaatatggtgaaacccca

SEQ ID NO: 218314 - DNA, 20 bp, Artificial
  CRISPR gRNA sequence
ctaaaaatacaaaaattacc

SEQ ID NO: 218315 - DNA, 20 bp, Artificial
  CRISPR gRNA sequence
aaaatacaaaaattacccag

SEQ ID NO: 218316 - DNA, 20 bp, Artificial
  CRISPR gRNA sequence
cccaggcatggtggtgcacg

SEQ ID NO: 218317 - DNA, 20 bp, Artificial
  CRISPR gRNA sequence
tagctactcgggaggctgag

SEQ ID NO: 218318 - DNA, 20 bp, Artificial
  CRISPR gRNA sequence
ctcgggaggctgagacagaa

SEQ ID NO: 218319 - DNA, 20 bp, Artificial
  CRISPR gRNA sequence
gggaggctgagacagaagaa

SEQ ID NO: 218320 - DNA, 20 bp, Artificial
  CRISPR gRNA sequence
agacagaagaatcgcttgaa

SEQ ID NO: 218321 - DNA, 20 bp, Artificial
  CRISPR gRNA sequence
gaacctgggaggcggaggtt

SEQ ID NO: 218322 - DNA, 20 bp, Artificial
  CRISPR gRNA sequence
aacctgggaggcggaggttg

SEQ ID NO: 218323 - DNA, 20 bp, Artificial
  CRISPR gRNA sequence
ggaggcggaggttgcagtga

SEQ ID NO: 218324 - DNA, 20 bp, Artificial
  CRISPR gRNA sequence
cagtgagccgagatcacgcc

SEQ ID NO: 218325 - DNA, 20 bp, Artificial
  CRISPR gRNA sequence
cactccagcctgggcaacag

SEQ ID NO: 218326 - DNA, 20 bp, Artificial
  CRISPR gRNA sequence
cagcctgggcaacagagcga

SEQ ID NO: 218327 - DNA, 20 bp, Artificial
  CRISPR gRNA sequence
ggcaacagagcgagactccg

SEQ ID NO: 218328 - DNA, 20 bp, Artificial
  CRISPR gRNA sequence
cgtctcaaaaaaaaaaaaaa

SEQ ID NO: 218329 - DNA, 20 bp, Artificial
  CRISPR gRNA sequence
aaaaaaaaaaaaaaaaaaaa

SEQ ID NO: 218330 - DNA, 20 bp, Artificial
  CRISPR gRNA sequence
acagtaaacttaataacaaa

SEQ ID NO: 218331 - DNA, 20 bp, Artificial
  CRISPR gRNA sequence
aataacaaagtcttattacc

SEQ ID NO: 218332 - DNA, 20 bp, Artificial
  CRISPR gRNA sequence
ataacaaagtcttattacca

SEQ ID NO: 218333 - DNA, 20 bp, Artificial
  CRISPR gRNA sequence
attaccaggggccatcaacc

SEQ ID NO: 218334 - DNA, 20 bp, Artificial
  CRISPR gRNA sequence
ttaccaggggccatcaacca

SEQ ID NO: 218335 - DNA, 20 bp, Artificial
  CRISPR gRNA sequence
ccaggggccatcaaccaggt

SEQ ID NO: 218336 - DNA, 20 bp, Artificial
  CRISPR gRNA sequence
tttgtgataatatttattgt

SEQ ID NO: 218337 - DNA, 20 bp, Artificial
  CRISPR gRNA sequence
tgtgataatatttattgtat

SEQ ID NO: 218338 - DNA, 20 bp, Artificial
  CRISPR gRNA sequence
gtgataatatttattgtata

SEQ ID NO: 218339 - DNA, 20 bp, Artificial
  CRISPR gRNA sequence
tgataatatttattgtatat

SEQ ID NO: 218340 - DNA, 20 bp, Artificial
  CRISPR gRNA sequence
attgtatattttactttctt

SEQ ID NO: 218341 - DNA, 20 bp, Artificial
  CRISPR gRNA sequence
ttgtatattttactttcttg

SEQ ID NO: 218342 - DNA, 20 bp, Artificial
  CRISPR gRNA sequence
tatattttactttcttggat

SEQ ID NO: 218343 - DNA, 20 bp, Artificial
  CRISPR gRNA sequence
tactttcttggatggaaatt

SEQ ID NO: 218344 - DNA, 20 bp, Artificial
  CRISPR gRNA sequence
actttcttggatggaaattt

SEQ ID NO: 218345 - DNA, 20 bp, Artificial
  CRISPR gRNA sequence
ctttcttggatggaaatttc

SEQ ID NO: 218346 - DNA, 20 bp, Artificial
  CRISPR gRNA sequence
tcttggatggaaatttccta

SEQ ID NO: 218347 - DNA, 20 bp, Artificial
  CRISPR gRNA sequence
cttggatggaaatttcctag

SEQ ID NO: 218348 - DNA, 20 bp, Artificial
  CRISPR gRNA sequence
ttggatggaaatttcctagt

SEQ ID NO: 218349 - DNA, 20 bp, Artificial
  CRISPR gRNA sequence
ggatggaaatttcctagtcc

SEQ ID NO: 218350 - DNA, 20 bp, Artificial
  CRISPR gRNA sequence
gatggaaatttcctagtcca

SEQ ID NO: 218351 - DNA, 20 bp, Artificial
  CRISPR gRNA sequence
cctagtccaagataggctat

SEQ ID NO: 218352 - DNA, 20 bp, Artificial
  CRISPR gRNA sequence
ctagtccaagataggctatg

SEQ ID NO: 218353 - DNA, 20 bp, Artificial
  CRISPR gRNA sequence
gtccaagataggctatgtct

SEQ ID NO: 218354 - DNA, 20 bp, Artificial
  CRISPR gRNA sequence
tgtcttcactttttcagaat

SEQ ID NO: 218355 - DNA, 20 bp, Artificial
  CRISPR gRNA sequence
cactttttcagaataatttt

SEQ ID NO: 218356 - DNA, 20 bp, Artificial
  CRISPR gRNA sequence
actttttcagaataattttt

SEQ ID NO: 218357 - DNA, 20 bp, Artificial
  CRISPR gRNA sequence
tttcagaataatttttctaa

SEQ ID NO: 218358 - DNA, 20 bp, Artificial
  CRISPR gRNA sequence
ttcagaataatttttctaat

SEQ ID NO: 218359 - DNA, 20 bp, Artificial
  CRISPR gRNA sequence
tcagaataatttttctaatc

SEQ ID NO: 218360 - DNA, 20 bp, Artificial
  CRISPR gRNA sequence
cagaataatttttctaatct

SEQ ID NO: 218361 - DNA, 20 bp, Artificial
  CRISPR gRNA sequence
agaataatttttctaatcta

SEQ ID NO: 218362 - DNA, 20 bp, Artificial
  CRISPR gRNA sequence
ttctaatctatgaagaaatt

SEQ ID NO: 218363 - DNA, 20 bp, Artificial
  CRISPR gRNA sequence
tctaatctatgaagaaattt

SEQ ID NO: 218364 - DNA, 20 bp, Artificial
  CRISPR gRNA sequence
ctaatctatgaagaaatttc

SEQ ID NO: 218365 - DNA, 20 bp, Artificial
  CRISPR gRNA sequence
taatctatgaagaaatttcc

SEQ ID NO: 218366 - DNA, 20 bp, Artificial
  CRISPR gRNA sequence
atctatgaagaaatttcctg

SEQ ID NO: 218367 - DNA, 20 bp, Artificial
  CRISPR gRNA sequence
tgaagaaatttcctgttcca

SEQ ID NO: 218368 - DNA, 20 bp, Artificial
  CRISPR gRNA sequence
cctgttccattacttatttt

SEQ ID NO: 218369 - DNA, 20 bp, Artificial
  CRISPR gRNA sequence
ctgttccattacttatttta

SEQ ID NO: 218370 - DNA, 20 bp, Artificial
  CRISPR gRNA sequence
ttccattacttattttaaat

SEQ ID NO: 218371 - DNA, 20 bp, Artificial
  CRISPR gRNA sequence
cattacttattttaaatatg

SEQ ID NO: 218372 - DNA, 20 bp, Artificial
  CRISPR gRNA sequence
cttattttaaatatgctttc

SEQ ID NO: 218373 - DNA, 20 bp, Artificial
  CRISPR gRNA sequence
attttaaatatgctttcatg

SEQ ID NO: 218374 - DNA, 20 bp, Artificial
  CRISPR gRNA sequence
ttttaaatatgctttcatgg

SEQ ID NO: 218375 - DNA, 20 bp, Artificial
  CRISPR gRNA sequence
taaatatgctttcatggctg

SEQ ID NO: 218376 - DNA, 20 bp, Artificial
  CRISPR gRNA sequence
aaatatgctttcatggctga

SEQ ID NO: 218377 - DNA, 20 bp, Artificial
  CRISPR gRNA sequence
aatatgctttcatggctgaa

SEQ ID NO: 218378 - DNA, 20 bp, Artificial
  CRISPR gRNA sequence
tcatggctgaattactttca

SEQ ID NO: 218379 - DNA, 20 bp, Artificial
  CRISPR gRNA sequence
catggctgaattactttcat

SEQ ID NO: 218380 - DNA, 20 bp, Artificial
  CRISPR gRNA sequence
atggctgaattactttcatt

SEQ ID NO: 218381 - DNA, 20 bp, Artificial
  CRISPR gRNA sequence
aattactttcattattaagc

SEQ ID NO: 218382 - DNA, 20 bp, Artificial
  CRISPR gRNA sequence
ctttcattattaagctgtcc

SEQ ID NO: 218383 - DNA, 20 bp, Artificial
  CRISPR gRNA sequence
tcattattaagctgtcctca

SEQ ID NO: 218384 - DNA, 20 bp, Artificial
  CRISPR gRNA sequence
cattattaagctgtcctcaa

SEQ ID NO: 218385 - DNA, 20 bp, Artificial
  CRISPR gRNA sequence
attattaagctgtcctcaag

SEQ ID NO: 218386 - DNA, 20 bp, Artificial
  CRISPR gRNA sequence
ttaagctgtcctcaagtcaa

SEQ ID NO: 218387 - DNA, 20 bp, Artificial
  CRISPR gRNA sequence
agctgtcctcaagtcaaaac

SEQ ID NO: 218388 - DNA, 20 bp, Artificial
  CRISPR gRNA sequence
tcctcaagtcaaaactcaag

SEQ ID NO: 218389 - DNA, 20 bp, Artificial
  CRISPR gRNA sequence
aagtcaaaactcaaggactt

SEQ ID NO: 218390 - DNA, 20 bp, Artificial
  CRISPR gRNA sequence
aaggacttggtaggatctca

SEQ ID NO: 218391 - DNA, 20 bp, Artificial
  CRISPR gRNA sequence
ggtaggatctcaaggtagtg

SEQ ID NO: 218392 - DNA, 20 bp, Artificial
  CRISPR gRNA sequence
gtaggatctcaaggtagtgt

SEQ ID NO: 218393 - DNA, 20 bp, Artificial
  CRISPR gRNA sequence
aaggtagtgtaatgagaact

SEQ ID NO: 218394 - DNA, 20 bp, Artificial
  CRISPR gRNA sequence
ttttccttgaattttctaac

SEQ ID NO: 218395 - DNA, 20 bp, Artificial
  CRISPR gRNA sequence
tttccttgaattttctaaca

SEQ ID NO: 218396 - DNA, 20 bp, Artificial
  CRISPR gRNA sequence
ttccttgaattttctaacaa

SEQ ID NO: 218397 - DNA, 20 bp, Artificial
  CRISPR gRNA sequence
tccttgaattttctaacaat

SEQ ID NO: 218398 - DNA, 20 bp, Artificial
  CRISPR gRNA sequence
ccttgaattttctaacaatg

SEQ ID NO: 218399 - DNA, 20 bp, Artificial
  CRISPR gRNA sequence
cttgaattttctaacaatga

SEQ ID NO: 218400 - DNA, 20 bp, Artificial
  CRISPR gRNA sequence
gaattttctaacaatgattt

SEQ ID NO: 218401 - DNA, 20 bp, Artificial
  CRISPR gRNA sequence
aattttctaacaatgatttc

SEQ ID NO: 218402 - DNA, 20 bp, Artificial
  CRISPR gRNA sequence
tctaacaatgatttctacag

SEQ ID NO: 218403 - DNA, 20 bp, Artificial
  CRISPR gRNA sequence
ctaacaatgatttctacagg

SEQ ID NO: 218404 - DNA, 20 bp, Artificial
  CRISPR gRNA sequence
taacaatgatttctacagga

SEQ ID NO: 218405 - DNA, 20 bp, Artificial
  CRISPR gRNA sequence
acaatgatttctacaggaac

SEQ ID NO: 218406 - DNA, 20 bp, Artificial
  CRISPR gRNA sequence
ctacaggaacatctactcaa

SEQ ID NO: 218407 - DNA, 20 bp, Artificial
  CRISPR gRNA sequence
tacaggaacatctactcaaa

SEQ ID NO: 218408 - DNA, 20 bp, Artificial
  CRISPR gRNA sequence
caggaacatctactcaaaga

SEQ ID NO: 218409 - DNA, 20 bp, Artificial
  CRISPR gRNA sequence
ctcaaagacatctgagccgt

SEQ ID NO: 218410 - DNA, 20 bp, Artificial
  CRISPR gRNA sequence
aaagacatctgagccgtaac

SEQ ID NO: 218411 - DNA, 20 bp, Artificial
  CRISPR gRNA sequence
agccgtaaccaaaatctctg

SEQ ID NO: 218412 - DNA, 20 bp, Artificial
  CRISPR gRNA sequence
tgtggagtaattttgagcag

SEQ ID NO: 218413 - DNA, 20 bp, Artificial
  CRISPR gRNA sequence
tggagtaattttgagcaggg

SEQ ID NO: 218414 - DNA, 20 bp, Artificial
  CRISPR gRNA sequence
tgagcagggaggggaaagtt

SEQ ID NO: 218415 - DNA, 20 bp, Artificial
  CRISPR gRNA sequence
gagcagggaggggaaagttg

SEQ ID NO: 218416 - DNA, 20 bp, Artificial
  CRISPR gRNA sequence
agcagggaggggaaagttga

SEQ ID NO: 218417 - DNA, 20 bp, Artificial
  CRISPR gRNA sequence
aaaaaaaaaaattaaagatg

SEQ ID NO: 218418 - DNA, 20 bp, Artificial
  CRISPR gRNA sequence
aagatgcctagaatacagtt

SEQ ID NO: 218419 - DNA, 20 bp, Artificial
  CRISPR gRNA sequence
gaatacagttttaaatttgg

SEQ ID NO: 218420 - DNA, 20 bp, Artificial
  CRISPR gRNA sequence
taaatttggaatcaagtaca

SEQ ID NO: 218421 - DNA, 20 bp, Artificial
  CRISPR gRNA sequence
aaatttggaatcaagtacag

SEQ ID NO: 218422 - DNA, 20 bp, Artificial
  CRISPR gRNA sequence
aatttggaatcaagtacagc

SEQ ID NO: 218423 - DNA, 20 bp, Artificial
  CRISPR gRNA sequence
ggaatcaagtacagcagtcc

SEQ ID NO: 218424 - DNA, 20 bp, Artificial
  CRISPR gRNA sequence
gaatcaagtacagcagtcct

SEQ ID NO: 218425 - DNA, 20 bp, Artificial
  CRISPR gRNA sequence
actttgcactattctgatat

SEQ ID NO: 218426 - DNA, 20 bp, Artificial
  CRISPR gRNA sequence
tgcactattctgatatgaat

SEQ ID NO: 218427 - DNA, 20 bp, Artificial
  CRISPR gRNA sequence
gcactattctgatatgaatt

SEQ ID NO: 218428 - DNA, 20 bp, Artificial
  CRISPR gRNA sequence
cactattctgatatgaattc

SEQ ID NO: 218429 - DNA, 20 bp, Artificial
  CRISPR gRNA sequence
ttctgatatgaattccagtt

SEQ ID NO: 218430 - DNA, 20 bp, Artificial
  CRISPR gRNA sequence
tgatatgaattccagttacc

SEQ ID NO: 218431 - DNA, 20 bp, Artificial
  CRISPR gRNA sequence
atatgaattccagttaccat

SEQ ID NO: 218432 - DNA, 20 bp, Artificial
  CRISPR gRNA sequence
cagttaccatggtttaatca

SEQ ID NO: 218433 - DNA, 20 bp, Artificial
  CRISPR gRNA sequence
ccatggtttaatcaaataaa

SEQ ID NO: 218434 - DNA, 20 bp, Artificial
  CRISPR gRNA sequence
aatcaaataaatccctcata

SEQ ID NO: 218435 - DNA, 20 bp, Artificial
  CRISPR gRNA sequence
atcaaataaatccctcataa

SEQ ID NO: 218436 - DNA, 20 bp, Artificial
  CRISPR gRNA sequence
ataaacagtccaaatttcaa

SEQ ID NO: 218437 - DNA, 20 bp, Artificial
  CRISPR gRNA sequence
caattaccacaatatattaa

SEQ ID NO: 218438 - DNA, 20 bp, Artificial
  CRISPR gRNA sequence
aattaccacaatatattaac

SEQ ID NO: 218439 - DNA, 20 bp, Artificial
  CRISPR gRNA sequence
ccacaatatattaactgagt

SEQ ID NO: 218440 - DNA, 20 bp, Artificial
  CRISPR gRNA sequence
actgagtaactgcataaagt

SEQ ID NO: 218441 - DNA, 20 bp, Artificial
  CRISPR gRNA sequence
agtaactgcataaagtacaa

SEQ ID NO: 218442 - DNA, 20 bp, Artificial
  CRISPR gRNA sequence
cataaagtacaacttcactg

SEQ ID NO: 218443 - DNA, 20 bp, Artificial
  CRISPR gRNA sequence
cactgctatttcttcagttc

SEQ ID NO: 218444 - DNA, 20 bp, Artificial
  CRISPR gRNA sequence
actgctatttcttcagttca

SEQ ID NO: 218445 - DNA, 20 bp, Artificial
  CRISPR gRNA sequence
ctatttcttcagttcaaaaa

SEQ ID NO: 218446 - DNA, 20 bp, Artificial
  CRISPR gRNA sequence
tttcttcagttcaaaaataa

SEQ ID NO: 218447 - DNA, 20 bp, Artificial
  CRISPR gRNA sequence
cttcagttcaaaaataacta

SEQ ID NO: 218448 - DNA, 20 bp, Artificial
  CRISPR gRNA sequence
ttcagttcaaaaataactat

SEQ ID NO: 218449 - DNA, 20 bp, Artificial
  CRISPR gRNA sequence
cagttcaaaaataactatgt

SEQ ID NO: 218450 - DNA, 20 bp, Artificial
  CRISPR gRNA sequence
agttcaaaaataactatgta

SEQ ID NO: 218451 - DNA, 20 bp, Artificial
  CRISPR gRNA sequence
aaaaataactatgtaaatag

SEQ ID NO: 218452 - DNA, 20 bp, Artificial
  CRISPR gRNA sequence
tgtaaatagcagatgtccca

SEQ ID NO: 218453 - DNA, 20 bp, Artificial
  CRISPR gRNA sequence
cttttgaagactgttggtga

SEQ ID NO: 218454 - DNA, 20 bp, Artificial
  CRISPR gRNA sequence
ttttgaagactgttggtgac

SEQ ID NO: 218455 - DNA, 20 bp, Artificial
  CRISPR gRNA sequence
ttgaagactgttggtgacta

SEQ ID NO: 218456 - DNA, 20 bp, Artificial
  CRISPR gRNA sequence
tgaagactgttggtgactag

SEQ ID NO: 218457 - DNA, 20 bp, Artificial
  CRISPR gRNA sequence
gaagactgttggtgactagt

SEQ ID NO: 218458 - DNA, 20 bp, Artificial
  CRISPR gRNA sequence
aagactgttggtgactagtc

SEQ ID NO: 218459 - DNA, 20 bp, Artificial
  CRISPR gRNA sequence
ttggtgactagtcactgtac

SEQ ID NO: 218460 - DNA, 20 bp, Artificial
  CRISPR gRNA sequence
gtgactagtcactgtacatc

SEQ ID NO: 218461 - DNA, 20 bp, Artificial
  CRISPR gRNA sequence
gtcactgtacatctgatatt

SEQ ID NO: 218462 - DNA, 20 bp, Artificial
  CRISPR gRNA sequence
tacatctgatatttaggtca

SEQ ID NO: 218463 - DNA, 20 bp, Artificial
  CRISPR gRNA sequence
atatttaggtcatgcacaga

SEQ ID NO: 218464 - DNA, 20 bp, Artificial
  CRISPR gRNA sequence
aggtcatgcacagacagcaa

SEQ ID NO: 218465 - DNA, 20 bp, Artificial
  CRISPR gRNA sequence
ggtcatgcacagacagcaaa

SEQ ID NO: 218466 - DNA, 20 bp, Artificial
  CRISPR gRNA sequence
tgttacctccttgtttccca

SEQ ID NO: 218467 - DNA, 20 bp, Artificial
  CRISPR gRNA sequence
gttacctccttgtttcccag

SEQ ID NO: 218468 - DNA, 20 bp, Artificial
  CRISPR gRNA sequence
ttacctccttgtttcccagt

SEQ ID NO: 218469 - DNA, 20 bp, Artificial
  CRISPR gRNA sequence
cctccttgtttcccagtgat

SEQ ID NO: 218470 - DNA, 20 bp, Artificial
  CRISPR gRNA sequence
cttgtttcccagtgataaac

SEQ ID NO: 218471 - DNA, 20 bp, Artificial
  CRISPR gRNA sequence
gtttcccagtgataaaccca

SEQ ID NO: 218472 - DNA, 20 bp, Artificial
  CRISPR gRNA sequence
tttcccagtgataaacccat

SEQ ID NO: 218473 - DNA, 20 bp, Artificial
  CRISPR gRNA sequence
cccagtgataaacccatgtg

SEQ ID NO: 218474 - DNA, 20 bp, Artificial
  CRISPR gRNA sequence
ccagtgataaacccatgtga

SEQ ID NO: 218475 - DNA, 20 bp, Artificial
  CRISPR gRNA sequence
tataatggataaatcaaaag

SEQ ID NO: 218476 - DNA, 20 bp, Artificial
  CRISPR gRNA sequence
ataatggataaatcaaaaga

SEQ ID NO: 218477 - DNA, 20 bp, Artificial
  CRISPR gRNA sequence
taatggataaatcaaaagag

SEQ ID NO: 218478 - DNA, 20 bp, Artificial
  CRISPR gRNA sequence
ggcaagaaagatgaaagagt

SEQ ID NO: 218479 - DNA, 20 bp, Artificial
  CRISPR gRNA sequence
acaaatgctaggagtgaaat

SEQ ID NO: 218480 - DNA, 20 bp, Artificial
  CRISPR gRNA sequence
ggagtgaaatttgaatagac

SEQ ID NO: 218481 - DNA, 20 bp, Artificial
  CRISPR gRNA sequence
gaatagaccataaatggagt

SEQ ID NO: 218482 - DNA, 20 bp, Artificial
  CRISPR gRNA sequence
aatagaccataaatggagta

SEQ ID NO: 218483 - DNA, 20 bp, Artificial
  CRISPR gRNA sequence
attgtgcgaatgtcgacatt

SEQ ID NO: 218484 - DNA, 20 bp, Artificial
  CRISPR gRNA sequence
tgcgaatgtcgacattactg

SEQ ID NO: 218485 - DNA, 20 bp, Artificial
  CRISPR gRNA sequence
ctgcaatgcaagaaactcta

SEQ ID NO: 218486 - DNA, 20 bp, Artificial
  CRISPR gRNA sequence
caatgcaagaaactctagag

SEQ ID NO: 218487 - DNA, 20 bp, Artificial
  CRISPR gRNA sequence
tagagatgaagccagaagaa

SEQ ID NO: 218488 - DNA, 20 bp, Artificial
  CRISPR gRNA sequence
gagatgaagccagaagaact

SEQ ID NO: 218489 - DNA, 20 bp, Artificial
  CRISPR gRNA sequence
agcgaaggtggacttactga

SEQ ID NO: 218490 - DNA, 20 bp, Artificial
  CRISPR gRNA sequence
actgatataaatgaggaaag

SEQ ID NO: 218491 - DNA, 20 bp, Artificial
  CRISPR gRNA sequence
ctgatataaatgaggaaagt

SEQ ID NO: 218492 - DNA, 20 bp, Artificial
  CRISPR gRNA sequence
atataaatgaggaaagtgag

SEQ ID NO: 218493 - DNA, 20 bp, Artificial
  CRISPR gRNA sequence
gcaataaaataaactttaaa

SEQ ID NO: 218494 - DNA, 20 bp, Artificial
  CRISPR gRNA sequence
taaacattcaaaaaaacatt

SEQ ID NO: 218495 - DNA, 20 bp, Artificial
  CRISPR gRNA sequence
aaacattcaaaaaaacatta

SEQ ID NO: 218496 - DNA, 20 bp, Artificial
  CRISPR gRNA sequence
aacattcaaaaaaacattaa

SEQ ID NO: 218497 - DNA, 20 bp, Artificial
  CRISPR gRNA sequence
aaaaaaacattaaaggaatt

SEQ ID NO: 218498 - DNA, 20 bp, Artificial
  CRISPR gRNA sequence
aaggaattctttcatgacat

SEQ ID NO: 218499 - DNA, 20 bp, Artificial
  CRISPR gRNA sequence
tttcatgacattgagagtgc

SEQ ID NO: 218500 - DNA, 20 bp, Artificial
  CRISPR gRNA sequence
tcatgacattgagagtgcaa

SEQ ID NO: 218501 - DNA, 20 bp, Artificial
  CRISPR gRNA sequence
catgacattgagagtgcaaa

SEQ ID NO: 218502 - DNA, 20 bp, Artificial
  CRISPR gRNA sequence
atgacattgagagtgcaaag

SEQ ID NO: 218503 - DNA, 20 bp, Artificial
  CRISPR gRNA sequence
agagtgcaaaggataaaacg

SEQ ID NO: 218504 - DNA, 20 bp, Artificial
  CRISPR gRNA sequence
agaaaggggtatgacaattc

SEQ ID NO: 218505 - DNA, 20 bp, Artificial
  CRISPR gRNA sequence
gaaaggggtatgacaattca

SEQ ID NO: 218506 - DNA, 20 bp, Artificial
  CRISPR gRNA sequence
accaagccatagagaagatg

SEQ ID NO: 218507 - DNA, 20 bp, Artificial
  CRISPR gRNA sequence
gctctgtatccaaagttatg

SEQ ID NO: 218508 - DNA, 20 bp, Artificial
  CRISPR gRNA sequence
ctctgtatccaaagttatgc

SEQ ID NO: 218509 - DNA, 20 bp, Artificial
  CRISPR gRNA sequence
tgtatccaaagttatgcaag

SEQ ID NO: 218510 - DNA, 20 bp, Artificial
  CRISPR gRNA sequence
tatccaaagttatgcaagaa

SEQ ID NO: 218511 - DNA, 20 bp, Artificial
  CRISPR gRNA sequence
tgcaagaagaacacacaagt

SEQ ID NO: 218512 - DNA, 20 bp, Artificial
  CRISPR gRNA sequence
ttcaaactactcttgataac

SEQ ID NO: 218513 - DNA, 20 bp, Artificial
  CRISPR gRNA sequence
aaactactcttgataacaca

SEQ ID NO: 218514 - DNA, 20 bp, Artificial
  CRISPR gRNA sequence
ctcttgataacacactttca

SEQ ID NO: 218515 - DNA, 20 bp, Artificial
  CRISPR gRNA sequence
ttgataacacactttcattc

SEQ ID NO: 218516 - DNA, 20 bp, Artificial
  CRISPR gRNA sequence
gataacacactttcattctc

SEQ ID NO: 218517 - DNA, 20 bp, Artificial
  CRISPR gRNA sequence
ataacacactttcattctcg

SEQ ID NO: 218518 - DNA, 20 bp, Artificial
  CRISPR gRNA sequence
tcattctcgatgtttctaat

SEQ ID NO: 218519 - DNA, 20 bp, Artificial
  CRISPR gRNA sequence
cattctcgatgtttctaatg

SEQ ID NO: 218520 - DNA, 20 bp, Artificial
  CRISPR gRNA sequence
attctcgatgtttctaatga

SEQ ID NO: 218521 - DNA, 20 bp, Artificial
  CRISPR gRNA sequence
tcgatgtttctaatgattta

SEQ ID NO: 218522 - DNA, 20 bp, Artificial
  CRISPR gRNA sequence
gatgtttctaatgatttaat

SEQ ID NO: 218523 - DNA, 20 bp, Artificial
  CRISPR gRNA sequence
ctaatgatttaatttaccac

SEQ ID NO: 218524 - DNA, 20 bp, Artificial
  CRISPR gRNA sequence
taatgatttaatttaccaca

SEQ ID NO: 218525 - DNA, 20 bp, Artificial
  CRISPR gRNA sequence
atgatttaatttaccacata

SEQ ID NO: 218526 - DNA, 20 bp, Artificial
  CRISPR gRNA sequence
aatttaccacatactaaata

SEQ ID NO: 218527 - DNA, 20 bp, Artificial
  CRISPR gRNA sequence
atttaccacatactaaatac

SEQ ID NO: 218528 - DNA, 20 bp, Artificial
  CRISPR gRNA sequence
accacatactaaatactagc

SEQ ID NO: 218529 - DNA, 20 bp, Artificial
  CRISPR gRNA sequence
ccacatactaaatactagct

SEQ ID NO: 218530 - DNA, 20 bp, Artificial
  CRISPR gRNA sequence
aatactagctttactatttt

SEQ ID NO: 218531 - DNA, 20 bp, Artificial
  CRISPR gRNA sequence
gctttactatttttcatttc

SEQ ID NO: 218532 - DNA, 20 bp, Artificial
  CRISPR gRNA sequence
tactatttttcatttcccaa

SEQ ID NO: 218533 - DNA, 20 bp, Artificial
  CRISPR gRNA sequence
actatttttcatttcccaat

SEQ ID NO: 218534 - DNA, 20 bp, Artificial
  CRISPR gRNA sequence
ctatttttcatttcccaatg

SEQ ID NO: 218535 - DNA, 20 bp, Artificial
  CRISPR gRNA sequence
tttttcatttcccaatgccg

SEQ ID NO: 218536 - DNA, 20 bp, Artificial
  CRISPR gRNA sequence
ttcatttcccaatgccgttg

SEQ ID NO: 218537 - DNA, 20 bp, Artificial
  CRISPR gRNA sequence
tcatttcccaatgccgttgt

SEQ ID NO: 218538 - DNA, 20 bp, Artificial
  CRISPR gRNA sequence
catttcccaatgccgttgtt

SEQ ID NO: 218539 - DNA, 20 bp, Artificial
  CRISPR gRNA sequence
atttcccaatgccgttgtta

SEQ ID NO: 218540 - DNA, 20 bp, Artificial
  CRISPR gRNA sequence
cccaatgccgttgttattga

SEQ ID NO: 218541 - DNA, 20 bp, Artificial
  CRISPR gRNA sequence
ccaatgccgttgttattgat

SEQ ID NO: 218542 - DNA, 20 bp, Artificial
  CRISPR gRNA sequence
ttattgataataacagagtt

SEQ ID NO: 218543 - DNA, 20 bp, Artificial
  CRISPR gRNA sequence
ttgataataacagagttttt

SEQ ID NO: 218544 - DNA, 20 bp, Artificial
  CRISPR gRNA sequence
ataataacagagtttttaag

SEQ ID NO: 218545 - DNA, 20 bp, Artificial
  CRISPR gRNA sequence
ttaaggttttaacaacaaaa

SEQ ID NO: 218546 - DNA, 20 bp, Artificial
  CRISPR gRNA sequence
taaggttttaacaacaaaaa

SEQ ID NO: 218547 - DNA, 20 bp, Artificial
  CRISPR gRNA sequence
aaggttttaacaacaaaaaa

SEQ ID NO: 218548 - DNA, 20 bp, Artificial
  CRISPR gRNA sequence
aggttttaacaacaaaaaaa

SEQ ID NO: 218549 - DNA, 20 bp, Artificial
  CRISPR gRNA sequence
taacaacaaaaaaaatttta

SEQ ID NO: 218550 - DNA, 20 bp, Artificial
  CRISPR gRNA sequence
aacaacaaaaaaaattttaa

SEQ ID NO: 218551 - DNA, 20 bp, Artificial
  CRISPR gRNA sequence
acaacaaaaaaaattttaaa

SEQ ID NO: 218552 - DNA, 20 bp, Artificial
  CRISPR gRNA sequence
taaaggtcatggaacaatat

SEQ ID NO: 218553 - DNA, 20 bp, Artificial
  CRISPR gRNA sequence
aaaggtcatggaacaatata

SEQ ID NO: 218554 - DNA, 20 bp, Artificial
  CRISPR gRNA sequence
aaggtcatggaacaatataa

SEQ ID NO: 218555 - DNA, 20 bp, Artificial
  CRISPR gRNA sequence
ttcccattcatcatgaagat

SEQ ID NO: 218556 - DNA, 20 bp, Artificial
  CRISPR gRNA sequence
tcccattcatcatgaagatt

SEQ ID NO: 218557 - DNA, 20 bp, Artificial
  CRISPR gRNA sequence
cccattcatcatgaagattg

SEQ ID NO: 218558 - DNA, 20 bp, Artificial
  CRISPR gRNA sequence
ccattcatcatgaagattgt

SEQ ID NO: 218559 - DNA, 20 bp, Artificial
  CRISPR gRNA sequence
atcatgaagattgttttgca

SEQ ID NO: 218560 - DNA, 20 bp, Artificial
  CRISPR gRNA sequence
ttttgcagaatttcagctta

SEQ ID NO: 218561 - DNA, 20 bp, Artificial
  CRISPR gRNA sequence
tgcagaatttcagcttacat

SEQ ID NO: 218562 - DNA, 20 bp, Artificial
  CRISPR gRNA sequence
gcagaatttcagcttacatg

SEQ ID NO: 218563 - DNA, 20 bp, Artificial
  CRISPR gRNA sequence
cagaatttcagcttacatgg

SEQ ID NO: 218564 - DNA, 20 bp, Artificial
  CRISPR gRNA sequence
cagcttacatggtcatgttt

SEQ ID NO: 218565 - DNA, 20 bp, Artificial
  CRISPR gRNA sequence
agcttacatggtcatgttta

SEQ ID NO: 218566 - DNA, 20 bp, Artificial
  CRISPR gRNA sequence
acatggtcatgtttatggtc

SEQ ID NO: 218567 - DNA, 20 bp, Artificial
  CRISPR gRNA sequence
catggtcatgtttatggtct

SEQ ID NO: 218568 - DNA, 20 bp, Artificial
  CRISPR gRNA sequence
atggtcttgcggttttgtgc

SEQ ID NO: 218569 - DNA, 20 bp, Artificial
  CRISPR gRNA sequence
tggtcttgcggttttgtgcg

SEQ ID NO: 218570 - DNA, 20 bp, Artificial
  CRISPR gRNA sequence
gcggttttgtgcgaagccag

SEQ ID NO: 218571 - DNA, 20 bp, Artificial
  CRISPR gRNA sequence
cggttttgtgcgaagccagt

SEQ ID NO: 218572 - DNA, 20 bp, Artificial
  CRISPR gRNA sequence
tgtgcgaagccagtattgcc

SEQ ID NO: 218573 - DNA, 20 bp, Artificial
  CRISPR gRNA sequence
gtgcgaagccagtattgcct

SEQ ID NO: 218574 - DNA, 20 bp, Artificial
  CRISPR gRNA sequence
tgcgaagccagtattgcctg

SEQ ID NO: 218575 - DNA, 20 bp, Artificial
  CRISPR gRNA sequence
cctgtataaaacaaagttac

SEQ ID NO: 218576 - DNA, 20 bp, Artificial
  CRISPR gRNA sequence
tataaaacaaagttacaaag

SEQ ID NO: 218577 - DNA, 20 bp, Artificial
  CRISPR gRNA sequence
caaaggcaaagaaagaacag

SEQ ID NO: 218578 - DNA, 20 bp, Artificial
  CRISPR gRNA sequence
tctcaaagaatttcaaaatg

SEQ ID NO: 218579 - DNA, 20 bp, Artificial
  CRISPR gRNA sequence
aaagaatttcaaaatgttag

SEQ ID NO: 218580 - DNA, 20 bp, Artificial
  CRISPR gRNA sequence
caaaatgttagccagttctt

SEQ ID NO: 218581 - DNA, 20 bp, Artificial
  CRISPR gRNA sequence
aaaatgttagccagttcttt

SEQ ID NO: 218582 - DNA, 20 bp, Artificial
  CRISPR gRNA sequence
gccagttctttacatacagt

SEQ ID NO: 218583 - DNA, 20 bp, Artificial
  CRISPR gRNA sequence
tttacatacagttggacctt

SEQ ID NO: 218584 - DNA, 20 bp, Artificial
  CRISPR gRNA sequence
tacatacagttggaccttaa

SEQ ID NO: 218585 - DNA, 20 bp, Artificial
  CRISPR gRNA sequence
acatacagttggaccttaat

SEQ ID NO: 218586 - DNA, 20 bp, Artificial
  CRISPR gRNA sequence
catacagttggaccttaatc

SEQ ID NO: 218587 - DNA, 20 bp, Artificial
  CRISPR gRNA sequence
gaccttaatcctgcaggaac

SEQ ID NO: 218588 - DNA, 20 bp, Artificial
  CRISPR gRNA sequence
aatcctgcaggaactggagg

SEQ ID NO: 218589 - DNA, 20 bp, Artificial
  CRISPR gRNA sequence
atcctgcaggaactggagga

SEQ ID NO: 218590 - DNA, 20 bp, Artificial
  CRISPR gRNA sequence
caggaactggaggactaggt

SEQ ID NO: 218591 - DNA, 20 bp, Artificial
  CRISPR gRNA sequence
gaggactaggtggacagcac

SEQ ID NO: 218592 - DNA, 20 bp, Artificial
  CRISPR gRNA sequence
ggtggacagcacttaaaatg

SEQ ID NO: 218593 - DNA, 20 bp, Artificial
  CRISPR gRNA sequence
aaaatgatatcagagtgaga

SEQ ID NO: 218594 - DNA, 20 bp, Artificial
  CRISPR gRNA sequence
aaatgatatcagagtgagaa

SEQ ID NO: 218595 - DNA, 20 bp, Artificial
  CRISPR gRNA sequence
aaaatcagccaggaacttaa

SEQ ID NO: 218596 - DNA, 20 bp, Artificial
  CRISPR gRNA sequence
aattgtcagtagagtggcaa

SEQ ID NO: 218597 - DNA, 20 bp, Artificial
  CRISPR gRNA sequence
attgtcagtagagtggcaaa

SEQ ID NO: 218598 - DNA, 20 bp, Artificial
  CRISPR gRNA sequence
tcagtagagtggcaaactgt

SEQ ID NO: 218599 - DNA, 20 bp, Artificial
  CRISPR gRNA sequence
tgagttggtgtagttttcag

SEQ ID NO: 218600 - DNA, 20 bp, Artificial
  CRISPR gRNA sequence
gtgtagttttcagaacacaa

SEQ ID NO: 218601 - DNA, 20 bp, Artificial
  CRISPR gRNA sequence
tcagaacacaaacaaagcgt

SEQ ID NO: 218602 - DNA, 20 bp, Artificial
  CRISPR gRNA sequence
cagaacacaaacaaagcgtc

SEQ ID NO: 218603 - DNA, 20 bp, Artificial
  CRISPR gRNA sequence
agaacacaaacaaagcgtct

SEQ ID NO: 218604 - DNA, 20 bp, Artificial
  CRISPR gRNA sequence
aaattcaatactatcagtta

SEQ ID NO: 218605 - DNA, 20 bp, Artificial
  CRISPR gRNA sequence
aatactatcagttaagcctt

SEQ ID NO: 218606 - DNA, 20 bp, Artificial
  CRISPR gRNA sequence
tcagttaagccttggtgttt

SEQ ID NO: 218607 - DNA, 20 bp, Artificial
  CRISPR gRNA sequence
agccttggtgtttgattcta

SEQ ID NO: 218608 - DNA, 20 bp, Artificial
  CRISPR gRNA sequence
ggtgtttgattctagcaatc

SEQ ID NO: 218609 - DNA, 20 bp, Artificial
  CRISPR gRNA sequence
gtgtttgattctagcaatct

SEQ ID NO: 218610 - DNA, 20 bp, Artificial
  CRISPR gRNA sequence
gattctagcaatctctgagc

SEQ ID NO: 218611 - DNA, 20 bp, Artificial
  CRISPR gRNA sequence
attctagcaatctctgagct

SEQ ID NO: 218612 - DNA, 20 bp, Artificial
  CRISPR gRNA sequence
tagcaatctctgagctgttt

SEQ ID NO: 218613 - DNA, 20 bp, Artificial
  CRISPR gRNA sequence
gcaatctctgagctgtttgc

SEQ ID NO: 218614 - DNA, 20 bp, Artificial
  CRISPR gRNA sequence
tgagctgtttgctaagcata

SEQ ID NO: 218615 - DNA, 20 bp, Artificial
  CRISPR gRNA sequence
agctgtttgctaagcataga

SEQ ID NO: 218616 - DNA, 20 bp, Artificial
  CRISPR gRNA sequence
tttgctaagcatagagattc

SEQ ID NO: 218617 - DNA, 20 bp, Artificial
  CRISPR gRNA sequence
gctaagcatagagattctgc

SEQ ID NO: 218618 - DNA, 20 bp, Artificial
  CRISPR gRNA sequence
ctaagcatagagattctgct

SEQ ID NO: 218619 - DNA, 20 bp, Artificial
  CRISPR gRNA sequence
agcatagagattctgcttaa

SEQ ID NO: 218620 - DNA, 20 bp, Artificial
  CRISPR gRNA sequence
tgcttaaaagttcctaagtt

SEQ ID NO: 218621 - DNA, 20 bp, Artificial
  CRISPR gRNA sequence
cttaaaagttcctaagttaa

SEQ ID NO: 218622 - DNA, 20 bp, Artificial
  CRISPR gRNA sequence
aaaagttcctaagttaaagc

SEQ ID NO: 218623 - DNA, 20 bp, Artificial
  CRISPR gRNA sequence
aaagttcctaagttaaagct

SEQ ID NO: 218624 - DNA, 20 bp, Artificial
  CRISPR gRNA sequence
ctaagttaaagctaagctaa

SEQ ID NO: 218625 - DNA, 20 bp, Artificial
  CRISPR gRNA sequence
agttaaagctaagctaaagg

SEQ ID NO: 218626 - DNA, 20 bp, Artificial
  CRISPR gRNA sequence
aagctaagctaaaggtgaag

SEQ ID NO: 218627 - DNA, 20 bp, Artificial
  CRISPR gRNA sequence
agctaaaggtgaaggtattt

SEQ ID NO: 218628 - DNA, 20 bp, Artificial
  CRISPR gRNA sequence
aaggtgaaggtatttaggaa

SEQ ID NO: 218629 - DNA, 20 bp, Artificial
  CRISPR gRNA sequence
aggaacatttccctgtaaga

SEQ ID NO: 218630 - DNA, 20 bp, Artificial
  CRISPR gRNA sequence
ggaacatttccctgtaagag

SEQ ID NO: 218631 - DNA, 20 bp, Artificial
  CRISPR gRNA sequence
ccctgtaagaggcctttatc

SEQ ID NO: 218632 - DNA, 20 bp, Artificial
  CRISPR gRNA sequence
cctgtaagaggcctttatct

SEQ ID NO: 218633 - DNA, 20 bp, Artificial
  CRISPR gRNA sequence
taagaggcctttatctttga

SEQ ID NO: 218634 - DNA, 20 bp, Artificial
  CRISPR gRNA sequence
tatctttgaaacgtggtcca

SEQ ID NO: 218635 - DNA, 20 bp, Artificial
  CRISPR gRNA sequence
atctttgaaacgtggtccag

SEQ ID NO: 218636 - DNA, 20 bp, Artificial
  CRISPR gRNA sequence
tctttgaaacgtggtccagg

SEQ ID NO: 218637 - DNA, 20 bp, Artificial
  CRISPR gRNA sequence
tgaaacgtggtccagggctc

SEQ ID NO: 218638 - DNA, 20 bp, Artificial
  CRISPR gRNA sequence
gaaacgtggtccagggctca

SEQ ID NO: 218639 - DNA, 20 bp, Artificial
  CRISPR gRNA sequence
aaacgtggtccagggctcac

SEQ ID NO: 218640 - DNA, 20 bp, Artificial
  CRISPR gRNA sequence
accaagtgctggctgggctc

SEQ ID NO: 218641 - DNA, 20 bp, Artificial
  CRISPR gRNA sequence
gctgggctctgggagtttaa

SEQ ID NO: 218642 - DNA, 20 bp, Artificial
  CRISPR gRNA sequence
ggctctgggagtttaagagt

SEQ ID NO: 218643 - DNA, 20 bp, Artificial
  CRISPR gRNA sequence
tgggagtttaagagtcttct

SEQ ID NO: 218644 - DNA, 20 bp, Artificial
  CRISPR gRNA sequence
ggagtttaagagtcttctca

SEQ ID NO: 218645 - DNA, 20 bp, Artificial
  CRISPR gRNA sequence
aagagtcttctcaggcttct

SEQ ID NO: 218646 - DNA, 20 bp, Artificial
  CRISPR gRNA sequence
agagtcttctcaggcttctt

SEQ ID NO: 218647 - DNA, 20 bp, Artificial
  CRISPR gRNA sequence
ctcaggcttcttcctcagta

SEQ ID NO: 218648 - DNA, 20 bp, Artificial
  CRISPR gRNA sequence
tcaggcttcttcctcagtag

SEQ ID NO: 218649 - DNA, 20 bp, Artificial
  CRISPR gRNA sequence
aggcttcttcctcagtagga

SEQ ID NO: 218650 - DNA, 20 bp, Artificial
  CRISPR gRNA sequence
cttcctcagtaggaccaatg

SEQ ID NO: 218651 - DNA, 20 bp, Artificial
  CRISPR gRNA sequence
ttcctcagtaggaccaatgg

SEQ ID NO: 218652 - DNA, 20 bp, Artificial
  CRISPR gRNA sequence
cctcagtaggaccaatggca

SEQ ID NO: 218653 - DNA, 20 bp, Artificial
  CRISPR gRNA sequence
ctcagtaggaccaatggcat

SEQ ID NO: 218654 - DNA, 20 bp, Artificial
  CRISPR gRNA sequence
agtaggaccaatggcatcct

SEQ ID NO: 218655 - DNA, 20 bp, Artificial
  CRISPR gRNA sequence
agacatctttcaagatacag

SEQ ID NO: 218656 - DNA, 20 bp, Artificial
  CRISPR gRNA sequence
tcaagatacagctctggtat

SEQ ID NO: 218657 - DNA, 20 bp, Artificial
  CRISPR gRNA sequence
caagatacagctctggtata

SEQ ID NO: 218658 - DNA, 20 bp, Artificial
  CRISPR gRNA sequence
aagatacagctctggtataa

SEQ ID NO: 218659 - DNA, 20 bp, Artificial
  CRISPR gRNA sequence
tggtataaagaaactctttc

SEQ ID NO: 218660 - DNA, 20 bp, Artificial
  CRISPR gRNA sequence
gtataaagaaactctttctc

SEQ ID NO: 218661 - DNA, 20 bp, Artificial
  CRISPR gRNA sequence
tttctcctcagagtgagcaa

SEQ ID NO: 218662 - DNA, 20 bp, Artificial
  CRISPR gRNA sequence
tctcctcagagtgagcaaat

SEQ ID NO: 218663 - DNA, 20 bp, Artificial
  CRISPR gRNA sequence
ctcctcagagtgagcaaatg

SEQ ID NO: 218664 - DNA, 20 bp, Artificial
  CRISPR gRNA sequence
tcctcagagtgagcaaatga

SEQ ID NO: 218665 - DNA, 20 bp, Artificial
  CRISPR gRNA sequence
ctcagagtgagcaaatgagg

SEQ ID NO: 218666 - DNA, 20 bp, Artificial
  CRISPR gRNA sequence
agagtgagcaaatgagggca

SEQ ID NO: 218667 - DNA, 20 bp, Artificial
  CRISPR gRNA sequence
ctgtctttactgaaagttta

SEQ ID NO: 218668 - DNA, 20 bp, Artificial
  CRISPR gRNA sequence
tctttactgaaagtttagcc

SEQ ID NO: 218669 - DNA, 20 bp, Artificial
  CRISPR gRNA sequence
tactgaaagtttagcctggt

SEQ ID NO: 218670 - DNA, 20 bp, Artificial
  CRISPR gRNA sequence
actgaaagtttagcctggta

SEQ ID NO: 218671 - DNA, 20 bp, Artificial
  CRISPR gRNA sequence
ctgaaagtttagcctggtaa

SEQ ID NO: 218672 - DNA, 20 bp, Artificial
  CRISPR gRNA sequence
aaagtttagcctggtaaagg

SEQ ID NO: 218673 - DNA, 20 bp, Artificial
  CRISPR gRNA sequence
agcctggtaaaggtccaggt

SEQ ID NO: 218674 - DNA, 20 bp, Artificial
  CRISPR gRNA sequence
gcctggtaaaggtccaggtt

SEQ ID NO: 218675 - DNA, 20 bp, Artificial
  CRISPR gRNA sequence
gtaaaggtccaggtttgtct

SEQ ID NO: 218676 - DNA, 20 bp, Artificial
  CRISPR gRNA sequence
gtcttggaccacaaagactc

SEQ ID NO: 218677 - DNA, 20 bp, Artificial
  CRISPR gRNA sequence
tcttggaccacaaagactca

SEQ ID NO: 218678 - DNA, 20 bp, Artificial
  CRISPR gRNA sequence
ggaccacaaagactcacatg

SEQ ID NO: 218679 - DNA, 20 bp, Artificial
  CRISPR gRNA sequence
gaccacaaagactcacatgc

SEQ ID NO: 218680 - DNA, 20 bp, Artificial
  CRISPR gRNA sequence
acatgcagagctggaaaaac

SEQ ID NO: 218681 - DNA, 20 bp, Artificial
  CRISPR gRNA sequence
gaaaaaccactgagagaaat

SEQ ID NO: 218682 - DNA, 20 bp, Artificial
  CRISPR gRNA sequence
agagaaatcccctgtagcca

SEQ ID NO: 218683 - DNA, 20 bp, Artificial
  CRISPR gRNA sequence
tagccaagtacagaccataa

SEQ ID NO: 218684 - DNA, 20 bp, Artificial
  CRISPR gRNA sequence
agcagaactagaaatctata

SEQ ID NO: 218685 - DNA, 20 bp, Artificial
  CRISPR gRNA sequence
gaaatctataaaataaaagt

SEQ ID NO: 218686 - DNA, 20 bp, Artificial
  CRISPR gRNA sequence
taaaataaaagtcatgggtc

SEQ ID NO: 218687 - DNA, 20 bp, Artificial
  CRISPR gRNA sequence
agttattatgaatgctttag

SEQ ID NO: 218688 - DNA, 20 bp, Artificial
  CRISPR gRNA sequence
ttatgaatgctttagaagat

SEQ ID NO: 218689 - DNA, 20 bp, Artificial
  CRISPR gRNA sequence
tgaatgctttagaagattta

SEQ ID NO: 218690 - DNA, 20 bp, Artificial
  CRISPR gRNA sequence
tagaagatttaccatactgg

SEQ ID NO: 218691 - DNA, 20 bp, Artificial
  CRISPR gRNA sequence
agaagatttaccatactgga

SEQ ID NO: 218692 - DNA, 20 bp, Artificial
  CRISPR gRNA sequence
gaagatttaccatactggat

SEQ ID NO: 218693 - DNA, 20 bp, Artificial
  CRISPR gRNA sequence
accatactggattctaaaaa

SEQ ID NO: 218694 - DNA, 20 bp, Artificial
  CRISPR gRNA sequence
ccatactggattctaaaaaa

SEQ ID NO: 218695 - DNA, 20 bp, Artificial
  CRISPR gRNA sequence
gattctaaaaaatatacatc

SEQ ID NO: 218696 - DNA, 20 bp, Artificial
  CRISPR gRNA sequence
taaaaaatatacatctaagc

SEQ ID NO: 218697 - DNA, 20 bp, Artificial
  CRISPR gRNA sequence
aaaaatatacatctaagcag

SEQ ID NO: 218698 - DNA, 20 bp, Artificial
  CRISPR gRNA sequence
agcaggtggagaatagaggt

SEQ ID NO: 218699 - DNA, 20 bp, Artificial
  CRISPR gRNA sequence
tctatttctatttggtggaa

SEQ ID NO: 218700 - DNA, 20 bp, Artificial
  CRISPR gRNA sequence
ctatttctatttggtggaat

SEQ ID NO: 218701 - DNA, 20 bp, Artificial
  CRISPR gRNA sequence
tatttctatttggtggaatg

SEQ ID NO: 218702 - DNA, 20 bp, Artificial
  CRISPR gRNA sequence
tttctatttggtggaatgct

SEQ ID NO: 218703 - DNA, 20 bp, Artificial
  CRISPR gRNA sequence
ctatttggtggaatgctcag

SEQ ID NO: 218704 - DNA, 20 bp, Artificial
  CRISPR gRNA sequence
tatttggtggaatgctcagg

SEQ ID NO: 218705 - DNA, 20 bp, Artificial
  CRISPR gRNA sequence
tttggtggaatgctcaggcc

SEQ ID NO: 218706 - DNA, 20 bp, Artificial
  CRISPR gRNA sequence
ggtggaatgctcaggccatc

SEQ ID NO: 218707 - DNA, 20 bp, Artificial
  CRISPR gRNA sequence
gtggaatgctcaggccatca

SEQ ID NO: 218708 - DNA, 20 bp, Artificial
  CRISPR gRNA sequence
aggccatcaacagaggcact

SEQ ID NO: 218709 - DNA, 20 bp, Artificial
  CRISPR gRNA sequence
acagaaaagttagatttgga

SEQ ID NO: 218710 - DNA, 20 bp, Artificial
  CRISPR gRNA sequence
gatttggatccatgactatc

SEQ ID NO: 218711 - DNA, 20 bp, Artificial
  CRISPR gRNA sequence
ggatccatgactatctcaaa

SEQ ID NO: 218712 - DNA, 20 bp, Artificial
  CRISPR gRNA sequence
gatccatgactatctcaaag

SEQ ID NO: 218713 - DNA, 20 bp, Artificial
  CRISPR gRNA sequence
tctcaaagatgtgacaaggc

SEQ ID NO: 218714 - DNA, 20 bp, Artificial
  CRISPR gRNA sequence
aaagatgtgacaaggcatgg

SEQ ID NO: 218715 - DNA, 20 bp, Artificial
  CRISPR gRNA sequence
gtgtctccctggcttaaatg

SEQ ID NO: 218716 - DNA, 20 bp, Artificial
  CRISPR gRNA sequence
cctggcttaaatgtgggtgc

SEQ ID NO: 218717 - DNA, 20 bp, Artificial
  CRISPR gRNA sequence
gcttaaatgtgggtgctaca

SEQ ID NO: 218718 - DNA, 20 bp, Artificial
  CRISPR gRNA sequence
aaatgtgggtgctacaaaac

SEQ ID NO: 218719 - DNA, 20 bp, Artificial
  CRISPR gRNA sequence
aatgtgggtgctacaaaacc

SEQ ID NO: 218720 - DNA, 20 bp, Artificial
  CRISPR gRNA sequence
caaaaccagggcaatatgca

SEQ ID NO: 218721 - DNA, 20 bp, Artificial
  CRISPR gRNA sequence
caggcatgtagcttggtgtc

SEQ ID NO: 218722 - DNA, 20 bp, Artificial
  CRISPR gRNA sequence
aggcatgtagcttggtgtcc

SEQ ID NO: 218723 - DNA, 20 bp, Artificial
  CRISPR gRNA sequence
ggtgtccagcaatcagtagg

SEQ ID NO: 218724 - DNA, 20 bp, Artificial
  CRISPR gRNA sequence
gtgtccagcaatcagtaggc

SEQ ID NO: 218725 - DNA, 20 bp, Artificial
  CRISPR gRNA sequence
tcactaggtatttgcagaat

SEQ ID NO: 218726 - DNA, 20 bp, Artificial
  CRISPR gRNA sequence
ggtatttgcagaataagtaa

SEQ ID NO: 218727 - DNA, 20 bp, Artificial
  CRISPR gRNA sequence
gcagaataagtaaacaaatc

SEQ ID NO: 218728 - DNA, 20 bp, Artificial
  CRISPR gRNA sequence
cagaataagtaaacaaatca

SEQ ID NO: 218729 - DNA, 20 bp, Artificial
  CRISPR gRNA sequence
tgctctcctaataagtttta

SEQ ID NO: 218730 - DNA, 20 bp, Artificial
  CRISPR gRNA sequence
ctctcctaataagttttagc

SEQ ID NO: 218731 - DNA, 20 bp, Artificial
  CRISPR gRNA sequence
tcctaataagttttagctac

SEQ ID NO: 218732 - DNA, 20 bp, Artificial
  CRISPR gRNA sequence
ctaataagttttagctactc

SEQ ID NO: 218733 - DNA, 20 bp, Artificial
  CRISPR gRNA sequence
ataagttttagctactcagt

SEQ ID NO: 218734 - DNA, 20 bp, Artificial
  CRISPR gRNA sequence
tagctactcagtattatgtg

SEQ ID NO: 218735 - DNA, 20 bp, Artificial
  CRISPR gRNA sequence
agctactcagtattatgtgc

SEQ ID NO: 218736 - DNA, 20 bp, Artificial
  CRISPR gRNA sequence
gctactcagtattatgtgct

SEQ ID NO: 218737 - DNA, 20 bp, Artificial
  CRISPR gRNA sequence
ctcagtattatgtgcttaga

SEQ ID NO: 218738 - DNA, 20 bp, Artificial
  CRISPR gRNA sequence
agtattatgtgcttagatat

SEQ ID NO: 218739 - DNA, 20 bp, Artificial
  CRISPR gRNA sequence
tgtgcttagatataggttca

SEQ ID NO: 218740 - DNA, 20 bp, Artificial
  CRISPR gRNA sequence
agatataggttcacccttca

SEQ ID NO: 218741 - DNA, 20 bp, Artificial
  CRISPR gRNA sequence
gatataggttcacccttcat

SEQ ID NO: 218742 - DNA, 20 bp, Artificial
  CRISPR gRNA sequence
acccttcatggaaataaaat

SEQ ID NO: 218743 - DNA, 20 bp, Artificial
  CRISPR gRNA sequence
catggaaataaaatcctcaa

SEQ ID NO: 218744 - DNA, 20 bp, Artificial
  CRISPR gRNA sequence
atggaaataaaatcctcaaa

SEQ ID NO: 218745 - DNA, 20 bp, Artificial
  CRISPR gRNA sequence
aaaataaatgcaaaacgggg

SEQ ID NO: 218746 - DNA, 20 bp, Artificial
  CRISPR gRNA sequence
gttcaaatcccagtactatc

SEQ ID NO: 218747 - DNA, 20 bp, Artificial
  CRISPR gRNA sequence
aaatcccagtactatcagga

SEQ ID NO: 218748 - DNA, 20 bp, Artificial
  CRISPR gRNA sequence
tcaggaaacggctgggtgat

SEQ ID NO: 218749 - DNA, 20 bp, Artificial
  CRISPR gRNA sequence
ggtgattgcgggcaaattgc

SEQ ID NO: 218750 - DNA, 20 bp, Artificial
  CRISPR gRNA sequence
cgggcaaattgcctaatcta

SEQ ID NO: 218751 - DNA, 20 bp, Artificial
  CRISPR gRNA sequence
cctaatctatctgtgcctgt

SEQ ID NO: 218752 - DNA, 20 bp, Artificial
  CRISPR gRNA sequence
atctatctgtgcctgtttct

SEQ ID NO: 218753 - DNA, 20 bp, Artificial
  CRISPR gRNA sequence
tctgtgcctgtttcttatct

SEQ ID NO: 218754 - DNA, 20 bp, Artificial
  CRISPR gRNA sequence
tgcctgtttcttatctacaa

SEQ ID NO: 218755 - DNA, 20 bp, Artificial
  CRISPR gRNA sequence
tttcttatctacaaaacggg

SEQ ID NO: 218756 - DNA, 20 bp, Artificial
  CRISPR gRNA sequence
cttatctacaaaacgggaat

SEQ ID NO: 218757 - DNA, 20 bp, Artificial
  CRISPR gRNA sequence
ttatctacaaaacgggaata

SEQ ID NO: 218758 - DNA, 20 bp, Artificial
  CRISPR gRNA sequence
atctacaaaacgggaataac

SEQ ID NO: 218759 - DNA, 20 bp, Artificial
  CRISPR gRNA sequence
tctacaaaacgggaataaca

SEQ ID NO: 218760 - DNA, 20 bp, Artificial
  CRISPR gRNA sequence
caaaacgggaataacaacag

SEQ ID NO: 218761 - DNA, 20 bp, Artificial
  CRISPR gRNA sequence
tgcccatagagtttctggga

SEQ ID NO: 218762 - DNA, 20 bp, Artificial
  CRISPR gRNA sequence
ctgggagaaataaatgtcat

SEQ ID NO: 218763 - DNA, 20 bp, Artificial
  CRISPR gRNA sequence
tgggagaaataaatgtcatt

SEQ ID NO: 218764 - DNA, 20 bp, Artificial
  CRISPR gRNA sequence
ggagaaataaatgtcatttc

SEQ ID NO: 218765 - DNA, 20 bp, Artificial
  CRISPR gRNA sequence
cagatatagagtactttgca

SEQ ID NO: 218766 - DNA, 20 bp, Artificial
  CRISPR gRNA sequence
agatatagagtactttgcac

SEQ ID NO: 218767 - DNA, 20 bp, Artificial
  CRISPR gRNA sequence
tgcacagaacctgtcaagca

SEQ ID NO: 218768 - DNA, 20 bp, Artificial
  CRISPR gRNA sequence
gcacagaacctgtcaagcag

SEQ ID NO: 218769 - DNA, 20 bp, Artificial
  CRISPR gRNA sequence
cacagaacctgtcaagcaga

SEQ ID NO: 218770 - DNA, 20 bp, Artificial
  CRISPR gRNA sequence
tcaagcagagcaagagctcc

SEQ ID NO: 218771 - DNA, 20 bp, Artificial
  CRISPR gRNA sequence
cacaaatggttagctactat

SEQ ID NO: 218772 - DNA, 20 bp, Artificial
  CRISPR gRNA sequence
gctactattatcatcaacac

SEQ ID NO: 218773 - DNA, 20 bp, Artificial
  CRISPR gRNA sequence
ctattatcatcaacaccttt

SEQ ID NO: 218774 - DNA, 20 bp, Artificial
  CRISPR gRNA sequence
ttatcatcaacacctttaaa

SEQ ID NO: 218775 - DNA, 20 bp, Artificial
  CRISPR gRNA sequence
tcatcaacacctttaaatgt

SEQ ID NO: 218776 - DNA, 20 bp, Artificial
  CRISPR gRNA sequence
taaatgtgagcgcaggctgg

SEQ ID NO: 218777 - DNA, 20 bp, Artificial
  CRISPR gRNA sequence
aaatgtgagcgcaggctggg

SEQ ID NO: 218778 - DNA, 20 bp, Artificial
  CRISPR gRNA sequence
aatgtgagcgcaggctgggt

SEQ ID NO: 218779 - DNA, 20 bp, Artificial
  CRISPR gRNA sequence
ggtgaatcatgtatagacat

SEQ ID NO: 218780 - DNA, 20 bp, Artificial
  CRISPR gRNA sequence
ttccatgcacatacacacac

SEQ ID NO: 218781 - DNA, 20 bp, Artificial
  CRISPR gRNA sequence
ccatgcacatacacacacat

SEQ ID NO: 218782 - DNA, 20 bp, Artificial
  CRISPR gRNA sequence
catgcacatacacacacatc

SEQ ID NO: 218783 - DNA, 20 bp, Artificial
  CRISPR gRNA sequence
cctgtttcaagatgagccaa

SEQ ID NO: 218784 - DNA, 20 bp, Artificial
  CRISPR gRNA sequence
tttcaagatgagccaaaaca

SEQ ID NO: 218785 - DNA, 20 bp, Artificial
  CRISPR gRNA sequence
caagatgagccaaaacaaaa

SEQ ID NO: 218786 - DNA, 20 bp, Artificial
  CRISPR gRNA sequence
aagatgagccaaaacaaaaa

SEQ ID NO: 218787 - DNA, 20 bp, Artificial
  CRISPR gRNA sequence
ccaccaaaatatttctttag

SEQ ID NO: 218788 - DNA, 20 bp, Artificial
  CRISPR gRNA sequence
ctttaggtttataagcacgt

SEQ ID NO: 218789 - DNA, 20 bp, Artificial
  CRISPR gRNA sequence
tttaggtttataagcacgtt

SEQ ID NO: 218790 - DNA, 20 bp, Artificial
  CRISPR gRNA sequence
taggtttataagcacgttcc

SEQ ID NO: 218791 - DNA, 20 bp, Artificial
  CRISPR gRNA sequence
aggtttataagcacgttcct

SEQ ID NO: 218792 - DNA, 20 bp, Artificial
  CRISPR gRNA sequence
ggtttataagcacgttcctt

SEQ ID NO: 218793 - DNA, 20 bp, Artificial
  CRISPR gRNA sequence
ataagcacgttccttaaaat

SEQ ID NO: 218794 - DNA, 20 bp, Artificial
  CRISPR gRNA sequence
taagcacgttccttaaaata

SEQ ID NO: 218795 - DNA, 20 bp, Artificial
  CRISPR gRNA sequence
cttaaaatatgaccagtaca

SEQ ID NO: 218796 - DNA, 20 bp, Artificial
  CRISPR gRNA sequence
aaaatatgaccagtacaaaa

SEQ ID NO: 218797 - DNA, 20 bp, Artificial
  CRISPR gRNA sequence
aaatatgaccagtacaaaaa

SEQ ID NO: 218798 - DNA, 20 bp, Artificial
  CRISPR gRNA sequence
caccttactaacacaaaaat

SEQ ID NO: 218799 - DNA, 20 bp, Artificial
  CRISPR gRNA sequence
actaacacaaaaattacaat

SEQ ID NO: 218800 - DNA, 20 bp, Artificial
  CRISPR gRNA sequence
ctaacacaaaaattacaatt

SEQ ID NO: 218801 - DNA, 20 bp, Artificial
  CRISPR gRNA sequence
acacaaaaattacaattaca

SEQ ID NO: 218802 - DNA, 20 bp, Artificial
  CRISPR gRNA sequence
caattacaataagatgcttt

SEQ ID NO: 218803 - DNA, 20 bp, Artificial
  CRISPR gRNA sequence
caataagatgctttttcacc

SEQ ID NO: 218804 - DNA, 20 bp, Artificial
  CRISPR gRNA sequence
tttcacccatcaaatttgca

SEQ ID NO: 218805 - DNA, 20 bp, Artificial
  CRISPR gRNA sequence
ttcacccatcaaatttgcag

SEQ ID NO: 218806 - DNA, 20 bp, Artificial
  CRISPR gRNA sequence
tcacccatcaaatttgcaga

SEQ ID NO: 218807 - DNA, 20 bp, Artificial
  CRISPR gRNA sequence
cacccatcaaatttgcagag

SEQ ID NO: 218808 - DNA, 20 bp, Artificial
  CRISPR gRNA sequence
acccatcaaatttgcagaga

SEQ ID NO: 218809 - DNA, 20 bp, Artificial
  CRISPR gRNA sequence
gcagagattttagcgttata

SEQ ID NO: 218810 - DNA, 20 bp, Artificial
  CRISPR gRNA sequence
cagagattttagcgttataa

SEQ ID NO: 218811 - DNA, 20 bp, Artificial
  CRISPR gRNA sequence
tagcgttataatatcagaat

SEQ ID NO: 218812 - DNA, 20 bp, Artificial
  CRISPR gRNA sequence
agcgttataatatcagaatt

SEQ ID NO: 218813 - DNA, 20 bp, Artificial
  CRISPR gRNA sequence
gcgttataatatcagaatta

SEQ ID NO: 218814 - DNA, 20 bp, Artificial
  CRISPR gRNA sequence
taatatcagaattataactg

SEQ ID NO: 218815 - DNA, 20 bp, Artificial
  CRISPR gRNA sequence
taactgaggtgaaagacagg

SEQ ID NO: 218816 - DNA, 20 bp, Artificial
  CRISPR gRNA sequence
aggtgaaagacaggtattct

SEQ ID NO: 218817 - DNA, 20 bp, Artificial
  CRISPR gRNA sequence
tcatctgcaatagtagttga

SEQ ID NO: 218818 - DNA, 20 bp, Artificial
  CRISPR gRNA sequence
atctgcaatagtagttgata

SEQ ID NO: 218819 - DNA, 20 bp, Artificial
  CRISPR gRNA sequence
caatagtagttgatacaaac

SEQ ID NO: 218820 - DNA, 20 bp, Artificial
  CRISPR gRNA sequence
atacaaacgtttctggaaaa

SEQ ID NO: 218821 - DNA, 20 bp, Artificial
  CRISPR gRNA sequence
ctggaaaacattttgccagt

SEQ ID NO: 218822 - DNA, 20 bp, Artificial
  CRISPR gRNA sequence
tggaaaacattttgccagta

SEQ ID NO: 218823 - DNA, 20 bp, Artificial
  CRISPR gRNA sequence
gaaaacattttgccagtatg

SEQ ID NO: 218824 - DNA, 20 bp, Artificial
  CRISPR gRNA sequence
tgccagtatgtatctagagt

SEQ ID NO: 218825 - DNA, 20 bp, Artificial
  CRISPR gRNA sequence
gccagtatgtatctagagtc

SEQ ID NO: 218826 - DNA, 20 bp, Artificial
  CRISPR gRNA sequence
ccagtatgtatctagagtct

SEQ ID NO: 218827 - DNA, 20 bp, Artificial
  CRISPR gRNA sequence
gagtcttaaaatatctctgc

SEQ ID NO: 218828 - DNA, 20 bp, Artificial
  CRISPR gRNA sequence
aaaatatctctgccaattcc

SEQ ID NO: 218829 - DNA, 20 bp, Artificial
  CRISPR gRNA sequence
aaatatctctgccaattcca

SEQ ID NO: 218830 - DNA, 20 bp, Artificial
  CRISPR gRNA sequence
tgccaattccaggcttcata

SEQ ID NO: 218831 - DNA, 20 bp, Artificial
  CRISPR gRNA sequence
ccaattccaggcttcatatc

SEQ ID NO: 218832 - DNA, 20 bp, Artificial
  CRISPR gRNA sequence
caggcttcatatctttagca

SEQ ID NO: 218833 - DNA, 20 bp, Artificial
  CRISPR gRNA sequence
catatctttagcagagttat

SEQ ID NO: 218834 - DNA, 20 bp, Artificial
  CRISPR gRNA sequence
atatctttagcagagttatt

SEQ ID NO: 218835 - DNA, 20 bp, Artificial
  CRISPR gRNA sequence
tagcagagttattttcatag

SEQ ID NO: 218836 - DNA, 20 bp, Artificial
  CRISPR gRNA sequence
agcagagttattttcatagt

SEQ ID NO: 218837 - DNA, 20 bp, Artificial
  CRISPR gRNA sequence
gcagagttattttcatagta

SEQ ID NO: 218838 - DNA, 20 bp, Artificial
  CRISPR gRNA sequence
ttttcatagtatcaaaaaaa

SEQ ID NO: 218839 - DNA, 20 bp, Artificial
  CRISPR gRNA sequence
tcatagtatcaaaaaaattg

SEQ ID NO: 218840 - DNA, 20 bp, Artificial
  CRISPR gRNA sequence
catagtatcaaaaaaattgg

SEQ ID NO: 218841 - DNA, 20 bp, Artificial
  CRISPR gRNA sequence
atagtatcaaaaaaattgga

SEQ ID NO: 218842 - DNA, 20 bp, Artificial
  CRISPR gRNA sequence
gaaacatccttaaaatccat

SEQ ID NO: 218843 - DNA, 20 bp, Artificial
  CRISPR gRNA sequence
aaaatccatcaagatgagag

SEQ ID NO: 218844 - DNA, 20 bp, Artificial
  CRISPR gRNA sequence
aaatccatcaagatgagagt

SEQ ID NO: 218845 - DNA, 20 bp, Artificial
  CRISPR gRNA sequence
agtaaattatagtgcatcca

SEQ ID NO: 218846 - DNA, 20 bp, Artificial
  CRISPR gRNA sequence
tagtgcatccacaaaagtag

SEQ ID NO: 218847 - DNA, 20 bp, Artificial
  CRISPR gRNA sequence
taacaagatttctgaagaca

SEQ ID NO: 218848 - DNA, 20 bp, Artificial
  CRISPR gRNA sequence
ctgaagacatgggggaacat

SEQ ID NO: 218849 - DNA, 20 bp, Artificial
  CRISPR gRNA sequence
tgaagacatgggggaacatc

SEQ ID NO: 218850 - DNA, 20 bp, Artificial
  CRISPR gRNA sequence
aagacatgggggaacatcag

SEQ ID NO: 218851 - DNA, 20 bp, Artificial
  CRISPR gRNA sequence
tacgagtccatttatggtta

SEQ ID NO: 218852 - DNA, 20 bp, Artificial
  CRISPR gRNA sequence
atggttacctttttttaaaa

SEQ ID NO: 218853 - DNA, 20 bp, Artificial
  CRISPR gRNA sequence
tggttacctttttttaaaaa

SEQ ID NO: 218854 - DNA, 20 bp, Artificial
  CRISPR gRNA sequence
cctttttttaaaaaaaagat

SEQ ID NO: 218855 - DNA, 20 bp, Artificial
  CRISPR gRNA sequence
tttttaaaaaaaagataaca

SEQ ID NO: 218856 - DNA, 20 bp, Artificial
  CRISPR gRNA sequence
ttttaaaaaaaagataacaa

SEQ ID NO: 218857 - DNA, 20 bp, Artificial
  CRISPR gRNA sequence
tttaaaaaaaagataacaaa

SEQ ID NO: 218858 - DNA, 20 bp, Artificial
  CRISPR gRNA sequence
ttaaaaaaaagataacaaaa

SEQ ID NO: 218859 - DNA, 20 bp, Artificial
  CRISPR gRNA sequence
taaaaaaaagataacaaaaa

SEQ ID NO: 218860 - DNA, 20 bp, Artificial
  CRISPR gRNA sequence
aaaaaaaagataacaaaaat

SEQ ID NO: 218861 - DNA, 20 bp, Artificial
  CRISPR gRNA sequence
aaaaaaagataacaaaaatg

SEQ ID NO: 218862 - DNA, 20 bp, Artificial
  CRISPR gRNA sequence
accagaatataccaatagtt

SEQ ID NO: 218863 - DNA, 20 bp, Artificial
  CRISPR gRNA sequence
atttctaggtttggggacta

SEQ ID NO: 218864 - DNA, 20 bp, Artificial
  CRISPR gRNA sequence
tttctaggtttggggactac

SEQ ID NO: 218865 - DNA, 20 bp, Artificial
  CRISPR gRNA sequence
ctaggtttggggactacaga

SEQ ID NO: 218866 - DNA, 20 bp, Artificial
  CRISPR gRNA sequence
taggtttggggactacagat

SEQ ID NO: 218867 - DNA, 20 bp, Artificial
  CRISPR gRNA sequence
ggtttggggactacagatga

SEQ ID NO: 218868 - DNA, 20 bp, Artificial
  CRISPR gRNA sequence
ggggactacagatgagtttt

SEQ ID NO: 218869 - DNA, 20 bp, Artificial
  CRISPR gRNA sequence
gggactacagatgagttttt

SEQ ID NO: 218870 - DNA, 20 bp, Artificial
  CRISPR gRNA sequence
cagatgagtttttttttttt

SEQ ID NO: 218871 - DNA, 20 bp, Artificial
  CRISPR gRNA sequence
tttttttttttttttaaata

SEQ ID NO: 218872 - DNA, 20 bp, Artificial
  CRISPR gRNA sequence
ttttttttttttttaaataa

SEQ ID NO: 218873 - DNA, 20 bp, Artificial
  CRISPR gRNA sequence
tttttttttttttaaataac

SEQ ID NO: 218874 - DNA, 20 bp, Artificial
  CRISPR gRNA sequence
ttttttttttttaaataact

SEQ ID NO: 218875 - DNA, 20 bp, Artificial
  CRISPR gRNA sequence
tttttttttttaaataactc

SEQ ID NO: 218876 - DNA, 20 bp, Artificial
  CRISPR gRNA sequence
ttttttttttaaataactcc

SEQ ID NO: 218877 - DNA, 20 bp, Artificial
  CRISPR gRNA sequence
tttttttttaaataactccc

SEQ ID NO: 218878 - DNA, 20 bp, Artificial
  CRISPR gRNA sequence
ttttttttaaataactccct

SEQ ID NO: 218879 - DNA, 20 bp, Artificial
  CRISPR gRNA sequence
tttttttaaataactcccta

SEQ ID NO: 218880 - DNA, 20 bp, Artificial
  CRISPR gRNA sequence
ttttttaaataactccctac

SEQ ID NO: 218881 - DNA, 20 bp, Artificial
  CRISPR gRNA sequence
tttttaaataactccctact

SEQ ID NO: 218882 - DNA, 20 bp, Artificial
  CRISPR gRNA sequence
ttttaaataactccctactt

SEQ ID NO: 218883 - DNA, 20 bp, Artificial
  CRISPR gRNA sequence
tttaaataactccctacttt

SEQ ID NO: 218884 - DNA, 20 bp, Artificial
  CRISPR gRNA sequence
ttaaataactccctactttg

SEQ ID NO: 218885 - DNA, 20 bp, Artificial
  CRISPR gRNA sequence
taaataactccctactttgt

SEQ ID NO: 218886 - DNA, 20 bp, Artificial
  CRISPR gRNA sequence
aaataactccctactttgta

SEQ ID NO: 218887 - DNA, 20 bp, Artificial
  CRISPR gRNA sequence
aataactccctactttgtac

SEQ ID NO: 218888 - DNA, 20 bp, Artificial
  CRISPR gRNA sequence
cctactttgtacgaggtgtt

SEQ ID NO: 218889 - DNA, 20 bp, Artificial
  CRISPR gRNA sequence
ctttgtacgaggtgttctaa

SEQ ID NO: 218890 - DNA, 20 bp, Artificial
  CRISPR gRNA sequence
tgtacgaggtgttctaaagt

SEQ ID NO: 218891 - DNA, 20 bp, Artificial
  CRISPR gRNA sequence
gtacgaggtgttctaaagtg

SEQ ID NO: 218892 - DNA, 20 bp, Artificial
  CRISPR gRNA sequence
tacgaggtgttctaaagtga

SEQ ID NO: 218893 - DNA, 20 bp, Artificial
  CRISPR gRNA sequence
taaagtgatatgtatgactt

SEQ ID NO: 218894 - DNA, 20 bp, Artificial
  CRISPR gRNA sequence
aagtgatatgtatgactttt

SEQ ID NO: 218895 - DNA, 20 bp, Artificial
  CRISPR gRNA sequence
ttttaagtcagaaaaaatat

SEQ ID NO: 218896 - DNA, 20 bp, Artificial
  CRISPR gRNA sequence
tttaagtcagaaaaaatatt

SEQ ID NO: 218897 - DNA, 20 bp, Artificial
  CRISPR gRNA sequence
ttaagtcagaaaaaatattg

SEQ ID NO: 218898 - DNA, 20 bp, Artificial
  CRISPR gRNA sequence
taagtcagaaaaaatattgt

SEQ ID NO: 218899 - DNA, 20 bp, Artificial
  CRISPR gRNA sequence
aagtcagaaaaaatattgta

SEQ ID NO: 218900 - DNA, 20 bp, Artificial
  CRISPR gRNA sequence
agtcagaaaaaatattgtaa

SEQ ID NO: 218901 - DNA, 20 bp, Artificial
  CRISPR gRNA sequence
taaagctcattttgtaaaaa

SEQ ID NO: 218902 - DNA, 20 bp, Artificial
  CRISPR gRNA sequence
attttgtaaaaatacagcca

SEQ ID NO: 218903 - DNA, 20 bp, Artificial
  CRISPR gRNA sequence
tgtaaaaatacagccaacag

SEQ ID NO: 218904 - DNA, 20 bp, Artificial
  CRISPR gRNA sequence
gtaaaaatacagccaacagt

SEQ ID NO: 218905 - DNA, 20 bp, Artificial
  CRISPR gRNA sequence
taaaaatacagccaacagtg

SEQ ID NO: 218906 - DNA, 20 bp, Artificial
  CRISPR gRNA sequence
actcctggttcatttcacta

SEQ ID NO: 218907 - DNA, 20 bp, Artificial
  CRISPR gRNA sequence
ctggttcatttcactaaaaa

SEQ ID NO: 218908 - DNA, 20 bp, Artificial
  CRISPR gRNA sequence
gttcatttcactaaaaataa

SEQ ID NO: 218909 - DNA, 20 bp, Artificial
  CRISPR gRNA sequence
atttcactaaaaataatgtc

SEQ ID NO: 218910 - DNA, 20 bp, Artificial
  CRISPR gRNA sequence
cactaaaaataatgtcacca

SEQ ID NO: 218911 - DNA, 20 bp, Artificial
  CRISPR gRNA sequence
actaaaaataatgtcaccaa

SEQ ID NO: 218912 - DNA, 20 bp, Artificial
  CRISPR gRNA sequence
aaaataatgtcaccaatgat

SEQ ID NO: 218913 - DNA, 20 bp, Artificial
  CRISPR gRNA sequence
gatcagcaaacatccatcaa

SEQ ID NO: 218914 - DNA, 20 bp, Artificial
  CRISPR gRNA sequence
aaaaaatcgcactatgtgaa

SEQ ID NO: 218915 - DNA, 20 bp, Artificial
  CRISPR gRNA sequence
tgtgaaataatttcatgatc

SEQ ID NO: 218916 - DNA, 20 bp, Artificial
  CRISPR gRNA sequence
catgatctttgaaaaaggct

SEQ ID NO: 218917 - DNA, 20 bp, Artificial
  CRISPR gRNA sequence
atgatctttgaaaaaggctg

SEQ ID NO: 218918 - DNA, 20 bp, Artificial
  CRISPR gRNA sequence
tgaaaaaggctgttccctgc

SEQ ID NO: 218919 - DNA, 20 bp, Artificial
  CRISPR gRNA sequence
gaaaaaggctgttccctgcc

SEQ ID NO: 218920 - DNA, 20 bp, Artificial
  CRISPR gRNA sequence
aaaaaggctgttccctgccc

SEQ ID NO: 218921 - DNA, 20 bp, Artificial
  CRISPR gRNA sequence
ttccctgcccaagtcatatg

SEQ ID NO: 218922 - DNA, 20 bp, Artificial
  CRISPR gRNA sequence
cctgcccaagtcatatgact

SEQ ID NO: 218923 - DNA, 20 bp, Artificial
  CRISPR gRNA sequence
cccaagtcatatgacttagc

SEQ ID NO: 218924 - DNA, 20 bp, Artificial
  CRISPR gRNA sequence
agcccttaaagtctggctct

SEQ ID NO: 218925 - DNA, 20 bp, Artificial
  CRISPR gRNA sequence
gcccttaaagtctggctctg

SEQ ID NO: 218926 - DNA, 20 bp, Artificial
  CRISPR gRNA sequence
aaagtctggctctgccaata

SEQ ID NO: 218927 - DNA, 20 bp, Artificial
  CRISPR gRNA sequence
aagtctggctctgccaatat

SEQ ID NO: 218928 - DNA, 20 bp, Artificial
  CRISPR gRNA sequence
gctctgccaatatggttaaa

SEQ ID NO: 218929 - DNA, 20 bp, Artificial
  CRISPR gRNA sequence
tgccaatatggttaaaagct

SEQ ID NO: 218930 - DNA, 20 bp, Artificial
  CRISPR gRNA sequence
ccaatatggttaaaagcttt

SEQ ID NO: 218931 - DNA, 20 bp, Artificial
  CRISPR gRNA sequence
aaagctttccctaatatcat

SEQ ID NO: 218932 - DNA, 20 bp, Artificial
  CRISPR gRNA sequence
tccctaatatcattgatgcc

SEQ ID NO: 218933 - DNA, 20 bp, Artificial
  CRISPR gRNA sequence
ccctaatatcattgatgcca

SEQ ID NO: 218934 - DNA, 20 bp, Artificial
  CRISPR gRNA sequence
cctaatatcattgatgccag

SEQ ID NO: 218935 - DNA, 20 bp, Artificial
  CRISPR gRNA sequence
atatcattgatgccagaata

SEQ ID NO: 218936 - DNA, 20 bp, Artificial
  CRISPR gRNA sequence
atgccagaataggtcttaat

SEQ ID NO: 218937 - DNA, 20 bp, Artificial
  CRISPR gRNA sequence
aatgctacaccagtcctttt

SEQ ID NO: 218938 - DNA, 20 bp, Artificial
  CRISPR gRNA sequence
atgctacaccagtccttttc

SEQ ID NO: 218939 - DNA, 20 bp, Artificial
  CRISPR gRNA sequence
caccagtccttttcttgaca

SEQ ID NO: 218940 - DNA, 20 bp, Artificial
  CRISPR gRNA sequence
ttcttgacataaaaaactaa

SEQ ID NO: 218941 - DNA, 20 bp, Artificial
  CRISPR gRNA sequence
tcttgacataaaaaactaag

SEQ ID NO: 218942 - DNA, 20 bp, Artificial
  CRISPR gRNA sequence
cttgacataaaaaactaaga

SEQ ID NO: 218943 - DNA, 20 bp, Artificial
  CRISPR gRNA sequence
ttgacataaaaaactaagag

SEQ ID NO: 218944 - DNA, 20 bp, Artificial
  CRISPR gRNA sequence
gacataaaaaactaagagat

SEQ ID NO: 218945 - DNA, 20 bp, Artificial
  CRISPR gRNA sequence
acataaaaaactaagagatt

SEQ ID NO: 218946 - DNA, 20 bp, Artificial
  CRISPR gRNA sequence
agagattataagaaaatttc

SEQ ID NO: 218947 - DNA, 20 bp, Artificial
  CRISPR gRNA sequence
taagaaaatttccaaaagaa

SEQ ID NO: 218948 - DNA, 20 bp, Artificial
  CRISPR gRNA sequence
ccaaaagaagtctagacact

SEQ ID NO: 218949 - DNA, 20 bp, Artificial
  CRISPR gRNA sequence
caaaagaagtctagacacta

SEQ ID NO: 218950 - DNA, 20 bp, Artificial
  CRISPR gRNA sequence
gacactatcttgaaagtaaa

SEQ ID NO: 218951 - DNA, 20 bp, Artificial
  CRISPR gRNA sequence
tcttgaaagtaaaagttata

SEQ ID NO: 218952 - DNA, 20 bp, Artificial
  CRISPR gRNA sequence
gaaagtaaaagttataaaat

SEQ ID NO: 218953 - DNA, 20 bp, Artificial
  CRISPR gRNA sequence
aaagtaaaagttataaaatg

SEQ ID NO: 218954 - DNA, 20 bp, Artificial
  CRISPR gRNA sequence
taaaatgtcttgacagttgc

SEQ ID NO: 218955 - DNA, 20 bp, Artificial
  CRISPR gRNA sequence
gacagttgccactgccaccc

SEQ ID NO: 218956 - DNA, 20 bp, Artificial
  CRISPR gRNA sequence
acagttgccactgccacccc

SEQ ID NO: 218957 - DNA, 20 bp, Artificial
  CRISPR gRNA sequence
ccactgccacccctttcttc

SEQ ID NO: 218958 - DNA, 20 bp, Artificial
  CRISPR gRNA sequence
ccacccctttcttccccctt

SEQ ID NO: 218959 - DNA, 20 bp, Artificial
  CRISPR gRNA sequence
tcttcccccttttttccttt

SEQ ID NO: 218960 - DNA, 20 bp, Artificial
  CRISPR gRNA sequence
cttcccccttttttcctttc

SEQ ID NO: 218961 - DNA, 20 bp, Artificial
  CRISPR gRNA sequence
ttcccccttttttcctttca

SEQ ID NO: 218962 - DNA, 20 bp, Artificial
  CRISPR gRNA sequence
cccccttttttcctttcaga

SEQ ID NO: 218963 - DNA, 20 bp, Artificial
  CRISPR gRNA sequence
ccccttttttcctttcagac

SEQ ID NO: 218964 - DNA, 20 bp, Artificial
  CRISPR gRNA sequence
ttttcctttcagacaaaagt

SEQ ID NO: 218965 - DNA, 20 bp, Artificial
  CRISPR gRNA sequence
tttcctttcagacaaaagtt

SEQ ID NO: 218966 - DNA, 20 bp, Artificial
  CRISPR gRNA sequence
ttcctttcagacaaaagttg

SEQ ID NO: 218967 - DNA, 20 bp, Artificial
  CRISPR gRNA sequence
tcctttcagacaaaagttga

SEQ ID NO: 218968 - DNA, 20 bp, Artificial
  CRISPR gRNA sequence
cctttcagacaaaagttgag

SEQ ID NO: 218969 - DNA, 20 bp, Artificial
  CRISPR gRNA sequence
ctttcagacaaaagttgaga

SEQ ID NO: 218970 - DNA, 20 bp, Artificial
  CRISPR gRNA sequence
tcagacaaaagttgagaaca

SEQ ID NO: 218971 - DNA, 20 bp, Artificial
  CRISPR gRNA sequence
cagacaaaagttgagaacat

SEQ ID NO: 218972 - DNA, 20 bp, Artificial
  CRISPR gRNA sequence
agacaaaagttgagaacatt

SEQ ID NO: 218973 - DNA, 20 bp, Artificial
  CRISPR gRNA sequence
agaacatttctgaaatcact

SEQ ID NO: 218974 - DNA, 20 bp, Artificial
  CRISPR gRNA sequence
ctgaaatcactaagcatttc

SEQ ID NO: 218975 - DNA, 20 bp, Artificial
  CRISPR gRNA sequence
tgaaatcactaagcatttcc

SEQ ID NO: 218976 - DNA, 20 bp, Artificial
  CRISPR gRNA sequence
aaatcactaagcatttccag

SEQ ID NO: 218977 - DNA, 20 bp, Artificial
  CRISPR gRNA sequence
agcatttccagaatgccata

SEQ ID NO: 218978 - DNA, 20 bp, Artificial
  CRISPR gRNA sequence
ccagaatgccatacactgag

SEQ ID NO: 218979 - DNA, 20 bp, Artificial
  CRISPR gRNA sequence
cagaatgccatacactgaga

SEQ ID NO: 218980 - DNA, 20 bp, Artificial
  CRISPR gRNA sequence
agaaaagcgcttaaaacata

SEQ ID NO: 218981 - DNA, 20 bp, Artificial
  CRISPR gRNA sequence
aaaacatataatcaatcagt

SEQ ID NO: 218982 - DNA, 20 bp, Artificial
  CRISPR gRNA sequence
aaacatataatcaatcagtc

SEQ ID NO: 218983 - DNA, 20 bp, Artificial
  CRISPR gRNA sequence
ccttccatgtttatacacca

SEQ ID NO: 218984 - DNA, 20 bp, Artificial
  CRISPR gRNA sequence
ccatgtttatacaccaccat

SEQ ID NO: 218985 - DNA, 20 bp, Artificial
  CRISPR gRNA sequence
catgtttatacaccaccata

SEQ ID NO: 218986 - DNA, 20 bp, Artificial
  CRISPR gRNA sequence
atacaccaccatagatatag

SEQ ID NO: 218987 - DNA, 20 bp, Artificial
  CRISPR gRNA sequence
tacaccaccatagatataga

SEQ ID NO: 218988 - DNA, 20 bp, Artificial
  CRISPR gRNA sequence
aaactgctgagtaaaagtaa

SEQ ID NO: 218989 - DNA, 20 bp, Artificial
  CRISPR gRNA sequence
aactgctgagtaaaagtaaa

SEQ ID NO: 218990 - DNA, 20 bp, Artificial
  CRISPR gRNA sequence
ctgagtaaaagtaaaattca

SEQ ID NO: 218991 - DNA, 20 bp, Artificial
  CRISPR gRNA sequence
agtaaaagtaaaattcataa

SEQ ID NO: 218992 - DNA, 20 bp, Artificial
  CRISPR gRNA sequence
ataaaatatacaacagggca

SEQ ID NO: 218993 - DNA, 20 bp, Artificial
  CRISPR gRNA sequence
caatagtttactagcttttg

SEQ ID NO: 218994 - DNA, 20 bp, Artificial
  CRISPR gRNA sequence
actagcttttgtgtgtttaa

SEQ ID NO: 218995 - DNA, 20 bp, Artificial
  CRISPR gRNA sequence
ctagcttttgtgtgtttaaa

SEQ ID NO: 218996 - DNA, 20 bp, Artificial
  CRISPR gRNA sequence
gcttttgtgtgtttaaaggt

SEQ ID NO: 218997 - DNA, 20 bp, Artificial
  CRISPR gRNA sequence
ttgtgtgtttaaaggttgca

SEQ ID NO: 218998 - DNA, 20 bp, Artificial
  CRISPR gRNA sequence
tgtgtgtttaaaggttgcag

SEQ ID NO: 218999 - DNA, 20 bp, Artificial
  CRISPR gRNA sequence
gtgtgtttaaaggttgcaga

SEQ ID NO: 219000 - DNA, 20 bp, Artificial
  CRISPR gRNA sequence
tgtgtttaaaggttgcagaa

SEQ ID NO: 219001 - DNA, 20 bp, Artificial
  CRISPR gRNA sequence
aaaggttgcagaataaatta

SEQ ID NO: 219002 - DNA, 20 bp, Artificial
  CRISPR gRNA sequence
aaggttgcagaataaattaa

SEQ ID NO: 219003 - DNA, 20 bp, Artificial
  CRISPR gRNA sequence
cagaataaattaaataagca

SEQ ID NO: 219004 - DNA, 20 bp, Artificial
  CRISPR gRNA sequence
aataagcagtatttattcct

SEQ ID NO: 219005 - DNA, 20 bp, Artificial
  CRISPR gRNA sequence
attccttgcttatataaatg

SEQ ID NO: 219006 - DNA, 20 bp, Artificial
  CRISPR gRNA sequence
ttccttgcttatataaatgt

SEQ ID NO: 219007 - DNA, 20 bp, Artificial
  CRISPR gRNA sequence
cttgcttatataaatgttta

SEQ ID NO: 219008 - DNA, 20 bp, Artificial
  CRISPR gRNA sequence
gcttatataaatgtttactg

SEQ ID NO: 219009 - DNA, 20 bp, Artificial
  CRISPR gRNA sequence
cttatataaatgtttactgg

SEQ ID NO: 219010 - DNA, 20 bp, Artificial
  CRISPR gRNA sequence
atataaatgtttactggtct

SEQ ID NO: 219011 - DNA, 20 bp, Artificial
  CRISPR gRNA sequence
tataaatgtttactggtctt

SEQ ID NO: 219012 - DNA, 20 bp, Artificial
  CRISPR gRNA sequence
actggtcttcaggatgctac

SEQ ID NO: 219013 - DNA, 20 bp, Artificial
  CRISPR gRNA sequence
ctggtcttcaggatgctaca

SEQ ID NO: 219014 - DNA, 20 bp, Artificial
  CRISPR gRNA sequence
gtcttcaggatgctacaagg

SEQ ID NO: 219015 - DNA, 20 bp, Artificial
  CRISPR gRNA sequence
caggatgctacaaggaaaga

SEQ ID NO: 219016 - DNA, 20 bp, Artificial
  CRISPR gRNA sequence
aggatgctacaaggaaagaa

SEQ ID NO: 219017 - DNA, 20 bp, Artificial
  CRISPR gRNA sequence
caaggaaagaaggaataaat

SEQ ID NO: 219018 - DNA, 20 bp, Artificial
  CRISPR gRNA sequence
gtatttaaaaagcttaaaag

SEQ ID NO: 219019 - DNA, 20 bp, Artificial
  CRISPR gRNA sequence
tatttaaaaagcttaaaagt

SEQ ID NO: 219020 - DNA, 20 bp, Artificial
  CRISPR gRNA sequence
aaaaagcttaaaagtttaga

SEQ ID NO: 219021 - DNA, 20 bp, Artificial
  CRISPR gRNA sequence
aaaagcttaaaagtttagac

SEQ ID NO: 219022 - DNA, 20 bp, Artificial
  CRISPR gRNA sequence
aaaagtttagactgtcacct

SEQ ID NO: 219023 - DNA, 20 bp, Artificial
  CRISPR gRNA sequence
aaagtttagactgtcacctc

SEQ ID NO: 219024 - DNA, 20 bp, Artificial
  CRISPR gRNA sequence
agactgtcacctcagaactt

SEQ ID NO: 219025 - DNA, 20 bp, Artificial
  CRISPR gRNA sequence
gactgtcacctcagaacttc

SEQ ID NO: 219026 - DNA, 20 bp, Artificial
  CRISPR gRNA sequence
tcacctcagaacttcattaa

SEQ ID NO: 219027 - DNA, 20 bp, Artificial
  CRISPR gRNA sequence
agaacttcattaattttgta

SEQ ID NO: 219028 - DNA, 20 bp, Artificial
  CRISPR gRNA sequence
cattaattttgtaaattttc

SEQ ID NO: 219029 - DNA, 20 bp, Artificial
  CRISPR gRNA sequence
attaattttgtaaattttct

SEQ ID NO: 219030 - DNA, 20 bp, Artificial
  CRISPR gRNA sequence
attttgtaaattttctttac

SEQ ID NO: 219031 - DNA, 20 bp, Artificial
  CRISPR gRNA sequence
tgtaaattttctttaccaaa

SEQ ID NO: 219032 - DNA, 20 bp, Artificial
  CRISPR gRNA sequence
gtaaattttctttaccaaaa

SEQ ID NO: 219033 - DNA, 20 bp, Artificial
  CRISPR gRNA sequence
taaattttctttaccaaaat

SEQ ID NO: 219034 - DNA, 20 bp, Artificial
  CRISPR gRNA sequence
tctttaccaaaatatgaaaa

SEQ ID NO: 219035 - DNA, 20 bp, Artificial
  CRISPR gRNA sequence
ctttaccaaaatatgaaaat

SEQ ID NO: 219036 - DNA, 20 bp, Artificial
  CRISPR gRNA sequence
tttaccaaaatatgaaaata

SEQ ID NO: 219037 - DNA, 20 bp, Artificial
  CRISPR gRNA sequence
taccaaaatatgaaaatatg

SEQ ID NO: 219038 - DNA, 20 bp, Artificial
  CRISPR gRNA sequence
accaaaatatgaaaatatgg

SEQ ID NO: 219039 - DNA, 20 bp, Artificial
  CRISPR gRNA sequence
ccaaaatatgaaaatatggt

SEQ ID NO: 219040 - DNA, 20 bp, Artificial
  CRISPR gRNA sequence
attaaacattaaccgtaatg

SEQ ID NO: 219041 - DNA, 20 bp, Artificial
  CRISPR gRNA sequence
aacattaaccgtaatgcata

SEQ ID NO: 219042 - DNA, 20 bp, Artificial
  CRISPR gRNA sequence
accgtaatgcatattaccta

SEQ ID NO: 219043 - DNA, 20 bp, Artificial
  CRISPR gRNA sequence
cctatttgcctagtaatgac

SEQ ID NO: 219044 - DNA, 20 bp, Artificial
  CRISPR gRNA sequence
tttgcctagtaatgacaatt

SEQ ID NO: 219045 - DNA, 20 bp, Artificial
  CRISPR gRNA sequence
gcctagtaatgacaattctg

SEQ ID NO: 219046 - DNA, 20 bp, Artificial
  CRISPR gRNA sequence
cctagtaatgacaattctgt

SEQ ID NO: 219047 - DNA, 20 bp, Artificial
  CRISPR gRNA sequence
gtaatgacaattctgtgttg

SEQ ID NO: 219048 - DNA, 20 bp, Artificial
  CRISPR gRNA sequence
tgtgttgttgaagctaaatc

SEQ ID NO: 219049 - DNA, 20 bp, Artificial
  CRISPR gRNA sequence
tgttgttgaagctaaatcta

SEQ ID NO: 219050 - DNA, 20 bp, Artificial
  CRISPR gRNA sequence
ttgaagctaaatctaatgca

SEQ ID NO: 219051 - DNA, 20 bp, Artificial
  CRISPR gRNA sequence
aagctaaatctaatgcagca

SEQ ID NO: 219052 - DNA, 20 bp, Artificial
  CRISPR gRNA sequence
aatctaatgcagcatcaaga

SEQ ID NO: 219053 - DNA, 20 bp, Artificial
  CRISPR gRNA sequence
atgcagcatcaagatctgcc

SEQ ID NO: 219054 - DNA, 20 bp, Artificial
  CRISPR gRNA sequence
ccttcagaagtctggttacg

SEQ ID NO: 219055 - DNA, 20 bp, Artificial
  CRISPR gRNA sequence
cagaagtctggttacgttac

SEQ ID NO: 219056 - DNA, 20 bp, Artificial
  CRISPR gRNA sequence
agaagtctggttacgttact

SEQ ID NO: 219057 - DNA, 20 bp, Artificial
  CRISPR gRNA sequence
gttacgttactattatagga

SEQ ID NO: 219058 - DNA, 20 bp, Artificial
  CRISPR gRNA sequence
cgttactattataggaaagc

SEQ ID NO: 219059 - DNA, 20 bp, Artificial
  CRISPR gRNA sequence
ctattataggaaagcaagat

SEQ ID NO: 219060 - DNA, 20 bp, Artificial
  CRISPR gRNA sequence
ttataggaaagcaagatcaa

SEQ ID NO: 219061 - DNA, 20 bp, Artificial
  CRISPR gRNA sequence
taggaaagcaagatcaaaga

SEQ ID NO: 219062 - DNA, 20 bp, Artificial
  CRISPR gRNA sequence
actctctggtggctgcttct

SEQ ID NO: 219063 - DNA, 20 bp, Artificial
  CRISPR gRNA sequence
tctggtggctgcttctttag

SEQ ID NO: 219064 - DNA, 20 bp, Artificial
  CRISPR gRNA sequence
tggtggctgcttctttagag

SEQ ID NO: 219065 - DNA, 20 bp, Artificial
  CRISPR gRNA sequence
gtggctgcttctttagaggc

SEQ ID NO: 219066 - DNA, 20 bp, Artificial
  CRISPR gRNA sequence
cttctttagaggctgcagaa

SEQ ID NO: 219067 - DNA, 20 bp, Artificial
  CRISPR gRNA sequence
ctttagaggctgcagaactg

SEQ ID NO: 219068 - DNA, 20 bp, Artificial
  CRISPR gRNA sequence
tttagaggctgcagaactgc

SEQ ID NO: 219069 - DNA, 20 bp, Artificial
  CRISPR gRNA sequence
tagaggctgcagaactgcac

SEQ ID NO: 219070 - DNA, 20 bp, Artificial
  CRISPR gRNA sequence
agaggctgcagaactgcacg

SEQ ID NO: 219071 - DNA, 20 bp, Artificial
  CRISPR gRNA sequence
gaggctgcagaactgcacgc

SEQ ID NO: 219072 - DNA, 20 bp, Artificial
  CRISPR gRNA sequence
cagaactgcacgcagaggat

SEQ ID NO: 219073 - DNA, 20 bp, Artificial
  CRISPR gRNA sequence
cacgcagaggatgacaaaac

SEQ ID NO: 219074 - DNA, 20 bp, Artificial
  CRISPR gRNA sequence
cgactggacttttccaaggg

SEQ ID NO: 219075 - DNA, 20 bp, Artificial
  CRISPR gRNA sequence
gacttttccaagggtgaaca

SEQ ID NO: 219076 - DNA, 20 bp, Artificial
  CRISPR gRNA sequence
ttccaagggtgaacacgtgt

SEQ ID NO: 219077 - DNA, 20 bp, Artificial
  CRISPR gRNA sequence
tccaagggtgaacacgtgta

SEQ ID NO: 219078 - DNA, 20 bp, Artificial
  CRISPR gRNA sequence
ccaagggtgaacacgtgtac

SEQ ID NO: 219079 - DNA, 20 bp, Artificial
  CRISPR gRNA sequence
caagggtgaacacgtgtaca

SEQ ID NO: 219080 - DNA, 20 bp, Artificial
  CRISPR gRNA sequence
ggaaaataaaaagaggggaa

SEQ ID NO: 219081 - DNA, 20 bp, Artificial
  CRISPR gRNA sequence
aatgctccaaagtataacgt

SEQ ID NO: 219082 - DNA, 20 bp, Artificial
  CRISPR gRNA sequence
caaagtataacgtcctacct

SEQ ID NO: 219083 - DNA, 20 bp, Artificial
  CRISPR gRNA sequence
ccttaaaactaatgcaggct

SEQ ID NO: 219084 - DNA, 20 bp, Artificial
  CRISPR gRNA sequence
aaaactaatgcaggctgtca

SEQ ID NO: 219085 - DNA, 20 bp, Artificial
  CRISPR gRNA sequence
aaactaatgcaggctgtcac

SEQ ID NO: 219086 - DNA, 20 bp, Artificial
  CRISPR gRNA sequence
atgcaggctgtcaccacctg

SEQ ID NO: 219087 - DNA, 20 bp, Artificial
  CRISPR gRNA sequence
tcaccacctgtttacctaat

SEQ ID NO: 219088 - DNA, 20 bp, Artificial
  CRISPR gRNA sequence
tttacctaataacataatgt

SEQ ID NO: 219089 - DNA, 20 bp, Artificial
  CRISPR gRNA sequence
acctaataacataatgtgtg

SEQ ID NO: 219090 - DNA, 20 bp, Artificial
  CRISPR gRNA sequence
cctaataacataatgtgtgt

SEQ ID NO: 219091 - DNA, 20 bp, Artificial
  CRISPR gRNA sequence
ataacataatgtgtgtgtag

SEQ ID NO: 219092 - DNA, 20 bp, Artificial
  CRISPR gRNA sequence
tgtgaatattaaaatgtgac

SEQ ID NO: 219093 - DNA, 20 bp, Artificial
  CRISPR gRNA sequence
tgaatattaaaatgtgacat

SEQ ID NO: 219094 - DNA, 20 bp, Artificial
  CRISPR gRNA sequence
aaatgtgacatgagtttaag

SEQ ID NO: 219095 - DNA, 20 bp, Artificial
  CRISPR gRNA sequence
aaggtgttggtactaatatt

SEQ ID NO: 219096 - DNA, 20 bp, Artificial
  CRISPR gRNA sequence
aggtgttggtactaatattc

SEQ ID NO: 219097 - DNA, 20 bp, Artificial
  CRISPR gRNA sequence
gtactaatattcctactatt

SEQ ID NO: 219098 - DNA, 20 bp, Artificial
  CRISPR gRNA sequence
atattcctactattcattct

SEQ ID NO: 219099 - DNA, 20 bp, Artificial
  CRISPR gRNA sequence
ctactattcattcttaagag

SEQ ID NO: 219100 - DNA, 20 bp, Artificial
  CRISPR gRNA sequence
ctattcattcttaagagatt

SEQ ID NO: 219101 - DNA, 20 bp, Artificial
  CRISPR gRNA sequence
ttcattcttaagagattaaa

SEQ ID NO: 219102 - DNA, 20 bp, Artificial
  CRISPR gRNA sequence
attcttaagagattaaaaaa

SEQ ID NO: 219103 - DNA, 20 bp, Artificial
  CRISPR gRNA sequence
ttaagagattaaaaaaacac

SEQ ID NO: 219104 - DNA, 20 bp, Artificial
  CRISPR gRNA sequence
aagagattaaaaaaacacca

SEQ ID NO: 219105 - DNA, 20 bp, Artificial
  CRISPR gRNA sequence
agagattaaaaaaacaccaa

SEQ ID NO: 219106 - DNA, 20 bp, Artificial
  CRISPR gRNA sequence
aaaaaacaccaagtgaaaac

SEQ ID NO: 219107 - DNA, 20 bp, Artificial
  CRISPR gRNA sequence
cttaggaattaaaagtgaac

SEQ ID NO: 219108 - DNA, 20 bp, Artificial
  CRISPR gRNA sequence
ttaggaattaaaagtgaact

SEQ ID NO: 219109 - DNA, 20 bp, Artificial
  CRISPR gRNA sequence
aggaattaaaagtgaactgc

SEQ ID NO: 219110 - DNA, 20 bp, Artificial
  CRISPR gRNA sequence
ggaattaaaagtgaactgca

SEQ ID NO: 219111 - DNA, 20 bp, Artificial
  CRISPR gRNA sequence
aaagtgaactgcagcaaaat

SEQ ID NO: 219112 - DNA, 20 bp, Artificial
  CRISPR gRNA sequence
cagcaaaatgtgggcgacaa

SEQ ID NO: 219113 - DNA, 20 bp, Artificial
  CRISPR gRNA sequence
caaggagactagtagtattc

SEQ ID NO: 219114 - DNA, 20 bp, Artificial
  CRISPR gRNA sequence
aaggagactagtagtattca

SEQ ID NO: 219115 - DNA, 20 bp, Artificial
  CRISPR gRNA sequence
gtagtattcaaattacatac

SEQ ID NO: 219116 - DNA, 20 bp, Artificial
  CRISPR gRNA sequence
aaattacatactcatattta

SEQ ID NO: 219117 - DNA, 20 bp, Artificial
  CRISPR gRNA sequence
catactcatatttatcataa

SEQ ID NO: 219118 - DNA, 20 bp, Artificial
  CRISPR gRNA sequence
atatttatcataatagcact

SEQ ID NO: 219119 - DNA, 20 bp, Artificial
  CRISPR gRNA sequence
atcataatagcacttttcct

SEQ ID NO: 219120 - DNA, 20 bp, Artificial
  CRISPR gRNA sequence
tcataatagcacttttccta

SEQ ID NO: 219121 - DNA, 20 bp, Artificial
  CRISPR gRNA sequence
ttcctagtacaactttaaat

SEQ ID NO: 219122 - DNA, 20 bp, Artificial
  CRISPR gRNA sequence
tcctagtacaactttaaata

SEQ ID NO: 219123 - DNA, 20 bp, Artificial
  CRISPR gRNA sequence
cctagtacaactttaaatat

SEQ ID NO: 219124 - DNA, 20 bp, Artificial
  CRISPR gRNA sequence
ctagtacaactttaaatatt

SEQ ID NO: 219125 - DNA, 20 bp, Artificial
  CRISPR gRNA sequence
gtacaactttaaatatttcg

SEQ ID NO: 219126 - DNA, 20 bp, Artificial
  CRISPR gRNA sequence
taaatatttcgctgacaatg

SEQ ID NO: 219127 - DNA, 20 bp, Artificial
  CRISPR gRNA sequence
aaatatttcgctgacaatgt

SEQ ID NO: 219128 - DNA, 20 bp, Artificial
  CRISPR gRNA sequence
aatatttcgctgacaatgtc

SEQ ID NO: 219129 - DNA, 20 bp, Artificial
  CRISPR gRNA sequence
cgctgacaatgtctcgtaga

SEQ ID NO: 219130 - DNA, 20 bp, Artificial
  CRISPR gRNA sequence
gctgacaatgtctcgtagaa

SEQ ID NO: 219131 - DNA, 20 bp, Artificial
  CRISPR gRNA sequence
acaatgtctcgtagaaataa

SEQ ID NO: 219132 - DNA, 20 bp, Artificial
  CRISPR gRNA sequence
gtagaaataactatatcatc

SEQ ID NO: 219133 - DNA, 20 bp, Artificial
  CRISPR gRNA sequence
tatcatcactgaaacataaa

SEQ ID NO: 219134 - DNA, 20 bp, Artificial
  CRISPR gRNA sequence
aaacataaatgaaaagtaga

SEQ ID NO: 219135 - DNA, 20 bp, Artificial
  CRISPR gRNA sequence
acttttaataccaaactgtc

SEQ ID NO: 219136 - DNA, 20 bp, Artificial
  CRISPR gRNA sequence
cttttaataccaaactgtcc

SEQ ID NO: 219137 - DNA, 20 bp, Artificial
  CRISPR gRNA sequence
ttaataccaaactgtcccca

SEQ ID NO: 219138 - DNA, 20 bp, Artificial
  CRISPR gRNA sequence
taataccaaactgtccccag

SEQ ID NO: 219139 - DNA, 20 bp, Artificial
  CRISPR gRNA sequence
aataccaaactgtccccaga

SEQ ID NO: 219140 - DNA, 20 bp, Artificial
  CRISPR gRNA sequence
ataccaaactgtccccagaa

SEQ ID NO: 219141 - DNA, 20 bp, Artificial
  CRISPR gRNA sequence
tccccagaacaggagtatag

SEQ ID NO: 219142 - DNA, 20 bp, Artificial
  CRISPR gRNA sequence
ggaaaataacaataagaata

SEQ ID NO: 219143 - DNA, 20 bp, Artificial
  CRISPR gRNA sequence
tcatttggagaaaaccatga

SEQ ID NO: 219144 - DNA, 20 bp, Artificial
  CRISPR gRNA sequence
catttggagaaaaccatgaa

SEQ ID NO: 219145 - DNA, 20 bp, Artificial
  CRISPR gRNA sequence
atttggagaaaaccatgaaa

SEQ ID NO: 219146 - DNA, 20 bp, Artificial
  CRISPR gRNA sequence
ggagaaaaccatgaaactgg

SEQ ID NO: 219147 - DNA, 20 bp, Artificial
  CRISPR gRNA sequence
gagaaaaccatgaaactggg

SEQ ID NO: 219148 - DNA, 20 bp, Artificial
  CRISPR gRNA sequence
gggaagaagaaaacaaaagt

SEQ ID NO: 219149 - DNA, 20 bp, Artificial
  CRISPR gRNA sequence
atatttactataacacttta

SEQ ID NO: 219150 - DNA, 20 bp, Artificial
  CRISPR gRNA sequence
actataacactttaaattct

SEQ ID NO: 219151 - DNA, 20 bp, Artificial
  CRISPR gRNA sequence
ctataacactttaaattctg

SEQ ID NO: 219152 - DNA, 20 bp, Artificial
  CRISPR gRNA sequence
taacactttaaattctgcta

SEQ ID NO: 219153 - DNA, 20 bp, Artificial
  CRISPR gRNA sequence
taaattctgctaatggtcta

SEQ ID NO: 219154 - DNA, 20 bp, Artificial
  CRISPR gRNA sequence
aaattctgctaatggtctat

SEQ ID NO: 219155 - DNA, 20 bp, Artificial
  CRISPR gRNA sequence
aattctgctaatggtctata

SEQ ID NO: 219156 - DNA, 20 bp, Artificial
  CRISPR gRNA sequence
tgctaatggtctataataca

SEQ ID NO: 219157 - DNA, 20 bp, Artificial
  CRISPR gRNA sequence
ctaatggtctataatacatg

SEQ ID NO: 219158 - DNA, 20 bp, Artificial
  CRISPR gRNA sequence
atggtctataatacatgctt

SEQ ID NO: 219159 - DNA, 20 bp, Artificial
  CRISPR gRNA sequence
taatacatgctttattatag

SEQ ID NO: 219160 - DNA, 20 bp, Artificial
  CRISPR gRNA sequence
tattatagagatggaaaaaa

SEQ ID NO: 219161 - DNA, 20 bp, Artificial
  CRISPR gRNA sequence
attatagagatggaaaaaaa

SEQ ID NO: 219162 - DNA, 20 bp, Artificial
  CRISPR gRNA sequence
ttatagagatggaaaaaaat

SEQ ID NO: 219163 - DNA, 20 bp, Artificial
  CRISPR gRNA sequence
tagagatggaaaaaaattaa

SEQ ID NO: 219164 - DNA, 20 bp, Artificial
  CRISPR gRNA sequence
aaactgtggccttattttta

SEQ ID NO: 219165 - DNA, 20 bp, Artificial
  CRISPR gRNA sequence
tggccttatttttacatgta

SEQ ID NO: 219166 - DNA, 20 bp, Artificial
  CRISPR gRNA sequence
atttttacatgtatttattt

SEQ ID NO: 219167 - DNA, 20 bp, Artificial
  CRISPR gRNA sequence
tttttacatgtatttattta

SEQ ID NO: 219168 - DNA, 20 bp, Artificial
  CRISPR gRNA sequence
ttacatgtatttatttatac

SEQ ID NO: 219169 - DNA, 20 bp, Artificial
  CRISPR gRNA sequence
tacatgtatttatttataca

SEQ ID NO: 219170 - DNA, 20 bp, Artificial
  CRISPR gRNA sequence
acatgtatttatttatacat

SEQ ID NO: 219171 - DNA, 20 bp, Artificial
  CRISPR gRNA sequence
catgtatttatttatacata

SEQ ID NO: 219172 - DNA, 20 bp, Artificial
  CRISPR gRNA sequence
atttatacatacacacatat

SEQ ID NO: 219173 - DNA, 20 bp, Artificial
  CRISPR gRNA sequence
tttatacatacacacatata

SEQ ID NO: 219174 - DNA, 20 bp, Artificial
  CRISPR gRNA sequence
atacatacacacatatacat

SEQ ID NO: 219175 - DNA, 20 bp, Artificial
  CRISPR gRNA sequence
tacatacacacatatacata

SEQ ID NO: 219176 - DNA, 20 bp, Artificial
  CRISPR gRNA sequence
cacataatgtacttatgtaa

SEQ ID NO: 219177 - DNA, 20 bp, Artificial
  CRISPR gRNA sequence
atgtaaattttatttatgaa

SEQ ID NO: 219178 - DNA, 20 bp, Artificial
  CRISPR gRNA sequence
tgtaaattttatttatgaat

SEQ ID NO: 219179 - DNA, 20 bp, Artificial
  CRISPR gRNA sequence
tatttatgaataaaaactac

SEQ ID NO: 219180 - DNA, 20 bp, Artificial
  CRISPR gRNA sequence
atttatgaataaaaactaca

SEQ ID NO: 219181 - DNA, 20 bp, Artificial
  CRISPR gRNA sequence
tttatgaataaaaactacac

SEQ ID NO: 219182 - DNA, 20 bp, Artificial
  CRISPR gRNA sequence
atgaataaaaactacactta

SEQ ID NO: 219183 - DNA, 20 bp, Artificial
  CRISPR gRNA sequence
tgaataaaaactacacttac

SEQ ID NO: 219184 - DNA, 20 bp, Artificial
  CRISPR gRNA sequence
cacttacttaagcatttctc

SEQ ID NO: 219185 - DNA, 20 bp, Artificial
  CRISPR gRNA sequence
acttaagcatttctcacatt

SEQ ID NO: 219186 - DNA, 20 bp, Artificial
  CRISPR gRNA sequence
cttaagcatttctcacattt

SEQ ID NO: 219187 - DNA, 20 bp, Artificial
  CRISPR gRNA sequence
aagcatttctcacatttttc

SEQ ID NO: 219188 - DNA, 20 bp, Artificial
  CRISPR gRNA sequence
agcatttctcacatttttct

SEQ ID NO: 219189 - DNA, 20 bp, Artificial
  CRISPR gRNA sequence
ctcacatttttcttatgttt

SEQ ID NO: 219190 - DNA, 20 bp, Artificial
  CRISPR gRNA sequence
tcacatttttcttatgtttc

SEQ ID NO: 219191 - DNA, 20 bp, Artificial
  CRISPR gRNA sequence
acatttttcttatgtttcac

SEQ ID NO: 219192 - DNA, 20 bp, Artificial
  CRISPR gRNA sequence
ttcttatgtttcacgggagg

SEQ ID NO: 219193 - DNA, 20 bp, Artificial
  CRISPR gRNA sequence
tcttatgtttcacgggagga

SEQ ID NO: 219194 - DNA, 20 bp, Artificial
  CRISPR gRNA sequence
cttatgtttcacgggaggag

SEQ ID NO: 219195 - DNA, 20 bp, Artificial
  CRISPR gRNA sequence
ttatgtttcacgggaggagg

SEQ ID NO: 219196 - DNA, 20 bp, Artificial
  CRISPR gRNA sequence
atgtttcacgggaggaggta

SEQ ID NO: 219197 - DNA, 20 bp, Artificial
  CRISPR gRNA sequence
tgtttcacgggaggaggtag

SEQ ID NO: 219198 - DNA, 20 bp, Artificial
  CRISPR gRNA sequence
cacgggaggaggtagtgcag

SEQ ID NO: 219199 - DNA, 20 bp, Artificial
  CRISPR gRNA sequence
acgggaggaggtagtgcagt

SEQ ID NO: 219200 - DNA, 20 bp, Artificial
  CRISPR gRNA sequence
agaacaaggctctgtggcca

SEQ ID NO: 219201 - DNA, 20 bp, Artificial
  CRISPR gRNA sequence
tgtggccacactgccagggt

SEQ ID NO: 219202 - DNA, 20 bp, Artificial
  CRISPR gRNA sequence
tggccacactgccagggttt

SEQ ID NO: 219203 - DNA, 20 bp, Artificial
  CRISPR gRNA sequence
ccagggtttgaacccaactc

SEQ ID NO: 219204 - DNA, 20 bp, Artificial
  CRISPR gRNA sequence
gaacccaactctaacttaac

SEQ ID NO: 219205 - DNA, 20 bp, Artificial
  CRISPR gRNA sequence
aacccaactctaacttaaca

SEQ ID NO: 219206 - DNA, 20 bp, Artificial
  CRISPR gRNA sequence
taacttaacactctatggaa

SEQ ID NO: 219207 - DNA, 20 bp, Artificial
  CRISPR gRNA sequence
acttaacactctatggaacc

SEQ ID NO: 219208 - DNA, 20 bp, Artificial
  CRISPR gRNA sequence
aacactctatggaaccgtga

SEQ ID NO: 219209 - DNA, 20 bp, Artificial
  CRISPR gRNA sequence
acactctatggaaccgtgac

SEQ ID NO: 219210 - DNA, 20 bp, Artificial
  CRISPR gRNA sequence
tatggaaccgtgaccacgtg

SEQ ID NO: 219211 - DNA, 20 bp, Artificial
  CRISPR gRNA sequence
tggaaccgtgaccacgtgtc

SEQ ID NO: 219212 - DNA, 20 bp, Artificial
  CRISPR gRNA sequence
tttgttctttggtgtcctca

SEQ ID NO: 219213 - DNA, 20 bp, Artificial
  CRISPR gRNA sequence
tgttctttggtgtcctcaac

SEQ ID NO: 219214 - DNA, 20 bp, Artificial
  CRISPR gRNA sequence
gttctttggtgtcctcaact

SEQ ID NO: 219215 - DNA, 20 bp, Artificial
  CRISPR gRNA sequence
ttctttggtgtcctcaactg

SEQ ID NO: 219216 - DNA, 20 bp, Artificial
  CRISPR gRNA sequence
tttggtgtcctcaactgtta

SEQ ID NO: 219217 - DNA, 20 bp, Artificial
  CRISPR gRNA sequence
tggtgtcctcaactgttaca

SEQ ID NO: 219218 - DNA, 20 bp, Artificial
  CRISPR gRNA sequence
ggtgtcctcaactgttacac

SEQ ID NO: 219219 - DNA, 20 bp, Artificial
  CRISPR gRNA sequence
gtgtcctcaactgttacact

SEQ ID NO: 219220 - DNA, 20 bp, Artificial
  CRISPR gRNA sequence
aactgttacactagtataac

SEQ ID NO: 219221 - DNA, 20 bp, Artificial
  CRISPR gRNA sequence
ttacactagtataacacagt

SEQ ID NO: 219222 - DNA, 20 bp, Artificial
  CRISPR gRNA sequence
cactagtataacacagtaca

SEQ ID NO: 219223 - DNA, 20 bp, Artificial
  CRISPR gRNA sequence
gtataacacagtacatgtat

SEQ ID NO: 219224 - DNA, 20 bp, Artificial
  CRISPR gRNA sequence
gaaggactgttgtaactatt

SEQ ID NO: 219225 - DNA, 20 bp, Artificial
  CRISPR gRNA sequence
aaggactgttgtaactatta

SEQ ID NO: 219226 - DNA, 20 bp, Artificial
  CRISPR gRNA sequence
ttgtaactattaacaaagtt

SEQ ID NO: 219227 - DNA, 20 bp, Artificial
  CRISPR gRNA sequence
taactattaacaaagttaat

SEQ ID NO: 219228 - DNA, 20 bp, Artificial
  CRISPR gRNA sequence
ttaacaaagttaataaacta

SEQ ID NO: 219229 - DNA, 20 bp, Artificial
  CRISPR gRNA sequence
acaaagttaataaactacat

SEQ ID NO: 219230 - DNA, 20 bp, Artificial
  CRISPR gRNA sequence
ataaactacatgcaaagggc

SEQ ID NO: 219231 - DNA, 20 bp, Artificial
  CRISPR gRNA sequence
catgcaaagggcttaaaaca

SEQ ID NO: 219232 - DNA, 20 bp, Artificial
  CRISPR gRNA sequence
aaaacaaagcttagcactca

SEQ ID NO: 219233 - DNA, 20 bp, Artificial
  CRISPR gRNA sequence
aaacaaagcttagcactcac

SEQ ID NO: 219234 - DNA, 20 bp, Artificial
  CRISPR gRNA sequence
agcactcactaagtactcag

SEQ ID NO: 219235 - DNA, 20 bp, Artificial
  CRISPR gRNA sequence
gcactcactaagtactcagt

SEQ ID NO: 219236 - DNA, 20 bp, Artificial
  CRISPR gRNA sequence
actaagtactcagttaacta

SEQ ID NO: 219237 - DNA, 20 bp, Artificial
  CRISPR gRNA sequence
agtactcagttaactaaaat

SEQ ID NO: 219238 - DNA, 20 bp, Artificial
  CRISPR gRNA sequence
agttaactaaaataagtatg

SEQ ID NO: 219239 - DNA, 20 bp, Artificial
  CRISPR gRNA sequence
actaaaataagtatgtattc

SEQ ID NO: 219240 - DNA, 20 bp, Artificial
  CRISPR gRNA sequence
aaataagtatgtattcatgt

SEQ ID NO: 219241 - DNA, 20 bp, Artificial
  CRISPR gRNA sequence
atgtgttgagtggctgggtg

SEQ ID NO: 219242 - DNA, 20 bp, Artificial
  CRISPR gRNA sequence
agtggctgggtgtgtaaagt

SEQ ID NO: 219243 - DNA, 20 bp, Artificial
  CRISPR gRNA sequence
ggtgtgtaaagttccaagaa

SEQ ID NO: 219244 - DNA, 20 bp, Artificial
  CRISPR gRNA sequence
caagaatgtaccttcaagta

SEQ ID NO: 219245 - DNA, 20 bp, Artificial
  CRISPR gRNA sequence
caagtaacaatgaagtcttc

SEQ ID NO: 219246 - DNA, 20 bp, Artificial
  CRISPR gRNA sequence
aagtaacaatgaagtcttcc

SEQ ID NO: 219247 - DNA, 20 bp, Artificial
  CRISPR gRNA sequence
cctgtaaagacagactcagg

SEQ ID NO: 219248 - DNA, 20 bp, Artificial
  CRISPR gRNA sequence
ctgtaaagacagactcaggg

SEQ ID NO: 219249 - DNA, 20 bp, Artificial
  CRISPR gRNA sequence
taaagacagactcagggaac

SEQ ID NO: 219250 - DNA, 20 bp, Artificial
  CRISPR gRNA sequence
agggaacctaagcgaggaag

SEQ ID NO: 219251 - DNA, 20 bp, Artificial
  CRISPR gRNA sequence
agcgaggaagatgcaccact

SEQ ID NO: 219252 - DNA, 20 bp, Artificial
  CRISPR gRNA sequence
ggtactctcttctcattgtg

SEQ ID NO: 219253 - DNA, 20 bp, Artificial
  CRISPR gRNA sequence
tcttctcattgtggttaaaa

SEQ ID NO: 219254 - DNA, 20 bp, Artificial
  CRISPR gRNA sequence
ttctcattgtggttaaaatg

SEQ ID NO: 219255 - DNA, 20 bp, Artificial
  CRISPR gRNA sequence
ctcattgtggttaaaatgga

SEQ ID NO: 219256 - DNA, 20 bp, Artificial
  CRISPR gRNA sequence
tcattgtggttaaaatggag

SEQ ID NO: 219257 - DNA, 20 bp, Artificial
  CRISPR gRNA sequence
attgtggttaaaatggagag

SEQ ID NO: 219258 - DNA, 20 bp, Artificial
  CRISPR gRNA sequence
tggttaaaatggagagagat

SEQ ID NO: 219259 - DNA, 20 bp, Artificial
  CRISPR gRNA sequence
aaatggagagagatgtgccc

SEQ ID NO: 219260 - DNA, 20 bp, Artificial
  CRISPR gRNA sequence
gtcttttcccaaactcactc

SEQ ID NO: 219261 - DNA, 20 bp, Artificial
  CRISPR gRNA sequence
ttcccaaactcactctgcaa

SEQ ID NO: 219262 - DNA, 20 bp, Artificial
  CRISPR gRNA sequence
tcccaaactcactctgcaat

SEQ ID NO: 219263 - DNA, 20 bp, Artificial
  CRISPR gRNA sequence
cccaaactcactctgcaatt

SEQ ID NO: 219264 - DNA, 20 bp, Artificial
  CRISPR gRNA sequence
ccaaactcactctgcaatta

SEQ ID NO: 219265 - DNA, 20 bp, Artificial
  CRISPR gRNA sequence
actctgcaattatccatgca

SEQ ID NO: 219266 - DNA, 20 bp, Artificial
  CRISPR gRNA sequence
tgcaattatccatgcataat

SEQ ID NO: 219267 - DNA, 20 bp, Artificial
  CRISPR gRNA sequence
caattatccatgcataatta

SEQ ID NO: 219268 - DNA, 20 bp, Artificial
  CRISPR gRNA sequence
tccatgcataattaggcttc

SEQ ID NO: 219269 - DNA, 20 bp, Artificial
  CRISPR gRNA sequence
ggcttcagaaggactgttta

SEQ ID NO: 219270 - DNA, 20 bp, Artificial
  CRISPR gRNA sequence
cagaaggactgtttatatgt

SEQ ID NO: 219271 - DNA, 20 bp, Artificial
  CRISPR gRNA sequence
agaaggactgtttatatgta

SEQ ID NO: 219272 - DNA, 20 bp, Artificial
  CRISPR gRNA sequence
tttatatgtaaagtaagatg

SEQ ID NO: 219273 - DNA, 20 bp, Artificial
  CRISPR gRNA sequence
atatgtaaagtaagatgagt

SEQ ID NO: 219274 - DNA, 20 bp, Artificial
  CRISPR gRNA sequence
tatgtaaagtaagatgagtg

SEQ ID NO: 219275 - DNA, 20 bp, Artificial
  CRISPR gRNA sequence
taggatattaacgaagctgt

SEQ ID NO: 219276 - DNA, 20 bp, Artificial
  CRISPR gRNA sequence
aggatattaacgaagctgtt

SEQ ID NO: 219277 - DNA, 20 bp, Artificial
  CRISPR gRNA sequence
ggatattaacgaagctgtta

SEQ ID NO: 219278 - DNA, 20 bp, Artificial
  CRISPR gRNA sequence
acgaagctgttattaagttg

SEQ ID NO: 219279 - DNA, 20 bp, Artificial
  CRISPR gRNA sequence
ttattaagttggtcacatgt

SEQ ID NO: 219280 - DNA, 20 bp, Artificial
  CRISPR gRNA sequence
ttaagttggtcacatgttac

SEQ ID NO: 219281 - DNA, 20 bp, Artificial
  CRISPR gRNA sequence
agttggtcacatgttacttt

SEQ ID NO: 219282 - DNA, 20 bp, Artificial
  CRISPR gRNA sequence
gtcacatgttacttttatca

SEQ ID NO: 219283 - DNA, 20 bp, Artificial
  CRISPR gRNA sequence
cttttatcataaaaatatat

SEQ ID NO: 219284 - DNA, 20 bp, Artificial
  CRISPR gRNA sequence
ttatcataaaaatatatcca

SEQ ID NO: 219285 - DNA, 20 bp, Artificial
  CRISPR gRNA sequence
tatcataaaaatatatccac

SEQ ID NO: 219286 - DNA, 20 bp, Artificial
  CRISPR gRNA sequence
atcataaaaatatatccaca

SEQ ID NO: 219287 - DNA, 20 bp, Artificial
  CRISPR gRNA sequence
tcataaaaatatatccacat

SEQ ID NO: 219288 - DNA, 20 bp, Artificial
  CRISPR gRNA sequence
tataaaggaaattaagatat

SEQ ID NO: 219289 - DNA, 20 bp, Artificial
  CRISPR gRNA sequence
agatattaagacttcaaata

SEQ ID NO: 219290 - DNA, 20 bp, Artificial
  CRISPR gRNA sequence
agacttcaaataagatttgt

SEQ ID NO: 219291 - DNA, 20 bp, Artificial
  CRISPR gRNA sequence
caaataagatttgtgagaac

SEQ ID NO: 219292 - DNA, 20 bp, Artificial
  CRISPR gRNA sequence
aaataagatttgtgagaact

SEQ ID NO: 219293 - DNA, 20 bp, Artificial
  CRISPR gRNA sequence
gtgagaacttttaaaaatta

SEQ ID NO: 219294 - DNA, 20 bp, Artificial
  CRISPR gRNA sequence
tgagaacttttaaaaattaa

SEQ ID NO: 219295 - DNA, 20 bp, Artificial
  CRISPR gRNA sequence
ttaaaaattaagtttaattg

SEQ ID NO: 219296 - DNA, 20 bp, Artificial
  CRISPR gRNA sequence
taaaaattaagtttaattgc

SEQ ID NO: 219297 - DNA, 20 bp, Artificial
  CRISPR gRNA sequence
aaaaattaagtttaattgca

SEQ ID NO: 219298 - DNA, 20 bp, Artificial
  CRISPR gRNA sequence
aaaattaagtttaattgcat

SEQ ID NO: 219299 - DNA, 20 bp, Artificial
  CRISPR gRNA sequence
agtttaattgcatcttataa

SEQ ID NO: 219300 - DNA, 20 bp, Artificial
  CRISPR gRNA sequence
aattgcatcttataaacccc

SEQ ID NO: 219301 - DNA, 20 bp, Artificial
  CRISPR gRNA sequence
attgcatcttataaacccct

SEQ ID NO: 219302 - DNA, 20 bp, Artificial
  CRISPR gRNA sequence
catcttataaacccctaaga

SEQ ID NO: 219303 - DNA, 20 bp, Artificial
  CRISPR gRNA sequence
ataaacccctaagaccataa

SEQ ID NO: 219304 - DNA, 20 bp, Artificial
  CRISPR gRNA sequence
taaacccctaagaccataat

SEQ ID NO: 219305 - DNA, 20 bp, Artificial
  CRISPR gRNA sequence
agaccataattttagctgtg

SEQ ID NO: 219306 - DNA, 20 bp, Artificial
  CRISPR gRNA sequence
tagctgtgaagtttctgctc

SEQ ID NO: 219307 - DNA, 20 bp, Artificial
  CRISPR gRNA sequence
agctgtgaagtttctgctct

SEQ ID NO: 219308 - DNA, 20 bp, Artificial
  CRISPR gRNA sequence
gctgtgaagtttctgctcta

SEQ ID NO: 219309 - DNA, 20 bp, Artificial
  CRISPR gRNA sequence
tgaagtttctgctctaacaa

SEQ ID NO: 219310 - DNA, 20 bp, Artificial
  CRISPR gRNA sequence
ctgctctaacaataaagcca

SEQ ID NO: 219311 - DNA, 20 bp, Artificial
  CRISPR gRNA sequence
tgctctaacaataaagccaa

SEQ ID NO: 219312 - DNA, 20 bp, Artificial
  CRISPR gRNA sequence
ctctaacaataaagccaagt

SEQ ID NO: 219313 - DNA, 20 bp, Artificial
  CRISPR gRNA sequence
taacaataaagccaagtaaa

SEQ ID NO: 219314 - DNA, 20 bp, Artificial
  CRISPR gRNA sequence
acaataaagccaagtaaatg

SEQ ID NO: 219315 - DNA, 20 bp, Artificial
  CRISPR gRNA sequence
aaagtattccggagtttgcc

SEQ ID NO: 219316 - DNA, 20 bp, Artificial
  CRISPR gRNA sequence
cggagtttgcctgtacaagg

SEQ ID NO: 219317 - DNA, 20 bp, Artificial
  CRISPR gRNA sequence
gcctgtacaaggggctgtgt

SEQ ID NO: 219318 - DNA, 20 bp, Artificial
  CRISPR gRNA sequence
cctgtacaaggggctgtgtg

SEQ ID NO: 219319 - DNA, 20 bp, Artificial
  CRISPR gRNA sequence
tacaaggggctgtgtgattg

SEQ ID NO: 219320 - DNA, 20 bp, Artificial
  CRISPR gRNA sequence
tgtgattggaagagttcttc

SEQ ID NO: 219321 - DNA, 20 bp, Artificial
  CRISPR gRNA sequence
gaagagttcttctgaatact

SEQ ID NO: 219322 - DNA, 20 bp, Artificial
  CRISPR gRNA sequence
ttctgaatactgccctaagc

SEQ ID NO: 219323 - DNA, 20 bp, Artificial
  CRISPR gRNA sequence
ctgaatactgccctaagcaa

SEQ ID NO: 219324 - DNA, 20 bp, Artificial
  CRISPR gRNA sequence
tgaatactgccctaagcaag

SEQ ID NO: 219325 - DNA, 20 bp, Artificial
  CRISPR gRNA sequence
aatactgccctaagcaagca

SEQ ID NO: 219326 - DNA, 20 bp, Artificial
  CRISPR gRNA sequence
ccctaagcaagcactagcat

SEQ ID NO: 219327 - DNA, 20 bp, Artificial
  CRISPR gRNA sequence
agcaagcactagcattcctc

SEQ ID NO: 219328 - DNA, 20 bp, Artificial
  CRISPR gRNA sequence
gcattcctctgaaatcaaca

SEQ ID NO: 219329 - DNA, 20 bp, Artificial
  CRISPR gRNA sequence
ctctgaaatcaacacttctt

SEQ ID NO: 219330 - DNA, 20 bp, Artificial
  CRISPR gRNA sequence
tgaaatcaacacttctttca

SEQ ID NO: 219331 - DNA, 20 bp, Artificial
  CRISPR gRNA sequence
aaatcaacacttctttcaaa

SEQ ID NO: 219332 - DNA, 20 bp, Artificial
  CRISPR gRNA sequence
ctttcaaattctaccacgca

SEQ ID NO: 219333 - DNA, 20 bp, Artificial
  CRISPR gRNA sequence
tttcaaattctaccacgcac

SEQ ID NO: 219334 - DNA, 20 bp, Artificial
  CRISPR gRNA sequence
tcaaattctaccacgcacta

SEQ ID NO: 219335 - DNA, 20 bp, Artificial
  CRISPR gRNA sequence
caaattctaccacgcactat

SEQ ID NO: 219336 - DNA, 20 bp, Artificial
  CRISPR gRNA sequence
aaattctaccacgcactatc

SEQ ID NO: 219337 - DNA, 20 bp, Artificial
  CRISPR gRNA sequence
taccacgcactatctctcag

SEQ ID NO: 219338 - DNA, 20 bp, Artificial
  CRISPR gRNA sequence
ccacgcactatctctcaggt

SEQ ID NO: 219339 - DNA, 20 bp, Artificial
  CRISPR gRNA sequence
tctctcaggtcacaggtgag

SEQ ID NO: 219340 - DNA, 20 bp, Artificial
  CRISPR gRNA sequence
tcaggtcacaggtgaggaat

SEQ ID NO: 219341 - DNA, 20 bp, Artificial
  CRISPR gRNA sequence
aggtcacaggtgaggaattt

SEQ ID NO: 219342 - DNA, 20 bp, Artificial
  CRISPR gRNA sequence
tccagcctttcactccataa

SEQ ID NO: 219343 - DNA, 20 bp, Artificial
  CRISPR gRNA sequence
ccagcctttcactccataat

SEQ ID NO: 219344 - DNA, 20 bp, Artificial
  CRISPR gRNA sequence
cagcctttcactccataatg

SEQ ID NO: 219345 - DNA, 20 bp, Artificial
  CRISPR gRNA sequence
tcactccataatgatagcca

SEQ ID NO: 219346 - DNA, 20 bp, Artificial
  CRISPR gRNA sequence
cactccataatgatagccac

SEQ ID NO: 219347 - DNA, 20 bp, Artificial
  CRISPR gRNA sequence
actccataatgatagccaca

SEQ ID NO: 219348 - DNA, 20 bp, Artificial
  CRISPR gRNA sequence
cataatgatagccacatatt

SEQ ID NO: 219349 - DNA, 20 bp, Artificial
  CRISPR gRNA sequence
cttgtgttaagcttataatg

SEQ ID NO: 219350 - DNA, 20 bp, Artificial
  CRISPR gRNA sequence
ttgtgttaagcttataatgc

SEQ ID NO: 219351 - DNA, 20 bp, Artificial
  CRISPR gRNA sequence
gtgttaagcttataatgcta

SEQ ID NO: 219352 - DNA, 20 bp, Artificial
  CRISPR gRNA sequence
tgttaagcttataatgctat

SEQ ID NO: 219353 - DNA, 20 bp, Artificial
  CRISPR gRNA sequence
agcttataatgctataataa

SEQ ID NO: 219354 - DNA, 20 bp, Artificial
  CRISPR gRNA sequence
ataatgctataataagtcct

SEQ ID NO: 219355 - DNA, 20 bp, Artificial
  CRISPR gRNA sequence
taatgctataataagtcctg

SEQ ID NO: 219356 - DNA, 20 bp, Artificial
  CRISPR gRNA sequence
taataagtcctggtaaaatg

SEQ ID NO: 219357 - DNA, 20 bp, Artificial
  CRISPR gRNA sequence
gtaaaatgcttacatcaatc

SEQ ID NO: 219358 - DNA, 20 bp, Artificial
  CRISPR gRNA sequence
acatcaatccccagaatata

SEQ ID NO: 219359 - DNA, 20 bp, Artificial
  CRISPR gRNA sequence
catcaatccccagaatataa

SEQ ID NO: 219360 - DNA, 20 bp, Artificial
  CRISPR gRNA sequence
tgttttatagatattagctt

SEQ ID NO: 219361 - DNA, 20 bp, Artificial
  CRISPR gRNA sequence
ttttatagatattagctttt

SEQ ID NO: 219362 - DNA, 20 bp, Artificial
  CRISPR gRNA sequence
tatagatattagcttttcag

SEQ ID NO: 219363 - DNA, 20 bp, Artificial
  CRISPR gRNA sequence
atagatattagcttttcaga

SEQ ID NO: 219364 - DNA, 20 bp, Artificial
  CRISPR gRNA sequence
tagatattagcttttcagaa

SEQ ID NO: 219365 - DNA, 20 bp, Artificial
  CRISPR gRNA sequence
gcttttcagaatctagcatt

SEQ ID NO: 219366 - DNA, 20 bp, Artificial
  CRISPR gRNA sequence
ttcagaatctagcattttcc

SEQ ID NO: 219367 - DNA, 20 bp, Artificial
  CRISPR gRNA sequence
tcagaatctagcattttcct

SEQ ID NO: 219368 - DNA, 20 bp, Artificial
  CRISPR gRNA sequence
cagaatctagcattttcctc

SEQ ID NO: 219369 - DNA, 20 bp, Artificial
  CRISPR gRNA sequence
agaatctagcattttcctct

SEQ ID NO: 219370 - DNA, 20 bp, Artificial
  CRISPR gRNA sequence
gcattttcctctatatgtag

SEQ ID NO: 219371 - DNA, 20 bp, Artificial
  CRISPR gRNA sequence
tcctctatatgtagtagaga

SEQ ID NO: 219372 - DNA, 20 bp, Artificial
  CRISPR gRNA sequence
cctctatatgtagtagagac

SEQ ID NO: 219373 - DNA, 20 bp, Artificial
  CRISPR gRNA sequence
ctctatatgtagtagagact

SEQ ID NO: 219374 - DNA, 20 bp, Artificial
  CRISPR gRNA sequence
tatatgtagtagagactcca

SEQ ID NO: 219375 - DNA, 20 bp, Artificial
  CRISPR gRNA sequence
tatgtagtagagactccata

SEQ ID NO: 219376 - DNA, 20 bp, Artificial
  CRISPR gRNA sequence
catatgtttgctgttgaggg

SEQ ID NO: 219377 - DNA, 20 bp, Artificial
  CRISPR gRNA sequence
gctgttgagggttgcaatgg

SEQ ID NO: 219378 - DNA, 20 bp, Artificial
  CRISPR gRNA sequence
ctgttgagggttgcaatggt

SEQ ID NO: 219379 - DNA, 20 bp, Artificial
  CRISPR gRNA sequence
ttgagggttgcaatggtcat

SEQ ID NO: 219380 - DNA, 20 bp, Artificial
  CRISPR gRNA sequence
agggttgcaatggtcataag

SEQ ID NO: 219381 - DNA, 20 bp, Artificial
  CRISPR gRNA sequence
caatggtcataagacagttt

SEQ ID NO: 219382 - DNA, 20 bp, Artificial
  CRISPR gRNA sequence
tgcgagtgaatggaagactt

SEQ ID NO: 219383 - DNA, 20 bp, Artificial
  CRISPR gRNA sequence
gcgagtgaatggaagacttt

SEQ ID NO: 219384 - DNA, 20 bp, Artificial
  CRISPR gRNA sequence
cgagtgaatggaagactttt

SEQ ID NO: 219385 - DNA, 20 bp, Artificial
  CRISPR gRNA sequence
ttttttatgcttctttggtt

SEQ ID NO: 219386 - DNA, 20 bp, Artificial
  CRISPR gRNA sequence
tttttatgcttctttggttg

SEQ ID NO: 219387 - DNA, 20 bp, Artificial
  CRISPR gRNA sequence
ttttatgcttctttggttgt

SEQ ID NO: 219388 - DNA, 20 bp, Artificial
  CRISPR gRNA sequence
tttatgcttctttggttgtg

SEQ ID NO: 219389 - DNA, 20 bp, Artificial
  CRISPR gRNA sequence
ttatgcttctttggttgtgg

SEQ ID NO: 219390 - DNA, 20 bp, Artificial
  CRISPR gRNA sequence
tatgcttctttggttgtgga

SEQ ID NO: 219391 - DNA, 20 bp, Artificial
  CRISPR gRNA sequence
atgcttctttggttgtggat

SEQ ID NO: 219392 - DNA, 20 bp, Artificial
  CRISPR gRNA sequence
tgcttctttggttgtggatc

SEQ ID NO: 219393 - DNA, 20 bp, Artificial
  CRISPR gRNA sequence
ctttggttgtggatctctac

SEQ ID NO: 219394 - DNA, 20 bp, Artificial
  CRISPR gRNA sequence
tttggttgtggatctctact

SEQ ID NO: 219395 - DNA, 20 bp, Artificial
  CRISPR gRNA sequence
tggttgtggatctctactga

SEQ ID NO: 219396 - DNA, 20 bp, Artificial
  CRISPR gRNA sequence
ggttgtggatctctactgag

SEQ ID NO: 219397 - DNA, 20 bp, Artificial
  CRISPR gRNA sequence
gttgtggatctctactgaga

SEQ ID NO: 219398 - DNA, 20 bp, Artificial
  CRISPR gRNA sequence
tggatctctactgagagatg

SEQ ID NO: 219399 - DNA, 20 bp, Artificial
  CRISPR gRNA sequence
tactgagagatgtttttgga

SEQ ID NO: 219400 - DNA, 20 bp, Artificial
  CRISPR gRNA sequence
ctgagagatgtttttggata

SEQ ID NO: 219401 - DNA, 20 bp, Artificial
  CRISPR gRNA sequence
agagatgtttttggatactc

SEQ ID NO: 219402 - DNA, 20 bp, Artificial
  CRISPR gRNA sequence
ttggatactccaaatcaata

SEQ ID NO: 219403 - DNA, 20 bp, Artificial
  CRISPR gRNA sequence
tggatactccaaatcaatac

SEQ ID NO: 219404 - DNA, 20 bp, Artificial
  CRISPR gRNA sequence
ggatactccaaatcaatacc

SEQ ID NO: 219405 - DNA, 20 bp, Artificial
  CRISPR gRNA sequence
gatactccaaatcaatacct

SEQ ID NO: 219406 - DNA, 20 bp, Artificial
  CRISPR gRNA sequence
caaatcaatacctttatttc

SEQ ID NO: 219407 - DNA, 20 bp, Artificial
  CRISPR gRNA sequence
tatttccaactgtataactg

SEQ ID NO: 219408 - DNA, 20 bp, Artificial
  CRISPR gRNA sequence
atttccaactgtataactga

SEQ ID NO: 219409 - DNA, 20 bp, Artificial
  CRISPR gRNA sequence
tttccaactgtataactgaa

SEQ ID NO: 219410 - DNA, 20 bp, Artificial
  CRISPR gRNA sequence
ccaactgtataactgaatat

SEQ ID NO: 219411 - DNA, 20 bp, Artificial
  CRISPR gRNA sequence
caactgtataactgaatatc

SEQ ID NO: 219412 - DNA, 20 bp, Artificial
  CRISPR gRNA sequence
tataactgaatatcttctta

SEQ ID NO: 219413 - DNA, 20 bp, Artificial
  CRISPR gRNA sequence
aatatcttcttatgccaaag

SEQ ID NO: 219414 - DNA, 20 bp, Artificial
  CRISPR gRNA sequence
cttatgccaaagaaaagtca

SEQ ID NO: 219415 - DNA, 20 bp, Artificial
  CRISPR gRNA sequence
ttatgccaaagaaaagtcac

SEQ ID NO: 219416 - DNA, 20 bp, Artificial
  CRISPR gRNA sequence
atgccaaagaaaagtcactt

SEQ ID NO: 219417 - DNA, 20 bp, Artificial
  CRISPR gRNA sequence
tgccaaagaaaagtcacttc

SEQ ID NO: 219418 - DNA, 20 bp, Artificial
  CRISPR gRNA sequence
cagtatagcctaaaacccta

SEQ ID NO: 219419 - DNA, 20 bp, Artificial
  CRISPR gRNA sequence
agtatagcctaaaaccctac

SEQ ID NO: 219420 - DNA, 20 bp, Artificial
  CRISPR gRNA sequence
aaaccctaccaggaaaaaat

SEQ ID NO: 219421 - DNA, 20 bp, Artificial
  CRISPR gRNA sequence
ccaggaaaaaattttggaga

SEQ ID NO: 219422 - DNA, 20 bp, Artificial
  CRISPR gRNA sequence
tggagatcatgcttggattt

SEQ ID NO: 219423 - DNA, 20 bp, Artificial
  CRISPR gRNA sequence
ggagatcatgcttggatttt

SEQ ID NO: 219424 - DNA, 20 bp, Artificial
  CRISPR gRNA sequence
gagatcatgcttggattttt

SEQ ID NO: 219425 - DNA, 20 bp, Artificial
  CRISPR gRNA sequence
ggatttttgtatctaatccc

SEQ ID NO: 219426 - DNA, 20 bp, Artificial
  CRISPR gRNA sequence
gatttttgtatctaatcccc

SEQ ID NO: 219427 - DNA, 20 bp, Artificial
  CRISPR gRNA sequence
ttgtatctaatccccaatgg

SEQ ID NO: 219428 - DNA, 20 bp, Artificial
  CRISPR gRNA sequence
tgtatctaatccccaatgga

SEQ ID NO: 219429 - DNA, 20 bp, Artificial
  CRISPR gRNA sequence
gtatctaatccccaatggat

SEQ ID NO: 219430 - DNA, 20 bp, Artificial
  CRISPR gRNA sequence
tatctaatccccaatggatt

SEQ ID NO: 219431 - DNA, 20 bp, Artificial
  CRISPR gRNA sequence
atccccaatggatttggtaa

SEQ ID NO: 219432 - DNA, 20 bp, Artificial
  CRISPR gRNA sequence
ggtaaggctgtatggtctaa

SEQ ID NO: 219433 - DNA, 20 bp, Artificial
  CRISPR gRNA sequence
gtaaggctgtatggtctaat

SEQ ID NO: 219434 - DNA, 20 bp, Artificial
  CRISPR gRNA sequence
tatggtctaatagccatgct

SEQ ID NO: 219435 - DNA, 20 bp, Artificial
  CRISPR gRNA sequence
atagccatgcttaattgatg

SEQ ID NO: 219436 - DNA, 20 bp, Artificial
  CRISPR gRNA sequence
aattgatgtatttttcctta

SEQ ID NO: 219437 - DNA, 20 bp, Artificial
  CRISPR gRNA sequence
attgatgtatttttccttac

SEQ ID NO: 219438 - DNA, 20 bp, Artificial
  CRISPR gRNA sequence
atgtatttttccttacttcc

SEQ ID NO: 219439 - DNA, 20 bp, Artificial
  CRISPR gRNA sequence
ttccttacttcccctgtgct

SEQ ID NO: 219440 - DNA, 20 bp, Artificial
  CRISPR gRNA sequence
tccttacttcccctgtgctt

SEQ ID NO: 219441 - DNA, 20 bp, Artificial
  CRISPR gRNA sequence
ccttacttcccctgtgcttt

SEQ ID NO: 219442 - DNA, 20 bp, Artificial
  CRISPR gRNA sequence
cttacttcccctgtgctttt

SEQ ID NO: 219443 - DNA, 20 bp, Artificial
  CRISPR gRNA sequence
acttcccctgtgcttttgtt

SEQ ID NO: 219444 - DNA, 20 bp, Artificial
  CRISPR gRNA sequence
cttcccctgtgcttttgttt

SEQ ID NO: 219445 - DNA, 20 bp, Artificial
  CRISPR gRNA sequence
cccctgtgcttttgttttta

SEQ ID NO: 219446 - DNA, 20 bp, Artificial
  CRISPR gRNA sequence
ccctgtgcttttgtttttaa

SEQ ID NO: 219447 - DNA, 20 bp, Artificial
  CRISPR gRNA sequence
tgcttttgtttttaattgtg

SEQ ID NO: 219448 - DNA, 20 bp, Artificial
  CRISPR gRNA sequence
ttgtttttaattgtgtacct

SEQ ID NO: 219449 - DNA, 20 bp, Artificial
  CRISPR gRNA sequence
tgtttttaattgtgtacctc

SEQ ID NO: 219450 - DNA, 20 bp, Artificial
  CRISPR gRNA sequence
gtttttaattgtgtacctca

SEQ ID NO: 219451 - DNA, 20 bp, Artificial
  CRISPR gRNA sequence
tttttaattgtgtacctcaa

SEQ ID NO: 219452 - DNA, 20 bp, Artificial
  CRISPR gRNA sequence
ttaattgtgtacctcaactc

SEQ ID NO: 219453 - DNA, 20 bp, Artificial
  CRISPR gRNA sequence
taattgtgtacctcaactcc

SEQ ID NO: 219454 - DNA, 20 bp, Artificial
  CRISPR gRNA sequence
aattgtgtacctcaactcct

SEQ ID NO: 219455 - DNA, 20 bp, Artificial
  CRISPR gRNA sequence
attgtgtacctcaactcctc

SEQ ID NO: 219456 - DNA, 20 bp, Artificial
  CRISPR gRNA sequence
tgtacctcaactcctcaaat

SEQ ID NO: 219457 - DNA, 20 bp, Artificial
  CRISPR gRNA sequence
aactcctcaaatcctcacaa

SEQ ID NO: 219458 - DNA, 20 bp, Artificial
  CRISPR gRNA sequence
ctcaaatcctcacaattatg

SEQ ID NO: 219459 - DNA, 20 bp, Artificial
  CRISPR gRNA sequence
aaatcctcacaattatgatg

SEQ ID NO: 219460 - DNA, 20 bp, Artificial
  CRISPR gRNA sequence
acaattatgatgtgagaaat

SEQ ID NO: 219461 - DNA, 20 bp, Artificial
  CRISPR gRNA sequence
tgatgtgagaaattattaac

SEQ ID NO: 219462 - DNA, 20 bp, Artificial
  CRISPR gRNA sequence
ttaacccctccttatagttg

SEQ ID NO: 219463 - DNA, 20 bp, Artificial
  CRISPR gRNA sequence
acccctccttatagttgtag

SEQ ID NO: 219464 - DNA, 20 bp, Artificial
  CRISPR gRNA sequence
cttatagttgtagaaactga

SEQ ID NO: 219465 - DNA, 20 bp, Artificial
  CRISPR gRNA sequence
atagttgtagaaactgagga

SEQ ID NO: 219466 - DNA, 20 bp, Artificial
  CRISPR gRNA sequence
tagttgtagaaactgaggaa

SEQ ID NO: 219467 - DNA, 20 bp, Artificial
  CRISPR gRNA sequence
tagaaactgaggaacagtga

SEQ ID NO: 219468 - DNA, 20 bp, Artificial
  CRISPR gRNA sequence
aggaacagtgaattcaggct

SEQ ID NO: 219469 - DNA, 20 bp, Artificial
  CRISPR gRNA sequence
aggctcttcagttaatctta

SEQ ID NO: 219470 - DNA, 20 bp, Artificial
  CRISPR gRNA sequence
ttcagttaatcttaactgtt

SEQ ID NO: 219471 - DNA, 20 bp, Artificial
  CRISPR gRNA sequence
cagttaatcttaactgttca

SEQ ID NO: 219472 - DNA, 20 bp, Artificial
  CRISPR gRNA sequence
agttaatcttaactgttcat

SEQ ID NO: 219473 - DNA, 20 bp, Artificial
  CRISPR gRNA sequence
atcttaactgttcatgttcc

SEQ ID NO: 219474 - DNA, 20 bp, Artificial
  CRISPR gRNA sequence
aactgttcatgttccacaat

SEQ ID NO: 219475 - DNA, 20 bp, Artificial
  CRISPR gRNA sequence
actgttcatgttccacaatg

SEQ ID NO: 219476 - DNA, 20 bp, Artificial
  CRISPR gRNA sequence
ttcatgttccacaatgaatc

SEQ ID NO: 219477 - DNA, 20 bp, Artificial
  CRISPR gRNA sequence
atgttccacaatgaatcctg

SEQ ID NO: 219478 - DNA, 20 bp, Artificial
  CRISPR gRNA sequence
cacaatgaatcctgatattt

SEQ ID NO: 219479 - DNA, 20 bp, Artificial
  CRISPR gRNA sequence
atattttcatcaccccatcc

SEQ ID NO: 219480 - DNA, 20 bp, Artificial
  CRISPR gRNA sequence
tcatcaccccatcccccact

SEQ ID NO: 219481 - DNA, 20 bp, Artificial
  CRISPR gRNA sequence
catcaccccatcccccacta

SEQ ID NO: 219482 - DNA, 20 bp, Artificial
  CRISPR gRNA sequence
atcaccccatcccccactaa

SEQ ID NO: 219483 - DNA, 20 bp, Artificial
  CRISPR gRNA sequence
aactccccctctcattttcc

SEQ ID NO: 219484 - DNA, 20 bp, Artificial
  CRISPR gRNA sequence
cccctctcattttcctcatt

SEQ ID NO: 219485 - DNA, 20 bp, Artificial
  CRISPR gRNA sequence
tcattttcctcatttcagtc

SEQ ID NO: 219486 - DNA, 20 bp, Artificial
  CRISPR gRNA sequence
attttcctcatttcagtcgt

SEQ ID NO: 219487 - DNA, 20 bp, Artificial
  CRISPR gRNA sequence
tcctcatttcagtcgtggtg

SEQ ID NO: 219488 - DNA, 20 bp, Artificial
  CRISPR gRNA sequence
cctcatttcagtcgtggtga

SEQ ID NO: 219489 - DNA, 20 bp, Artificial
  CRISPR gRNA sequence
ctcatttcagtcgtggtgac

SEQ ID NO: 219490 - DNA, 20 bp, Artificial
  CRISPR gRNA sequence
atttcagtcgtggtgacccc

SEQ ID NO: 219491 - DNA, 20 bp, Artificial
  CRISPR gRNA sequence
cagtcgtggtgaccccattt

SEQ ID NO: 219492 - DNA, 20 bp, Artificial
  CRISPR gRNA sequence
agtcgtggtgaccccatttc

SEQ ID NO: 219493 - DNA, 20 bp, Artificial
  CRISPR gRNA sequence
cttcagttgcttgaggctga

SEQ ID NO: 219494 - DNA, 20 bp, Artificial
  CRISPR gRNA sequence
ttcagttgcttgaggctgaa

SEQ ID NO: 219495 - DNA, 20 bp, Artificial
  CRISPR gRNA sequence
cagttgcttgaggctgaaaa

SEQ ID NO: 219496 - DNA, 20 bp, Artificial
  CRISPR gRNA sequence
agttgcttgaggctgaaaac

SEQ ID NO: 219497 - DNA, 20 bp, Artificial
  CRISPR gRNA sequence
cttgaggctgaaaaccttgg

SEQ ID NO: 219498 - DNA, 20 bp, Artificial
  CRISPR gRNA sequence
gaggctgaaaaccttggagt

SEQ ID NO: 219499 - DNA, 20 bp, Artificial
  CRISPR gRNA sequence
aggctgaaaaccttggagtt

SEQ ID NO: 219500 - DNA, 20 bp, Artificial
  CRISPR gRNA sequence
aaaaccttggagttatacct

SEQ ID NO: 219501 - DNA, 20 bp, Artificial
  CRISPR gRNA sequence
ggagttatacctgactccct

SEQ ID NO: 219502 - DNA, 20 bp, Artificial
  CRISPR gRNA sequence
gagttatacctgactccctg

SEQ ID NO: 219503 - DNA, 20 bp, Artificial
  CRISPR gRNA sequence
tacctgactccctgatttct

SEQ ID NO: 219504 - DNA, 20 bp, Artificial
  CRISPR gRNA sequence
actccctgatttctcccaca

SEQ ID NO: 219505 - DNA, 20 bp, Artificial
  CRISPR gRNA sequence
cctgatttctcccacatccc

SEQ ID NO: 219506 - DNA, 20 bp, Artificial
  CRISPR gRNA sequence
atttctcccacatcccactc

SEQ ID NO: 219507 - DNA, 20 bp, Artificial
  CRISPR gRNA sequence
ctcccacatcccactctagt

SEQ ID NO: 219508 - DNA, 20 bp, Artificial
  CRISPR gRNA sequence
tcccacatcccactctagtt

SEQ ID NO: 219509 - DNA, 20 bp, Artificial
  CRISPR gRNA sequence
ccacatcccactctagttaa

SEQ ID NO: 219510 - DNA, 20 bp, Artificial
  CRISPR gRNA sequence
tagttaaacagcaaatcctg

SEQ ID NO: 219511 - DNA, 20 bp, Artificial
  CRISPR gRNA sequence
gttaaacagcaaatcctgct

SEQ ID NO: 219512 - DNA, 20 bp, Artificial
  CRISPR gRNA sequence
aacagcaaatcctgctgact

SEQ ID NO: 219513 - DNA, 20 bp, Artificial
  CRISPR gRNA sequence
ctgactctaccttcaaaata

SEQ ID NO: 219514 - DNA, 20 bp, Artificial
  CRISPR gRNA sequence
actctaccttcaaaatatag

SEQ ID NO: 219515 - DNA, 20 bp, Artificial
  CRISPR gRNA sequence
taccttcaaaatatagccaa

SEQ ID NO: 219516 - DNA, 20 bp, Artificial
  CRISPR gRNA sequence
ccttcaaaatatagccaata

SEQ ID NO: 219517 - DNA, 20 bp, Artificial
  CRISPR gRNA sequence
caaaatatagccaatatctg

SEQ ID NO: 219518 - DNA, 20 bp, Artificial
  CRISPR gRNA sequence
aaaatatagccaatatctga

SEQ ID NO: 219519 - DNA, 20 bp, Artificial
  CRISPR gRNA sequence
atctcatagtcaagatgagc

SEQ ID NO: 219520 - DNA, 20 bp, Artificial
  CRISPR gRNA sequence
atagtcaagatgagctgaca

SEQ ID NO: 219521 - DNA, 20 bp, Artificial
  CRISPR gRNA sequence
acaatgaaatgttctttcat

SEQ ID NO: 219522 - DNA, 20 bp, Artificial
  CRISPR gRNA sequence
tttcattggtccctgcccct

SEQ ID NO: 219523 - DNA, 20 bp, Artificial
  CRISPR gRNA sequence
tcattggtccctgcccctat

SEQ ID NO: 219524 - DNA, 20 bp, Artificial
  CRISPR gRNA sequence
cattggtccctgcccctata

SEQ ID NO: 219525 - DNA, 20 bp, Artificial
  CRISPR gRNA sequence
attggtccctgcccctatac

SEQ ID NO: 219526 - DNA, 20 bp, Artificial
  CRISPR gRNA sequence
gtccctgcccctatacacaa

SEQ ID NO: 219527 - DNA, 20 bp, Artificial
  CRISPR gRNA sequence
cccctatacacaacaaaatt

SEQ ID NO: 219528 - DNA, 20 bp, Artificial
  CRISPR gRNA sequence
tacacaacaaaattttagga

SEQ ID NO: 219529 - DNA, 20 bp, Artificial
  CRISPR gRNA sequence
taggatatattaatagaata

SEQ ID NO: 219530 - DNA, 20 bp, Artificial
  CRISPR gRNA sequence
aggatatattaatagaatat

SEQ ID NO: 219531 - DNA, 20 bp, Artificial
  CRISPR gRNA sequence
ggatatattaatagaatatt

SEQ ID NO: 219532 - DNA, 20 bp, Artificial
  CRISPR gRNA sequence
atagaatattaatatattaa

SEQ ID NO: 219533 - DNA, 20 bp, Artificial
  CRISPR gRNA sequence
atatattaatattaatttga

SEQ ID NO: 219534 - DNA, 20 bp, Artificial
  CRISPR gRNA sequence
atattaatttgaatatatta

SEQ ID NO: 219535 - DNA, 20 bp, Artificial
  CRISPR gRNA sequence
atttgaatatattaacaaaa

SEQ ID NO: 219536 - DNA, 20 bp, Artificial
  CRISPR gRNA sequence
gaatatattaacaaaagtaa

SEQ ID NO: 219537 - DNA, 20 bp, Artificial
  CRISPR gRNA sequence
aatatattaacaaaagtaag

SEQ ID NO: 219538 - DNA, 20 bp, Artificial
  CRISPR gRNA sequence
acaaaagtaagaggtgcatt

SEQ ID NO: 219539 - DNA, 20 bp, Artificial
  CRISPR gRNA sequence
gatcctggtgtgaccactca

SEQ ID NO: 219540 - DNA, 20 bp, Artificial
  CRISPR gRNA sequence
gtgtgaccactcatttttca

SEQ ID NO: 219541 - DNA, 20 bp, Artificial
  CRISPR gRNA sequence
atttttcacttattccacaa

SEQ ID NO: 219542 - DNA, 20 bp, Artificial
  CRISPR gRNA sequence
ttcacttattccacaaacac

SEQ ID NO: 219543 - DNA, 20 bp, Artificial
  CRISPR gRNA sequence
tcacttattccacaaacact

SEQ ID NO: 219544 - DNA, 20 bp, Artificial
  CRISPR gRNA sequence
cacttattccacaaacactt

SEQ ID NO: 219545 - DNA, 20 bp, Artificial
  CRISPR gRNA sequence
acttattccacaaacactta

SEQ ID NO: 219546 - DNA, 20 bp, Artificial
  CRISPR gRNA sequence
attccacaaacacttattga

SEQ ID NO: 219547 - DNA, 20 bp, Artificial
  CRISPR gRNA sequence
ttccacaaacacttattgaa

SEQ ID NO: 219548 - DNA, 20 bp, Artificial
  CRISPR gRNA sequence
cacaaacacttattgaaagc

SEQ ID NO: 219549 - DNA, 20 bp, Artificial
  CRISPR gRNA sequence
attgaaagcccaccatgggg

SEQ ID NO: 219550 - DNA, 20 bp, Artificial
  CRISPR gRNA sequence
ttgaaagcccaccatgggga

SEQ ID NO: 219551 - DNA, 20 bp, Artificial
  CRISPR gRNA sequence
aaagcccaccatggggagga

SEQ ID NO: 219552 - DNA, 20 bp, Artificial
  CRISPR gRNA sequence
ctctaggctcttgaaggcca

SEQ ID NO: 219553 - DNA, 20 bp, Artificial
  CRISPR gRNA sequence
taggctcttgaaggccagca

SEQ ID NO: 219554 - DNA, 20 bp, Artificial
  CRISPR gRNA sequence
ggctcttgaaggccagcagt

SEQ ID NO: 219555 - DNA, 20 bp, Artificial
  CRISPR gRNA sequence
ttgaaggccagcagtgaaca

SEQ ID NO: 219556 - DNA, 20 bp, Artificial
  CRISPR gRNA sequence
gaaggccagcagtgaacaat

SEQ ID NO: 219557 - DNA, 20 bp, Artificial
  CRISPR gRNA sequence
aaggccagcagtgaacaatg

SEQ ID NO: 219558 - DNA, 20 bp, Artificial
  CRISPR gRNA sequence
agtgtgcagagtgggagaag

SEQ ID NO: 219559 - DNA, 20 bp, Artificial
  CRISPR gRNA sequence
aggcagtaaggaaaggcctc

SEQ ID NO: 219560 - DNA, 20 bp, Artificial
  CRISPR gRNA sequence
tagggagaggaacgaaacta

SEQ ID NO: 219561 - DNA, 20 bp, Artificial
  CRISPR gRNA sequence
gggagaggaacgaaactaag

SEQ ID NO: 219562 - DNA, 20 bp, Artificial
  CRISPR gRNA sequence
agcctaggatgggaaggagc

SEQ ID NO: 219563 - DNA, 20 bp, Artificial
  CRISPR gRNA sequence
ggatgggaaggagcctacat

SEQ ID NO: 219564 - DNA, 20 bp, Artificial
  CRISPR gRNA sequence
cattgtgaagacagggagga

SEQ ID NO: 219565 - DNA, 20 bp, Artificial
  CRISPR gRNA sequence
tgaagacagggaggaagaga

SEQ ID NO: 219566 - DNA, 20 bp, Artificial
  CRISPR gRNA sequence
tgagaaaccaaaggatggcc

SEQ ID NO: 219567 - DNA, 20 bp, Artificial
  CRISPR gRNA sequence
gagaaaccaaaggatggcca

SEQ ID NO: 219568 - DNA, 20 bp, Artificial
  CRISPR gRNA sequence
agaaaccaaaggatggccat

SEQ ID NO: 219569 - DNA, 20 bp, Artificial
  CRISPR gRNA sequence
tgactggaattcagtgatga

SEQ ID NO: 219570 - DNA, 20 bp, Artificial
  CRISPR gRNA sequence
gaattcagtgatgagatcaa

SEQ ID NO: 219571 - DNA, 20 bp, Artificial
  CRISPR gRNA sequence
agtgatgagatcaaatggga

SEQ ID NO: 219572 - DNA, 20 bp, Artificial
  CRISPR gRNA sequence
gctggggcaagaccatgtag

SEQ ID NO: 219573 - DNA, 20 bp, Artificial
  CRISPR gRNA sequence
ctggggcaagaccatgtaga

SEQ ID NO: 219574 - DNA, 20 bp, Artificial
  CRISPR gRNA sequence
gggcaagaccatgtagagtc

SEQ ID NO: 219575 - DNA, 20 bp, Artificial
  CRISPR gRNA sequence
aaaagcttgttgggagagtt

SEQ ID NO: 219576 - DNA, 20 bp, Artificial
  CRISPR gRNA sequence
aaagcttgttgggagagttt

SEQ ID NO: 219577 - DNA, 20 bp, Artificial
  CRISPR gRNA sequence
gttgggagagtttggatttt

SEQ ID NO: 219578 - DNA, 20 bp, Artificial
  CRISPR gRNA sequence
ttgggagagtttggatttta

SEQ ID NO: 219579 - DNA, 20 bp, Artificial
  CRISPR gRNA sequence
ggagagtttggattttattc

SEQ ID NO: 219580 - DNA, 20 bp, Artificial
  CRISPR gRNA sequence
ggattttattctaagagcaa

SEQ ID NO: 219581 - DNA, 20 bp, Artificial
  CRISPR gRNA sequence
gattttattctaagagcaat

SEQ ID NO: 219582 - DNA, 20 bp, Artificial
  CRISPR gRNA sequence
tattctaagagcaatgacaa

SEQ ID NO: 219583 - DNA, 20 bp, Artificial
  CRISPR gRNA sequence
attctaagagcaatgacaag

SEQ ID NO: 219584 - DNA, 20 bp, Artificial
  CRISPR gRNA sequence
ttctaagagcaatgacaagc

SEQ ID NO: 219585 - DNA, 20 bp, Artificial
  CRISPR gRNA sequence
taagagcaatgacaagcggc

SEQ ID NO: 219586 - DNA, 20 bp, Artificial
  CRISPR gRNA sequence
agagcaatgacaagcggctg

SEQ ID NO: 219587 - DNA, 20 bp, Artificial
  CRISPR gRNA sequence
gaaggctttaaatagggaag

SEQ ID NO: 219588 - DNA, 20 bp, Artificial
  CRISPR gRNA sequence
taaatagggaagaaaaataa

SEQ ID NO: 219589 - DNA, 20 bp, Artificial
  CRISPR gRNA sequence
aaatagggaagaaaaataac

SEQ ID NO: 219590 - DNA, 20 bp, Artificial
  CRISPR gRNA sequence
aatagggaagaaaaataacc

SEQ ID NO: 219591 - DNA, 20 bp, Artificial
  CRISPR gRNA sequence
acttatttcaaatcttcttt

SEQ ID NO: 219592 - DNA, 20 bp, Artificial
  CRISPR gRNA sequence
atttcaaatcttctttggca

SEQ ID NO: 219593 - DNA, 20 bp, Artificial
  CRISPR gRNA sequence
tttcaaatcttctttggcag

SEQ ID NO: 219594 - DNA, 20 bp, Artificial
  CRISPR gRNA sequence
caaatcttctttggcagcca

SEQ ID NO: 219595 - DNA, 20 bp, Artificial
  CRISPR gRNA sequence
aaatcttctttggcagccac

SEQ ID NO: 219596 - DNA, 20 bp, Artificial
  CRISPR gRNA sequence
ctttggcagccacatggaga

SEQ ID NO: 219597 - DNA, 20 bp, Artificial
  CRISPR gRNA sequence
tttggcagccacatggagaa

SEQ ID NO: 219598 - DNA, 20 bp, Artificial
  CRISPR gRNA sequence
tggcagccacatggagaatg

SEQ ID NO: 219599 - DNA, 20 bp, Artificial
  CRISPR gRNA sequence
ggcagccacatggagaatgg

SEQ ID NO: 219600 - DNA, 20 bp, Artificial
  CRISPR gRNA sequence
gcagccacatggagaatgga

SEQ ID NO: 219601 - DNA, 20 bp, Artificial
  CRISPR gRNA sequence
cagggaagcaggacctgtca

SEQ ID NO: 219602 - DNA, 20 bp, Artificial
  CRISPR gRNA sequence
tcagaaagttacagcagcag

SEQ ID NO: 219603 - DNA, 20 bp, Artificial
  CRISPR gRNA sequence
cagcagcagtcatttggaag

SEQ ID NO: 219604 - DNA, 20 bp, Artificial
  CRISPR gRNA sequence
ggaagggagaagggtgtgac

SEQ ID NO: 219605 - DNA, 20 bp, Artificial
  CRISPR gRNA sequence
gaagggagaagggtgtgacc

SEQ ID NO: 219606 - DNA, 20 bp, Artificial
  CRISPR gRNA sequence
agctcagttttactcatcac

SEQ ID NO: 219607 - DNA, 20 bp, Artificial
  CRISPR gRNA sequence
agttttactcatcacatttg

SEQ ID NO: 219608 - DNA, 20 bp, Artificial
  CRISPR gRNA sequence
tactcatcacatttgaagat

SEQ ID NO: 219609 - DNA, 20 bp, Artificial
  CRISPR gRNA sequence
actcatcacatttgaagatc

SEQ ID NO: 219610 - DNA, 20 bp, Artificial
  CRISPR gRNA sequence
ctcatcacatttgaagatct

SEQ ID NO: 219611 - DNA, 20 bp, Artificial
  CRISPR gRNA sequence
atcacatttgaagatctaac

SEQ ID NO: 219612 - DNA, 20 bp, Artificial
  CRISPR gRNA sequence
gaagatctaacagggaattg

SEQ ID NO: 219613 - DNA, 20 bp, Artificial
  CRISPR gRNA sequence
aagatctaacagggaattgc

SEQ ID NO: 219614 - DNA, 20 bp, Artificial
  CRISPR gRNA sequence
acagggaattgctccaaagg

SEQ ID NO: 219615 - DNA, 20 bp, Artificial
  CRISPR gRNA sequence
ctccaaaggaagatgactag

SEQ ID NO: 219616 - DNA, 20 bp, Artificial
  CRISPR gRNA sequence
caaaggaagatgactagaat

SEQ ID NO: 219617 - DNA, 20 bp, Artificial
  CRISPR gRNA sequence
gaatggggatcccgaaacca

SEQ ID NO: 219618 - DNA, 20 bp, Artificial
  CRISPR gRNA sequence
aaagaacagagattttcatc

SEQ ID NO: 219619 - DNA, 20 bp, Artificial
  CRISPR gRNA sequence
tcatcacagagaggtataaa

SEQ ID NO: 219620 - DNA, 20 bp, Artificial
  CRISPR gRNA sequence
catcacagagaggtataaac

SEQ ID NO: 219621 - DNA, 20 bp, Artificial
  CRISPR gRNA sequence
atcacagagaggtataaact

SEQ ID NO: 219622 - DNA, 20 bp, Artificial
  CRISPR gRNA sequence
gagagaaatactacagccct

SEQ ID NO: 219623 - DNA, 20 bp, Artificial
  CRISPR gRNA sequence
agagaaatactacagccctc

SEQ ID NO: 219624 - DNA, 20 bp, Artificial
  CRISPR gRNA sequence
cagccctcccagtgagtgag

SEQ ID NO: 219625 - DNA, 20 bp, Artificial
  CRISPR gRNA sequence
ccagtgagtgagaatagtag

SEQ ID NO: 219626 - DNA, 20 bp, Artificial
  CRISPR gRNA sequence
tagcttgatttaaggaagaa

SEQ ID NO: 219627 - DNA, 20 bp, Artificial
  CRISPR gRNA sequence
agcttgatttaaggaagaac

SEQ ID NO: 219628 - DNA, 20 bp, Artificial
  CRISPR gRNA sequence
gcttgatttaaggaagaact

SEQ ID NO: 219629 - DNA, 20 bp, Artificial
  CRISPR gRNA sequence
gatttaaggaagaactgaaa

SEQ ID NO: 219630 - DNA, 20 bp, Artificial
  CRISPR gRNA sequence
atttaaggaagaactgaaat

SEQ ID NO: 219631 - DNA, 20 bp, Artificial
  CRISPR gRNA sequence
aaggaagaactgaaattgcc

SEQ ID NO: 219632 - DNA, 20 bp, Artificial
  CRISPR gRNA sequence
aggaagaactgaaattgcct

SEQ ID NO: 219633 - DNA, 20 bp, Artificial
  CRISPR gRNA sequence
aaattgcctgataacagacc

SEQ ID NO: 219634 - DNA, 20 bp, Artificial
  CRISPR gRNA sequence
cctgataacagaccaagatc

SEQ ID NO: 219635 - DNA, 20 bp, Artificial
  CRISPR gRNA sequence
ataacagaccaagatcctct

SEQ ID NO: 219636 - DNA, 20 bp, Artificial
  CRISPR gRNA sequence
tgggaagtaataatgtctca

SEQ ID NO: 219637 - DNA, 20 bp, Artificial
  CRISPR gRNA sequence
ggaagtaataatgtctcatc

SEQ ID NO: 219638 - DNA, 20 bp, Artificial
  CRISPR gRNA sequence
atcatgtcaagctttcagta

SEQ ID NO: 219639 - DNA, 20 bp, Artificial
  CRISPR gRNA sequence
tcagtaaaaaatctgaatcg

SEQ ID NO: 219640 - DNA, 20 bp, Artificial
  CRISPR gRNA sequence
cagtaaaaaatctgaatcgc

SEQ ID NO: 219641 - DNA, 20 bp, Artificial
  CRISPR gRNA sequence
agtaaaaaatctgaatcgcc

SEQ ID NO: 219642 - DNA, 20 bp, Artificial
  CRISPR gRNA sequence
aatcgccagctacttggggt

SEQ ID NO: 219643 - DNA, 20 bp, Artificial
  CRISPR gRNA sequence
cttggggtgtgatagaaata

SEQ ID NO: 219644 - DNA, 20 bp, Artificial
  CRISPR gRNA sequence
ggggtgtgatagaaataatt

SEQ ID NO: 219645 - DNA, 20 bp, Artificial
  CRISPR gRNA sequence
gggtgtgatagaaataattc

SEQ ID NO: 219646 - DNA, 20 bp, Artificial
  CRISPR gRNA sequence
gtaaattagatgatgagata

SEQ ID NO: 219647 - DNA, 20 bp, Artificial
  CRISPR gRNA sequence
gatgatgagatagactagat

SEQ ID NO: 219648 - DNA, 20 bp, Artificial
  CRISPR gRNA sequence
gatgactacttgatgactcc

SEQ ID NO: 219649 - DNA, 20 bp, Artificial
  CRISPR gRNA sequence
cttgatgactcccagattct

SEQ ID NO: 219650 - DNA, 20 bp, Artificial
  CRISPR gRNA sequence
gatgactcccagattctatg

SEQ ID NO: 219651 - DNA, 20 bp, Artificial
  CRISPR gRNA sequence
atgactcccagattctatgt

SEQ ID NO: 219652 - DNA, 20 bp, Artificial
  CRISPR gRNA sequence
ccagattctatgtgaaacaa

SEQ ID NO: 219653 - DNA, 20 bp, Artificial
  CRISPR gRNA sequence
tatgtgaaacaagaaatatg

SEQ ID NO: 219654 - DNA, 20 bp, Artificial
  CRISPR gRNA sequence
tgtgaaacaagaaatatgag

SEQ ID NO: 219655 - DNA, 20 bp, Artificial
  CRISPR gRNA sequence
caatgacagagaggaagatt

SEQ ID NO: 219656 - DNA, 20 bp, Artificial
  CRISPR gRNA sequence
aatgacagagaggaagatta

SEQ ID NO: 219657 - DNA, 20 bp, Artificial
  CRISPR gRNA sequence
cagaacaaaaaatactgtct

SEQ ID NO: 219658 - DNA, 20 bp, Artificial
  CRISPR gRNA sequence
tctaagtgattctttttttt

SEQ ID NO: 219659 - DNA, 20 bp, Artificial
  CRISPR gRNA sequence
agtgattcttttttttttat

SEQ ID NO: 219660 - DNA, 20 bp, Artificial
  CRISPR gRNA sequence
ttttttttttatttttgaga

SEQ ID NO: 219661 - DNA, 20 bp, Artificial
  CRISPR gRNA sequence
ttttttttatttttgagatg

SEQ ID NO: 219662 - DNA, 20 bp, Artificial
  CRISPR gRNA sequence
tttttttatttttgagatgg

SEQ ID NO: 219663 - DNA, 20 bp, Artificial
  CRISPR gRNA sequence
ttttttatttttgagatgga

SEQ ID NO: 219664 - DNA, 20 bp, Artificial
  CRISPR gRNA sequence
tttttatttttgagatggag

SEQ ID NO: 219665 - DNA, 20 bp, Artificial
  CRISPR gRNA sequence
ttttatttttgagatggagt

SEQ ID NO: 219666 - DNA, 20 bp, Artificial
  CRISPR gRNA sequence
tttatttttgagatggagtc

SEQ ID NO: 219667 - DNA, 20 bp, Artificial
  CRISPR gRNA sequence
ttatttttgagatggagtct

SEQ ID NO: 219668 - DNA, 20 bp, Artificial
  CRISPR gRNA sequence
tatttttgagatggagtctc

SEQ ID NO: 219669 - DNA, 20 bp, Artificial
  CRISPR gRNA sequence
atttttgagatggagtctca

SEQ ID NO: 219670 - DNA, 20 bp, Artificial
  CRISPR gRNA sequence
tttttgagatggagtctcac

SEQ ID NO: 219671 - DNA, 20 bp, Artificial
  CRISPR gRNA sequence
ttgagatggagtctcactct

SEQ ID NO: 219672 - DNA, 20 bp, Artificial
  CRISPR gRNA sequence
tgagatggagtctcactctg

SEQ ID NO: 219673 - DNA, 20 bp, Artificial
  CRISPR gRNA sequence
gagatggagtctcactctgt

SEQ ID NO: 219674 - DNA, 20 bp, Artificial
  CRISPR gRNA sequence
agatggagtctcactctgtt

SEQ ID NO: 219675 - DNA, 20 bp, Artificial
  CRISPR gRNA sequence
actctgttgcccaggctgga

SEQ ID NO: 219676 - DNA, 20 bp, Artificial
  CRISPR gRNA sequence
tgttgcccaggctggagtgc

SEQ ID NO: 219677 - DNA, 20 bp, Artificial
  CRISPR gRNA sequence
ttgcccaggctggagtgcag

SEQ ID NO: 219678 - DNA, 20 bp, Artificial
  CRISPR gRNA sequence
cccaggctggagtgcagtgg

SEQ ID NO: 219679 - DNA, 20 bp, Artificial
  CRISPR gRNA sequence
gagtgcagtggtgtggtctc

SEQ ID NO: 219680 - DNA, 20 bp, Artificial
  CRISPR gRNA sequence
agctcactgcaacctccacc

SEQ ID NO: 219681 - DNA, 20 bp, Artificial
  CRISPR gRNA sequence
actgcaacctccacctcccg

SEQ ID NO: 219682 - DNA, 20 bp, Artificial
  CRISPR gRNA sequence
caacctccacctcccgggtt

SEQ ID NO: 219683 - DNA, 20 bp, Artificial
  CRISPR gRNA sequence
cacctcccgggttcaagcaa

SEQ ID NO: 219684 - DNA, 20 bp, Artificial
  CRISPR gRNA sequence
ccgggttcaagcaattctcc

SEQ ID NO: 219685 - DNA, 20 bp, Artificial
  CRISPR gRNA sequence
aagcaattctcctgtctcag

SEQ ID NO: 219686 - DNA, 20 bp, Artificial
  CRISPR gRNA sequence
tcctgtctcagcctcccaag

SEQ ID NO: 219687 - DNA, 20 bp, Artificial
  CRISPR gRNA sequence
ctgtctcagcctcccaagta

SEQ ID NO: 219688 - DNA, 20 bp, Artificial
  CRISPR gRNA sequence
tctcagcctcccaagtagct

SEQ ID NO: 219689 - DNA, 20 bp, Artificial
  CRISPR gRNA sequence
agcctcccaagtagctggga

SEQ ID NO: 219690 - DNA, 20 bp, Artificial
  CRISPR gRNA sequence
ccaagtagctgggattatag

SEQ ID NO: 219691 - DNA, 20 bp, Artificial
  CRISPR gRNA sequence
ggattataggcaggcgccac

SEQ ID NO: 219692 - DNA, 20 bp, Artificial
  CRISPR gRNA sequence
taggcaggcgccaccatgcc

SEQ ID NO: 219693 - DNA, 20 bp, Artificial
  CRISPR gRNA sequence
aattttgtaattttggtaga

SEQ ID NO: 219694 - DNA, 20 bp, Artificial
  CRISPR gRNA sequence
tgtaattttggtagagacag

SEQ ID NO: 219695 - DNA, 20 bp, Artificial
  CRISPR gRNA sequence
gtaattttggtagagacagg

SEQ ID NO: 219696 - DNA, 20 bp, Artificial
  CRISPR gRNA sequence
taattttggtagagacaggg

SEQ ID NO: 219697 - DNA, 20 bp, Artificial
  CRISPR gRNA sequence
tggtagagacagggttttat

SEQ ID NO: 219698 - DNA, 20 bp, Artificial
  CRISPR gRNA sequence
ggtagagacagggttttatc

SEQ ID NO: 219699 - DNA, 20 bp, Artificial
  CRISPR gRNA sequence
gtagagacagggttttatca

SEQ ID NO: 219700 - DNA, 20 bp, Artificial
  CRISPR gRNA sequence
tatcatgttggccaggctgg

SEQ ID NO: 219701 - DNA, 20 bp, Artificial
  CRISPR gRNA sequence
atcatgttggccaggctggt

SEQ ID NO: 219702 - DNA, 20 bp, Artificial
  CRISPR gRNA sequence
tcatgttggccaggctggtc

SEQ ID NO: 219703 - DNA, 20 bp, Artificial
  CRISPR gRNA sequence
gccaggctggtctcaaattc

SEQ ID NO: 219704 - DNA, 20 bp, Artificial
  CRISPR gRNA sequence
gtctcaaattcctgacctca

SEQ ID NO: 219705 - DNA, 20 bp, Artificial
  CRISPR gRNA sequence
aaattcctgacctcaggtga

SEQ ID NO: 219706 - DNA, 20 bp, Artificial
  CRISPR gRNA sequence
ctgacctcaggtgatccacc

SEQ ID NO: 219707 - DNA, 20 bp, Artificial
  CRISPR gRNA sequence
acctcaggtgatccacctgc

SEQ ID NO: 219708 - DNA, 20 bp, Artificial
  CRISPR gRNA sequence
aggtgatccacctgcctcag

SEQ ID NO: 219709 - DNA, 20 bp, Artificial
  CRISPR gRNA sequence
cctcagcctcccaaagtgct

SEQ ID NO: 219710 - DNA, 20 bp, Artificial
  CRISPR gRNA sequence
agcctcccaaagtgctggta

SEQ ID NO: 219711 - DNA, 20 bp, Artificial
  CRISPR gRNA sequence
ccaaagtgctggtattacag

SEQ ID NO: 219712 - DNA, 20 bp, Artificial
  CRISPR gRNA sequence
gtattacaggcgtgggctgc

SEQ ID NO: 219713 - DNA, 20 bp, Artificial
  CRISPR gRNA sequence
caggcgtgggctgccacacc

SEQ ID NO: 219714 - DNA, 20 bp, Artificial
  CRISPR gRNA sequence
ccacacctggcctgtctaag

SEQ ID NO: 219715 - DNA, 20 bp, Artificial
  CRISPR gRNA sequence
gcctgtctaagtgattctta

SEQ ID NO: 219716 - DNA, 20 bp, Artificial
  CRISPR gRNA sequence
tctaagtgattcttaactgg

SEQ ID NO: 219717 - DNA, 20 bp, Artificial
  CRISPR gRNA sequence
agtgattcttaactggaact

SEQ ID NO: 219718 - DNA, 20 bp, Artificial
  CRISPR gRNA sequence
ttaactggaacttatcagtt

SEQ ID NO: 219719 - DNA, 20 bp, Artificial
  CRISPR gRNA sequence
aactggaacttatcagtttg

SEQ ID NO: 219720 - DNA, 20 bp, Artificial
  CRISPR gRNA sequence
actggaacttatcagtttgt

SEQ ID NO: 219721 - DNA, 20 bp, Artificial
  CRISPR gRNA sequence
gaacttatcagtttgtcact

SEQ ID NO: 219722 - DNA, 20 bp, Artificial
  CRISPR gRNA sequence
atcagtttgtcactctccct

SEQ ID NO: 219723 - DNA, 20 bp, Artificial
  CRISPR gRNA sequence
tcagtttgtcactctccctt

SEQ ID NO: 219724 - DNA, 20 bp, Artificial
  CRISPR gRNA sequence
gtcactctcccttctcatta

SEQ ID NO: 219725 - DNA, 20 bp, Artificial
  CRISPR gRNA sequence
tcactctcccttctcattat

SEQ ID NO: 219726 - DNA, 20 bp, Artificial
  CRISPR gRNA sequence
tcccttctcattattgtgcc

SEQ ID NO: 219727 - DNA, 20 bp, Artificial
  CRISPR gRNA sequence
ccttctcattattgtgccag

SEQ ID NO: 219728 - DNA, 20 bp, Artificial
  CRISPR gRNA sequence
ctcattattgtgccaggatt

SEQ ID NO: 219729 - DNA, 20 bp, Artificial
  CRISPR gRNA sequence
tcattattgtgccaggattt

SEQ ID NO: 219730 - DNA, 20 bp, Artificial
  CRISPR gRNA sequence
attattgtgccaggatttta

SEQ ID NO: 219731 - DNA, 20 bp, Artificial
  CRISPR gRNA sequence
ttgtgccaggattttaaatt

SEQ ID NO: 219732 - DNA, 20 bp, Artificial
  CRISPR gRNA sequence
tgccaggattttaaattgtt

SEQ ID NO: 219733 - DNA, 20 bp, Artificial
  CRISPR gRNA sequence
taaattgttccctgatatgt

SEQ ID NO: 219734 - DNA, 20 bp, Artificial
  CRISPR gRNA sequence
aaattgttccctgatatgtg

SEQ ID NO: 219735 - DNA, 20 bp, Artificial
  CRISPR gRNA sequence
aattgttccctgatatgtgg

SEQ ID NO: 219736 - DNA, 20 bp, Artificial
  CRISPR gRNA sequence
ttccctgatatgtggggcgg

SEQ ID NO: 219737 - DNA, 20 bp, Artificial
  CRISPR gRNA sequence
cctgatatgtggggcgggtg

SEQ ID NO: 219738 - DNA, 20 bp, Artificial
  CRISPR gRNA sequence
atatgtggggcgggtggggg

SEQ ID NO: 219739 - DNA, 20 bp, Artificial
  CRISPR gRNA sequence
tctcagtttgaaatcactgc

SEQ ID NO: 219740 - DNA, 20 bp, Artificial
  CRISPR gRNA sequence
tcagtttgaaatcactgctg

SEQ ID NO: 219741 - DNA, 20 bp, Artificial
  CRISPR gRNA sequence
agtttgaaatcactgctgca

SEQ ID NO: 219742 - DNA, 20 bp, Artificial
  CRISPR gRNA sequence
gaaatcactgctgcacattt

SEQ ID NO: 219743 - DNA, 20 bp, Artificial
  CRISPR gRNA sequence
aaatcactgctgcacatttc

SEQ ID NO: 219744 - DNA, 20 bp, Artificial
  CRISPR gRNA sequence
ctgcacatttctgctgtatt

SEQ ID NO: 219745 - DNA, 20 bp, Artificial
  CRISPR gRNA sequence
cacatttctgctgtatttga

SEQ ID NO: 219746 - DNA, 20 bp, Artificial
  CRISPR gRNA sequence
ctgctgtatttgaactacag

SEQ ID NO: 219747 - DNA, 20 bp, Artificial
  CRISPR gRNA sequence
tgctgtatttgaactacagt

SEQ ID NO: 219748 - DNA, 20 bp, Artificial
  CRISPR gRNA sequence
ctgtatttgaactacagtca

SEQ ID NO: 219749 - DNA, 20 bp, Artificial
  CRISPR gRNA sequence
tatttgaactacagtcactg

SEQ ID NO: 219750 - DNA, 20 bp, Artificial
  CRISPR gRNA sequence
gaactacagtcactgatgaa

SEQ ID NO: 219751 - DNA, 20 bp, Artificial
  CRISPR gRNA sequence
aactacagtcactgatgaac

SEQ ID NO: 219752 - DNA, 20 bp, Artificial
  CRISPR gRNA sequence
cagtcactgatgaacatgtt

SEQ ID NO: 219753 - DNA, 20 bp, Artificial
  CRISPR gRNA sequence
atgaacatgttcctcctctc

SEQ ID NO: 219754 - DNA, 20 bp, Artificial
  CRISPR gRNA sequence
ctcctctctctaatttgtta

SEQ ID NO: 219755 - DNA, 20 bp, Artificial
  CRISPR gRNA sequence
ctctctctaatttgttacag

SEQ ID NO: 219756 - DNA, 20 bp, Artificial
  CRISPR gRNA sequence
tctctaatttgttacagtgg

SEQ ID NO: 219757 - DNA, 20 bp, Artificial
  CRISPR gRNA sequence
tctaatttgttacagtggga

SEQ ID NO: 219758 - DNA, 20 bp, Artificial
  CRISPR gRNA sequence
taatttgttacagtgggaaa

SEQ ID NO: 219759 - DNA, 20 bp, Artificial
  CRISPR gRNA sequence
atttgttacagtgggaaaag

SEQ ID NO: 219760 - DNA, 20 bp, Artificial
  CRISPR gRNA sequence
gttacagtgggaaaagtttg

SEQ ID NO: 219761 - DNA, 20 bp, Artificial
  CRISPR gRNA sequence
ttacagtgggaaaagtttga

SEQ ID NO: 219762 - DNA, 20 bp, Artificial
  CRISPR gRNA sequence
cagtgggaaaagtttgagga

SEQ ID NO: 219763 - DNA, 20 bp, Artificial
  CRISPR gRNA sequence
gaggatcatggaattagata

SEQ ID NO: 219764 - DNA, 20 bp, Artificial
  CRISPR gRNA sequence
aggatcatggaattagatat

SEQ ID NO: 219765 - DNA, 20 bp, Artificial
  CRISPR gRNA sequence
gatatttaagaaccaactga

SEQ ID NO: 219766 - DNA, 20 bp, Artificial
  CRISPR gRNA sequence
aagaaccaactgagatgctg

SEQ ID NO: 219767 - DNA, 20 bp, Artificial
  CRISPR gRNA sequence
agaaccaactgagatgctgg

SEQ ID NO: 219768 - DNA, 20 bp, Artificial
  CRISPR gRNA sequence
agatgctgggggaaaaaaac

SEQ ID NO: 219769 - DNA, 20 bp, Artificial
  CRISPR gRNA sequence
ggggaaaaaaaccaacattt

SEQ ID NO: 219770 - DNA, 20 bp, Artificial
  CRISPR gRNA sequence
tatataaagccacttatatg

SEQ ID NO: 219771 - DNA, 20 bp, Artificial
  CRISPR gRNA sequence
atataaagccacttatatgc

SEQ ID NO: 219772 - DNA, 20 bp, Artificial
  CRISPR gRNA sequence
tataaagccacttatatgcc

SEQ ID NO: 219773 - DNA, 20 bp, Artificial
  CRISPR gRNA sequence
atatgcctattaagctattg

SEQ ID NO: 219774 - DNA, 20 bp, Artificial
  CRISPR gRNA sequence
tatgcctattaagctattga

SEQ ID NO: 219775 - DNA, 20 bp, Artificial
  CRISPR gRNA sequence
ttaagctattgatttgttat

SEQ ID NO: 219776 - DNA, 20 bp, Artificial
  CRISPR gRNA sequence
agctattgatttgttatggt

SEQ ID NO: 219777 - DNA, 20 bp, Artificial
  CRISPR gRNA sequence
ttgatttgttatggtagtac

SEQ ID NO: 219778 - DNA, 20 bp, Artificial
  CRISPR gRNA sequence
atttgttatggtagtactgt

SEQ ID NO: 219779 - DNA, 20 bp, Artificial
  CRISPR gRNA sequence
gttatggtagtactgtcaga

SEQ ID NO: 219780 - DNA, 20 bp, Artificial
  CRISPR gRNA sequence
ttatggtagtactgtcagat

SEQ ID NO: 219781 - DNA, 20 bp, Artificial
  CRISPR gRNA sequence
tggtagtactgtcagatgac

SEQ ID NO: 219782 - DNA, 20 bp, Artificial
  CRISPR gRNA sequence
tcagatgacgttaactcttg

SEQ ID NO: 219783 - DNA, 20 bp, Artificial
  CRISPR gRNA sequence
actcttgttcctcaagggga

SEQ ID NO: 219784 - DNA, 20 bp, Artificial
  CRISPR gRNA sequence
ttgttcctcaaggggagagt

SEQ ID NO: 219785 - DNA, 20 bp, Artificial
  CRISPR gRNA sequence
gttcctcaaggggagagtga

SEQ ID NO: 219786 - DNA, 20 bp, Artificial
  CRISPR gRNA sequence
ttcctcaaggggagagtgag

SEQ ID NO: 219787 - DNA, 20 bp, Artificial
  CRISPR gRNA sequence
ctcaaggggagagtgagaca

SEQ ID NO: 219788 - DNA, 20 bp, Artificial
  CRISPR gRNA sequence
aaggggagagtgagacatga

SEQ ID NO: 219789 - DNA, 20 bp, Artificial
  CRISPR gRNA sequence
ctttcagctctgaatttcta

SEQ ID NO: 219790 - DNA, 20 bp, Artificial
  CRISPR gRNA sequence
tttcagctctgaatttctat

SEQ ID NO: 219791 - DNA, 20 bp, Artificial
  CRISPR gRNA sequence
tcagctctgaatttctatgc

SEQ ID NO: 219792 - DNA, 20 bp, Artificial
  CRISPR gRNA sequence
cagctctgaatttctatgcc

SEQ ID NO: 219793 - DNA, 20 bp, Artificial
  CRISPR gRNA sequence
agctctgaatttctatgcca

SEQ ID NO: 219794 - DNA, 20 bp, Artificial
  CRISPR gRNA sequence
tgaatttctatgccactaag

SEQ ID NO: 219795 - DNA, 20 bp, Artificial
  CRISPR gRNA sequence
aatttctatgccactaagaa

SEQ ID NO: 219796 - DNA, 20 bp, Artificial
  CRISPR gRNA sequence
ctatgccactaagaacataa

SEQ ID NO: 219797 - DNA, 20 bp, Artificial
  CRISPR gRNA sequence
tatgccactaagaacataaa

SEQ ID NO: 219798 - DNA, 20 bp, Artificial
  CRISPR gRNA sequence
tgccactaagaacataaatt

SEQ ID NO: 219799 - DNA, 20 bp, Artificial
  CRISPR gRNA sequence
agaacataaattaagcttaa

SEQ ID NO: 219800 - DNA, 20 bp, Artificial
  CRISPR gRNA sequence
agcttaaaatggactaagaa

SEQ ID NO: 219801 - DNA, 20 bp, Artificial
  CRISPR gRNA sequence
aaaatggactaagaacaatg

SEQ ID NO: 219802 - DNA, 20 bp, Artificial
  CRISPR gRNA sequence
aaatggactaagaacaatgt

SEQ ID NO: 219803 - DNA, 20 bp, Artificial
  CRISPR gRNA sequence
agaacaatgtcagatatttt

SEQ ID NO: 219804 - DNA, 20 bp, Artificial
  CRISPR gRNA sequence
ttccatcacaagattaataa

SEQ ID NO: 219805 - DNA, 20 bp, Artificial
  CRISPR gRNA sequence
tccatcacaagattaataaa

SEQ ID NO: 219806 - DNA, 20 bp, Artificial
  CRISPR gRNA sequence
ccatcacaagattaataaag

SEQ ID NO: 219807 - DNA, 20 bp, Artificial
  CRISPR gRNA sequence
catcacaagattaataaaga

SEQ ID NO: 219808 - DNA, 20 bp, Artificial
  CRISPR gRNA sequence
ataaagataagccaaggaca

SEQ ID NO: 219809 - DNA, 20 bp, Artificial
  CRISPR gRNA sequence
acatccttattctacccaag

SEQ ID NO: 219810 - DNA, 20 bp, Artificial
  CRISPR gRNA sequence
attctacccaagctatggct

SEQ ID NO: 219811 - DNA, 20 bp, Artificial
  CRISPR gRNA sequence
ttctacccaagctatggctg

SEQ ID NO: 219812 - DNA, 20 bp, Artificial
  CRISPR gRNA sequence
tacccaagctatggctgaca

SEQ ID NO: 219813 - DNA, 20 bp, Artificial
  CRISPR gRNA sequence
cccaagctatggctgacaac

SEQ ID NO: 219814 - DNA, 20 bp, Artificial
  CRISPR gRNA sequence
tggctgacaactgtgtctat

SEQ ID NO: 219815 - DNA, 20 bp, Artificial
  CRISPR gRNA sequence
acaactgtgtctatcactct

SEQ ID NO: 219816 - DNA, 20 bp, Artificial
  CRISPR gRNA sequence
tgtctatcactctcctccaa

SEQ ID NO: 219817 - DNA, 20 bp, Artificial
  CRISPR gRNA sequence
tcactctcctccaattcctg

SEQ ID NO: 219818 - DNA, 20 bp, Artificial
  CRISPR gRNA sequence
tcctccaattcctggacagg

SEQ ID NO: 219819 - DNA, 20 bp, Artificial
  CRISPR gRNA sequence
ctccaattcctggacaggca

SEQ ID NO: 219820 - DNA, 20 bp, Artificial
  CRISPR gRNA sequence
caattcctggacaggcagaa

SEQ ID NO: 219821 - DNA, 20 bp, Artificial
  CRISPR gRNA sequence
ctggacaggcagaatggctt

SEQ ID NO: 219822 - DNA, 20 bp, Artificial
  CRISPR gRNA sequence
gacaggcagaatggcttcca

SEQ ID NO: 219823 - DNA, 20 bp, Artificial
  CRISPR gRNA sequence
ccacgaaaatgaacttcttg

SEQ ID NO: 219824 - DNA, 20 bp, Artificial
  CRISPR gRNA sequence
cacgaaaatgaacttcttgc

SEQ ID NO: 219825 - DNA, 20 bp, Artificial
  CRISPR gRNA sequence
cttgctagtggaaaggcaaa

SEQ ID NO: 219826 - DNA, 20 bp, Artificial
  CRISPR gRNA sequence
ttgctagtggaaaggcaaag

SEQ ID NO: 219827 - DNA, 20 bp, Artificial
  CRISPR gRNA sequence
gctagtggaaaggcaaagaa

SEQ ID NO: 219828 - DNA, 20 bp, Artificial
  CRISPR gRNA sequence
ctagtggaaaggcaaagaag

SEQ ID NO: 219829 - DNA, 20 bp, Artificial
  CRISPR gRNA sequence
gtggaaaggcaaagaagtga

SEQ ID NO: 219830 - DNA, 20 bp, Artificial
  CRISPR gRNA sequence
caagggtgtagtcaatgaat

SEQ ID NO: 219831 - DNA, 20 bp, Artificial
  CRISPR gRNA sequence
aatttttgctttcaagctga

SEQ ID NO: 219832 - DNA, 20 bp, Artificial
  CRISPR gRNA sequence
atttttgctttcaagctgaa

SEQ ID NO: 219833 - DNA, 20 bp, Artificial
  CRISPR gRNA sequence
ttgctttcaagctgaagtgt

SEQ ID NO: 219834 - DNA, 20 bp, Artificial
  CRISPR gRNA sequence
tgctttcaagctgaagtgtt

SEQ ID NO: 219835 - DNA, 20 bp, Artificial
  CRISPR gRNA sequence
gctttcaagctgaagtgtta

SEQ ID NO: 219836 - DNA, 20 bp, Artificial
  CRISPR gRNA sequence
ctttcaagctgaagtgttat

SEQ ID NO: 219837 - DNA, 20 bp, Artificial
  CRISPR gRNA sequence
tcaagctgaagtgttattaa

SEQ ID NO: 219838 - DNA, 20 bp, Artificial
  CRISPR gRNA sequence
caagctgaagtgttattaaa

SEQ ID NO: 219839 - DNA, 20 bp, Artificial
  CRISPR gRNA sequence
aagctgaagtgttattaaaa

SEQ ID NO: 219840 - DNA, 20 bp, Artificial
  CRISPR gRNA sequence
aagtgttattaaaacccagg

SEQ ID NO: 219841 - DNA, 20 bp, Artificial
  CRISPR gRNA sequence
ttaaaacccaggacctcatt

SEQ ID NO: 219842 - DNA, 20 bp, Artificial
  CRISPR gRNA sequence
aaacccaggacctcatttgt

SEQ ID NO: 219843 - DNA, 20 bp, Artificial
  CRISPR gRNA sequence
atttgtcttatcactgtaca

SEQ ID NO: 219844 - DNA, 20 bp, Artificial
  CRISPR gRNA sequence
gtcttatcactgtacaaaaa

SEQ ID NO: 219845 - DNA, 20 bp, Artificial
  CRISPR gRNA sequence
tcttatcactgtacaaaaat

SEQ ID NO: 219846 - DNA, 20 bp, Artificial
  CRISPR gRNA sequence
atcactgtacaaaaatgaga

SEQ ID NO: 219847 - DNA, 20 bp, Artificial
  CRISPR gRNA sequence
tcactgtacaaaaatgagac

SEQ ID NO: 219848 - DNA, 20 bp, Artificial
  CRISPR gRNA sequence
tacaaaaatgagacaaccta

SEQ ID NO: 219849 - DNA, 20 bp, Artificial
  CRISPR gRNA sequence
aaaaagtgaagacaccattc

SEQ ID NO: 219850 - DNA, 20 bp, Artificial
  CRISPR gRNA sequence
ctatcaacaaagtgtctcct

SEQ ID NO: 219851 - DNA, 20 bp, Artificial
  CRISPR gRNA sequence
tcaacaaagtgtctccttca

SEQ ID NO: 219852 - DNA, 20 bp, Artificial
  CRISPR gRNA sequence
cttcaaactcccacaaacat

SEQ ID NO: 219853 - DNA, 20 bp, Artificial
  CRISPR gRNA sequence
caaactcccacaaacatagg

SEQ ID NO: 219854 - DNA, 20 bp, Artificial
  CRISPR gRNA sequence
aaactcccacaaacataggg

SEQ ID NO: 219855 - DNA, 20 bp, Artificial
  CRISPR gRNA sequence
ccacaaacatagggaacacc

SEQ ID NO: 219856 - DNA, 20 bp, Artificial
  CRISPR gRNA sequence
cacacacacacacacgcata

SEQ ID NO: 219857 - DNA, 20 bp, Artificial
  CRISPR gRNA sequence
acaatcctaaaatgcaaacc

SEQ ID NO: 219858 - DNA, 20 bp, Artificial
  CRISPR gRNA sequence
caatcctaaaatgcaaacca

SEQ ID NO: 219859 - DNA, 20 bp, Artificial
  CRISPR gRNA sequence
aaatgcaaaccaaattttta

SEQ ID NO: 219860 - DNA, 20 bp, Artificial
  CRISPR gRNA sequence
ttacttgatgtttcaggatt

SEQ ID NO: 219861 - DNA, 20 bp, Artificial
  CRISPR gRNA sequence
tacttgatgtttcaggattg

SEQ ID NO: 219862 - DNA, 20 bp, Artificial
  CRISPR gRNA sequence
acttgatgtttcaggattgt

SEQ ID NO: 219863 - DNA, 20 bp, Artificial
  CRISPR gRNA sequence
cttgatgtttcaggattgtg

SEQ ID NO: 219864 - DNA, 20 bp, Artificial
  CRISPR gRNA sequence
gatgtttcaggattgtgatg

SEQ ID NO: 219865 - DNA, 20 bp, Artificial
  CRISPR gRNA sequence
atgtttcaggattgtgatgg

SEQ ID NO: 219866 - DNA, 20 bp, Artificial
  CRISPR gRNA sequence
caggattgtgatggcttttc

SEQ ID NO: 219867 - DNA, 20 bp, Artificial
  CRISPR gRNA sequence
aggattgtgatggcttttct

SEQ ID NO: 219868 - DNA, 20 bp, Artificial
  CRISPR gRNA sequence
tgatggcttttctgatgtgt

SEQ ID NO: 219869 - DNA, 20 bp, Artificial
  CRISPR gRNA sequence
ttctgatgtgtcgacttgct

SEQ ID NO: 219870 - DNA, 20 bp, Artificial
  CRISPR gRNA sequence
tctgatgtgtcgacttgcta

SEQ ID NO: 219871 - DNA, 20 bp, Artificial
  CRISPR gRNA sequence
ctgatgtgtcgacttgctag

SEQ ID NO: 219872 - DNA, 20 bp, Artificial
  CRISPR gRNA sequence
tgatgtgtcgacttgctagg

SEQ ID NO: 219873 - DNA, 20 bp, Artificial
  CRISPR gRNA sequence
atgtgtcgacttgctaggct

SEQ ID NO: 219874 - DNA, 20 bp, Artificial
  CRISPR gRNA sequence
gctaggctacagtcccatta

SEQ ID NO: 219875 - DNA, 20 bp, Artificial
  CRISPR gRNA sequence
ctaggctacagtcccattat

SEQ ID NO: 219876 - DNA, 20 bp, Artificial
  CRISPR gRNA sequence
ggctacagtcccattattta

SEQ ID NO: 219877 - DNA, 20 bp, Artificial
  CRISPR gRNA sequence
cagtcccattatttatttaa

SEQ ID NO: 219878 - DNA, 20 bp, Artificial
  CRISPR gRNA sequence
tttatttaatcaaacccaga

SEQ ID NO: 219879 - DNA, 20 bp, Artificial
  CRISPR gRNA sequence
atttaatcaaacccagaatt

SEQ ID NO: 219880 - DNA, 20 bp, Artificial
  CRISPR gRNA sequence
tttaatcaaacccagaattc

SEQ ID NO: 219881 - DNA, 20 bp, Artificial
  CRISPR gRNA sequence
aatcaaacccagaattctaa

SEQ ID NO: 219882 - DNA, 20 bp, Artificial
  CRISPR gRNA sequence
atcaaacccagaattctaag

SEQ ID NO: 219883 - DNA, 20 bp, Artificial
  CRISPR gRNA sequence
taaggtggtcccaaaacccc

SEQ ID NO: 219884 - DNA, 20 bp, Artificial
  CRISPR gRNA sequence
aggtggtcccaaaacccctg

SEQ ID NO: 219885 - DNA, 20 bp, Artificial
  CRISPR gRNA sequence
ccctagccatgcatctttta

SEQ ID NO: 219886 - DNA, 20 bp, Artificial
  CRISPR gRNA sequence
gccatgcatcttttataatt

SEQ ID NO: 219887 - DNA, 20 bp, Artificial
  CRISPR gRNA sequence
ttataattccctccccttgt

SEQ ID NO: 219888 - DNA, 20 bp, Artificial
  CRISPR gRNA sequence
tataattccctccccttgtg

SEQ ID NO: 219889 - DNA, 20 bp, Artificial
  CRISPR gRNA sequence
ataattccctccccttgtgt

SEQ ID NO: 219890 - DNA, 20 bp, Artificial
  CRISPR gRNA sequence
taattccctccccttgtgtg

SEQ ID NO: 219891 - DNA, 20 bp, Artificial
  CRISPR gRNA sequence
cctccccttgtgtgtgggag

SEQ ID NO: 219892 - DNA, 20 bp, Artificial
  CRISPR gRNA sequence
cccttgtgtgtgggagacta

SEQ ID NO: 219893 - DNA, 20 bp, Artificial
  CRISPR gRNA sequence
gtgtgtgggagactaggact

SEQ ID NO: 219894 - DNA, 20 bp, Artificial
  CRISPR gRNA sequence
tgtgtgggagactaggactg

SEQ ID NO: 219895 - DNA, 20 bp, Artificial
  CRISPR gRNA sequence
ggactgtgaatgtattggat

SEQ ID NO: 219896 - DNA, 20 bp, Artificial
  CRISPR gRNA sequence
tgaatgtattggatttcatt

SEQ ID NO: 219897 - DNA, 20 bp, Artificial
  CRISPR gRNA sequence
gatttcattttcatgattat

SEQ ID NO: 219898 - DNA, 20 bp, Artificial
  CRISPR gRNA sequence
cattttcatgattatatcac

SEQ ID NO: 219899 - DNA, 20 bp, Artificial
  CRISPR gRNA sequence
attttcatgattatatcacc

SEQ ID NO: 219900 - DNA, 20 bp, Artificial
  CRISPR gRNA sequence
tcatgattatatcacccagc

SEQ ID NO: 219901 - DNA, 20 bp, Artificial
  CRISPR gRNA sequence
catgattatatcacccagca

SEQ ID NO: 219902 - DNA, 20 bp, Artificial
  CRISPR gRNA sequence
atgattatatcacccagcaa

SEQ ID NO: 219903 - DNA, 20 bp, Artificial
  CRISPR gRNA sequence
tatcacccagcaaaagggag

SEQ ID NO: 219904 - DNA, 20 bp, Artificial
  CRISPR gRNA sequence
gctgatgtaattaagatccc

SEQ ID NO: 219905 - DNA, 20 bp, Artificial
  CRISPR gRNA sequence
ctgatgtaattaagatccca

SEQ ID NO: 219906 - DNA, 20 bp, Artificial
  CRISPR gRNA sequence
atgtaattaagatcccaaat

SEQ ID NO: 219907 - DNA, 20 bp, Artificial
  CRISPR gRNA sequence
agatcccaaatcagctgact

SEQ ID NO: 219908 - DNA, 20 bp, Artificial
  CRISPR gRNA sequence
actttaagaaagagagatta

SEQ ID NO: 219909 - DNA, 20 bp, Artificial
  CRISPR gRNA sequence
taagaaagagagattatttt

SEQ ID NO: 219910 - DNA, 20 bp, Artificial
  CRISPR gRNA sequence
aagaaagagagattattttt

SEQ ID NO: 219911 - DNA, 20 bp, Artificial
  CRISPR gRNA sequence
agaaagagagattatttttg

SEQ ID NO: 219912 - DNA, 20 bp, Artificial
  CRISPR gRNA sequence
tttttgagggagagagagct

SEQ ID NO: 219913 - DNA, 20 bp, Artificial
  CRISPR gRNA sequence
ttgagggagagagagctgac

SEQ ID NO: 219914 - DNA, 20 bp, Artificial
  CRISPR gRNA sequence
tgagggagagagagctgacc

SEQ ID NO: 219915 - DNA, 20 bp, Artificial
  CRISPR gRNA sequence
gagggagagagagctgacct

SEQ ID NO: 219916 - DNA, 20 bp, Artificial
  CRISPR gRNA sequence
agggagagagagctgaccta

SEQ ID NO: 219917 - DNA, 20 bp, Artificial
  CRISPR gRNA sequence
acctaaccaagtggtctctt

SEQ ID NO: 219918 - DNA, 20 bp, Artificial
  CRISPR gRNA sequence
accaagtggtctcttaaaag

SEQ ID NO: 219919 - DNA, 20 bp, Artificial
  CRISPR gRNA sequence
ttaaaagggtctgggttctt

SEQ ID NO: 219920 - DNA, 20 bp, Artificial
  CRISPR gRNA sequence
aaaagggtctgggttcttcc

SEQ ID NO: 219921 - DNA, 20 bp, Artificial
  CRISPR gRNA sequence
aaagggtctgggttcttcct

SEQ ID NO: 219922 - DNA, 20 bp, Artificial
  CRISPR gRNA sequence
ggttcttcctggcaaaataa

SEQ ID NO: 219923 - DNA, 20 bp, Artificial
  CRISPR gRNA sequence
ttcctggcaaaataaactca

SEQ ID NO: 219924 - DNA, 20 bp, Artificial
  CRISPR gRNA sequence
cctggcaaaataaactcaat

SEQ ID NO: 219925 - DNA, 20 bp, Artificial
  CRISPR gRNA sequence
ctggcaaaataaactcaata

SEQ ID NO: 219926 - DNA, 20 bp, Artificial
  CRISPR gRNA sequence
gcaaaataaactcaatatgt

SEQ ID NO: 219927 - DNA, 20 bp, Artificial
  CRISPR gRNA sequence
aatatgtgagagggattcaa

SEQ ID NO: 219928 - DNA, 20 bp, Artificial
  CRISPR gRNA sequence
aacaagaggaagattctcct

SEQ ID NO: 219929 - DNA, 20 bp, Artificial
  CRISPR gRNA sequence
tcctttgctggctttaaata

SEQ ID NO: 219930 - DNA, 20 bp, Artificial
  CRISPR gRNA sequence
ctttgctggctttaaatatg

SEQ ID NO: 219931 - DNA, 20 bp, Artificial
  CRISPR gRNA sequence
tgctggctttaaatatgcaa

SEQ ID NO: 219932 - DNA, 20 bp, Artificial
  CRISPR gRNA sequence
gctggctttaaatatgcaag

SEQ ID NO: 219933 - DNA, 20 bp, Artificial
  CRISPR gRNA sequence
ctggctttaaatatgcaagg

SEQ ID NO: 219934 - DNA, 20 bp, Artificial
  CRISPR gRNA sequence
gctttaaatatgcaaggggc

SEQ ID NO: 219935 - DNA, 20 bp, Artificial
  CRISPR gRNA sequence
taaatatgcaaggggccatg

SEQ ID NO: 219936 - DNA, 20 bp, Artificial
  CRISPR gRNA sequence
aaatatgcaaggggccatgg

SEQ ID NO: 219937 - DNA, 20 bp, Artificial
  CRISPR gRNA sequence
aatatgcaaggggccatggg

SEQ ID NO: 219938 - DNA, 20 bp, Artificial
  CRISPR gRNA sequence
taggagctgctacaattcct

SEQ ID NO: 219939 - DNA, 20 bp, Artificial
  CRISPR gRNA sequence
ggagctgctacaattccttg

SEQ ID NO: 219940 - DNA, 20 bp, Artificial
  CRISPR gRNA sequence
ctacaattccttggcagata

SEQ ID NO: 219941 - DNA, 20 bp, Artificial
  CRISPR gRNA sequence
caattccttggcagatactt

SEQ ID NO: 219942 - DNA, 20 bp, Artificial
  CRISPR gRNA sequence
cttggcagatacttagcaaa

SEQ ID NO: 219943 - DNA, 20 bp, Artificial
  CRISPR gRNA sequence
ggcagatacttagcaaagaa

SEQ ID NO: 219944 - DNA, 20 bp, Artificial
  CRISPR gRNA sequence
gcagatacttagcaaagaaa

SEQ ID NO: 219945 - DNA, 20 bp, Artificial
  CRISPR gRNA sequence
agcaaagaaacagggacccc

SEQ ID NO: 219946 - DNA, 20 bp, Artificial
  CRISPR gRNA sequence
gcaaagaaacagggacccca

SEQ ID NO: 219947 - DNA, 20 bp, Artificial
  CRISPR gRNA sequence
acaatcacaaggaattgaat

SEQ ID NO: 219948 - DNA, 20 bp, Artificial
  CRISPR gRNA sequence
caatcacaaggaattgaatt

SEQ ID NO: 219949 - DNA, 20 bp, Artificial
  CRISPR gRNA sequence
aattctgtcacaattatgtg

SEQ ID NO: 219950 - DNA, 20 bp, Artificial
  CRISPR gRNA sequence
tgtcacaattatgtgagcct

SEQ ID NO: 219951 - DNA, 20 bp, Artificial
  CRISPR gRNA sequence
tcacaattatgtgagcctag

SEQ ID NO: 219952 - DNA, 20 bp, Artificial
  CRISPR gRNA sequence
tgtgagcctagaacaagacc

SEQ ID NO: 219953 - DNA, 20 bp, Artificial
  CRISPR gRNA sequence
gaacaagaccccaaactcca

SEQ ID NO: 219954 - DNA, 20 bp, Artificial
  CRISPR gRNA sequence
caaataaagtatgccctggg

SEQ ID NO: 219955 - DNA, 20 bp, Artificial
  CRISPR gRNA sequence
ggcaacaccttgattttagt

SEQ ID NO: 219956 - DNA, 20 bp, Artificial
  CRISPR gRNA sequence
gattttagtcttttaagact

SEQ ID NO: 219957 - DNA, 20 bp, Artificial
  CRISPR gRNA sequence
attttagtcttttaagactt

SEQ ID NO: 219958 - DNA, 20 bp, Artificial
  CRISPR gRNA sequence
tagtcttttaagactttgat

SEQ ID NO: 219959 - DNA, 20 bp, Artificial
  CRISPR gRNA sequence
agtcttttaagactttgatc

SEQ ID NO: 219960 - DNA, 20 bp, Artificial
  CRISPR gRNA sequence
gtcttttaagactttgatca

SEQ ID NO: 219961 - DNA, 20 bp, Artificial
  CRISPR gRNA sequence
ttaagactttgatcagagaa

SEQ ID NO: 219962 - DNA, 20 bp, Artificial
  CRISPR gRNA sequence
taagactttgatcagagaac

SEQ ID NO: 219963 - DNA, 20 bp, Artificial
  CRISPR gRNA sequence
aagactttgatcagagaacc

SEQ ID NO: 219964 - DNA, 20 bp, Artificial
  CRISPR gRNA sequence
agactttgatcagagaaccc

SEQ ID NO: 219965 - DNA, 20 bp, Artificial
  CRISPR gRNA sequence
tgatcagagaacccagtcat

SEQ ID NO: 219966 - DNA, 20 bp, Artificial
  CRISPR gRNA sequence
gatcagagaacccagtcatg

SEQ ID NO: 219967 - DNA, 20 bp, Artificial
  CRISPR gRNA sequence
atcagagaacccagtcatgc

SEQ ID NO: 219968 - DNA, 20 bp, Artificial
  CRISPR gRNA sequence
gccacctacaaaactttgag

SEQ ID NO: 219969 - DNA, 20 bp, Artificial
  CRISPR gRNA sequence
ccacctacaaaactttgagc

SEQ ID NO: 219970 - DNA, 20 bp, Artificial
  CRISPR gRNA sequence
caaaactttgagctaaaaaa

SEQ ID NO: 219971 - DNA, 20 bp, Artificial
  CRISPR gRNA sequence
tgagctaaaaaatgggtagt

SEQ ID NO: 219972 - DNA, 20 bp, Artificial
  CRISPR gRNA sequence
gagctaaaaaatgggtagtg

SEQ ID NO: 219973 - DNA, 20 bp, Artificial
  CRISPR gRNA sequence
agctaaaaaatgggtagtgt

SEQ ID NO: 219974 - DNA, 20 bp, Artificial
  CRISPR gRNA sequence
aaaaatgggtagtgttttaa

SEQ ID NO: 219975 - DNA, 20 bp, Artificial
  CRISPR gRNA sequence
taagctgctatatttgtagt

SEQ ID NO: 219976 - DNA, 20 bp, Artificial
  CRISPR gRNA sequence
aagctgctatatttgtagtt

SEQ ID NO: 219977 - DNA, 20 bp, Artificial
  CRISPR gRNA sequence
agctgctatatttgtagttg

SEQ ID NO: 219978 - DNA, 20 bp, Artificial
  CRISPR gRNA sequence
ctatatttgtagttgttatg

SEQ ID NO: 219979 - DNA, 20 bp, Artificial
  CRISPR gRNA sequence
tatttgtagttgttatgcag

SEQ ID NO: 219980 - DNA, 20 bp, Artificial
  CRISPR gRNA sequence
gtagttgttatgcagcacta

SEQ ID NO: 219981 - DNA, 20 bp, Artificial
  CRISPR gRNA sequence
tagttgttatgcagcactag

SEQ ID NO: 219982 - DNA, 20 bp, Artificial
  CRISPR gRNA sequence
ttatgcagcactagaaaact

SEQ ID NO: 219983 - DNA, 20 bp, Artificial
  CRISPR gRNA sequence
tgcagcactagaaaactaat

SEQ ID NO: 219984 - DNA, 20 bp, Artificial
  CRISPR gRNA sequence
gaaaactaatacaaagatct

SEQ ID NO: 219985 - DNA, 20 bp, Artificial
  CRISPR gRNA sequence
atacaaagatcttgcaatgc

SEQ ID NO: 219986 - DNA, 20 bp, Artificial
  CRISPR gRNA sequence
gcaatgccttcatgtcttca

SEQ ID NO: 219987 - DNA, 20 bp, Artificial
  CRISPR gRNA sequence
caatgccttcatgtcttcat

SEQ ID NO: 219988 - DNA, 20 bp, Artificial
  CRISPR gRNA sequence
catgtcttcattataaacag

SEQ ID NO: 219989 - DNA, 20 bp, Artificial
  CRISPR gRNA sequence
atgtcttcattataaacaga

SEQ ID NO: 219990 - DNA, 20 bp, Artificial
  CRISPR gRNA sequence
cattataaacagaccatatg

SEQ ID NO: 219991 - DNA, 20 bp, Artificial
  CRISPR gRNA sequence
attataaacagaccatatgt

SEQ ID NO: 219992 - DNA, 20 bp, Artificial
  CRISPR gRNA sequence
taaacagaccatatgtcctg

SEQ ID NO: 219993 - DNA, 20 bp, Artificial
  CRISPR gRNA sequence
ttgataataatggaattggc

SEQ ID NO: 219994 - DNA, 20 bp, Artificial
  CRISPR gRNA sequence
ataataatggaattggcaac

SEQ ID NO: 219995 - DNA, 20 bp, Artificial
  CRISPR gRNA sequence
gcaacactgcggaacttgaa

SEQ ID NO: 219996 - DNA, 20 bp, Artificial
  CRISPR gRNA sequence
cggaacttgaactgaccttt

SEQ ID NO: 219997 - DNA, 20 bp, Artificial
  CRISPR gRNA sequence
gaactgacctttctaaacaa

SEQ ID NO: 219998 - DNA, 20 bp, Artificial
  CRISPR gRNA sequence
aactgacctttctaaacaaa

SEQ ID NO: 219999 - DNA, 20 bp, Artificial
  CRISPR gRNA sequence
acctttctaaacaaaactct

SEQ ID NO: 220000 - DNA, 20 bp, Artificial
  CRISPR gRNA sequence
tctaaacaaaactctaatag

SEQ ID NO: 220001 - DNA, 20 bp, Artificial
  CRISPR gRNA sequence
ctaaacaaaactctaatagc

SEQ ID NO: 220002 - DNA, 20 bp, Artificial
  CRISPR gRNA sequence
taaacaaaactctaatagct

SEQ ID NO: 220003 - DNA, 20 bp, Artificial
  CRISPR gRNA sequence
aacaaaactctaatagctta

SEQ ID NO: 220004 - DNA, 20 bp, Artificial
  CRISPR gRNA sequence
taatagcttagagaaaaata

SEQ ID NO: 220005 - DNA, 20 bp, Artificial
  CRISPR gRNA sequence
atagcttagagaaaaataaa

SEQ ID NO: 220006 - DNA, 20 bp, Artificial
  CRISPR gRNA sequence
agagaaaaataaactttaag

SEQ ID NO: 220007 - DNA, 20 bp, Artificial
  CRISPR gRNA sequence
gagaaaaataaactttaagt

SEQ ID NO: 220008 - DNA, 20 bp, Artificial
  CRISPR gRNA sequence
taagttttcaagtttttgta

SEQ ID NO: 220009 - DNA, 20 bp, Artificial
  CRISPR gRNA sequence
aagttttcaagtttttgtat

SEQ ID NO: 220010 - DNA, 20 bp, Artificial
  CRISPR gRNA sequence
agttttcaagtttttgtatt

SEQ ID NO: 220011 - DNA, 20 bp, Artificial
  CRISPR gRNA sequence
tcaagtttttgtattgctaa

SEQ ID NO: 220012 - DNA, 20 bp, Artificial
  CRISPR gRNA sequence
caagtttttgtattgctaat

SEQ ID NO: 220013 - DNA, 20 bp, Artificial
  CRISPR gRNA sequence
aagtttttgtattgctaata

SEQ ID NO: 220014 - DNA, 20 bp, Artificial
  CRISPR gRNA sequence
ttgtattgctaatagaacag

SEQ ID NO: 220015 - DNA, 20 bp, Artificial
  CRISPR gRNA sequence
tgtattgctaatagaacaga

SEQ ID NO: 220016 - DNA, 20 bp, Artificial
  CRISPR gRNA sequence
gtattgctaatagaacagaa

SEQ ID NO: 220017 - DNA, 20 bp, Artificial
  CRISPR gRNA sequence
tattgctaatagaacagaaa

SEQ ID NO: 220018 - DNA, 20 bp, Artificial
  CRISPR gRNA sequence
ctaatagaacagaaatatta

SEQ ID NO: 220019 - DNA, 20 bp, Artificial
  CRISPR gRNA sequence
atagaacagaaatattaatg

SEQ ID NO: 220020 - DNA, 20 bp, Artificial
  CRISPR gRNA sequence
atgataaattttatgattac

SEQ ID NO: 220021 - DNA, 20 bp, Artificial
  CRISPR gRNA sequence
tatgattactagtatttgca

SEQ ID NO: 220022 - DNA, 20 bp, Artificial
  CRISPR gRNA sequence
atgattactagtatttgcat

SEQ ID NO: 220023 - DNA, 20 bp, Artificial
  CRISPR gRNA sequence
tgattactagtatttgcatt

SEQ ID NO: 220024 - DNA, 20 bp, Artificial
  CRISPR gRNA sequence
ctagtatttgcattcagtat

SEQ ID NO: 220025 - DNA, 20 bp, Artificial
  CRISPR gRNA sequence
gtatttgcattcagtattta

SEQ ID NO: 220026 - DNA, 20 bp, Artificial
  CRISPR gRNA sequence
gcattcagtatttagttatt

SEQ ID NO: 220027 - DNA, 20 bp, Artificial
  CRISPR gRNA sequence
cattcagtatttagttattt

SEQ ID NO: 220028 - DNA, 20 bp, Artificial
  CRISPR gRNA sequence
agtatttagttatttacaag

SEQ ID NO: 220029 - DNA, 20 bp, Artificial
  CRISPR gRNA sequence
agttatttacaaggtgtttt

SEQ ID NO: 220030 - DNA, 20 bp, Artificial
  CRISPR gRNA sequence
gttatttacaaggtgttttc

SEQ ID NO: 220031 - DNA, 20 bp, Artificial
  CRISPR gRNA sequence
tttacaaggtgttttcacat

SEQ ID NO: 220032 - DNA, 20 bp, Artificial
  CRISPR gRNA sequence
acaaggtgttttcacatgaa

SEQ ID NO: 220033 - DNA, 20 bp, Artificial
  CRISPR gRNA sequence
caaggtgttttcacatgaac

SEQ ID NO: 220034 - DNA, 20 bp, Artificial
  CRISPR gRNA sequence
tcacatgaaccacatattac

SEQ ID NO: 220035 - DNA, 20 bp, Artificial
  CRISPR gRNA sequence
cacatgaaccacatattacg

SEQ ID NO: 220036 - DNA, 20 bp, Artificial
  CRISPR gRNA sequence
acatgaaccacatattacgg

SEQ ID NO: 220037 - DNA, 20 bp, Artificial
  CRISPR gRNA sequence
cggtggtaaaaatactgggt

SEQ ID NO: 220038 - DNA, 20 bp, Artificial
  CRISPR gRNA sequence
ggttttgatgccaaagagat

SEQ ID NO: 220039 - DNA, 20 bp, Artificial
  CRISPR gRNA sequence
tgatgccaaagagatctagg

SEQ ID NO: 220040 - DNA, 20 bp, Artificial
  CRISPR gRNA sequence
gatgccaaagagatctaggt

SEQ ID NO: 220041 - DNA, 20 bp, Artificial
  CRISPR gRNA sequence
atgccaaagagatctaggtt

SEQ ID NO: 220042 - DNA, 20 bp, Artificial
  CRISPR gRNA sequence
ggtttaattcttggctatta

SEQ ID NO: 220043 - DNA, 20 bp, Artificial
  CRISPR gRNA sequence
aattcttggctattactctg

SEQ ID NO: 220044 - DNA, 20 bp, Artificial
  CRISPR gRNA sequence
attcttggctattactctga

SEQ ID NO: 220045 - DNA, 20 bp, Artificial
  CRISPR gRNA sequence
ttggctattactctgacctt

SEQ ID NO: 220046 - DNA, 20 bp, Artificial
  CRISPR gRNA sequence
ggctattactctgaccttga

SEQ ID NO: 220047 - DNA, 20 bp, Artificial
  CRISPR gRNA sequence
gctattactctgaccttgaa

SEQ ID NO: 220048 - DNA, 20 bp, Artificial
  CRISPR gRNA sequence
ttactctgaccttgaacaat

SEQ ID NO: 220049 - DNA, 20 bp, Artificial
  CRISPR gRNA sequence
ctctgaccttgaacaatacc

SEQ ID NO: 220050 - DNA, 20 bp, Artificial
  CRISPR gRNA sequence
tgaccttgaacaataccttg

SEQ ID NO: 220051 - DNA, 20 bp, Artificial
  CRISPR gRNA sequence
accttgaacaataccttgaa

SEQ ID NO: 220052 - DNA, 20 bp, Artificial
  CRISPR gRNA sequence
gaacaataccttgaatctct

SEQ ID NO: 220053 - DNA, 20 bp, Artificial
  CRISPR gRNA sequence
aacaataccttgaatctctt

SEQ ID NO: 220054 - DNA, 20 bp, Artificial
  CRISPR gRNA sequence
gaatctcttttgcttcccta

SEQ ID NO: 220055 - DNA, 20 bp, Artificial
  CRISPR gRNA sequence
aatctcttttgcttccctat

SEQ ID NO: 220056 - DNA, 20 bp, Artificial
  CRISPR gRNA sequence
ttttgcttccctatttgtta

SEQ ID NO: 220057 - DNA, 20 bp, Artificial
  CRISPR gRNA sequence
ttgcttccctatttgttaaa

SEQ ID NO: 220058 - DNA, 20 bp, Artificial
  CRISPR gRNA sequence
tgcttccctatttgttaaat

SEQ ID NO: 220059 - DNA, 20 bp, Artificial
  CRISPR gRNA sequence
gcttccctatttgttaaatg

SEQ ID NO: 220060 - DNA, 20 bp, Artificial
  CRISPR gRNA sequence
cttccctatttgttaaatgg

SEQ ID NO: 220061 - DNA, 20 bp, Artificial
  CRISPR gRNA sequence
ccctatttgttaaatggtaa

SEQ ID NO: 220062 - DNA, 20 bp, Artificial
  CRISPR gRNA sequence
cctatttgttaaatggtaag

SEQ ID NO: 220063 - DNA, 20 bp, Artificial
  CRISPR gRNA sequence
tttgttaaatggtaagaact

SEQ ID NO: 220064 - DNA, 20 bp, Artificial
  CRISPR gRNA sequence
gttaaatggtaagaactcca

SEQ ID NO: 220065 - DNA, 20 bp, Artificial
  CRISPR gRNA sequence
ttaaatggtaagaactccat

SEQ ID NO: 220066 - DNA, 20 bp, Artificial
  CRISPR gRNA sequence
aatggtaagaactccatcta

SEQ ID NO: 220067 - DNA, 20 bp, Artificial
  CRISPR gRNA sequence
catctatctcctagagttct

SEQ ID NO: 220068 - DNA, 20 bp, Artificial
  CRISPR gRNA sequence
tctcctagagttcttgagag

SEQ ID NO: 220069 - DNA, 20 bp, Artificial
  CRISPR gRNA sequence
ctagagttcttgagaggata

SEQ ID NO: 220070 - DNA, 20 bp, Artificial
  CRISPR gRNA sequence
gagttcttgagaggataaca

SEQ ID NO: 220071 - DNA, 20 bp, Artificial
  CRISPR gRNA sequence
ttgagaggataacaggacac

SEQ ID NO: 220072 - DNA, 20 bp, Artificial
  CRISPR gRNA sequence
gagaggataacaggacacga

SEQ ID NO: 220073 - DNA, 20 bp, Artificial
  CRISPR gRNA sequence
agaggataacaggacacgac

SEQ ID NO: 220074 - DNA, 20 bp, Artificial
  CRISPR gRNA sequence
acataaagtatgtggcacat

SEQ ID NO: 220075 - DNA, 20 bp, Artificial
  CRISPR gRNA sequence
cataaagtatgtggcacatg

SEQ ID NO: 220076 - DNA, 20 bp, Artificial
  CRISPR gRNA sequence
ggtcacttcactcttcatat

SEQ ID NO: 220077 - DNA, 20 bp, Artificial
  CRISPR gRNA sequence
cactcttcatatttgtactg

SEQ ID NO: 220078 - DNA, 20 bp, Artificial
  CRISPR gRNA sequence
actcttcatatttgtactgc

SEQ ID NO: 220079 - DNA, 20 bp, Artificial
  CRISPR gRNA sequence
ttcatatttgtactgcaacc

SEQ ID NO: 220080 - DNA, 20 bp, Artificial
  CRISPR gRNA sequence
catatttgtactgcaaccac

SEQ ID NO: 220081 - DNA, 20 bp, Artificial
  CRISPR gRNA sequence
atatttgtactgcaaccact

SEQ ID NO: 220082 - DNA, 20 bp, Artificial
  CRISPR gRNA sequence
gtactgcaaccacttccttg

SEQ ID NO: 220083 - DNA, 20 bp, Artificial
  CRISPR gRNA sequence
tactgcaaccacttccttga

SEQ ID NO: 220084 - DNA, 20 bp, Artificial
  CRISPR gRNA sequence
caaccacttccttgaaatca

SEQ ID NO: 220085 - DNA, 20 bp, Artificial
  CRISPR gRNA sequence
ccttgaaatcagcaataatg

SEQ ID NO: 220086 - DNA, 20 bp, Artificial
  CRISPR gRNA sequence
cttgaaatcagcaataatgt

SEQ ID NO: 220087 - DNA, 20 bp, Artificial
  CRISPR gRNA sequence
gaaatcagcaataatgtctt

SEQ ID NO: 220088 - DNA, 20 bp, Artificial
  CRISPR gRNA sequence
aaatcagcaataatgtctta

SEQ ID NO: 220089 - DNA, 20 bp, Artificial
  CRISPR gRNA sequence
attcatcacagaatctgtga

SEQ ID NO: 220090 - DNA, 20 bp, Artificial
  CRISPR gRNA sequence
ttcatcacagaatctgtgat

SEQ ID NO: 220091 - DNA, 20 bp, Artificial
  CRISPR gRNA sequence
atcacagaatctgtgatgcc

SEQ ID NO: 220092 - DNA, 20 bp, Artificial
  CRISPR gRNA sequence
tgatgcctagtacggtgact

SEQ ID NO: 220093 - DNA, 20 bp, Artificial
  CRISPR gRNA sequence
gtacggtgactggcacatgg

SEQ ID NO: 220094 - DNA, 20 bp, Artificial
  CRISPR gRNA sequence
gcacatggtaggcacttagt

SEQ ID NO: 220095 - DNA, 20 bp, Artificial
  CRISPR gRNA sequence
agtaaaattttgttaagtaa

SEQ ID NO: 220096 - DNA, 20 bp, Artificial
  CRISPR gRNA sequence
gtaaaattttgttaagtaag

SEQ ID NO: 220097 - DNA, 20 bp, Artificial
  CRISPR gRNA sequence
tgttaagtaagagaggtatt

SEQ ID NO: 220098 - DNA, 20 bp, Artificial
  CRISPR gRNA sequence
gttaagtaagagaggtatta

SEQ ID NO: 220099 - DNA, 20 bp, Artificial
  CRISPR gRNA sequence
ttaagtaagagaggtattat

SEQ ID NO: 220100 - DNA, 20 bp, Artificial
  CRISPR gRNA sequence
agtaagagaggtattattta

SEQ ID NO: 220101 - DNA, 20 bp, Artificial
  CRISPR gRNA sequence
tttatatctcaaacatttcc

SEQ ID NO: 220102 - DNA, 20 bp, Artificial
  CRISPR gRNA sequence
atatctcaaacatttccatg

SEQ ID NO: 220103 - DNA, 20 bp, Artificial
  CRISPR gRNA sequence
tatctcaaacatttccatga

SEQ ID NO: 220104 - DNA, 20 bp, Artificial
  CRISPR gRNA sequence
aaacatttccatgatggtga

SEQ ID NO: 220105 - DNA, 20 bp, Artificial
  CRISPR gRNA sequence
ccatgatggtgatgccatct

SEQ ID NO: 220106 - DNA, 20 bp, Artificial
  CRISPR gRNA sequence
catgatggtgatgccatctt

SEQ ID NO: 220107 - DNA, 20 bp, Artificial
  CRISPR gRNA sequence
tactgtactaagaagaattt

SEQ ID NO: 220108 - DNA, 20 bp, Artificial
  CRISPR gRNA sequence
actgtactaagaagaatttg

SEQ ID NO: 220109 - DNA, 20 bp, Artificial
  CRISPR gRNA sequence
ctgtactaagaagaatttga

SEQ ID NO: 220110 - DNA, 20 bp, Artificial
  CRISPR gRNA sequence
tactaagaagaatttgaggg

SEQ ID NO: 220111 - DNA, 20 bp, Artificial
  CRISPR gRNA sequence
agaagaatttgagggacaga

SEQ ID NO: 220112 - DNA, 20 bp, Artificial
  CRISPR gRNA sequence
gagggacagataggttgagt

SEQ ID NO: 220113 - DNA, 20 bp, Artificial
  CRISPR gRNA sequence
agggacagataggttgagtt

SEQ ID NO: 220114 - DNA, 20 bp, Artificial
  CRISPR gRNA sequence
agttttttatccaacttttc

SEQ ID NO: 220115 - DNA, 20 bp, Artificial
  CRISPR gRNA sequence
tttatccaacttttcttaag

SEQ ID NO: 220116 - DNA, 20 bp, Artificial
  CRISPR gRNA sequence
ttatccaacttttcttaagc

SEQ ID NO: 220117 - DNA, 20 bp, Artificial
  CRISPR gRNA sequence
tatccaacttttcttaagct

SEQ ID NO: 220118 - DNA, 20 bp, Artificial
  CRISPR gRNA sequence
atccaacttttcttaagcta

SEQ ID NO: 220119 - DNA, 20 bp, Artificial
  CRISPR gRNA sequence
tccaacttttcttaagctat

SEQ ID NO: 220120 - DNA, 20 bp, Artificial
  CRISPR gRNA sequence
ttcttaagctattaaacagt

SEQ ID NO: 220121 - DNA, 20 bp, Artificial
  CRISPR gRNA sequence
tcttaagctattaaacagtg

SEQ ID NO: 220122 - DNA, 20 bp, Artificial
  CRISPR gRNA sequence
cttaagctattaaacagtga

SEQ ID NO: 220123 - DNA, 20 bp, Artificial
  CRISPR gRNA sequence
ttaagctattaaacagtgaa

SEQ ID NO: 220124 - DNA, 20 bp, Artificial
  CRISPR gRNA sequence
aagctattaaacagtgaagt

SEQ ID NO: 220125 - DNA, 20 bp, Artificial
  CRISPR gRNA sequence
agctattaaacagtgaagtc

SEQ ID NO: 220126 - DNA, 20 bp, Artificial
  CRISPR gRNA sequence
ttaaacagtgaagtctagaa

SEQ ID NO: 220127 - DNA, 20 bp, Artificial
  CRISPR gRNA sequence
aacagtgaagtctagaaaac

SEQ ID NO: 220128 - DNA, 20 bp, Artificial
  CRISPR gRNA sequence
gaaaacagctttctaatttc

SEQ ID NO: 220129 - DNA, 20 bp, Artificial
  CRISPR gRNA sequence
tctaatttcaagtccagtgc

SEQ ID NO: 220130 - DNA, 20 bp, Artificial
  CRISPR gRNA sequence
ctaatttcaagtccagtgct

SEQ ID NO: 220131 - DNA, 20 bp, Artificial
  CRISPR gRNA sequence
taatttcaagtccagtgctc

SEQ ID NO: 220132 - DNA, 20 bp, Artificial
  CRISPR gRNA sequence
atttcaagtccagtgctcct

SEQ ID NO: 220133 - DNA, 20 bp, Artificial
  CRISPR gRNA sequence
caagtccagtgctccttcta

SEQ ID NO: 220134 - DNA, 20 bp, Artificial
  CRISPR gRNA sequence
aagtccagtgctccttctaa

SEQ ID NO: 220135 - DNA, 20 bp, Artificial
  CRISPR gRNA sequence
cttctaatggactatatcat

SEQ ID NO: 220136 - DNA, 20 bp, Artificial
  CRISPR gRNA sequence
ctaatggactatatcataca

SEQ ID NO: 220137 - DNA, 20 bp, Artificial
  CRISPR gRNA sequence
taatggactatatcatacat

SEQ ID NO: 220138 - DNA, 20 bp, Artificial
  CRISPR gRNA sequence
atggactatatcatacatag

SEQ ID NO: 220139 - DNA, 20 bp, Artificial
  CRISPR gRNA sequence
tatcatacataggcacagag

SEQ ID NO: 220140 - DNA, 20 bp, Artificial
  CRISPR gRNA sequence
tatcttatagtgtttccatg

SEQ ID NO: 220141 - DNA, 20 bp, Artificial
  CRISPR gRNA sequence
atagtgtttccatgtattca

SEQ ID NO: 220142 - DNA, 20 bp, Artificial
  CRISPR gRNA sequence
tagtgtttccatgtattcag

SEQ ID NO: 220143 - DNA, 20 bp, Artificial
  CRISPR gRNA sequence
ccatgtattcagtcctagtc

SEQ ID NO: 220144 - DNA, 20 bp, Artificial
  CRISPR gRNA sequence
catgtattcagtcctagtcc

SEQ ID NO: 220145 - DNA, 20 bp, Artificial
  CRISPR gRNA sequence
agtcctagtcctccaaaaaa

SEQ ID NO: 220146 - DNA, 20 bp, Artificial
  CRISPR gRNA sequence
gtcctccaaaaaatttaaaa

SEQ ID NO: 220147 - DNA, 20 bp, Artificial
  CRISPR gRNA sequence
caaaaaatttaaaaaggcac

SEQ ID NO: 220148 - DNA, 20 bp, Artificial
  CRISPR gRNA sequence
aaaaaggcacaaagaatggt

SEQ ID NO: 220149 - DNA, 20 bp, Artificial
  CRISPR gRNA sequence
aaaaggcacaaagaatggtc

SEQ ID NO: 220150 - DNA, 20 bp, Artificial
  CRISPR gRNA sequence
ttatctgcattctattaagt

SEQ ID NO: 220151 - DNA, 20 bp, Artificial
  CRISPR gRNA sequence
tctgcattctattaagtaga

SEQ ID NO: 220152 - DNA, 20 bp, Artificial
  CRISPR gRNA sequence
cattctattaagtagaattc

SEQ ID NO: 220153 - DNA, 20 bp, Artificial
  CRISPR gRNA sequence
tattaagtagaattcacttc

SEQ ID NO: 220154 - DNA, 20 bp, Artificial
  CRISPR gRNA sequence
ttaagtagaattcacttctc

SEQ ID NO: 220155 - DNA, 20 bp, Artificial
  CRISPR gRNA sequence
agtagaattcacttctctat

SEQ ID NO: 220156 - DNA, 20 bp, Artificial
  CRISPR gRNA sequence
acttctctattgagcaaatt

SEQ ID NO: 220157 - DNA, 20 bp, Artificial
  CRISPR gRNA sequence
ctctattgagcaaattctgt

SEQ ID NO: 220158 - DNA, 20 bp, Artificial
  CRISPR gRNA sequence
tctattgagcaaattctgtt

SEQ ID NO: 220159 - DNA, 20 bp, Artificial
  CRISPR gRNA sequence
tattgagcaaattctgtttc

SEQ ID NO: 220160 - DNA, 20 bp, Artificial
  CRISPR gRNA sequence
ttgagcaaattctgtttctc

SEQ ID NO: 220161 - DNA, 20 bp, Artificial
  CRISPR gRNA sequence
agcaaattctgtttctcatt

SEQ ID NO: 220162 - DNA, 20 bp, Artificial
  CRISPR gRNA sequence
tgtttctcatttatgcctgt

SEQ ID NO: 220163 - DNA, 20 bp, Artificial
  CRISPR gRNA sequence
tttctcatttatgcctgtat

SEQ ID NO: 220164 - DNA, 20 bp, Artificial
  CRISPR gRNA sequence
ctcatttatgcctgtatttg

SEQ ID NO: 220165 - DNA, 20 bp, Artificial
  CRISPR gRNA sequence
tcatttatgcctgtatttgc

SEQ ID NO: 220166 - DNA, 20 bp, Artificial
  CRISPR gRNA sequence
atttatgcctgtatttgcaa

SEQ ID NO: 220167 - DNA, 20 bp, Artificial
  CRISPR gRNA sequence
atgcctgtatttgcaaaaat

SEQ ID NO: 220168 - DNA, 20 bp, Artificial
  CRISPR gRNA sequence
tgcctgtatttgcaaaaatc

SEQ ID NO: 220169 - DNA, 20 bp, Artificial
  CRISPR gRNA sequence
tatttgcaaaaatcacgaca

SEQ ID NO: 220170 - DNA, 20 bp, Artificial
  CRISPR gRNA sequence
gcaaaaatcacgacatagta

SEQ ID NO: 220171 - DNA, 20 bp, Artificial
  CRISPR gRNA sequence
caaaaatcacgacatagtaa

SEQ ID NO: 220172 - DNA, 20 bp, Artificial
  CRISPR gRNA sequence
ctaatgcttaaatcctcaaa

SEQ ID NO: 220173 - DNA, 20 bp, Artificial
  CRISPR gRNA sequence
taatgcttaaatcctcaaag

SEQ ID NO: 220174 - DNA, 20 bp, Artificial
  CRISPR gRNA sequence
atgcttaaatcctcaaagtc

SEQ ID NO: 220175 - DNA, 20 bp, Artificial
  CRISPR gRNA sequence
aaatcctcaaagtccgtgac

SEQ ID NO: 220176 - DNA, 20 bp, Artificial
  CRISPR gRNA sequence
aatcctcaaagtccgtgaca

SEQ ID NO: 220177 - DNA, 20 bp, Artificial
  CRISPR gRNA sequence
aaagtccgtgacaagtaagt

SEQ ID NO: 220178 - DNA, 20 bp, Artificial
  CRISPR gRNA sequence
ttattagaaaagaacttata

SEQ ID NO: 220179 - DNA, 20 bp, Artificial
  CRISPR gRNA sequence
attagaaaagaacttatact

SEQ ID NO: 220180 - DNA, 20 bp, Artificial
  CRISPR gRNA sequence
ttagaaaagaacttatactc

SEQ ID NO: 220181 - DNA, 20 bp, Artificial
  CRISPR gRNA sequence
gaaaagaacttatactccat

SEQ ID NO: 220182 - DNA, 20 bp, Artificial
  CRISPR gRNA sequence
atactccatagtaagagtcc

SEQ ID NO: 220183 - DNA, 20 bp, Artificial
  CRISPR gRNA sequence
tactccatagtaagagtcct

SEQ ID NO: 220184 - DNA, 20 bp, Artificial
  CRISPR gRNA sequence
catagtaagagtcctgcccc

SEQ ID NO: 220185 - DNA, 20 bp, Artificial
  CRISPR gRNA sequence
ccccatttaacctttttgtg

SEQ ID NO: 220186 - DNA, 20 bp, Artificial
  CRISPR gRNA sequence
aacctttttgtgcagataac

SEQ ID NO: 220187 - DNA, 20 bp, Artificial
  CRISPR gRNA sequence
acctttttgtgcagataact

SEQ ID NO: 220188 - DNA, 20 bp, Artificial
  CRISPR gRNA sequence
tttgtgcagataacttttta

SEQ ID NO: 220189 - DNA, 20 bp, Artificial
  CRISPR gRNA sequence
ttgtgcagataactttttaa

SEQ ID NO: 220190 - DNA, 20 bp, Artificial
  CRISPR gRNA sequence
tgtgcagataactttttaac

SEQ ID NO: 220191 - DNA, 20 bp, Artificial
  CRISPR gRNA sequence
gtgcagataactttttaact

SEQ ID NO: 220192 - DNA, 20 bp, Artificial
  CRISPR gRNA sequence
tgcagataactttttaactg

SEQ ID NO: 220193 - DNA, 20 bp, Artificial
  CRISPR gRNA sequence
tttaactggtttttgtttgt

SEQ ID NO: 220194 - DNA, 20 bp, Artificial
  CRISPR gRNA sequence
ttaactggtttttgtttgtt

SEQ ID NO: 220195 - DNA, 20 bp, Artificial
  CRISPR gRNA sequence
taactggtttttgtttgttt

SEQ ID NO: 220196 - DNA, 20 bp, Artificial
  CRISPR gRNA sequence
aactggtttttgtttgtttg

SEQ ID NO: 220197 - DNA, 20 bp, Artificial
  CRISPR gRNA sequence
actggtttttgtttgtttgt

SEQ ID NO: 220198 - DNA, 20 bp, Artificial
  CRISPR gRNA sequence
gtttttgtttgtttgttgtt

SEQ ID NO: 220199 - DNA, 20 bp, Artificial
  CRISPR gRNA sequence
ttgtttgtttgttgtttttt

SEQ ID NO: 220200 - DNA, 20 bp, Artificial
  CRISPR gRNA sequence
tgtttgtttgttgttttttt

SEQ ID NO: 220201 - DNA, 20 bp, Artificial
  CRISPR gRNA sequence
gtttgtttgttgtttttttc

SEQ ID NO: 220202 - DNA, 20 bp, Artificial
  CRISPR gRNA sequence
tttgtttgttgtttttttca

SEQ ID NO: 220203 - DNA, 20 bp, Artificial
  CRISPR gRNA sequence
gtttgttgtttttttcagtt

SEQ ID NO: 220204 - DNA, 20 bp, Artificial
  CRISPR gRNA sequence
tttgttgtttttttcagtta

SEQ ID NO: 220205 - DNA, 20 bp, Artificial
  CRISPR gRNA sequence
gttgtttttttcagttaaaa

SEQ ID NO: 220206 - DNA, 20 bp, Artificial
  CRISPR gRNA sequence
ttgtttttttcagttaaaaa

SEQ ID NO: 220207 - DNA, 20 bp, Artificial
  CRISPR gRNA sequence
tttttttcagttaaaaatgg

SEQ ID NO: 220208 - DNA, 20 bp, Artificial
  CRISPR gRNA sequence
ttttcagttaaaaatggtta

SEQ ID NO: 220209 - DNA, 20 bp, Artificial
  CRISPR gRNA sequence
tttcagttaaaaatggttac

SEQ ID NO: 220210 - DNA, 20 bp, Artificial
  CRISPR gRNA sequence
ttcagttaaaaatggttaca

SEQ ID NO: 220211 - DNA, 20 bp, Artificial
  CRISPR gRNA sequence
tcagttaaaaatggttacaa

SEQ ID NO: 220212 - DNA, 20 bp, Artificial
  CRISPR gRNA sequence
cagttaaaaatggttacaac

SEQ ID NO: 220213 - DNA, 20 bp, Artificial
  CRISPR gRNA sequence
agttaaaaatggttacaaca

SEQ ID NO: 220214 - DNA, 20 bp, Artificial
  CRISPR gRNA sequence
aaaatggttacaacatagtg

SEQ ID NO: 220215 - DNA, 20 bp, Artificial
  CRISPR gRNA sequence
caacatagtggcaccagata

SEQ ID NO: 220216 - DNA, 20 bp, Artificial
  CRISPR gRNA sequence
gtgaggatgtggagaaacca

SEQ ID NO: 220217 - DNA, 20 bp, Artificial
  CRISPR gRNA sequence
ttacattgttgatggaaatg

SEQ ID NO: 220218 - DNA, 20 bp, Artificial
  CRISPR gRNA sequence
acattgttgatggaaatgta

SEQ ID NO: 220219 - DNA, 20 bp, Artificial
  CRISPR gRNA sequence
cattgttgatggaaatgtaa

SEQ ID NO: 220220 - DNA, 20 bp, Artificial
  CRISPR gRNA sequence
ttgatggaaatgtaaaatga

SEQ ID NO: 220221 - DNA, 20 bp, Artificial
  CRISPR gRNA sequence
atggaaatgtaaaatgaaat

SEQ ID NO: 220222 - DNA, 20 bp, Artificial
  CRISPR gRNA sequence
tggaaaagtctggcagtttc

SEQ ID NO: 220223 - DNA, 20 bp, Artificial
  CRISPR gRNA sequence
gaaaagtctggcagtttctt

SEQ ID NO: 220224 - DNA, 20 bp, Artificial
  CRISPR gRNA sequence
gcagtttctttaaaaactaa

SEQ ID NO: 220225 - DNA, 20 bp, Artificial
  CRISPR gRNA sequence
ctttaaaaactaagcatata

SEQ ID NO: 220226 - DNA, 20 bp, Artificial
  CRISPR gRNA sequence
tttaaaaactaagcatatac

SEQ ID NO: 220227 - DNA, 20 bp, Artificial
  CRISPR gRNA sequence
taaaaactaagcatatactt

SEQ ID NO: 220228 - DNA, 20 bp, Artificial
  CRISPR gRNA sequence
aaaaactaagcatatactta

SEQ ID NO: 220229 - DNA, 20 bp, Artificial
  CRISPR gRNA sequence
aaaactaagcatatacttac

SEQ ID NO: 220230 - DNA, 20 bp, Artificial
  CRISPR gRNA sequence
agcatatacttaccatacag

SEQ ID NO: 220231 - DNA, 20 bp, Artificial
  CRISPR gRNA sequence
accatacagcccagtaacca

SEQ ID NO: 220232 - DNA, 20 bp, Artificial
  CRISPR gRNA sequence
ccatacagcccagtaaccat

SEQ ID NO: 220233 - DNA, 20 bp, Artificial
  CRISPR gRNA sequence
ctgagcatttatcccagaga

SEQ ID NO: 220234 - DNA, 20 bp, Artificial
  CRISPR gRNA sequence
tgagcatttatcccagagaa

SEQ ID NO: 220235 - DNA, 20 bp, Artificial
  CRISPR gRNA sequence
agcatttatcccagagaaat

SEQ ID NO: 220236 - DNA, 20 bp, Artificial
  CRISPR gRNA sequence
atcccagagaaatgaaaact

SEQ ID NO: 220237 - DNA, 20 bp, Artificial
  CRISPR gRNA sequence
tcccagagaaatgaaaactg

SEQ ID NO: 220238 - DNA, 20 bp, Artificial
  CRISPR gRNA sequence
tgtctacacaagaacctgta

SEQ ID NO: 220239 - DNA, 20 bp, Artificial
  CRISPR gRNA sequence
cacaagaacctgtacacaat

SEQ ID NO: 220240 - DNA, 20 bp, Artificial
  CRISPR gRNA sequence
tacacaattgttcagagcag

SEQ ID NO: 220241 - DNA, 20 bp, Artificial
  CRISPR gRNA sequence
ttcagagcagtttcatttgt

SEQ ID NO: 220242 - DNA, 20 bp, Artificial
  CRISPR gRNA sequence
agagcagtttcatttgtaac

SEQ ID NO: 220243 - DNA, 20 bp, Artificial
  CRISPR gRNA sequence
catttgtaacagcccaaact

SEQ ID NO: 220244 - DNA, 20 bp, Artificial
  CRISPR gRNA sequence
atttgtaacagcccaaactt

SEQ ID NO: 220245 - DNA, 20 bp, Artificial
  CRISPR gRNA sequence
gtaacagcccaaacttggaa

SEQ ID NO: 220246 - DNA, 20 bp, Artificial
  CRISPR gRNA sequence
taacagcccaaacttggaaa

SEQ ID NO: 220247 - DNA, 20 bp, Artificial
  CRISPR gRNA sequence
ggaaacaaccaaaatgtcct

SEQ ID NO: 220248 - DNA, 20 bp, Artificial
  CRISPR gRNA sequence
gaaacaaccaaaatgtccta

SEQ ID NO: 220249 - DNA, 20 bp, Artificial
  CRISPR gRNA sequence
ctataggtaagtggttaaac

SEQ ID NO: 220250 - DNA, 20 bp, Artificial
  CRISPR gRNA sequence
taggtaagtggttaaacaaa

SEQ ID NO: 220251 - DNA, 20 bp, Artificial
  CRISPR gRNA sequence
aacaaactgtgatatattca

SEQ ID NO: 220252 - DNA, 20 bp, Artificial
  CRISPR gRNA sequence
tgatatattcatactatgga

SEQ ID NO: 220253 - DNA, 20 bp, Artificial
  CRISPR gRNA sequence
atactatggactactactca

SEQ ID NO: 220254 - DNA, 20 bp, Artificial
  CRISPR gRNA sequence
tggactactactcagcaaaa

SEQ ID NO: 220255 - DNA, 20 bp, Artificial
  CRISPR gRNA sequence
ctactcagcaaaaaaaaaag

SEQ ID NO: 220256 - DNA, 20 bp, Artificial
  CRISPR gRNA sequence
ctcagcaaaaaaaaaagtaa

SEQ ID NO: 220257 - DNA, 20 bp, Artificial
  CRISPR gRNA sequence
agcaaaaaaaaaagtaagga

SEQ ID NO: 220258 - DNA, 20 bp, Artificial
  CRISPR gRNA sequence
ttgatagatgcaaaaacttg

SEQ ID NO: 220259 - DNA, 20 bp, Artificial
  CRISPR gRNA sequence
atagatgcaaaaacttggat

SEQ ID NO: 220260 - DNA, 20 bp, Artificial
  CRISPR gRNA sequence
ggatagatctcaagggcatt

SEQ ID NO: 220261 - DNA, 20 bp, Artificial
  CRISPR gRNA sequence
gatagatctcaagggcattg

SEQ ID NO: 220262 - DNA, 20 bp, Artificial
  CRISPR gRNA sequence
aagggcattgtgcttagtga

SEQ ID NO: 220263 - DNA, 20 bp, Artificial
  CRISPR gRNA sequence
tgcttagtgaaaaagccctt

SEQ ID NO: 220264 - DNA, 20 bp, Artificial
  CRISPR gRNA sequence
agtgaaaaagcccttctcaa

SEQ ID NO: 220265 - DNA, 20 bp, Artificial
  CRISPR gRNA sequence
gtgaaaaagcccttctcaaa

SEQ ID NO: 220266 - DNA, 20 bp, Artificial
  CRISPR gRNA sequence
ctcaaaaggtcacatcttgt

SEQ ID NO: 220267 - DNA, 20 bp, Artificial
  CRISPR gRNA sequence
tcaaaaggtcacatcttgta

SEQ ID NO: 220268 - DNA, 20 bp, Artificial
  CRISPR gRNA sequence
aaaaggtcacatcttgtatc

SEQ ID NO: 220269 - DNA, 20 bp, Artificial
  CRISPR gRNA sequence
gtatcattccatttatatag

SEQ ID NO: 220270 - DNA, 20 bp, Artificial
  CRISPR gRNA sequence
tatcattccatttatatagc

SEQ ID NO: 220271 - DNA, 20 bp, Artificial
  CRISPR gRNA sequence
catttatatagcattgttga

SEQ ID NO: 220272 - DNA, 20 bp, Artificial
  CRISPR gRNA sequence
atatagcattgttgaaatga

SEQ ID NO: 220273 - DNA, 20 bp, Artificial
  CRISPR gRNA sequence
tatagcattgttgaaatgac

SEQ ID NO: 220274 - DNA, 20 bp, Artificial
  CRISPR gRNA sequence
ttgaaatgacaaaattatag

SEQ ID NO: 220275 - DNA, 20 bp, Artificial
  CRISPR gRNA sequence
aaatgacaaaattatagata

SEQ ID NO: 220276 - DNA, 20 bp, Artificial
  CRISPR gRNA sequence
tagatatggaggacaaattg

SEQ ID NO: 220277 - DNA, 20 bp, Artificial
  CRISPR gRNA sequence
gtgcttgccaggttagggac

SEQ ID NO: 220278 - DNA, 20 bp, Artificial
  CRISPR gRNA sequence
gccaggttagggacagtggg

SEQ ID NO: 220279 - DNA, 20 bp, Artificial
  CRISPR gRNA sequence
ccaggttagggacagtggga

SEQ ID NO: 220280 - DNA, 20 bp, Artificial
  CRISPR gRNA sequence
gggacagtgggaggtggcgg

SEQ ID NO: 220281 - DNA, 20 bp, Artificial
  CRISPR gRNA sequence
gtaagaataagcatgaggga

SEQ ID NO: 220282 - DNA, 20 bp, Artificial
  CRISPR gRNA sequence
gttatgatggataggtctat

SEQ ID NO: 220283 - DNA, 20 bp, Artificial
  CRISPR gRNA sequence
ttatgatggataggtctatg

SEQ ID NO: 220284 - DNA, 20 bp, Artificial
  CRISPR gRNA sequence
tgatggataggtctatgtcc

SEQ ID NO: 220285 - DNA, 20 bp, Artificial
  CRISPR gRNA sequence
tgtcctgattgtgtaggtag

SEQ ID NO: 220286 - DNA, 20 bp, Artificial
  CRISPR gRNA sequence
attgtgtaggtagttacgca

SEQ ID NO: 220287 - DNA, 20 bp, Artificial
  CRISPR gRNA sequence
tgtaggtagttacgcaaata

SEQ ID NO: 220288 - DNA, 20 bp, Artificial
  CRISPR gRNA sequence
cgcaaataaacacgtgataa

SEQ ID NO: 220289 - DNA, 20 bp, Artificial
  CRISPR gRNA sequence
acacacactgcaccattgtg

SEQ ID NO: 220290 - DNA, 20 bp, Artificial
  CRISPR gRNA sequence
caccattgtgaacttcctga

SEQ ID NO: 220291 - DNA, 20 bp, Artificial
  CRISPR gRNA sequence
tgaacttcctgattttcata

SEQ ID NO: 220292 - DNA, 20 bp, Artificial
  CRISPR gRNA sequence
cctgattttcatattgtgtc

SEQ ID NO: 220293 - DNA, 20 bp, Artificial
  CRISPR gRNA sequence
ctgattttcatattgtgtca

SEQ ID NO: 220294 - DNA, 20 bp, Artificial
  CRISPR gRNA sequence
attttcatattgtgtcacat

SEQ ID NO: 220295 - DNA, 20 bp, Artificial
  CRISPR gRNA sequence
tcatattgtgtcacataaga

SEQ ID NO: 220296 - DNA, 20 bp, Artificial
  CRISPR gRNA sequence
catattgtgtcacataagag

SEQ ID NO: 220297 - DNA, 20 bp, Artificial
  CRISPR gRNA sequence
atattgtgtcacataagagg

SEQ ID NO: 220298 - DNA, 20 bp, Artificial
  CRISPR gRNA sequence
tgtcacataagaggaaacca

SEQ ID NO: 220299 - DNA, 20 bp, Artificial
  CRISPR gRNA sequence
gggggactgggtgaagggca

SEQ ID NO: 220300 - DNA, 20 bp, Artificial
  CRISPR gRNA sequence
ggtgaagggcacatggaagc

SEQ ID NO: 220301 - DNA, 20 bp, Artificial
  CRISPR gRNA sequence
tctatctttgaatcgtcctg

SEQ ID NO: 220302 - DNA, 20 bp, Artificial
  CRISPR gRNA sequence
tatctttgaatcgtcctgta

SEQ ID NO: 220303 - DNA, 20 bp, Artificial
  CRISPR gRNA sequence
tctttgaatcgtcctgtaaa

SEQ ID NO: 220304 - DNA, 20 bp, Artificial
  CRISPR gRNA sequence
tgaatcgtcctgtaaatcaa

SEQ ID NO: 220305 - DNA, 20 bp, Artificial
  CRISPR gRNA sequence
gaatcgtcctgtaaatcaat

SEQ ID NO: 220306 - DNA, 20 bp, Artificial
  CRISPR gRNA sequence
aatcgtcctgtaaatcaata

SEQ ID NO: 220307 - DNA, 20 bp, Artificial
  CRISPR gRNA sequence
taaatcaataattatttcaa

SEQ ID NO: 220308 - DNA, 20 bp, Artificial
  CRISPR gRNA sequence
tttcaaaaaattaaaatgga

SEQ ID NO: 220309 - DNA, 20 bp, Artificial
  CRISPR gRNA sequence
caaaaaattaaaatggatgc

SEQ ID NO: 220310 - DNA, 20 bp, Artificial
  CRISPR gRNA sequence
aaaaaattaaaatggatgca

SEQ ID NO: 220311 - DNA, 20 bp, Artificial
  CRISPR gRNA sequence
aaatggatgcaaagccaaat

SEQ ID NO: 220312 - DNA, 20 bp, Artificial
  CRISPR gRNA sequence
aaacctctggtagaattttc

SEQ ID NO: 220313 - DNA, 20 bp, Artificial
  CRISPR gRNA sequence
tggtagaattttctacattc

SEQ ID NO: 220314 - DNA, 20 bp, Artificial
  CRISPR gRNA sequence
gtagaattttctacattctc

SEQ ID NO: 220315 - DNA, 20 bp, Artificial
  CRISPR gRNA sequence
tctacattctctataataaa

SEQ ID NO: 220316 - DNA, 20 bp, Artificial
  CRISPR gRNA sequence
ctacattctctataataaaa

SEQ ID NO: 220317 - DNA, 20 bp, Artificial
  CRISPR gRNA sequence
tacattctctataataaaac

SEQ ID NO: 220318 - DNA, 20 bp, Artificial
  CRISPR gRNA sequence
cattctctataataaaacaa

SEQ ID NO: 220319 - DNA, 20 bp, Artificial
  CRISPR gRNA sequence
tctataataaaacaatactt

SEQ ID NO: 220320 - DNA, 20 bp, Artificial
  CRISPR gRNA sequence
tataataaaacaatactttc

SEQ ID NO: 220321 - DNA, 20 bp, Artificial
  CRISPR gRNA sequence
taataaaacaatactttctc

SEQ ID NO: 220322 - DNA, 20 bp, Artificial
  CRISPR gRNA sequence
tctccttttaatggctccca

SEQ ID NO: 220323 - DNA, 20 bp, Artificial
  CRISPR gRNA sequence
ctccttttaatggctcccaa

SEQ ID NO: 220324 - DNA, 20 bp, Artificial
  CRISPR gRNA sequence
tccttttaatggctcccaaa

SEQ ID NO: 220325 - DNA, 20 bp, Artificial
  CRISPR gRNA sequence
cttttaatggctcccaaaat

SEQ ID NO: 220326 - DNA, 20 bp, Artificial
  CRISPR gRNA sequence
ttaatggctcccaaaataag

SEQ ID NO: 220327 - DNA, 20 bp, Artificial
  CRISPR gRNA sequence
taatggctcccaaaataagt

SEQ ID NO: 220328 - DNA, 20 bp, Artificial
  CRISPR gRNA sequence
aatggctcccaaaataagtc

SEQ ID NO: 220329 - DNA, 20 bp, Artificial
  CRISPR gRNA sequence
atggctcccaaaataagtct

SEQ ID NO: 220330 - DNA, 20 bp, Artificial
  CRISPR gRNA sequence
ccaaaataagtctagttttt

SEQ ID NO: 220331 - DNA, 20 bp, Artificial
  CRISPR gRNA sequence
gtttttatttttatagggta

SEQ ID NO: 220332 - DNA, 20 bp, Artificial
  CRISPR gRNA sequence
ttatttttatagggtatttt

SEQ ID NO: 220333 - DNA, 20 bp, Artificial
  CRISPR gRNA sequence
tatttttatagggtattttg

SEQ ID NO: 220334 - DNA, 20 bp, Artificial
  CRISPR gRNA sequence
atttttatagggtattttgc

SEQ ID NO: 220335 - DNA, 20 bp, Artificial
  CRISPR gRNA sequence
tttttatagggtattttgca

SEQ ID NO: 220336 - DNA, 20 bp, Artificial
  CRISPR gRNA sequence
ttatagggtattttgcaaac

SEQ ID NO: 220337 - DNA, 20 bp, Artificial
  CRISPR gRNA sequence
tatagggtattttgcaaaca

SEQ ID NO: 220338 - DNA, 20 bp, Artificial
  CRISPR gRNA sequence
atagggtattttgcaaacaa

SEQ ID NO: 220339 - DNA, 20 bp, Artificial
  CRISPR gRNA sequence
tagggtattttgcaaacaaa

SEQ ID NO: 220340 - DNA, 20 bp, Artificial
  CRISPR gRNA sequence
tgcaaacaaagataaaacag

SEQ ID NO: 220341 - DNA, 20 bp, Artificial
  CRISPR gRNA sequence
gcaaacaaagataaaacagt

SEQ ID NO: 220342 - DNA, 20 bp, Artificial
  CRISPR gRNA sequence
caaacaaagataaaacagtc

SEQ ID NO: 220343 - DNA, 20 bp, Artificial
  CRISPR gRNA sequence
tcaatcacacgcaaaataat

SEQ ID NO: 220344 - DNA, 20 bp, Artificial
  CRISPR gRNA sequence
caatcacacgcaaaataata

SEQ ID NO: 220345 - DNA, 20 bp, Artificial
  CRISPR gRNA sequence
aatcacacgcaaaataataa

SEQ ID NO: 220346 - DNA, 20 bp, Artificial
  CRISPR gRNA sequence
tttttatctcagatcctggc

SEQ ID NO: 220347 - DNA, 20 bp, Artificial
  CRISPR gRNA sequence
ttatctcagatcctggcatt

SEQ ID NO: 220348 - DNA, 20 bp, Artificial
  CRISPR gRNA sequence
tatctcagatcctggcattc

SEQ ID NO: 220349 - DNA, 20 bp, Artificial
  CRISPR gRNA sequence
atctcagatcctggcattcc

SEQ ID NO: 220350 - DNA, 20 bp, Artificial
  CRISPR gRNA sequence
tctcagatcctggcattcct

SEQ ID NO: 220351 - DNA, 20 bp, Artificial
  CRISPR gRNA sequence
agatcctggcattcctttct

SEQ ID NO: 220352 - DNA, 20 bp, Artificial
  CRISPR gRNA sequence
gcattcctttctcttccatc

SEQ ID NO: 220353 - DNA, 20 bp, Artificial
  CRISPR gRNA sequence
ctttctcttccatcttcatt

SEQ ID NO: 220354 - DNA, 20 bp, Artificial
  CRISPR gRNA sequence
tctcttccatcttcatttca

SEQ ID NO: 220355 - DNA, 20 bp, Artificial
  CRISPR gRNA sequence
ctcttccatcttcatttcat

SEQ ID NO: 220356 - DNA, 20 bp, Artificial
  CRISPR gRNA sequence
tcttccatcttcatttcatc

SEQ ID NO: 220357 - DNA, 20 bp, Artificial
  CRISPR gRNA sequence
ttccatcttcatttcatctt

SEQ ID NO: 220358 - DNA, 20 bp, Artificial
  CRISPR gRNA sequence
ccatcttcatttcatcttct

SEQ ID NO: 220359 - DNA, 20 bp, Artificial
  CRISPR gRNA sequence
catcttcatttcatcttctg

SEQ ID NO: 220360 - DNA, 20 bp, Artificial
  CRISPR gRNA sequence
catttcatcttctggccttt

SEQ ID NO: 220361 - DNA, 20 bp, Artificial
  CRISPR gRNA sequence
atttcatcttctggcctttc

SEQ ID NO: 220362 - DNA, 20 bp, Artificial
  CRISPR gRNA sequence
catcttctggcctttcaaat

SEQ ID NO: 220363 - DNA, 20 bp, Artificial
  CRISPR gRNA sequence
atcttctggcctttcaaatc

SEQ ID NO: 220364 - DNA, 20 bp, Artificial
  CRISPR gRNA sequence
ctggcctttcaaatctcata

SEQ ID NO: 220365 - DNA, 20 bp, Artificial
  CRISPR gRNA sequence
tggcctttcaaatctcatat

SEQ ID NO: 220366 - DNA, 20 bp, Artificial
  CRISPR gRNA sequence
gcctttcaaatctcatattt

SEQ ID NO: 220367 - DNA, 20 bp, Artificial
  CRISPR gRNA sequence
tcaaatctcatattttgagt

SEQ ID NO: 220368 - DNA, 20 bp, Artificial
  CRISPR gRNA sequence
caaatctcatattttgagtt

SEQ ID NO: 220369 - DNA, 20 bp, Artificial
  CRISPR gRNA sequence
aaatctcatattttgagttt

SEQ ID NO: 220370 - DNA, 20 bp, Artificial
  CRISPR gRNA sequence
atattttgagttttccagtt

SEQ ID NO: 220371 - DNA, 20 bp, Artificial
  CRISPR gRNA sequence
tgagttttccagtttacctc

SEQ ID NO: 220372 - DNA, 20 bp, Artificial
  CRISPR gRNA sequence
gagttttccagtttacctct

SEQ ID NO: 220373 - DNA, 20 bp, Artificial
  CRISPR gRNA sequence
agttttccagtttacctctc

SEQ ID NO: 220374 - DNA, 20 bp, Artificial
  CRISPR gRNA sequence
tccagtttacctctcagtga

SEQ ID NO: 220375 - DNA, 20 bp, Artificial
  CRISPR gRNA sequence
ccagtttacctctcagtgac

SEQ ID NO: 220376 - DNA, 20 bp, Artificial
  CRISPR gRNA sequence
cagtttacctctcagtgacc

SEQ ID NO: 220377 - DNA, 20 bp, Artificial
  CRISPR gRNA sequence
acctctcagtgacctgcatt

SEQ ID NO: 220378 - DNA, 20 bp, Artificial
  CRISPR gRNA sequence
cctctcagtgacctgcatta

SEQ ID NO: 220379 - DNA, 20 bp, Artificial
  CRISPR gRNA sequence
tcagtgacctgcattacccc

SEQ ID NO: 220380 - DNA, 20 bp, Artificial
  CRISPR gRNA sequence
agtgacctgcattacccccc

SEQ ID NO: 220381 - DNA, 20 bp, Artificial
  CRISPR gRNA sequence
cattaccccccaaaagttac

SEQ ID NO: 220382 - DNA, 20 bp, Artificial
  CRISPR gRNA sequence
ccccccaaaagttactgttc

SEQ ID NO: 220383 - DNA, 20 bp, Artificial
  CRISPR gRNA sequence
ctgttcccccatatcttatt

SEQ ID NO: 220384 - DNA, 20 bp, Artificial
  CRISPR gRNA sequence
ttcccccatatcttattctt

SEQ ID NO: 220385 - DNA, 20 bp, Artificial
  CRISPR gRNA sequence
ccccatatcttattctttca

SEQ ID NO: 220386 - DNA, 20 bp, Artificial
  CRISPR gRNA sequence
attctttcatttccacaaaa

SEQ ID NO: 220387 - DNA, 20 bp, Artificial
  CRISPR gRNA sequence
ttctttcatttccacaaaat

SEQ ID NO: 220388 - DNA, 20 bp, Artificial
  CRISPR gRNA sequence
tttcatttccacaaaattgt

SEQ ID NO: 220389 - DNA, 20 bp, Artificial
  CRISPR gRNA sequence
tcatttccacaaaattgtac

SEQ ID NO: 220390 - DNA, 20 bp, Artificial
  CRISPR gRNA sequence
catttccacaaaattgtaca

SEQ ID NO: 220391 - DNA, 20 bp, Artificial
  CRISPR gRNA sequence
atttccacaaaattgtacat

SEQ ID NO: 220392 - DNA, 20 bp, Artificial
  CRISPR gRNA sequence
ccacaaaattgtacattacc

SEQ ID NO: 220393 - DNA, 20 bp, Artificial
  CRISPR gRNA sequence
cacaaaattgtacattacct

SEQ ID NO: 220394 - DNA, 20 bp, Artificial
  CRISPR gRNA sequence
tacattacctcagaaaaatt

SEQ ID NO: 220395 - DNA, 20 bp, Artificial
  CRISPR gRNA sequence
cctcagaaaaatttcaacta

SEQ ID NO: 220396 - DNA, 20 bp, Artificial
  CRISPR gRNA sequence
agaaaaatttcaactaggta

SEQ ID NO: 220397 - DNA, 20 bp, Artificial
  CRISPR gRNA sequence
caactaggtattagatgatc

SEQ ID NO: 220398 - DNA, 20 bp, Artificial
  CRISPR gRNA sequence
aactaggtattagatgatct

SEQ ID NO: 220399 - DNA, 20 bp, Artificial
  CRISPR gRNA sequence
ggtattagatgatctaatac

SEQ ID NO: 220400 - DNA, 20 bp, Artificial
  CRISPR gRNA sequence
gatgatctaataccagttag

SEQ ID NO: 220401 - DNA, 20 bp, Artificial
  CRISPR gRNA sequence
ataccagttagttgcagtgg

SEQ ID NO: 220402 - DNA, 20 bp, Artificial
  CRISPR gRNA sequence
gttgcagtggatatgactga

SEQ ID NO: 220403 - DNA, 20 bp, Artificial
  CRISPR gRNA sequence
cagtggatatgactgactga

SEQ ID NO: 220404 - DNA, 20 bp, Artificial
  CRISPR gRNA sequence
actgattacacccttcatta

SEQ ID NO: 220405 - DNA, 20 bp, Artificial
  CRISPR gRNA sequence
attacacccttcattaaagg

SEQ ID NO: 220406 - DNA, 20 bp, Artificial
  CRISPR gRNA sequence
cacccttcattaaaggtata

SEQ ID NO: 220407 - DNA, 20 bp, Artificial
  CRISPR gRNA sequence
cattaaaggtatacttaaca

SEQ ID NO: 220408 - DNA, 20 bp, Artificial
  CRISPR gRNA sequence
attaaaggtatacttaacaa

SEQ ID NO: 220409 - DNA, 20 bp, Artificial
  CRISPR gRNA sequence
aaggtatacttaacaacaac

SEQ ID NO: 220410 - DNA, 20 bp, Artificial
  CRISPR gRNA sequence
aacaacaacaaaaaaagctc

SEQ ID NO: 220411 - DNA, 20 bp, Artificial
  CRISPR gRNA sequence
acaacaacaaaaaaagctcc

SEQ ID NO: 220412 - DNA, 20 bp, Artificial
  CRISPR gRNA sequence
ctttgcccaaattaatatca

SEQ ID NO: 220413 - DNA, 20 bp, Artificial
  CRISPR gRNA sequence
tgcccaaattaatatcaata

SEQ ID NO: 220414 - DNA, 20 bp, Artificial
  CRISPR gRNA sequence
gcccaaattaatatcaatag

SEQ ID NO: 220415 - DNA, 20 bp, Artificial
  CRISPR gRNA sequence
cccaaattaatatcaatagt

SEQ ID NO: 220416 - DNA, 20 bp, Artificial
  CRISPR gRNA sequence
atatcaatagtaaaagctac

SEQ ID NO: 220417 - DNA, 20 bp, Artificial
  CRISPR gRNA sequence
caatgtaagagagatttctg

SEQ ID NO: 220418 - DNA, 20 bp, Artificial
  CRISPR gRNA sequence
ctgagcagaaagacctttca

SEQ ID NO: 220419 - DNA, 20 bp, Artificial
  CRISPR gRNA sequence
tgagcagaaagacctttcaa

SEQ ID NO: 220420 - DNA, 20 bp, Artificial
  CRISPR gRNA sequence
agcagaaagacctttcaaat

SEQ ID NO: 220421 - DNA, 20 bp, Artificial
  CRISPR gRNA sequence
tcaaattctccttgcctact

SEQ ID NO: 220422 - DNA, 20 bp, Artificial
  CRISPR gRNA sequence
caaattctccttgcctactc

SEQ ID NO: 220423 - DNA, 20 bp, Artificial
  CRISPR gRNA sequence
aaattctccttgcctactcg

SEQ ID NO: 220424 - DNA, 20 bp, Artificial
  CRISPR gRNA sequence
tccttgcctactcggagcca

SEQ ID NO: 220425 - DNA, 20 bp, Artificial
  CRISPR gRNA sequence
cttgcctactcggagccatc

SEQ ID NO: 220426 - DNA, 20 bp, Artificial
  CRISPR gRNA sequence
gcctactcggagccatccct

SEQ ID NO: 220427 - DNA, 20 bp, Artificial
  CRISPR gRNA sequence
cctactcggagccatccctt

SEQ ID NO: 220428 - DNA, 20 bp, Artificial
  CRISPR gRNA sequence
ctcggagccatcccttgccc

SEQ ID NO: 220429 - DNA, 20 bp, Artificial
  CRISPR gRNA sequence
ggagccatcccttgcccatt

SEQ ID NO: 220430 - DNA, 20 bp, Artificial
  CRISPR gRNA sequence
gcccattcctcactgcacac

SEQ ID NO: 220431 - DNA, 20 bp, Artificial
  CRISPR gRNA sequence
cccattcctcactgcacaca

SEQ ID NO: 220432 - DNA, 20 bp, Artificial
  CRISPR gRNA sequence
ctcactgcacacaaatccct

SEQ ID NO: 220433 - DNA, 20 bp, Artificial
  CRISPR gRNA sequence
actgcacacaaatccctctc

SEQ ID NO: 220434 - DNA, 20 bp, Artificial
  CRISPR gRNA sequence
cacacaaatccctctcacaa

SEQ ID NO: 220435 - DNA, 20 bp, Artificial
  CRISPR gRNA sequence
tcacaatgctctaggctaac

SEQ ID NO: 220436 - DNA, 20 bp, Artificial
  CRISPR gRNA sequence
acaatgctctaggctaactt

SEQ ID NO: 220437 - DNA, 20 bp, Artificial
  CRISPR gRNA sequence
taggctaacttcaacaactt

SEQ ID NO: 220438 - DNA, 20 bp, Artificial
  CRISPR gRNA sequence
ggctaacttcaacaacttga

SEQ ID NO: 220439 - DNA, 20 bp, Artificial
  CRISPR gRNA sequence
acttcaacaacttgatacct

SEQ ID NO: 220440 - DNA, 20 bp, Artificial
  CRISPR gRNA sequence
caacaacttgataccttact

SEQ ID NO: 220441 - DNA, 20 bp, Artificial
  CRISPR gRNA sequence
aacaacttgataccttactt

SEQ ID NO: 220442 - DNA, 20 bp, Artificial
  CRISPR gRNA sequence
gataccttacttcataaaat

SEQ ID NO: 220443 - DNA, 20 bp, Artificial
  CRISPR gRNA sequence
ataccttacttcataaaata

SEQ ID NO: 220444 - DNA, 20 bp, Artificial
  CRISPR gRNA sequence
acttcataaaataaacatcc

SEQ ID NO: 220445 - DNA, 20 bp, Artificial
  CRISPR gRNA sequence
cttcataaaataaacatccc

SEQ ID NO: 220446 - DNA, 20 bp, Artificial
  CRISPR gRNA sequence
cataaaataaacatcccagg

SEQ ID NO: 220447 - DNA, 20 bp, Artificial
  CRISPR gRNA sequence
ataaaataaacatcccagga

SEQ ID NO: 220448 - DNA, 20 bp, Artificial
  CRISPR gRNA sequence
acatttacaacacactttgg

SEQ ID NO: 220449 - DNA, 20 bp, Artificial
  CRISPR gRNA sequence
acaacacactttggtttatg

SEQ ID NO: 220450 - DNA, 20 bp, Artificial
  CRISPR gRNA sequence
caacacactttggtttatgc

SEQ ID NO: 220451 - DNA, 20 bp, Artificial
  CRISPR gRNA sequence
tggtttatgctcattagact

SEQ ID NO: 220452 - DNA, 20 bp, Artificial
  CRISPR gRNA sequence
ggtttatgctcattagactg

SEQ ID NO: 220453 - DNA, 20 bp, Artificial
  CRISPR gRNA sequence
gtttatgctcattagactgt

SEQ ID NO: 220454 - DNA, 20 bp, Artificial
  CRISPR gRNA sequence
atgctcattagactgtagaa

SEQ ID NO: 220455 - DNA, 20 bp, Artificial
  CRISPR gRNA sequence
tgctcattagactgtagaat

SEQ ID NO: 220456 - DNA, 20 bp, Artificial
  CRISPR gRNA sequence
attagactgtagaatacata

SEQ ID NO: 220457 - DNA, 20 bp, Artificial
  CRISPR gRNA sequence
gactgtagaatacataaaag

SEQ ID NO: 220458 - DNA, 20 bp, Artificial
  CRISPR gRNA sequence
tagaatacataaaagcaagt

SEQ ID NO: 220459 - DNA, 20 bp, Artificial
  CRISPR gRNA sequence
ttgtcatctccatttcggac

SEQ ID NO: 220460 - DNA, 20 bp, Artificial
  CRISPR gRNA sequence
tcatctccatttcggacatg

SEQ ID NO: 220461 - DNA, 20 bp, Artificial
  CRISPR gRNA sequence
catttcggacatgaggtaac

SEQ ID NO: 220462 - DNA, 20 bp, Artificial
  CRISPR gRNA sequence
cggacatgaggtaacttgga

SEQ ID NO: 220463 - DNA, 20 bp, Artificial
  CRISPR gRNA sequence
ggacatgaggtaacttggac

SEQ ID NO: 220464 - DNA, 20 bp, Artificial
  CRISPR gRNA sequence
ggactcggttaagcaccttc

SEQ ID NO: 220465 - DNA, 20 bp, Artificial
  CRISPR gRNA sequence
gactcggttaagcaccttct

SEQ ID NO: 220466 - DNA, 20 bp, Artificial
  CRISPR gRNA sequence
ggttaagcaccttctcaaga

SEQ ID NO: 220467 - DNA, 20 bp, Artificial
  CRISPR gRNA sequence
agcaccttctcaagatcaca

SEQ ID NO: 220468 - DNA, 20 bp, Artificial
  CRISPR gRNA sequence
ctcaagatcacacaggtgaa

SEQ ID NO: 220469 - DNA, 20 bp, Artificial
  CRISPR gRNA sequence
tcaagatcacacaggtgaat

SEQ ID NO: 220470 - DNA, 20 bp, Artificial
  CRISPR gRNA sequence
aagatcacacaggtgaatag

SEQ ID NO: 220471 - DNA, 20 bp, Artificial
  CRISPR gRNA sequence
ctgaacaggggctgtaactc

SEQ ID NO: 220472 - DNA, 20 bp, Artificial
  CRISPR gRNA sequence
aacaggggctgtaactcaga

SEQ ID NO: 220473 - DNA, 20 bp, Artificial
  CRISPR gRNA sequence
taactcagacctcctgattc

SEQ ID NO: 220474 - DNA, 20 bp, Artificial
  CRISPR gRNA sequence
agacctcctgattctcaatc

SEQ ID NO: 220475 - DNA, 20 bp, Artificial
  CRISPR gRNA sequence
ctgattctcaatcctaagta

SEQ ID NO: 220476 - DNA, 20 bp, Artificial
  CRISPR gRNA sequence
attctcaatcctaagtaatg

SEQ ID NO: 220477 - DNA, 20 bp, Artificial
  CRISPR gRNA sequence
tcaatcctaagtaatgtgca

SEQ ID NO: 220478 - DNA, 20 bp, Artificial
  CRISPR gRNA sequence
aatcctaagtaatgtgcaaa

SEQ ID NO: 220479 - DNA, 20 bp, Artificial
  CRISPR gRNA sequence
agtaatgtgcaaacatttca

SEQ ID NO: 220480 - DNA, 20 bp, Artificial
  CRISPR gRNA sequence
catcaaaccaaacaccccat

SEQ ID NO: 220481 - DNA, 20 bp, Artificial
  CRISPR gRNA sequence
atcaaaccaaacaccccatt

SEQ ID NO: 220482 - DNA, 20 bp, Artificial
  CRISPR gRNA sequence
ctaatctggtagtagattat

SEQ ID NO: 220483 - DNA, 20 bp, Artificial
  CRISPR gRNA sequence
atctggtagtagattatttt

SEQ ID NO: 220484 - DNA, 20 bp, Artificial
  CRISPR gRNA sequence
gtagtagattattttataaa

SEQ ID NO: 220485 - DNA, 20 bp, Artificial
  CRISPR gRNA sequence
ttttataaaagctaggcaaa

SEQ ID NO: 220486 - DNA, 20 bp, Artificial
  CRISPR gRNA sequence
tataaaagctaggcaaatag

SEQ ID NO: 220487 - DNA, 20 bp, Artificial
  CRISPR gRNA sequence
ataaaagctaggcaaatagt

SEQ ID NO: 220488 - DNA, 20 bp, Artificial
  CRISPR gRNA sequence
taaaagctaggcaaatagtt

SEQ ID NO: 220489 - DNA, 20 bp, Artificial
  CRISPR gRNA sequence
ggcaaatagttgatccaact

SEQ ID NO: 220490 - DNA, 20 bp, Artificial
  CRISPR gRNA sequence
atccaactgaacagaactga

SEQ ID NO: 220491 - DNA, 20 bp, Artificial
  CRISPR gRNA sequence
aacagaactgaacctatcta

SEQ ID NO: 220492 - DNA, 20 bp, Artificial
  CRISPR gRNA sequence
aacctatctagagttaaggt

SEQ ID NO: 220493 - DNA, 20 bp, Artificial
  CRISPR gRNA sequence
tctagagttaaggttctcaa

SEQ ID NO: 220494 - DNA, 20 bp, Artificial
  CRISPR gRNA sequence
gagttaaggttctcaaaatg

SEQ ID NO: 220495 - DNA, 20 bp, Artificial
  CRISPR gRNA sequence
aggttctcaaaatgtggtta

SEQ ID NO: 220496 - DNA, 20 bp, Artificial
  CRISPR gRNA sequence
tcaaaatgtggttaagccat

SEQ ID NO: 220497 - DNA, 20 bp, Artificial
  CRISPR gRNA sequence
aaaatgtggttaagccatga

SEQ ID NO: 220498 - DNA, 20 bp, Artificial
  CRISPR gRNA sequence
agccatgatcggtaatatga

SEQ ID NO: 220499 - DNA, 20 bp, Artificial
  CRISPR gRNA sequence
taaatagagatttcaaaaca

SEQ ID NO: 220500 - DNA, 20 bp, Artificial
  CRISPR gRNA sequence
aatagagatttcaaaacaga

SEQ ID NO: 220501 - DNA, 20 bp, Artificial
  CRISPR gRNA sequence
caaaacagaaagaacatact

SEQ ID NO: 220502 - DNA, 20 bp, Artificial
  CRISPR gRNA sequence
aaaacagaaagaacatactc

SEQ ID NO: 220503 - DNA, 20 bp, Artificial
  CRISPR gRNA sequence
atatggggttgaagaactca

SEQ ID NO: 220504 - DNA, 20 bp, Artificial
  CRISPR gRNA sequence
aagaactcagctagcacagc

SEQ ID NO: 220505 - DNA, 20 bp, Artificial
  CRISPR gRNA sequence
agctagcacagcaggaaaca

SEQ ID NO: 220506 - DNA, 20 bp, Artificial
  CRISPR gRNA sequence
gcacagcaggaaacagcaag

SEQ ID NO: 220507 - DNA, 20 bp, Artificial
  CRISPR gRNA sequence
tttacttcagctaattttac

SEQ ID NO: 220508 - DNA, 20 bp, Artificial
  CRISPR gRNA sequence
acttcagctaattttactac

SEQ ID NO: 220509 - DNA, 20 bp, Artificial
  CRISPR gRNA sequence
cttcagctaattttactacc

SEQ ID NO: 220510 - DNA, 20 bp, Artificial
  CRISPR gRNA sequence
cagctaattttactaccttc

SEQ ID NO: 220511 - DNA, 20 bp, Artificial
  CRISPR gRNA sequence
agctaattttactaccttct

SEQ ID NO: 220512 - DNA, 20 bp, Artificial
  CRISPR gRNA sequence
attttactaccttctacacc

SEQ ID NO: 220513 - DNA, 20 bp, Artificial
  CRISPR gRNA sequence
tactaccttctacacctcag

SEQ ID NO: 220514 - DNA, 20 bp, Artificial
  CRISPR gRNA sequence
actaccttctacacctcagc

SEQ ID NO: 220515 - DNA, 20 bp, Artificial
  CRISPR gRNA sequence
ctaccttctacacctcagca

SEQ ID NO: 220516 - DNA, 20 bp, Artificial
  CRISPR gRNA sequence
ccttctacacctcagcaacc

SEQ ID NO: 220517 - DNA, 20 bp, Artificial
  CRISPR gRNA sequence
ctacacctcagcaacccaag

SEQ ID NO: 220518 - DNA, 20 bp, Artificial
  CRISPR gRNA sequence
tacacctcagcaacccaagt

SEQ ID NO: 220519 - DNA, 20 bp, Artificial
  CRISPR gRNA sequence
cacctcagcaacccaagttt

SEQ ID NO: 220520 - DNA, 20 bp, Artificial
  CRISPR gRNA sequence
agcaacccaagtttgtgata

SEQ ID NO: 220521 - DNA, 20 bp, Artificial
  CRISPR gRNA sequence
gtgataaaaagggcagaatc

SEQ ID NO: 220522 - DNA, 20 bp, Artificial
  CRISPR gRNA sequence
tgataaaaagggcagaatca

SEQ ID NO: 220523 - DNA, 20 bp, Artificial
  CRISPR gRNA sequence
tcatcaagtctgaatttgaa

SEQ ID NO: 220524 - DNA, 20 bp, Artificial
  CRISPR gRNA sequence
aatttgaataaatgaatttg

SEQ ID NO: 220525 - DNA, 20 bp, Artificial
  CRISPR gRNA sequence
gaataaatgaatttgaatct

SEQ ID NO: 220526 - DNA, 20 bp, Artificial
  CRISPR gRNA sequence
aataaatgaatttgaatctc

SEQ ID NO: 220527 - DNA, 20 bp, Artificial
  CRISPR gRNA sequence
gaatctctagttctctcata

SEQ ID NO: 220528 - DNA, 20 bp, Artificial
  CRISPR gRNA sequence
aatctctagttctctcatat

SEQ ID NO: 220529 - DNA, 20 bp, Artificial
  CRISPR gRNA sequence
tagttctctcatattttggc

SEQ ID NO: 220530 - DNA, 20 bp, Artificial
  CRISPR gRNA sequence
gttctctcatattttggcca

SEQ ID NO: 220531 - DNA, 20 bp, Artificial
  CRISPR gRNA sequence
tctcatattttggccaacaa

SEQ ID NO: 220532 - DNA, 20 bp, Artificial
  CRISPR gRNA sequence
tcatattttggccaacaaaa

SEQ ID NO: 220533 - DNA, 20 bp, Artificial
  CRISPR gRNA sequence
atattttggccaacaaaaag

SEQ ID NO: 220534 - DNA, 20 bp, Artificial
  CRISPR gRNA sequence
tggccaacaaaaagaagacc

SEQ ID NO: 220535 - DNA, 20 bp, Artificial
  CRISPR gRNA sequence
ggccaacaaaaagaagacca

SEQ ID NO: 220536 - DNA, 20 bp, Artificial
  CRISPR gRNA sequence
gccaacaaaaagaagaccaa

SEQ ID NO: 220537 - DNA, 20 bp, Artificial
  CRISPR gRNA sequence
agcacagaaaatctgaagaa

SEQ ID NO: 220538 - DNA, 20 bp, Artificial
  CRISPR gRNA sequence
aagaaatcatccatgataac

SEQ ID NO: 220539 - DNA, 20 bp, Artificial
  CRISPR gRNA sequence
aatctcctgactctcctcta

SEQ ID NO: 220540 - DNA, 20 bp, Artificial
  CRISPR gRNA sequence
atctcctgactctcctctat

SEQ ID NO: 220541 - DNA, 20 bp, Artificial
  CRISPR gRNA sequence
ctgactctcctctattctct

SEQ ID NO: 220542 - DNA, 20 bp, Artificial
  CRISPR gRNA sequence
actctcctctattctctcca

SEQ ID NO: 220543 - DNA, 20 bp, Artificial
  CRISPR gRNA sequence
tcctctattctctccagagg

SEQ ID NO: 220544 - DNA, 20 bp, Artificial
  CRISPR gRNA sequence
ctctattctctccagaggga

SEQ ID NO: 220545 - DNA, 20 bp, Artificial
  CRISPR gRNA sequence
tattctctccagagggagca

SEQ ID NO: 220546 - DNA, 20 bp, Artificial
  CRISPR gRNA sequence
ttctctccagagggagcatg

SEQ ID NO: 220547 - DNA, 20 bp, Artificial
  CRISPR gRNA sequence
tctccagagggagcatggct

SEQ ID NO: 220548 - DNA, 20 bp, Artificial
  CRISPR gRNA sequence
tccagagggagcatggctgg

SEQ ID NO: 220549 - DNA, 20 bp, Artificial
  CRISPR gRNA sequence
cagagggagcatggctggga

SEQ ID NO: 220550 - DNA, 20 bp, Artificial
  CRISPR gRNA sequence
ggacttgtcatcccttggtc

SEQ ID NO: 220551 - DNA, 20 bp, Artificial
  CRISPR gRNA sequence
gtcatcccttggtcaaagtg

SEQ ID NO: 220552 - DNA, 20 bp, Artificial
  CRISPR gRNA sequence
tcatcccttggtcaaagtgt

SEQ ID NO: 220553 - DNA, 20 bp, Artificial
  CRISPR gRNA sequence
ggtcaaagtgtaaggttaaa

SEQ ID NO: 220554 - DNA, 20 bp, Artificial
  CRISPR gRNA sequence
gtcaaagtgtaaggttaaaa

SEQ ID NO: 220555 - DNA, 20 bp, Artificial
  CRISPR gRNA sequence
aaaaaaaaaaaaaaaaaaaa

SEQ ID NO: 220556 - DNA, 20 bp, Artificial
  CRISPR gRNA sequence
aataattggaaagagacttg

SEQ ID NO: 220557 - DNA, 20 bp, Artificial
  CRISPR gRNA sequence
gaaagagacttgaaaattag

SEQ ID NO: 220558 - DNA, 20 bp, Artificial
  CRISPR gRNA sequence
gaaaattagtcacaggaaag

SEQ ID NO: 220559 - DNA, 20 bp, Artificial
  CRISPR gRNA sequence
aaaattagtcacaggaaaga

SEQ ID NO: 220560 - DNA, 20 bp, Artificial
  CRISPR gRNA sequence
gtcacaggaaagaaagcact

SEQ ID NO: 220561 - DNA, 20 bp, Artificial
  CRISPR gRNA sequence
ggatggcagcaaacagaaat

SEQ ID NO: 220562 - DNA, 20 bp, Artificial
  CRISPR gRNA sequence
gatggcagcaaacagaaatg

SEQ ID NO: 220563 - DNA, 20 bp, Artificial
  CRISPR gRNA sequence
ccccaggaccaatcagccaa

SEQ ID NO: 220564 - DNA, 20 bp, Artificial
  CRISPR gRNA sequence
agaccaaaagtttgagaacc

SEQ ID NO: 220565 - DNA, 20 bp, Artificial
  CRISPR gRNA sequence
gaccaaaagtttgagaacca

SEQ ID NO: 220566 - DNA, 20 bp, Artificial
  CRISPR gRNA sequence
gagaaccacacaatatacaa

SEQ ID NO: 220567 - DNA, 20 bp, Artificial
  CRISPR gRNA sequence
agaaccacacaatatacaaa

SEQ ID NO: 220568 - DNA, 20 bp, Artificial
  CRISPR gRNA sequence
acaagtaatacaaattaaat

SEQ ID NO: 220569 - DNA, 20 bp, Artificial
  CRISPR gRNA sequence
aatagtaaatgtgttttacc

SEQ ID NO: 220570 - DNA, 20 bp, Artificial
  CRISPR gRNA sequence
taccatgaagagtagattaa

SEQ ID NO: 220571 - DNA, 20 bp, Artificial
  CRISPR gRNA sequence
accatgaagagtagattaac

SEQ ID NO: 220572 - DNA, 20 bp, Artificial
  CRISPR gRNA sequence
ccatgaagagtagattaaca

SEQ ID NO: 220573 - DNA, 20 bp, Artificial
  CRISPR gRNA sequence
acaaataggatagaaatcac

SEQ ID NO: 220574 - DNA, 20 bp, Artificial
  CRISPR gRNA sequence
aaacttgctaaacattacat

SEQ ID NO: 220575 - DNA, 20 bp, Artificial
  CRISPR gRNA sequence
aacttgctaaacattacatc

SEQ ID NO: 220576 - DNA, 20 bp, Artificial
  CRISPR gRNA sequence
gctaaacattacatcaacat

SEQ ID NO: 220577 - DNA, 20 bp, Artificial
  CRISPR gRNA sequence
ctaaacattacatcaacatt

SEQ ID NO: 220578 - DNA, 20 bp, Artificial
  CRISPR gRNA sequence
aacattacatcaacatttat

SEQ ID NO: 220579 - DNA, 20 bp, Artificial
  CRISPR gRNA sequence
catcaacatttattaataac

SEQ ID NO: 220580 - DNA, 20 bp, Artificial
  CRISPR gRNA sequence
attaataacagcctgctttt

SEQ ID NO: 220581 - DNA, 20 bp, Artificial
  CRISPR gRNA sequence
ttaataacagcctgcttttt

SEQ ID NO: 220582 - DNA, 20 bp, Artificial
  CRISPR gRNA sequence
ataacagcctgctttttgat

SEQ ID NO: 220583 - DNA, 20 bp, Artificial
  CRISPR gRNA sequence
ctttttgattcaaaggagta

SEQ ID NO: 220584 - DNA, 20 bp, Artificial
  CRISPR gRNA sequence
tttgattcaaaggagtacct

SEQ ID NO: 220585 - DNA, 20 bp, Artificial
  CRISPR gRNA sequence
ttgattcaaaggagtaccta

SEQ ID NO: 220586 - DNA, 20 bp, Artificial
  CRISPR gRNA sequence
tgattcaaaggagtacctat

SEQ ID NO: 220587 - DNA, 20 bp, Artificial
  CRISPR gRNA sequence
gattcaaaggagtacctatc

SEQ ID NO: 220588 - DNA, 20 bp, Artificial
  CRISPR gRNA sequence
attcaaaggagtacctatcc

SEQ ID NO: 220589 - DNA, 20 bp, Artificial
  CRISPR gRNA sequence
aaaggagtacctatccccat

SEQ ID NO: 220590 - DNA, 20 bp, Artificial
  CRISPR gRNA sequence
tccccatttggcctcctctc

SEQ ID NO: 220591 - DNA, 20 bp, Artificial
  CRISPR gRNA sequence
ggcctcctctcgaaagagga

SEQ ID NO: 220592 - DNA, 20 bp, Artificial
  CRISPR gRNA sequence
gcctcctctcgaaagaggat

SEQ ID NO: 220593 - DNA, 20 bp, Artificial
  CRISPR gRNA sequence
ctctcgaaagaggatcaggt

SEQ ID NO: 220594 - DNA, 20 bp, Artificial
  CRISPR gRNA sequence
tcgaaagaggatcaggttgc

SEQ ID NO: 220595 - DNA, 20 bp, Artificial
  CRISPR gRNA sequence
gaaagaggatcaggttgcac

SEQ ID NO: 220596 - DNA, 20 bp, Artificial
  CRISPR gRNA sequence
caccaggacaaataaaaaaa

SEQ ID NO: 220597 - DNA, 20 bp, Artificial
  CRISPR gRNA sequence
tcatagaagtcttaccaaca

SEQ ID NO: 220598 - DNA, 20 bp, Artificial
  CRISPR gRNA sequence
catagaagtcttaccaacac

SEQ ID NO: 220599 - DNA, 20 bp, Artificial
  CRISPR gRNA sequence
atagaagtcttaccaacacg

SEQ ID NO: 220600 - DNA, 20 bp, Artificial
  CRISPR gRNA sequence
accaacacgatattttagct

SEQ ID NO: 220601 - DNA, 20 bp, Artificial
  CRISPR gRNA sequence
ccaacacgatattttagctc

SEQ ID NO: 220602 - DNA, 20 bp, Artificial
  CRISPR gRNA sequence
tagctcgatgatcgtttcac

SEQ ID NO: 220603 - DNA, 20 bp, Artificial
  CRISPR gRNA sequence
agctcgatgatcgtttcacc

SEQ ID NO: 220604 - DNA, 20 bp, Artificial
  CRISPR gRNA sequence
gctcgatgatcgtttcacct

SEQ ID NO: 220605 - DNA, 20 bp, Artificial
  CRISPR gRNA sequence
gatgatcgtttcaccttctc

SEQ ID NO: 220606 - DNA, 20 bp, Artificial
  CRISPR gRNA sequence
caccttctctggttaattct

SEQ ID NO: 220607 - DNA, 20 bp, Artificial
  CRISPR gRNA sequence
accttctctggttaattctg

SEQ ID NO: 220608 - DNA, 20 bp, Artificial
  CRISPR gRNA sequence
ctctggttaattctgttact

SEQ ID NO: 220609 - DNA, 20 bp, Artificial
  CRISPR gRNA sequence
tctggttaattctgttactt

SEQ ID NO: 220610 - DNA, 20 bp, Artificial
  CRISPR gRNA sequence
tggttaattctgttacttca

SEQ ID NO: 220611 - DNA, 20 bp, Artificial
  CRISPR gRNA sequence
gttaattctgttacttcaca

SEQ ID NO: 220612 - DNA, 20 bp, Artificial
  CRISPR gRNA sequence
attctgttacttcacaagtg

SEQ ID NO: 220613 - DNA, 20 bp, Artificial
  CRISPR gRNA sequence
tgttacttcacaagtgtagt

SEQ ID NO: 220614 - DNA, 20 bp, Artificial
  CRISPR gRNA sequence
ttacttcacaagtgtagttt

SEQ ID NO: 220615 - DNA, 20 bp, Artificial
  CRISPR gRNA sequence
cttcacaagtgtagtttcct

SEQ ID NO: 220616 - DNA, 20 bp, Artificial
  CRISPR gRNA sequence
cacaagtgtagtttcctgtg

SEQ ID NO: 220617 - DNA, 20 bp, Artificial
  CRISPR gRNA sequence
acaagtgtagtttcctgtgt

SEQ ID NO: 220618 - DNA, 20 bp, Artificial
  CRISPR gRNA sequence
cctgtgtgtgagacagcatc

SEQ ID NO: 220619 - DNA, 20 bp, Artificial
  CRISPR gRNA sequence
ctgtgtgtgagacagcatca

SEQ ID NO: 220620 - DNA, 20 bp, Artificial
  CRISPR gRNA sequence
tgtgtgagacagcatcactc

SEQ ID NO: 220621 - DNA, 20 bp, Artificial
  CRISPR gRNA sequence
ttatccatcttcaaagaggc

SEQ ID NO: 220622 - DNA, 20 bp, Artificial
  CRISPR gRNA sequence
atccatcttcaaagaggcat

SEQ ID NO: 220623 - DNA, 20 bp, Artificial
  CRISPR gRNA sequence
tccatcttcaaagaggcatc

SEQ ID NO: 220624 - DNA, 20 bp, Artificial
  CRISPR gRNA sequence
caaagaggcatctcctttta

SEQ ID NO: 220625 - DNA, 20 bp, Artificial
  CRISPR gRNA sequence
aaagaggcatctccttttag

SEQ ID NO: 220626 - DNA, 20 bp, Artificial
  CRISPR gRNA sequence
cttttagtaattgtgagact

SEQ ID NO: 220627 - DNA, 20 bp, Artificial
  CRISPR gRNA sequence
ttagtaattgtgagacttca

SEQ ID NO: 220628 - DNA, 20 bp, Artificial
  CRISPR gRNA sequence
tagtaattgtgagacttcaa

SEQ ID NO: 220629 - DNA, 20 bp, Artificial
  CRISPR gRNA sequence
agtaattgtgagacttcaat

SEQ ID NO: 220630 - DNA, 20 bp, Artificial
  CRISPR gRNA sequence
gtaattgtgagacttcaatt

SEQ ID NO: 220631 - DNA, 20 bp, Artificial
  CRISPR gRNA sequence
tgagacttcaatttttgcac

SEQ ID NO: 220632 - DNA, 20 bp, Artificial
  CRISPR gRNA sequence
caatttttgcactactaaag

SEQ ID NO: 220633 - DNA, 20 bp, Artificial
  CRISPR gRNA sequence
aatttttgcactactaaagt

SEQ ID NO: 220634 - DNA, 20 bp, Artificial
  CRISPR gRNA sequence
ttgcactactaaagtcagtg

SEQ ID NO: 220635 - DNA, 20 bp, Artificial
  CRISPR gRNA sequence
tgcactactaaagtcagtgg

SEQ ID NO: 220636 - DNA, 20 bp, Artificial
  CRISPR gRNA sequence
gcactactaaagtcagtggg

SEQ ID NO: 220637 - DNA, 20 bp, Artificial
  CRISPR gRNA sequence
cactactaaagtcagtgggg

SEQ ID NO: 220638 - DNA, 20 bp, Artificial
  CRISPR gRNA sequence
ctaaagtcagtggggacagt

SEQ ID NO: 220639 - DNA, 20 bp, Artificial
  CRISPR gRNA sequence
aagtcagtggggacagtgga

SEQ ID NO: 220640 - DNA, 20 bp, Artificial
  CRISPR gRNA sequence
gtttagagctccatcaaagg

SEQ ID NO: 220641 - DNA, 20 bp, Artificial
  CRISPR gRNA sequence
tttagagctccatcaaaggt

SEQ ID NO: 220642 - DNA, 20 bp, Artificial
  CRISPR gRNA sequence
agagctccatcaaaggtgta

SEQ ID NO: 220643 - DNA, 20 bp, Artificial
  CRISPR gRNA sequence
gagctccatcaaaggtgtaa

SEQ ID NO: 220644 - DNA, 20 bp, Artificial
  CRISPR gRNA sequence
catcaaaggtgtaaatatct

SEQ ID NO: 220645 - DNA, 20 bp, Artificial
  CRISPR gRNA sequence
ttcctttaaatttccacttt

SEQ ID NO: 220646 - DNA, 20 bp, Artificial
  CRISPR gRNA sequence
cctttaaatttccactttac

SEQ ID NO: 220647 - DNA, 20 bp, Artificial
  CRISPR gRNA sequence
ctttaaatttccactttacg

SEQ ID NO: 220648 - DNA, 20 bp, Artificial
  CRISPR gRNA sequence
taaatttccactttacgtat

SEQ ID NO: 220649 - DNA, 20 bp, Artificial
  CRISPR gRNA sequence
aaatttccactttacgtata

SEQ ID NO: 220650 - DNA, 20 bp, Artificial
  CRISPR gRNA sequence
aatttccactttacgtatac

SEQ ID NO: 220651 - DNA, 20 bp, Artificial
  CRISPR gRNA sequence
ccactttacgtatacttcag

SEQ ID NO: 220652 - DNA, 20 bp, Artificial
  CRISPR gRNA sequence
cactttacgtatacttcagt

SEQ ID NO: 220653 - DNA, 20 bp, Artificial
  CRISPR gRNA sequence
tacgtatacttcagtagtgt

SEQ ID NO: 220654 - DNA, 20 bp, Artificial
  CRISPR gRNA sequence
acgtatacttcagtagtgtt

SEQ ID NO: 220655 - DNA, 20 bp, Artificial
  CRISPR gRNA sequence
cgtatacttcagtagtgttt

SEQ ID NO: 220656 - DNA, 20 bp, Artificial
  CRISPR gRNA sequence
cagtagtgttttgtgcctcc

SEQ ID NO: 220657 - DNA, 20 bp, Artificial
  CRISPR gRNA sequence
agtagtgttttgtgcctcca

SEQ ID NO: 220658 - DNA, 20 bp, Artificial
  CRISPR gRNA sequence
tgtgcctccatattagtaac

SEQ ID NO: 220659 - DNA, 20 bp, Artificial
  CRISPR gRNA sequence
gtgcctccatattagtaaca

SEQ ID NO: 220660 - DNA, 20 bp, Artificial
  CRISPR gRNA sequence
tgcctccatattagtaacaa

SEQ ID NO: 220661 - DNA, 20 bp, Artificial
  CRISPR gRNA sequence
catattagtaacaaagcatg

SEQ ID NO: 220662 - DNA, 20 bp, Artificial
  CRISPR gRNA sequence
gtaacaaagcatggaatgac

SEQ ID NO: 220663 - DNA, 20 bp, Artificial
  CRISPR gRNA sequence
caaaacgtgaattctacaga

SEQ ID NO: 220664 - DNA, 20 bp, Artificial
  CRISPR gRNA sequence
tacagattttgttttattaa

SEQ ID NO: 220665 - DNA, 20 bp, Artificial
  CRISPR gRNA sequence
cagattttgttttattaaat

SEQ ID NO: 220666 - DNA, 20 bp, Artificial
  CRISPR gRNA sequence
tgttttattaaatagtagct

SEQ ID NO: 220667 - DNA, 20 bp, Artificial
  CRISPR gRNA sequence
gttttattaaatagtagctg

SEQ ID NO: 220668 - DNA, 20 bp, Artificial
  CRISPR gRNA sequence
ttttattaaatagtagctga

SEQ ID NO: 220669 - DNA, 20 bp, Artificial
  CRISPR gRNA sequence
tattaaatagtagctgagct

SEQ ID NO: 220670 - DNA, 20 bp, Artificial
  CRISPR gRNA sequence
attaaatagtagctgagctg

SEQ ID NO: 220671 - DNA, 20 bp, Artificial
  CRISPR gRNA sequence
ttaaatagtagctgagctga

SEQ ID NO: 220672 - DNA, 20 bp, Artificial
  CRISPR gRNA sequence
aatagtagctgagctgatcc

SEQ ID NO: 220673 - DNA, 20 bp, Artificial
  CRISPR gRNA sequence
agctgatcctggaaaggaaa

SEQ ID NO: 220674 - DNA, 20 bp, Artificial
  CRISPR gRNA sequence
atcctggaaaggaaaaagaa

SEQ ID NO: 220675 - DNA, 20 bp, Artificial
  CRISPR gRNA sequence
gaaaggaaaaagaaaaatgt

SEQ ID NO: 220676 - DNA, 20 bp, Artificial
  CRISPR gRNA sequence
cattaattatagaagtctgt

SEQ ID NO: 220677 - DNA, 20 bp, Artificial
  CRISPR gRNA sequence
attaattatagaagtctgta

SEQ ID NO: 220678 - DNA, 20 bp, Artificial
  CRISPR gRNA sequence
attatagaagtctgtactgt

SEQ ID NO: 220679 - DNA, 20 bp, Artificial
  CRISPR gRNA sequence
tagaagtctgtactgtaaga

SEQ ID NO: 220680 - DNA, 20 bp, Artificial
  CRISPR gRNA sequence
tactgtaagatcttaggcat

SEQ ID NO: 220681 - DNA, 20 bp, Artificial
  CRISPR gRNA sequence
taagatcttaggcatgttac

SEQ ID NO: 220682 - DNA, 20 bp, Artificial
  CRISPR gRNA sequence
aggcatgttacaaatcctta

SEQ ID NO: 220683 - DNA, 20 bp, Artificial
  CRISPR gRNA sequence
ggcatgttacaaatccttaa

SEQ ID NO: 220684 - DNA, 20 bp, Artificial
  CRISPR gRNA sequence
caaatccttaagataaacag

SEQ ID NO: 220685 - DNA, 20 bp, Artificial
  CRISPR gRNA sequence
aagataaacagcaacatttc

SEQ ID NO: 220686 - DNA, 20 bp, Artificial
  CRISPR gRNA sequence
agataaacagcaacatttcc

SEQ ID NO: 220687 - DNA, 20 bp, Artificial
  CRISPR gRNA sequence
ccattgttcacttaagtaaa

SEQ ID NO: 220688 - DNA, 20 bp, Artificial
  CRISPR gRNA sequence
cattgttcacttaagtaaac

SEQ ID NO: 220689 - DNA, 20 bp, Artificial
  CRISPR gRNA sequence
ttcacttaagtaaacagtat

SEQ ID NO: 220690 - DNA, 20 bp, Artificial
  CRISPR gRNA sequence
acttaagtaaacagtatagc

SEQ ID NO: 220691 - DNA, 20 bp, Artificial
  CRISPR gRNA sequence
aagtaaacagtatagcaatg

SEQ ID NO: 220692 - DNA, 20 bp, Artificial
  CRISPR gRNA sequence
agtaaacagtatagcaatga

SEQ ID NO: 220693 - DNA, 20 bp, Artificial
  CRISPR gRNA sequence
ttaggtgaaatatgcaaaca

SEQ ID NO: 220694 - DNA, 20 bp, Artificial
  CRISPR gRNA sequence
ggtgaaatatgcaaacaaat

SEQ ID NO: 220695 - DNA, 20 bp, Artificial
  CRISPR gRNA sequence
tattttaatattaacttgca

SEQ ID NO: 220696 - DNA, 20 bp, Artificial
  CRISPR gRNA sequence
taatattaacttgcacagct

SEQ ID NO: 220697 - DNA, 20 bp, Artificial
  CRISPR gRNA sequence
aatattaacttgcacagctg

SEQ ID NO: 220698 - DNA, 20 bp, Artificial
  CRISPR gRNA sequence
atattaacttgcacagctgg

SEQ ID NO: 220699 - DNA, 20 bp, Artificial
  CRISPR gRNA sequence
acttgcacagctggaaggca

SEQ ID NO: 220700 - DNA, 20 bp, Artificial
  CRISPR gRNA sequence
gcacagctggaaggcatcat

SEQ ID NO: 220701 - DNA, 20 bp, Artificial
  CRISPR gRNA sequence
cacagctggaaggcatcatt

SEQ ID NO: 220702 - DNA, 20 bp, Artificial
  CRISPR gRNA sequence
gaaggcatcattatgacttt

SEQ ID NO: 220703 - DNA, 20 bp, Artificial
  CRISPR gRNA sequence
tgacttttctttattcattc

SEQ ID NO: 220704 - DNA, 20 bp, Artificial
  CRISPR gRNA sequence
ttctttattcattctcaata

SEQ ID NO: 220705 - DNA, 20 bp, Artificial
  CRISPR gRNA sequence
tctttattcattctcaataa

SEQ ID NO: 220706 - DNA, 20 bp, Artificial
  CRISPR gRNA sequence
ctttattcattctcaataat

SEQ ID NO: 220707 - DNA, 20 bp, Artificial
  CRISPR gRNA sequence
tttattcattctcaataata

SEQ ID NO: 220708 - DNA, 20 bp, Artificial
  CRISPR gRNA sequence
tattcattctcaataataca

SEQ ID NO: 220709 - DNA, 20 bp, Artificial
  CRISPR gRNA sequence
attcattctcaataatacaa

SEQ ID NO: 220710 - DNA, 20 bp, Artificial
  CRISPR gRNA sequence
ttcattctcaataatacaaa

SEQ ID NO: 220711 - DNA, 20 bp, Artificial
  CRISPR gRNA sequence
attctcaataatacaaagta

SEQ ID NO: 220712 - DNA, 20 bp, Artificial
  CRISPR gRNA sequence
tcaataatacaaagtataca

SEQ ID NO: 220713 - DNA, 20 bp, Artificial
  CRISPR gRNA sequence
aataatacaaagtatacatt

SEQ ID NO: 220714 - DNA, 20 bp, Artificial
  CRISPR gRNA sequence
catgcatcttgggaataaat

SEQ ID NO: 220715 - DNA, 20 bp, Artificial
  CRISPR gRNA sequence
gggaataaattcagcaacta

SEQ ID NO: 220716 - DNA, 20 bp, Artificial
  CRISPR gRNA sequence
ggaataaattcagcaactat

SEQ ID NO: 220717 - DNA, 20 bp, Artificial
  CRISPR gRNA sequence
agcaactatgttggaacatg

SEQ ID NO: 220718 - DNA, 20 bp, Artificial
  CRISPR gRNA sequence
tgttggaacatgcaggtgta

SEQ ID NO: 220719 - DNA, 20 bp, Artificial
  CRISPR gRNA sequence
gaacatgcaggtgtagtatc

SEQ ID NO: 220720 - DNA, 20 bp, Artificial
  CRISPR gRNA sequence
gctttggaagctttgaagta

SEQ ID NO: 220721 - DNA, 20 bp, Artificial
  CRISPR gRNA sequence
tggaagctttgaagtaatca

SEQ ID NO: 220722 - DNA, 20 bp, Artificial
  CRISPR gRNA sequence
ggaagctttgaagtaatcat

SEQ ID NO: 220723 - DNA, 20 bp, Artificial
  CRISPR gRNA sequence
gaagctttgaagtaatcatt

SEQ ID NO: 220724 - DNA, 20 bp, Artificial
  CRISPR gRNA sequence
tgaagtaatcattactgcct

SEQ ID NO: 220725 - DNA, 20 bp, Artificial
  CRISPR gRNA sequence
gaagtaatcattactgccta

SEQ ID NO: 220726 - DNA, 20 bp, Artificial
  CRISPR gRNA sequence
aagtaatcattactgcctac

SEQ ID NO: 220727 - DNA, 20 bp, Artificial
  CRISPR gRNA sequence
ctgcctactgatatatgtag

SEQ ID NO: 220728 - DNA, 20 bp, Artificial
  CRISPR gRNA sequence
cctactgatatatgtagaaa

SEQ ID NO: 220729 - DNA, 20 bp, Artificial
  CRISPR gRNA sequence
ctgatatatgtagaaaaata

SEQ ID NO: 220730 - DNA, 20 bp, Artificial
  CRISPR gRNA sequence
atatatgtagaaaaatattg

SEQ ID NO: 220731 - DNA, 20 bp, Artificial
  CRISPR gRNA sequence
tccttatcaaggtaaaattt

SEQ ID NO: 220732 - DNA, 20 bp, Artificial
  CRISPR gRNA sequence
atcaaggtaaaattttgaac

SEQ ID NO: 220733 - DNA, 20 bp, Artificial
  CRISPR gRNA sequence
tcaaggtaaaattttgaaca

SEQ ID NO: 220734 - DNA, 20 bp, Artificial
  CRISPR gRNA sequence
tgaacagaaaaccaaaccaa

SEQ ID NO: 220735 - DNA, 20 bp, Artificial
  CRISPR gRNA sequence
gaacagaaaaccaaaccaaa

SEQ ID NO: 220736 - DNA, 20 bp, Artificial
  CRISPR gRNA sequence
aacagaaaaccaaaccaaat

SEQ ID NO: 220737 - DNA, 20 bp, Artificial
  CRISPR gRNA sequence
tattcagtctcaacttcaac

SEQ ID NO: 220738 - DNA, 20 bp, Artificial
  CRISPR gRNA sequence
attcagtctcaacttcaaca

SEQ ID NO: 220739 - DNA, 20 bp, Artificial
  CRISPR gRNA sequence
ttcagtctcaacttcaacac

SEQ ID NO: 220740 - DNA, 20 bp, Artificial
  CRISPR gRNA sequence
agtctcaacttcaacacact

SEQ ID NO: 220741 - DNA, 20 bp, Artificial
  CRISPR gRNA sequence
aacttcaacacactgctaaa

SEQ ID NO: 220742 - DNA, 20 bp, Artificial
  CRISPR gRNA sequence
caacacactgctaaatagaa

SEQ ID NO: 220743 - DNA, 20 bp, Artificial
  CRISPR gRNA sequence
aacacactgctaaatagaac

SEQ ID NO: 220744 - DNA, 20 bp, Artificial
  CRISPR gRNA sequence
ctaaatagaacttgctgaac

SEQ ID NO: 220745 - DNA, 20 bp, Artificial
  CRISPR gRNA sequence
aatagaacttgctgaactga

SEQ ID NO: 220746 - DNA, 20 bp, Artificial
  CRISPR gRNA sequence
gctgaactgatatgaaattt

SEQ ID NO: 220747 - DNA, 20 bp, Artificial
  CRISPR gRNA sequence
ctgaactgatatgaaattta

SEQ ID NO: 220748 - DNA, 20 bp, Artificial
  CRISPR gRNA sequence
aactgatatgaaatttatct

SEQ ID NO: 220749 - DNA, 20 bp, Artificial
  CRISPR gRNA sequence
atatgaaatttatctttatc

SEQ ID NO: 220750 - DNA, 20 bp, Artificial
  CRISPR gRNA sequence
atctttatccttatgctgca

SEQ ID NO: 220751 - DNA, 20 bp, Artificial
  CRISPR gRNA sequence
tctttatccttatgctgcat

SEQ ID NO: 220752 - DNA, 20 bp, Artificial
  CRISPR gRNA sequence
tatccttatgctgcatttcc

SEQ ID NO: 220753 - DNA, 20 bp, Artificial
  CRISPR gRNA sequence
atccttatgctgcatttcca

SEQ ID NO: 220754 - DNA, 20 bp, Artificial
  CRISPR gRNA sequence
tccttatgctgcatttccaa

SEQ ID NO: 220755 - DNA, 20 bp, Artificial
  CRISPR gRNA sequence
atgctgcatttccaaaaaaa

SEQ ID NO: 220756 - DNA, 20 bp, Artificial
  CRISPR gRNA sequence
tgctgcatttccaaaaaaag

SEQ ID NO: 220757 - DNA, 20 bp, Artificial
  CRISPR gRNA sequence
catttccaaaaaaagtggca

SEQ ID NO: 220758 - DNA, 20 bp, Artificial
  CRISPR gRNA sequence
ccaaaaaaagtggcaggttc

SEQ ID NO: 220759 - DNA, 20 bp, Artificial
  CRISPR gRNA sequence
caaaaaaagtggcaggttct

SEQ ID NO: 220760 - DNA, 20 bp, Artificial
  CRISPR gRNA sequence
tactgtactttaatatacaa

SEQ ID NO: 220761 - DNA, 20 bp, Artificial
  CRISPR gRNA sequence
ctgtactttaatatacaaag

SEQ ID NO: 220762 - DNA, 20 bp, Artificial
  CRISPR gRNA sequence
tactttaatatacaaagtaa

SEQ ID NO: 220763 - DNA, 20 bp, Artificial
  CRISPR gRNA sequence
taatatacaaagtaaatagg

SEQ ID NO: 220764 - DNA, 20 bp, Artificial
  CRISPR gRNA sequence
aatatacaaagtaaatagga

SEQ ID NO: 220765 - DNA, 20 bp, Artificial
  CRISPR gRNA sequence
atatacaaagtaaataggat

SEQ ID NO: 220766 - DNA, 20 bp, Artificial
  CRISPR gRNA sequence
tccactaggatggaaaatct

SEQ ID NO: 220767 - DNA, 20 bp, Artificial
  CRISPR gRNA sequence
ccactaggatggaaaatctt

SEQ ID NO: 220768 - DNA, 20 bp, Artificial
  CRISPR gRNA sequence
cactaggatggaaaatctta

SEQ ID NO: 220769 - DNA, 20 bp, Artificial
  CRISPR gRNA sequence
ggatggaaaatcttaaaata

SEQ ID NO: 220770 - DNA, 20 bp, Artificial
  CRISPR gRNA sequence
aaaatactaatgaggaaaaa

SEQ ID NO: 220771 - DNA, 20 bp, Artificial
  CRISPR gRNA sequence
aaatactaatgaggaaaaaa

SEQ ID NO: 220772 - DNA, 20 bp, Artificial
  CRISPR gRNA sequence
atgaggaaaaaaaaaacatt

SEQ ID NO: 220773 - DNA, 20 bp, Artificial
  CRISPR gRNA sequence
tctgtggctactttcccata

SEQ ID NO: 220774 - DNA, 20 bp, Artificial
  CRISPR gRNA sequence
tggctactttcccatagcaa

SEQ ID NO: 220775 - DNA, 20 bp, Artificial
  CRISPR gRNA sequence
ctttcccatagcaaaatata

SEQ ID NO: 220776 - DNA, 20 bp, Artificial
  CRISPR gRNA sequence
tcccatagcaaaatataggc

SEQ ID NO: 220777 - DNA, 20 bp, Artificial
  CRISPR gRNA sequence
cccatagcaaaatataggca

SEQ ID NO: 220778 - DNA, 20 bp, Artificial
  CRISPR gRNA sequence
ccatagcaaaatataggcag

SEQ ID NO: 220779 - DNA, 20 bp, Artificial
  CRISPR gRNA sequence
tgtatgggagtcttgaatga

SEQ ID NO: 220780 - DNA, 20 bp, Artificial
  CRISPR gRNA sequence
gtatgggagtcttgaatgac

SEQ ID NO: 220781 - DNA, 20 bp, Artificial
  CRISPR gRNA sequence
tatgggagtcttgaatgaca

SEQ ID NO: 220782 - DNA, 20 bp, Artificial
  CRISPR gRNA sequence
gaatgacattttcccacccc

SEQ ID NO: 220783 - DNA, 20 bp, Artificial
  CRISPR gRNA sequence
aatgacattttcccaccccc

SEQ ID NO: 220784 - DNA, 20 bp, Artificial
  CRISPR gRNA sequence
tcccacccccacatttcatt

SEQ ID NO: 220785 - DNA, 20 bp, Artificial
  CRISPR gRNA sequence
cccacccccacatttcattg

SEQ ID NO: 220786 - DNA, 20 bp, Artificial
  CRISPR gRNA sequence
ccacccccacatttcattga

SEQ ID NO: 220787 - DNA, 20 bp, Artificial
  CRISPR gRNA sequence
cattgacactacagaacaac

SEQ ID NO: 220788 - DNA, 20 bp, Artificial
  CRISPR gRNA sequence
attgacactacagaacaaca

SEQ ID NO: 220789 - DNA, 20 bp, Artificial
  CRISPR gRNA sequence
acactacagaacaacagtct

SEQ ID NO: 220790 - DNA, 20 bp, Artificial
  CRISPR gRNA sequence
cagaacaacagtctccaaat

SEQ ID NO: 220791 - DNA, 20 bp, Artificial
  CRISPR gRNA sequence
caaatgtatattatgggtat

SEQ ID NO: 220792 - DNA, 20 bp, Artificial
  CRISPR gRNA sequence
tgggtattcttcctccaaga

SEQ ID NO: 220793 - DNA, 20 bp, Artificial
  CRISPR gRNA sequence
ttcctccaagaaaccacaaa

SEQ ID NO: 220794 - DNA, 20 bp, Artificial
  CRISPR gRNA sequence
cctccaagaaaccacaaaac

SEQ ID NO: 220795 - DNA, 20 bp, Artificial
  CRISPR gRNA sequence
ctccaagaaaccacaaaacg

SEQ ID NO: 220796 - DNA, 20 bp, Artificial
  CRISPR gRNA sequence
caagaaaccacaaaacggtg

SEQ ID NO: 220797 - DNA, 20 bp, Artificial
  CRISPR gRNA sequence
agtaagatgcaagttgaaac

SEQ ID NO: 220798 - DNA, 20 bp, Artificial
  CRISPR gRNA sequence
aaaccaagagcagttactgc

SEQ ID NO: 220799 - DNA, 20 bp, Artificial
  CRISPR gRNA sequence
ctgctaataagcatcctatc

SEQ ID NO: 220800 - DNA, 20 bp, Artificial
  CRISPR gRNA sequence
ctaataagcatcctatctac

SEQ ID NO: 220801 - DNA, 20 bp, Artificial
  CRISPR gRNA sequence
ataagcatcctatctacgct

SEQ ID NO: 220802 - DNA, 20 bp, Artificial
  CRISPR gRNA sequence
tctacgcttctcaataggat

SEQ ID NO: 220803 - DNA, 20 bp, Artificial
  CRISPR gRNA sequence
cgcttctcaataggataaac

SEQ ID NO: 220804 - DNA, 20 bp, Artificial
  CRISPR gRNA sequence
ctcaataggataaactacca

SEQ ID NO: 220805 - DNA, 20 bp, Artificial
  CRISPR gRNA sequence
tcaataggataaactaccag

SEQ ID NO: 220806 - DNA, 20 bp, Artificial
  CRISPR gRNA sequence
aataggataaactaccagtt

SEQ ID NO: 220807 - DNA, 20 bp, Artificial
  CRISPR gRNA sequence
ccagttgttgccttatagaa

SEQ ID NO: 220808 - DNA, 20 bp, Artificial
  CRISPR gRNA sequence
ttgccttatagaagaggcac

SEQ ID NO: 220809 - DNA, 20 bp, Artificial
  CRISPR gRNA sequence
ccttatagaagaggcactgg

SEQ ID NO: 220810 - DNA, 20 bp, Artificial
  CRISPR gRNA sequence
atagaagaggcactgggtaa

SEQ ID NO: 220811 - DNA, 20 bp, Artificial
  CRISPR gRNA sequence
tagaagaggcactgggtaaa

SEQ ID NO: 220812 - DNA, 20 bp, Artificial
  CRISPR gRNA sequence
ggtaaataaatgtaatcact

SEQ ID NO: 220813 - DNA, 20 bp, Artificial
  CRISPR gRNA sequence
attgttcaactaaaatgtac

SEQ ID NO: 220814 - DNA, 20 bp, Artificial
  CRISPR gRNA sequence
ttcaactaaaatgtacaaga

SEQ ID NO: 220815 - DNA, 20 bp, Artificial
  CRISPR gRNA sequence
aactaaaatgtacaagaatg

SEQ ID NO: 220816 - DNA, 20 bp, Artificial
  CRISPR gRNA sequence
aaatgtacaagaatgtgtag

SEQ ID NO: 220817 - DNA, 20 bp, Artificial
  CRISPR gRNA sequence
tagttgtcttccatattctt

SEQ ID NO: 220818 - DNA, 20 bp, Artificial
  CRISPR gRNA sequence
tcttccatattcttcagcca

SEQ ID NO: 220819 - DNA, 20 bp, Artificial
  CRISPR gRNA sequence
ccatattcttcagccactca

SEQ ID NO: 220820 - DNA, 20 bp, Artificial
  CRISPR gRNA sequence
catattcttcagccactcag

SEQ ID NO: 220821 - DNA, 20 bp, Artificial
  CRISPR gRNA sequence
ttcagccactcagcaactct

SEQ ID NO: 220822 - DNA, 20 bp, Artificial
  CRISPR gRNA sequence
cagccactcagcaactcttt

SEQ ID NO: 220823 - DNA, 20 bp, Artificial
  CRISPR gRNA sequence
agccactcagcaactctttt

SEQ ID NO: 220824 - DNA, 20 bp, Artificial
  CRISPR gRNA sequence
agcaactcttttacctaagt

SEQ ID NO: 220825 - DNA, 20 bp, Artificial
  CRISPR gRNA sequence
ttttacctaagtagctactt

SEQ ID NO: 220826 - DNA, 20 bp, Artificial
  CRISPR gRNA sequence
ttacctaagtagctacttgg

SEQ ID NO: 220827 - DNA, 20 bp, Artificial
  CRISPR gRNA sequence
tacctaagtagctacttggc

SEQ ID NO: 220828 - DNA, 20 bp, Artificial
  CRISPR gRNA sequence
acctaagtagctacttggcc

SEQ ID NO: 220829 - DNA, 20 bp, Artificial
  CRISPR gRNA sequence
cctaagtagctacttggcct

SEQ ID NO: 220830 - DNA, 20 bp, Artificial
  CRISPR gRNA sequence
agtagctacttggccttccc

SEQ ID NO: 220831 - DNA, 20 bp, Artificial
  CRISPR gRNA sequence
cttggccttcccctcaaaac

SEQ ID NO: 220832 - DNA, 20 bp, Artificial
  CRISPR gRNA sequence
ggccttcccctcaaaacata

SEQ ID NO: 220833 - DNA, 20 bp, Artificial
  CRISPR gRNA sequence
gccttcccctcaaaacataa

SEQ ID NO: 220834 - DNA, 20 bp, Artificial
  CRISPR gRNA sequence
cccctcaaaacataaacaaa

SEQ ID NO: 220835 - DNA, 20 bp, Artificial
  CRISPR gRNA sequence
ccctcaaaacataaacaaaa

SEQ ID NO: 220836 - DNA, 20 bp, Artificial
  CRISPR gRNA sequence
aaaacataaacaaaaacaaa

SEQ ID NO: 220837 - DNA, 20 bp, Artificial
  CRISPR gRNA sequence
ctaacaaatataaataaaat

SEQ ID NO: 220838 - DNA, 20 bp, Artificial
  CRISPR gRNA sequence
acaaatataaataaaatatc

SEQ ID NO: 220839 - DNA, 20 bp, Artificial
  CRISPR gRNA sequence
tgttaatagttcacacttaa

SEQ ID NO: 220840 - DNA, 20 bp, Artificial
  CRISPR gRNA sequence
gttaatagttcacacttaag

SEQ ID NO: 220841 - DNA, 20 bp, Artificial
  CRISPR gRNA sequence
ttaatagttcacacttaaga

SEQ ID NO: 220842 - DNA, 20 bp, Artificial
  CRISPR gRNA sequence
atagttcacacttaagattt

SEQ ID NO: 220843 - DNA, 20 bp, Artificial
  CRISPR gRNA sequence
acacttaagatttacttcta

SEQ ID NO: 220844 - DNA, 20 bp, Artificial
  CRISPR gRNA sequence
aagatttacttctacataaa

SEQ ID NO: 220845 - DNA, 20 bp, Artificial
  CRISPR gRNA sequence
agatttacttctacataaac

SEQ ID NO: 220846 - DNA, 20 bp, Artificial
  CRISPR gRNA sequence
acttctacataaactggaat

SEQ ID NO: 220847 - DNA, 20 bp, Artificial
  CRISPR gRNA sequence
cttctacataaactggaata

SEQ ID NO: 220848 - DNA, 20 bp, Artificial
  CRISPR gRNA sequence
ctacataaactggaataaaa

SEQ ID NO: 220849 - DNA, 20 bp, Artificial
  CRISPR gRNA sequence
tacataaactggaataaaaa

SEQ ID NO: 220850 - DNA, 20 bp, Artificial
  CRISPR gRNA sequence
cataaactggaataaaaatc

SEQ ID NO: 220851 - DNA, 20 bp, Artificial
  CRISPR gRNA sequence
gaataaaaatcagaggcata

SEQ ID NO: 220852 - DNA, 20 bp, Artificial
  CRISPR gRNA sequence
ctattgtaagaacactatgt

SEQ ID NO: 220853 - DNA, 20 bp, Artificial
  CRISPR gRNA sequence
tattgtaagaacactatgtt

SEQ ID NO: 220854 - DNA, 20 bp, Artificial
  CRISPR gRNA sequence
ttgtaagaacactatgttta

SEQ ID NO: 220855 - DNA, 20 bp, Artificial
  CRISPR gRNA sequence
taagaacactatgtttactc

SEQ ID NO: 220856 - DNA, 20 bp, Artificial
  CRISPR gRNA sequence
tgtttactcaataaataccc

SEQ ID NO: 220857 - DNA, 20 bp, Artificial
  CRISPR gRNA sequence
actcaataaataccccatga

SEQ ID NO: 220858 - DNA, 20 bp, Artificial
  CRISPR gRNA sequence
ctcaataaataccccatgaa

SEQ ID NO: 220859 - DNA, 20 bp, Artificial
  CRISPR gRNA sequence
aataaataccccatgaattg

SEQ ID NO: 220860 - DNA, 20 bp, Artificial
  CRISPR gRNA sequence
aatgcaaggatgcatactgg

SEQ ID NO: 220861 - DNA, 20 bp, Artificial
  CRISPR gRNA sequence
gaatataggtactggacaat

SEQ ID NO: 220862 - DNA, 20 bp, Artificial
  CRISPR gRNA sequence
gacaatgttcaaaacacctg

SEQ ID NO: 220863 - DNA, 20 bp, Artificial
  CRISPR gRNA sequence
aaaacacctgagtaaaaata

SEQ ID NO: 220864 - DNA, 20 bp, Artificial
  CRISPR gRNA sequence
agtaaaaatactatttctgc

SEQ ID NO: 220865 - DNA, 20 bp, Artificial
  CRISPR gRNA sequence
tttctgcccctttttaatat

SEQ ID NO: 220866 - DNA, 20 bp, Artificial
  CRISPR gRNA sequence
ctgcccctttttaatatgct

SEQ ID NO: 220867 - DNA, 20 bp, Artificial
  CRISPR gRNA sequence
tgcccctttttaatatgctg

SEQ ID NO: 220868 - DNA, 20 bp, Artificial
  CRISPR gRNA sequence
cccctttttaatatgctgcc

SEQ ID NO: 220869 - DNA, 20 bp, Artificial
  CRISPR gRNA sequence
tttaatatgctgccttaagc

SEQ ID NO: 220870 - DNA, 20 bp, Artificial
  CRISPR gRNA sequence
ttaatatgctgccttaagca

SEQ ID NO: 220871 - DNA, 20 bp, Artificial
  CRISPR gRNA sequence
taatatgctgccttaagcaa

SEQ ID NO: 220872 - DNA, 20 bp, Artificial
  CRISPR gRNA sequence
aatatgctgccttaagcaac

SEQ ID NO: 220873 - DNA, 20 bp, Artificial
  CRISPR gRNA sequence
atatgctgccttaagcaact

SEQ ID NO: 220874 - DNA, 20 bp, Artificial
  CRISPR gRNA sequence
ccttaagcaactcacttttc

SEQ ID NO: 220875 - DNA, 20 bp, Artificial
  CRISPR gRNA sequence
aagcaactcacttttctatg

SEQ ID NO: 220876 - DNA, 20 bp, Artificial
  CRISPR gRNA sequence
agcaactcacttttctatgc

SEQ ID NO: 220877 - DNA, 20 bp, Artificial
  CRISPR gRNA sequence
acttttctatgccttggttt

SEQ ID NO: 220878 - DNA, 20 bp, Artificial
  CRISPR gRNA sequence
ttctatgccttggtttactc

SEQ ID NO: 220879 - DNA, 20 bp, Artificial
  CRISPR gRNA sequence
tctatgccttggtttactct

SEQ ID NO: 220880 - DNA, 20 bp, Artificial
  CRISPR gRNA sequence
ctatgccttggtttactctc

SEQ ID NO: 220881 - DNA, 20 bp, Artificial
  CRISPR gRNA sequence
tatgccttggtttactctct

SEQ ID NO: 220882 - DNA, 20 bp, Artificial
  CRISPR gRNA sequence
tgccttggtttactctctaa

SEQ ID NO: 220883 - DNA, 20 bp, Artificial
  CRISPR gRNA sequence
ggtttactctctaaaatagg

SEQ ID NO: 220884 - DNA, 20 bp, Artificial
  CRISPR gRNA sequence
gtttactctctaaaatagga

SEQ ID NO: 220885 - DNA, 20 bp, Artificial
  CRISPR gRNA sequence
actctctaaaataggaggat

SEQ ID NO: 220886 - DNA, 20 bp, Artificial
  CRISPR gRNA sequence
ctctctaaaataggaggatc

SEQ ID NO: 220887 - DNA, 20 bp, Artificial
  CRISPR gRNA sequence
tctaaaataggaggatctct

SEQ ID NO: 220888 - DNA, 20 bp, Artificial
  CRISPR gRNA sequence
taaaataggaggatctctta

SEQ ID NO: 220889 - DNA, 20 bp, Artificial
  CRISPR gRNA sequence
aaataggaggatctcttaag

SEQ ID NO: 220890 - DNA, 20 bp, Artificial
  CRISPR gRNA sequence
ttaagtaggaggatcaaaaa

SEQ ID NO: 220891 - DNA, 20 bp, Artificial
  CRISPR gRNA sequence
aagtaggaggatcaaaaaca

SEQ ID NO: 220892 - DNA, 20 bp, Artificial
  CRISPR gRNA sequence
agtaggaggatcaaaaacaa

SEQ ID NO: 220893 - DNA, 20 bp, Artificial
  CRISPR gRNA sequence
cttcacagaactgtgttgag

SEQ ID NO: 220894 - DNA, 20 bp, Artificial
  CRISPR gRNA sequence
cacagaactgtgttgagcat

SEQ ID NO: 220895 - DNA, 20 bp, Artificial
  CRISPR gRNA sequence
acagaactgtgttgagcatt

SEQ ID NO: 220896 - DNA, 20 bp, Artificial
  CRISPR gRNA sequence
tgttgagcattaacatggaa

SEQ ID NO: 220897 - DNA, 20 bp, Artificial
  CRISPR gRNA sequence
agcattaacatggaaaacat

SEQ ID NO: 220898 - DNA, 20 bp, Artificial
  CRISPR gRNA sequence
acatggaaaacatagcggca

SEQ ID NO: 220899 - DNA, 20 bp, Artificial
  CRISPR gRNA sequence
tctaaacaatactatgctgt

SEQ ID NO: 220900 - DNA, 20 bp, Artificial
  CRISPR gRNA sequence
taaacaatactatgctgtaa

SEQ ID NO: 220901 - DNA, 20 bp, Artificial
  CRISPR gRNA sequence
aacaatactatgctgtaaaa

SEQ ID NO: 220902 - DNA, 20 bp, Artificial
  CRISPR gRNA sequence
tgctgtaaaaatgtagggtg

SEQ ID NO: 220903 - DNA, 20 bp, Artificial
  CRISPR gRNA sequence
taaaaatgtagggtgatact

SEQ ID NO: 220904 - DNA, 20 bp, Artificial
  CRISPR gRNA sequence
taaaaactagataatctggc

SEQ ID NO: 220905 - DNA, 20 bp, Artificial
  CRISPR gRNA sequence
gataatctggcattttaatg

SEQ ID NO: 220906 - DNA, 20 bp, Artificial
  CRISPR gRNA sequence
gcattttaatgtaatgatat

SEQ ID NO: 220907 - DNA, 20 bp, Artificial
  CRISPR gRNA sequence
taatgtaatgatatgggccc

SEQ ID NO: 220908 - DNA, 20 bp, Artificial
  CRISPR gRNA sequence
aatgtaatgatatgggccct

SEQ ID NO: 220909 - DNA, 20 bp, Artificial
  CRISPR gRNA sequence
atgtaatgatatgggccctc

SEQ ID NO: 220910 - DNA, 20 bp, Artificial
  CRISPR gRNA sequence
tttgactagtccaaattgtt

SEQ ID NO: 220911 - DNA, 20 bp, Artificial
  CRISPR gRNA sequence
tgactagtccaaattgttat

SEQ ID NO: 220912 - DNA, 20 bp, Artificial
  CRISPR gRNA sequence
gactagtccaaattgttata

SEQ ID NO: 220913 - DNA, 20 bp, Artificial
  CRISPR gRNA sequence
actagtccaaattgttatat

SEQ ID NO: 220914 - DNA, 20 bp, Artificial
  CRISPR gRNA sequence
gtccaaattgttatatttct

SEQ ID NO: 220915 - DNA, 20 bp, Artificial
  CRISPR gRNA sequence
ttatatttctgggaaattgc

SEQ ID NO: 220916 - DNA, 20 bp, Artificial
  CRISPR gRNA sequence
tatttctgggaaattgcagt

SEQ ID NO: 220917 - DNA, 20 bp, Artificial
  CRISPR gRNA sequence
ctgggaaattgcagtctgaa

SEQ ID NO: 220918 - DNA, 20 bp, Artificial
  CRISPR gRNA sequence
tgggaaattgcagtctgaac

SEQ ID NO: 220919 - DNA, 20 bp, Artificial
  CRISPR gRNA sequence
ggaaattgcagtctgaacct

SEQ ID NO: 220920 - DNA, 20 bp, Artificial
  CRISPR gRNA sequence
cagtctgaacctatattgtg

SEQ ID NO: 220921 - DNA, 20 bp, Artificial
  CRISPR gRNA sequence
aacctatattgtgggcatcc

SEQ ID NO: 220922 - DNA, 20 bp, Artificial
  CRISPR gRNA sequence
tattgtgggcatccacagct

SEQ ID NO: 220923 - DNA, 20 bp, Artificial
  CRISPR gRNA sequence
tgggcatccacagctcacct

SEQ ID NO: 220924 - DNA, 20 bp, Artificial
  CRISPR gRNA sequence
acctcttcccagttttctac

SEQ ID NO: 220925 - DNA, 20 bp, Artificial
  CRISPR gRNA sequence
ttcccagttttctacatttc

SEQ ID NO: 220926 - DNA, 20 bp, Artificial
  CRISPR gRNA sequence
cccagttttctacatttcta

SEQ ID NO: 220927 - DNA, 20 bp, Artificial
  CRISPR gRNA sequence
ccagttttctacatttctag

SEQ ID NO: 220928 - DNA, 20 bp, Artificial
  CRISPR gRNA sequence
tctacatttctagccaccca

SEQ ID NO: 220929 - DNA, 20 bp, Artificial
  CRISPR gRNA sequence
ctacatttctagccacccaa

SEQ ID NO: 220930 - DNA, 20 bp, Artificial
  CRISPR gRNA sequence
tacatttctagccacccaaa

SEQ ID NO: 220931 - DNA, 20 bp, Artificial
  CRISPR gRNA sequence
catttctagccacccaaata

SEQ ID NO: 220932 - DNA, 20 bp, Artificial
  CRISPR gRNA sequence
ctagccacccaaatactagg

SEQ ID NO: 220933 - DNA, 20 bp, Artificial
  CRISPR gRNA sequence
tagccacccaaatactagga

SEQ ID NO: 220934 - DNA, 20 bp, Artificial
  CRISPR gRNA sequence
gccacccaaatactaggaag

SEQ ID NO: 220935 - DNA, 20 bp, Artificial
  CRISPR gRNA sequence
ggaagcccaaggcaaaacct

SEQ ID NO: 220936 - DNA, 20 bp, Artificial
  CRISPR gRNA sequence
gacttccgttgcattcttta

SEQ ID NO: 220937 - DNA, 20 bp, Artificial
  CRISPR gRNA sequence
ccgttgcattctttaaaact

SEQ ID NO: 220938 - DNA, 20 bp, Artificial
  CRISPR gRNA sequence
cgttgcattctttaaaactt

SEQ ID NO: 220939 - DNA, 20 bp, Artificial
  CRISPR gRNA sequence
cattctttaaaactttggaa

SEQ ID NO: 220940 - DNA, 20 bp, Artificial
  CRISPR gRNA sequence
tttaaaactttggaattgtg

SEQ ID NO: 220941 - DNA, 20 bp, Artificial
  CRISPR gRNA sequence
taaaactttggaattgtgaa

SEQ ID NO: 220942 - DNA, 20 bp, Artificial
  CRISPR gRNA sequence
aaaactttggaattgtgaat

SEQ ID NO: 220943 - DNA, 20 bp, Artificial
  CRISPR gRNA sequence
aaactttggaattgtgaatt

SEQ ID NO: 220944 - DNA, 20 bp, Artificial
  CRISPR gRNA sequence
tggaattgtgaattatttcc

SEQ ID NO: 220945 - DNA, 20 bp, Artificial
  CRISPR gRNA sequence
ggaattgtgaattatttccc

SEQ ID NO: 220946 - DNA, 20 bp, Artificial
  CRISPR gRNA sequence
gaattgtgaattatttcccc

SEQ ID NO: 220947 - DNA, 20 bp, Artificial
  CRISPR gRNA sequence
tgaattatttcccctgagag

SEQ ID NO: 220948 - DNA, 20 bp, Artificial
  CRISPR gRNA sequence
tttcccctgagagagaaaca

SEQ ID NO: 220949 - DNA, 20 bp, Artificial
  CRISPR gRNA sequence
cccctgagagagaaacactg

SEQ ID NO: 220950 - DNA, 20 bp, Artificial
  CRISPR gRNA sequence
ccctgagagagaaacactga

SEQ ID NO: 220951 - DNA, 20 bp, Artificial
  CRISPR gRNA sequence
agagagaaacactgagggag

SEQ ID NO: 220952 - DNA, 20 bp, Artificial
  CRISPR gRNA sequence
agggagagaggacatagtat

SEQ ID NO: 220953 - DNA, 20 bp, Artificial
  CRISPR gRNA sequence
aaattataaaggaaggaaag

SEQ ID NO: 220954 - DNA, 20 bp, Artificial
  CRISPR gRNA sequence
taaaggaaggaaagtatcag

SEQ ID NO: 220955 - DNA, 20 bp, Artificial
  CRISPR gRNA sequence
tgaaagggatacaaagacta

SEQ ID NO: 220956 - DNA, 20 bp, Artificial
  CRISPR gRNA sequence
gaaagggatacaaagactac

SEQ ID NO: 220957 - DNA, 20 bp, Artificial
  CRISPR gRNA sequence
aaagggatacaaagactact

SEQ ID NO: 220958 - DNA, 20 bp, Artificial
  CRISPR gRNA sequence
ctgggtatcctttcagtcaa

SEQ ID NO: 220959 - DNA, 20 bp, Artificial
  CRISPR gRNA sequence
ggtatcctttcagtcaagtg

SEQ ID NO: 220960 - DNA, 20 bp, Artificial
  CRISPR gRNA sequence
tcagtcaagtgctgggcaat

SEQ ID NO: 220961 - DNA, 20 bp, Artificial
  CRISPR gRNA sequence
cagtcaagtgctgggcaatg

SEQ ID NO: 220962 - DNA, 20 bp, Artificial
  CRISPR gRNA sequence
agtcaagtgctgggcaatgt

SEQ ID NO: 220963 - DNA, 20 bp, Artificial
  CRISPR gRNA sequence
ggcaatgtctaacagacgct

SEQ ID NO: 220964 - DNA, 20 bp, Artificial
  CRISPR gRNA sequence
acagacgctttggaattatc

SEQ ID NO: 220965 - DNA, 20 bp, Artificial
  CRISPR gRNA sequence
tggaattatctgactctata

SEQ ID NO: 220966 - DNA, 20 bp, Artificial
  CRISPR gRNA sequence
ggaattatctgactctatag

SEQ ID NO: 220967 - DNA, 20 bp, Artificial
  CRISPR gRNA sequence
gaattatctgactctataga

SEQ ID NO: 220968 - DNA, 20 bp, Artificial
  CRISPR gRNA sequence
tctgactctatagaagcctg

SEQ ID NO: 220969 - DNA, 20 bp, Artificial
  CRISPR gRNA sequence
actctatagaagcctgtgcc

SEQ ID NO: 220970 - DNA, 20 bp, Artificial
  CRISPR gRNA sequence
tatagaagcctgtgcctttc

SEQ ID NO: 220971 - DNA, 20 bp, Artificial
  CRISPR gRNA sequence
tagaagcctgtgcctttcac

SEQ ID NO: 220972 - DNA, 20 bp, Artificial
  CRISPR gRNA sequence
tgcctttcactgactttgac

SEQ ID NO: 220973 - DNA, 20 bp, Artificial
  CRISPR gRNA sequence
tcactgactttgactgggct

SEQ ID NO: 220974 - DNA, 20 bp, Artificial
  CRISPR gRNA sequence
cactgactttgactgggctg

SEQ ID NO: 220975 - DNA, 20 bp, Artificial
  CRISPR gRNA sequence
actgactttgactgggctgt

SEQ ID NO: 220976 - DNA, 20 bp, Artificial
  CRISPR gRNA sequence
actttgactgggctgtttta

SEQ ID NO: 220977 - DNA, 20 bp, Artificial
  CRISPR gRNA sequence
tgactgggctgttttacagt

SEQ ID NO: 220978 - DNA, 20 bp, Artificial
  CRISPR gRNA sequence
gactgggctgttttacagtt

SEQ ID NO: 220979 - DNA, 20 bp, Artificial
  CRISPR gRNA sequence
actgggctgttttacagttt

SEQ ID NO: 220980 - DNA, 20 bp, Artificial
  CRISPR gRNA sequence
ggctgttttacagtttcata

SEQ ID NO: 220981 - DNA, 20 bp, Artificial
  CRISPR gRNA sequence
ttttacagtttcataagttg

SEQ ID NO: 220982 - DNA, 20 bp, Artificial
  CRISPR gRNA sequence
tacagtttcataagttgtag

SEQ ID NO: 220983 - DNA, 20 bp, Artificial
  CRISPR gRNA sequence
acagtttcataagttgtaga

SEQ ID NO: 220984 - DNA, 20 bp, Artificial
  CRISPR gRNA sequence
cagtttcataagttgtagaa

SEQ ID NO: 220985 - DNA, 20 bp, Artificial
  CRISPR gRNA sequence
cataagttgtagaaaactga

SEQ ID NO: 220986 - DNA, 20 bp, Artificial
  CRISPR gRNA sequence
ataagttgtagaaaactgag

SEQ ID NO: 220987 - DNA, 20 bp, Artificial
  CRISPR gRNA sequence
tagaaaactgagagtaattc

SEQ ID NO: 220988 - DNA, 20 bp, Artificial
  CRISPR gRNA sequence
agagtaattcaaatggattg

SEQ ID NO: 220989 - DNA, 20 bp, Artificial
  CRISPR gRNA sequence
aaatggattgctgtccatac

SEQ ID NO: 220990 - DNA, 20 bp, Artificial
  CRISPR gRNA sequence
ctgtccatacagataaaaat

SEQ ID NO: 220991 - DNA, 20 bp, Artificial
  CRISPR gRNA sequence
tccatacagataaaaataaa

SEQ ID NO: 220992 - DNA, 20 bp, Artificial
  CRISPR gRNA sequence
gttctgcaattgatttccac

SEQ ID NO: 220993 - DNA, 20 bp, Artificial
  CRISPR gRNA sequence
ttctgcaattgatttccacc

SEQ ID NO: 220994 - DNA, 20 bp, Artificial
  CRISPR gRNA sequence
tgcaattgatttccacctgg

SEQ ID NO: 220995 - DNA, 20 bp, Artificial
  CRISPR gRNA sequence
caattgatttccacctggtg

SEQ ID NO: 220996 - DNA, 20 bp, Artificial
  CRISPR gRNA sequence
atttccacctggtggaagag

SEQ ID NO: 220997 - DNA, 20 bp, Artificial
  CRISPR gRNA sequence
ccacctggtggaagagagga

SEQ ID NO: 220998 - DNA, 20 bp, Artificial
  CRISPR gRNA sequence
cacctggtggaagagaggat

SEQ ID NO: 220999 - DNA, 20 bp, Artificial
  CRISPR gRNA sequence
gtggaagagaggattccaaa

SEQ ID NO: 221000 - DNA, 20 bp, Artificial
  CRISPR gRNA sequence
caaaagactacattttactg

SEQ ID NO: 221001 - DNA, 20 bp, Artificial
  CRISPR gRNA sequence
cattttactgccctgaggat

SEQ ID NO: 221002 - DNA, 20 bp, Artificial
  CRISPR gRNA sequence
tactgccctgaggatattga

SEQ ID NO: 221003 - DNA, 20 bp, Artificial
  CRISPR gRNA sequence
actgccctgaggatattgac

SEQ ID NO: 221004 - DNA, 20 bp, Artificial
  CRISPR gRNA sequence
ctgccctgaggatattgacc

SEQ ID NO: 221005 - DNA, 20 bp, Artificial
  CRISPR gRNA sequence
ccctgaggatattgaccaat

SEQ ID NO: 221006 - DNA, 20 bp, Artificial
  CRISPR gRNA sequence
aggatattgaccaattttgc

SEQ ID NO: 221007 - DNA, 20 bp, Artificial
  CRISPR gRNA sequence
accaattttgcatttattag

SEQ ID NO: 221008 - DNA, 20 bp, Artificial
  CRISPR gRNA sequence
tgcatttattagcaaattca

SEQ ID NO: 221009 - DNA, 20 bp, Artificial
  CRISPR gRNA sequence
gcatttattagcaaattcat

SEQ ID NO: 221010 - DNA, 20 bp, Artificial
  CRISPR gRNA sequence
catttattagcaaattcatt

SEQ ID NO: 221011 - DNA, 20 bp, Artificial
  CRISPR gRNA sequence
attagcaaattcatttaggc

SEQ ID NO: 221012 - DNA, 20 bp, Artificial
  CRISPR gRNA sequence
ttagcaaattcatttaggca

SEQ ID NO: 221013 - DNA, 20 bp, Artificial
  CRISPR gRNA sequence
gcaaattcatttaggcattc

SEQ ID NO: 221014 - DNA, 20 bp, Artificial
  CRISPR gRNA sequence
atttaggcattcttgattgc

SEQ ID NO: 221015 - DNA, 20 bp, Artificial
  CRISPR gRNA sequence
aggcattcttgattgcctat

SEQ ID NO: 221016 - DNA, 20 bp, Artificial
  CRISPR gRNA sequence
ggcattcttgattgcctata

SEQ ID NO: 221017 - DNA, 20 bp, Artificial
  CRISPR gRNA sequence
ttgattgcctataaatgtgt

SEQ ID NO: 221018 - DNA, 20 bp, Artificial
  CRISPR gRNA sequence
gattgcctataaatgtgtct

SEQ ID NO: 221019 - DNA, 20 bp, Artificial
  CRISPR gRNA sequence
attgcctataaatgtgtctg

SEQ ID NO: 221020 - DNA, 20 bp, Artificial
  CRISPR gRNA sequence
cctataaatgtgtctgtttt

SEQ ID NO: 221021 - DNA, 20 bp, Artificial
  CRISPR gRNA sequence
taaatgtgtctgtttttcca

SEQ ID NO: 221022 - DNA, 20 bp, Artificial
  CRISPR gRNA sequence
tttttccaattttcttttaa

SEQ ID NO: 221023 - DNA, 20 bp, Artificial
  CRISPR gRNA sequence
ttccaattttcttttaaaag

SEQ ID NO: 221024 - DNA, 20 bp, Artificial
  CRISPR gRNA sequence
tccaattttcttttaaaagg

SEQ ID NO: 221025 - DNA, 20 bp, Artificial
  CRISPR gRNA sequence
ccaattttcttttaaaaggg

SEQ ID NO: 221026 - DNA, 20 bp, Artificial
  CRISPR gRNA sequence
caattttcttttaaaagggt

SEQ ID NO: 221027 - DNA, 20 bp, Artificial
  CRISPR gRNA sequence
tcttttaaaagggttttgcc

SEQ ID NO: 221028 - DNA, 20 bp, Artificial
  CRISPR gRNA sequence
cttttaaaagggttttgcct

SEQ ID NO: 221029 - DNA, 20 bp, Artificial
  CRISPR gRNA sequence
ttttaaaagggttttgcctt

SEQ ID NO: 221030 - DNA, 20 bp, Artificial
  CRISPR gRNA sequence
ttaaaagggttttgccttct

SEQ ID NO: 221031 - DNA, 20 bp, Artificial
  CRISPR gRNA sequence
taaaagggttttgccttctt

SEQ ID NO: 221032 - DNA, 20 bp, Artificial
  CRISPR gRNA sequence
aaaagggttttgccttcttg

SEQ ID NO: 221033 - DNA, 20 bp, Artificial
  CRISPR gRNA sequence
aaagggttttgccttcttgc

SEQ ID NO: 221034 - DNA, 20 bp, Artificial
  CRISPR gRNA sequence
tgccttcttgctagtttgct

SEQ ID NO: 221035 - DNA, 20 bp, Artificial
  CRISPR gRNA sequence
gccttcttgctagtttgctt

SEQ ID NO: 221036 - DNA, 20 bp, Artificial
  CRISPR gRNA sequence
ccttcttgctagtttgcttg

SEQ ID NO: 221037 - DNA, 20 bp, Artificial
  CRISPR gRNA sequence
cttgctagtttgcttgttaa

SEQ ID NO: 221038 - DNA, 20 bp, Artificial
  CRISPR gRNA sequence
ttgctagtttgcttgttaat

SEQ ID NO: 221039 - DNA, 20 bp, Artificial
  CRISPR gRNA sequence
gctagtttgcttgttaatta

SEQ ID NO: 221040 - DNA, 20 bp, Artificial
  CRISPR gRNA sequence
ctagtttgcttgttaattaa

SEQ ID NO: 221041 - DNA, 20 bp, Artificial
  CRISPR gRNA sequence
gtttgcttgttaattaatta

SEQ ID NO: 221042 - DNA, 20 bp, Artificial
  CRISPR gRNA sequence
gcttgttaattaattagtga

SEQ ID NO: 221043 - DNA, 20 bp, Artificial
  CRISPR gRNA sequence
cttgttaattaattagtgaa

SEQ ID NO: 221044 - DNA, 20 bp, Artificial
  CRISPR gRNA sequence
gttaattaattagtgaaata

SEQ ID NO: 221045 - DNA, 20 bp, Artificial
  CRISPR gRNA sequence
ttaattaattagtgaaataa

SEQ ID NO: 221046 - DNA, 20 bp, Artificial
  CRISPR gRNA sequence
attaattagtgaaataaaat

SEQ ID NO: 221047 - DNA, 20 bp, Artificial
  CRISPR gRNA sequence
attagtgaaataaaatcttt

SEQ ID NO: 221048 - DNA, 20 bp, Artificial
  CRISPR gRNA sequence
gtgaaataaaatctttgaca

SEQ ID NO: 221049 - DNA, 20 bp, Artificial
  CRISPR gRNA sequence
tgacacatgttcattttata

SEQ ID NO: 221050 - DNA, 20 bp, Artificial
  CRISPR gRNA sequence
gacacatgttcattttatat

SEQ ID NO: 221051 - DNA, 20 bp, Artificial
  CRISPR gRNA sequence
acacatgttcattttatatt

SEQ ID NO: 221052 - DNA, 20 bp, Artificial
  CRISPR gRNA sequence
attttatatttgtatgaatc

SEQ ID NO: 221053 - DNA, 20 bp, Artificial
  CRISPR gRNA sequence
tatatttgtatgaatcatgg

SEQ ID NO: 221054 - DNA, 20 bp, Artificial
  CRISPR gRNA sequence
atatttgtatgaatcatggt

SEQ ID NO: 221055 - DNA, 20 bp, Artificial
  CRISPR gRNA sequence
tatttgtatgaatcatggtt

SEQ ID NO: 221056 - DNA, 20 bp, Artificial
  CRISPR gRNA sequence
gtatgaatcatggtttgact

SEQ ID NO: 221057 - DNA, 20 bp, Artificial
  CRISPR gRNA sequence
tatgaatcatggtttgactt

SEQ ID NO: 221058 - DNA, 20 bp, Artificial
  CRISPR gRNA sequence
gactttcaagagattattct

SEQ ID NO: 221059 - DNA, 20 bp, Artificial
  CRISPR gRNA sequence
actttcaagagattattctt

SEQ ID NO: 221060 - DNA, 20 bp, Artificial
  CRISPR gRNA sequence
tcaagagattattcttaaaa

SEQ ID NO: 221061 - DNA, 20 bp, Artificial
  CRISPR gRNA sequence
caagagattattcttaaaaa

SEQ ID NO: 221062 - DNA, 20 bp, Artificial
  CRISPR gRNA sequence
aagagattattcttaaaaaa

SEQ ID NO: 221063 - DNA, 20 bp, Artificial
  CRISPR gRNA sequence
ttcttaaaaaaaagaggtac

SEQ ID NO: 221064 - DNA, 20 bp, Artificial
  CRISPR gRNA sequence
ttaaaaaaaagaggtacgaa

SEQ ID NO: 221065 - DNA, 20 bp, Artificial
  CRISPR gRNA sequence
aaaaaaaagaggtacgaatg

SEQ ID NO: 221066 - DNA, 20 bp, Artificial
  CRISPR gRNA sequence
aaaaaaagaggtacgaatga

SEQ ID NO: 221067 - DNA, 20 bp, Artificial
  CRISPR gRNA sequence
agtcatcctatgaaactttt

SEQ ID NO: 221068 - DNA, 20 bp, Artificial
  CRISPR gRNA sequence
tgaaactttttgcaaaggct

SEQ ID NO: 221069 - DNA, 20 bp, Artificial
  CRISPR gRNA sequence
tttgcaaaggctttaattaa

SEQ ID NO: 221070 - DNA, 20 bp, Artificial
  CRISPR gRNA sequence
ttgcaaaggctttaattaag

SEQ ID NO: 221071 - DNA, 20 bp, Artificial
  CRISPR gRNA sequence
tgcaaaggctttaattaagt

SEQ ID NO: 221072 - DNA, 20 bp, Artificial
  CRISPR gRNA sequence
gcaaaggctttaattaagta

SEQ ID NO: 221073 - DNA, 20 bp, Artificial
  CRISPR gRNA sequence
caaaggctttaattaagtaa

SEQ ID NO: 221074 - DNA, 20 bp, Artificial
  CRISPR gRNA sequence
taattaagtaagtaagaagt

SEQ ID NO: 221075 - DNA, 20 bp, Artificial
  CRISPR gRNA sequence
aattaagtaagtaagaagta

SEQ ID NO: 221076 - DNA, 20 bp, Artificial
  CRISPR gRNA sequence
attaagtaagtaagaagtag

SEQ ID NO: 221077 - DNA, 20 bp, Artificial
  CRISPR gRNA sequence
agtaagtaagaagtagttgg

SEQ ID NO: 221078 - DNA, 20 bp, Artificial
  CRISPR gRNA sequence
gtgaacaatccaccatttca

SEQ ID NO: 221079 - DNA, 20 bp, Artificial
  CRISPR gRNA sequence
cataacatatgtttagagaa

SEQ ID NO: 221080 - DNA, 20 bp, Artificial
  CRISPR gRNA sequence
ataacatatgtttagagaat

SEQ ID NO: 221081 - DNA, 20 bp, Artificial
  CRISPR gRNA sequence
agagaatgaattttcaaagg

SEQ ID NO: 221082 - DNA, 20 bp, Artificial
  CRISPR gRNA sequence
gagaatgaattttcaaagga

SEQ ID NO: 221083 - DNA, 20 bp, Artificial
  CRISPR gRNA sequence
tcaaaggaatacagaaagca

SEQ ID NO: 221084 - DNA, 20 bp, Artificial
  CRISPR gRNA sequence
caaaggaatacagaaagcaa

SEQ ID NO: 221085 - DNA, 20 bp, Artificial
  CRISPR gRNA sequence
aaaggaatacagaaagcaat

SEQ ID NO: 221086 - DNA, 20 bp, Artificial
  CRISPR gRNA sequence
tactgcattatttgttacaa

SEQ ID NO: 221087 - DNA, 20 bp, Artificial
  CRISPR gRNA sequence
cattatttgttacaataaaa

SEQ ID NO: 221088 - DNA, 20 bp, Artificial
  CRISPR gRNA sequence
tttgttacaataaaaacatt

SEQ ID NO: 221089 - DNA, 20 bp, Artificial
  CRISPR gRNA sequence
gttacaataaaaacatttta

SEQ ID NO: 221090 - DNA, 20 bp, Artificial
  CRISPR gRNA sequence
ttacaataaaaacattttat

SEQ ID NO: 221091 - DNA, 20 bp, Artificial
  CRISPR gRNA sequence
caataaaaacattttatagc

SEQ ID NO: 221092 - DNA, 20 bp, Artificial
  CRISPR gRNA sequence
tatagctgaagcaatttaag

SEQ ID NO: 221093 - DNA, 20 bp, Artificial
  CRISPR gRNA sequence
atagctgaagcaatttaagt

SEQ ID NO: 221094 - DNA, 20 bp, Artificial
  CRISPR gRNA sequence
tagctgaagcaatttaagta

SEQ ID NO: 221095 - DNA, 20 bp, Artificial
  CRISPR gRNA sequence
aagcaatttaagtagaataa

SEQ ID NO: 221096 - DNA, 20 bp, Artificial
  CRISPR gRNA sequence
aagtagaataaatgctatta

SEQ ID NO: 221097 - DNA, 20 bp, Artificial
  CRISPR gRNA sequence
agtagaataaatgctattag

SEQ ID NO: 221098 - DNA, 20 bp, Artificial
  CRISPR gRNA sequence
ttagtaaaaataacagtaaa

SEQ ID NO: 221099 - DNA, 20 bp, Artificial
  CRISPR gRNA sequence
gtaaaaataacagtaaaatt

SEQ ID NO: 221100 - DNA, 20 bp, Artificial
  CRISPR gRNA sequence
acctggataaaccacaattt

SEQ ID NO: 221101 - DNA, 20 bp, Artificial
  CRISPR gRNA sequence
gataaaccacaatttgaata

SEQ ID NO: 221102 - DNA, 20 bp, Artificial
  CRISPR gRNA sequence
gaataacctttgcactagta

SEQ ID NO: 221103 - DNA, 20 bp, Artificial
  CRISPR gRNA sequence
aataacctttgcactagtaa

SEQ ID NO: 221104 - DNA, 20 bp, Artificial
  CRISPR gRNA sequence
tgcactagtaattaataaat

SEQ ID NO: 221105 - DNA, 20 bp, Artificial
  CRISPR gRNA sequence
gcactagtaattaataaata

SEQ ID NO: 221106 - DNA, 20 bp, Artificial
  CRISPR gRNA sequence
cactagtaattaataaataa

SEQ ID NO: 221107 - DNA, 20 bp, Artificial
  CRISPR gRNA sequence
gtaattaataaataagggca

SEQ ID NO: 221108 - DNA, 20 bp, Artificial
  CRISPR gRNA sequence
ataaataagggcaggccaaa

SEQ ID NO: 221109 - DNA, 20 bp, Artificial
  CRISPR gRNA sequence
tagctgttaactacaacttc

SEQ ID NO: 221110 - DNA, 20 bp, Artificial
  CRISPR gRNA sequence
gctgttaactacaacttcaa

SEQ ID NO: 221111 - DNA, 20 bp, Artificial
  CRISPR gRNA sequence
ttaactacaacttcaatctc

SEQ ID NO: 221112 - DNA, 20 bp, Artificial
  CRISPR gRNA sequence
actacaacttcaatctctat

SEQ ID NO: 221113 - DNA, 20 bp, Artificial
  CRISPR gRNA sequence
caacttcaatctctataaag

SEQ ID NO: 221114 - DNA, 20 bp, Artificial
  CRISPR gRNA sequence
caatctctataaagatgcat

SEQ ID NO: 221115 - DNA, 20 bp, Artificial
  CRISPR gRNA sequence
aatctctataaagatgcatt

SEQ ID NO: 221116 - DNA, 20 bp, Artificial
  CRISPR gRNA sequence
tataaagatgcattaaaaaa

SEQ ID NO: 221117 - DNA, 20 bp, Artificial
  CRISPR gRNA sequence
taaagatgcattaaaaaact

SEQ ID NO: 221118 - DNA, 20 bp, Artificial
  CRISPR gRNA sequence
aaaaactattaagtagtaaa

SEQ ID NO: 221119 - DNA, 20 bp, Artificial
  CRISPR gRNA sequence
ttaagtagtaaaactgtctg

SEQ ID NO: 221120 - DNA, 20 bp, Artificial
  CRISPR gRNA sequence
agtagtaaaactgtctgatt

SEQ ID NO: 221121 - DNA, 20 bp, Artificial
  CRISPR gRNA sequence
tctgatttggggttttttcc

SEQ ID NO: 221122 - DNA, 20 bp, Artificial
  CRISPR gRNA sequence
atttggggttttttcctttt

SEQ ID NO: 221123 - DNA, 20 bp, Artificial
  CRISPR gRNA sequence
ggggttttttccttttgcct

SEQ ID NO: 221124 - DNA, 20 bp, Artificial
  CRISPR gRNA sequence
gggttttttccttttgccta

SEQ ID NO: 221125 - DNA, 20 bp, Artificial
  CRISPR gRNA sequence
tttccttttgcctactccct

SEQ ID NO: 221126 - DNA, 20 bp, Artificial
  CRISPR gRNA sequence
ttccttttgcctactccctt

SEQ ID NO: 221127 - DNA, 20 bp, Artificial
  CRISPR gRNA sequence
tccttttgcctactcccttc

SEQ ID NO: 221128 - DNA, 20 bp, Artificial
  CRISPR gRNA sequence
ccttttgcctactcccttct

SEQ ID NO: 221129 - DNA, 20 bp, Artificial
  CRISPR gRNA sequence
cttttgcctactcccttctc

SEQ ID NO: 221130 - DNA, 20 bp, Artificial
  CRISPR gRNA sequence
ttgcctactcccttctcata

SEQ ID NO: 221131 - DNA, 20 bp, Artificial
  CRISPR gRNA sequence
tgcctactcccttctcataa

SEQ ID NO: 221132 - DNA, 20 bp, Artificial
  CRISPR gRNA sequence
gcctactcccttctcataaa

SEQ ID NO: 221133 - DNA, 20 bp, Artificial
  CRISPR gRNA sequence
cctactcccttctcataaaa

SEQ ID NO: 221134 - DNA, 20 bp, Artificial
  CRISPR gRNA sequence
ctcccttctcataaaacagc

SEQ ID NO: 221135 - DNA, 20 bp, Artificial
  CRISPR gRNA sequence
ccttctcataaaacagcaaa

SEQ ID NO: 221136 - DNA, 20 bp, Artificial
  CRISPR gRNA sequence
ctcataaaacagcaaagtga

SEQ ID NO: 221137 - DNA, 20 bp, Artificial
  CRISPR gRNA sequence
tcataaaacagcaaagtgaa

SEQ ID NO: 221138 - DNA, 20 bp, Artificial
  CRISPR gRNA sequence
ataaaacagcaaagtgaaga

SEQ ID NO: 221139 - DNA, 20 bp, Artificial
  CRISPR gRNA sequence
tttaaaatgtagagagcaaa

SEQ ID NO: 221140 - DNA, 20 bp, Artificial
  CRISPR gRNA sequence
aaaatgtagagagcaaataa

SEQ ID NO: 221141 - DNA, 20 bp, Artificial
  CRISPR gRNA sequence
aaatgtagagagcaaataaa

SEQ ID NO: 221142 - DNA, 20 bp, Artificial
  CRISPR gRNA sequence
acatgaataagaaaactctg

SEQ ID NO: 221143 - DNA, 20 bp, Artificial
  CRISPR gRNA sequence
tgaataaacaagatatgctt

SEQ ID NO: 221144 - DNA, 20 bp, Artificial
  CRISPR gRNA sequence
aataaacaagatatgcttat

SEQ ID NO: 221145 - DNA, 20 bp, Artificial
  CRISPR gRNA sequence
atagcagtctaaatcagata

SEQ ID NO: 221146 - DNA, 20 bp, Artificial
  CRISPR gRNA sequence
tagcagtctaaatcagatag

SEQ ID NO: 221147 - DNA, 20 bp, Artificial
  CRISPR gRNA sequence
aatcagatagcagcagacaa

SEQ ID NO: 221148 - DNA, 20 bp, Artificial
  CRISPR gRNA sequence
tagataaattagcaaataaa

SEQ ID NO: 221149 - DNA, 20 bp, Artificial
  CRISPR gRNA sequence
gcaaataaaatgggaaaatg

SEQ ID NO: 221150 - DNA, 20 bp, Artificial
  CRISPR gRNA sequence
tatatcaaatgccaaaagta

SEQ ID NO: 221151 - DNA, 20 bp, Artificial
  CRISPR gRNA sequence
atatcaaatgccaaaagtat

SEQ ID NO: 221152 - DNA, 20 bp, Artificial
  CRISPR gRNA sequence
tatcaaatgccaaaagtatt

SEQ ID NO: 221153 - DNA, 20 bp, Artificial
  CRISPR gRNA sequence
gacttgaaaccttcattgga

SEQ ID NO: 221154 - DNA, 20 bp, Artificial
  CRISPR gRNA sequence
gaaaccttcattggaactgt

SEQ ID NO: 221155 - DNA, 20 bp, Artificial
  CRISPR gRNA sequence
aaaccttcattggaactgta

SEQ ID NO: 221156 - DNA, 20 bp, Artificial
  CRISPR gRNA sequence
cattggaactgtacaagtat

SEQ ID NO: 221157 - DNA, 20 bp, Artificial
  CRISPR gRNA sequence
attggaactgtacaagtatt

SEQ ID NO: 221158 - DNA, 20 bp, Artificial
  CRISPR gRNA sequence
gaactgtacaagtattggtg

SEQ ID NO: 221159 - DNA, 20 bp, Artificial
  CRISPR gRNA sequence
tacaagtattggtgaatata

SEQ ID NO: 221160 - DNA, 20 bp, Artificial
  CRISPR gRNA sequence
gtgaatatagactatcagcc

SEQ ID NO: 221161 - DNA, 20 bp, Artificial
  CRISPR gRNA sequence
tcagcccaaaccatctcata

SEQ ID NO: 221162 - DNA, 20 bp, Artificial
  CRISPR gRNA sequence
atatcatagtctagaaaaga

SEQ ID NO: 221163 - DNA, 20 bp, Artificial
  CRISPR gRNA sequence
gaaaagagctttgtagtggc

SEQ ID NO: 221164 - DNA, 20 bp, Artificial
  CRISPR gRNA sequence
tgtagtggcagagaagactc

SEQ ID NO: 221165 - DNA, 20 bp, Artificial
  CRISPR gRNA sequence
gtagtggcagagaagactca

SEQ ID NO: 221166 - DNA, 20 bp, Artificial
  CRISPR gRNA sequence
tagtggcagagaagactcaa

SEQ ID NO: 221167 - DNA, 20 bp, Artificial
  CRISPR gRNA sequence
aatccatggtggtcacagca

SEQ ID NO: 221168 - DNA, 20 bp, Artificial
  CRISPR gRNA sequence
aggttagaaattttaaaaat

SEQ ID NO: 221169 - DNA, 20 bp, Artificial
  CRISPR gRNA sequence
gaaattttaaaaatgcaatc

SEQ ID NO: 221170 - DNA, 20 bp, Artificial
  CRISPR gRNA sequence
taaaaatgcaatcaacattt

SEQ ID NO: 221171 - DNA, 20 bp, Artificial
  CRISPR gRNA sequence
aaaaatgcaatcaacatttg

SEQ ID NO: 221172 - DNA, 20 bp, Artificial
  CRISPR gRNA sequence
aaaatgcaatcaacatttgt

SEQ ID NO: 221173 - DNA, 20 bp, Artificial
  CRISPR gRNA sequence
gtcaagaattacctgtgatg

SEQ ID NO: 221174 - DNA, 20 bp, Artificial
  CRISPR gRNA sequence
tcaagaattacctgtgatga

SEQ ID NO: 221175 - DNA, 20 bp, Artificial
  CRISPR gRNA sequence
cctgtgatgaaatattgtga

SEQ ID NO: 221176 - DNA, 20 bp, Artificial
  CRISPR gRNA sequence
tgatgaaatattgtgatagg

SEQ ID NO: 221177 - DNA, 20 bp, Artificial
  CRISPR gRNA sequence
tgataggatgtggggatata

SEQ ID NO: 221178 - DNA, 20 bp, Artificial
  CRISPR gRNA sequence
ttatcttttaggagcttaca

SEQ ID NO: 221179 - DNA, 20 bp, Artificial
  CRISPR gRNA sequence
tcttttaggagcttacaatt

SEQ ID NO: 221180 - DNA, 20 bp, Artificial
  CRISPR gRNA sequence
ttaggagcttacaattctca

SEQ ID NO: 221181 - DNA, 20 bp, Artificial
  CRISPR gRNA sequence
taggagcttacaattctcaa

SEQ ID NO: 221182 - DNA, 20 bp, Artificial
  CRISPR gRNA sequence
aggagcttacaattctcaaa

SEQ ID NO: 221183 - DNA, 20 bp, Artificial
  CRISPR gRNA sequence
ggagcttacaattctcaaat

SEQ ID NO: 221184 - DNA, 20 bp, Artificial
  CRISPR gRNA sequence
acaattctcaaatgggcgat

SEQ ID NO: 221185 - DNA, 20 bp, Artificial
  CRISPR gRNA sequence
caattctcaaatgggcgatg

SEQ ID NO: 221186 - DNA, 20 bp, Artificial
  CRISPR gRNA sequence
tcaaatgggcgatgataagt

SEQ ID NO: 221187 - DNA, 20 bp, Artificial
  CRISPR gRNA sequence
aaatgggcgatgataagtat

SEQ ID NO: 221188 - DNA, 20 bp, Artificial
  CRISPR gRNA sequence
caagtgttatcttttctgca

SEQ ID NO: 221189 - DNA, 20 bp, Artificial
  CRISPR gRNA sequence
tcttttctgcatggacaacg

SEQ ID NO: 221190 - DNA, 20 bp, Artificial
  CRISPR gRNA sequence
ttctgcatggacaacgtcct

SEQ ID NO: 221191 - DNA, 20 bp, Artificial
  CRISPR gRNA sequence
tctgcatggacaacgtcctt

SEQ ID NO: 221192 - DNA, 20 bp, Artificial
  CRISPR gRNA sequence
ctgcatggacaacgtcctta

SEQ ID NO: 221193 - DNA, 20 bp, Artificial
  CRISPR gRNA sequence
tgcatggacaacgtccttat

SEQ ID NO: 221194 - DNA, 20 bp, Artificial
  CRISPR gRNA sequence
catggacaacgtccttatgg

SEQ ID NO: 221195 - DNA, 20 bp, Artificial
  CRISPR gRNA sequence
atggatgggcagaagagtaa

SEQ ID NO: 221196 - DNA, 20 bp, Artificial
  CRISPR gRNA sequence
tggatgggcagaagagtaat

SEQ ID NO: 221197 - DNA, 20 bp, Artificial
  CRISPR gRNA sequence
gtcttacagatttctaagaa

SEQ ID NO: 221198 - DNA, 20 bp, Artificial
  CRISPR gRNA sequence
acagatttctaagaaaattc

SEQ ID NO: 221199 - DNA, 20 bp, Artificial
  CRISPR gRNA sequence
cagatttctaagaaaattca

SEQ ID NO: 221200 - DNA, 20 bp, Artificial
  CRISPR gRNA sequence
ctaagaaaattcatgttgct

SEQ ID NO: 221201 - DNA, 20 bp, Artificial
  CRISPR gRNA sequence
taagaaaattcatgttgcta

SEQ ID NO: 221202 - DNA, 20 bp, Artificial
  CRISPR gRNA sequence
agaaaattcatgttgctaat

SEQ ID NO: 221203 - DNA, 20 bp, Artificial
  CRISPR gRNA sequence
atgttgctaataggcaaaaa

SEQ ID NO: 221204 - DNA, 20 bp, Artificial
  CRISPR gRNA sequence
ctaataggcaaaaacagaag

SEQ ID NO: 221205 - DNA, 20 bp, Artificial
  CRISPR gRNA sequence
ataggcaaaaacagaagaat

SEQ ID NO: 221206 - DNA, 20 bp, Artificial
  CRISPR gRNA sequence
ctcctccgggccttcaatct

SEQ ID NO: 221207 - DNA, 20 bp, Artificial
  CRISPR gRNA sequence
ctccgggccttcaatcttta

SEQ ID NO: 221208 - DNA, 20 bp, Artificial
  CRISPR gRNA sequence
cgggccttcaatctttacca

SEQ ID NO: 221209 - DNA, 20 bp, Artificial
  CRISPR gRNA sequence
caatctttaccattttacat

SEQ ID NO: 221210 - DNA, 20 bp, Artificial
  CRISPR gRNA sequence
aatctttaccattttacata

SEQ ID NO: 221211 - DNA, 20 bp, Artificial
  CRISPR gRNA sequence
taccattttacatatttcat

SEQ ID NO: 221212 - DNA, 20 bp, Artificial
  CRISPR gRNA sequence
accattttacatatttcatg

SEQ ID NO: 221213 - DNA, 20 bp, Artificial
  CRISPR gRNA sequence
ccattttacatatttcatgt

SEQ ID NO: 221214 - DNA, 20 bp, Artificial
  CRISPR gRNA sequence
tacatatttcatgtaaatgt

SEQ ID NO: 221215 - DNA, 20 bp, Artificial
  CRISPR gRNA sequence
acatatttcatgtaaatgtt

SEQ ID NO: 221216 - DNA, 20 bp, Artificial
  CRISPR gRNA sequence
catatttcatgtaaatgttc

SEQ ID NO: 221217 - DNA, 20 bp, Artificial
  CRISPR gRNA sequence
catgtaaatgttcgcttctt

SEQ ID NO: 221218 - DNA, 20 bp, Artificial
  CRISPR gRNA sequence
atgtaaatgttcgcttcttt

SEQ ID NO: 221219 - DNA, 20 bp, Artificial
  CRISPR gRNA sequence
gcttctttttaacaactctt

SEQ ID NO: 221220 - DNA, 20 bp, Artificial
  CRISPR gRNA sequence
ctttttaacaactcttaaat

SEQ ID NO: 221221 - DNA, 20 bp, Artificial
  CRISPR gRNA sequence
tttttaacaactcttaaatt

SEQ ID NO: 221222 - DNA, 20 bp, Artificial
  CRISPR gRNA sequence
tttaacaactcttaaattac

SEQ ID NO: 221223 - DNA, 20 bp, Artificial
  CRISPR gRNA sequence
ttaacaactcttaaattact

SEQ ID NO: 221224 - DNA, 20 bp, Artificial
  CRISPR gRNA sequence
taacaactcttaaattactc

SEQ ID NO: 221225 - DNA, 20 bp, Artificial
  CRISPR gRNA sequence
aacaactcttaaattactcc

SEQ ID NO: 221226 - DNA, 20 bp, Artificial
  CRISPR gRNA sequence
acaactcttaaattactccc

SEQ ID NO: 221227 - DNA, 20 bp, Artificial
  CRISPR gRNA sequence
ttaaattactcccttctgcc

SEQ ID NO: 221228 - DNA, 20 bp, Artificial
  CRISPR gRNA sequence
aaattactcccttctgccct

SEQ ID NO: 221229 - DNA, 20 bp, Artificial
  CRISPR gRNA sequence
aattactcccttctgccctt

SEQ ID NO: 221230 - DNA, 20 bp, Artificial
  CRISPR gRNA sequence
ctcccttctgccctttatcc

SEQ ID NO: 221231 - DNA, 20 bp, Artificial
  CRISPR gRNA sequence
ccttctgccctttatcccat

SEQ ID NO: 221232 - DNA, 20 bp, Artificial
  CRISPR gRNA sequence
ctgccctttatcccatactc

SEQ ID NO: 221233 - DNA, 20 bp, Artificial
  CRISPR gRNA sequence
tgccctttatcccatactct

SEQ ID NO: 221234 - DNA, 20 bp, Artificial
  CRISPR gRNA sequence
ccctttatcccatactctcc

SEQ ID NO: 221235 - DNA, 20 bp, Artificial
  CRISPR gRNA sequence
tatcccatactctccaacag

SEQ ID NO: 221236 - DNA, 20 bp, Artificial
  CRISPR gRNA sequence
atcccatactctccaacagt

SEQ ID NO: 221237 - DNA, 20 bp, Artificial
  CRISPR gRNA sequence
tcccatactctccaacagtc

SEQ ID NO: 221238 - DNA, 20 bp, Artificial
  CRISPR gRNA sequence
tccaacagtcctctctccct

SEQ ID NO: 221239 - DNA, 20 bp, Artificial
  CRISPR gRNA sequence
caacagtcctctctccctat

SEQ ID NO: 221240 - DNA, 20 bp, Artificial
  CRISPR gRNA sequence
tctccctatttcttaataca

SEQ ID NO: 221241 - DNA, 20 bp, Artificial
  CRISPR gRNA sequence
tccctatttcttaatacaaa

SEQ ID NO: 221242 - DNA, 20 bp, Artificial
  CRISPR gRNA sequence
cctatttcttaatacaaact

SEQ ID NO: 221243 - DNA, 20 bp, Artificial
  CRISPR gRNA sequence
tttcttaatacaaactgaaa

SEQ ID NO: 221244 - DNA, 20 bp, Artificial
  CRISPR gRNA sequence
cttaatacaaactgaaacct

SEQ ID NO: 221245 - DNA, 20 bp, Artificial
  CRISPR gRNA sequence
ttaatacaaactgaaacctt

SEQ ID NO: 221246 - DNA, 20 bp, Artificial
  CRISPR gRNA sequence
aatacaaactgaaaccttca

SEQ ID NO: 221247 - DNA, 20 bp, Artificial
  CRISPR gRNA sequence
atacaaactgaaaccttcag

SEQ ID NO: 221248 - DNA, 20 bp, Artificial
  CRISPR gRNA sequence
aaaccttcagaggagaatcc

SEQ ID NO: 221249 - DNA, 20 bp, Artificial
  CRISPR gRNA sequence
cagaggagaatcctgaagct

SEQ ID NO: 221250 - DNA, 20 bp, Artificial
  CRISPR gRNA sequence
agaggagaatcctgaagctt

SEQ ID NO: 221251 - DNA, 20 bp, Artificial
  CRISPR gRNA sequence
aagcttccaatactccttcc

SEQ ID NO: 221252 - DNA, 20 bp, Artificial
  CRISPR gRNA sequence
ccaatactccttccctataa

SEQ ID NO: 221253 - DNA, 20 bp, Artificial
  CRISPR gRNA sequence
caatactccttccctataaa

SEQ ID NO: 221254 - DNA, 20 bp, Artificial
  CRISPR gRNA sequence
cttccctataaacctacctg

SEQ ID NO: 221255 - DNA, 20 bp, Artificial
  CRISPR gRNA sequence
ccctataaacctacctgtaa

SEQ ID NO: 221256 - DNA, 20 bp, Artificial
  CRISPR gRNA sequence
cctataaacctacctgtaac

SEQ ID NO: 221257 - DNA, 20 bp, Artificial
  CRISPR gRNA sequence
taaacctacctgtaacccca

SEQ ID NO: 221258 - DNA, 20 bp, Artificial
  CRISPR gRNA sequence
cctgtaaccccaactatcca

SEQ ID NO: 221259 - DNA, 20 bp, Artificial
  CRISPR gRNA sequence
taaccccaactatccacacc

SEQ ID NO: 221260 - DNA, 20 bp, Artificial
  CRISPR gRNA sequence
tccacacctttttttttttt

SEQ ID NO: 221261 - DNA, 20 bp, Artificial
  CRISPR gRNA sequence
ttttttttttttgcttcctt

SEQ ID NO: 221262 - DNA, 20 bp, Artificial
  CRISPR gRNA sequence
tttttttttttgcttccttt

SEQ ID NO: 221263 - DNA, 20 bp, Artificial
  CRISPR gRNA sequence
ttttttttttgcttcctttt

SEQ ID NO: 221264 - DNA, 20 bp, Artificial
  CRISPR gRNA sequence
tttttttttgcttccttttc

SEQ ID NO: 221265 - DNA, 20 bp, Artificial
  CRISPR gRNA sequence
ttttttttgcttccttttct

SEQ ID NO: 221266 - DNA, 20 bp, Artificial
  CRISPR gRNA sequence
tttttttgcttccttttctg

SEQ ID NO: 221267 - DNA, 20 bp, Artificial
  CRISPR gRNA sequence
ttttttgcttccttttctga

SEQ ID NO: 221268 - DNA, 20 bp, Artificial
  CRISPR gRNA sequence
tttttgcttccttttctgaa

SEQ ID NO: 221269 - DNA, 20 bp, Artificial
  CRISPR gRNA sequence
ttttgcttccttttctgaaa

SEQ ID NO: 221270 - DNA, 20 bp, Artificial
  CRISPR gRNA sequence
tttgcttccttttctgaaat

SEQ ID NO: 221271 - DNA, 20 bp, Artificial
  CRISPR gRNA sequence
ttgcttccttttctgaaatg

SEQ ID NO: 221272 - DNA, 20 bp, Artificial
  CRISPR gRNA sequence
tgcttccttttctgaaatga

SEQ ID NO: 221273 - DNA, 20 bp, Artificial
  CRISPR gRNA sequence
gcttccttttctgaaatgaa

SEQ ID NO: 221274 - DNA, 20 bp, Artificial
  CRISPR gRNA sequence
cttccttttctgaaatgaat

SEQ ID NO: 221275 - DNA, 20 bp, Artificial
  CRISPR gRNA sequence
ccttttctgaaatgaatccc

SEQ ID NO: 221276 - DNA, 20 bp, Artificial
  CRISPR gRNA sequence
cttttctgaaatgaatccca

SEQ ID NO: 221277 - DNA, 20 bp, Artificial
  CRISPR gRNA sequence
ttctgaaatgaatcccatca

SEQ ID NO: 221278 - DNA, 20 bp, Artificial
  CRISPR gRNA sequence
tctgaaatgaatcccatcac

SEQ ID NO: 221279 - DNA, 20 bp, Artificial
  CRISPR gRNA sequence
ctgaaatgaatcccatcacc

SEQ ID NO: 221280 - DNA, 20 bp, Artificial
  CRISPR gRNA sequence
tgaaatgaatcccatcacct

SEQ ID NO: 221281 - DNA, 20 bp, Artificial
  CRISPR gRNA sequence
aaatgaatcccatcacctga

SEQ ID NO: 221282 - DNA, 20 bp, Artificial
  CRISPR gRNA sequence
aaagctagtttccatttctg

SEQ ID NO: 221283 - DNA, 20 bp, Artificial
  CRISPR gRNA sequence
gtttccatttctgcctccat

SEQ ID NO: 221284 - DNA, 20 bp, Artificial
  CRISPR gRNA sequence
ccatttctgcctccataccc

SEQ ID NO: 221285 - DNA, 20 bp, Artificial
  CRISPR gRNA sequence
catttctgcctccataccca

SEQ ID NO: 221286 - DNA, 20 bp, Artificial
  CRISPR gRNA sequence
ctgcctccatacccatcagt

SEQ ID NO: 221287 - DNA, 20 bp, Artificial
  CRISPR gRNA sequence
tgcctccatacccatcagtc

SEQ ID NO: 221288 - DNA, 20 bp, Artificial
  CRISPR gRNA sequence
cctccatacccatcagtctc

SEQ ID NO: 221289 - DNA, 20 bp, Artificial
  CRISPR gRNA sequence
catacccatcagtctcctca

SEQ ID NO: 221290 - DNA, 20 bp, Artificial
  CRISPR gRNA sequence
ctcaacgactttccttagtt

SEQ ID NO: 221291 - DNA, 20 bp, Artificial
  CRISPR gRNA sequence
aacgactttccttagttgat

SEQ ID NO: 221292 - DNA, 20 bp, Artificial
  CRISPR gRNA sequence
tccttagttgattatcagcc

SEQ ID NO: 221293 - DNA, 20 bp, Artificial
  CRISPR gRNA sequence
ccttagttgattatcagcct

SEQ ID NO: 221294 - DNA, 20 bp, Artificial
  CRISPR gRNA sequence
cttagttgattatcagcctc

SEQ ID NO: 221295 - DNA, 20 bp, Artificial
  CRISPR gRNA sequence
agttgattatcagcctccca

SEQ ID NO: 221296 - DNA, 20 bp, Artificial
  CRISPR gRNA sequence
gttgattatcagcctcccac

SEQ ID NO: 221297 - DNA, 20 bp, Artificial
  CRISPR gRNA sequence
attatcagcctcccacatcc

SEQ ID NO: 221298 - DNA, 20 bp, Artificial
  CRISPR gRNA sequence
tcagcctcccacatccccca

SEQ ID NO: 221299 - DNA, 20 bp, Artificial
  CRISPR gRNA sequence
ccacatcccccattccattt

SEQ ID NO: 221300 - DNA, 20 bp, Artificial
  CRISPR gRNA sequence
catttacaaggtgttgtttt

SEQ ID NO: 221301 - DNA, 20 bp, Artificial
  CRISPR gRNA sequence
acaaggtgttgtttttgtgt

SEQ ID NO: 221302 - DNA, 20 bp, Artificial
  CRISPR gRNA sequence
caaggtgttgtttttgtgtg

SEQ ID NO: 221303 - DNA, 20 bp, Artificial
  CRISPR gRNA sequence
tttttgtgtgtgtctttaaa

SEQ ID NO: 221304 - DNA, 20 bp, Artificial
  CRISPR gRNA sequence
ttgtgtgtgtctttaaaaat

SEQ ID NO: 221305 - DNA, 20 bp, Artificial
  CRISPR gRNA sequence
tgtgtgtgtctttaaaaatt

SEQ ID NO: 221306 - DNA, 20 bp, Artificial
  CRISPR gRNA sequence
gtgtgtgtctttaaaaattg

SEQ ID NO: 221307 - DNA, 20 bp, Artificial
  CRISPR gRNA sequence
tgtgtgtctttaaaaattgc

SEQ ID NO: 221308 - DNA, 20 bp, Artificial
  CRISPR gRNA sequence
taaaaattgcttgaatattt

SEQ ID NO: 221309 - DNA, 20 bp, Artificial
  CRISPR gRNA sequence
aaaaattgcttgaatatttg

SEQ ID NO: 221310 - DNA, 20 bp, Artificial
  CRISPR gRNA sequence
aaaattgcttgaatatttgc

SEQ ID NO: 221311 - DNA, 20 bp, Artificial
  CRISPR gRNA sequence
cttgaatatttgccaactta

SEQ ID NO: 221312 - DNA, 20 bp, Artificial
  CRISPR gRNA sequence
gaatatttgccaacttaaaa

SEQ ID NO: 221313 - DNA, 20 bp, Artificial
  CRISPR gRNA sequence
aatatttgccaacttaaaaa

SEQ ID NO: 221314 - DNA, 20 bp, Artificial
  CRISPR gRNA sequence
gccaacttaaaaaaaatccc

SEQ ID NO: 221315 - DNA, 20 bp, Artificial
  CRISPR gRNA sequence
ccaacttaaaaaaaatccct

SEQ ID NO: 221316 - DNA, 20 bp, Artificial
  CRISPR gRNA sequence
aaaaaaaatccctcatactt

SEQ ID NO: 221317 - DNA, 20 bp, Artificial
  CRISPR gRNA sequence
aaaaaaatccctcatacttt

SEQ ID NO: 221318 - DNA, 20 bp, Artificial
  CRISPR gRNA sequence
atactttctctctccctagc

SEQ ID NO: 221319 - DNA, 20 bp, Artificial
  CRISPR gRNA sequence
tctctctccctagcatccca

SEQ ID NO: 221320 - DNA, 20 bp, Artificial
  CRISPR gRNA sequence
ctctctccctagcatcccaa

SEQ ID NO: 221321 - DNA, 20 bp, Artificial
  CRISPR gRNA sequence
tctctccctagcatcccaaa

SEQ ID NO: 221322 - DNA, 20 bp, Artificial
  CRISPR gRNA sequence
tctccctagcatcccaaatt

SEQ ID NO: 221323 - DNA, 20 bp, Artificial
  CRISPR gRNA sequence
tccctagcatcccaaattaa

SEQ ID NO: 221324 - DNA, 20 bp, Artificial
  CRISPR gRNA sequence
cctagcatcccaaattaaca

SEQ ID NO: 221325 - DNA, 20 bp, Artificial
  CRISPR gRNA sequence
gcatcccaaattaacaatct

SEQ ID NO: 221326 - DNA, 20 bp, Artificial
  CRISPR gRNA sequence
acaatctataagcatttcct

SEQ ID NO: 221327 - DNA, 20 bp, Artificial
  CRISPR gRNA sequence
taagcatttcctcacttcca

SEQ ID NO: 221328 - DNA, 20 bp, Artificial
  CRISPR gRNA sequence
cctcacttccaattcactcc

SEQ ID NO: 221329 - DNA, 20 bp, Artificial
  CRISPR gRNA sequence
ctcacttccaattcactcct

SEQ ID NO: 221330 - DNA, 20 bp, Artificial
  CRISPR gRNA sequence
acttccaattcactccttaa

SEQ ID NO: 221331 - DNA, 20 bp, Artificial
  CRISPR gRNA sequence
ccaattcactccttaaatct

SEQ ID NO: 221332 - DNA, 20 bp, Artificial
  CRISPR gRNA sequence
caattcactccttaaatctg

SEQ ID NO: 221333 - DNA, 20 bp, Artificial
  CRISPR gRNA sequence
actccttaaatctgttacgt

SEQ ID NO: 221334 - DNA, 20 bp, Artificial
  CRISPR gRNA sequence
cttaaatctgttacgtggcc

SEQ ID NO: 221335 - DNA, 20 bp, Artificial
  CRISPR gRNA sequence
aaatctgttacgtggcctcc

SEQ ID NO: 221336 - DNA, 20 bp, Artificial
  CRISPR gRNA sequence
aatctgttacgtggcctcca

SEQ ID NO: 221337 - DNA, 20 bp, Artificial
  CRISPR gRNA sequence
ttacgtggcctccacccatt

SEQ ID NO: 221338 - DNA, 20 bp, Artificial
  CRISPR gRNA sequence
cgtggcctccacccattcac

SEQ ID NO: 221339 - DNA, 20 bp, Artificial
  CRISPR gRNA sequence
cacccattcacccctacttc

SEQ ID NO: 221340 - DNA, 20 bp, Artificial
  CRISPR gRNA sequence
acccctacttcttcattact

SEQ ID NO: 221341 - DNA, 20 bp, Artificial
  CRISPR gRNA sequence
cttcttcattactacagctc

SEQ ID NO: 221342 - DNA, 20 bp, Artificial
  CRISPR gRNA sequence
cttcattactacagctcttg

SEQ ID NO: 221343 - DNA, 20 bp, Artificial
  CRISPR gRNA sequence
ttcattactacagctcttgc

SEQ ID NO: 221344 - DNA, 20 bp, Artificial
  CRISPR gRNA sequence
cattactacagctcttgcca

SEQ ID NO: 221345 - DNA, 20 bp, Artificial
  CRISPR gRNA sequence
attactacagctcttgccaa

SEQ ID NO: 221346 - DNA, 20 bp, Artificial
  CRISPR gRNA sequence
ctacagctcttgccaaagtc

SEQ ID NO: 221347 - DNA, 20 bp, Artificial
  CRISPR gRNA sequence
cagctcttgccaaagtcacc

SEQ ID NO: 221348 - DNA, 20 bp, Artificial
  CRISPR gRNA sequence
ttgccaaagtcaccaccaat

SEQ ID NO: 221349 - DNA, 20 bp, Artificial
  CRISPR gRNA sequence
gccaaagtcaccaccaatcc

SEQ ID NO: 221350 - DNA, 20 bp, Artificial
  CRISPR gRNA sequence
ccaaagtcaccaccaatccc

SEQ ID NO: 221351 - DNA, 20 bp, Artificial
  CRISPR gRNA sequence
gtgaaaaatcaaatatgcat

SEQ ID NO: 221352 - DNA, 20 bp, Artificial
  CRISPR gRNA sequence
tgaaaaatcaaatatgcatg

SEQ ID NO: 221353 - DNA, 20 bp, Artificial
  CRISPR gRNA sequence
actttctgtcttgacttttc

SEQ ID NO: 221354 - DNA, 20 bp, Artificial
  CRISPR gRNA sequence
tctgtcttgacttttccaca

SEQ ID NO: 221355 - DNA, 20 bp, Artificial
  CRISPR gRNA sequence
ctgtcttgacttttccacag

SEQ ID NO: 221356 - DNA, 20 bp, Artificial
  CRISPR gRNA sequence
tgtcttgacttttccacagt

SEQ ID NO: 221357 - DNA, 20 bp, Artificial
  CRISPR gRNA sequence
tcttgacttttccacagttc

SEQ ID NO: 221358 - DNA, 20 bp, Artificial
  CRISPR gRNA sequence
gacttttccacagttcttga

SEQ ID NO: 221359 - DNA, 20 bp, Artificial
  CRISPR gRNA sequence
acttttccacagttcttgag

SEQ ID NO: 221360 - DNA, 20 bp, Artificial
  CRISPR gRNA sequence
ttccacagttcttgagccag

SEQ ID NO: 221361 - DNA, 20 bp, Artificial
  CRISPR gRNA sequence
tccacagttcttgagccagt

SEQ ID NO: 221362 - DNA, 20 bp, Artificial
  CRISPR gRNA sequence
ccacagttcttgagccagtg

SEQ ID NO: 221363 - DNA, 20 bp, Artificial
  CRISPR gRNA sequence
cacagttcttgagccagtgg

SEQ ID NO: 221364 - DNA, 20 bp, Artificial
  CRISPR gRNA sequence
ttgagccagtgggcagtctc

SEQ ID NO: 221365 - DNA, 20 bp, Artificial
  CRISPR gRNA sequence
gagccagtgggcagtctctt

SEQ ID NO: 221366 - DNA, 20 bp, Artificial
  CRISPR gRNA sequence
agccagtgggcagtctcttt

SEQ ID NO: 221367 - DNA, 20 bp, Artificial
  CRISPR gRNA sequence
tttcttgctcttctctcttg

SEQ ID NO: 221368 - DNA, 20 bp, Artificial
  CRISPR gRNA sequence
tcttgctcttctctcttggc

SEQ ID NO: 221369 - DNA, 20 bp, Artificial
  CRISPR gRNA sequence
cttgctcttctctcttggcc

SEQ ID NO: 221370 - DNA, 20 bp, Artificial
  CRISPR gRNA sequence
ttgctcttctctcttggcct

SEQ ID NO: 221371 - DNA, 20 bp, Artificial
  CRISPR gRNA sequence
gctcttctctcttggcctcc

SEQ ID NO: 221372 - DNA, 20 bp, Artificial
  CRISPR gRNA sequence
ctcttctctcttggcctcca

SEQ ID NO: 221373 - DNA, 20 bp, Artificial
  CRISPR gRNA sequence
ttctctcttggcctccatgg

SEQ ID NO: 221374 - DNA, 20 bp, Artificial
  CRISPR gRNA sequence
ctctcttggcctccatggta

SEQ ID NO: 221375 - DNA, 20 bp, Artificial
  CRISPR gRNA sequence
tctcttggcctccatggtat

SEQ ID NO: 221376 - DNA, 20 bp, Artificial
  CRISPR gRNA sequence
tcttggcctccatggtatct

SEQ ID NO: 221377 - DNA, 20 bp, Artificial
  CRISPR gRNA sequence
ttggcctccatggtatctcc

SEQ ID NO: 221378 - DNA, 20 bp, Artificial
  CRISPR gRNA sequence
ggcctccatggtatctcctg

SEQ ID NO: 221379 - DNA, 20 bp, Artificial
  CRISPR gRNA sequence
gcctccatggtatctcctga

SEQ ID NO: 221380 - DNA, 20 bp, Artificial
  CRISPR gRNA sequence
catggtatctcctgattacg

SEQ ID NO: 221381 - DNA, 20 bp, Artificial
  CRISPR gRNA sequence
ctgattacgaatttcctcct

SEQ ID NO: 221382 - DNA, 20 bp, Artificial
  CRISPR gRNA sequence
attacgaatttcctcctgct

SEQ ID NO: 221383 - DNA, 20 bp, Artificial
  CRISPR gRNA sequence
cgaatttcctcctgctttgt

SEQ ID NO: 221384 - DNA, 20 bp, Artificial
  CRISPR gRNA sequence
cctcctgctttgtccacccc

SEQ ID NO: 221385 - DNA, 20 bp, Artificial
  CRISPR gRNA sequence
ctcctgctttgtccacccca

SEQ ID NO: 221386 - DNA, 20 bp, Artificial
  CRISPR gRNA sequence
ctgctttgtccaccccatcc

SEQ ID NO: 221387 - DNA, 20 bp, Artificial
  CRISPR gRNA sequence
ctttgtccaccccatcctag

SEQ ID NO: 221388 - DNA, 20 bp, Artificial
  CRISPR gRNA sequence
tgtccaccccatcctagttt

SEQ ID NO: 221389 - DNA, 20 bp, Artificial
  CRISPR gRNA sequence
gtccaccccatcctagtttg

SEQ ID NO: 221390 - DNA, 20 bp, Artificial
  CRISPR gRNA sequence
tccaccccatcctagtttgc

SEQ ID NO: 221391 - DNA, 20 bp, Artificial
  CRISPR gRNA sequence
gtttgctttctttgttgaaa

SEQ ID NO: 221392 - DNA, 20 bp, Artificial
  CRISPR gRNA sequence
gctttctttgttgaaatcta

SEQ ID NO: 221393 - DNA, 20 bp, Artificial
  CRISPR gRNA sequence
ctttctttgttgaaatctat

SEQ ID NO: 221394 - DNA, 20 bp, Artificial
  CRISPR gRNA sequence
tctttgttgaaatctattcc

SEQ ID NO: 221395 - DNA, 20 bp, Artificial
  CRISPR gRNA sequence
ctttgttgaaatctattcct

SEQ ID NO: 221396 - DNA, 20 bp, Artificial
  CRISPR gRNA sequence
tttgttgaaatctattcctt

SEQ ID NO: 221397 - DNA, 20 bp, Artificial
  CRISPR gRNA sequence
tgttgaaatctattccttga

SEQ ID NO: 221398 - DNA, 20 bp, Artificial
  CRISPR gRNA sequence
gttgaaatctattccttgac

SEQ ID NO: 221399 - DNA, 20 bp, Artificial
  CRISPR gRNA sequence
ttgaaatctattccttgact

SEQ ID NO: 221400 - DNA, 20 bp, Artificial
  CRISPR gRNA sequence
aaatctattccttgactcac

SEQ ID NO: 221401 - DNA, 20 bp, Artificial
  CRISPR gRNA sequence
ttccttgactcacactaaat

SEQ ID NO: 221402 - DNA, 20 bp, Artificial
  CRISPR gRNA sequence
cttgactcacactaaatgtt

SEQ ID NO: 221403 - DNA, 20 bp, Artificial
  CRISPR gRNA sequence
gactcacactaaatgttagt

SEQ ID NO: 221404 - DNA, 20 bp, Artificial
  CRISPR gRNA sequence
actcacactaaatgttagtg

SEQ ID NO: 221405 - DNA, 20 bp, Artificial
  CRISPR gRNA sequence
acactaaatgttagtgtccc

SEQ ID NO: 221406 - DNA, 20 bp, Artificial
  CRISPR gRNA sequence
aatgttagtgtccctaaggg

SEQ ID NO: 221407 - DNA, 20 bp, Artificial
  CRISPR gRNA sequence
gtgtccctaagggcttcaga

SEQ ID NO: 221408 - DNA, 20 bp, Artificial
  CRISPR gRNA sequence
agggcttcagattcagtacc

SEQ ID NO: 221409 - DNA, 20 bp, Artificial
  CRISPR gRNA sequence
cagattcagtaccctctgcc

SEQ ID NO: 221410 - DNA, 20 bp, Artificial
  CRISPR gRNA sequence
agattcagtaccctctgccc

SEQ ID NO: 221411 - DNA, 20 bp, Artificial
  CRISPR gRNA sequence
agtaccctctgccccctagt

SEQ ID NO: 221412 - DNA, 20 bp, Artificial
  CRISPR gRNA sequence
tgccccctagtattttccct

SEQ ID NO: 221413 - DNA, 20 bp, Artificial
  CRISPR gRNA sequence
ccccctagtattttccctga

SEQ ID NO: 221414 - DNA, 20 bp, Artificial
  CRISPR gRNA sequence
gtattttccctgactcccat

SEQ ID NO: 221415 - DNA, 20 bp, Artificial
  CRISPR gRNA sequence
tccctgactcccatggtttt

SEQ ID NO: 221416 - DNA, 20 bp, Artificial
  CRISPR gRNA sequence
ccctgactcccatggttttc

SEQ ID NO: 221417 - DNA, 20 bp, Artificial
  CRISPR gRNA sequence
cctgactcccatggttttct

SEQ ID NO: 221418 - DNA, 20 bp, Artificial
  CRISPR gRNA sequence
actcccatggttttcttcac

SEQ ID NO: 221419 - DNA, 20 bp, Artificial
  CRISPR gRNA sequence
ccatggttttcttcacctgc

SEQ ID NO: 221420 - DNA, 20 bp, Artificial
  CRISPR gRNA sequence
tcttcacctgcaaactttta

SEQ ID NO: 221421 - DNA, 20 bp, Artificial
  CRISPR gRNA sequence
cttcacctgcaaacttttaa

SEQ ID NO: 221422 - DNA, 20 bp, Artificial
  CRISPR gRNA sequence
ttcacctgcaaacttttaaa

SEQ ID NO: 221423 - DNA, 20 bp, Artificial
  CRISPR gRNA sequence
cacctgcaaacttttaaata

SEQ ID NO: 221424 - DNA, 20 bp, Artificial
  CRISPR gRNA sequence
acctgcaaacttttaaataa

SEQ ID NO: 221425 - DNA, 20 bp, Artificial
  CRISPR gRNA sequence
caaacttttaaataaaaaac

SEQ ID NO: 221426 - DNA, 20 bp, Artificial
  CRISPR gRNA sequence
ttaaataaaaaactgaatca

SEQ ID NO: 221427 - DNA, 20 bp, Artificial
  CRISPR gRNA sequence
taaataaaaaactgaatcat

SEQ ID NO: 221428 - DNA, 20 bp, Artificial
  CRISPR gRNA sequence
aaataaaaaactgaatcatg

SEQ ID NO: 221429 - DNA, 20 bp, Artificial
  CRISPR gRNA sequence
aataaaaaactgaatcatgc

SEQ ID NO: 221430 - DNA, 20 bp, Artificial
  CRISPR gRNA sequence
aatcatgcactgcctttctt

SEQ ID NO: 221431 - DNA, 20 bp, Artificial
  CRISPR gRNA sequence
cctttcttctaaactgcaga

SEQ ID NO: 221432 - DNA, 20 bp, Artificial
  CRISPR gRNA sequence
tcttctaaactgcagatgtt

SEQ ID NO: 221433 - DNA, 20 bp, Artificial
  CRISPR gRNA sequence
cttctaaactgcagatgttg

SEQ ID NO: 221434 - DNA, 20 bp, Artificial
  CRISPR gRNA sequence
ttctaaactgcagatgttgg

SEQ ID NO: 221435 - DNA, 20 bp, Artificial
  CRISPR gRNA sequence
ctaaactgcagatgttggac

SEQ ID NO: 221436 - DNA, 20 bp, Artificial
  CRISPR gRNA sequence
taaactgcagatgttggaca

SEQ ID NO: 221437 - DNA, 20 bp, Artificial
  CRISPR gRNA sequence
aactgcagatgttggacagc

SEQ ID NO: 221438 - DNA, 20 bp, Artificial
  CRISPR gRNA sequence
cagatgttggacagccaact

SEQ ID NO: 221439 - DNA, 20 bp, Artificial
  CRISPR gRNA sequence
gacagccaactgtctgctgt

SEQ ID NO: 221440 - DNA, 20 bp, Artificial
  CRISPR gRNA sequence
tctgctgtgcacttccactt

SEQ ID NO: 221441 - DNA, 20 bp, Artificial
  CRISPR gRNA sequence
ctgtgcacttccacttggat

SEQ ID NO: 221442 - DNA, 20 bp, Artificial
  CRISPR gRNA sequence
tgcacttccacttggatgta

SEQ ID NO: 221443 - DNA, 20 bp, Artificial
  CRISPR gRNA sequence
ccacttggatgtaatacagt

SEQ ID NO: 221444 - DNA, 20 bp, Artificial
  CRISPR gRNA sequence
cacttggatgtaatacagtt

SEQ ID NO: 221445 - DNA, 20 bp, Artificial
  CRISPR gRNA sequence
ggatgtaatacagttacttc

SEQ ID NO: 221446 - DNA, 20 bp, Artificial
  CRISPR gRNA sequence
gatgtaatacagttacttca

SEQ ID NO: 221447 - DNA, 20 bp, Artificial
  CRISPR gRNA sequence
cttcaaagtcagtatgtcca

SEQ ID NO: 221448 - DNA, 20 bp, Artificial
  CRISPR gRNA sequence
caaagtcagtatgtccaaaa

SEQ ID NO: 221449 - DNA, 20 bp, Artificial
  CRISPR gRNA sequence
aaagtcagtatgtccaaaaa

SEQ ID NO: 221450 - DNA, 20 bp, Artificial
  CRISPR gRNA sequence
acgtacccccacttcttacc

SEQ ID NO: 221451 - DNA, 20 bp, Artificial
  CRISPR gRNA sequence
cgtacccccacttcttaccc

SEQ ID NO: 221452 - DNA, 20 bp, Artificial
  CRISPR gRNA sequence
cttaccctcagcctaaatca

SEQ ID NO: 221453 - DNA, 20 bp, Artificial
  CRISPR gRNA sequence
ttaccctcagcctaaatcac

SEQ ID NO: 221454 - DNA, 20 bp, Artificial
  CRISPR gRNA sequence
accctcagcctaaatcactt

SEQ ID NO: 221455 - DNA, 20 bp, Artificial
  CRISPR gRNA sequence
ccctcagcctaaatcacttt

SEQ ID NO: 221456 - DNA, 20 bp, Artificial
  CRISPR gRNA sequence
agcctaaatcactttgctaa

SEQ ID NO: 221457 - DNA, 20 bp, Artificial
  CRISPR gRNA sequence
aatcactttgctaaagtatt

SEQ ID NO: 221458 - DNA, 20 bp, Artificial
  CRISPR gRNA sequence
tgctaaagtattttctatca

SEQ ID NO: 221459 - DNA, 20 bp, Artificial
  CRISPR gRNA sequence
gctaaagtattttctatcat

SEQ ID NO: 221460 - DNA, 20 bp, Artificial
  CRISPR gRNA sequence
ctaaagtattttctatcatc

SEQ ID NO: 221461 - DNA, 20 bp, Artificial
  CRISPR gRNA sequence
aagtattttctatcatctac

SEQ ID NO: 221462 - DNA, 20 bp, Artificial
  CRISPR gRNA sequence
tctatcatctaccagtgaac

SEQ ID NO: 221463 - DNA, 20 bp, Artificial
  CRISPR gRNA sequence
ctatcatctaccagtgaacc

SEQ ID NO: 221464 - DNA, 20 bp, Artificial
  CRISPR gRNA sequence
tatcatctaccagtgaacca

SEQ ID NO: 221465 - DNA, 20 bp, Artificial
  CRISPR gRNA sequence
tcatctaccagtgaaccaga

SEQ ID NO: 221466 - DNA, 20 bp, Artificial
  CRISPR gRNA sequence
ccagtgaaccagacctggac

SEQ ID NO: 221467 - DNA, 20 bp, Artificial
  CRISPR gRNA sequence
gacctaagaatcacattaga

SEQ ID NO: 221468 - DNA, 20 bp, Artificial
  CRISPR gRNA sequence
agaatcacattagattactc

SEQ ID NO: 221469 - DNA, 20 bp, Artificial
  CRISPR gRNA sequence
gattactccctctccttagc

SEQ ID NO: 221470 - DNA, 20 bp, Artificial
  CRISPR gRNA sequence
ctccctctccttagccatgg

SEQ ID NO: 221471 - DNA, 20 bp, Artificial
  CRISPR gRNA sequence
cctctccttagccatggaga

SEQ ID NO: 221472 - DNA, 20 bp, Artificial
  CRISPR gRNA sequence
tccttagccatggagaattc

SEQ ID NO: 221473 - DNA, 20 bp, Artificial
  CRISPR gRNA sequence
cttagccatggagaattctt

SEQ ID NO: 221474 - DNA, 20 bp, Artificial
  CRISPR gRNA sequence
agccatggagaattcttagt

SEQ ID NO: 221475 - DNA, 20 bp, Artificial
  CRISPR gRNA sequence
gccatggagaattcttagta

SEQ ID NO: 221476 - DNA, 20 bp, Artificial
  CRISPR gRNA sequence
ttagtaggttcaacctaatt

SEQ ID NO: 221477 - DNA, 20 bp, Artificial
  CRISPR gRNA sequence
agtaggttcaacctaattaa

SEQ ID NO: 221478 - DNA, 20 bp, Artificial
  CRISPR gRNA sequence
gtaggttcaacctaattaat

SEQ ID NO: 221479 - DNA, 20 bp, Artificial
  CRISPR gRNA sequence
aacctaattaatagttccta

SEQ ID NO: 221480 - DNA, 20 bp, Artificial
  CRISPR gRNA sequence
attaatagttcctaaatcca

SEQ ID NO: 221481 - DNA, 20 bp, Artificial
  CRISPR gRNA sequence
atagttcctaaatccaatgt

SEQ ID NO: 221482 - DNA, 20 bp, Artificial
  CRISPR gRNA sequence
ctaaatccaatgtctgttga

SEQ ID NO: 221483 - DNA, 20 bp, Artificial
  CRISPR gRNA sequence
aatccaatgtctgttgaatg

SEQ ID NO: 221484 - DNA, 20 bp, Artificial
  CRISPR gRNA sequence
ttgaatgaatgaattagaca

SEQ ID NO: 221485 - DNA, 20 bp, Artificial
  CRISPR gRNA sequence
aatgaatgaattagacactc

SEQ ID NO: 221486 - DNA, 20 bp, Artificial
  CRISPR gRNA sequence
gacactcatcctcccccctc

SEQ ID NO: 221487 - DNA, 20 bp, Artificial
  CRISPR gRNA sequence
atcctcccccctcgaactac

SEQ ID NO: 221488 - DNA, 20 bp, Artificial
  CRISPR gRNA sequence
ccccctcgaactactgccat

SEQ ID NO: 221489 - DNA, 20 bp, Artificial
  CRISPR gRNA sequence
gaactactgccatacccttc

SEQ ID NO: 221490 - DNA, 20 bp, Artificial
  CRISPR gRNA sequence
ctgccatacccttctaacca

SEQ ID NO: 221491 - DNA, 20 bp, Artificial
  CRISPR gRNA sequence
ccatacccttctaaccagct

SEQ ID NO: 221492 - DNA, 20 bp, Artificial
  CRISPR gRNA sequence
ctaaccagctccctgcctcc

SEQ ID NO: 221493 - DNA, 20 bp, Artificial
  CRISPR gRNA sequence
taaccagctccctgcctcca

SEQ ID NO: 221494 - DNA, 20 bp, Artificial
  CRISPR gRNA sequence
accagctccctgcctccatc

SEQ ID NO: 221495 - DNA, 20 bp, Artificial
  CRISPR gRNA sequence
cctgcctccatcctcaaggt

SEQ ID NO: 221496 - DNA, 20 bp, Artificial
  CRISPR gRNA sequence
cctccatcctcaaggtttct

SEQ ID NO: 221497 - DNA, 20 bp, Artificial
  CRISPR gRNA sequence
catcctcaaggtttctccat

SEQ ID NO: 221498 - DNA, 20 bp, Artificial
  CRISPR gRNA sequence
aaggtttctccatcctggcc

SEQ ID NO: 221499 - DNA, 20 bp, Artificial
  CRISPR gRNA sequence
ctccatcctggccctgatgt

SEQ ID NO: 221500 - DNA, 20 bp, Artificial
  CRISPR gRNA sequence
tccatcctggccctgatgta

SEQ ID NO: 221501 - DNA, 20 bp, Artificial
  CRISPR gRNA sequence
catcctggccctgatgtatt

SEQ ID NO: 221502 - DNA, 20 bp, Artificial
  CRISPR gRNA sequence
gccctgatgtattttctaca

SEQ ID NO: 221503 - DNA, 20 bp, Artificial
  CRISPR gRNA sequence
atgtattttctacagttccc

SEQ ID NO: 221504 - DNA, 20 bp, Artificial
  CRISPR gRNA sequence
tctacagttcccaaaataac

SEQ ID NO: 221505 - DNA, 20 bp, Artificial
  CRISPR gRNA sequence
ctacagttcccaaaataact

SEQ ID NO: 221506 - DNA, 20 bp, Artificial
  CRISPR gRNA sequence
tacagttcccaaaataactg

SEQ ID NO: 221507 - DNA, 20 bp, Artificial
  CRISPR gRNA sequence
cagttcccaaaataactgtt

SEQ ID NO: 221508 - DNA, 20 bp, Artificial
  CRISPR gRNA sequence
ccaaaataactgttctaaat

SEQ ID NO: 221509 - DNA, 20 bp, Artificial
  CRISPR gRNA sequence
ttctaaatgcaaatgtgcac

SEQ ID NO: 221510 - DNA, 20 bp, Artificial
  CRISPR gRNA sequence
taaatgcaaatgtgcactcc

SEQ ID NO: 221511 - DNA, 20 bp, Artificial
  CRISPR gRNA sequence
aatgcaaatgtgcactcctt

SEQ ID NO: 221512 - DNA, 20 bp, Artificial
  CRISPR gRNA sequence
ctttgcctaagatactttaa

SEQ ID NO: 221513 - DNA, 20 bp, Artificial
  CRISPR gRNA sequence
tgcctaagatactttaacaa

SEQ ID NO: 221514 - DNA, 20 bp, Artificial
  CRISPR gRNA sequence
gcctaagatactttaacaac

SEQ ID NO: 221515 - DNA, 20 bp, Artificial
  CRISPR gRNA sequence
cctaagatactttaacaaca

SEQ ID NO: 221516 - DNA, 20 bp, Artificial
  CRISPR gRNA sequence
agatactttaacaacaccct

SEQ ID NO: 221517 - DNA, 20 bp, Artificial
  CRISPR gRNA sequence
taacaacaccctcaaccctt

SEQ ID NO: 221518 - DNA, 20 bp, Artificial
  CRISPR gRNA sequence
aacaacaccctcaacccttt

SEQ ID NO: 221519 - DNA, 20 bp, Artificial
  CRISPR gRNA sequence
acaacaccctcaaccctttt

SEQ ID NO: 221520 - DNA, 20 bp, Artificial
  CRISPR gRNA sequence
aacccttttcaggctaaatt

SEQ ID NO: 221521 - DNA, 20 bp, Artificial
  CRISPR gRNA sequence
ttcaggctaaattctaagta

SEQ ID NO: 221522 - DNA, 20 bp, Artificial
  CRISPR gRNA sequence
tcaggctaaattctaagtac

SEQ ID NO: 221523 - DNA, 20 bp, Artificial
  CRISPR gRNA sequence
caggctaaattctaagtaca

SEQ ID NO: 221524 - DNA, 20 bp, Artificial
  CRISPR gRNA sequence
aggctaaattctaagtacat

SEQ ID NO: 221525 - DNA, 20 bp, Artificial
  CRISPR gRNA sequence
aattctaagtacattagcat

SEQ ID NO: 221526 - DNA, 20 bp, Artificial
  CRISPR gRNA sequence
taagtacattagcatggaat

SEQ ID NO: 221527 - DNA, 20 bp, Artificial
  CRISPR gRNA sequence
agtacattagcatggaatac

SEQ ID NO: 221528 - DNA, 20 bp, Artificial
  CRISPR gRNA sequence
gcatggaatacaaacgaggt

SEQ ID NO: 221529 - DNA, 20 bp, Artificial
  CRISPR gRNA sequence
caagatcctttccagcccca

SEQ ID NO: 221530 - DNA, 20 bp, Artificial
  CRISPR gRNA sequence
aagatcctttccagccccac

SEQ ID NO: 221531 - DNA, 20 bp, Artificial
  CRISPR gRNA sequence
tccagccccacctcctgtac

SEQ ID NO: 221532 - DNA, 20 bp, Artificial
  CRISPR gRNA sequence
ccagccccacctcctgtact

SEQ ID NO: 221533 - DNA, 20 bp, Artificial
  CRISPR gRNA sequence
cagccccacctcctgtactc

SEQ ID NO: 221534 - DNA, 20 bp, Artificial
  CRISPR gRNA sequence
ctgtactccctcatttccac

SEQ ID NO: 221535 - DNA, 20 bp, Artificial
  CRISPR gRNA sequence
tactccctcatttccacact

SEQ ID NO: 221536 - DNA, 20 bp, Artificial
  CRISPR gRNA sequence
cctcatttccacactaagct

SEQ ID NO: 221537 - DNA, 20 bp, Artificial
  CRISPR gRNA sequence
atttccacactaagctccaa

SEQ ID NO: 221538 - DNA, 20 bp, Artificial
  CRISPR gRNA sequence
ccacactaagctccaatcat

SEQ ID NO: 221539 - DNA, 20 bp, Artificial
  CRISPR gRNA sequence
cacactaagctccaatcata

SEQ ID NO: 221540 - DNA, 20 bp, Artificial
  CRISPR gRNA sequence
agctccaatcataatgacgt

SEQ ID NO: 221541 - DNA, 20 bp, Artificial
  CRISPR gRNA sequence
caatcataatgacgttattg

SEQ ID NO: 221542 - DNA, 20 bp, Artificial
  CRISPR gRNA sequence
ttgcaattccatgactatgc

SEQ ID NO: 221543 - DNA, 20 bp, Artificial
  CRISPR gRNA sequence
caattccatgactatgcaaa

SEQ ID NO: 221544 - DNA, 20 bp, Artificial
  CRISPR gRNA sequence
catgactatgcaaatgcact

SEQ ID NO: 221545 - DNA, 20 bp, Artificial
  CRISPR gRNA sequence
tgcaaatgcactctcatccc

SEQ ID NO: 221546 - DNA, 20 bp, Artificial
  CRISPR gRNA sequence
tcatccccatgccttagcac

SEQ ID NO: 221547 - DNA, 20 bp, Artificial
  CRISPR gRNA sequence
atccccatgccttagcacat

SEQ ID NO: 221548 - DNA, 20 bp, Artificial
  CRISPR gRNA sequence
agcacatactgttcctcaaa

SEQ ID NO: 221549 - DNA, 20 bp, Artificial
  CRISPR gRNA sequence
gcacatactgttcctcaaac

SEQ ID NO: 221550 - DNA, 20 bp, Artificial
  CRISPR gRNA sequence
ttcctcaaacctaaatagcc

SEQ ID NO: 221551 - DNA, 20 bp, Artificial
  CRISPR gRNA sequence
ctcaaacctaaatagcctct

SEQ ID NO: 221552 - DNA, 20 bp, Artificial
  CRISPR gRNA sequence
aaacctaaatagcctcttaa

SEQ ID NO: 221553 - DNA, 20 bp, Artificial
  CRISPR gRNA sequence
aatagcctcttaactgttat

SEQ ID NO: 221554 - DNA, 20 bp, Artificial
  CRISPR gRNA sequence
ttaactgttatacactatta

SEQ ID NO: 221555 - DNA, 20 bp, Artificial
  CRISPR gRNA sequence
aactgttatacactattacc

SEQ ID NO: 221556 - DNA, 20 bp, Artificial
  CRISPR gRNA sequence
actgttatacactattaccc

SEQ ID NO: 221557 - DNA, 20 bp, Artificial
  CRISPR gRNA sequence
ttatacactattaccccact

SEQ ID NO: 221558 - DNA, 20 bp, Artificial
  CRISPR gRNA sequence
tacactattaccccactgag

SEQ ID NO: 221559 - DNA, 20 bp, Artificial
  CRISPR gRNA sequence
ttaccccactgagtacatag

SEQ ID NO: 221560 - DNA, 20 bp, Artificial
  CRISPR gRNA sequence
ccccactgagtacatagggt

SEQ ID NO: 221561 - DNA, 20 bp, Artificial
  CRISPR gRNA sequence
agtacatagggtgtataata

SEQ ID NO: 221562 - DNA, 20 bp, Artificial
  CRISPR gRNA sequence
agtgcacacattaaggggtc

SEQ ID NO: 221563 - DNA, 20 bp, Artificial
  CRISPR gRNA sequence
aggggtcgaccctagtttaa

SEQ ID NO: 221564 - DNA, 20 bp, Artificial
  CRISPR gRNA sequence
gtttaagattcacctcatgt

SEQ ID NO: 221565 - DNA, 20 bp, Artificial
  CRISPR gRNA sequence
aagattcacctcatgtactt

SEQ ID NO: 221566 - DNA, 20 bp, Artificial
  CRISPR gRNA sequence
agattcacctcatgtacttc

SEQ ID NO: 221567 - DNA, 20 bp, Artificial
  CRISPR gRNA sequence
acctcatgtacttcttagct

SEQ ID NO: 221568 - DNA, 20 bp, Artificial
  CRISPR gRNA sequence
atgtacttcttagctgtata

SEQ ID NO: 221569 - DNA, 20 bp, Artificial
  CRISPR gRNA sequence
cttagctgtataaccttagg

SEQ ID NO: 221570 - DNA, 20 bp, Artificial
  CRISPR gRNA sequence
ttagctgtataaccttaggc

SEQ ID NO: 221571 - DNA, 20 bp, Artificial
  CRISPR gRNA sequence
agctgtataaccttaggcaa

SEQ ID NO: 221572 - DNA, 20 bp, Artificial
  CRISPR gRNA sequence
gctgtataaccttaggcaag

SEQ ID NO: 221573 - DNA, 20 bp, Artificial
  CRISPR gRNA sequence
tataaccttaggcaagttac

SEQ ID NO: 221574 - DNA, 20 bp, Artificial
  CRISPR gRNA sequence
aggcaagttacttacctctg

SEQ ID NO: 221575 - DNA, 20 bp, Artificial
  CRISPR gRNA sequence
ggcaagttacttacctctgc

SEQ ID NO: 221576 - DNA, 20 bp, Artificial
  CRISPR gRNA sequence
cttacctctgctcctcagtt

SEQ ID NO: 221577 - DNA, 20 bp, Artificial
  CRISPR gRNA sequence
acctctgctcctcagtttcc

SEQ ID NO: 221578 - DNA, 20 bp, Artificial
  CRISPR gRNA sequence
cctctgctcctcagtttcct

SEQ ID NO: 221579 - DNA, 20 bp, Artificial
  CRISPR gRNA sequence
tgctcctcagtttcctcatc

SEQ ID NO: 221580 - DNA, 20 bp, Artificial
  CRISPR gRNA sequence
ctcctcagtttcctcatcta

SEQ ID NO: 221581 - DNA, 20 bp, Artificial
  CRISPR gRNA sequence
ctcagtttcctcatctataa

SEQ ID NO: 221582 - DNA, 20 bp, Artificial
  CRISPR gRNA sequence
agtttcctcatctataaaat

SEQ ID NO: 221583 - DNA, 20 bp, Artificial
  CRISPR gRNA sequence
cctcatctataaaatgtgca

SEQ ID NO: 221584 - DNA, 20 bp, Artificial
  CRISPR gRNA sequence
ctcatctataaaatgtgcat

SEQ ID NO: 221585 - DNA, 20 bp, Artificial
  CRISPR gRNA sequence
atctataaaatgtgcatagt

SEQ ID NO: 221586 - DNA, 20 bp, Artificial
  CRISPR gRNA sequence
taaaatgtgcatagtgatgg

SEQ ID NO: 221587 - DNA, 20 bp, Artificial
  CRISPR gRNA sequence
atagagatattgttaagatt

SEQ ID NO: 221588 - DNA, 20 bp, Artificial
  CRISPR gRNA sequence
ttaagatttaataagataac

SEQ ID NO: 221589 - DNA, 20 bp, Artificial
  CRISPR gRNA sequence
agatttaataagataacatg

SEQ ID NO: 221590 - DNA, 20 bp, Artificial
  CRISPR gRNA sequence
aataagataacatgtttttg

SEQ ID NO: 221591 - DNA, 20 bp, Artificial
  CRISPR gRNA sequence
ataagataacatgtttttgt

SEQ ID NO: 221592 - DNA, 20 bp, Artificial
  CRISPR gRNA sequence
ttgtatcacctttcacatat

SEQ ID NO: 221593 - DNA, 20 bp, Artificial
  CRISPR gRNA sequence
tgtatcacctttcacatata

SEQ ID NO: 221594 - DNA, 20 bp, Artificial
  CRISPR gRNA sequence
gtatcacctttcacatatac

SEQ ID NO: 221595 - DNA, 20 bp, Artificial
  CRISPR gRNA sequence
tatcacctttcacatataca

SEQ ID NO: 221596 - DNA, 20 bp, Artificial
  CRISPR gRNA sequence
tcacatatacagcaagtact

SEQ ID NO: 221597 - DNA, 20 bp, Artificial
  CRISPR gRNA sequence
cacatatacagcaagtactc

SEQ ID NO: 221598 - DNA, 20 bp, Artificial
  CRISPR gRNA sequence
acatatacagcaagtactca

SEQ ID NO: 221599 - DNA, 20 bp, Artificial
  CRISPR gRNA sequence
aataaatggcagctacagtt

SEQ ID NO: 221600 - DNA, 20 bp, Artificial
  CRISPR gRNA sequence
cagtttgctaacttttgctc

SEQ ID NO: 221601 - DNA, 20 bp, Artificial
  CRISPR gRNA sequence
gctaacttttgctcttccta

SEQ ID NO: 221602 - DNA, 20 bp, Artificial
  CRISPR gRNA sequence
ctaacttttgctcttcctac

SEQ ID NO: 221603 - DNA, 20 bp, Artificial
  CRISPR gRNA sequence
acttttgctcttcctactaa

SEQ ID NO: 221604 - DNA, 20 bp, Artificial
  CRISPR gRNA sequence
ttgctcttcctactaaagca

SEQ ID NO: 221605 - DNA, 20 bp, Artificial
  CRISPR gRNA sequence
tgctcttcctactaaagcac

SEQ ID NO: 221606 - DNA, 20 bp, Artificial
  CRISPR gRNA sequence
gctcttcctactaaagcaca

SEQ ID NO: 221607 - DNA, 20 bp, Artificial
  CRISPR gRNA sequence
ctcttcctactaaagcacag

SEQ ID NO: 221608 - DNA, 20 bp, Artificial
  CRISPR gRNA sequence
ttcctactaaagcacagttg

SEQ ID NO: 221609 - DNA, 20 bp, Artificial
  CRISPR gRNA sequence
cctactaaagcacagttgag

SEQ ID NO: 221610 - DNA, 20 bp, Artificial
  CRISPR gRNA sequence
ctactaaagcacagttgagt

SEQ ID NO: 221611 - DNA, 20 bp, Artificial
  CRISPR gRNA sequence
ctaaagcacagttgagttgt

SEQ ID NO: 221612 - DNA, 20 bp, Artificial
  CRISPR gRNA sequence
aagcacagttgagttgttca

SEQ ID NO: 221613 - DNA, 20 bp, Artificial
  CRISPR gRNA sequence
agttgttcaatcttgttccc

SEQ ID NO: 221614 - DNA, 20 bp, Artificial
  CRISPR gRNA sequence
ttcaatcttgttccccttcc

SEQ ID NO: 221615 - DNA, 20 bp, Artificial
  CRISPR gRNA sequence
aatcttgttccccttcccta

SEQ ID NO: 221616 - DNA, 20 bp, Artificial
  CRISPR gRNA sequence
gttccccttccctaccatta

SEQ ID NO: 221617 - DNA, 20 bp, Artificial
  CRISPR gRNA sequence
ttccccttccctaccattac

SEQ ID NO: 221618 - DNA, 20 bp, Artificial
  CRISPR gRNA sequence
cccttccctaccattactca

SEQ ID NO: 221619 - DNA, 20 bp, Artificial
  CRISPR gRNA sequence
ccctaccattactcaattgt

SEQ ID NO: 221620 - DNA, 20 bp, Artificial
  CRISPR gRNA sequence
cctaccattactcaattgta

SEQ ID NO: 221621 - DNA, 20 bp, Artificial
  CRISPR gRNA sequence
ccattactcaattgtattct

SEQ ID NO: 221622 - DNA, 20 bp, Artificial
  CRISPR gRNA sequence
ctcaattgtattcttcccct

SEQ ID NO: 221623 - DNA, 20 bp, Artificial
  CRISPR gRNA sequence
aattgtattcttcccctcct

SEQ ID NO: 221624 - DNA, 20 bp, Artificial
  CRISPR gRNA sequence
tattcttcccctccttattg

SEQ ID NO: 221625 - DNA, 20 bp, Artificial
  CRISPR gRNA sequence
ttcccctccttattgctccc

SEQ ID NO: 221626 - DNA, 20 bp, Artificial
  CRISPR gRNA sequence
cccctccttattgctcccat

SEQ ID NO: 221627 - DNA, 20 bp, Artificial
  CRISPR gRNA sequence
ccctccttattgctcccatt

SEQ ID NO: 221628 - DNA, 20 bp, Artificial
  CRISPR gRNA sequence
cttattgctcccattgcctt

SEQ ID NO: 221629 - DNA, 20 bp, Artificial
  CRISPR gRNA sequence
attgctcccattgccttgtg

SEQ ID NO: 221630 - DNA, 20 bp, Artificial
  CRISPR gRNA sequence
ttgctcccattgccttgtgt

SEQ ID NO: 221631 - DNA, 20 bp, Artificial
  CRISPR gRNA sequence
ctcccattgccttgtgttca

SEQ ID NO: 221632 - DNA, 20 bp, Artificial
  CRISPR gRNA sequence
ccattgccttgtgttcaaat

SEQ ID NO: 221633 - DNA, 20 bp, Artificial
  CRISPR gRNA sequence
ccttgtgttcaaatgttgtc

SEQ ID NO: 221634 - DNA, 20 bp, Artificial
  CRISPR gRNA sequence
gtgttcaaatgttgtcactg

SEQ ID NO: 221635 - DNA, 20 bp, Artificial
  CRISPR gRNA sequence
tgttcaaatgttgtcactgt

SEQ ID NO: 221636 - DNA, 20 bp, Artificial
  CRISPR gRNA sequence
aaatgttgtcactgtaccta

SEQ ID NO: 221637 - DNA, 20 bp, Artificial
  CRISPR gRNA sequence
tcactgtacctactactgtg

SEQ ID NO: 221638 - DNA, 20 bp, Artificial
  CRISPR gRNA sequence
tacctactactgtgtaatta

SEQ ID NO: 221639 - DNA, 20 bp, Artificial
  CRISPR gRNA sequence
ctactgtgtaattactattt

SEQ ID NO: 221640 - DNA, 20 bp, Artificial
  CRISPR gRNA sequence
ctgtgtaattactattttac

SEQ ID NO: 221641 - DNA, 20 bp, Artificial
  CRISPR gRNA sequence
tgtaattactattttactta

SEQ ID NO: 221642 - DNA, 20 bp, Artificial
  CRISPR gRNA sequence
ctattttacttaactgatct

SEQ ID NO: 221643 - DNA, 20 bp, Artificial
  CRISPR gRNA sequence
ttttacttaactgatctctc

SEQ ID NO: 221644 - DNA, 20 bp, Artificial
  CRISPR gRNA sequence
tacttaactgatctctccag

SEQ ID NO: 221645 - DNA, 20 bp, Artificial
  CRISPR gRNA sequence
acttaactgatctctccagg

SEQ ID NO: 221646 - DNA, 20 bp, Artificial
  CRISPR gRNA sequence
cttaactgatctctccaggc

SEQ ID NO: 221647 - DNA, 20 bp, Artificial
  CRISPR gRNA sequence
aactgatctctccaggctca

SEQ ID NO: 221648 - DNA, 20 bp, Artificial
  CRISPR gRNA sequence
actgatctctccaggctcag

SEQ ID NO: 221649 - DNA, 20 bp, Artificial
  CRISPR gRNA sequence
atctctccaggctcagaaag

SEQ ID NO: 221650 - DNA, 20 bp, Artificial
  CRISPR gRNA sequence
tccaggctcagaaagtaaga

SEQ ID NO: 221651 - DNA, 20 bp, Artificial
  CRISPR gRNA sequence
caggctcagaaagtaagaca

SEQ ID NO: 221652 - DNA, 20 bp, Artificial
  CRISPR gRNA sequence
agaaagtaagacactgtctt

SEQ ID NO: 221653 - DNA, 20 bp, Artificial
  CRISPR gRNA sequence
tcttcatttggtatcctaag

SEQ ID NO: 221654 - DNA, 20 bp, Artificial
  CRISPR gRNA sequence
catttggtatcctaagaatc

SEQ ID NO: 221655 - DNA, 20 bp, Artificial
  CRISPR gRNA sequence
atttggtatcctaagaatct

SEQ ID NO: 221656 - DNA, 20 bp, Artificial
  CRISPR gRNA sequence
ggtatcctaagaatctaaca

SEQ ID NO: 221657 - DNA, 20 bp, Artificial
  CRISPR gRNA sequence
gtatcctaagaatctaacac

SEQ ID NO: 221658 - DNA, 20 bp, Artificial
  CRISPR gRNA sequence
agaatctaacacagggtcca

SEQ ID NO: 221659 - DNA, 20 bp, Artificial
  CRISPR gRNA sequence
acacagggtccagaaagtag

SEQ ID NO: 221660 - DNA, 20 bp, Artificial
  CRISPR gRNA sequence
aataccttccttgtgaatgt

SEQ ID NO: 221661 - DNA, 20 bp, Artificial
  CRISPR gRNA sequence
ccttgtgaatgtaaaaagtt

SEQ ID NO: 221662 - DNA, 20 bp, Artificial
  CRISPR gRNA sequence
cttgtgaatgtaaaaagttt

SEQ ID NO: 221663 - DNA, 20 bp, Artificial
  CRISPR gRNA sequence
gtgaatgtaaaaagtttaaa

SEQ ID NO: 221664 - DNA, 20 bp, Artificial
  CRISPR gRNA sequence
tgaatgtaaaaagtttaaag

SEQ ID NO: 221665 - DNA, 20 bp, Artificial
  CRISPR gRNA sequence
aaagtataaattccatagaa

SEQ ID NO: 221666 - DNA, 20 bp, Artificial
  CRISPR gRNA sequence
aagtataaattccatagaag

SEQ ID NO: 221667 - DNA, 20 bp, Artificial
  CRISPR gRNA sequence
catagaagaaaaatctaaaa

SEQ ID NO: 221668 - DNA, 20 bp, Artificial
  CRISPR gRNA sequence
aaaatcatgtgggagaagat

SEQ ID NO: 221669 - DNA, 20 bp, Artificial
  CRISPR gRNA sequence
ttcttctgtatttcaagaga

SEQ ID NO: 221670 - DNA, 20 bp, Artificial
  CRISPR gRNA sequence
tcttctgtatttcaagagaa

SEQ ID NO: 221671 - DNA, 20 bp, Artificial
  CRISPR gRNA sequence
cttctgtatttcaagagaac

SEQ ID NO: 221672 - DNA, 20 bp, Artificial
  CRISPR gRNA sequence
ttctgtatttcaagagaacc

SEQ ID NO: 221673 - DNA, 20 bp, Artificial
  CRISPR gRNA sequence
ctgtatttcaagagaacctg

SEQ ID NO: 221674 - DNA, 20 bp, Artificial
  CRISPR gRNA sequence
tgtatttcaagagaacctgc

SEQ ID NO: 221675 - DNA, 20 bp, Artificial
  CRISPR gRNA sequence
tatttcaagagaacctgcca

SEQ ID NO: 221676 - DNA, 20 bp, Artificial
  CRISPR gRNA sequence
caagagaacctgccactgct

SEQ ID NO: 221677 - DNA, 20 bp, Artificial
  CRISPR gRNA sequence
aagagaacctgccactgctt

SEQ ID NO: 221678 - DNA, 20 bp, Artificial
  CRISPR gRNA sequence
ccactgcttctcacttgtat

SEQ ID NO: 221679 - DNA, 20 bp, Artificial
  CRISPR gRNA sequence
cttctcacttgtatagactt

SEQ ID NO: 221680 - DNA, 20 bp, Artificial
  CRISPR gRNA sequence
ctcacttgtatagacttgat

SEQ ID NO: 221681 - DNA, 20 bp, Artificial
  CRISPR gRNA sequence
tcacttgtatagacttgatt

SEQ ID NO: 221682 - DNA, 20 bp, Artificial
  CRISPR gRNA sequence
acttgtatagacttgattat

SEQ ID NO: 221683 - DNA, 20 bp, Artificial
  CRISPR gRNA sequence
gtatagacttgattatgaaa

SEQ ID NO: 221684 - DNA, 20 bp, Artificial
  CRISPR gRNA sequence
tatagacttgattatgaaat

SEQ ID NO: 221685 - DNA, 20 bp, Artificial
  CRISPR gRNA sequence
gattatgaaatcatgaagct

SEQ ID NO: 221686 - DNA, 20 bp, Artificial
  CRISPR gRNA sequence
attatgaaatcatgaagctg

SEQ ID NO: 221687 - DNA, 20 bp, Artificial
  CRISPR gRNA sequence
tgaaatcatgaagctgcata

SEQ ID NO: 221688 - DNA, 20 bp, Artificial
  CRISPR gRNA sequence
catattttcatggaaaatct

SEQ ID NO: 221689 - DNA, 20 bp, Artificial
  CRISPR gRNA sequence
tcatggaaaatctcaagtca

SEQ ID NO: 221690 - DNA, 20 bp, Artificial
  CRISPR gRNA sequence
catggaaaatctcaagtcac

SEQ ID NO: 221691 - DNA, 20 bp, Artificial
  CRISPR gRNA sequence
atggaaaatctcaagtcact

SEQ ID NO: 221692 - DNA, 20 bp, Artificial
  CRISPR gRNA sequence
aagtcacttgtatggttgga

SEQ ID NO: 221693 - DNA, 20 bp, Artificial
  CRISPR gRNA sequence
gtatggttggatagaaaagt

SEQ ID NO: 221694 - DNA, 20 bp, Artificial
  CRISPR gRNA sequence
tatggttggatagaaaagtt

SEQ ID NO: 221695 - DNA, 20 bp, Artificial
  CRISPR gRNA sequence
gatagaaaagttccttaaaa

SEQ ID NO: 221696 - DNA, 20 bp, Artificial
  CRISPR gRNA sequence
cttaaaaatcacaagaatgt

SEQ ID NO: 221697 - DNA, 20 bp, Artificial
  CRISPR gRNA sequence
aaaaatcacaagaatgtgtc

SEQ ID NO: 221698 - DNA, 20 bp, Artificial
  CRISPR gRNA sequence
aaaatcacaagaatgtgtct

SEQ ID NO: 221699 - DNA, 20 bp, Artificial
  CRISPR gRNA sequence
tgaatgatcttcctagaggg

SEQ ID NO: 221700 - DNA, 20 bp, Artificial
  CRISPR gRNA sequence
cctagagggtgatgtttaaa

SEQ ID NO: 221701 - DNA, 20 bp, Artificial
  CRISPR gRNA sequence
ctagagggtgatgtttaaac

SEQ ID NO: 221702 - DNA, 20 bp, Artificial
  CRISPR gRNA sequence
gagggtgatgtttaaactgg

SEQ ID NO: 221703 - DNA, 20 bp, Artificial
  CRISPR gRNA sequence
aaactgggtcttaaaggatg

SEQ ID NO: 221704 - DNA, 20 bp, Artificial
  CRISPR gRNA sequence
aactgggtcttaaaggatga

SEQ ID NO: 221705 - DNA, 20 bp, Artificial
  CRISPR gRNA sequence
ggtcttaaaggatgagtaag

SEQ ID NO: 221706 - DNA, 20 bp, Artificial
  CRISPR gRNA sequence
aaaggatgagtaagaatgtt

SEQ ID NO: 221707 - DNA, 20 bp, Artificial
  CRISPR gRNA sequence
aaggatgagtaagaatgtta

SEQ ID NO: 221708 - DNA, 20 bp, Artificial
  CRISPR gRNA sequence
tgggaaagaaggggctttct

SEQ ID NO: 221709 - DNA, 20 bp, Artificial
  CRISPR gRNA sequence
tctaggcagagtaacgtgta

SEQ ID NO: 221710 - DNA, 20 bp, Artificial
  CRISPR gRNA sequence
ctaggcagagtaacgtgtac

SEQ ID NO: 221711 - DNA, 20 bp, Artificial
  CRISPR gRNA sequence
taggcagagtaacgtgtaca

SEQ ID NO: 221712 - DNA, 20 bp, Artificial
  CRISPR gRNA sequence
ggcagagtaacgtgtacagc

SEQ ID NO: 221713 - DNA, 20 bp, Artificial
  CRISPR gRNA sequence
aaagcagagaattatttagg

SEQ ID NO: 221714 - DNA, 20 bp, Artificial
  CRISPR gRNA sequence
tttaggtgagctctaggaaa

SEQ ID NO: 221715 - DNA, 20 bp, Artificial
  CRISPR gRNA sequence
aggtgagctctaggaaatga

SEQ ID NO: 221716 - DNA, 20 bp, Artificial
  CRISPR gRNA sequence
ggtgagctctaggaaatgag

SEQ ID NO: 221717 - DNA, 20 bp, Artificial
  CRISPR gRNA sequence
taggaaatgaggttggaaaa

SEQ ID NO: 221718 - DNA, 20 bp, Artificial
  CRISPR gRNA sequence
ggaaatgaggttggaaaaga

SEQ ID NO: 221719 - DNA, 20 bp, Artificial
  CRISPR gRNA sequence
gaaaagatgaataagaaaaa

SEQ ID NO: 221720 - DNA, 20 bp, Artificial
  CRISPR gRNA sequence
taaagggcttccttgaatgt

SEQ ID NO: 221721 - DNA, 20 bp, Artificial
  CRISPR gRNA sequence
aagggcttccttgaatgtca

SEQ ID NO: 221722 - DNA, 20 bp, Artificial
  CRISPR gRNA sequence
ccttgaatgtcatgctgagt

SEQ ID NO: 221723 - DNA, 20 bp, Artificial
  CRISPR gRNA sequence
cttgaatgtcatgctgagtt

SEQ ID NO: 221724 - DNA, 20 bp, Artificial
  CRISPR gRNA sequence
gaatgtcatgctgagtttag

SEQ ID NO: 221725 - DNA, 20 bp, Artificial
  CRISPR gRNA sequence
aatgtcatgctgagtttaga

SEQ ID NO: 221726 - DNA, 20 bp, Artificial
  CRISPR gRNA sequence
agtttagacttgataacata

SEQ ID NO: 221727 - DNA, 20 bp, Artificial
  CRISPR gRNA sequence
agacttgataacataaacaa

SEQ ID NO: 221728 - DNA, 20 bp, Artificial
  CRISPR gRNA sequence
gacttgataacataaacaac

SEQ ID NO: 221729 - DNA, 20 bp, Artificial
  CRISPR gRNA sequence
gataacataaacaactgtaa

SEQ ID NO: 221730 - DNA, 20 bp, Artificial
  CRISPR gRNA sequence
ataacataaacaactgtaaa

SEQ ID NO: 221731 - DNA, 20 bp, Artificial
  CRISPR gRNA sequence
taaaccactcagatttaatt

SEQ ID NO: 221732 - DNA, 20 bp, Artificial
  CRISPR gRNA sequence
agatttaatttcattaaaaa

SEQ ID NO: 221733 - DNA, 20 bp, Artificial
  CRISPR gRNA sequence
aatttcattaaaaaaaaaac

SEQ ID NO: 221734 - DNA, 20 bp, Artificial
  CRISPR gRNA sequence
atttcattaaaaaaaaaaca

SEQ ID NO: 221735 - DNA, 20 bp, Artificial
  CRISPR gRNA sequence
cattaaaaaaaaaacattga

SEQ ID NO: 221736 - DNA, 20 bp, Artificial
  CRISPR gRNA sequence
attaaaaaaaaaacattgac

SEQ ID NO: 221737 - DNA, 20 bp, Artificial
  CRISPR gRNA sequence
aaaaaaaaacattgacagca

SEQ ID NO: 221738 - DNA, 20 bp, Artificial
  CRISPR gRNA sequence
acagcagtgtaaaggaagga

SEQ ID NO: 221739 - DNA, 20 bp, Artificial
  CRISPR gRNA sequence
agggcagcaagggaaaagag

SEQ ID NO: 221740 - DNA, 20 bp, Artificial
  CRISPR gRNA sequence
acagactactgcaatagtcc

SEQ ID NO: 221741 - DNA, 20 bp, Artificial
  CRISPR gRNA sequence
ctgcaatagtccaggtaaag

SEQ ID NO: 221742 - DNA, 20 bp, Artificial
  CRISPR gRNA sequence
caatagtccaggtaaagaac

SEQ ID NO: 221743 - DNA, 20 bp, Artificial
  CRISPR gRNA sequence
gagagaagacctaaaactta

SEQ ID NO: 221744 - DNA, 20 bp, Artificial
  CRISPR gRNA sequence
aaacttacagtaatcaacag

SEQ ID NO: 221745 - DNA, 20 bp, Artificial
  CRISPR gRNA sequence
acagtaatcaacagaagtta

SEQ ID NO: 221746 - DNA, 20 bp, Artificial
  CRISPR gRNA sequence
cagtaatcaacagaagttag

SEQ ID NO: 221747 - DNA, 20 bp, Artificial
  CRISPR gRNA sequence
gttgtgggaagcaggggaga

SEQ ID NO: 221748 - DNA, 20 bp, Artificial
  CRISPR gRNA sequence
tgggaagcaggggagataaa

SEQ ID NO: 221749 - DNA, 20 bp, Artificial
  CRISPR gRNA sequence
aaattgtgaaccaaaatagt

SEQ ID NO: 221750 - DNA, 20 bp, Artificial
  CRISPR gRNA sequence
tgaaccaaaatagtatgtgt

SEQ ID NO: 221751 - DNA, 20 bp, Artificial
  CRISPR gRNA sequence
gttagatggtaggctaatta

SEQ ID NO: 221752 - DNA, 20 bp, Artificial
  CRISPR gRNA sequence
gatggtaggctaattataga

SEQ ID NO: 221753 - DNA, 20 bp, Artificial
  CRISPR gRNA sequence
attatagagaaaagaggctt

SEQ ID NO: 221754 - DNA, 20 bp, Artificial
  CRISPR gRNA sequence
tagagaaaagaggcttaaat

SEQ ID NO: 221755 - DNA, 20 bp, Artificial
  CRISPR gRNA sequence
aaatatttggggagaatatc

SEQ ID NO: 221756 - DNA, 20 bp, Artificial
  CRISPR gRNA sequence
aatatttggggagaatatct

SEQ ID NO: 221757 - DNA, 20 bp, Artificial
  CRISPR gRNA sequence
ggggagaatatctttccatc

SEQ ID NO: 221758 - DNA, 20 bp, Artificial
  CRISPR gRNA sequence
gggagaatatctttccatct

SEQ ID NO: 221759 - DNA, 20 bp, Artificial
  CRISPR gRNA sequence
tccatctgtcaatggactag

SEQ ID NO: 221760 - DNA, 20 bp, Artificial
  CRISPR gRNA sequence
ccatctgtcaatggactagt

SEQ ID NO: 221761 - DNA, 20 bp, Artificial
  CRISPR gRNA sequence
catctgtcaatggactagtg

SEQ ID NO: 221762 - DNA, 20 bp, Artificial
  CRISPR gRNA sequence
tcaatggactagtgagatct

SEQ ID NO: 221763 - DNA, 20 bp, Artificial
  CRISPR gRNA sequence
gtgagatctgatgcacacta

SEQ ID NO: 221764 - DNA, 20 bp, Artificial
  CRISPR gRNA sequence
atgcacactatgtttgagaa

SEQ ID NO: 221765 - DNA, 20 bp, Artificial
  CRISPR gRNA sequence
tgtttgagaaatgagagaga

SEQ ID NO: 221766 - DNA, 20 bp, Artificial
  CRISPR gRNA sequence
gagaaatgagagagaaacaa

SEQ ID NO: 221767 - DNA, 20 bp, Artificial
  CRISPR gRNA sequence
agaaatgagagagaaacaag

SEQ ID NO: 221768 - DNA, 20 bp, Artificial
  CRISPR gRNA sequence
tatcaagcacttaaaatata

SEQ ID NO: 221769 - DNA, 20 bp, Artificial
  CRISPR gRNA sequence
atcaagcacttaaaatatat

SEQ ID NO: 221770 - DNA, 20 bp, Artificial
  CRISPR gRNA sequence
tcaagcacttaaaatatatt

SEQ ID NO: 221771 - DNA, 20 bp, Artificial
  CRISPR gRNA sequence
aaaatatattaagtggcagt

SEQ ID NO: 221772 - DNA, 20 bp, Artificial
  CRISPR gRNA sequence
aaatatattaagtggcagtg

SEQ ID NO: 221773 - DNA, 20 bp, Artificial
  CRISPR gRNA sequence
agtggcagtgattcttttac

SEQ ID NO: 221774 - DNA, 20 bp, Artificial
  CRISPR gRNA sequence
ttttacaataaatttggcag

SEQ ID NO: 221775 - DNA, 20 bp, Artificial
  CRISPR gRNA sequence
ttacaataaatttggcagtg

SEQ ID NO: 221776 - DNA, 20 bp, Artificial
  CRISPR gRNA sequence
tacaataaatttggcagtgt

SEQ ID NO: 221777 - DNA, 20 bp, Artificial
  CRISPR gRNA sequence
acaataaatttggcagtgta

SEQ ID NO: 221778 - DNA, 20 bp, Artificial
  CRISPR gRNA sequence
caataaatttggcagtgtaa

SEQ ID NO: 221779 - DNA, 20 bp, Artificial
  CRISPR gRNA sequence
ggcagtgtaagaaagcagag

SEQ ID NO: 221780 - DNA, 20 bp, Artificial
  CRISPR gRNA sequence
gcagtgtaagaaagcagaga

SEQ ID NO: 221781 - DNA, 20 bp, Artificial
  CRISPR gRNA sequence
acaatgtgcaggcaggaaca

SEQ ID NO: 221782 - DNA, 20 bp, Artificial
  CRISPR gRNA sequence
tggttcttgaggttttttgt

SEQ ID NO: 221783 - DNA, 20 bp, Artificial
  CRISPR gRNA sequence
ggttcttgaggttttttgtt

SEQ ID NO: 221784 - DNA, 20 bp, Artificial
  CRISPR gRNA sequence
gttcttgaggttttttgttt

SEQ ID NO: 221785 - DNA, 20 bp, Artificial
  CRISPR gRNA sequence
ttgaggttttttgttttatt

SEQ ID NO: 221786 - DNA, 20 bp, Artificial
  CRISPR gRNA sequence
gaggttttttgttttatttt

SEQ ID NO: 221787 - DNA, 20 bp, Artificial
  CRISPR gRNA sequence
aggttttttgttttattttt

SEQ ID NO: 221788 - DNA, 20 bp, Artificial
  CRISPR gRNA sequence
tttgttttattttttaatat

SEQ ID NO: 221789 - DNA, 20 bp, Artificial
  CRISPR gRNA sequence
ttgttttattttttaatatg

SEQ ID NO: 221790 - DNA, 20 bp, Artificial
  CRISPR gRNA sequence
tgttttattttttaatatgg

SEQ ID NO: 221791 - DNA, 20 bp, Artificial
  CRISPR gRNA sequence
gttttattttttaatatggg

SEQ ID NO: 221792 - DNA, 20 bp, Artificial
  CRISPR gRNA sequence
ttttattttttaatatgggg

SEQ ID NO: 221793 - DNA, 20 bp, Artificial
  CRISPR gRNA sequence
tattttttaatatggggtaa

SEQ ID NO: 221794 - DNA, 20 bp, Artificial
  CRISPR gRNA sequence
attttttaatatggggtaaa

SEQ ID NO: 221795 - DNA, 20 bp, Artificial
  CRISPR gRNA sequence
ttttttaatatggggtaaaa

SEQ ID NO: 221796 - DNA, 20 bp, Artificial
  CRISPR gRNA sequence
tttaatatggggtaaaattt

SEQ ID NO: 221797 - DNA, 20 bp, Artificial
  CRISPR gRNA sequence
ttaatatggggtaaaatttg

SEQ ID NO: 221798 - DNA, 20 bp, Artificial
  CRISPR gRNA sequence
taatatggggtaaaatttga

SEQ ID NO: 221799 - DNA, 20 bp, Artificial
  CRISPR gRNA sequence
aatatggggtaaaatttgat

SEQ ID NO: 221800 - DNA, 20 bp, Artificial
  CRISPR gRNA sequence
atatggggtaaaatttgatc

SEQ ID NO: 221801 - DNA, 20 bp, Artificial
  CRISPR gRNA sequence
gatcatgtgtgcaagctacg

SEQ ID NO: 221802 - DNA, 20 bp, Artificial
  CRISPR gRNA sequence
atcatgtgtgcaagctacgg

SEQ ID NO: 221803 - DNA, 20 bp, Artificial
  CRISPR gRNA sequence
cggggaaggagtcaatggag

SEQ ID NO: 221804 - DNA, 20 bp, Artificial
  CRISPR gRNA sequence
agatgcaagactgaagaatt

SEQ ID NO: 221805 - DNA, 20 bp, Artificial
  CRISPR gRNA sequence
aagaattatgctgactgagc

SEQ ID NO: 221806 - DNA, 20 bp, Artificial
  CRISPR gRNA sequence
tgctgactgagcaggtctcc

SEQ ID NO: 221807 - DNA, 20 bp, Artificial
  CRISPR gRNA sequence
actgagcaggtctccaagat

SEQ ID NO: 221808 - DNA, 20 bp, Artificial
  CRISPR gRNA sequence
agcaggtctccaagatggta

SEQ ID NO: 221809 - DNA, 20 bp, Artificial
  CRISPR gRNA sequence
caagatggtagaagtgaaaa

SEQ ID NO: 221810 - DNA, 20 bp, Artificial
  CRISPR gRNA sequence
tcctttcgttggaaaagtga

SEQ ID NO: 221811 - DNA, 20 bp, Artificial
  CRISPR gRNA sequence
tcgttggaaaagtgagtagg

SEQ ID NO: 221812 - DNA, 20 bp, Artificial
  CRISPR gRNA sequence
cgttggaaaagtgagtaggt

SEQ ID NO: 221813 - DNA, 20 bp, Artificial
  CRISPR gRNA sequence
gttggaaaagtgagtaggtt

SEQ ID NO: 221814 - DNA, 20 bp, Artificial
  CRISPR gRNA sequence
gaaaagtgagtaggttttct

SEQ ID NO: 221815 - DNA, 20 bp, Artificial
  CRISPR gRNA sequence
tcttctgaagctggatgacg

SEQ ID NO: 221816 - DNA, 20 bp, Artificial
  CRISPR gRNA sequence
cttctgaagctggatgacgg

SEQ ID NO: 221817 - DNA, 20 bp, Artificial
  CRISPR gRNA sequence
ttctgaagctggatgacgga

SEQ ID NO: 221818 - DNA, 20 bp, Artificial
  CRISPR gRNA sequence
ctgaagctggatgacggaag

SEQ ID NO: 221819 - DNA, 20 bp, Artificial
  CRISPR gRNA sequence
tgaagctggatgacggaaga

SEQ ID NO: 221820 - DNA, 20 bp, Artificial
  CRISPR gRNA sequence
aagctggatgacggaagaga

SEQ ID NO: 221821 - DNA, 20 bp, Artificial
  CRISPR gRNA sequence
gatgacggaagagaatgaga

SEQ ID NO: 221822 - DNA, 20 bp, Artificial
  CRISPR gRNA sequence
tctaagatgttatagatcag

SEQ ID NO: 221823 - DNA, 20 bp, Artificial
  CRISPR gRNA sequence
agatgttatagatcagttta

SEQ ID NO: 221824 - DNA, 20 bp, Artificial
  CRISPR gRNA sequence
tagatcagtttagtaatggt

SEQ ID NO: 221825 - DNA, 20 bp, Artificial
  CRISPR gRNA sequence
agtaatggtgggagggaagc

SEQ ID NO: 221826 - DNA, 20 bp, Artificial
  CRISPR gRNA sequence
gtaatggtgggagggaagca

SEQ ID NO: 221827 - DNA, 20 bp, Artificial
  CRISPR gRNA sequence
ttttttgcagtagagtagga

SEQ ID NO: 221828 - DNA, 20 bp, Artificial
  CRISPR gRNA sequence
tttgcagtagagtaggaagt

SEQ ID NO: 221829 - DNA, 20 bp, Artificial
  CRISPR gRNA sequence
ttgcagtagagtaggaagtt

SEQ ID NO: 221830 - DNA, 20 bp, Artificial
  CRISPR gRNA sequence
tgcagtagagtaggaagtta

SEQ ID NO: 221831 - DNA, 20 bp, Artificial
  CRISPR gRNA sequence
gcagtagagtaggaagttaa

SEQ ID NO: 221832 - DNA, 20 bp, Artificial
  CRISPR gRNA sequence
cagtagagtaggaagttaat

SEQ ID NO: 221833 - DNA, 20 bp, Artificial
  CRISPR gRNA sequence
attatctgctgggaatggat

SEQ ID NO: 221834 - DNA, 20 bp, Artificial
  CRISPR gRNA sequence
tctgctgggaatggatgttc

SEQ ID NO: 221835 - DNA, 20 bp, Artificial
  CRISPR gRNA sequence
ctgggaatggatgttcagga

SEQ ID NO: 221836 - DNA, 20 bp, Artificial
  CRISPR gRNA sequence
ggaatggatgttcaggaatg

SEQ ID NO: 221837 - DNA, 20 bp, Artificial
  CRISPR gRNA sequence
aggaatggagtaagaagtct

SEQ ID NO: 221838 - DNA, 20 bp, Artificial
  CRISPR gRNA sequence
agcagcctcttaggtaaaga

SEQ ID NO: 221839 - DNA, 20 bp, Artificial
  CRISPR gRNA sequence
ttaggtaaagaagcaaagat

SEQ ID NO: 221840 - DNA, 20 bp, Artificial
  CRISPR gRNA sequence
aggtaaagaagcaaagatca

SEQ ID NO: 221841 - DNA, 20 bp, Artificial
  CRISPR gRNA sequence
ggtaaagaagcaaagatcat

SEQ ID NO: 221842 - DNA, 20 bp, Artificial
  CRISPR gRNA sequence
cctacttttgccccttagaa

SEQ ID NO: 221843 - DNA, 20 bp, Artificial
  CRISPR gRNA sequence
cttttgccccttagaactag

SEQ ID NO: 221844 - DNA, 20 bp, Artificial
  CRISPR gRNA sequence
ttgccccttagaactagtgt

SEQ ID NO: 221845 - DNA, 20 bp, Artificial
  CRISPR gRNA sequence
tgccccttagaactagtgtc

SEQ ID NO: 221846 - DNA, 20 bp, Artificial
  CRISPR gRNA sequence
gccccttagaactagtgtct

SEQ ID NO: 221847 - DNA, 20 bp, Artificial
  CRISPR gRNA sequence
ccccttagaactagtgtctg

SEQ ID NO: 221848 - DNA, 20 bp, Artificial
  CRISPR gRNA sequence
agaactagtgtctggcttga

SEQ ID NO: 221849 - DNA, 20 bp, Artificial
  CRISPR gRNA sequence
gaactagtgtctggcttgaa

SEQ ID NO: 221850 - DNA, 20 bp, Artificial
  CRISPR gRNA sequence
gtgtctggcttgaagaactg

SEQ ID NO: 221851 - DNA, 20 bp, Artificial
  CRISPR gRNA sequence
gcttgaagaactggagtctc

SEQ ID NO: 221852 - DNA, 20 bp, Artificial
  CRISPR gRNA sequence
gaagaactggagtctctagc

SEQ ID NO: 221853 - DNA, 20 bp, Artificial
  CRISPR gRNA sequence
aagaactggagtctctagct

SEQ ID NO: 221854 - DNA, 20 bp, Artificial
  CRISPR gRNA sequence
gagtctctagctacactggg

SEQ ID NO: 221855 - DNA, 20 bp, Artificial
  CRISPR gRNA sequence
tagctacactgggttacgta

SEQ ID NO: 221856 - DNA, 20 bp, Artificial
  CRISPR gRNA sequence
gctacactgggttacgtaca

SEQ ID NO: 221857 - DNA, 20 bp, Artificial
  CRISPR gRNA sequence
cactgggttacgtacaaaaa

SEQ ID NO: 221858 - DNA, 20 bp, Artificial
  CRISPR gRNA sequence
ggttacgtacaaaaaggatg

SEQ ID NO: 221859 - DNA, 20 bp, Artificial
  CRISPR gRNA sequence
cgtacaaaaaggatgaagtc

SEQ ID NO: 221860 - DNA, 20 bp, Artificial
  CRISPR gRNA sequence
tcctcaatggacactaaaat

SEQ ID NO: 221861 - DNA, 20 bp, Artificial
  CRISPR gRNA sequence
ctcaatggacactaaaataa

SEQ ID NO: 221862 - DNA, 20 bp, Artificial
  CRISPR gRNA sequence
aatggacactaaaataaagg

SEQ ID NO: 221863 - DNA, 20 bp, Artificial
  CRISPR gRNA sequence
aaataaaggtctggggtaga

SEQ ID NO: 221864 - DNA, 20 bp, Artificial
  CRISPR gRNA sequence
gggtagagtggggtgtccac

SEQ ID NO: 221865 - DNA, 20 bp, Artificial
  CRISPR gRNA sequence
tacttagttctgacccaacg

SEQ ID NO: 221866 - DNA, 20 bp, Artificial
  CRISPR gRNA sequence
agttctgacccaacgcaatc

SEQ ID NO: 221867 - DNA, 20 bp, Artificial
  CRISPR gRNA sequence
gttctgacccaacgcaatcc

SEQ ID NO: 221868 - DNA, 20 bp, Artificial
  CRISPR gRNA sequence
tgacccaacgcaatccccct

SEQ ID NO: 221869 - DNA, 20 bp, Artificial
  CRISPR gRNA sequence
acccaacgcaatccccctaa

SEQ ID NO: 221870 - DNA, 20 bp, Artificial
  CRISPR gRNA sequence
atgaatttaaaagtggcctt

SEQ ID NO: 221871 - DNA, 20 bp, Artificial
  CRISPR gRNA sequence
aaaagtggccttataagaat

SEQ ID NO: 221872 - DNA, 20 bp, Artificial
  CRISPR gRNA sequence
aaagtggccttataagaatg

SEQ ID NO: 221873 - DNA, 20 bp, Artificial
  CRISPR gRNA sequence
ataagaatggaagaggccaa

SEQ ID NO: 221874 - DNA, 20 bp, Artificial
  CRISPR gRNA sequence
taagaatggaagaggccaac

SEQ ID NO: 221875 - DNA, 20 bp, Artificial
  CRISPR gRNA sequence
agaattaaaaagggcagggc

SEQ ID NO: 221876 - DNA, 20 bp, Artificial
  CRISPR gRNA sequence
gaattaaaaagggcagggca

SEQ ID NO: 221877 - DNA, 20 bp, Artificial
  CRISPR gRNA sequence
aaaagggcagggcagtttaa

SEQ ID NO: 221878 - DNA, 20 bp, Artificial
  CRISPR gRNA sequence
aaagtcaataacatccagaa

SEQ ID NO: 221879 - DNA, 20 bp, Artificial
  CRISPR gRNA sequence
aagtcaataacatccagaat

SEQ ID NO: 221880 - DNA, 20 bp, Artificial
  CRISPR gRNA sequence
tggccttaacaagcacctaa

SEQ ID NO: 221881 - DNA, 20 bp, Artificial
  CRISPR gRNA sequence
aacaagcacctaagtaccat

SEQ ID NO: 221882 - DNA, 20 bp, Artificial
  CRISPR gRNA sequence
acaagcacctaagtaccatg

SEQ ID NO: 221883 - DNA, 20 bp, Artificial
  CRISPR gRNA sequence
agtaccatgagggaataaaa

SEQ ID NO: 221884 - DNA, 20 bp, Artificial
  CRISPR gRNA sequence
ctgtctatatactacatctt

SEQ ID NO: 221885 - DNA, 20 bp, Artificial
  CRISPR gRNA sequence
tctatatactacatcttaag

SEQ ID NO: 221886 - DNA, 20 bp, Artificial
  CRISPR gRNA sequence
tatactacatcttaagtcat

SEQ ID NO: 221887 - DNA, 20 bp, Artificial
  CRISPR gRNA sequence
catcttaagtcattaagaga

SEQ ID NO: 221888 - DNA, 20 bp, Artificial
  CRISPR gRNA sequence
aagtcattaagagacatact

SEQ ID NO: 221889 - DNA, 20 bp, Artificial
  CRISPR gRNA sequence
agtcattaagagacatactg

SEQ ID NO: 221890 - DNA, 20 bp, Artificial
  CRISPR gRNA sequence
agagacatactgacatactg

SEQ ID NO: 221891 - DNA, 20 bp, Artificial
  CRISPR gRNA sequence
acatactgtctgaaatttgt

SEQ ID NO: 221892 - DNA, 20 bp, Artificial
  CRISPR gRNA sequence
tctgaaatttgtctatatgc

SEQ ID NO: 221893 - DNA, 20 bp, Artificial
  CRISPR gRNA sequence
aaatttgtctatatgccaaa

SEQ ID NO: 221894 - DNA, 20 bp, Artificial
  CRISPR gRNA sequence
gtctatatgccaaagagggc

SEQ ID NO: 221895 - DNA, 20 bp, Artificial
  CRISPR gRNA sequence
tctatatgccaaagagggct

SEQ ID NO: 221896 - DNA, 20 bp, Artificial
  CRISPR gRNA sequence
tatgccaaagagggctttgc

SEQ ID NO: 221897 - DNA, 20 bp, Artificial
  CRISPR gRNA sequence
tgcaaactgcttggtgtgta

SEQ ID NO: 221898 - DNA, 20 bp, Artificial
  CRISPR gRNA sequence
gcaaactgcttggtgtgtag

SEQ ID NO: 221899 - DNA, 20 bp, Artificial
  CRISPR gRNA sequence
caaactgcttggtgtgtagt

SEQ ID NO: 221900 - DNA, 20 bp, Artificial
  CRISPR gRNA sequence
cttggtgtgtagtataggct

SEQ ID NO: 221901 - DNA, 20 bp, Artificial
  CRISPR gRNA sequence
ggtgtgtagtataggctcat

SEQ ID NO: 221902 - DNA, 20 bp, Artificial
  CRISPR gRNA sequence
gtgtgtagtataggctcata

SEQ ID NO: 221903 - DNA, 20 bp, Artificial
  CRISPR gRNA sequence
atacttgcttgaaatggaaa

SEQ ID NO: 221904 - DNA, 20 bp, Artificial
  CRISPR gRNA sequence
gcttgaaatggaaaaaagtg

SEQ ID NO: 221905 - DNA, 20 bp, Artificial
  CRISPR gRNA sequence
cttgaaatggaaaaaagtgg

SEQ ID NO: 221906 - DNA, 20 bp, Artificial
  CRISPR gRNA sequence
gaaatggaaaaaagtggttt

SEQ ID NO: 221907 - DNA, 20 bp, Artificial
  CRISPR gRNA sequence
aaatggaaaaaagtggtttt

SEQ ID NO: 221908 - DNA, 20 bp, Artificial
  CRISPR gRNA sequence
tgacaggccttgaactagcc

SEQ ID NO: 221909 - DNA, 20 bp, Artificial
  CRISPR gRNA sequence
gacaggccttgaactagcca

SEQ ID NO: 221910 - DNA, 20 bp, Artificial
  CRISPR gRNA sequence
acaggccttgaactagccaa

SEQ ID NO: 221911 - DNA, 20 bp, Artificial
  CRISPR gRNA sequence
gaactagccaaaccccttgc

SEQ ID NO: 221912 - DNA, 20 bp, Artificial
  CRISPR gRNA sequence
aactagccaaaccccttgct

SEQ ID NO: 221913 - DNA, 20 bp, Artificial
  CRISPR gRNA sequence
gccaaaccccttgctttacc

SEQ ID NO: 221914 - DNA, 20 bp, Artificial
  CRISPR gRNA sequence
gctttaccttttaacctaca

SEQ ID NO: 221915 - DNA, 20 bp, Artificial
  CRISPR gRNA sequence
ctttaccttttaacctacaa

SEQ ID NO: 221916 - DNA, 20 bp, Artificial
  CRISPR gRNA sequence
taccttttaacctacaagtg

SEQ ID NO: 221917 - DNA, 20 bp, Artificial
  CRISPR gRNA sequence
accttttaacctacaagtgt

SEQ ID NO: 221918 - DNA, 20 bp, Artificial
  CRISPR gRNA sequence
ccttttaacctacaagtgtg

SEQ ID NO: 221919 - DNA, 20 bp, Artificial
  CRISPR gRNA sequence
ttaacctacaagtgtgatat

SEQ ID NO: 221920 - DNA, 20 bp, Artificial
  CRISPR gRNA sequence
taacctacaagtgtgatata

SEQ ID NO: 221921 - DNA, 20 bp, Artificial
  CRISPR gRNA sequence
aacctacaagtgtgatatat

SEQ ID NO: 221922 - DNA, 20 bp, Artificial
  CRISPR gRNA sequence
acctacaagtgtgatatata

SEQ ID NO: 221923 - DNA, 20 bp, Artificial
  CRISPR gRNA sequence
caagtgtgatatatattcaa

SEQ ID NO: 221924 - DNA, 20 bp, Artificial
  CRISPR gRNA sequence
aaatatgcacattaattctc

SEQ ID NO: 221925 - DNA, 20 bp, Artificial
  CRISPR gRNA sequence
attctcctaatctgaatctc

SEQ ID NO: 221926 - DNA, 20 bp, Artificial
  CRISPR gRNA sequence
tcctaatctgaatctcaaac

SEQ ID NO: 221927 - DNA, 20 bp, Artificial
  CRISPR gRNA sequence
ctaatctgaatctcaaacca

SEQ ID NO: 221928 - DNA, 20 bp, Artificial
  CRISPR gRNA sequence
atctgaatctcaaaccatga

SEQ ID NO: 221929 - DNA, 20 bp, Artificial
  CRISPR gRNA sequence
aatctcaaaccatgagattg

SEQ ID NO: 221930 - DNA, 20 bp, Artificial
  CRISPR gRNA sequence
aaaccatgagattgaccaga

SEQ ID NO: 221931 - DNA, 20 bp, Artificial
  CRISPR gRNA sequence
accagattctgagtcttatg

SEQ ID NO: 221932 - DNA, 20 bp, Artificial
  CRISPR gRNA sequence
tgagtcttatgcaactgctc

SEQ ID NO: 221933 - DNA, 20 bp, Artificial
  CRISPR gRNA sequence
agtcttatgcaactgctcca

SEQ ID NO: 221934 - DNA, 20 bp, Artificial
  CRISPR gRNA sequence
atgcaactgctccatggatt

SEQ ID NO: 221935 - DNA, 20 bp, Artificial
  CRISPR gRNA sequence
tgcaactgctccatggattt

SEQ ID NO: 221936 - DNA, 20 bp, Artificial
  CRISPR gRNA sequence
ctccatggatttggaatgaa

SEQ ID NO: 221937 - DNA, 20 bp, Artificial
  CRISPR gRNA sequence
catggatttggaatgaaata

SEQ ID NO: 221938 - DNA, 20 bp, Artificial
  CRISPR gRNA sequence
ggaatgaaatattcagaggt

SEQ ID NO: 221939 - DNA, 20 bp, Artificial
  CRISPR gRNA sequence
gaatgaaatattcagaggtg

SEQ ID NO: 221940 - DNA, 20 bp, Artificial
  CRISPR gRNA sequence
agaggtgggtgtagcttgat

SEQ ID NO: 221941 - DNA, 20 bp, Artificial
  CRISPR gRNA sequence
gatttctgtttcaacactgt

SEQ ID NO: 221942 - DNA, 20 bp, Artificial
  CRISPR gRNA sequence
atttctgtttcaacactgta

SEQ ID NO: 221943 - DNA, 20 bp, Artificial
  CRISPR gRNA sequence
ctgtttcaacactgtataat

SEQ ID NO: 221944 - DNA, 20 bp, Artificial
  CRISPR gRNA sequence
tgtttcaacactgtataatc

SEQ ID NO: 221945 - DNA, 20 bp, Artificial
  CRISPR gRNA sequence
tttcaacactgtataatcgt

SEQ ID NO: 221946 - DNA, 20 bp, Artificial
  CRISPR gRNA sequence
caacactgtataatcgtaaa

SEQ ID NO: 221947 - DNA, 20 bp, Artificial
  CRISPR gRNA sequence
aacactgtataatcgtaaag

SEQ ID NO: 221948 - DNA, 20 bp, Artificial
  CRISPR gRNA sequence
tataatcgtaaagaggaaaa

SEQ ID NO: 221949 - DNA, 20 bp, Artificial
  CRISPR gRNA sequence
tattgtcttagtctaggtat

SEQ ID NO: 221950 - DNA, 20 bp, Artificial
  CRISPR gRNA sequence
ttgtcttagtctaggtatat

SEQ ID NO: 221951 - DNA, 20 bp, Artificial
  CRISPR gRNA sequence
tcttagtctaggtatatcag

SEQ ID NO: 221952 - DNA, 20 bp, Artificial
  CRISPR gRNA sequence
agtctaggtatatcagaatc

SEQ ID NO: 221953 - DNA, 20 bp, Artificial
  CRISPR gRNA sequence
gtctaggtatatcagaatca

SEQ ID NO: 221954 - DNA, 20 bp, Artificial
  CRISPR gRNA sequence
ggtatatcagaatcaaattt

SEQ ID NO: 221955 - DNA, 20 bp, Artificial
  CRISPR gRNA sequence
cctgggtgctctgtattttc

SEQ ID NO: 221956 - DNA, 20 bp, Artificial
  CRISPR gRNA sequence
ctgggtgctctgtattttct

SEQ ID NO: 221957 - DNA, 20 bp, Artificial
  CRISPR gRNA sequence
ggtgctctgtattttctact

SEQ ID NO: 221958 - DNA, 20 bp, Artificial
  CRISPR gRNA sequence
tgtattttctactttagtac

SEQ ID NO: 221959 - DNA, 20 bp, Artificial
  CRISPR gRNA sequence
tattttctactttagtacta

SEQ ID NO: 221960 - DNA, 20 bp, Artificial
  CRISPR gRNA sequence
tctactttagtactacaatg

SEQ ID NO: 221961 - DNA, 20 bp, Artificial
  CRISPR gRNA sequence
ctactttagtactacaatga

SEQ ID NO: 221962 - DNA, 20 bp, Artificial
  CRISPR gRNA sequence
tactttagtactacaatgag

SEQ ID NO: 221963 - DNA, 20 bp, Artificial
  CRISPR gRNA sequence
ctttagtactacaatgagtt

SEQ ID NO: 221964 - DNA, 20 bp, Artificial
  CRISPR gRNA sequence
tagtactacaatgagtttaa

SEQ ID NO: 221965 - DNA, 20 bp, Artificial
  CRISPR gRNA sequence
agtactacaatgagtttaac

SEQ ID NO: 221966 - DNA, 20 bp, Artificial
  CRISPR gRNA sequence
gtactacaatgagtttaaca

SEQ ID NO: 221967 - DNA, 20 bp, Artificial
  CRISPR gRNA sequence
caatgagtttaacaaaactg

SEQ ID NO: 221968 - DNA, 20 bp, Artificial
  CRISPR gRNA sequence
aacaaaactgatcctacact

SEQ ID NO: 221969 - DNA, 20 bp, Artificial
  CRISPR gRNA sequence
acaaaactgatcctacacta

SEQ ID NO: 221970 - DNA, 20 bp, Artificial
  CRISPR gRNA sequence
atcctacactattattcttg

SEQ ID NO: 221971 - DNA, 20 bp, Artificial
  CRISPR gRNA sequence
cactattattcttgttcttt

SEQ ID NO: 221972 - DNA, 20 bp, Artificial
  CRISPR gRNA sequence
ttattcttgttctttttatc

SEQ ID NO: 221973 - DNA, 20 bp, Artificial
  CRISPR gRNA sequence
ttcttgttctttttatcaca

SEQ ID NO: 221974 - DNA, 20 bp, Artificial
  CRISPR gRNA sequence
ttgttctttttatcacagaa

SEQ ID NO: 221975 - DNA, 20 bp, Artificial
  CRISPR gRNA sequence
gttctttttatcacagaaga

SEQ ID NO: 221976 - DNA, 20 bp, Artificial
  CRISPR gRNA sequence
ttctttttatcacagaagaa

SEQ ID NO: 221977 - DNA, 20 bp, Artificial
  CRISPR gRNA sequence
tttttatcacagaagaaata

SEQ ID NO: 221978 - DNA, 20 bp, Artificial
  CRISPR gRNA sequence
tttatcacagaagaaatatc

SEQ ID NO: 221979 - DNA, 20 bp, Artificial
  CRISPR gRNA sequence
ttatcacagaagaaatatct

SEQ ID NO: 221980 - DNA, 20 bp, Artificial
  CRISPR gRNA sequence
tatcacagaagaaatatcta

SEQ ID NO: 221981 - DNA, 20 bp, Artificial
  CRISPR gRNA sequence
atcacagaagaaatatctac

SEQ ID NO: 221982 - DNA, 20 bp, Artificial
  CRISPR gRNA sequence
tcacagaagaaatatctaca

SEQ ID NO: 221983 - DNA, 20 bp, Artificial
  CRISPR gRNA sequence
cactagtatacaaagtgaaa

SEQ ID NO: 221984 - DNA, 20 bp, Artificial
  CRISPR gRNA sequence
gtatacaaagtgaaagtaac

SEQ ID NO: 221985 - DNA, 20 bp, Artificial
  CRISPR gRNA sequence
tatgataacccaagacgata

SEQ ID NO: 221986 - DNA, 20 bp, Artificial
  CRISPR gRNA sequence
atgataacccaagacgatat

SEQ ID NO: 221987 - DNA, 20 bp, Artificial
  CRISPR gRNA sequence
tgataacccaagacgatatt

SEQ ID NO: 221988 - DNA, 20 bp, Artificial
  CRISPR gRNA sequence
ttaaaatcagactgagagat

SEQ ID NO: 221989 - DNA, 20 bp, Artificial
  CRISPR gRNA sequence
aaatcagactgagagataag

SEQ ID NO: 221990 - DNA, 20 bp, Artificial
  CRISPR gRNA sequence
agagataagatatgaaaata

SEQ ID NO: 221991 - DNA, 20 bp, Artificial
  CRISPR gRNA sequence
atcttgtataaaaaggtagg

SEQ ID NO: 221992 - DNA, 20 bp, Artificial
  CRISPR gRNA sequence
tcttgtataaaaaggtaggc

SEQ ID NO: 221993 - DNA, 20 bp, Artificial
  CRISPR gRNA sequence
gtataaaaaggtaggcagaa

SEQ ID NO: 221994 - DNA, 20 bp, Artificial
  CRISPR gRNA sequence
tataaaaaggtaggcagaaa

SEQ ID NO: 221995 - DNA, 20 bp, Artificial
  CRISPR gRNA sequence
agacagggaaagtgattgaa

SEQ ID NO: 221996 - DNA, 20 bp, Artificial
  CRISPR gRNA sequence
aaaattatgccacaaaaaga

SEQ ID NO: 221997 - DNA, 20 bp, Artificial
  CRISPR gRNA sequence
tgccacaaaaagaacattac

SEQ ID NO: 221998 - DNA, 20 bp, Artificial
  CRISPR gRNA sequence
ctatattaaaagcaatgcct

SEQ ID NO: 221999 - DNA, 20 bp, Artificial
  CRISPR gRNA sequence
tattaaaagcaatgcctata

SEQ ID NO: 222000 - DNA, 20 bp, Artificial
  CRISPR gRNA sequence
aaagcaatgcctatatacta

SEQ ID NO: 222001 - DNA, 20 bp, Artificial
  CRISPR gRNA sequence
tatactagctatagctgaat

SEQ ID NO: 222002 - DNA, 20 bp, Artificial
  CRISPR gRNA sequence
gctatagctgaattcatact

SEQ ID NO: 222003 - DNA, 20 bp, Artificial
  CRISPR gRNA sequence
tagctgaattcatactatga

SEQ ID NO: 222004 - DNA, 20 bp, Artificial
  CRISPR gRNA sequence
aattcatactatgaaatgca

SEQ ID NO: 222005 - DNA, 20 bp, Artificial
  CRISPR gRNA sequence
atactatgaaatgcaaatct

SEQ ID NO: 222006 - DNA, 20 bp, Artificial
  CRISPR gRNA sequence
tgaaatgcaaatctagtttt

SEQ ID NO: 222007 - DNA, 20 bp, Artificial
  CRISPR gRNA sequence
gttttgcgaatatgcgtgat

SEQ ID NO: 222008 - DNA, 20 bp, Artificial
  CRISPR gRNA sequence
tgcgaatatgcgtgattatt

SEQ ID NO: 222009 - DNA, 20 bp, Artificial
  CRISPR gRNA sequence
gcgaatatgcgtgattattt

SEQ ID NO: 222010 - DNA, 20 bp, Artificial
  CRISPR gRNA sequence
cgaatatgcgtgattatttt

SEQ ID NO: 222011 - DNA, 20 bp, Artificial
  CRISPR gRNA sequence
ttttggatttagaatatgta

SEQ ID NO: 222012 - DNA, 20 bp, Artificial
  CRISPR gRNA sequence
tggatttagaatatgtatca

SEQ ID NO: 222013 - DNA, 20 bp, Artificial
  CRISPR gRNA sequence
ggatttagaatatgtatcaa

SEQ ID NO: 222014 - DNA, 20 bp, Artificial
  CRISPR gRNA sequence
gatttagaatatgtatcaat

SEQ ID NO: 222015 - DNA, 20 bp, Artificial
  CRISPR gRNA sequence
agaatatgtatcaatttggg

SEQ ID NO: 222016 - DNA, 20 bp, Artificial
  CRISPR gRNA sequence
gaatatgtatcaatttgggg

SEQ ID NO: 222017 - DNA, 20 bp, Artificial
  CRISPR gRNA sequence
ggggggaaagtcatctatct

SEQ ID NO: 222018 - DNA, 20 bp, Artificial
  CRISPR gRNA sequence
gggggaaagtcatctatctc

SEQ ID NO: 222019 - DNA, 20 bp, Artificial
  CRISPR gRNA sequence
tctctcatctttagaacttg

SEQ ID NO: 222020 - DNA, 20 bp, Artificial
  CRISPR gRNA sequence
tcatctttagaacttggcct

SEQ ID NO: 222021 - DNA, 20 bp, Artificial
  CRISPR gRNA sequence
atctttagaacttggccttt

SEQ ID NO: 222022 - DNA, 20 bp, Artificial
  CRISPR gRNA sequence
tagaacttggcctttcaaat

SEQ ID NO: 222023 - DNA, 20 bp, Artificial
  CRISPR gRNA sequence
agaacttggcctttcaaatc

SEQ ID NO: 222024 - DNA, 20 bp, Artificial
  CRISPR gRNA sequence
gaacttggcctttcaaatct

SEQ ID NO: 222025 - DNA, 20 bp, Artificial
  CRISPR gRNA sequence
ggcctttcaaatctccatga

SEQ ID NO: 222026 - DNA, 20 bp, Artificial
  CRISPR gRNA sequence
gcctttcaaatctccatgaa

SEQ ID NO: 222027 - DNA, 20 bp, Artificial
  CRISPR gRNA sequence
tcaaatctccatgaacaact

SEQ ID NO: 222028 - DNA, 20 bp, Artificial
  CRISPR gRNA sequence
caaatctccatgaacaactc

SEQ ID NO: 222029 - DNA, 20 bp, Artificial
  CRISPR gRNA sequence
aaatctccatgaacaactca

SEQ ID NO: 222030 - DNA, 20 bp, Artificial
  CRISPR gRNA sequence
catgaacaactcagtgacaa

SEQ ID NO: 222031 - DNA, 20 bp, Artificial
  CRISPR gRNA sequence
agtgacaaagataaaacatc

SEQ ID NO: 222032 - DNA, 20 bp, Artificial
  CRISPR gRNA sequence
ccaaaacacagatgacagca

SEQ ID NO: 222033 - DNA, 20 bp, Artificial
  CRISPR gRNA sequence
atggtaggcatttagtgtaa

SEQ ID NO: 222034 - DNA, 20 bp, Artificial
  CRISPR gRNA sequence
agtgtaatgctttaaaaaac

SEQ ID NO: 222035 - DNA, 20 bp, Artificial
  CRISPR gRNA sequence
gtgtaatgctttaaaaaaca

SEQ ID NO: 222036 - DNA, 20 bp, Artificial
  CRISPR gRNA sequence
taaaaaacactgcctctaga

SEQ ID NO: 222037 - DNA, 20 bp, Artificial
  CRISPR gRNA sequence
aaaaaacactgcctctagac

SEQ ID NO: 222038 - DNA, 20 bp, Artificial
  CRISPR gRNA sequence
aaaaacactgcctctagact

SEQ ID NO: 222039 - DNA, 20 bp, Artificial
  CRISPR gRNA sequence
cctctagactgctggggcgg

SEQ ID NO: 222040 - DNA, 20 bp, Artificial
  CRISPR gRNA sequence
tagactgctggggcggcccc

SEQ ID NO: 222041 - DNA, 20 bp, Artificial
  CRISPR gRNA sequence
gactgctggggcggccccat

SEQ ID NO: 222042 - DNA, 20 bp, Artificial
  CRISPR gRNA sequence
ctggggcggccccataaata

SEQ ID NO: 222043 - DNA, 20 bp, Artificial
  CRISPR gRNA sequence
gggcggccccataaatacgt

SEQ ID NO: 222044 - DNA, 20 bp, Artificial
  CRISPR gRNA sequence
ttaaataggcatttacttcc

SEQ ID NO: 222045 - DNA, 20 bp, Artificial
  CRISPR gRNA sequence
taaataggcatttacttcct

SEQ ID NO: 222046 - DNA, 20 bp, Artificial
  CRISPR gRNA sequence
aaataggcatttacttcctt

SEQ ID NO: 222047 - DNA, 20 bp, Artificial
  CRISPR gRNA sequence
aataggcatttacttcctta

SEQ ID NO: 222048 - DNA, 20 bp, Artificial
  CRISPR gRNA sequence
acttccttaaaatggcaact

SEQ ID NO: 222049 - DNA, 20 bp, Artificial
  CRISPR gRNA sequence
cttccttaaaatggcaactt

SEQ ID NO: 222050 - DNA, 20 bp, Artificial
  CRISPR gRNA sequence
ccttaaaatggcaacttgta

SEQ ID NO: 222051 - DNA, 20 bp, Artificial
  CRISPR gRNA sequence
cttaaaatggcaacttgtaa

SEQ ID NO: 222052 - DNA, 20 bp, Artificial
  CRISPR gRNA sequence
aaaatggcaacttgtaatta

SEQ ID NO: 222053 - DNA, 20 bp, Artificial
  CRISPR gRNA sequence
aaatggcaacttgtaattaa

SEQ ID NO: 222054 - DNA, 20 bp, Artificial
  CRISPR gRNA sequence
gtaattaaaaataatatatt

SEQ ID NO: 222055 - DNA, 20 bp, Artificial
  CRISPR gRNA sequence
taattaaaaataatatattc

SEQ ID NO: 222056 - DNA, 20 bp, Artificial
  CRISPR gRNA sequence
aaaataatatattctttaag

SEQ ID NO: 222057 - DNA, 20 bp, Artificial
  CRISPR gRNA sequence
tttaagagaaaacattttta

SEQ ID NO: 222058 - DNA, 20 bp, Artificial
  CRISPR gRNA sequence
taagagaaaacatttttatt

SEQ ID NO: 222059 - DNA, 20 bp, Artificial
  CRISPR gRNA sequence
aagagaaaacatttttattt

SEQ ID NO: 222060 - DNA, 20 bp, Artificial
  CRISPR gRNA sequence
agagaaaacatttttattta

SEQ ID NO: 222061 - DNA, 20 bp, Artificial
  CRISPR gRNA sequence
ttatttaaacaagccaaatt

SEQ ID NO: 222062 - DNA, 20 bp, Artificial
  CRISPR gRNA sequence
tatttaaacaagccaaatta

SEQ ID NO: 222063 - DNA, 20 bp, Artificial
  CRISPR gRNA sequence
atttaaacaagccaaattac

SEQ ID NO: 222064 - DNA, 20 bp, Artificial
  CRISPR gRNA sequence
tttaaacaagccaaattact

SEQ ID NO: 222065 - DNA, 20 bp, Artificial
  CRISPR gRNA sequence
aaacaagccaaattactact

SEQ ID NO: 222066 - DNA, 20 bp, Artificial
  CRISPR gRNA sequence
aacaagccaaattactacta

SEQ ID NO: 222067 - DNA, 20 bp, Artificial
  CRISPR gRNA sequence
ctactagacttagacgatgg

SEQ ID NO: 222068 - DNA, 20 bp, Artificial
  CRISPR gRNA sequence
ctagacttagacgatggaaa

SEQ ID NO: 222069 - DNA, 20 bp, Artificial
  CRISPR gRNA sequence
gacttagacgatggaaaaaa

SEQ ID NO: 222070 - DNA, 20 bp, Artificial
  CRISPR gRNA sequence
agacgatggaaaaaaatttt

SEQ ID NO: 222071 - DNA, 20 bp, Artificial
  CRISPR gRNA sequence
gacgatggaaaaaaatttta

SEQ ID NO: 222072 - DNA, 20 bp, Artificial
  CRISPR gRNA sequence
tatttaatcatatgtaccct

SEQ ID NO: 222073 - DNA, 20 bp, Artificial
  CRISPR gRNA sequence
atttaatcatatgtaccctg

SEQ ID NO: 222074 - DNA, 20 bp, Artificial
  CRISPR gRNA sequence
tttaatcatatgtaccctga

SEQ ID NO: 222075 - DNA, 20 bp, Artificial
  CRISPR gRNA sequence
aatcatatgtaccctgattt

SEQ ID NO: 222076 - DNA, 20 bp, Artificial
  CRISPR gRNA sequence
atcatatgtaccctgattta

SEQ ID NO: 222077 - DNA, 20 bp, Artificial
  CRISPR gRNA sequence
atttaaaaaaaaaaacaact

SEQ ID NO: 222078 - DNA, 20 bp, Artificial
  CRISPR gRNA sequence
aaaaaaaaaaacaactcatt

SEQ ID NO: 222079 - DNA, 20 bp, Artificial
  CRISPR gRNA sequence
aaaaaaaaaacaactcattt

SEQ ID NO: 222080 - DNA, 20 bp, Artificial
  CRISPR gRNA sequence
attttgaacaaagaggaatc

SEQ ID NO: 222081 - DNA, 20 bp, Artificial
  CRISPR gRNA sequence
tgaacaaagaggaatcattc

SEQ ID NO: 222082 - DNA, 20 bp, Artificial
  CRISPR gRNA sequence
gaacaaagaggaatcattca

SEQ ID NO: 222083 - DNA, 20 bp, Artificial
  CRISPR gRNA sequence
aacaaagaggaatcattcaa

SEQ ID NO: 222084 - DNA, 20 bp, Artificial
  CRISPR gRNA sequence
aaccactgaaaagacagttc

SEQ ID NO: 222085 - DNA, 20 bp, Artificial
  CRISPR gRNA sequence
aaaagacagttcacaacacc

SEQ ID NO: 222086 - DNA, 20 bp, Artificial
  CRISPR gRNA sequence
acaacaccatcattatttat

SEQ ID NO: 222087 - DNA, 20 bp, Artificial
  CRISPR gRNA sequence
tttatttaaagttttatttg

SEQ ID NO: 222088 - DNA, 20 bp, Artificial
  CRISPR gRNA sequence
atttaaagttttatttgcta

SEQ ID NO: 222089 - DNA, 20 bp, Artificial
  CRISPR gRNA sequence
tttaaagttttatttgctag

SEQ ID NO: 222090 - DNA, 20 bp, Artificial
  CRISPR gRNA sequence
aaagttttatttgctagcta

SEQ ID NO: 222091 - DNA, 20 bp, Artificial
  CRISPR gRNA sequence
aagttttatttgctagctaa

SEQ ID NO: 222092 - DNA, 20 bp, Artificial
  CRISPR gRNA sequence
tatttgctagctaataaata

SEQ ID NO: 222093 - DNA, 20 bp, Artificial
  CRISPR gRNA sequence
atttgctagctaataaatac

SEQ ID NO: 222094 - DNA, 20 bp, Artificial
  CRISPR gRNA sequence
tttgctagctaataaatacc

SEQ ID NO: 222095 - DNA, 20 bp, Artificial
  CRISPR gRNA sequence
gctagctaataaataccact

SEQ ID NO: 222096 - DNA, 20 bp, Artificial
  CRISPR gRNA sequence
ctagctaataaataccactg

SEQ ID NO: 222097 - DNA, 20 bp, Artificial
  CRISPR gRNA sequence
gctaataaataccactgaaa

SEQ ID NO: 222098 - DNA, 20 bp, Artificial
  CRISPR gRNA sequence
ataaataccactgaaactat

SEQ ID NO: 222099 - DNA, 20 bp, Artificial
  CRISPR gRNA sequence
aaactatgcacttttaaaca

SEQ ID NO: 222100 - DNA, 20 bp, Artificial
  CRISPR gRNA sequence
tgcacttttaaacaaagtat

SEQ ID NO: 222101 - DNA, 20 bp, Artificial
  CRISPR gRNA sequence
ttaaacaaagtataattgta

SEQ ID NO: 222102 - DNA, 20 bp, Artificial
  CRISPR gRNA sequence
taaacaaagtataattgtac

SEQ ID NO: 222103 - DNA, 20 bp, Artificial
  CRISPR gRNA sequence
aaacaaagtataattgtaca

SEQ ID NO: 222104 - DNA, 20 bp, Artificial
  CRISPR gRNA sequence
aacaaagtataattgtacat

SEQ ID NO: 222105 - DNA, 20 bp, Artificial
  CRISPR gRNA sequence
tacatgagtgggggcagagt

SEQ ID NO: 222106 - DNA, 20 bp, Artificial
  CRISPR gRNA sequence
atttcacatcttgcatacca

SEQ ID NO: 222107 - DNA, 20 bp, Artificial
  CRISPR gRNA sequence
cacatcttgcataccattaa

SEQ ID NO: 222108 - DNA, 20 bp, Artificial
  CRISPR gRNA sequence
acatcttgcataccattaag

SEQ ID NO: 222109 - DNA, 20 bp, Artificial
  CRISPR gRNA sequence
gcataccattaaggtgcctt

SEQ ID NO: 222110 - DNA, 20 bp, Artificial
  CRISPR gRNA sequence
cataccattaaggtgccttc

SEQ ID NO: 222111 - DNA, 20 bp, Artificial
  CRISPR gRNA sequence
aggtgccttccagtttgcct

SEQ ID NO: 222112 - DNA, 20 bp, Artificial
  CRISPR gRNA sequence
ccagtttgcctgtaattgca

SEQ ID NO: 222113 - DNA, 20 bp, Artificial
  CRISPR gRNA sequence
cagtttgcctgtaattgcat

SEQ ID NO: 222114 - DNA, 20 bp, Artificial
  CRISPR gRNA sequence
gcctgtaattgcatgaaatg

SEQ ID NO: 222115 - DNA, 20 bp, Artificial
  CRISPR gRNA sequence
cctgtaattgcatgaaatga

SEQ ID NO: 222116 - DNA, 20 bp, Artificial
  CRISPR gRNA sequence
taattgcatgaaatgagtat

SEQ ID NO: 222117 - DNA, 20 bp, Artificial
  CRISPR gRNA sequence
catgaaatgagtatctgaga

SEQ ID NO: 222118 - DNA, 20 bp, Artificial
  CRISPR gRNA sequence
agataacttcttttaccaca

SEQ ID NO: 222119 - DNA, 20 bp, Artificial
  CRISPR gRNA sequence
cttttaccacaaaggccact

SEQ ID NO: 222120 - DNA, 20 bp, Artificial
  CRISPR gRNA sequence
ttttaccacaaaggccacta

SEQ ID NO: 222121 - DNA, 20 bp, Artificial
  CRISPR gRNA sequence
ttaccacaaaggccactaac

SEQ ID NO: 222122 - DNA, 20 bp, Artificial
  CRISPR gRNA sequence
taccacaaaggccactaaca

SEQ ID NO: 222123 - DNA, 20 bp, Artificial
  CRISPR gRNA sequence
accacaaaggccactaacac

SEQ ID NO: 222124 - DNA, 20 bp, Artificial
  CRISPR gRNA sequence
ccacaaaggccactaacact

SEQ ID NO: 222125 - DNA, 20 bp, Artificial
  CRISPR gRNA sequence
acactgtagagggtgccagg

SEQ ID NO: 222126 - DNA, 20 bp, Artificial
  CRISPR gRNA sequence
tagagggtgccaggaaaggt

SEQ ID NO: 222127 - DNA, 20 bp, Artificial
  CRISPR gRNA sequence
attcccggggcttaattaac

SEQ ID NO: 222128 - DNA, 20 bp, Artificial
  CRISPR gRNA sequence
ccggggcttaattaacgaaa

SEQ ID NO: 222129 - DNA, 20 bp, Artificial
  CRISPR gRNA sequence
aattaacgaaactgaaagca

SEQ ID NO: 222130 - DNA, 20 bp, Artificial
  CRISPR gRNA sequence
attaacgaaactgaaagcaa

SEQ ID NO: 222131 - DNA, 20 bp, Artificial
  CRISPR gRNA sequence
acgaaactgaaagcaaaatc

SEQ ID NO: 222132 - DNA, 20 bp, Artificial
  CRISPR gRNA sequence
aaagcaaaatcaaacttcaa

SEQ ID NO: 222133 - DNA, 20 bp, Artificial
  CRISPR gRNA sequence
caatacaaatgaatgtacag

SEQ ID NO: 222134 - DNA, 20 bp, Artificial
  CRISPR gRNA sequence
aatacaaatgaatgtacaga

SEQ ID NO: 222135 - DNA, 20 bp, Artificial
  CRISPR gRNA sequence
tcttactcattctagattct

SEQ ID NO: 222136 - DNA, 20 bp, Artificial
  CRISPR gRNA sequence
cttactcattctagattcta

SEQ ID NO: 222137 - DNA, 20 bp, Artificial
  CRISPR gRNA sequence
ttactcattctagattctaa

SEQ ID NO: 222138 - DNA, 20 bp, Artificial
  CRISPR gRNA sequence
actcattctagattctaaag

SEQ ID NO: 222139 - DNA, 20 bp, Artificial
  CRISPR gRNA sequence
ctcattctagattctaaagt

SEQ ID NO: 222140 - DNA, 20 bp, Artificial
  CRISPR gRNA sequence
attctagattctaaagtcag

SEQ ID NO: 222141 - DNA, 20 bp, Artificial
  CRISPR gRNA sequence
tagattctaaagtcagtctc

SEQ ID NO: 222142 - DNA, 20 bp, Artificial
  CRISPR gRNA sequence
gattctaaagtcagtctctc

SEQ ID NO: 222143 - DNA, 20 bp, Artificial
  CRISPR gRNA sequence
taaagtcagtctctcaaacc

SEQ ID NO: 222144 - DNA, 20 bp, Artificial
  CRISPR gRNA sequence
aagtcagtctctcaaaccct

SEQ ID NO: 222145 - DNA, 20 bp, Artificial
  CRISPR gRNA sequence
tcaaacccttggtttataac

SEQ ID NO: 222146 - DNA, 20 bp, Artificial
  CRISPR gRNA sequence
aaacccttggtttataacta

SEQ ID NO: 222147 - DNA, 20 bp, Artificial
  CRISPR gRNA sequence
ggtttataactacctatgtg

SEQ ID NO: 222148 - DNA, 20 bp, Artificial
  CRISPR gRNA sequence
gtttataactacctatgtgc

SEQ ID NO: 222149 - DNA, 20 bp, Artificial
  CRISPR gRNA sequence
ataactacctatgtgctgag

SEQ ID NO: 222150 - DNA, 20 bp, Artificial
  CRISPR gRNA sequence
taactacctatgtgctgaga

SEQ ID NO: 222151 - DNA, 20 bp, Artificial
  CRISPR gRNA sequence
cctatgtgctgagacatctt

SEQ ID NO: 222152 - DNA, 20 bp, Artificial
  CRISPR gRNA sequence
tgtgctgagacatctttctt

SEQ ID NO: 222153 - DNA, 20 bp, Artificial
  CRISPR gRNA sequence
agacatctttcttcatacat

SEQ ID NO: 222154 - DNA, 20 bp, Artificial
  CRISPR gRNA sequence
tcttcatacatgtccttttg

SEQ ID NO: 222155 - DNA, 20 bp, Artificial
  CRISPR gRNA sequence
cttcatacatgtccttttga

SEQ ID NO: 222156 - DNA, 20 bp, Artificial
  CRISPR gRNA sequence
ttcatacatgtccttttgaa

SEQ ID NO: 222157 - DNA, 20 bp, Artificial
  CRISPR gRNA sequence
catacatgtccttttgaagc

SEQ ID NO: 222158 - DNA, 20 bp, Artificial
  CRISPR gRNA sequence
atacatgtccttttgaagct

SEQ ID NO: 222159 - DNA, 20 bp, Artificial
  CRISPR gRNA sequence
ttgaagctatatattaaaca

SEQ ID NO: 222160 - DNA, 20 bp, Artificial
  CRISPR gRNA sequence
tgaagctatatattaaacac

SEQ ID NO: 222161 - DNA, 20 bp, Artificial
  CRISPR gRNA sequence
gaagctatatattaaacaca

SEQ ID NO: 222162 - DNA, 20 bp, Artificial
  CRISPR gRNA sequence
aagctatatattaaacacat

SEQ ID NO: 222163 - DNA, 20 bp, Artificial
  CRISPR gRNA sequence
tatattaaacacatacaaaa

SEQ ID NO: 222164 - DNA, 20 bp, Artificial
  CRISPR gRNA sequence
aacacatacaaaaacatatt

SEQ ID NO: 222165 - DNA, 20 bp, Artificial
  CRISPR gRNA sequence
tataacaaatactatcctgt

SEQ ID NO: 222166 - DNA, 20 bp, Artificial
  CRISPR gRNA sequence
ataacaaatactatcctgtt

SEQ ID NO: 222167 - DNA, 20 bp, Artificial
  CRISPR gRNA sequence
taacaaatactatcctgttt

SEQ ID NO: 222168 - DNA, 20 bp, Artificial
  CRISPR gRNA sequence
tcctgttttacagtccacac

SEQ ID NO: 222169 - DNA, 20 bp, Artificial
  CRISPR gRNA sequence
ttttacagtccacacttaac

SEQ ID NO: 222170 - DNA, 20 bp, Artificial
  CRISPR gRNA sequence
tacagtccacacttaacaca

SEQ ID NO: 222171 - DNA, 20 bp, Artificial
  CRISPR gRNA sequence
acagtccacacttaacacaa

SEQ ID NO: 222172 - DNA, 20 bp, Artificial
  CRISPR gRNA sequence
cagtccacacttaacacaac

SEQ ID NO: 222173 - DNA, 20 bp, Artificial
  CRISPR gRNA sequence
aacacaactcaactgcataa

SEQ ID NO: 222174 - DNA, 20 bp, Artificial
  CRISPR gRNA sequence
acacaactcaactgcataat

SEQ ID NO: 222175 - DNA, 20 bp, Artificial
  CRISPR gRNA sequence
aactgcataatgcctgtatt

SEQ ID NO: 222176 - DNA, 20 bp, Artificial
  CRISPR gRNA sequence
cataatgcctgtattttgct

SEQ ID NO: 222177 - DNA, 20 bp, Artificial
  CRISPR gRNA sequence
tattttgctttttttttagg

SEQ ID NO: 222178 - DNA, 20 bp, Artificial
  CRISPR gRNA sequence
tgctttttttttaggttaat

SEQ ID NO: 222179 - DNA, 20 bp, Artificial
  CRISPR gRNA sequence
gctttttttttaggttaata

SEQ ID NO: 222180 - DNA, 20 bp, Artificial
  CRISPR gRNA sequence
ctttttttttaggttaatat

SEQ ID NO: 222181 - DNA, 20 bp, Artificial
  CRISPR gRNA sequence
tttttttaggttaatattaa

SEQ ID NO: 222182 - DNA, 20 bp, Artificial
  CRISPR gRNA sequence
ttttttaggttaatattaac

SEQ ID NO: 222183 - DNA, 20 bp, Artificial
  CRISPR gRNA sequence
tttttaggttaatattaact

SEQ ID NO: 222184 - DNA, 20 bp, Artificial
  CRISPR gRNA sequence
ttttaggttaatattaacta

SEQ ID NO: 222185 - DNA, 20 bp, Artificial
  CRISPR gRNA sequence
tttaggttaatattaactaa

SEQ ID NO: 222186 - DNA, 20 bp, Artificial
  CRISPR gRNA sequence
ttaggttaatattaactaag

SEQ ID NO: 222187 - DNA, 20 bp, Artificial
  CRISPR gRNA sequence
taggttaatattaactaagt

SEQ ID NO: 222188 - DNA, 20 bp, Artificial
  CRISPR gRNA sequence
aggttaatattaactaagta

SEQ ID NO: 222189 - DNA, 20 bp, Artificial
  CRISPR gRNA sequence
ggttaatattaactaagtaa

SEQ ID NO: 222190 - DNA, 20 bp, Artificial
  CRISPR gRNA sequence
atattaactaagtaaaataa

SEQ ID NO: 222191 - DNA, 20 bp, Artificial
  CRISPR gRNA sequence
actaagtaaaataaaatact

SEQ ID NO: 222192 - DNA, 20 bp, Artificial
  CRISPR gRNA sequence
agtaaaataaaatactataa

SEQ ID NO: 222193 - DNA, 20 bp, Artificial
  CRISPR gRNA sequence
taaattctgaattcgatgac

SEQ ID NO: 222194 - DNA, 20 bp, Artificial
  CRISPR gRNA sequence
tgaattcgatgactctaggg

SEQ ID NO: 222195 - DNA, 20 bp, Artificial
  CRISPR gRNA sequence
aattcgatgactctagggat

SEQ ID NO: 222196 - DNA, 20 bp, Artificial
  CRISPR gRNA sequence
gatgactctagggattcgaa

SEQ ID NO: 222197 - DNA, 20 bp, Artificial
  CRISPR gRNA sequence
tagggattcgaacacattaa

SEQ ID NO: 222198 - DNA, 20 bp, Artificial
  CRISPR gRNA sequence
gggattcgaacacattaaaa

SEQ ID NO: 222199 - DNA, 20 bp, Artificial
  CRISPR gRNA sequence
gaacacattaaaattgtgtg

SEQ ID NO: 222200 - DNA, 20 bp, Artificial
  CRISPR gRNA sequence
aaattgtgtgtaaacgagtg

SEQ ID NO: 222201 - DNA, 20 bp, Artificial
  CRISPR gRNA sequence
tgtgtaaacgagtgctaatt

SEQ ID NO: 222202 - DNA, 20 bp, Artificial
  CRISPR gRNA sequence
attacatgatattaactatt

SEQ ID NO: 222203 - DNA, 20 bp, Artificial
  CRISPR gRNA sequence
catgatattaactattacta

SEQ ID NO: 222204 - DNA, 20 bp, Artificial
  CRISPR gRNA sequence
actattactaaagaaggcct

SEQ ID NO: 222205 - DNA, 20 bp, Artificial
  CRISPR gRNA sequence
ttactaaagaaggcctaaca

SEQ ID NO: 222206 - DNA, 20 bp, Artificial
  CRISPR gRNA sequence
ctaaagaaggcctaacataa

SEQ ID NO: 222207 - DNA, 20 bp, Artificial
  CRISPR gRNA sequence
aagaaggcctaacataaatc

SEQ ID NO: 222208 - DNA, 20 bp, Artificial
  CRISPR gRNA sequence
acataaatcctatcactcaa

SEQ ID NO: 222209 - DNA, 20 bp, Artificial
  CRISPR gRNA sequence
tcactcaaagtaccattcca

SEQ ID NO: 222210 - DNA, 20 bp, Artificial
  CRISPR gRNA sequence
aaagtaccattccaacagtt

SEQ ID NO: 222211 - DNA, 20 bp, Artificial
  CRISPR gRNA sequence
caacagttctaaactacgtg

SEQ ID NO: 222212 - DNA, 20 bp, Artificial
  CRISPR gRNA sequence
taaactacgtgatttaaatc

SEQ ID NO: 222213 - DNA, 20 bp, Artificial
  CRISPR gRNA sequence
aactacgtgatttaaatcta

SEQ ID NO: 222214 - DNA, 20 bp, Artificial
  CRISPR gRNA sequence
cgtgatttaaatctaaccta

SEQ ID NO: 222215 - DNA, 20 bp, Artificial
  CRISPR gRNA sequence
aaatctaacctacctgtttt

SEQ ID NO: 222216 - DNA, 20 bp, Artificial
  CRISPR gRNA sequence
aatctaacctacctgtttta

SEQ ID NO: 222217 - DNA, 20 bp, Artificial
  CRISPR gRNA sequence
acctacctgttttaaaaata

SEQ ID NO: 222218 - DNA, 20 bp, Artificial
  CRISPR gRNA sequence
cctgttttaaaaatagtata

SEQ ID NO: 222219 - DNA, 20 bp, Artificial
  CRISPR gRNA sequence
ttttaaaaatagtatatggt

SEQ ID NO: 222220 - DNA, 20 bp, Artificial
  CRISPR gRNA sequence
taaaaatagtatatggttta

SEQ ID NO: 222221 - DNA, 20 bp, Artificial
  CRISPR gRNA sequence
aaaaatagtatatggtttat

SEQ ID NO: 222222 - DNA, 20 bp, Artificial
  CRISPR gRNA sequence
aaaatagtatatggtttata

SEQ ID NO: 222223 - DNA, 20 bp, Artificial
  CRISPR gRNA sequence
atactttttactttttaggc

SEQ ID NO: 222224 - DNA, 20 bp, Artificial
  CRISPR gRNA sequence
tactttttactttttaggca

SEQ ID NO: 222225 - DNA, 20 bp, Artificial
  CRISPR gRNA sequence
tttactttttaggcagtttg

SEQ ID NO: 222226 - DNA, 20 bp, Artificial
  CRISPR gRNA sequence
ttactttttaggcagtttga

SEQ ID NO: 222227 - DNA, 20 bp, Artificial
  CRISPR gRNA sequence
tactttttaggcagtttgaa

SEQ ID NO: 222228 - DNA, 20 bp, Artificial
  CRISPR gRNA sequence
actttttaggcagtttgaat

SEQ ID NO: 222229 - DNA, 20 bp, Artificial
  CRISPR gRNA sequence
ctttttaggcagtttgaata

SEQ ID NO: 222230 - DNA, 20 bp, Artificial
  CRISPR gRNA sequence
tttaggcagtttgaataaat

SEQ ID NO: 222231 - DNA, 20 bp, Artificial
  CRISPR gRNA sequence
ttaggcagtttgaataaatg

SEQ ID NO: 222232 - DNA, 20 bp, Artificial
  CRISPR gRNA sequence
taggcagtttgaataaatga

SEQ ID NO: 222233 - DNA, 20 bp, Artificial
  CRISPR gRNA sequence
aggcagtttgaataaatgat

SEQ ID NO: 222234 - DNA, 20 bp, Artificial
  CRISPR gRNA sequence
ggcagtttgaataaatgata

SEQ ID NO: 222235 - DNA, 20 bp, Artificial
  CRISPR gRNA sequence
gaataaatgatactgtatca

SEQ ID NO: 222236 - DNA, 20 bp, Artificial
  CRISPR gRNA sequence
aataaatgatactgtatcac

SEQ ID NO: 222237 - DNA, 20 bp, Artificial
  CRISPR gRNA sequence
tatcacttcatatctggttc

SEQ ID NO: 222238 - DNA, 20 bp, Artificial
  CRISPR gRNA sequence
catatctggttcaatatgaa

SEQ ID NO: 222239 - DNA, 20 bp, Artificial
  CRISPR gRNA sequence
atatctggttcaatatgaag

SEQ ID NO: 222240 - DNA, 20 bp, Artificial
  CRISPR gRNA sequence
gttcaatatgaaggcgttct

SEQ ID NO: 222241 - DNA, 20 bp, Artificial
  CRISPR gRNA sequence
aatatgaaggcgttctgaaa

SEQ ID NO: 222242 - DNA, 20 bp, Artificial
  CRISPR gRNA sequence
tgaaattattatgcgattat

SEQ ID NO: 222243 - DNA, 20 bp, Artificial
  CRISPR gRNA sequence
aaattattatgcgattatac

SEQ ID NO: 222244 - DNA, 20 bp, Artificial
  CRISPR gRNA sequence
ttatgcgattatacaacaca

SEQ ID NO: 222245 - DNA, 20 bp, Artificial
  CRISPR gRNA sequence
tgcgattatacaacacatct

SEQ ID NO: 222246 - DNA, 20 bp, Artificial
  CRISPR gRNA sequence
tacaacacatctctgaaagc

SEQ ID NO: 222247 - DNA, 20 bp, Artificial
  CRISPR gRNA sequence
tgaaagcagtattattttag

SEQ ID NO: 222248 - DNA, 20 bp, Artificial
  CRISPR gRNA sequence
aaagcagtattattttagct

SEQ ID NO: 222249 - DNA, 20 bp, Artificial
  CRISPR gRNA sequence
ttttagctataatgatagta

SEQ ID NO: 222250 - DNA, 20 bp, Artificial
  CRISPR gRNA sequence
tagctataatgatagtaaag

SEQ ID NO: 222251 - DNA, 20 bp, Artificial
  CRISPR gRNA sequence
agctataatgatagtaaagg

SEQ ID NO: 222252 - DNA, 20 bp, Artificial
  CRISPR gRNA sequence
gctataatgatagtaaaggc

SEQ ID NO: 222253 - DNA, 20 bp, Artificial
  CRISPR gRNA sequence
taatgatagtaaaggcaaca

SEQ ID NO: 222254 - DNA, 20 bp, Artificial
  CRISPR gRNA sequence
aacgtgatgacaggaaacac

SEQ ID NO: 222255 - DNA, 20 bp, Artificial
  CRISPR gRNA sequence
acatcaaccatttagataac

SEQ ID NO: 222256 - DNA, 20 bp, Artificial
  CRISPR gRNA sequence
agataacggagacctggatt

SEQ ID NO: 222257 - DNA, 20 bp, Artificial
  CRISPR gRNA sequence
gataacggagacctggattc

SEQ ID NO: 222258 - DNA, 20 bp, Artificial
  CRISPR gRNA sequence
gattcacagtcccaacatcc

SEQ ID NO: 222259 - DNA, 20 bp, Artificial
  CRISPR gRNA sequence
acagtcccaacatccaggat

SEQ ID NO: 222260 - DNA, 20 bp, Artificial
  CRISPR gRNA sequence
ggggagggaggaaagtggta

SEQ ID NO: 222261 - DNA, 20 bp, Artificial
  CRISPR gRNA sequence
aagggcatcttggaaatacc

SEQ ID NO: 222262 - DNA, 20 bp, Artificial
  CRISPR gRNA sequence
agggcatcttggaaatacct

SEQ ID NO: 222263 - DNA, 20 bp, Artificial
  CRISPR gRNA sequence
ggaaatacctaaagtcacaa

SEQ ID NO: 222264 - DNA, 20 bp, Artificial
  CRISPR gRNA sequence
gaaatacctaaagtcacaag

SEQ ID NO: 222265 - DNA, 20 bp, Artificial
  CRISPR gRNA sequence
aagtcacaagcctttaggaa

SEQ ID NO: 222266 - DNA, 20 bp, Artificial
  CRISPR gRNA sequence
taggaacggcacaccgaggc

SEQ ID NO: 222267 - DNA, 20 bp, Artificial
  CRISPR gRNA sequence
aggaacggcacaccgaggct

SEQ ID NO: 222268 - DNA, 20 bp, Artificial
  CRISPR gRNA sequence
ggaacggcacaccgaggcta

SEQ ID NO: 222269 - DNA, 20 bp, Artificial
  CRISPR gRNA sequence
ataatcagtttaaaatcgaa

SEQ ID NO: 222270 - DNA, 20 bp, Artificial
  CRISPR gRNA sequence
aaaatcgaattaatttagca

SEQ ID NO: 222271 - DNA, 20 bp, Artificial
  CRISPR gRNA sequence
aaatcgaattaatttagcat

SEQ ID NO: 222272 - DNA, 20 bp, Artificial
  CRISPR gRNA sequence
atttagcattctagaataaa

SEQ ID NO: 222273 - DNA, 20 bp, Artificial
  CRISPR gRNA sequence
agcattctagaataaatgta

SEQ ID NO: 222274 - DNA, 20 bp, Artificial
  CRISPR gRNA sequence
gcattctagaataaatgtaa

SEQ ID NO: 222275 - DNA, 20 bp, Artificial
  CRISPR gRNA sequence
tagaataaatgtaacaattg

SEQ ID NO: 222276 - DNA, 20 bp, Artificial
  CRISPR gRNA sequence
gaataaatgtaacaattgct

SEQ ID NO: 222277 - DNA, 20 bp, Artificial
  CRISPR gRNA sequence
ctgtcactggtgctcaagct

SEQ ID NO: 222278 - DNA, 20 bp, Artificial
  CRISPR gRNA sequence
tcactggtgctcaagctgaa

SEQ ID NO: 222279 - DNA, 20 bp, Artificial
  CRISPR gRNA sequence
gtgctcaagctgaattctga

SEQ ID NO: 222280 - DNA, 20 bp, Artificial
  CRISPR gRNA sequence
aagctgaattctgaatctta

SEQ ID NO: 222281 - DNA, 20 bp, Artificial
  CRISPR gRNA sequence
aattctgaatcttataaaag

SEQ ID NO: 222282 - DNA, 20 bp, Artificial
  CRISPR gRNA sequence
tgaatcttataaaagttcac

SEQ ID NO: 222283 - DNA, 20 bp, Artificial
  CRISPR gRNA sequence
aatcttataaaagttcacaa

SEQ ID NO: 222284 - DNA, 20 bp, Artificial
  CRISPR gRNA sequence
ataaaagttcacaaaaggct

SEQ ID NO: 222285 - DNA, 20 bp, Artificial
  CRISPR gRNA sequence
taaaagttcacaaaaggctc

SEQ ID NO: 222286 - DNA, 20 bp, Artificial
  CRISPR gRNA sequence
acaaaaggctctatggatgt

SEQ ID NO: 222287 - DNA, 20 bp, Artificial
  CRISPR gRNA sequence
tatggatgtgaagtgtgaca

SEQ ID NO: 222288 - DNA, 20 bp, Artificial
  CRISPR gRNA sequence
tggatgtgaagtgtgacagg

SEQ ID NO: 222289 - DNA, 20 bp, Artificial
  CRISPR gRNA sequence
actgtagagctacgaatgtt

SEQ ID NO: 222290 - DNA, 20 bp, Artificial
  CRISPR gRNA sequence
tagagctacgaatgtttcta

SEQ ID NO: 222291 - DNA, 20 bp, Artificial
  CRISPR gRNA sequence
cgaatgtttctattccttgc

SEQ ID NO: 222292 - DNA, 20 bp, Artificial
  CRISPR gRNA sequence
ctattccttgctcagttttt

SEQ ID NO: 222293 - DNA, 20 bp, Artificial
  CRISPR gRNA sequence
tattccttgctcagttttta

SEQ ID NO: 222294 - DNA, 20 bp, Artificial
  CRISPR gRNA sequence
ttccttgctcagtttttaca

SEQ ID NO: 222295 - DNA, 20 bp, Artificial
  CRISPR gRNA sequence
cttgctcagtttttacagac

SEQ ID NO: 222296 - DNA, 20 bp, Artificial
  CRISPR gRNA sequence
gctcagtttttacagacgaa

SEQ ID NO: 222297 - DNA, 20 bp, Artificial
  CRISPR gRNA sequence
ctcagtttttacagacgaag

SEQ ID NO: 222298 - DNA, 20 bp, Artificial
  CRISPR gRNA sequence
agtttttacagacgaagcac

SEQ ID NO: 222299 - DNA, 20 bp, Artificial
  CRISPR gRNA sequence
ttacagacgaagcacacgtt

SEQ ID NO: 222300 - DNA, 20 bp, Artificial
  CRISPR gRNA sequence
tacagacgaagcacacgttt

SEQ ID NO: 222301 - DNA, 20 bp, Artificial
  CRISPR gRNA sequence
acagacgaagcacacgtttt

SEQ ID NO: 222302 - DNA, 20 bp, Artificial
  CRISPR gRNA sequence
cagacgaagcacacgtttta

SEQ ID NO: 222303 - DNA, 20 bp, Artificial
  CRISPR gRNA sequence
tacaaaagcgaaatggattc

SEQ ID NO: 222304 - DNA, 20 bp, Artificial
  CRISPR gRNA sequence
acaaaagcgaaatggattcc

SEQ ID NO: 222305 - DNA, 20 bp, Artificial
  CRISPR gRNA sequence
caaaagcgaaatggattcca

SEQ ID NO: 222306 - DNA, 20 bp, Artificial
  CRISPR gRNA sequence
caaaagctcggggtgggggt

SEQ ID NO: 222307 - DNA, 20 bp, Artificial
  CRISPR gRNA sequence
ggggtgggggtgggggggtg

SEQ ID NO: 222308 - DNA, 20 bp, Artificial
  CRISPR gRNA sequence
tttggcgtcgaaaaacacca

SEQ ID NO: 222309 - DNA, 20 bp, Artificial
  CRISPR gRNA sequence
tggcgtcgaaaaacaccaaa

SEQ ID NO: 222310 - DNA, 20 bp, Artificial
  CRISPR gRNA sequence
ggcgtcgaaaaacaccaaat

SEQ ID NO: 222311 - DNA, 20 bp, Artificial
  CRISPR gRNA sequence
gcgtcgaaaaacaccaaatc

SEQ ID NO: 222312 - DNA, 20 bp, Artificial
  CRISPR gRNA sequence
tgctgcacatgttttgactg

SEQ ID NO: 222313 - DNA, 20 bp, Artificial
  CRISPR gRNA sequence
ctgcacatgttttgactgga

SEQ ID NO: 222314 - DNA, 20 bp, Artificial
  CRISPR gRNA sequence
cacatgttttgactggaggt

SEQ ID NO: 222315 - DNA, 20 bp, Artificial
  CRISPR gRNA sequence
tgactggaggttactgtctt

SEQ ID NO: 222316 - DNA, 20 bp, Artificial
  CRISPR gRNA sequence
gactggaggttactgtcttc

SEQ ID NO: 222317 - DNA, 20 bp, Artificial
  CRISPR gRNA sequence
actggaggttactgtcttcc

SEQ ID NO: 222318 - DNA, 20 bp, Artificial
  CRISPR gRNA sequence
gaggttactgtcttcctatt

SEQ ID NO: 222319 - DNA, 20 bp, Artificial
  CRISPR gRNA sequence
ctgtcttcctatttcaggcg

SEQ ID NO: 222320 - DNA, 20 bp, Artificial
  CRISPR gRNA sequence
tcttcctatttcaggcgaaa

SEQ ID NO: 222321 - DNA, 20 bp, Artificial
  CRISPR gRNA sequence
cctatttcaggcgaaaacca

SEQ ID NO: 222322 - DNA, 20 bp, Artificial
  CRISPR gRNA sequence
ctatttcaggcgaaaaccag

SEQ ID NO: 222323 - DNA, 20 bp, Artificial
  CRISPR gRNA sequence
tttcaggcgaaaaccagatt

SEQ ID NO: 222324 - DNA, 20 bp, Artificial
  CRISPR gRNA sequence
caggcgaaaaccagattact

SEQ ID NO: 222325 - DNA, 20 bp, Artificial
  CRISPR gRNA sequence
aggcgaaaaccagattactt

SEQ ID NO: 222326 - DNA, 20 bp, Artificial
  CRISPR gRNA sequence
cttttaaaacggttccccca

SEQ ID NO: 222327 - DNA, 20 bp, Artificial
  CRISPR gRNA sequence
ttaaaacggttcccccaaat

SEQ ID NO: 222328 - DNA, 20 bp, Artificial
  CRISPR gRNA sequence
taaaacggttcccccaaata

SEQ ID NO: 222329 - DNA, 20 bp, Artificial
  CRISPR gRNA sequence
aaaacggttcccccaaataa

SEQ ID NO: 222330 - DNA, 20 bp, Artificial
  CRISPR gRNA sequence
aaacggttcccccaaataaa

SEQ ID NO: 222331 - DNA, 20 bp, Artificial
  CRISPR gRNA sequence
ccccaaataaagtgggaaaa

SEQ ID NO: 222332 - DNA, 20 bp, Artificial
  CRISPR gRNA sequence
caacgtacaatttagaatgt

SEQ ID NO: 222333 - DNA, 20 bp, Artificial
  CRISPR gRNA sequence
aacgtacaatttagaatgta

SEQ ID NO: 222334 - DNA, 20 bp, Artificial
  CRISPR gRNA sequence
agaatgtatgcaagtggctg

SEQ ID NO: 222335 - DNA, 20 bp, Artificial
  CRISPR gRNA sequence
gaatgtatgcaagtggctga

SEQ ID NO: 222336 - DNA, 20 bp, Artificial
  CRISPR gRNA sequence
atggggcgtgagggtcacga

SEQ ID NO: 222337 - DNA, 20 bp, Artificial
  CRISPR gRNA sequence
ccagcaagcttatttttagg

SEQ ID NO: 222338 - DNA, 20 bp, Artificial
  CRISPR gRNA sequence
cagcaagcttatttttagga

SEQ ID NO: 222339 - DNA, 20 bp, Artificial
  CRISPR gRNA sequence
atttttaggattaaaaacga

SEQ ID NO: 222340 - DNA, 20 bp, Artificial
  CRISPR gRNA sequence
tttttaggattaaaaacgac

SEQ ID NO: 222341 - DNA, 20 bp, Artificial
  CRISPR gRNA sequence
ttaggattaaaaacgacagc

SEQ ID NO: 222342 - DNA, 20 bp, Artificial
  CRISPR gRNA sequence
taggattaaaaacgacagca

SEQ ID NO: 222343 - DNA, 20 bp, Artificial
  CRISPR gRNA sequence
aggattaaaaacgacagcaa

SEQ ID NO: 222344 - DNA, 20 bp, Artificial
  CRISPR gRNA sequence
ggattaaaaacgacagcaaa

SEQ ID NO: 222345 - DNA, 20 bp, Artificial
  CRISPR gRNA sequence
aaaacgacagcaaaaattac

SEQ ID NO: 222346 - DNA, 20 bp, Artificial
  CRISPR gRNA sequence
cacggccggaagattcttct

SEQ ID NO: 222347 - DNA, 20 bp, Artificial
  CRISPR gRNA sequence
ttctgattgaatgctgagtt

SEQ ID NO: 222348 - DNA, 20 bp, Artificial
  CRISPR gRNA sequence
ctgattgaatgctgagttga

SEQ ID NO: 222349 - DNA, 20 bp, Artificial
  CRISPR gRNA sequence
tgattgaatgctgagttgaa

SEQ ID NO: 222350 - DNA, 20 bp, Artificial
  CRISPR gRNA sequence
attgaatgctgagttgaaaa

SEQ ID NO: 222351 - DNA, 20 bp, Artificial
  CRISPR gRNA sequence
aatgctgagttgaaaatgaa

SEQ ID NO: 222352 - DNA, 20 bp, Artificial
  CRISPR gRNA sequence
agttgaaaatgaaacttaat

SEQ ID NO: 222353 - DNA, 20 bp, Artificial
  CRISPR gRNA sequence
aaaatgaaacttaattgtgt

SEQ ID NO: 222354 - DNA, 20 bp, Artificial
  CRISPR gRNA sequence
aattgtgtcctttacgtcct

SEQ ID NO: 222355 - DNA, 20 bp, Artificial
  CRISPR gRNA sequence
attgtgtcctttacgtcctc

SEQ ID NO: 222356 - DNA, 20 bp, Artificial
  CRISPR gRNA sequence
tgtcctttacgtcctcttcg

SEQ ID NO: 222357 - DNA, 20 bp, Artificial
  CRISPR gRNA sequence
tacgtcctcttcgctcctat

SEQ ID NO: 222358 - DNA, 20 bp, Artificial
  CRISPR gRNA sequence
acgtcctcttcgctcctatg

SEQ ID NO: 222359 - DNA, 20 bp, Artificial
  CRISPR gRNA sequence
cgtcctcttcgctcctatgt

SEQ ID NO: 222360 - DNA, 20 bp, Artificial
  CRISPR gRNA sequence
ttcgctcctatgttcatgtg

SEQ ID NO: 222361 - DNA, 20 bp, Artificial
  CRISPR gRNA sequence
cgctcctatgttcatgtggg

SEQ ID NO: 222362 - DNA, 20 bp, Artificial
  CRISPR gRNA sequence
gctcctatgttcatgtggga

SEQ ID NO: 222363 - DNA, 20 bp, Artificial
  CRISPR gRNA sequence
ctatgttcatgtgggaggca

SEQ ID NO: 222364 - DNA, 20 bp, Artificial
  CRISPR gRNA sequence
tgttcatgtgggaggcaaac

SEQ ID NO: 222365 - DNA, 20 bp, Artificial
  CRISPR gRNA sequence
atgtgggaggcaaacggcag

SEQ ID NO: 222366 - DNA, 20 bp, Artificial
  CRISPR gRNA sequence
ctcaccgacttcgccaaaat

SEQ ID NO: 222367 - DNA, 20 bp, Artificial
  CRISPR gRNA sequence
tcaccgacttcgccaaaatg

SEQ ID NO: 222368 - DNA, 20 bp, Artificial
  CRISPR gRNA sequence
accgacttcgccaaaatgcg

SEQ ID NO: 222369 - DNA, 20 bp, Artificial
  CRISPR gRNA sequence
cgccaaaatgcgcacttcca

SEQ ID NO: 222370 - DNA, 20 bp, Artificial
  CRISPR gRNA sequence
gccaaaatgcgcacttccat

SEQ ID NO: 222371 - DNA, 20 bp, Artificial
  CRISPR gRNA sequence
ccatcgcaagaggcccgggc

SEQ ID NO: 222372 - DNA, 20 bp, Artificial
  CRISPR gRNA sequence
catcgcaagaggcccgggcc

SEQ ID NO: 222373 - DNA, 20 bp, Artificial
  CRISPR gRNA sequence
ccactctccctccctcaacc

SEQ ID NO: 222374 - DNA, 20 bp, Artificial
  CRISPR gRNA sequence
tccctccctcaaccccaaat

SEQ ID NO: 222375 - DNA, 20 bp, Artificial
  CRISPR gRNA sequence
cctccctcaaccccaaatgc

SEQ ID NO: 222376 - DNA, 20 bp, Artificial
  CRISPR gRNA sequence
cctcaaccccaaatgcgtct

SEQ ID NO: 222377 - DNA, 20 bp, Artificial
  CRISPR gRNA sequence
aaccccaaatgcgtctaagc

SEQ ID NO: 222378 - DNA, 20 bp, Artificial
  CRISPR gRNA sequence
agcactgagaagggagaggg

SEQ ID NO: 222379 - DNA, 20 bp, Artificial
  CRISPR gRNA sequence
agaagggagaggggtgcgaa

SEQ ID NO: 222380 - DNA, 20 bp, Artificial
  CRISPR gRNA sequence
gcagctgcagccccttgcct

SEQ ID NO: 222381 - DNA, 20 bp, Artificial
  CRISPR gRNA sequence
cagccccttgcctctgatcg

SEQ ID NO: 222382 - DNA, 20 bp, Artificial
  CRISPR gRNA sequence
gcctctgatcgcgccctttc

SEQ ID NO: 222383 - DNA, 20 bp, Artificial
  CRISPR gRNA sequence
cctctgatcgcgccctttct

SEQ ID NO: 222384 - DNA, 20 bp, Artificial
  CRISPR gRNA sequence
tgatcgcgccctttcttgct

SEQ ID NO: 222385 - DNA, 20 bp, Artificial
  CRISPR gRNA sequence
atcgcgccctttcttgctag

SEQ ID NO: 222386 - DNA, 20 bp, Artificial
  CRISPR gRNA sequence
tcttgctagttaatttttgc

SEQ ID NO: 222387 - DNA, 20 bp, Artificial
  CRISPR gRNA sequence
cttgctagttaatttttgcg

SEQ ID NO: 222388 - DNA, 20 bp, Artificial
  CRISPR gRNA sequence
ttgctagttaatttttgcgc

SEQ ID NO: 222389 - DNA, 20 bp, Artificial
  CRISPR gRNA sequence
gctagttaatttttgcgcga

SEQ ID NO: 222390 - DNA, 20 bp, Artificial
  CRISPR gRNA sequence
ctagttaatttttgcgcgag

SEQ ID NO: 222391 - DNA, 20 bp, Artificial
  CRISPR gRNA sequence
gttaatttttgcgcgaggtg

SEQ ID NO: 222392 - DNA, 20 bp, Artificial
  CRISPR gRNA sequence
atttttgcgcgaggtgcgcg

SEQ ID NO: 222393 - DNA, 20 bp, Artificial
  CRISPR gRNA sequence
ttgcgcgaggtgcgcggttt

SEQ ID NO: 222394 - DNA, 20 bp, Artificial
  CRISPR gRNA sequence
tgcgcgaggtgcgcggtttg

SEQ ID NO: 222395 - DNA, 20 bp, Artificial
  CRISPR gRNA sequence
gcgcgaggtgcgcggtttgg

SEQ ID NO: 222396 - DNA, 20 bp, Artificial
  CRISPR gRNA sequence
cgcgaggtgcgcggtttgga

SEQ ID NO: 222397 - DNA, 20 bp, Artificial
  CRISPR gRNA sequence
ggagtcttcctgtgtgtgtg

SEQ ID NO: 222398 - DNA, 20 bp, Artificial
  CRISPR gRNA sequence
gagtcttcctgtgtgtgtgc

SEQ ID NO: 222399 - DNA, 20 bp, Artificial
  CRISPR gRNA sequence
cctgtgtgtgtgcatttgga

SEQ ID NO: 222400 - DNA, 20 bp, Artificial
  CRISPR gRNA sequence
ctgtgtgtgtgcatttggag

SEQ ID NO: 222401 - DNA, 20 bp, Artificial
  CRISPR gRNA sequence
tgtgtgtgcatttggagatg

SEQ ID NO: 222402 - DNA, 20 bp, Artificial
  CRISPR gRNA sequence
ggagatggagaaccgggtgg

SEQ ID NO: 222403 - DNA, 20 bp, Artificial
  CRISPR gRNA sequence
gagatggagaaccgggtgga

SEQ ID NO: 222404 - DNA, 20 bp, Artificial
  CRISPR gRNA sequence
tcacccagggggaagaagac

SEQ ID NO: 222405 - DNA, 20 bp, Artificial
  CRISPR gRNA sequence
acccagggggaagaagacga

SEQ ID NO: 222406 - DNA, 20 bp, Artificial
  CRISPR gRNA sequence
cccgtggggccctcccacgt

SEQ ID NO: 222407 - DNA, 20 bp, Artificial
  CRISPR gRNA sequence
ccacgtctgcacttcgggcg

SEQ ID NO: 222408 - DNA, 20 bp, Artificial
  CRISPR gRNA sequence
cacttcgggcgctcagggcc

SEQ ID NO: 222409 - DNA, 20 bp, Artificial
  CRISPR gRNA sequence
cgggcgctcagggcccgagt

SEQ ID NO: 222410 - DNA, 20 bp, Artificial
  CRISPR gRNA sequence
gggcgctcagggcccgagtg

SEQ ID NO: 222411 - DNA, 20 bp, Artificial
  CRISPR gRNA sequence
agggcccgagtgttctgcgc

SEQ ID NO: 222412 - DNA, 20 bp, Artificial
  CRISPR gRNA sequence
tgcgccccggccaccctctt

SEQ ID NO: 222413 - DNA, 20 bp, Artificial
  CRISPR gRNA sequence
cgccccggccaccctcttca

SEQ ID NO: 222414 - DNA, 20 bp, Artificial
  CRISPR gRNA sequence
ttcagggcgccgccgggctg

SEQ ID NO: 222415 - DNA, 20 bp, Artificial
  CRISPR gRNA sequence
cagggcgccgccgggctggc

SEQ ID NO: 222416 - DNA, 20 bp, Artificial
  CRISPR gRNA sequence
agggcgccgccgggctggct

SEQ ID NO: 222417 - DNA, 20 bp, Artificial
  CRISPR gRNA sequence
gctggggcgcagcccacacg

SEQ ID NO: 222418 - DNA, 20 bp, Artificial
  CRISPR gRNA sequence
gggcgcagcccacacgcccg

SEQ ID NO: 222419 - DNA, 20 bp, Artificial
  CRISPR gRNA sequence
ggagcgaggagccactcacc

SEQ ID NO: 222420 - DNA, 20 bp, Artificial
  CRISPR gRNA sequence
accgcagcacgccgagccca

SEQ ID NO: 222421 - DNA, 20 bp, Artificial
  CRISPR gRNA sequence
ccaggggccacatctccgcg

SEQ ID NO: 222422 - DNA, 20 bp, Artificial
  CRISPR gRNA sequence
cgcgcccgccgcggggtcgc

SEQ ID NO: 222423 - DNA, 20 bp, Artificial
  CRISPR gRNA sequence
caggcaggaccgaccgccgc

SEQ ID NO: 222424 - DNA, 20 bp, Artificial
  CRISPR gRNA sequence
cccaggctgcacggccgcgc

SEQ ID NO: 222425 - DNA, 20 bp, Artificial
  CRISPR gRNA sequence
cacggccgcgcgcacgcgcg

SEQ ID NO: 222426 - DNA, 20 bp, Artificial
  CRISPR gRNA sequence
ccactgcttcccgcccgctc

SEQ ID NO: 222427 - DNA, 20 bp, Artificial
  CRISPR gRNA sequence
cttcccgcccgctcccccgc

SEQ ID NO: 222428 - DNA, 20 bp, Artificial
  CRISPR gRNA sequence
cccgcccgctcccccgcctg

SEQ ID NO: 222429 - DNA, 20 bp, Artificial
  CRISPR gRNA sequence
ccgcccgctcccccgcctgc

SEQ ID NO: 222430 - DNA, 20 bp, Artificial
  CRISPR gRNA sequence
ccccgcctgctccccgcccg

SEQ ID NO: 222431 - DNA, 20 bp, Artificial
  CRISPR gRNA sequence
ctccccgcccgcgagagccg

SEQ ID NO: 222432 - DNA, 20 bp, Artificial
  CRISPR gRNA sequence
cccgcccgcgagagccgcgc

SEQ ID NO: 222433 - DNA, 20 bp, Artificial
  CRISPR gRNA sequence
ggccccgccccgcaaccgct

SEQ ID NO: 222434 - DNA, 20 bp, Artificial
  CRISPR gRNA sequence
ctgttgacgcggcgccctcc

SEQ ID NO: 222435 - DNA, 20 bp, Artificial
  CRISPR gRNA sequence
ttgacgcggcgccctcccca

SEQ ID NO: 222436 - DNA, 20 bp, Artificial
  CRISPR gRNA sequence
acgcggcgccctccccagtc

SEQ ID NO: 222437 - DNA, 20 bp, Artificial
  CRISPR gRNA sequence
cccagtcgcaggctccagac

SEQ ID NO: 222438 - DNA, 20 bp, Artificial
  CRISPR gRNA sequence
gagcctgcgactggggaggg

SEQ ID NO: 222439 - DNA, 20 bp, Artificial
  CRISPR gRNA sequence
cgactggggagggcgccgcg

SEQ ID NO: 222440 - DNA, 20 bp, Artificial
  CRISPR gRNA sequence
gggagggcgccgcgtcaaca

SEQ ID NO: 222441 - DNA, 20 bp, Artificial
  CRISPR gRNA sequence
cggggcggggccgagtgcgc

SEQ ID NO: 222442 - DNA, 20 bp, Artificial
  CRISPR gRNA sequence
tcgcgggcggggagcaggcg

SEQ ID NO: 222443 - DNA, 20 bp, Artificial
  CRISPR gRNA sequence
gcgggcggggagcaggcggg

SEQ ID NO: 222444 - DNA, 20 bp, Artificial
  CRISPR gRNA sequence
ggcagtgggtcctgcctgtg

SEQ ID NO: 222445 - DNA, 20 bp, Artificial
  CRISPR gRNA sequence
cctgtgacgcgcggcggcgg

SEQ ID NO: 222446 - DNA, 20 bp, Artificial
  CRISPR gRNA sequence
tgacgcgcggcggcggtcgg

SEQ ID NO: 222447 - DNA, 20 bp, Artificial
  CRISPR gRNA sequence
cctgtaacggcggcggcggc

SEQ ID NO: 222448 - DNA, 20 bp, Artificial
  CRISPR gRNA sequence
taacggcggcggcggctgct

SEQ ID NO: 222449 - DNA, 20 bp, Artificial
  CRISPR gRNA sequence
ctgctccggacacctgcggc

SEQ ID NO: 222450 - DNA, 20 bp, Artificial
  CRISPR gRNA sequence
ctccggacacctgcggcggc

SEQ ID NO: 222451 - DNA, 20 bp, Artificial
  CRISPR gRNA sequence
cggacacctgcggcggcggc

SEQ ID NO: 222452 - DNA, 20 bp, Artificial
  CRISPR gRNA sequence
cggcggcggcggcgaccccg

SEQ ID NO: 222453 - DNA, 20 bp, Artificial
  CRISPR gRNA sequence
gtagcggcgctgttgctggg

SEQ ID NO: 222454 - DNA, 20 bp, Artificial
  CRISPR gRNA sequence
ttgctgggctcggcgtgctg

SEQ ID NO: 222455 - DNA, 20 bp, Artificial
  CRISPR gRNA sequence
ctgggctcggcgtgctgcgg

SEQ ID NO: 222456 - DNA, 20 bp, Artificial
  CRISPR gRNA sequence
ggctcggcgtgctgcggtga

SEQ ID NO: 222457 - DNA, 20 bp, Artificial
  CRISPR gRNA sequence
ggcgtgctgcggtgagtggc

SEQ ID NO: 222458 - DNA, 20 bp, Artificial
  CRISPR gRNA sequence
cggtgagtggctcctcgctc

SEQ ID NO: 222459 - DNA, 20 bp, Artificial
  CRISPR gRNA sequence
ctcgctcccagccctgcggc

SEQ ID NO: 222460 - DNA, 20 bp, Artificial
  CRISPR gRNA sequence
gctcccagccctgcggctgc

SEQ ID NO: 222461 - DNA, 20 bp, Artificial
  CRISPR gRNA sequence
ccagccctgcggctgctgtc

SEQ ID NO: 222462 - DNA, 20 bp, Artificial
  CRISPR gRNA sequence
cggctgctgtcgcttcgccc

SEQ ID NO: 222463 - DNA, 20 bp, Artificial
  CRISPR gRNA sequence
ctgtcgcttcgcccccgcgg

SEQ ID NO: 222464 - DNA, 20 bp, Artificial
  CRISPR gRNA sequence
tcgcttcgcccccgcgggcg

SEQ ID NO: 222465 - DNA, 20 bp, Artificial
  CRISPR gRNA sequence
cgcccccgcgggcgtgtggg

SEQ ID NO: 222466 - DNA, 20 bp, Artificial
  CRISPR gRNA sequence
gcccccgcgggcgtgtgggc

SEQ ID NO: 222467 - DNA, 20 bp, Artificial
  CRISPR gRNA sequence
cgccccagccagcccggcgg

SEQ ID NO: 222468 - DNA, 20 bp, Artificial
  CRISPR gRNA sequence
aagagggtggccggggcgca

SEQ ID NO: 222469 - DNA, 20 bp, Artificial
  CRISPR gRNA sequence
gggccctgagcgcccgaagt

SEQ ID NO: 222470 - DNA, 20 bp, Artificial
  CRISPR gRNA sequence
agcgcccgaagtgcagacgt

SEQ ID NO: 222471 - DNA, 20 bp, Artificial
  CRISPR gRNA sequence
cttcctcccttcctttccct

SEQ ID NO: 222472 - DNA, 20 bp, Artificial
  CRISPR gRNA sequence
ttcctcccttcctttccctg

SEQ ID NO: 222473 - DNA, 20 bp, Artificial
  CRISPR gRNA sequence
cctcccttcctttccctggt

SEQ ID NO: 222474 - DNA, 20 bp, Artificial
  CRISPR gRNA sequence
ctcccttcctttccctggtc

SEQ ID NO: 222475 - DNA, 20 bp, Artificial
  CRISPR gRNA sequence
ccttcctttccctggtcgtc

SEQ ID NO: 222476 - DNA, 20 bp, Artificial
  CRISPR gRNA sequence
cctttccctggtcgtcttct

SEQ ID NO: 222477 - DNA, 20 bp, Artificial
  CRISPR gRNA sequence
ctttccctggtcgtcttctt

SEQ ID NO: 222478 - DNA, 20 bp, Artificial
  CRISPR gRNA sequence
tccctggtcgtcttcttccc

SEQ ID NO: 222479 - DNA, 20 bp, Artificial
  CRISPR gRNA sequence
ccctggtcgtcttcttcccc

SEQ ID NO: 222480 - DNA, 20 bp, Artificial
  CRISPR gRNA sequence
cctggtcgtcttcttccccc

SEQ ID NO: 222481 - DNA, 20 bp, Artificial
  CRISPR gRNA sequence
gtcgtcttcttccccctggg

SEQ ID NO: 222482 - DNA, 20 bp, Artificial
  CRISPR gRNA sequence
cttccccctgggtgagagcg

SEQ ID NO: 222483 - DNA, 20 bp, Artificial
  CRISPR gRNA sequence
ttccccctgggtgagagcgg

SEQ ID NO: 222484 - DNA, 20 bp, Artificial
  CRISPR gRNA sequence
ccccctgggtgagagcgggg

SEQ ID NO: 222485 - DNA, 20 bp, Artificial
  CRISPR gRNA sequence
cccctgggtgagagcggggc

SEQ ID NO: 222486 - DNA, 20 bp, Artificial
  CRISPR gRNA sequence
ggtgagagcggggctcatct

SEQ ID NO: 222487 - DNA, 20 bp, Artificial
  CRISPR gRNA sequence
atctcctccacccggttctc

SEQ ID NO: 222488 - DNA, 20 bp, Artificial
  CRISPR gRNA sequence
ctccacccggttctccatct

SEQ ID NO: 222489 - DNA, 20 bp, Artificial
  CRISPR gRNA sequence
cacccggttctccatctcca

SEQ ID NO: 222490 - DNA, 20 bp, Artificial
  CRISPR gRNA sequence
tccatctccaaatgcacaca

SEQ ID NO: 222491 - DNA, 20 bp, Artificial
  CRISPR gRNA sequence
catctccaaatgcacacaca

SEQ ID NO: 222492 - DNA, 20 bp, Artificial
  CRISPR gRNA sequence
caaatgcacacacacaggaa

SEQ ID NO: 222493 - DNA, 20 bp, Artificial
  CRISPR gRNA sequence
caaaccgcgcacctcgcgca

SEQ ID NO: 222494 - DNA, 20 bp, Artificial
  CRISPR gRNA sequence
gcgcaaaaattaactagcaa

SEQ ID NO: 222495 - DNA, 20 bp, Artificial
  CRISPR gRNA sequence
actagcaagaaagggcgcga

SEQ ID NO: 222496 - DNA, 20 bp, Artificial
  CRISPR gRNA sequence
gcaagaaagggcgcgatcag

SEQ ID NO: 222497 - DNA, 20 bp, Artificial
  CRISPR gRNA sequence
cagctgctagggatcccctt

SEQ ID NO: 222498 - DNA, 20 bp, Artificial
  CRISPR gRNA sequence
ctagggatccccttctttcg

SEQ ID NO: 222499 - DNA, 20 bp, Artificial
  CRISPR gRNA sequence
gggatccccttctttcgcac

SEQ ID NO: 222500 - DNA, 20 bp, Artificial
  CRISPR gRNA sequence
ctttcgcacccctctccctt

SEQ ID NO: 222501 - DNA, 20 bp, Artificial
  CRISPR gRNA sequence
tttcgcacccctctcccttc

SEQ ID NO: 222502 - DNA, 20 bp, Artificial
  CRISPR gRNA sequence
tcgcacccctctcccttctc

SEQ ID NO: 222503 - DNA, 20 bp, Artificial
  CRISPR gRNA sequence
cgcacccctctcccttctca

SEQ ID NO: 222504 - DNA, 20 bp, Artificial
  CRISPR gRNA sequence
gcacccctctcccttctcag

SEQ ID NO: 222505 - DNA, 20 bp, Artificial
  CRISPR gRNA sequence
tcccttctcagtgcttagac

SEQ ID NO: 222506 - DNA, 20 bp, Artificial
  CRISPR gRNA sequence
ccttctcagtgcttagacgc

SEQ ID NO: 222507 - DNA, 20 bp, Artificial
  CRISPR gRNA sequence
ctcagtgcttagacgcattt

SEQ ID NO: 222508 - DNA, 20 bp, Artificial
  CRISPR gRNA sequence
tcagtgcttagacgcatttg

SEQ ID NO: 222509 - DNA, 20 bp, Artificial
  CRISPR gRNA sequence
agtgcttagacgcatttggg

SEQ ID NO: 222510 - DNA, 20 bp, Artificial
  CRISPR gRNA sequence
agacgcatttggggttgagg

SEQ ID NO: 222511 - DNA, 20 bp, Artificial
  CRISPR gRNA sequence
gacgcatttggggttgaggg

SEQ ID NO: 222512 - DNA, 20 bp, Artificial
  CRISPR gRNA sequence
ggggttgagggagggagagt

SEQ ID NO: 222513 - DNA, 20 bp, Artificial
  CRISPR gRNA sequence
gggttgagggagggagagtg

SEQ ID NO: 222514 - DNA, 20 bp, Artificial
  CRISPR gRNA sequence
agggagggagagtgggaggg

SEQ ID NO: 222515 - DNA, 20 bp, Artificial
  CRISPR gRNA sequence
ttgcgatggaagtgcgcatt

SEQ ID NO: 222516 - DNA, 20 bp, Artificial
  CRISPR gRNA sequence
gcgatggaagtgcgcatttt

SEQ ID NO: 222517 - DNA, 20 bp, Artificial
  CRISPR gRNA sequence
cgatggaagtgcgcattttg

SEQ ID NO: 222518 - DNA, 20 bp, Artificial
  CRISPR gRNA sequence
tggcgaagtcggtgagaagg

SEQ ID NO: 222519 - DNA, 20 bp, Artificial
  CRISPR gRNA sequence
ggcgaagtcggtgagaaggg

SEQ ID NO: 222520 - DNA, 20 bp, Artificial
  CRISPR gRNA sequence
gcgaagtcggtgagaagggg

SEQ ID NO: 222521 - DNA, 20 bp, Artificial
  CRISPR gRNA sequence
ctgccgtttgcctcccacat

SEQ ID NO: 222522 - DNA, 20 bp, Artificial
  CRISPR gRNA sequence
tgccgtttgcctcccacatg

SEQ ID NO: 222523 - DNA, 20 bp, Artificial
  CRISPR gRNA sequence
ccgtttgcctcccacatgaa

SEQ ID NO: 222524 - DNA, 20 bp, Artificial
  CRISPR gRNA sequence
gcctcccacatgaacatagg

SEQ ID NO: 222525 - DNA, 20 bp, Artificial
  CRISPR gRNA sequence
cctcccacatgaacatagga

SEQ ID NO: 222526 - DNA, 20 bp, Artificial
  CRISPR gRNA sequence
ccacatgaacataggagcga

SEQ ID NO: 222527 - DNA, 20 bp, Artificial
  CRISPR gRNA sequence
agtttcattttcaactcagc

SEQ ID NO: 222528 - DNA, 20 bp, Artificial
  CRISPR gRNA sequence
cattttcaactcagcattca

SEQ ID NO: 222529 - DNA, 20 bp, Artificial
  CRISPR gRNA sequence
attttcaactcagcattcaa

SEQ ID NO: 222530 - DNA, 20 bp, Artificial
  CRISPR gRNA sequence
tcaactcagcattcaatcag

SEQ ID NO: 222531 - DNA, 20 bp, Artificial
  CRISPR gRNA sequence
caactcagcattcaatcaga

SEQ ID NO: 222532 - DNA, 20 bp, Artificial
  CRISPR gRNA sequence
aactcagcattcaatcagaa

SEQ ID NO: 222533 - DNA, 20 bp, Artificial
  CRISPR gRNA sequence
agcattcaatcagaagaatc

SEQ ID NO: 222534 - DNA, 20 bp, Artificial
  CRISPR gRNA sequence
aatcagaagaatcttccggc

SEQ ID NO: 222535 - DNA, 20 bp, Artificial
  CRISPR gRNA sequence
ccggccgtgtaatttttgct

SEQ ID NO: 222536 - DNA, 20 bp, Artificial
  CRISPR gRNA sequence
cggccgtgtaatttttgctg

SEQ ID NO: 222537 - DNA, 20 bp, Artificial
  CRISPR gRNA sequence
ttgctgtcgtttttaatcct

SEQ ID NO: 222538 - DNA, 20 bp, Artificial
  CRISPR gRNA sequence
tgctgtcgtttttaatccta

SEQ ID NO: 222539 - DNA, 20 bp, Artificial
  CRISPR gRNA sequence
gctgtcgtttttaatcctaa

SEQ ID NO: 222540 - DNA, 20 bp, Artificial
  CRISPR gRNA sequence
ctgtcgtttttaatcctaaa

SEQ ID NO: 222541 - DNA, 20 bp, Artificial
  CRISPR gRNA sequence
tcgtttttaatcctaaaaat

SEQ ID NO: 222542 - DNA, 20 bp, Artificial
  CRISPR gRNA sequence
ttaatcctaaaaataagctt

SEQ ID NO: 222543 - DNA, 20 bp, Artificial
  CRISPR gRNA sequence
taatcctaaaaataagcttg

SEQ ID NO: 222544 - DNA, 20 bp, Artificial
  CRISPR gRNA sequence
aatcctaaaaataagcttgc

SEQ ID NO: 222545 - DNA, 20 bp, Artificial
  CRISPR gRNA sequence
atcctaaaaataagcttgct

SEQ ID NO: 222546 - DNA, 20 bp, Artificial
  CRISPR gRNA sequence
aaaataagcttgctggaaac

SEQ ID NO: 222547 - DNA, 20 bp, Artificial
  CRISPR gRNA sequence
gctggaaactcttcctttct

SEQ ID NO: 222548 - DNA, 20 bp, Artificial
  CRISPR gRNA sequence
ctggaaactcttcctttctc

SEQ ID NO: 222549 - DNA, 20 bp, Artificial
  CRISPR gRNA sequence
gaaactcttcctttctcgtg

SEQ ID NO: 222550 - DNA, 20 bp, Artificial
  CRISPR gRNA sequence
ttcctttctcgtgaccctca

SEQ ID NO: 222551 - DNA, 20 bp, Artificial
  CRISPR gRNA sequence
cctttctcgtgaccctcacg

SEQ ID NO: 222552 - DNA, 20 bp, Artificial
  CRISPR gRNA sequence
ctttctcgtgaccctcacgc

SEQ ID NO: 222553 - DNA, 20 bp, Artificial
  CRISPR gRNA sequence
tctcgtgaccctcacgcccc

SEQ ID NO: 222554 - DNA, 20 bp, Artificial
  CRISPR gRNA sequence
ctcgtgaccctcacgcccca

SEQ ID NO: 222555 - DNA, 20 bp, Artificial
  CRISPR gRNA sequence
tcgtgaccctcacgccccat

SEQ ID NO: 222556 - DNA, 20 bp, Artificial
  CRISPR gRNA sequence
gtgaccctcacgccccatca

SEQ ID NO: 222557 - DNA, 20 bp, Artificial
  CRISPR gRNA sequence
acgccccatcagccacttgc

SEQ ID NO: 222558 - DNA, 20 bp, Artificial
  CRISPR gRNA sequence
gcatacattctaaattgtac

SEQ ID NO: 222559 - DNA, 20 bp, Artificial
  CRISPR gRNA sequence
catacattctaaattgtacg

SEQ ID NO: 222560 - DNA, 20 bp, Artificial
  CRISPR gRNA sequence
taaattgtacgttgaagttt

SEQ ID NO: 222561 - DNA, 20 bp, Artificial
  CRISPR gRNA sequence
aattgtacgttgaagttttt

SEQ ID NO: 222562 - DNA, 20 bp, Artificial
  CRISPR gRNA sequence
tacgttgaagtttttcccac

SEQ ID NO: 222563 - DNA, 20 bp, Artificial
  CRISPR gRNA sequence
aagtttttcccactttattt

SEQ ID NO: 222564 - DNA, 20 bp, Artificial
  CRISPR gRNA sequence
ttcccactttatttggggga

SEQ ID NO: 222565 - DNA, 20 bp, Artificial
  CRISPR gRNA sequence
tcccactttatttgggggaa

SEQ ID NO: 222566 - DNA, 20 bp, Artificial
  CRISPR gRNA sequence
cccactttatttgggggaac

SEQ ID NO: 222567 - DNA, 20 bp, Artificial
  CRISPR gRNA sequence
ccactttatttgggggaacc

SEQ ID NO: 222568 - DNA, 20 bp, Artificial
  CRISPR gRNA sequence
tatttgggggaaccgtttta

SEQ ID NO: 222569 - DNA, 20 bp, Artificial
  CRISPR gRNA sequence
atttgggggaaccgttttaa

SEQ ID NO: 222570 - DNA, 20 bp, Artificial
  CRISPR gRNA sequence
tttgggggaaccgttttaaa

SEQ ID NO: 222571 - DNA, 20 bp, Artificial
  CRISPR gRNA sequence
gggggaaccgttttaaaagt

SEQ ID NO: 222572 - DNA, 20 bp, Artificial
  CRISPR gRNA sequence
ggggaaccgttttaaaagta

SEQ ID NO: 222573 - DNA, 20 bp, Artificial
  CRISPR gRNA sequence
taaaagtaatctggttttcg

SEQ ID NO: 222574 - DNA, 20 bp, Artificial
  CRISPR gRNA sequence
aaaagtaatctggttttcgc

SEQ ID NO: 222575 - DNA, 20 bp, Artificial
  CRISPR gRNA sequence
aaagtaatctggttttcgcc

SEQ ID NO: 222576 - DNA, 20 bp, Artificial
  CRISPR gRNA sequence
gttttcgcctgaaataggaa

SEQ ID NO: 222577 - DNA, 20 bp, Artificial
  CRISPR gRNA sequence
tcgcctgaaataggaagaca

SEQ ID NO: 222578 - DNA, 20 bp, Artificial
  CRISPR gRNA sequence
cgcctgaaataggaagacag

SEQ ID NO: 222579 - DNA, 20 bp, Artificial
  CRISPR gRNA sequence
gcctgaaataggaagacagt

SEQ ID NO: 222580 - DNA, 20 bp, Artificial
  CRISPR gRNA sequence
aaataggaagacagtaacct

SEQ ID NO: 222581 - DNA, 20 bp, Artificial
  CRISPR gRNA sequence
cagtcaaaacatgtgcagca

SEQ ID NO: 222582 - DNA, 20 bp, Artificial
  CRISPR gRNA sequence
ggtgtttttcgacgccaaag

SEQ ID NO: 222583 - DNA, 20 bp, Artificial
  CRISPR gRNA sequence
gtgtttttcgacgccaaaga

SEQ ID NO: 222584 - DNA, 20 bp, Artificial
  CRISPR gRNA sequence
ttcgacgccaaagaacctcc

SEQ ID NO: 222585 - DNA, 20 bp, Artificial
  CRISPR gRNA sequence
tcgacgccaaagaacctcca

SEQ ID NO: 222586 - DNA, 20 bp, Artificial
  CRISPR gRNA sequence
cgacgccaaagaacctccac

SEQ ID NO: 222587 - DNA, 20 bp, Artificial
  CRISPR gRNA sequence
gacgccaaagaacctccacc

SEQ ID NO: 222588 - DNA, 20 bp, Artificial
  CRISPR gRNA sequence
cacccccccacccccacccc

SEQ ID NO: 222589 - DNA, 20 bp, Artificial
  CRISPR gRNA sequence
ttggaatccatttcgctttt

SEQ ID NO: 222590 - DNA, 20 bp, Artificial
  CRISPR gRNA sequence
tggaatccatttcgcttttg

SEQ ID NO: 222591 - DNA, 20 bp, Artificial
  CRISPR gRNA sequence
ggaatccatttcgcttttgt

SEQ ID NO: 222592 - DNA, 20 bp, Artificial
  CRISPR gRNA sequence
gaatccatttcgcttttgta

SEQ ID NO: 222593 - DNA, 20 bp, Artificial
  CRISPR gRNA sequence
cgcttttgtaaaacgtgtgc

SEQ ID NO: 222594 - DNA, 20 bp, Artificial
  CRISPR gRNA sequence
gcttttgtaaaacgtgtgct

SEQ ID NO: 222595 - DNA, 20 bp, Artificial
  CRISPR gRNA sequence
ttgtaaaacgtgtgcttcgt

SEQ ID NO: 222596 - DNA, 20 bp, Artificial
  CRISPR gRNA sequence
tgtaaaacgtgtgcttcgtc

SEQ ID NO: 222597 - DNA, 20 bp, Artificial
  CRISPR gRNA sequence
gtaaaacgtgtgcttcgtct

SEQ ID NO: 222598 - DNA, 20 bp, Artificial
  CRISPR gRNA sequence
taaaacgtgtgcttcgtctg

SEQ ID NO: 222599 - DNA, 20 bp, Artificial
  CRISPR gRNA sequence
cgtctgtaaaaactgagcaa

SEQ ID NO: 222600 - DNA, 20 bp, Artificial
  CRISPR gRNA sequence
gtctgtaaaaactgagcaag

SEQ ID NO: 222601 - DNA, 20 bp, Artificial
  CRISPR gRNA sequence
taaaaactgagcaaggaata

SEQ ID NO: 222602 - DNA, 20 bp, Artificial
  CRISPR gRNA sequence
agcaaggaatagaaacattc

SEQ ID NO: 222603 - DNA, 20 bp, Artificial
  CRISPR gRNA sequence
gtagctctacagtgagtgcc

SEQ ID NO: 222604 - DNA, 20 bp, Artificial
  CRISPR gRNA sequence
tacagtgagtgcctgtcaca

SEQ ID NO: 222605 - DNA, 20 bp, Artificial
  CRISPR gRNA sequence
cagtgagtgcctgtcacact

SEQ ID NO: 222606 - DNA, 20 bp, Artificial
  CRISPR gRNA sequence
tcacacttcacatccataga

SEQ ID NO: 222607 - DNA, 20 bp, Artificial
  CRISPR gRNA sequence
cacatccatagagccttttg

SEQ ID NO: 222608 - DNA, 20 bp, Artificial
  CRISPR gRNA sequence
acatccatagagccttttgt

SEQ ID NO: 222609 - DNA, 20 bp, Artificial
  CRISPR gRNA sequence
ttgtgaacttttataagatt

SEQ ID NO: 222610 - DNA, 20 bp, Artificial
  CRISPR gRNA sequence
tgtgaacttttataagattc

SEQ ID NO: 222611 - DNA, 20 bp, Artificial
  CRISPR gRNA sequence
gtgaacttttataagattca

SEQ ID NO: 222612 - DNA, 20 bp, Artificial
  CRISPR gRNA sequence
tgaacttttataagattcag

SEQ ID NO: 222613 - DNA, 20 bp, Artificial
  CRISPR gRNA sequence
ttataagattcagaattcag

SEQ ID NO: 222614 - DNA, 20 bp, Artificial
  CRISPR gRNA sequence
tataagattcagaattcagc

SEQ ID NO: 222615 - DNA, 20 bp, Artificial
  CRISPR gRNA sequence
ataagattcagaattcagct

SEQ ID NO: 222616 - DNA, 20 bp, Artificial
  CRISPR gRNA sequence
taagattcagaattcagctt

SEQ ID NO: 222617 - DNA, 20 bp, Artificial
  CRISPR gRNA sequence
agaattcagcttgagcacca

SEQ ID NO: 222618 - DNA, 20 bp, Artificial
  CRISPR gRNA sequence
agcttgagcaccagtgacag

SEQ ID NO: 222619 - DNA, 20 bp, Artificial
  CRISPR gRNA sequence
gagcaccagtgacagcaatt

SEQ ID NO: 222620 - DNA, 20 bp, Artificial
  CRISPR gRNA sequence
agcaccagtgacagcaattg

SEQ ID NO: 222621 - DNA, 20 bp, Artificial
  CRISPR gRNA sequence
ttacatttattctagaatgc

SEQ ID NO: 222622 - DNA, 20 bp, Artificial
  CRISPR gRNA sequence
catttattctagaatgctaa

SEQ ID NO: 222623 - DNA, 20 bp, Artificial
  CRISPR gRNA sequence
attctagaatgctaaattaa

SEQ ID NO: 222624 - DNA, 20 bp, Artificial
  CRISPR gRNA sequence
ttctagaatgctaaattaat

SEQ ID NO: 222625 - DNA, 20 bp, Artificial
  CRISPR gRNA sequence
tagaatgctaaattaattcg

SEQ ID NO: 222626 - DNA, 20 bp, Artificial
  CRISPR gRNA sequence
gaatgctaaattaattcgat

SEQ ID NO: 222627 - DNA, 20 bp, Artificial
  CRISPR gRNA sequence
aattaattcgattttaaact

SEQ ID NO: 222628 - DNA, 20 bp, Artificial
  CRISPR gRNA sequence
attcgattttaaactgatta

SEQ ID NO: 222629 - DNA, 20 bp, Artificial
  CRISPR gRNA sequence
gattttaaactgattattag

SEQ ID NO: 222630 - DNA, 20 bp, Artificial
  CRISPR gRNA sequence
taaactgattattagcctcg

SEQ ID NO: 222631 - DNA, 20 bp, Artificial
  CRISPR gRNA sequence
aaactgattattagcctcgg

SEQ ID NO: 222632 - DNA, 20 bp, Artificial
  CRISPR gRNA sequence
aactgattattagcctcggt

SEQ ID NO: 222633 - DNA, 20 bp, Artificial
  CRISPR gRNA sequence
attattagcctcggtgtgcc

SEQ ID NO: 222634 - DNA, 20 bp, Artificial
  CRISPR gRNA sequence
ttagcctcggtgtgccgttc

SEQ ID NO: 222635 - DNA, 20 bp, Artificial
  CRISPR gRNA sequence
gcctcggtgtgccgttccta

SEQ ID NO: 222636 - DNA, 20 bp, Artificial
  CRISPR gRNA sequence
ggtgtgccgttcctaaaggc

SEQ ID NO: 222637 - DNA, 20 bp, Artificial
  CRISPR gRNA sequence
ctaaaggcttgtgactttag

SEQ ID NO: 222638 - DNA, 20 bp, Artificial
  CRISPR gRNA sequence
aaggcttgtgactttaggta

SEQ ID NO: 222639 - DNA, 20 bp, Artificial
  CRISPR gRNA sequence
gtgactttaggtatttccaa

SEQ ID NO: 222640 - DNA, 20 bp, Artificial
  CRISPR gRNA sequence
tgactttaggtatttccaag

SEQ ID NO: 222641 - DNA, 20 bp, Artificial
  CRISPR gRNA sequence
taggtatttccaagatgccc

SEQ ID NO: 222642 - DNA, 20 bp, Artificial
  CRISPR gRNA sequence
aggtatttccaagatgccct

SEQ ID NO: 222643 - DNA, 20 bp, Artificial
  CRISPR gRNA sequence
ggtatttccaagatgccctt

SEQ ID NO: 222644 - DNA, 20 bp, Artificial
  CRISPR gRNA sequence
ccaagatgcccttaagtctc

SEQ ID NO: 222645 - DNA, 20 bp, Artificial
  CRISPR gRNA sequence
caagatgcccttaagtctct

SEQ ID NO: 222646 - DNA, 20 bp, Artificial
  CRISPR gRNA sequence
aagtctctgcttaccacttt

SEQ ID NO: 222647 - DNA, 20 bp, Artificial
  CRISPR gRNA sequence
agtctctgcttaccactttc

SEQ ID NO: 222648 - DNA, 20 bp, Artificial
  CRISPR gRNA sequence
tgcttaccactttcctccct

SEQ ID NO: 222649 - DNA, 20 bp, Artificial
  CRISPR gRNA sequence
cttaccactttcctccctcc

SEQ ID NO: 222650 - DNA, 20 bp, Artificial
  CRISPR gRNA sequence
accactttcctccctccccg

SEQ ID NO: 222651 - DNA, 20 bp, Artificial
  CRISPR gRNA sequence
ccactttcctccctccccga

SEQ ID NO: 222652 - DNA, 20 bp, Artificial
  CRISPR gRNA sequence
tcctccctccccgagcatcc

SEQ ID NO: 222653 - DNA, 20 bp, Artificial
  CRISPR gRNA sequence
cctccctccccgagcatcct

SEQ ID NO: 222654 - DNA, 20 bp, Artificial
  CRISPR gRNA sequence
ctccctccccgagcatcctg

SEQ ID NO: 222655 - DNA, 20 bp, Artificial
  CRISPR gRNA sequence
cctccccgagcatcctggat

SEQ ID NO: 222656 - DNA, 20 bp, Artificial
  CRISPR gRNA sequence
cccgagcatcctggatgttg

SEQ ID NO: 222657 - DNA, 20 bp, Artificial
  CRISPR gRNA sequence
gatgttgggactgtgaatcc

SEQ ID NO: 222658 - DNA, 20 bp, Artificial
  CRISPR gRNA sequence
ggactgtgaatccaggtctc

SEQ ID NO: 222659 - DNA, 20 bp, Artificial
  CRISPR gRNA sequence
tgaatccaggtctccgttat

SEQ ID NO: 222660 - DNA, 20 bp, Artificial
  CRISPR gRNA sequence
cgttatctaaatggttgatg

SEQ ID NO: 222661 - DNA, 20 bp, Artificial
  CRISPR gRNA sequence
tctaaatggttgatgttagt

SEQ ID NO: 222662 - DNA, 20 bp, Artificial
  CRISPR gRNA sequence
aatggttgatgttagtgttt

SEQ ID NO: 222663 - DNA, 20 bp, Artificial
  CRISPR gRNA sequence
atgttagtgtttcctgtcat

SEQ ID NO: 222664 - DNA, 20 bp, Artificial
  CRISPR gRNA sequence
gtgtttcctgtcatcacgtt

SEQ ID NO: 222665 - DNA, 20 bp, Artificial
  CRISPR gRNA sequence
cctgtcatcacgtttagtat

SEQ ID NO: 222666 - DNA, 20 bp, Artificial
  CRISPR gRNA sequence
ctgtcatcacgtttagtatg

SEQ ID NO: 222667 - DNA, 20 bp, Artificial
  CRISPR gRNA sequence
tcatcacgtttagtatgctt

SEQ ID NO: 222668 - DNA, 20 bp, Artificial
  CRISPR gRNA sequence
agtatgcttgttgcctttac

SEQ ID NO: 222669 - DNA, 20 bp, Artificial
  CRISPR gRNA sequence
gtatgcttgttgcctttact

SEQ ID NO: 222670 - DNA, 20 bp, Artificial
  CRISPR gRNA sequence
gttgcctttactatcattat

SEQ ID NO: 222671 - DNA, 20 bp, Artificial
  CRISPR gRNA sequence
ttgcctttactatcattata

SEQ ID NO: 222672 - DNA, 20 bp, Artificial
  CRISPR gRNA sequence
cctttactatcattatagct

SEQ ID NO: 222673 - DNA, 20 bp, Artificial
  CRISPR gRNA sequence
tactatcattatagctaaaa

SEQ ID NO: 222674 - DNA, 20 bp, Artificial
  CRISPR gRNA sequence
actatcattatagctaaaat

SEQ ID NO: 222675 - DNA, 20 bp, Artificial
  CRISPR gRNA sequence
ctatcattatagctaaaata

SEQ ID NO: 222676 - DNA, 20 bp, Artificial
  CRISPR gRNA sequence
tcattatagctaaaataata

SEQ ID NO: 222677 - DNA, 20 bp, Artificial
  CRISPR gRNA sequence
tagctaaaataatactgctt

SEQ ID NO: 222678 - DNA, 20 bp, Artificial
  CRISPR gRNA sequence
aaataatactgctttcagag

SEQ ID NO: 222679 - DNA, 20 bp, Artificial
  CRISPR gRNA sequence
ctttcagagatgtgttgtat

SEQ ID NO: 222680 - DNA, 20 bp, Artificial
  CRISPR gRNA sequence
tcagagatgtgttgtataat

SEQ ID NO: 222681 - DNA, 20 bp, Artificial
  CRISPR gRNA sequence
cagagatgtgttgtataatc

SEQ ID NO: 222682 - DNA, 20 bp, Artificial
  CRISPR gRNA sequence
agagatgtgttgtataatcg

SEQ ID NO: 222683 - DNA, 20 bp, Artificial
  CRISPR gRNA sequence
tataatcgcataataatttc

SEQ ID NO: 222684 - DNA, 20 bp, Artificial
  CRISPR gRNA sequence
cagaacgccttcatattgaa

SEQ ID NO: 222685 - DNA, 20 bp, Artificial
  CRISPR gRNA sequence
agaacgccttcatattgaac

SEQ ID NO: 222686 - DNA, 20 bp, Artificial
  CRISPR gRNA sequence
catattgaaccagatatgaa

SEQ ID NO: 222687 - DNA, 20 bp, Artificial
  CRISPR gRNA sequence
atattgaaccagatatgaag

SEQ ID NO: 222688 - DNA, 20 bp, Artificial
  CRISPR gRNA sequence
aaccagatatgaagtgatac

SEQ ID NO: 222689 - DNA, 20 bp, Artificial
  CRISPR gRNA sequence
attcaaactgcctaaaaagt

SEQ ID NO: 222690 - DNA, 20 bp, Artificial
  CRISPR gRNA sequence
ttcaaactgcctaaaaagta

SEQ ID NO: 222691 - DNA, 20 bp, Artificial
  CRISPR gRNA sequence
aaactgcctaaaaagtaaaa

SEQ ID NO: 222692 - DNA, 20 bp, Artificial
  CRISPR gRNA sequence
cctaaaaagtaaaaagtata

SEQ ID NO: 222693 - DNA, 20 bp, Artificial
  CRISPR gRNA sequence
aaaagtaaaaagtataaacc

SEQ ID NO: 222694 - DNA, 20 bp, Artificial
  CRISPR gRNA sequence
tttttaaaacaggtaggtta

SEQ ID NO: 222695 - DNA, 20 bp, Artificial
  CRISPR gRNA sequence
ttaaaacaggtaggttagat

SEQ ID NO: 222696 - DNA, 20 bp, Artificial
  CRISPR gRNA sequence
taaaacaggtaggttagatt

SEQ ID NO: 222697 - DNA, 20 bp, Artificial
  CRISPR gRNA sequence
aaaacaggtaggttagattt

SEQ ID NO: 222698 - DNA, 20 bp, Artificial
  CRISPR gRNA sequence
aaacaggtaggttagattta

SEQ ID NO: 222699 - DNA, 20 bp, Artificial
  CRISPR gRNA sequence
gatttaaatcacgtagttta

SEQ ID NO: 222700 - DNA, 20 bp, Artificial
  CRISPR gRNA sequence
aaatcacgtagtttagaact

SEQ ID NO: 222701 - DNA, 20 bp, Artificial
  CRISPR gRNA sequence
aatcacgtagtttagaactg

SEQ ID NO: 222702 - DNA, 20 bp, Artificial
  CRISPR gRNA sequence
agaactgttggaatggtact

SEQ ID NO: 222703 - DNA, 20 bp, Artificial
  CRISPR gRNA sequence
gaactgttggaatggtactt

SEQ ID NO: 222704 - DNA, 20 bp, Artificial
  CRISPR gRNA sequence
ttggaatggtactttgagtg

SEQ ID NO: 222705 - DNA, 20 bp, Artificial
  CRISPR gRNA sequence
gaatggtactttgagtgata

SEQ ID NO: 222706 - DNA, 20 bp, Artificial
  CRISPR gRNA sequence
tgagtgataggatttatgtt

SEQ ID NO: 222707 - DNA, 20 bp, Artificial
  CRISPR gRNA sequence
gagtgataggatttatgtta

SEQ ID NO: 222708 - DNA, 20 bp, Artificial
  CRISPR gRNA sequence
agtgataggatttatgttag

SEQ ID NO: 222709 - DNA, 20 bp, Artificial
  CRISPR gRNA sequence
atgttaggccttctttagta

SEQ ID NO: 222710 - DNA, 20 bp, Artificial
  CRISPR gRNA sequence
tgttaggccttctttagtaa

SEQ ID NO: 222711 - DNA, 20 bp, Artificial
  CRISPR gRNA sequence
ggccttctttagtaatagtt

SEQ ID NO: 222712 - DNA, 20 bp, Artificial
  CRISPR gRNA sequence
ctttagtaatagttaatatc

SEQ ID NO: 222713 - DNA, 20 bp, Artificial
  CRISPR gRNA sequence
tttagtaatagttaatatca

SEQ ID NO: 222714 - DNA, 20 bp, Artificial
  CRISPR gRNA sequence
tagtaatagttaatatcatg

SEQ ID NO: 222715 - DNA, 20 bp, Artificial
  CRISPR gRNA sequence
agtaatagttaatatcatgt

SEQ ID NO: 222716 - DNA, 20 bp, Artificial
  CRISPR gRNA sequence
gtaatagttaatatcatgta

SEQ ID NO: 222717 - DNA, 20 bp, Artificial
  CRISPR gRNA sequence
atatcatgtaattagcactc

SEQ ID NO: 222718 - DNA, 20 bp, Artificial
  CRISPR gRNA sequence
gcactcgtttacacacaatt

SEQ ID NO: 222719 - DNA, 20 bp, Artificial
  CRISPR gRNA sequence
gtttacacacaattttaatg

SEQ ID NO: 222720 - DNA, 20 bp, Artificial
  CRISPR gRNA sequence
acacacaattttaatgtgtt

SEQ ID NO: 222721 - DNA, 20 bp, Artificial
  CRISPR gRNA sequence
cacacaattttaatgtgttc

SEQ ID NO: 222722 - DNA, 20 bp, Artificial
  CRISPR gRNA sequence
taatgtgttcgaatccctag

SEQ ID NO: 222723 - DNA, 20 bp, Artificial
  CRISPR gRNA sequence
aatgtgttcgaatccctaga

SEQ ID NO: 222724 - DNA, 20 bp, Artificial
  CRISPR gRNA sequence
atgtgttcgaatccctagag

SEQ ID NO: 222725 - DNA, 20 bp, Artificial
  CRISPR gRNA sequence
gaatccctagagtcatcgaa

SEQ ID NO: 222726 - DNA, 20 bp, Artificial
  CRISPR gRNA sequence
gagtcatcgaattcagaatt

SEQ ID NO: 222727 - DNA, 20 bp, Artificial
  CRISPR gRNA sequence
agaatttatagtattttatt

SEQ ID NO: 222728 - DNA, 20 bp, Artificial
  CRISPR gRNA sequence
atagtattttattttactta

SEQ ID NO: 222729 - DNA, 20 bp, Artificial
  CRISPR gRNA sequence
tagtattttattttacttag

SEQ ID NO: 222730 - DNA, 20 bp, Artificial
  CRISPR gRNA sequence
tattttacttagttaatatt

SEQ ID NO: 222731 - DNA, 20 bp, Artificial
  CRISPR gRNA sequence
attttacttagttaatatta

SEQ ID NO: 222732 - DNA, 20 bp, Artificial
  CRISPR gRNA sequence
ttttacttagttaatattaa

SEQ ID NO: 222733 - DNA, 20 bp, Artificial
  CRISPR gRNA sequence
tacttagttaatattaacct

SEQ ID NO: 222734 - DNA, 20 bp, Artificial
  CRISPR gRNA sequence
acttagttaatattaaccta

SEQ ID NO: 222735 - DNA, 20 bp, Artificial
  CRISPR gRNA sequence
cttagttaatattaacctaa

SEQ ID NO: 222736 - DNA, 20 bp, Artificial
  CRISPR gRNA sequence
agttaatattaacctaaaaa

SEQ ID NO: 222737 - DNA, 20 bp, Artificial
  CRISPR gRNA sequence
gttaatattaacctaaaaaa

SEQ ID NO: 222738 - DNA, 20 bp, Artificial
  CRISPR gRNA sequence
atattaacctaaaaaaaaag

SEQ ID NO: 222739 - DNA, 20 bp, Artificial
  CRISPR gRNA sequence
acctaaaaaaaaagcaaaat

SEQ ID NO: 222740 - DNA, 20 bp, Artificial
  CRISPR gRNA sequence
aaaaaaaagcaaaatacagg

SEQ ID NO: 222741 - DNA, 20 bp, Artificial
  CRISPR gRNA sequence
tgcagttgagttgtgttaag

SEQ ID NO: 222742 - DNA, 20 bp, Artificial
  CRISPR gRNA sequence
agttgtgttaagtgtggact

SEQ ID NO: 222743 - DNA, 20 bp, Artificial
  CRISPR gRNA sequence
tgttaagtgtggactgtaaa

SEQ ID NO: 222744 - DNA, 20 bp, Artificial
  CRISPR gRNA sequence
agtgtggactgtaaaacagg

SEQ ID NO: 222745 - DNA, 20 bp, Artificial
  CRISPR gRNA sequence
taaaacaggatagtatttgt

SEQ ID NO: 222746 - DNA, 20 bp, Artificial
  CRISPR gRNA sequence
gttataaaatatgtttttgt

SEQ ID NO: 222747 - DNA, 20 bp, Artificial
  CRISPR gRNA sequence
ttataaaatatgtttttgta

SEQ ID NO: 222748 - DNA, 20 bp, Artificial
  CRISPR gRNA sequence
taaaatatgtttttgtatgt

SEQ ID NO: 222749 - DNA, 20 bp, Artificial
  CRISPR gRNA sequence
ttgtatgtgtttaatatata

SEQ ID NO: 222750 - DNA, 20 bp, Artificial
  CRISPR gRNA sequence
tgtatgtgtttaatatatag

SEQ ID NO: 222751 - DNA, 20 bp, Artificial
  CRISPR gRNA sequence
gtatgtgtttaatatatagc

SEQ ID NO: 222752 - DNA, 20 bp, Artificial
  CRISPR gRNA sequence
tatgtgtttaatatatagct

SEQ ID NO: 222753 - DNA, 20 bp, Artificial
  CRISPR gRNA sequence
aatatatagcttcaaaagga

SEQ ID NO: 222754 - DNA, 20 bp, Artificial
  CRISPR gRNA sequence
atatatagcttcaaaaggac

SEQ ID NO: 222755 - DNA, 20 bp, Artificial
  CRISPR gRNA sequence
caaaaggacatgtatgaaga

SEQ ID NO: 222756 - DNA, 20 bp, Artificial
  CRISPR gRNA sequence
aaaaggacatgtatgaagaa

SEQ ID NO: 222757 - DNA, 20 bp, Artificial
  CRISPR gRNA sequence
agcacataggtagttataaa

SEQ ID NO: 222758 - DNA, 20 bp, Artificial
  CRISPR gRNA sequence
taaaccaagggtttgagaga

SEQ ID NO: 222759 - DNA, 20 bp, Artificial
  CRISPR gRNA sequence
gagagactgactttagaatc

SEQ ID NO: 222760 - DNA, 20 bp, Artificial
  CRISPR gRNA sequence
agagactgactttagaatct

SEQ ID NO: 222761 - DNA, 20 bp, Artificial
  CRISPR gRNA sequence
actttagaatctagaatgag

SEQ ID NO: 222762 - DNA, 20 bp, Artificial
  CRISPR gRNA sequence
tagaatctagaatgagtaag

SEQ ID NO: 222763 - DNA, 20 bp, Artificial
  CRISPR gRNA sequence
agaatctagaatgagtaaga

SEQ ID NO: 222764 - DNA, 20 bp, Artificial
  CRISPR gRNA sequence
gaatctagaatgagtaagaa

SEQ ID NO: 222765 - DNA, 20 bp, Artificial
  CRISPR gRNA sequence
gaatgagtaagaaagtgatg

SEQ ID NO: 222766 - DNA, 20 bp, Artificial
  CRISPR gRNA sequence
tacattcatttgtattgaag

SEQ ID NO: 222767 - DNA, 20 bp, Artificial
  CRISPR gRNA sequence
atttgtattgaagtttgatt

SEQ ID NO: 222768 - DNA, 20 bp, Artificial
  CRISPR gRNA sequence
gtattgaagtttgattttgc

SEQ ID NO: 222769 - DNA, 20 bp, Artificial
  CRISPR gRNA sequence
tattgaagtttgattttgct

SEQ ID NO: 222770 - DNA, 20 bp, Artificial
  CRISPR gRNA sequence
aagtttgattttgctttcag

SEQ ID NO: 222771 - DNA, 20 bp, Artificial
  CRISPR gRNA sequence
gattttgctttcagtttcgt

SEQ ID NO: 222772 - DNA, 20 bp, Artificial
  CRISPR gRNA sequence
attttgctttcagtttcgtt

SEQ ID NO: 222773 - DNA, 20 bp, Artificial
  CRISPR gRNA sequence
tgctttcagtttcgttaatt

SEQ ID NO: 222774 - DNA, 20 bp, Artificial
  CRISPR gRNA sequence
gctttcagtttcgttaatta

SEQ ID NO: 222775 - DNA, 20 bp, Artificial
  CRISPR gRNA sequence
ctttcagtttcgttaattaa

SEQ ID NO: 222776 - DNA, 20 bp, Artificial
  CRISPR gRNA sequence
tcagtttcgttaattaagcc

SEQ ID NO: 222777 - DNA, 20 bp, Artificial
  CRISPR gRNA sequence
cagtttcgttaattaagccc

SEQ ID NO: 222778 - DNA, 20 bp, Artificial
  CRISPR gRNA sequence
agtttcgttaattaagcccc

SEQ ID NO: 222779 - DNA, 20 bp, Artificial
  CRISPR gRNA sequence
cgttaattaagccccgggaa

SEQ ID NO: 222780 - DNA, 20 bp, Artificial
  CRISPR gRNA sequence
gttaattaagccccgggaat

SEQ ID NO: 222781 - DNA, 20 bp, Artificial
  CRISPR gRNA sequence
attaagccccgggaatcagg

SEQ ID NO: 222782 - DNA, 20 bp, Artificial
  CRISPR gRNA sequence
agccccgggaatcagggacc

SEQ ID NO: 222783 - DNA, 20 bp, Artificial
  CRISPR gRNA sequence
tcctggcaccctctacagtg

SEQ ID NO: 222784 - DNA, 20 bp, Artificial
  CRISPR gRNA sequence
cctggcaccctctacagtgt

SEQ ID NO: 222785 - DNA, 20 bp, Artificial
  CRISPR gRNA sequence
ctggcaccctctacagtgtt

SEQ ID NO: 222786 - DNA, 20 bp, Artificial
  CRISPR gRNA sequence
gcaccctctacagtgttagt

SEQ ID NO: 222787 - DNA, 20 bp, Artificial
  CRISPR gRNA sequence
tacagtgttagtggcctttg

SEQ ID NO: 222788 - DNA, 20 bp, Artificial
  CRISPR gRNA sequence
cagtgttagtggcctttgtg

SEQ ID NO: 222789 - DNA, 20 bp, Artificial
  CRISPR gRNA sequence
gtggcctttgtggtaaaaga

SEQ ID NO: 222790 - DNA, 20 bp, Artificial
  CRISPR gRNA sequence
tgtggtaaaagaagttatct

SEQ ID NO: 222791 - DNA, 20 bp, Artificial
  CRISPR gRNA sequence
gtggtaaaagaagttatctc

SEQ ID NO: 222792 - DNA, 20 bp, Artificial
  CRISPR gRNA sequence
tggtaaaagaagttatctca

SEQ ID NO: 222793 - DNA, 20 bp, Artificial
  CRISPR gRNA sequence
tctcagatactcatttcatg

SEQ ID NO: 222794 - DNA, 20 bp, Artificial
  CRISPR gRNA sequence
agatactcatttcatgcaat

SEQ ID NO: 222795 - DNA, 20 bp, Artificial
  CRISPR gRNA sequence
atttcatgcaattacaggca

SEQ ID NO: 222796 - DNA, 20 bp, Artificial
  CRISPR gRNA sequence
catgcaattacaggcaaact

SEQ ID NO: 222797 - DNA, 20 bp, Artificial
  CRISPR gRNA sequence
atgcaattacaggcaaactg

SEQ ID NO: 222798 - DNA, 20 bp, Artificial
  CRISPR gRNA sequence
caggcaaactggaaggcacc

SEQ ID NO: 222799 - DNA, 20 bp, Artificial
  CRISPR gRNA sequence
gaaggcaccttaatggtatg

SEQ ID NO: 222800 - DNA, 20 bp, Artificial
  CRISPR gRNA sequence
aatggtatgcaagatgtgaa

SEQ ID NO: 222801 - DNA, 20 bp, Artificial
  CRISPR gRNA sequence
atggtatgcaagatgtgaaa

SEQ ID NO: 222802 - DNA, 20 bp, Artificial
  CRISPR gRNA sequence
ctatgttgcattccactctg

SEQ ID NO: 222803 - DNA, 20 bp, Artificial
  CRISPR gRNA sequence
tgttgcattccactctgccc

SEQ ID NO: 222804 - DNA, 20 bp, Artificial
  CRISPR gRNA sequence
cattccactctgcccccact

SEQ ID NO: 222805 - DNA, 20 bp, Artificial
  CRISPR gRNA sequence
cactctgcccccactcatgt

SEQ ID NO: 222806 - DNA, 20 bp, Artificial
  CRISPR gRNA sequence
tgcccccactcatgtacaat

SEQ ID NO: 222807 - DNA, 20 bp, Artificial
  CRISPR gRNA sequence
cccccactcatgtacaatta

SEQ ID NO: 222808 - DNA, 20 bp, Artificial
  CRISPR gRNA sequence
atgtacaattatactttgtt

SEQ ID NO: 222809 - DNA, 20 bp, Artificial
  CRISPR gRNA sequence
tactttgtttaaaagtgcat

SEQ ID NO: 222810 - DNA, 20 bp, Artificial
  CRISPR gRNA sequence
tgtttaaaagtgcatagttt

SEQ ID NO: 222811 - DNA, 20 bp, Artificial
  CRISPR gRNA sequence
gtttaaaagtgcatagtttc

SEQ ID NO: 222812 - DNA, 20 bp, Artificial
  CRISPR gRNA sequence
tttaaaagtgcatagtttca

SEQ ID NO: 222813 - DNA, 20 bp, Artificial
  CRISPR gRNA sequence
aaaagtgcatagtttcagtg

SEQ ID NO: 222814 - DNA, 20 bp, Artificial
  CRISPR gRNA sequence
aaagtgcatagtttcagtgg

SEQ ID NO: 222815 - DNA, 20 bp, Artificial
  CRISPR gRNA sequence
cagtggtatttattagctag

SEQ ID NO: 222816 - DNA, 20 bp, Artificial
  CRISPR gRNA sequence
agtggtatttattagctagc

SEQ ID NO: 222817 - DNA, 20 bp, Artificial
  CRISPR gRNA sequence
attagctagcaaataaaact

SEQ ID NO: 222818 - DNA, 20 bp, Artificial
  CRISPR gRNA sequence
ttagctagcaaataaaactt

SEQ ID NO: 222819 - DNA, 20 bp, Artificial
  CRISPR gRNA sequence
gctagcaaataaaactttaa

SEQ ID NO: 222820 - DNA, 20 bp, Artificial
  CRISPR gRNA sequence
gcaaataaaactttaaataa

SEQ ID NO: 222821 - DNA, 20 bp, Artificial
  CRISPR gRNA sequence
taaataaataatgatggtgt

SEQ ID NO: 222822 - DNA, 20 bp, Artificial
  CRISPR gRNA sequence
aaataaataatgatggtgtt

SEQ ID NO: 222823 - DNA, 20 bp, Artificial
  CRISPR gRNA sequence
aataaataatgatggtgttg

SEQ ID NO: 222824 - DNA, 20 bp, Artificial
  CRISPR gRNA sequence
tgaactgtcttttcagtggt

SEQ ID NO: 222825 - DNA, 20 bp, Artificial
  CRISPR gRNA sequence
tcttttcagtggttgaatga

SEQ ID NO: 222826 - DNA, 20 bp, Artificial
  CRISPR gRNA sequence
ttcagtggttgaatgattcc

SEQ ID NO: 222827 - DNA, 20 bp, Artificial
  CRISPR gRNA sequence
tcagtggttgaatgattcct

SEQ ID NO: 222828 - DNA, 20 bp, Artificial
  CRISPR gRNA sequence
cagtggttgaatgattcctc

SEQ ID NO: 222829 - DNA, 20 bp, Artificial
  CRISPR gRNA sequence
agtggttgaatgattcctct

SEQ ID NO: 222830 - DNA, 20 bp, Artificial
  CRISPR gRNA sequence
aatgattcctctttgttcaa

SEQ ID NO: 222831 - DNA, 20 bp, Artificial
  CRISPR gRNA sequence
ctctttgttcaaaatgagtt

SEQ ID NO: 222832 - DNA, 20 bp, Artificial
  CRISPR gRNA sequence
tttgttcaaaatgagttgtt

SEQ ID NO: 222833 - DNA, 20 bp, Artificial
  CRISPR gRNA sequence
tgttcaaaatgagttgtttt

SEQ ID NO: 222834 - DNA, 20 bp, Artificial
  CRISPR gRNA sequence
gttcaaaatgagttgttttt

SEQ ID NO: 222835 - DNA, 20 bp, Artificial
  CRISPR gRNA sequence
ttcaaaatgagttgtttttt

SEQ ID NO: 222836 - DNA, 20 bp, Artificial
  CRISPR gRNA sequence
aaaatgagttgttttttttt

SEQ ID NO: 222837 - DNA, 20 bp, Artificial
  CRISPR gRNA sequence
tttttttttttaaatcaggg

SEQ ID NO: 222838 - DNA, 20 bp, Artificial
  CRISPR gRNA sequence
ttttttttaaatcagggtac

SEQ ID NO: 222839 - DNA, 20 bp, Artificial
  CRISPR gRNA sequence
tttttttaaatcagggtaca

SEQ ID NO: 222840 - DNA, 20 bp, Artificial
  CRISPR gRNA sequence
ttttttaaatcagggtacat

SEQ ID NO: 222841 - DNA, 20 bp, Artificial
  CRISPR gRNA sequence
tttttaaatcagggtacata

SEQ ID NO: 222842 - DNA, 20 bp, Artificial
  CRISPR gRNA sequence
ttttaaatcagggtacatat

SEQ ID NO: 222843 - DNA, 20 bp, Artificial
  CRISPR gRNA sequence
tttaaatcagggtacatatg

SEQ ID NO: 222844 - DNA, 20 bp, Artificial
  CRISPR gRNA sequence
ttaaatcagggtacatatga

SEQ ID NO: 222845 - DNA, 20 bp, Artificial
  CRISPR gRNA sequence
taaatcagggtacatatgat

SEQ ID NO: 222846 - DNA, 20 bp, Artificial
  CRISPR gRNA sequence
aaatcagggtacatatgatt

SEQ ID NO: 222847 - DNA, 20 bp, Artificial
  CRISPR gRNA sequence
aatcagggtacatatgatta

SEQ ID NO: 222848 - DNA, 20 bp, Artificial
  CRISPR gRNA sequence
aataaaatttttttccatcg

SEQ ID NO: 222849 - DNA, 20 bp, Artificial
  CRISPR gRNA sequence
ttttccatcgtctaagtcta

SEQ ID NO: 222850 - DNA, 20 bp, Artificial
  CRISPR gRNA sequence
tttccatcgtctaagtctag

SEQ ID NO: 222851 - DNA, 20 bp, Artificial
  CRISPR gRNA sequence
ttccatcgtctaagtctagt

SEQ ID NO: 222852 - DNA, 20 bp, Artificial
  CRISPR gRNA sequence
tccatcgtctaagtctagta

SEQ ID NO: 222853 - DNA, 20 bp, Artificial
  CRISPR gRNA sequence
ccatcgtctaagtctagtag

SEQ ID NO: 222854 - DNA, 20 bp, Artificial
  CRISPR gRNA sequence
catcgtctaagtctagtagt

SEQ ID NO: 222855 - DNA, 20 bp, Artificial
  CRISPR gRNA sequence
agtctagtagtaatttggct

SEQ ID NO: 222856 - DNA, 20 bp, Artificial
  CRISPR gRNA sequence
gtagtaatttggcttgttta

SEQ ID NO: 222857 - DNA, 20 bp, Artificial
  CRISPR gRNA sequence
ggcttgtttaaataaaaatg

SEQ ID NO: 222858 - DNA, 20 bp, Artificial
  CRISPR gRNA sequence
gcttgtttaaataaaaatgt

SEQ ID NO: 222859 - DNA, 20 bp, Artificial
  CRISPR gRNA sequence
gtttaaataaaaatgttttc

SEQ ID NO: 222860 - DNA, 20 bp, Artificial
  CRISPR gRNA sequence
tttaaataaaaatgttttct

SEQ ID NO: 222861 - DNA, 20 bp, Artificial
  CRISPR gRNA sequence
aaataaaaatgttttctctt

SEQ ID NO: 222862 - DNA, 20 bp, Artificial
  CRISPR gRNA sequence
aataaaaatgttttctctta

SEQ ID NO: 222863 - DNA, 20 bp, Artificial
  CRISPR gRNA sequence
tctcttaaagaatatattat

SEQ ID NO: 222864 - DNA, 20 bp, Artificial
  CRISPR gRNA sequence
ctcttaaagaatatattatt

SEQ ID NO: 222865 - DNA, 20 bp, Artificial
  CRISPR gRNA sequence
tcttaaagaatatattattt

SEQ ID NO: 222866 - DNA, 20 bp, Artificial
  CRISPR gRNA sequence
ttaaagaatatattattttt

SEQ ID NO: 222867 - DNA, 20 bp, Artificial
  CRISPR gRNA sequence
aaagaatatattatttttaa

SEQ ID NO: 222868 - DNA, 20 bp, Artificial
  CRISPR gRNA sequence
aagaatatattatttttaat

SEQ ID NO: 222869 - DNA, 20 bp, Artificial
  CRISPR gRNA sequence
tttttaattacaagttgcca

SEQ ID NO: 222870 - DNA, 20 bp, Artificial
  CRISPR gRNA sequence
ttaattacaagttgccattt

SEQ ID NO: 222871 - DNA, 20 bp, Artificial
  CRISPR gRNA sequence
taattacaagttgccatttt

SEQ ID NO: 222872 - DNA, 20 bp, Artificial
  CRISPR gRNA sequence
aattacaagttgccatttta

SEQ ID NO: 222873 - DNA, 20 bp, Artificial
  CRISPR gRNA sequence
attacaagttgccattttaa

SEQ ID NO: 222874 - DNA, 20 bp, Artificial
  CRISPR gRNA sequence
caagttgccattttaaggaa

SEQ ID NO: 222875 - DNA, 20 bp, Artificial
  CRISPR gRNA sequence
ccattttaaggaagtaaatg

SEQ ID NO: 222876 - DNA, 20 bp, Artificial
  CRISPR gRNA sequence
taaggaagtaaatgcctatt

SEQ ID NO: 222877 - DNA, 20 bp, Artificial
  CRISPR gRNA sequence
aaggaagtaaatgcctattt

SEQ ID NO: 222878 - DNA, 20 bp, Artificial
  CRISPR gRNA sequence
aggaagtaaatgcctattta

SEQ ID NO: 222879 - DNA, 20 bp, Artificial
  CRISPR gRNA sequence
tttaaaagtacgtatttatg

SEQ ID NO: 222880 - DNA, 20 bp, Artificial
  CRISPR gRNA sequence
aaaagtacgtatttatgggg

SEQ ID NO: 222881 - DNA, 20 bp, Artificial
  CRISPR gRNA sequence
aaagtacgtatttatggggc

SEQ ID NO: 222882 - DNA, 20 bp, Artificial
  CRISPR gRNA sequence
atggggccgccccagcagtc

SEQ ID NO: 222883 - DNA, 20 bp, Artificial
  CRISPR gRNA sequence
tggggccgccccagcagtct

SEQ ID NO: 222884 - DNA, 20 bp, Artificial
  CRISPR gRNA sequence
gaggcagtgttttttaaagc

SEQ ID NO: 222885 - DNA, 20 bp, Artificial
  CRISPR gRNA sequence
tttaaagcattacactaaat

SEQ ID NO: 222886 - DNA, 20 bp, Artificial
  CRISPR gRNA sequence
ttaaagcattacactaaatg

SEQ ID NO: 222887 - DNA, 20 bp, Artificial
  CRISPR gRNA sequence
taaagcattacactaaatgc

SEQ ID NO: 222888 - DNA, 20 bp, Artificial
  CRISPR gRNA sequence
aaagcattacactaaatgcc

SEQ ID NO: 222889 - DNA, 20 bp, Artificial
  CRISPR gRNA sequence
aagcattacactaaatgcct

SEQ ID NO: 222890 - DNA, 20 bp, Artificial
  CRISPR gRNA sequence
cactaaatgcctaccattag

SEQ ID NO: 222891 - DNA, 20 bp, Artificial
  CRISPR gRNA sequence
aatgcctaccattaggacac

SEQ ID NO: 222892 - DNA, 20 bp, Artificial
  CRISPR gRNA sequence
ccattaggacacttgctcat

SEQ ID NO: 222893 - DNA, 20 bp, Artificial
  CRISPR gRNA sequence
ggacacttgctcatgctgtc

SEQ ID NO: 222894 - DNA, 20 bp, Artificial
  CRISPR gRNA sequence
gctcatgctgtcatctgtgt

SEQ ID NO: 222895 - DNA, 20 bp, Artificial
  CRISPR gRNA sequence
ctcatgctgtcatctgtgtt

SEQ ID NO: 222896 - DNA, 20 bp, Artificial
  CRISPR gRNA sequence
atgctgtcatctgtgttttg

SEQ ID NO: 222897 - DNA, 20 bp, Artificial
  CRISPR gRNA sequence
tcatctgtgttttggcagat

SEQ ID NO: 222898 - DNA, 20 bp, Artificial
  CRISPR gRNA sequence
tgttttggcagatgttttat

SEQ ID NO: 222899 - DNA, 20 bp, Artificial
  CRISPR gRNA sequence
tggcagatgttttatctttg

SEQ ID NO: 222900 - DNA, 20 bp, Artificial
  CRISPR gRNA sequence
ggcagatgttttatctttgt

SEQ ID NO: 222901 - DNA, 20 bp, Artificial
  CRISPR gRNA sequence
gcagatgttttatctttgtc

SEQ ID NO: 222902 - DNA, 20 bp, Artificial
  CRISPR gRNA sequence
tatctttgtcactgagttgt

SEQ ID NO: 222903 - DNA, 20 bp, Artificial
  CRISPR gRNA sequence
atctttgtcactgagttgtt

SEQ ID NO: 222904 - DNA, 20 bp, Artificial
  CRISPR gRNA sequence
tctttgtcactgagttgttc

SEQ ID NO: 222905 - DNA, 20 bp, Artificial
  CRISPR gRNA sequence
tgtcactgagttgttcatgg

SEQ ID NO: 222906 - DNA, 20 bp, Artificial
  CRISPR gRNA sequence
gtcactgagttgttcatgga

SEQ ID NO: 222907 - DNA, 20 bp, Artificial
  CRISPR gRNA sequence
tcactgagttgttcatggag

SEQ ID NO: 222908 - DNA, 20 bp, Artificial
  CRISPR gRNA sequence
agttgttcatggagatttga

SEQ ID NO: 222909 - DNA, 20 bp, Artificial
  CRISPR gRNA sequence
ttcatggagatttgaaaggc

SEQ ID NO: 222910 - DNA, 20 bp, Artificial
  CRISPR gRNA sequence
atggagatttgaaaggccaa

SEQ ID NO: 222911 - DNA, 20 bp, Artificial
  CRISPR gRNA sequence
gaaaggccaagttctaaaga

SEQ ID NO: 222912 - DNA, 20 bp, Artificial
  CRISPR gRNA sequence
aaaggccaagttctaaagat

SEQ ID NO: 222913 - DNA, 20 bp, Artificial
  CRISPR gRNA sequence
taaagatgagagatagatga

SEQ ID NO: 222914 - DNA, 20 bp, Artificial
  CRISPR gRNA sequence
aagatgagagatagatgact

SEQ ID NO: 222915 - DNA, 20 bp, Artificial
  CRISPR gRNA sequence
tccccccaaattgatacata

SEQ ID NO: 222916 - DNA, 20 bp, Artificial
  CRISPR gRNA sequence
ccccccaaattgatacatat

SEQ ID NO: 222917 - DNA, 20 bp, Artificial
  CRISPR gRNA sequence
cccccaaattgatacatatt

SEQ ID NO: 222918 - DNA, 20 bp, Artificial
  CRISPR gRNA sequence
atacatattctaaatccaaa

SEQ ID NO: 222919 - DNA, 20 bp, Artificial
  CRISPR gRNA sequence
taaatccaaaataatcacgc

SEQ ID NO: 222920 - DNA, 20 bp, Artificial
  CRISPR gRNA sequence
aatccaaaataatcacgcat

SEQ ID NO: 222921 - DNA, 20 bp, Artificial
  CRISPR gRNA sequence
gcaaaactagatttgcattt

SEQ ID NO: 222922 - DNA, 20 bp, Artificial
  CRISPR gRNA sequence
gatttgcatttcatagtatg

SEQ ID NO: 222923 - DNA, 20 bp, Artificial
  CRISPR gRNA sequence
gcatttcatagtatgaattc

SEQ ID NO: 222924 - DNA, 20 bp, Artificial
  CRISPR gRNA sequence
catttcatagtatgaattca

SEQ ID NO: 222925 - DNA, 20 bp, Artificial
  CRISPR gRNA sequence
catagtatgaattcagctat

SEQ ID NO: 222926 - DNA, 20 bp, Artificial
  CRISPR gRNA sequence
atagtatgaattcagctata

SEQ ID NO: 222927 - DNA, 20 bp, Artificial
  CRISPR gRNA sequence
agctatagctagtatatagg

SEQ ID NO: 222928 - DNA, 20 bp, Artificial
  CRISPR gRNA sequence
tagctagtatataggcattg

SEQ ID NO: 222929 - DNA, 20 bp, Artificial
  CRISPR gRNA sequence
gtatataggcattgctttta

SEQ ID NO: 222930 - DNA, 20 bp, Artificial
  CRISPR gRNA sequence
cttttaatatagtaatgttc

SEQ ID NO: 222931 - DNA, 20 bp, Artificial
  CRISPR gRNA sequence
ttaatatagtaatgttcttt

SEQ ID NO: 222932 - DNA, 20 bp, Artificial
  CRISPR gRNA sequence
taatatagtaatgttctttt

SEQ ID NO: 222933 - DNA, 20 bp, Artificial
  CRISPR gRNA sequence
aatatagtaatgttcttttt

SEQ ID NO: 222934 - DNA, 20 bp, Artificial
  CRISPR gRNA sequence
atatagtaatgttctttttg

SEQ ID NO: 222935 - DNA, 20 bp, Artificial
  CRISPR gRNA sequence
tttttgtggcataattttca

SEQ ID NO: 222936 - DNA, 20 bp, Artificial
  CRISPR gRNA sequence
tttgtggcataattttcaat

SEQ ID NO: 222937 - DNA, 20 bp, Artificial
  CRISPR gRNA sequence
ttgtggcataattttcaatc

SEQ ID NO: 222938 - DNA, 20 bp, Artificial
  CRISPR gRNA sequence
tgtggcataattttcaatca

SEQ ID NO: 222939 - DNA, 20 bp, Artificial
  CRISPR gRNA sequence
gtggcataattttcaatcac

SEQ ID NO: 222940 - DNA, 20 bp, Artificial
  CRISPR gRNA sequence
tggcataattttcaatcact

SEQ ID NO: 222941 - DNA, 20 bp, Artificial
  CRISPR gRNA sequence
tcaatcactttccctgtctt

SEQ ID NO: 222942 - DNA, 20 bp, Artificial
  CRISPR gRNA sequence
caatcactttccctgtctta

SEQ ID NO: 222943 - DNA, 20 bp, Artificial
  CRISPR gRNA sequence
aatcactttccctgtcttag

SEQ ID NO: 222944 - DNA, 20 bp, Artificial
  CRISPR gRNA sequence
tccctgtcttaggtttctgc

SEQ ID NO: 222945 - DNA, 20 bp, Artificial
  CRISPR gRNA sequence
ccctgtcttaggtttctgcc

SEQ ID NO: 222946 - DNA, 20 bp, Artificial
  CRISPR gRNA sequence
cctgtcttaggtttctgcct

SEQ ID NO: 222947 - DNA, 20 bp, Artificial
  CRISPR gRNA sequence
tcttaggtttctgcctacct

SEQ ID NO: 222948 - DNA, 20 bp, Artificial
  CRISPR gRNA sequence
aggtttctgcctaccttttt

SEQ ID NO: 222949 - DNA, 20 bp, Artificial
  CRISPR gRNA sequence
ggtttctgcctaccttttta

SEQ ID NO: 222950 - DNA, 20 bp, Artificial
  CRISPR gRNA sequence
ctgcctacctttttatacaa

SEQ ID NO: 222951 - DNA, 20 bp, Artificial
  CRISPR gRNA sequence
tgcctacctttttatacaag

SEQ ID NO: 222952 - DNA, 20 bp, Artificial
  CRISPR gRNA sequence
cctacctttttatacaagat

SEQ ID NO: 222953 - DNA, 20 bp, Artificial
  CRISPR gRNA sequence
cctttttatacaagataaac

SEQ ID NO: 222954 - DNA, 20 bp, Artificial
  CRISPR gRNA sequence
tttatacaagataaacattt

SEQ ID NO: 222955 - DNA, 20 bp, Artificial
  CRISPR gRNA sequence
ttatacaagataaacatttc

SEQ ID NO: 222956 - DNA, 20 bp, Artificial
  CRISPR gRNA sequence
tatacaagataaacatttct

SEQ ID NO: 222957 - DNA, 20 bp, Artificial
  CRISPR gRNA sequence
atacaagataaacatttcta

SEQ ID NO: 222958 - DNA, 20 bp, Artificial
  CRISPR gRNA sequence
tacaagataaacatttctat

SEQ ID NO: 222959 - DNA, 20 bp, Artificial
  CRISPR gRNA sequence
ctattttcatatcttatctc

SEQ ID NO: 222960 - DNA, 20 bp, Artificial
  CRISPR gRNA sequence
tattttcatatcttatctct

SEQ ID NO: 222961 - DNA, 20 bp, Artificial
  CRISPR gRNA sequence
ttttcatatcttatctctca

SEQ ID NO: 222962 - DNA, 20 bp, Artificial
  CRISPR gRNA sequence
tcatatcttatctctcagtc

SEQ ID NO: 222963 - DNA, 20 bp, Artificial
  CRISPR gRNA sequence
catatcttatctctcagtct

SEQ ID NO: 222964 - DNA, 20 bp, Artificial
  CRISPR gRNA sequence
atatcttatctctcagtctg

SEQ ID NO: 222965 - DNA, 20 bp, Artificial
  CRISPR gRNA sequence
atctctcagtctgattttaa

SEQ ID NO: 222966 - DNA, 20 bp, Artificial
  CRISPR gRNA sequence
tctctcagtctgattttaat

SEQ ID NO: 222967 - DNA, 20 bp, Artificial
  CRISPR gRNA sequence
tcagtctgattttaataata

SEQ ID NO: 222968 - DNA, 20 bp, Artificial
  CRISPR gRNA sequence
agtctgattttaataatatc

SEQ ID NO: 222969 - DNA, 20 bp, Artificial
  CRISPR gRNA sequence
attttaataatatcgtcttg

SEQ ID NO: 222970 - DNA, 20 bp, Artificial
  CRISPR gRNA sequence
taataatatcgtcttgggtt

SEQ ID NO: 222971 - DNA, 20 bp, Artificial
  CRISPR gRNA sequence
aataatatcgtcttgggtta

SEQ ID NO: 222972 - DNA, 20 bp, Artificial
  CRISPR gRNA sequence
ataatatcgtcttgggttat

SEQ ID NO: 222973 - DNA, 20 bp, Artificial
  CRISPR gRNA sequence
gggttatcataaagttactt

SEQ ID NO: 222974 - DNA, 20 bp, Artificial
  CRISPR gRNA sequence
ggttatcataaagttacttt

SEQ ID NO: 222975 - DNA, 20 bp, Artificial
  CRISPR gRNA sequence
tcataaagttactttcactt

SEQ ID NO: 222976 - DNA, 20 bp, Artificial
  CRISPR gRNA sequence
ctttcactttgtatactagt

SEQ ID NO: 222977 - DNA, 20 bp, Artificial
  CRISPR gRNA sequence
tcactttgtatactagtgta

SEQ ID NO: 222978 - DNA, 20 bp, Artificial
  CRISPR gRNA sequence
cactttgtatactagtgtag

SEQ ID NO: 222979 - DNA, 20 bp, Artificial
  CRISPR gRNA sequence
actttgtatactagtgtaga

SEQ ID NO: 222980 - DNA, 20 bp, Artificial
  CRISPR gRNA sequence
tgtatactagtgtagatatt

SEQ ID NO: 222981 - DNA, 20 bp, Artificial
  CRISPR gRNA sequence
gtatactagtgtagatattt

SEQ ID NO: 222982 - DNA, 20 bp, Artificial
  CRISPR gRNA sequence
tatactagtgtagatatttc

SEQ ID NO: 222983 - DNA, 20 bp, Artificial
  CRISPR gRNA sequence
gtgtagatatttcttctgtg

SEQ ID NO: 222984 - DNA, 20 bp, Artificial
  CRISPR gRNA sequence
cttctgtgataaaaagaaca

SEQ ID NO: 222985 - DNA, 20 bp, Artificial
  CRISPR gRNA sequence
ttctgtgataaaaagaacaa

SEQ ID NO: 222986 - DNA, 20 bp, Artificial
  CRISPR gRNA sequence
ctgtgataaaaagaacaaga

SEQ ID NO: 222987 - DNA, 20 bp, Artificial
  CRISPR gRNA sequence
tgtgataaaaagaacaagaa

SEQ ID NO: 222988 - DNA, 20 bp, Artificial
  CRISPR gRNA sequence
tgataaaaagaacaagaata

SEQ ID NO: 222989 - DNA, 20 bp, Artificial
  CRISPR gRNA sequence
tgttaaactcattgtagtac

SEQ ID NO: 222990 - DNA, 20 bp, Artificial
  CRISPR gRNA sequence
gttaaactcattgtagtact

SEQ ID NO: 222991 - DNA, 20 bp, Artificial
  CRISPR gRNA sequence
ttaaactcattgtagtacta

SEQ ID NO: 222992 - DNA, 20 bp, Artificial
  CRISPR gRNA sequence
aactcattgtagtactaaag

SEQ ID NO: 222993 - DNA, 20 bp, Artificial
  CRISPR gRNA sequence
attgtagtactaaagtagaa

SEQ ID NO: 222994 - DNA, 20 bp, Artificial
  CRISPR gRNA sequence
tagtactaaagtagaaaata

SEQ ID NO: 222995 - DNA, 20 bp, Artificial
  CRISPR gRNA sequence
aagtagaaaatacagagcac

SEQ ID NO: 222996 - DNA, 20 bp, Artificial
  CRISPR gRNA sequence
gattctgatatacctagact

SEQ ID NO: 222997 - DNA, 20 bp, Artificial
  CRISPR gRNA sequence
attctgatatacctagacta

SEQ ID NO: 222998 - DNA, 20 bp, Artificial
  CRISPR gRNA sequence
tgatatacctagactaagac

SEQ ID NO: 222999 - DNA, 20 bp, Artificial
  CRISPR gRNA sequence
atatacctagactaagacaa

SEQ ID NO: 223000 - DNA, 20 bp, Artificial
  CRISPR gRNA sequence
gactaagacaatagaatctg

SEQ ID NO: 223001 - DNA, 20 bp, Artificial
  CRISPR gRNA sequence
agacaatagaatctgggttt

SEQ ID NO: 223002 - DNA, 20 bp, Artificial
  CRISPR gRNA sequence
ggtttttcctctttacgatt

SEQ ID NO: 223003 - DNA, 20 bp, Artificial
  CRISPR gRNA sequence
ttcctctttacgattataca

SEQ ID NO: 223004 - DNA, 20 bp, Artificial
  CRISPR gRNA sequence
tcctctttacgattatacag

SEQ ID NO: 223005 - DNA, 20 bp, Artificial
  CRISPR gRNA sequence
cctctttacgattatacagt

SEQ ID NO: 223006 - DNA, 20 bp, Artificial
  CRISPR gRNA sequence
ctctttacgattatacagtg

SEQ ID NO: 223007 - DNA, 20 bp, Artificial
  CRISPR gRNA sequence
tttacgattatacagtgttg

SEQ ID NO: 223008 - DNA, 20 bp, Artificial
  CRISPR gRNA sequence
tacgattatacagtgttgaa

SEQ ID NO: 223009 - DNA, 20 bp, Artificial
  CRISPR gRNA sequence
acgattatacagtgttgaaa

SEQ ID NO: 223010 - DNA, 20 bp, Artificial
  CRISPR gRNA sequence
cgattatacagtgttgaaac

SEQ ID NO: 223011 - DNA, 20 bp, Artificial
  CRISPR gRNA sequence
tacagtgttgaaacagaaat

SEQ ID NO: 223012 - DNA, 20 bp, Artificial
  CRISPR gRNA sequence
aaacagaaatcaagctacac

SEQ ID NO: 223013 - DNA, 20 bp, Artificial
  CRISPR gRNA sequence
cacccacctctgaatatttc

SEQ ID NO: 223014 - DNA, 20 bp, Artificial
  CRISPR gRNA sequence
tgaatatttcattccaaatc

SEQ ID NO: 223015 - DNA, 20 bp, Artificial
  CRISPR gRNA sequence
aatatttcattccaaatcca

SEQ ID NO: 223016 - DNA, 20 bp, Artificial
  CRISPR gRNA sequence
cattccaaatccatggagca

SEQ ID NO: 223017 - DNA, 20 bp, Artificial
  CRISPR gRNA sequence
attccaaatccatggagcag

SEQ ID NO: 223018 - DNA, 20 bp, Artificial
  CRISPR gRNA sequence
caaatccatggagcagttgc

SEQ ID NO: 223019 - DNA, 20 bp, Artificial
  CRISPR gRNA sequence
cataagactcagaatctggt

SEQ ID NO: 223020 - DNA, 20 bp, Artificial
  CRISPR gRNA sequence
agaatctggtcaatctcatg

SEQ ID NO: 223021 - DNA, 20 bp, Artificial
  CRISPR gRNA sequence
gtcaatctcatggtttgaga

SEQ ID NO: 223022 - DNA, 20 bp, Artificial
  CRISPR gRNA sequence
atggtttgagattcagatta

SEQ ID NO: 223023 - DNA, 20 bp, Artificial
  CRISPR gRNA sequence
gagattcagattaggagaat

SEQ ID NO: 223024 - DNA, 20 bp, Artificial
  CRISPR gRNA sequence
agattcagattaggagaatt

SEQ ID NO: 223025 - DNA, 20 bp, Artificial
  CRISPR gRNA sequence
agattaggagaattaatgtg

SEQ ID NO: 223026 - DNA, 20 bp, Artificial
  CRISPR gRNA sequence
ggagaattaatgtgcatatt

SEQ ID NO: 223027 - DNA, 20 bp, Artificial
  CRISPR gRNA sequence
atgtgcatatttgaatatat

SEQ ID NO: 223028 - DNA, 20 bp, Artificial
  CRISPR gRNA sequence
gaatatatatcacacttgta

SEQ ID NO: 223029 - DNA, 20 bp, Artificial
  CRISPR gRNA sequence
aatatatatcacacttgtag

SEQ ID NO: 223030 - DNA, 20 bp, Artificial
  CRISPR gRNA sequence
gtaggttaaaaggtaaagca

SEQ ID NO: 223031 - DNA, 20 bp, Artificial
  CRISPR gRNA sequence
taggttaaaaggtaaagcaa

SEQ ID NO: 223032 - DNA, 20 bp, Artificial
  CRISPR gRNA sequence
aaaggtaaagcaaggggttt

SEQ ID NO: 223033 - DNA, 20 bp, Artificial
  CRISPR gRNA sequence
ggctagttcaaggcctgtca

SEQ ID NO: 223034 - DNA, 20 bp, Artificial
  CRISPR gRNA sequence
gctagttcaaggcctgtcaa

SEQ ID NO: 223035 - DNA, 20 bp, Artificial
  CRISPR gRNA sequence
gttcaaggcctgtcaaaacc

SEQ ID NO: 223036 - DNA, 20 bp, Artificial
  CRISPR gRNA sequence
aaggcctgtcaaaaccactt

SEQ ID NO: 223037 - DNA, 20 bp, Artificial
  CRISPR gRNA sequence
tcaaaaccacttttttccat

SEQ ID NO: 223038 - DNA, 20 bp, Artificial
  CRISPR gRNA sequence
ttttccatttcaagcaagta

SEQ ID NO: 223039 - DNA, 20 bp, Artificial
  CRISPR gRNA sequence
tttccatttcaagcaagtat

SEQ ID NO: 223040 - DNA, 20 bp, Artificial
  CRISPR gRNA sequence
ttccatttcaagcaagtatg

SEQ ID NO: 223041 - DNA, 20 bp, Artificial
  CRISPR gRNA sequence
tccatttcaagcaagtatga

SEQ ID NO: 223042 - DNA, 20 bp, Artificial
  CRISPR gRNA sequence
ccatttcaagcaagtatgag

SEQ ID NO: 223043 - DNA, 20 bp, Artificial
  CRISPR gRNA sequence
catttcaagcaagtatgagc

SEQ ID NO: 223044 - DNA, 20 bp, Artificial
  CRISPR gRNA sequence
caagcaagtatgagcctata

SEQ ID NO: 223045 - DNA, 20 bp, Artificial
  CRISPR gRNA sequence
aagcaagtatgagcctatac

SEQ ID NO: 223046 - DNA, 20 bp, Artificial
  CRISPR gRNA sequence
tactacacaccaagcagttt

SEQ ID NO: 223047 - DNA, 20 bp, Artificial
  CRISPR gRNA sequence
cacaccaagcagtttgcaaa

SEQ ID NO: 223048 - DNA, 20 bp, Artificial
  CRISPR gRNA sequence
gcaaagccctctttggcata

SEQ ID NO: 223049 - DNA, 20 bp, Artificial
  CRISPR gRNA sequence
caaagccctctttggcatat

SEQ ID NO: 223050 - DNA, 20 bp, Artificial
  CRISPR gRNA sequence
tttggcatatagacaaattt

SEQ ID NO: 223051 - DNA, 20 bp, Artificial
  CRISPR gRNA sequence
tggcatatagacaaatttca

SEQ ID NO: 223052 - DNA, 20 bp, Artificial
  CRISPR gRNA sequence
ggcatatagacaaatttcag

SEQ ID NO: 223053 - DNA, 20 bp, Artificial
  CRISPR gRNA sequence
gcatatagacaaatttcaga

SEQ ID NO: 223054 - DNA, 20 bp, Artificial
  CRISPR gRNA sequence
cagacagtatgtcagtatgt

SEQ ID NO: 223055 - DNA, 20 bp, Artificial
  CRISPR gRNA sequence
agacagtatgtcagtatgtc

SEQ ID NO: 223056 - DNA, 20 bp, Artificial
  CRISPR gRNA sequence
ttaatgacttaagatgtagt

SEQ ID NO: 223057 - DNA, 20 bp, Artificial
  CRISPR gRNA sequence
aatgacttaagatgtagtat

SEQ ID NO: 223058 - DNA, 20 bp, Artificial
  CRISPR gRNA sequence
atgacttaagatgtagtata

SEQ ID NO: 223059 - DNA, 20 bp, Artificial
  CRISPR gRNA sequence
aagatgtagtatatagacag

SEQ ID NO: 223060 - DNA, 20 bp, Artificial
  CRISPR gRNA sequence
agatgtagtatatagacagt

SEQ ID NO: 223061 - DNA, 20 bp, Artificial
  CRISPR gRNA sequence
gtttttattccctcatggta

SEQ ID NO: 223062 - DNA, 20 bp, Artificial
  CRISPR gRNA sequence
tttttattccctcatggtac

SEQ ID NO: 223063 - DNA, 20 bp, Artificial
  CRISPR gRNA sequence
ttattccctcatggtactta

SEQ ID NO: 223064 - DNA, 20 bp, Artificial
  CRISPR gRNA sequence
tattccctcatggtacttag

SEQ ID NO: 223065 - DNA, 20 bp, Artificial
  CRISPR gRNA sequence
attccctcatggtacttagg

SEQ ID NO: 223066 - DNA, 20 bp, Artificial
  CRISPR gRNA sequence
ttccctcatggtacttaggt

SEQ ID NO: 223067 - DNA, 20 bp, Artificial
  CRISPR gRNA sequence
cctcatggtacttaggtgct

SEQ ID NO: 223068 - DNA, 20 bp, Artificial
  CRISPR gRNA sequence
atggtacttaggtgcttgtt

SEQ ID NO: 223069 - DNA, 20 bp, Artificial
  CRISPR gRNA sequence
aggtgcttgttaaggccata

SEQ ID NO: 223070 - DNA, 20 bp, Artificial
  CRISPR gRNA sequence
ggtgcttgttaaggccataa

SEQ ID NO: 223071 - DNA, 20 bp, Artificial
  CRISPR gRNA sequence
gttaaggccataattctgga

SEQ ID NO: 223072 - DNA, 20 bp, Artificial
  CRISPR gRNA sequence
ttaaggccataattctggat

SEQ ID NO: 223073 - DNA, 20 bp, Artificial
  CRISPR gRNA sequence
aggccataattctggatgtt

SEQ ID NO: 223074 - DNA, 20 bp, Artificial
  CRISPR gRNA sequence
tggatgttattgactttaaa

SEQ ID NO: 223075 - DNA, 20 bp, Artificial
  CRISPR gRNA sequence
gatgttattgactttaaact

SEQ ID NO: 223076 - DNA, 20 bp, Artificial
  CRISPR gRNA sequence
ttgactttaaactgccctgc

SEQ ID NO: 223077 - DNA, 20 bp, Artificial
  CRISPR gRNA sequence
actttaaactgccctgccct

SEQ ID NO: 223078 - DNA, 20 bp, Artificial
  CRISPR gRNA sequence
taaactgccctgcccttttt

SEQ ID NO: 223079 - DNA, 20 bp, Artificial
  CRISPR gRNA sequence
aaactgccctgcccttttta

SEQ ID NO: 223080 - DNA, 20 bp, Artificial
  CRISPR gRNA sequence
aactgccctgccctttttaa

SEQ ID NO: 223081 - DNA, 20 bp, Artificial
  CRISPR gRNA sequence
ccctgccctttttaattcta

SEQ ID NO: 223082 - DNA, 20 bp, Artificial
  CRISPR gRNA sequence
ccctttttaattctaagttg

SEQ ID NO: 223083 - DNA, 20 bp, Artificial
  CRISPR gRNA sequence
tttaattctaagttggcctc

SEQ ID NO: 223084 - DNA, 20 bp, Artificial
  CRISPR gRNA sequence
ttaattctaagttggcctct

SEQ ID NO: 223085 - DNA, 20 bp, Artificial
  CRISPR gRNA sequence
taattctaagttggcctctt

SEQ ID NO: 223086 - DNA, 20 bp, Artificial
  CRISPR gRNA sequence
aattctaagttggcctcttc

SEQ ID NO: 223087 - DNA, 20 bp, Artificial
  CRISPR gRNA sequence
attctaagttggcctcttcc

SEQ ID NO: 223088 - DNA, 20 bp, Artificial
  CRISPR gRNA sequence
taagttggcctcttccattc

SEQ ID NO: 223089 - DNA, 20 bp, Artificial
  CRISPR gRNA sequence
agttggcctcttccattctt

SEQ ID NO: 223090 - DNA, 20 bp, Artificial
  CRISPR gRNA sequence
gcctcttccattcttataag

SEQ ID NO: 223091 - DNA, 20 bp, Artificial
  CRISPR gRNA sequence
ttccattcttataaggccac

SEQ ID NO: 223092 - DNA, 20 bp, Artificial
  CRISPR gRNA sequence
ccattcttataaggccactt

SEQ ID NO: 223093 - DNA, 20 bp, Artificial
  CRISPR gRNA sequence
cattcttataaggccacttt

SEQ ID NO: 223094 - DNA, 20 bp, Artificial
  CRISPR gRNA sequence
ttataaggccacttttaaat

SEQ ID NO: 223095 - DNA, 20 bp, Artificial
  CRISPR gRNA sequence
ataaggccacttttaaattc

SEQ ID NO: 223096 - DNA, 20 bp, Artificial
  CRISPR gRNA sequence
taaggccacttttaaattca

SEQ ID NO: 223097 - DNA, 20 bp, Artificial
  CRISPR gRNA sequence
ttaaattcattagggggatt

SEQ ID NO: 223098 - DNA, 20 bp, Artificial
  CRISPR gRNA sequence
taaattcattagggggattg

SEQ ID NO: 223099 - DNA, 20 bp, Artificial
  CRISPR gRNA sequence
aaattcattagggggattgc

SEQ ID NO: 223100 - DNA, 20 bp, Artificial
  CRISPR gRNA sequence
aattcattagggggattgcg

SEQ ID NO: 223101 - DNA, 20 bp, Artificial
  CRISPR gRNA sequence
attagggggattgcgttggg

SEQ ID NO: 223102 - DNA, 20 bp, Artificial
  CRISPR gRNA sequence
gggggattgcgttgggtcag

SEQ ID NO: 223103 - DNA, 20 bp, Artificial
  CRISPR gRNA sequence
cgttgggtcagaactaagta

SEQ ID NO: 223104 - DNA, 20 bp, Artificial
  CRISPR gRNA sequence
ggtcagaactaagtacaact

SEQ ID NO: 223105 - DNA, 20 bp, Artificial
  CRISPR gRNA sequence
agtacaacttgtggacaccc

SEQ ID NO: 223106 - DNA, 20 bp, Artificial
  CRISPR gRNA sequence
gtggacaccccactctaccc

SEQ ID NO: 223107 - DNA, 20 bp, Artificial
  CRISPR gRNA sequence
tggacaccccactctacccc

SEQ ID NO: 223108 - DNA, 20 bp, Artificial
  CRISPR gRNA sequence
taccccagacctttatttta

SEQ ID NO: 223109 - DNA, 20 bp, Artificial
  CRISPR gRNA sequence
ccccagacctttattttagt

SEQ ID NO: 223110 - DNA, 20 bp, Artificial
  CRISPR gRNA sequence
tattttagtgtccattgagg

SEQ ID NO: 223111 - DNA, 20 bp, Artificial
  CRISPR gRNA sequence
attttagtgtccattgagga

SEQ ID NO: 223112 - DNA, 20 bp, Artificial
  CRISPR gRNA sequence
ttttagtgtccattgaggag

SEQ ID NO: 223113 - DNA, 20 bp, Artificial
  CRISPR gRNA sequence
tagtgtccattgaggagaga

SEQ ID NO: 223114 - DNA, 20 bp, Artificial
  CRISPR gRNA sequence
agtgtccattgaggagagat

SEQ ID NO: 223115 - DNA, 20 bp, Artificial
  CRISPR gRNA sequence
gtgtccattgaggagagatc

SEQ ID NO: 223116 - DNA, 20 bp, Artificial
  CRISPR gRNA sequence
aggagagatctgacttcatc

SEQ ID NO: 223117 - DNA, 20 bp, Artificial
  CRISPR gRNA sequence
acttcatcctttttgtacgt

SEQ ID NO: 223118 - DNA, 20 bp, Artificial
  CRISPR gRNA sequence
catcctttttgtacgtaacc

SEQ ID NO: 223119 - DNA, 20 bp, Artificial
  CRISPR gRNA sequence
atcctttttgtacgtaaccc

SEQ ID NO: 223120 - DNA, 20 bp, Artificial
  CRISPR gRNA sequence
tttgtacgtaacccagtgta

SEQ ID NO: 223121 - DNA, 20 bp, Artificial
  CRISPR gRNA sequence
ttgtacgtaacccagtgtag

SEQ ID NO: 223122 - DNA, 20 bp, Artificial
  CRISPR gRNA sequence
tgtacgtaacccagtgtagc

SEQ ID NO: 223123 - DNA, 20 bp, Artificial
  CRISPR gRNA sequence
gtacgtaacccagtgtagct

SEQ ID NO: 223124 - DNA, 20 bp, Artificial
  CRISPR gRNA sequence
tacgtaacccagtgtagcta

SEQ ID NO: 223125 - DNA, 20 bp, Artificial
  CRISPR gRNA sequence
gagactccagttcttcaagc

SEQ ID NO: 223126 - DNA, 20 bp, Artificial
  CRISPR gRNA sequence
cagttcttcaagccagacac

SEQ ID NO: 223127 - DNA, 20 bp, Artificial
  CRISPR gRNA sequence
ttcaagccagacactagttc

SEQ ID NO: 223128 - DNA, 20 bp, Artificial
  CRISPR gRNA sequence
caagccagacactagttcta

SEQ ID NO: 223129 - DNA, 20 bp, Artificial
  CRISPR gRNA sequence
aagccagacactagttctaa

SEQ ID NO: 223130 - DNA, 20 bp, Artificial
  CRISPR gRNA sequence
gttctaaggggcaaaagtag

SEQ ID NO: 223131 - DNA, 20 bp, Artificial
  CRISPR gRNA sequence
taaggggcaaaagtaggtag

SEQ ID NO: 223132 - DNA, 20 bp, Artificial
  CRISPR gRNA sequence
aggggcaaaagtaggtagga

SEQ ID NO: 223133 - DNA, 20 bp, Artificial
  CRISPR gRNA sequence
ctttctggcatgtgtcttta

SEQ ID NO: 223134 - DNA, 20 bp, Artificial
  CRISPR gRNA sequence
tctggcatgtgtctttactg

SEQ ID NO: 223135 - DNA, 20 bp, Artificial
  CRISPR gRNA sequence
ctggcatgtgtctttactga

SEQ ID NO: 223136 - DNA, 20 bp, Artificial
  CRISPR gRNA sequence
tggcatgtgtctttactgat

SEQ ID NO: 223137 - DNA, 20 bp, Artificial
  CRISPR gRNA sequence
gcatgtgtctttactgatga

SEQ ID NO: 223138 - DNA, 20 bp, Artificial
  CRISPR gRNA sequence
tactgatgatctttgcttct

SEQ ID NO: 223139 - DNA, 20 bp, Artificial
  CRISPR gRNA sequence
actgatgatctttgcttctt

SEQ ID NO: 223140 - DNA, 20 bp, Artificial
  CRISPR gRNA sequence
ctgatgatctttgcttcttt

SEQ ID NO: 223141 - DNA, 20 bp, Artificial
  CRISPR gRNA sequence
atgatctttgcttctttacc

SEQ ID NO: 223142 - DNA, 20 bp, Artificial
  CRISPR gRNA sequence
tgcttctttacctaagaggc

SEQ ID NO: 223143 - DNA, 20 bp, Artificial
  CRISPR gRNA sequence
gcttctttacctaagaggct

SEQ ID NO: 223144 - DNA, 20 bp, Artificial
  CRISPR gRNA sequence
cttctttacctaagaggctg

SEQ ID NO: 223145 - DNA, 20 bp, Artificial
  CRISPR gRNA sequence
ctttacctaagaggctgctg

SEQ ID NO: 223146 - DNA, 20 bp, Artificial
  CRISPR gRNA sequence
tttacctaagaggctgctga

SEQ ID NO: 223147 - DNA, 20 bp, Artificial
  CRISPR gRNA sequence
tacctaagaggctgctgaga

SEQ ID NO: 223148 - DNA, 20 bp, Artificial
  CRISPR gRNA sequence
acctaagaggctgctgagac

SEQ ID NO: 223149 - DNA, 20 bp, Artificial
  CRISPR gRNA sequence
cctaagaggctgctgagact

SEQ ID NO: 223150 - DNA, 20 bp, Artificial
  CRISPR gRNA sequence
agaggctgctgagacttctt

SEQ ID NO: 223151 - DNA, 20 bp, Artificial
  CRISPR gRNA sequence
ctgagacttcttactccatt

SEQ ID NO: 223152 - DNA, 20 bp, Artificial
  CRISPR gRNA sequence
agacttcttactccattcct

SEQ ID NO: 223153 - DNA, 20 bp, Artificial
  CRISPR gRNA sequence
cttactccattcctgaacat

SEQ ID NO: 223154 - DNA, 20 bp, Artificial
  CRISPR gRNA sequence
ttactccattcctgaacatc

SEQ ID NO: 223155 - DNA, 20 bp, Artificial
  CRISPR gRNA sequence
actccattcctgaacatcca

SEQ ID NO: 223156 - DNA, 20 bp, Artificial
  CRISPR gRNA sequence
ctccattcctgaacatccat

SEQ ID NO: 223157 - DNA, 20 bp, Artificial
  CRISPR gRNA sequence
cattcctgaacatccattcc

SEQ ID NO: 223158 - DNA, 20 bp, Artificial
  CRISPR gRNA sequence
ctgaacatccattcccagca

SEQ ID NO: 223159 - DNA, 20 bp, Artificial
  CRISPR gRNA sequence
aacatccattcccagcagat

SEQ ID NO: 223160 - DNA, 20 bp, Artificial
  CRISPR gRNA sequence
ccagcagataattaacttcc

SEQ ID NO: 223161 - DNA, 20 bp, Artificial
  CRISPR gRNA sequence
acttcctactctactgcaaa

SEQ ID NO: 223162 - DNA, 20 bp, Artificial
  CRISPR gRNA sequence
cctactctactgcaaaaaat

SEQ ID NO: 223163 - DNA, 20 bp, Artificial
  CRISPR gRNA sequence
ctactctactgcaaaaaata

SEQ ID NO: 223164 - DNA, 20 bp, Artificial
  CRISPR gRNA sequence
ctctactgcaaaaaatagtg

SEQ ID NO: 223165 - DNA, 20 bp, Artificial
  CRISPR gRNA sequence
tactgcaaaaaatagtggtg

SEQ ID NO: 223166 - DNA, 20 bp, Artificial
  CRISPR gRNA sequence
ctgcaaaaaatagtggtgtg

SEQ ID NO: 223167 - DNA, 20 bp, Artificial
  CRISPR gRNA sequence
caaaaaatagtggtgtgtgg

SEQ ID NO: 223168 - DNA, 20 bp, Artificial
  CRISPR gRNA sequence
ggactccctctgcttccctc

SEQ ID NO: 223169 - DNA, 20 bp, Artificial
  CRISPR gRNA sequence
gactccctctgcttccctcc

SEQ ID NO: 223170 - DNA, 20 bp, Artificial
  CRISPR gRNA sequence
cctctgcttccctcccacca

SEQ ID NO: 223171 - DNA, 20 bp, Artificial
  CRISPR gRNA sequence
tgcttccctcccaccattac

SEQ ID NO: 223172 - DNA, 20 bp, Artificial
  CRISPR gRNA sequence
cttccctcccaccattacta

SEQ ID NO: 223173 - DNA, 20 bp, Artificial
  CRISPR gRNA sequence
ccctcccaccattactaaac

SEQ ID NO: 223174 - DNA, 20 bp, Artificial
  CRISPR gRNA sequence
cctcccaccattactaaact

SEQ ID NO: 223175 - DNA, 20 bp, Artificial
  CRISPR gRNA sequence
ccaccattactaaactgatc

SEQ ID NO: 223176 - DNA, 20 bp, Artificial
  CRISPR gRNA sequence
ctaaactgatctataacatc

SEQ ID NO: 223177 - DNA, 20 bp, Artificial
  CRISPR gRNA sequence
aactgatctataacatctta

SEQ ID NO: 223178 - DNA, 20 bp, Artificial
  CRISPR gRNA sequence
atctataacatcttagataa

SEQ ID NO: 223179 - DNA, 20 bp, Artificial
  CRISPR gRNA sequence
taacatcttagataaccttc

SEQ ID NO: 223180 - DNA, 20 bp, Artificial
  CRISPR gRNA sequence
agataaccttcgtctcattc

SEQ ID NO: 223181 - DNA, 20 bp, Artificial
  CRISPR gRNA sequence
gataaccttcgtctcattct

SEQ ID NO: 223182 - DNA, 20 bp, Artificial
  CRISPR gRNA sequence
cgtctcattctcttccgtca

SEQ ID NO: 223183 - DNA, 20 bp, Artificial
  CRISPR gRNA sequence
gtctcattctcttccgtcat

SEQ ID NO: 223184 - DNA, 20 bp, Artificial
  CRISPR gRNA sequence
attctcttccgtcatccagc

SEQ ID NO: 223185 - DNA, 20 bp, Artificial
  CRISPR gRNA sequence
tcttccgtcatccagcttca

SEQ ID NO: 223186 - DNA, 20 bp, Artificial
  CRISPR gRNA sequence
ttccgtcatccagcttcaga

SEQ ID NO: 223187 - DNA, 20 bp, Artificial
  CRISPR gRNA sequence
ccgtcatccagcttcagaag

SEQ ID NO: 223188 - DNA, 20 bp, Artificial
  CRISPR gRNA sequence
cgtcatccagcttcagaaga

SEQ ID NO: 223189 - DNA, 20 bp, Artificial
  CRISPR gRNA sequence
cagaagaaaacctactcact

SEQ ID NO: 223190 - DNA, 20 bp, Artificial
  CRISPR gRNA sequence
agaagaaaacctactcactt

SEQ ID NO: 223191 - DNA, 20 bp, Artificial
  CRISPR gRNA sequence
ctcacttttccaacgaaagg

SEQ ID NO: 223192 - DNA, 20 bp, Artificial
  CRISPR gRNA sequence
acttttccaacgaaaggaca

SEQ ID NO: 223193 - DNA, 20 bp, Artificial
  CRISPR gRNA sequence
ttccaacgaaaggacaacct

SEQ ID NO: 223194 - DNA, 20 bp, Artificial
  CRISPR gRNA sequence
tccaacgaaaggacaacctg

SEQ ID NO: 223195 - DNA, 20 bp, Artificial
  CRISPR gRNA sequence
ccaacgaaaggacaacctgt

SEQ ID NO: 223196 - DNA, 20 bp, Artificial
  CRISPR gRNA sequence
caacgaaaggacaacctgtc

SEQ ID NO: 223197 - DNA, 20 bp, Artificial
  CRISPR gRNA sequence
tctaccaccttttcacttct

SEQ ID NO: 223198 - DNA, 20 bp, Artificial
  CRISPR gRNA sequence
ccaccttttcacttctacca

SEQ ID NO: 223199 - DNA, 20 bp, Artificial
  CRISPR gRNA sequence
ttcacttctaccatcttgga

SEQ ID NO: 223200 - DNA, 20 bp, Artificial
  CRISPR gRNA sequence
tcacttctaccatcttggag

SEQ ID NO: 223201 - DNA, 20 bp, Artificial
  CRISPR gRNA sequence
cacttctaccatcttggaga

SEQ ID NO: 223202 - DNA, 20 bp, Artificial
  CRISPR gRNA sequence
acttctaccatcttggagac

SEQ ID NO: 223203 - DNA, 20 bp, Artificial
  CRISPR gRNA sequence
ctaccatcttggagacctgc

SEQ ID NO: 223204 - DNA, 20 bp, Artificial
  CRISPR gRNA sequence
taccatcttggagacctgct

SEQ ID NO: 223205 - DNA, 20 bp, Artificial
  CRISPR gRNA sequence
ccatcttggagacctgctca

SEQ ID NO: 223206 - DNA, 20 bp, Artificial
  CRISPR gRNA sequence
ggagacctgctcagtcagca

SEQ ID NO: 223207 - DNA, 20 bp, Artificial
  CRISPR gRNA sequence
gagacctgctcagtcagcat

SEQ ID NO: 223208 - DNA, 20 bp, Artificial
  CRISPR gRNA sequence
ctcagtcagcataattcttc

SEQ ID NO: 223209 - DNA, 20 bp, Artificial
  CRISPR gRNA sequence
agtcagcataattcttcagt

SEQ ID NO: 223210 - DNA, 20 bp, Artificial
  CRISPR gRNA sequence
ttcagtcttgcatcttagat

SEQ ID NO: 223211 - DNA, 20 bp, Artificial
  CRISPR gRNA sequence
cagtcttgcatcttagatct

SEQ ID NO: 223212 - DNA, 20 bp, Artificial
  CRISPR gRNA sequence
agtcttgcatcttagatctt

SEQ ID NO: 223213 - DNA, 20 bp, Artificial
  CRISPR gRNA sequence
gcatcttagatctttccctc

SEQ ID NO: 223214 - DNA, 20 bp, Artificial
  CRISPR gRNA sequence
catcttagatctttccctct

SEQ ID NO: 223215 - DNA, 20 bp, Artificial
  CRISPR gRNA sequence
agatctttccctctccattg

SEQ ID NO: 223216 - DNA, 20 bp, Artificial
  CRISPR gRNA sequence
gatctttccctctccattga

SEQ ID NO: 223217 - DNA, 20 bp, Artificial
  CRISPR gRNA sequence
tccctctccattgactcctt

SEQ ID NO: 223218 - DNA, 20 bp, Artificial
  CRISPR gRNA sequence
ccctctccattgactccttc

SEQ ID NO: 223219 - DNA, 20 bp, Artificial
  CRISPR gRNA sequence
cctctccattgactccttcc

SEQ ID NO: 223220 - DNA, 20 bp, Artificial
  CRISPR gRNA sequence
tccattgactccttccccgt

SEQ ID NO: 223221 - DNA, 20 bp, Artificial
  CRISPR gRNA sequence
cattgactccttccccgtag

SEQ ID NO: 223222 - DNA, 20 bp, Artificial
  CRISPR gRNA sequence
actccttccccgtagcttgc

SEQ ID NO: 223223 - DNA, 20 bp, Artificial
  CRISPR gRNA sequence
cttccccgtagcttgcacac

SEQ ID NO: 223224 - DNA, 20 bp, Artificial
  CRISPR gRNA sequence
ccccgtagcttgcacacatg

SEQ ID NO: 223225 - DNA, 20 bp, Artificial
  CRISPR gRNA sequence
cccgtagcttgcacacatga

SEQ ID NO: 223226 - DNA, 20 bp, Artificial
  CRISPR gRNA sequence
gcacacatgatcaaatttta

SEQ ID NO: 223227 - DNA, 20 bp, Artificial
  CRISPR gRNA sequence
cacacatgatcaaattttac

SEQ ID NO: 223228 - DNA, 20 bp, Artificial
  CRISPR gRNA sequence
taccccatattaaaaaataa

SEQ ID NO: 223229 - DNA, 20 bp, Artificial
  CRISPR gRNA sequence
accccatattaaaaaataaa

SEQ ID NO: 223230 - DNA, 20 bp, Artificial
  CRISPR gRNA sequence
ccccatattaaaaaataaaa

SEQ ID NO: 223231 - DNA, 20 bp, Artificial
  CRISPR gRNA sequence
aaaaataaaacaaaaaacct

SEQ ID NO: 223232 - DNA, 20 bp, Artificial
  CRISPR gRNA sequence
aagaaccaaaatgtccttgc

SEQ ID NO: 223233 - DNA, 20 bp, Artificial
  CRISPR gRNA sequence
gcccttgttcctgcctgcac

SEQ ID NO: 223234 - DNA, 20 bp, Artificial
  CRISPR gRNA sequence
cccttgttcctgcctgcaca

SEQ ID NO: 223235 - DNA, 20 bp, Artificial
  CRISPR gRNA sequence
gttcctgcctgcacattgtc

SEQ ID NO: 223236 - DNA, 20 bp, Artificial
  CRISPR gRNA sequence
ttcctgcctgcacattgtca

SEQ ID NO: 223237 - DNA, 20 bp, Artificial
  CRISPR gRNA sequence
ctgcctgcacattgtcagtt

SEQ ID NO: 223238 - DNA, 20 bp, Artificial
  CRISPR gRNA sequence
cctgcacattgtcagttgtt

SEQ ID NO: 223239 - DNA, 20 bp, Artificial
  CRISPR gRNA sequence
cacattgtcagttgttgcct

SEQ ID NO: 223240 - DNA, 20 bp, Artificial
  CRISPR gRNA sequence
tcagttgttgccttctctgc

SEQ ID NO: 223241 - DNA, 20 bp, Artificial
  CRISPR gRNA sequence
ttgccttctctgctttctta

SEQ ID NO: 223242 - DNA, 20 bp, Artificial
  CRISPR gRNA sequence
ccttctctgctttcttacac

SEQ ID NO: 223243 - DNA, 20 bp, Artificial
  CRISPR gRNA sequence
ctctgctttcttacactgcc

SEQ ID NO: 223244 - DNA, 20 bp, Artificial
  CRISPR gRNA sequence
tctgctttcttacactgcca

SEQ ID NO: 223245 - DNA, 20 bp, Artificial
  CRISPR gRNA sequence
tgctttcttacactgccaaa

SEQ ID NO: 223246 - DNA, 20 bp, Artificial
  CRISPR gRNA sequence
ctttcttacactgccaaatt

SEQ ID NO: 223247 - DNA, 20 bp, Artificial
  CRISPR gRNA sequence
tcttacactgccaaatttat

SEQ ID NO: 223248 - DNA, 20 bp, Artificial
  CRISPR gRNA sequence
cttacactgccaaatttatt

SEQ ID NO: 223249 - DNA, 20 bp, Artificial
  CRISPR gRNA sequence
ttacactgccaaatttattg

SEQ ID NO: 223250 - DNA, 20 bp, Artificial
  CRISPR gRNA sequence
acactgccaaatttattgta

SEQ ID NO: 223251 - DNA, 20 bp, Artificial
  CRISPR gRNA sequence
cactgccaaatttattgtaa

SEQ ID NO: 223252 - DNA, 20 bp, Artificial
  CRISPR gRNA sequence
ccaaatttattgtaaaagaa

SEQ ID NO: 223253 - DNA, 20 bp, Artificial
  CRISPR gRNA sequence
attgtaaaagaatcactgcc

SEQ ID NO: 223254 - DNA, 20 bp, Artificial
  CRISPR gRNA sequence
ttgtaaaagaatcactgcca

SEQ ID NO: 223255 - DNA, 20 bp, Artificial
  CRISPR gRNA sequence
taaaagaatcactgccactt

SEQ ID NO: 223256 - DNA, 20 bp, Artificial
  CRISPR gRNA sequence
ccacttaatatattttaagt

SEQ ID NO: 223257 - DNA, 20 bp, Artificial
  CRISPR gRNA sequence
aatatattttaagtgcttga

SEQ ID NO: 223258 - DNA, 20 bp, Artificial
  CRISPR gRNA sequence
atatattttaagtgcttgat

SEQ ID NO: 223259 - DNA, 20 bp, Artificial
  CRISPR gRNA sequence
taagtgcttgataaagccat

SEQ ID NO: 223260 - DNA, 20 bp, Artificial
  CRISPR gRNA sequence
aagtgcttgataaagccatc

SEQ ID NO: 223261 - DNA, 20 bp, Artificial
  CRISPR gRNA sequence
agtgcttgataaagccatct

SEQ ID NO: 223262 - DNA, 20 bp, Artificial
  CRISPR gRNA sequence
gataaagccatcttgtttct

SEQ ID NO: 223263 - DNA, 20 bp, Artificial
  CRISPR gRNA sequence
ataaagccatcttgtttctc

SEQ ID NO: 223264 - DNA, 20 bp, Artificial
  CRISPR gRNA sequence
gtttctctctcatttctcaa

SEQ ID NO: 223265 - DNA, 20 bp, Artificial
  CRISPR gRNA sequence
tttctctctcatttctcaaa

SEQ ID NO: 223266 - DNA, 20 bp, Artificial
  CRISPR gRNA sequence
ctctctcatttctcaaacat

SEQ ID NO: 223267 - DNA, 20 bp, Artificial
  CRISPR gRNA sequence
tctctcatttctcaaacata

SEQ ID NO: 223268 - DNA, 20 bp, Artificial
  CRISPR gRNA sequence
tctcatttctcaaacatagt

SEQ ID NO: 223269 - DNA, 20 bp, Artificial
  CRISPR gRNA sequence
tcatttctcaaacatagtgt

SEQ ID NO: 223270 - DNA, 20 bp, Artificial
  CRISPR gRNA sequence
atttctcaaacatagtgtgc

SEQ ID NO: 223271 - DNA, 20 bp, Artificial
  CRISPR gRNA sequence
ctcaaacatagtgtgcatca

SEQ ID NO: 223272 - DNA, 20 bp, Artificial
  CRISPR gRNA sequence
tcaaacatagtgtgcatcag

SEQ ID NO: 223273 - DNA, 20 bp, Artificial
  CRISPR gRNA sequence
aaacatagtgtgcatcagat

SEQ ID NO: 223274 - DNA, 20 bp, Artificial
  CRISPR gRNA sequence
actagtccattgacagatgg

SEQ ID NO: 223275 - DNA, 20 bp, Artificial
  CRISPR gRNA sequence
gtccattgacagatggaaag

SEQ ID NO: 223276 - DNA, 20 bp, Artificial
  CRISPR gRNA sequence
acagatggaaagatattctc

SEQ ID NO: 223277 - DNA, 20 bp, Artificial
  CRISPR gRNA sequence
tccccaaatatttaagcctc

SEQ ID NO: 223278 - DNA, 20 bp, Artificial
  CRISPR gRNA sequence
cccaaatatttaagcctctt

SEQ ID NO: 223279 - DNA, 20 bp, Artificial
  CRISPR gRNA sequence
aagcctcttttctctataat

SEQ ID NO: 223280 - DNA, 20 bp, Artificial
  CRISPR gRNA sequence
agcctcttttctctataatt

SEQ ID NO: 223281 - DNA, 20 bp, Artificial
  CRISPR gRNA sequence
ttttctctataattagccta

SEQ ID NO: 223282 - DNA, 20 bp, Artificial
  CRISPR gRNA sequence
ttctctataattagcctacc

SEQ ID NO: 223283 - DNA, 20 bp, Artificial
  CRISPR gRNA sequence
tctctataattagcctacca

SEQ ID NO: 223284 - DNA, 20 bp, Artificial
  CRISPR gRNA sequence
ctctataattagcctaccat

SEQ ID NO: 223285 - DNA, 20 bp, Artificial
  CRISPR gRNA sequence
tctataattagcctaccatc

SEQ ID NO: 223286 - DNA, 20 bp, Artificial
  CRISPR gRNA sequence
tataattagcctaccatcta

SEQ ID NO: 223287 - DNA, 20 bp, Artificial
  CRISPR gRNA sequence
taattagcctaccatctaac

SEQ ID NO: 223288 - DNA, 20 bp, Artificial
  CRISPR gRNA sequence
gcctaccatctaactagcta

SEQ ID NO: 223289 - DNA, 20 bp, Artificial
  CRISPR gRNA sequence
ccatctaactagctacacat

SEQ ID NO: 223290 - DNA, 20 bp, Artificial
  CRISPR gRNA sequence
actagctacacatactattt

SEQ ID NO: 223291 - DNA, 20 bp, Artificial
  CRISPR gRNA sequence
gctacacatactattttggt

SEQ ID NO: 223292 - DNA, 20 bp, Artificial
  CRISPR gRNA sequence
cacatactattttggttcac

SEQ ID NO: 223293 - DNA, 20 bp, Artificial
  CRISPR gRNA sequence
ttttggttcacaattttaat

SEQ ID NO: 223294 - DNA, 20 bp, Artificial
  CRISPR gRNA sequence
tggttcacaattttaatttt

SEQ ID NO: 223295 - DNA, 20 bp, Artificial
  CRISPR gRNA sequence
ggttcacaattttaattttc

SEQ ID NO: 223296 - DNA, 20 bp, Artificial
  CRISPR gRNA sequence
gttcacaattttaattttcc

SEQ ID NO: 223297 - DNA, 20 bp, Artificial
  CRISPR gRNA sequence
acaattttaattttcccctc

SEQ ID NO: 223298 - DNA, 20 bp, Artificial
  CRISPR gRNA sequence
taattttcccctctttatct

SEQ ID NO: 223299 - DNA, 20 bp, Artificial
  CRISPR gRNA sequence
aattttcccctctttatctc

SEQ ID NO: 223300 - DNA, 20 bp, Artificial
  CRISPR gRNA sequence
attttcccctctttatctcc

SEQ ID NO: 223301 - DNA, 20 bp, Artificial
  CRISPR gRNA sequence
tcccctctttatctcccctg

SEQ ID NO: 223302 - DNA, 20 bp, Artificial
  CRISPR gRNA sequence
cccctctttatctcccctgc

SEQ ID NO: 223303 - DNA, 20 bp, Artificial
  CRISPR gRNA sequence
ccctctttatctcccctgct

SEQ ID NO: 223304 - DNA, 20 bp, Artificial
  CRISPR gRNA sequence
tttatctcccctgcttccca

SEQ ID NO: 223305 - DNA, 20 bp, Artificial
  CRISPR gRNA sequence
tatctcccctgcttcccaca

SEQ ID NO: 223306 - DNA, 20 bp, Artificial
  CRISPR gRNA sequence
atctcccctgcttcccacaa

SEQ ID NO: 223307 - DNA, 20 bp, Artificial
  CRISPR gRNA sequence
tctcccctgcttcccacaac

SEQ ID NO: 223308 - DNA, 20 bp, Artificial
  CRISPR gRNA sequence
ccctgcttcccacaactaac

SEQ ID NO: 223309 - DNA, 20 bp, Artificial
  CRISPR gRNA sequence
cttcccacaactaacttctg

SEQ ID NO: 223310 - DNA, 20 bp, Artificial
  CRISPR gRNA sequence
cccacaactaacttctgttg

SEQ ID NO: 223311 - DNA, 20 bp, Artificial
  CRISPR gRNA sequence
ccacaactaacttctgttga

SEQ ID NO: 223312 - DNA, 20 bp, Artificial
  CRISPR gRNA sequence
acttctgttgattactgtaa

SEQ ID NO: 223313 - DNA, 20 bp, Artificial
  CRISPR gRNA sequence
ctgttgattactgtaagttt

SEQ ID NO: 223314 - DNA, 20 bp, Artificial
  CRISPR gRNA sequence
tgttgattactgtaagtttt

SEQ ID NO: 223315 - DNA, 20 bp, Artificial
  CRISPR gRNA sequence
ttgattactgtaagttttag

SEQ ID NO: 223316 - DNA, 20 bp, Artificial
  CRISPR gRNA sequence
attactgtaagttttaggtc

SEQ ID NO: 223317 - DNA, 20 bp, Artificial
  CRISPR gRNA sequence
ctgtaagttttaggtcttct

SEQ ID NO: 223318 - DNA, 20 bp, Artificial
  CRISPR gRNA sequence
taagttttaggtcttctctc

SEQ ID NO: 223319 - DNA, 20 bp, Artificial
  CRISPR gRNA sequence
taggtcttctctccagttgt

SEQ ID NO: 223320 - DNA, 20 bp, Artificial
  CRISPR gRNA sequence
aggtcttctctccagttgtt

SEQ ID NO: 223321 - DNA, 20 bp, Artificial
  CRISPR gRNA sequence
ggtcttctctccagttgttc

SEQ ID NO: 223322 - DNA, 20 bp, Artificial
  CRISPR gRNA sequence
ctctccagttgttctttacc

SEQ ID NO: 223323 - DNA, 20 bp, Artificial
  CRISPR gRNA sequence
tctccagttgttctttacct

SEQ ID NO: 223324 - DNA, 20 bp, Artificial
  CRISPR gRNA sequence
tccagttgttctttacctgg

SEQ ID NO: 223325 - DNA, 20 bp, Artificial
  CRISPR gRNA sequence
cagttgttctttacctggac

SEQ ID NO: 223326 - DNA, 20 bp, Artificial
  CRISPR gRNA sequence
ttctttacctggactattgc

SEQ ID NO: 223327 - DNA, 20 bp, Artificial
  CRISPR gRNA sequence
tttacctggactattgcagt

SEQ ID NO: 223328 - DNA, 20 bp, Artificial
  CRISPR gRNA sequence
tacctggactattgcagtag

SEQ ID NO: 223329 - DNA, 20 bp, Artificial
  CRISPR gRNA sequence
acctggactattgcagtagt

SEQ ID NO: 223330 - DNA, 20 bp, Artificial
  CRISPR gRNA sequence
cctggactattgcagtagtc

SEQ ID NO: 223331 - DNA, 20 bp, Artificial
  CRISPR gRNA sequence
gactattgcagtagtctgtt

SEQ ID NO: 223332 - DNA, 20 bp, Artificial
  CRISPR gRNA sequence
ttgcagtagtctgttaacgg

SEQ ID NO: 223333 - DNA, 20 bp, Artificial
  CRISPR gRNA sequence
cagtagtctgttaacggatc

SEQ ID NO: 223334 - DNA, 20 bp, Artificial
  CRISPR gRNA sequence
ttaacggatctccctttctc

SEQ ID NO: 223335 - DNA, 20 bp, Artificial
  CRISPR gRNA sequence
acggatctccctttctcttt

SEQ ID NO: 223336 - DNA, 20 bp, Artificial
  CRISPR gRNA sequence
cctttctcttttcccttgct

SEQ ID NO: 223337 - DNA, 20 bp, Artificial
  CRISPR gRNA sequence
tctcttttcccttgctgccc

SEQ ID NO: 223338 - DNA, 20 bp, Artificial
  CRISPR gRNA sequence
ctcttttcccttgctgccct

SEQ ID NO: 223339 - DNA, 20 bp, Artificial
  CRISPR gRNA sequence
tcttttcccttgctgccctc

SEQ ID NO: 223340 - DNA, 20 bp, Artificial
  CRISPR gRNA sequence
ttttcccttgctgccctcag

SEQ ID NO: 223341 - DNA, 20 bp, Artificial
  CRISPR gRNA sequence
ttcccttgctgccctcagtc

SEQ ID NO: 223342 - DNA, 20 bp, Artificial
  CRISPR gRNA sequence
tcccttgctgccctcagtcc

SEQ ID NO: 223343 - DNA, 20 bp, Artificial
  CRISPR gRNA sequence
cccttgctgccctcagtcct

SEQ ID NO: 223344 - DNA, 20 bp, Artificial
  CRISPR gRNA sequence
ccttgctgccctcagtcctt

SEQ ID NO: 223345 - DNA, 20 bp, Artificial
  CRISPR gRNA sequence
gctgccctcagtccttcctt

SEQ ID NO: 223346 - DNA, 20 bp, Artificial
  CRISPR gRNA sequence
ctgccctcagtccttccttt

SEQ ID NO: 223347 - DNA, 20 bp, Artificial
  CRISPR gRNA sequence
ccctcagtccttcctttaca

SEQ ID NO: 223348 - DNA, 20 bp, Artificial
  CRISPR gRNA sequence
agtccttcctttacactgct

SEQ ID NO: 223349 - DNA, 20 bp, Artificial
  CRISPR gRNA sequence
cctttacactgctgtcaatg

SEQ ID NO: 223350 - DNA, 20 bp, Artificial
  CRISPR gRNA sequence
ctttacactgctgtcaatgt

SEQ ID NO: 223351 - DNA, 20 bp, Artificial
  CRISPR gRNA sequence
tacactgctgtcaatgtttt

SEQ ID NO: 223352 - DNA, 20 bp, Artificial
  CRISPR gRNA sequence
acactgctgtcaatgttttt

SEQ ID NO: 223353 - DNA, 20 bp, Artificial
  CRISPR gRNA sequence
cactgctgtcaatgtttttt

SEQ ID NO: 223354 - DNA, 20 bp, Artificial
  CRISPR gRNA sequence
ctgtcaatgtttttttttta

SEQ ID NO: 223355 - DNA, 20 bp, Artificial
  CRISPR gRNA sequence
tcaatgttttttttttaatg

SEQ ID NO: 223356 - DNA, 20 bp, Artificial
  CRISPR gRNA sequence
tttttttaatgaaattaaat

SEQ ID NO: 223357 - DNA, 20 bp, Artificial
  CRISPR gRNA sequence
ttttttaatgaaattaaatc

SEQ ID NO: 223358 - DNA, 20 bp, Artificial
  CRISPR gRNA sequence
tttttaatgaaattaaatct

SEQ ID NO: 223359 - DNA, 20 bp, Artificial
  CRISPR gRNA sequence
ttttaatgaaattaaatctg

SEQ ID NO: 223360 - DNA, 20 bp, Artificial
  CRISPR gRNA sequence
tttaatgaaattaaatctga

SEQ ID NO: 223361 - DNA, 20 bp, Artificial
  CRISPR gRNA sequence
ttaatgaaattaaatctgag

SEQ ID NO: 223362 - DNA, 20 bp, Artificial
  CRISPR gRNA sequence
taatgaaattaaatctgagt

SEQ ID NO: 223363 - DNA, 20 bp, Artificial
  CRISPR gRNA sequence
aatgaaattaaatctgagtg

SEQ ID NO: 223364 - DNA, 20 bp, Artificial
  CRISPR gRNA sequence
atgaaattaaatctgagtgg

SEQ ID NO: 223365 - DNA, 20 bp, Artificial
  CRISPR gRNA sequence
aatctgagtggtttacagtt

SEQ ID NO: 223366 - DNA, 20 bp, Artificial
  CRISPR gRNA sequence
agtggtttacagttgtttat

SEQ ID NO: 223367 - DNA, 20 bp, Artificial
  CRISPR gRNA sequence
acagttgtttatgttatcaa

SEQ ID NO: 223368 - DNA, 20 bp, Artificial
  CRISPR gRNA sequence
cagttgtttatgttatcaag

SEQ ID NO: 223369 - DNA, 20 bp, Artificial
  CRISPR gRNA sequence
tttatgttatcaagtctaaa

SEQ ID NO: 223370 - DNA, 20 bp, Artificial
  CRISPR gRNA sequence
atgttatcaagtctaaactc

SEQ ID NO: 223371 - DNA, 20 bp, Artificial
  CRISPR gRNA sequence
tgttatcaagtctaaactca

SEQ ID NO: 223372 - DNA, 20 bp, Artificial
  CRISPR gRNA sequence
tcaagtctaaactcagcatg

SEQ ID NO: 223373 - DNA, 20 bp, Artificial
  CRISPR gRNA sequence
aactcagcatgacattcaag

SEQ ID NO: 223374 - DNA, 20 bp, Artificial
  CRISPR gRNA sequence
agcatgacattcaaggaagc

SEQ ID NO: 223375 - DNA, 20 bp, Artificial
  CRISPR gRNA sequence
aaggaagccctttagaattt

SEQ ID NO: 223376 - DNA, 20 bp, Artificial
  CRISPR gRNA sequence
tagaatttttcttattcatc

SEQ ID NO: 223377 - DNA, 20 bp, Artificial
  CRISPR gRNA sequence
agaatttttcttattcatct

SEQ ID NO: 223378 - DNA, 20 bp, Artificial
  CRISPR gRNA sequence
gaatttttcttattcatctt

SEQ ID NO: 223379 - DNA, 20 bp, Artificial
  CRISPR gRNA sequence
ttcttattcatcttttccaa

SEQ ID NO: 223380 - DNA, 20 bp, Artificial
  CRISPR gRNA sequence
tcttattcatcttttccaac

SEQ ID NO: 223381 - DNA, 20 bp, Artificial
  CRISPR gRNA sequence
cttattcatcttttccaacc

SEQ ID NO: 223382 - DNA, 20 bp, Artificial
  CRISPR gRNA sequence
ttattcatcttttccaacct

SEQ ID NO: 223383 - DNA, 20 bp, Artificial
  CRISPR gRNA sequence
attcatcttttccaacctca

SEQ ID NO: 223384 - DNA, 20 bp, Artificial
  CRISPR gRNA sequence
ttcatcttttccaacctcat

SEQ ID NO: 223385 - DNA, 20 bp, Artificial
  CRISPR gRNA sequence
atcttttccaacctcatttc

SEQ ID NO: 223386 - DNA, 20 bp, Artificial
  CRISPR gRNA sequence
ttccaacctcatttcctaga

SEQ ID NO: 223387 - DNA, 20 bp, Artificial
  CRISPR gRNA sequence
tccaacctcatttcctagag

SEQ ID NO: 223388 - DNA, 20 bp, Artificial
  CRISPR gRNA sequence
ccaacctcatttcctagagc

SEQ ID NO: 223389 - DNA, 20 bp, Artificial
  CRISPR gRNA sequence
caacctcatttcctagagct

SEQ ID NO: 223390 - DNA, 20 bp, Artificial
  CRISPR gRNA sequence
atttcctagagctcacctaa

SEQ ID NO: 223391 - DNA, 20 bp, Artificial
  CRISPR gRNA sequence
cctagagctcacctaaataa

SEQ ID NO: 223392 - DNA, 20 bp, Artificial
  CRISPR gRNA sequence
ctagagctcacctaaataat

SEQ ID NO: 223393 - DNA, 20 bp, Artificial
  CRISPR gRNA sequence
gagctcacctaaataattct

SEQ ID NO: 223394 - DNA, 20 bp, Artificial
  CRISPR gRNA sequence
acctaaataattctctgctt

SEQ ID NO: 223395 - DNA, 20 bp, Artificial
  CRISPR gRNA sequence
aataattctctgctttcagt

SEQ ID NO: 223396 - DNA, 20 bp, Artificial
  CRISPR gRNA sequence
tctgctttcagttcttcact

SEQ ID NO: 223397 - DNA, 20 bp, Artificial
  CRISPR gRNA sequence
tgctttcagttcttcacttt

SEQ ID NO: 223398 - DNA, 20 bp, Artificial
  CRISPR gRNA sequence
ctttcagttcttcactttct

SEQ ID NO: 223399 - DNA, 20 bp, Artificial
  CRISPR gRNA sequence
tcagttcttcactttcttta

SEQ ID NO: 223400 - DNA, 20 bp, Artificial
  CRISPR gRNA sequence
cagttcttcactttctttat

SEQ ID NO: 223401 - DNA, 20 bp, Artificial
  CRISPR gRNA sequence
agttcttcactttctttatc

SEQ ID NO: 223402 - DNA, 20 bp, Artificial
  CRISPR gRNA sequence
ttcactttctttatctggct

SEQ ID NO: 223403 - DNA, 20 bp, Artificial
  CRISPR gRNA sequence
cactttctttatctggctgt

SEQ ID NO: 223404 - DNA, 20 bp, Artificial
  CRISPR gRNA sequence
actttctttatctggctgta

SEQ ID NO: 223405 - DNA, 20 bp, Artificial
  CRISPR gRNA sequence
tctttatctggctgtacacg

SEQ ID NO: 223406 - DNA, 20 bp, Artificial
  CRISPR gRNA sequence
ctttatctggctgtacacgt

SEQ ID NO: 223407 - DNA, 20 bp, Artificial
  CRISPR gRNA sequence
tttatctggctgtacacgtt

SEQ ID NO: 223408 - DNA, 20 bp, Artificial
  CRISPR gRNA sequence
tatctggctgtacacgttac

SEQ ID NO: 223409 - DNA, 20 bp, Artificial
  CRISPR gRNA sequence
atctggctgtacacgttact

SEQ ID NO: 223410 - DNA, 20 bp, Artificial
  CRISPR gRNA sequence
tctggctgtacacgttactc

SEQ ID NO: 223411 - DNA, 20 bp, Artificial
  CRISPR gRNA sequence
gctgtacacgttactctgcc

SEQ ID NO: 223412 - DNA, 20 bp, Artificial
  CRISPR gRNA sequence
tacacgttactctgcctaga

SEQ ID NO: 223413 - DNA, 20 bp, Artificial
  CRISPR gRNA sequence
ctctgcctagaaagcccctt

SEQ ID NO: 223414 - DNA, 20 bp, Artificial
  CRISPR gRNA sequence
tgcctagaaagccccttctt

SEQ ID NO: 223415 - DNA, 20 bp, Artificial
  CRISPR gRNA sequence
cctagaaagccccttctttc

SEQ ID NO: 223416 - DNA, 20 bp, Artificial
  CRISPR gRNA sequence
gaaagccccttctttcccat

SEQ ID NO: 223417 - DNA, 20 bp, Artificial
  CRISPR gRNA sequence
ctttcccataacattcttac

SEQ ID NO: 223418 - DNA, 20 bp, Artificial
  CRISPR gRNA sequence
tttcccataacattcttact

SEQ ID NO: 223419 - DNA, 20 bp, Artificial
  CRISPR gRNA sequence
tcccataacattcttactca

SEQ ID NO: 223420 - DNA, 20 bp, Artificial
  CRISPR gRNA sequence
cccataacattcttactcat

SEQ ID NO: 223421 - DNA, 20 bp, Artificial
  CRISPR gRNA sequence
ccataacattcttactcatc

SEQ ID NO: 223422 - DNA, 20 bp, Artificial
  CRISPR gRNA sequence
ttactcatcctttaagaccc

SEQ ID NO: 223423 - DNA, 20 bp, Artificial
  CRISPR gRNA sequence
actcatcctttaagacccag

SEQ ID NO: 223424 - DNA, 20 bp, Artificial
  CRISPR gRNA sequence
ctcatcctttaagacccagt

SEQ ID NO: 223425 - DNA, 20 bp, Artificial
  CRISPR gRNA sequence
atcctttaagacccagttta

SEQ ID NO: 223426 - DNA, 20 bp, Artificial
  CRISPR gRNA sequence
taagacccagtttaaacatc

SEQ ID NO: 223427 - DNA, 20 bp, Artificial
  CRISPR gRNA sequence
aagacccagtttaaacatca

SEQ ID NO: 223428 - DNA, 20 bp, Artificial
  CRISPR gRNA sequence
agacccagtttaaacatcac

SEQ ID NO: 223429 - DNA, 20 bp, Artificial
  CRISPR gRNA sequence
aaacatcaccctctaggaag

SEQ ID NO: 223430 - DNA, 20 bp, Artificial
  CRISPR gRNA sequence
aacatcaccctctaggaaga

SEQ ID NO: 223431 - DNA, 20 bp, Artificial
  CRISPR gRNA sequence
taggaagatcattcatagac

SEQ ID NO: 223432 - DNA, 20 bp, Artificial
  CRISPR gRNA sequence
ggaagatcattcatagacac

SEQ ID NO: 223433 - DNA, 20 bp, Artificial
  CRISPR gRNA sequence
atagacacattcttgtgatt

SEQ ID NO: 223434 - DNA, 20 bp, Artificial
  CRISPR gRNA sequence
ttgtgatttttaaggaactt

SEQ ID NO: 223435 - DNA, 20 bp, Artificial
  CRISPR gRNA sequence
gtgatttttaaggaactttt

SEQ ID NO: 223436 - DNA, 20 bp, Artificial
  CRISPR gRNA sequence
tgatttttaaggaacttttc

SEQ ID NO: 223437 - DNA, 20 bp, Artificial
  CRISPR gRNA sequence
ttaaggaacttttctatcca

SEQ ID NO: 223438 - DNA, 20 bp, Artificial
  CRISPR gRNA sequence
taaggaacttttctatccaa

SEQ ID NO: 223439 - DNA, 20 bp, Artificial
  CRISPR gRNA sequence
aaggaacttttctatccaac

SEQ ID NO: 223440 - DNA, 20 bp, Artificial
  CRISPR gRNA sequence
aggaacttttctatccaacc

SEQ ID NO: 223441 - DNA, 20 bp, Artificial
  CRISPR gRNA sequence
ttctatccaaccatacaagt

SEQ ID NO: 223442 - DNA, 20 bp, Artificial
  CRISPR gRNA sequence
tctatccaaccatacaagtg

SEQ ID NO: 223443 - DNA, 20 bp, Artificial
  CRISPR gRNA sequence
ctatccaaccatacaagtga

SEQ ID NO: 223444 - DNA, 20 bp, Artificial
  CRISPR gRNA sequence
tatccaaccatacaagtgac

SEQ ID NO: 223445 - DNA, 20 bp, Artificial
  CRISPR gRNA sequence
tccaaccatacaagtgactt

SEQ ID NO: 223446 - DNA, 20 bp, Artificial
  CRISPR gRNA sequence
gagattttccatgaaaatat

SEQ ID NO: 223447 - DNA, 20 bp, Artificial
  CRISPR gRNA sequence
agattttccatgaaaatatg

SEQ ID NO: 223448 - DNA, 20 bp, Artificial
  CRISPR gRNA sequence
tccatgaaaatatgcagctt

SEQ ID NO: 223449 - DNA, 20 bp, Artificial
  CRISPR gRNA sequence
ccatgaaaatatgcagcttc

SEQ ID NO: 223450 - DNA, 20 bp, Artificial
  CRISPR gRNA sequence
catgaaaatatgcagcttca

SEQ ID NO: 223451 - DNA, 20 bp, Artificial
  CRISPR gRNA sequence
catgatttcataatcaagtc

SEQ ID NO: 223452 - DNA, 20 bp, Artificial
  CRISPR gRNA sequence
atgatttcataatcaagtct

SEQ ID NO: 223453 - DNA, 20 bp, Artificial
  CRISPR gRNA sequence
cataatcaagtctatacaag

SEQ ID NO: 223454 - DNA, 20 bp, Artificial
  CRISPR gRNA sequence
ataatcaagtctatacaagt

SEQ ID NO: 223455 - DNA, 20 bp, Artificial
  CRISPR gRNA sequence
tacaagtgagaagcagtggc

SEQ ID NO: 223456 - DNA, 20 bp, Artificial
  CRISPR gRNA sequence
tcttgaaatacagaagaaaa

SEQ ID NO: 223457 - DNA, 20 bp, Artificial
  CRISPR gRNA sequence
ttgaaatacagaagaaaaat

SEQ ID NO: 223458 - DNA, 20 bp, Artificial
  CRISPR gRNA sequence
gaaatacagaagaaaaatct

SEQ ID NO: 223459 - DNA, 20 bp, Artificial
  CRISPR gRNA sequence
aaatacagaagaaaaatcta

SEQ ID NO: 223460 - DNA, 20 bp, Artificial
  CRISPR gRNA sequence
tcttctcccacatgattttt

SEQ ID NO: 223461 - DNA, 20 bp, Artificial
  CRISPR gRNA sequence
ctcccacatgatttttagat

SEQ ID NO: 223462 - DNA, 20 bp, Artificial
  CRISPR gRNA sequence
tcccacatgatttttagatt

SEQ ID NO: 223463 - DNA, 20 bp, Artificial
  CRISPR gRNA sequence
ccacatgatttttagatttt

SEQ ID NO: 223464 - DNA, 20 bp, Artificial
  CRISPR gRNA sequence
ttagatttttcttctatgga

SEQ ID NO: 223465 - DNA, 20 bp, Artificial
  CRISPR gRNA sequence
tagatttttcttctatggaa

SEQ ID NO: 223466 - DNA, 20 bp, Artificial
  CRISPR gRNA sequence
agatttttcttctatggaat

SEQ ID NO: 223467 - DNA, 20 bp, Artificial
  CRISPR gRNA sequence
gatttttcttctatggaatt

SEQ ID NO: 223468 - DNA, 20 bp, Artificial
  CRISPR gRNA sequence
ttcttctatggaatttatac

SEQ ID NO: 223469 - DNA, 20 bp, Artificial
  CRISPR gRNA sequence
tcttctatggaatttatact

SEQ ID NO: 223470 - DNA, 20 bp, Artificial
  CRISPR gRNA sequence
cttctatggaatttatactt

SEQ ID NO: 223471 - DNA, 20 bp, Artificial
  CRISPR gRNA sequence
ttctatggaatttatacttt

SEQ ID NO: 223472 - DNA, 20 bp, Artificial
  CRISPR gRNA sequence
ctatggaatttatactttaa

SEQ ID NO: 223473 - DNA, 20 bp, Artificial
  CRISPR gRNA sequence
tatggaatttatactttaaa

SEQ ID NO: 223474 - DNA, 20 bp, Artificial
  CRISPR gRNA sequence
tggaatttatactttaaact

SEQ ID NO: 223475 - DNA, 20 bp, Artificial
  CRISPR gRNA sequence
atactttaaactttttacat

SEQ ID NO: 223476 - DNA, 20 bp, Artificial
  CRISPR gRNA sequence
tactttaaactttttacatt

SEQ ID NO: 223477 - DNA, 20 bp, Artificial
  CRISPR gRNA sequence
taaactttttacattcacaa

SEQ ID NO: 223478 - DNA, 20 bp, Artificial
  CRISPR gRNA sequence
aaactttttacattcacaag

SEQ ID NO: 223479 - DNA, 20 bp, Artificial
  CRISPR gRNA sequence
aactttttacattcacaagg

SEQ ID NO: 223480 - DNA, 20 bp, Artificial
  CRISPR gRNA sequence
tttacattcacaaggaaggt

SEQ ID NO: 223481 - DNA, 20 bp, Artificial
  CRISPR gRNA sequence
ttacattcacaaggaaggta

SEQ ID NO: 223482 - DNA, 20 bp, Artificial
  CRISPR gRNA sequence
tacattcacaaggaaggtat

SEQ ID NO: 223483 - DNA, 20 bp, Artificial
  CRISPR gRNA sequence
acattcacaaggaaggtatt

SEQ ID NO: 223484 - DNA, 20 bp, Artificial
  CRISPR gRNA sequence
cattcacaaggaaggtattg

SEQ ID NO: 223485 - DNA, 20 bp, Artificial
  CRISPR gRNA sequence
acaaggaaggtattgaatcc

SEQ ID NO: 223486 - DNA, 20 bp, Artificial
  CRISPR gRNA sequence
aatcctactttctggaccct

SEQ ID NO: 223487 - DNA, 20 bp, Artificial
  CRISPR gRNA sequence
ctttctggaccctgtgttag

SEQ ID NO: 223488 - DNA, 20 bp, Artificial
  CRISPR gRNA sequence
tctggaccctgtgttagatt

SEQ ID NO: 223489 - DNA, 20 bp, Artificial
  CRISPR gRNA sequence
ctggaccctgtgttagattc

SEQ ID NO: 223490 - DNA, 20 bp, Artificial
  CRISPR gRNA sequence
tggaccctgtgttagattct

SEQ ID NO: 223491 - DNA, 20 bp, Artificial
  CRISPR gRNA sequence
gaccctgtgttagattctta

SEQ ID NO: 223492 - DNA, 20 bp, Artificial
  CRISPR gRNA sequence
tgttagattcttaggatacc

SEQ ID NO: 223493 - DNA, 20 bp, Artificial
  CRISPR gRNA sequence
gattcttaggataccaaatg

SEQ ID NO: 223494 - DNA, 20 bp, Artificial
  CRISPR gRNA sequence
ttaggataccaaatgaagac

SEQ ID NO: 223495 - DNA, 20 bp, Artificial
  CRISPR gRNA sequence
aggataccaaatgaagacag

SEQ ID NO: 223496 - DNA, 20 bp, Artificial
  CRISPR gRNA sequence
ggataccaaatgaagacagt

SEQ ID NO: 223497 - DNA, 20 bp, Artificial
  CRISPR gRNA sequence
actttctgagcctggagaga

SEQ ID NO: 223498 - DNA, 20 bp, Artificial
  CRISPR gRNA sequence
ctttctgagcctggagagat

SEQ ID NO: 223499 - DNA, 20 bp, Artificial
  CRISPR gRNA sequence
tctgagcctggagagatcag

SEQ ID NO: 223500 - DNA, 20 bp, Artificial
  CRISPR gRNA sequence
ctgagcctggagagatcagt

SEQ ID NO: 223501 - DNA, 20 bp, Artificial
  CRISPR gRNA sequence
tgagcctggagagatcagtt

SEQ ID NO: 223502 - DNA, 20 bp, Artificial
  CRISPR gRNA sequence
agcctggagagatcagttaa

SEQ ID NO: 223503 - DNA, 20 bp, Artificial
  CRISPR gRNA sequence
gagagatcagttaagtaaaa

SEQ ID NO: 223504 - DNA, 20 bp, Artificial
  CRISPR gRNA sequence
agtaaaatagtaattacaca

SEQ ID NO: 223505 - DNA, 20 bp, Artificial
  CRISPR gRNA sequence
cacagtagtaggtacagtga

SEQ ID NO: 223506 - DNA, 20 bp, Artificial
  CRISPR gRNA sequence
gaacacaaggcaatgggagc

SEQ ID NO: 223507 - DNA, 20 bp, Artificial
  CRISPR gRNA sequence
aacacaaggcaatgggagca

SEQ ID NO: 223508 - DNA, 20 bp, Artificial
  CRISPR gRNA sequence
agtaatggtagggaagggga

SEQ ID NO: 223509 - DNA, 20 bp, Artificial
  CRISPR gRNA sequence
aacaactcaactgtgcttta

SEQ ID NO: 223510 - DNA, 20 bp, Artificial
  CRISPR gRNA sequence
aactgtgctttagtaggaag

SEQ ID NO: 223511 - DNA, 20 bp, Artificial
  CRISPR gRNA sequence
tgctttagtaggaagagcaa

SEQ ID NO: 223512 - DNA, 20 bp, Artificial
  CRISPR gRNA sequence
tagtaggaagagcaaaagtt

SEQ ID NO: 223513 - DNA, 20 bp, Artificial
  CRISPR gRNA sequence
agtaggaagagcaaaagtta

SEQ ID NO: 223514 - DNA, 20 bp, Artificial
  CRISPR gRNA sequence
gtaggaagagcaaaagttag

SEQ ID NO: 223515 - DNA, 20 bp, Artificial
  CRISPR gRNA sequence
gcaaactgtagctgccattt

SEQ ID NO: 223516 - DNA, 20 bp, Artificial
  CRISPR gRNA sequence
tagctgccatttattgagta

SEQ ID NO: 223517 - DNA, 20 bp, Artificial
  CRISPR gRNA sequence
ccatttattgagtacttgct

SEQ ID NO: 223518 - DNA, 20 bp, Artificial
  CRISPR gRNA sequence
attgagtacttgctgtatat

SEQ ID NO: 223519 - DNA, 20 bp, Artificial
  CRISPR gRNA sequence
ttgagtacttgctgtatatg

SEQ ID NO: 223520 - DNA, 20 bp, Artificial
  CRISPR gRNA sequence
agtacttgctgtatatgtga

SEQ ID NO: 223521 - DNA, 20 bp, Artificial
  CRISPR gRNA sequence
gctgtatatgtgaaaggtga

SEQ ID NO: 223522 - DNA, 20 bp, Artificial
  CRISPR gRNA sequence
ctgtatatgtgaaaggtgat

SEQ ID NO: 223523 - DNA, 20 bp, Artificial
  CRISPR gRNA sequence
tatatgtgaaaggtgataca

SEQ ID NO: 223524 - DNA, 20 bp, Artificial
  CRISPR gRNA sequence
tcttattaaatcttaacaat

SEQ ID NO: 223525 - DNA, 20 bp, Artificial
  CRISPR gRNA sequence
attaaatcttaacaatatct

SEQ ID NO: 223526 - DNA, 20 bp, Artificial
  CRISPR gRNA sequence
ttaaatcttaacaatatctc

SEQ ID NO: 223527 - DNA, 20 bp, Artificial
  CRISPR gRNA sequence
aatcttaacaatatctctat

SEQ ID NO: 223528 - DNA, 20 bp, Artificial
  CRISPR gRNA sequence
aacaatatctctatgaggta

SEQ ID NO: 223529 - DNA, 20 bp, Artificial
  CRISPR gRNA sequence
acaatatctctatgaggtat

SEQ ID NO: 223530 - DNA, 20 bp, Artificial
  CRISPR gRNA sequence
tatgaggtatataccatcac

SEQ ID NO: 223531 - DNA, 20 bp, Artificial
  CRISPR gRNA sequence
tgaggtatataccatcacta

SEQ ID NO: 223532 - DNA, 20 bp, Artificial
  CRISPR gRNA sequence
tgcacattttatagatgagg

SEQ ID NO: 223533 - DNA, 20 bp, Artificial
  CRISPR gRNA sequence
tatagatgaggaaactgagg

SEQ ID NO: 223534 - DNA, 20 bp, Artificial
  CRISPR gRNA sequence
atagatgaggaaactgagga

SEQ ID NO: 223535 - DNA, 20 bp, Artificial
  CRISPR gRNA sequence
tagatgaggaaactgaggag

SEQ ID NO: 223536 - DNA, 20 bp, Artificial
  CRISPR gRNA sequence
aggagcagaggtaagtaact

SEQ ID NO: 223537 - DNA, 20 bp, Artificial
  CRISPR gRNA sequence
gcctaaggttatacagctaa

SEQ ID NO: 223538 - DNA, 20 bp, Artificial
  CRISPR gRNA sequence
cctaaggttatacagctaag

SEQ ID NO: 223539 - DNA, 20 bp, Artificial
  CRISPR gRNA sequence
aggttatacagctaagaagt

SEQ ID NO: 223540 - DNA, 20 bp, Artificial
  CRISPR gRNA sequence
tacagctaagaagtacatga

SEQ ID NO: 223541 - DNA, 20 bp, Artificial
  CRISPR gRNA sequence
agaagtacatgaggtgaatc

SEQ ID NO: 223542 - DNA, 20 bp, Artificial
  CRISPR gRNA sequence
aaactagggtcgacccctta

SEQ ID NO: 223543 - DNA, 20 bp, Artificial
  CRISPR gRNA sequence
aactagggtcgaccccttaa

SEQ ID NO: 223544 - DNA, 20 bp, Artificial
  CRISPR gRNA sequence
gggtcgaccccttaatgtgt

SEQ ID NO: 223545 - DNA, 20 bp, Artificial
  CRISPR gRNA sequence
aatgtgtgcacttaactatt

SEQ ID NO: 223546 - DNA, 20 bp, Artificial
  CRISPR gRNA sequence
atgtgtgcacttaactatta

SEQ ID NO: 223547 - DNA, 20 bp, Artificial
  CRISPR gRNA sequence
aactattatacaccctatgt

SEQ ID NO: 223548 - DNA, 20 bp, Artificial
  CRISPR gRNA sequence
actattatacaccctatgta

SEQ ID NO: 223549 - DNA, 20 bp, Artificial
  CRISPR gRNA sequence
ttatacaccctatgtactca

SEQ ID NO: 223550 - DNA, 20 bp, Artificial
  CRISPR gRNA sequence
tacaccctatgtactcagtg

SEQ ID NO: 223551 - DNA, 20 bp, Artificial
  CRISPR gRNA sequence
tgtactcagtggggtaatag

SEQ ID NO: 223552 - DNA, 20 bp, Artificial
  CRISPR gRNA sequence
agtggggtaatagtgtataa

SEQ ID NO: 223553 - DNA, 20 bp, Artificial
  CRISPR gRNA sequence
agaggctatttaggtttgag

SEQ ID NO: 223554 - DNA, 20 bp, Artificial
  CRISPR gRNA sequence
tttaggtttgaggaacagta

SEQ ID NO: 223555 - DNA, 20 bp, Artificial
  CRISPR gRNA sequence
aggtttgaggaacagtatgt

SEQ ID NO: 223556 - DNA, 20 bp, Artificial
  CRISPR gRNA sequence
ggtttgaggaacagtatgtg

SEQ ID NO: 223557 - DNA, 20 bp, Artificial
  CRISPR gRNA sequence
gaggaacagtatgtgctaag

SEQ ID NO: 223558 - DNA, 20 bp, Artificial
  CRISPR gRNA sequence
aggaacagtatgtgctaagg

SEQ ID NO: 223559 - DNA, 20 bp, Artificial
  CRISPR gRNA sequence
aggcatggggatgagagtgc

SEQ ID NO: 223560 - DNA, 20 bp, Artificial
  CRISPR gRNA sequence
gcatagtcatggaattgcaa

SEQ ID NO: 223561 - DNA, 20 bp, Artificial
  CRISPR gRNA sequence
catagtcatggaattgcaat

SEQ ID NO: 223562 - DNA, 20 bp, Artificial
  CRISPR gRNA sequence
caataacgtcattatgattg

SEQ ID NO: 223563 - DNA, 20 bp, Artificial
  CRISPR gRNA sequence
tgattggagcttagtgtgga

SEQ ID NO: 223564 - DNA, 20 bp, Artificial
  CRISPR gRNA sequence
gagcttagtgtggaaatgag

SEQ ID NO: 223565 - DNA, 20 bp, Artificial
  CRISPR gRNA sequence
agtgtggaaatgagggagta

SEQ ID NO: 223566 - DNA, 20 bp, Artificial
  CRISPR gRNA sequence
gtgtggaaatgagggagtac

SEQ ID NO: 223567 - DNA, 20 bp, Artificial
  CRISPR gRNA sequence
gaaaggatcttgaaggacct

SEQ ID NO: 223568 - DNA, 20 bp, Artificial
  CRISPR gRNA sequence
gaaggacctcgtttgtattc

SEQ ID NO: 223569 - DNA, 20 bp, Artificial
  CRISPR gRNA sequence
aaggacctcgtttgtattcc

SEQ ID NO: 223570 - DNA, 20 bp, Artificial
  CRISPR gRNA sequence
gtttgtattccatgctaatg

SEQ ID NO: 223571 - DNA, 20 bp, Artificial
  CRISPR gRNA sequence
gtattccatgctaatgtact

SEQ ID NO: 223572 - DNA, 20 bp, Artificial
  CRISPR gRNA sequence
tattccatgctaatgtactt

SEQ ID NO: 223573 - DNA, 20 bp, Artificial
  CRISPR gRNA sequence
catgctaatgtacttagaat

SEQ ID NO: 223574 - DNA, 20 bp, Artificial
  CRISPR gRNA sequence
atgtacttagaatttagcct

SEQ ID NO: 223575 - DNA, 20 bp, Artificial
  CRISPR gRNA sequence
agaatttagcctgaaaaggg

SEQ ID NO: 223576 - DNA, 20 bp, Artificial
  CRISPR gRNA sequence
gaatttagcctgaaaagggt

SEQ ID NO: 223577 - DNA, 20 bp, Artificial
  CRISPR gRNA sequence
agcctgaaaagggttgaggg

SEQ ID NO: 223578 - DNA, 20 bp, Artificial
  CRISPR gRNA sequence
gcctgaaaagggttgagggt

SEQ ID NO: 223579 - DNA, 20 bp, Artificial
  CRISPR gRNA sequence
aaaagggttgagggtgttgt

SEQ ID NO: 223580 - DNA, 20 bp, Artificial
  CRISPR gRNA sequence
agggtgttgttaaagtatct

SEQ ID NO: 223581 - DNA, 20 bp, Artificial
  CRISPR gRNA sequence
ttaaagtatcttaggcaaag

SEQ ID NO: 223582 - DNA, 20 bp, Artificial
  CRISPR gRNA sequence
aagtatcttaggcaaaggag

SEQ ID NO: 223583 - DNA, 20 bp, Artificial
  CRISPR gRNA sequence
aggcaaaggagtgcacattt

SEQ ID NO: 223584 - DNA, 20 bp, Artificial
  CRISPR gRNA sequence
ggcaaaggagtgcacatttg

SEQ ID NO: 223585 - DNA, 20 bp, Artificial
  CRISPR gRNA sequence
gcatttagaacagttatttt

SEQ ID NO: 223586 - DNA, 20 bp, Artificial
  CRISPR gRNA sequence
catttagaacagttattttg

SEQ ID NO: 223587 - DNA, 20 bp, Artificial
  CRISPR gRNA sequence
agaacagttattttgggaac

SEQ ID NO: 223588 - DNA, 20 bp, Artificial
  CRISPR gRNA sequence
gaacagttattttgggaact

SEQ ID NO: 223589 - DNA, 20 bp, Artificial
  CRISPR gRNA sequence
ttttgggaactgtagaaaat

SEQ ID NO: 223590 - DNA, 20 bp, Artificial
  CRISPR gRNA sequence
tgggaactgtagaaaataca

SEQ ID NO: 223591 - DNA, 20 bp, Artificial
  CRISPR gRNA sequence
gggaactgtagaaaatacat

SEQ ID NO: 223592 - DNA, 20 bp, Artificial
  CRISPR gRNA sequence
ggaactgtagaaaatacatc

SEQ ID NO: 223593 - DNA, 20 bp, Artificial
  CRISPR gRNA sequence
tagaaaatacatcagggcca

SEQ ID NO: 223594 - DNA, 20 bp, Artificial
  CRISPR gRNA sequence
gaggatggaggcagggagct

SEQ ID NO: 223595 - DNA, 20 bp, Artificial
  CRISPR gRNA sequence
aggatggaggcagggagctg

SEQ ID NO: 223596 - DNA, 20 bp, Artificial
  CRISPR gRNA sequence
gttagaagggtatggcagta

SEQ ID NO: 223597 - DNA, 20 bp, Artificial
  CRISPR gRNA sequence
gaagggtatggcagtagttc

SEQ ID NO: 223598 - DNA, 20 bp, Artificial
  CRISPR gRNA sequence
gaggggggaggatgagtgtc

SEQ ID NO: 223599 - DNA, 20 bp, Artificial
  CRISPR gRNA sequence
attcattcattcaacagaca

SEQ ID NO: 223600 - DNA, 20 bp, Artificial
  CRISPR gRNA sequence
attcattcaacagacattgg

SEQ ID NO: 223601 - DNA, 20 bp, Artificial
  CRISPR gRNA sequence
attcaacagacattggattt

SEQ ID NO: 223602 - DNA, 20 bp, Artificial
  CRISPR gRNA sequence
aacagacattggatttagga

SEQ ID NO: 223603 - DNA, 20 bp, Artificial
  CRISPR gRNA sequence
gatttaggaactattaatta

SEQ ID NO: 223604 - DNA, 20 bp, Artificial
  CRISPR gRNA sequence
aggaactattaattaggttg

SEQ ID NO: 223605 - DNA, 20 bp, Artificial
  CRISPR gRNA sequence
ggaactattaattaggttga

SEQ ID NO: 223606 - DNA, 20 bp, Artificial
  CRISPR gRNA sequence
ttaattaggttgaacctact

SEQ ID NO: 223607 - DNA, 20 bp, Artificial
  CRISPR gRNA sequence
attaggttgaacctactaag

SEQ ID NO: 223608 - DNA, 20 bp, Artificial
  CRISPR gRNA sequence
ggttgaacctactaagaatt

SEQ ID NO: 223609 - DNA, 20 bp, Artificial
  CRISPR gRNA sequence
aacctactaagaattctcca

SEQ ID NO: 223610 - DNA, 20 bp, Artificial
  CRISPR gRNA sequence
ctaagaattctccatggcta

SEQ ID NO: 223611 - DNA, 20 bp, Artificial
  CRISPR gRNA sequence
agaattctccatggctaagg

SEQ ID NO: 223612 - DNA, 20 bp, Artificial
  CRISPR gRNA sequence
tccatggctaaggagaggga

SEQ ID NO: 223613 - DNA, 20 bp, Artificial
  CRISPR gRNA sequence
catggctaaggagagggagt

SEQ ID NO: 223614 - DNA, 20 bp, Artificial
  CRISPR gRNA sequence
aggagagggagtaatctaat

SEQ ID NO: 223615 - DNA, 20 bp, Artificial
  CRISPR gRNA sequence
atgtgattcttaggtccagg

SEQ ID NO: 223616 - DNA, 20 bp, Artificial
  CRISPR gRNA sequence
ttaggtccaggtctggttca

SEQ ID NO: 223617 - DNA, 20 bp, Artificial
  CRISPR gRNA sequence
aggtccaggtctggttcact

SEQ ID NO: 223618 - DNA, 20 bp, Artificial
  CRISPR gRNA sequence
ggtccaggtctggttcactg

SEQ ID NO: 223619 - DNA, 20 bp, Artificial
  CRISPR gRNA sequence
gttcactggtagatgataga

SEQ ID NO: 223620 - DNA, 20 bp, Artificial
  CRISPR gRNA sequence
actggtagatgatagaaaat

SEQ ID NO: 223621 - DNA, 20 bp, Artificial
  CRISPR gRNA sequence
gtagatgatagaaaatactt

SEQ ID NO: 223622 - DNA, 20 bp, Artificial
  CRISPR gRNA sequence
tagcaaagtgatttaggctg

SEQ ID NO: 223623 - DNA, 20 bp, Artificial
  CRISPR gRNA sequence
agcaaagtgatttaggctga

SEQ ID NO: 223624 - DNA, 20 bp, Artificial
  CRISPR gRNA sequence
gcaaagtgatttaggctgag

SEQ ID NO: 223625 - DNA, 20 bp, Artificial
  CRISPR gRNA sequence
aggctgagggtaagaagtgg

SEQ ID NO: 223626 - DNA, 20 bp, Artificial
  CRISPR gRNA sequence
ggctgagggtaagaagtggg

SEQ ID NO: 223627 - DNA, 20 bp, Artificial
  CRISPR gRNA sequence
agggtaagaagtgggggtac

SEQ ID NO: 223628 - DNA, 20 bp, Artificial
  CRISPR gRNA sequence
ttggacatactgactttgaa

SEQ ID NO: 223629 - DNA, 20 bp, Artificial
  CRISPR gRNA sequence
tggacatactgactttgaag

SEQ ID NO: 223630 - DNA, 20 bp, Artificial
  CRISPR gRNA sequence
ggacatactgactttgaagt

SEQ ID NO: 223631 - DNA, 20 bp, Artificial
  CRISPR gRNA sequence
gacatactgactttgaagta

SEQ ID NO: 223632 - DNA, 20 bp, Artificial
  CRISPR gRNA sequence
actttgaagtaactgtatta

SEQ ID NO: 223633 - DNA, 20 bp, Artificial
  CRISPR gRNA sequence
tgaagtaactgtattacatc

SEQ ID NO: 223634 - DNA, 20 bp, Artificial
  CRISPR gRNA sequence
gaagtaactgtattacatcc

SEQ ID NO: 223635 - DNA, 20 bp, Artificial
  CRISPR gRNA sequence
aagtaactgtattacatcca

SEQ ID NO: 223636 - DNA, 20 bp, Artificial
  CRISPR gRNA sequence
tattacatccaagtggaagt

SEQ ID NO: 223637 - DNA, 20 bp, Artificial
  CRISPR gRNA sequence
catccaagtggaagtgcaca

SEQ ID NO: 223638 - DNA, 20 bp, Artificial
  CRISPR gRNA sequence
gctgtccaacatctgcagtt

SEQ ID NO: 223639 - DNA, 20 bp, Artificial
  CRISPR gRNA sequence
tccaacatctgcagtttaga

SEQ ID NO: 223640 - DNA, 20 bp, Artificial
  CRISPR gRNA sequence
cagtttagaagaaaggcagt

SEQ ID NO: 223641 - DNA, 20 bp, Artificial
  CRISPR gRNA sequence
agaagaaaggcagtgcatga

SEQ ID NO: 223642 - DNA, 20 bp, Artificial
  CRISPR gRNA sequence
gaagaaaggcagtgcatgat

SEQ ID NO: 223643 - DNA, 20 bp, Artificial
  CRISPR gRNA sequence
agttttttatttaaaagttt

SEQ ID NO: 223644 - DNA, 20 bp, Artificial
  CRISPR gRNA sequence
tttatttaaaagtttgcagg

SEQ ID NO: 223645 - DNA, 20 bp, Artificial
  CRISPR gRNA sequence
ttatttaaaagtttgcaggt

SEQ ID NO: 223646 - DNA, 20 bp, Artificial
  CRISPR gRNA sequence
tatttaaaagtttgcaggtg

SEQ ID NO: 223647 - DNA, 20 bp, Artificial
  CRISPR gRNA sequence
atttaaaagtttgcaggtga

SEQ ID NO: 223648 - DNA, 20 bp, Artificial
  CRISPR gRNA sequence
tttaaaagtttgcaggtgaa

SEQ ID NO: 223649 - DNA, 20 bp, Artificial
  CRISPR gRNA sequence
aaaagtttgcaggtgaagaa

SEQ ID NO: 223650 - DNA, 20 bp, Artificial
  CRISPR gRNA sequence
aaagtttgcaggtgaagaaa

SEQ ID NO: 223651 - DNA, 20 bp, Artificial
  CRISPR gRNA sequence
gcaggtgaagaaaaccatgg

SEQ ID NO: 223652 - DNA, 20 bp, Artificial
  CRISPR gRNA sequence
caggtgaagaaaaccatggg

SEQ ID NO: 223653 - DNA, 20 bp, Artificial
  CRISPR gRNA sequence
gggggcagagggtactgaat

SEQ ID NO: 223654 - DNA, 20 bp, Artificial
  CRISPR gRNA sequence
aatctgaagcccttagggac

SEQ ID NO: 223655 - DNA, 20 bp, Artificial
  CRISPR gRNA sequence
aagcccttagggacactaac

SEQ ID NO: 223656 - DNA, 20 bp, Artificial
  CRISPR gRNA sequence
agggacactaacatttagtg

SEQ ID NO: 223657 - DNA, 20 bp, Artificial
  CRISPR gRNA sequence
gggacactaacatttagtgt

SEQ ID NO: 223658 - DNA, 20 bp, Artificial
  CRISPR gRNA sequence
acatttagtgtgagtcaagg

SEQ ID NO: 223659 - DNA, 20 bp, Artificial
  CRISPR gRNA sequence
agtgtgagtcaaggaataga

SEQ ID NO: 223660 - DNA, 20 bp, Artificial
  CRISPR gRNA sequence
gtgtgagtcaaggaatagat

SEQ ID NO: 223661 - DNA, 20 bp, Artificial
  CRISPR gRNA sequence
caacaaagaaagcaaactag

SEQ ID NO: 223662 - DNA, 20 bp, Artificial
  CRISPR gRNA sequence
aacaaagaaagcaaactagg

SEQ ID NO: 223663 - DNA, 20 bp, Artificial
  CRISPR gRNA sequence
ggatggggtggacaaagcag

SEQ ID NO: 223664 - DNA, 20 bp, Artificial
  CRISPR gRNA sequence
gtaatcaggagataccatgg

SEQ ID NO: 223665 - DNA, 20 bp, Artificial
  CRISPR gRNA sequence
cccactggctcaagaactgt

SEQ ID NO: 223666 - DNA, 20 bp, Artificial
  CRISPR gRNA sequence
gctcaagaactgtggaaaag

SEQ ID NO: 223667 - DNA, 20 bp, Artificial
  CRISPR gRNA sequence
aagaactgtggaaaagtcaa

SEQ ID NO: 223668 - DNA, 20 bp, Artificial
  CRISPR gRNA sequence
tggaaaagtcaagacagaaa

SEQ ID NO: 223669 - DNA, 20 bp, Artificial
  CRISPR gRNA sequence
gatttttcacaagggattgg

SEQ ID NO: 223670 - DNA, 20 bp, Artificial
  CRISPR gRNA sequence
atttttcacaagggattggt

SEQ ID NO: 223671 - DNA, 20 bp, Artificial
  CRISPR gRNA sequence
ttcacaagggattggtggtg

SEQ ID NO: 223672 - DNA, 20 bp, Artificial
  CRISPR gRNA sequence
tcacaagggattggtggtga

SEQ ID NO: 223673 - DNA, 20 bp, Artificial
  CRISPR gRNA sequence
cacaagggattggtggtgac

SEQ ID NO: 223674 - DNA, 20 bp, Artificial
  CRISPR gRNA sequence
acaagggattggtggtgact

SEQ ID NO: 223675 - DNA, 20 bp, Artificial
  CRISPR gRNA sequence
gtggtgactttggcaagagc

SEQ ID NO: 223676 - DNA, 20 bp, Artificial
  CRISPR gRNA sequence
tggcaagagctgtagtaatg

SEQ ID NO: 223677 - DNA, 20 bp, Artificial
  CRISPR gRNA sequence
ggcaagagctgtagtaatga

SEQ ID NO: 223678 - DNA, 20 bp, Artificial
  CRISPR gRNA sequence
gcaagagctgtagtaatgaa

SEQ ID NO: 223679 - DNA, 20 bp, Artificial
  CRISPR gRNA sequence
tagtaatgaagaagtagggg

SEQ ID NO: 223680 - DNA, 20 bp, Artificial
  CRISPR gRNA sequence
aaggagtgaattggaagtga

SEQ ID NO: 223681 - DNA, 20 bp, Artificial
  CRISPR gRNA sequence
aggagtgaattggaagtgag

SEQ ID NO: 223682 - DNA, 20 bp, Artificial
  CRISPR gRNA sequence
gaagtgaggaaatgcttata

SEQ ID NO: 223683 - DNA, 20 bp, Artificial
  CRISPR gRNA sequence
atagattgttaatttgggat

SEQ ID NO: 223684 - DNA, 20 bp, Artificial
  CRISPR gRNA sequence
tagattgttaatttgggatg

SEQ ID NO: 223685 - DNA, 20 bp, Artificial
  CRISPR gRNA sequence
ttaatttgggatgctaggga

SEQ ID NO: 223686 - DNA, 20 bp, Artificial
  CRISPR gRNA sequence
atttgggatgctagggagag

SEQ ID NO: 223687 - DNA, 20 bp, Artificial
  CRISPR gRNA sequence
gggatgctagggagagagaa

SEQ ID NO: 223688 - DNA, 20 bp, Artificial
  CRISPR gRNA sequence
ggatgctagggagagagaaa

SEQ ID NO: 223689 - DNA, 20 bp, Artificial
  CRISPR gRNA sequence
gggagagagaaagtatgagg

SEQ ID NO: 223690 - DNA, 20 bp, Artificial
  CRISPR gRNA sequence
tttttaagttggcaaatatt

SEQ ID NO: 223691 - DNA, 20 bp, Artificial
  CRISPR gRNA sequence
ttttaagttggcaaatattc

SEQ ID NO: 223692 - DNA, 20 bp, Artificial
  CRISPR gRNA sequence
tttaagttggcaaatattca

SEQ ID NO: 223693 - DNA, 20 bp, Artificial
  CRISPR gRNA sequence
ttaagttggcaaatattcaa

SEQ ID NO: 223694 - DNA, 20 bp, Artificial
  CRISPR gRNA sequence
taagttggcaaatattcaag

SEQ ID NO: 223695 - DNA, 20 bp, Artificial
  CRISPR gRNA sequence
aagttggcaaatattcaagc

SEQ ID NO: 223696 - DNA, 20 bp, Artificial
  CRISPR gRNA sequence
agttggcaaatattcaagca

SEQ ID NO: 223697 - DNA, 20 bp, Artificial
  CRISPR gRNA sequence
gcaaatattcaagcaatttt

SEQ ID NO: 223698 - DNA, 20 bp, Artificial
  CRISPR gRNA sequence
aagcaatttttaaagacaca

SEQ ID NO: 223699 - DNA, 20 bp, Artificial
  CRISPR gRNA sequence
ttaaagacacacacaaaaac

SEQ ID NO: 223700 - DNA, 20 bp, Artificial
  CRISPR gRNA sequence
taaagacacacacaaaaaca

SEQ ID NO: 223701 - DNA, 20 bp, Artificial
  CRISPR gRNA sequence
aaagacacacacaaaaacaa

SEQ ID NO: 223702 - DNA, 20 bp, Artificial
  CRISPR gRNA sequence
aagacacacacaaaaacaac

SEQ ID NO: 223703 - DNA, 20 bp, Artificial
  CRISPR gRNA sequence
gtaaatggaatgggggatgt

SEQ ID NO: 223704 - DNA, 20 bp, Artificial
  CRISPR gRNA sequence
taaatggaatgggggatgtg

SEQ ID NO: 223705 - DNA, 20 bp, Artificial
  CRISPR gRNA sequence
ataatcaactaaggaaagtc

SEQ ID NO: 223706 - DNA, 20 bp, Artificial
  CRISPR gRNA sequence
aggaaagtcgttgaggagac

SEQ ID NO: 223707 - DNA, 20 bp, Artificial
  CRISPR gRNA sequence
aggagactgatgggtatgga

SEQ ID NO: 223708 - DNA, 20 bp, Artificial
  CRISPR gRNA sequence
atgggtatggaggcagaaat

SEQ ID NO: 223709 - DNA, 20 bp, Artificial
  CRISPR gRNA sequence
gctttcaggtgatgggattc

SEQ ID NO: 223710 - DNA, 20 bp, Artificial
  CRISPR gRNA sequence
tcaggtgatgggattcattt

SEQ ID NO: 223711 - DNA, 20 bp, Artificial
  CRISPR gRNA sequence
caggtgatgggattcatttc

SEQ ID NO: 223712 - DNA, 20 bp, Artificial
  CRISPR gRNA sequence
aggtgatgggattcatttca

SEQ ID NO: 223713 - DNA, 20 bp, Artificial
  CRISPR gRNA sequence
atttcagaaaaggaagcaaa

SEQ ID NO: 223714 - DNA, 20 bp, Artificial
  CRISPR gRNA sequence
cagaaaaggaagcaaaaaaa

SEQ ID NO: 223715 - DNA, 20 bp, Artificial
  CRISPR gRNA sequence
agaaaaggaagcaaaaaaaa

SEQ ID NO: 223716 - DNA, 20 bp, Artificial
  CRISPR gRNA sequence
gggttacaggtaggtttata

SEQ ID NO: 223717 - DNA, 20 bp, Artificial
  CRISPR gRNA sequence
caggtaggtttatagggaag

SEQ ID NO: 223718 - DNA, 20 bp, Artificial
  CRISPR gRNA sequence
atagggaaggagtattggaa

SEQ ID NO: 223719 - DNA, 20 bp, Artificial
  CRISPR gRNA sequence
tagggaaggagtattggaag

SEQ ID NO: 223720 - DNA, 20 bp, Artificial
  CRISPR gRNA sequence
gaagcttcaggattctcctc

SEQ ID NO: 223721 - DNA, 20 bp, Artificial
  CRISPR gRNA sequence
caggattctcctctgaaggt

SEQ ID NO: 223722 - DNA, 20 bp, Artificial
  CRISPR gRNA sequence
aggattctcctctgaaggtt

SEQ ID NO: 223723 - DNA, 20 bp, Artificial
  CRISPR gRNA sequence
tcctctgaaggtttcagttt

SEQ ID NO: 223724 - DNA, 20 bp, Artificial
  CRISPR gRNA sequence
ctctgaaggtttcagtttgt

SEQ ID NO: 223725 - DNA, 20 bp, Artificial
  CRISPR gRNA sequence
tgaaggtttcagtttgtatt

SEQ ID NO: 223726 - DNA, 20 bp, Artificial
  CRISPR gRNA sequence
aaggtttcagtttgtattaa

SEQ ID NO: 223727 - DNA, 20 bp, Artificial
  CRISPR gRNA sequence
cagtttgtattaagaaatag

SEQ ID NO: 223728 - DNA, 20 bp, Artificial
  CRISPR gRNA sequence
agtttgtattaagaaatagg

SEQ ID NO: 223729 - DNA, 20 bp, Artificial
  CRISPR gRNA sequence
gtattaagaaatagggagag

SEQ ID NO: 223730 - DNA, 20 bp, Artificial
  CRISPR gRNA sequence
tattaagaaatagggagaga

SEQ ID NO: 223731 - DNA, 20 bp, Artificial
  CRISPR gRNA sequence
agaaatagggagagaggact

SEQ ID NO: 223732 - DNA, 20 bp, Artificial
  CRISPR gRNA sequence
ttggagagtatgggataaag

SEQ ID NO: 223733 - DNA, 20 bp, Artificial
  CRISPR gRNA sequence
gagagtatgggataaagggc

SEQ ID NO: 223734 - DNA, 20 bp, Artificial
  CRISPR gRNA sequence
aagagttgttaaaaagaagc

SEQ ID NO: 223735 - DNA, 20 bp, Artificial
  CRISPR gRNA sequence
agagttgttaaaaagaagcg

SEQ ID NO: 223736 - DNA, 20 bp, Artificial
  CRISPR gRNA sequence
ttaaaaagaagcgaacattt

SEQ ID NO: 223737 - DNA, 20 bp, Artificial
  CRISPR gRNA sequence
aaaagaagcgaacatttaca

SEQ ID NO: 223738 - DNA, 20 bp, Artificial
  CRISPR gRNA sequence
acatgaaatatgtaaaatgg

SEQ ID NO: 223739 - DNA, 20 bp, Artificial
  CRISPR gRNA sequence
catgaaatatgtaaaatggt

SEQ ID NO: 223740 - DNA, 20 bp, Artificial
  CRISPR gRNA sequence
aaggcccggaggagcaggga

SEQ ID NO: 223741 - DNA, 20 bp, Artificial
  CRISPR gRNA sequence
tgacattcttctgtttttgc

SEQ ID NO: 223742 - DNA, 20 bp, Artificial
  CRISPR gRNA sequence
ttctgtttttgcctattagc

SEQ ID NO: 223743 - DNA, 20 bp, Artificial
  CRISPR gRNA sequence
ctgtttttgcctattagcaa

SEQ ID NO: 223744 - DNA, 20 bp, Artificial
  CRISPR gRNA sequence
tgtttttgcctattagcaac

SEQ ID NO: 223745 - DNA, 20 bp, Artificial
  CRISPR gRNA sequence
tttttgcctattagcaacat

SEQ ID NO: 223746 - DNA, 20 bp, Artificial
  CRISPR gRNA sequence
ttgcctattagcaacatgaa

SEQ ID NO: 223747 - DNA, 20 bp, Artificial
  CRISPR gRNA sequence
tgcctattagcaacatgaat

SEQ ID NO: 223748 - DNA, 20 bp, Artificial
  CRISPR gRNA sequence
gcctattagcaacatgaatt

SEQ ID NO: 223749 - DNA, 20 bp, Artificial
  CRISPR gRNA sequence
cctattagcaacatgaattt

SEQ ID NO: 223750 - DNA, 20 bp, Artificial
  CRISPR gRNA sequence
ttagcaacatgaattttctt

SEQ ID NO: 223751 - DNA, 20 bp, Artificial
  CRISPR gRNA sequence
gcaacatgaattttcttaga

SEQ ID NO: 223752 - DNA, 20 bp, Artificial
  CRISPR gRNA sequence
tcttagaaatctgtaagacc

SEQ ID NO: 223753 - DNA, 20 bp, Artificial
  CRISPR gRNA sequence
cttagaaatctgtaagacca

SEQ ID NO: 223754 - DNA, 20 bp, Artificial
  CRISPR gRNA sequence
ttagaaatctgtaagaccaa

SEQ ID NO: 223755 - DNA, 20 bp, Artificial
  CRISPR gRNA sequence
agaaatctgtaagaccaatt

SEQ ID NO: 223756 - DNA, 20 bp, Artificial
  CRISPR gRNA sequence
gaaatctgtaagaccaatta

SEQ ID NO: 223757 - DNA, 20 bp, Artificial
  CRISPR gRNA sequence
taagaccaattactcttctg

SEQ ID NO: 223758 - DNA, 20 bp, Artificial
  CRISPR gRNA sequence
ctcttctgcccatccataag

SEQ ID NO: 223759 - DNA, 20 bp, Artificial
  CRISPR gRNA sequence
ttctgcccatccataaggac

SEQ ID NO: 223760 - DNA, 20 bp, Artificial
  CRISPR gRNA sequence
ctgcccatccataaggacgt

SEQ ID NO: 223761 - DNA, 20 bp, Artificial
  CRISPR gRNA sequence
tgcccatccataaggacgtt

SEQ ID NO: 223762 - DNA, 20 bp, Artificial
  CRISPR gRNA sequence
cccatccataaggacgttgt

SEQ ID NO: 223763 - DNA, 20 bp, Artificial
  CRISPR gRNA sequence
tccatgcagaaaagataaca

SEQ ID NO: 223764 - DNA, 20 bp, Artificial
  CRISPR gRNA sequence
gtaaccttgtattatatact

SEQ ID NO: 223765 - DNA, 20 bp, Artificial
  CRISPR gRNA sequence
taaccttgtattatatactt

SEQ ID NO: 223766 - DNA, 20 bp, Artificial
  CRISPR gRNA sequence
gtattatatacttatcatcg

SEQ ID NO: 223767 - DNA, 20 bp, Artificial
  CRISPR gRNA sequence
tattatatacttatcatcgc

SEQ ID NO: 223768 - DNA, 20 bp, Artificial
  CRISPR gRNA sequence
tatacttatcatcgcccatt

SEQ ID NO: 223769 - DNA, 20 bp, Artificial
  CRISPR gRNA sequence
atcatcgcccatttgagaat

SEQ ID NO: 223770 - DNA, 20 bp, Artificial
  CRISPR gRNA sequence
tcatcgcccatttgagaatt

SEQ ID NO: 223771 - DNA, 20 bp, Artificial
  CRISPR gRNA sequence
gagaattgtaagctcctaaa

SEQ ID NO: 223772 - DNA, 20 bp, Artificial
  CRISPR gRNA sequence
agaattgtaagctcctaaaa

SEQ ID NO: 223773 - DNA, 20 bp, Artificial
  CRISPR gRNA sequence
taagctcctaaaagataata

SEQ ID NO: 223774 - DNA, 20 bp, Artificial
  CRISPR gRNA sequence
ctaaaagataataactatat

SEQ ID NO: 223775 - DNA, 20 bp, Artificial
  CRISPR gRNA sequence
aaagataataactatatttt

SEQ ID NO: 223776 - DNA, 20 bp, Artificial
  CRISPR gRNA sequence
tattttttcatcactatatc

SEQ ID NO: 223777 - DNA, 20 bp, Artificial
  CRISPR gRNA sequence
tttcatcactatatccccac

SEQ ID NO: 223778 - DNA, 20 bp, Artificial
  CRISPR gRNA sequence
ttcatcactatatccccaca

SEQ ID NO: 223779 - DNA, 20 bp, Artificial
  CRISPR gRNA sequence
tcatcactatatccccacat

SEQ ID NO: 223780 - DNA, 20 bp, Artificial
  CRISPR gRNA sequence
catcactatatccccacatc

SEQ ID NO: 223781 - DNA, 20 bp, Artificial
  CRISPR gRNA sequence
atcactatatccccacatcc

SEQ ID NO: 223782 - DNA, 20 bp, Artificial
  CRISPR gRNA sequence
tatccccacatcctatcaca

SEQ ID NO: 223783 - DNA, 20 bp, Artificial
  CRISPR gRNA sequence
tcacaatatttcatcacagg

SEQ ID NO: 223784 - DNA, 20 bp, Artificial
  CRISPR gRNA sequence
catcacaggtaattcttgac

SEQ ID NO: 223785 - DNA, 20 bp, Artificial
  CRISPR gRNA sequence
atcacaggtaattcttgaca

SEQ ID NO: 223786 - DNA, 20 bp, Artificial
  CRISPR gRNA sequence
ttgacaaatgttgattgcat

SEQ ID NO: 223787 - DNA, 20 bp, Artificial
  CRISPR gRNA sequence
gacaaatgttgattgcattt

SEQ ID NO: 223788 - DNA, 20 bp, Artificial
  CRISPR gRNA sequence
acaaatgttgattgcatttt

SEQ ID NO: 223789 - DNA, 20 bp, Artificial
  CRISPR gRNA sequence
attgcatttttaaaatttct

SEQ ID NO: 223790 - DNA, 20 bp, Artificial
  CRISPR gRNA sequence
catttttaaaatttctaacc

SEQ ID NO: 223791 - DNA, 20 bp, Artificial
  CRISPR gRNA sequence
ttaaaatttctaacctgaac

SEQ ID NO: 223792 - DNA, 20 bp, Artificial
  CRISPR gRNA sequence
taaaatttctaacctgaact

SEQ ID NO: 223793 - DNA, 20 bp, Artificial
  CRISPR gRNA sequence
aaaatttctaacctgaactt

SEQ ID NO: 223794 - DNA, 20 bp, Artificial
  CRISPR gRNA sequence
aaatttctaacctgaacttg

SEQ ID NO: 223795 - DNA, 20 bp, Artificial
  CRISPR gRNA sequence
ctaacctgaacttgtgtgct

SEQ ID NO: 223796 - DNA, 20 bp, Artificial
  CRISPR gRNA sequence
taacctgaacttgtgtgctg

SEQ ID NO: 223797 - DNA, 20 bp, Artificial
  CRISPR gRNA sequence
acctgaacttgtgtgctgtg

SEQ ID NO: 223798 - DNA, 20 bp, Artificial
  CRISPR gRNA sequence
aacttgtgtgctgtgaccac

SEQ ID NO: 223799 - DNA, 20 bp, Artificial
  CRISPR gRNA sequence
gtgtgctgtgaccaccatgg

SEQ ID NO: 223800 - DNA, 20 bp, Artificial
  CRISPR gRNA sequence
tgtgctgtgaccaccatgga

SEQ ID NO: 223801 - DNA, 20 bp, Artificial
  CRISPR gRNA sequence
tgaccaccatggattgagtc

SEQ ID NO: 223802 - DNA, 20 bp, Artificial
  CRISPR gRNA sequence
agtcttctctgccactacaa

SEQ ID NO: 223803 - DNA, 20 bp, Artificial
  CRISPR gRNA sequence
ctctgccactacaaagctct

SEQ ID NO: 223804 - DNA, 20 bp, Artificial
  CRISPR gRNA sequence
tctgccactacaaagctctt

SEQ ID NO: 223805 - DNA, 20 bp, Artificial
  CRISPR gRNA sequence
tgccactacaaagctctttt

SEQ ID NO: 223806 - DNA, 20 bp, Artificial
  CRISPR gRNA sequence
ccactacaaagctcttttct

SEQ ID NO: 223807 - DNA, 20 bp, Artificial
  CRISPR gRNA sequence
caaagctcttttctagacta

SEQ ID NO: 223808 - DNA, 20 bp, Artificial
  CRISPR gRNA sequence
ttttctagactatgatatga

SEQ ID NO: 223809 - DNA, 20 bp, Artificial
  CRISPR gRNA sequence
ttctagactatgatatgaga

SEQ ID NO: 223810 - DNA, 20 bp, Artificial
  CRISPR gRNA sequence
tctagactatgatatgagat

SEQ ID NO: 223811 - DNA, 20 bp, Artificial
  CRISPR gRNA sequence
ctagactatgatatgagatg

SEQ ID NO: 223812 - DNA, 20 bp, Artificial
  CRISPR gRNA sequence
tagactatgatatgagatgg

SEQ ID NO: 223813 - DNA, 20 bp, Artificial
  CRISPR gRNA sequence
gactatgatatgagatggtt

SEQ ID NO: 223814 - DNA, 20 bp, Artificial
  CRISPR gRNA sequence
tgatatgagatggtttgggc

SEQ ID NO: 223815 - DNA, 20 bp, Artificial
  CRISPR gRNA sequence
gggctgatagtctatattca

SEQ ID NO: 223816 - DNA, 20 bp, Artificial
  CRISPR gRNA sequence
ggctgatagtctatattcac

SEQ ID NO: 223817 - DNA, 20 bp, Artificial
  CRISPR gRNA sequence
atagtctatattcaccaata

SEQ ID NO: 223818 - DNA, 20 bp, Artificial
  CRISPR gRNA sequence
tattcaccaatacttgtaca

SEQ ID NO: 223819 - DNA, 20 bp, Artificial
  CRISPR gRNA sequence
accaatacttgtacagttcc

SEQ ID NO: 223820 - DNA, 20 bp, Artificial
  CRISPR gRNA sequence
gtacagttccaatgaaggtt

SEQ ID NO: 223821 - DNA, 20 bp, Artificial
  CRISPR gRNA sequence
tacagttccaatgaaggttt

SEQ ID NO: 223822 - DNA, 20 bp, Artificial
  CRISPR gRNA sequence
caatgaaggtttcaagtcta

SEQ ID NO: 223823 - DNA, 20 bp, Artificial
  CRISPR gRNA sequence
caagtctaatacttttggca

SEQ ID NO: 223824 - DNA, 20 bp, Artificial
  CRISPR gRNA sequence
aagtctaatacttttggcat

SEQ ID NO: 223825 - DNA, 20 bp, Artificial
  CRISPR gRNA sequence
atacttttggcatttgatat

SEQ ID NO: 223826 - DNA, 20 bp, Artificial
  CRISPR gRNA sequence
ttggcatttgatataaaatc

SEQ ID NO: 223827 - DNA, 20 bp, Artificial
  CRISPR gRNA sequence
tggcatttgatataaaatca

SEQ ID NO: 223828 - DNA, 20 bp, Artificial
  CRISPR gRNA sequence
ggcatttgatataaaatcat

SEQ ID NO: 223829 - DNA, 20 bp, Artificial
  CRISPR gRNA sequence
gcatttgatataaaatcatt

SEQ ID NO: 223830 - DNA, 20 bp, Artificial
  CRISPR gRNA sequence
gatataaaatcattttccca

SEQ ID NO: 223831 - DNA, 20 bp, Artificial
  CRISPR gRNA sequence
atataaaatcattttcccat

SEQ ID NO: 223832 - DNA, 20 bp, Artificial
  CRISPR gRNA sequence
tcccattttatttgctaatt

SEQ ID NO: 223833 - DNA, 20 bp, Artificial
  CRISPR gRNA sequence
cccattttatttgctaattt

SEQ ID NO: 223834 - DNA, 20 bp, Artificial
  CRISPR gRNA sequence
ccattttatttgctaattta

SEQ ID NO: 223835 - DNA, 20 bp, Artificial
  CRISPR gRNA sequence
tatttgctaatttatctata

SEQ ID NO: 223836 - DNA, 20 bp, Artificial
  CRISPR gRNA sequence
atttgctaatttatctataa

SEQ ID NO: 223837 - DNA, 20 bp, Artificial
  CRISPR gRNA sequence
tttgctaatttatctataac

SEQ ID NO: 223838 - DNA, 20 bp, Artificial
  CRISPR gRNA sequence
gctaatttatctataactct

SEQ ID NO: 223839 - DNA, 20 bp, Artificial
  CRISPR gRNA sequence
ctaatttatctataactctg

SEQ ID NO: 223840 - DNA, 20 bp, Artificial
  CRISPR gRNA sequence
atttatctataactctggca

SEQ ID NO: 223841 - DNA, 20 bp, Artificial
  CRISPR gRNA sequence
atctataactctggcattac

SEQ ID NO: 223842 - DNA, 20 bp, Artificial
  CRISPR gRNA sequence
tctataactctggcattact

SEQ ID NO: 223843 - DNA, 20 bp, Artificial
  CRISPR gRNA sequence
taactctggcattactcttg

SEQ ID NO: 223844 - DNA, 20 bp, Artificial
  CRISPR gRNA sequence
tggcattactcttggttaca

SEQ ID NO: 223845 - DNA, 20 bp, Artificial
  CRISPR gRNA sequence
gcattactcttggttacatt

SEQ ID NO: 223846 - DNA, 20 bp, Artificial
  CRISPR gRNA sequence
ctcttggttacatttgtctg

SEQ ID NO: 223847 - DNA, 20 bp, Artificial
  CRISPR gRNA sequence
ttggttacatttgtctgctg

SEQ ID NO: 223848 - DNA, 20 bp, Artificial
  CRISPR gRNA sequence
ggttacatttgtctgctgct

SEQ ID NO: 223849 - DNA, 20 bp, Artificial
  CRISPR gRNA sequence
gttacatttgtctgctgcta

SEQ ID NO: 223850 - DNA, 20 bp, Artificial
  CRISPR gRNA sequence
catttgtctgctgctatctg

SEQ ID NO: 223851 - DNA, 20 bp, Artificial
  CRISPR gRNA sequence
gtctgctgctatctgattta

SEQ ID NO: 223852 - DNA, 20 bp, Artificial
  CRISPR gRNA sequence
tctgctgctatctgatttag

SEQ ID NO: 223853 - DNA, 20 bp, Artificial
  CRISPR gRNA sequence
ctgctatctgatttagactg

SEQ ID NO: 223854 - DNA, 20 bp, Artificial
  CRISPR gRNA sequence
ctatctgatttagactgcta

SEQ ID NO: 223855 - DNA, 20 bp, Artificial
  CRISPR gRNA sequence
tctgatttagactgctataa

SEQ ID NO: 223856 - DNA, 20 bp, Artificial
  CRISPR gRNA sequence
atttagactgctataagcat

SEQ ID NO: 223857 - DNA, 20 bp, Artificial
  CRISPR gRNA sequence
agactgctataagcatatct

SEQ ID NO: 223858 - DNA, 20 bp, Artificial
  CRISPR gRNA sequence
gactgctataagcatatctt

SEQ ID NO: 223859 - DNA, 20 bp, Artificial
  CRISPR gRNA sequence
ctataagcatatcttgttta

SEQ ID NO: 223860 - DNA, 20 bp, Artificial
  CRISPR gRNA sequence
taagcatatcttgtttattc

SEQ ID NO: 223861 - DNA, 20 bp, Artificial
  CRISPR gRNA sequence
gtttattcagagttttctta

SEQ ID NO: 223862 - DNA, 20 bp, Artificial
  CRISPR gRNA sequence
tttattcagagttttcttat

SEQ ID NO: 223863 - DNA, 20 bp, Artificial
  CRISPR gRNA sequence
attcagagttttcttattca

SEQ ID NO: 223864 - DNA, 20 bp, Artificial
  CRISPR gRNA sequence
ttcagagttttcttattcat

SEQ ID NO: 223865 - DNA, 20 bp, Artificial
  CRISPR gRNA sequence
agagttttcttattcatgtt

SEQ ID NO: 223866 - DNA, 20 bp, Artificial
  CRISPR gRNA sequence
tcttattcatgttaattatc

SEQ ID NO: 223867 - DNA, 20 bp, Artificial
  CRISPR gRNA sequence
cttattcatgttaattatct

SEQ ID NO: 223868 - DNA, 20 bp, Artificial
  CRISPR gRNA sequence
ttattcatgttaattatctg

SEQ ID NO: 223869 - DNA, 20 bp, Artificial
  CRISPR gRNA sequence
attcatgttaattatctgtg

SEQ ID NO: 223870 - DNA, 20 bp, Artificial
  CRISPR gRNA sequence
ttcatgttaattatctgtgt

SEQ ID NO: 223871 - DNA, 20 bp, Artificial
  CRISPR gRNA sequence
atgttaattatctgtgtttc

SEQ ID NO: 223872 - DNA, 20 bp, Artificial
  CRISPR gRNA sequence
attatctgtgtttctttatt

SEQ ID NO: 223873 - DNA, 20 bp, Artificial
  CRISPR gRNA sequence
tctgtgtttctttatttgct

SEQ ID NO: 223874 - DNA, 20 bp, Artificial
  CRISPR gRNA sequence
tgtttctttatttgctctct

SEQ ID NO: 223875 - DNA, 20 bp, Artificial
  CRISPR gRNA sequence
ctttatttgctctctacatt

SEQ ID NO: 223876 - DNA, 20 bp, Artificial
  CRISPR gRNA sequence
tttatttgctctctacattt

SEQ ID NO: 223877 - DNA, 20 bp, Artificial
  CRISPR gRNA sequence
tatttgctctctacatttta

SEQ ID NO: 223878 - DNA, 20 bp, Artificial
  CRISPR gRNA sequence
atttgctctctacattttaa

SEQ ID NO: 223879 - DNA, 20 bp, Artificial
  CRISPR gRNA sequence
tttgctctctacattttaaa

SEQ ID NO: 223880 - DNA, 20 bp, Artificial
  CRISPR gRNA sequence
gctctctacattttaaatag

SEQ ID NO: 223881 - DNA, 20 bp, Artificial
  CRISPR gRNA sequence
ctctctacattttaaatagt

SEQ ID NO: 223882 - DNA, 20 bp, Artificial
  CRISPR gRNA sequence
tctacattttaaatagtttc

SEQ ID NO: 223883 - DNA, 20 bp, Artificial
  CRISPR gRNA sequence
tacattttaaatagtttctt

SEQ ID NO: 223884 - DNA, 20 bp, Artificial
  CRISPR gRNA sequence
cattttaaatagtttcttca

SEQ ID NO: 223885 - DNA, 20 bp, Artificial
  CRISPR gRNA sequence
taaatagtttcttcactttg

SEQ ID NO: 223886 - DNA, 20 bp, Artificial
  CRISPR gRNA sequence
aaatagtttcttcactttgc

SEQ ID NO: 223887 - DNA, 20 bp, Artificial
  CRISPR gRNA sequence
aatagtttcttcactttgct

SEQ ID NO: 223888 - DNA, 20 bp, Artificial
  CRISPR gRNA sequence
cttcactttgctgttttatg

SEQ ID NO: 223889 - DNA, 20 bp, Artificial
  CRISPR gRNA sequence
ttcactttgctgttttatga

SEQ ID NO: 223890 - DNA, 20 bp, Artificial
  CRISPR gRNA sequence
cactttgctgttttatgaga

SEQ ID NO: 223891 - DNA, 20 bp, Artificial
  CRISPR gRNA sequence
actttgctgttttatgagaa

SEQ ID NO: 223892 - DNA, 20 bp, Artificial
  CRISPR gRNA sequence
tgctgttttatgagaaggga

SEQ ID NO: 223893 - DNA, 20 bp, Artificial
  CRISPR gRNA sequence
gctgttttatgagaagggag

SEQ ID NO: 223894 - DNA, 20 bp, Artificial
  CRISPR gRNA sequence
ctgttttatgagaagggagt

SEQ ID NO: 223895 - DNA, 20 bp, Artificial
  CRISPR gRNA sequence
ttttatgagaagggagtagg

SEQ ID NO: 223896 - DNA, 20 bp, Artificial
  CRISPR gRNA sequence
tatgagaagggagtaggcaa

SEQ ID NO: 223897 - DNA, 20 bp, Artificial
  CRISPR gRNA sequence
atgagaagggagtaggcaaa

SEQ ID NO: 223898 - DNA, 20 bp, Artificial
  CRISPR gRNA sequence
tgagaagggagtaggcaaaa

SEQ ID NO: 223899 - DNA, 20 bp, Artificial
  CRISPR gRNA sequence
tactacttaatagtttttta

SEQ ID NO: 223900 - DNA, 20 bp, Artificial
  CRISPR gRNA sequence
actacttaatagttttttaa

SEQ ID NO: 223901 - DNA, 20 bp, Artificial
  CRISPR gRNA sequence
ctacttaatagttttttaat

SEQ ID NO: 223902 - DNA, 20 bp, Artificial
  CRISPR gRNA sequence
cttaatagttttttaatgca

SEQ ID NO: 223903 - DNA, 20 bp, Artificial
  CRISPR gRNA sequence
aatagttttttaatgcatct

SEQ ID NO: 223904 - DNA, 20 bp, Artificial
  CRISPR gRNA sequence
atagttttttaatgcatctt

SEQ ID NO: 223905 - DNA, 20 bp, Artificial
  CRISPR gRNA sequence
tttaatgcatctttatagag

SEQ ID NO: 223906 - DNA, 20 bp, Artificial
  CRISPR gRNA sequence
ttaatgcatctttatagaga

SEQ ID NO: 223907 - DNA, 20 bp, Artificial
  CRISPR gRNA sequence
taatgcatctttatagagat

SEQ ID NO: 223908 - DNA, 20 bp, Artificial
  CRISPR gRNA sequence
aatgcatctttatagagatt

SEQ ID NO: 223909 - DNA, 20 bp, Artificial
  CRISPR gRNA sequence
atgcatctttatagagattg

SEQ ID NO: 223910 - DNA, 20 bp, Artificial
  CRISPR gRNA sequence
tatagagattgaagttgtag

SEQ ID NO: 223911 - DNA, 20 bp, Artificial
  CRISPR gRNA sequence
atagagattgaagttgtagt

SEQ ID NO: 223912 - DNA, 20 bp, Artificial
  CRISPR gRNA sequence
tagagattgaagttgtagtt

SEQ ID NO: 223913 - DNA, 20 bp, Artificial
  CRISPR gRNA sequence
aagttgtagttaacagctag

SEQ ID NO: 223914 - DNA, 20 bp, Artificial
  CRISPR gRNA sequence
tagttaacagctagagtgat

SEQ ID NO: 223915 - DNA, 20 bp, Artificial
  CRISPR gRNA sequence
acagctagagtgatattttt

SEQ ID NO: 223916 - DNA, 20 bp, Artificial
  CRISPR gRNA sequence
gagtgatatttttggcctgc

SEQ ID NO: 223917 - DNA, 20 bp, Artificial
  CRISPR gRNA sequence
ttggcctgcccttatttatt

SEQ ID NO: 223918 - DNA, 20 bp, Artificial
  CRISPR gRNA sequence
tggcctgcccttatttatta

SEQ ID NO: 223919 - DNA, 20 bp, Artificial
  CRISPR gRNA sequence
ggcctgcccttatttattaa

SEQ ID NO: 223920 - DNA, 20 bp, Artificial
  CRISPR gRNA sequence
gcctgcccttatttattaat

SEQ ID NO: 223921 - DNA, 20 bp, Artificial
  CRISPR gRNA sequence
cccttatttattaattacta

SEQ ID NO: 223922 - DNA, 20 bp, Artificial
  CRISPR gRNA sequence
atttattaattactagtgca

SEQ ID NO: 223923 - DNA, 20 bp, Artificial
  CRISPR gRNA sequence
tttattaattactagtgcaa

SEQ ID NO: 223924 - DNA, 20 bp, Artificial
  CRISPR gRNA sequence
attaattactagtgcaaagg

SEQ ID NO: 223925 - DNA, 20 bp, Artificial
  CRISPR gRNA sequence
ttaattactagtgcaaaggt

SEQ ID NO: 223926 - DNA, 20 bp, Artificial
  CRISPR gRNA sequence
attactagtgcaaaggttat

SEQ ID NO: 223927 - DNA, 20 bp, Artificial
  CRISPR gRNA sequence
ctagtgcaaaggttattcaa

SEQ ID NO: 223928 - DNA, 20 bp, Artificial
  CRISPR gRNA sequence
gtgcaaaggttattcaaatt

SEQ ID NO: 223929 - DNA, 20 bp, Artificial
  CRISPR gRNA sequence
ttcaaattgtggtttatcca

SEQ ID NO: 223930 - DNA, 20 bp, Artificial
  CRISPR gRNA sequence
aaattgtggtttatccaggt

SEQ ID NO: 223931 - DNA, 20 bp, Artificial
  CRISPR gRNA sequence
tggtttatccaggtcaattt

SEQ ID NO: 223932 - DNA, 20 bp, Artificial
  CRISPR gRNA sequence
atccaggtcaattttactgt

SEQ ID NO: 223933 - DNA, 20 bp, Artificial
  CRISPR gRNA sequence
tccaggtcaattttactgtt

SEQ ID NO: 223934 - DNA, 20 bp, Artificial
  CRISPR gRNA sequence
tactgttatttttactaata

SEQ ID NO: 223935 - DNA, 20 bp, Artificial
  CRISPR gRNA sequence
actgttatttttactaatag

SEQ ID NO: 223936 - DNA, 20 bp, Artificial
  CRISPR gRNA sequence
ctgttatttttactaatagc

SEQ ID NO: 223937 - DNA, 20 bp, Artificial
  CRISPR gRNA sequence
ttatttttactaatagcatt

SEQ ID NO: 223938 - DNA, 20 bp, Artificial
  CRISPR gRNA sequence
tttttactaatagcatttat

SEQ ID NO: 223939 - DNA, 20 bp, Artificial
  CRISPR gRNA sequence
ttactaatagcatttattct

SEQ ID NO: 223940 - DNA, 20 bp, Artificial
  CRISPR gRNA sequence
tactaatagcatttattcta

SEQ ID NO: 223941 - DNA, 20 bp, Artificial
  CRISPR gRNA sequence
actaatagcatttattctac

SEQ ID NO: 223942 - DNA, 20 bp, Artificial
  CRISPR gRNA sequence
ctaatagcatttattctact

SEQ ID NO: 223943 - DNA, 20 bp, Artificial
  CRISPR gRNA sequence
atagcatttattctacttaa

SEQ ID NO: 223944 - DNA, 20 bp, Artificial
  CRISPR gRNA sequence
attctacttaaattgcttca

SEQ ID NO: 223945 - DNA, 20 bp, Artificial
  CRISPR gRNA sequence
ttctacttaaattgcttcag

SEQ ID NO: 223946 - DNA, 20 bp, Artificial
  CRISPR gRNA sequence
tacttaaattgcttcagcta

SEQ ID NO: 223947 - DNA, 20 bp, Artificial
  CRISPR gRNA sequence
cttaaattgcttcagctata

SEQ ID NO: 223948 - DNA, 20 bp, Artificial
  CRISPR gRNA sequence
aaattgcttcagctataaaa

SEQ ID NO: 223949 - DNA, 20 bp, Artificial
  CRISPR gRNA sequence
aattgcttcagctataaaat

SEQ ID NO: 223950 - DNA, 20 bp, Artificial
  CRISPR gRNA sequence
cttcagctataaaatgtttt

SEQ ID NO: 223951 - DNA, 20 bp, Artificial
  CRISPR gRNA sequence
cagctataaaatgtttttat

SEQ ID NO: 223952 - DNA, 20 bp, Artificial
  CRISPR gRNA sequence
agctataaaatgtttttatt

SEQ ID NO: 223953 - DNA, 20 bp, Artificial
  CRISPR gRNA sequence
taaaatgtttttattgtaac

SEQ ID NO: 223954 - DNA, 20 bp, Artificial
  CRISPR gRNA sequence
ttattgtaacaaataatgca

SEQ ID NO: 223955 - DNA, 20 bp, Artificial
  CRISPR gRNA sequence
tattgtaacaaataatgcag

SEQ ID NO: 223956 - DNA, 20 bp, Artificial
  CRISPR gRNA sequence
attgtaacaaataatgcagt

SEQ ID NO: 223957 - DNA, 20 bp, Artificial
  CRISPR gRNA sequence
ttgtaacaaataatgcagta

SEQ ID NO: 223958 - DNA, 20 bp, Artificial
  CRISPR gRNA sequence
taacaaataatgcagtataa

SEQ ID NO: 223959 - DNA, 20 bp, Artificial
  CRISPR gRNA sequence
ttgctttctgtattcctttg

SEQ ID NO: 223960 - DNA, 20 bp, Artificial
  CRISPR gRNA sequence
ctttctgtattcctttgaaa

SEQ ID NO: 223961 - DNA, 20 bp, Artificial
  CRISPR gRNA sequence
tctgtattcctttgaaaatt

SEQ ID NO: 223962 - DNA, 20 bp, Artificial
  CRISPR gRNA sequence
ctgtattcctttgaaaattc

SEQ ID NO: 223963 - DNA, 20 bp, Artificial
  CRISPR gRNA sequence
tgtattcctttgaaaattca

SEQ ID NO: 223964 - DNA, 20 bp, Artificial
  CRISPR gRNA sequence
tattcctttgaaaattcatt

SEQ ID NO: 223965 - DNA, 20 bp, Artificial
  CRISPR gRNA sequence
ctttgaaaattcattctcta

SEQ ID NO: 223966 - DNA, 20 bp, Artificial
  CRISPR gRNA sequence
tgaaaattcattctctaaac

SEQ ID NO: 223967 - DNA, 20 bp, Artificial
  CRISPR gRNA sequence
gaaaattcattctctaaaca

SEQ ID NO: 223968 - DNA, 20 bp, Artificial
  CRISPR gRNA sequence
aaaattcattctctaaacat

SEQ ID NO: 223969 - DNA, 20 bp, Artificial
  CRISPR gRNA sequence
attctctaaacatatgttat

SEQ ID NO: 223970 - DNA, 20 bp, Artificial
  CRISPR gRNA sequence
tctaaacatatgttatgaaa

SEQ ID NO: 223971 - DNA, 20 bp, Artificial
  CRISPR gRNA sequence
taaacatatgttatgaaatg

SEQ ID NO: 223972 - DNA, 20 bp, Artificial
  CRISPR gRNA sequence
aacatatgttatgaaatggt

SEQ ID NO: 223973 - DNA, 20 bp, Artificial
  CRISPR gRNA sequence
tgaaatggtggattgttcac

SEQ ID NO: 223974 - DNA, 20 bp, Artificial
  CRISPR gRNA sequence
ttcaccaactacttcttact

SEQ ID NO: 223975 - DNA, 20 bp, Artificial
  CRISPR gRNA sequence
accaactacttcttacttac

SEQ ID NO: 223976 - DNA, 20 bp, Artificial
  CRISPR gRNA sequence
cttcttacttacttaattaa

SEQ ID NO: 223977 - DNA, 20 bp, Artificial
  CRISPR gRNA sequence
cttacttacttaattaaagc

SEQ ID NO: 223978 - DNA, 20 bp, Artificial
  CRISPR gRNA sequence
ttacttacttaattaaagcc

SEQ ID NO: 223979 - DNA, 20 bp, Artificial
  CRISPR gRNA sequence
acttacttaattaaagcctt

SEQ ID NO: 223980 - DNA, 20 bp, Artificial
  CRISPR gRNA sequence
cttacttaattaaagccttt

SEQ ID NO: 223981 - DNA, 20 bp, Artificial
  CRISPR gRNA sequence
acttaattaaagcctttgca

SEQ ID NO: 223982 - DNA, 20 bp, Artificial
  CRISPR gRNA sequence
cttaattaaagcctttgcaa

SEQ ID NO: 223983 - DNA, 20 bp, Artificial
  CRISPR gRNA sequence
aattaaagcctttgcaaaaa

SEQ ID NO: 223984 - DNA, 20 bp, Artificial
  CRISPR gRNA sequence
attaaagcctttgcaaaaag

SEQ ID NO: 223985 - DNA, 20 bp, Artificial
  CRISPR gRNA sequence
aagcctttgcaaaaagtttc

SEQ ID NO: 223986 - DNA, 20 bp, Artificial
  CRISPR gRNA sequence
tgcaaaaagtttcataggat

SEQ ID NO: 223987 - DNA, 20 bp, Artificial
  CRISPR gRNA sequence
gcaaaaagtttcataggatg

SEQ ID NO: 223988 - DNA, 20 bp, Artificial
  CRISPR gRNA sequence
caaaaagtttcataggatga

SEQ ID NO: 223989 - DNA, 20 bp, Artificial
  CRISPR gRNA sequence
cataggatgactgagttctt

SEQ ID NO: 223990 - DNA, 20 bp, Artificial
  CRISPR gRNA sequence
ataggatgactgagttcttc

SEQ ID NO: 223991 - DNA, 20 bp, Artificial
  CRISPR gRNA sequence
agttcttcattcgtacctct

SEQ ID NO: 223992 - DNA, 20 bp, Artificial
  CRISPR gRNA sequence
ttcattcgtacctctttttt

SEQ ID NO: 223993 - DNA, 20 bp, Artificial
  CRISPR gRNA sequence
cattcgtacctctttttttt

SEQ ID NO: 223994 - DNA, 20 bp, Artificial
  CRISPR gRNA sequence
attcgtacctctttttttta

SEQ ID NO: 223995 - DNA, 20 bp, Artificial
  CRISPR gRNA sequence
gtacctcttttttttaagaa

SEQ ID NO: 223996 - DNA, 20 bp, Artificial
  CRISPR gRNA sequence
ttttttttaagaataatctc

SEQ ID NO: 223997 - DNA, 20 bp, Artificial
  CRISPR gRNA sequence
ttttttaagaataatctctt

SEQ ID NO: 223998 - DNA, 20 bp, Artificial
  CRISPR gRNA sequence
tttttaagaataatctcttg

SEQ ID NO: 223999 - DNA, 20 bp, Artificial
  CRISPR gRNA sequence
ttttaagaataatctcttga

SEQ ID NO: 224000 - DNA, 20 bp, Artificial
  CRISPR gRNA sequence
tttaagaataatctcttgaa

SEQ ID NO: 224001 - DNA, 20 bp, Artificial
  CRISPR gRNA sequence
ttaagaataatctcttgaaa

SEQ ID NO: 224002 - DNA, 20 bp, Artificial
  CRISPR gRNA sequence
taagaataatctcttgaaag

SEQ ID NO: 224003 - DNA, 20 bp, Artificial
  CRISPR gRNA sequence
aagaataatctcttgaaagt

SEQ ID NO: 224004 - DNA, 20 bp, Artificial
  CRISPR gRNA sequence
agaataatctcttgaaagtc

SEQ ID NO: 224005 - DNA, 20 bp, Artificial
  CRISPR gRNA sequence
ttgaaagtcaaaccatgatt

SEQ ID NO: 224006 - DNA, 20 bp, Artificial
  CRISPR gRNA sequence
gaaagtcaaaccatgattca

SEQ ID NO: 224007 - DNA, 20 bp, Artificial
  CRISPR gRNA sequence
aaagtcaaaccatgattcat

SEQ ID NO: 224008 - DNA, 20 bp, Artificial
  CRISPR gRNA sequence
atacaaatataaaatgaaca

SEQ ID NO: 224009 - DNA, 20 bp, Artificial
  CRISPR gRNA sequence
tatttcactaattaattaac

SEQ ID NO: 224010 - DNA, 20 bp, Artificial
  CRISPR gRNA sequence
atttcactaattaattaaca

SEQ ID NO: 224011 - DNA, 20 bp, Artificial
  CRISPR gRNA sequence
tttcactaattaattaacaa

SEQ ID NO: 224012 - DNA, 20 bp, Artificial
  CRISPR gRNA sequence
cactaattaattaacaagca

SEQ ID NO: 224013 - DNA, 20 bp, Artificial
  CRISPR gRNA sequence
actaattaattaacaagcaa

SEQ ID NO: 224014 - DNA, 20 bp, Artificial
  CRISPR gRNA sequence
attaattaacaagcaaacta

SEQ ID NO: 224015 - DNA, 20 bp, Artificial
  CRISPR gRNA sequence
attaacaagcaaactagcaa

SEQ ID NO: 224016 - DNA, 20 bp, Artificial
  CRISPR gRNA sequence
acaagcaaactagcaagaag

SEQ ID NO: 224017 - DNA, 20 bp, Artificial
  CRISPR gRNA sequence
gcaagaaggcaaaacccttt

SEQ ID NO: 224018 - DNA, 20 bp, Artificial
  CRISPR gRNA sequence
ttaaaagaaaattggaaaaa

SEQ ID NO: 224019 - DNA, 20 bp, Artificial
  CRISPR gRNA sequence
taaaagaaaattggaaaaac

SEQ ID NO: 224020 - DNA, 20 bp, Artificial
  CRISPR gRNA sequence
aaaagaaaattggaaaaaca

SEQ ID NO: 224021 - DNA, 20 bp, Artificial
  CRISPR gRNA sequence
aaagaaaattggaaaaacag

SEQ ID NO: 224022 - DNA, 20 bp, Artificial
  CRISPR gRNA sequence
gaaaaacagacacatttata

SEQ ID NO: 224023 - DNA, 20 bp, Artificial
  CRISPR gRNA sequence
ataggcaatcaagaatgcct

SEQ ID NO: 224024 - DNA, 20 bp, Artificial
  CRISPR gRNA sequence
taggcaatcaagaatgccta

SEQ ID NO: 224025 - DNA, 20 bp, Artificial
  CRISPR gRNA sequence
aatgaatttgctaataaatg

SEQ ID NO: 224026 - DNA, 20 bp, Artificial
  CRISPR gRNA sequence
gctaataaatgcaaaattgg

SEQ ID NO: 224027 - DNA, 20 bp, Artificial
  CRISPR gRNA sequence
ctaataaatgcaaaattggt

SEQ ID NO: 224028 - DNA, 20 bp, Artificial
  CRISPR gRNA sequence
ataaatgcaaaattggtcaa

SEQ ID NO: 224029 - DNA, 20 bp, Artificial
  CRISPR gRNA sequence
gtcaatatcctcagggcagt

SEQ ID NO: 224030 - DNA, 20 bp, Artificial
  CRISPR gRNA sequence
agggcagtaaaatgtagtct

SEQ ID NO: 224031 - DNA, 20 bp, Artificial
  CRISPR gRNA sequence
ttggaatcctctcttccacc

SEQ ID NO: 224032 - DNA, 20 bp, Artificial
  CRISPR gRNA sequence
tggaatcctctcttccacca

SEQ ID NO: 224033 - DNA, 20 bp, Artificial
  CRISPR gRNA sequence
ggaatcctctcttccaccag

SEQ ID NO: 224034 - DNA, 20 bp, Artificial
  CRISPR gRNA sequence
gaatcctctcttccaccagg

SEQ ID NO: 224035 - DNA, 20 bp, Artificial
  CRISPR gRNA sequence
tcttccaccaggtggaaatc

SEQ ID NO: 224036 - DNA, 20 bp, Artificial
  CRISPR gRNA sequence
ttccaccaggtggaaatcaa

SEQ ID NO: 224037 - DNA, 20 bp, Artificial
  CRISPR gRNA sequence
ccaccaggtggaaatcaatt

SEQ ID NO: 224038 - DNA, 20 bp, Artificial
  CRISPR gRNA sequence
caccaggtggaaatcaattg

SEQ ID NO: 224039 - DNA, 20 bp, Artificial
  CRISPR gRNA sequence
cagaacaagatttattttta

SEQ ID NO: 224040 - DNA, 20 bp, Artificial
  CRISPR gRNA sequence
atttttatctgtatggacag

SEQ ID NO: 224041 - DNA, 20 bp, Artificial
  CRISPR gRNA sequence
tttttatctgtatggacagc

SEQ ID NO: 224042 - DNA, 20 bp, Artificial
  CRISPR gRNA sequence
ttatctgtatggacagcaat

SEQ ID NO: 224043 - DNA, 20 bp, Artificial
  CRISPR gRNA sequence
tatctgtatggacagcaatc

SEQ ID NO: 224044 - DNA, 20 bp, Artificial
  CRISPR gRNA sequence
atctgtatggacagcaatcc

SEQ ID NO: 224045 - DNA, 20 bp, Artificial
  CRISPR gRNA sequence
tctgtatggacagcaatcca

SEQ ID NO: 224046 - DNA, 20 bp, Artificial
  CRISPR gRNA sequence
tatggacagcaatccatttg

SEQ ID NO: 224047 - DNA, 20 bp, Artificial
  CRISPR gRNA sequence
gaattactctcagttttcta

SEQ ID NO: 224048 - DNA, 20 bp, Artificial
  CRISPR gRNA sequence
aattactctcagttttctac

SEQ ID NO: 224049 - DNA, 20 bp, Artificial
  CRISPR gRNA sequence
ctctcagttttctacaactt

SEQ ID NO: 224050 - DNA, 20 bp, Artificial
  CRISPR gRNA sequence
tcagttttctacaacttatg

SEQ ID NO: 224051 - DNA, 20 bp, Artificial
  CRISPR gRNA sequence
agttttctacaacttatgaa

SEQ ID NO: 224052 - DNA, 20 bp, Artificial
  CRISPR gRNA sequence
tctacaacttatgaaactgt

SEQ ID NO: 224053 - DNA, 20 bp, Artificial
  CRISPR gRNA sequence
ctacaacttatgaaactgta

SEQ ID NO: 224054 - DNA, 20 bp, Artificial
  CRISPR gRNA sequence
tacaacttatgaaactgtaa

SEQ ID NO: 224055 - DNA, 20 bp, Artificial
  CRISPR gRNA sequence
caacttatgaaactgtaaaa

SEQ ID NO: 224056 - DNA, 20 bp, Artificial
  CRISPR gRNA sequence
atgaaactgtaaaacagccc

SEQ ID NO: 224057 - DNA, 20 bp, Artificial
  CRISPR gRNA sequence
tgaaactgtaaaacagccca

SEQ ID NO: 224058 - DNA, 20 bp, Artificial
  CRISPR gRNA sequence
taaaacagcccagtcaaagt

SEQ ID NO: 224059 - DNA, 20 bp, Artificial
  CRISPR gRNA sequence
ctatagagtcagataattcc

SEQ ID NO: 224060 - DNA, 20 bp, Artificial
  CRISPR gRNA sequence
tatagagtcagataattcca

SEQ ID NO: 224061 - DNA, 20 bp, Artificial
  CRISPR gRNA sequence
tagagtcagataattccaaa

SEQ ID NO: 224062 - DNA, 20 bp, Artificial
  CRISPR gRNA sequence
caaagcgtctgttagacatt

SEQ ID NO: 224063 - DNA, 20 bp, Artificial
  CRISPR gRNA sequence
ttagacattgcccagcactt

SEQ ID NO: 224064 - DNA, 20 bp, Artificial
  CRISPR gRNA sequence
gacattgcccagcacttgac

SEQ ID NO: 224065 - DNA, 20 bp, Artificial
  CRISPR gRNA sequence
cccagcacttgactgaaagg

SEQ ID NO: 224066 - DNA, 20 bp, Artificial
  CRISPR gRNA sequence
gactgaaaggatacccagta

SEQ ID NO: 224067 - DNA, 20 bp, Artificial
  CRISPR gRNA sequence
actgaaaggatacccagtag

SEQ ID NO: 224068 - DNA, 20 bp, Artificial
  CRISPR gRNA sequence
aaaggatacccagtagtctt

SEQ ID NO: 224069 - DNA, 20 bp, Artificial
  CRISPR gRNA sequence
tgtatccctttcaaaatctt

SEQ ID NO: 224070 - DNA, 20 bp, Artificial
  CRISPR gRNA sequence
gtatccctttcaaaatcttc

SEQ ID NO: 224071 - DNA, 20 bp, Artificial
  CRISPR gRNA sequence
tatccctttcaaaatcttca

SEQ ID NO: 224072 - DNA, 20 bp, Artificial
  CRISPR gRNA sequence
tcaaaatcttcaccatattt

SEQ ID NO: 224073 - DNA, 20 bp, Artificial
  CRISPR gRNA sequence
caaaatcttcaccatatttt

SEQ ID NO: 224074 - DNA, 20 bp, Artificial
  CRISPR gRNA sequence
aaaatcttcaccatattttc

SEQ ID NO: 224075 - DNA, 20 bp, Artificial
  CRISPR gRNA sequence
caccatattttctgatactt

SEQ ID NO: 224076 - DNA, 20 bp, Artificial
  CRISPR gRNA sequence
accatattttctgatacttt

SEQ ID NO: 224077 - DNA, 20 bp, Artificial
  CRISPR gRNA sequence
tctgatactttccttccttt

SEQ ID NO: 224078 - DNA, 20 bp, Artificial
  CRISPR gRNA sequence
ctgatactttccttccttta

SEQ ID NO: 224079 - DNA, 20 bp, Artificial
  CRISPR gRNA sequence
tgatactttccttcctttat

SEQ ID NO: 224080 - DNA, 20 bp, Artificial
  CRISPR gRNA sequence
atactttccttcctttataa

SEQ ID NO: 224081 - DNA, 20 bp, Artificial
  CRISPR gRNA sequence
tccttcctttataatttgaa

SEQ ID NO: 224082 - DNA, 20 bp, Artificial
  CRISPR gRNA sequence
ccttcctttataatttgaac

SEQ ID NO: 224083 - DNA, 20 bp, Artificial
  CRISPR gRNA sequence
cttcctttataatttgaaca

SEQ ID NO: 224084 - DNA, 20 bp, Artificial
  CRISPR gRNA sequence
cctttataatttgaacatct

SEQ ID NO: 224085 - DNA, 20 bp, Artificial
  CRISPR gRNA sequence
ctttataatttgaacatctt

SEQ ID NO: 224086 - DNA, 20 bp, Artificial
  CRISPR gRNA sequence
tataatttgaacatcttcac

SEQ ID NO: 224087 - DNA, 20 bp, Artificial
  CRISPR gRNA sequence
ataatttgaacatcttcacc

SEQ ID NO: 224088 - DNA, 20 bp, Artificial
  CRISPR gRNA sequence
taatttgaacatcttcaccc

SEQ ID NO: 224089 - DNA, 20 bp, Artificial
  CRISPR gRNA sequence
gaacatcttcacccctttat

SEQ ID NO: 224090 - DNA, 20 bp, Artificial
  CRISPR gRNA sequence
aacatcttcacccctttatt

SEQ ID NO: 224091 - DNA, 20 bp, Artificial
  CRISPR gRNA sequence
cacccctttattcttctctg

SEQ ID NO: 224092 - DNA, 20 bp, Artificial
  CRISPR gRNA sequence
acccctttattcttctctgg

SEQ ID NO: 224093 - DNA, 20 bp, Artificial
  CRISPR gRNA sequence
tattcttctctggtatacta

SEQ ID NO: 224094 - DNA, 20 bp, Artificial
  CRISPR gRNA sequence
attcttctctggtatactat

SEQ ID NO: 224095 - DNA, 20 bp, Artificial
  CRISPR gRNA sequence
ttcttctctggtatactatg

SEQ ID NO: 224096 - DNA, 20 bp, Artificial
  CRISPR gRNA sequence
ttctctggtatactatgtcc

SEQ ID NO: 224097 - DNA, 20 bp, Artificial
  CRISPR gRNA sequence
ctctggtatactatgtcctc

SEQ ID NO: 224098 - DNA, 20 bp, Artificial
  CRISPR gRNA sequence
tctggtatactatgtcctct

SEQ ID NO: 224099 - DNA, 20 bp, Artificial
  CRISPR gRNA sequence
tggtatactatgtcctctct

SEQ ID NO: 224100 - DNA, 20 bp, Artificial
  CRISPR gRNA sequence
gtatactatgtcctctctcc

SEQ ID NO: 224101 - DNA, 20 bp, Artificial
  CRISPR gRNA sequence
tgtcctctctccctcagtgt

SEQ ID NO: 224102 - DNA, 20 bp, Artificial
  CRISPR gRNA sequence
tctccctcagtgtttctctc

SEQ ID NO: 224103 - DNA, 20 bp, Artificial
  CRISPR gRNA sequence
tccctcagtgtttctctctc

SEQ ID NO: 224104 - DNA, 20 bp, Artificial
  CRISPR gRNA sequence
cctcagtgtttctctctcag

SEQ ID NO: 224105 - DNA, 20 bp, Artificial
  CRISPR gRNA sequence
agtgtttctctctcagggga

SEQ ID NO: 224106 - DNA, 20 bp, Artificial
  CRISPR gRNA sequence
ctctctcaggggaaataatt

SEQ ID NO: 224107 - DNA, 20 bp, Artificial
  CRISPR gRNA sequence
tctctcaggggaaataattc

SEQ ID NO: 224108 - DNA, 20 bp, Artificial
  CRISPR gRNA sequence
tctcaggggaaataattcac

SEQ ID NO: 224109 - DNA, 20 bp, Artificial
  CRISPR gRNA sequence
tcaggggaaataattcacaa

SEQ ID NO: 224110 - DNA, 20 bp, Artificial
  CRISPR gRNA sequence
aggggaaataattcacaatt

SEQ ID NO: 224111 - DNA, 20 bp, Artificial
  CRISPR gRNA sequence
acaattccaaagttttaaag

SEQ ID NO: 224112 - DNA, 20 bp, Artificial
  CRISPR gRNA sequence
caaagttttaaagaatgcaa

SEQ ID NO: 224113 - DNA, 20 bp, Artificial
  CRISPR gRNA sequence
taaagaatgcaacggaagtc

SEQ ID NO: 224114 - DNA, 20 bp, Artificial
  CRISPR gRNA sequence
aaagaatgcaacggaagtcc

SEQ ID NO: 224115 - DNA, 20 bp, Artificial
  CRISPR gRNA sequence
aagaatgcaacggaagtcca

SEQ ID NO: 224116 - DNA, 20 bp, Artificial
  CRISPR gRNA sequence
tgccttgggcttcctagtat

SEQ ID NO: 224117 - DNA, 20 bp, Artificial
  CRISPR gRNA sequence
gccttgggcttcctagtatt

SEQ ID NO: 224118 - DNA, 20 bp, Artificial
  CRISPR gRNA sequence
ccttgggcttcctagtattt

SEQ ID NO: 224119 - DNA, 20 bp, Artificial
  CRISPR gRNA sequence
gggcttcctagtatttgggt

SEQ ID NO: 224120 - DNA, 20 bp, Artificial
  CRISPR gRNA sequence
ggcttcctagtatttgggtg

SEQ ID NO: 224121 - DNA, 20 bp, Artificial
  CRISPR gRNA sequence
cctagtatttgggtggctag

SEQ ID NO: 224122 - DNA, 20 bp, Artificial
  CRISPR gRNA sequence
ctagtatttgggtggctaga

SEQ ID NO: 224123 - DNA, 20 bp, Artificial
  CRISPR gRNA sequence
gtatttgggtggctagaaat

SEQ ID NO: 224124 - DNA, 20 bp, Artificial
  CRISPR gRNA sequence
gggtggctagaaatgtagaa

SEQ ID NO: 224125 - DNA, 20 bp, Artificial
  CRISPR gRNA sequence
ggtggctagaaatgtagaaa

SEQ ID NO: 224126 - DNA, 20 bp, Artificial
  CRISPR gRNA sequence
gaaatgtagaaaactgggaa

SEQ ID NO: 224127 - DNA, 20 bp, Artificial
  CRISPR gRNA sequence
ggaagaggtgagctgtggat

SEQ ID NO: 224128 - DNA, 20 bp, Artificial
  CRISPR gRNA sequence
tggatgcccacaatataggt

SEQ ID NO: 224129 - DNA, 20 bp, Artificial
  CRISPR gRNA sequence
agactgcaatttcccagaaa

SEQ ID NO: 224130 - DNA, 20 bp, Artificial
  CRISPR gRNA sequence
caatttcccagaaatataac

SEQ ID NO: 224131 - DNA, 20 bp, Artificial
  CRISPR gRNA sequence
cccagaaatataacaatttg

SEQ ID NO: 224132 - DNA, 20 bp, Artificial
  CRISPR gRNA sequence
ccagaaatataacaatttgg

SEQ ID NO: 224133 - DNA, 20 bp, Artificial
  CRISPR gRNA sequence
ggactagtcaaagagggccc

SEQ ID NO: 224134 - DNA, 20 bp, Artificial
  CRISPR gRNA sequence
gactagtcaaagagggccca

SEQ ID NO: 224135 - DNA, 20 bp, Artificial
  CRISPR gRNA sequence
gtcaaagagggcccatatca

SEQ ID NO: 224136 - DNA, 20 bp, Artificial
  CRISPR gRNA sequence
cattaaaatgccagattatc

SEQ ID NO: 224137 - DNA, 20 bp, Artificial
  CRISPR gRNA sequence
aaatgccagattatctagtt

SEQ ID NO: 224138 - DNA, 20 bp, Artificial
  CRISPR gRNA sequence
tctagtttttatagtatcac

SEQ ID NO: 224139 - DNA, 20 bp, Artificial
  CRISPR gRNA sequence
gtttttatagtatcacccta

SEQ ID NO: 224140 - DNA, 20 bp, Artificial
  CRISPR gRNA sequence
ttatagtatcaccctacatt

SEQ ID NO: 224141 - DNA, 20 bp, Artificial
  CRISPR gRNA sequence
tatagtatcaccctacattt

SEQ ID NO: 224142 - DNA, 20 bp, Artificial
  CRISPR gRNA sequence
atagtatcaccctacatttt

SEQ ID NO: 224143 - DNA, 20 bp, Artificial
  CRISPR gRNA sequence
tagtatcaccctacattttt

SEQ ID NO: 224144 - DNA, 20 bp, Artificial
  CRISPR gRNA sequence
catttttacagcatagtatt

SEQ ID NO: 224145 - DNA, 20 bp, Artificial
  CRISPR gRNA sequence
ttacagcatagtattgttta

SEQ ID NO: 224146 - DNA, 20 bp, Artificial
  CRISPR gRNA sequence
tacagcatagtattgtttag

SEQ ID NO: 224147 - DNA, 20 bp, Artificial
  CRISPR gRNA sequence
acagcatagtattgtttaga

SEQ ID NO: 224148 - DNA, 20 bp, Artificial
  CRISPR gRNA sequence
cagcatagtattgtttagag

SEQ ID NO: 224149 - DNA, 20 bp, Artificial
  CRISPR gRNA sequence
tttagagagcacttgccgct

SEQ ID NO: 224150 - DNA, 20 bp, Artificial
  CRISPR gRNA sequence
agagagcacttgccgctatg

SEQ ID NO: 224151 - DNA, 20 bp, Artificial
  CRISPR gRNA sequence
gagagcacttgccgctatgt

SEQ ID NO: 224152 - DNA, 20 bp, Artificial
  CRISPR gRNA sequence
gccgctatgttttccatgtt

SEQ ID NO: 224153 - DNA, 20 bp, Artificial
  CRISPR gRNA sequence
ccgctatgttttccatgtta

SEQ ID NO: 224154 - DNA, 20 bp, Artificial
  CRISPR gRNA sequence
tgttttccatgttaatgctc

SEQ ID NO: 224155 - DNA, 20 bp, Artificial
  CRISPR gRNA sequence
tccatgttaatgctcaacac

SEQ ID NO: 224156 - DNA, 20 bp, Artificial
  CRISPR gRNA sequence
ccatgttaatgctcaacaca

SEQ ID NO: 224157 - DNA, 20 bp, Artificial
  CRISPR gRNA sequence
catgttaatgctcaacacag

SEQ ID NO: 224158 - DNA, 20 bp, Artificial
  CRISPR gRNA sequence
atgctcaacacagttctgtg

SEQ ID NO: 224159 - DNA, 20 bp, Artificial
  CRISPR gRNA sequence
aacacagttctgtgaagtag

SEQ ID NO: 224160 - DNA, 20 bp, Artificial
  CRISPR gRNA sequence
tgtgaagtagcccggtgttt

SEQ ID NO: 224161 - DNA, 20 bp, Artificial
  CRISPR gRNA sequence
tgaagtagcccggtgtttgt

SEQ ID NO: 224162 - DNA, 20 bp, Artificial
  CRISPR gRNA sequence
gtttttgatcctcctactta

SEQ ID NO: 224163 - DNA, 20 bp, Artificial
  CRISPR gRNA sequence
tttttgatcctcctacttaa

SEQ ID NO: 224164 - DNA, 20 bp, Artificial
  CRISPR gRNA sequence
ttgatcctcctacttaagag

SEQ ID NO: 224165 - DNA, 20 bp, Artificial
  CRISPR gRNA sequence
tgatcctcctacttaagaga

SEQ ID NO: 224166 - DNA, 20 bp, Artificial
  CRISPR gRNA sequence
gatcctcctacttaagagat

SEQ ID NO: 224167 - DNA, 20 bp, Artificial
  CRISPR gRNA sequence
atcctcctacttaagagatc

SEQ ID NO: 224168 - DNA, 20 bp, Artificial
  CRISPR gRNA sequence
ctacttaagagatcctccta

SEQ ID NO: 224169 - DNA, 20 bp, Artificial
  CRISPR gRNA sequence
cttaagagatcctcctattt

SEQ ID NO: 224170 - DNA, 20 bp, Artificial
  CRISPR gRNA sequence
aagagatcctcctattttag

SEQ ID NO: 224171 - DNA, 20 bp, Artificial
  CRISPR gRNA sequence
agagatcctcctattttaga

SEQ ID NO: 224172 - DNA, 20 bp, Artificial
  CRISPR gRNA sequence
ctattttagagagtaaacca

SEQ ID NO: 224173 - DNA, 20 bp, Artificial
  CRISPR gRNA sequence
ttttagagagtaaaccaagg

SEQ ID NO: 224174 - DNA, 20 bp, Artificial
  CRISPR gRNA sequence
tagagagtaaaccaaggcat

SEQ ID NO: 224175 - DNA, 20 bp, Artificial
  CRISPR gRNA sequence
agagagtaaaccaaggcata

SEQ ID NO: 224176 - DNA, 20 bp, Artificial
  CRISPR gRNA sequence
gagagtaaaccaaggcatag

SEQ ID NO: 224177 - DNA, 20 bp, Artificial
  CRISPR gRNA sequence
cttaaggcagcatattaaaa

SEQ ID NO: 224178 - DNA, 20 bp, Artificial
  CRISPR gRNA sequence
aaggcagcatattaaaaagg

SEQ ID NO: 224179 - DNA, 20 bp, Artificial
  CRISPR gRNA sequence
aggcagcatattaaaaaggg

SEQ ID NO: 224180 - DNA, 20 bp, Artificial
  CRISPR gRNA sequence
aaaaggggcagaaatagtat

SEQ ID NO: 224181 - DNA, 20 bp, Artificial
  CRISPR gRNA sequence
ttactcaggtgttttgaaca

SEQ ID NO: 224182 - DNA, 20 bp, Artificial
  CRISPR gRNA sequence
tactcaggtgttttgaacat

SEQ ID NO: 224183 - DNA, 20 bp, Artificial
  CRISPR gRNA sequence
actcaggtgttttgaacatt

SEQ ID NO: 224184 - DNA, 20 bp, Artificial
  CRISPR gRNA sequence
ctcaggtgttttgaacattg

SEQ ID NO: 224185 - DNA, 20 bp, Artificial
  CRISPR gRNA sequence
aggtgttttgaacattgtcc

SEQ ID NO: 224186 - DNA, 20 bp, Artificial
  CRISPR gRNA sequence
tgaacattgtccagtaccta

SEQ ID NO: 224187 - DNA, 20 bp, Artificial
  CRISPR gRNA sequence
gaacattgtccagtacctat

SEQ ID NO: 224188 - DNA, 20 bp, Artificial
  CRISPR gRNA sequence
aacattgtccagtacctata

SEQ ID NO: 224189 - DNA, 20 bp, Artificial
  CRISPR gRNA sequence
tccagtacctatattccagt

SEQ ID NO: 224190 - DNA, 20 bp, Artificial
  CRISPR gRNA sequence
tattccagtatgcatccttg

SEQ ID NO: 224191 - DNA, 20 bp, Artificial
  CRISPR gRNA sequence
cagtatgcatccttgcattc

SEQ ID NO: 224192 - DNA, 20 bp, Artificial
  CRISPR gRNA sequence
gcattcaattcatggggtat

SEQ ID NO: 224193 - DNA, 20 bp, Artificial
  CRISPR gRNA sequence
cattcaattcatggggtatt

SEQ ID NO: 224194 - DNA, 20 bp, Artificial
  CRISPR gRNA sequence
aattcatggggtatttattg

SEQ ID NO: 224195 - DNA, 20 bp, Artificial
  CRISPR gRNA sequence
atggggtatttattgagtaa

SEQ ID NO: 224196 - DNA, 20 bp, Artificial
  CRISPR gRNA sequence
attgagtaaacatagtgttc

SEQ ID NO: 224197 - DNA, 20 bp, Artificial
  CRISPR gRNA sequence
ttgagtaaacatagtgttct

SEQ ID NO: 224198 - DNA, 20 bp, Artificial
  CRISPR gRNA sequence
agtaaacatagtgttcttac

SEQ ID NO: 224199 - DNA, 20 bp, Artificial
  CRISPR gRNA sequence
ttacaatagaaacattctat

SEQ ID NO: 224200 - DNA, 20 bp, Artificial
  CRISPR gRNA sequence
acaatagaaacattctatgc

SEQ ID NO: 224201 - DNA, 20 bp, Artificial
  CRISPR gRNA sequence
caatagaaacattctatgcc

SEQ ID NO: 224202 - DNA, 20 bp, Artificial
  CRISPR gRNA sequence
tatgcctctgatttttattc

SEQ ID NO: 224203 - DNA, 20 bp, Artificial
  CRISPR gRNA sequence
tgcctctgatttttattcca

SEQ ID NO: 224204 - DNA, 20 bp, Artificial
  CRISPR gRNA sequence
tgatttttattccagtttat

SEQ ID NO: 224205 - DNA, 20 bp, Artificial
  CRISPR gRNA sequence
atttttattccagtttatgt

SEQ ID NO: 224206 - DNA, 20 bp, Artificial
  CRISPR gRNA sequence
ttattccagtttatgtagaa

SEQ ID NO: 224207 - DNA, 20 bp, Artificial
  CRISPR gRNA sequence
tattccagtttatgtagaag

SEQ ID NO: 224208 - DNA, 20 bp, Artificial
  CRISPR gRNA sequence
attccagtttatgtagaagt

SEQ ID NO: 224209 - DNA, 20 bp, Artificial
  CRISPR gRNA sequence
ttccagtttatgtagaagta

SEQ ID NO: 224210 - DNA, 20 bp, Artificial
  CRISPR gRNA sequence
cagtttatgtagaagtaaat

SEQ ID NO: 224211 - DNA, 20 bp, Artificial
  CRISPR gRNA sequence
atgtagaagtaaatcttaag

SEQ ID NO: 224212 - DNA, 20 bp, Artificial
  CRISPR gRNA sequence
tgtagaagtaaatcttaagt

SEQ ID NO: 224213 - DNA, 20 bp, Artificial
  CRISPR gRNA sequence
aagtgtgaactattaacaaa

SEQ ID NO: 224214 - DNA, 20 bp, Artificial
  CRISPR gRNA sequence
agtgtgaactattaacaaag

SEQ ID NO: 224215 - DNA, 20 bp, Artificial
  CRISPR gRNA sequence
ttaacaaagttgatatttta

SEQ ID NO: 224216 - DNA, 20 bp, Artificial
  CRISPR gRNA sequence
acaaagttgatattttattt

SEQ ID NO: 224217 - DNA, 20 bp, Artificial
  CRISPR gRNA sequence
atattttatttatatttgtt

SEQ ID NO: 224218 - DNA, 20 bp, Artificial
  CRISPR gRNA sequence
tatttatatttgttagtaat

SEQ ID NO: 224219 - DNA, 20 bp, Artificial
  CRISPR gRNA sequence
atttatatttgttagtaatt

SEQ ID NO: 224220 - DNA, 20 bp, Artificial
  CRISPR gRNA sequence
tttatatttgttagtaattt

SEQ ID NO: 224221 - DNA, 20 bp, Artificial
  CRISPR gRNA sequence
atatttgttagtaatttgtg

SEQ ID NO: 224222 - DNA, 20 bp, Artificial
  CRISPR gRNA sequence
tatttgttagtaatttgtgt

SEQ ID NO: 224223 - DNA, 20 bp, Artificial
  CRISPR gRNA sequence
gttagtaatttgtgttttgt

SEQ ID NO: 224224 - DNA, 20 bp, Artificial
  CRISPR gRNA sequence
ttagtaatttgtgttttgtt

SEQ ID NO: 224225 - DNA, 20 bp, Artificial
  CRISPR gRNA sequence
gtaatttgtgttttgttttt

SEQ ID NO: 224226 - DNA, 20 bp, Artificial
  CRISPR gRNA sequence
gtgttttgtttttgtttatg

SEQ ID NO: 224227 - DNA, 20 bp, Artificial
  CRISPR gRNA sequence
tgttttgtttttgtttatgt

SEQ ID NO: 224228 - DNA, 20 bp, Artificial
  CRISPR gRNA sequence
tgtttttgtttatgttttga

SEQ ID NO: 224229 - DNA, 20 bp, Artificial
  CRISPR gRNA sequence
gtttttgtttatgttttgag

SEQ ID NO: 224230 - DNA, 20 bp, Artificial
  CRISPR gRNA sequence
tttttgtttatgttttgagg

SEQ ID NO: 224231 - DNA, 20 bp, Artificial
  CRISPR gRNA sequence
ttgtttatgttttgagggga

SEQ ID NO: 224232 - DNA, 20 bp, Artificial
  CRISPR gRNA sequence
tgtttatgttttgaggggaa

SEQ ID NO: 224233 - DNA, 20 bp, Artificial
  CRISPR gRNA sequence
gtttatgttttgaggggaag

SEQ ID NO: 224234 - DNA, 20 bp, Artificial
  CRISPR gRNA sequence
tttatgttttgaggggaagg

SEQ ID NO: 224235 - DNA, 20 bp, Artificial
  CRISPR gRNA sequence
atgttttgaggggaaggcca

SEQ ID NO: 224236 - DNA, 20 bp, Artificial
  CRISPR gRNA sequence
tgttttgaggggaaggccaa

SEQ ID NO: 224237 - DNA, 20 bp, Artificial
  CRISPR gRNA sequence
tgaggggaaggccaagtagc

SEQ ID NO: 224238 - DNA, 20 bp, Artificial
  CRISPR gRNA sequence
gaggggaaggccaagtagct

SEQ ID NO: 224239 - DNA, 20 bp, Artificial
  CRISPR gRNA sequence
aggggaaggccaagtagcta

SEQ ID NO: 224240 - DNA, 20 bp, Artificial
  CRISPR gRNA sequence
cttaggtaaaagagttgctg

SEQ ID NO: 224241 - DNA, 20 bp, Artificial
  CRISPR gRNA sequence
aggtaaaagagttgctgagt

SEQ ID NO: 224242 - DNA, 20 bp, Artificial
  CRISPR gRNA sequence
ggtaaaagagttgctgagtg

SEQ ID NO: 224243 - DNA, 20 bp, Artificial
  CRISPR gRNA sequence
ctgagtggctgaagaatatg

SEQ ID NO: 224244 - DNA, 20 bp, Artificial
  CRISPR gRNA sequence
agtggctgaagaatatggaa

SEQ ID NO: 224245 - DNA, 20 bp, Artificial
  CRISPR gRNA sequence
aagaatatggaagacaacta

SEQ ID NO: 224246 - DNA, 20 bp, Artificial
  CRISPR gRNA sequence
caattcctacacattcttgt

SEQ ID NO: 224247 - DNA, 20 bp, Artificial
  CRISPR gRNA sequence
ctacacattcttgtacattt

SEQ ID NO: 224248 - DNA, 20 bp, Artificial
  CRISPR gRNA sequence
cacattcttgtacattttag

SEQ ID NO: 224249 - DNA, 20 bp, Artificial
  CRISPR gRNA sequence
ttgtacattttagttgaaca

SEQ ID NO: 224250 - DNA, 20 bp, Artificial
  CRISPR gRNA sequence
gtacattttagttgaacaat

SEQ ID NO: 224251 - DNA, 20 bp, Artificial
  CRISPR gRNA sequence
tacattttagttgaacaatg

SEQ ID NO: 224252 - DNA, 20 bp, Artificial
  CRISPR gRNA sequence
tagttgaacaatgagtgatt

SEQ ID NO: 224253 - DNA, 20 bp, Artificial
  CRISPR gRNA sequence
agttgaacaatgagtgatta

SEQ ID NO: 224254 - DNA, 20 bp, Artificial
  CRISPR gRNA sequence
gttgaacaatgagtgattac

SEQ ID NO: 224255 - DNA, 20 bp, Artificial
  CRISPR gRNA sequence
aacaatgagtgattacattt

SEQ ID NO: 224256 - DNA, 20 bp, Artificial
  CRISPR gRNA sequence
catttatttacccagtgcct

SEQ ID NO: 224257 - DNA, 20 bp, Artificial
  CRISPR gRNA sequence
atttacccagtgcctcttct

SEQ ID NO: 224258 - DNA, 20 bp, Artificial
  CRISPR gRNA sequence
tttacccagtgcctcttcta

SEQ ID NO: 224259 - DNA, 20 bp, Artificial
  CRISPR gRNA sequence
acccagtgcctcttctataa

SEQ ID NO: 224260 - DNA, 20 bp, Artificial
  CRISPR gRNA sequence
cccagtgcctcttctataag

SEQ ID NO: 224261 - DNA, 20 bp, Artificial
  CRISPR gRNA sequence
ttctataaggcaacaactgg

SEQ ID NO: 224262 - DNA, 20 bp, Artificial
  CRISPR gRNA sequence
ctataaggcaacaactggta

SEQ ID NO: 224263 - DNA, 20 bp, Artificial
  CRISPR gRNA sequence
tataaggcaacaactggtag

SEQ ID NO: 224264 - DNA, 20 bp, Artificial
  CRISPR gRNA sequence
taaggcaacaactggtagtt

SEQ ID NO: 224265 - DNA, 20 bp, Artificial
  CRISPR gRNA sequence
gtagtttatcctattgagaa

SEQ ID NO: 224266 - DNA, 20 bp, Artificial
  CRISPR gRNA sequence
atcctattgagaagcgtaga

SEQ ID NO: 224267 - DNA, 20 bp, Artificial
  CRISPR gRNA sequence
tcctattgagaagcgtagat

SEQ ID NO: 224268 - DNA, 20 bp, Artificial
  CRISPR gRNA sequence
ttgagaagcgtagataggat

SEQ ID NO: 224269 - DNA, 20 bp, Artificial
  CRISPR gRNA sequence
agaagcgtagataggatgct

SEQ ID NO: 224270 - DNA, 20 bp, Artificial
  CRISPR gRNA sequence
attagcagtaactgctcttg

SEQ ID NO: 224271 - DNA, 20 bp, Artificial
  CRISPR gRNA sequence
ttagcagtaactgctcttgg

SEQ ID NO: 224272 - DNA, 20 bp, Artificial
  CRISPR gRNA sequence
gcagtaactgctcttggttt

SEQ ID NO: 224273 - DNA, 20 bp, Artificial
  CRISPR gRNA sequence
ctcttggtttcaacttgcat

SEQ ID NO: 224274 - DNA, 20 bp, Artificial
  CRISPR gRNA sequence
ttggtttcaacttgcatctt

SEQ ID NO: 224275 - DNA, 20 bp, Artificial
  CRISPR gRNA sequence
ggtttcaacttgcatcttac

SEQ ID NO: 224276 - DNA, 20 bp, Artificial
  CRISPR gRNA sequence
gtttcaacttgcatcttact

SEQ ID NO: 224277 - DNA, 20 bp, Artificial
  CRISPR gRNA sequence
caacttgcatcttacttagc

SEQ ID NO: 224278 - DNA, 20 bp, Artificial
  CRISPR gRNA sequence
aacttgcatcttacttagct

SEQ ID NO: 224279 - DNA, 20 bp, Artificial
  CRISPR gRNA sequence
gcatcttacttagctttttc

SEQ ID NO: 224280 - DNA, 20 bp, Artificial
  CRISPR gRNA sequence
catcttacttagctttttca

SEQ ID NO: 224281 - DNA, 20 bp, Artificial
  CRISPR gRNA sequence
acttagctttttcaccgttt

SEQ ID NO: 224282 - DNA, 20 bp, Artificial
  CRISPR gRNA sequence
cttagctttttcaccgtttt

SEQ ID NO: 224283 - DNA, 20 bp, Artificial
  CRISPR gRNA sequence
agctttttcaccgttttgtg

SEQ ID NO: 224284 - DNA, 20 bp, Artificial
  CRISPR gRNA sequence
gctttttcaccgttttgtgg

SEQ ID NO: 224285 - DNA, 20 bp, Artificial
  CRISPR gRNA sequence
tttcaccgttttgtggtttc

SEQ ID NO: 224286 - DNA, 20 bp, Artificial
  CRISPR gRNA sequence
ttcaccgttttgtggtttct

SEQ ID NO: 224287 - DNA, 20 bp, Artificial
  CRISPR gRNA sequence
tcaccgttttgtggtttctt

SEQ ID NO: 224288 - DNA, 20 bp, Artificial
  CRISPR gRNA sequence
caccgttttgtggtttcttg

SEQ ID NO: 224289 - DNA, 20 bp, Artificial
  CRISPR gRNA sequence
accgttttgtggtttcttgg

SEQ ID NO: 224290 - DNA, 20 bp, Artificial
  CRISPR gRNA sequence
tgtggtttcttggaggaaga

SEQ ID NO: 224291 - DNA, 20 bp, Artificial
  CRISPR gRNA sequence
gtggtttcttggaggaagaa

SEQ ID NO: 224292 - DNA, 20 bp, Artificial
  CRISPR gRNA sequence
tggtttcttggaggaagaat

SEQ ID NO: 224293 - DNA, 20 bp, Artificial
  CRISPR gRNA sequence
cttggaggaagaatacccat

SEQ ID NO: 224294 - DNA, 20 bp, Artificial
  CRISPR gRNA sequence
ttggaggaagaatacccata

SEQ ID NO: 224295 - DNA, 20 bp, Artificial
  CRISPR gRNA sequence
ggaggaagaatacccataat

SEQ ID NO: 224296 - DNA, 20 bp, Artificial
  CRISPR gRNA sequence
gaggaagaatacccataata

SEQ ID NO: 224297 - DNA, 20 bp, Artificial
  CRISPR gRNA sequence
ggagactgttgttctgtagt

SEQ ID NO: 224298 - DNA, 20 bp, Artificial
  CRISPR gRNA sequence
gagactgttgttctgtagtg

SEQ ID NO: 224299 - DNA, 20 bp, Artificial
  CRISPR gRNA sequence
ttgttctgtagtgtcaatga

SEQ ID NO: 224300 - DNA, 20 bp, Artificial
  CRISPR gRNA sequence
ttctgtagtgtcaatgaaat

SEQ ID NO: 224301 - DNA, 20 bp, Artificial
  CRISPR gRNA sequence
tgtagtgtcaatgaaatgtg

SEQ ID NO: 224302 - DNA, 20 bp, Artificial
  CRISPR gRNA sequence
tagtgtcaatgaaatgtggg

SEQ ID NO: 224303 - DNA, 20 bp, Artificial
  CRISPR gRNA sequence
aagactcccatacaaaatgt

SEQ ID NO: 224304 - DNA, 20 bp, Artificial
  CRISPR gRNA sequence
ccatacaaaatgtctattgc

SEQ ID NO: 224305 - DNA, 20 bp, Artificial
  CRISPR gRNA sequence
ttgctgcctatattttgcta

SEQ ID NO: 224306 - DNA, 20 bp, Artificial
  CRISPR gRNA sequence
ctgcctatattttgctatgg

SEQ ID NO: 224307 - DNA, 20 bp, Artificial
  CRISPR gRNA sequence
cctatattttgctatgggaa

SEQ ID NO: 224308 - DNA, 20 bp, Artificial
  CRISPR gRNA sequence
tattttgctatgggaaagta

SEQ ID NO: 224309 - DNA, 20 bp, Artificial
  CRISPR gRNA sequence
tgctatgggaaagtagccac

SEQ ID NO: 224310 - DNA, 20 bp, Artificial
  CRISPR gRNA sequence
gctatgggaaagtagccaca

SEQ ID NO: 224311 - DNA, 20 bp, Artificial
  CRISPR gRNA sequence
ctatgggaaagtagccacag

SEQ ID NO: 224312 - DNA, 20 bp, Artificial
  CRISPR gRNA sequence
tgggaaagtagccacagata

SEQ ID NO: 224313 - DNA, 20 bp, Artificial
  CRISPR gRNA sequence
tttttttcctcattagtatt

SEQ ID NO: 224314 - DNA, 20 bp, Artificial
  CRISPR gRNA sequence
ttttttcctcattagtattt

SEQ ID NO: 224315 - DNA, 20 bp, Artificial
  CRISPR gRNA sequence
tttttcctcattagtatttt

SEQ ID NO: 224316 - DNA, 20 bp, Artificial
  CRISPR gRNA sequence
ttttcctcattagtatttta

SEQ ID NO: 224317 - DNA, 20 bp, Artificial
  CRISPR gRNA sequence
tttcctcattagtattttaa

SEQ ID NO: 224318 - DNA, 20 bp, Artificial
  CRISPR gRNA sequence
ttcctcattagtattttaag

SEQ ID NO: 224319 - DNA, 20 bp, Artificial
  CRISPR gRNA sequence
tcctcattagtattttaaga

SEQ ID NO: 224320 - DNA, 20 bp, Artificial
  CRISPR gRNA sequence
cctcattagtattttaagat

SEQ ID NO: 224321 - DNA, 20 bp, Artificial
  CRISPR gRNA sequence
ctcattagtattttaagatt

SEQ ID NO: 224322 - DNA, 20 bp, Artificial
  CRISPR gRNA sequence
attagtattttaagattttc

SEQ ID NO: 224323 - DNA, 20 bp, Artificial
  CRISPR gRNA sequence
gtattttaagattttccatc

SEQ ID NO: 224324 - DNA, 20 bp, Artificial
  CRISPR gRNA sequence
taagattttccatcctagtg

SEQ ID NO: 224325 - DNA, 20 bp, Artificial
  CRISPR gRNA sequence
aagattttccatcctagtgg

SEQ ID NO: 224326 - DNA, 20 bp, Artificial
  CRISPR gRNA sequence
agattttccatcctagtgga

SEQ ID NO: 224327 - DNA, 20 bp, Artificial
  CRISPR gRNA sequence
tccatcctagtggaaagata

SEQ ID NO: 224328 - DNA, 20 bp, Artificial
  CRISPR gRNA sequence
ccatcctagtggaaagatat

SEQ ID NO: 224329 - DNA, 20 bp, Artificial
  CRISPR gRNA sequence
catcctagtggaaagatatg

SEQ ID NO: 224330 - DNA, 20 bp, Artificial
  CRISPR gRNA sequence
gtggaaagatatgatttgat

SEQ ID NO: 224331 - DNA, 20 bp, Artificial
  CRISPR gRNA sequence
gattcatcctatttactttg

SEQ ID NO: 224332 - DNA, 20 bp, Artificial
  CRISPR gRNA sequence
attcatcctatttactttgt

SEQ ID NO: 224333 - DNA, 20 bp, Artificial
  CRISPR gRNA sequence
atcctatttactttgtatat

SEQ ID NO: 224334 - DNA, 20 bp, Artificial
  CRISPR gRNA sequence
tttactttgtatattaaagt

SEQ ID NO: 224335 - DNA, 20 bp, Artificial
  CRISPR gRNA sequence
actttgtatattaaagtaca

SEQ ID NO: 224336 - DNA, 20 bp, Artificial
  CRISPR gRNA sequence
ctttgtatattaaagtacag

SEQ ID NO: 224337 - DNA, 20 bp, Artificial
  CRISPR gRNA sequence
tgtatattaaagtacagtag

SEQ ID NO: 224338 - DNA, 20 bp, Artificial
  CRISPR gRNA sequence
gtatattaaagtacagtaga

SEQ ID NO: 224339 - DNA, 20 bp, Artificial
  CRISPR gRNA sequence
tatattaaagtacagtagaa

SEQ ID NO: 224340 - DNA, 20 bp, Artificial
  CRISPR gRNA sequence
aagtacagtagaacctgcca

SEQ ID NO: 224341 - DNA, 20 bp, Artificial
  CRISPR gRNA sequence
ccactttttttggaaatgca

SEQ ID NO: 224342 - DNA, 20 bp, Artificial
  CRISPR gRNA sequence
tttttggaaatgcagcataa

SEQ ID NO: 224343 - DNA, 20 bp, Artificial
  CRISPR gRNA sequence
ttttggaaatgcagcataag

SEQ ID NO: 224344 - DNA, 20 bp, Artificial
  CRISPR gRNA sequence
tttggaaatgcagcataagg

SEQ ID NO: 224345 - DNA, 20 bp, Artificial
  CRISPR gRNA sequence
ttggaaatgcagcataagga

SEQ ID NO: 224346 - DNA, 20 bp, Artificial
  CRISPR gRNA sequence
tggaaatgcagcataaggat

SEQ ID NO: 224347 - DNA, 20 bp, Artificial
  CRISPR gRNA sequence
ggaaatgcagcataaggata

SEQ ID NO: 224348 - DNA, 20 bp, Artificial
  CRISPR gRNA sequence
gaaatgcagcataaggataa

SEQ ID NO: 224349 - DNA, 20 bp, Artificial
  CRISPR gRNA sequence
catatcagttcagcaagttc

SEQ ID NO: 224350 - DNA, 20 bp, Artificial
  CRISPR gRNA sequence
atatcagttcagcaagttct

SEQ ID NO: 224351 - DNA, 20 bp, Artificial
  CRISPR gRNA sequence
agcaagttctatttagcagt

SEQ ID NO: 224352 - DNA, 20 bp, Artificial
  CRISPR gRNA sequence
tatttagcagtgtgttgaag

SEQ ID NO: 224353 - DNA, 20 bp, Artificial
  CRISPR gRNA sequence
tttagcagtgtgttgaagtt

SEQ ID NO: 224354 - DNA, 20 bp, Artificial
  CRISPR gRNA sequence
agcagtgtgttgaagttgag

SEQ ID NO: 224355 - DNA, 20 bp, Artificial
  CRISPR gRNA sequence
gcagtgtgttgaagttgaga

SEQ ID NO: 224356 - DNA, 20 bp, Artificial
  CRISPR gRNA sequence
aagttgagactgaataaaat

SEQ ID NO: 224357 - DNA, 20 bp, Artificial
  CRISPR gRNA sequence
agactgaataaaatatttgg

SEQ ID NO: 224358 - DNA, 20 bp, Artificial
  CRISPR gRNA sequence
aataaaatatttggtttggt

SEQ ID NO: 224359 - DNA, 20 bp, Artificial
  CRISPR gRNA sequence
ggtttggttttctgttcaaa

SEQ ID NO: 224360 - DNA, 20 bp, Artificial
  CRISPR gRNA sequence
gtttggttttctgttcaaaa

SEQ ID NO: 224361 - DNA, 20 bp, Artificial
  CRISPR gRNA sequence
ggttttctgttcaaaatttt

SEQ ID NO: 224362 - DNA, 20 bp, Artificial
  CRISPR gRNA sequence
gttttctgttcaaaatttta

SEQ ID NO: 224363 - DNA, 20 bp, Artificial
  CRISPR gRNA sequence
tctgttcaaaattttacctt

SEQ ID NO: 224364 - DNA, 20 bp, Artificial
  CRISPR gRNA sequence
ctgttcaaaattttaccttg

SEQ ID NO: 224365 - DNA, 20 bp, Artificial
  CRISPR gRNA sequence
tgttcaaaattttaccttga

SEQ ID NO: 224366 - DNA, 20 bp, Artificial
  CRISPR gRNA sequence
ttcaaaattttaccttgata

SEQ ID NO: 224367 - DNA, 20 bp, Artificial
  CRISPR gRNA sequence
aaaattttaccttgataagg

SEQ ID NO: 224368 - DNA, 20 bp, Artificial
  CRISPR gRNA sequence
taccttgataaggacaatat

SEQ ID NO: 224369 - DNA, 20 bp, Artificial
  CRISPR gRNA sequence
accttgataaggacaatatt

SEQ ID NO: 224370 - DNA, 20 bp, Artificial
  CRISPR gRNA sequence
ccttgataaggacaatattt

SEQ ID NO: 224371 - DNA, 20 bp, Artificial
  CRISPR gRNA sequence
gataaggacaatatttttct

SEQ ID NO: 224372 - DNA, 20 bp, Artificial
  CRISPR gRNA sequence
ataaggacaatatttttcta

SEQ ID NO: 224373 - DNA, 20 bp, Artificial
  CRISPR gRNA sequence
ttctacatatatcagtaggc

SEQ ID NO: 224374 - DNA, 20 bp, Artificial
  CRISPR gRNA sequence
tctacatatatcagtaggca

SEQ ID NO: 224375 - DNA, 20 bp, Artificial
  CRISPR gRNA sequence
ctacatatatcagtaggcag

SEQ ID NO: 224376 - DNA, 20 bp, Artificial
  CRISPR gRNA sequence
tacatatatcagtaggcagt

SEQ ID NO: 224377 - DNA, 20 bp, Artificial
  CRISPR gRNA sequence
catatatcagtaggcagtaa

SEQ ID NO: 224378 - DNA, 20 bp, Artificial
  CRISPR gRNA sequence
cttcaaagcttccaaagcca

SEQ ID NO: 224379 - DNA, 20 bp, Artificial
  CRISPR gRNA sequence
caaagcttccaaagccagat

SEQ ID NO: 224380 - DNA, 20 bp, Artificial
  CRISPR gRNA sequence
aaagcttccaaagccagata

SEQ ID NO: 224381 - DNA, 20 bp, Artificial
  CRISPR gRNA sequence
ccaaagccagatactacacc

SEQ ID NO: 224382 - DNA, 20 bp, Artificial
  CRISPR gRNA sequence
caaagccagatactacacct

SEQ ID NO: 224383 - DNA, 20 bp, Artificial
  CRISPR gRNA sequence
cacctgcatgttccaacata

SEQ ID NO: 224384 - DNA, 20 bp, Artificial
  CRISPR gRNA sequence
catgttccaacatagttgct

SEQ ID NO: 224385 - DNA, 20 bp, Artificial
  CRISPR gRNA sequence
caacatagttgctgaattta

SEQ ID NO: 224386 - DNA, 20 bp, Artificial
  CRISPR gRNA sequence
ctgaatttattcccaagatg

SEQ ID NO: 224387 - DNA, 20 bp, Artificial
  CRISPR gRNA sequence
aatttattcccaagatgcat

SEQ ID NO: 224388 - DNA, 20 bp, Artificial
  CRISPR gRNA sequence
attcccaagatgcatgtaat

SEQ ID NO: 224389 - DNA, 20 bp, Artificial
  CRISPR gRNA sequence
ttcccaagatgcatgtaatg

SEQ ID NO: 224390 - DNA, 20 bp, Artificial
  CRISPR gRNA sequence
ccaagatgcatgtaatgtat

SEQ ID NO: 224391 - DNA, 20 bp, Artificial
  CRISPR gRNA sequence
tgtattattgagaatgaata

SEQ ID NO: 224392 - DNA, 20 bp, Artificial
  CRISPR gRNA sequence
gtattattgagaatgaataa

SEQ ID NO: 224393 - DNA, 20 bp, Artificial
  CRISPR gRNA sequence
tattattgagaatgaataaa

SEQ ID NO: 224394 - DNA, 20 bp, Artificial
  CRISPR gRNA sequence
ttgagaatgaataaagaaaa

SEQ ID NO: 224395 - DNA, 20 bp, Artificial
  CRISPR gRNA sequence
agaatgaataaagaaaagtc

SEQ ID NO: 224396 - DNA, 20 bp, Artificial
  CRISPR gRNA sequence
ccagctgtgcaagttaatat

SEQ ID NO: 224397 - DNA, 20 bp, Artificial
  CRISPR gRNA sequence
cagctgtgcaagttaatatt

SEQ ID NO: 224398 - DNA, 20 bp, Artificial
  CRISPR gRNA sequence
tgcaagttaatattaaaata

SEQ ID NO: 224399 - DNA, 20 bp, Artificial
  CRISPR gRNA sequence
atattaaaatataatttgtt

SEQ ID NO: 224400 - DNA, 20 bp, Artificial
  CRISPR gRNA sequence
aaatataatttgtttgcata

SEQ ID NO: 224401 - DNA, 20 bp, Artificial
  CRISPR gRNA sequence
gtttgcatatttcacctaat

SEQ ID NO: 224402 - DNA, 20 bp, Artificial
  CRISPR gRNA sequence
tttgcatatttcacctaata

SEQ ID NO: 224403 - DNA, 20 bp, Artificial
  CRISPR gRNA sequence
gcatatttcacctaataggt

SEQ ID NO: 224404 - DNA, 20 bp, Artificial
  CRISPR gRNA sequence
catatttcacctaataggtc

SEQ ID NO: 224405 - DNA, 20 bp, Artificial
  CRISPR gRNA sequence
cacctaataggtcttcttca

SEQ ID NO: 224406 - DNA, 20 bp, Artificial
  CRISPR gRNA sequence
acctaataggtcttcttcat

SEQ ID NO: 224407 - DNA, 20 bp, Artificial
  CRISPR gRNA sequence
ataggtcttcttcattgcta

SEQ ID NO: 224408 - DNA, 20 bp, Artificial
  CRISPR gRNA sequence
cttcattgctatactgttta

SEQ ID NO: 224409 - DNA, 20 bp, Artificial
  CRISPR gRNA sequence
ttcattgctatactgtttac

SEQ ID NO: 224410 - DNA, 20 bp, Artificial
  CRISPR gRNA sequence
cattgctatactgtttactt

SEQ ID NO: 224411 - DNA, 20 bp, Artificial
  CRISPR gRNA sequence
attgctatactgtttactta

SEQ ID NO: 224412 - DNA, 20 bp, Artificial
  CRISPR gRNA sequence
ctatactgtttacttaagtg

SEQ ID NO: 224413 - DNA, 20 bp, Artificial
  CRISPR gRNA sequence
tactgtttacttaagtgaac

SEQ ID NO: 224414 - DNA, 20 bp, Artificial
  CRISPR gRNA sequence
tttacttaagtgaacaatgg

SEQ ID NO: 224415 - DNA, 20 bp, Artificial
  CRISPR gRNA sequence
acttaagtgaacaatggaaa

SEQ ID NO: 224416 - DNA, 20 bp, Artificial
  CRISPR gRNA sequence
cttaagtgaacaatggaaat

SEQ ID NO: 224417 - DNA, 20 bp, Artificial
  CRISPR gRNA sequence
aagtgaacaatggaaatgtt

SEQ ID NO: 224418 - DNA, 20 bp, Artificial
  CRISPR gRNA sequence
agtgaacaatggaaatgttg

SEQ ID NO: 224419 - DNA, 20 bp, Artificial
  CRISPR gRNA sequence
ctgtttatcttaaggatttg

SEQ ID NO: 224420 - DNA, 20 bp, Artificial
  CRISPR gRNA sequence
tttatcttaaggatttgtaa

SEQ ID NO: 224421 - DNA, 20 bp, Artificial
  CRISPR gRNA sequence
atcttaaggatttgtaacat

SEQ ID NO: 224422 - DNA, 20 bp, Artificial
  CRISPR gRNA sequence
tcttaaggatttgtaacatg

SEQ ID NO: 224423 - DNA, 20 bp, Artificial
  CRISPR gRNA sequence
aaggatttgtaacatgccta

SEQ ID NO: 224424 - DNA, 20 bp, Artificial
  CRISPR gRNA sequence
aggatttgtaacatgcctaa

SEQ ID NO: 224425 - DNA, 20 bp, Artificial
  CRISPR gRNA sequence
gtaacatgcctaagatctta

SEQ ID NO: 224426 - DNA, 20 bp, Artificial
  CRISPR gRNA sequence
taacatgcctaagatcttac

SEQ ID NO: 224427 - DNA, 20 bp, Artificial
  CRISPR gRNA sequence
agatcttacagtacagactt

SEQ ID NO: 224428 - DNA, 20 bp, Artificial
  CRISPR gRNA sequence
acagtacagacttctataat

SEQ ID NO: 224429 - DNA, 20 bp, Artificial
  CRISPR gRNA sequence
cagtacagacttctataatt

SEQ ID NO: 224430 - DNA, 20 bp, Artificial
  CRISPR gRNA sequence
ctataattaatgaaacattt

SEQ ID NO: 224431 - DNA, 20 bp, Artificial
  CRISPR gRNA sequence
tataattaatgaaacatttt

SEQ ID NO: 224432 - DNA, 20 bp, Artificial
  CRISPR gRNA sequence
taattaatgaaacatttttc

SEQ ID NO: 224433 - DNA, 20 bp, Artificial
  CRISPR gRNA sequence
atgaaacatttttctttttc

SEQ ID NO: 224434 - DNA, 20 bp, Artificial
  CRISPR gRNA sequence
ttctttttcctttccaggat

SEQ ID NO: 224435 - DNA, 20 bp, Artificial
  CRISPR gRNA sequence
tctttttcctttccaggatc

SEQ ID NO: 224436 - DNA, 20 bp, Artificial
  CRISPR gRNA sequence
ctttttcctttccaggatca

SEQ ID NO: 224437 - DNA, 20 bp, Artificial
  CRISPR gRNA sequence
tttttcctttccaggatcag

SEQ ID NO: 224438 - DNA, 20 bp, Artificial
  CRISPR gRNA sequence
tttcctttccaggatcagct

SEQ ID NO: 224439 - DNA, 20 bp, Artificial
  CRISPR gRNA sequence
ttcctttccaggatcagctc

SEQ ID NO: 224440 - DNA, 20 bp, Artificial
  CRISPR gRNA sequence
tcctttccaggatcagctca

SEQ ID NO: 224441 - DNA, 20 bp, Artificial
  CRISPR gRNA sequence
cctttccaggatcagctcag

SEQ ID NO: 224442 - DNA, 20 bp, Artificial
  CRISPR gRNA sequence
ctttccaggatcagctcagc

SEQ ID NO: 224443 - DNA, 20 bp, Artificial
  CRISPR gRNA sequence
tccaggatcagctcagctac

SEQ ID NO: 224444 - DNA, 20 bp, Artificial
  CRISPR gRNA sequence
ccaggatcagctcagctact

SEQ ID NO: 224445 - DNA, 20 bp, Artificial
  CRISPR gRNA sequence
caggatcagctcagctacta

SEQ ID NO: 224446 - DNA, 20 bp, Artificial
  CRISPR gRNA sequence
agctactatttaataaaaca

SEQ ID NO: 224447 - DNA, 20 bp, Artificial
  CRISPR gRNA sequence
ctatttaataaaacaaaatc

SEQ ID NO: 224448 - DNA, 20 bp, Artificial
  CRISPR gRNA sequence
tttaataaaacaaaatctgt

SEQ ID NO: 224449 - DNA, 20 bp, Artificial
  CRISPR gRNA sequence
aataaaacaaaatctgtaga

SEQ ID NO: 224450 - DNA, 20 bp, Artificial
  CRISPR gRNA sequence
ataaaacaaaatctgtagaa

SEQ ID NO: 224451 - DNA, 20 bp, Artificial
  CRISPR gRNA sequence
tagaattcacgttttgtaat

SEQ ID NO: 224452 - DNA, 20 bp, Artificial
  CRISPR gRNA sequence
acgttttgtaatgacactgt

SEQ ID NO: 224453 - DNA, 20 bp, Artificial
  CRISPR gRNA sequence
tgtaatgacactgtcgtcat

SEQ ID NO: 224454 - DNA, 20 bp, Artificial
  CRISPR gRNA sequence
gtaatgacactgtcgtcatt

SEQ ID NO: 224455 - DNA, 20 bp, Artificial
  CRISPR gRNA sequence
taatgacactgtcgtcattc

SEQ ID NO: 224456 - DNA, 20 bp, Artificial
  CRISPR gRNA sequence
tcgtcattccatgctttgtt

SEQ ID NO: 224457 - DNA, 20 bp, Artificial
  CRISPR gRNA sequence
catgctttgttactaatatg

SEQ ID NO: 224458 - DNA, 20 bp, Artificial
  CRISPR gRNA sequence
tgttactaatatggaggcac

SEQ ID NO: 224459 - DNA, 20 bp, Artificial
  CRISPR gRNA sequence
gttactaatatggaggcaca

SEQ ID NO: 224460 - DNA, 20 bp, Artificial
  CRISPR gRNA sequence
ttactaatatggaggcacaa

SEQ ID NO: 224461 - DNA, 20 bp, Artificial
  CRISPR gRNA sequence
ctaatatggaggcacaaaac

SEQ ID NO: 224462 - DNA, 20 bp, Artificial
  CRISPR gRNA sequence
atatggaggcacaaaacact

SEQ ID NO: 224463 - DNA, 20 bp, Artificial
  CRISPR gRNA sequence
ctgaagtatacgtaaagtgg

SEQ ID NO: 224464 - DNA, 20 bp, Artificial
  CRISPR gRNA sequence
aagtatacgtaaagtggaaa

SEQ ID NO: 224465 - DNA, 20 bp, Artificial
  CRISPR gRNA sequence
aaaggaagagatatttacac

SEQ ID NO: 224466 - DNA, 20 bp, Artificial
  CRISPR gRNA sequence
aaggaagagatatttacacc

SEQ ID NO: 224467 - DNA, 20 bp, Artificial
  CRISPR gRNA sequence
acacctttgatggagctcta

SEQ ID NO: 224468 - DNA, 20 bp, Artificial
  CRISPR gRNA sequence
cacctttgatggagctctaa

SEQ ID NO: 224469 - DNA, 20 bp, Artificial
  CRISPR gRNA sequence
tgatggagctctaaacaagt

SEQ ID NO: 224470 - DNA, 20 bp, Artificial
  CRISPR gRNA sequence
gatggagctctaaacaagtc

SEQ ID NO: 224471 - DNA, 20 bp, Artificial
  CRISPR gRNA sequence
atggagctctaaacaagtcc

SEQ ID NO: 224472 - DNA, 20 bp, Artificial
  CRISPR gRNA sequence
taaacaagtccactgtcccc

SEQ ID NO: 224473 - DNA, 20 bp, Artificial
  CRISPR gRNA sequence
aacaagtccactgtccccac

SEQ ID NO: 224474 - DNA, 20 bp, Artificial
  CRISPR gRNA sequence
tccccactgactttagtagt

SEQ ID NO: 224475 - DNA, 20 bp, Artificial
  CRISPR gRNA sequence
actttagtagtgcaaaaatt

SEQ ID NO: 224476 - DNA, 20 bp, Artificial
  CRISPR gRNA sequence
tagtagtgcaaaaattgaag

SEQ ID NO: 224477 - DNA, 20 bp, Artificial
  CRISPR gRNA sequence
agtagtgcaaaaattgaagt

SEQ ID NO: 224478 - DNA, 20 bp, Artificial
  CRISPR gRNA sequence
gtagtgcaaaaattgaagtc

SEQ ID NO: 224479 - DNA, 20 bp, Artificial
  CRISPR gRNA sequence
aagtctcacaattactaaaa

SEQ ID NO: 224480 - DNA, 20 bp, Artificial
  CRISPR gRNA sequence
acaattactaaaaggagatg

SEQ ID NO: 224481 - DNA, 20 bp, Artificial
  CRISPR gRNA sequence
ctaaaaggagatgcctcttt

SEQ ID NO: 224482 - DNA, 20 bp, Artificial
  CRISPR gRNA sequence
aaaggagatgcctctttgaa

SEQ ID NO: 224483 - DNA, 20 bp, Artificial
  CRISPR gRNA sequence
tttgaagatggataagagtg

SEQ ID NO: 224484 - DNA, 20 bp, Artificial
  CRISPR gRNA sequence
tgaagatggataagagtgat

SEQ ID NO: 224485 - DNA, 20 bp, Artificial
  CRISPR gRNA sequence
gaagatggataagagtgatg

SEQ ID NO: 224486 - DNA, 20 bp, Artificial
  CRISPR gRNA sequence
aagatggataagagtgatgc

SEQ ID NO: 224487 - DNA, 20 bp, Artificial
  CRISPR gRNA sequence
tctcacacacaggaaactac

SEQ ID NO: 224488 - DNA, 20 bp, Artificial
  CRISPR gRNA sequence
acacacaggaaactacactt

SEQ ID NO: 224489 - DNA, 20 bp, Artificial
  CRISPR gRNA sequence
cacttgtgaagtaacagaat

SEQ ID NO: 224490 - DNA, 20 bp, Artificial
  CRISPR gRNA sequence
gtgaagtaacagaattaacc

SEQ ID NO: 224491 - DNA, 20 bp, Artificial
  CRISPR gRNA sequence
tgaagtaacagaattaacca

SEQ ID NO: 224492 - DNA, 20 bp, Artificial
  CRISPR gRNA sequence
accagagaaggtgaaacgat

SEQ ID NO: 224493 - DNA, 20 bp, Artificial
  CRISPR gRNA sequence
aaatatcgtgttggtaagac

SEQ ID NO: 224494 - DNA, 20 bp, Artificial
  CRISPR gRNA sequence
gtaagacttctatgaaagct

SEQ ID NO: 224495 - DNA, 20 bp, Artificial
  CRISPR gRNA sequence
ctatgaaagcttcttttttt

SEQ ID NO: 224496 - DNA, 20 bp, Artificial
  CRISPR gRNA sequence
tatgaaagcttcttttttta

SEQ ID NO: 224497 - DNA, 20 bp, Artificial
  CRISPR gRNA sequence
tgaaagcttctttttttatt

SEQ ID NO: 224498 - DNA, 20 bp, Artificial
  CRISPR gRNA sequence
ctttttttatttgtcctggt

SEQ ID NO: 224499 - DNA, 20 bp, Artificial
  CRISPR gRNA sequence
tttttttatttgtcctggtg

SEQ ID NO: 224500 - DNA, 20 bp, Artificial
  CRISPR gRNA sequence
tttttatttgtcctggtgca

SEQ ID NO: 224501 - DNA, 20 bp, Artificial
  CRISPR gRNA sequence
ttttatttgtcctggtgcaa

SEQ ID NO: 224502 - DNA, 20 bp, Artificial
  CRISPR gRNA sequence
tttatttgtcctggtgcaac

SEQ ID NO: 224503 - DNA, 20 bp, Artificial
  CRISPR gRNA sequence
ttatttgtcctggtgcaacc

SEQ ID NO: 224504 - DNA, 20 bp, Artificial
  CRISPR gRNA sequence
tatttgtcctggtgcaacct

SEQ ID NO: 224505 - DNA, 20 bp, Artificial
  CRISPR gRNA sequence
atttgtcctggtgcaacctg

SEQ ID NO: 224506 - DNA, 20 bp, Artificial
  CRISPR gRNA sequence
tttgtcctggtgcaacctga

SEQ ID NO: 224507 - DNA, 20 bp, Artificial
  CRISPR gRNA sequence
gtcctggtgcaacctgatcc

SEQ ID NO: 224508 - DNA, 20 bp, Artificial
  CRISPR gRNA sequence
tcctggtgcaacctgatcct

SEQ ID NO: 224509 - DNA, 20 bp, Artificial
  CRISPR gRNA sequence
gtgcaacctgatcctctttc

SEQ ID NO: 224510 - DNA, 20 bp, Artificial
  CRISPR gRNA sequence
atcctctttcgagaggaggc

SEQ ID NO: 224511 - DNA, 20 bp, Artificial
  CRISPR gRNA sequence
tttcgagaggaggccaaatg

SEQ ID NO: 224512 - DNA, 20 bp, Artificial
  CRISPR gRNA sequence
tcgagaggaggccaaatggg

SEQ ID NO: 224513 - DNA, 20 bp, Artificial
  CRISPR gRNA sequence
cgagaggaggccaaatgggg

SEQ ID NO: 224514 - DNA, 20 bp, Artificial
  CRISPR gRNA sequence
gagaggaggccaaatgggga

SEQ ID NO: 224515 - DNA, 20 bp, Artificial
  CRISPR gRNA sequence
ctttgaatcaaaaagcaggc

SEQ ID NO: 224516 - DNA, 20 bp, Artificial
  CRISPR gRNA sequence
tgaatcaaaaagcaggctgt

SEQ ID NO: 224517 - DNA, 20 bp, Artificial
  CRISPR gRNA sequence
gaatcaaaaagcaggctgtt

SEQ ID NO: 224518 - DNA, 20 bp, Artificial
  CRISPR gRNA sequence
aatcaaaaagcaggctgtta

SEQ ID NO: 224519 - DNA, 20 bp, Artificial
  CRISPR gRNA sequence
ttattaataaatgttgatgt

SEQ ID NO: 224520 - DNA, 20 bp, Artificial
  CRISPR gRNA sequence
ttaataaatgttgatgtaat

SEQ ID NO: 224521 - DNA, 20 bp, Artificial
  CRISPR gRNA sequence
ataaatgttgatgtaatgtt

SEQ ID NO: 224522 - DNA, 20 bp, Artificial
  CRISPR gRNA sequence
atgtaatgtttagcaagttt

SEQ ID NO: 224523 - DNA, 20 bp, Artificial
  CRISPR gRNA sequence
agcaagtttaagattgtgat

SEQ ID NO: 224524 - DNA, 20 bp, Artificial
  CRISPR gRNA sequence
gcaagtttaagattgtgatt

SEQ ID NO: 224525 - DNA, 20 bp, Artificial
  CRISPR gRNA sequence
aagattgtgatttctatcct

SEQ ID NO: 224526 - DNA, 20 bp, Artificial
  CRISPR gRNA sequence
agattgtgatttctatccta

SEQ ID NO: 224527 - DNA, 20 bp, Artificial
  CRISPR gRNA sequence
tgatttctatcctatttgtt

SEQ ID NO: 224528 - DNA, 20 bp, Artificial
  CRISPR gRNA sequence
ctatcctatttgttaatcta

SEQ ID NO: 224529 - DNA, 20 bp, Artificial
  CRISPR gRNA sequence
tatcctatttgttaatctac

SEQ ID NO: 224530 - DNA, 20 bp, Artificial
  CRISPR gRNA sequence
tcctatttgttaatctactc

SEQ ID NO: 224531 - DNA, 20 bp, Artificial
  CRISPR gRNA sequence
tttgttaatctactcttcat

SEQ ID NO: 224532 - DNA, 20 bp, Artificial
  CRISPR gRNA sequence
gttaatctactcttcatggt

SEQ ID NO: 224533 - DNA, 20 bp, Artificial
  CRISPR gRNA sequence
ttaatctactcttcatggta

SEQ ID NO: 224534 - DNA, 20 bp, Artificial
  CRISPR gRNA sequence
atctactcttcatggtaaaa

SEQ ID NO: 224535 - DNA, 20 bp, Artificial
  CRISPR gRNA sequence
ctcttcatggtaaaacacat

SEQ ID NO: 224536 - DNA, 20 bp, Artificial
  CRISPR gRNA sequence
ttcatggtaaaacacattta

SEQ ID NO: 224537 - DNA, 20 bp, Artificial
  CRISPR gRNA sequence
catggtaaaacacatttact

SEQ ID NO: 224538 - DNA, 20 bp, Artificial
  CRISPR gRNA sequence
atggtaaaacacatttacta

SEQ ID NO: 224539 - DNA, 20 bp, Artificial
  CRISPR gRNA sequence
actatttaatttgtattact

SEQ ID NO: 224540 - DNA, 20 bp, Artificial
  CRISPR gRNA sequence
ctatttaatttgtattactt

SEQ ID NO: 224541 - DNA, 20 bp, Artificial
  CRISPR gRNA sequence
tttaatttgtattacttgtt

SEQ ID NO: 224542 - DNA, 20 bp, Artificial
  CRISPR gRNA sequence
aatttgtattacttgttaat

SEQ ID NO: 224543 - DNA, 20 bp, Artificial
  CRISPR gRNA sequence
atttgtattacttgttaatt

SEQ ID NO: 224544 - DNA, 20 bp, Artificial
  CRISPR gRNA sequence
gtattacttgttaatttgta

SEQ ID NO: 224545 - DNA, 20 bp, Artificial
  CRISPR gRNA sequence
tattacttgttaatttgtat

SEQ ID NO: 224546 - DNA, 20 bp, Artificial
  CRISPR gRNA sequence
cttgttaatttgtatattgt

SEQ ID NO: 224547 - DNA, 20 bp, Artificial
  CRISPR gRNA sequence
gttaatttgtatattgtgtg

SEQ ID NO: 224548 - DNA, 20 bp, Artificial
  CRISPR gRNA sequence
ttaatttgtatattgtgtgg

SEQ ID NO: 224549 - DNA, 20 bp, Artificial
  CRISPR gRNA sequence
atttgtatattgtgtggttc

SEQ ID NO: 224550 - DNA, 20 bp, Artificial
  CRISPR gRNA sequence
gtatattgtgtggttctcaa

SEQ ID NO: 224551 - DNA, 20 bp, Artificial
  CRISPR gRNA sequence
tatattgtgtggttctcaaa

SEQ ID NO: 224552 - DNA, 20 bp, Artificial
  CRISPR gRNA sequence
tgtggttctcaaacttttgg

SEQ ID NO: 224553 - DNA, 20 bp, Artificial
  CRISPR gRNA sequence
tcaaacttttggtctaagga

SEQ ID NO: 224554 - DNA, 20 bp, Artificial
  CRISPR gRNA sequence
aaacttttggtctaaggacc

SEQ ID NO: 224555 - DNA, 20 bp, Artificial
  CRISPR gRNA sequence
ttggtctaaggaccatttta

SEQ ID NO: 224556 - DNA, 20 bp, Artificial
  CRISPR gRNA sequence
tggtctaaggaccattttat

SEQ ID NO: 224557 - DNA, 20 bp, Artificial
  CRISPR gRNA sequence
ggtctaaggaccattttatt

SEQ ID NO: 224558 - DNA, 20 bp, Artificial
  CRISPR gRNA sequence
gtctaaggaccattttattt

SEQ ID NO: 224559 - DNA, 20 bp, Artificial
  CRISPR gRNA sequence
aggaccattttatttggctg

SEQ ID NO: 224560 - DNA, 20 bp, Artificial
  CRISPR gRNA sequence
tatttggctgattggtcctg

SEQ ID NO: 224561 - DNA, 20 bp, Artificial
  CRISPR gRNA sequence
atttggctgattggtcctgg

SEQ ID NO: 224562 - DNA, 20 bp, Artificial
  CRISPR gRNA sequence
tttggctgattggtcctggg

SEQ ID NO: 224563 - DNA, 20 bp, Artificial
  CRISPR gRNA sequence
ggctgattggtcctggggta

SEQ ID NO: 224564 - DNA, 20 bp, Artificial
  CRISPR gRNA sequence
gctgattggtcctggggtaa

SEQ ID NO: 224565 - DNA, 20 bp, Artificial
  CRISPR gRNA sequence
attggtcctggggtaatgta

SEQ ID NO: 224566 - DNA, 20 bp, Artificial
  CRISPR gRNA sequence
gtcctggggtaatgtactct

SEQ ID NO: 224567 - DNA, 20 bp, Artificial
  CRISPR gRNA sequence
gggtaatgtactcttcattt

SEQ ID NO: 224568 - DNA, 20 bp, Artificial
  CRISPR gRNA sequence
ttcatttctgtttgctgcca

SEQ ID NO: 224569 - DNA, 20 bp, Artificial
  CRISPR gRNA sequence
catttctgtttgctgccatc

SEQ ID NO: 224570 - DNA, 20 bp, Artificial
  CRISPR gRNA sequence
atttctgtttgctgccatcc

SEQ ID NO: 224571 - DNA, 20 bp, Artificial
  CRISPR gRNA sequence
ctgtttgctgccatccaagt

SEQ ID NO: 224572 - DNA, 20 bp, Artificial
  CRISPR gRNA sequence
tgtttgctgccatccaagtg

SEQ ID NO: 224573 - DNA, 20 bp, Artificial
  CRISPR gRNA sequence
tttgctgccatccaagtgct

SEQ ID NO: 224574 - DNA, 20 bp, Artificial
  CRISPR gRNA sequence
gctgccatccaagtgctttc

SEQ ID NO: 224575 - DNA, 20 bp, Artificial
  CRISPR gRNA sequence
ctgccatccaagtgctttct

SEQ ID NO: 224576 - DNA, 20 bp, Artificial
  CRISPR gRNA sequence
ccatccaagtgctttctttc

SEQ ID NO: 224577 - DNA, 20 bp, Artificial
  CRISPR gRNA sequence
tctttcctgtgactaatttt

SEQ ID NO: 224578 - DNA, 20 bp, Artificial
  CRISPR gRNA sequence
ctttcctgtgactaattttc

SEQ ID NO: 224579 - DNA, 20 bp, Artificial
  CRISPR gRNA sequence
tttcctgtgactaattttca

SEQ ID NO: 224580 - DNA, 20 bp, Artificial
  CRISPR gRNA sequence
tcctgtgactaattttcaag

SEQ ID NO: 224581 - DNA, 20 bp, Artificial
  CRISPR gRNA sequence
cctgtgactaattttcaagt

SEQ ID NO: 224582 - DNA, 20 bp, Artificial
  CRISPR gRNA sequence
ctgtgactaattttcaagtc

SEQ ID NO: 224583 - DNA, 20 bp, Artificial
  CRISPR gRNA sequence
tgactaattttcaagtctct

SEQ ID NO: 224584 - DNA, 20 bp, Artificial
  CRISPR gRNA sequence
attttcaagtctctttccaa

SEQ ID NO: 224585 - DNA, 20 bp, Artificial
  CRISPR gRNA sequence
tcaagtctctttccaattat

SEQ ID NO: 224586 - DNA, 20 bp, Artificial
  CRISPR gRNA sequence
caagtctctttccaattatt

SEQ ID NO: 224587 - DNA, 20 bp, Artificial
  CRISPR gRNA sequence
aagtctctttccaattattc

SEQ ID NO: 224588 - DNA, 20 bp, Artificial
  CRISPR gRNA sequence
tttccaattattcagccttc

SEQ ID NO: 224589 - DNA, 20 bp, Artificial
  CRISPR gRNA sequence
tccaattattcagccttctg

SEQ ID NO: 224590 - DNA, 20 bp, Artificial
  CRISPR gRNA sequence
ccaattattcagccttctgt

SEQ ID NO: 224591 - DNA, 20 bp, Artificial
  CRISPR gRNA sequence
caattattcagccttctgtt

SEQ ID NO: 224592 - DNA, 20 bp, Artificial
  CRISPR gRNA sequence
ttcagccttctgttttttgt

SEQ ID NO: 224593 - DNA, 20 bp, Artificial
  CRISPR gRNA sequence
agccttctgttttttgtgtt

SEQ ID NO: 224594 - DNA, 20 bp, Artificial
  CRISPR gRNA sequence
ctgttttttgtgtttttttt

SEQ ID NO: 224595 - DNA, 20 bp, Artificial
  CRISPR gRNA sequence
tgttttttgtgttttttttt

SEQ ID NO: 224596 - DNA, 20 bp, Artificial
  CRISPR gRNA sequence
ttttttgtgttttttttttt

SEQ ID NO: 224597 - DNA, 20 bp, Artificial
  CRISPR gRNA sequence
tttgtgtttttttttttttt

SEQ ID NO: 224598 - DNA, 20 bp, Artificial
  CRISPR gRNA sequence
ttgtgttttttttttttttt

SEQ ID NO: 224599 - DNA, 20 bp, Artificial
  CRISPR gRNA sequence
tgtgtttttttttttttttt

SEQ ID NO: 224600 - DNA, 20 bp, Artificial
  CRISPR gRNA sequence
gtgttttttttttttttttt

SEQ ID NO: 224601 - DNA, 20 bp, Artificial
  CRISPR gRNA sequence
tgtttttttttttttttttt

SEQ ID NO: 224602 - DNA, 20 bp, Artificial
  CRISPR gRNA sequence
tttttttttttttttttttt

SEQ ID NO: 224603 - DNA, 20 bp, Artificial
  CRISPR gRNA sequence
tttttttttttttttttttt

SEQ ID NO: 224604 - DNA, 20 bp, Artificial
  CRISPR gRNA sequence
tttttttttttttttttttt

SEQ ID NO: 224605 - DNA, 20 bp, Artificial
  CRISPR gRNA sequence
tttttttttttttttttttt

SEQ ID NO: 224606 - DNA, 20 bp, Artificial
  CRISPR gRNA sequence
tttttttttttttttttttt

SEQ ID NO: 224607 - DNA, 20 bp, Artificial
  CRISPR gRNA sequence
tttttttttttttttttttt

SEQ ID NO: 224608 - DNA, 20 bp, Artificial
  CRISPR gRNA sequence
ttttttttttttttttttta

SEQ ID NO: 224609 - DNA, 20 bp, Artificial
  CRISPR gRNA sequence
ttttttttttttttttttaa

SEQ ID NO: 224610 - DNA, 20 bp, Artificial
  CRISPR gRNA sequence
tttttttttttttttttaac

SEQ ID NO: 224611 - DNA, 20 bp, Artificial
  CRISPR gRNA sequence
ttttttttttttttttaacc

SEQ ID NO: 224612 - DNA, 20 bp, Artificial
  CRISPR gRNA sequence
tttttttttttttttaacct

SEQ ID NO: 224613 - DNA, 20 bp, Artificial
  CRISPR gRNA sequence
ttttttttttttttaacctt

SEQ ID NO: 224614 - DNA, 20 bp, Artificial
  CRISPR gRNA sequence
tttttttttttttaacctta

SEQ ID NO: 224615 - DNA, 20 bp, Artificial
  CRISPR gRNA sequence
ttttttttttttaaccttac

SEQ ID NO: 224616 - DNA, 20 bp, Artificial
  CRISPR gRNA sequence
tttttttttttaaccttaca

SEQ ID NO: 224617 - DNA, 20 bp, Artificial
  CRISPR gRNA sequence
ttttttttttaaccttacac

SEQ ID NO: 224618 - DNA, 20 bp, Artificial
  CRISPR gRNA sequence
tttttttttaaccttacact

SEQ ID NO: 224619 - DNA, 20 bp, Artificial
  CRISPR gRNA sequence
ttttttttaaccttacactt

SEQ ID NO: 224620 - DNA, 20 bp, Artificial
  CRISPR gRNA sequence
tttttttaaccttacacttt

SEQ ID NO: 224621 - DNA, 20 bp, Artificial
  CRISPR gRNA sequence
ttttttaaccttacactttg

SEQ ID NO: 224622 - DNA, 20 bp, Artificial
  CRISPR gRNA sequence
tttttaaccttacactttga

SEQ ID NO: 224623 - DNA, 20 bp, Artificial
  CRISPR gRNA sequence
ttttaaccttacactttgac

SEQ ID NO: 224624 - DNA, 20 bp, Artificial
  CRISPR gRNA sequence
tttaaccttacactttgacc

SEQ ID NO: 224625 - DNA, 20 bp, Artificial
  CRISPR gRNA sequence
ttaaccttacactttgacca

SEQ ID NO: 224626 - DNA, 20 bp, Artificial
  CRISPR gRNA sequence
taaccttacactttgaccaa

SEQ ID NO: 224627 - DNA, 20 bp, Artificial
  CRISPR gRNA sequence
aaccttacactttgaccaag

SEQ ID NO: 224628 - DNA, 20 bp, Artificial
  CRISPR gRNA sequence
accttacactttgaccaagg

SEQ ID NO: 224629 - DNA, 20 bp, Artificial
  CRISPR gRNA sequence
acactttgaccaagggatga

SEQ ID NO: 224630 - DNA, 20 bp, Artificial
  CRISPR gRNA sequence
cactttgaccaagggatgac

SEQ ID NO: 224631 - DNA, 20 bp, Artificial
  CRISPR gRNA sequence
tgaccaagggatgacaagtc

SEQ ID NO: 224632 - DNA, 20 bp, Artificial
  CRISPR gRNA sequence
gaccaagggatgacaagtcc

SEQ ID NO: 224633 - DNA, 20 bp, Artificial
  CRISPR gRNA sequence
accaagggatgacaagtccc

SEQ ID NO: 224634 - DNA, 20 bp, Artificial
  CRISPR gRNA sequence
cctctggagagaatagagga

SEQ ID NO: 224635 - DNA, 20 bp, Artificial
  CRISPR gRNA sequence
tggagagaatagaggagagt

SEQ ID NO: 224636 - DNA, 20 bp, Artificial
  CRISPR gRNA sequence
gagagaatagaggagagtca

SEQ ID NO: 224637 - DNA, 20 bp, Artificial
  CRISPR gRNA sequence
aatcacgttatcatggatga

SEQ ID NO: 224638 - DNA, 20 bp, Artificial
  CRISPR gRNA sequence
tcatggatgatttcttcaga

SEQ ID NO: 224639 - DNA, 20 bp, Artificial
  CRISPR gRNA sequence
cttcagattttctgtgctta

SEQ ID NO: 224640 - DNA, 20 bp, Artificial
  CRISPR gRNA sequence
ttcagattttctgtgcttag

SEQ ID NO: 224641 - DNA, 20 bp, Artificial
  CRISPR gRNA sequence
cagattttctgtgcttagcc

SEQ ID NO: 224642 - DNA, 20 bp, Artificial
  CRISPR gRNA sequence
agattttctgtgcttagcct

SEQ ID NO: 224643 - DNA, 20 bp, Artificial
  CRISPR gRNA sequence
tctgtgcttagccttacttt

SEQ ID NO: 224644 - DNA, 20 bp, Artificial
  CRISPR gRNA sequence
ctgtgcttagccttactttg

SEQ ID NO: 224645 - DNA, 20 bp, Artificial
  CRISPR gRNA sequence
tgtgcttagccttactttgg

SEQ ID NO: 224646 - DNA, 20 bp, Artificial
  CRISPR gRNA sequence
tgcttagccttactttggtc

SEQ ID NO: 224647 - DNA, 20 bp, Artificial
  CRISPR gRNA sequence
agccttactttggtcttctt

SEQ ID NO: 224648 - DNA, 20 bp, Artificial
  CRISPR gRNA sequence
gccttactttggtcttcttt

SEQ ID NO: 224649 - DNA, 20 bp, Artificial
  CRISPR gRNA sequence
actttggtcttctttttgtt

SEQ ID NO: 224650 - DNA, 20 bp, Artificial
  CRISPR gRNA sequence
ctttggtcttctttttgttg

SEQ ID NO: 224651 - DNA, 20 bp, Artificial
  CRISPR gRNA sequence
tggtcttctttttgttggcc

SEQ ID NO: 224652 - DNA, 20 bp, Artificial
  CRISPR gRNA sequence
ggtcttctttttgttggcca

SEQ ID NO: 224653 - DNA, 20 bp, Artificial
  CRISPR gRNA sequence
gtcttctttttgttggccaa

SEQ ID NO: 224654 - DNA, 20 bp, Artificial
  CRISPR gRNA sequence
ctttttgttggccaaaatat

SEQ ID NO: 224655 - DNA, 20 bp, Artificial
  CRISPR gRNA sequence
tttttgttggccaaaatatg

SEQ ID NO: 224656 - DNA, 20 bp, Artificial
  CRISPR gRNA sequence
tttgttggccaaaatatgag

SEQ ID NO: 224657 - DNA, 20 bp, Artificial
  CRISPR gRNA sequence
ttgttggccaaaatatgaga

SEQ ID NO: 224658 - DNA, 20 bp, Artificial
  CRISPR gRNA sequence
tgttggccaaaatatgagag

SEQ ID NO: 224659 - DNA, 20 bp, Artificial
  CRISPR gRNA sequence
gttggccaaaatatgagaga

SEQ ID NO: 224660 - DNA, 20 bp, Artificial
  CRISPR gRNA sequence
ttggccaaaatatgagagaa

SEQ ID NO: 224661 - DNA, 20 bp, Artificial
  CRISPR gRNA sequence
gccaaaatatgagagaacta

SEQ ID NO: 224662 - DNA, 20 bp, Artificial
  CRISPR gRNA sequence
gagattcaaattcatttatt

SEQ ID NO: 224663 - DNA, 20 bp, Artificial
  CRISPR gRNA sequence
aaattcatttattcaaattc

SEQ ID NO: 224664 - DNA, 20 bp, Artificial
  CRISPR gRNA sequence
atttattcaaattcagactt

SEQ ID NO: 224665 - DNA, 20 bp, Artificial
  CRISPR gRNA sequence
attcaaattcagacttgatg

SEQ ID NO: 224666 - DNA, 20 bp, Artificial
  CRISPR gRNA sequence
ttcaaattcagacttgatga

SEQ ID NO: 224667 - DNA, 20 bp, Artificial
  CRISPR gRNA sequence
aaattcagacttgatgatag

SEQ ID NO: 224668 - DNA, 20 bp, Artificial
  CRISPR gRNA sequence
agacttgatgatagcaccat

SEQ ID NO: 224669 - DNA, 20 bp, Artificial
  CRISPR gRNA sequence
gatgatagcaccatgattct

SEQ ID NO: 224670 - DNA, 20 bp, Artificial
  CRISPR gRNA sequence
atgatagcaccatgattctg

SEQ ID NO: 224671 - DNA, 20 bp, Artificial
  CRISPR gRNA sequence
tgccctttttatcacaaact

SEQ ID NO: 224672 - DNA, 20 bp, Artificial
  CRISPR gRNA sequence
ccctttttatcacaaacttg

SEQ ID NO: 224673 - DNA, 20 bp, Artificial
  CRISPR gRNA sequence
tttatcacaaacttgggttg

SEQ ID NO: 224674 - DNA, 20 bp, Artificial
  CRISPR gRNA sequence
ttatcacaaacttgggttgc

SEQ ID NO: 224675 - DNA, 20 bp, Artificial
  CRISPR gRNA sequence
tatcacaaacttgggttgct

SEQ ID NO: 224676 - DNA, 20 bp, Artificial
  CRISPR gRNA sequence
atcacaaacttgggttgctg

SEQ ID NO: 224677 - DNA, 20 bp, Artificial
  CRISPR gRNA sequence
tcacaaacttgggttgctga

SEQ ID NO: 224678 - DNA, 20 bp, Artificial
  CRISPR gRNA sequence
gggttgctgaggtgtagaag

SEQ ID NO: 224679 - DNA, 20 bp, Artificial
  CRISPR gRNA sequence
ggttgctgaggtgtagaagg

SEQ ID NO: 224680 - DNA, 20 bp, Artificial
  CRISPR gRNA sequence
ctgaggtgtagaaggtagta

SEQ ID NO: 224681 - DNA, 20 bp, Artificial
  CRISPR gRNA sequence
aggtgtagaaggtagtaaaa

SEQ ID NO: 224682 - DNA, 20 bp, Artificial
  CRISPR gRNA sequence
gctgaagtaaatagtctcct

SEQ ID NO: 224683 - DNA, 20 bp, Artificial
  CRISPR gRNA sequence
aagtaaatagtctcctctcc

SEQ ID NO: 224684 - DNA, 20 bp, Artificial
  CRISPR gRNA sequence
ctctccttgctgtttcctgc

SEQ ID NO: 224685 - DNA, 20 bp, Artificial
  CRISPR gRNA sequence
tccttgctgtttcctgctgt

SEQ ID NO: 224686 - DNA, 20 bp, Artificial
  CRISPR gRNA sequence
cttgctgtttcctgctgtgc

SEQ ID NO: 224687 - DNA, 20 bp, Artificial
  CRISPR gRNA sequence
gctgtttcctgctgtgctag

SEQ ID NO: 224688 - DNA, 20 bp, Artificial
  CRISPR gRNA sequence
ctgtttcctgctgtgctagc

SEQ ID NO: 224689 - DNA, 20 bp, Artificial
  CRISPR gRNA sequence
tttcctgctgtgctagctga

SEQ ID NO: 224690 - DNA, 20 bp, Artificial
  CRISPR gRNA sequence
cctgctgtgctagctgagtt

SEQ ID NO: 224691 - DNA, 20 bp, Artificial
  CRISPR gRNA sequence
ctgctgtgctagctgagttc

SEQ ID NO: 224692 - DNA, 20 bp, Artificial
  CRISPR gRNA sequence
ctgtgctagctgagttcttc

SEQ ID NO: 224693 - DNA, 20 bp, Artificial
  CRISPR gRNA sequence
tgctagctgagttcttcaac

SEQ ID NO: 224694 - DNA, 20 bp, Artificial
  CRISPR gRNA sequence
gctgagttcttcaaccccat

SEQ ID NO: 224695 - DNA, 20 bp, Artificial
  CRISPR gRNA sequence
agttcttcaaccccatatga

SEQ ID NO: 224696 - DNA, 20 bp, Artificial
  CRISPR gRNA sequence
ttcaaccccatatgagtatg

SEQ ID NO: 224697 - DNA, 20 bp, Artificial
  CRISPR gRNA sequence
caaccccatatgagtatgtt

SEQ ID NO: 224698 - DNA, 20 bp, Artificial
  CRISPR gRNA sequence
aaccccatatgagtatgttc

SEQ ID NO: 224699 - DNA, 20 bp, Artificial
  CRISPR gRNA sequence
tttctgttttgaaatctcta

SEQ ID NO: 224700 - DNA, 20 bp, Artificial
  CRISPR gRNA sequence
tctgttttgaaatctctatt

SEQ ID NO: 224701 - DNA, 20 bp, Artificial
  CRISPR gRNA sequence
ctgttttgaaatctctattt

SEQ ID NO: 224702 - DNA, 20 bp, Artificial
  CRISPR gRNA sequence
tgttttgaaatctctattta

SEQ ID NO: 224703 - DNA, 20 bp, Artificial
  CRISPR gRNA sequence
ttttgaaatctctatttaga

SEQ ID NO: 224704 - DNA, 20 bp, Artificial
  CRISPR gRNA sequence
tgaaatctctatttagaatt

SEQ ID NO: 224705 - DNA, 20 bp, Artificial
  CRISPR gRNA sequence
gaaatctctatttagaatta

SEQ ID NO: 224706 - DNA, 20 bp, Artificial
  CRISPR gRNA sequence
aaatctctatttagaattac

SEQ ID NO: 224707 - DNA, 20 bp, Artificial
  CRISPR gRNA sequence
tatttagaattacctgtcat

SEQ ID NO: 224708 - DNA, 20 bp, Artificial
  CRISPR gRNA sequence
tttagaattacctgtcatat

SEQ ID NO: 224709 - DNA, 20 bp, Artificial
  CRISPR gRNA sequence
agaattacctgtcatattac

SEQ ID NO: 224710 - DNA, 20 bp, Artificial
  CRISPR gRNA sequence
gaattacctgtcatattacc

SEQ ID NO: 224711 - DNA, 20 bp, Artificial
  CRISPR gRNA sequence
cctgtcatattaccgatcat

SEQ ID NO: 224712 - DNA, 20 bp, Artificial
  CRISPR gRNA sequence
tcatattaccgatcatggct

SEQ ID NO: 224713 - DNA, 20 bp, Artificial
  CRISPR gRNA sequence
ccgatcatggcttaaccaca

SEQ ID NO: 224714 - DNA, 20 bp, Artificial
  CRISPR gRNA sequence
aaccacattttgagaacctt

SEQ ID NO: 224715 - DNA, 20 bp, Artificial
  CRISPR gRNA sequence
accacattttgagaacctta

SEQ ID NO: 224716 - DNA, 20 bp, Artificial
  CRISPR gRNA sequence
tgagaaccttaactctagat

SEQ ID NO: 224717 - DNA, 20 bp, Artificial
  CRISPR gRNA sequence
gagaaccttaactctagata

SEQ ID NO: 224718 - DNA, 20 bp, Artificial
  CRISPR gRNA sequence
agaaccttaactctagatag

SEQ ID NO: 224719 - DNA, 20 bp, Artificial
  CRISPR gRNA sequence
aactctagataggttcagtt

SEQ ID NO: 224720 - DNA, 20 bp, Artificial
  CRISPR gRNA sequence
actctagataggttcagttc

SEQ ID NO: 224721 - DNA, 20 bp, Artificial
  CRISPR gRNA sequence
tagataggttcagttctgtt

SEQ ID NO: 224722 - DNA, 20 bp, Artificial
  CRISPR gRNA sequence
gataggttcagttctgttca

SEQ ID NO: 224723 - DNA, 20 bp, Artificial
  CRISPR gRNA sequence
agttctgttcagttggatca

SEQ ID NO: 224724 - DNA, 20 bp, Artificial
  CRISPR gRNA sequence
tgttcagttggatcaactat

SEQ ID NO: 224725 - DNA, 20 bp, Artificial
  CRISPR gRNA sequence
ttcagttggatcaactattt

SEQ ID NO: 224726 - DNA, 20 bp, Artificial
  CRISPR gRNA sequence
agttggatcaactatttgcc

SEQ ID NO: 224727 - DNA, 20 bp, Artificial
  CRISPR gRNA sequence
gatcaactatttgcctagct

SEQ ID NO: 224728 - DNA, 20 bp, Artificial
  CRISPR gRNA sequence
tttgcctagcttttataaaa

SEQ ID NO: 224729 - DNA, 20 bp, Artificial
  CRISPR gRNA sequence
gcctagcttttataaaataa

SEQ ID NO: 224730 - DNA, 20 bp, Artificial
  CRISPR gRNA sequence
cctagcttttataaaataat

SEQ ID NO: 224731 - DNA, 20 bp, Artificial
  CRISPR gRNA sequence
gcttttataaaataatctac

SEQ ID NO: 224732 - DNA, 20 bp, Artificial
  CRISPR gRNA sequence
ttataaaataatctactacc

SEQ ID NO: 224733 - DNA, 20 bp, Artificial
  CRISPR gRNA sequence
tataaaataatctactacca

SEQ ID NO: 224734 - DNA, 20 bp, Artificial
  CRISPR gRNA sequence
ataaaataatctactaccag

SEQ ID NO: 224735 - DNA, 20 bp, Artificial
  CRISPR gRNA sequence
taaaataatctactaccaga

SEQ ID NO: 224736 - DNA, 20 bp, Artificial
  CRISPR gRNA sequence
ctaccagattaggaatgggg

SEQ ID NO: 224737 - DNA, 20 bp, Artificial
  CRISPR gRNA sequence
ccagattaggaatggggtgt

SEQ ID NO: 224738 - DNA, 20 bp, Artificial
  CRISPR gRNA sequence
ggaatggggtgtttggtttg

SEQ ID NO: 224739 - DNA, 20 bp, Artificial
  CRISPR gRNA sequence
ggtttgatgaaatgtttgca

SEQ ID NO: 224740 - DNA, 20 bp, Artificial
  CRISPR gRNA sequence
gtttgatgaaatgtttgcac

SEQ ID NO: 224741 - DNA, 20 bp, Artificial
  CRISPR gRNA sequence
gatgaaatgtttgcacatta

SEQ ID NO: 224742 - DNA, 20 bp, Artificial
  CRISPR gRNA sequence
atgaaatgtttgcacattac

SEQ ID NO: 224743 - DNA, 20 bp, Artificial
  CRISPR gRNA sequence
gcacattacttaggattgag

SEQ ID NO: 224744 - DNA, 20 bp, Artificial
  CRISPR gRNA sequence
cacattacttaggattgaga

SEQ ID NO: 224745 - DNA, 20 bp, Artificial
  CRISPR gRNA sequence
cttaggattgagaatcagga

SEQ ID NO: 224746 - DNA, 20 bp, Artificial
  CRISPR gRNA sequence
aggattgagaatcaggaggt

SEQ ID NO: 224747 - DNA, 20 bp, Artificial
  CRISPR gRNA sequence
ggattgagaatcaggaggtc

SEQ ID NO: 224748 - DNA, 20 bp, Artificial
  CRISPR gRNA sequence
agaatcaggaggtctgagtt

SEQ ID NO: 224749 - DNA, 20 bp, Artificial
  CRISPR gRNA sequence
agttacagcccctgttcagc

SEQ ID NO: 224750 - DNA, 20 bp, Artificial
  CRISPR gRNA sequence
cagcccctgttcagcaactt

SEQ ID NO: 224751 - DNA, 20 bp, Artificial
  CRISPR gRNA sequence
ttcagcaacttactattcac

SEQ ID NO: 224752 - DNA, 20 bp, Artificial
  CRISPR gRNA sequence
agcaacttactattcacctg

SEQ ID NO: 224753 - DNA, 20 bp, Artificial
  CRISPR gRNA sequence
actattcacctgtgtgatct

SEQ ID NO: 224754 - DNA, 20 bp, Artificial
  CRISPR gRNA sequence
ctattcacctgtgtgatctt

SEQ ID NO: 224755 - DNA, 20 bp, Artificial
  CRISPR gRNA sequence
ttcacctgtgtgatcttgag

SEQ ID NO: 224756 - DNA, 20 bp, Artificial
  CRISPR gRNA sequence
acctgtgtgatcttgagaag

SEQ ID NO: 224757 - DNA, 20 bp, Artificial
  CRISPR gRNA sequence
tgtgatcttgagaaggtgct

SEQ ID NO: 224758 - DNA, 20 bp, Artificial
  CRISPR gRNA sequence
gagaaggtgcttaaccgagt

SEQ ID NO: 224759 - DNA, 20 bp, Artificial
  CRISPR gRNA sequence
agaaggtgcttaaccgagtc

SEQ ID NO: 224760 - DNA, 20 bp, Artificial
  CRISPR gRNA sequence
aaccgagtccaagttacctc

SEQ ID NO: 224761 - DNA, 20 bp, Artificial
  CRISPR gRNA sequence
accgagtccaagttacctca

SEQ ID NO: 224762 - DNA, 20 bp, Artificial
  CRISPR gRNA sequence
cctcatgtccgaaatggaga

SEQ ID NO: 224763 - DNA, 20 bp, Artificial
  CRISPR gRNA sequence
atgtccgaaatggagatgac

SEQ ID NO: 224764 - DNA, 20 bp, Artificial
  CRISPR gRNA sequence
gcttttatgtattctacagt

SEQ ID NO: 224765 - DNA, 20 bp, Artificial
  CRISPR gRNA sequence
cttttatgtattctacagtc

SEQ ID NO: 224766 - DNA, 20 bp, Artificial
  CRISPR gRNA sequence
ttatgtattctacagtctaa

SEQ ID NO: 224767 - DNA, 20 bp, Artificial
  CRISPR gRNA sequence
tatgtattctacagtctaat

SEQ ID NO: 224768 - DNA, 20 bp, Artificial
  CRISPR gRNA sequence
atgtattctacagtctaatg

SEQ ID NO: 224769 - DNA, 20 bp, Artificial
  CRISPR gRNA sequence
tgtattctacagtctaatga

SEQ ID NO: 224770 - DNA, 20 bp, Artificial
  CRISPR gRNA sequence
tacagtctaatgagcataaa

SEQ ID NO: 224771 - DNA, 20 bp, Artificial
  CRISPR gRNA sequence
cagtctaatgagcataaacc

SEQ ID NO: 224772 - DNA, 20 bp, Artificial
  CRISPR gRNA sequence
atgagcataaaccaaagtgt

SEQ ID NO: 224773 - DNA, 20 bp, Artificial
  CRISPR gRNA sequence
taaatgttagttgttttcct

SEQ ID NO: 224774 - DNA, 20 bp, Artificial
  CRISPR gRNA sequence
gttgttttcctgggatgttt

SEQ ID NO: 224775 - DNA, 20 bp, Artificial
  CRISPR gRNA sequence
ttttcctgggatgtttattt

SEQ ID NO: 224776 - DNA, 20 bp, Artificial
  CRISPR gRNA sequence
tcctgggatgtttattttat

SEQ ID NO: 224777 - DNA, 20 bp, Artificial
  CRISPR gRNA sequence
cctgggatgtttattttatg

SEQ ID NO: 224778 - DNA, 20 bp, Artificial
  CRISPR gRNA sequence
ctgggatgtttattttatga

SEQ ID NO: 224779 - DNA, 20 bp, Artificial
  CRISPR gRNA sequence
ggatgtttattttatgaagt

SEQ ID NO: 224780 - DNA, 20 bp, Artificial
  CRISPR gRNA sequence
attttatgaagtaaggtatc

SEQ ID NO: 224781 - DNA, 20 bp, Artificial
  CRISPR gRNA sequence
ttttatgaagtaaggtatca

SEQ ID NO: 224782 - DNA, 20 bp, Artificial
  CRISPR gRNA sequence
tatgaagtaaggtatcaagt

SEQ ID NO: 224783 - DNA, 20 bp, Artificial
  CRISPR gRNA sequence
atgaagtaaggtatcaagtt

SEQ ID NO: 224784 - DNA, 20 bp, Artificial
  CRISPR gRNA sequence
tgaagtaaggtatcaagttg

SEQ ID NO: 224785 - DNA, 20 bp, Artificial
  CRISPR gRNA sequence
ttgaagttagcctagagcat

SEQ ID NO: 224786 - DNA, 20 bp, Artificial
  CRISPR gRNA sequence
aagttagcctagagcattgt

SEQ ID NO: 224787 - DNA, 20 bp, Artificial
  CRISPR gRNA sequence
gcctagagcattgtgagagg

SEQ ID NO: 224788 - DNA, 20 bp, Artificial
  CRISPR gRNA sequence
gagcattgtgagagggattt

SEQ ID NO: 224789 - DNA, 20 bp, Artificial
  CRISPR gRNA sequence
tgagagggatttgtgtgcag

SEQ ID NO: 224790 - DNA, 20 bp, Artificial
  CRISPR gRNA sequence
gtgtgcagtgaggaatgggc

SEQ ID NO: 224791 - DNA, 20 bp, Artificial
  CRISPR gRNA sequence
tgtgcagtgaggaatgggca

SEQ ID NO: 224792 - DNA, 20 bp, Artificial
  CRISPR gRNA sequence
cgagtaggcaaggagaattt

SEQ ID NO: 224793 - DNA, 20 bp, Artificial
  CRISPR gRNA sequence
gaaaggtctttctgctcaga

SEQ ID NO: 224794 - DNA, 20 bp, Artificial
  CRISPR gRNA sequence
aaaggtctttctgctcagaa

SEQ ID NO: 224795 - DNA, 20 bp, Artificial
  CRISPR gRNA sequence
tctgctcagaaatctctctt

SEQ ID NO: 224796 - DNA, 20 bp, Artificial
  CRISPR gRNA sequence
ctgctcagaaatctctctta

SEQ ID NO: 224797 - DNA, 20 bp, Artificial
  CRISPR gRNA sequence
tgctcagaaatctctcttac

SEQ ID NO: 224798 - DNA, 20 bp, Artificial
  CRISPR gRNA sequence
ctcagaaatctctcttacat

SEQ ID NO: 224799 - DNA, 20 bp, Artificial
  CRISPR gRNA sequence
agaaatctctcttacattgt

SEQ ID NO: 224800 - DNA, 20 bp, Artificial
  CRISPR gRNA sequence
tcttacattgtagcttttac

SEQ ID NO: 224801 - DNA, 20 bp, Artificial
  CRISPR gRNA sequence
ttacattgtagcttttacta

SEQ ID NO: 224802 - DNA, 20 bp, Artificial
  CRISPR gRNA sequence
acattgtagcttttactatt

SEQ ID NO: 224803 - DNA, 20 bp, Artificial
  CRISPR gRNA sequence
cattgtagcttttactattg

SEQ ID NO: 224804 - DNA, 20 bp, Artificial
  CRISPR gRNA sequence
tagcttttactattgatatt

SEQ ID NO: 224805 - DNA, 20 bp, Artificial
  CRISPR gRNA sequence
ttactattgatattaatttg

SEQ ID NO: 224806 - DNA, 20 bp, Artificial
  CRISPR gRNA sequence
tactattgatattaatttgg

SEQ ID NO: 224807 - DNA, 20 bp, Artificial
  CRISPR gRNA sequence
actattgatattaatttggg

SEQ ID NO: 224808 - DNA, 20 bp, Artificial
  CRISPR gRNA sequence
ctattgatattaatttgggc

SEQ ID NO: 224809 - DNA, 20 bp, Artificial
  CRISPR gRNA sequence
ttgatattaatttgggcaaa

SEQ ID NO: 224810 - DNA, 20 bp, Artificial
  CRISPR gRNA sequence
atattaatttgggcaaagga

SEQ ID NO: 224811 - DNA, 20 bp, Artificial
  CRISPR gRNA sequence
atttgggcaaaggagctttt

SEQ ID NO: 224812 - DNA, 20 bp, Artificial
  CRISPR gRNA sequence
gggcaaaggagctttttttg

SEQ ID NO: 224813 - DNA, 20 bp, Artificial
  CRISPR gRNA sequence
ggcaaaggagctttttttgt

SEQ ID NO: 224814 - DNA, 20 bp, Artificial
  CRISPR gRNA sequence
tttttgttgttgttaagtat

SEQ ID NO: 224815 - DNA, 20 bp, Artificial
  CRISPR gRNA sequence
ttttgttgttgttaagtata

SEQ ID NO: 224816 - DNA, 20 bp, Artificial
  CRISPR gRNA sequence
tttgttgttgttaagtatac

SEQ ID NO: 224817 - DNA, 20 bp, Artificial
  CRISPR gRNA sequence
ttgttgttgttaagtatacc

SEQ ID NO: 224818 - DNA, 20 bp, Artificial
  CRISPR gRNA sequence
tgttgttgttaagtatacct

SEQ ID NO: 224819 - DNA, 20 bp, Artificial
  CRISPR gRNA sequence
gttgttgttaagtatacctt

SEQ ID NO: 224820 - DNA, 20 bp, Artificial
  CRISPR gRNA sequence
ttgttgttaagtataccttt

SEQ ID NO: 224821 - DNA, 20 bp, Artificial
  CRISPR gRNA sequence
ttgttaagtatacctttaat

SEQ ID NO: 224822 - DNA, 20 bp, Artificial
  CRISPR gRNA sequence
ttaagtatacctttaatgaa

SEQ ID NO: 224823 - DNA, 20 bp, Artificial
  CRISPR gRNA sequence
agtatacctttaatgaaggg

SEQ ID NO: 224824 - DNA, 20 bp, Artificial
  CRISPR gRNA sequence
taatgaagggtgtaatcagt

SEQ ID NO: 224825 - DNA, 20 bp, Artificial
  CRISPR gRNA sequence
aatgaagggtgtaatcagtc

SEQ ID NO: 224826 - DNA, 20 bp, Artificial
  CRISPR gRNA sequence
atgaagggtgtaatcagtca

SEQ ID NO: 224827 - DNA, 20 bp, Artificial
  CRISPR gRNA sequence
caactaactggtattagatc

SEQ ID NO: 224828 - DNA, 20 bp, Artificial
  CRISPR gRNA sequence
actggtattagatcatctaa

SEQ ID NO: 224829 - DNA, 20 bp, Artificial
  CRISPR gRNA sequence
gtattagatcatctaatacc

SEQ ID NO: 224830 - DNA, 20 bp, Artificial
  CRISPR gRNA sequence
gatcatctaatacctagttg

SEQ ID NO: 224831 - DNA, 20 bp, Artificial
  CRISPR gRNA sequence
atacctagttgaaatttttc

SEQ ID NO: 224832 - DNA, 20 bp, Artificial
  CRISPR gRNA sequence
gttgaaatttttctgaggta

SEQ ID NO: 224833 - DNA, 20 bp, Artificial
  CRISPR gRNA sequence
aaatttttctgaggtaatgt

SEQ ID NO: 224834 - DNA, 20 bp, Artificial
  CRISPR gRNA sequence
ttctgaggtaatgtacaatt

SEQ ID NO: 224835 - DNA, 20 bp, Artificial
  CRISPR gRNA sequence
tctgaggtaatgtacaattt

SEQ ID NO: 224836 - DNA, 20 bp, Artificial
  CRISPR gRNA sequence
ctgaggtaatgtacaatttt

SEQ ID NO: 224837 - DNA, 20 bp, Artificial
  CRISPR gRNA sequence
tgaggtaatgtacaattttg

SEQ ID NO: 224838 - DNA, 20 bp, Artificial
  CRISPR gRNA sequence
aggtaatgtacaattttgtg

SEQ ID NO: 224839 - DNA, 20 bp, Artificial
  CRISPR gRNA sequence
tgtggaaatgaaagaataag

SEQ ID NO: 224840 - DNA, 20 bp, Artificial
  CRISPR gRNA sequence
gtggaaatgaaagaataaga

SEQ ID NO: 224841 - DNA, 20 bp, Artificial
  CRISPR gRNA sequence
tggaaatgaaagaataagat

SEQ ID NO: 224842 - DNA, 20 bp, Artificial
  CRISPR gRNA sequence
ttggggggtaatgcaggtca

SEQ ID NO: 224843 - DNA, 20 bp, Artificial
  CRISPR gRNA sequence
tggggggtaatgcaggtcac

SEQ ID NO: 224844 - DNA, 20 bp, Artificial
  CRISPR gRNA sequence
ggggggtaatgcaggtcact

SEQ ID NO: 224845 - DNA, 20 bp, Artificial
  CRISPR gRNA sequence
gggggtaatgcaggtcactg

SEQ ID NO: 224846 - DNA, 20 bp, Artificial
  CRISPR gRNA sequence
agaggtaaactggaaaactc

SEQ ID NO: 224847 - DNA, 20 bp, Artificial
  CRISPR gRNA sequence
gaaaactcaaaatatgagat

SEQ ID NO: 224848 - DNA, 20 bp, Artificial
  CRISPR gRNA sequence
aaaatatgagatttgaaagg

SEQ ID NO: 224849 - DNA, 20 bp, Artificial
  CRISPR gRNA sequence
gaaaggccagaagatgaaat

SEQ ID NO: 224850 - DNA, 20 bp, Artificial
  CRISPR gRNA sequence
aaaggccagaagatgaaatg

SEQ ID NO: 224851 - DNA, 20 bp, Artificial
  CRISPR gRNA sequence
agataaaaacagtttattat

SEQ ID NO: 224852 - DNA, 20 bp, Artificial
  CRISPR gRNA sequence
attattttgcgtgtgattga

SEQ ID NO: 224853 - DNA, 20 bp, Artificial
  CRISPR gRNA sequence
ttattttgcgtgtgattgaa

SEQ ID NO: 224854 - DNA, 20 bp, Artificial
  CRISPR gRNA sequence
ttttgcgtgtgattgaaaga

SEQ ID NO: 224855 - DNA, 20 bp, Artificial
  CRISPR gRNA sequence
tgcgtgtgattgaaagactg

SEQ ID NO: 224856 - DNA, 20 bp, Artificial
  CRISPR gRNA sequence
gcgtgtgattgaaagactgt

SEQ ID NO: 224857 - DNA, 20 bp, Artificial
  CRISPR gRNA sequence
cgtgtgattgaaagactgtt

SEQ ID NO: 224858 - DNA, 20 bp, Artificial
  CRISPR gRNA sequence
aaagactgttttatctttgt

SEQ ID NO: 224859 - DNA, 20 bp, Artificial
  CRISPR gRNA sequence
ttttatctttgtttgcaaaa

SEQ ID NO: 224860 - DNA, 20 bp, Artificial
  CRISPR gRNA sequence
tatctttgtttgcaaaatac

SEQ ID NO: 224861 - DNA, 20 bp, Artificial
  CRISPR gRNA sequence
atctttgtttgcaaaatacc

SEQ ID NO: 224862 - DNA, 20 bp, Artificial
  CRISPR gRNA sequence
tctttgtttgcaaaataccc

SEQ ID NO: 224863 - DNA, 20 bp, Artificial
  CRISPR gRNA sequence
tgtttgcaaaataccctata

SEQ ID NO: 224864 - DNA, 20 bp, Artificial
  CRISPR gRNA sequence
gtttgcaaaataccctataa

SEQ ID NO: 224865 - DNA, 20 bp, Artificial
  CRISPR gRNA sequence
tttgcaaaataccctataaa

SEQ ID NO: 224866 - DNA, 20 bp, Artificial
  CRISPR gRNA sequence
gcaaaataccctataaaaat

SEQ ID NO: 224867 - DNA, 20 bp, Artificial
  CRISPR gRNA sequence
caaaataccctataaaaata

SEQ ID NO: 224868 - DNA, 20 bp, Artificial
  CRISPR gRNA sequence
taaaaataaaaactagactt

SEQ ID NO: 224869 - DNA, 20 bp, Artificial
  CRISPR gRNA sequence
gacttattttgggagccatt

SEQ ID NO: 224870 - DNA, 20 bp, Artificial
  CRISPR gRNA sequence
attttgggagccattaaaag

SEQ ID NO: 224871 - DNA, 20 bp, Artificial
  CRISPR gRNA sequence
ttttgggagccattaaaagg

SEQ ID NO: 224872 - DNA, 20 bp, Artificial
  CRISPR gRNA sequence
tgggagccattaaaaggaga

SEQ ID NO: 224873 - DNA, 20 bp, Artificial
  CRISPR gRNA sequence
gggagccattaaaaggagaa

SEQ ID NO: 224874 - DNA, 20 bp, Artificial
  CRISPR gRNA sequence
ggagccattaaaaggagaaa

SEQ ID NO: 224875 - DNA, 20 bp, Artificial
  CRISPR gRNA sequence
aaaggagaaagtattgtttt

SEQ ID NO: 224876 - DNA, 20 bp, Artificial
  CRISPR gRNA sequence
ttttattatagagaatgtag

SEQ ID NO: 224877 - DNA, 20 bp, Artificial
  CRISPR gRNA sequence
tattatagagaatgtagaaa

SEQ ID NO: 224878 - DNA, 20 bp, Artificial
  CRISPR gRNA sequence
attatagagaatgtagaaaa

SEQ ID NO: 224879 - DNA, 20 bp, Artificial
  CRISPR gRNA sequence
ttatagagaatgtagaaaat

SEQ ID NO: 224880 - DNA, 20 bp, Artificial
  CRISPR gRNA sequence
tagagaatgtagaaaattct

SEQ ID NO: 224881 - DNA, 20 bp, Artificial
  CRISPR gRNA sequence
taccagaggtttgagacatt

SEQ ID NO: 224882 - DNA, 20 bp, Artificial
  CRISPR gRNA sequence
ccagaggtttgagacatttg

SEQ ID NO: 224883 - DNA, 20 bp, Artificial
  CRISPR gRNA sequence
gagacatttggctttgcatc

SEQ ID NO: 224884 - DNA, 20 bp, Artificial
  CRISPR gRNA sequence
agacatttggctttgcatcc

SEQ ID NO: 224885 - DNA, 20 bp, Artificial
  CRISPR gRNA sequence
ggctttgcatccattttaat

SEQ ID NO: 224886 - DNA, 20 bp, Artificial
  CRISPR gRNA sequence
gctttgcatccattttaatt

SEQ ID NO: 224887 - DNA, 20 bp, Artificial
  CRISPR gRNA sequence
tgcatccattttaatttttt

SEQ ID NO: 224888 - DNA, 20 bp, Artificial
  CRISPR gRNA sequence
gcatccattttaattttttg

SEQ ID NO: 224889 - DNA, 20 bp, Artificial
  CRISPR gRNA sequence
catccattttaattttttga

SEQ ID NO: 224890 - DNA, 20 bp, Artificial
  CRISPR gRNA sequence
taattttttgaaataattat

SEQ ID NO: 224891 - DNA, 20 bp, Artificial
  CRISPR gRNA sequence
aattttttgaaataattatt

SEQ ID NO: 224892 - DNA, 20 bp, Artificial
  CRISPR gRNA sequence
attttttgaaataattattg

SEQ ID NO: 224893 - DNA, 20 bp, Artificial
  CRISPR gRNA sequence
tttgaaataattattgattt

SEQ ID NO: 224894 - DNA, 20 bp, Artificial
  CRISPR gRNA sequence
ttgaaataattattgattta

SEQ ID NO: 224895 - DNA, 20 bp, Artificial
  CRISPR gRNA sequence
tgaaataattattgatttac

SEQ ID NO: 224896 - DNA, 20 bp, Artificial
  CRISPR gRNA sequence
gaaataattattgatttaca

SEQ ID NO: 224897 - DNA, 20 bp, Artificial
  CRISPR gRNA sequence
aaataattattgatttacag

SEQ ID NO: 224898 - DNA, 20 bp, Artificial
  CRISPR gRNA sequence
ttgatttacaggacgattca

SEQ ID NO: 224899 - DNA, 20 bp, Artificial
  CRISPR gRNA sequence
atttacaggacgattcaaag

SEQ ID NO: 224900 - DNA, 20 bp, Artificial
  CRISPR gRNA sequence
acaggacgattcaaagatag

SEQ ID NO: 224901 - DNA, 20 bp, Artificial
  CRISPR gRNA sequence
caggacgattcaaagataga

SEQ ID NO: 224902 - DNA, 20 bp, Artificial
  CRISPR gRNA sequence
aaagatagagagcttccatg

SEQ ID NO: 224903 - DNA, 20 bp, Artificial
  CRISPR gRNA sequence
ccatgtgcccttcacccagt

SEQ ID NO: 224904 - DNA, 20 bp, Artificial
  CRISPR gRNA sequence
catgtgcccttcacccagtc

SEQ ID NO: 224905 - DNA, 20 bp, Artificial
  CRISPR gRNA sequence
cacccagtccccccaatggt

SEQ ID NO: 224906 - DNA, 20 bp, Artificial
  CRISPR gRNA sequence
acccagtccccccaatggtt

SEQ ID NO: 224907 - DNA, 20 bp, Artificial
  CRISPR gRNA sequence
cctcttatgtgacacaatat

SEQ ID NO: 224908 - DNA, 20 bp, Artificial
  CRISPR gRNA sequence
ctcttatgtgacacaatatg

SEQ ID NO: 224909 - DNA, 20 bp, Artificial
  CRISPR gRNA sequence
ttatgtgacacaatatgaaa

SEQ ID NO: 224910 - DNA, 20 bp, Artificial
  CRISPR gRNA sequence
atgtgacacaatatgaaaat

SEQ ID NO: 224911 - DNA, 20 bp, Artificial
  CRISPR gRNA sequence
tgtgacacaatatgaaaatc

SEQ ID NO: 224912 - DNA, 20 bp, Artificial
  CRISPR gRNA sequence
acaatggtgcagtgtgtgtt

SEQ ID NO: 224913 - DNA, 20 bp, Artificial
  CRISPR gRNA sequence
atggttcgctctcattttat

SEQ ID NO: 224914 - DNA, 20 bp, Artificial
  CRISPR gRNA sequence
gctctcattttatcacgtgt

SEQ ID NO: 224915 - DNA, 20 bp, Artificial
  CRISPR gRNA sequence
tcattttatcacgtgtttat

SEQ ID NO: 224916 - DNA, 20 bp, Artificial
  CRISPR gRNA sequence
attttatcacgtgtttattt

SEQ ID NO: 224917 - DNA, 20 bp, Artificial
  CRISPR gRNA sequence
tatcacgtgtttatttgcgt

SEQ ID NO: 224918 - DNA, 20 bp, Artificial
  CRISPR gRNA sequence
atcacgtgtttatttgcgta

SEQ ID NO: 224919 - DNA, 20 bp, Artificial
  CRISPR gRNA sequence
tcacgtgtttatttgcgtaa

SEQ ID NO: 224920 - DNA, 20 bp, Artificial
  CRISPR gRNA sequence
atttgcgtaactacctacac

SEQ ID NO: 224921 - DNA, 20 bp, Artificial
  CRISPR gRNA sequence
tttgcgtaactacctacaca

SEQ ID NO: 224922 - DNA, 20 bp, Artificial
  CRISPR gRNA sequence
gcgtaactacctacacaatc

SEQ ID NO: 224923 - DNA, 20 bp, Artificial
  CRISPR gRNA sequence
cgtaactacctacacaatca

SEQ ID NO: 224924 - DNA, 20 bp, Artificial
  CRISPR gRNA sequence
cctacacaatcaggacatag

SEQ ID NO: 224925 - DNA, 20 bp, Artificial
  CRISPR gRNA sequence
cacaatcaggacatagacct

SEQ ID NO: 224926 - DNA, 20 bp, Artificial
  CRISPR gRNA sequence
tccatcataacaaacatctc

SEQ ID NO: 224927 - DNA, 20 bp, Artificial
  CRISPR gRNA sequence
cctcatgcttattcttacta

SEQ ID NO: 224928 - DNA, 20 bp, Artificial
  CRISPR gRNA sequence
atgcttattcttactagtca

SEQ ID NO: 224929 - DNA, 20 bp, Artificial
  CRISPR gRNA sequence
attcttactagtcataccgc

SEQ ID NO: 224930 - DNA, 20 bp, Artificial
  CRISPR gRNA sequence
ttcttactagtcataccgcc

SEQ ID NO: 224931 - DNA, 20 bp, Artificial
  CRISPR gRNA sequence
ttactagtcataccgccacc

SEQ ID NO: 224932 - DNA, 20 bp, Artificial
  CRISPR gRNA sequence
actagtcataccgccacctc

SEQ ID NO: 224933 - DNA, 20 bp, Artificial
  CRISPR gRNA sequence
ctagtcataccgccacctcc

SEQ ID NO: 224934 - DNA, 20 bp, Artificial
  CRISPR gRNA sequence
gtcataccgccacctcccac

SEQ ID NO: 224935 - DNA, 20 bp, Artificial
  CRISPR gRNA sequence
ccactgtccctaacctggca

SEQ ID NO: 224936 - DNA, 20 bp, Artificial
  CRISPR gRNA sequence
tccctaacctggcaagcacc

SEQ ID NO: 224937 - DNA, 20 bp, Artificial
  CRISPR gRNA sequence
acctggcaagcaccaatttg

SEQ ID NO: 224938 - DNA, 20 bp, Artificial
  CRISPR gRNA sequence
gcaagcaccaatttgtcctc

SEQ ID NO: 224939 - DNA, 20 bp, Artificial
  CRISPR gRNA sequence
gtcctccatatctataattt

SEQ ID NO: 224940 - DNA, 20 bp, Artificial
  CRISPR gRNA sequence
tcctccatatctataatttt

SEQ ID NO: 224941 - DNA, 20 bp, Artificial
  CRISPR gRNA sequence
catatctataattttgtcat

SEQ ID NO: 224942 - DNA, 20 bp, Artificial
  CRISPR gRNA sequence
taattttgtcatttcaacaa

SEQ ID NO: 224943 - DNA, 20 bp, Artificial
  CRISPR gRNA sequence
tgtcatttcaacaatgctat

SEQ ID NO: 224944 - DNA, 20 bp, Artificial
  CRISPR gRNA sequence
gtcatttcaacaatgctata

SEQ ID NO: 224945 - DNA, 20 bp, Artificial
  CRISPR gRNA sequence
tcatttcaacaatgctatat

SEQ ID NO: 224946 - DNA, 20 bp, Artificial
  CRISPR gRNA sequence
caacaatgctatataaatgg

SEQ ID NO: 224947 - DNA, 20 bp, Artificial
  CRISPR gRNA sequence
aacaatgctatataaatgga

SEQ ID NO: 224948 - DNA, 20 bp, Artificial
  CRISPR gRNA sequence
tataaatggaatgatacaag

SEQ ID NO: 224949 - DNA, 20 bp, Artificial
  CRISPR gRNA sequence
ttgagaagggctttttcact

SEQ ID NO: 224950 - DNA, 20 bp, Artificial
  CRISPR gRNA sequence
tgagaagggctttttcacta

SEQ ID NO: 224951 - DNA, 20 bp, Artificial
  CRISPR gRNA sequence
gagaagggctttttcactaa

SEQ ID NO: 224952 - DNA, 20 bp, Artificial
  CRISPR gRNA sequence
agaagggctttttcactaag

SEQ ID NO: 224953 - DNA, 20 bp, Artificial
  CRISPR gRNA sequence
tttcactaagcacaatgccc

SEQ ID NO: 224954 - DNA, 20 bp, Artificial
  CRISPR gRNA sequence
ttcactaagcacaatgccct

SEQ ID NO: 224955 - DNA, 20 bp, Artificial
  CRISPR gRNA sequence
tcactaagcacaatgccctt

SEQ ID NO: 224956 - DNA, 20 bp, Artificial
  CRISPR gRNA sequence
cactaagcacaatgcccttg

SEQ ID NO: 224957 - DNA, 20 bp, Artificial
  CRISPR gRNA sequence
actaagcacaatgcccttga

SEQ ID NO: 224958 - DNA, 20 bp, Artificial
  CRISPR gRNA sequence
agcacaatgcccttgagatc

SEQ ID NO: 224959 - DNA, 20 bp, Artificial
  CRISPR gRNA sequence
gagatctatccaagtttttg

SEQ ID NO: 224960 - DNA, 20 bp, Artificial
  CRISPR gRNA sequence
agatctatccaagtttttgc

SEQ ID NO: 224961 - DNA, 20 bp, Artificial
  CRISPR gRNA sequence
tccaagtttttgcatctatc

SEQ ID NO: 224962 - DNA, 20 bp, Artificial
  CRISPR gRNA sequence
ttgcatctatcaatagttct

SEQ ID NO: 224963 - DNA, 20 bp, Artificial
  CRISPR gRNA sequence
tgcatctatcaatagttctt

SEQ ID NO: 224964 - DNA, 20 bp, Artificial
  CRISPR gRNA sequence
gcatctatcaatagttcttt

SEQ ID NO: 224965 - DNA, 20 bp, Artificial
  CRISPR gRNA sequence
catctatcaatagttctttt

SEQ ID NO: 224966 - DNA, 20 bp, Artificial
  CRISPR gRNA sequence
tcaatagttcttttttcctt

SEQ ID NO: 224967 - DNA, 20 bp, Artificial
  CRISPR gRNA sequence
ttttttccttactttttttt

SEQ ID NO: 224968 - DNA, 20 bp, Artificial
  CRISPR gRNA sequence
ttttccttactttttttttt

SEQ ID NO: 224969 - DNA, 20 bp, Artificial
  CRISPR gRNA sequence
tttccttacttttttttttg

SEQ ID NO: 224970 - DNA, 20 bp, Artificial
  CRISPR gRNA sequence
ttccttacttttttttttgc

SEQ ID NO: 224971 - DNA, 20 bp, Artificial
  CRISPR gRNA sequence
tccttacttttttttttgct

SEQ ID NO: 224972 - DNA, 20 bp, Artificial
  CRISPR gRNA sequence
ccttacttttttttttgctg

SEQ ID NO: 224973 - DNA, 20 bp, Artificial
  CRISPR gRNA sequence
cttacttttttttttgctga

SEQ ID NO: 224974 - DNA, 20 bp, Artificial
  CRISPR gRNA sequence
acttttttttttgctgagta

SEQ ID NO: 224975 - DNA, 20 bp, Artificial
  CRISPR gRNA sequence
cttttttttttgctgagtag

SEQ ID NO: 224976 - DNA, 20 bp, Artificial
  CRISPR gRNA sequence
ttttttttgctgagtagtag

SEQ ID NO: 224977 - DNA, 20 bp, Artificial
  CRISPR gRNA sequence
tttttttgctgagtagtagt

SEQ ID NO: 224978 - DNA, 20 bp, Artificial
  CRISPR gRNA sequence
ttttttgctgagtagtagtc

SEQ ID NO: 224979 - DNA, 20 bp, Artificial
  CRISPR gRNA sequence
tttttgctgagtagtagtcc

SEQ ID NO: 224980 - DNA, 20 bp, Artificial
  CRISPR gRNA sequence
ttttgctgagtagtagtcca

SEQ ID NO: 224981 - DNA, 20 bp, Artificial
  CRISPR gRNA sequence
tttgctgagtagtagtccat

SEQ ID NO: 224982 - DNA, 20 bp, Artificial
  CRISPR gRNA sequence
ttgctgagtagtagtccata

SEQ ID NO: 224983 - DNA, 20 bp, Artificial
  CRISPR gRNA sequence
tgctgagtagtagtccatag

SEQ ID NO: 224984 - DNA, 20 bp, Artificial
  CRISPR gRNA sequence
gctgagtagtagtccatagt

SEQ ID NO: 224985 - DNA, 20 bp, Artificial
  CRISPR gRNA sequence
ctgagtagtagtccatagta

SEQ ID NO: 224986 - DNA, 20 bp, Artificial
  CRISPR gRNA sequence
agtagtagtccatagtatga

SEQ ID NO: 224987 - DNA, 20 bp, Artificial
  CRISPR gRNA sequence
gtttaaccacttacctatag

SEQ ID NO: 224988 - DNA, 20 bp, Artificial
  CRISPR gRNA sequence
tttaaccacttacctatagt

SEQ ID NO: 224989 - DNA, 20 bp, Artificial
  CRISPR gRNA sequence
aaccacttacctatagtagg

SEQ ID NO: 224990 - DNA, 20 bp, Artificial
  CRISPR gRNA sequence
accacttacctatagtagga

SEQ ID NO: 224991 - DNA, 20 bp, Artificial
  CRISPR gRNA sequence
acctatagtaggacattttg

SEQ ID NO: 224992 - DNA, 20 bp, Artificial
  CRISPR gRNA sequence
cctatagtaggacattttgg

SEQ ID NO: 224993 - DNA, 20 bp, Artificial
  CRISPR gRNA sequence
tagtaggacattttggttgt

SEQ ID NO: 224994 - DNA, 20 bp, Artificial
  CRISPR gRNA sequence
tggttgtttccaagtttggg

SEQ ID NO: 224995 - DNA, 20 bp, Artificial
  CRISPR gRNA sequence
ggttgtttccaagtttgggc

SEQ ID NO: 224996 - DNA, 20 bp, Artificial
  CRISPR gRNA sequence
gttgtttccaagtttgggct

SEQ ID NO: 224997 - DNA, 20 bp, Artificial
  CRISPR gRNA sequence
tttccaagtttgggctgtta

SEQ ID NO: 224998 - DNA, 20 bp, Artificial
  CRISPR gRNA sequence
ccaagtttgggctgttacaa

SEQ ID NO: 224999 - DNA, 20 bp, Artificial
  CRISPR gRNA sequence
caagtttgggctgttacaaa

SEQ ID NO: 225000 - DNA, 20 bp, Artificial
  CRISPR gRNA sequence
gggctgttacaaatgaaact

SEQ ID NO: 225001 - DNA, 20 bp, Artificial
  CRISPR gRNA sequence
ggctgttacaaatgaaactg

SEQ ID NO: 225002 - DNA, 20 bp, Artificial
  CRISPR gRNA sequence
ttacaaatgaaactgctctg

SEQ ID NO: 225003 - DNA, 20 bp, Artificial
  CRISPR gRNA sequence
caaatgaaactgctctgaac

SEQ ID NO: 225004 - DNA, 20 bp, Artificial
  CRISPR gRNA sequence
ctctgaacaattgtgtacag

SEQ ID NO: 225005 - DNA, 20 bp, Artificial
  CRISPR gRNA sequence
tgaacaattgtgtacaggtt

SEQ ID NO: 225006 - DNA, 20 bp, Artificial
  CRISPR gRNA sequence
aacaattgtgtacaggttct

SEQ ID NO: 225007 - DNA, 20 bp, Artificial
  CRISPR gRNA sequence
tgtacaggttcttgtgtaga

SEQ ID NO: 225008 - DNA, 20 bp, Artificial
  CRISPR gRNA sequence
ttgtgtagacacagttttca

SEQ ID NO: 225009 - DNA, 20 bp, Artificial
  CRISPR gRNA sequence
gtgtagacacagttttcatt

SEQ ID NO: 225010 - DNA, 20 bp, Artificial
  CRISPR gRNA sequence
tgtagacacagttttcattt

SEQ ID NO: 225011 - DNA, 20 bp, Artificial
  CRISPR gRNA sequence
tcatttctctgggataaatg

SEQ ID NO: 225012 - DNA, 20 bp, Artificial
  CRISPR gRNA sequence
catttctctgggataaatgc

SEQ ID NO: 225013 - DNA, 20 bp, Artificial
  CRISPR gRNA sequence
atttctctgggataaatgct

SEQ ID NO: 225014 - DNA, 20 bp, Artificial
  CRISPR gRNA sequence
ctctgggataaatgctcaga

SEQ ID NO: 225015 - DNA, 20 bp, Artificial
  CRISPR gRNA sequence
tctgggataaatgctcagaa

SEQ ID NO: 225016 - DNA, 20 bp, Artificial
  CRISPR gRNA sequence
tgggataaatgctcagaagt

SEQ ID NO: 225017 - DNA, 20 bp, Artificial
  CRISPR gRNA sequence
ggataaatgctcagaagtat

SEQ ID NO: 225018 - DNA, 20 bp, Artificial
  CRISPR gRNA sequence
agaagtatggttactgggct

SEQ ID NO: 225019 - DNA, 20 bp, Artificial
  CRISPR gRNA sequence
ctgggctgtatggtaagtat

SEQ ID NO: 225020 - DNA, 20 bp, Artificial
  CRISPR gRNA sequence
ggctgtatggtaagtatatg

SEQ ID NO: 225021 - DNA, 20 bp, Artificial
  CRISPR gRNA sequence
tatggtaagtatatgcttag

SEQ ID NO: 225022 - DNA, 20 bp, Artificial
  CRISPR gRNA sequence
agtttttaaagaaactgcca

SEQ ID NO: 225023 - DNA, 20 bp, Artificial
  CRISPR gRNA sequence
gtttttaaagaaactgccag

SEQ ID NO: 225024 - DNA, 20 bp, Artificial
  CRISPR gRNA sequence
ttaaagaaactgccagactt

SEQ ID NO: 225025 - DNA, 20 bp, Artificial
  CRISPR gRNA sequence
taaagaaactgccagacttt

SEQ ID NO: 225026 - DNA, 20 bp, Artificial
  CRISPR gRNA sequence
aaagaaactgccagactttt

SEQ ID NO: 225027 - DNA, 20 bp, Artificial
  CRISPR gRNA sequence
aagaaactgccagacttttc

SEQ ID NO: 225028 - DNA, 20 bp, Artificial
  CRISPR gRNA sequence
ccagacttttccagagtggc

SEQ ID NO: 225029 - DNA, 20 bp, Artificial
  CRISPR gRNA sequence
ttccagagtggctatttcat

SEQ ID NO: 225030 - DNA, 20 bp, Artificial
  CRISPR gRNA sequence
tccagagtggctatttcatt

SEQ ID NO: 225031 - DNA, 20 bp, Artificial
  CRISPR gRNA sequence
ccagagtggctatttcattt

SEQ ID NO: 225032 - DNA, 20 bp, Artificial
  CRISPR gRNA sequence
cagagtggctatttcatttt

SEQ ID NO: 225033 - DNA, 20 bp, Artificial
  CRISPR gRNA sequence
tttcattttacatttccatc

SEQ ID NO: 225034 - DNA, 20 bp, Artificial
  CRISPR gRNA sequence
cattttacatttccatcaac

SEQ ID NO: 225035 - DNA, 20 bp, Artificial
  CRISPR gRNA sequence
attttacatttccatcaaca

SEQ ID NO: 225036 - DNA, 20 bp, Artificial
  CRISPR gRNA sequence
tacatttccatcaacaatgt

SEQ ID NO: 225037 - DNA, 20 bp, Artificial
  CRISPR gRNA sequence
acatttccatcaacaatgta

SEQ ID NO: 225038 - DNA, 20 bp, Artificial
  CRISPR gRNA sequence
catttccatcaacaatgtaa

SEQ ID NO: 225039 - DNA, 20 bp, Artificial
  CRISPR gRNA sequence
ccatcaacaatgtaagagtg

SEQ ID NO: 225040 - DNA, 20 bp, Artificial
  CRISPR gRNA sequence
catcaacaatgtaagagtga

SEQ ID NO: 225041 - DNA, 20 bp, Artificial
  CRISPR gRNA sequence
gtttctccacatcctcacca

SEQ ID NO: 225042 - DNA, 20 bp, Artificial
  CRISPR gRNA sequence
ctccacatcctcaccagtat

SEQ ID NO: 225043 - DNA, 20 bp, Artificial
  CRISPR gRNA sequence
tccacatcctcaccagtatc

SEQ ID NO: 225044 - DNA, 20 bp, Artificial
  CRISPR gRNA sequence
cacatcctcaccagtatctg

SEQ ID NO: 225045 - DNA, 20 bp, Artificial
  CRISPR gRNA sequence
accagtatctggtgccacta

SEQ ID NO: 225046 - DNA, 20 bp, Artificial
  CRISPR gRNA sequence
gtgccactatgttgtaacca

SEQ ID NO: 225047 - DNA, 20 bp, Artificial
  CRISPR gRNA sequence
tgttgtaaccatttttaact

SEQ ID NO: 225048 - DNA, 20 bp, Artificial
  CRISPR gRNA sequence
taaccatttttaactgaaaa

SEQ ID NO: 225049 - DNA, 20 bp, Artificial
  CRISPR gRNA sequence
ttaactgaaaaaaacaacaa

SEQ ID NO: 225050 - DNA, 20 bp, Artificial
  CRISPR gRNA sequence
taactgaaaaaaacaacaaa

SEQ ID NO: 225051 - DNA, 20 bp, Artificial
  CRISPR gRNA sequence
aactgaaaaaaacaacaaac

SEQ ID NO: 225052 - DNA, 20 bp, Artificial
  CRISPR gRNA sequence
actgaaaaaaacaacaaaca

SEQ ID NO: 225053 - DNA, 20 bp, Artificial
  CRISPR gRNA sequence
aaaaaaacaacaaacaaaca

SEQ ID NO: 225054 - DNA, 20 bp, Artificial
  CRISPR gRNA sequence
aaaagttatctgcacaaaaa

SEQ ID NO: 225055 - DNA, 20 bp, Artificial
  CRISPR gRNA sequence
tctgcacaaaaaggttaaat

SEQ ID NO: 225056 - DNA, 20 bp, Artificial
  CRISPR gRNA sequence
cacaaaaaggttaaatgggg

SEQ ID NO: 225057 - DNA, 20 bp, Artificial
  CRISPR gRNA sequence
aatggggcaggactcttact

SEQ ID NO: 225058 - DNA, 20 bp, Artificial
  CRISPR gRNA sequence
ttactatggagtataagttc

SEQ ID NO: 225059 - DNA, 20 bp, Artificial
  CRISPR gRNA sequence
actatggagtataagttctt

SEQ ID NO: 225060 - DNA, 20 bp, Artificial
  CRISPR gRNA sequence
ctatggagtataagttcttt

SEQ ID NO: 225061 - DNA, 20 bp, Artificial
  CRISPR gRNA sequence
tggagtataagttcttttct

SEQ ID NO: 225062 - DNA, 20 bp, Artificial
  CRISPR gRNA sequence
ttttctaataagaatactta

SEQ ID NO: 225063 - DNA, 20 bp, Artificial
  CRISPR gRNA sequence
ttctaataagaatacttact

SEQ ID NO: 225064 - DNA, 20 bp, Artificial
  CRISPR gRNA sequence
tctaataagaatacttactt

SEQ ID NO: 225065 - DNA, 20 bp, Artificial
  CRISPR gRNA sequence
ctaataagaatacttacttg

SEQ ID NO: 225066 - DNA, 20 bp, Artificial
  CRISPR gRNA sequence
taataagaatacttacttgt

SEQ ID NO: 225067 - DNA, 20 bp, Artificial
  CRISPR gRNA sequence
ataagaatacttacttgtca

SEQ ID NO: 225068 - DNA, 20 bp, Artificial
  CRISPR gRNA sequence
acttgtcacggactttgagg

SEQ ID NO: 225069 - DNA, 20 bp, Artificial
  CRISPR gRNA sequence
cttgtcacggactttgagga

SEQ ID NO: 225070 - DNA, 20 bp, Artificial
  CRISPR gRNA sequence
gtcacggactttgaggattt

SEQ ID NO: 225071 - DNA, 20 bp, Artificial
  CRISPR gRNA sequence
tcacggactttgaggattta

SEQ ID NO: 225072 - DNA, 20 bp, Artificial
  CRISPR gRNA sequence
tgaggatttaagcattagaa

SEQ ID NO: 225073 - DNA, 20 bp, Artificial
  CRISPR gRNA sequence
gaggatttaagcattagaaa

SEQ ID NO: 225074 - DNA, 20 bp, Artificial
  CRISPR gRNA sequence
aggatttaagcattagaaac

SEQ ID NO: 225075 - DNA, 20 bp, Artificial
  CRISPR gRNA sequence
aagcattagaaaccattttt

SEQ ID NO: 225076 - DNA, 20 bp, Artificial
  CRISPR gRNA sequence
agcattagaaaccattttta

SEQ ID NO: 225077 - DNA, 20 bp, Artificial
  CRISPR gRNA sequence
gaaaccatttttactatgtc

SEQ ID NO: 225078 - DNA, 20 bp, Artificial
  CRISPR gRNA sequence
ttactatgtcgtgatttttg

SEQ ID NO: 225079 - DNA, 20 bp, Artificial
  CRISPR gRNA sequence
tactatgtcgtgatttttgc

SEQ ID NO: 225080 - DNA, 20 bp, Artificial
  CRISPR gRNA sequence
actatgtcgtgatttttgca

SEQ ID NO: 225081 - DNA, 20 bp, Artificial
  CRISPR gRNA sequence
ctatgtcgtgatttttgcaa

SEQ ID NO: 225082 - DNA, 20 bp, Artificial
  CRISPR gRNA sequence
tgtcgtgatttttgcaaata

SEQ ID NO: 225083 - DNA, 20 bp, Artificial
  CRISPR gRNA sequence
ttgcaaatacaggcataaat

SEQ ID NO: 225084 - DNA, 20 bp, Artificial
  CRISPR gRNA sequence
tgcaaatacaggcataaatg

SEQ ID NO: 225085 - DNA, 20 bp, Artificial
  CRISPR gRNA sequence
gcaaatacaggcataaatga

SEQ ID NO: 225086 - DNA, 20 bp, Artificial
  CRISPR gRNA sequence
caaatacaggcataaatgag

SEQ ID NO: 225087 - DNA, 20 bp, Artificial
  CRISPR gRNA sequence
gctcaatagagaagtgaatt

SEQ ID NO: 225088 - DNA, 20 bp, Artificial
  CRISPR gRNA sequence
ctcaatagagaagtgaattc

SEQ ID NO: 225089 - DNA, 20 bp, Artificial
  CRISPR gRNA sequence
aatagagaagtgaattctac

SEQ ID NO: 225090 - DNA, 20 bp, Artificial
  CRISPR gRNA sequence
tacttaatagaatgcagata

SEQ ID NO: 225091 - DNA, 20 bp, Artificial
  CRISPR gRNA sequence
cttaatagaatgcagataat

SEQ ID NO: 225092 - DNA, 20 bp, Artificial
  CRISPR gRNA sequence
aatagaatgcagataatagt

SEQ ID NO: 225093 - DNA, 20 bp, Artificial
  CRISPR gRNA sequence
atagaatgcagataatagtg

SEQ ID NO: 225094 - DNA, 20 bp, Artificial
  CRISPR gRNA sequence
tttgtgcctttttaaatttt

SEQ ID NO: 225095 - DNA, 20 bp, Artificial
  CRISPR gRNA sequence
tgtgcctttttaaatttttt

SEQ ID NO: 225096 - DNA, 20 bp, Artificial
  CRISPR gRNA sequence
gtgcctttttaaattttttg

SEQ ID NO: 225097 - DNA, 20 bp, Artificial
  CRISPR gRNA sequence
tgcctttttaaattttttgg

SEQ ID NO: 225098 - DNA, 20 bp, Artificial
  CRISPR gRNA sequence
tttaaattttttggaggact

SEQ ID NO: 225099 - DNA, 20 bp, Artificial
  CRISPR gRNA sequence
ttaaattttttggaggacta

SEQ ID NO: 225100 - DNA, 20 bp, Artificial
  CRISPR gRNA sequence
taaattttttggaggactag

SEQ ID NO: 225101 - DNA, 20 bp, Artificial
  CRISPR gRNA sequence
aaattttttggaggactagg

SEQ ID NO: 225102 - DNA, 20 bp, Artificial
  CRISPR gRNA sequence
aattttttggaggactagga

SEQ ID NO: 225103 - DNA, 20 bp, Artificial
  CRISPR gRNA sequence
tttggaggactaggactgaa

SEQ ID NO: 225104 - DNA, 20 bp, Artificial
  CRISPR gRNA sequence
ttggaggactaggactgaat

SEQ ID NO: 225105 - DNA, 20 bp, Artificial
  CRISPR gRNA sequence
tggaggactaggactgaata

SEQ ID NO: 225106 - DNA, 20 bp, Artificial
  CRISPR gRNA sequence
ggaggactaggactgaatac

SEQ ID NO: 225107 - DNA, 20 bp, Artificial
  CRISPR gRNA sequence
gaggactaggactgaataca

SEQ ID NO: 225108 - DNA, 20 bp, Artificial
  CRISPR gRNA sequence
ggactgaatacatggaaaca

SEQ ID NO: 225109 - DNA, 20 bp, Artificial
  CRISPR gRNA sequence
aatacatggaaacactataa

SEQ ID NO: 225110 - DNA, 20 bp, Artificial
  CRISPR gRNA sequence
taagatatagttttatatac

SEQ ID NO: 225111 - DNA, 20 bp, Artificial
  CRISPR gRNA sequence
tatatacctctgtgcctatg

SEQ ID NO: 225112 - DNA, 20 bp, Artificial
  CRISPR gRNA sequence
atatacctctgtgcctatgt

SEQ ID NO: 225113 - DNA, 20 bp, Artificial
  CRISPR gRNA sequence
tatacctctgtgcctatgta

SEQ ID NO: 225114 - DNA, 20 bp, Artificial
  CRISPR gRNA sequence
tgtgcctatgtatgatatag

SEQ ID NO: 225115 - DNA, 20 bp, Artificial
  CRISPR gRNA sequence
tgcctatgtatgatatagtc

SEQ ID NO: 225116 - DNA, 20 bp, Artificial
  CRISPR gRNA sequence
tgtatgatatagtccattag

SEQ ID NO: 225117 - DNA, 20 bp, Artificial
  CRISPR gRNA sequence
gaaggagcactggacttgaa

SEQ ID NO: 225118 - DNA, 20 bp, Artificial
  CRISPR gRNA sequence
gacttgaaattagaaagctg

SEQ ID NO: 225119 - DNA, 20 bp, Artificial
  CRISPR gRNA sequence
gaaattagaaagctgttttc

SEQ ID NO: 225120 - DNA, 20 bp, Artificial
  CRISPR gRNA sequence
aaattagaaagctgttttct

SEQ ID NO: 225121 - DNA, 20 bp, Artificial
  CRISPR gRNA sequence
gaaagctgttttctagactt

SEQ ID NO: 225122 - DNA, 20 bp, Artificial
  CRISPR gRNA sequence
ttttctagacttcactgttt

SEQ ID NO: 225123 - DNA, 20 bp, Artificial
  CRISPR gRNA sequence
tctagacttcactgtttaat

SEQ ID NO: 225124 - DNA, 20 bp, Artificial
  CRISPR gRNA sequence
ctagacttcactgtttaata

SEQ ID NO: 225125 - DNA, 20 bp, Artificial
  CRISPR gRNA sequence
tagacttcactgtttaatag

SEQ ID NO: 225126 - DNA, 20 bp, Artificial
  CRISPR gRNA sequence
gacttcactgtttaatagct

SEQ ID NO: 225127 - DNA, 20 bp, Artificial
  CRISPR gRNA sequence
cactgtttaatagcttaaga

SEQ ID NO: 225128 - DNA, 20 bp, Artificial
  CRISPR gRNA sequence
actgtttaatagcttaagaa

SEQ ID NO: 225129 - DNA, 20 bp, Artificial
  CRISPR gRNA sequence
tttaatagcttaagaaaagt

SEQ ID NO: 225130 - DNA, 20 bp, Artificial
  CRISPR gRNA sequence
aatagcttaagaaaagttgg

SEQ ID NO: 225131 - DNA, 20 bp, Artificial
  CRISPR gRNA sequence
atagcttaagaaaagttgga

SEQ ID NO: 225132 - DNA, 20 bp, Artificial
  CRISPR gRNA sequence
aagaaaagttggataaaaaa

SEQ ID NO: 225133 - DNA, 20 bp, Artificial
  CRISPR gRNA sequence
agaaaagttggataaaaaac

SEQ ID NO: 225134 - DNA, 20 bp, Artificial
  CRISPR gRNA sequence
gataaaaaactcaacctatc

SEQ ID NO: 225135 - DNA, 20 bp, Artificial
  CRISPR gRNA sequence
aacctatctgtccctcaaat

SEQ ID NO: 225136 - DNA, 20 bp, Artificial
  CRISPR gRNA sequence
tctgtccctcaaattcttct

SEQ ID NO: 225137 - DNA, 20 bp, Artificial
  CRISPR gRNA sequence
tccctcaaattcttcttagt

SEQ ID NO: 225138 - DNA, 20 bp, Artificial
  CRISPR gRNA sequence
aaattcttcttagtacagta

SEQ ID NO: 225139 - DNA, 20 bp, Artificial
  CRISPR gRNA sequence
ttcttagtacagtaaagatg

SEQ ID NO: 225140 - DNA, 20 bp, Artificial
  CRISPR gRNA sequence
cttagtacagtaaagatggc

SEQ ID NO: 225141 - DNA, 20 bp, Artificial
  CRISPR gRNA sequence
ttagtacagtaaagatggca

SEQ ID NO: 225142 - DNA, 20 bp, Artificial
  CRISPR gRNA sequence
agtacagtaaagatggcatc

SEQ ID NO: 225143 - DNA, 20 bp, Artificial
  CRISPR gRNA sequence
gtacagtaaagatggcatca

SEQ ID NO: 225144 - DNA, 20 bp, Artificial
  CRISPR gRNA sequence
gagatataaataatacctct

SEQ ID NO: 225145 - DNA, 20 bp, Artificial
  CRISPR gRNA sequence
agatataaataatacctctc

SEQ ID NO: 225146 - DNA, 20 bp, Artificial
  CRISPR gRNA sequence
tcttacttaacaaaatttta

SEQ ID NO: 225147 - DNA, 20 bp, Artificial
  CRISPR gRNA sequence
ttacttaacaaaattttact

SEQ ID NO: 225148 - DNA, 20 bp, Artificial
  CRISPR gRNA sequence
acttaacaaaattttactaa

SEQ ID NO: 225149 - DNA, 20 bp, Artificial
  CRISPR gRNA sequence
cttaacaaaattttactaag

SEQ ID NO: 225150 - DNA, 20 bp, Artificial
  CRISPR gRNA sequence
aacaaaattttactaagtgc

SEQ ID NO: 225151 - DNA, 20 bp, Artificial
  CRISPR gRNA sequence
acaaaattttactaagtgcc

SEQ ID NO: 225152 - DNA, 20 bp, Artificial
  CRISPR gRNA sequence
tactaagtgcctaccatgtg

SEQ ID NO: 225153 - DNA, 20 bp, Artificial
  CRISPR gRNA sequence
actaagtgcctaccatgtgc

SEQ ID NO: 225154 - DNA, 20 bp, Artificial
  CRISPR gRNA sequence
ctaagtgcctaccatgtgcc

SEQ ID NO: 225155 - DNA, 20 bp, Artificial
  CRISPR gRNA sequence
agtgcctaccatgtgccagt

SEQ ID NO: 225156 - DNA, 20 bp, Artificial
  CRISPR gRNA sequence
ccatgtgccagtcaccgtac

SEQ ID NO: 225157 - DNA, 20 bp, Artificial
  CRISPR gRNA sequence
ggcatcacagattctgtgat

SEQ ID NO: 225158 - DNA, 20 bp, Artificial
  CRISPR gRNA sequence
tgtgatgaataagacattat

SEQ ID NO: 225159 - DNA, 20 bp, Artificial
  CRISPR gRNA sequence
tgatgaataagacattattg

SEQ ID NO: 225160 - DNA, 20 bp, Artificial
  CRISPR gRNA sequence
ttgctgatttcaaggaagtg

SEQ ID NO: 225161 - DNA, 20 bp, Artificial
  CRISPR gRNA sequence
ctgatttcaaggaagtggtt

SEQ ID NO: 225162 - DNA, 20 bp, Artificial
  CRISPR gRNA sequence
atttcaaggaagtggttgca

SEQ ID NO: 225163 - DNA, 20 bp, Artificial
  CRISPR gRNA sequence
caaggaagtggttgcagtac

SEQ ID NO: 225164 - DNA, 20 bp, Artificial
  CRISPR gRNA sequence
aaggaagtggttgcagtaca

SEQ ID NO: 225165 - DNA, 20 bp, Artificial
  CRISPR gRNA sequence
cagtacaaatatgaagagtg

SEQ ID NO: 225166 - DNA, 20 bp, Artificial
  CRISPR gRNA sequence
acatttatttgcacatgtgc

SEQ ID NO: 225167 - DNA, 20 bp, Artificial
  CRISPR gRNA sequence
atttgcacatgtgccacata

SEQ ID NO: 225168 - DNA, 20 bp, Artificial
  CRISPR gRNA sequence
tttgcacatgtgccacatac

SEQ ID NO: 225169 - DNA, 20 bp, Artificial
  CRISPR gRNA sequence
gcacatgtgccacatacttt

SEQ ID NO: 225170 - DNA, 20 bp, Artificial
  CRISPR gRNA sequence
cacatgtgccacatacttta

SEQ ID NO: 225171 - DNA, 20 bp, Artificial
  CRISPR gRNA sequence
tatgtaagtcgtgtcctgtt

SEQ ID NO: 225172 - DNA, 20 bp, Artificial
  CRISPR gRNA sequence
atgtaagtcgtgtcctgtta

SEQ ID NO: 225173 - DNA, 20 bp, Artificial
  CRISPR gRNA sequence
tgtaagtcgtgtcctgttat

SEQ ID NO: 225174 - DNA, 20 bp, Artificial
  CRISPR gRNA sequence
ttatcctctcaagaactcta

SEQ ID NO: 225175 - DNA, 20 bp, Artificial
  CRISPR gRNA sequence
tcctctcaagaactctagga

SEQ ID NO: 225176 - DNA, 20 bp, Artificial
  CRISPR gRNA sequence
tcaagaactctaggagatag

SEQ ID NO: 225177 - DNA, 20 bp, Artificial
  CRISPR gRNA sequence
aagaactctaggagatagat

SEQ ID NO: 225178 - DNA, 20 bp, Artificial
  CRISPR gRNA sequence
taggagatagatggagttct

SEQ ID NO: 225179 - DNA, 20 bp, Artificial
  CRISPR gRNA sequence
ggagatagatggagttctta

SEQ ID NO: 225180 - DNA, 20 bp, Artificial
  CRISPR gRNA sequence
ttaccatttaacaaataggg

SEQ ID NO: 225181 - DNA, 20 bp, Artificial
  CRISPR gRNA sequence
accatttaacaaatagggaa

SEQ ID NO: 225182 - DNA, 20 bp, Artificial
  CRISPR gRNA sequence
ccatttaacaaatagggaag

SEQ ID NO: 225183 - DNA, 20 bp, Artificial
  CRISPR gRNA sequence
aacaaatagggaagcaaaag

SEQ ID NO: 225184 - DNA, 20 bp, Artificial
  CRISPR gRNA sequence
acaaatagggaagcaaaaga

SEQ ID NO: 225185 - DNA, 20 bp, Artificial
  CRISPR gRNA sequence
aaggtattgttcaaggtcag

SEQ ID NO: 225186 - DNA, 20 bp, Artificial
  CRISPR gRNA sequence
ttcaaggtcagagtaatagc

SEQ ID NO: 225187 - DNA, 20 bp, Artificial
  CRISPR gRNA sequence
aaggtcagagtaatagccaa

SEQ ID NO: 225188 - DNA, 20 bp, Artificial
  CRISPR gRNA sequence
aacctagatctctttggcat

SEQ ID NO: 225189 - DNA, 20 bp, Artificial
  CRISPR gRNA sequence
gatctctttggcatcaaaac

SEQ ID NO: 225190 - DNA, 20 bp, Artificial
  CRISPR gRNA sequence
tttggcatcaaaacccagta

SEQ ID NO: 225191 - DNA, 20 bp, Artificial
  CRISPR gRNA sequence
tggcatcaaaacccagtatt

SEQ ID NO: 225192 - DNA, 20 bp, Artificial
  CRISPR gRNA sequence
ggcatcaaaacccagtattt

SEQ ID NO: 225193 - DNA, 20 bp, Artificial
  CRISPR gRNA sequence
gcatcaaaacccagtatttt

SEQ ID NO: 225194 - DNA, 20 bp, Artificial
  CRISPR gRNA sequence
ttaccaccgtaatatgtggt

SEQ ID NO: 225195 - DNA, 20 bp, Artificial
  CRISPR gRNA sequence
taccaccgtaatatgtggtt

SEQ ID NO: 225196 - DNA, 20 bp, Artificial
  CRISPR gRNA sequence
accaccgtaatatgtggttc

SEQ ID NO: 225197 - DNA, 20 bp, Artificial
  CRISPR gRNA sequence
ccaccgtaatatgtggttca

SEQ ID NO: 225198 - DNA, 20 bp, Artificial
  CRISPR gRNA sequence
atgtgaaaacaccttgtaaa

SEQ ID NO: 225199 - DNA, 20 bp, Artificial
  CRISPR gRNA sequence
gtaaataactaaatactgaa

SEQ ID NO: 225200 - DNA, 20 bp, Artificial
  CRISPR gRNA sequence
taaataactaaatactgaat

SEQ ID NO: 225201 - DNA, 20 bp, Artificial
  CRISPR gRNA sequence
aatactgaatgcaaatacta

SEQ ID NO: 225202 - DNA, 20 bp, Artificial
  CRISPR gRNA sequence
aatgcaaatactagtaatca

SEQ ID NO: 225203 - DNA, 20 bp, Artificial
  CRISPR gRNA sequence
gtaatcataaaatttatcat

SEQ ID NO: 225204 - DNA, 20 bp, Artificial
  CRISPR gRNA sequence
atcattaatatttctgttct

SEQ ID NO: 225205 - DNA, 20 bp, Artificial
  CRISPR gRNA sequence
tcattaatatttctgttcta

SEQ ID NO: 225206 - DNA, 20 bp, Artificial
  CRISPR gRNA sequence
atatttctgttctattagca

SEQ ID NO: 225207 - DNA, 20 bp, Artificial
  CRISPR gRNA sequence
ctgttctattagcaatacaa

SEQ ID NO: 225208 - DNA, 20 bp, Artificial
  CRISPR gRNA sequence
tgttctattagcaatacaaa

SEQ ID NO: 225209 - DNA, 20 bp, Artificial
  CRISPR gRNA sequence
ttctattagcaatacaaaaa

SEQ ID NO: 225210 - DNA, 20 bp, Artificial
  CRISPR gRNA sequence
tattagcaatacaaaaactt

SEQ ID NO: 225211 - DNA, 20 bp, Artificial
  CRISPR gRNA sequence
ttagcaatacaaaaacttga

SEQ ID NO: 225212 - DNA, 20 bp, Artificial
  CRISPR gRNA sequence
gcaatacaaaaacttgaaaa

SEQ ID NO: 225213 - DNA, 20 bp, Artificial
  CRISPR gRNA sequence
gaaaacttaaagtttatttt

SEQ ID NO: 225214 - DNA, 20 bp, Artificial
  CRISPR gRNA sequence
aaaacttaaagtttattttt

SEQ ID NO: 225215 - DNA, 20 bp, Artificial
  CRISPR gRNA sequence
aaagtttatttttctctaag

SEQ ID NO: 225216 - DNA, 20 bp, Artificial
  CRISPR gRNA sequence
aagtttatttttctctaagc

SEQ ID NO: 225217 - DNA, 20 bp, Artificial
  CRISPR gRNA sequence
atttttctctaagctattag

SEQ ID NO: 225218 - DNA, 20 bp, Artificial
  CRISPR gRNA sequence
tttttctctaagctattaga

SEQ ID NO: 225219 - DNA, 20 bp, Artificial
  CRISPR gRNA sequence
ttctctaagctattagagtt

SEQ ID NO: 225220 - DNA, 20 bp, Artificial
  CRISPR gRNA sequence
tctctaagctattagagttt

SEQ ID NO: 225221 - DNA, 20 bp, Artificial
  CRISPR gRNA sequence
ctctaagctattagagtttt

SEQ ID NO: 225222 - DNA, 20 bp, Artificial
  CRISPR gRNA sequence
tctaagctattagagttttg

SEQ ID NO: 225223 - DNA, 20 bp, Artificial
  CRISPR gRNA sequence
taagctattagagttttgtt

SEQ ID NO: 225224 - DNA, 20 bp, Artificial
  CRISPR gRNA sequence
agctattagagttttgttta

SEQ ID NO: 225225 - DNA, 20 bp, Artificial
  CRISPR gRNA sequence
ttagagttttgtttagaaag

SEQ ID NO: 225226 - DNA, 20 bp, Artificial
  CRISPR gRNA sequence
gagttttgtttagaaaggtc

SEQ ID NO: 225227 - DNA, 20 bp, Artificial
  CRISPR gRNA sequence
tgtttagaaaggtcagttca

SEQ ID NO: 225228 - DNA, 20 bp, Artificial
  CRISPR gRNA sequence
gtttagaaaggtcagttcaa

SEQ ID NO: 225229 - DNA, 20 bp, Artificial
  CRISPR gRNA sequence
tttagaaaggtcagttcaag

SEQ ID NO: 225230 - DNA, 20 bp, Artificial
  CRISPR gRNA sequence
agaaaggtcagttcaagttc

SEQ ID NO: 225231 - DNA, 20 bp, Artificial
  CRISPR gRNA sequence
gaaaggtcagttcaagttcc

SEQ ID NO: 225232 - DNA, 20 bp, Artificial
  CRISPR gRNA sequence
aagttccgcagtgttgccaa

SEQ ID NO: 225233 - DNA, 20 bp, Artificial
  CRISPR gRNA sequence
cgcagtgttgccaattccat

SEQ ID NO: 225234 - DNA, 20 bp, Artificial
  CRISPR gRNA sequence
ccaattccattattatcaac

SEQ ID NO: 225235 - DNA, 20 bp, Artificial
  CRISPR gRNA sequence
cattattatcaacaggacat

SEQ ID NO: 225236 - DNA, 20 bp, Artificial
  CRISPR gRNA sequence
ttatcaacaggacatatggt

SEQ ID NO: 225237 - DNA, 20 bp, Artificial
  CRISPR gRNA sequence
tcaacaggacatatggtctg

SEQ ID NO: 225238 - DNA, 20 bp, Artificial
  CRISPR gRNA sequence
tttataatgaagacatgaag

SEQ ID NO: 225239 - DNA, 20 bp, Artificial
  CRISPR gRNA sequence
ataatgaagacatgaaggca

SEQ ID NO: 225240 - DNA, 20 bp, Artificial
  CRISPR gRNA sequence
taatgaagacatgaaggcat

SEQ ID NO: 225241 - DNA, 20 bp, Artificial
  CRISPR gRNA sequence
caagatctttgtattagttt

SEQ ID NO: 225242 - DNA, 20 bp, Artificial
  CRISPR gRNA sequence
tgtattagttttctagtgct

SEQ ID NO: 225243 - DNA, 20 bp, Artificial
  CRISPR gRNA sequence
gtattagttttctagtgctg

SEQ ID NO: 225244 - DNA, 20 bp, Artificial
  CRISPR gRNA sequence
tattagttttctagtgctgc

SEQ ID NO: 225245 - DNA, 20 bp, Artificial
  CRISPR gRNA sequence
gttttctagtgctgcataac

SEQ ID NO: 225246 - DNA, 20 bp, Artificial
  CRISPR gRNA sequence
tctagtgctgcataacaact

SEQ ID NO: 225247 - DNA, 20 bp, Artificial
  CRISPR gRNA sequence
ctagtgctgcataacaacta

SEQ ID NO: 225248 - DNA, 20 bp, Artificial
  CRISPR gRNA sequence
tagtgctgcataacaactac

SEQ ID NO: 225249 - DNA, 20 bp, Artificial
  CRISPR gRNA sequence
gtgctgcataacaactacaa

SEQ ID NO: 225250 - DNA, 20 bp, Artificial
  CRISPR gRNA sequence
cataacaactacaaatatag

SEQ ID NO: 225251 - DNA, 20 bp, Artificial
  CRISPR gRNA sequence
caaatatagcagcttaaaac

SEQ ID NO: 225252 - DNA, 20 bp, Artificial
  CRISPR gRNA sequence
aaaacactacccatttttta

SEQ ID NO: 225253 - DNA, 20 bp, Artificial
  CRISPR gRNA sequence
aaacactacccattttttag

SEQ ID NO: 225254 - DNA, 20 bp, Artificial
  CRISPR gRNA sequence
cccattttttagctcaaagt

SEQ ID NO: 225255 - DNA, 20 bp, Artificial
  CRISPR gRNA sequence
tttagctcaaagttttgtag

SEQ ID NO: 225256 - DNA, 20 bp, Artificial
  CRISPR gRNA sequence
ttagctcaaagttttgtagg

SEQ ID NO: 225257 - DNA, 20 bp, Artificial
  CRISPR gRNA sequence
tagctcaaagttttgtaggt

SEQ ID NO: 225258 - DNA, 20 bp, Artificial
  CRISPR gRNA sequence
agctcaaagttttgtaggtg

SEQ ID NO: 225259 - DNA, 20 bp, Artificial
  CRISPR gRNA sequence
gctcaaagttttgtaggtgg

SEQ ID NO: 225260 - DNA, 20 bp, Artificial
  CRISPR gRNA sequence
aaagttttgtaggtggcaag

SEQ ID NO: 225261 - DNA, 20 bp, Artificial
  CRISPR gRNA sequence
tgtaggtggcaagcctggtc

SEQ ID NO: 225262 - DNA, 20 bp, Artificial
  CRISPR gRNA sequence
gtaggtggcaagcctggtca

SEQ ID NO: 225263 - DNA, 20 bp, Artificial
  CRISPR gRNA sequence
taggtggcaagcctggtcat

SEQ ID NO: 225264 - DNA, 20 bp, Artificial
  CRISPR gRNA sequence
gtcatggcatgactgggttc

SEQ ID NO: 225265 - DNA, 20 bp, Artificial
  CRISPR gRNA sequence
ggttctctgatcaaagtctt

SEQ ID NO: 225266 - DNA, 20 bp, Artificial
  CRISPR gRNA sequence
tctgatcaaagtcttaaaag

SEQ ID NO: 225267 - DNA, 20 bp, Artificial
  CRISPR gRNA sequence
tgatcaaagtcttaaaagac

SEQ ID NO: 225268 - DNA, 20 bp, Artificial
  CRISPR gRNA sequence
atcaaagtcttaaaagacta

SEQ ID NO: 225269 - DNA, 20 bp, Artificial
  CRISPR gRNA sequence
aaaagactaaaatcaaggtg

SEQ ID NO: 225270 - DNA, 20 bp, Artificial
  CRISPR gRNA sequence
aaagactaaaatcaaggtgt

SEQ ID NO: 225271 - DNA, 20 bp, Artificial
  CRISPR gRNA sequence
aaatcaaggtgttgcccagg

SEQ ID NO: 225272 - DNA, 20 bp, Artificial
  CRISPR gRNA sequence
cccagggcatactttatttg

SEQ ID NO: 225273 - DNA, 20 bp, Artificial
  CRISPR gRNA sequence
tatttggagtttggggtctt

SEQ ID NO: 225274 - DNA, 20 bp, Artificial
  CRISPR gRNA sequence
atttggagtttggggtcttg

SEQ ID NO: 225275 - DNA, 20 bp, Artificial
  CRISPR gRNA sequence
tttggagtttggggtcttgt

SEQ ID NO: 225276 - DNA, 20 bp, Artificial
  CRISPR gRNA sequence
ggagtttggggtcttgttct

SEQ ID NO: 225277 - DNA, 20 bp, Artificial
  CRISPR gRNA sequence
gagtttggggtcttgttcta

SEQ ID NO: 225278 - DNA, 20 bp, Artificial
  CRISPR gRNA sequence
ggggtcttgttctaggctca

SEQ ID NO: 225279 - DNA, 20 bp, Artificial
  CRISPR gRNA sequence
gggtcttgttctaggctcac

SEQ ID NO: 225280 - DNA, 20 bp, Artificial
  CRISPR gRNA sequence
gttctaggctcacataattg

SEQ ID NO: 225281 - DNA, 20 bp, Artificial
  CRISPR gRNA sequence
ttctaggctcacataattgt

SEQ ID NO: 225282 - DNA, 20 bp, Artificial
  CRISPR gRNA sequence
taggctcacataattgtgac

SEQ ID NO: 225283 - DNA, 20 bp, Artificial
  CRISPR gRNA sequence
ggctcacataattgtgacag

SEQ ID NO: 225284 - DNA, 20 bp, Artificial
  CRISPR gRNA sequence
acataattgtgacagaattc

SEQ ID NO: 225285 - DNA, 20 bp, Artificial
  CRISPR gRNA sequence
tgacagaattcaattccttg

SEQ ID NO: 225286 - DNA, 20 bp, Artificial
  CRISPR gRNA sequence
aattccttgtgattgtaaga

SEQ ID NO: 225287 - DNA, 20 bp, Artificial
  CRISPR gRNA sequence
cttgtgattgtaagactggg

SEQ ID NO: 225288 - DNA, 20 bp, Artificial
  CRISPR gRNA sequence
gtgattgtaagactggggtc

SEQ ID NO: 225289 - DNA, 20 bp, Artificial
  CRISPR gRNA sequence
tgattgtaagactggggtcc

SEQ ID NO: 225290 - DNA, 20 bp, Artificial
  CRISPR gRNA sequence
taagactggggtccctgttt

SEQ ID NO: 225291 - DNA, 20 bp, Artificial
  CRISPR gRNA sequence
gggtccctgtttctttgcta

SEQ ID NO: 225292 - DNA, 20 bp, Artificial
  CRISPR gRNA sequence
tttctttgctaagtatctgc

SEQ ID NO: 225293 - DNA, 20 bp, Artificial
  CRISPR gRNA sequence
ctttgctaagtatctgccaa

SEQ ID NO: 225294 - DNA, 20 bp, Artificial
  CRISPR gRNA sequence
tttgctaagtatctgccaag

SEQ ID NO: 225295 - DNA, 20 bp, Artificial
  CRISPR gRNA sequence
tgctaagtatctgccaagga

SEQ ID NO: 225296 - DNA, 20 bp, Artificial
  CRISPR gRNA sequence
gctaagtatctgccaaggaa

SEQ ID NO: 225297 - DNA, 20 bp, Artificial
  CRISPR gRNA sequence
ctaagtatctgccaaggaat

SEQ ID NO: 225298 - DNA, 20 bp, Artificial
  CRISPR gRNA sequence
agtatctgccaaggaattgt

SEQ ID NO: 225299 - DNA, 20 bp, Artificial
  CRISPR gRNA sequence
ccaaggaattgtagcagctc

SEQ ID NO: 225300 - DNA, 20 bp, Artificial
  CRISPR gRNA sequence
tagcagctcctagagattgc

SEQ ID NO: 225301 - DNA, 20 bp, Artificial
  CRISPR gRNA sequence
ctagagattgccctcatttc

SEQ ID NO: 225302 - DNA, 20 bp, Artificial
  CRISPR gRNA sequence
gagattgccctcatttcttg

SEQ ID NO: 225303 - DNA, 20 bp, Artificial
  CRISPR gRNA sequence
ccctcatttcttgccccatg

SEQ ID NO: 225304 - DNA, 20 bp, Artificial
  CRISPR gRNA sequence
atttcttgccccatggcccc

SEQ ID NO: 225305 - DNA, 20 bp, Artificial
  CRISPR gRNA sequence
cttgccccatggccccttgc

SEQ ID NO: 225306 - DNA, 20 bp, Artificial
  CRISPR gRNA sequence
ttgccccatggccccttgca

SEQ ID NO: 225307 - DNA, 20 bp, Artificial
  CRISPR gRNA sequence
gccccatggccccttgcata

SEQ ID NO: 225308 - DNA, 20 bp, Artificial
  CRISPR gRNA sequence
ccccatggccccttgcatat

SEQ ID NO: 225309 - DNA, 20 bp, Artificial
  CRISPR gRNA sequence
gcatatttaaagccagcaaa

SEQ ID NO: 225310 - DNA, 20 bp, Artificial
  CRISPR gRNA sequence
catatttaaagccagcaaag

SEQ ID NO: 225311 - DNA, 20 bp, Artificial
  CRISPR gRNA sequence
aaagccagcaaaggagaatc

SEQ ID NO: 225312 - DNA, 20 bp, Artificial
  CRISPR gRNA sequence
aagccagcaaaggagaatct

SEQ ID NO: 225313 - DNA, 20 bp, Artificial
  CRISPR gRNA sequence
cctcttgttgaatccctctc

SEQ ID NO: 225314 - DNA, 20 bp, Artificial
  CRISPR gRNA sequence
ctcttgttgaatccctctca

SEQ ID NO: 225315 - DNA, 20 bp, Artificial
  CRISPR gRNA sequence
ttgttgaatccctctcacat

SEQ ID NO: 225316 - DNA, 20 bp, Artificial
  CRISPR gRNA sequence
gttgaatccctctcacatat

SEQ ID NO: 225317 - DNA, 20 bp, Artificial
  CRISPR gRNA sequence
ttgaatccctctcacatatt

SEQ ID NO: 225318 - DNA, 20 bp, Artificial
  CRISPR gRNA sequence
aatccctctcacatattgag

SEQ ID NO: 225319 - DNA, 20 bp, Artificial
  CRISPR gRNA sequence
tcacatattgagtttatttt

SEQ ID NO: 225320 - DNA, 20 bp, Artificial
  CRISPR gRNA sequence
acatattgagtttattttgc

SEQ ID NO: 225321 - DNA, 20 bp, Artificial
  CRISPR gRNA sequence
agtttattttgccaggaaga

SEQ ID NO: 225322 - DNA, 20 bp, Artificial
  CRISPR gRNA sequence
attttgccaggaagaaccca

SEQ ID NO: 225323 - DNA, 20 bp, Artificial
  CRISPR gRNA sequence
ttttgccaggaagaacccag

SEQ ID NO: 225324 - DNA, 20 bp, Artificial
  CRISPR gRNA sequence
tgccaggaagaacccagacc

SEQ ID NO: 225325 - DNA, 20 bp, Artificial
  CRISPR gRNA sequence
gccaggaagaacccagaccc

SEQ ID NO: 225326 - DNA, 20 bp, Artificial
  CRISPR gRNA sequence
ccaggaagaacccagaccct

SEQ ID NO: 225327 - DNA, 20 bp, Artificial
  CRISPR gRNA sequence
ttaagagaccacttggttag

SEQ ID NO: 225328 - DNA, 20 bp, Artificial
  CRISPR gRNA sequence
taagagaccacttggttagg

SEQ ID NO: 225329 - DNA, 20 bp, Artificial
  CRISPR gRNA sequence
aagagaccacttggttaggt

SEQ ID NO: 225330 - DNA, 20 bp, Artificial
  CRISPR gRNA sequence
agagaccacttggttaggtc

SEQ ID NO: 225331 - DNA, 20 bp, Artificial
  CRISPR gRNA sequence
ggttaggtcagctctctctc

SEQ ID NO: 225332 - DNA, 20 bp, Artificial
  CRISPR gRNA sequence
gttaggtcagctctctctcc

SEQ ID NO: 225333 - DNA, 20 bp, Artificial
  CRISPR gRNA sequence
ggtcagctctctctccctca

SEQ ID NO: 225334 - DNA, 20 bp, Artificial
  CRISPR gRNA sequence
tctctccctcaaaaataatc

SEQ ID NO: 225335 - DNA, 20 bp, Artificial
  CRISPR gRNA sequence
tctccctcaaaaataatctc

SEQ ID NO: 225336 - DNA, 20 bp, Artificial
  CRISPR gRNA sequence
tccctcaaaaataatctctc

SEQ ID NO: 225337 - DNA, 20 bp, Artificial
  CRISPR gRNA sequence
cctcaaaaataatctctctt

SEQ ID NO: 225338 - DNA, 20 bp, Artificial
  CRISPR gRNA sequence
aaaaataatctctctttctt

SEQ ID NO: 225339 - DNA, 20 bp, Artificial
  CRISPR gRNA sequence
tctttcttaaagtcagctga

SEQ ID NO: 225340 - DNA, 20 bp, Artificial
  CRISPR gRNA sequence
tttcttaaagtcagctgatt

SEQ ID NO: 225341 - DNA, 20 bp, Artificial
  CRISPR gRNA sequence
tcttaaagtcagctgatttg

SEQ ID NO: 225342 - DNA, 20 bp, Artificial
  CRISPR gRNA sequence
cttaaagtcagctgatttgg

SEQ ID NO: 225343 - DNA, 20 bp, Artificial
  CRISPR gRNA sequence
ttaaagtcagctgatttggg

SEQ ID NO: 225344 - DNA, 20 bp, Artificial
  CRISPR gRNA sequence
aaagtcagctgatttgggat

SEQ ID NO: 225345 - DNA, 20 bp, Artificial
  CRISPR gRNA sequence
aagtcagctgatttgggatc

SEQ ID NO: 225346 - DNA, 20 bp, Artificial
  CRISPR gRNA sequence
atttgggatcttaattacat

SEQ ID NO: 225347 - DNA, 20 bp, Artificial
  CRISPR gRNA sequence
gggatcttaattacatcagc

SEQ ID NO: 225348 - DNA, 20 bp, Artificial
  CRISPR gRNA sequence
ggatcttaattacatcagca

SEQ ID NO: 225349 - DNA, 20 bp, Artificial
  CRISPR gRNA sequence
aattacatcagcaaactccc

SEQ ID NO: 225350 - DNA, 20 bp, Artificial
  CRISPR gRNA sequence
attacatcagcaaactccct

SEQ ID NO: 225351 - DNA, 20 bp, Artificial
  CRISPR gRNA sequence
catcagcaaactcccttttg

SEQ ID NO: 225352 - DNA, 20 bp, Artificial
  CRISPR gRNA sequence
ccttttgctgggtgatataa

SEQ ID NO: 225353 - DNA, 20 bp, Artificial
  CRISPR gRNA sequence
ttgctgggtgatataatcat

SEQ ID NO: 225354 - DNA, 20 bp, Artificial
  CRISPR gRNA sequence
tgctgggtgatataatcatg

SEQ ID NO: 225355 - DNA, 20 bp, Artificial
  CRISPR gRNA sequence
gctgggtgatataatcatga

SEQ ID NO: 225356 - DNA, 20 bp, Artificial
  CRISPR gRNA sequence
ctgggtgatataatcatgaa

SEQ ID NO: 225357 - DNA, 20 bp, Artificial
  CRISPR gRNA sequence
ggtgatataatcatgaaaat

SEQ ID NO: 225358 - DNA, 20 bp, Artificial
  CRISPR gRNA sequence
acagtcctagtctcccacac

SEQ ID NO: 225359 - DNA, 20 bp, Artificial
  CRISPR gRNA sequence
gtctcccacacacaagggga

SEQ ID NO: 225360 - DNA, 20 bp, Artificial
  CRISPR gRNA sequence
ccacacacaaggggagggaa

SEQ ID NO: 225361 - DNA, 20 bp, Artificial
  CRISPR gRNA sequence
taaaagatgcatggctaggg

SEQ ID NO: 225362 - DNA, 20 bp, Artificial
  CRISPR gRNA sequence
gggcaggggttttgggacca

SEQ ID NO: 225363 - DNA, 20 bp, Artificial
  CRISPR gRNA sequence
tgggaccaccttagaattct

SEQ ID NO: 225364 - DNA, 20 bp, Artificial
  CRISPR gRNA sequence
gggaccaccttagaattctg

SEQ ID NO: 225365 - DNA, 20 bp, Artificial
  CRISPR gRNA sequence
ggaccaccttagaattctgg

SEQ ID NO: 225366 - DNA, 20 bp, Artificial
  CRISPR gRNA sequence
agaattctgggtttgattaa

SEQ ID NO: 225367 - DNA, 20 bp, Artificial
  CRISPR gRNA sequence
gaattctgggtttgattaaa

SEQ ID NO: 225368 - DNA, 20 bp, Artificial
  CRISPR gRNA sequence
tgggtttgattaaataaata

SEQ ID NO: 225369 - DNA, 20 bp, Artificial
  CRISPR gRNA sequence
ggtttgattaaataaataat

SEQ ID NO: 225370 - DNA, 20 bp, Artificial
  CRISPR gRNA sequence
gattaaataaataatgggac

SEQ ID NO: 225371 - DNA, 20 bp, Artificial
  CRISPR gRNA sequence
attaaataaataatgggact

SEQ ID NO: 225372 - DNA, 20 bp, Artificial
  CRISPR gRNA sequence
aataaataatgggactgtag

SEQ ID NO: 225373 - DNA, 20 bp, Artificial
  CRISPR gRNA sequence
tagcctagcaagtcgacaca

SEQ ID NO: 225374 - DNA, 20 bp, Artificial
  CRISPR gRNA sequence
gcaagtcgacacatcagaaa

SEQ ID NO: 225375 - DNA, 20 bp, Artificial
  CRISPR gRNA sequence
aaacatcaagtaaaaatttg

SEQ ID NO: 225376 - DNA, 20 bp, Artificial
  CRISPR gRNA sequence
ggtttgcattttaggattgt

SEQ ID NO: 225377 - DNA, 20 bp, Artificial
  CRISPR gRNA sequence
gtttgcattttaggattgta

SEQ ID NO: 225378 - DNA, 20 bp, Artificial
  CRISPR gRNA sequence
gcattttaggattgtaaatg

SEQ ID NO: 225379 - DNA, 20 bp, Artificial
  CRISPR gRNA sequence
cattttaggattgtaaatgt

SEQ ID NO: 225380 - DNA, 20 bp, Artificial
  CRISPR gRNA sequence
taggattgtaaatgttactg

SEQ ID NO: 225381 - DNA, 20 bp, Artificial
  CRISPR gRNA sequence
aggattgtaaatgttactgt

SEQ ID NO: 225382 - DNA, 20 bp, Artificial
  CRISPR gRNA sequence
ggattgtaaatgttactgtg

SEQ ID NO: 225383 - DNA, 20 bp, Artificial
  CRISPR gRNA sequence
taaatgttactgtggtgtat

SEQ ID NO: 225384 - DNA, 20 bp, Artificial
  CRISPR gRNA sequence
ctgtggtgtatgcgtgtgtg

SEQ ID NO: 225385 - DNA, 20 bp, Artificial
  CRISPR gRNA sequence
tggtgtatgcgtgtgtgtgt

SEQ ID NO: 225386 - DNA, 20 bp, Artificial
  CRISPR gRNA sequence
gtgttccctatgtttgtggg

SEQ ID NO: 225387 - DNA, 20 bp, Artificial
  CRISPR gRNA sequence
cctatgtttgtgggagtttg

SEQ ID NO: 225388 - DNA, 20 bp, Artificial
  CRISPR gRNA sequence
tgtttgtgggagtttgaagg

SEQ ID NO: 225389 - DNA, 20 bp, Artificial
  CRISPR gRNA sequence
gtgggagtttgaaggagaca

SEQ ID NO: 225390 - DNA, 20 bp, Artificial
  CRISPR gRNA sequence
tgggagtttgaaggagacac

SEQ ID NO: 225391 - DNA, 20 bp, Artificial
  CRISPR gRNA sequence
gaaggagacactttgttgat

SEQ ID NO: 225392 - DNA, 20 bp, Artificial
  CRISPR gRNA sequence
aaggagacactttgttgata

SEQ ID NO: 225393 - DNA, 20 bp, Artificial
  CRISPR gRNA sequence
tgttgataggaatggtgtct

SEQ ID NO: 225394 - DNA, 20 bp, Artificial
  CRISPR gRNA sequence
gttgataggaatggtgtctt

SEQ ID NO: 225395 - DNA, 20 bp, Artificial
  CRISPR gRNA sequence
ttgataggaatggtgtcttc

SEQ ID NO: 225396 - DNA, 20 bp, Artificial
  CRISPR gRNA sequence
ataggaatggtgtcttcact

SEQ ID NO: 225397 - DNA, 20 bp, Artificial
  CRISPR gRNA sequence
cacttttttaggttgtctca

SEQ ID NO: 225398 - DNA, 20 bp, Artificial
  CRISPR gRNA sequence
acttttttaggttgtctcat

SEQ ID NO: 225399 - DNA, 20 bp, Artificial
  CRISPR gRNA sequence
ttttaggttgtctcattttt

SEQ ID NO: 225400 - DNA, 20 bp, Artificial
  CRISPR gRNA sequence
tttaggttgtctcatttttg

SEQ ID NO: 225401 - DNA, 20 bp, Artificial
  CRISPR gRNA sequence
ttaggttgtctcatttttgt

SEQ ID NO: 225402 - DNA, 20 bp, Artificial
  CRISPR gRNA sequence
taggttgtctcatttttgta

SEQ ID NO: 225403 - DNA, 20 bp, Artificial
  CRISPR gRNA sequence
aggttgtctcatttttgtac

SEQ ID NO: 225404 - DNA, 20 bp, Artificial
  CRISPR gRNA sequence
ggttgtctcatttttgtaca

SEQ ID NO: 225405 - DNA, 20 bp, Artificial
  CRISPR gRNA sequence
tctcatttttgtacagtgat

SEQ ID NO: 225406 - DNA, 20 bp, Artificial
  CRISPR gRNA sequence
atttttgtacagtgataaga

SEQ ID NO: 225407 - DNA, 20 bp, Artificial
  CRISPR gRNA sequence
ttgtacagtgataagacaaa

SEQ ID NO: 225408 - DNA, 20 bp, Artificial
  CRISPR gRNA sequence
tgtacagtgataagacaaat

SEQ ID NO: 225409 - DNA, 20 bp, Artificial
  CRISPR gRNA sequence
gtacagtgataagacaaatg

SEQ ID NO: 225410 - DNA, 20 bp, Artificial
  CRISPR gRNA sequence
tacagtgataagacaaatga

SEQ ID NO: 225411 - DNA, 20 bp, Artificial
  CRISPR gRNA sequence
ggttttaataacacttcagc

SEQ ID NO: 225412 - DNA, 20 bp, Artificial
  CRISPR gRNA sequence
taataacacttcagcttgaa

SEQ ID NO: 225413 - DNA, 20 bp, Artificial
  CRISPR gRNA sequence
aataacacttcagcttgaaa

SEQ ID NO: 225414 - DNA, 20 bp, Artificial
  CRISPR gRNA sequence
ataacacttcagcttgaaag

SEQ ID NO: 225415 - DNA, 20 bp, Artificial
  CRISPR gRNA sequence
cagcttgaaagcaaaaatta

SEQ ID NO: 225416 - DNA, 20 bp, Artificial
  CRISPR gRNA sequence
agcttgaaagcaaaaattaa

SEQ ID NO: 225417 - DNA, 20 bp, Artificial
  CRISPR gRNA sequence
gaaagcaaaaattaaacact

SEQ ID NO: 225418 - DNA, 20 bp, Artificial
  CRISPR gRNA sequence
aaagcaaaaattaaacactt

SEQ ID NO: 225419 - DNA, 20 bp, Artificial
  CRISPR gRNA sequence
aacacttattcattgactac

SEQ ID NO: 225420 - DNA, 20 bp, Artificial
  CRISPR gRNA sequence
attcattgactacacccttg

SEQ ID NO: 225421 - DNA, 20 bp, Artificial
  CRISPR gRNA sequence
ttcattgactacacccttgt

SEQ ID NO: 225422 - DNA, 20 bp, Artificial
  CRISPR gRNA sequence
attgactacacccttgtaat

SEQ ID NO: 225423 - DNA, 20 bp, Artificial
  CRISPR gRNA sequence
actacacccttgtaatatca

SEQ ID NO: 225424 - DNA, 20 bp, Artificial
  CRISPR gRNA sequence
cacccttgtaatatcacttc

SEQ ID NO: 225425 - DNA, 20 bp, Artificial
  CRISPR gRNA sequence
gtaatatcacttctttgcct

SEQ ID NO: 225426 - DNA, 20 bp, Artificial
  CRISPR gRNA sequence
taatatcacttctttgcctt

SEQ ID NO: 225427 - DNA, 20 bp, Artificial
  CRISPR gRNA sequence
ctttgcctttccactagcaa

SEQ ID NO: 225428 - DNA, 20 bp, Artificial
  CRISPR gRNA sequence
tttgcctttccactagcaag

SEQ ID NO: 225429 - DNA, 20 bp, Artificial
  CRISPR gRNA sequence
tgcctttccactagcaagaa

SEQ ID NO: 225430 - DNA, 20 bp, Artificial
  CRISPR gRNA sequence
gcctttccactagcaagaag

SEQ ID NO: 225431 - DNA, 20 bp, Artificial
  CRISPR gRNA sequence
cctttccactagcaagaagt

SEQ ID NO: 225432 - DNA, 20 bp, Artificial
  CRISPR gRNA sequence
tccactagcaagaagttcat

SEQ ID NO: 225433 - DNA, 20 bp, Artificial
  CRISPR gRNA sequence
ccactagcaagaagttcatt

SEQ ID NO: 225434 - DNA, 20 bp, Artificial
  CRISPR gRNA sequence
cactagcaagaagttcattt

SEQ ID NO: 225435 - DNA, 20 bp, Artificial
  CRISPR gRNA sequence
gcaagaagttcattttcgtg

SEQ ID NO: 225436 - DNA, 20 bp, Artificial
  CRISPR gRNA sequence
attttcgtggaagccattct

SEQ ID NO: 225437 - DNA, 20 bp, Artificial
  CRISPR gRNA sequence
tcgtggaagccattctgcct

SEQ ID NO: 225438 - DNA, 20 bp, Artificial
  CRISPR gRNA sequence
cgtggaagccattctgcctg

SEQ ID NO: 225439 - DNA, 20 bp, Artificial
  CRISPR gRNA sequence
gtggaagccattctgcctgt

SEQ ID NO: 225440 - DNA, 20 bp, Artificial
  CRISPR gRNA sequence
tgcctgtccaggaattggag

SEQ ID NO: 225441 - DNA, 20 bp, Artificial
  CRISPR gRNA sequence
cctgtccaggaattggagga

SEQ ID NO: 225442 - DNA, 20 bp, Artificial
  CRISPR gRNA sequence
tccaggaattggaggagagt

SEQ ID NO: 225443 - DNA, 20 bp, Artificial
  CRISPR gRNA sequence
gaggagagtgatagacacag

SEQ ID NO: 225444 - DNA, 20 bp, Artificial
  CRISPR gRNA sequence
tcagccatagcttgggtaga

SEQ ID NO: 225445 - DNA, 20 bp, Artificial
  CRISPR gRNA sequence
gggtagaataaggatgtgaa

SEQ ID NO: 225446 - DNA, 20 bp, Artificial
  CRISPR gRNA sequence
ggtagaataaggatgtgaat

SEQ ID NO: 225447 - DNA, 20 bp, Artificial
  CRISPR gRNA sequence
ggcttatctttattaatctt

SEQ ID NO: 225448 - DNA, 20 bp, Artificial
  CRISPR gRNA sequence
gcttatctttattaatcttg

SEQ ID NO: 225449 - DNA, 20 bp, Artificial
  CRISPR gRNA sequence
atctttattaatcttgtgat

SEQ ID NO: 225450 - DNA, 20 bp, Artificial
  CRISPR gRNA sequence
tctttattaatcttgtgatg

SEQ ID NO: 225451 - DNA, 20 bp, Artificial
  CRISPR gRNA sequence
tattaatcttgtgatggaaa

SEQ ID NO: 225452 - DNA, 20 bp, Artificial
  CRISPR gRNA sequence
attaatcttgtgatggaaaa

SEQ ID NO: 225453 - DNA, 20 bp, Artificial
  CRISPR gRNA sequence
ttaatcttgtgatggaaaaa

SEQ ID NO: 225454 - DNA, 20 bp, Artificial
  CRISPR gRNA sequence
atcttgtgatggaaaaatat

SEQ ID NO: 225455 - DNA, 20 bp, Artificial
  CRISPR gRNA sequence
gtgatggaaaaatatctgac

SEQ ID NO: 225456 - DNA, 20 bp, Artificial
  CRISPR gRNA sequence
tgatggaaaaatatctgaca

SEQ ID NO: 225457 - DNA, 20 bp, Artificial
  CRISPR gRNA sequence
acattgttcttagtccattt

SEQ ID NO: 225458 - DNA, 20 bp, Artificial
  CRISPR gRNA sequence
ttcttagtccattttaagct

SEQ ID NO: 225459 - DNA, 20 bp, Artificial
  CRISPR gRNA sequence
ttagtccattttaagcttaa

SEQ ID NO: 225460 - DNA, 20 bp, Artificial
  CRISPR gRNA sequence
agtccattttaagcttaatt

SEQ ID NO: 225461 - DNA, 20 bp, Artificial
  CRISPR gRNA sequence
gtccattttaagcttaattt

SEQ ID NO: 225462 - DNA, 20 bp, Artificial
  CRISPR gRNA sequence
taagcttaatttatgttctt

SEQ ID NO: 225463 - DNA, 20 bp, Artificial
  CRISPR gRNA sequence
aagcttaatttatgttctta

SEQ ID NO: 225464 - DNA, 20 bp, Artificial
  CRISPR gRNA sequence
agcttaatttatgttcttag

SEQ ID NO: 225465 - DNA, 20 bp, Artificial
  CRISPR gRNA sequence
aatttatgttcttagtggca

SEQ ID NO: 225466 - DNA, 20 bp, Artificial
  CRISPR gRNA sequence
atttatgttcttagtggcat

SEQ ID NO: 225467 - DNA, 20 bp, Artificial
  CRISPR gRNA sequence
atgttcttagtggcatagaa

SEQ ID NO: 225468 - DNA, 20 bp, Artificial
  CRISPR gRNA sequence
tgttcttagtggcatagaaa

SEQ ID NO: 225469 - DNA, 20 bp, Artificial
  CRISPR gRNA sequence
ttagtggcatagaaattcag

SEQ ID NO: 225470 - DNA, 20 bp, Artificial
  CRISPR gRNA sequence
agtggcatagaaattcagag

SEQ ID NO: 225471 - DNA, 20 bp, Artificial
  CRISPR gRNA sequence
gtggcatagaaattcagagc

SEQ ID NO: 225472 - DNA, 20 bp, Artificial
  CRISPR gRNA sequence
agagctgaaagaagtatcat

SEQ ID NO: 225473 - DNA, 20 bp, Artificial
  CRISPR gRNA sequence
aaagaagtatcatgtctcac

SEQ ID NO: 225474 - DNA, 20 bp, Artificial
  CRISPR gRNA sequence
actctccccttgaggaacaa

SEQ ID NO: 225475 - DNA, 20 bp, Artificial
  CRISPR gRNA sequence
tccccttgaggaacaagagt

SEQ ID NO: 225476 - DNA, 20 bp, Artificial
  CRISPR gRNA sequence
cccttgaggaacaagagtta

SEQ ID NO: 225477 - DNA, 20 bp, Artificial
  CRISPR gRNA sequence
gaggaacaagagttaacgtc

SEQ ID NO: 225478 - DNA, 20 bp, Artificial
  CRISPR gRNA sequence
aggaacaagagttaacgtca

SEQ ID NO: 225479 - DNA, 20 bp, Artificial
  CRISPR gRNA sequence
acgtcatctgacagtactac

SEQ ID NO: 225480 - DNA, 20 bp, Artificial
  CRISPR gRNA sequence
acagtactaccataacaaat

SEQ ID NO: 225481 - DNA, 20 bp, Artificial
  CRISPR gRNA sequence
ccataacaaatcaatagctt

SEQ ID NO: 225482 - DNA, 20 bp, Artificial
  CRISPR gRNA sequence
aataggcatataagtggctt

SEQ ID NO: 225483 - DNA, 20 bp, Artificial
  CRISPR gRNA sequence
ataggcatataagtggcttt

SEQ ID NO: 225484 - DNA, 20 bp, Artificial
  CRISPR gRNA sequence
tatataaaatgttggttttt

SEQ ID NO: 225485 - DNA, 20 bp, Artificial
  CRISPR gRNA sequence
atataaaatgttggtttttt

SEQ ID NO: 225486 - DNA, 20 bp, Artificial
  CRISPR gRNA sequence
tataaaatgttggttttttt

SEQ ID NO: 225487 - DNA, 20 bp, Artificial
  CRISPR gRNA sequence
gtttttttcccccagcatct

SEQ ID NO: 225488 - DNA, 20 bp, Artificial
  CRISPR gRNA sequence
ttttcccccagcatctcagt

SEQ ID NO: 225489 - DNA, 20 bp, Artificial
  CRISPR gRNA sequence
tttcccccagcatctcagtt

SEQ ID NO: 225490 - DNA, 20 bp, Artificial
  CRISPR gRNA sequence
ttcccccagcatctcagttg

SEQ ID NO: 225491 - DNA, 20 bp, Artificial
  CRISPR gRNA sequence
tcccccagcatctcagttgg

SEQ ID NO: 225492 - DNA, 20 bp, Artificial
  CRISPR gRNA sequence
cccccagcatctcagttggt

SEQ ID NO: 225493 - DNA, 20 bp, Artificial
  CRISPR gRNA sequence
ccccagcatctcagttggtt

SEQ ID NO: 225494 - DNA, 20 bp, Artificial
  CRISPR gRNA sequence
agttggttcttaaatatcta

SEQ ID NO: 225495 - DNA, 20 bp, Artificial
  CRISPR gRNA sequence
gttcttaaatatctaattcc

SEQ ID NO: 225496 - DNA, 20 bp, Artificial
  CRISPR gRNA sequence
ttaaatatctaattccatga

SEQ ID NO: 225497 - DNA, 20 bp, Artificial
  CRISPR gRNA sequence
aaatatctaattccatgatc

SEQ ID NO: 225498 - DNA, 20 bp, Artificial
  CRISPR gRNA sequence
aatatctaattccatgatcc

SEQ ID NO: 225499 - DNA, 20 bp, Artificial
  CRISPR gRNA sequence
attccatgatcctcaaactt

SEQ ID NO: 225500 - DNA, 20 bp, Artificial
  CRISPR gRNA sequence
catgatcctcaaacttttcc

SEQ ID NO: 225501 - DNA, 20 bp, Artificial
  CRISPR gRNA sequence
aaacttttcccactgtaaca

SEQ ID NO: 225502 - DNA, 20 bp, Artificial
  CRISPR gRNA sequence
ttcccactgtaacaaattag

SEQ ID NO: 225503 - DNA, 20 bp, Artificial
  CRISPR gRNA sequence
tcccactgtaacaaattaga

SEQ ID NO: 225504 - DNA, 20 bp, Artificial
  CRISPR gRNA sequence
cccactgtaacaaattagag

SEQ ID NO: 225505 - DNA, 20 bp, Artificial
  CRISPR gRNA sequence
ccactgtaacaaattagaga

SEQ ID NO: 225506 - DNA, 20 bp, Artificial
  CRISPR gRNA sequence
taacaaattagagagaggag

SEQ ID NO: 225507 - DNA, 20 bp, Artificial
  CRISPR gRNA sequence
gagagaggaggaacatgttc

SEQ ID NO: 225508 - DNA, 20 bp, Artificial
  CRISPR gRNA sequence
atcagtgactgtagttcaaa

SEQ ID NO: 225509 - DNA, 20 bp, Artificial
  CRISPR gRNA sequence
tagttcaaatacagcagaaa

SEQ ID NO: 225510 - DNA, 20 bp, Artificial
  CRISPR gRNA sequence
aaatacagcagaaatgtgca

SEQ ID NO: 225511 - DNA, 20 bp, Artificial
  CRISPR gRNA sequence
caaactgagagaatcctgga

SEQ ID NO: 225512 - DNA, 20 bp, Artificial
  CRISPR gRNA sequence
aaactgagagaatcctggat

SEQ ID NO: 225513 - DNA, 20 bp, Artificial
  CRISPR gRNA sequence
agagaatcctggatgccctt

SEQ ID NO: 225514 - DNA, 20 bp, Artificial
  CRISPR gRNA sequence
gatgcccttctccattgtgt

SEQ ID NO: 225515 - DNA, 20 bp, Artificial
  CRISPR gRNA sequence
ctccattgtgtgcccccccc

SEQ ID NO: 225516 - DNA, 20 bp, Artificial
  CRISPR gRNA sequence
tccattgtgtgccccccccc

SEQ ID NO: 225517 - DNA, 20 bp, Artificial
  CRISPR gRNA sequence
cattgtgtgccccccccccc

SEQ ID NO: 225518 - DNA, 20 bp, Artificial
  CRISPR gRNA sequence
tgtgccccccccccccaccc

SEQ ID NO: 225519 - DNA, 20 bp, Artificial
  CRISPR gRNA sequence
aaaatcctggcacaataatg

SEQ ID NO: 225520 - DNA, 20 bp, Artificial
  CRISPR gRNA sequence
aaatcctggcacaataatga

SEQ ID NO: 225521 - DNA, 20 bp, Artificial
  CRISPR gRNA sequence
gcacaataatgagaagggag

SEQ ID NO: 225522 - DNA, 20 bp, Artificial
  CRISPR gRNA sequence
ataagttccagttaagaatc

SEQ ID NO: 225523 - DNA, 20 bp, Artificial
  CRISPR gRNA sequence
cagttaagaatcacttagac

SEQ ID NO: 225524 - DNA, 20 bp, Artificial
  CRISPR gRNA sequence
agaatcacttagacaggcca

SEQ ID NO: 225525 - DNA, 20 bp, Artificial
  CRISPR gRNA sequence
agacaggccaggtgtggcag

SEQ ID NO: 225526 - DNA, 20 bp, Artificial
  CRISPR gRNA sequence
gacaggccaggtgtggcagc

SEQ ID NO: 225527 - DNA, 20 bp, Artificial
  CRISPR gRNA sequence
taataccagcactttgggag

SEQ ID NO: 225528 - DNA, 20 bp, Artificial
  CRISPR gRNA sequence
tgggaggctgaggcaggtgg

SEQ ID NO: 225529 - DNA, 20 bp, Artificial
  CRISPR gRNA sequence
gggaggctgaggcaggtgga

SEQ ID NO: 225530 - DNA, 20 bp, Artificial
  CRISPR gRNA sequence
ggaggctgaggcaggtggat

SEQ ID NO: 225531 - DNA, 20 bp, Artificial
  CRISPR gRNA sequence
aggcaggtggatcacctgag

SEQ ID NO: 225532 - DNA, 20 bp, Artificial
  CRISPR gRNA sequence
aggtcaggaatttgagacca

SEQ ID NO: 225533 - DNA, 20 bp, Artificial
  CRISPR gRNA sequence
gagaccagcctggccaacat

SEQ ID NO: 225534 - DNA, 20 bp, Artificial
  CRISPR gRNA sequence
agaccagcctggccaacatg

SEQ ID NO: 225535 - DNA, 20 bp, Artificial
  CRISPR gRNA sequence
gccaacatgataaaaccctg

SEQ ID NO: 225536 - DNA, 20 bp, Artificial
  CRISPR gRNA sequence
tctctaccaaaattacaaaa

SEQ ID NO: 225537 - DNA, 20 bp, Artificial
  CRISPR gRNA sequence
taccaaaattacaaaattta

SEQ ID NO: 225538 - DNA, 20 bp, Artificial
  CRISPR gRNA sequence
ccaaaattacaaaatttagc

SEQ ID NO: 225539 - DNA, 20 bp, Artificial
  CRISPR gRNA sequence
caaaatttagctgggcatgg

SEQ ID NO: 225540 - DNA, 20 bp, Artificial
  CRISPR gRNA sequence
agctgggcatggtggcgcct

SEQ ID NO: 225541 - DNA, 20 bp, Artificial
  CRISPR gRNA sequence
gctgggcatggtggcgcctg

SEQ ID NO: 225542 - DNA, 20 bp, Artificial
  CRISPR gRNA sequence
ggcatggtggcgcctgccta

SEQ ID NO: 225543 - DNA, 20 bp, Artificial
  CRISPR gRNA sequence
cctataatcccagctacttg

SEQ ID NO: 225544 - DNA, 20 bp, Artificial
  CRISPR gRNA sequence
taatcccagctacttgggag

SEQ ID NO: 225545 - DNA, 20 bp, Artificial
  CRISPR gRNA sequence
cttgggaggctgagacagga

SEQ ID NO: 225546 - DNA, 20 bp, Artificial
  CRISPR gRNA sequence
gggaggctgagacaggagaa

SEQ ID NO: 225547 - DNA, 20 bp, Artificial
  CRISPR gRNA sequence
ggaggctgagacaggagaat

SEQ ID NO: 225548 - DNA, 20 bp, Artificial
  CRISPR gRNA sequence
agacaggagaattgcttgaa

SEQ ID NO: 225549 - DNA, 20 bp, Artificial
  CRISPR gRNA sequence
cttgaacccgggaggtggag

SEQ ID NO: 225550 - DNA, 20 bp, Artificial
  CRISPR gRNA sequence
gaacccgggaggtggaggtt

SEQ ID NO: 225551 - DNA, 20 bp, Artificial
  CRISPR gRNA sequence
aacccgggaggtggaggttg

SEQ ID NO: 225552 - DNA, 20 bp, Artificial
  CRISPR gRNA sequence
cagtgagctgagaccacacc

SEQ ID NO: 225553 - DNA, 20 bp, Artificial
  CRISPR gRNA sequence
agaccacaccactgcactcc

SEQ ID NO: 225554 - DNA, 20 bp, Artificial
  CRISPR gRNA sequence
cactccagcctgggcaacag

SEQ ID NO: 225555 - DNA, 20 bp, Artificial
  CRISPR gRNA sequence
cagcctgggcaacagagtga

SEQ ID NO: 225556 - DNA, 20 bp, Artificial
  CRISPR gRNA sequence
ggcaacagagtgagactcca

SEQ ID NO: 225557 - DNA, 20 bp, Artificial
  CRISPR gRNA sequence
catctcaaaaataaaaaaaa

SEQ ID NO: 225558 - DNA, 20 bp, Artificial
  CRISPR gRNA sequence
aaaaataaaaaaaaaagaat

SEQ ID NO: 225559 - DNA, 20 bp, Artificial
  CRISPR gRNA sequence
agacagtattttttgttctg

SEQ ID NO: 225560 - DNA, 20 bp, Artificial
  CRISPR gRNA sequence
gacagtattttttgttctgt

SEQ ID NO: 225561 - DNA, 20 bp, Artificial
  CRISPR gRNA sequence
tttgttctgtaatcttcctc

SEQ ID NO: 225562 - DNA, 20 bp, Artificial
  CRISPR gRNA sequence
ttgttctgtaatcttcctct

SEQ ID NO: 225563 - DNA, 20 bp, Artificial
  CRISPR gRNA sequence
tgttctgtaatcttcctctc

SEQ ID NO: 225564 - DNA, 20 bp, Artificial
  CRISPR gRNA sequence
gttctgtaatcttcctctct

SEQ ID NO: 225565 - DNA, 20 bp, Artificial
  CRISPR gRNA sequence
ttctgtaatcttcctctctg

SEQ ID NO: 225566 - DNA, 20 bp, Artificial
  CRISPR gRNA sequence
tgtaatcttcctctctgtca

SEQ ID NO: 225567 - DNA, 20 bp, Artificial
  CRISPR gRNA sequence
taatcttcctctctgtcatt

SEQ ID NO: 225568 - DNA, 20 bp, Artificial
  CRISPR gRNA sequence
cctctctgtcattgaaatgt

SEQ ID NO: 225569 - DNA, 20 bp, Artificial
  CRISPR gRNA sequence
ctctctgtcattgaaatgtc

SEQ ID NO: 225570 - DNA, 20 bp, Artificial
  CRISPR gRNA sequence
tctgtcattgaaatgtctca

SEQ ID NO: 225571 - DNA, 20 bp, Artificial
  CRISPR gRNA sequence
tgtcattgaaatgtctcata

SEQ ID NO: 225572 - DNA, 20 bp, Artificial
  CRISPR gRNA sequence
tcattgaaatgtctcatatt

SEQ ID NO: 225573 - DNA, 20 bp, Artificial
  CRISPR gRNA sequence
aaatgtctcatatttcttgt

SEQ ID NO: 225574 - DNA, 20 bp, Artificial
  CRISPR gRNA sequence
atatttcttgtttcacatag

SEQ ID NO: 225575 - DNA, 20 bp, Artificial
  CRISPR gRNA sequence
cttgtttcacatagaatctg

SEQ ID NO: 225576 - DNA, 20 bp, Artificial
  CRISPR gRNA sequence
ttgtttcacatagaatctgg

SEQ ID NO: 225577 - DNA, 20 bp, Artificial
  CRISPR gRNA sequence
gtttcacatagaatctggga

SEQ ID NO: 225578 - DNA, 20 bp, Artificial
  CRISPR gRNA sequence
tttcacatagaatctgggag

SEQ ID NO: 225579 - DNA, 20 bp, Artificial
  CRISPR gRNA sequence
cacatagaatctgggagtca

SEQ ID NO: 225580 - DNA, 20 bp, Artificial
  CRISPR gRNA sequence
acatagaatctgggagtcat

SEQ ID NO: 225581 - DNA, 20 bp, Artificial
  CRISPR gRNA sequence
ggagtcatcaagtagtcatc

SEQ ID NO: 225582 - DNA, 20 bp, Artificial
  CRISPR gRNA sequence
gtctatctcatcatctaatt

SEQ ID NO: 225583 - DNA, 20 bp, Artificial
  CRISPR gRNA sequence
tctcatcatctaatttacga

SEQ ID NO: 225584 - DNA, 20 bp, Artificial
  CRISPR gRNA sequence
atcatctaatttacgaatta

SEQ ID NO: 225585 - DNA, 20 bp, Artificial
  CRISPR gRNA sequence
atttacgaattatttctatc

SEQ ID NO: 225586 - DNA, 20 bp, Artificial
  CRISPR gRNA sequence
acgaattatttctatcacac

SEQ ID NO: 225587 - DNA, 20 bp, Artificial
  CRISPR gRNA sequence
cgaattatttctatcacacc

SEQ ID NO: 225588 - DNA, 20 bp, Artificial
  CRISPR gRNA sequence
tttctatcacaccccaagta

SEQ ID NO: 225589 - DNA, 20 bp, Artificial
  CRISPR gRNA sequence
ctatcacaccccaagtagct

SEQ ID NO: 225590 - DNA, 20 bp, Artificial
  CRISPR gRNA sequence
tatcacaccccaagtagctg

SEQ ID NO: 225591 - DNA, 20 bp, Artificial
  CRISPR gRNA sequence
tcacaccccaagtagctggc

SEQ ID NO: 225592 - DNA, 20 bp, Artificial
  CRISPR gRNA sequence
gcgattcagattttttactg

SEQ ID NO: 225593 - DNA, 20 bp, Artificial
  CRISPR gRNA sequence
agattttttactgaaagctt

SEQ ID NO: 225594 - DNA, 20 bp, Artificial
  CRISPR gRNA sequence
tttactgaaagcttgacatg

SEQ ID NO: 225595 - DNA, 20 bp, Artificial
  CRISPR gRNA sequence
ttactgaaagcttgacatga

SEQ ID NO: 225596 - DNA, 20 bp, Artificial
  CRISPR gRNA sequence
tactgaaagcttgacatgat

SEQ ID NO: 225597 - DNA, 20 bp, Artificial
  CRISPR gRNA sequence
actgaaagcttgacatgatg

SEQ ID NO: 225598 - DNA, 20 bp, Artificial
  CRISPR gRNA sequence
ctgaaagcttgacatgatga

SEQ ID NO: 225599 - DNA, 20 bp, Artificial
  CRISPR gRNA sequence
aaagcttgacatgatgagac

SEQ ID NO: 225600 - DNA, 20 bp, Artificial
  CRISPR gRNA sequence
gacatgatgagacattatta

SEQ ID NO: 225601 - DNA, 20 bp, Artificial
  CRISPR gRNA sequence
acatgatgagacattattac

SEQ ID NO: 225602 - DNA, 20 bp, Artificial
  CRISPR gRNA sequence
ttacttcccagaggatcttg

SEQ ID NO: 225603 - DNA, 20 bp, Artificial
  CRISPR gRNA sequence
cttcccagaggatcttggtc

SEQ ID NO: 225604 - DNA, 20 bp, Artificial
  CRISPR gRNA sequence
cccagaggatcttggtctgt

SEQ ID NO: 225605 - DNA, 20 bp, Artificial
  CRISPR gRNA sequence
ccagaggatcttggtctgtt

SEQ ID NO: 225606 - DNA, 20 bp, Artificial
  CRISPR gRNA sequence
ggtctgttatcaggcaattt

SEQ ID NO: 225607 - DNA, 20 bp, Artificial
  CRISPR gRNA sequence
gtctgttatcaggcaatttc

SEQ ID NO: 225608 - DNA, 20 bp, Artificial
  CRISPR gRNA sequence
ttatcaggcaatttcagttc

SEQ ID NO: 225609 - DNA, 20 bp, Artificial
  CRISPR gRNA sequence
tcaggcaatttcagttcttc

SEQ ID NO: 225610 - DNA, 20 bp, Artificial
  CRISPR gRNA sequence
cagttcttccttaaatcaag

SEQ ID NO: 225611 - DNA, 20 bp, Artificial
  CRISPR gRNA sequence
agttcttccttaaatcaagc

SEQ ID NO: 225612 - DNA, 20 bp, Artificial
  CRISPR gRNA sequence
ttccttaaatcaagctaaaa

SEQ ID NO: 225613 - DNA, 20 bp, Artificial
  CRISPR gRNA sequence
ccttaaatcaagctaaaact

SEQ ID NO: 225614 - DNA, 20 bp, Artificial
  CRISPR gRNA sequence
cttaaatcaagctaaaactt

SEQ ID NO: 225615 - DNA, 20 bp, Artificial
  CRISPR gRNA sequence
aaatcaagctaaaacttgct

SEQ ID NO: 225616 - DNA, 20 bp, Artificial
  CRISPR gRNA sequence
aatcaagctaaaacttgcta

SEQ ID NO: 225617 - DNA, 20 bp, Artificial
  CRISPR gRNA sequence
aaacttgctactattctcac

SEQ ID NO: 225618 - DNA, 20 bp, Artificial
  CRISPR gRNA sequence
gctactattctcactcactg

SEQ ID NO: 225619 - DNA, 20 bp, Artificial
  CRISPR gRNA sequence
ctactattctcactcactgg

SEQ ID NO: 225620 - DNA, 20 bp, Artificial
  CRISPR gRNA sequence
ctattctcactcactgggag

SEQ ID NO: 225621 - DNA, 20 bp, Artificial
  CRISPR gRNA sequence
ttctcactcactgggagggc

SEQ ID NO: 225622 - DNA, 20 bp, Artificial
  CRISPR gRNA sequence
tcactcactgggagggctgt

SEQ ID NO: 225623 - DNA, 20 bp, Artificial
  CRISPR gRNA sequence
actcactgggagggctgtag

SEQ ID NO: 225624 - DNA, 20 bp, Artificial
  CRISPR gRNA sequence
actgggagggctgtagtatt

SEQ ID NO: 225625 - DNA, 20 bp, Artificial
  CRISPR gRNA sequence
ggagggctgtagtatttctc

SEQ ID NO: 225626 - DNA, 20 bp, Artificial
  CRISPR gRNA sequence
tagtatttctctcaagttta

SEQ ID NO: 225627 - DNA, 20 bp, Artificial
  CRISPR gRNA sequence
ctctcaagtttatacctctc

SEQ ID NO: 225628 - DNA, 20 bp, Artificial
  CRISPR gRNA sequence
tctcaagtttatacctctct

SEQ ID NO: 225629 - DNA, 20 bp, Artificial
  CRISPR gRNA sequence
tcaagtttatacctctctgt

SEQ ID NO: 225630 - DNA, 20 bp, Artificial
  CRISPR gRNA sequence
aagtttatacctctctgtga

SEQ ID NO: 225631 - DNA, 20 bp, Artificial
  CRISPR gRNA sequence
atacctctctgtgatgaaaa

SEQ ID NO: 225632 - DNA, 20 bp, Artificial
  CRISPR gRNA sequence
tacctctctgtgatgaaaat

SEQ ID NO: 225633 - DNA, 20 bp, Artificial
  CRISPR gRNA sequence
tctgtgatgaaaatctctgt

SEQ ID NO: 225634 - DNA, 20 bp, Artificial
  CRISPR gRNA sequence
tgtgatgaaaatctctgttc

SEQ ID NO: 225635 - DNA, 20 bp, Artificial
  CRISPR gRNA sequence
tgatgaaaatctctgttctt

SEQ ID NO: 225636 - DNA, 20 bp, Artificial
  CRISPR gRNA sequence
tgttcttttagccattgctc

SEQ ID NO: 225637 - DNA, 20 bp, Artificial
  CRISPR gRNA sequence
ttcttttagccattgctcat

SEQ ID NO: 225638 - DNA, 20 bp, Artificial
  CRISPR gRNA sequence
ttttagccattgctcatggt

SEQ ID NO: 225639 - DNA, 20 bp, Artificial
  CRISPR gRNA sequence
ttagccattgctcatggttt

SEQ ID NO: 225640 - DNA, 20 bp, Artificial
  CRISPR gRNA sequence
tagccattgctcatggtttc

SEQ ID NO: 225641 - DNA, 20 bp, Artificial
  CRISPR gRNA sequence
agccattgctcatggtttcg

SEQ ID NO: 225642 - DNA, 20 bp, Artificial
  CRISPR gRNA sequence
gccattgctcatggtttcgg

SEQ ID NO: 225643 - DNA, 20 bp, Artificial
  CRISPR gRNA sequence
ctcatggtttcgggatcccc

SEQ ID NO: 225644 - DNA, 20 bp, Artificial
  CRISPR gRNA sequence
atggtttcgggatccccatt

SEQ ID NO: 225645 - DNA, 20 bp, Artificial
  CRISPR gRNA sequence
cgggatccccattctagtca

SEQ ID NO: 225646 - DNA, 20 bp, Artificial
  CRISPR gRNA sequence
gggatccccattctagtcat

SEQ ID NO: 225647 - DNA, 20 bp, Artificial
  CRISPR gRNA sequence
tagtcatcttcctttggagc

SEQ ID NO: 225648 - DNA, 20 bp, Artificial
  CRISPR gRNA sequence
gtcatcttcctttggagcaa

SEQ ID NO: 225649 - DNA, 20 bp, Artificial
  CRISPR gRNA sequence
cctttggagcaattccctgt

SEQ ID NO: 225650 - DNA, 20 bp, Artificial
  CRISPR gRNA sequence
ctttggagcaattccctgtt

SEQ ID NO: 225651 - DNA, 20 bp, Artificial
  CRISPR gRNA sequence
tggagcaattccctgttaga

SEQ ID NO: 225652 - DNA, 20 bp, Artificial
  CRISPR gRNA sequence
ggagcaattccctgttagat

SEQ ID NO: 225653 - DNA, 20 bp, Artificial
  CRISPR gRNA sequence
gagcaattccctgttagatc

SEQ ID NO: 225654 - DNA, 20 bp, Artificial
  CRISPR gRNA sequence
cctgttagatcttcaaatgt

SEQ ID NO: 225655 - DNA, 20 bp, Artificial
  CRISPR gRNA sequence
ttagatcttcaaatgtgatg

SEQ ID NO: 225656 - DNA, 20 bp, Artificial
  CRISPR gRNA sequence
gatcttcaaatgtgatgagt

SEQ ID NO: 225657 - DNA, 20 bp, Artificial
  CRISPR gRNA sequence
caaatgtgatgagtaaaact

SEQ ID NO: 225658 - DNA, 20 bp, Artificial
  CRISPR gRNA sequence
aaatgtgatgagtaaaactg

SEQ ID NO: 225659 - DNA, 20 bp, Artificial
  CRISPR gRNA sequence
agctcaggactgcgtttgtt

SEQ ID NO: 225660 - DNA, 20 bp, Artificial
  CRISPR gRNA sequence
aggactgcgtttgttggtca

SEQ ID NO: 225661 - DNA, 20 bp, Artificial
  CRISPR gRNA sequence
cgtttgttggtcacaccctt

SEQ ID NO: 225662 - DNA, 20 bp, Artificial
  CRISPR gRNA sequence
gttggtcacacccttctccc

SEQ ID NO: 225663 - DNA, 20 bp, Artificial
  CRISPR gRNA sequence
ttggtcacacccttctccct

SEQ ID NO: 225664 - DNA, 20 bp, Artificial
  CRISPR gRNA sequence
gtcacacccttctcccttcc

SEQ ID NO: 225665 - DNA, 20 bp, Artificial
  CRISPR gRNA sequence
ctcccttccaaatgactgct

SEQ ID NO: 225666 - DNA, 20 bp, Artificial
  CRISPR gRNA sequence
tcccttccaaatgactgctg

SEQ ID NO: 225667 - DNA, 20 bp, Artificial
  CRISPR gRNA sequence
ccttccaaatgactgctgct

SEQ ID NO: 225668 - DNA, 20 bp, Artificial
  CRISPR gRNA sequence
ccaaatgactgctgctgtaa

SEQ ID NO: 225669 - DNA, 20 bp, Artificial
  CRISPR gRNA sequence
caaatgactgctgctgtaac

SEQ ID NO: 225670 - DNA, 20 bp, Artificial
  CRISPR gRNA sequence
ctgctgtaactttctgacag

SEQ ID NO: 225671 - DNA, 20 bp, Artificial
  CRISPR gRNA sequence
ctgtaactttctgacaggtc

SEQ ID NO: 225672 - DNA, 20 bp, Artificial
  CRISPR gRNA sequence
taactttctgacaggtcctg

SEQ ID NO: 225673 - DNA, 20 bp, Artificial
  CRISPR gRNA sequence
tctgacaggtcctgcttccc

SEQ ID NO: 225674 - DNA, 20 bp, Artificial
  CRISPR gRNA sequence
ctgacaggtcctgcttccct

SEQ ID NO: 225675 - DNA, 20 bp, Artificial
  CRISPR gRNA sequence
tgacaggtcctgcttccctg

SEQ ID NO: 225676 - DNA, 20 bp, Artificial
  CRISPR gRNA sequence
acaggtcctgcttccctgta

SEQ ID NO: 225677 - DNA, 20 bp, Artificial
  CRISPR gRNA sequence
cttccctgtaatccattctc

SEQ ID NO: 225678 - DNA, 20 bp, Artificial
  CRISPR gRNA sequence
ccctgtaatccattctccat

SEQ ID NO: 225679 - DNA, 20 bp, Artificial
  CRISPR gRNA sequence
cctgtaatccattctccatg

SEQ ID NO: 225680 - DNA, 20 bp, Artificial
  CRISPR gRNA sequence
taatccattctccatgtggc

SEQ ID NO: 225681 - DNA, 20 bp, Artificial
  CRISPR gRNA sequence
tccatgtggctgccaaagaa

SEQ ID NO: 225682 - DNA, 20 bp, Artificial
  CRISPR gRNA sequence
catgtggctgccaaagaaga

SEQ ID NO: 225683 - DNA, 20 bp, Artificial
  CRISPR gRNA sequence
ccaaagaagatttgaaataa

SEQ ID NO: 225684 - DNA, 20 bp, Artificial
  CRISPR gRNA sequence
gaaataagtcaggttatttt

SEQ ID NO: 225685 - DNA, 20 bp, Artificial
  CRISPR gRNA sequence
aaataagtcaggttattttt

SEQ ID NO: 225686 - DNA, 20 bp, Artificial
  CRISPR gRNA sequence
tttttcttccctatttaaag

SEQ ID NO: 225687 - DNA, 20 bp, Artificial
  CRISPR gRNA sequence
ttcttccctatttaaagcct

SEQ ID NO: 225688 - DNA, 20 bp, Artificial
  CRISPR gRNA sequence
tcttccctatttaaagcctt

SEQ ID NO: 225689 - DNA, 20 bp, Artificial
  CRISPR gRNA sequence
cttccctatttaaagccttc

SEQ ID NO: 225690 - DNA, 20 bp, Artificial
  CRISPR gRNA sequence
ttccctatttaaagccttcc

SEQ ID NO: 225691 - DNA, 20 bp, Artificial
  CRISPR gRNA sequence
ccctatttaaagccttccag

SEQ ID NO: 225692 - DNA, 20 bp, Artificial
  CRISPR gRNA sequence
cctatttaaagccttccagc

SEQ ID NO: 225693 - DNA, 20 bp, Artificial
  CRISPR gRNA sequence
tttaaagccttccagccgct

SEQ ID NO: 225694 - DNA, 20 bp, Artificial
  CRISPR gRNA sequence
aaagccttccagccgcttgt

SEQ ID NO: 225695 - DNA, 20 bp, Artificial
  CRISPR gRNA sequence
aagccttccagccgcttgtc

SEQ ID NO: 225696 - DNA, 20 bp, Artificial
  CRISPR gRNA sequence
ccagccgcttgtcattgctc

SEQ ID NO: 225697 - DNA, 20 bp, Artificial
  CRISPR gRNA sequence
cagccgcttgtcattgctct

SEQ ID NO: 225698 - DNA, 20 bp, Artificial
  CRISPR gRNA sequence
gtcattgctcttagaataaa

SEQ ID NO: 225699 - DNA, 20 bp, Artificial
  CRISPR gRNA sequence
tcattgctcttagaataaaa

SEQ ID NO: 225700 - DNA, 20 bp, Artificial
  CRISPR gRNA sequence
ctcttagaataaaatccaaa

SEQ ID NO: 225701 - DNA, 20 bp, Artificial
  CRISPR gRNA sequence
ttagaataaaatccaaactc

SEQ ID NO: 225702 - DNA, 20 bp, Artificial
  CRISPR gRNA sequence
agaataaaatccaaactctc

SEQ ID NO: 225703 - DNA, 20 bp, Artificial
  CRISPR gRNA sequence
gaataaaatccaaactctcc

SEQ ID NO: 225704 - DNA, 20 bp, Artificial
  CRISPR gRNA sequence
tcccaacaagcttttaagac

SEQ ID NO: 225705 - DNA, 20 bp, Artificial
  CRISPR gRNA sequence
ccaacaagcttttaagactc

SEQ ID NO: 225706 - DNA, 20 bp, Artificial
  CRISPR gRNA sequence
ttaagactctacatggtctt

SEQ ID NO: 225707 - DNA, 20 bp, Artificial
  CRISPR gRNA sequence
taagactctacatggtcttg

SEQ ID NO: 225708 - DNA, 20 bp, Artificial
  CRISPR gRNA sequence
aagactctacatggtcttgc

SEQ ID NO: 225709 - DNA, 20 bp, Artificial
  CRISPR gRNA sequence
agactctacatggtcttgcc

SEQ ID NO: 225710 - DNA, 20 bp, Artificial
  CRISPR gRNA sequence
tacatggtcttgccccagca

SEQ ID NO: 225711 - DNA, 20 bp, Artificial
  CRISPR gRNA sequence
catggtcttgccccagcaaa

SEQ ID NO: 225712 - DNA, 20 bp, Artificial
  CRISPR gRNA sequence
gccccagcaaactcttccca

SEQ ID NO: 225713 - DNA, 20 bp, Artificial
  CRISPR gRNA sequence
ccccagcaaactcttcccat

SEQ ID NO: 225714 - DNA, 20 bp, Artificial
  CRISPR gRNA sequence
ttcccatttgatctcatcac

SEQ ID NO: 225715 - DNA, 20 bp, Artificial
  CRISPR gRNA sequence
cccatttgatctcatcactg

SEQ ID NO: 225716 - DNA, 20 bp, Artificial
  CRISPR gRNA sequence
ccatttgatctcatcactga

SEQ ID NO: 225717 - DNA, 20 bp, Artificial
  CRISPR gRNA sequence
gatctcatcactgaattcca

SEQ ID NO: 225718 - DNA, 20 bp, Artificial
  CRISPR gRNA sequence
atctcatcactgaattccag

SEQ ID NO: 225719 - DNA, 20 bp, Artificial
  CRISPR gRNA sequence
atcactgaattccagtcaca

SEQ ID NO: 225720 - DNA, 20 bp, Artificial
  CRISPR gRNA sequence
aattccagtcacaatggcca

SEQ ID NO: 225721 - DNA, 20 bp, Artificial
  CRISPR gRNA sequence
cagtcacaatggccatcctt

SEQ ID NO: 225722 - DNA, 20 bp, Artificial
  CRISPR gRNA sequence
tggtttctcaaagttgccgt

SEQ ID NO: 225723 - DNA, 20 bp, Artificial
  CRISPR gRNA sequence
ggtttctcaaagttgccgtt

SEQ ID NO: 225724 - DNA, 20 bp, Artificial
  CRISPR gRNA sequence
gtttctcaaagttgccgttc

SEQ ID NO: 225725 - DNA, 20 bp, Artificial
  CRISPR gRNA sequence
ctcaaagttgccgttccttt

SEQ ID NO: 225726 - DNA, 20 bp, Artificial
  CRISPR gRNA sequence
tcaaagttgccgttcctttg

SEQ ID NO: 225727 - DNA, 20 bp, Artificial
  CRISPR gRNA sequence
aaagttgccgttcctttggc

SEQ ID NO: 225728 - DNA, 20 bp, Artificial
  CRISPR gRNA sequence
ccgttcctttggcatctctt

SEQ ID NO: 225729 - DNA, 20 bp, Artificial
  CRISPR gRNA sequence
ctttggcatctcttcctccc

SEQ ID NO: 225730 - DNA, 20 bp, Artificial
  CRISPR gRNA sequence
tggcatctcttcctccctgt

SEQ ID NO: 225731 - DNA, 20 bp, Artificial
  CRISPR gRNA sequence
ggcatctcttcctccctgtc

SEQ ID NO: 225732 - DNA, 20 bp, Artificial
  CRISPR gRNA sequence
gcatctcttcctccctgtct

SEQ ID NO: 225733 - DNA, 20 bp, Artificial
  CRISPR gRNA sequence
ttcctccctgtcttcacaat

SEQ ID NO: 225734 - DNA, 20 bp, Artificial
  CRISPR gRNA sequence
cctccctgtcttcacaatgt

SEQ ID NO: 225735 - DNA, 20 bp, Artificial
  CRISPR gRNA sequence
ctccctgtcttcacaatgta

SEQ ID NO: 225736 - DNA, 20 bp, Artificial
  CRISPR gRNA sequence
cctgtcttcacaatgtaggc

SEQ ID NO: 225737 - DNA, 20 bp, Artificial
  CRISPR gRNA sequence
tcttcacaatgtaggctcct

SEQ ID NO: 225738 - DNA, 20 bp, Artificial
  CRISPR gRNA sequence
cacaatgtaggctccttccc

SEQ ID NO: 225739 - DNA, 20 bp, Artificial
  CRISPR gRNA sequence
acaatgtaggctccttccca

SEQ ID NO: 225740 - DNA, 20 bp, Artificial
  CRISPR gRNA sequence
cttcccatcctaggcttagt

SEQ ID NO: 225741 - DNA, 20 bp, Artificial
  CRISPR gRNA sequence
cccatcctaggcttagtttc

SEQ ID NO: 225742 - DNA, 20 bp, Artificial
  CRISPR gRNA sequence
ccatcctaggcttagtttcg

SEQ ID NO: 225743 - DNA, 20 bp, Artificial
  CRISPR gRNA sequence
ggcttagtttcgttcctctc

SEQ ID NO: 225744 - DNA, 20 bp, Artificial
  CRISPR gRNA sequence
agtttcgttcctctccctag

SEQ ID NO: 225745 - DNA, 20 bp, Artificial
  CRISPR gRNA sequence
gtttcgttcctctccctaga

SEQ ID NO: 225746 - DNA, 20 bp, Artificial
  CRISPR gRNA sequence
cgttcctctccctagaggcc

SEQ ID NO: 225747 - DNA, 20 bp, Artificial
  CRISPR gRNA sequence
gttcctctccctagaggcct

SEQ ID NO: 225748 - DNA, 20 bp, Artificial
  CRISPR gRNA sequence
ctctccctagaggcctttcc

SEQ ID NO: 225749 - DNA, 20 bp, Artificial
  CRISPR gRNA sequence
tccctagaggcctttcctta

SEQ ID NO: 225750 - DNA, 20 bp, Artificial
  CRISPR gRNA sequence
cctagaggcctttccttact

SEQ ID NO: 225751 - DNA, 20 bp, Artificial
  CRISPR gRNA sequence
gaggcctttccttactgcct

SEQ ID NO: 225752 - DNA, 20 bp, Artificial
  CRISPR gRNA sequence
tccttactgcctcagcttct

SEQ ID NO: 225753 - DNA, 20 bp, Artificial
  CRISPR gRNA sequence
ccttactgcctcagcttctc

SEQ ID NO: 225754 - DNA, 20 bp, Artificial
  CRISPR gRNA sequence
cttactgcctcagcttctcc

SEQ ID NO: 225755 - DNA, 20 bp, Artificial
  CRISPR gRNA sequence
actgcctcagcttctcccac

SEQ ID NO: 225756 - DNA, 20 bp, Artificial
  CRISPR gRNA sequence
ctgcctcagcttctcccact

SEQ ID NO: 225757 - DNA, 20 bp, Artificial
  CRISPR gRNA sequence
cctcagcttctcccactctg

SEQ ID NO: 225758 - DNA, 20 bp, Artificial
  CRISPR gRNA sequence
agcttctcccactctgcaca

SEQ ID NO: 225759 - DNA, 20 bp, Artificial
  CRISPR gRNA sequence
ctcccactctgcacactcag

SEQ ID NO: 225760 - DNA, 20 bp, Artificial
  CRISPR gRNA sequence
tcccactctgcacactcagg

SEQ ID NO: 225761 - DNA, 20 bp, Artificial
  CRISPR gRNA sequence
ccactctgcacactcagggt

SEQ ID NO: 225762 - DNA, 20 bp, Artificial
  CRISPR gRNA sequence
tgcacactcagggtcctctg

SEQ ID NO: 225763 - DNA, 20 bp, Artificial
  CRISPR gRNA sequence
cacactcagggtcctctgca

SEQ ID NO: 225764 - DNA, 20 bp, Artificial
  CRISPR gRNA sequence
agggtcctctgcattgttca

SEQ ID NO: 225765 - DNA, 20 bp, Artificial
  CRISPR gRNA sequence
tgcattgttcactgctggcc

SEQ ID NO: 225766 - DNA, 20 bp, Artificial
  CRISPR gRNA sequence
cattgttcactgctggcctt

SEQ ID NO: 225767 - DNA, 20 bp, Artificial
  CRISPR gRNA sequence
ttcactgctggccttcaaga

SEQ ID NO: 225768 - DNA, 20 bp, Artificial
  CRISPR gRNA sequence
actgctggccttcaagagcc

SEQ ID NO: 225769 - DNA, 20 bp, Artificial
  CRISPR gRNA sequence
ctggccttcaagagcctaga

SEQ ID NO: 225770 - DNA, 20 bp, Artificial
  CRISPR gRNA sequence
gccttcaagagcctagagga

SEQ ID NO: 225771 - DNA, 20 bp, Artificial
  CRISPR gRNA sequence
caagagcctagaggagttcc

SEQ ID NO: 225772 - DNA, 20 bp, Artificial
  CRISPR gRNA sequence
aagagcctagaggagttcct

SEQ ID NO: 225773 - DNA, 20 bp, Artificial
  CRISPR gRNA sequence
gaggagttcctccccatggt

SEQ ID NO: 225774 - DNA, 20 bp, Artificial
  CRISPR gRNA sequence
ctccccatggtgggctttca

SEQ ID NO: 225775 - DNA, 20 bp, Artificial
  CRISPR gRNA sequence
cccatggtgggctttcaata

SEQ ID NO: 225776 - DNA, 20 bp, Artificial
  CRISPR gRNA sequence
tcaataagtgtttgtggaat

SEQ ID NO: 225777 - DNA, 20 bp, Artificial
  CRISPR gRNA sequence
caataagtgtttgtggaata

SEQ ID NO: 225778 - DNA, 20 bp, Artificial
  CRISPR gRNA sequence
aataagtgtttgtggaataa

SEQ ID NO: 225779 - DNA, 20 bp, Artificial
  CRISPR gRNA sequence
gtggaataagtgaaaaatga

SEQ ID NO: 225780 - DNA, 20 bp, Artificial
  CRISPR gRNA sequence
tggaataagtgaaaaatgag

SEQ ID NO: 225781 - DNA, 20 bp, Artificial
  CRISPR gRNA sequence
ttacttttgttaatatattc

SEQ ID NO: 225782 - DNA, 20 bp, Artificial
  CRISPR gRNA sequence
acttttgttaatatattcaa

SEQ ID NO: 225783 - DNA, 20 bp, Artificial
  CRISPR gRNA sequence
cttttgttaatatattcaaa

SEQ ID NO: 225784 - DNA, 20 bp, Artificial
  CRISPR gRNA sequence
ttgttaatatattcaaatta

SEQ ID NO: 225785 - DNA, 20 bp, Artificial
  CRISPR gRNA sequence
tgttaatatattcaaattaa

SEQ ID NO: 225786 - DNA, 20 bp, Artificial
  CRISPR gRNA sequence
gttaatatattcaaattaat

SEQ ID NO: 225787 - DNA, 20 bp, Artificial
  CRISPR gRNA sequence
ttaatatattcaaattaata

SEQ ID NO: 225788 - DNA, 20 bp, Artificial
  CRISPR gRNA sequence
atatattcaaattaatatta

SEQ ID NO: 225789 - DNA, 20 bp, Artificial
  CRISPR gRNA sequence
aaattaatattaatatatta

SEQ ID NO: 225790 - DNA, 20 bp, Artificial
  CRISPR gRNA sequence
atattaatatattaatattc

SEQ ID NO: 225791 - DNA, 20 bp, Artificial
  CRISPR gRNA sequence
atatattaatattctattaa

SEQ ID NO: 225792 - DNA, 20 bp, Artificial
  CRISPR gRNA sequence
atattctattaatatatcct

SEQ ID NO: 225793 - DNA, 20 bp, Artificial
  CRISPR gRNA sequence
tattaatatatcctaaaatt

SEQ ID NO: 225794 - DNA, 20 bp, Artificial
  CRISPR gRNA sequence
ttaatatatcctaaaatttt

SEQ ID NO: 225795 - DNA, 20 bp, Artificial
  CRISPR gRNA sequence
atatatcctaaaattttgtt

SEQ ID NO: 225796 - DNA, 20 bp, Artificial
  CRISPR gRNA sequence
aaattttgttgtgtataggg

SEQ ID NO: 225797 - DNA, 20 bp, Artificial
  CRISPR gRNA sequence
tgttgtgtataggggcaggg

SEQ ID NO: 225798 - DNA, 20 bp, Artificial
  CRISPR gRNA sequence
gttgtgtataggggcaggga

SEQ ID NO: 225799 - DNA, 20 bp, Artificial
  CRISPR gRNA sequence
ttgtgtataggggcagggac

SEQ ID NO: 225800 - DNA, 20 bp, Artificial
  CRISPR gRNA sequence
tgtataggggcagggaccaa

SEQ ID NO: 225801 - DNA, 20 bp, Artificial
  CRISPR gRNA sequence
cattgtcagctcatcttgac

SEQ ID NO: 225802 - DNA, 20 bp, Artificial
  CRISPR gRNA sequence
attgtcagctcatcttgact

SEQ ID NO: 225803 - DNA, 20 bp, Artificial
  CRISPR gRNA sequence
tcagctcatcttgactatga

SEQ ID NO: 225804 - DNA, 20 bp, Artificial
  CRISPR gRNA sequence
atcttgactatgagatcaga

SEQ ID NO: 225805 - DNA, 20 bp, Artificial
  CRISPR gRNA sequence
gactatgagatcagatattg

SEQ ID NO: 225806 - DNA, 20 bp, Artificial
  CRISPR gRNA sequence
actatgagatcagatattgg

SEQ ID NO: 225807 - DNA, 20 bp, Artificial
  CRISPR gRNA sequence
tgagatcagatattggctat

SEQ ID NO: 225808 - DNA, 20 bp, Artificial
  CRISPR gRNA sequence
gctatattttgaaggtagag

SEQ ID NO: 225809 - DNA, 20 bp, Artificial
  CRISPR gRNA sequence
tattttgaaggtagagtcag

SEQ ID NO: 225810 - DNA, 20 bp, Artificial
  CRISPR gRNA sequence
tgaaggtagagtcagcagga

SEQ ID NO: 225811 - DNA, 20 bp, Artificial
  CRISPR gRNA sequence
gaaggtagagtcagcaggat

SEQ ID NO: 225812 - DNA, 20 bp, Artificial
  CRISPR gRNA sequence
aaggtagagtcagcaggatt

SEQ ID NO: 225813 - DNA, 20 bp, Artificial
  CRISPR gRNA sequence
gctgtttaactagagtggga

SEQ ID NO: 225814 - DNA, 20 bp, Artificial
  CRISPR gRNA sequence
ctgtttaactagagtgggat

SEQ ID NO: 225815 - DNA, 20 bp, Artificial
  CRISPR gRNA sequence
tttaactagagtgggatgtg

SEQ ID NO: 225816 - DNA, 20 bp, Artificial
  CRISPR gRNA sequence
aactagagtgggatgtggga

SEQ ID NO: 225817 - DNA, 20 bp, Artificial
  CRISPR gRNA sequence
actagagtgggatgtgggag

SEQ ID NO: 225818 - DNA, 20 bp, Artificial
  CRISPR gRNA sequence
gagtgggatgtgggagaaat

SEQ ID NO: 225819 - DNA, 20 bp, Artificial
  CRISPR gRNA sequence
caaggttttcagcctcaagc

SEQ ID NO: 225820 - DNA, 20 bp, Artificial
  CRISPR gRNA sequence
tcagcctcaagcaactgaag

SEQ ID NO: 225821 - DNA, 20 bp, Artificial
  CRISPR gRNA sequence
cagcctcaagcaactgaaga

SEQ ID NO: 225822 - DNA, 20 bp, Artificial
  CRISPR gRNA sequence
agcctcaagcaactgaagaa

SEQ ID NO: 225823 - DNA, 20 bp, Artificial
  CRISPR gRNA sequence
aagcaactgaagaaatgggg

SEQ ID NO: 225824 - DNA, 20 bp, Artificial
  CRISPR gRNA sequence
aagaaatggggtcaccacga

SEQ ID NO: 225825 - DNA, 20 bp, Artificial
  CRISPR gRNA sequence
aaatgaggaaaatgagaggg

SEQ ID NO: 225826 - DNA, 20 bp, Artificial
  CRISPR gRNA sequence
agtgggggatggggtgatga

SEQ ID NO: 225827 - DNA, 20 bp, Artificial
  CRISPR gRNA sequence
gtgggggatggggtgatgaa

SEQ ID NO: 225828 - DNA, 20 bp, Artificial
  CRISPR gRNA sequence
attgtggaacatgaacagtt

SEQ ID NO: 225829 - DNA, 20 bp, Artificial
  CRISPR gRNA sequence
tggaacatgaacagttaaga

SEQ ID NO: 225830 - DNA, 20 bp, Artificial
  CRISPR gRNA sequence
agattaactgaagagcctga

SEQ ID NO: 225831 - DNA, 20 bp, Artificial
  CRISPR gRNA sequence
actgaagagcctgaattcac

SEQ ID NO: 225832 - DNA, 20 bp, Artificial
  CRISPR gRNA sequence
aagagcctgaattcactgtt

SEQ ID NO: 225833 - DNA, 20 bp, Artificial
  CRISPR gRNA sequence
aattcactgttcctcagttt

SEQ ID NO: 225834 - DNA, 20 bp, Artificial
  CRISPR gRNA sequence
actgttcctcagtttctaca

SEQ ID NO: 225835 - DNA, 20 bp, Artificial
  CRISPR gRNA sequence
ttcctcagtttctacaacta

SEQ ID NO: 225836 - DNA, 20 bp, Artificial
  CRISPR gRNA sequence
ctcagtttctacaactataa

SEQ ID NO: 225837 - DNA, 20 bp, Artificial
  CRISPR gRNA sequence
agtttctacaactataagga

SEQ ID NO: 225838 - DNA, 20 bp, Artificial
  CRISPR gRNA sequence
ctacaactataaggaggggt

SEQ ID NO: 225839 - DNA, 20 bp, Artificial
  CRISPR gRNA sequence
tacaactataaggaggggtt

SEQ ID NO: 225840 - DNA, 20 bp, Artificial
  CRISPR gRNA sequence
caactataaggaggggttaa

SEQ ID NO: 225841 - DNA, 20 bp, Artificial
  CRISPR gRNA sequence
taaggaggggttaataattt

SEQ ID NO: 225842 - DNA, 20 bp, Artificial
  CRISPR gRNA sequence
ataatttctcacatcataat

SEQ ID NO: 225843 - DNA, 20 bp, Artificial
  CRISPR gRNA sequence
ctcacatcataattgtgagg

SEQ ID NO: 225844 - DNA, 20 bp, Artificial
  CRISPR gRNA sequence
tcacatcataattgtgagga

SEQ ID NO: 225845 - DNA, 20 bp, Artificial
  CRISPR gRNA sequence
acatcataattgtgaggatt

SEQ ID NO: 225846 - DNA, 20 bp, Artificial
  CRISPR gRNA sequence
tgaggatttgaggagttgag

SEQ ID NO: 225847 - DNA, 20 bp, Artificial
  CRISPR gRNA sequence
gaggagttgaggtacacaat

SEQ ID NO: 225848 - DNA, 20 bp, Artificial
  CRISPR gRNA sequence
aggagttgaggtacacaatt

SEQ ID NO: 225849 - DNA, 20 bp, Artificial
  CRISPR gRNA sequence
aggtacacaattaaaaacaa

SEQ ID NO: 225850 - DNA, 20 bp, Artificial
  CRISPR gRNA sequence
aaaacaaaagcacaggggaa

SEQ ID NO: 225851 - DNA, 20 bp, Artificial
  CRISPR gRNA sequence
agcatggctattagaccata

SEQ ID NO: 225852 - DNA, 20 bp, Artificial
  CRISPR gRNA sequence
ttagaccatacagccttacc

SEQ ID NO: 225853 - DNA, 20 bp, Artificial
  CRISPR gRNA sequence
gaccatacagccttaccaaa

SEQ ID NO: 225854 - DNA, 20 bp, Artificial
  CRISPR gRNA sequence
accaaatccattggggatta

SEQ ID NO: 225855 - DNA, 20 bp, Artificial
  CRISPR gRNA sequence
ccaaatccattggggattag

SEQ ID NO: 225856 - DNA, 20 bp, Artificial
  CRISPR gRNA sequence
gggattagatacaaaaatcc

SEQ ID NO: 225857 - DNA, 20 bp, Artificial
  CRISPR gRNA sequence
gatacaaaaatccaagcatg

SEQ ID NO: 225858 - DNA, 20 bp, Artificial
  CRISPR gRNA sequence
caaaattttttcctggtagg

SEQ ID NO: 225859 - DNA, 20 bp, Artificial
  CRISPR gRNA sequence
tttcctggtagggttttagg

SEQ ID NO: 225860 - DNA, 20 bp, Artificial
  CRISPR gRNA sequence
ttcctggtagggttttaggc

SEQ ID NO: 225861 - DNA, 20 bp, Artificial
  CRISPR gRNA sequence
tcctggtagggttttaggct

SEQ ID NO: 225862 - DNA, 20 bp, Artificial
  CRISPR gRNA sequence
cctggtagggttttaggcta

SEQ ID NO: 225863 - DNA, 20 bp, Artificial
  CRISPR gRNA sequence
ctggtagggttttaggctat

SEQ ID NO: 225864 - DNA, 20 bp, Artificial
  CRISPR gRNA sequence
gtagggttttaggctatact

SEQ ID NO: 225865 - DNA, 20 bp, Artificial
  CRISPR gRNA sequence
taggctatactgaagtgact

SEQ ID NO: 225866 - DNA, 20 bp, Artificial
  CRISPR gRNA sequence
aggctatactgaagtgactt

SEQ ID NO: 225867 - DNA, 20 bp, Artificial
  CRISPR gRNA sequence
ggctatactgaagtgacttt

SEQ ID NO: 225868 - DNA, 20 bp, Artificial
  CRISPR gRNA sequence
tactgaagtgacttttcttt

SEQ ID NO: 225869 - DNA, 20 bp, Artificial
  CRISPR gRNA sequence
aagtgacttttctttggcat

SEQ ID NO: 225870 - DNA, 20 bp, Artificial
  CRISPR gRNA sequence
ttctttggcataagaagata

SEQ ID NO: 225871 - DNA, 20 bp, Artificial
  CRISPR gRNA sequence
tctttggcataagaagatat

SEQ ID NO: 225872 - DNA, 20 bp, Artificial
  CRISPR gRNA sequence
ctttggcataagaagatatt

SEQ ID NO: 225873 - DNA, 20 bp, Artificial
  CRISPR gRNA sequence
tttggcataagaagatattc

SEQ ID NO: 225874 - DNA, 20 bp, Artificial
  CRISPR gRNA sequence
tggcataagaagatattcag

SEQ ID NO: 225875 - DNA, 20 bp, Artificial
  CRISPR gRNA sequence
ggcataagaagatattcagt

SEQ ID NO: 225876 - DNA, 20 bp, Artificial
  CRISPR gRNA sequence
gcataagaagatattcagtt

SEQ ID NO: 225877 - DNA, 20 bp, Artificial
  CRISPR gRNA sequence
agttatacagttggaaataa

SEQ ID NO: 225878 - DNA, 20 bp, Artificial
  CRISPR gRNA sequence
tacagttggaaataaaggta

SEQ ID NO: 225879 - DNA, 20 bp, Artificial
  CRISPR gRNA sequence
gaaataaaggtattgatttg

SEQ ID NO: 225880 - DNA, 20 bp, Artificial
  CRISPR gRNA sequence
atttggagtatccaaaaaca

SEQ ID NO: 225881 - DNA, 20 bp, Artificial
  CRISPR gRNA sequence
ggagtatccaaaaacatctc

SEQ ID NO: 225882 - DNA, 20 bp, Artificial
  CRISPR gRNA sequence
gagtatccaaaaacatctct

SEQ ID NO: 225883 - DNA, 20 bp, Artificial
  CRISPR gRNA sequence
tcagtagagatccacaacca

SEQ ID NO: 225884 - DNA, 20 bp, Artificial
  CRISPR gRNA sequence
agtagagatccacaaccaaa

SEQ ID NO: 225885 - DNA, 20 bp, Artificial
  CRISPR gRNA sequence
ccattcactcgcaaaactgt

SEQ ID NO: 225886 - DNA, 20 bp, Artificial
  CRISPR gRNA sequence
cattcactcgcaaaactgtc

SEQ ID NO: 225887 - DNA, 20 bp, Artificial
  CRISPR gRNA sequence
actcgcaaaactgtcttatg

SEQ ID NO: 225888 - DNA, 20 bp, Artificial
  CRISPR gRNA sequence
gcaaaactgtcttatgacca

SEQ ID NO: 225889 - DNA, 20 bp, Artificial
  CRISPR gRNA sequence
tcttatgaccattgcaaccc

SEQ ID NO: 225890 - DNA, 20 bp, Artificial
  CRISPR gRNA sequence
atgaccattgcaaccctcaa

SEQ ID NO: 225891 - DNA, 20 bp, Artificial
  CRISPR gRNA sequence
tgaccattgcaaccctcaac

SEQ ID NO: 225892 - DNA, 20 bp, Artificial
  CRISPR gRNA sequence
caaccctcaacagcaaacat

SEQ ID NO: 225893 - DNA, 20 bp, Artificial
  CRISPR gRNA sequence
aacagcaaacatatggagtc

SEQ ID NO: 225894 - DNA, 20 bp, Artificial
  CRISPR gRNA sequence
tactacatatagaggaaaat

SEQ ID NO: 225895 - DNA, 20 bp, Artificial
  CRISPR gRNA sequence
ctacatatagaggaaaatgc

SEQ ID NO: 225896 - DNA, 20 bp, Artificial
  CRISPR gRNA sequence
catatagaggaaaatgctag

SEQ ID NO: 225897 - DNA, 20 bp, Artificial
  CRISPR gRNA sequence
gattctgaaaagctaatatc

SEQ ID NO: 225898 - DNA, 20 bp, Artificial
  CRISPR gRNA sequence
tgaaaagctaatatctataa

SEQ ID NO: 225899 - DNA, 20 bp, Artificial
  CRISPR gRNA sequence
aaaagctaatatctataaaa

SEQ ID NO: 225900 - DNA, 20 bp, Artificial
  CRISPR gRNA sequence
atatctataaaacagagttt

SEQ ID NO: 225901 - DNA, 20 bp, Artificial
  CRISPR gRNA sequence
taaaacagagtttatgatgt

SEQ ID NO: 225902 - DNA, 20 bp, Artificial
  CRISPR gRNA sequence
atgatgttgttatattctgg

SEQ ID NO: 225903 - DNA, 20 bp, Artificial
  CRISPR gRNA sequence
tgatgttgttatattctggg

SEQ ID NO: 225904 - DNA, 20 bp, Artificial
  CRISPR gRNA sequence
ttatattctggggattgatg

SEQ ID NO: 225905 - DNA, 20 bp, Artificial
  CRISPR gRNA sequence
tattctggggattgatgtaa

SEQ ID NO: 225906 - DNA, 20 bp, Artificial
  CRISPR gRNA sequence
tggggattgatgtaagcatt

SEQ ID NO: 225907 - DNA, 20 bp, Artificial
  CRISPR gRNA sequence
gggattgatgtaagcatttt

SEQ ID NO: 225908 - DNA, 20 bp, Artificial
  CRISPR gRNA sequence
atgtaagcattttaccagga

SEQ ID NO: 225909 - DNA, 20 bp, Artificial
  CRISPR gRNA sequence
taccaggacttattatagca

SEQ ID NO: 225910 - DNA, 20 bp, Artificial
  CRISPR gRNA sequence
accaggacttattatagcat

SEQ ID NO: 225911 - DNA, 20 bp, Artificial
  CRISPR gRNA sequence
ccaggacttattatagcatt

SEQ ID NO: 225912 - DNA, 20 bp, Artificial
  CRISPR gRNA sequence
attatagcattataagctta

SEQ ID NO: 225913 - DNA, 20 bp, Artificial
  CRISPR gRNA sequence
ttatagcattataagcttaa

SEQ ID NO: 225914 - DNA, 20 bp, Artificial
  CRISPR gRNA sequence
tagcattataagcttaacac

SEQ ID NO: 225915 - DNA, 20 bp, Artificial
  CRISPR gRNA sequence
taagcttaacacaagaaata

SEQ ID NO: 225916 - DNA, 20 bp, Artificial
  CRISPR gRNA sequence
aacacaagaaatatgtggct

SEQ ID NO: 225917 - DNA, 20 bp, Artificial
  CRISPR gRNA sequence
acacaagaaatatgtggcta

SEQ ID NO: 225918 - DNA, 20 bp, Artificial
  CRISPR gRNA sequence
tcattatggagtgaaaggct

SEQ ID NO: 225919 - DNA, 20 bp, Artificial
  CRISPR gRNA sequence
tggagtgaaaggctggaaaa

SEQ ID NO: 225920 - DNA, 20 bp, Artificial
  CRISPR gRNA sequence
gaaaattcctcacctgtgac

SEQ ID NO: 225921 - DNA, 20 bp, Artificial
  CRISPR gRNA sequence
ctcacctgtgacctgagaga

SEQ ID NO: 225922 - DNA, 20 bp, Artificial
  CRISPR gRNA sequence
acctgtgacctgagagatag

SEQ ID NO: 225923 - DNA, 20 bp, Artificial
  CRISPR gRNA sequence
tgacctgagagatagtgcgt

SEQ ID NO: 225924 - DNA, 20 bp, Artificial
  CRISPR gRNA sequence
agagatagtgcgtggtagaa

SEQ ID NO: 225925 - DNA, 20 bp, Artificial
  CRISPR gRNA sequence
gaaagaagtgttgatttcag

SEQ ID NO: 225926 - DNA, 20 bp, Artificial
  CRISPR gRNA sequence
aaagaagtgttgatttcaga

SEQ ID NO: 225927 - DNA, 20 bp, Artificial
  CRISPR gRNA sequence
atttcagaggaatgctagtg

SEQ ID NO: 225928 - DNA, 20 bp, Artificial
  CRISPR gRNA sequence
cagaggaatgctagtgcttg

SEQ ID NO: 225929 - DNA, 20 bp, Artificial
  CRISPR gRNA sequence
agaggaatgctagtgcttgc

SEQ ID NO: 225930 - DNA, 20 bp, Artificial
  CRISPR gRNA sequence
gtgcttgcttagggcagtat

SEQ ID NO: 225931 - DNA, 20 bp, Artificial
  CRISPR gRNA sequence
gcttagggcagtattcagaa

SEQ ID NO: 225932 - DNA, 20 bp, Artificial
  CRISPR gRNA sequence
cttagggcagtattcagaag

SEQ ID NO: 225933 - DNA, 20 bp, Artificial
  CRISPR gRNA sequence
agggcagtattcagaagaac

SEQ ID NO: 225934 - DNA, 20 bp, Artificial
  CRISPR gRNA sequence
gggcagtattcagaagaact

SEQ ID NO: 225935 - DNA, 20 bp, Artificial
  CRISPR gRNA sequence
agaagaactcttccaatcac

SEQ ID NO: 225936 - DNA, 20 bp, Artificial
  CRISPR gRNA sequence
ttccaatcacacagcccctt

SEQ ID NO: 225937 - DNA, 20 bp, Artificial
  CRISPR gRNA sequence
ccaatcacacagccccttgt

SEQ ID NO: 225938 - DNA, 20 bp, Artificial
  CRISPR gRNA sequence
caatcacacagccccttgta

SEQ ID NO: 225939 - DNA, 20 bp, Artificial
  CRISPR gRNA sequence
gtacaggcaaactccggaat

SEQ ID NO: 225940 - DNA, 20 bp, Artificial
  CRISPR gRNA sequence
tacaggcaaactccggaata

SEQ ID NO: 225941 - DNA, 20 bp, Artificial
  CRISPR gRNA sequence
cggaatactttcagtacatt

SEQ ID NO: 225942 - DNA, 20 bp, Artificial
  CRISPR gRNA sequence
tcagtacatttacttggctt

SEQ ID NO: 225943 - DNA, 20 bp, Artificial
  CRISPR gRNA sequence
cagtacatttacttggcttt

SEQ ID NO: 225944 - DNA, 20 bp, Artificial
  CRISPR gRNA sequence
agtacatttacttggcttta

SEQ ID NO: 225945 - DNA, 20 bp, Artificial
  CRISPR gRNA sequence
acttggctttattgttagag

SEQ ID NO: 225946 - DNA, 20 bp, Artificial
  CRISPR gRNA sequence
cttggctttattgttagagc

SEQ ID NO: 225947 - DNA, 20 bp, Artificial
  CRISPR gRNA sequence
ggctttattgttagagcaga

SEQ ID NO: 225948 - DNA, 20 bp, Artificial
  CRISPR gRNA sequence
gctttattgttagagcagaa

SEQ ID NO: 225949 - DNA, 20 bp, Artificial
  CRISPR gRNA sequence
tattgttagagcagaaactt

SEQ ID NO: 225950 - DNA, 20 bp, Artificial
  CRISPR gRNA sequence
attgttagagcagaaacttc

SEQ ID NO: 225951 - DNA, 20 bp, Artificial
  CRISPR gRNA sequence
ttgttagagcagaaacttca

SEQ ID NO: 225952 - DNA, 20 bp, Artificial
  CRISPR gRNA sequence
ttagagcagaaacttcacag

SEQ ID NO: 225953 - DNA, 20 bp, Artificial
  CRISPR gRNA sequence
gagcagaaacttcacagcta

SEQ ID NO: 225954 - DNA, 20 bp, Artificial
  CRISPR gRNA sequence
cacagctaaaattatggtct

SEQ ID NO: 225955 - DNA, 20 bp, Artificial
  CRISPR gRNA sequence
acagctaaaattatggtctt

SEQ ID NO: 225956 - DNA, 20 bp, Artificial
  CRISPR gRNA sequence
aaattatggtcttaggggtt

SEQ ID NO: 225957 - DNA, 20 bp, Artificial
  CRISPR gRNA sequence
tggtcttaggggtttataag

SEQ ID NO: 225958 - DNA, 20 bp, Artificial
  CRISPR gRNA sequence
aggggtttataagatgcaat

SEQ ID NO: 225959 - DNA, 20 bp, Artificial
  CRISPR gRNA sequence
ggggtttataagatgcaatt

SEQ ID NO: 225960 - DNA, 20 bp, Artificial
  CRISPR gRNA sequence
ataagatgcaattaaactta

SEQ ID NO: 225961 - DNA, 20 bp, Artificial
  CRISPR gRNA sequence
taagatgcaattaaacttaa

SEQ ID NO: 225962 - DNA, 20 bp, Artificial
  CRISPR gRNA sequence
aacttaatttttaaaagttc

SEQ ID NO: 225963 - DNA, 20 bp, Artificial
  CRISPR gRNA sequence
aatttttaaaagttctcaca

SEQ ID NO: 225964 - DNA, 20 bp, Artificial
  CRISPR gRNA sequence
atttttaaaagttctcacaa

SEQ ID NO: 225965 - DNA, 20 bp, Artificial
  CRISPR gRNA sequence
ttaaaagttctcacaaatct

SEQ ID NO: 225966 - DNA, 20 bp, Artificial
  CRISPR gRNA sequence
taaaagttctcacaaatctt

SEQ ID NO: 225967 - DNA, 20 bp, Artificial
  CRISPR gRNA sequence
aaaagttctcacaaatctta

SEQ ID NO: 225968 - DNA, 20 bp, Artificial
  CRISPR gRNA sequence
aaagttctcacaaatcttat

SEQ ID NO: 225969 - DNA, 20 bp, Artificial
  CRISPR gRNA sequence
tcacaaatcttatttgaagt

SEQ ID NO: 225970 - DNA, 20 bp, Artificial
  CRISPR gRNA sequence
acaaatcttatttgaagtct

SEQ ID NO: 225971 - DNA, 20 bp, Artificial
  CRISPR gRNA sequence
atttgaagtcttaatatctt

SEQ ID NO: 225972 - DNA, 20 bp, Artificial
  CRISPR gRNA sequence
tttgaagtcttaatatctta

SEQ ID NO: 225973 - DNA, 20 bp, Artificial
  CRISPR gRNA sequence
gaagtcttaatatcttaatt

SEQ ID NO: 225974 - DNA, 20 bp, Artificial
  CRISPR gRNA sequence
aagtcttaatatcttaattt

SEQ ID NO: 225975 - DNA, 20 bp, Artificial
  CRISPR gRNA sequence
aatatcttaatttcctttat

SEQ ID NO: 225976 - DNA, 20 bp, Artificial
  CRISPR gRNA sequence
atatcttaatttcctttata

SEQ ID NO: 225977 - DNA, 20 bp, Artificial
  CRISPR gRNA sequence
aatttcctttatataggata

SEQ ID NO: 225978 - DNA, 20 bp, Artificial
  CRISPR gRNA sequence
atttcctttatataggatat

SEQ ID NO: 225979 - DNA, 20 bp, Artificial
  CRISPR gRNA sequence
cctttatataggatatgtgg

SEQ ID NO: 225980 - DNA, 20 bp, Artificial
  CRISPR gRNA sequence
ctttatataggatatgtgga

SEQ ID NO: 225981 - DNA, 20 bp, Artificial
  CRISPR gRNA sequence
tatataggatatgtggatat

SEQ ID NO: 225982 - DNA, 20 bp, Artificial
  CRISPR gRNA sequence
atataggatatgtggatata

SEQ ID NO: 225983 - DNA, 20 bp, Artificial
  CRISPR gRNA sequence
tataggatatgtggatatat

SEQ ID NO: 225984 - DNA, 20 bp, Artificial
  CRISPR gRNA sequence
ttatgataaaagtaacatgt

SEQ ID NO: 225985 - DNA, 20 bp, Artificial
  CRISPR gRNA sequence
tatgataaaagtaacatgtg

SEQ ID NO: 225986 - DNA, 20 bp, Artificial
  CRISPR gRNA sequence
atgataaaagtaacatgtga

SEQ ID NO: 225987 - DNA, 20 bp, Artificial
  CRISPR gRNA sequence
tgataaaagtaacatgtgac

SEQ ID NO: 225988 - DNA, 20 bp, Artificial
  CRISPR gRNA sequence
aataacagcttcgttaatat

SEQ ID NO: 225989 - DNA, 20 bp, Artificial
  CRISPR gRNA sequence
ataacagcttcgttaatatc

SEQ ID NO: 225990 - DNA, 20 bp, Artificial
  CRISPR gRNA sequence
cgttaatatcctaaagccac

SEQ ID NO: 225991 - DNA, 20 bp, Artificial
  CRISPR gRNA sequence
gttaatatcctaaagccact

SEQ ID NO: 225992 - DNA, 20 bp, Artificial
  CRISPR gRNA sequence
atatcctaaagccactcatc

SEQ ID NO: 225993 - DNA, 20 bp, Artificial
  CRISPR gRNA sequence
aagccactcatcttacttta

SEQ ID NO: 225994 - DNA, 20 bp, Artificial
  CRISPR gRNA sequence
atcttactttacatataaac

SEQ ID NO: 225995 - DNA, 20 bp, Artificial
  CRISPR gRNA sequence
actttacatataaacagtcc

SEQ ID NO: 225996 - DNA, 20 bp, Artificial
  CRISPR gRNA sequence
ctttacatataaacagtcct

SEQ ID NO: 225997 - DNA, 20 bp, Artificial
  CRISPR gRNA sequence
tacatataaacagtccttct

SEQ ID NO: 225998 - DNA, 20 bp, Artificial
  CRISPR gRNA sequence
acatataaacagtccttctg

SEQ ID NO: 225999 - DNA, 20 bp, Artificial
  CRISPR gRNA sequence
catataaacagtccttctga

SEQ ID NO: 226000 - DNA, 20 bp, Artificial
  CRISPR gRNA sequence
ctgaagcctaattatgcatg

SEQ ID NO: 226001 - DNA, 20 bp, Artificial
  CRISPR gRNA sequence
tgaagcctaattatgcatgg

SEQ ID NO: 226002 - DNA, 20 bp, Artificial
  CRISPR gRNA sequence
aagcctaattatgcatggat

SEQ ID NO: 226003 - DNA, 20 bp, Artificial
  CRISPR gRNA sequence
attatgcatggataattgca

SEQ ID NO: 226004 - DNA, 20 bp, Artificial
  CRISPR gRNA sequence
tgcatggataattgcagagt

SEQ ID NO: 226005 - DNA, 20 bp, Artificial
  CRISPR gRNA sequence
cagagtgagtttgggaaaag

SEQ ID NO: 226006 - DNA, 20 bp, Artificial
  CRISPR gRNA sequence
gggaaaagaccaaccgggca

SEQ ID NO: 226007 - DNA, 20 bp, Artificial
  CRISPR gRNA sequence
ggaaaagaccaaccgggcac

SEQ ID NO: 226008 - DNA, 20 bp, Artificial
  CRISPR gRNA sequence
tctccattttaaccacaatg

SEQ ID NO: 226009 - DNA, 20 bp, Artificial
  CRISPR gRNA sequence
tccattttaaccacaatgag

SEQ ID NO: 226010 - DNA, 20 bp, Artificial
  CRISPR gRNA sequence
cattttaaccacaatgagaa

SEQ ID NO: 226011 - DNA, 20 bp, Artificial
  CRISPR gRNA sequence
taaccacaatgagaagagag

SEQ ID NO: 226012 - DNA, 20 bp, Artificial
  CRISPR gRNA sequence
aaccacaatgagaagagagt

SEQ ID NO: 226013 - DNA, 20 bp, Artificial
  CRISPR gRNA sequence
accacaatgagaagagagta

SEQ ID NO: 226014 - DNA, 20 bp, Artificial
  CRISPR gRNA sequence
gtggtgcatcttcctcgctt

SEQ ID NO: 226015 - DNA, 20 bp, Artificial
  CRISPR gRNA sequence
cctcgcttaggttccctgag

SEQ ID NO: 226016 - DNA, 20 bp, Artificial
  CRISPR gRNA sequence
ctcgcttaggttccctgagt

SEQ ID NO: 226017 - DNA, 20 bp, Artificial
  CRISPR gRNA sequence
gcttaggttccctgagtctg

SEQ ID NO: 226018 - DNA, 20 bp, Artificial
  CRISPR gRNA sequence
aggttccctgagtctgtctt

SEQ ID NO: 226019 - DNA, 20 bp, Artificial
  CRISPR gRNA sequence
ggttccctgagtctgtcttt

SEQ ID NO: 226020 - DNA, 20 bp, Artificial
  CRISPR gRNA sequence
cctgagtctgtctttacagg

SEQ ID NO: 226021 - DNA, 20 bp, Artificial
  CRISPR gRNA sequence
agtctgtctttacaggaaga

SEQ ID NO: 226022 - DNA, 20 bp, Artificial
  CRISPR gRNA sequence
tctttacaggaagacttcat

SEQ ID NO: 226023 - DNA, 20 bp, Artificial
  CRISPR gRNA sequence
tacaggaagacttcattgtt

SEQ ID NO: 226024 - DNA, 20 bp, Artificial
  CRISPR gRNA sequence
acaggaagacttcattgtta

SEQ ID NO: 226025 - DNA, 20 bp, Artificial
  CRISPR gRNA sequence
caggaagacttcattgttac

SEQ ID NO: 226026 - DNA, 20 bp, Artificial
  CRISPR gRNA sequence
cattgttacttgaaggtaca

SEQ ID NO: 226027 - DNA, 20 bp, Artificial
  CRISPR gRNA sequence
attgttacttgaaggtacat

SEQ ID NO: 226028 - DNA, 20 bp, Artificial
  CRISPR gRNA sequence
ttacttgaaggtacattctt

SEQ ID NO: 226029 - DNA, 20 bp, Artificial
  CRISPR gRNA sequence
cttgaaggtacattcttgga

SEQ ID NO: 226030 - DNA, 20 bp, Artificial
  CRISPR gRNA sequence
gaaggtacattcttggaact

SEQ ID NO: 226031 - DNA, 20 bp, Artificial
  CRISPR gRNA sequence
aaggtacattcttggaactt

SEQ ID NO: 226032 - DNA, 20 bp, Artificial
  CRISPR gRNA sequence
ttggaactttacacacccag

SEQ ID NO: 226033 - DNA, 20 bp, Artificial
  CRISPR gRNA sequence
ggaactttacacacccagcc

SEQ ID NO: 226034 - DNA, 20 bp, Artificial
  CRISPR gRNA sequence
gaactttacacacccagcca

SEQ ID NO: 226035 - DNA, 20 bp, Artificial
  CRISPR gRNA sequence
tacacacccagccactcaac

SEQ ID NO: 226036 - DNA, 20 bp, Artificial
  CRISPR gRNA sequence
acacacccagccactcaaca

SEQ ID NO: 226037 - DNA, 20 bp, Artificial
  CRISPR gRNA sequence
cacacccagccactcaacac

SEQ ID NO: 226038 - DNA, 20 bp, Artificial
  CRISPR gRNA sequence
aacacatgaatacatactta

SEQ ID NO: 226039 - DNA, 20 bp, Artificial
  CRISPR gRNA sequence
attttagttaactgagtact

SEQ ID NO: 226040 - DNA, 20 bp, Artificial
  CRISPR gRNA sequence
ttttagttaactgagtactt

SEQ ID NO: 226041 - DNA, 20 bp, Artificial
  CRISPR gRNA sequence
tagttaactgagtacttagt

SEQ ID NO: 226042 - DNA, 20 bp, Artificial
  CRISPR gRNA sequence
agttaactgagtacttagtg

SEQ ID NO: 226043 - DNA, 20 bp, Artificial
  CRISPR gRNA sequence
gttaactgagtacttagtga

SEQ ID NO: 226044 - DNA, 20 bp, Artificial
  CRISPR gRNA sequence
actgagtacttagtgagtgc

SEQ ID NO: 226045 - DNA, 20 bp, Artificial
  CRISPR gRNA sequence
agtacttagtgagtgctaag

SEQ ID NO: 226046 - DNA, 20 bp, Artificial
  CRISPR gRNA sequence
agtgagtgctaagctttgtt

SEQ ID NO: 226047 - DNA, 20 bp, Artificial
  CRISPR gRNA sequence
gtgagtgctaagctttgttt

SEQ ID NO: 226048 - DNA, 20 bp, Artificial
  CRISPR gRNA sequence
agctttgttttaagcccttt

SEQ ID NO: 226049 - DNA, 20 bp, Artificial
  CRISPR gRNA sequence
tgttttaagccctttgcatg

SEQ ID NO: 226050 - DNA, 20 bp, Artificial
  CRISPR gRNA sequence
gttttaagccctttgcatgt

SEQ ID NO: 226051 - DNA, 20 bp, Artificial
  CRISPR gRNA sequence
ttttaagccctttgcatgta

SEQ ID NO: 226052 - DNA, 20 bp, Artificial
  CRISPR gRNA sequence
taagccctttgcatgtagtt

SEQ ID NO: 226053 - DNA, 20 bp, Artificial
  CRISPR gRNA sequence
aagccctttgcatgtagttt

SEQ ID NO: 226054 - DNA, 20 bp, Artificial
  CRISPR gRNA sequence
agccctttgcatgtagttta

SEQ ID NO: 226055 - DNA, 20 bp, Artificial
  CRISPR gRNA sequence
tgcatgtagtttattaactt

SEQ ID NO: 226056 - DNA, 20 bp, Artificial
  CRISPR gRNA sequence
gcatgtagtttattaacttt

SEQ ID NO: 226057 - DNA, 20 bp, Artificial
  CRISPR gRNA sequence
catgtagtttattaactttg

SEQ ID NO: 226058 - DNA, 20 bp, Artificial
  CRISPR gRNA sequence
attaactttgttaatagtta

SEQ ID NO: 226059 - DNA, 20 bp, Artificial
  CRISPR gRNA sequence
ttaactttgttaatagttac

SEQ ID NO: 226060 - DNA, 20 bp, Artificial
  CRISPR gRNA sequence
actttgttaatagttacaac

SEQ ID NO: 226061 - DNA, 20 bp, Artificial
  CRISPR gRNA sequence
tgttaatagttacaacagtc

SEQ ID NO: 226062 - DNA, 20 bp, Artificial
  CRISPR gRNA sequence
gttaatagttacaacagtcc

SEQ ID NO: 226063 - DNA, 20 bp, Artificial
  CRISPR gRNA sequence
ttaatagttacaacagtcct

SEQ ID NO: 226064 - DNA, 20 bp, Artificial
  CRISPR gRNA sequence
atagttacaacagtccttca

SEQ ID NO: 226065 - DNA, 20 bp, Artificial
  CRISPR gRNA sequence
caacagtccttcaagataca

SEQ ID NO: 226066 - DNA, 20 bp, Artificial
  CRISPR gRNA sequence
caagatacatgtactgtgtt

SEQ ID NO: 226067 - DNA, 20 bp, Artificial
  CRISPR gRNA sequence
aagatacatgtactgtgtta

SEQ ID NO: 226068 - DNA, 20 bp, Artificial
  CRISPR gRNA sequence
tgttatactagtgtaacagt

SEQ ID NO: 226069 - DNA, 20 bp, Artificial
  CRISPR gRNA sequence
tactagtgtaacagttgagg

SEQ ID NO: 226070 - DNA, 20 bp, Artificial
  CRISPR gRNA sequence
gtgtaacagttgaggacacc

SEQ ID NO: 226071 - DNA, 20 bp, Artificial
  CRISPR gRNA sequence
aggacaccaaagaacaaaga

SEQ ID NO: 226072 - DNA, 20 bp, Artificial
  CRISPR gRNA sequence
acacgtggtcacggttccat

SEQ ID NO: 226073 - DNA, 20 bp, Artificial
  CRISPR gRNA sequence
catagagtgttaagttagag

SEQ ID NO: 226074 - DNA, 20 bp, Artificial
  CRISPR gRNA sequence
agttagagttgggttcaaac

SEQ ID NO: 226075 - DNA, 20 bp, Artificial
  CRISPR gRNA sequence
gagttgggttcaaaccctgg

SEQ ID NO: 226076 - DNA, 20 bp, Artificial
  CRISPR gRNA sequence
ggttcaaaccctggcagtgt

SEQ ID NO: 226077 - DNA, 20 bp, Artificial
  CRISPR gRNA sequence
aaaccctggcagtgtggcca

SEQ ID NO: 226078 - DNA, 20 bp, Artificial
  CRISPR gRNA sequence
gcagtgtggccacagagcct

SEQ ID NO: 226079 - DNA, 20 bp, Artificial
  CRISPR gRNA sequence
gttctcagccactgcactgc

SEQ ID NO: 226080 - DNA, 20 bp, Artificial
  CRISPR gRNA sequence
ttctcagccactgcactgca

SEQ ID NO: 226081 - DNA, 20 bp, Artificial
  CRISPR gRNA sequence
tcagccactgcactgcacta

SEQ ID NO: 226082 - DNA, 20 bp, Artificial
  CRISPR gRNA sequence
agccactgcactgcactacc

SEQ ID NO: 226083 - DNA, 20 bp, Artificial
  CRISPR gRNA sequence
cactgcactacctcctcccg

SEQ ID NO: 226084 - DNA, 20 bp, Artificial
  CRISPR gRNA sequence
cactacctcctcccgtgaaa

SEQ ID NO: 226085 - DNA, 20 bp, Artificial
  CRISPR gRNA sequence
cctcctcccgtgaaacataa

SEQ ID NO: 226086 - DNA, 20 bp, Artificial
  CRISPR gRNA sequence
ctcccgtgaaacataagaaa

SEQ ID NO: 226087 - DNA, 20 bp, Artificial
  CRISPR gRNA sequence
ccgtgaaacataagaaaaat

SEQ ID NO: 226088 - DNA, 20 bp, Artificial
  CRISPR gRNA sequence
aagtaagtgtagtttttatt

SEQ ID NO: 226089 - DNA, 20 bp, Artificial
  CRISPR gRNA sequence
agtaagtgtagtttttattc

SEQ ID NO: 226090 - DNA, 20 bp, Artificial
  CRISPR gRNA sequence
ttattcataaataaaattta

SEQ ID NO: 226091 - DNA, 20 bp, Artificial
  CRISPR gRNA sequence
tattcataaataaaatttac

SEQ ID NO: 226092 - DNA, 20 bp, Artificial
  CRISPR gRNA sequence
attcataaataaaatttaca

SEQ ID NO: 226093 - DNA, 20 bp, Artificial
  CRISPR gRNA sequence
ttcataaataaaatttacat

SEQ ID NO: 226094 - DNA, 20 bp, Artificial
  CRISPR gRNA sequence
ataaataaaatttacataag

SEQ ID NO: 226095 - DNA, 20 bp, Artificial
  CRISPR gRNA sequence
acataagtacattatgtgta

SEQ ID NO: 226096 - DNA, 20 bp, Artificial
  CRISPR gRNA sequence
cataagtacattatgtgtaa

SEQ ID NO: 226097 - DNA, 20 bp, Artificial
  CRISPR gRNA sequence
tgtgtaatttgttttatgta

SEQ ID NO: 226098 - DNA, 20 bp, Artificial
  CRISPR gRNA sequence
gttttatgtatatgtgtgta

SEQ ID NO: 226099 - DNA, 20 bp, Artificial
  CRISPR gRNA sequence
ttttatgtatatgtgtgtat

SEQ ID NO: 226100 - DNA, 20 bp, Artificial
  CRISPR gRNA sequence
tatgtatatgtgtgtatgta

SEQ ID NO: 226101 - DNA, 20 bp, Artificial
  CRISPR gRNA sequence
atgtatatgtgtgtatgtat

SEQ ID NO: 226102 - DNA, 20 bp, Artificial
  CRISPR gRNA sequence
tgtatatgtgtgtatgtata

SEQ ID NO: 226103 - DNA, 20 bp, Artificial
  CRISPR gRNA sequence
taatttttttccatctctat

SEQ ID NO: 226104 - DNA, 20 bp, Artificial
  CRISPR gRNA sequence
aatttttttccatctctata

SEQ ID NO: 226105 - DNA, 20 bp, Artificial
  CRISPR gRNA sequence
atttttttccatctctataa

SEQ ID NO: 226106 - DNA, 20 bp, Artificial
  CRISPR gRNA sequence
ttttccatctctataataaa

SEQ ID NO: 226107 - DNA, 20 bp, Artificial
  CRISPR gRNA sequence
tttccatctctataataaag

SEQ ID NO: 226108 - DNA, 20 bp, Artificial
  CRISPR gRNA sequence
ttccatctctataataaagc

SEQ ID NO: 226109 - DNA, 20 bp, Artificial
  CRISPR gRNA sequence
tccatctctataataaagca

SEQ ID NO: 226110 - DNA, 20 bp, Artificial
  CRISPR gRNA sequence
ccatctctataataaagcat

SEQ ID NO: 226111 - DNA, 20 bp, Artificial
  CRISPR gRNA sequence
catctctataataaagcatg

SEQ ID NO: 226112 - DNA, 20 bp, Artificial
  CRISPR gRNA sequence
tataataaagcatgtattat

SEQ ID NO: 226113 - DNA, 20 bp, Artificial
  CRISPR gRNA sequence
taataaagcatgtattatag

SEQ ID NO: 226114 - DNA, 20 bp, Artificial
  CRISPR gRNA sequence
tagaccattagcagaattta

SEQ ID NO: 226115 - DNA, 20 bp, Artificial
  CRISPR gRNA sequence
gcagaatttaaagtgttata

SEQ ID NO: 226116 - DNA, 20 bp, Artificial
  CRISPR gRNA sequence
aaagtgttatagtaaatatt

SEQ ID NO: 226117 - DNA, 20 bp, Artificial
  CRISPR gRNA sequence
aagtgttatagtaaatatta

SEQ ID NO: 226118 - DNA, 20 bp, Artificial
  CRISPR gRNA sequence
tagtaaatattaattgtgac

SEQ ID NO: 226119 - DNA, 20 bp, Artificial
  CRISPR gRNA sequence
attgtgacttttgttttctt

SEQ ID NO: 226120 - DNA, 20 bp, Artificial
  CRISPR gRNA sequence
tgacttttgttttcttcttc

SEQ ID NO: 226121 - DNA, 20 bp, Artificial
  CRISPR gRNA sequence
ttgttttcttcttccccagt

SEQ ID NO: 226122 - DNA, 20 bp, Artificial
  CRISPR gRNA sequence
tgttttcttcttccccagtt

SEQ ID NO: 226123 - DNA, 20 bp, Artificial
  CRISPR gRNA sequence
gttttcttcttccccagttt

SEQ ID NO: 226124 - DNA, 20 bp, Artificial
  CRISPR gRNA sequence
ttttcttcttccccagtttc

SEQ ID NO: 226125 - DNA, 20 bp, Artificial
  CRISPR gRNA sequence
tcttcttccccagtttcatg

SEQ ID NO: 226126 - DNA, 20 bp, Artificial
  CRISPR gRNA sequence
cttcttccccagtttcatgg

SEQ ID NO: 226127 - DNA, 20 bp, Artificial
  CRISPR gRNA sequence
ttcttccccagtttcatggt

SEQ ID NO: 226128 - DNA, 20 bp, Artificial
  CRISPR gRNA sequence
cttccccagtttcatggttt

SEQ ID NO: 226129 - DNA, 20 bp, Artificial
  CRISPR gRNA sequence
ttccccagtttcatggtttt

SEQ ID NO: 226130 - DNA, 20 bp, Artificial
  CRISPR gRNA sequence
ccccagtttcatggttttct

SEQ ID NO: 226131 - DNA, 20 bp, Artificial
  CRISPR gRNA sequence
cccagtttcatggttttctc

SEQ ID NO: 226132 - DNA, 20 bp, Artificial
  CRISPR gRNA sequence
catggttttctccaaatgaa

SEQ ID NO: 226133 - DNA, 20 bp, Artificial
  CRISPR gRNA sequence
atggttttctccaaatgaaa

SEQ ID NO: 226134 - DNA, 20 bp, Artificial
  CRISPR gRNA sequence
tctccaaatgaaaatattct

SEQ ID NO: 226135 - DNA, 20 bp, Artificial
  CRISPR gRNA sequence
ctccaaatgaaaatattctt

SEQ ID NO: 226136 - DNA, 20 bp, Artificial
  CRISPR gRNA sequence
tccaaatgaaaatattctta

SEQ ID NO: 226137 - DNA, 20 bp, Artificial
  CRISPR gRNA sequence
caaatgaaaatattcttatt

SEQ ID NO: 226138 - DNA, 20 bp, Artificial
  CRISPR gRNA sequence
ttattgttattttcccaatt

SEQ ID NO: 226139 - DNA, 20 bp, Artificial
  CRISPR gRNA sequence
attgttattttcccaatttt

SEQ ID NO: 226140 - DNA, 20 bp, Artificial
  CRISPR gRNA sequence
ttgttattttcccaattttt

SEQ ID NO: 226141 - DNA, 20 bp, Artificial
  CRISPR gRNA sequence
ttattttcccaatttttgct

SEQ ID NO: 226142 - DNA, 20 bp, Artificial
  CRISPR gRNA sequence
ttttcccaatttttgctata

SEQ ID NO: 226143 - DNA, 20 bp, Artificial
  CRISPR gRNA sequence
tcccaatttttgctatactc

SEQ ID NO: 226144 - DNA, 20 bp, Artificial
  CRISPR gRNA sequence
cccaatttttgctatactcc

SEQ ID NO: 226145 - DNA, 20 bp, Artificial
  CRISPR gRNA sequence
ccaatttttgctatactcct

SEQ ID NO: 226146 - DNA, 20 bp, Artificial
  CRISPR gRNA sequence
ttgctatactcctgttctgg

SEQ ID NO: 226147 - DNA, 20 bp, Artificial
  CRISPR gRNA sequence
tgctatactcctgttctggg

SEQ ID NO: 226148 - DNA, 20 bp, Artificial
  CRISPR gRNA sequence
gctatactcctgttctgggg

SEQ ID NO: 226149 - DNA, 20 bp, Artificial
  CRISPR gRNA sequence
ctatactcctgttctgggga

SEQ ID NO: 226150 - DNA, 20 bp, Artificial
  CRISPR gRNA sequence
tactcctgttctggggacag

SEQ ID NO: 226151 - DNA, 20 bp, Artificial
  CRISPR gRNA sequence
ctgttctggggacagtttgg

SEQ ID NO: 226152 - DNA, 20 bp, Artificial
  CRISPR gRNA sequence
ttctggggacagtttggtat

SEQ ID NO: 226153 - DNA, 20 bp, Artificial
  CRISPR gRNA sequence
tggggacagtttggtattaa

SEQ ID NO: 226154 - DNA, 20 bp, Artificial
  CRISPR gRNA sequence
gggacagtttggtattaaaa

SEQ ID NO: 226155 - DNA, 20 bp, Artificial
  CRISPR gRNA sequence
ggtattaaaagtaagtatta

SEQ ID NO: 226156 - DNA, 20 bp, Artificial
  CRISPR gRNA sequence
gtattaaaagtaagtattat

SEQ ID NO: 226157 - DNA, 20 bp, Artificial
  CRISPR gRNA sequence
aaagtaagtattatttctac

SEQ ID NO: 226158 - DNA, 20 bp, Artificial
  CRISPR gRNA sequence
tttctacttttcatttatgt

SEQ ID NO: 226159 - DNA, 20 bp, Artificial
  CRISPR gRNA sequence
ctacttttcatttatgtttc

SEQ ID NO: 226160 - DNA, 20 bp, Artificial
  CRISPR gRNA sequence
tacttttcatttatgtttca

SEQ ID NO: 226161 - DNA, 20 bp, Artificial
  CRISPR gRNA sequence
cttttcatttatgtttcagt

SEQ ID NO: 226162 - DNA, 20 bp, Artificial
  CRISPR gRNA sequence
ttcatttatgtttcagtgat

SEQ ID NO: 226163 - DNA, 20 bp, Artificial
  CRISPR gRNA sequence
tcatttatgtttcagtgatg

SEQ ID NO: 226164 - DNA, 20 bp, Artificial
  CRISPR gRNA sequence
catttatgtttcagtgatga

SEQ ID NO: 226165 - DNA, 20 bp, Artificial
  CRISPR gRNA sequence
atttatgtttcagtgatgat

SEQ ID NO: 226166 - DNA, 20 bp, Artificial
  CRISPR gRNA sequence
atgtttcagtgatgatatag

SEQ ID NO: 226167 - DNA, 20 bp, Artificial
  CRISPR gRNA sequence
tgtttcagtgatgatatagt

SEQ ID NO: 226168 - DNA, 20 bp, Artificial
  CRISPR gRNA sequence
cagtgatgatatagttattt

SEQ ID NO: 226169 - DNA, 20 bp, Artificial
  CRISPR gRNA sequence
agtgatgatatagttatttc

SEQ ID NO: 226170 - DNA, 20 bp, Artificial
  CRISPR gRNA sequence
tttctacgagacattgtcag

SEQ ID NO: 226171 - DNA, 20 bp, Artificial
  CRISPR gRNA sequence
ctacgagacattgtcagcga

SEQ ID NO: 226172 - DNA, 20 bp, Artificial
  CRISPR gRNA sequence
tacgagacattgtcagcgaa

SEQ ID NO: 226173 - DNA, 20 bp, Artificial
  CRISPR gRNA sequence
cgagacattgtcagcgaaat

SEQ ID NO: 226174 - DNA, 20 bp, Artificial
  CRISPR gRNA sequence
tcagcgaaatatttaaagtt

SEQ ID NO: 226175 - DNA, 20 bp, Artificial
  CRISPR gRNA sequence
aaagttgtactaggaaaagt

SEQ ID NO: 226176 - DNA, 20 bp, Artificial
  CRISPR gRNA sequence
aagttgtactaggaaaagtg

SEQ ID NO: 226177 - DNA, 20 bp, Artificial
  CRISPR gRNA sequence
tactaggaaaagtgctatta

SEQ ID NO: 226178 - DNA, 20 bp, Artificial
  CRISPR gRNA sequence
ggaaaagtgctattatgata

SEQ ID NO: 226179 - DNA, 20 bp, Artificial
  CRISPR gRNA sequence
ttatgataaatatgagtatg

SEQ ID NO: 226180 - DNA, 20 bp, Artificial
  CRISPR gRNA sequence
tgataaatatgagtatgtaa

SEQ ID NO: 226181 - DNA, 20 bp, Artificial
  CRISPR gRNA sequence
gaatactactagtctccttg

SEQ ID NO: 226182 - DNA, 20 bp, Artificial
  CRISPR gRNA sequence
aatactactagtctccttga

SEQ ID NO: 226183 - DNA, 20 bp, Artificial
  CRISPR gRNA sequence
ctagtctccttgaagtatat

SEQ ID NO: 226184 - DNA, 20 bp, Artificial
  CRISPR gRNA sequence
gtctccttgaagtatatgtt

SEQ ID NO: 226185 - DNA, 20 bp, Artificial
  CRISPR gRNA sequence
cttgaagtatatgttgtcgc

SEQ ID NO: 226186 - DNA, 20 bp, Artificial
  CRISPR gRNA sequence
gaagtatatgttgtcgccca

SEQ ID NO: 226187 - DNA, 20 bp, Artificial
  CRISPR gRNA sequence
aagtatatgttgtcgcccac

SEQ ID NO: 226188 - DNA, 20 bp, Artificial
  CRISPR gRNA sequence
tcgcccacattttgctgcag

SEQ ID NO: 226189 - DNA, 20 bp, Artificial
  CRISPR gRNA sequence
tgctgcagttcacttttaat

SEQ ID NO: 226190 - DNA, 20 bp, Artificial
  CRISPR gRNA sequence
gctgcagttcacttttaatt

SEQ ID NO: 226191 - DNA, 20 bp, Artificial
  CRISPR gRNA sequence
ctgcagttcacttttaattc

SEQ ID NO: 226192 - DNA, 20 bp, Artificial
  CRISPR gRNA sequence
cagttcacttttaattccta

SEQ ID NO: 226193 - DNA, 20 bp, Artificial
  CRISPR gRNA sequence
acttttaattcctaagaagg

SEQ ID NO: 226194 - DNA, 20 bp, Artificial
  CRISPR gRNA sequence
ttaattcctaagaaggttgt

SEQ ID NO: 226195 - DNA, 20 bp, Artificial
  CRISPR gRNA sequence
taattcctaagaaggttgtt

SEQ ID NO: 226196 - DNA, 20 bp, Artificial
  CRISPR gRNA sequence
aattcctaagaaggttgttt

SEQ ID NO: 226197 - DNA, 20 bp, Artificial
  CRISPR gRNA sequence
attcctaagaaggttgtttt

SEQ ID NO: 226198 - DNA, 20 bp, Artificial
  CRISPR gRNA sequence
ctaagaaggttgttttcact

SEQ ID NO: 226199 - DNA, 20 bp, Artificial
  CRISPR gRNA sequence
agaaggttgttttcacttgg

SEQ ID NO: 226200 - DNA, 20 bp, Artificial
  CRISPR gRNA sequence
ttttcacttggtgttttttt

SEQ ID NO: 226201 - DNA, 20 bp, Artificial
  CRISPR gRNA sequence
tcacttggtgtttttttaat

SEQ ID NO: 226202 - DNA, 20 bp, Artificial
  CRISPR gRNA sequence
cacttggtgtttttttaatc

SEQ ID NO: 226203 - DNA, 20 bp, Artificial
  CRISPR gRNA sequence
acttggtgtttttttaatct

SEQ ID NO: 226204 - DNA, 20 bp, Artificial
  CRISPR gRNA sequence
ggtgtttttttaatctctta

SEQ ID NO: 226205 - DNA, 20 bp, Artificial
  CRISPR gRNA sequence
gtgtttttttaatctcttaa

SEQ ID NO: 226206 - DNA, 20 bp, Artificial
  CRISPR gRNA sequence
ttttaatctcttaagaatga

SEQ ID NO: 226207 - DNA, 20 bp, Artificial
  CRISPR gRNA sequence
tttaatctcttaagaatgaa

SEQ ID NO: 226208 - DNA, 20 bp, Artificial
  CRISPR gRNA sequence
ttaatctcttaagaatgaat

SEQ ID NO: 226209 - DNA, 20 bp, Artificial
  CRISPR gRNA sequence
taatctcttaagaatgaata

SEQ ID NO: 226210 - DNA, 20 bp, Artificial
  CRISPR gRNA sequence
aatctcttaagaatgaatag

SEQ ID NO: 226211 - DNA, 20 bp, Artificial
  CRISPR gRNA sequence
atctcttaagaatgaatagt

SEQ ID NO: 226212 - DNA, 20 bp, Artificial
  CRISPR gRNA sequence
ttaagaatgaatagtaggaa

SEQ ID NO: 226213 - DNA, 20 bp, Artificial
  CRISPR gRNA sequence
aagaatgaatagtaggaata

SEQ ID NO: 226214 - DNA, 20 bp, Artificial
  CRISPR gRNA sequence
agaatgaatagtaggaatat

SEQ ID NO: 226215 - DNA, 20 bp, Artificial
  CRISPR gRNA sequence
gtaccaacaccttaaactca

SEQ ID NO: 226216 - DNA, 20 bp, Artificial
  CRISPR gRNA sequence
aaactcatgtcacattttaa

SEQ ID NO: 226217 - DNA, 20 bp, Artificial
  CRISPR gRNA sequence
aactcatgtcacattttaat

SEQ ID NO: 226218 - DNA, 20 bp, Artificial
  CRISPR gRNA sequence
atgtcacattttaatattca

SEQ ID NO: 226219 - DNA, 20 bp, Artificial
  CRISPR gRNA sequence
taatattcacagaacatcta

SEQ ID NO: 226220 - DNA, 20 bp, Artificial
  CRISPR gRNA sequence
aatattcacagaacatctac

SEQ ID NO: 226221 - DNA, 20 bp, Artificial
  CRISPR gRNA sequence
atattcacagaacatctaca

SEQ ID NO: 226222 - DNA, 20 bp, Artificial
  CRISPR gRNA sequence
acagaacatctacacacaca

SEQ ID NO: 226223 - DNA, 20 bp, Artificial
  CRISPR gRNA sequence
cacacacattatgttattag

SEQ ID NO: 226224 - DNA, 20 bp, Artificial
  CRISPR gRNA sequence
tgttattaggtaaacaggtg

SEQ ID NO: 226225 - DNA, 20 bp, Artificial
  CRISPR gRNA sequence
ttaggtaaacaggtggtgac

SEQ ID NO: 226226 - DNA, 20 bp, Artificial
  CRISPR gRNA sequence
ggtaaacaggtggtgacagc

SEQ ID NO: 226227 - DNA, 20 bp, Artificial
  CRISPR gRNA sequence
cattagttttaaggtaggac

SEQ ID NO: 226228 - DNA, 20 bp, Artificial
  CRISPR gRNA sequence
gttttaaggtaggacgttat

SEQ ID NO: 226229 - DNA, 20 bp, Artificial
  CRISPR gRNA sequence
taaggtaggacgttatactt

SEQ ID NO: 226230 - DNA, 20 bp, Artificial
  CRISPR gRNA sequence
aaggtaggacgttatacttt

SEQ ID NO: 226231 - DNA, 20 bp, Artificial
  CRISPR gRNA sequence
aggtaggacgttatactttg

SEQ ID NO: 226232 - DNA, 20 bp, Artificial
  CRISPR gRNA sequence
tactttggagcatttagatt

SEQ ID NO: 226233 - DNA, 20 bp, Artificial
  CRISPR gRNA sequence
tggagcatttagattcccct

SEQ ID NO: 226234 - DNA, 20 bp, Artificial
  CRISPR gRNA sequence
ggagcatttagattcccctc

SEQ ID NO: 226235 - DNA, 20 bp, Artificial
  CRISPR gRNA sequence
gagcatttagattcccctct

SEQ ID NO: 226236 - DNA, 20 bp, Artificial
  CRISPR gRNA sequence
agattcccctctttttattt

SEQ ID NO: 226237 - DNA, 20 bp, Artificial
  CRISPR gRNA sequence
gattcccctctttttatttt

SEQ ID NO: 226238 - DNA, 20 bp, Artificial
  CRISPR gRNA sequence
ccctctttttattttcccag

SEQ ID NO: 226239 - DNA, 20 bp, Artificial
  CRISPR gRNA sequence
tttttattttcccagtttga

SEQ ID NO: 226240 - DNA, 20 bp, Artificial
  CRISPR gRNA sequence
tttattttcccagtttgatt

SEQ ID NO: 226241 - DNA, 20 bp, Artificial
  CRISPR gRNA sequence
ttattttcccagtttgattt

SEQ ID NO: 226242 - DNA, 20 bp, Artificial
  CRISPR gRNA sequence
tattttcccagtttgatttt

SEQ ID NO: 226243 - DNA, 20 bp, Artificial
  CRISPR gRNA sequence
attttcccagtttgattttc

SEQ ID NO: 226244 - DNA, 20 bp, Artificial
  CRISPR gRNA sequence
ttttcccagtttgattttct

SEQ ID NO: 226245 - DNA, 20 bp, Artificial
  CRISPR gRNA sequence
tcccagtttgattttctctg

SEQ ID NO: 226246 - DNA, 20 bp, Artificial
  CRISPR gRNA sequence
cccagtttgattttctctgt

SEQ ID NO: 226247 - DNA, 20 bp, Artificial
  CRISPR gRNA sequence
ccagtttgattttctctgtg

SEQ ID NO: 226248 - DNA, 20 bp, Artificial
  CRISPR gRNA sequence
gattttctctgtgtacacgt

SEQ ID NO: 226249 - DNA, 20 bp, Artificial
  CRISPR gRNA sequence
attttctctgtgtacacgtg

SEQ ID NO: 226250 - DNA, 20 bp, Artificial
  CRISPR gRNA sequence
tctctgtgtacacgtgttca

SEQ ID NO: 226251 - DNA, 20 bp, Artificial
  CRISPR gRNA sequence
ctctgtgtacacgtgttcac

SEQ ID NO: 226252 - DNA, 20 bp, Artificial
  CRISPR gRNA sequence
tctgtgtacacgtgttcacc

SEQ ID NO: 226253 - DNA, 20 bp, Artificial
  CRISPR gRNA sequence
tgtgtacacgtgttcaccct

SEQ ID NO: 226254 - DNA, 20 bp, Artificial
  CRISPR gRNA sequence
tgtacacgtgttcacccttg

SEQ ID NO: 226255 - DNA, 20 bp, Artificial
  CRISPR gRNA sequence
acccttggaaaagtccagtc

SEQ ID NO: 226256 - DNA, 20 bp, Artificial
  CRISPR gRNA sequence
ggaaaagtccagtcggaact

SEQ ID NO: 226257 - DNA, 20 bp, Artificial
  CRISPR gRNA sequence
gaaaagtccagtcggaacta

SEQ ID NO: 226258 - DNA, 20 bp, Artificial
  CRISPR gRNA sequence
tgttttgtcatcctctgcgt

SEQ ID NO: 226259 - DNA, 20 bp, Artificial
  CRISPR gRNA sequence
tgtcatcctctgcgtgcagt

SEQ ID NO: 226260 - DNA, 20 bp, Artificial
  CRISPR gRNA sequence
gtcatcctctgcgtgcagtt

SEQ ID NO: 226261 - DNA, 20 bp, Artificial
  CRISPR gRNA sequence
tcatcctctgcgtgcagttc

SEQ ID NO: 226262 - DNA, 20 bp, Artificial
  CRISPR gRNA sequence
tgcgtgcagttctgcagcct

SEQ ID NO: 226263 - DNA, 20 bp, Artificial
  CRISPR gRNA sequence
cgtgcagttctgcagcctct

SEQ ID NO: 226264 - DNA, 20 bp, Artificial
  CRISPR gRNA sequence
tgcagcctctaaagaagcag

SEQ ID NO: 226265 - DNA, 20 bp, Artificial
  CRISPR gRNA sequence
cagcctctaaagaagcagcc

SEQ ID NO: 226266 - DNA, 20 bp, Artificial
  CRISPR gRNA sequence
taaagaagcagccaccagag

SEQ ID NO: 226267 - DNA, 20 bp, Artificial
  CRISPR gRNA sequence
aagaagcagccaccagagag

SEQ ID NO: 226268 - DNA, 20 bp, Artificial
  CRISPR gRNA sequence
ggttctttgatcttgctttc

SEQ ID NO: 226269 - DNA, 20 bp, Artificial
  CRISPR gRNA sequence
tttgatcttgctttcctata

SEQ ID NO: 226270 - DNA, 20 bp, Artificial
  CRISPR gRNA sequence
tgatcttgctttcctataat

SEQ ID NO: 226271 - DNA, 20 bp, Artificial
  CRISPR gRNA sequence
gatcttgctttcctataata

SEQ ID NO: 226272 - DNA, 20 bp, Artificial
  CRISPR gRNA sequence
atcttgctttcctataatag

SEQ ID NO: 226273 - DNA, 20 bp, Artificial
  CRISPR gRNA sequence
gctttcctataatagtaacg

SEQ ID NO: 226274 - DNA, 20 bp, Artificial
  CRISPR gRNA sequence
ctttcctataatagtaacgt

SEQ ID NO: 226275 - DNA, 20 bp, Artificial
  CRISPR gRNA sequence
tcctataatagtaacgtaac

SEQ ID NO: 226276 - DNA, 20 bp, Artificial
  CRISPR gRNA sequence
cctataatagtaacgtaacc

SEQ ID NO: 226277 - DNA, 20 bp, Artificial
  CRISPR gRNA sequence
ctataatagtaacgtaacca

SEQ ID NO: 226278 - DNA, 20 bp, Artificial
  CRISPR gRNA sequence
taatagtaacgtaaccagac

SEQ ID NO: 226279 - DNA, 20 bp, Artificial
  CRISPR gRNA sequence
ctgaaggcagatcttgatgc

SEQ ID NO: 226280 - DNA, 20 bp, Artificial
  CRISPR gRNA sequence
tgaaggcagatcttgatgct

SEQ ID NO: 226281 - DNA, 20 bp, Artificial
  CRISPR gRNA sequence
aaggcagatcttgatgctgc

SEQ ID NO: 226282 - DNA, 20 bp, Artificial
  CRISPR gRNA sequence
gatgctgcattagatttagc

SEQ ID NO: 226283 - DNA, 20 bp, Artificial
  CRISPR gRNA sequence
atgctgcattagatttagct

SEQ ID NO: 226284 - DNA, 20 bp, Artificial
  CRISPR gRNA sequence
cattagatttagcttcaaca

SEQ ID NO: 226285 - DNA, 20 bp, Artificial
  CRISPR gRNA sequence
gatttagcttcaacaacaca

SEQ ID NO: 226286 - DNA, 20 bp, Artificial
  CRISPR gRNA sequence
agcttcaacaacacagaatt

SEQ ID NO: 226287 - DNA, 20 bp, Artificial
  CRISPR gRNA sequence
gcttcaacaacacagaattg

SEQ ID NO: 226288 - DNA, 20 bp, Artificial
  CRISPR gRNA sequence
caacaacacagaattgtcat

SEQ ID NO: 226289 - DNA, 20 bp, Artificial
  CRISPR gRNA sequence
aacaacacagaattgtcatt

SEQ ID NO: 226290 - DNA, 20 bp, Artificial
  CRISPR gRNA sequence
tcattactaggcaaataggt

SEQ ID NO: 226291 - DNA, 20 bp, Artificial
  CRISPR gRNA sequence
ctaggcaaataggtaatatg

SEQ ID NO: 226292 - DNA, 20 bp, Artificial
  CRISPR gRNA sequence
ggcaaataggtaatatgcat

SEQ ID NO: 226293 - DNA, 20 bp, Artificial
  CRISPR gRNA sequence
cggttaatgtttaatcaacc

SEQ ID NO: 226294 - DNA, 20 bp, Artificial
  CRISPR gRNA sequence
atgtttaatcaaccatattt

SEQ ID NO: 226295 - DNA, 20 bp, Artificial
  CRISPR gRNA sequence
aatcaaccatattttcatat

SEQ ID NO: 226296 - DNA, 20 bp, Artificial
  CRISPR gRNA sequence
atcaaccatattttcatatt

SEQ ID NO: 226297 - DNA, 20 bp, Artificial
  CRISPR gRNA sequence
tcatattttggtaaagaaaa

SEQ ID NO: 226298 - DNA, 20 bp, Artificial
  CRISPR gRNA sequence
catattttggtaaagaaaat

SEQ ID NO: 226299 - DNA, 20 bp, Artificial
  CRISPR gRNA sequence
atattttggtaaagaaaatt

SEQ ID NO: 226300 - DNA, 20 bp, Artificial
  CRISPR gRNA sequence
tggtaaagaaaatttacaaa

SEQ ID NO: 226301 - DNA, 20 bp, Artificial
  CRISPR gRNA sequence
ggtaaagaaaatttacaaaa

SEQ ID NO: 226302 - DNA, 20 bp, Artificial
  CRISPR gRNA sequence
gtaaagaaaatttacaaaat

SEQ ID NO: 226303 - DNA, 20 bp, Artificial
  CRISPR gRNA sequence
acaaaattaatgaagttctg

SEQ ID NO: 226304 - DNA, 20 bp, Artificial
  CRISPR gRNA sequence
caaaattaatgaagttctga

SEQ ID NO: 226305 - DNA, 20 bp, Artificial
  CRISPR gRNA sequence
atgaagttctgaggtgacag

SEQ ID NO: 226306 - DNA, 20 bp, Artificial
  CRISPR gRNA sequence
tgaggtgacagtctaaactt

SEQ ID NO: 226307 - DNA, 20 bp, Artificial
  CRISPR gRNA sequence
aggtgacagtctaaactttt

SEQ ID NO: 226308 - DNA, 20 bp, Artificial
  CRISPR gRNA sequence
aacttttaagctttttaaat

SEQ ID NO: 226309 - DNA, 20 bp, Artificial
  CRISPR gRNA sequence
ttaagctttttaaatacaag

SEQ ID NO: 226310 - DNA, 20 bp, Artificial
  CRISPR gRNA sequence
taagctttttaaatacaaga

SEQ ID NO: 226311 - DNA, 20 bp, Artificial
  CRISPR gRNA sequence
aagctttttaaatacaagat

SEQ ID NO: 226312 - DNA, 20 bp, Artificial
  CRISPR gRNA sequence
agctttttaaatacaagatt

SEQ ID NO: 226313 - DNA, 20 bp, Artificial
  CRISPR gRNA sequence
tttaaatacaagatttattc

SEQ ID NO: 226314 - DNA, 20 bp, Artificial
  CRISPR gRNA sequence
ttaaatacaagatttattcc

SEQ ID NO: 226315 - DNA, 20 bp, Artificial
  CRISPR gRNA sequence
taaatacaagatttattcct

SEQ ID NO: 226316 - DNA, 20 bp, Artificial
  CRISPR gRNA sequence
aaatacaagatttattcctt

SEQ ID NO: 226317 - DNA, 20 bp, Artificial
  CRISPR gRNA sequence
aatacaagatttattccttc

SEQ ID NO: 226318 - DNA, 20 bp, Artificial
  CRISPR gRNA sequence
attccttctttccttgtagc

SEQ ID NO: 226319 - DNA, 20 bp, Artificial
  CRISPR gRNA sequence
ttccttctttccttgtagca

SEQ ID NO: 226320 - DNA, 20 bp, Artificial
  CRISPR gRNA sequence
cttctttccttgtagcatcc

SEQ ID NO: 226321 - DNA, 20 bp, Artificial
  CRISPR gRNA sequence
ctttccttgtagcatcctga

SEQ ID NO: 226322 - DNA, 20 bp, Artificial
  CRISPR gRNA sequence
tttccttgtagcatcctgaa

SEQ ID NO: 226323 - DNA, 20 bp, Artificial
  CRISPR gRNA sequence
tccttgtagcatcctgaaga

SEQ ID NO: 226324 - DNA, 20 bp, Artificial
  CRISPR gRNA sequence
ccttgtagcatcctgaagac

SEQ ID NO: 226325 - DNA, 20 bp, Artificial
  CRISPR gRNA sequence
cttgtagcatcctgaagacc

SEQ ID NO: 226326 - DNA, 20 bp, Artificial
  CRISPR gRNA sequence
gtagcatcctgaagaccagt

SEQ ID NO: 226327 - DNA, 20 bp, Artificial
  CRISPR gRNA sequence
tagcatcctgaagaccagta

SEQ ID NO: 226328 - DNA, 20 bp, Artificial
  CRISPR gRNA sequence
aagaccagtaaacatttata

SEQ ID NO: 226329 - DNA, 20 bp, Artificial
  CRISPR gRNA sequence
atataagcaaggaataaata

SEQ ID NO: 226330 - DNA, 20 bp, Artificial
  CRISPR gRNA sequence
tataagcaaggaataaatac

SEQ ID NO: 226331 - DNA, 20 bp, Artificial
  CRISPR gRNA sequence
cttatttaatttattctgca

SEQ ID NO: 226332 - DNA, 20 bp, Artificial
  CRISPR gRNA sequence
atttaatttattctgcaacc

SEQ ID NO: 226333 - DNA, 20 bp, Artificial
  CRISPR gRNA sequence
tttaatttattctgcaacct

SEQ ID NO: 226334 - DNA, 20 bp, Artificial
  CRISPR gRNA sequence
aatttattctgcaaccttta

SEQ ID NO: 226335 - DNA, 20 bp, Artificial
  CRISPR gRNA sequence
atttattctgcaacctttaa

SEQ ID NO: 226336 - DNA, 20 bp, Artificial
  CRISPR gRNA sequence
attctgcaacctttaaacac

SEQ ID NO: 226337 - DNA, 20 bp, Artificial
  CRISPR gRNA sequence
ttctgcaacctttaaacaca

SEQ ID NO: 226338 - DNA, 20 bp, Artificial
  CRISPR gRNA sequence
tgcaacctttaaacacacaa

SEQ ID NO: 226339 - DNA, 20 bp, Artificial
  CRISPR gRNA sequence
caacctttaaacacacaaaa

SEQ ID NO: 226340 - DNA, 20 bp, Artificial
  CRISPR gRNA sequence
taaacacacaaaagctagta

SEQ ID NO: 226341 - DNA, 20 bp, Artificial
  CRISPR gRNA sequence
aaacacacaaaagctagtaa

SEQ ID NO: 226342 - DNA, 20 bp, Artificial
  CRISPR gRNA sequence
aacacacaaaagctagtaaa

SEQ ID NO: 226343 - DNA, 20 bp, Artificial
  CRISPR gRNA sequence
gtaaactattgcagtggatt

SEQ ID NO: 226344 - DNA, 20 bp, Artificial
  CRISPR gRNA sequence
ttgcagtggattgccctgtt

SEQ ID NO: 226345 - DNA, 20 bp, Artificial
  CRISPR gRNA sequence
cagtggattgccctgttgta

SEQ ID NO: 226346 - DNA, 20 bp, Artificial
  CRISPR gRNA sequence
ccctgttgtatattttatga

SEQ ID NO: 226347 - DNA, 20 bp, Artificial
  CRISPR gRNA sequence
ttgtatattttatgaatttt

SEQ ID NO: 226348 - DNA, 20 bp, Artificial
  CRISPR gRNA sequence
tatattttatgaattttact

SEQ ID NO: 226349 - DNA, 20 bp, Artificial
  CRISPR gRNA sequence
tatgaattttacttttactc

SEQ ID NO: 226350 - DNA, 20 bp, Artificial
  CRISPR gRNA sequence
atgaattttacttttactca

SEQ ID NO: 226351 - DNA, 20 bp, Artificial
  CRISPR gRNA sequence
tgaattttacttttactcag

SEQ ID NO: 226352 - DNA, 20 bp, Artificial
  CRISPR gRNA sequence
tacttttactcagcagttta

SEQ ID NO: 226353 - DNA, 20 bp, Artificial
  CRISPR gRNA sequence
acttttactcagcagtttaa

SEQ ID NO: 226354 - DNA, 20 bp, Artificial
  CRISPR gRNA sequence
cttttactcagcagtttaag

SEQ ID NO: 226355 - DNA, 20 bp, Artificial
  CRISPR gRNA sequence
ttactcagcagtttaagctg

SEQ ID NO: 226356 - DNA, 20 bp, Artificial
  CRISPR gRNA sequence
tactcagcagtttaagctgt

SEQ ID NO: 226357 - DNA, 20 bp, Artificial
  CRISPR gRNA sequence
actcagcagtttaagctgtc

SEQ ID NO: 226358 - DNA, 20 bp, Artificial
  CRISPR gRNA sequence
ctcagcagtttaagctgtct

SEQ ID NO: 226359 - DNA, 20 bp, Artificial
  CRISPR gRNA sequence
agcagtttaagctgtctata

SEQ ID NO: 226360 - DNA, 20 bp, Artificial
  CRISPR gRNA sequence
aagctgtctatatctatggt

SEQ ID NO: 226361 - DNA, 20 bp, Artificial
  CRISPR gRNA sequence
agctgtctatatctatggtg

SEQ ID NO: 226362 - DNA, 20 bp, Artificial
  CRISPR gRNA sequence
tctatatctatggtggtgta

SEQ ID NO: 226363 - DNA, 20 bp, Artificial
  CRISPR gRNA sequence
tatctatggtggtgtataaa

SEQ ID NO: 226364 - DNA, 20 bp, Artificial
  CRISPR gRNA sequence
tggtggtgtataaacatgga

SEQ ID NO: 226365 - DNA, 20 bp, Artificial
  CRISPR gRNA sequence
attgattatatgttttaagc

SEQ ID NO: 226366 - DNA, 20 bp, Artificial
  CRISPR gRNA sequence
attatatgttttaagcgctt

SEQ ID NO: 226367 - DNA, 20 bp, Artificial
  CRISPR gRNA sequence
tatgttttaagcgcttttct

SEQ ID NO: 226368 - DNA, 20 bp, Artificial
  CRISPR gRNA sequence
taagcgcttttctcagtgta

SEQ ID NO: 226369 - DNA, 20 bp, Artificial
  CRISPR gRNA sequence
aagcgcttttctcagtgtat

SEQ ID NO: 226370 - DNA, 20 bp, Artificial
  CRISPR gRNA sequence
agcgcttttctcagtgtatg

SEQ ID NO: 226371 - DNA, 20 bp, Artificial
  CRISPR gRNA sequence
ttctcagtgtatggcattct

SEQ ID NO: 226372 - DNA, 20 bp, Artificial
  CRISPR gRNA sequence
tctcagtgtatggcattctg

SEQ ID NO: 226373 - DNA, 20 bp, Artificial
  CRISPR gRNA sequence
ctcagtgtatggcattctgg

SEQ ID NO: 226374 - DNA, 20 bp, Artificial
  CRISPR gRNA sequence
tcagtgtatggcattctgga

SEQ ID NO: 226375 - DNA, 20 bp, Artificial
  CRISPR gRNA sequence
agtgtatggcattctggaaa

SEQ ID NO: 226376 - DNA, 20 bp, Artificial
  CRISPR gRNA sequence
tggaaatgcttagtgatttc

SEQ ID NO: 226377 - DNA, 20 bp, Artificial
  CRISPR gRNA sequence
gaaatgcttagtgatttcag

SEQ ID NO: 226378 - DNA, 20 bp, Artificial
  CRISPR gRNA sequence
agtgatttcagaaatgttct

SEQ ID NO: 226379 - DNA, 20 bp, Artificial
  CRISPR gRNA sequence
gtgatttcagaaatgttctc

SEQ ID NO: 226380 - DNA, 20 bp, Artificial
  CRISPR gRNA sequence
cagaaatgttctcaactttt

SEQ ID NO: 226381 - DNA, 20 bp, Artificial
  CRISPR gRNA sequence
agaaatgttctcaacttttg

SEQ ID NO: 226382 - DNA, 20 bp, Artificial
  CRISPR gRNA sequence
tcaacttttgtctgaaagga

SEQ ID NO: 226383 - DNA, 20 bp, Artificial
  CRISPR gRNA sequence
aacttttgtctgaaaggaaa

SEQ ID NO: 226384 - DNA, 20 bp, Artificial
  CRISPR gRNA sequence
ttgtctgaaaggaaaaaagg

SEQ ID NO: 226385 - DNA, 20 bp, Artificial
  CRISPR gRNA sequence
tgtctgaaaggaaaaaaggg

SEQ ID NO: 226386 - DNA, 20 bp, Artificial
  CRISPR gRNA sequence
gtctgaaaggaaaaaagggg

SEQ ID NO: 226387 - DNA, 20 bp, Artificial
  CRISPR gRNA sequence
tctgaaaggaaaaaaggggg

SEQ ID NO: 226388 - DNA, 20 bp, Artificial
  CRISPR gRNA sequence
aaaggaaaaaagggggaaga

SEQ ID NO: 226389 - DNA, 20 bp, Artificial
  CRISPR gRNA sequence
tcaagacattttataacttt

SEQ ID NO: 226390 - DNA, 20 bp, Artificial
  CRISPR gRNA sequence
tataacttttactttcaaga

SEQ ID NO: 226391 - DNA, 20 bp, Artificial
  CRISPR gRNA sequence
ataacttttactttcaagat

SEQ ID NO: 226392 - DNA, 20 bp, Artificial
  CRISPR gRNA sequence
taacttttactttcaagata

SEQ ID NO: 226393 - DNA, 20 bp, Artificial
  CRISPR gRNA sequence
ttactttcaagatagtgtct

SEQ ID NO: 226394 - DNA, 20 bp, Artificial
  CRISPR gRNA sequence
tactttcaagatagtgtcta

SEQ ID NO: 226395 - DNA, 20 bp, Artificial
  CRISPR gRNA sequence
actttcaagatagtgtctag

SEQ ID NO: 226396 - DNA, 20 bp, Artificial
  CRISPR gRNA sequence
ctttcaagatagtgtctaga

SEQ ID NO: 226397 - DNA, 20 bp, Artificial
  CRISPR gRNA sequence
tcaagatagtgtctagactt

SEQ ID NO: 226398 - DNA, 20 bp, Artificial
  CRISPR gRNA sequence
caagatagtgtctagacttc

SEQ ID NO: 226399 - DNA, 20 bp, Artificial
  CRISPR gRNA sequence
aagatagtgtctagacttct

SEQ ID NO: 226400 - DNA, 20 bp, Artificial
  CRISPR gRNA sequence
gacttcttttggaaattttc

SEQ ID NO: 226401 - DNA, 20 bp, Artificial
  CRISPR gRNA sequence
cttttggaaattttcttata

SEQ ID NO: 226402 - DNA, 20 bp, Artificial
  CRISPR gRNA sequence
ttttggaaattttcttataa

SEQ ID NO: 226403 - DNA, 20 bp, Artificial
  CRISPR gRNA sequence
ttggaaattttcttataatc

SEQ ID NO: 226404 - DNA, 20 bp, Artificial
  CRISPR gRNA sequence
tggaaattttcttataatct

SEQ ID NO: 226405 - DNA, 20 bp, Artificial
  CRISPR gRNA sequence
ggaaattttcttataatctc

SEQ ID NO: 226406 - DNA, 20 bp, Artificial
  CRISPR gRNA sequence
gaaattttcttataatctct

SEQ ID NO: 226407 - DNA, 20 bp, Artificial
  CRISPR gRNA sequence
tcttataatctcttagtttt

SEQ ID NO: 226408 - DNA, 20 bp, Artificial
  CRISPR gRNA sequence
cttataatctcttagttttt

SEQ ID NO: 226409 - DNA, 20 bp, Artificial
  CRISPR gRNA sequence
ttataatctcttagtttttt

SEQ ID NO: 226410 - DNA, 20 bp, Artificial
  CRISPR gRNA sequence
ataatctcttagttttttat

SEQ ID NO: 226411 - DNA, 20 bp, Artificial
  CRISPR gRNA sequence
taatctcttagttttttatg

SEQ ID NO: 226412 - DNA, 20 bp, Artificial
  CRISPR gRNA sequence
ttagttttttatgtcaagaa

SEQ ID NO: 226413 - DNA, 20 bp, Artificial
  CRISPR gRNA sequence
agttttttatgtcaagaaaa

SEQ ID NO: 226414 - DNA, 20 bp, Artificial
  CRISPR gRNA sequence
gttttttatgtcaagaaaag

SEQ ID NO: 226415 - DNA, 20 bp, Artificial
  CRISPR gRNA sequence
tttatgtcaagaaaaggact

SEQ ID NO: 226416 - DNA, 20 bp, Artificial
  CRISPR gRNA sequence
ttatgtcaagaaaaggactg

SEQ ID NO: 226417 - DNA, 20 bp, Artificial
  CRISPR gRNA sequence
tatgtcaagaaaaggactgg

SEQ ID NO: 226418 - DNA, 20 bp, Artificial
  CRISPR gRNA sequence
atgtcaagaaaaggactggt

SEQ ID NO: 226419 - DNA, 20 bp, Artificial
  CRISPR gRNA sequence
tgtcaagaaaaggactggtg

SEQ ID NO: 226420 - DNA, 20 bp, Artificial
  CRISPR gRNA sequence
gtgtagcattaagacctatt

SEQ ID NO: 226421 - DNA, 20 bp, Artificial
  CRISPR gRNA sequence
agacctattctggcatcaat

SEQ ID NO: 226422 - DNA, 20 bp, Artificial
  CRISPR gRNA sequence
ttctggcatcaatgatatta

SEQ ID NO: 226423 - DNA, 20 bp, Artificial
  CRISPR gRNA sequence
tggcatcaatgatattaggg

SEQ ID NO: 226424 - DNA, 20 bp, Artificial
  CRISPR gRNA sequence
gcatcaatgatattagggaa

SEQ ID NO: 226425 - DNA, 20 bp, Artificial
  CRISPR gRNA sequence
gggaaagcttttaaccatat

SEQ ID NO: 226426 - DNA, 20 bp, Artificial
  CRISPR gRNA sequence
ttaaccatattggcagagcc

SEQ ID NO: 226427 - DNA, 20 bp, Artificial
  CRISPR gRNA sequence
taaccatattggcagagcca

SEQ ID NO: 226428 - DNA, 20 bp, Artificial
  CRISPR gRNA sequence
aaccatattggcagagccag

SEQ ID NO: 226429 - DNA, 20 bp, Artificial
  CRISPR gRNA sequence
accatattggcagagccaga

SEQ ID NO: 226430 - DNA, 20 bp, Artificial
  CRISPR gRNA sequence
gcagagccagactttaaggg

SEQ ID NO: 226431 - DNA, 20 bp, Artificial
  CRISPR gRNA sequence
taagggctaagtcatatgac

SEQ ID NO: 226432 - DNA, 20 bp, Artificial
  CRISPR gRNA sequence
aagggctaagtcatatgact

SEQ ID NO: 226433 - DNA, 20 bp, Artificial
  CRISPR gRNA sequence
agggctaagtcatatgactt

SEQ ID NO: 226434 - DNA, 20 bp, Artificial
  CRISPR gRNA sequence
agtcatatgacttgggcagg

SEQ ID NO: 226435 - DNA, 20 bp, Artificial
  CRISPR gRNA sequence
gggcagggaacagccttttt

SEQ ID NO: 226436 - DNA, 20 bp, Artificial
  CRISPR gRNA sequence
ggcagggaacagcctttttc

SEQ ID NO: 226437 - DNA, 20 bp, Artificial
  CRISPR gRNA sequence
tttcaaagatcatgaaatta

SEQ ID NO: 226438 - DNA, 20 bp, Artificial
  CRISPR gRNA sequence
ttcaaagatcatgaaattat

SEQ ID NO: 226439 - DNA, 20 bp, Artificial
  CRISPR gRNA sequence
tcaaagatcatgaaattatt

SEQ ID NO: 226440 - DNA, 20 bp, Artificial
  CRISPR gRNA sequence
caaagatcatgaaattattt

SEQ ID NO: 226441 - DNA, 20 bp, Artificial
  CRISPR gRNA sequence
aaagatcatgaaattatttc

SEQ ID NO: 226442 - DNA, 20 bp, Artificial
  CRISPR gRNA sequence
tttcacatagtgcgattttt

SEQ ID NO: 226443 - DNA, 20 bp, Artificial
  CRISPR gRNA sequence
cacatagtgcgattttttga

SEQ ID NO: 226444 - DNA, 20 bp, Artificial
  CRISPR gRNA sequence
acatagtgcgattttttgag

SEQ ID NO: 226445 - DNA, 20 bp, Artificial
  CRISPR gRNA sequence
tttgagtttggcttgatgga

SEQ ID NO: 226446 - DNA, 20 bp, Artificial
  CRISPR gRNA sequence
ttgagtttggcttgatggat

SEQ ID NO: 226447 - DNA, 20 bp, Artificial
  CRISPR gRNA sequence
tgagtttggcttgatggatg

SEQ ID NO: 226448 - DNA, 20 bp, Artificial
  CRISPR gRNA sequence
gagtttggcttgatggatgt

SEQ ID NO: 226449 - DNA, 20 bp, Artificial
  CRISPR gRNA sequence
agtttggcttgatggatgtt

SEQ ID NO: 226450 - DNA, 20 bp, Artificial
  CRISPR gRNA sequence
ggcttgatggatgtttgctg

SEQ ID NO: 226451 - DNA, 20 bp, Artificial
  CRISPR gRNA sequence
gcttgatggatgtttgctga

SEQ ID NO: 226452 - DNA, 20 bp, Artificial
  CRISPR gRNA sequence
gatggatgtttgctgatcca

SEQ ID NO: 226453 - DNA, 20 bp, Artificial
  CRISPR gRNA sequence
atggatgtttgctgatccag

SEQ ID NO: 226454 - DNA, 20 bp, Artificial
  CRISPR gRNA sequence
gctgatccagacgttatcat

SEQ ID NO: 226455 - DNA, 20 bp, Artificial
  CRISPR gRNA sequence
ctgatccagacgttatcatt

SEQ ID NO: 226456 - DNA, 20 bp, Artificial
  CRISPR gRNA sequence
atccagacgttatcattggt

SEQ ID NO: 226457 - DNA, 20 bp, Artificial
  CRISPR gRNA sequence
tcattggtgacattattttt

SEQ ID NO: 226458 - DNA, 20 bp, Artificial
  CRISPR gRNA sequence
gtgacattatttttagtgaa

SEQ ID NO: 226459 - DNA, 20 bp, Artificial
  CRISPR gRNA sequence
tttttagtgaaatgaaccag

SEQ ID NO: 226460 - DNA, 20 bp, Artificial
  CRISPR gRNA sequence
ttagtgaaatgaaccaggag

SEQ ID NO: 226461 - DNA, 20 bp, Artificial
  CRISPR gRNA sequence
tagtgaaatgaaccaggagt

SEQ ID NO: 226462 - DNA, 20 bp, Artificial
  CRISPR gRNA sequence
agtgaaatgaaccaggagtg

SEQ ID NO: 226463 - DNA, 20 bp, Artificial
  CRISPR gRNA sequence
gtgaaatgaaccaggagtga

SEQ ID NO: 226464 - DNA, 20 bp, Artificial
  CRISPR gRNA sequence
gttcactgttggctgtattt

SEQ ID NO: 226465 - DNA, 20 bp, Artificial
  CRISPR gRNA sequence
ttcactgttggctgtatttt

SEQ ID NO: 226466 - DNA, 20 bp, Artificial
  CRISPR gRNA sequence
actgttggctgtatttttac

SEQ ID NO: 226467 - DNA, 20 bp, Artificial
  CRISPR gRNA sequence
ttggctgtatttttacaaaa

SEQ ID NO: 226468 - DNA, 20 bp, Artificial
  CRISPR gRNA sequence
gctgtatttttacaaaatga

SEQ ID NO: 226469 - DNA, 20 bp, Artificial
  CRISPR gRNA sequence
tatttttacaaaatgagctt

SEQ ID NO: 226470 - DNA, 20 bp, Artificial
  CRISPR gRNA sequence
ttacaaaatgagctttacaa

SEQ ID NO: 226471 - DNA, 20 bp, Artificial
  CRISPR gRNA sequence
tacaaaatgagctttacaat

SEQ ID NO: 226472 - DNA, 20 bp, Artificial
  CRISPR gRNA sequence
acaaaatgagctttacaata

SEQ ID NO: 226473 - DNA, 20 bp, Artificial
  CRISPR gRNA sequence
caaaatgagctttacaatat

SEQ ID NO: 226474 - DNA, 20 bp, Artificial
  CRISPR gRNA sequence
tacaatattttttctgactt

SEQ ID NO: 226475 - DNA, 20 bp, Artificial
  CRISPR gRNA sequence
acaatattttttctgactta

SEQ ID NO: 226476 - DNA, 20 bp, Artificial
  CRISPR gRNA sequence
caatattttttctgacttaa

SEQ ID NO: 226477 - DNA, 20 bp, Artificial
  CRISPR gRNA sequence
tttctgacttaaaaaagtca

SEQ ID NO: 226478 - DNA, 20 bp, Artificial
  CRISPR gRNA sequence
ttctgacttaaaaaagtcat

SEQ ID NO: 226479 - DNA, 20 bp, Artificial
  CRISPR gRNA sequence
tctgacttaaaaaagtcata

SEQ ID NO: 226480 - DNA, 20 bp, Artificial
  CRISPR gRNA sequence
ctgacttaaaaaagtcatac

SEQ ID NO: 226481 - DNA, 20 bp, Artificial
  CRISPR gRNA sequence
tgacttaaaaaagtcataca

SEQ ID NO: 226482 - DNA, 20 bp, Artificial
  CRISPR gRNA sequence
acttaaaaaagtcatacata

SEQ ID NO: 226483 - DNA, 20 bp, Artificial
  CRISPR gRNA sequence
aaaaaagtcatacatatcac

SEQ ID NO: 226484 - DNA, 20 bp, Artificial
  CRISPR gRNA sequence
aaaaagtcatacatatcact

SEQ ID NO: 226485 - DNA, 20 bp, Artificial
  CRISPR gRNA sequence
tagaacacctcgtacaaagt

SEQ ID NO: 226486 - DNA, 20 bp, Artificial
  CRISPR gRNA sequence
agaacacctcgtacaaagta

SEQ ID NO: 226487 - DNA, 20 bp, Artificial
  CRISPR gRNA sequence
gaacacctcgtacaaagtag

SEQ ID NO: 226488 - DNA, 20 bp, Artificial
  CRISPR gRNA sequence
gtacaaagtagggagttatt

SEQ ID NO: 226489 - DNA, 20 bp, Artificial
  CRISPR gRNA sequence
tttaaaaaaaaaaaaaaaaa

SEQ ID NO: 226490 - DNA, 20 bp, Artificial
  CRISPR gRNA sequence
aaaaaaaaaaaaaaaaaact

SEQ ID NO: 226491 - DNA, 20 bp, Artificial
  CRISPR gRNA sequence
aaaaaaaaaaaaaaaaactc

SEQ ID NO: 226492 - DNA, 20 bp, Artificial
  CRISPR gRNA sequence
atctgtagtccccaaaccta

SEQ ID NO: 226493 - DNA, 20 bp, Artificial
  CRISPR gRNA sequence
tagtccccaaacctagaaat

SEQ ID NO: 226494 - DNA, 20 bp, Artificial
  CRISPR gRNA sequence
gaaataaactattggtatat

SEQ ID NO: 226495 - DNA, 20 bp, Artificial
  CRISPR gRNA sequence
ttggtatattctggtgaatt

SEQ ID NO: 226496 - DNA, 20 bp, Artificial
  CRISPR gRNA sequence
gtatattctggtgaatttcc

SEQ ID NO: 226497 - DNA, 20 bp, Artificial
  CRISPR gRNA sequence
tggtgaatttcctgtttccc

SEQ ID NO: 226498 - DNA, 20 bp, Artificial
  CRISPR gRNA sequence
gtgaatttcctgtttccctt

SEQ ID NO: 226499 - DNA, 20 bp, Artificial
  CRISPR gRNA sequence
cctgtttccctttctgtctt

SEQ ID NO: 226500 - DNA, 20 bp, Artificial
  CRISPR gRNA sequence
ctgtttccctttctgtcttt

SEQ ID NO: 226501 - DNA, 20 bp, Artificial
  CRISPR gRNA sequence
tttccctttctgtctttttc

SEQ ID NO: 226502 - DNA, 20 bp, Artificial
  CRISPR gRNA sequence
ccctttctgtctttttctat

SEQ ID NO: 226503 - DNA, 20 bp, Artificial
  CRISPR gRNA sequence
cctttctgtctttttctatt

SEQ ID NO: 226504 - DNA, 20 bp, Artificial
  CRISPR gRNA sequence
tctgtctttttctattcatt

SEQ ID NO: 226505 - DNA, 20 bp, Artificial
  CRISPR gRNA sequence
ctgtctttttctattcattt

SEQ ID NO: 226506 - DNA, 20 bp, Artificial
  CRISPR gRNA sequence
tgtctttttctattcatttt

SEQ ID NO: 226507 - DNA, 20 bp, Artificial
  CRISPR gRNA sequence
tctttttctattcatttttg

SEQ ID NO: 226508 - DNA, 20 bp, Artificial
  CRISPR gRNA sequence
tttctattcatttttgttat

SEQ ID NO: 226509 - DNA, 20 bp, Artificial
  CRISPR gRNA sequence
ttctattcatttttgttatc

SEQ ID NO: 226510 - DNA, 20 bp, Artificial
  CRISPR gRNA sequence
tctattcatttttgttatct

SEQ ID NO: 226511 - DNA, 20 bp, Artificial
  CRISPR gRNA sequence
ctattcatttttgttatctt

SEQ ID NO: 226512 - DNA, 20 bp, Artificial
  CRISPR gRNA sequence
tattcatttttgttatcttt

SEQ ID NO: 226513 - DNA, 20 bp, Artificial
  CRISPR gRNA sequence
ttcatttttgttatcttttt

SEQ ID NO: 226514 - DNA, 20 bp, Artificial
  CRISPR gRNA sequence
atttttgttatctttttttt

SEQ ID NO: 226515 - DNA, 20 bp, Artificial
  CRISPR gRNA sequence
ttgttatcttttttttaaaa

SEQ ID NO: 226516 - DNA, 20 bp, Artificial
  CRISPR gRNA sequence
tgttatcttttttttaaaaa

SEQ ID NO: 226517 - DNA, 20 bp, Artificial
  CRISPR gRNA sequence
gttatcttttttttaaaaaa

SEQ ID NO: 226518 - DNA, 20 bp, Artificial
  CRISPR gRNA sequence
ttatcttttttttaaaaaaa

SEQ ID NO: 226519 - DNA, 20 bp, Artificial
  CRISPR gRNA sequence
tcttttttttaaaaaaaggt

SEQ ID NO: 226520 - DNA, 20 bp, Artificial
  CRISPR gRNA sequence
ttttttaaaaaaaggtaacc

SEQ ID NO: 226521 - DNA, 20 bp, Artificial
  CRISPR gRNA sequence
tttttaaaaaaaggtaacca

SEQ ID NO: 226522 - DNA, 20 bp, Artificial
  CRISPR gRNA sequence
ttttaaaaaaaggtaaccat

SEQ ID NO: 226523 - DNA, 20 bp, Artificial
  CRISPR gRNA sequence
tttaaaaaaaggtaaccata

SEQ ID NO: 226524 - DNA, 20 bp, Artificial
  CRISPR gRNA sequence
ttaaaaaaaggtaaccataa

SEQ ID NO: 226525 - DNA, 20 bp, Artificial
  CRISPR gRNA sequence
taaaaaaaggtaaccataaa

SEQ ID NO: 226526 - DNA, 20 bp, Artificial
  CRISPR gRNA sequence
aaaaaaaggtaaccataaat

SEQ ID NO: 226527 - DNA, 20 bp, Artificial
  CRISPR gRNA sequence
aaaaaaggtaaccataaatg

SEQ ID NO: 226528 - DNA, 20 bp, Artificial
  CRISPR gRNA sequence
gtacagcttatatgcttgta

SEQ ID NO: 226529 - DNA, 20 bp, Artificial
  CRISPR gRNA sequence
atatgcttgtacgttctgat

SEQ ID NO: 226530 - DNA, 20 bp, Artificial
  CRISPR gRNA sequence
tatgcttgtacgttctgatg

SEQ ID NO: 226531 - DNA, 20 bp, Artificial
  CRISPR gRNA sequence
gtacgttctgatgttccccc

SEQ ID NO: 226532 - DNA, 20 bp, Artificial
  CRISPR gRNA sequence
tacgttctgatgttccccca

SEQ ID NO: 226533 - DNA, 20 bp, Artificial
  CRISPR gRNA sequence
tgatgttcccccatgtcttc

SEQ ID NO: 226534 - DNA, 20 bp, Artificial
  CRISPR gRNA sequence
atgttcccccatgtcttcag

SEQ ID NO: 226535 - DNA, 20 bp, Artificial
  CRISPR gRNA sequence
ccccatgtcttcagaaatct

SEQ ID NO: 226536 - DNA, 20 bp, Artificial
  CRISPR gRNA sequence
cagaaatcttgttatagctg

SEQ ID NO: 226537 - DNA, 20 bp, Artificial
  CRISPR gRNA sequence
agaaatcttgttatagctgc

SEQ ID NO: 226538 - DNA, 20 bp, Artificial
  CRISPR gRNA sequence
gttatagctgcctgtgttct

SEQ ID NO: 226539 - DNA, 20 bp, Artificial
  CRISPR gRNA sequence
ttatagctgcctgtgttcta

SEQ ID NO: 226540 - DNA, 20 bp, Artificial
  CRISPR gRNA sequence
tagctgcctgtgttctactt

SEQ ID NO: 226541 - DNA, 20 bp, Artificial
  CRISPR gRNA sequence
cctgtgttctacttttgtgg

SEQ ID NO: 226542 - DNA, 20 bp, Artificial
  CRISPR gRNA sequence
tgttctacttttgtggatgc

SEQ ID NO: 226543 - DNA, 20 bp, Artificial
  CRISPR gRNA sequence
tacttttgtggatgcactat

SEQ ID NO: 226544 - DNA, 20 bp, Artificial
  CRISPR gRNA sequence
cttttgtggatgcactataa

SEQ ID NO: 226545 - DNA, 20 bp, Artificial
  CRISPR gRNA sequence
ttgtggatgcactataattt

SEQ ID NO: 226546 - DNA, 20 bp, Artificial
  CRISPR gRNA sequence
tgtggatgcactataattta

SEQ ID NO: 226547 - DNA, 20 bp, Artificial
  CRISPR gRNA sequence
gtggatgcactataatttac

SEQ ID NO: 226548 - DNA, 20 bp, Artificial
  CRISPR gRNA sequence
tggatgcactataatttact

SEQ ID NO: 226549 - DNA, 20 bp, Artificial
  CRISPR gRNA sequence
taatttacttaactctcatc

SEQ ID NO: 226550 - DNA, 20 bp, Artificial
  CRISPR gRNA sequence
acttaactctcatcttgatg

SEQ ID NO: 226551 - DNA, 20 bp, Artificial
  CRISPR gRNA sequence
cttaactctcatcttgatgg

SEQ ID NO: 226552 - DNA, 20 bp, Artificial
  CRISPR gRNA sequence
aactctcatcttgatggatt

SEQ ID NO: 226553 - DNA, 20 bp, Artificial
  CRISPR gRNA sequence
actctcatcttgatggattt

SEQ ID NO: 226554 - DNA, 20 bp, Artificial
  CRISPR gRNA sequence
tcatcttgatggattttaag

SEQ ID NO: 226555 - DNA, 20 bp, Artificial
  CRISPR gRNA sequence
atcttgatggattttaagga

SEQ ID NO: 226556 - DNA, 20 bp, Artificial
  CRISPR gRNA sequence
gatggattttaaggatgttt

SEQ ID NO: 226557 - DNA, 20 bp, Artificial
  CRISPR gRNA sequence
atggattttaaggatgtttc

SEQ ID NO: 226558 - DNA, 20 bp, Artificial
  CRISPR gRNA sequence
taaggatgtttccaattttt

SEQ ID NO: 226559 - DNA, 20 bp, Artificial
  CRISPR gRNA sequence
aaggatgtttccaatttttt

SEQ ID NO: 226560 - DNA, 20 bp, Artificial
  CRISPR gRNA sequence
aggatgtttccaattttttt

SEQ ID NO: 226561 - DNA, 20 bp, Artificial
  CRISPR gRNA sequence
ccaatttttttgatactatg

SEQ ID NO: 226562 - DNA, 20 bp, Artificial
  CRISPR gRNA sequence
caatttttttgatactatga

SEQ ID NO: 226563 - DNA, 20 bp, Artificial
  CRISPR gRNA sequence
ttttgatactatgaaaataa

SEQ ID NO: 226564 - DNA, 20 bp, Artificial
  CRISPR gRNA sequence
tttgatactatgaaaataac

SEQ ID NO: 226565 - DNA, 20 bp, Artificial
  CRISPR gRNA sequence
ttgatactatgaaaataact

SEQ ID NO: 226566 - DNA, 20 bp, Artificial
  CRISPR gRNA sequence
tgatactatgaaaataactc

SEQ ID NO: 226567 - DNA, 20 bp, Artificial
  CRISPR gRNA sequence
gatactatgaaaataactct

SEQ ID NO: 226568 - DNA, 20 bp, Artificial
  CRISPR gRNA sequence
atactatgaaaataactctg

SEQ ID NO: 226569 - DNA, 20 bp, Artificial
  CRISPR gRNA sequence
tgaaaataactctgctaaag

SEQ ID NO: 226570 - DNA, 20 bp, Artificial
  CRISPR gRNA sequence
tgctaaagatatgaagcctg

SEQ ID NO: 226571 - DNA, 20 bp, Artificial
  CRISPR gRNA sequence
ctaaagatatgaagcctgga

SEQ ID NO: 226572 - DNA, 20 bp, Artificial
  CRISPR gRNA sequence
aagatatgaagcctggaatt

SEQ ID NO: 226573 - DNA, 20 bp, Artificial
  CRISPR gRNA sequence
gaattggcagagatatttta

SEQ ID NO: 226574 - DNA, 20 bp, Artificial
  CRISPR gRNA sequence
gcagagatattttaagactc

SEQ ID NO: 226575 - DNA, 20 bp, Artificial
  CRISPR gRNA sequence
taagactctagatacatact

SEQ ID NO: 226576 - DNA, 20 bp, Artificial
  CRISPR gRNA sequence
aagactctagatacatactg

SEQ ID NO: 226577 - DNA, 20 bp, Artificial
  CRISPR gRNA sequence
agactctagatacatactgg

SEQ ID NO: 226578 - DNA, 20 bp, Artificial
  CRISPR gRNA sequence
tagatacatactggcaaaat

SEQ ID NO: 226579 - DNA, 20 bp, Artificial
  CRISPR gRNA sequence
gatacatactggcaaaatgt

SEQ ID NO: 226580 - DNA, 20 bp, Artificial
  CRISPR gRNA sequence
gcaaaatgttttccagaaac

SEQ ID NO: 226581 - DNA, 20 bp, Artificial
  CRISPR gRNA sequence
tccagaaacgtttgtatcaa

SEQ ID NO: 226582 - DNA, 20 bp, Artificial
  CRISPR gRNA sequence
ccagaaacgtttgtatcaac

SEQ ID NO: 226583 - DNA, 20 bp, Artificial
  CRISPR gRNA sequence
cagaaacgtttgtatcaact

SEQ ID NO: 226584 - DNA, 20 bp, Artificial
  CRISPR gRNA sequence
gtatcaactactattgcaga

SEQ ID NO: 226585 - DNA, 20 bp, Artificial
  CRISPR gRNA sequence
tatcaactactattgcagat

SEQ ID NO: 226586 - DNA, 20 bp, Artificial
  CRISPR gRNA sequence
ctattgcagatgagaatacc

SEQ ID NO: 226587 - DNA, 20 bp, Artificial
  CRISPR gRNA sequence
ttgcagatgagaatacctgt

SEQ ID NO: 226588 - DNA, 20 bp, Artificial
  CRISPR gRNA sequence
cagatgagaatacctgtctt

SEQ ID NO: 226589 - DNA, 20 bp, Artificial
  CRISPR gRNA sequence
tctttcacctcagttataat

SEQ ID NO: 226590 - DNA, 20 bp, Artificial
  CRISPR gRNA sequence
tcacctcagttataattctg

SEQ ID NO: 226591 - DNA, 20 bp, Artificial
  CRISPR gRNA sequence
cacctcagttataattctga

SEQ ID NO: 226592 - DNA, 20 bp, Artificial
  CRISPR gRNA sequence
acctcagttataattctgat

SEQ ID NO: 226593 - DNA, 20 bp, Artificial
  CRISPR gRNA sequence
agttataattctgatattat

SEQ ID NO: 226594 - DNA, 20 bp, Artificial
  CRISPR gRNA sequence
taattctgatattataacgc

SEQ ID NO: 226595 - DNA, 20 bp, Artificial
  CRISPR gRNA sequence
tgatattataacgctaaaat

SEQ ID NO: 226596 - DNA, 20 bp, Artificial
  CRISPR gRNA sequence
atattataacgctaaaatct

SEQ ID NO: 226597 - DNA, 20 bp, Artificial
  CRISPR gRNA sequence
taacgctaaaatctctgcaa

SEQ ID NO: 226598 - DNA, 20 bp, Artificial
  CRISPR gRNA sequence
aaatctctgcaaatttgatg

SEQ ID NO: 226599 - DNA, 20 bp, Artificial
  CRISPR gRNA sequence
tgcaaatttgatgggtgaaa

SEQ ID NO: 226600 - DNA, 20 bp, Artificial
  CRISPR gRNA sequence
caaatttgatgggtgaaaaa

SEQ ID NO: 226601 - DNA, 20 bp, Artificial
  CRISPR gRNA sequence
gatgggtgaaaaagcatctt

SEQ ID NO: 226602 - DNA, 20 bp, Artificial
  CRISPR gRNA sequence
atgggtgaaaaagcatctta

SEQ ID NO: 226603 - DNA, 20 bp, Artificial
  CRISPR gRNA sequence
attgtaattgtaatttttgt

SEQ ID NO: 226604 - DNA, 20 bp, Artificial
  CRISPR gRNA sequence
ttgtaattgtaatttttgtg

SEQ ID NO: 226605 - DNA, 20 bp, Artificial
  CRISPR gRNA sequence
taattgtaatttttgtgtta

SEQ ID NO: 226606 - DNA, 20 bp, Artificial
  CRISPR gRNA sequence
taatttttgtgttagtaagg

SEQ ID NO: 226607 - DNA, 20 bp, Artificial
  CRISPR gRNA sequence
ttgtgttagtaaggtggaat

SEQ ID NO: 226608 - DNA, 20 bp, Artificial
  CRISPR gRNA sequence
tgtgttagtaaggtggaatg

SEQ ID NO: 226609 - DNA, 20 bp, Artificial
  CRISPR gRNA sequence
gtgttagtaaggtggaatgt

SEQ ID NO: 226610 - DNA, 20 bp, Artificial
  CRISPR gRNA sequence
tgttagtaaggtggaatgtt

SEQ ID NO: 226611 - DNA, 20 bp, Artificial
  CRISPR gRNA sequence
gtaaggtggaatgttctttt

SEQ ID NO: 226612 - DNA, 20 bp, Artificial
  CRISPR gRNA sequence
ttttttatattttttgtact

SEQ ID NO: 226613 - DNA, 20 bp, Artificial
  CRISPR gRNA sequence
ttttatattttttgtactgg

SEQ ID NO: 226614 - DNA, 20 bp, Artificial
  CRISPR gRNA sequence
tttatattttttgtactggt

SEQ ID NO: 226615 - DNA, 20 bp, Artificial
  CRISPR gRNA sequence
ttatattttttgtactggtc

SEQ ID NO: 226616 - DNA, 20 bp, Artificial
  CRISPR gRNA sequence
tatattttttgtactggtca

SEQ ID NO: 226617 - DNA, 20 bp, Artificial
  CRISPR gRNA sequence
atattttttgtactggtcat

SEQ ID NO: 226618 - DNA, 20 bp, Artificial
  CRISPR gRNA sequence
tattttttgtactggtcata

SEQ ID NO: 226619 - DNA, 20 bp, Artificial
  CRISPR gRNA sequence
tttgtactggtcatatttta

SEQ ID NO: 226620 - DNA, 20 bp, Artificial
  CRISPR gRNA sequence
ttgtactggtcatattttaa

SEQ ID NO: 226621 - DNA, 20 bp, Artificial
  CRISPR gRNA sequence
tgtactggtcatattttaag

SEQ ID NO: 226622 - DNA, 20 bp, Artificial
  CRISPR gRNA sequence
gtactggtcatattttaagg

SEQ ID NO: 226623 - DNA, 20 bp, Artificial
  CRISPR gRNA sequence
tactggtcatattttaagga

SEQ ID NO: 226624 - DNA, 20 bp, Artificial
  CRISPR gRNA sequence
gtcatattttaaggaacgtg

SEQ ID NO: 226625 - DNA, 20 bp, Artificial
  CRISPR gRNA sequence
taaggaacgtgcttataaac

SEQ ID NO: 226626 - DNA, 20 bp, Artificial
  CRISPR gRNA sequence
aaggaacgtgcttataaacc

SEQ ID NO: 226627 - DNA, 20 bp, Artificial
  CRISPR gRNA sequence
aggaacgtgcttataaacct

SEQ ID NO: 226628 - DNA, 20 bp, Artificial
  CRISPR gRNA sequence
ataaacctaaagaaatattt

SEQ ID NO: 226629 - DNA, 20 bp, Artificial
  CRISPR gRNA sequence
taaacctaaagaaatatttt

SEQ ID NO: 226630 - DNA, 20 bp, Artificial
  CRISPR gRNA sequence
aagaaatattttggtgggaa

SEQ ID NO: 226631 - DNA, 20 bp, Artificial
  CRISPR gRNA sequence
tggtgggaattttttgtttt

SEQ ID NO: 226632 - DNA, 20 bp, Artificial
  CRISPR gRNA sequence
ggtgggaattttttgttttg

SEQ ID NO: 226633 - DNA, 20 bp, Artificial
  CRISPR gRNA sequence
gtgggaattttttgttttgg

SEQ ID NO: 226634 - DNA, 20 bp, Artificial
  CRISPR gRNA sequence
tttgttttggctcatcttga

SEQ ID NO: 226635 - DNA, 20 bp, Artificial
  CRISPR gRNA sequence
ttgttttggctcatcttgaa

SEQ ID NO: 226636 - DNA, 20 bp, Artificial
  CRISPR gRNA sequence
tgttttggctcatcttgaaa

SEQ ID NO: 226637 - DNA, 20 bp, Artificial
  CRISPR gRNA sequence
gttttggctcatcttgaaac

SEQ ID NO: 226638 - DNA, 20 bp, Artificial
  CRISPR gRNA sequence
ttttggctcatcttgaaaca

SEQ ID NO: 226639 - DNA, 20 bp, Artificial
  CRISPR gRNA sequence
tggctcatcttgaaacaggt

SEQ ID NO: 226640 - DNA, 20 bp, Artificial
  CRISPR gRNA sequence
ggctcatcttgaaacaggta

SEQ ID NO: 226641 - DNA, 20 bp, Artificial
  CRISPR gRNA sequence
gctcatcttgaaacaggtag

SEQ ID NO: 226642 - DNA, 20 bp, Artificial
  CRISPR gRNA sequence
atcttgaaacaggtagatgt

SEQ ID NO: 226643 - DNA, 20 bp, Artificial
  CRISPR gRNA sequence
gaaacaggtagatgtgtgtg

SEQ ID NO: 226644 - DNA, 20 bp, Artificial
  CRISPR gRNA sequence
aaacaggtagatgtgtgtgt

SEQ ID NO: 226645 - DNA, 20 bp, Artificial
  CRISPR gRNA sequence
tacatgattcacccagcctg

SEQ ID NO: 226646 - DNA, 20 bp, Artificial
  CRISPR gRNA sequence
acccagcctgcgctcacatt

SEQ ID NO: 226647 - DNA, 20 bp, Artificial
  CRISPR gRNA sequence
cgctcacatttaaaggtgtt

SEQ ID NO: 226648 - DNA, 20 bp, Artificial
  CRISPR gRNA sequence
acatttaaaggtgttgatga

SEQ ID NO: 226649 - DNA, 20 bp, Artificial
  CRISPR gRNA sequence
aaaggtgttgatgataatag

SEQ ID NO: 226650 - DNA, 20 bp, Artificial
  CRISPR gRNA sequence
aaggtgttgatgataatagt

SEQ ID NO: 226651 - DNA, 20 bp, Artificial
  CRISPR gRNA sequence
atgataatagtagctaacca

SEQ ID NO: 226652 - DNA, 20 bp, Artificial
  CRISPR gRNA sequence
accatttgtggagctcttgc

SEQ ID NO: 226653 - DNA, 20 bp, Artificial
  CRISPR gRNA sequence
gtggagctcttgctctgctt

SEQ ID NO: 226654 - DNA, 20 bp, Artificial
  CRISPR gRNA sequence
tggagctcttgctctgcttg

SEQ ID NO: 226655 - DNA, 20 bp, Artificial
  CRISPR gRNA sequence
ttgctctgcttgacaggttc

SEQ ID NO: 226656 - DNA, 20 bp, Artificial
  CRISPR gRNA sequence
gctctgcttgacaggttctg

SEQ ID NO: 226657 - DNA, 20 bp, Artificial
  CRISPR gRNA sequence
ctctgcttgacaggttctgt

SEQ ID NO: 226658 - DNA, 20 bp, Artificial
  CRISPR gRNA sequence
tgcttgacaggttctgtgca

SEQ ID NO: 226659 - DNA, 20 bp, Artificial
  CRISPR gRNA sequence
cttgacaggttctgtgcaaa

SEQ ID NO: 226660 - DNA, 20 bp, Artificial
  CRISPR gRNA sequence
gacaggttctgtgcaaagta

SEQ ID NO: 226661 - DNA, 20 bp, Artificial
  CRISPR gRNA sequence
acaggttctgtgcaaagtac

SEQ ID NO: 226662 - DNA, 20 bp, Artificial
  CRISPR gRNA sequence
tgtgcaaagtactctatatc

SEQ ID NO: 226663 - DNA, 20 bp, Artificial
  CRISPR gRNA sequence
tgcaaagtactctatatctg

SEQ ID NO: 226664 - DNA, 20 bp, Artificial
  CRISPR gRNA sequence
tatatctgaaatgacattta

SEQ ID NO: 226665 - DNA, 20 bp, Artificial
  CRISPR gRNA sequence
tatctgaaatgacatttatt

SEQ ID NO: 226666 - DNA, 20 bp, Artificial
  CRISPR gRNA sequence
aaatgacatttatttctccc

SEQ ID NO: 226667 - DNA, 20 bp, Artificial
  CRISPR gRNA sequence
atttctcccagaaactctat

SEQ ID NO: 226668 - DNA, 20 bp, Artificial
  CRISPR gRNA sequence
tttctcccagaaactctatg

SEQ ID NO: 226669 - DNA, 20 bp, Artificial
  CRISPR gRNA sequence
ctcccagaaactctatgggc

SEQ ID NO: 226670 - DNA, 20 bp, Artificial
  CRISPR gRNA sequence
tcccagaaactctatgggca

SEQ ID NO: 226671 - DNA, 20 bp, Artificial
  CRISPR gRNA sequence
ccagaaactctatgggcata

SEQ ID NO: 226672 - DNA, 20 bp, Artificial
  CRISPR gRNA sequence
tatgggcatagacactgttg

SEQ ID NO: 226673 - DNA, 20 bp, Artificial
  CRISPR gRNA sequence
tgggcatagacactgttgtt

SEQ ID NO: 226674 - DNA, 20 bp, Artificial
  CRISPR gRNA sequence
ttgttattcccgttttgtag

SEQ ID NO: 226675 - DNA, 20 bp, Artificial
  CRISPR gRNA sequence
ttattcccgttttgtagata

SEQ ID NO: 226676 - DNA, 20 bp, Artificial
  CRISPR gRNA sequence
ttcccgttttgtagataaga

SEQ ID NO: 226677 - DNA, 20 bp, Artificial
  CRISPR gRNA sequence
ccgttttgtagataagaaac

SEQ ID NO: 226678 - DNA, 20 bp, Artificial
  CRISPR gRNA sequence
tgtagataagaaacaggcac

SEQ ID NO: 226679 - DNA, 20 bp, Artificial
  CRISPR gRNA sequence
gtagataagaaacaggcaca

SEQ ID NO: 226680 - DNA, 20 bp, Artificial
  CRISPR gRNA sequence
tagataagaaacaggcacag

SEQ ID NO: 226681 - DNA, 20 bp, Artificial
  CRISPR gRNA sequence
ggcaatttgcccgcaatcac

SEQ ID NO: 226682 - DNA, 20 bp, Artificial
  CRISPR gRNA sequence
gcccgcaatcacccagccgt

SEQ ID NO: 226683 - DNA, 20 bp, Artificial
  CRISPR gRNA sequence
cccgcaatcacccagccgtt

SEQ ID NO: 226684 - DNA, 20 bp, Artificial
  CRISPR gRNA sequence
cctgatagtactgggatttg

SEQ ID NO: 226685 - DNA, 20 bp, Artificial
  CRISPR gRNA sequence
ctgatagtactgggatttga

SEQ ID NO: 226686 - DNA, 20 bp, Artificial
  CRISPR gRNA sequence
atagtactgggatttgaact

SEQ ID NO: 226687 - DNA, 20 bp, Artificial
  CRISPR gRNA sequence
ggatttgaactagtactgtt

SEQ ID NO: 226688 - DNA, 20 bp, Artificial
  CRISPR gRNA sequence
gaactagtactgtttaccac

SEQ ID NO: 226689 - DNA, 20 bp, Artificial
  CRISPR gRNA sequence
aactagtactgtttaccact

SEQ ID NO: 226690 - DNA, 20 bp, Artificial
  CRISPR gRNA sequence
gtactgtttaccactgcact

SEQ ID NO: 226691 - DNA, 20 bp, Artificial
  CRISPR gRNA sequence
tttaccactgcactgtactg

SEQ ID NO: 226692 - DNA, 20 bp, Artificial
  CRISPR gRNA sequence
accactgcactgtactgcct

SEQ ID NO: 226693 - DNA, 20 bp, Artificial
  CRISPR gRNA sequence
ccactgcactgtactgcctc

SEQ ID NO: 226694 - DNA, 20 bp, Artificial
  CRISPR gRNA sequence
cactgtactgcctccccgtt

SEQ ID NO: 226695 - DNA, 20 bp, Artificial
  CRISPR gRNA sequence
tactgcctccccgttttgca

SEQ ID NO: 226696 - DNA, 20 bp, Artificial
  CRISPR gRNA sequence
cctccccgttttgcatttat

SEQ ID NO: 226697 - DNA, 20 bp, Artificial
  CRISPR gRNA sequence
cccgttttgcatttattttg

SEQ ID NO: 226698 - DNA, 20 bp, Artificial
  CRISPR gRNA sequence
tgcatttattttgaggattt

SEQ ID NO: 226699 - DNA, 20 bp, Artificial
  CRISPR gRNA sequence
gcatttattttgaggatttt

SEQ ID NO: 226700 - DNA, 20 bp, Artificial
  CRISPR gRNA sequence
catttattttgaggatttta

SEQ ID NO: 226701 - DNA, 20 bp, Artificial
  CRISPR gRNA sequence
attttgaggattttatttcc

SEQ ID NO: 226702 - DNA, 20 bp, Artificial
  CRISPR gRNA sequence
ttttgaggattttatttcca

SEQ ID NO: 226703 - DNA, 20 bp, Artificial
  CRISPR gRNA sequence
tgaggattttatttccatga

SEQ ID NO: 226704 - DNA, 20 bp, Artificial
  CRISPR gRNA sequence
gaggattttatttccatgaa

SEQ ID NO: 226705 - DNA, 20 bp, Artificial
  CRISPR gRNA sequence
aggattttatttccatgaag

SEQ ID NO: 226706 - DNA, 20 bp, Artificial
  CRISPR gRNA sequence
tatttccatgaagggtgaac

SEQ ID NO: 226707 - DNA, 20 bp, Artificial
  CRISPR gRNA sequence
atttccatgaagggtgaacc

SEQ ID NO: 226708 - DNA, 20 bp, Artificial
  CRISPR gRNA sequence
tttccatgaagggtgaacct

SEQ ID NO: 226709 - DNA, 20 bp, Artificial
  CRISPR gRNA sequence
ccatgaagggtgaacctata

SEQ ID NO: 226710 - DNA, 20 bp, Artificial
  CRISPR gRNA sequence
catgaagggtgaacctatat

SEQ ID NO: 226711 - DNA, 20 bp, Artificial
  CRISPR gRNA sequence
tatctaagcacataatactg

SEQ ID NO: 226712 - DNA, 20 bp, Artificial
  CRISPR gRNA sequence
agcacataatactgagtagc

SEQ ID NO: 226713 - DNA, 20 bp, Artificial
  CRISPR gRNA sequence
agtagctaaaacttattagg

SEQ ID NO: 226714 - DNA, 20 bp, Artificial
  CRISPR gRNA sequence
aaacttattaggagagcaga

SEQ ID NO: 226715 - DNA, 20 bp, Artificial
  CRISPR gRNA sequence
attaggagagcagaatgttg

SEQ ID NO: 226716 - DNA, 20 bp, Artificial
  CRISPR gRNA sequence
ttaggagagcagaatgttga

SEQ ID NO: 226717 - DNA, 20 bp, Artificial
  CRISPR gRNA sequence
ggagagcagaatgttgacct

SEQ ID NO: 226718 - DNA, 20 bp, Artificial
  CRISPR gRNA sequence
acctgatttgtttacttatt

SEQ ID NO: 226719 - DNA, 20 bp, Artificial
  CRISPR gRNA sequence
atttgtttacttattctgca

SEQ ID NO: 226720 - DNA, 20 bp, Artificial
  CRISPR gRNA sequence
gtttacttattctgcaaata

SEQ ID NO: 226721 - DNA, 20 bp, Artificial
  CRISPR gRNA sequence
tttacttattctgcaaatac

SEQ ID NO: 226722 - DNA, 20 bp, Artificial
  CRISPR gRNA sequence
acttattctgcaaataccta

SEQ ID NO: 226723 - DNA, 20 bp, Artificial
  CRISPR gRNA sequence
cttattctgcaaatacctag

SEQ ID NO: 226724 - DNA, 20 bp, Artificial
  CRISPR gRNA sequence
attctgcaaatacctagtga

SEQ ID NO: 226725 - DNA, 20 bp, Artificial
  CRISPR gRNA sequence
ttctgcaaatacctagtgac

SEQ ID NO: 226726 - DNA, 20 bp, Artificial
  CRISPR gRNA sequence
tgcaaatacctagtgacagg

SEQ ID NO: 226727 - DNA, 20 bp, Artificial
  CRISPR gRNA sequence
caaatacctagtgacagggt

SEQ ID NO: 226728 - DNA, 20 bp, Artificial
  CRISPR gRNA sequence
gtgacagggtgcctactgat

SEQ ID NO: 226729 - DNA, 20 bp, Artificial
  CRISPR gRNA sequence
ctgattgctggacaccaagc

SEQ ID NO: 226730 - DNA, 20 bp, Artificial
  CRISPR gRNA sequence
attgctggacaccaagctac

SEQ ID NO: 226731 - DNA, 20 bp, Artificial
  CRISPR gRNA sequence
ctggacaccaagctacatgc

SEQ ID NO: 226732 - DNA, 20 bp, Artificial
  CRISPR gRNA sequence
gacaccaagctacatgcctg

SEQ ID NO: 226733 - DNA, 20 bp, Artificial
  CRISPR gRNA sequence
catgcctgaaatgtgggtgt

SEQ ID NO: 226734 - DNA, 20 bp, Artificial
  CRISPR gRNA sequence
aaatgtgggtgtgatgtgca

SEQ ID NO: 226735 - DNA, 20 bp, Artificial
  CRISPR gRNA sequence
ccctggttttgtagcaccca

SEQ ID NO: 226736 - DNA, 20 bp, Artificial
  CRISPR gRNA sequence
gttttgtagcacccacattt

SEQ ID NO: 226737 - DNA, 20 bp, Artificial
  CRISPR gRNA sequence
tgtagcacccacatttaagc

SEQ ID NO: 226738 - DNA, 20 bp, Artificial
  CRISPR gRNA sequence
gtagcacccacatttaagcc

SEQ ID NO: 226739 - DNA, 20 bp, Artificial
  CRISPR gRNA sequence
tagcacccacatttaagcca

SEQ ID NO: 226740 - DNA, 20 bp, Artificial
  CRISPR gRNA sequence
aagccagggagacacgaatg

SEQ ID NO: 226741 - DNA, 20 bp, Artificial
  CRISPR gRNA sequence
agccagggagacacgaatgt

SEQ ID NO: 226742 - DNA, 20 bp, Artificial
  CRISPR gRNA sequence
gtcacatctttgagatagtc

SEQ ID NO: 226743 - DNA, 20 bp, Artificial
  CRISPR gRNA sequence
tcacatctttgagatagtca

SEQ ID NO: 226744 - DNA, 20 bp, Artificial
  CRISPR gRNA sequence
tgagatagtcatggatccaa

SEQ ID NO: 226745 - DNA, 20 bp, Artificial
  CRISPR gRNA sequence
gagatagtcatggatccaaa

SEQ ID NO: 226746 - DNA, 20 bp, Artificial
  CRISPR gRNA sequence
agatagtcatggatccaaat

SEQ ID NO: 226747 - DNA, 20 bp, Artificial
  CRISPR gRNA sequence
acttttctgttagtgcctct

SEQ ID NO: 226748 - DNA, 20 bp, Artificial
  CRISPR gRNA sequence
ttctgttagtgcctctgttg

SEQ ID NO: 226749 - DNA, 20 bp, Artificial
  CRISPR gRNA sequence
tctgttagtgcctctgttga

SEQ ID NO: 226750 - DNA, 20 bp, Artificial
  CRISPR gRNA sequence
ctgttagtgcctctgttgat

SEQ ID NO: 226751 - DNA, 20 bp, Artificial
  CRISPR gRNA sequence
tgttagtgcctctgttgatg

SEQ ID NO: 226752 - DNA, 20 bp, Artificial
  CRISPR gRNA sequence
ttagtgcctctgttgatggc

SEQ ID NO: 226753 - DNA, 20 bp, Artificial
  CRISPR gRNA sequence
gtgcctctgttgatggcctg

SEQ ID NO: 226754 - DNA, 20 bp, Artificial
  CRISPR gRNA sequence
tgttgatggcctgagcattc

SEQ ID NO: 226755 - DNA, 20 bp, Artificial
  CRISPR gRNA sequence
ttgatggcctgagcattcca

SEQ ID NO: 226756 - DNA, 20 bp, Artificial
  CRISPR gRNA sequence
atggcctgagcattccacca

SEQ ID NO: 226757 - DNA, 20 bp, Artificial
  CRISPR gRNA sequence
agcattccaccaaatagaaa

SEQ ID NO: 226758 - DNA, 20 bp, Artificial
  CRISPR gRNA sequence
caccaaatagaaatagaaag

SEQ ID NO: 226759 - DNA, 20 bp, Artificial
  CRISPR gRNA sequence
tattctccacctgcttagat

SEQ ID NO: 226760 - DNA, 20 bp, Artificial
  CRISPR gRNA sequence
ttctccacctgcttagatgt

SEQ ID NO: 226761 - DNA, 20 bp, Artificial
  CRISPR gRNA sequence
tccacctgcttagatgtata

SEQ ID NO: 226762 - DNA, 20 bp, Artificial
  CRISPR gRNA sequence
cacctgcttagatgtatatt

SEQ ID NO: 226763 - DNA, 20 bp, Artificial
  CRISPR gRNA sequence
cttagatgtatattttttag

SEQ ID NO: 226764 - DNA, 20 bp, Artificial
  CRISPR gRNA sequence
agatgtatattttttagaat

SEQ ID NO: 226765 - DNA, 20 bp, Artificial
  CRISPR gRNA sequence
gatgtatattttttagaatc

SEQ ID NO: 226766 - DNA, 20 bp, Artificial
  CRISPR gRNA sequence
tttagaatccagtatggtaa

SEQ ID NO: 226767 - DNA, 20 bp, Artificial
  CRISPR gRNA sequence
ttagaatccagtatggtaaa

SEQ ID NO: 226768 - DNA, 20 bp, Artificial
  CRISPR gRNA sequence
tagaatccagtatggtaaat

SEQ ID NO: 226769 - DNA, 20 bp, Artificial
  CRISPR gRNA sequence
agaatccagtatggtaaatc

SEQ ID NO: 226770 - DNA, 20 bp, Artificial
  CRISPR gRNA sequence
gaatccagtatggtaaatct

SEQ ID NO: 226771 - DNA, 20 bp, Artificial
  CRISPR gRNA sequence
ctaaagcattcataataact

SEQ ID NO: 226772 - DNA, 20 bp, Artificial
  CRISPR gRNA sequence
taaagcattcataataactc

SEQ ID NO: 226773 - DNA, 20 bp, Artificial
  CRISPR gRNA sequence
aagcattcataataactcag

SEQ ID NO: 226774 - DNA, 20 bp, Artificial
  CRISPR gRNA sequence
ataataactcagacccatga

SEQ ID NO: 226775 - DNA, 20 bp, Artificial
  CRISPR gRNA sequence
agacccatgacttttatttt

SEQ ID NO: 226776 - DNA, 20 bp, Artificial
  CRISPR gRNA sequence
ttattttatagatttctagt

SEQ ID NO: 226777 - DNA, 20 bp, Artificial
  CRISPR gRNA sequence
tattttatagatttctagtt

SEQ ID NO: 226778 - DNA, 20 bp, Artificial
  CRISPR gRNA sequence
attttatagatttctagttc

SEQ ID NO: 226779 - DNA, 20 bp, Artificial
  CRISPR gRNA sequence
ttttatagatttctagttct

SEQ ID NO: 226780 - DNA, 20 bp, Artificial
  CRISPR gRNA sequence
tatagatttctagttctgct

SEQ ID NO: 226781 - DNA, 20 bp, Artificial
  CRISPR gRNA sequence
atagatttctagttctgctt

SEQ ID NO: 226782 - DNA, 20 bp, Artificial
  CRISPR gRNA sequence
tagatttctagttctgctta

SEQ ID NO: 226783 - DNA, 20 bp, Artificial
  CRISPR gRNA sequence
ctagttctgcttaacttttc

SEQ ID NO: 226784 - DNA, 20 bp, Artificial
  CRISPR gRNA sequence
tagttctgcttaacttttcc

SEQ ID NO: 226785 - DNA, 20 bp, Artificial
  CRISPR gRNA sequence
gttctgcttaacttttcctg

SEQ ID NO: 226786 - DNA, 20 bp, Artificial
  CRISPR gRNA sequence
tgcttaacttttcctgatta

SEQ ID NO: 226787 - DNA, 20 bp, Artificial
  CRISPR gRNA sequence
cttaacttttcctgattacc

SEQ ID NO: 226788 - DNA, 20 bp, Artificial
  CRISPR gRNA sequence
aacttttcctgattaccatt

SEQ ID NO: 226789 - DNA, 20 bp, Artificial
  CRISPR gRNA sequence
acttttcctgattaccattt

SEQ ID NO: 226790 - DNA, 20 bp, Artificial
  CRISPR gRNA sequence
ttcctgattaccatttatgg

SEQ ID NO: 226791 - DNA, 20 bp, Artificial
  CRISPR gRNA sequence
tcctgattaccatttatggt

SEQ ID NO: 226792 - DNA, 20 bp, Artificial
  CRISPR gRNA sequence
cctgattaccatttatggtc

SEQ ID NO: 226793 - DNA, 20 bp, Artificial
  CRISPR gRNA sequence
ctgattaccatttatggtct

SEQ ID NO: 226794 - DNA, 20 bp, Artificial
  CRISPR gRNA sequence
attaccatttatggtctgta

SEQ ID NO: 226795 - DNA, 20 bp, Artificial
  CRISPR gRNA sequence
ccatttatggtctgtacttg

SEQ ID NO: 226796 - DNA, 20 bp, Artificial
  CRISPR gRNA sequence
atggtctgtacttggctaca

SEQ ID NO: 226797 - DNA, 20 bp, Artificial
  CRISPR gRNA sequence
tggtctgtacttggctacag

SEQ ID NO: 226798 - DNA, 20 bp, Artificial
  CRISPR gRNA sequence
tacttggctacaggggattt

SEQ ID NO: 226799 - DNA, 20 bp, Artificial
  CRISPR gRNA sequence
ggctacaggggatttctctc

SEQ ID NO: 226800 - DNA, 20 bp, Artificial
  CRISPR gRNA sequence
gctacaggggatttctctca

SEQ ID NO: 226801 - DNA, 20 bp, Artificial
  CRISPR gRNA sequence
caggggatttctctcagtgg

SEQ ID NO: 226802 - DNA, 20 bp, Artificial
  CRISPR gRNA sequence
ctctcagtggtttttccagc

SEQ ID NO: 226803 - DNA, 20 bp, Artificial
  CRISPR gRNA sequence
tctcagtggtttttccagct

SEQ ID NO: 226804 - DNA, 20 bp, Artificial
  CRISPR gRNA sequence
tcagtggtttttccagctct

SEQ ID NO: 226805 - DNA, 20 bp, Artificial
  CRISPR gRNA sequence
agtggtttttccagctctgc

SEQ ID NO: 226806 - DNA, 20 bp, Artificial
  CRISPR gRNA sequence
ttccagctctgcatgtgagt

SEQ ID NO: 226807 - DNA, 20 bp, Artificial
  CRISPR gRNA sequence
tccagctctgcatgtgagtc

SEQ ID NO: 226808 - DNA, 20 bp, Artificial
  CRISPR gRNA sequence
ccagctctgcatgtgagtct

SEQ ID NO: 226809 - DNA, 20 bp, Artificial
  CRISPR gRNA sequence
cagctctgcatgtgagtctt

SEQ ID NO: 226810 - DNA, 20 bp, Artificial
  CRISPR gRNA sequence
tgcatgtgagtctttgtggt

SEQ ID NO: 226811 - DNA, 20 bp, Artificial
  CRISPR gRNA sequence
catgtgagtctttgtggtcc

SEQ ID NO: 226812 - DNA, 20 bp, Artificial
  CRISPR gRNA sequence
tgtggtccaagacaaacctg

SEQ ID NO: 226813 - DNA, 20 bp, Artificial
  CRISPR gRNA sequence
gtggtccaagacaaacctgg

SEQ ID NO: 226814 - DNA, 20 bp, Artificial
  CRISPR gRNA sequence
tggtccaagacaaacctgga

SEQ ID NO: 226815 - DNA, 20 bp, Artificial
  CRISPR gRNA sequence
gacctttaccaggctaaact

SEQ ID NO: 226816 - DNA, 20 bp, Artificial
  CRISPR gRNA sequence
taccaggctaaactttcagt

SEQ ID NO: 226817 - DNA, 20 bp, Artificial
  CRISPR gRNA sequence
accaggctaaactttcagta

SEQ ID NO: 226818 - DNA, 20 bp, Artificial
  CRISPR gRNA sequence
ccaggctaaactttcagtaa

SEQ ID NO: 226819 - DNA, 20 bp, Artificial
  CRISPR gRNA sequence
aactttcagtaaagacagca

SEQ ID NO: 226820 - DNA, 20 bp, Artificial
  CRISPR gRNA sequence
tcagtaaagacagcaggtta

SEQ ID NO: 226821 - DNA, 20 bp, Artificial
  CRISPR gRNA sequence
cagtaaagacagcaggttat

SEQ ID NO: 226822 - DNA, 20 bp, Artificial
  CRISPR gRNA sequence
agtaaagacagcaggttatg

SEQ ID NO: 226823 - DNA, 20 bp, Artificial
  CRISPR gRNA sequence
tgccctcatttgctcactct

SEQ ID NO: 226824 - DNA, 20 bp, Artificial
  CRISPR gRNA sequence
atttgctcactctgaggaga

SEQ ID NO: 226825 - DNA, 20 bp, Artificial
  CRISPR gRNA sequence
gctcactctgaggagaaaga

SEQ ID NO: 226826 - DNA, 20 bp, Artificial
  CRISPR gRNA sequence
ctcactctgaggagaaagag

SEQ ID NO: 226827 - DNA, 20 bp, Artificial
  CRISPR gRNA sequence
actctgaggagaaagagttt

SEQ ID NO: 226828 - DNA, 20 bp, Artificial
  CRISPR gRNA sequence
tgaggagaaagagtttcttt

SEQ ID NO: 226829 - DNA, 20 bp, Artificial
  CRISPR gRNA sequence
aggagaaagagtttctttat

SEQ ID NO: 226830 - DNA, 20 bp, Artificial
  CRISPR gRNA sequence
ctttataccagagctgtatc

SEQ ID NO: 226831 - DNA, 20 bp, Artificial
  CRISPR gRNA sequence
tttataccagagctgtatct

SEQ ID NO: 226832 - DNA, 20 bp, Artificial
  CRISPR gRNA sequence
tataccagagctgtatcttg

SEQ ID NO: 226833 - DNA, 20 bp, Artificial
  CRISPR gRNA sequence
ataccagagctgtatcttga

SEQ ID NO: 226834 - DNA, 20 bp, Artificial
  CRISPR gRNA sequence
taccagagctgtatcttgaa

SEQ ID NO: 226835 - DNA, 20 bp, Artificial
  CRISPR gRNA sequence
tatcttgaaagatgtctcag

SEQ ID NO: 226836 - DNA, 20 bp, Artificial
  CRISPR gRNA sequence
gaaagatgtctcaggatgcc

SEQ ID NO: 226837 - DNA, 20 bp, Artificial
  CRISPR gRNA sequence
aaagatgtctcaggatgcca

SEQ ID NO: 226838 - DNA, 20 bp, Artificial
  CRISPR gRNA sequence
aggatgccattggtcctact

SEQ ID NO: 226839 - DNA, 20 bp, Artificial
  CRISPR gRNA sequence
gtcctactgaggaagaagcc

SEQ ID NO: 226840 - DNA, 20 bp, Artificial
  CRISPR gRNA sequence
ctgaggaagaagcctgagaa

SEQ ID NO: 226841 - DNA, 20 bp, Artificial
  CRISPR gRNA sequence
aggaagaagcctgagaagac

SEQ ID NO: 226842 - DNA, 20 bp, Artificial
  CRISPR gRNA sequence
agaagactcttaaactccca

SEQ ID NO: 226843 - DNA, 20 bp, Artificial
  CRISPR gRNA sequence
ttaaactcccagagcccagc

SEQ ID NO: 226844 - DNA, 20 bp, Artificial
  CRISPR gRNA sequence
aaactcccagagcccagcca

SEQ ID NO: 226845 - DNA, 20 bp, Artificial
  CRISPR gRNA sequence
aactcccagagcccagccag

SEQ ID NO: 226846 - DNA, 20 bp, Artificial
  CRISPR gRNA sequence
ccagagcccagccagcactt

SEQ ID NO: 226847 - DNA, 20 bp, Artificial
  CRISPR gRNA sequence
ggtgagccctggaccacgtt

SEQ ID NO: 226848 - DNA, 20 bp, Artificial
  CRISPR gRNA sequence
gtgagccctggaccacgttt

SEQ ID NO: 226849 - DNA, 20 bp, Artificial
  CRISPR gRNA sequence
gaccacgtttcaaagataaa

SEQ ID NO: 226850 - DNA, 20 bp, Artificial
  CRISPR gRNA sequence
caaagataaaggcctcttac

SEQ ID NO: 226851 - DNA, 20 bp, Artificial
  CRISPR gRNA sequence
aaagataaaggcctcttaca

SEQ ID NO: 226852 - DNA, 20 bp, Artificial
  CRISPR gRNA sequence
ttacagggaaatgttcctaa

SEQ ID NO: 226853 - DNA, 20 bp, Artificial
  CRISPR gRNA sequence
acagggaaatgttcctaaat

SEQ ID NO: 226854 - DNA, 20 bp, Artificial
  CRISPR gRNA sequence
cagggaaatgttcctaaata

SEQ ID NO: 226855 - DNA, 20 bp, Artificial
  CRISPR gRNA sequence
ctaaataccttcacctttag

SEQ ID NO: 226856 - DNA, 20 bp, Artificial
  CRISPR gRNA sequence
aataccttcacctttagctt

SEQ ID NO: 226857 - DNA, 20 bp, Artificial
  CRISPR gRNA sequence
cacctttagcttagctttaa

SEQ ID NO: 226858 - DNA, 20 bp, Artificial
  CRISPR gRNA sequence
acctttagcttagctttaac

SEQ ID NO: 226859 - DNA, 20 bp, Artificial
  CRISPR gRNA sequence
tagcttagctttaacttagg

SEQ ID NO: 226860 - DNA, 20 bp, Artificial
  CRISPR gRNA sequence
agcttagctttaacttagga

SEQ ID NO: 226861 - DNA, 20 bp, Artificial
  CRISPR gRNA sequence
gcttagctttaacttaggaa

SEQ ID NO: 226862 - DNA, 20 bp, Artificial
  CRISPR gRNA sequence
agctttaacttaggaacttt

SEQ ID NO: 226863 - DNA, 20 bp, Artificial
  CRISPR gRNA sequence
gctttaacttaggaactttt

SEQ ID NO: 226864 - DNA, 20 bp, Artificial
  CRISPR gRNA sequence
taacttaggaacttttaagc

SEQ ID NO: 226865 - DNA, 20 bp, Artificial
  CRISPR gRNA sequence
aacttaggaacttttaagca

SEQ ID NO: 226866 - DNA, 20 bp, Artificial
  CRISPR gRNA sequence
acttaggaacttttaagcag

SEQ ID NO: 226867 - DNA, 20 bp, Artificial
  CRISPR gRNA sequence
aggaacttttaagcagaatc

SEQ ID NO: 226868 - DNA, 20 bp, Artificial
  CRISPR gRNA sequence
ggaacttttaagcagaatct

SEQ ID NO: 226869 - DNA, 20 bp, Artificial
  CRISPR gRNA sequence
ttaagcagaatctctatgct

SEQ ID NO: 226870 - DNA, 20 bp, Artificial
  CRISPR gRNA sequence
taagcagaatctctatgctt

SEQ ID NO: 226871 - DNA, 20 bp, Artificial
  CRISPR gRNA sequence
aagcagaatctctatgctta

SEQ ID NO: 226872 - DNA, 20 bp, Artificial
  CRISPR gRNA sequence
agcagaatctctatgcttag

SEQ ID NO: 226873 - DNA, 20 bp, Artificial
  CRISPR gRNA sequence
tatgcttagcaaacagctca

SEQ ID NO: 226874 - DNA, 20 bp, Artificial
  CRISPR gRNA sequence
tgcttagcaaacagctcaga

SEQ ID NO: 226875 - DNA, 20 bp, Artificial
  CRISPR gRNA sequence
agcaaacagctcagagattg

SEQ ID NO: 226876 - DNA, 20 bp, Artificial
  CRISPR gRNA sequence
gcaaacagctcagagattgc

SEQ ID NO: 226877 - DNA, 20 bp, Artificial
  CRISPR gRNA sequence
agagattgctagaatcaaac

SEQ ID NO: 226878 - DNA, 20 bp, Artificial
  CRISPR gRNA sequence
ctagaatcaaacaccaaggc

SEQ ID NO: 226879 - DNA, 20 bp, Artificial
  CRISPR gRNA sequence
gaatcaaacaccaaggctta

SEQ ID NO: 226880 - DNA, 20 bp, Artificial
  CRISPR gRNA sequence
aactgatagtattgaatttc

SEQ ID NO: 226881 - DNA, 20 bp, Artificial
  CRISPR gRNA sequence
actgatagtattgaatttca

SEQ ID NO: 226882 - DNA, 20 bp, Artificial
  CRISPR gRNA sequence
atagtattgaatttcagacg

SEQ ID NO: 226883 - DNA, 20 bp, Artificial
  CRISPR gRNA sequence
aatttcagacgctttgtttg

SEQ ID NO: 226884 - DNA, 20 bp, Artificial
  CRISPR gRNA sequence
cagacgctttgtttgtgttc

SEQ ID NO: 226885 - DNA, 20 bp, Artificial
  CRISPR gRNA sequence
agacgctttgtttgtgttct

SEQ ID NO: 226886 - DNA, 20 bp, Artificial
  CRISPR gRNA sequence
tgtttgtgttctgaaaacta

SEQ ID NO: 226887 - DNA, 20 bp, Artificial
  CRISPR gRNA sequence
gtttgtgttctgaaaactac

SEQ ID NO: 226888 - DNA, 20 bp, Artificial
  CRISPR gRNA sequence
tttgtgttctgaaaactaca

SEQ ID NO: 226889 - DNA, 20 bp, Artificial
  CRISPR gRNA sequence
gtgttctgaaaactacacca

SEQ ID NO: 226890 - DNA, 20 bp, Artificial
  CRISPR gRNA sequence
tgttctgaaaactacaccaa

SEQ ID NO: 226891 - DNA, 20 bp, Artificial
  CRISPR gRNA sequence
tgaaaactacaccaactcac

SEQ ID NO: 226892 - DNA, 20 bp, Artificial
  CRISPR gRNA sequence
aaaactacaccaactcacag

SEQ ID NO: 226893 - DNA, 20 bp, Artificial
  CRISPR gRNA sequence
caccaactcacagtttgcca

SEQ ID NO: 226894 - DNA, 20 bp, Artificial
  CRISPR gRNA sequence
acagtttgccactctactga

SEQ ID NO: 226895 - DNA, 20 bp, Artificial
  CRISPR gRNA sequence
gccactctactgacaattaa

SEQ ID NO: 226896 - DNA, 20 bp, Artificial
  CRISPR gRNA sequence
ccactctactgacaattaag

SEQ ID NO: 226897 - DNA, 20 bp, Artificial
  CRISPR gRNA sequence
tactgacaattaagttcctg

SEQ ID NO: 226898 - DNA, 20 bp, Artificial
  CRISPR gRNA sequence
ctgacaattaagttcctggc

SEQ ID NO: 226899 - DNA, 20 bp, Artificial
  CRISPR gRNA sequence
acaattaagttcctggctga

SEQ ID NO: 226900 - DNA, 20 bp, Artificial
  CRISPR gRNA sequence
agttcctggctgattttcag

SEQ ID NO: 226901 - DNA, 20 bp, Artificial
  CRISPR gRNA sequence
ctggctgattttcaggattc

SEQ ID NO: 226902 - DNA, 20 bp, Artificial
  CRISPR gRNA sequence
gctgattttcaggattcttc

SEQ ID NO: 226903 - DNA, 20 bp, Artificial
  CRISPR gRNA sequence
attttcaggattcttctttc

SEQ ID NO: 226904 - DNA, 20 bp, Artificial
  CRISPR gRNA sequence
tcaggattcttctttctcac

SEQ ID NO: 226905 - DNA, 20 bp, Artificial
  CRISPR gRNA sequence
caggattcttctttctcact

SEQ ID NO: 226906 - DNA, 20 bp, Artificial
  CRISPR gRNA sequence
aggattcttctttctcactc

SEQ ID NO: 226907 - DNA, 20 bp, Artificial
  CRISPR gRNA sequence
ttctttctcactctgatatc

SEQ ID NO: 226908 - DNA, 20 bp, Artificial
  CRISPR gRNA sequence
ctttctcactctgatatcat

SEQ ID NO: 226909 - DNA, 20 bp, Artificial
  CRISPR gRNA sequence
tttctcactctgatatcatt

SEQ ID NO: 226910 - DNA, 20 bp, Artificial
  CRISPR gRNA sequence
tctcactctgatatcatttt

SEQ ID NO: 226911 - DNA, 20 bp, Artificial
  CRISPR gRNA sequence
ctcactctgatatcatttta

SEQ ID NO: 226912 - DNA, 20 bp, Artificial
  CRISPR gRNA sequence
tcactctgatatcattttaa

SEQ ID NO: 226913 - DNA, 20 bp, Artificial
  CRISPR gRNA sequence
actctgatatcattttaagt

SEQ ID NO: 226914 - DNA, 20 bp, Artificial
  CRISPR gRNA sequence
tgatatcattttaagtgctg

SEQ ID NO: 226915 - DNA, 20 bp, Artificial
  CRISPR gRNA sequence
atatcattttaagtgctgtc

SEQ ID NO: 226916 - DNA, 20 bp, Artificial
  CRISPR gRNA sequence
taagtgctgtccacctagtc

SEQ ID NO: 226917 - DNA, 20 bp, Artificial
  CRISPR gRNA sequence
aagtgctgtccacctagtcc

SEQ ID NO: 226918 - DNA, 20 bp, Artificial
  CRISPR gRNA sequence
agtgctgtccacctagtcct

SEQ ID NO: 226919 - DNA, 20 bp, Artificial
  CRISPR gRNA sequence
tccacctagtcctccagttc

SEQ ID NO: 226920 - DNA, 20 bp, Artificial
  CRISPR gRNA sequence
gtcctccagttcctgcagga

SEQ ID NO: 226921 - DNA, 20 bp, Artificial
  CRISPR gRNA sequence
cagttcctgcaggattaagg

SEQ ID NO: 226922 - DNA, 20 bp, Artificial
  CRISPR gRNA sequence
ctgcaggattaaggtccaac

SEQ ID NO: 226923 - DNA, 20 bp, Artificial
  CRISPR gRNA sequence
caggattaaggtccaactgt

SEQ ID NO: 226924 - DNA, 20 bp, Artificial
  CRISPR gRNA sequence
aggtccaactgtatgtaaag

SEQ ID NO: 226925 - DNA, 20 bp, Artificial
  CRISPR gRNA sequence
tatgtaaagaactggctaac

SEQ ID NO: 226926 - DNA, 20 bp, Artificial
  CRISPR gRNA sequence
gctaacattttgaaattctt

SEQ ID NO: 226927 - DNA, 20 bp, Artificial
  CRISPR gRNA sequence
acattttgaaattctttgag

SEQ ID NO: 226928 - DNA, 20 bp, Artificial
  CRISPR gRNA sequence
tgaaattctttgagataggc

SEQ ID NO: 226929 - DNA, 20 bp, Artificial
  CRISPR gRNA sequence
gaaattctttgagataggcc

SEQ ID NO: 226930 - DNA, 20 bp, Artificial
  CRISPR gRNA sequence
aaattctttgagataggcct

SEQ ID NO: 226931 - DNA, 20 bp, Artificial
  CRISPR gRNA sequence
tttgagataggcctatctgt

SEQ ID NO: 226932 - DNA, 20 bp, Artificial
  CRISPR gRNA sequence
tgagataggcctatctgttc

SEQ ID NO: 226933 - DNA, 20 bp, Artificial
  CRISPR gRNA sequence
gagataggcctatctgttct

SEQ ID NO: 226934 - DNA, 20 bp, Artificial
  CRISPR gRNA sequence
agataggcctatctgttctt

SEQ ID NO: 226935 - DNA, 20 bp, Artificial
  CRISPR gRNA sequence
tctgttctttctttgccttt

SEQ ID NO: 226936 - DNA, 20 bp, Artificial
  CRISPR gRNA sequence
ttctttctttgcctttgtaa

SEQ ID NO: 226937 - DNA, 20 bp, Artificial
  CRISPR gRNA sequence
tttctttgcctttgtaactt

SEQ ID NO: 226938 - DNA, 20 bp, Artificial
  CRISPR gRNA sequence
tctttgcctttgtaactttg

SEQ ID NO: 226939 - DNA, 20 bp, Artificial
  CRISPR gRNA sequence
ctttgcctttgtaactttgt

SEQ ID NO: 226940 - DNA, 20 bp, Artificial
  CRISPR gRNA sequence
tttgcctttgtaactttgtt

SEQ ID NO: 226941 - DNA, 20 bp, Artificial
  CRISPR gRNA sequence
tgcctttgtaactttgtttt

SEQ ID NO: 226942 - DNA, 20 bp, Artificial
  CRISPR gRNA sequence
gcctttgtaactttgtttta

SEQ ID NO: 226943 - DNA, 20 bp, Artificial
  CRISPR gRNA sequence
cctttgtaactttgttttat

SEQ ID NO: 226944 - DNA, 20 bp, Artificial
  CRISPR gRNA sequence
tgtaactttgttttatacag

SEQ ID NO: 226945 - DNA, 20 bp, Artificial
  CRISPR gRNA sequence
gtaactttgttttatacagg

SEQ ID NO: 226946 - DNA, 20 bp, Artificial
  CRISPR gRNA sequence
taactttgttttatacaggc

SEQ ID NO: 226947 - DNA, 20 bp, Artificial
  CRISPR gRNA sequence
tgttttatacaggcaatact

SEQ ID NO: 226948 - DNA, 20 bp, Artificial
  CRISPR gRNA sequence
gttttatacaggcaatactg

SEQ ID NO: 226949 - DNA, 20 bp, Artificial
  CRISPR gRNA sequence
ttttatacaggcaatactgg

SEQ ID NO: 226950 - DNA, 20 bp, Artificial
  CRISPR gRNA sequence
tatacaggcaatactggctt

SEQ ID NO: 226951 - DNA, 20 bp, Artificial
  CRISPR gRNA sequence
atacaggcaatactggcttc

SEQ ID NO: 226952 - DNA, 20 bp, Artificial
  CRISPR gRNA sequence
tacaggcaatactggcttcg

SEQ ID NO: 226953 - DNA, 20 bp, Artificial
  CRISPR gRNA sequence
gcttcgcacaaaaccgcaag

SEQ ID NO: 226954 - DNA, 20 bp, Artificial
  CRISPR gRNA sequence
cgcacaaaaccgcaagacca

SEQ ID NO: 226955 - DNA, 20 bp, Artificial
  CRISPR gRNA sequence
gcacaaaaccgcaagaccat

SEQ ID NO: 226956 - DNA, 20 bp, Artificial
  CRISPR gRNA sequence
aaattctgcaaaacaatctt

SEQ ID NO: 226957 - DNA, 20 bp, Artificial
  CRISPR gRNA sequence
tgcaaaacaatcttcatgat

SEQ ID NO: 226958 - DNA, 20 bp, Artificial
  CRISPR gRNA sequence
caaaacaatcttcatgatga

SEQ ID NO: 226959 - DNA, 20 bp, Artificial
  CRISPR gRNA sequence
catgatgaatgggaaaaact

SEQ ID NO: 226960 - DNA, 20 bp, Artificial
  CRISPR gRNA sequence
atgatgaatgggaaaaacta

SEQ ID NO: 226961 - DNA, 20 bp, Artificial
  CRISPR gRNA sequence
ttattatattgttccatgac

SEQ ID NO: 226962 - DNA, 20 bp, Artificial
  CRISPR gRNA sequence
ttatattgttccatgacctt

SEQ ID NO: 226963 - DNA, 20 bp, Artificial
  CRISPR gRNA sequence
tattgttccatgacctttaa

SEQ ID NO: 226964 - DNA, 20 bp, Artificial
  CRISPR gRNA sequence
ttccatgacctttaaaattt

SEQ ID NO: 226965 - DNA, 20 bp, Artificial
  CRISPR gRNA sequence
catgacctttaaaatttttt

SEQ ID NO: 226966 - DNA, 20 bp, Artificial
  CRISPR gRNA sequence
taaaattttttttgttgtta

SEQ ID NO: 226967 - DNA, 20 bp, Artificial
  CRISPR gRNA sequence
aaaattttttttgttgttaa

SEQ ID NO: 226968 - DNA, 20 bp, Artificial
  CRISPR gRNA sequence
aaattttttttgttgttaaa

SEQ ID NO: 226969 - DNA, 20 bp, Artificial
  CRISPR gRNA sequence
tttttgttgttaaaacctta

SEQ ID NO: 226970 - DNA, 20 bp, Artificial
  CRISPR gRNA sequence
ttttgttgttaaaaccttaa

SEQ ID NO: 226971 - DNA, 20 bp, Artificial
  CRISPR gRNA sequence
tttgttgttaaaaccttaaa

SEQ ID NO: 226972 - DNA, 20 bp, Artificial
  CRISPR gRNA sequence
ttgttgttaaaaccttaaaa

SEQ ID NO: 226973 - DNA, 20 bp, Artificial
  CRISPR gRNA sequence
tgttgttaaaaccttaaaaa

SEQ ID NO: 226974 - DNA, 20 bp, Artificial
  CRISPR gRNA sequence
gttgttaaaaccttaaaaac

SEQ ID NO: 226975 - DNA, 20 bp, Artificial
  CRISPR gRNA sequence
ttgttaaaaccttaaaaact

SEQ ID NO: 226976 - DNA, 20 bp, Artificial
  CRISPR gRNA sequence
ttaaaaccttaaaaactctg

SEQ ID NO: 226977 - DNA, 20 bp, Artificial
  CRISPR gRNA sequence
aaaccttaaaaactctgtta

SEQ ID NO: 226978 - DNA, 20 bp, Artificial
  CRISPR gRNA sequence
aaaaactctgttattatcaa

SEQ ID NO: 226979 - DNA, 20 bp, Artificial
  CRISPR gRNA sequence
aaaactctgttattatcaat

SEQ ID NO: 226980 - DNA, 20 bp, Artificial
  CRISPR gRNA sequence
tgttattatcaataacaacg

SEQ ID NO: 226981 - DNA, 20 bp, Artificial
  CRISPR gRNA sequence
ttattatcaataacaacggc

SEQ ID NO: 226982 - DNA, 20 bp, Artificial
  CRISPR gRNA sequence
ttatcaataacaacggcatt

SEQ ID NO: 226983 - DNA, 20 bp, Artificial
  CRISPR gRNA sequence
tcaataacaacggcattggg

SEQ ID NO: 226984 - DNA, 20 bp, Artificial
  CRISPR gRNA sequence
ggaaatgaaaaatagtaaag

SEQ ID NO: 226985 - DNA, 20 bp, Artificial
  CRISPR gRNA sequence
gtatttagtatgtggtaaat

SEQ ID NO: 226986 - DNA, 20 bp, Artificial
  CRISPR gRNA sequence
agtatgtggtaaattaaatc

SEQ ID NO: 226987 - DNA, 20 bp, Artificial
  CRISPR gRNA sequence
gtatgtggtaaattaaatca

SEQ ID NO: 226988 - DNA, 20 bp, Artificial
  CRISPR gRNA sequence
aatcattagaaacatcgaga

SEQ ID NO: 226989 - DNA, 20 bp, Artificial
  CRISPR gRNA sequence
gaaacatcgagaatgaaagt

SEQ ID NO: 226990 - DNA, 20 bp, Artificial
  CRISPR gRNA sequence
tcaagagtagtttgaacaac

SEQ ID NO: 226991 - DNA, 20 bp, Artificial
  CRISPR gRNA sequence
gaacaacacttgtgtgttct

SEQ ID NO: 226992 - DNA, 20 bp, Artificial
  CRISPR gRNA sequence
aacaacacttgtgtgttctt

SEQ ID NO: 226993 - DNA, 20 bp, Artificial
  CRISPR gRNA sequence
gtgtgttcttcttgcataac

SEQ ID NO: 226994 - DNA, 20 bp, Artificial
  CRISPR gRNA sequence
tgtgttcttcttgcataact

SEQ ID NO: 226995 - DNA, 20 bp, Artificial
  CRISPR gRNA sequence
ttcttgcataactttggata

SEQ ID NO: 226996 - DNA, 20 bp, Artificial
  CRISPR gRNA sequence
cttgcataactttggataca

SEQ ID NO: 226997 - DNA, 20 bp, Artificial
  CRISPR gRNA sequence
ttgcataactttggatacag

SEQ ID NO: 226998 - DNA, 20 bp, Artificial
  CRISPR gRNA sequence
gcataactttggatacagag

SEQ ID NO: 226999 - DNA, 20 bp, Artificial
  CRISPR gRNA sequence
cataactttggatacagagc

SEQ ID NO: 227000 - DNA, 20 bp, Artificial
  CRISPR gRNA sequence
tggatacagagcaagcatct

SEQ ID NO: 227001 - DNA, 20 bp, Artificial
  CRISPR gRNA sequence
ggatacagagcaagcatctt

SEQ ID NO: 227002 - DNA, 20 bp, Artificial
  CRISPR gRNA sequence
gatacagagcaagcatcttc

SEQ ID NO: 227003 - DNA, 20 bp, Artificial
  CRISPR gRNA sequence
ctctatggcttggtgaattg

SEQ ID NO: 227004 - DNA, 20 bp, Artificial
  CRISPR gRNA sequence
tctatggcttggtgaattgt

SEQ ID NO: 227005 - DNA, 20 bp, Artificial
  CRISPR gRNA sequence
tatggcttggtgaattgtca

SEQ ID NO: 227006 - DNA, 20 bp, Artificial
  CRISPR gRNA sequence
tggcttggtgaattgtcata

SEQ ID NO: 227007 - DNA, 20 bp, Artificial
  CRISPR gRNA sequence
ggtgaattgtcatacccctt

SEQ ID NO: 227008 - DNA, 20 bp, Artificial
  CRISPR gRNA sequence
gtgaattgtcataccccttt

SEQ ID NO: 227009 - DNA, 20 bp, Artificial
  CRISPR gRNA sequence
tcatacccctttctaagttt

SEQ ID NO: 227010 - DNA, 20 bp, Artificial
  CRISPR gRNA sequence
tctaagtttggatcggtttc

SEQ ID NO: 227011 - DNA, 20 bp, Artificial
  CRISPR gRNA sequence
ctaagtttggatcggtttct

SEQ ID NO: 227012 - DNA, 20 bp, Artificial
  CRISPR gRNA sequence
taagtttggatcggtttcta

SEQ ID NO: 227013 - DNA, 20 bp, Artificial
  CRISPR gRNA sequence
agtttggatcggtttctacc

SEQ ID NO: 227014 - DNA, 20 bp, Artificial
  CRISPR gRNA sequence
ggatcggtttctaccgtttt

SEQ ID NO: 227015 - DNA, 20 bp, Artificial
  CRISPR gRNA sequence
gatcggtttctaccgtttta

SEQ ID NO: 227016 - DNA, 20 bp, Artificial
  CRISPR gRNA sequence
ctaccgttttatcctttgca

SEQ ID NO: 227017 - DNA, 20 bp, Artificial
  CRISPR gRNA sequence
taccgttttatcctttgcac

SEQ ID NO: 227018 - DNA, 20 bp, Artificial
  CRISPR gRNA sequence
ccgttttatcctttgcactc

SEQ ID NO: 227019 - DNA, 20 bp, Artificial
  CRISPR gRNA sequence
tatcctttgcactctcaatg

SEQ ID NO: 227020 - DNA, 20 bp, Artificial
  CRISPR gRNA sequence
atcctttgcactctcaatgt

SEQ ID NO: 227021 - DNA, 20 bp, Artificial
  CRISPR gRNA sequence
tcctttgcactctcaatgtc

SEQ ID NO: 227022 - DNA, 20 bp, Artificial
  CRISPR gRNA sequence
tgcactctcaatgtcatgaa

SEQ ID NO: 227023 - DNA, 20 bp, Artificial
  CRISPR gRNA sequence
gcactctcaatgtcatgaaa

SEQ ID NO: 227024 - DNA, 20 bp, Artificial
  CRISPR gRNA sequence
cactctcaatgtcatgaaag

SEQ ID NO: 227025 - DNA, 20 bp, Artificial
  CRISPR gRNA sequence
tcaatgtcatgaaagaattc

SEQ ID NO: 227026 - DNA, 20 bp, Artificial
  CRISPR gRNA sequence
aatgtcatgaaagaattcct

SEQ ID NO: 227027 - DNA, 20 bp, Artificial
  CRISPR gRNA sequence
ctttaatgtttttttgaatg

SEQ ID NO: 227028 - DNA, 20 bp, Artificial
  CRISPR gRNA sequence
taatgtttttttgaatgttt

SEQ ID NO: 227029 - DNA, 20 bp, Artificial
  CRISPR gRNA sequence
aatgtttttttgaatgttta

SEQ ID NO: 227030 - DNA, 20 bp, Artificial
  CRISPR gRNA sequence
atgtttttttgaatgtttaa

SEQ ID NO: 227031 - DNA, 20 bp, Artificial
  CRISPR gRNA sequence
ttttgaatgtttaaagttta

SEQ ID NO: 227032 - DNA, 20 bp, Artificial
  CRISPR gRNA sequence
tttgaatgtttaaagtttat

SEQ ID NO: 227033 - DNA, 20 bp, Artificial
  CRISPR gRNA sequence
ttgaatgtttaaagtttatt

SEQ ID NO: 227034 - DNA, 20 bp, Artificial
  CRISPR gRNA sequence
tgaatgtttaaagtttattt

SEQ ID NO: 227035 - DNA, 20 bp, Artificial
  CRISPR gRNA sequence
gaatgtttaaagtttatttt

SEQ ID NO: 227036 - DNA, 20 bp, Artificial
  CRISPR gRNA sequence
aatgtttaaagtttatttta

SEQ ID NO: 227037 - DNA, 20 bp, Artificial
  CRISPR gRNA sequence
aaagtttattttattgccag

SEQ ID NO: 227038 - DNA, 20 bp, Artificial
  CRISPR gRNA sequence
aagtttattttattgccagt

SEQ ID NO: 227039 - DNA, 20 bp, Artificial
  CRISPR gRNA sequence
attttattgccagtcacttc

SEQ ID NO: 227040 - DNA, 20 bp, Artificial
  CRISPR gRNA sequence
ttttattgccagtcacttcc

SEQ ID NO: 227041 - DNA, 20 bp, Artificial
  CRISPR gRNA sequence
tattgccagtcacttcctct

SEQ ID NO: 227042 - DNA, 20 bp, Artificial
  CRISPR gRNA sequence
attgccagtcacttcctctg

SEQ ID NO: 227043 - DNA, 20 bp, Artificial
  CRISPR gRNA sequence
ttgccagtcacttcctctgg

SEQ ID NO: 227044 - DNA, 20 bp, Artificial
  CRISPR gRNA sequence
ccagtcacttcctctgggac

SEQ ID NO: 227045 - DNA, 20 bp, Artificial
  CRISPR gRNA sequence
cctctgggacatctttattc

SEQ ID NO: 227046 - DNA, 20 bp, Artificial
  CRISPR gRNA sequence
ctctgggacatctttattct

SEQ ID NO: 227047 - DNA, 20 bp, Artificial
  CRISPR gRNA sequence
tgggacatctttattctttt

SEQ ID NO: 227048 - DNA, 20 bp, Artificial
  CRISPR gRNA sequence
ggacatctttattctttttg

SEQ ID NO: 227049 - DNA, 20 bp, Artificial
  CRISPR gRNA sequence
tattctttttgttacatcct

SEQ ID NO: 227050 - DNA, 20 bp, Artificial
  CRISPR gRNA sequence
attctttttgttacatcctc

SEQ ID NO: 227051 - DNA, 20 bp, Artificial
  CRISPR gRNA sequence
ttctttttgttacatcctcc

SEQ ID NO: 227052 - DNA, 20 bp, Artificial
  CRISPR gRNA sequence
tttttgttacatcctcctca

SEQ ID NO: 227053 - DNA, 20 bp, Artificial
  CRISPR gRNA sequence
tttgttacatcctcctcact

SEQ ID NO: 227054 - DNA, 20 bp, Artificial
  CRISPR gRNA sequence
ttgttacatcctcctcactt

SEQ ID NO: 227055 - DNA, 20 bp, Artificial
  CRISPR gRNA sequence
tgttacatcctcctcacttt

SEQ ID NO: 227056 - DNA, 20 bp, Artificial
  CRISPR gRNA sequence
gttacatcctcctcactttc

SEQ ID NO: 227057 - DNA, 20 bp, Artificial
  CRISPR gRNA sequence
ttacatcctcctcactttcc

SEQ ID NO: 227058 - DNA, 20 bp, Artificial
  CRISPR gRNA sequence
catcctcctcactttcctca

SEQ ID NO: 227059 - DNA, 20 bp, Artificial
  CRISPR gRNA sequence
ctcactttcctcatttatat

SEQ ID NO: 227060 - DNA, 20 bp, Artificial
  CRISPR gRNA sequence
actttcctcatttatatcag

SEQ ID NO: 227061 - DNA, 20 bp, Artificial
  CRISPR gRNA sequence
tcctcatttatatcagtaag

SEQ ID NO: 227062 - DNA, 20 bp, Artificial
  CRISPR gRNA sequence
cctcatttatatcagtaagt

SEQ ID NO: 227063 - DNA, 20 bp, Artificial
  CRISPR gRNA sequence
ctcatttatatcagtaagtc

SEQ ID NO: 227064 - DNA, 20 bp, Artificial
  CRISPR gRNA sequence
atttatatcagtaagtccac

SEQ ID NO: 227065 - DNA, 20 bp, Artificial
  CRISPR gRNA sequence
atatcagtaagtccaccttc

SEQ ID NO: 227066 - DNA, 20 bp, Artificial
  CRISPR gRNA sequence
tatcagtaagtccaccttcg

SEQ ID NO: 227067 - DNA, 20 bp, Artificial
  CRISPR gRNA sequence
cgctgagttcttctggcttc

SEQ ID NO: 227068 - DNA, 20 bp, Artificial
  CRISPR gRNA sequence
gctgagttcttctggcttca

SEQ ID NO: 227069 - DNA, 20 bp, Artificial
  CRISPR gRNA sequence
agttcttctggcttcatctc

SEQ ID NO: 227070 - DNA, 20 bp, Artificial
  CRISPR gRNA sequence
ttctggcttcatctctagag

SEQ ID NO: 227071 - DNA, 20 bp, Artificial
  CRISPR gRNA sequence
ctggcttcatctctagagtt

SEQ ID NO: 227072 - DNA, 20 bp, Artificial
  CRISPR gRNA sequence
tggcttcatctctagagttt

SEQ ID NO: 227073 - DNA, 20 bp, Artificial
  CRISPR gRNA sequence
gcttcatctctagagtttct

SEQ ID NO: 227074 - DNA, 20 bp, Artificial
  CRISPR gRNA sequence
catctctagagtttcttgca

SEQ ID NO: 227075 - DNA, 20 bp, Artificial
  CRISPR gRNA sequence
atctctagagtttcttgcat

SEQ ID NO: 227076 - DNA, 20 bp, Artificial
  CRISPR gRNA sequence
tagagtttcttgcattgcag

SEQ ID NO: 227077 - DNA, 20 bp, Artificial
  CRISPR gRNA sequence
gagtttcttgcattgcagta

SEQ ID NO: 227078 - DNA, 20 bp, Artificial
  CRISPR gRNA sequence
cttgcattgcagtaatgtcg

SEQ ID NO: 227079 - DNA, 20 bp, Artificial
  CRISPR gRNA sequence
ttgcattgcagtaatgtcga

SEQ ID NO: 227080 - DNA, 20 bp, Artificial
  CRISPR gRNA sequence
gcattgcagtaatgtcgaca

SEQ ID NO: 227081 - DNA, 20 bp, Artificial
  CRISPR gRNA sequence
cattgcagtaatgtcgacat

SEQ ID NO: 227082 - DNA, 20 bp, Artificial
  CRISPR gRNA sequence
cagtaatgtcgacattcgca

SEQ ID NO: 227083 - DNA, 20 bp, Artificial
  CRISPR gRNA sequence
gcacaatcagctatttcttc

SEQ ID NO: 227084 - DNA, 20 bp, Artificial
  CRISPR gRNA sequence
tttcttctcttactccattt

SEQ ID NO: 227085 - DNA, 20 bp, Artificial
  CRISPR gRNA sequence
cttctcttactccatttatg

SEQ ID NO: 227086 - DNA, 20 bp, Artificial
  CRISPR gRNA sequence
ttctcttactccatttatgg

SEQ ID NO: 227087 - DNA, 20 bp, Artificial
  CRISPR gRNA sequence
ctcttactccatttatggtc

SEQ ID NO: 227088 - DNA, 20 bp, Artificial
  CRISPR gRNA sequence
tcttactccatttatggtct

SEQ ID NO: 227089 - DNA, 20 bp, Artificial
  CRISPR gRNA sequence
ttactccatttatggtctat

SEQ ID NO: 227090 - DNA, 20 bp, Artificial
  CRISPR gRNA sequence
actccatttatggtctattc

SEQ ID NO: 227091 - DNA, 20 bp, Artificial
  CRISPR gRNA sequence
ctccatttatggtctattca

SEQ ID NO: 227092 - DNA, 20 bp, Artificial
  CRISPR gRNA sequence
catttatggtctattcaaat

SEQ ID NO: 227093 - DNA, 20 bp, Artificial
  CRISPR gRNA sequence
atggtctattcaaatttcac

SEQ ID NO: 227094 - DNA, 20 bp, Artificial
  CRISPR gRNA sequence
tggtctattcaaatttcact

SEQ ID NO: 227095 - DNA, 20 bp, Artificial
  CRISPR gRNA sequence
ttcaaatttcactcctagca

SEQ ID NO: 227096 - DNA, 20 bp, Artificial
  CRISPR gRNA sequence
aaatttcactcctagcattt

SEQ ID NO: 227097 - DNA, 20 bp, Artificial
  CRISPR gRNA sequence
cactcctagcatttgtcagt

SEQ ID NO: 227098 - DNA, 20 bp, Artificial
  CRISPR gRNA sequence
actcctagcatttgtcagtt

SEQ ID NO: 227099 - DNA, 20 bp, Artificial
  CRISPR gRNA sequence
ctagcatttgtcagttttta

SEQ ID NO: 227100 - DNA, 20 bp, Artificial
  CRISPR gRNA sequence
gcatttgtcagtttttattt

SEQ ID NO: 227101 - DNA, 20 bp, Artificial
  CRISPR gRNA sequence
gtcagtttttatttctttac

SEQ ID NO: 227102 - DNA, 20 bp, Artificial
  CRISPR gRNA sequence
tcagtttttatttctttact

SEQ ID NO: 227103 - DNA, 20 bp, Artificial
  CRISPR gRNA sequence
ttatttctttactctttcat

SEQ ID NO: 227104 - DNA, 20 bp, Artificial
  CRISPR gRNA sequence
tatttctttactctttcatc

SEQ ID NO: 227105 - DNA, 20 bp, Artificial
  CRISPR gRNA sequence
atttctttactctttcatct

SEQ ID NO: 227106 - DNA, 20 bp, Artificial
  CRISPR gRNA sequence
tttctttactctttcatctt

SEQ ID NO: 227107 - DNA, 20 bp, Artificial
  CRISPR gRNA sequence
ctttactctttcatctttct

SEQ ID NO: 227108 - DNA, 20 bp, Artificial
  CRISPR gRNA sequence
tttactctttcatctttctt

SEQ ID NO: 227109 - DNA, 20 bp, Artificial
  CRISPR gRNA sequence
tactctttcatctttcttgc

SEQ ID NO: 227110 - DNA, 20 bp, Artificial
  CRISPR gRNA sequence
actctttcatctttcttgcc

SEQ ID NO: 227111 - DNA, 20 bp, Artificial
  CRISPR gRNA sequence
ctctttcatctttcttgcct

SEQ ID NO: 227112 - DNA, 20 bp, Artificial
  CRISPR gRNA sequence
tttcatctttcttgcctagt

SEQ ID NO: 227113 - DNA, 20 bp, Artificial
  CRISPR gRNA sequence
tcatctttcttgcctagttt

SEQ ID NO: 227114 - DNA, 20 bp, Artificial
  CRISPR gRNA sequence
catctttcttgcctagtttc

SEQ ID NO: 227115 - DNA, 20 bp, Artificial
  CRISPR gRNA sequence
atctttcttgcctagtttcc

SEQ ID NO: 227116 - DNA, 20 bp, Artificial
  CRISPR gRNA sequence
tcttgcctagtttcctcttt

SEQ ID NO: 227117 - DNA, 20 bp, Artificial
  CRISPR gRNA sequence
cttgcctagtttcctctttt

SEQ ID NO: 227118 - DNA, 20 bp, Artificial
  CRISPR gRNA sequence
ttgcctagtttcctcttttg

SEQ ID NO: 227119 - DNA, 20 bp, Artificial
  CRISPR gRNA sequence
gcctagtttcctcttttgat

SEQ ID NO: 227120 - DNA, 20 bp, Artificial
  CRISPR gRNA sequence
cctagtttcctcttttgatt

SEQ ID NO: 227121 - DNA, 20 bp, Artificial
  CRISPR gRNA sequence
gtttcctcttttgatttatc

SEQ ID NO: 227122 - DNA, 20 bp, Artificial
  CRISPR gRNA sequence
cctcttttgatttatccatt

SEQ ID NO: 227123 - DNA, 20 bp, Artificial
  CRISPR gRNA sequence
ctcttttgatttatccatta

SEQ ID NO: 227124 - DNA, 20 bp, Artificial
  CRISPR gRNA sequence
ttttgatttatccattataa

SEQ ID NO: 227125 - DNA, 20 bp, Artificial
  CRISPR gRNA sequence
ttgatttatccattataaaa

SEQ ID NO: 227126 - DNA, 20 bp, Artificial
  CRISPR gRNA sequence
tgatttatccattataaaat

SEQ ID NO: 227127 - DNA, 20 bp, Artificial
  CRISPR gRNA sequence
gatttatccattataaaatg

SEQ ID NO: 227128 - DNA, 20 bp, Artificial
  CRISPR gRNA sequence
atttatccattataaaatgt

SEQ ID NO: 227129 - DNA, 20 bp, Artificial
  CRISPR gRNA sequence
atccattataaaatgtcaca

SEQ ID NO: 227130 - DNA, 20 bp, Artificial
  CRISPR gRNA sequence
tccattataaaatgtcacat

SEQ ID NO: 227131 - DNA, 20 bp, Artificial
  CRISPR gRNA sequence
taaaatgtcacatgggttta

SEQ ID NO: 227132 - DNA, 20 bp, Artificial
  CRISPR gRNA sequence
atcactgggaaacaaggagg

SEQ ID NO: 227133 - DNA, 20 bp, Artificial
  CRISPR gRNA sequence
tcactgggaaacaaggaggt

SEQ ID NO: 227134 - DNA, 20 bp, Artificial
  CRISPR gRNA sequence
ggaaacaaggaggtaacaaa

SEQ ID NO: 227135 - DNA, 20 bp, Artificial
  CRISPR gRNA sequence
catactttgctgtctgtgca

SEQ ID NO: 227136 - DNA, 20 bp, Artificial
  CRISPR gRNA sequence
tgctgtctgtgcatgaccta

SEQ ID NO: 227137 - DNA, 20 bp, Artificial
  CRISPR gRNA sequence
gctgtctgtgcatgacctaa

SEQ ID NO: 227138 - DNA, 20 bp, Artificial
  CRISPR gRNA sequence
ctgtctgtgcatgacctaaa

SEQ ID NO: 227139 - DNA, 20 bp, Artificial
  CRISPR gRNA sequence
tctgtgcatgacctaaatat

SEQ ID NO: 227140 - DNA, 20 bp, Artificial
  CRISPR gRNA sequence
tgcatgacctaaatatcaga

SEQ ID NO: 227141 - DNA, 20 bp, Artificial
  CRISPR gRNA sequence
aatatcagatgtacagtgac

SEQ ID NO: 227142 - DNA, 20 bp, Artificial
  CRISPR gRNA sequence
gtcaccaacagtcttcaaaa

SEQ ID NO: 227143 - DNA, 20 bp, Artificial
  CRISPR gRNA sequence
caaaagaagtgacatggttg

SEQ ID NO: 227144 - DNA, 20 bp, Artificial
  CRISPR gRNA sequence
aaaagaagtgacatggttga

SEQ ID NO: 227145 - DNA, 20 bp, Artificial
  CRISPR gRNA sequence
atcactgatcatgatgggac

SEQ ID NO: 227146 - DNA, 20 bp, Artificial
  CRISPR gRNA sequence
atcatgatgggacatctgct

SEQ ID NO: 227147 - DNA, 20 bp, Artificial
  CRISPR gRNA sequence
ctatttacatagttattttt

SEQ ID NO: 227148 - DNA, 20 bp, Artificial
  CRISPR gRNA sequence
tttacatagttatttttgaa

SEQ ID NO: 227149 - DNA, 20 bp, Artificial
  CRISPR gRNA sequence
acatagttatttttgaactg

SEQ ID NO: 227150 - DNA, 20 bp, Artificial
  CRISPR gRNA sequence
catagttatttttgaactga

SEQ ID NO: 227151 - DNA, 20 bp, Artificial
  CRISPR gRNA sequence
tttttgaactgaagaaatag

SEQ ID NO: 227152 - DNA, 20 bp, Artificial
  CRISPR gRNA sequence
ttgaactgaagaaatagcag

SEQ ID NO: 227153 - DNA, 20 bp, Artificial
  CRISPR gRNA sequence
tgaactgaagaaatagcagt

SEQ ID NO: 227154 - DNA, 20 bp, Artificial
  CRISPR gRNA sequence
gaactgaagaaatagcagtg

SEQ ID NO: 227155 - DNA, 20 bp, Artificial
  CRISPR gRNA sequence
aactgaagaaatagcagtga

SEQ ID NO: 227156 - DNA, 20 bp, Artificial
  CRISPR gRNA sequence
aagaaatagcagtgaagttg

SEQ ID NO: 227157 - DNA, 20 bp, Artificial
  CRISPR gRNA sequence
tactttatgcagttactcag

SEQ ID NO: 227158 - DNA, 20 bp, Artificial
  CRISPR gRNA sequence
tatgcagttactcagttaat

SEQ ID NO: 227159 - DNA, 20 bp, Artificial
  CRISPR gRNA sequence
atgcagttactcagttaata

SEQ ID NO: 227160 - DNA, 20 bp, Artificial
  CRISPR gRNA sequence
tgcagttactcagttaatat

SEQ ID NO: 227161 - DNA, 20 bp, Artificial
  CRISPR gRNA sequence
ctcagttaatatattgtggt

SEQ ID NO: 227162 - DNA, 20 bp, Artificial
  CRISPR gRNA sequence
agttaatatattgtggtaat

SEQ ID NO: 227163 - DNA, 20 bp, Artificial
  CRISPR gRNA sequence
atatattgtggtaattgaaa

SEQ ID NO: 227164 - DNA, 20 bp, Artificial
  CRISPR gRNA sequence
tggtaattgaaatttggact

SEQ ID NO: 227165 - DNA, 20 bp, Artificial
  CRISPR gRNA sequence
aaatttggactgtttatgag

SEQ ID NO: 227166 - DNA, 20 bp, Artificial
  CRISPR gRNA sequence
ggactgtttatgagggattt

SEQ ID NO: 227167 - DNA, 20 bp, Artificial
  CRISPR gRNA sequence
gactgtttatgagggattta

SEQ ID NO: 227168 - DNA, 20 bp, Artificial
  CRISPR gRNA sequence
tttatgagggatttatttga

SEQ ID NO: 227169 - DNA, 20 bp, Artificial
  CRISPR gRNA sequence
atgagggatttatttgatta

SEQ ID NO: 227170 - DNA, 20 bp, Artificial
  CRISPR gRNA sequence
tgagggatttatttgattaa

SEQ ID NO: 227171 - DNA, 20 bp, Artificial
  CRISPR gRNA sequence
atttgattaaaccatggtaa

SEQ ID NO: 227172 - DNA, 20 bp, Artificial
  CRISPR gRNA sequence
tttgattaaaccatggtaac

SEQ ID NO: 227173 - DNA, 20 bp, Artificial
  CRISPR gRNA sequence
gattaaaccatggtaactgg

SEQ ID NO: 227174 - DNA, 20 bp, Artificial
  CRISPR gRNA sequence
attaaaccatggtaactgga

SEQ ID NO: 227175 - DNA, 20 bp, Artificial
  CRISPR gRNA sequence
aaccatggtaactggaattc

SEQ ID NO: 227176 - DNA, 20 bp, Artificial
  CRISPR gRNA sequence
gaattcatatcagaatagtg

SEQ ID NO: 227177 - DNA, 20 bp, Artificial
  CRISPR gRNA sequence
atatcagaatagtgcaaagt

SEQ ID NO: 227178 - DNA, 20 bp, Artificial
  CRISPR gRNA sequence
ctgtacttgattccaaattt

SEQ ID NO: 227179 - DNA, 20 bp, Artificial
  CRISPR gRNA sequence
tacttgattccaaatttaaa

SEQ ID NO: 227180 - DNA, 20 bp, Artificial
  CRISPR gRNA sequence
gattccaaatttaaaactgt

SEQ ID NO: 227181 - DNA, 20 bp, Artificial
  CRISPR gRNA sequence
attccaaatttaaaactgta

SEQ ID NO: 227182 - DNA, 20 bp, Artificial
  CRISPR gRNA sequence
caaatttaaaactgtattct

SEQ ID NO: 227183 - DNA, 20 bp, Artificial
  CRISPR gRNA sequence
aaaactgtattctaggcatc

SEQ ID NO: 227184 - DNA, 20 bp, Artificial
  CRISPR gRNA sequence
aaactgtattctaggcatct

SEQ ID NO: 227185 - DNA, 20 bp, Artificial
  CRISPR gRNA sequence
tattctaggcatctttaatt

SEQ ID NO: 227186 - DNA, 20 bp, Artificial
  CRISPR gRNA sequence
taggcatctttaattttttt

SEQ ID NO: 227187 - DNA, 20 bp, Artificial
  CRISPR gRNA sequence
ggcatctttaattttttttt

SEQ ID NO: 227188 - DNA, 20 bp, Artificial
  CRISPR gRNA sequence
taatttttttttttcaactt

SEQ ID NO: 227189 - DNA, 20 bp, Artificial
  CRISPR gRNA sequence
aatttttttttttcaacttt

SEQ ID NO: 227190 - DNA, 20 bp, Artificial
  CRISPR gRNA sequence
atttttttttttcaactttc

SEQ ID NO: 227191 - DNA, 20 bp, Artificial
  CRISPR gRNA sequence
ttttttttcaactttcccct

SEQ ID NO: 227192 - DNA, 20 bp, Artificial
  CRISPR gRNA sequence
tttttttcaactttcccctc

SEQ ID NO: 227193 - DNA, 20 bp, Artificial
  CRISPR gRNA sequence
ttttttcaactttcccctcc

SEQ ID NO: 227194 - DNA, 20 bp, Artificial
  CRISPR gRNA sequence
tttttcaactttcccctccc

SEQ ID NO: 227195 - DNA, 20 bp, Artificial
  CRISPR gRNA sequence
ttttcaactttcccctccct

SEQ ID NO: 227196 - DNA, 20 bp, Artificial
  CRISPR gRNA sequence
tttcaactttcccctccctg

SEQ ID NO: 227197 - DNA, 20 bp, Artificial
  CRISPR gRNA sequence
ttcaactttcccctccctgc

SEQ ID NO: 227198 - DNA, 20 bp, Artificial
  CRISPR gRNA sequence
tcaactttcccctccctgct

SEQ ID NO: 227199 - DNA, 20 bp, Artificial
  CRISPR gRNA sequence
caactttcccctccctgctc

SEQ ID NO: 227200 - DNA, 20 bp, Artificial
  CRISPR gRNA sequence
aactttcccctccctgctca

SEQ ID NO: 227201 - DNA, 20 bp, Artificial
  CRISPR gRNA sequence
tcccctccctgctcaaaatt

SEQ ID NO: 227202 - DNA, 20 bp, Artificial
  CRISPR gRNA sequence
cccctccctgctcaaaatta

SEQ ID NO: 227203 - DNA, 20 bp, Artificial
  CRISPR gRNA sequence
ccctccctgctcaaaattac

SEQ ID NO: 227204 - DNA, 20 bp, Artificial
  CRISPR gRNA sequence
cctgctcaaaattactccac

SEQ ID NO: 227205 - DNA, 20 bp, Artificial
  CRISPR gRNA sequence
ctcaaaattactccacagag

SEQ ID NO: 227206 - DNA, 20 bp, Artificial
  CRISPR gRNA sequence
aaaattactccacagagatt

SEQ ID NO: 227207 - DNA, 20 bp, Artificial
  CRISPR gRNA sequence
ctccacagagattttggtta

SEQ ID NO: 227208 - DNA, 20 bp, Artificial
  CRISPR gRNA sequence
cacagagattttggttacgg

SEQ ID NO: 227209 - DNA, 20 bp, Artificial
  CRISPR gRNA sequence
tggttacggctcagatgtct

SEQ ID NO: 227210 - DNA, 20 bp, Artificial
  CRISPR gRNA sequence
ggttacggctcagatgtctt

SEQ ID NO: 227211 - DNA, 20 bp, Artificial
  CRISPR gRNA sequence
gttacggctcagatgtcttt

SEQ ID NO: 227212 - DNA, 20 bp, Artificial
  CRISPR gRNA sequence
cggctcagatgtctttgagt

SEQ ID NO: 227213 - DNA, 20 bp, Artificial
  CRISPR gRNA sequence
agatgtctttgagtagatgt

SEQ ID NO: 227214 - DNA, 20 bp, Artificial
  CRISPR gRNA sequence
tgagtagatgttcctgtaga

SEQ ID NO: 227215 - DNA, 20 bp, Artificial
  CRISPR gRNA sequence
gagtagatgttcctgtagaa

SEQ ID NO: 227216 - DNA, 20 bp, Artificial
  CRISPR gRNA sequence
agtagatgttcctgtagaaa

SEQ ID NO: 227217 - DNA, 20 bp, Artificial
  CRISPR gRNA sequence
ctgtagaaatcattgttaga

SEQ ID NO: 227218 - DNA, 20 bp, Artificial
  CRISPR gRNA sequence
tagaaatcattgttagaaaa

SEQ ID NO: 227219 - DNA, 20 bp, Artificial
  CRISPR gRNA sequence
ttagaaaattcaaggaaaaa

SEQ ID NO: 227220 - DNA, 20 bp, Artificial
  CRISPR gRNA sequence
gaaaattcaaggaaaaaagt

SEQ ID NO: 227221 - DNA, 20 bp, Artificial
  CRISPR gRNA sequence
aaggaaaaaagttctcatta

SEQ ID NO: 227222 - DNA, 20 bp, Artificial
  CRISPR gRNA sequence
tcattacactaccttgagat

SEQ ID NO: 227223 - DNA, 20 bp, Artificial
  CRISPR gRNA sequence
attacactaccttgagatcc

SEQ ID NO: 227224 - DNA, 20 bp, Artificial
  CRISPR gRNA sequence
cactaccttgagatcctacc

SEQ ID NO: 227225 - DNA, 20 bp, Artificial
  CRISPR gRNA sequence
ccttgagatcctaccaagtc

SEQ ID NO: 227226 - DNA, 20 bp, Artificial
  CRISPR gRNA sequence
gagatcctaccaagtccttg

SEQ ID NO: 227227 - DNA, 20 bp, Artificial
  CRISPR gRNA sequence
agatcctaccaagtccttga

SEQ ID NO: 227228 - DNA, 20 bp, Artificial
  CRISPR gRNA sequence
ccaagtccttgagttttgac

SEQ ID NO: 227229 - DNA, 20 bp, Artificial
  CRISPR gRNA sequence
gagttttgacttgaggacag

SEQ ID NO: 227230 - DNA, 20 bp, Artificial
  CRISPR gRNA sequence
agttttgacttgaggacagc

SEQ ID NO: 227231 - DNA, 20 bp, Artificial
  CRISPR gRNA sequence
tgacttgaggacagcttaat

SEQ ID NO: 227232 - DNA, 20 bp, Artificial
  CRISPR gRNA sequence
gacttgaggacagcttaata

SEQ ID NO: 227233 - DNA, 20 bp, Artificial
  CRISPR gRNA sequence
acttgaggacagcttaataa

SEQ ID NO: 227234 - DNA, 20 bp, Artificial
  CRISPR gRNA sequence
gaggacagcttaataatgaa

SEQ ID NO: 227235 - DNA, 20 bp, Artificial
  CRISPR gRNA sequence
aggacagcttaataatgaaa

SEQ ID NO: 227236 - DNA, 20 bp, Artificial
  CRISPR gRNA sequence
aataatgaaagtaattcagc

SEQ ID NO: 227237 - DNA, 20 bp, Artificial
  CRISPR gRNA sequence
ataatgaaagtaattcagcc

SEQ ID NO: 227238 - DNA, 20 bp, Artificial
  CRISPR gRNA sequence
agccatgaaagcatatttaa

SEQ ID NO: 227239 - DNA, 20 bp, Artificial
  CRISPR gRNA sequence
aaaataagtaatggaacagg

SEQ ID NO: 227240 - DNA, 20 bp, Artificial
  CRISPR gRNA sequence
aaataagtaatggaacagga

SEQ ID NO: 227241 - DNA, 20 bp, Artificial
  CRISPR gRNA sequence
cttcatagattagaaaaatt

SEQ ID NO: 227242 - DNA, 20 bp, Artificial
  CRISPR gRNA sequence
ttcatagattagaaaaatta

SEQ ID NO: 227243 - DNA, 20 bp, Artificial
  CRISPR gRNA sequence
catagattagaaaaattatt

SEQ ID NO: 227244 - DNA, 20 bp, Artificial
  CRISPR gRNA sequence
atagattagaaaaattattc

SEQ ID NO: 227245 - DNA, 20 bp, Artificial
  CRISPR gRNA sequence
gaaaaattattctgaaaaag

SEQ ID NO: 227246 - DNA, 20 bp, Artificial
  CRISPR gRNA sequence
ttctgaaaaagtgaagacat

SEQ ID NO: 227247 - DNA, 20 bp, Artificial
  CRISPR gRNA sequence
tgaaaaagtgaagacatagc

SEQ ID NO: 227248 - DNA, 20 bp, Artificial
  CRISPR gRNA sequence
aaaaagtgaagacatagcct

SEQ ID NO: 227249 - DNA, 20 bp, Artificial
  CRISPR gRNA sequence
tcttggactaggaaatttcc

SEQ ID NO: 227250 - DNA, 20 bp, Artificial
  CRISPR gRNA sequence
ggactaggaaatttccatcc

SEQ ID NO: 227251 - DNA, 20 bp, Artificial
  CRISPR gRNA sequence
gactaggaaatttccatcca

SEQ ID NO: 227252 - DNA, 20 bp, Artificial
  CRISPR gRNA sequence
ggaaatttccatccaagaaa

SEQ ID NO: 227253 - DNA, 20 bp, Artificial
  CRISPR gRNA sequence
ccatccaagaaagtaaaata

SEQ ID NO: 227254 - DNA, 20 bp, Artificial
  CRISPR gRNA sequence
catccaagaaagtaaaatat

SEQ ID NO: 227255 - DNA, 20 bp, Artificial
  CRISPR gRNA sequence
tcacaaagaatcattctgtg

SEQ ID NO: 227256 - DNA, 20 bp, Artificial
  CRISPR gRNA sequence
tgtgacctggttgatggccc

SEQ ID NO: 227257 - DNA, 20 bp, Artificial
  CRISPR gRNA sequence
tgacctggttgatggcccct

SEQ ID NO: 227258 - DNA, 20 bp, Artificial
  CRISPR gRNA sequence
gttgatggcccctggtaata

SEQ ID NO: 227259 - DNA, 20 bp, Artificial
  CRISPR gRNA sequence
atggcccctggtaataagac

SEQ ID NO: 227260 - DNA, 20 bp, Artificial
  CRISPR gRNA sequence
gtaataagactttgttatta

SEQ ID NO: 227261 - DNA, 20 bp, Artificial
  CRISPR gRNA sequence
tgttattaagtttactgtga

SEQ ID NO: 227262 - DNA, 20 bp, Artificial
  CRISPR gRNA sequence
gttattaagtttactgtgaa

SEQ ID NO: 227263 - DNA, 20 bp, Artificial
  CRISPR gRNA sequence
ttattaagtttactgtgaat

SEQ ID NO: 227264 - DNA, 20 bp, Artificial
  CRISPR gRNA sequence
ttaagtttactgtgaattct

SEQ ID NO: 227265 - DNA, 20 bp, Artificial
  CRISPR gRNA sequence
agtttactgtgaattctttt

SEQ ID NO: 227266 - DNA, 20 bp, Artificial
  CRISPR gRNA sequence
actgtgaattcttttttttt

SEQ ID NO: 227267 - DNA, 20 bp, Artificial
  CRISPR gRNA sequence
ctgtgaattctttttttttt

SEQ ID NO: 227268 - DNA, 20 bp, Artificial
  CRISPR gRNA sequence
tgaattcttttttttttttt

SEQ ID NO: 227269 - DNA, 20 bp, Artificial
  CRISPR gRNA sequence
tttttttttttttttttttt

SEQ ID NO: 227270 - DNA, 20 bp, Artificial
  CRISPR gRNA sequence
tttttttttttttttttttt

SEQ ID NO: 227271 - DNA, 20 bp, Artificial
  CRISPR gRNA sequence
tttttttttttttttttttt

SEQ ID NO: 227272 - DNA, 20 bp, Artificial
  CRISPR gRNA sequence
tttttttttttttttttttt

SEQ ID NO: 227273 - DNA, 20 bp, Artificial
  CRISPR gRNA sequence
tttttttttttttttttttt

SEQ ID NO: 227274 - DNA, 20 bp, Artificial
  CRISPR gRNA sequence
tttttttttttttttttttt

SEQ ID NO: 227275 - DNA, 20 bp, Artificial
  CRISPR gRNA sequence
tttttttttttttttttttt

SEQ ID NO: 227276 - DNA, 20 bp, Artificial
  CRISPR gRNA sequence
tttttttttttttttttttt

SEQ ID NO: 227277 - DNA, 20 bp, Artificial
  CRISPR gRNA sequence
tttttttttttttttttttt

SEQ ID NO: 227278 - DNA, 20 bp, Artificial
  CRISPR gRNA sequence
tttttttttttttttttttt

SEQ ID NO: 227279 - DNA, 20 bp, Artificial
  CRISPR gRNA sequence
tttttttttttttttttttt

SEQ ID NO: 227280 - DNA, 20 bp, Artificial
  CRISPR gRNA sequence
tttttttttttttttttttt

SEQ ID NO: 227281 - DNA, 20 bp, Artificial
  CRISPR gRNA sequence
tttttttttttttttttttt

SEQ ID NO: 227282 - DNA, 20 bp, Artificial
  CRISPR gRNA sequence
tttttttttttttttttttg

SEQ ID NO: 227283 - DNA, 20 bp, Artificial
  CRISPR gRNA sequence
ttttttttttttttttttga

SEQ ID NO: 227284 - DNA, 20 bp, Artificial
  CRISPR gRNA sequence
tttttttttttttttttgag

SEQ ID NO: 227285 - DNA, 20 bp, Artificial
  CRISPR gRNA sequence
ttttttttttttttttgaga

SEQ ID NO: 227286 - DNA, 20 bp, Artificial
  CRISPR gRNA sequence
tttttttttttttttgagac

SEQ ID NO: 227287 - DNA, 20 bp, Artificial
  CRISPR gRNA sequence
ttttttttttttttgagacg

SEQ ID NO: 227288 - DNA, 20 bp, Artificial
  CRISPR gRNA sequence
tttttttttttttgagacgg

SEQ ID NO: 227289 - DNA, 20 bp, Artificial
  CRISPR gRNA sequence
ttttttttttttgagacgga

SEQ ID NO: 227290 - DNA, 20 bp, Artificial
  CRISPR gRNA sequence
tttttttttttgagacggag

SEQ ID NO: 227291 - DNA, 20 bp, Artificial
  CRISPR gRNA sequence
ttttttttttgagacggagt

SEQ ID NO: 227292 - DNA, 20 bp, Artificial
  CRISPR gRNA sequence
tttttttttgagacggagtc

SEQ ID NO: 227293 - DNA, 20 bp, Artificial
  CRISPR gRNA sequence
ttttttttgagacggagtct

SEQ ID NO: 227294 - DNA, 20 bp, Artificial
  CRISPR gRNA sequence
tttttttgagacggagtctc

SEQ ID NO: 227295 - DNA, 20 bp, Artificial
  CRISPR gRNA sequence
ttttttgagacggagtctcg

SEQ ID NO: 227296 - DNA, 20 bp, Artificial
  CRISPR gRNA sequence
tttttgagacggagtctcgc

SEQ ID NO: 227297 - DNA, 20 bp, Artificial
  CRISPR gRNA sequence
ttttgagacggagtctcgct

SEQ ID NO: 227298 - DNA, 20 bp, Artificial
  CRISPR gRNA sequence
tttgagacggagtctcgctc

SEQ ID NO: 227299 - DNA, 20 bp, Artificial
  CRISPR gRNA sequence
ttgagacggagtctcgctct

SEQ ID NO: 227300 - DNA, 20 bp, Artificial
  CRISPR gRNA sequence
tgagacggagtctcgctctg

SEQ ID NO: 227301 - DNA, 20 bp, Artificial
  CRISPR gRNA sequence
gagacggagtctcgctctgt

SEQ ID NO: 227302 - DNA, 20 bp, Artificial
  CRISPR gRNA sequence
agacggagtctcgctctgtt

SEQ ID NO: 227303 - DNA, 20 bp, Artificial
  CRISPR gRNA sequence
gctctgttgcccaggctgga

SEQ ID NO: 227304 - DNA, 20 bp, Artificial
  CRISPR gRNA sequence
tgttgcccaggctggagtgc

SEQ ID NO: 227305 - DNA, 20 bp, Artificial
  CRISPR gRNA sequence
ttgcccaggctggagtgcag

SEQ ID NO: 227306 - DNA, 20 bp, Artificial
  CRISPR gRNA sequence
cccaggctggagtgcagtgg

SEQ ID NO: 227307 - DNA, 20 bp, Artificial
  CRISPR gRNA sequence
gagtgcagtggcgtgatctc

SEQ ID NO: 227308 - DNA, 20 bp, Artificial
  CRISPR gRNA sequence
ggctcactgcaacctccgcc

SEQ ID NO: 227309 - DNA, 20 bp, Artificial
  CRISPR gRNA sequence
actgcaacctccgcctccca

SEQ ID NO: 227310 - DNA, 20 bp, Artificial
  CRISPR gRNA sequence
caacctccgcctcccaggtt

SEQ ID NO: 227311 - DNA, 20 bp, Artificial
  CRISPR gRNA sequence
cgcctcccaggttcaagcga

SEQ ID NO: 227312 - DNA, 20 bp, Artificial
  CRISPR gRNA sequence
ccaggttcaagcgattcttc

SEQ ID NO: 227313 - DNA, 20 bp, Artificial
  CRISPR gRNA sequence
aagcgattcttctgtctcag

SEQ ID NO: 227314 - DNA, 20 bp, Artificial
  CRISPR gRNA sequence
ttctgtctcagcctcccgag

SEQ ID NO: 227315 - DNA, 20 bp, Artificial
  CRISPR gRNA sequence
ctgtctcagcctcccgagta

SEQ ID NO: 227316 - DNA, 20 bp, Artificial
  CRISPR gRNA sequence
tgtctcagcctcccgagtag

SEQ ID NO: 227317 - DNA, 20 bp, Artificial
  CRISPR gRNA sequence
tctcagcctcccgagtagct

SEQ ID NO: 227318 - DNA, 20 bp, Artificial
  CRISPR gRNA sequence
agcctcccgagtagctacag

SEQ ID NO: 227319 - DNA, 20 bp, Artificial
  CRISPR gRNA sequence
ccgagtagctacaggctact

SEQ ID NO: 227320 - DNA, 20 bp, Artificial
  CRISPR gRNA sequence
caggctactggcgtgcacca

SEQ ID NO: 227321 - DNA, 20 bp, Artificial
  CRISPR gRNA sequence
ctggcgtgcaccaccatgcc

SEQ ID NO: 227322 - DNA, 20 bp, Artificial
  CRISPR gRNA sequence
gcgtgcaccaccatgcctgg

SEQ ID NO: 227323 - DNA, 20 bp, Artificial
  CRISPR gRNA sequence
ggtaatttttgtatttttag

SEQ ID NO: 227324 - DNA, 20 bp, Artificial
  CRISPR gRNA sequence
ttgtatttttagtagtgatg

SEQ ID NO: 227325 - DNA, 20 bp, Artificial
  CRISPR gRNA sequence
tgtatttttagtagtgatgg

SEQ ID NO: 227326 - DNA, 20 bp, Artificial
  CRISPR gRNA sequence
gtatttttagtagtgatggg

SEQ ID NO: 227327 - DNA, 20 bp, Artificial
  CRISPR gRNA sequence
tatttttagtagtgatgggg

SEQ ID NO: 227328 - DNA, 20 bp, Artificial
  CRISPR gRNA sequence
ttagtagtgatggggtttca

SEQ ID NO: 227329 - DNA, 20 bp, Artificial
  CRISPR gRNA sequence
tagtagtgatggggtttcac

SEQ ID NO: 227330 - DNA, 20 bp, Artificial
  CRISPR gRNA sequence
agtagtgatggggtttcacc

SEQ ID NO: 227331 - DNA, 20 bp, Artificial
  CRISPR gRNA sequence
gtagtgatggggtttcacca

SEQ ID NO: 227332 - DNA, 20 bp, Artificial
  CRISPR gRNA sequence
caccatattggccaggctgg

SEQ ID NO: 227333 - DNA, 20 bp, Artificial
  CRISPR gRNA sequence
accatattggccaggctggt

SEQ ID NO: 227334 - DNA, 20 bp, Artificial
  CRISPR gRNA sequence
gccaggctggtctcgaactc

SEQ ID NO: 227335 - DNA, 20 bp, Artificial
  CRISPR gRNA sequence
gtctcgaactcctgacctcg

SEQ ID NO: 227336 - DNA, 20 bp, Artificial
  CRISPR gRNA sequence
gaactcctgacctcgtgatc

SEQ ID NO: 227337 - DNA, 20 bp, Artificial
  CRISPR gRNA sequence
ctgacctcgtgatccgtctg

SEQ ID NO: 227338 - DNA, 20 bp, Artificial
  CRISPR gRNA sequence
acctcgtgatccgtctgtct

SEQ ID NO: 227339 - DNA, 20 bp, Artificial
  CRISPR gRNA sequence
gtgatccgtctgtctcggcc

SEQ ID NO: 227340 - DNA, 20 bp, Artificial
  CRISPR gRNA sequence
tctcggcctcccaaagtgct

SEQ ID NO: 227341 - DNA, 20 bp, Artificial
  CRISPR gRNA sequence
ggcctcccaaagtgctgaga

SEQ ID NO: 227342 - DNA, 20 bp, Artificial
  CRISPR gRNA sequence
ccaaagtgctgagattacag

SEQ ID NO: 227343 - DNA, 20 bp, Artificial
  CRISPR gRNA sequence
agattacaggcattagccac

SEQ ID NO: 227344 - DNA, 20 bp, Artificial
  CRISPR gRNA sequence
caggcattagccaccatgca

SEQ ID NO: 227345 - DNA, 20 bp, Artificial
  CRISPR gRNA sequence
gccaccatgcatggcccctt

SEQ ID NO: 227346 - DNA, 20 bp, Artificial
  CRISPR gRNA sequence
acagtgaattctgttcaata

SEQ ID NO: 227347 - DNA, 20 bp, Artificial
  CRISPR gRNA sequence
cagtgaattctgttcaataa

SEQ ID NO: 227348 - DNA, 20 bp, Artificial
  CRISPR gRNA sequence
tgttcaataatcttgaactc

SEQ ID NO: 227349 - DNA, 20 bp, Artificial
  CRISPR gRNA sequence
ttcaataatcttgaactccc

SEQ ID NO: 227350 - DNA, 20 bp, Artificial
  CRISPR gRNA sequence
aataatcttgaactcccagt

SEQ ID NO: 227351 - DNA, 20 bp, Artificial
  CRISPR gRNA sequence
gaactcccagtgctttccct

SEQ ID NO: 227352 - DNA, 20 bp, Artificial
  CRISPR gRNA sequence
aactcccagtgctttccctt

SEQ ID NO: 227353 - DNA, 20 bp, Artificial
  CRISPR gRNA sequence
ccagtgctttcccttggtcc

SEQ ID NO: 227354 - DNA, 20 bp, Artificial
  CRISPR gRNA sequence
tcccttggtcctgtccatat

SEQ ID NO: 227355 - DNA, 20 bp, Artificial
  CRISPR gRNA sequence
cccttggtcctgtccatata

SEQ ID NO: 227356 - DNA, 20 bp, Artificial
  CRISPR gRNA sequence
ccttggtcctgtccatataa

SEQ ID NO: 227357 - DNA, 20 bp, Artificial
  CRISPR gRNA sequence
ggtcctgtccatataatgat

SEQ ID NO: 227358 - DNA, 20 bp, Artificial
  CRISPR gRNA sequence
gtcctgtccatataatgatc

SEQ ID NO: 227359 - DNA, 20 bp, Artificial
  CRISPR gRNA sequence
tccatataatgatcacattc

SEQ ID NO: 227360 - DNA, 20 bp, Artificial
  CRISPR gRNA sequence
tgttattaaataatgtgctt

SEQ ID NO: 227361 - DNA, 20 bp, Artificial
  CRISPR gRNA sequence
ttattaaataatgtgcttat

SEQ ID NO: 227362 - DNA, 20 bp, Artificial
  CRISPR gRNA sequence
ttaaataatgtgcttatgtg

SEQ ID NO: 227363 - DNA, 20 bp, Artificial
  CRISPR gRNA sequence
aataatgtgcttatgtgctg

SEQ ID NO: 227364 - DNA, 20 bp, Artificial
  CRISPR gRNA sequence
atgtgctgattttattgtag

SEQ ID NO: 227365 - DNA, 20 bp, Artificial
  CRISPR gRNA sequence
tgtgctgattttattgtagg

SEQ ID NO: 227366 - DNA, 20 bp, Artificial
  CRISPR gRNA sequence
attttattgtaggaggaatt

SEQ ID NO: 227367 - DNA, 20 bp, Artificial
  CRISPR gRNA sequence
tattgtaggaggaattgaac

SEQ ID NO: 227368 - DNA, 20 bp, Artificial
  CRISPR gRNA sequence
attgtaggaggaattgaaca

SEQ ID NO: 227369 - DNA, 20 bp, Artificial
  CRISPR gRNA sequence
ttgtaggaggaattgaacaa

SEQ ID NO: 227370 - DNA, 20 bp, Artificial
  CRISPR gRNA sequence
taggaggaattgaacaaatc

SEQ ID NO: 227371 - DNA, 20 bp, Artificial
  CRISPR gRNA sequence
aacaaatctatagctcagca

SEQ ID NO: 227372 - DNA, 20 bp, Artificial
  CRISPR gRNA sequence
tagctcagcattttactctt

SEQ ID NO: 227373 - DNA, 20 bp, Artificial
  CRISPR gRNA sequence
agcattttactcttttgtag

SEQ ID NO: 227374 - DNA, 20 bp, Artificial
  CRISPR gRNA sequence
tactcttttgtagaaatccc

SEQ ID NO: 227375 - DNA, 20 bp, Artificial
  CRISPR gRNA sequence
actcttttgtagaaatccct

SEQ ID NO: 227376 - DNA, 20 bp, Artificial
  CRISPR gRNA sequence
ctcttttgtagaaatccctt

SEQ ID NO: 227377 - DNA, 20 bp, Artificial
  CRISPR gRNA sequence
ttttgtagaaatcccttgac

SEQ ID NO: 227378 - DNA, 20 bp, Artificial
  CRISPR gRNA sequence
ttgtagaaatcccttgaccc

SEQ ID NO: 227379 - DNA, 20 bp, Artificial
  CRISPR gRNA sequence
tgtagaaatcccttgaccct

SEQ ID NO: 227380 - DNA, 20 bp, Artificial
  CRISPR gRNA sequence
gtagaaatcccttgaccctt

SEQ ID NO: 227381 - DNA, 20 bp, Artificial
  CRISPR gRNA sequence
tagaaatcccttgacccttt

SEQ ID NO: 227382 - DNA, 20 bp, Artificial
  CRISPR gRNA sequence
gaccctttccaaatccagac

SEQ ID NO: 227383 - DNA, 20 bp, Artificial
  CRISPR gRNA sequence
accctttccaaatccagaca

SEQ ID NO: 227384 - DNA, 20 bp, Artificial
  CRISPR gRNA sequence
tccaaatccagacatcacaa

SEQ ID NO: 227385 - DNA, 20 bp, Artificial
  CRISPR gRNA sequence
ccaaatccagacatcacaac

SEQ ID NO: 227386 - DNA, 20 bp, Artificial
  CRISPR gRNA sequence
caaatccagacatcacaacc

SEQ ID NO: 227387 - DNA, 20 bp, Artificial
  CRISPR gRNA sequence
ctccatatactcaaaaattg

SEQ ID NO: 227388 - DNA, 20 bp, Artificial
  CRISPR gRNA sequence
tccatatactcaaaaattgt

SEQ ID NO: 227389 - DNA, 20 bp, Artificial
  CRISPR gRNA sequence
catatactcaaaaattgtga

SEQ ID NO: 227390 - DNA, 20 bp, Artificial
  CRISPR gRNA sequence
aaaaattgtgaaatccacaa

SEQ ID NO: 227391 - DNA, 20 bp, Artificial
  CRISPR gRNA sequence
tgaaatccacaaggcaggga

SEQ ID NO: 227392 - DNA, 20 bp, Artificial
  CRISPR gRNA sequence
ataatgaaaaaaaggaagtt

SEQ ID NO: 227393 - DNA, 20 bp, Artificial
  CRISPR gRNA sequence
ggtctgttggacatcctctt

SEQ ID NO: 227394 - DNA, 20 bp, Artificial
  CRISPR gRNA sequence
gtctgttggacatcctcttc

SEQ ID NO: 227395 - DNA, 20 bp, Artificial
  CRISPR gRNA sequence
ttggacatcctcttctttca

SEQ ID NO: 227396 - DNA, 20 bp, Artificial
  CRISPR gRNA sequence
gacatcctcttctttcatct

SEQ ID NO: 227397 - DNA, 20 bp, Artificial
  CRISPR gRNA sequence
ttctttcatcttttatgttc

SEQ ID NO: 227398 - DNA, 20 bp, Artificial
  CRISPR gRNA sequence
ctttcatcttttatgttcaa

SEQ ID NO: 227399 - DNA, 20 bp, Artificial
  CRISPR gRNA sequence
tttcatcttttatgttcaaa

SEQ ID NO: 227400 - DNA, 20 bp, Artificial
  CRISPR gRNA sequence
tcatcttttatgttcaaagt

SEQ ID NO: 227401 - DNA, 20 bp, Artificial
  CRISPR gRNA sequence
catcttttatgttcaaagta

SEQ ID NO: 227402 - DNA, 20 bp, Artificial
  CRISPR gRNA sequence
atcttttatgttcaaagtac

SEQ ID NO: 227403 - DNA, 20 bp, Artificial
  CRISPR gRNA sequence
ttatgttcaaagtacttgat

SEQ ID NO: 227404 - DNA, 20 bp, Artificial
  CRISPR gRNA sequence
tatgttcaaagtacttgatg

SEQ ID NO: 227405 - DNA, 20 bp, Artificial
  CRISPR gRNA sequence
atgttcaaagtacttgatgc

SEQ ID NO: 227406 - DNA, 20 bp, Artificial
  CRISPR gRNA sequence
tgttcaaagtacttgatgca

SEQ ID NO: 227407 - DNA, 20 bp, Artificial
  CRISPR gRNA sequence
aaagtacttgatgcacaaag

SEQ ID NO: 227408 - DNA, 20 bp, Artificial
  CRISPR gRNA sequence
gatgcacaaagcctggactc

SEQ ID NO: 227409 - DNA, 20 bp, Artificial
  CRISPR gRNA sequence
atgcacaaagcctggactct

SEQ ID NO: 227410 - DNA, 20 bp, Artificial
  CRISPR gRNA sequence
gactcttttatctctgtcct

SEQ ID NO: 227411 - DNA, 20 bp, Artificial
  CRISPR gRNA sequence
ttttatctctgtcctataga

SEQ ID NO: 227412 - DNA, 20 bp, Artificial
  CRISPR gRNA sequence
ttatctctgtcctatagact

SEQ ID NO: 227413 - DNA, 20 bp, Artificial
  CRISPR gRNA sequence
tatctctgtcctatagactg

SEQ ID NO: 227414 - DNA, 20 bp, Artificial
  CRISPR gRNA sequence
atctctgtcctatagactga

SEQ ID NO: 227415 - DNA, 20 bp, Artificial
  CRISPR gRNA sequence
tctctgtcctatagactgat

SEQ ID NO: 227416 - DNA, 20 bp, Artificial
  CRISPR gRNA sequence
tgtcctatagactgatgtct

SEQ ID NO: 227417 - DNA, 20 bp, Artificial
  CRISPR gRNA sequence
tcctatagactgatgtctag

SEQ ID NO: 227418 - DNA, 20 bp, Artificial
  CRISPR gRNA sequence
tagactgatgtctagtcagt

SEQ ID NO: 227419 - DNA, 20 bp, Artificial
  CRISPR gRNA sequence
atgtctagtcagtattcatt

SEQ ID NO: 227420 - DNA, 20 bp, Artificial
  CRISPR gRNA sequence
gtcagtattcattgtgacaa

SEQ ID NO: 227421 - DNA, 20 bp, Artificial
  CRISPR gRNA sequence
attgtgacaaaattgtttca

SEQ ID NO: 227422 - DNA, 20 bp, Artificial
  CRISPR gRNA sequence
tgacaaaattgtttcattag

SEQ ID NO: 227423 - DNA, 20 bp, Artificial
  CRISPR gRNA sequence
tttcattagagcaagttgga

SEQ ID NO: 227424 - DNA, 20 bp, Artificial
  CRISPR gRNA sequence
cattagagcaagttggatag

SEQ ID NO: 227425 - DNA, 20 bp, Artificial
  CRISPR gRNA sequence
attagagcaagttggatagt

SEQ ID NO: 227426 - DNA, 20 bp, Artificial
  CRISPR gRNA sequence
gagcaagttggatagtgtat

SEQ ID NO: 227427 - DNA, 20 bp, Artificial
  CRISPR gRNA sequence
gatagtgtatggagattatt

SEQ ID NO: 227428 - DNA, 20 bp, Artificial
  CRISPR gRNA sequence
ttataaaatgatttaacttg

SEQ ID NO: 227429 - DNA, 20 bp, Artificial
  CRISPR gRNA sequence
taaaatgatttaacttgtct

SEQ ID NO: 227430 - DNA, 20 bp, Artificial
  CRISPR gRNA sequence
aacttgtcttctgtcaagta

SEQ ID NO: 227431 - DNA, 20 bp, Artificial
  CRISPR gRNA sequence
acttgtcttctgtcaagtaa

SEQ ID NO: 227432 - DNA, 20 bp, Artificial
  CRISPR gRNA sequence
gtcttctgtcaagtaatttt

SEQ ID NO: 227433 - DNA, 20 bp, Artificial
  CRISPR gRNA sequence
tcttctgtcaagtaatttta

SEQ ID NO: 227434 - DNA, 20 bp, Artificial
  CRISPR gRNA sequence
ctgtcaagtaattttataat

SEQ ID NO: 227435 - DNA, 20 bp, Artificial
  CRISPR gRNA sequence
tgtcaagtaattttataatt

SEQ ID NO: 227436 - DNA, 20 bp, Artificial
  CRISPR gRNA sequence
tcaagtaattttataattgg

SEQ ID NO: 227437 - DNA, 20 bp, Artificial
  CRISPR gRNA sequence
tataattggtattaatgttc

SEQ ID NO: 227438 - DNA, 20 bp, Artificial
  CRISPR gRNA sequence
ataattggtattaatgttca

SEQ ID NO: 227439 - DNA, 20 bp, Artificial
  CRISPR gRNA sequence
taattggtattaatgttcat

SEQ ID NO: 227440 - DNA, 20 bp, Artificial
  CRISPR gRNA sequence
gtattaatgttcattttttt

SEQ ID NO: 227441 - DNA, 20 bp, Artificial
  CRISPR gRNA sequence
atgttcatttttttccagta

SEQ ID NO: 227442 - DNA, 20 bp, Artificial
  CRISPR gRNA sequence
atttttttccagtaccagtt

SEQ ID NO: 227443 - DNA, 20 bp, Artificial
  CRISPR gRNA sequence
ttttccagtaccagtttcag

SEQ ID NO: 227444 - DNA, 20 bp, Artificial
  CRISPR gRNA sequence
tttccagtaccagtttcaga

SEQ ID NO: 227445 - DNA, 20 bp, Artificial
  CRISPR gRNA sequence
ttccagtaccagtttcagaa

SEQ ID NO: 227446 - DNA, 20 bp, Artificial
  CRISPR gRNA sequence
tccagtaccagtttcagaag

SEQ ID NO: 227447 - DNA, 20 bp, Artificial
  CRISPR gRNA sequence
ccagtaccagtttcagaagc

SEQ ID NO: 227448 - DNA, 20 bp, Artificial
  CRISPR gRNA sequence
cagtaccagtttcagaagct

SEQ ID NO: 227449 - DNA, 20 bp, Artificial
  CRISPR gRNA sequence
cagaagctttcatttgtgta

SEQ ID NO: 227450 - DNA, 20 bp, Artificial
  CRISPR gRNA sequence
agaagctttcatttgtgtat

SEQ ID NO: 227451 - DNA, 20 bp, Artificial
  CRISPR gRNA sequence
tcatttgtgtatgcatgtgt

SEQ ID NO: 227452 - DNA, 20 bp, Artificial
  CRISPR gRNA sequence
catttgtgtatgcatgtgtg

SEQ ID NO: 227453 - DNA, 20 bp, Artificial
  CRISPR gRNA sequence
atttgtgtatgcatgtgtgt

SEQ ID NO: 227454 - DNA, 20 bp, Artificial
  CRISPR gRNA sequence
gtgtatgcatgtgtgtgtta

SEQ ID NO: 227455 - DNA, 20 bp, Artificial
  CRISPR gRNA sequence
tgtatgcatgtgtgtgttaa

SEQ ID NO: 227456 - DNA, 20 bp, Artificial
  CRISPR gRNA sequence
aataagtgtattagatactt

SEQ ID NO: 227457 - DNA, 20 bp, Artificial
  CRISPR gRNA sequence
gatacttgaaaaatagtaat

SEQ ID NO: 227458 - DNA, 20 bp, Artificial
  CRISPR gRNA sequence
gaaaaatagtaatttaaatt

SEQ ID NO: 227459 - DNA, 20 bp, Artificial
  CRISPR gRNA sequence
aaaaatagtaatttaaattt

SEQ ID NO: 227460 - DNA, 20 bp, Artificial
  CRISPR gRNA sequence
aaatttaaacaatttaaaaa

SEQ ID NO: 227461 - DNA, 20 bp, Artificial
  CRISPR gRNA sequence
aatttaaacaatttaaaaaa

SEQ ID NO: 227462 - DNA, 20 bp, Artificial
  CRISPR gRNA sequence
aaacaatttaaaaaatgaaa

SEQ ID NO: 227463 - DNA, 20 bp, Artificial
  CRISPR gRNA sequence
aacaatttaaaaaatgaaat

SEQ ID NO: 227464 - DNA, 20 bp, Artificial
  CRISPR gRNA sequence
aaaaaatgaaattgtaattt

SEQ ID NO: 227465 - DNA, 20 bp, Artificial
  CRISPR gRNA sequence
aaaaatgaaattgtaatttt

SEQ ID NO: 227466 - DNA, 20 bp, Artificial
  CRISPR gRNA sequence
taattttatgtgtaaaggtg

SEQ ID NO: 227467 - DNA, 20 bp, Artificial
  CRISPR gRNA sequence
tatgtgtaaaggtgtctgat

SEQ ID NO: 227468 - DNA, 20 bp, Artificial
  CRISPR gRNA sequence
atgtgtaaaggtgtctgatg

SEQ ID NO: 227469 - DNA, 20 bp, Artificial
  CRISPR gRNA sequence
tgtgtaaaggtgtctgatgt

SEQ ID NO: 227470 - DNA, 20 bp, Artificial
  CRISPR gRNA sequence
atgtgctttattctgcactg

SEQ ID NO: 227471 - DNA, 20 bp, Artificial
  CRISPR gRNA sequence
tattctgcactgaaaacaat

SEQ ID NO: 227472 - DNA, 20 bp, Artificial
  CRISPR gRNA sequence
attctgcactgaaaacaata

SEQ ID NO: 227473 - DNA, 20 bp, Artificial
  CRISPR gRNA sequence
ttctgcactgaaaacaatat

SEQ ID NO: 227474 - DNA, 20 bp, Artificial
  CRISPR gRNA sequence
tgcactgaaaacaatattca

SEQ ID NO: 227475 - DNA, 20 bp, Artificial
  CRISPR gRNA sequence
cactgaaaacaatattcatt

SEQ ID NO: 227476 - DNA, 20 bp, Artificial
  CRISPR gRNA sequence
aaaacaatattcatttacag

SEQ ID NO: 227477 - DNA, 20 bp, Artificial
  CRISPR gRNA sequence
atttacagctcaacagacac

SEQ ID NO: 227478 - DNA, 20 bp, Artificial
  CRISPR gRNA sequence
acagctcaacagacaccaaa

SEQ ID NO: 227479 - DNA, 20 bp, Artificial
  CRISPR gRNA sequence
cagctcaacagacaccaaat

SEQ ID NO: 227480 - DNA, 20 bp, Artificial
  CRISPR gRNA sequence
aacagacaccaaatatattc

SEQ ID NO: 227481 - DNA, 20 bp, Artificial
  CRISPR gRNA sequence
taaaattactttcctagagt

SEQ ID NO: 227482 - DNA, 20 bp, Artificial
  CRISPR gRNA sequence
aaattactttcctagagtta

SEQ ID NO: 227483 - DNA, 20 bp, Artificial
  CRISPR gRNA sequence
ctttcctagagttatcagaa

SEQ ID NO: 227484 - DNA, 20 bp, Artificial
  CRISPR gRNA sequence
tcctagagttatcagaaaac

SEQ ID NO: 227485 - DNA, 20 bp, Artificial
  CRISPR gRNA sequence
cctagagttatcagaaaaca

SEQ ID NO: 227486 - DNA, 20 bp, Artificial
  CRISPR gRNA sequence
ctagagttatcagaaaacag

SEQ ID NO: 227487 - DNA, 20 bp, Artificial
  CRISPR gRNA sequence
gagttatcagaaaacagcac

SEQ ID NO: 227488 - DNA, 20 bp, Artificial
  CRISPR gRNA sequence
tcagaaaacagcactgtaat

SEQ ID NO: 227489 - DNA, 20 bp, Artificial
  CRISPR gRNA sequence
taataatgaaatcaaaccca

SEQ ID NO: 227490 - DNA, 20 bp, Artificial
  CRISPR gRNA sequence
tctttatgatttattcttag

SEQ ID NO: 227491 - DNA, 20 bp, Artificial
  CRISPR gRNA sequence
ctttatgatttattcttagt

SEQ ID NO: 227492 - DNA, 20 bp, Artificial
  CRISPR gRNA sequence
tttatgatttattcttagtc

SEQ ID NO: 227493 - DNA, 20 bp, Artificial
  CRISPR gRNA sequence
tatgatttattcttagtctg

SEQ ID NO: 227494 - DNA, 20 bp, Artificial
  CRISPR gRNA sequence
atgatttattcttagtctga

SEQ ID NO: 227495 - DNA, 20 bp, Artificial
  CRISPR gRNA sequence
tgatttattcttagtctgat

SEQ ID NO: 227496 - DNA, 20 bp, Artificial
  CRISPR gRNA sequence
attcttagtctgatacgcat

SEQ ID NO: 227497 - DNA, 20 bp, Artificial
  CRISPR gRNA sequence
ttcttagtctgatacgcatc

SEQ ID NO: 227498 - DNA, 20 bp, Artificial
  CRISPR gRNA sequence
ttagtctgatacgcatcagc

SEQ ID NO: 227499 - DNA, 20 bp, Artificial
  CRISPR gRNA sequence
agtctgatacgcatcagcct

SEQ ID NO: 227500 - DNA, 20 bp, Artificial
  CRISPR gRNA sequence
gtctgatacgcatcagcctg

SEQ ID NO: 227501 - DNA, 20 bp, Artificial
  CRISPR gRNA sequence
atacgcatcagcctggtaag

SEQ ID NO: 227502 - DNA, 20 bp, Artificial
  CRISPR gRNA sequence
gtaagccttcctgtctctct

SEQ ID NO: 227503 - DNA, 20 bp, Artificial
  CRISPR gRNA sequence
cctgtctctctgcttactta

SEQ ID NO: 227504 - DNA, 20 bp, Artificial
  CRISPR gRNA sequence
ctgtctctctgcttacttac

SEQ ID NO: 227505 - DNA, 20 bp, Artificial
  CRISPR gRNA sequence
tctctctgcttacttaccaa

SEQ ID NO: 227506 - DNA, 20 bp, Artificial
  CRISPR gRNA sequence
tctgcttacttaccaatcac

SEQ ID NO: 227507 - DNA, 20 bp, Artificial
  CRISPR gRNA sequence
tgcttacttaccaatcactc

SEQ ID NO: 227508 - DNA, 20 bp, Artificial
  CRISPR gRNA sequence
cttacttaccaatcactcca

SEQ ID NO: 227509 - DNA, 20 bp, Artificial
  CRISPR gRNA sequence
acttaccaatcactccaaat

SEQ ID NO: 227510 - DNA, 20 bp, Artificial
  CRISPR gRNA sequence
cttaccaatcactccaaatg

SEQ ID NO: 227511 - DNA, 20 bp, Artificial
  CRISPR gRNA sequence
accaatcactccaaatgtca

SEQ ID NO: 227512 - DNA, 20 bp, Artificial
  CRISPR gRNA sequence
ccaatcactccaaatgtcat

SEQ ID NO: 227513 - DNA, 20 bp, Artificial
  CRISPR gRNA sequence
caaatgtcatgtctttgggc

SEQ ID NO: 227514 - DNA, 20 bp, Artificial
  CRISPR gRNA sequence
tgggcaggcattaaattctt

SEQ ID NO: 227515 - DNA, 20 bp, Artificial
  CRISPR gRNA sequence
gggcaggcattaaattcttg

SEQ ID NO: 227516 - DNA, 20 bp, Artificial
  CRISPR gRNA sequence
ggcaggcattaaattcttgg

SEQ ID NO: 227517 - DNA, 20 bp, Artificial
  CRISPR gRNA sequence
aattcttgggttttgggttt

SEQ ID NO: 227518 - DNA, 20 bp, Artificial
  CRISPR gRNA sequence
ttgggttttgggttttgttg

SEQ ID NO: 227519 - DNA, 20 bp, Artificial
  CRISPR gRNA sequence
gggttttgggttttgttgga

SEQ ID NO: 227520 - DNA, 20 bp, Artificial
  CRISPR gRNA sequence
ggttttgggttttgttggat

SEQ ID NO: 227521 - DNA, 20 bp, Artificial
  CRISPR gRNA sequence
tgggttttgttggatggact

SEQ ID NO: 227522 - DNA, 20 bp, Artificial
  CRISPR gRNA sequence
gggttttgttggatggactg

SEQ ID NO: 227523 - DNA, 20 bp, Artificial
  CRISPR gRNA sequence
ggttttgttggatggactgc

SEQ ID NO: 227524 - DNA, 20 bp, Artificial
  CRISPR gRNA sequence
tgttggatggactgcagtct

SEQ ID NO: 227525 - DNA, 20 bp, Artificial
  CRISPR gRNA sequence
gttggatggactgcagtctg

SEQ ID NO: 227526 - DNA, 20 bp, Artificial
  CRISPR gRNA sequence
ttggatggactgcagtctgt

SEQ ID NO: 227527 - DNA, 20 bp, Artificial
  CRISPR gRNA sequence
gatggactgcagtctgtgtg

SEQ ID NO: 227528 - DNA, 20 bp, Artificial
  CRISPR gRNA sequence
cagtctgtgtgagcctatat

SEQ ID NO: 227529 - DNA, 20 bp, Artificial
  CRISPR gRNA sequence
tgtgagcctatatgggtgtg

SEQ ID NO: 227530 - DNA, 20 bp, Artificial
  CRISPR gRNA sequence
tatgggtgtgtcaaatccag

SEQ ID NO: 227531 - DNA, 20 bp, Artificial
  CRISPR gRNA sequence
tggggtgtcatggaaactta

SEQ ID NO: 227532 - DNA, 20 bp, Artificial
  CRISPR gRNA sequence
ggggtgtcatggaaacttag

SEQ ID NO: 227533 - DNA, 20 bp, Artificial
  CRISPR gRNA sequence
gggtgtcatggaaacttagc

SEQ ID NO: 227534 - DNA, 20 bp, Artificial
  CRISPR gRNA sequence
agcatgatagacttgatttt

SEQ ID NO: 227535 - DNA, 20 bp, Artificial
  CRISPR gRNA sequence
gcatgatagacttgatttta

SEQ ID NO: 227536 - DNA, 20 bp, Artificial
  CRISPR gRNA sequence
gattttatccccaagttgac

SEQ ID NO: 227537 - DNA, 20 bp, Artificial
  CRISPR gRNA sequence
attttatccccaagttgact

SEQ ID NO: 227538 - DNA, 20 bp, Artificial
  CRISPR gRNA sequence
tatccccaagttgacttggt

SEQ ID NO: 227539 - DNA, 20 bp, Artificial
  CRISPR gRNA sequence
atccccaagttgacttggta

SEQ ID NO: 227540 - DNA, 20 bp, Artificial
  CRISPR gRNA sequence
tccccaagttgacttggtaa

SEQ ID NO: 227541 - DNA, 20 bp, Artificial
  CRISPR gRNA sequence
acttggtaatttcattagat

SEQ ID NO: 227542 - DNA, 20 bp, Artificial
  CRISPR gRNA sequence
ggtaatttcattagatttca

SEQ ID NO: 227543 - DNA, 20 bp, Artificial
  CRISPR gRNA sequence
gtaatttcattagatttcat

SEQ ID NO: 227544 - DNA, 20 bp, Artificial
  CRISPR gRNA sequence
cattagatttcatcagtcac

SEQ ID NO: 227545 - DNA, 20 bp, Artificial
  CRISPR gRNA sequence
attagatttcatcagtcaca

SEQ ID NO: 227546 - DNA, 20 bp, Artificial
  CRISPR gRNA sequence
gatttcatcagtcacaacct

SEQ ID NO: 227547 - DNA, 20 bp, Artificial
  CRISPR gRNA sequence
catcagtcacaacctgcatt

SEQ ID NO: 227548 - DNA, 20 bp, Artificial
  CRISPR gRNA sequence
atcagtcacaacctgcattt

SEQ ID NO: 227549 - DNA, 20 bp, Artificial
  CRISPR gRNA sequence
cattttatcttgtatgtgct

SEQ ID NO: 227550 - DNA, 20 bp, Artificial
  CRISPR gRNA sequence
tatcttgtatgtgctgtcta

SEQ ID NO: 227551 - DNA, 20 bp, Artificial
  CRISPR gRNA sequence
atcttgtatgtgctgtctat

SEQ ID NO: 227552 - DNA, 20 bp, Artificial
  CRISPR gRNA sequence
tcttgtatgtgctgtctatt

SEQ ID NO: 227553 - DNA, 20 bp, Artificial
  CRISPR gRNA sequence
gtatgtgctgtctattggtc

SEQ ID NO: 227554 - DNA, 20 bp, Artificial
  CRISPR gRNA sequence
tatgtgctgtctattggtca

SEQ ID NO: 227555 - DNA, 20 bp, Artificial
  CRISPR gRNA sequence
tctattggtcacaaaatcag

SEQ ID NO: 227556 - DNA, 20 bp, Artificial
  CRISPR gRNA sequence
ttggtcacaaaatcagaaaa

SEQ ID NO: 227557 - DNA, 20 bp, Artificial
  CRISPR gRNA sequence
gtcacaaaatcagaaaacct

SEQ ID NO: 227558 - DNA, 20 bp, Artificial
  CRISPR gRNA sequence
cttgtccattcataacatta

SEQ ID NO: 227559 - DNA, 20 bp, Artificial
  CRISPR gRNA sequence
ttgtccattcataacattag

SEQ ID NO: 227560 - DNA, 20 bp, Artificial
  CRISPR gRNA sequence
gtccattcataacattagct

SEQ ID NO: 227561 - DNA, 20 bp, Artificial
  CRISPR gRNA sequence
tccattcataacattagctg

SEQ ID NO: 227562 - DNA, 20 bp, Artificial
  CRISPR gRNA sequence
ataacattagctgttttttc

SEQ ID NO: 227563 - DNA, 20 bp, Artificial
  CRISPR gRNA sequence
gctgttttttcaggtggcta

SEQ ID NO: 227564 - DNA, 20 bp, Artificial
  CRISPR gRNA sequence
ttttttcaggtggctagagg

SEQ ID NO: 227565 - DNA, 20 bp, Artificial
  CRISPR gRNA sequence
tttcaggtggctagagggac

SEQ ID NO: 227566 - DNA, 20 bp, Artificial
  CRISPR gRNA sequence
ttcaggtggctagagggaca

SEQ ID NO: 227567 - DNA, 20 bp, Artificial
  CRISPR gRNA sequence
tcaggtggctagagggacat

SEQ ID NO: 227568 - DNA, 20 bp, Artificial
  CRISPR gRNA sequence
caggtggctagagggacatg

SEQ ID NO: 227569 - DNA, 20 bp, Artificial
  CRISPR gRNA sequence
aggtggctagagggacatgt

SEQ ID NO: 227570 - DNA, 20 bp, Artificial
  CRISPR gRNA sequence
gagggacatgtcattgcttc

SEQ ID NO: 227571 - DNA, 20 bp, Artificial
  CRISPR gRNA sequence
cttcatctgcatgaatttga

SEQ ID NO: 227572 - DNA, 20 bp, Artificial
  CRISPR gRNA sequence
catctgcatgaatttgaaag

SEQ ID NO: 227573 - DNA, 20 bp, Artificial
  CRISPR gRNA sequence
atctgcatgaatttgaaaga

SEQ ID NO: 227574 - DNA, 20 bp, Artificial
  CRISPR gRNA sequence
catgaatttgaaagattaaa

SEQ ID NO: 227575 - DNA, 20 bp, Artificial
  CRISPR gRNA sequence
gaaagattaaatgcataaag

SEQ ID NO: 227576 - DNA, 20 bp, Artificial
  CRISPR gRNA sequence
aaagattaaatgcataaagg

SEQ ID NO: 227577 - DNA, 20 bp, Artificial
  CRISPR gRNA sequence
aatgcataaaggaattttct

SEQ ID NO: 227578 - DNA, 20 bp, Artificial
  CRISPR gRNA sequence
tcttagagtagagtaggcct

SEQ ID NO: 227579 - DNA, 20 bp, Artificial
  CRISPR gRNA sequence
cttagagtagagtaggcctt

SEQ ID NO: 227580 - DNA, 20 bp, Artificial
  CRISPR gRNA sequence
ttagagtagagtaggccttc

SEQ ID NO: 227581 - DNA, 20 bp, Artificial
  CRISPR gRNA sequence
agagtagagtaggccttcac

SEQ ID NO: 227582 - DNA, 20 bp, Artificial
  CRISPR gRNA sequence
gagtagagtaggccttcacc

SEQ ID NO: 227583 - DNA, 20 bp, Artificial
  CRISPR gRNA sequence
caccatctctttaactggga

SEQ ID NO: 227584 - DNA, 20 bp, Artificial
  CRISPR gRNA sequence
accatctctttaactgggaa

SEQ ID NO: 227585 - DNA, 20 bp, Artificial
  CRISPR gRNA sequence
tttaactgggaaagaagttt

SEQ ID NO: 227586 - DNA, 20 bp, Artificial
  CRISPR gRNA sequence
taactgggaaagaagttttg

SEQ ID NO: 227587 - DNA, 20 bp, Artificial
  CRISPR gRNA sequence
aactgggaaagaagttttgg

SEQ ID NO: 227588 - DNA, 20 bp, Artificial
  CRISPR gRNA sequence
actgggaaagaagttttggg

SEQ ID NO: 227589 - DNA, 20 bp, Artificial
  CRISPR gRNA sequence
ggaaagaagttttgggagta

SEQ ID NO: 227590 - DNA, 20 bp, Artificial
  CRISPR gRNA sequence
tgggagtaacatactcatca

SEQ ID NO: 227591 - DNA, 20 bp, Artificial
  CRISPR gRNA sequence
gggagtaacatactcatcac

SEQ ID NO: 227592 - DNA, 20 bp, Artificial
  CRISPR gRNA sequence
ggagtaacatactcatcact

SEQ ID NO: 227593 - DNA, 20 bp, Artificial
  CRISPR gRNA sequence
atcactcacacccccctccc

SEQ ID NO: 227594 - DNA, 20 bp, Artificial
  CRISPR gRNA sequence
acacccccctcccctcaaac

SEQ ID NO: 227595 - DNA, 20 bp, Artificial
  CRISPR gRNA sequence
ccctcaaacacacacactca

SEQ ID NO: 227596 - DNA, 20 bp, Artificial
  CRISPR gRNA sequence
aaacacacacactcacccat

SEQ ID NO: 227597 - DNA, 20 bp, Artificial
  CRISPR gRNA sequence
acccattagaatgtaagggc

SEQ ID NO: 227598 - DNA, 20 bp, Artificial
  CRISPR gRNA sequence
gaatgtaagggccttgaggc

SEQ ID NO: 227599 - DNA, 20 bp, Artificial
  CRISPR gRNA sequence
gaggcaggccttgtgtttgc

SEQ ID NO: 227600 - DNA, 20 bp, Artificial
  CRISPR gRNA sequence
aggcaggccttgtgtttgct

SEQ ID NO: 227601 - DNA, 20 bp, Artificial
  CRISPR gRNA sequence
gtgtttgcttttcgtgttca

SEQ ID NO: 227602 - DNA, 20 bp, Artificial
  CRISPR gRNA sequence
tgtttgcttttcgtgttcac

SEQ ID NO: 227603 - DNA, 20 bp, Artificial
  CRISPR gRNA sequence
gcttttcgtgttcactgtca

SEQ ID NO: 227604 - DNA, 20 bp, Artificial
  CRISPR gRNA sequence
cttttcgtgttcactgtcag

SEQ ID NO: 227605 - DNA, 20 bp, Artificial
  CRISPR gRNA sequence
ttcgtgttcactgtcagcat

SEQ ID NO: 227606 - DNA, 20 bp, Artificial
  CRISPR gRNA sequence
tcgtgttcactgtcagcatt

SEQ ID NO: 227607 - DNA, 20 bp, Artificial
  CRISPR gRNA sequence
cgtgttcactgtcagcattt

SEQ ID NO: 227608 - DNA, 20 bp, Artificial
  CRISPR gRNA sequence
gtgttcactgtcagcattta

SEQ ID NO: 227609 - DNA, 20 bp, Artificial
  CRISPR gRNA sequence
actgtcagcatttagaatag

SEQ ID NO: 227610 - DNA, 20 bp, Artificial
  CRISPR gRNA sequence
tcagcatttagaatagtgat

SEQ ID NO: 227611 - DNA, 20 bp, Artificial
  CRISPR gRNA sequence
agaatagtgatagtcatata

SEQ ID NO: 227612 - DNA, 20 bp, Artificial
  CRISPR gRNA sequence
gaatagtgatagtcatatag

SEQ ID NO: 227613 - DNA, 20 bp, Artificial
  CRISPR gRNA sequence
aatcaattattgtcaaataa

SEQ ID NO: 227614 - DNA, 20 bp, Artificial
  CRISPR gRNA sequence
ttgtcaaataaagtaatcta

SEQ ID NO: 227615 - DNA, 20 bp, Artificial
  CRISPR gRNA sequence
tcaaataaagtaatctactt

SEQ ID NO: 227616 - DNA, 20 bp, Artificial
  CRISPR gRNA sequence
cttgttccttgatttagact

SEQ ID NO: 227617 - DNA, 20 bp, Artificial
  CRISPR gRNA sequence
gttccttgatttagactagc

SEQ ID NO: 227618 - DNA, 20 bp, Artificial
  CRISPR gRNA sequence
ttccttgatttagactagca

SEQ ID NO: 227619 - DNA, 20 bp, Artificial
  CRISPR gRNA sequence
cttgatttagactagcaaaa

SEQ ID NO: 227620 - DNA, 20 bp, Artificial
  CRISPR gRNA sequence
gatttagactagcaaaaggg

SEQ ID NO: 227621 - DNA, 20 bp, Artificial
  CRISPR gRNA sequence
atttagactagcaaaagggg

SEQ ID NO: 227622 - DNA, 20 bp, Artificial
  CRISPR gRNA sequence
agactagcaaaaggggctgg

SEQ ID NO: 227623 - DNA, 20 bp, Artificial
  CRISPR gRNA sequence
gactagcaaaaggggctggt

SEQ ID NO: 227624 - DNA, 20 bp, Artificial
  CRISPR gRNA sequence
gcaaaaggggctggtacatt

SEQ ID NO: 227625 - DNA, 20 bp, Artificial
  CRISPR gRNA sequence
gtacattgtaggtacacagt

SEQ ID NO: 227626 - DNA, 20 bp, Artificial
  CRISPR gRNA sequence
taggtacacagtaaatattt

SEQ ID NO: 227627 - DNA, 20 bp, Artificial
  CRISPR gRNA sequence
gtagaacagatgaatgaacc

SEQ ID NO: 227628 - DNA, 20 bp, Artificial
  CRISPR gRNA sequence
tagaacagatgaatgaacca

SEQ ID NO: 227629 - DNA, 20 bp, Artificial
  CRISPR gRNA sequence
cttagaagtagcctgctttt

SEQ ID NO: 227630 - DNA, 20 bp, Artificial
  CRISPR gRNA sequence
ttagaagtagcctgcttttg

SEQ ID NO: 227631 - DNA, 20 bp, Artificial
  CRISPR gRNA sequence
agaagtagcctgcttttggt

SEQ ID NO: 227632 - DNA, 20 bp, Artificial
  CRISPR gRNA sequence
gaagtagcctgcttttggtt

SEQ ID NO: 227633 - DNA, 20 bp, Artificial
  CRISPR gRNA sequence
cttttggttactaattattt

SEQ ID NO: 227634 - DNA, 20 bp, Artificial
  CRISPR gRNA sequence
ttggttactaattattttat

SEQ ID NO: 227635 - DNA, 20 bp, Artificial
  CRISPR gRNA sequence
tggttactaattattttata

SEQ ID NO: 227636 - DNA, 20 bp, Artificial
  CRISPR gRNA sequence
ggttactaattattttatag

SEQ ID NO: 227637 - DNA, 20 bp, Artificial
  CRISPR gRNA sequence
gttactaattattttataga

SEQ ID NO: 227638 - DNA, 20 bp, Artificial
  CRISPR gRNA sequence
ctaattattttatagaacat

SEQ ID NO: 227639 - DNA, 20 bp, Artificial
  CRISPR gRNA sequence
attattttatagaacatata

SEQ ID NO: 227640 - DNA, 20 bp, Artificial
  CRISPR gRNA sequence
ttttatagaacatataaaag

SEQ ID NO: 227641 - DNA, 20 bp, Artificial
  CRISPR gRNA sequence
tatagaacatataaaagaaa

SEQ ID NO: 227642 - DNA, 20 bp, Artificial
  CRISPR gRNA sequence
atagaacatataaaagaaaa

SEQ ID NO: 227643 - DNA, 20 bp, Artificial
  CRISPR gRNA sequence
tagaacatataaaagaaaat

SEQ ID NO: 227644 - DNA, 20 bp, Artificial
  CRISPR gRNA sequence
tagaatacctaatttgttca

SEQ ID NO: 227645 - DNA, 20 bp, Artificial
  CRISPR gRNA sequence
agaatacctaatttgttcac

SEQ ID NO: 227646 - DNA, 20 bp, Artificial
  CRISPR gRNA sequence
gaatacctaatttgttcaca

SEQ ID NO: 227647 - DNA, 20 bp, Artificial
  CRISPR gRNA sequence
atttgttcacaaaaatgtta

SEQ ID NO: 227648 - DNA, 20 bp, Artificial
  CRISPR gRNA sequence
gttcacaaaaatgttatatt

SEQ ID NO: 227649 - DNA, 20 bp, Artificial
  CRISPR gRNA sequence
ttcacaaaaatgttatattg

SEQ ID NO: 227650 - DNA, 20 bp, Artificial
  CRISPR gRNA sequence
acaaaaatgttatattgtct

SEQ ID NO: 227651 - DNA, 20 bp, Artificial
  CRISPR gRNA sequence
tattgtctcccctgatactt

SEQ ID NO: 227652 - DNA, 20 bp, Artificial
  CRISPR gRNA sequence
tctcccctgatacttggtat

SEQ ID NO: 227653 - DNA, 20 bp, Artificial
  CRISPR gRNA sequence
ccctgatacttggtattcct

SEQ ID NO: 227654 - DNA, 20 bp, Artificial
  CRISPR gRNA sequence
atacttggtattcctgtgtc

SEQ ID NO: 227655 - DNA, 20 bp, Artificial
  CRISPR gRNA sequence
ggtattcctgtgtcaggctg

SEQ ID NO: 227656 - DNA, 20 bp, Artificial
  CRISPR gRNA sequence
gtattcctgtgtcaggctga

SEQ ID NO: 227657 - DNA, 20 bp, Artificial
  CRISPR gRNA sequence
ctgtgtcaggctgagcacta

SEQ ID NO: 227658 - DNA, 20 bp, Artificial
  CRISPR gRNA sequence
tgtcaggctgagcactaagg

SEQ ID NO: 227659 - DNA, 20 bp, Artificial
  CRISPR gRNA sequence
agcactaaggttatacattt

SEQ ID NO: 227660 - DNA, 20 bp, Artificial
  CRISPR gRNA sequence
aggttatacattttttgtta

SEQ ID NO: 227661 - DNA, 20 bp, Artificial
  CRISPR gRNA sequence
tacattttttgttaagcatg

SEQ ID NO: 227662 - DNA, 20 bp, Artificial
  CRISPR gRNA sequence
tttgttaagcatgtaattac

SEQ ID NO: 227663 - DNA, 20 bp, Artificial
  CRISPR gRNA sequence
ttgttaagcatgtaattact

SEQ ID NO: 227664 - DNA, 20 bp, Artificial
  CRISPR gRNA sequence
tgttaagcatgtaattactg

SEQ ID NO: 227665 - DNA, 20 bp, Artificial
  CRISPR gRNA sequence
gttaagcatgtaattactgt

SEQ ID NO: 227666 - DNA, 20 bp, Artificial
  CRISPR gRNA sequence
ttaagcatgtaattactgtt

SEQ ID NO: 227667 - DNA, 20 bp, Artificial
  CRISPR gRNA sequence
agcatgtaattactgttatt

SEQ ID NO: 227668 - DNA, 20 bp, Artificial
  CRISPR gRNA sequence
ctgttatttctcatgtactt

SEQ ID NO: 227669 - DNA, 20 bp, Artificial
  CRISPR gRNA sequence
ttatttctcatgtactttat

SEQ ID NO: 227670 - DNA, 20 bp, Artificial
  CRISPR gRNA sequence
tttctcatgtactttatttt

SEQ ID NO: 227671 - DNA, 20 bp, Artificial
  CRISPR gRNA sequence
ctcatgtactttattttgtg

SEQ ID NO: 227672 - DNA, 20 bp, Artificial
  CRISPR gRNA sequence
tcatgtactttattttgtgt

SEQ ID NO: 227673 - DNA, 20 bp, Artificial
  CRISPR gRNA sequence
atgtactttattttgtgtat

SEQ ID NO: 227674 - DNA, 20 bp, Artificial
  CRISPR gRNA sequence
tattttgtgtattgatttca

SEQ ID NO: 227675 - DNA, 20 bp, Artificial
  CRISPR gRNA sequence
attttgtgtattgatttcag

SEQ ID NO: 227676 - DNA, 20 bp, Artificial
  CRISPR gRNA sequence
ttttgtgtattgatttcagt

SEQ ID NO: 227677 - DNA, 20 bp, Artificial
  CRISPR gRNA sequence
tgtgtattgatttcagtagt

SEQ ID NO: 227678 - DNA, 20 bp, Artificial
  CRISPR gRNA sequence
gtgtattgatttcagtagtt

SEQ ID NO: 227679 - DNA, 20 bp, Artificial
  CRISPR gRNA sequence
tgtattgatttcagtagttg

SEQ ID NO: 227680 - DNA, 20 bp, Artificial
  CRISPR gRNA sequence
atttcagtagttgtagctga

SEQ ID NO: 227681 - DNA, 20 bp, Artificial
  CRISPR gRNA sequence
cagtagttgtagctgagggt

SEQ ID NO: 227682 - DNA, 20 bp, Artificial
  CRISPR gRNA sequence
agtagttgtagctgagggta

SEQ ID NO: 227683 - DNA, 20 bp, Artificial
  CRISPR gRNA sequence
tagctgagggtaatccttaa

SEQ ID NO: 227684 - DNA, 20 bp, Artificial
  CRISPR gRNA sequence
agggtaatccttaagagcat

SEQ ID NO: 227685 - DNA, 20 bp, Artificial
  CRISPR gRNA sequence
aagagcatgcagattttaaa

SEQ ID NO: 227686 - DNA, 20 bp, Artificial
  CRISPR gRNA sequence
agagcatgcagattttaaaa

SEQ ID NO: 227687 - DNA, 20 bp, Artificial
  CRISPR gRNA sequence
taaaaattacatagattgcc

SEQ ID NO: 227688 - DNA, 20 bp, Artificial
  CRISPR gRNA sequence
aaaaattacatagattgcct

SEQ ID NO: 227689 - DNA, 20 bp, Artificial
  CRISPR gRNA sequence
aaaattacatagattgcctt

SEQ ID NO: 227690 - DNA, 20 bp, Artificial
  CRISPR gRNA sequence
catagattgccttgccaagc

SEQ ID NO: 227691 - DNA, 20 bp, Artificial
  CRISPR gRNA sequence
ccttgccaagccgtctgaaa

SEQ ID NO: 227692 - DNA, 20 bp, Artificial
  CRISPR gRNA sequence
gccaagccgtctgaaagtca

SEQ ID NO: 227693 - DNA, 20 bp, Artificial
  CRISPR gRNA sequence
ccaagccgtctgaaagtcat

SEQ ID NO: 227694 - DNA, 20 bp, Artificial
  CRISPR gRNA sequence
aaagtcatactagaaaattt

SEQ ID NO: 227695 - DNA, 20 bp, Artificial
  CRISPR gRNA sequence
gaaaatttgataagagcctg

SEQ ID NO: 227696 - DNA, 20 bp, Artificial
  CRISPR gRNA sequence
gataagagcctgctgttaac

SEQ ID NO: 227697 - DNA, 20 bp, Artificial
  CRISPR gRNA sequence
ataagagcctgctgttaaca

SEQ ID NO: 227698 - DNA, 20 bp, Artificial
  CRISPR gRNA sequence
ctgttaacaacacattgagt

SEQ ID NO: 227699 - DNA, 20 bp, Artificial
  CRISPR gRNA sequence
ttaacaacacattgagttat

SEQ ID NO: 227700 - DNA, 20 bp, Artificial
  CRISPR gRNA sequence
acaacacattgagttatttt

SEQ ID NO: 227701 - DNA, 20 bp, Artificial
  CRISPR gRNA sequence
agttatttttatcttaatgc

SEQ ID NO: 227702 - DNA, 20 bp, Artificial
  CRISPR gRNA sequence
tttttatcttaatgctaagt

SEQ ID NO: 227703 - DNA, 20 bp, Artificial
  CRISPR gRNA sequence
ttatcttaatgctaagtgga

SEQ ID NO: 227704 - DNA, 20 bp, Artificial
  CRISPR gRNA sequence
tatcttaatgctaagtggag

SEQ ID NO: 227705 - DNA, 20 bp, Artificial
  CRISPR gRNA sequence
atcttaatgctaagtggaga

SEQ ID NO: 227706 - DNA, 20 bp, Artificial
  CRISPR gRNA sequence
tcttaatgctaagtggagaa

SEQ ID NO: 227707 - DNA, 20 bp, Artificial
  CRISPR gRNA sequence
aatgctaagtggagaattac

SEQ ID NO: 227708 - DNA, 20 bp, Artificial
  CRISPR gRNA sequence
atgctaagtggagaattact

SEQ ID NO: 227709 - DNA, 20 bp, Artificial
  CRISPR gRNA sequence
agtggagaattacttgaatt

SEQ ID NO: 227710 - DNA, 20 bp, Artificial
  CRISPR gRNA sequence
cttgaatttattttttttgc

SEQ ID NO: 227711 - DNA, 20 bp, Artificial
  CRISPR gRNA sequence
gaatttattttttttgctgc

SEQ ID NO: 227712 - DNA, 20 bp, Artificial
  CRISPR gRNA sequence
aatttattttttttgctgca

SEQ ID NO: 227713 - DNA, 20 bp, Artificial
  CRISPR gRNA sequence
attttttttgctgcatttaa

SEQ ID NO: 227714 - DNA, 20 bp, Artificial
  CRISPR gRNA sequence
ttttttttgctgcatttaat

SEQ ID NO: 227715 - DNA, 20 bp, Artificial
  CRISPR gRNA sequence
tttttgctgcatttaatgtt

SEQ ID NO: 227716 - DNA, 20 bp, Artificial
  CRISPR gRNA sequence
ttttgctgcatttaatgttt

SEQ ID NO: 227717 - DNA, 20 bp, Artificial
  CRISPR gRNA sequence
tttgctgcatttaatgtttt

SEQ ID NO: 227718 - DNA, 20 bp, Artificial
  CRISPR gRNA sequence
ttgctgcatttaatgttttg

SEQ ID NO: 227719 - DNA, 20 bp, Artificial
  CRISPR gRNA sequence
tgctgcatttaatgttttga

SEQ ID NO: 227720 - DNA, 20 bp, Artificial
  CRISPR gRNA sequence
gctgcatttaatgttttgat

SEQ ID NO: 227721 - DNA, 20 bp, Artificial
  CRISPR gRNA sequence
ctgcatttaatgttttgata

SEQ ID NO: 227722 - DNA, 20 bp, Artificial
  CRISPR gRNA sequence
catttaatgttttgatacat

SEQ ID NO: 227723 - DNA, 20 bp, Artificial
  CRISPR gRNA sequence
aatgttttgatacattcaat

SEQ ID NO: 227724 - DNA, 20 bp, Artificial
  CRISPR gRNA sequence
atgttttgatacattcaata

SEQ ID NO: 227725 - DNA, 20 bp, Artificial
  CRISPR gRNA sequence
tgatacattcaataaataag

SEQ ID NO: 227726 - DNA, 20 bp, Artificial
  CRISPR gRNA sequence
gatacattcaataaataagg

SEQ ID NO: 227727 - DNA, 20 bp, Artificial
  CRISPR gRNA sequence
atacattcaataaataagga

SEQ ID NO: 227728 - DNA, 20 bp, Artificial
  CRISPR gRNA sequence
aataaataaggataaatcca

SEQ ID NO: 227729 - DNA, 20 bp, Artificial
  CRISPR gRNA sequence
actgaaggacaagaaaagat

SEQ ID NO: 227730 - DNA, 20 bp, Artificial
  CRISPR gRNA sequence
ctgaaggacaagaaaagatc

SEQ ID NO: 227731 - DNA, 20 bp, Artificial
  CRISPR gRNA sequence
aaggacaagaaaagatcaat

SEQ ID NO: 227732 - DNA, 20 bp, Artificial
  CRISPR gRNA sequence
gaggttattgggttctatgg

SEQ ID NO: 227733 - DNA, 20 bp, Artificial
  CRISPR gRNA sequence
aggttattgggttctatggc

SEQ ID NO: 227734 - DNA, 20 bp, Artificial
  CRISPR gRNA sequence
ttgggttctatggcatctat

SEQ ID NO: 227735 - DNA, 20 bp, Artificial
  CRISPR gRNA sequence
ggttctatggcatctattat

SEQ ID NO: 227736 - DNA, 20 bp, Artificial
  CRISPR gRNA sequence
tatggcatctattatatcaa

SEQ ID NO: 227737 - DNA, 20 bp, Artificial
  CRISPR gRNA sequence
tggcatctattatatcaaat

SEQ ID NO: 227738 - DNA, 20 bp, Artificial
  CRISPR gRNA sequence
ttatatcaaattccttgccc

SEQ ID NO: 227739 - DNA, 20 bp, Artificial
  CRISPR gRNA sequence
tatcaaattccttgcccttt

SEQ ID NO: 227740 - DNA, 20 bp, Artificial
  CRISPR gRNA sequence
cttgccctttcactatactg

SEQ ID NO: 227741 - DNA, 20 bp, Artificial
  CRISPR gRNA sequence
gccctttcactatactgaga

SEQ ID NO: 227742 - DNA, 20 bp, Artificial
  CRISPR gRNA sequence
ccctttcactatactgagaa

SEQ ID NO: 227743 - DNA, 20 bp, Artificial
  CRISPR gRNA sequence
tcactatactgagaaatttg

SEQ ID NO: 227744 - DNA, 20 bp, Artificial
  CRISPR gRNA sequence
cactatactgagaaatttga

SEQ ID NO: 227745 - DNA, 20 bp, Artificial
  CRISPR gRNA sequence
actatactgagaaatttgac

SEQ ID NO: 227746 - DNA, 20 bp, Artificial
  CRISPR gRNA sequence
tactgagaaatttgacgact

SEQ ID NO: 227747 - DNA, 20 bp, Artificial
  CRISPR gRNA sequence
agaaatttgacgactgggct

SEQ ID NO: 227748 - DNA, 20 bp, Artificial
  CRISPR gRNA sequence
gacgactgggctagcaacaa

SEQ ID NO: 227749 - DNA, 20 bp, Artificial
  CRISPR gRNA sequence
acgactgggctagcaacaag

SEQ ID NO: 227750 - DNA, 20 bp, Artificial
  CRISPR gRNA sequence
ggctagcaacaagataccta

SEQ ID NO: 227751 - DNA, 20 bp, Artificial
  CRISPR gRNA sequence
gcaacaagatacctacccca

SEQ ID NO: 227752 - DNA, 20 bp, Artificial
  CRISPR gRNA sequence
ccccacattagctgtggtac

SEQ ID NO: 227753 - DNA, 20 bp, Artificial
  CRISPR gRNA sequence
gctgtggtacctgctgaaat

SEQ ID NO: 227754 - DNA, 20 bp, Artificial
  CRISPR gRNA sequence
tggtacctgctgaaatgtga

SEQ ID NO: 227755 - DNA, 20 bp, Artificial
  CRISPR gRNA sequence
ctgaaatgtgaccatgtgag

SEQ ID NO: 227756 - DNA, 20 bp, Artificial
  CRISPR gRNA sequence
aaatgtgaccatgtgagcaa

SEQ ID NO: 227757 - DNA, 20 bp, Artificial
  CRISPR gRNA sequence
tttctgaagattcactgaag

SEQ ID NO: 227758 - DNA, 20 bp, Artificial
  CRISPR gRNA sequence
tctgaagattcactgaagaa

SEQ ID NO: 227759 - DNA, 20 bp, Artificial
  CRISPR gRNA sequence
ctgaagattcactgaagaaa

SEQ ID NO: 227760 - DNA, 20 bp, Artificial
  CRISPR gRNA sequence
tgaagattcactgaagaaaa

SEQ ID NO: 227761 - DNA, 20 bp, Artificial
  CRISPR gRNA sequence
aagattcactgaagaaaacc

SEQ ID NO: 227762 - DNA, 20 bp, Artificial
  CRISPR gRNA sequence
actgaagaaaacctggagat

SEQ ID NO: 227763 - DNA, 20 bp, Artificial
  CRISPR gRNA sequence
aagaaaacctggagatactc

SEQ ID NO: 227764 - DNA, 20 bp, Artificial
  CRISPR gRNA sequence
gagatactctttcattagta

SEQ ID NO: 227765 - DNA, 20 bp, Artificial
  CRISPR gRNA sequence
tttcattagtagaccccaca

SEQ ID NO: 227766 - DNA, 20 bp, Artificial
  CRISPR gRNA sequence
tcattagtagaccccacaga

SEQ ID NO: 227767 - DNA, 20 bp, Artificial
  CRISPR gRNA sequence
cattagtagaccccacagag

SEQ ID NO: 227768 - DNA, 20 bp, Artificial
  CRISPR gRNA sequence
attagtagaccccacagaga

SEQ ID NO: 227769 - DNA, 20 bp, Artificial
  CRISPR gRNA sequence
gtagaccccacagagacagg

SEQ ID NO: 227770 - DNA, 20 bp, Artificial
  CRISPR gRNA sequence
tccagaatgcctgggaccag

SEQ ID NO: 227771 - DNA, 20 bp, Artificial
  CRISPR gRNA sequence
ggaccagaagtgttttggat

SEQ ID NO: 227772 - DNA, 20 bp, Artificial
  CRISPR gRNA sequence
tggatttcagattttttcac

SEQ ID NO: 227773 - DNA, 20 bp, Artificial
  CRISPR gRNA sequence
ggatttcagattttttcaca

SEQ ID NO: 227774 - DNA, 20 bp, Artificial
  CRISPR gRNA sequence
gatttcagattttttcacac

SEQ ID NO: 227775 - DNA, 20 bp, Artificial
  CRISPR gRNA sequence
cagattttttcacacttggg

SEQ ID NO: 227776 - DNA, 20 bp, Artificial
  CRISPR gRNA sequence
agattttttcacacttggga

SEQ ID NO: 227777 - DNA, 20 bp, Artificial
  CRISPR gRNA sequence
tttcacacttgggatcctca

SEQ ID NO: 227778 - DNA, 20 bp, Artificial
  CRISPR gRNA sequence
ttcacacttgggatcctcaa

SEQ ID NO: 227779 - DNA, 20 bp, Artificial
  CRISPR gRNA sequence
tcacacttgggatcctcaac

SEQ ID NO: 227780 - DNA, 20 bp, Artificial
  CRISPR gRNA sequence
cacacttgggatcctcaaca

SEQ ID NO: 227781 - DNA, 20 bp, Artificial
  CRISPR gRNA sequence
acacttgggatcctcaacat

SEQ ID NO: 227782 - DNA, 20 bp, Artificial
  CRISPR gRNA sequence
gggatcctcaacatgtgtat

SEQ ID NO: 227783 - DNA, 20 bp, Artificial
  CRISPR gRNA sequence
ggatcctcaacatgtgtatt

SEQ ID NO: 227784 - DNA, 20 bp, Artificial
  CRISPR gRNA sequence
aacatgtgtatttgttggaa

SEQ ID NO: 227785 - DNA, 20 bp, Artificial
  CRISPR gRNA sequence
gttggaaatggctacttaat

SEQ ID NO: 227786 - DNA, 20 bp, Artificial
  CRISPR gRNA sequence
ttggaaatggctacttaatt

SEQ ID NO: 227787 - DNA, 20 bp, Artificial
  CRISPR gRNA sequence
gaaatggctacttaatttaa

SEQ ID NO: 227788 - DNA, 20 bp, Artificial
  CRISPR gRNA sequence
cttaatttaaggaaaagttt

SEQ ID NO: 227789 - DNA, 20 bp, Artificial
  CRISPR gRNA sequence
aatttaaggaaaagtttaag

SEQ ID NO: 227790 - DNA, 20 bp, Artificial
  CRISPR gRNA sequence
atttaaggaaaagtttaagg

SEQ ID NO: 227791 - DNA, 20 bp, Artificial
  CRISPR gRNA sequence
aaggaaaagtttaaggtggc

SEQ ID NO: 227792 - DNA, 20 bp, Artificial
  CRISPR gRNA sequence
aggaaaagtttaaggtggcc

SEQ ID NO: 227793 - DNA, 20 bp, Artificial
  CRISPR gRNA sequence
aaggtggcctggaaaataag

SEQ ID NO: 227794 - DNA, 20 bp, Artificial
  CRISPR gRNA sequence
aggtggcctggaaaataagt

SEQ ID NO: 227795 - DNA, 20 bp, Artificial
  CRISPR gRNA sequence
gaaaataagtagtagttgaa

SEQ ID NO: 227796 - DNA, 20 bp, Artificial
  CRISPR gRNA sequence
aactaatcaacaggaaccaa

SEQ ID NO: 227797 - DNA, 20 bp, Artificial
  CRISPR gRNA sequence
atcaacaggaaccaaaacta

SEQ ID NO: 227798 - DNA, 20 bp, Artificial
  CRISPR gRNA sequence
ctttcaatatatagtgtact

SEQ ID NO: 227799 - DNA, 20 bp, Artificial
  CRISPR gRNA sequence
tcaatatatagtgtacttat

SEQ ID NO: 227800 - DNA, 20 bp, Artificial
  CRISPR gRNA sequence
caatatatagtgtacttata

SEQ ID NO: 227801 - DNA, 20 bp, Artificial
  CRISPR gRNA sequence
aatatatagtgtacttatac

SEQ ID NO: 227802 - DNA, 20 bp, Artificial
  CRISPR gRNA sequence
atactcaaagagagacggac

SEQ ID NO: 227803 - DNA, 20 bp, Artificial
  CRISPR gRNA sequence
tactcaaagagagacggacc

SEQ ID NO: 227804 - DNA, 20 bp, Artificial
  CRISPR gRNA sequence
aaagagagacggaccatttt

SEQ ID NO: 227805 - DNA, 20 bp, Artificial
  CRISPR gRNA sequence
tatggtggaaccctgtctat

SEQ ID NO: 227806 - DNA, 20 bp, Artificial
  CRISPR gRNA sequence
atggtggaaccctgtctatg

SEQ ID NO: 227807 - DNA, 20 bp, Artificial
  CRISPR gRNA sequence
tggtggaaccctgtctatgg

SEQ ID NO: 227808 - DNA, 20 bp, Artificial
  CRISPR gRNA sequence
tctatggtagtattttgtga

SEQ ID NO: 227809 - DNA, 20 bp, Artificial
  CRISPR gRNA sequence
tggtagtattttgtgatgtt

SEQ ID NO: 227810 - DNA, 20 bp, Artificial
  CRISPR gRNA sequence
tgtgatgttttatttttgtt

SEQ ID NO: 227811 - DNA, 20 bp, Artificial
  CRISPR gRNA sequence
gtgatgttttatttttgttg

SEQ ID NO: 227812 - DNA, 20 bp, Artificial
  CRISPR gRNA sequence
tgatgttttatttttgttgc

SEQ ID NO: 227813 - DNA, 20 bp, Artificial
  CRISPR gRNA sequence
tatttttgttgctattgttt

SEQ ID NO: 227814 - DNA, 20 bp, Artificial
  CRISPR gRNA sequence
atttttgttgctattgtttg

SEQ ID NO: 227815 - DNA, 20 bp, Artificial
  CRISPR gRNA sequence
tttttgttgctattgtttgc

SEQ ID NO: 227816 - DNA, 20 bp, Artificial
  CRISPR gRNA sequence
ttgttgctattgtttgcact

SEQ ID NO: 227817 - DNA, 20 bp, Artificial
  CRISPR gRNA sequence
tgttgctattgtttgcactg

SEQ ID NO: 227818 - DNA, 20 bp, Artificial
  CRISPR gRNA sequence
gttgctattgtttgcactgt

SEQ ID NO: 227819 - DNA, 20 bp, Artificial
  CRISPR gRNA sequence
ttgctattgtttgcactgtt

SEQ ID NO: 227820 - DNA, 20 bp, Artificial
  CRISPR gRNA sequence
ctattgtttgcactgttttc

SEQ ID NO: 227821 - DNA, 20 bp, Artificial
  CRISPR gRNA sequence
ttgtttgcactgttttctcc

SEQ ID NO: 227822 - DNA, 20 bp, Artificial
  CRISPR gRNA sequence
tttgcactgttttctcctat

SEQ ID NO: 227823 - DNA, 20 bp, Artificial
  CRISPR gRNA sequence
gcactgttttctcctataac

SEQ ID NO: 227824 - DNA, 20 bp, Artificial
  CRISPR gRNA sequence
cactgttttctcctataaca

SEQ ID NO: 227825 - DNA, 20 bp, Artificial
  CRISPR gRNA sequence
ttttctcctataacagctct

SEQ ID NO: 227826 - DNA, 20 bp, Artificial
  CRISPR gRNA sequence
tctcctataacagctcttct

SEQ ID NO: 227827 - DNA, 20 bp, Artificial
  CRISPR gRNA sequence
ctcctataacagctcttcta

SEQ ID NO: 227828 - DNA, 20 bp, Artificial
  CRISPR gRNA sequence
tcctataacagctcttctaa

SEQ ID NO: 227829 - DNA, 20 bp, Artificial
  CRISPR gRNA sequence
ctataacagctcttctaagc

SEQ ID NO: 227830 - DNA, 20 bp, Artificial
  CRISPR gRNA sequence
taacagctcttctaagcctt

SEQ ID NO: 227831 - DNA, 20 bp, Artificial
  CRISPR gRNA sequence
ttctaagccttaagaggata

SEQ ID NO: 227832 - DNA, 20 bp, Artificial
  CRISPR gRNA sequence
ctaagccttaagaggataaa

SEQ ID NO: 227833 - DNA, 20 bp, Artificial
  CRISPR gRNA sequence
taagccttaagaggataaat

SEQ ID NO: 227834 - DNA, 20 bp, Artificial
  CRISPR gRNA sequence
agccttaagaggataaattt

SEQ ID NO: 227835 - DNA, 20 bp, Artificial
  CRISPR gRNA sequence
aagaggataaattttatatg

SEQ ID NO: 227836 - DNA, 20 bp, Artificial
  CRISPR gRNA sequence
agaggataaattttatatga

SEQ ID NO: 227837 - DNA, 20 bp, Artificial
  CRISPR gRNA sequence
tatatgagattcaaactctt

SEQ ID NO: 227838 - DNA, 20 bp, Artificial
  CRISPR gRNA sequence
atatgagattcaaactctta

SEQ ID NO: 227839 - DNA, 20 bp, Artificial
  CRISPR gRNA sequence
tatgagattcaaactcttat

SEQ ID NO: 227840 - DNA, 20 bp, Artificial
  CRISPR gRNA sequence
aaactcttatttttgttaag

SEQ ID NO: 227841 - DNA, 20 bp, Artificial
  CRISPR gRNA sequence
ttatttttgttaagaaggat

SEQ ID NO: 227842 - DNA, 20 bp, Artificial
  CRISPR gRNA sequence
atttttgttaagaaggatgt

SEQ ID NO: 227843 - DNA, 20 bp, Artificial
  CRISPR gRNA sequence
tttttgttaagaaggatgta

SEQ ID NO: 227844 - DNA, 20 bp, Artificial
  CRISPR gRNA sequence
ttgttaagaaggatgtaagt

SEQ ID NO: 227845 - DNA, 20 bp, Artificial
  CRISPR gRNA sequence
tgttaagaaggatgtaagtc

SEQ ID NO: 227846 - DNA, 20 bp, Artificial
  CRISPR gRNA sequence
gttaagaaggatgtaagtca

SEQ ID NO: 227847 - DNA, 20 bp, Artificial
  CRISPR gRNA sequence
ttaagaaggatgtaagtcac

SEQ ID NO: 227848 - DNA, 20 bp, Artificial
  CRISPR gRNA sequence
agaaggatgtaagtcaccag

SEQ ID NO: 227849 - DNA, 20 bp, Artificial
  CRISPR gRNA sequence
acacctgtaatcccagcact

SEQ ID NO: 227850 - DNA, 20 bp, Artificial
  CRISPR gRNA sequence
taatcccagcactttgggag

SEQ ID NO: 227851 - DNA, 20 bp, Artificial
  CRISPR gRNA sequence
tgggaggccgtggcaggtgg

SEQ ID NO: 227852 - DNA, 20 bp, Artificial
  CRISPR gRNA sequence
gggaggccgtggcaggtgga

SEQ ID NO: 227853 - DNA, 20 bp, Artificial
  CRISPR gRNA sequence
ggaggccgtggcaggtggat

SEQ ID NO: 227854 - DNA, 20 bp, Artificial
  CRISPR gRNA sequence
gagatcagcctggccaacaa

SEQ ID NO: 227855 - DNA, 20 bp, Artificial
  CRISPR gRNA sequence
gccaacaatgtgaaaccccg

SEQ ID NO: 227856 - DNA, 20 bp, Artificial
  CRISPR gRNA sequence
tactaaaaaaaaaaaaaaaa

SEQ ID NO: 227857 - DNA, 20 bp, Artificial
  CRISPR gRNA sequence
ctaaaaaaaaaaaaaaaaga

SEQ ID NO: 227858 - DNA, 20 bp, Artificial
  CRISPR gRNA sequence
aaaaaaaaaaaaaaagaatt

SEQ ID NO: 227859 - DNA, 20 bp, Artificial
  CRISPR gRNA sequence
aaaaattagccaggcctggt

SEQ ID NO: 227860 - DNA, 20 bp, Artificial
  CRISPR gRNA sequence
gccaggcctggtggcgcatg

SEQ ID NO: 227861 - DNA, 20 bp, Artificial
  CRISPR gRNA sequence
gtggcgcatgcctgtagtcc

SEQ ID NO: 227862 - DNA, 20 bp, Artificial
  CRISPR gRNA sequence
tagtcccagctactcgggag

SEQ ID NO: 227863 - DNA, 20 bp, Artificial
  CRISPR gRNA sequence
ctcgggaggctgaggcagga

SEQ ID NO: 227864 - DNA, 20 bp, Artificial
  CRISPR gRNA sequence
gggaggctgaggcaggagaa

SEQ ID NO: 227865 - DNA, 20 bp, Artificial
  CRISPR gRNA sequence
aggcaggagaatcattgaac

SEQ ID NO: 227866 - DNA, 20 bp, Artificial
  CRISPR gRNA sequence
aacctgggaggcagagtttg

SEQ ID NO: 227867 - DNA, 20 bp, Artificial
  CRISPR gRNA sequence
ggaggcagagtttgcagtga

SEQ ID NO: 227868 - DNA, 20 bp, Artificial
  CRISPR gRNA sequence
gcagtgagccgagattgtgc

SEQ ID NO: 227869 - DNA, 20 bp, Artificial
  CRISPR gRNA sequence
cagtgagccgagattgtgcc

SEQ ID NO: 227870 - DNA, 20 bp, Artificial
  CRISPR gRNA sequence
tgccactgcactccagcctg

SEQ ID NO: 227871 - DNA, 20 bp, Artificial
  CRISPR gRNA sequence
cactccagcctgggtaacgg

SEQ ID NO: 227872 - DNA, 20 bp, Artificial
  CRISPR gRNA sequence
cagcctgggtaacggagtga

SEQ ID NO: 227873 - DNA, 20 bp, Artificial
  CRISPR gRNA sequence
ggtaacggagtgagagactc

SEQ ID NO: 227874 - DNA, 20 bp, Artificial
  CRISPR gRNA sequence
tgtctccaaaaaaaaaaaaa

SEQ ID NO: 227875 - DNA, 20 bp, Artificial
  CRISPR gRNA sequence
tctccaaaaaaaaaaaaaaa

SEQ ID NO: 227876 - DNA, 20 bp, Artificial
  CRISPR gRNA sequence
caaaaaaaaaaaaaaagaaa

SEQ ID NO: 227877 - DNA, 20 bp, Artificial
  CRISPR gRNA sequence
tttccatgaaattatactgt

SEQ ID NO: 227878 - DNA, 20 bp, Artificial
  CRISPR gRNA sequence
ttccatgaaattatactgta

SEQ ID NO: 227879 - DNA, 20 bp, Artificial
  CRISPR gRNA sequence
tccatgaaattatactgtac

SEQ ID NO: 227880 - DNA, 20 bp, Artificial
  CRISPR gRNA sequence
ccatgaaattatactgtact

SEQ ID NO: 227881 - DNA, 20 bp, Artificial
  CRISPR gRNA sequence
catgaaattatactgtactc

SEQ ID NO: 227882 - DNA, 20 bp, Artificial
  CRISPR gRNA sequence
tactgtactctaaggcaaat

SEQ ID NO: 227883 - DNA, 20 bp, Artificial
  CRISPR gRNA sequence
tactctaaggcaaattcttg

SEQ ID NO: 227884 - DNA, 20 bp, Artificial
  CRISPR gRNA sequence
taaggcaaattcttgttgct

SEQ ID NO: 227885 - DNA, 20 bp, Artificial
  CRISPR gRNA sequence
aggcaaattcttgttgcttg

SEQ ID NO: 227886 - DNA, 20 bp, Artificial
  CRISPR gRNA sequence
ttgttgcttgatcttagtag

SEQ ID NO: 227887 - DNA, 20 bp, Artificial
  CRISPR gRNA sequence
gttgcttgatcttagtagct

SEQ ID NO: 227888 - DNA, 20 bp, Artificial
  CRISPR gRNA sequence
ttgcttgatcttagtagctt

SEQ ID NO: 227889 - DNA, 20 bp, Artificial
  CRISPR gRNA sequence
cttgatcttagtagcttttt

SEQ ID NO: 227890 - DNA, 20 bp, Artificial
  CRISPR gRNA sequence
gatcttagtagcttttttat

SEQ ID NO: 227891 - DNA, 20 bp, Artificial
  CRISPR gRNA sequence
atcttagtagcttttttatg

SEQ ID NO: 227892 - DNA, 20 bp, Artificial
  CRISPR gRNA sequence
agtagcttttttatgcattg

SEQ ID NO: 227893 - DNA, 20 bp, Artificial
  CRISPR gRNA sequence
gtagcttttttatgcattga

SEQ ID NO: 227894 - DNA, 20 bp, Artificial
  CRISPR gRNA sequence
ttttatgcattgacttaaac

SEQ ID NO: 227895 - DNA, 20 bp, Artificial
  CRISPR gRNA sequence
tttatgcattgacttaaacc

SEQ ID NO: 227896 - DNA, 20 bp, Artificial
  CRISPR gRNA sequence
ttatgcattgacttaaacct

SEQ ID NO: 227897 - DNA, 20 bp, Artificial
  CRISPR gRNA sequence
tatgcattgacttaaacctg

SEQ ID NO: 227898 - DNA, 20 bp, Artificial
  CRISPR gRNA sequence
atgcattgacttaaacctgg

SEQ ID NO: 227899 - DNA, 20 bp, Artificial
  CRISPR gRNA sequence
tgcattgacttaaacctgga

SEQ ID NO: 227900 - DNA, 20 bp, Artificial
  CRISPR gRNA sequence
acttaaacctggaagagttt

SEQ ID NO: 227901 - DNA, 20 bp, Artificial
  CRISPR gRNA sequence
aaacctggaagagtttctta

SEQ ID NO: 227902 - DNA, 20 bp, Artificial
  CRISPR gRNA sequence
aacctggaagagtttcttat

SEQ ID NO: 227903 - DNA, 20 bp, Artificial
  CRISPR gRNA sequence
gaagagtttcttatgaatgt

SEQ ID NO: 227904 - DNA, 20 bp, Artificial
  CRISPR gRNA sequence
cttatgaatgtttgattgac

SEQ ID NO: 227905 - DNA, 20 bp, Artificial
  CRISPR gRNA sequence
ttatgaatgtttgattgact

SEQ ID NO: 227906 - DNA, 20 bp, Artificial
  CRISPR gRNA sequence
atgaatgtttgattgactgt

SEQ ID NO: 227907 - DNA, 20 bp, Artificial
  CRISPR gRNA sequence
tgaatgtttgattgactgtg

SEQ ID NO: 227908 - DNA, 20 bp, Artificial
  CRISPR gRNA sequence
gattgactgtgaggtgcatt

SEQ ID NO: 227909 - DNA, 20 bp, Artificial
  CRISPR gRNA sequence
attgactgtgaggtgcattt

SEQ ID NO: 227910 - DNA, 20 bp, Artificial
  CRISPR gRNA sequence
actgtgaggtgcatttgaaa

SEQ ID NO: 227911 - DNA, 20 bp, Artificial
  CRISPR gRNA sequence
tgaggtgcatttgaaacagc

SEQ ID NO: 227912 - DNA, 20 bp, Artificial
  CRISPR gRNA sequence
gaaacagcttctactttata

SEQ ID NO: 227913 - DNA, 20 bp, Artificial
  CRISPR gRNA sequence
aaacagcttctactttataa

SEQ ID NO: 227914 - DNA, 20 bp, Artificial
  CRISPR gRNA sequence
ctactttataaccctttgca

SEQ ID NO: 227915 - DNA, 20 bp, Artificial
  CRISPR gRNA sequence
tactttataaccctttgcag

SEQ ID NO: 227916 - DNA, 20 bp, Artificial
  CRISPR gRNA sequence
ctttataaccctttgcagaa

SEQ ID NO: 227917 - DNA, 20 bp, Artificial
  CRISPR gRNA sequence
tataaccctttgcagaactt

SEQ ID NO: 227918 - DNA, 20 bp, Artificial
  CRISPR gRNA sequence
ataaccctttgcagaacttt

SEQ ID NO: 227919 - DNA, 20 bp, Artificial
  CRISPR gRNA sequence
taaccctttgcagaactttc

SEQ ID NO: 227920 - DNA, 20 bp, Artificial
  CRISPR gRNA sequence
tgcagaactttcaagctcta

SEQ ID NO: 227921 - DNA, 20 bp, Artificial
  CRISPR gRNA sequence
gcagaactttcaagctctat

SEQ ID NO: 227922 - DNA, 20 bp, Artificial
  CRISPR gRNA sequence
cagaactttcaagctctatt

SEQ ID NO: 227923 - DNA, 20 bp, Artificial
  CRISPR gRNA sequence
tcaagctctatttagataac

SEQ ID NO: 227924 - DNA, 20 bp, Artificial
  CRISPR gRNA sequence
caagctctatttagataaca

SEQ ID NO: 227925 - DNA, 20 bp, Artificial
  CRISPR gRNA sequence
aagctctatttagataacaa

SEQ ID NO: 227926 - DNA, 20 bp, Artificial
  CRISPR gRNA sequence
tatttagataacaatatata

SEQ ID NO: 227927 - DNA, 20 bp, Artificial
  CRISPR gRNA sequence
tttagataacaatatatatg

SEQ ID NO: 227928 - DNA, 20 bp, Artificial
  CRISPR gRNA sequence
agataacaatatatatggga

SEQ ID NO: 227929 - DNA, 20 bp, Artificial
  CRISPR gRNA sequence
gataacaatatatatgggat

SEQ ID NO: 227930 - DNA, 20 bp, Artificial
  CRISPR gRNA sequence
aaatggaaaatgtgacatat

SEQ ID NO: 227931 - DNA, 20 bp, Artificial
  CRISPR gRNA sequence
gagaaagttcctttttctgt

SEQ ID NO: 227932 - DNA, 20 bp, Artificial
  CRISPR gRNA sequence
ctttttctgtgtatgtgcct

SEQ ID NO: 227933 - DNA, 20 bp, Artificial
  CRISPR gRNA sequence
tttctgtgtatgtgcctttt

SEQ ID NO: 227934 - DNA, 20 bp, Artificial
  CRISPR gRNA sequence
ttctgtgtatgtgccttttg

SEQ ID NO: 227935 - DNA, 20 bp, Artificial
  CRISPR gRNA sequence
tctgtgtatgtgccttttgt

SEQ ID NO: 227936 - DNA, 20 bp, Artificial
  CRISPR gRNA sequence
ctgtgtatgtgccttttgtg

SEQ ID NO: 227937 - DNA, 20 bp, Artificial
  CRISPR gRNA sequence
tgtgtatgtgccttttgtga

SEQ ID NO: 227938 - DNA, 20 bp, Artificial
  CRISPR gRNA sequence
tgtatgtgccttttgtgact

SEQ ID NO: 227939 - DNA, 20 bp, Artificial
  CRISPR gRNA sequence
ttgtgacttatacactcagt

SEQ ID NO: 227940 - DNA, 20 bp, Artificial
  CRISPR gRNA sequence
tgtgacttatacactcagtt

SEQ ID NO: 227941 - DNA, 20 bp, Artificial
  CRISPR gRNA sequence
gtgacttatacactcagttt

SEQ ID NO: 227942 - DNA, 20 bp, Artificial
  CRISPR gRNA sequence
tgacttatacactcagtttc

SEQ ID NO: 227943 - DNA, 20 bp, Artificial
  CRISPR gRNA sequence
atacactcagtttcattcta

SEQ ID NO: 227944 - DNA, 20 bp, Artificial
  CRISPR gRNA sequence
tacactcagtttcattctag

SEQ ID NO: 227945 - DNA, 20 bp, Artificial
  CRISPR gRNA sequence
agtttcattctagccagcat

SEQ ID NO: 227946 - DNA, 20 bp, Artificial
  CRISPR gRNA sequence
cattctagccagcatttgag

SEQ ID NO: 227947 - DNA, 20 bp, Artificial
  CRISPR gRNA sequence
attctagccagcatttgagc

SEQ ID NO: 227948 - DNA, 20 bp, Artificial
  CRISPR gRNA sequence
tagccagcatttgagcctag

SEQ ID NO: 227949 - DNA, 20 bp, Artificial
  CRISPR gRNA sequence
gccagcatttgagcctagaa

SEQ ID NO: 227950 - DNA, 20 bp, Artificial
  CRISPR gRNA sequence
gagcctagaaaatagggaag

SEQ ID NO: 227951 - DNA, 20 bp, Artificial
  CRISPR gRNA sequence
agcctagaaaatagggaagt

SEQ ID NO: 227952 - DNA, 20 bp, Artificial
  CRISPR gRNA sequence
gaaaatagggaagttatgaa

SEQ ID NO: 227953 - DNA, 20 bp, Artificial
  CRISPR gRNA sequence
tgaaaactctgtgccttata

SEQ ID NO: 227954 - DNA, 20 bp, Artificial
  CRISPR gRNA sequence
tgtgccttataagaaggcaa

SEQ ID NO: 227955 - DNA, 20 bp, Artificial
  CRISPR gRNA sequence
tgccttataagaaggcaagg

SEQ ID NO: 227956 - DNA, 20 bp, Artificial
  CRISPR gRNA sequence
ataagaaggcaaggctatga

SEQ ID NO: 227957 - DNA, 20 bp, Artificial
  CRISPR gRNA sequence
taagaaggcaaggctatgac

SEQ ID NO: 227958 - DNA, 20 bp, Artificial
  CRISPR gRNA sequence
tgactgagtattagacacat

SEQ ID NO: 227959 - DNA, 20 bp, Artificial
  CRISPR gRNA sequence
agtattagacacataagtcc

SEQ ID NO: 227960 - DNA, 20 bp, Artificial
  CRISPR gRNA sequence
gacacataagtccagggctg

SEQ ID NO: 227961 - DNA, 20 bp, Artificial
  CRISPR gRNA sequence
ggcggaagtaatgaatcaaa

SEQ ID NO: 227962 - DNA, 20 bp, Artificial
  CRISPR gRNA sequence
ggggaacttgccataggatg

SEQ ID NO: 227963 - DNA, 20 bp, Artificial
  CRISPR gRNA sequence
gggaacttgccataggatgt

SEQ ID NO: 227964 - DNA, 20 bp, Artificial
  CRISPR gRNA sequence
gccataggatgttttctgat

SEQ ID NO: 227965 - DNA, 20 bp, Artificial
  CRISPR gRNA sequence
ccataggatgttttctgatt

SEQ ID NO: 227966 - DNA, 20 bp, Artificial
  CRISPR gRNA sequence
tctgattaatatgggtttct

SEQ ID NO: 227967 - DNA, 20 bp, Artificial
  CRISPR gRNA sequence
ctgattaatatgggtttctc

SEQ ID NO: 227968 - DNA, 20 bp, Artificial
  CRISPR gRNA sequence
tgattaatatgggtttctct

SEQ ID NO: 227969 - DNA, 20 bp, Artificial
  CRISPR gRNA sequence
attaatatgggtttctcttc

SEQ ID NO: 227970 - DNA, 20 bp, Artificial
  CRISPR gRNA sequence
atatgggtttctcttctctg

SEQ ID NO: 227971 - DNA, 20 bp, Artificial
  CRISPR gRNA sequence
ctcttctctgattaatgtgg

SEQ ID NO: 227972 - DNA, 20 bp, Artificial
  CRISPR gRNA sequence
tcttctctgattaatgtgga

SEQ ID NO: 227973 - DNA, 20 bp, Artificial
  CRISPR gRNA sequence
ttctctgattaatgtggatt

SEQ ID NO: 227974 - DNA, 20 bp, Artificial
  CRISPR gRNA sequence
ctctgattaatgtggatttc

SEQ ID NO: 227975 - DNA, 20 bp, Artificial
  CRISPR gRNA sequence
tctgattaatgtggatttca

SEQ ID NO: 227976 - DNA, 20 bp, Artificial
  CRISPR gRNA sequence
tgattaatgtggatttcagt

SEQ ID NO: 227977 - DNA, 20 bp, Artificial
  CRISPR gRNA sequence
attaatgtggatttcagtta

SEQ ID NO: 227978 - DNA, 20 bp, Artificial
  CRISPR gRNA sequence
atgtggatttcagttactca

SEQ ID NO: 227979 - DNA, 20 bp, Artificial
  CRISPR gRNA sequence
cagttactcaactgtgtaac

SEQ ID NO: 227980 - DNA, 20 bp, Artificial
  CRISPR gRNA sequence
agttactcaactgtgtaact

SEQ ID NO: 227981 - DNA, 20 bp, Artificial
  CRISPR gRNA sequence
ctcaactgtgtaactgaaat

SEQ ID NO: 227982 - DNA, 20 bp, Artificial
  CRISPR gRNA sequence
aactgtgtaactgaaatcca

SEQ ID NO: 227983 - DNA, 20 bp, Artificial
  CRISPR gRNA sequence
tgtaactgaaatccacatta

SEQ ID NO: 227984 - DNA, 20 bp, Artificial
  CRISPR gRNA sequence
aaatccacattaataaattg

SEQ ID NO: 227985 - DNA, 20 bp, Artificial
  CRISPR gRNA sequence
ataaattggttatttattgc

SEQ ID NO: 227986 - DNA, 20 bp, Artificial
  CRISPR gRNA sequence
gttatttattgcttaggact

SEQ ID NO: 227987 - DNA, 20 bp, Artificial
  CRISPR gRNA sequence
tttattgcttaggacttatc

SEQ ID NO: 227988 - DNA, 20 bp, Artificial
  CRISPR gRNA sequence
attgcttaggacttatctcc

SEQ ID NO: 227989 - DNA, 20 bp, Artificial
  CRISPR gRNA sequence
ttgcttaggacttatctccc

SEQ ID NO: 227990 - DNA, 20 bp, Artificial
  CRISPR gRNA sequence
cttaggacttatctccccat

SEQ ID NO: 227991 - DNA, 20 bp, Artificial
  CRISPR gRNA sequence
aggacttatctccccataaa

SEQ ID NO: 227992 - DNA, 20 bp, Artificial
  CRISPR gRNA sequence
ggacttatctccccataaag

SEQ ID NO: 227993 - DNA, 20 bp, Artificial
  CRISPR gRNA sequence
atctccccataaagagacta

SEQ ID NO: 227994 - DNA, 20 bp, Artificial
  CRISPR gRNA sequence
tctccccataaagagactaa

SEQ ID NO: 227995 - DNA, 20 bp, Artificial
  CRISPR gRNA sequence
cccataaagagactaaaatt

SEQ ID NO: 227996 - DNA, 20 bp, Artificial
  CRISPR gRNA sequence
aaattgaggttataaattat

SEQ ID NO: 227997 - DNA, 20 bp, Artificial
  CRISPR gRNA sequence
aggttataaattatgggtag

SEQ ID NO: 227998 - DNA, 20 bp, Artificial
  CRISPR gRNA sequence
taaattatgggtagatagaa

SEQ ID NO: 227999 - DNA, 20 bp, Artificial
  CRISPR gRNA sequence
tgggtagatagaaattccag

SEQ ID NO: 228000 - DNA, 20 bp, Artificial
  CRISPR gRNA sequence
cagaaatatttaggtacctg

SEQ ID NO: 228001 - DNA, 20 bp, Artificial
  CRISPR gRNA sequence
aggtacctgtcatatacctt

SEQ ID NO: 228002 - DNA, 20 bp, Artificial
  CRISPR gRNA sequence
ggtacctgtcatatacctta

SEQ ID NO: 228003 - DNA, 20 bp, Artificial
  CRISPR gRNA sequence
tcatataccttaaacataga

SEQ ID NO: 228004 - DNA, 20 bp, Artificial
  CRISPR gRNA sequence
aaacatagatttttatcaca

SEQ ID NO: 228005 - DNA, 20 bp, Artificial
  CRISPR gRNA sequence
aacatagatttttatcacaa

SEQ ID NO: 228006 - DNA, 20 bp, Artificial
  CRISPR gRNA sequence
ttatcacaatcatttagggg

SEQ ID NO: 228007 - DNA, 20 bp, Artificial
  CRISPR gRNA sequence
tatcacaatcatttaggggc

SEQ ID NO: 228008 - DNA, 20 bp, Artificial
  CRISPR gRNA sequence
atcacaatcatttaggggct

SEQ ID NO: 228009 - DNA, 20 bp, Artificial
  CRISPR gRNA sequence
tcacaatcatttaggggctt

SEQ ID NO: 228010 - DNA, 20 bp, Artificial
  CRISPR gRNA sequence
aggggcttatttattgcttt

SEQ ID NO: 228011 - DNA, 20 bp, Artificial
  CRISPR gRNA sequence
ggggcttatttattgctttt

SEQ ID NO: 228012 - DNA, 20 bp, Artificial
  CRISPR gRNA sequence
atttattgcttttactttat

SEQ ID NO: 228013 - DNA, 20 bp, Artificial
  CRISPR gRNA sequence
tttattgcttttactttatt

SEQ ID NO: 228014 - DNA, 20 bp, Artificial
  CRISPR gRNA sequence
attgcttttactttatttaa

SEQ ID NO: 228015 - DNA, 20 bp, Artificial
  CRISPR gRNA sequence
ttgcttttactttatttaat

SEQ ID NO: 228016 - DNA, 20 bp, Artificial
  CRISPR gRNA sequence
cttttactttatttaatgtt

SEQ ID NO: 228017 - DNA, 20 bp, Artificial
  CRISPR gRNA sequence
ttactttatttaatgtttgt

SEQ ID NO: 228018 - DNA, 20 bp, Artificial
  CRISPR gRNA sequence
tactttatttaatgtttgtc

SEQ ID NO: 228019 - DNA, 20 bp, Artificial
  CRISPR gRNA sequence
actttatttaatgtttgtca

SEQ ID NO: 228020 - DNA, 20 bp, Artificial
  CRISPR gRNA sequence
ctttatttaatgtttgtcac

SEQ ID NO: 228021 - DNA, 20 bp, Artificial
  CRISPR gRNA sequence
tatttaatgtttgtcactgt

SEQ ID NO: 228022 - DNA, 20 bp, Artificial
  CRISPR gRNA sequence
atttaatgtttgtcactgta

SEQ ID NO: 228023 - DNA, 20 bp, Artificial
  CRISPR gRNA sequence
tttaatgtttgtcactgtag

SEQ ID NO: 228024 - DNA, 20 bp, Artificial
  CRISPR gRNA sequence
aatgtttgtcactgtagaag

SEQ ID NO: 228025 - DNA, 20 bp, Artificial
  CRISPR gRNA sequence
atgtttgtcactgtagaaga

SEQ ID NO: 228026 - DNA, 20 bp, Artificial
  CRISPR gRNA sequence
gtcactgtagaagaaaaaaa

SEQ ID NO: 228027 - DNA, 20 bp, Artificial
  CRISPR gRNA sequence
tcactgtagaagaaaaaaaa

SEQ ID NO: 228028 - DNA, 20 bp, Artificial
  CRISPR gRNA sequence
tagaagaaaaaaaactaaat

SEQ ID NO: 228029 - DNA, 20 bp, Artificial
  CRISPR gRNA sequence
aatgctaaatataacattta

SEQ ID NO: 228030 - DNA, 20 bp, Artificial
  CRISPR gRNA sequence
aatataacatttaaaatatt

SEQ ID NO: 228031 - DNA, 20 bp, Artificial
  CRISPR gRNA sequence
aaaatattttccccttcatg

SEQ ID NO: 228032 - DNA, 20 bp, Artificial
  CRISPR gRNA sequence
aaatattttccccttcatga

SEQ ID NO: 228033 - DNA, 20 bp, Artificial
  CRISPR gRNA sequence
tccccttcatgacagccacc

SEQ ID NO: 228034 - DNA, 20 bp, Artificial
  CRISPR gRNA sequence
ccccttcatgacagccacca

SEQ ID NO: 228035 - DNA, 20 bp, Artificial
  CRISPR gRNA sequence
cccttcatgacagccaccaa

SEQ ID NO: 228036 - DNA, 20 bp, Artificial
  CRISPR gRNA sequence
catgacagccaccaattgat

SEQ ID NO: 228037 - DNA, 20 bp, Artificial
  CRISPR gRNA sequence
atgacagccaccaattgatt

SEQ ID NO: 228038 - DNA, 20 bp, Artificial
  CRISPR gRNA sequence
attactgtcatggagactat

SEQ ID NO: 228039 - DNA, 20 bp, Artificial
  CRISPR gRNA sequence
ctgtcatggagactatctct

SEQ ID NO: 228040 - DNA, 20 bp, Artificial
  CRISPR gRNA sequence
tcatggagactatctctatg

SEQ ID NO: 228041 - DNA, 20 bp, Artificial
  CRISPR gRNA sequence
tctctatgtggatgacacac

SEQ ID NO: 228042 - DNA, 20 bp, Artificial
  CRISPR gRNA sequence
tatgtggatgacacacagca

SEQ ID NO: 228043 - DNA, 20 bp, Artificial
  CRISPR gRNA sequence
tgtggatgacacacagcagc

SEQ ID NO: 228044 - DNA, 20 bp, Artificial
  CRISPR gRNA sequence
caatcacacgctgtttcttt

SEQ ID NO: 228045 - DNA, 20 bp, Artificial
  CRISPR gRNA sequence
aatcacacgctgtttctttc

SEQ ID NO: 228046 - DNA, 20 bp, Artificial
  CRISPR gRNA sequence
tttctttccgctactcagtt

SEQ ID NO: 228047 - DNA, 20 bp, Artificial
  CRISPR gRNA sequence
ctttccgctactcagtttgc

SEQ ID NO: 228048 - DNA, 20 bp, Artificial
  CRISPR gRNA sequence
tttccgctactcagtttgct

SEQ ID NO: 228049 - DNA, 20 bp, Artificial
  CRISPR gRNA sequence
tccgctactcagtttgcttt

SEQ ID NO: 228050 - DNA, 20 bp, Artificial
  CRISPR gRNA sequence
ccgctactcagtttgctttt

SEQ ID NO: 228051 - DNA, 20 bp, Artificial
  CRISPR gRNA sequence
cgctactcagtttgctttta

SEQ ID NO: 228052 - DNA, 20 bp, Artificial
  CRISPR gRNA sequence
ctcagtttgcttttaggttg

SEQ ID NO: 228053 - DNA, 20 bp, Artificial
  CRISPR gRNA sequence
agtttgcttttaggttgcct

SEQ ID NO: 228054 - DNA, 20 bp, Artificial
  CRISPR gRNA sequence
gcttttaggttgccttaaac

SEQ ID NO: 228055 - DNA, 20 bp, Artificial
  CRISPR gRNA sequence
cttttaggttgccttaaaca

SEQ ID NO: 228056 - DNA, 20 bp, Artificial
  CRISPR gRNA sequence
ttaggttgccttaaacaact

SEQ ID NO: 228057 - DNA, 20 bp, Artificial
  CRISPR gRNA sequence
taggttgccttaaacaactt

SEQ ID NO: 228058 - DNA, 20 bp, Artificial
  CRISPR gRNA sequence
aggttgccttaaacaacttc

SEQ ID NO: 228059 - DNA, 20 bp, Artificial
  CRISPR gRNA sequence
ggttgccttaaacaacttcc

SEQ ID NO: 228060 - DNA, 20 bp, Artificial
  CRISPR gRNA sequence
ccttaaacaacttccttggt

SEQ ID NO: 228061 - DNA, 20 bp, Artificial
  CRISPR gRNA sequence
aaacaacttccttggtgaaa

SEQ ID NO: 228062 - DNA, 20 bp, Artificial
  CRISPR gRNA sequence
aacaacttccttggtgaaaa

SEQ ID NO: 228063 - DNA, 20 bp, Artificial
  CRISPR gRNA sequence
ccttggtgaaaaaatcaact

SEQ ID NO: 228064 - DNA, 20 bp, Artificial
  CRISPR gRNA sequence
cttggtgaaaaaatcaactt

SEQ ID NO: 228065 - DNA, 20 bp, Artificial
  CRISPR gRNA sequence
ggtgaaaaaatcaacttcaa

SEQ ID NO: 228066 - DNA, 20 bp, Artificial
  CRISPR gRNA sequence
gtgaaaaaatcaacttcaat

SEQ ID NO: 228067 - DNA, 20 bp, Artificial
  CRISPR gRNA sequence
caatattaaccaaaatttaa

SEQ ID NO: 228068 - DNA, 20 bp, Artificial
  CRISPR gRNA sequence
aatattaaccaaaatttaaa

SEQ ID NO: 228069 - DNA, 20 bp, Artificial
  CRISPR gRNA sequence
accaaaatttaaaagattca

SEQ ID NO: 228070 - DNA, 20 bp, Artificial
  CRISPR gRNA sequence
aaaagattcatatatagtaa

SEQ ID NO: 228071 - DNA, 20 bp, Artificial
  CRISPR gRNA sequence
aaagattcatatatagtaaa

SEQ ID NO: 228072 - DNA, 20 bp, Artificial
  CRISPR gRNA sequence
atatatagtaaaagaactaa

SEQ ID NO: 228073 - DNA, 20 bp, Artificial
  CRISPR gRNA sequence
atattcgcagattgacccat

SEQ ID NO: 228074 - DNA, 20 bp, Artificial
  CRISPR gRNA sequence
gcagattgacccattccatt

SEQ ID NO: 228075 - DNA, 20 bp, Artificial
  CRISPR gRNA sequence
acccattccattctttcaga

SEQ ID NO: 228076 - DNA, 20 bp, Artificial
  CRISPR gRNA sequence
cattctttcagagaaggtat

SEQ ID NO: 228077 - DNA, 20 bp, Artificial
  CRISPR gRNA sequence
tttcagagaaggtatgagat

SEQ ID NO: 228078 - DNA, 20 bp, Artificial
  CRISPR gRNA sequence
tcagagaaggtatgagatac

SEQ ID NO: 228079 - DNA, 20 bp, Artificial
  CRISPR gRNA sequence
cagagaaggtatgagatact

SEQ ID NO: 228080 - DNA, 20 bp, Artificial
  CRISPR gRNA sequence
agagaaggtatgagatactt

SEQ ID NO: 228081 - DNA, 20 bp, Artificial
  CRISPR gRNA sequence
gacagtggagctagcagcag

SEQ ID NO: 228082 - DNA, 20 bp, Artificial
  CRISPR gRNA sequence
acagtggagctagcagcaga

SEQ ID NO: 228083 - DNA, 20 bp, Artificial
  CRISPR gRNA sequence
gcagcagaaacaataacatg

SEQ ID NO: 228084 - DNA, 20 bp, Artificial
  CRISPR gRNA sequence
agtctttgcagtttattttt

SEQ ID NO: 228085 - DNA, 20 bp, Artificial
  CRISPR gRNA sequence
tgcagtttatttttattaaa

SEQ ID NO: 228086 - DNA, 20 bp, Artificial
  CRISPR gRNA sequence
gcagtttatttttattaaaa

SEQ ID NO: 228087 - DNA, 20 bp, Artificial
  CRISPR gRNA sequence
cagtttatttttattaaaat

SEQ ID NO: 228088 - DNA, 20 bp, Artificial
  CRISPR gRNA sequence
atttttattaaaatatttta

SEQ ID NO: 228089 - DNA, 20 bp, Artificial
  CRISPR gRNA sequence
tttttattaaaatattttaa

SEQ ID NO: 228090 - DNA, 20 bp, Artificial
  CRISPR gRNA sequence
ttattaaaatattttaattg

SEQ ID NO: 228091 - DNA, 20 bp, Artificial
  CRISPR gRNA sequence
tattaaaatattttaattga

SEQ ID NO: 228092 - DNA, 20 bp, Artificial
  CRISPR gRNA sequence
attaaaatattttaattgaa

SEQ ID NO: 228093 - DNA, 20 bp, Artificial
  CRISPR gRNA sequence
ttaaaatattttaattgaac

SEQ ID NO: 228094 - DNA, 20 bp, Artificial
  CRISPR gRNA sequence
aaatattttaattgaacaat

SEQ ID NO: 228095 - DNA, 20 bp, Artificial
  CRISPR gRNA sequence
taattgaacaatttaagctt

SEQ ID NO: 228096 - DNA, 20 bp, Artificial
  CRISPR gRNA sequence
aattgaacaatttaagcttt

SEQ ID NO: 228097 - DNA, 20 bp, Artificial
  CRISPR gRNA sequence
attgaacaatttaagctttt

SEQ ID NO: 228098 - DNA, 20 bp, Artificial
  CRISPR gRNA sequence
aacaatttaagctttttttc

SEQ ID NO: 228099 - DNA, 20 bp, Artificial
  CRISPR gRNA sequence
aagctttttttcttcatcag

SEQ ID NO: 228100 - DNA, 20 bp, Artificial
  CRISPR gRNA sequence
agctttttttcttcatcagg

SEQ ID NO: 228101 - DNA, 20 bp, Artificial
  CRISPR gRNA sequence
tttttcttcatcaggatttc

SEQ ID NO: 228102 - DNA, 20 bp, Artificial
  CRISPR gRNA sequence
ttttcttcatcaggatttca

SEQ ID NO: 228103 - DNA, 20 bp, Artificial
  CRISPR gRNA sequence
tttcttcatcaggatttcac

SEQ ID NO: 228104 - DNA, 20 bp, Artificial
  CRISPR gRNA sequence
ttcttcatcaggatttcaca

SEQ ID NO: 228105 - DNA, 20 bp, Artificial
  CRISPR gRNA sequence
tcttcatcaggatttcacaa

SEQ ID NO: 228106 - DNA, 20 bp, Artificial
  CRISPR gRNA sequence
cttcatcaggatttcacaag

SEQ ID NO: 228107 - DNA, 20 bp, Artificial
  CRISPR gRNA sequence
ttcatcaggatttcacaagg

SEQ ID NO: 228108 - DNA, 20 bp, Artificial
  CRISPR gRNA sequence
catcaggatttcacaagggt

SEQ ID NO: 228109 - DNA, 20 bp, Artificial
  CRISPR gRNA sequence
atcaggatttcacaagggtg

SEQ ID NO: 228110 - DNA, 20 bp, Artificial
  CRISPR gRNA sequence
cacaagggtgtaatctgccc

SEQ ID NO: 228111 - DNA, 20 bp, Artificial
  CRISPR gRNA sequence
acaagggtgtaatctgccca

SEQ ID NO: 228112 - DNA, 20 bp, Artificial
  CRISPR gRNA sequence
cccagttttattctgtcatt

SEQ ID NO: 228113 - DNA, 20 bp, Artificial
  CRISPR gRNA sequence
tattctgtcatttttttcaa

SEQ ID NO: 228114 - DNA, 20 bp, Artificial
  CRISPR gRNA sequence
attctgtcatttttttcaaa

SEQ ID NO: 228115 - DNA, 20 bp, Artificial
  CRISPR gRNA sequence
ttctgtcatttttttcaaaa

SEQ ID NO: 228116 - DNA, 20 bp, Artificial
  CRISPR gRNA sequence
tgtcatttttttcaaaacaa

SEQ ID NO: 228117 - DNA, 20 bp, Artificial
  CRISPR gRNA sequence
tcatttttttcaaaacaaaa

SEQ ID NO: 228118 - DNA, 20 bp, Artificial
  CRISPR gRNA sequence
ttttcaaaacaaaataacta

SEQ ID NO: 228119 - DNA, 20 bp, Artificial
  CRISPR gRNA sequence
tttcaaaacaaaataactag

SEQ ID NO: 228120 - DNA, 20 bp, Artificial
  CRISPR gRNA sequence
ttcaaaacaaaataactaga

SEQ ID NO: 228121 - DNA, 20 bp, Artificial
  CRISPR gRNA sequence
tcaaaacaaaataactagat

SEQ ID NO: 228122 - DNA, 20 bp, Artificial
  CRISPR gRNA sequence
caaaacaaaataactagatt

SEQ ID NO: 228123 - DNA, 20 bp, Artificial
  CRISPR gRNA sequence
aaaacaaaataactagattt

SEQ ID NO: 228124 - DNA, 20 bp, Artificial
  CRISPR gRNA sequence
gatttccagattgtttacta

SEQ ID NO: 228125 - DNA, 20 bp, Artificial
  CRISPR gRNA sequence
ccagattgtttactaatttt

SEQ ID NO: 228126 - DNA, 20 bp, Artificial
  CRISPR gRNA sequence
cagattgtttactaattttt

SEQ ID NO: 228127 - DNA, 20 bp, Artificial
  CRISPR gRNA sequence
tttactaattttttataagg

SEQ ID NO: 228128 - DNA, 20 bp, Artificial
  CRISPR gRNA sequence
actaattttttataaggtag

SEQ ID NO: 228129 - DNA, 20 bp, Artificial
  CRISPR gRNA sequence
ctaattttttataaggtagg

SEQ ID NO: 228130 - DNA, 20 bp, Artificial
  CRISPR gRNA sequence
attttttataaggtaggaca

SEQ ID NO: 228131 - DNA, 20 bp, Artificial
  CRISPR gRNA sequence
tttataaggtaggacaaaat

SEQ ID NO: 228132 - DNA, 20 bp, Artificial
  CRISPR gRNA sequence
ttataaggtaggacaaaatt

SEQ ID NO: 228133 - DNA, 20 bp, Artificial
  CRISPR gRNA sequence
tataaggtaggacaaaattc

SEQ ID NO: 228134 - DNA, 20 bp, Artificial
  CRISPR gRNA sequence
ataaggtaggacaaaattct

SEQ ID NO: 228135 - DNA, 20 bp, Artificial
  CRISPR gRNA sequence
taaggtaggacaaaattctc

SEQ ID NO: 228136 - DNA, 20 bp, Artificial
  CRISPR gRNA sequence
tctttttctcaatattgtta

SEQ ID NO: 228137 - DNA, 20 bp, Artificial
  CRISPR gRNA sequence
tttttctcaatattgttaat

SEQ ID NO: 228138 - DNA, 20 bp, Artificial
  CRISPR gRNA sequence
tttctcaatattgttaatta

SEQ ID NO: 228139 - DNA, 20 bp, Artificial
  CRISPR gRNA sequence
ttctcaatattgttaattaa

SEQ ID NO: 228140 - DNA, 20 bp, Artificial
  CRISPR gRNA sequence
tctcaatattgttaattaac

SEQ ID NO: 228141 - DNA, 20 bp, Artificial
  CRISPR gRNA sequence
ctcaatattgttaattaacc

SEQ ID NO: 228142 - DNA, 20 bp, Artificial
  CRISPR gRNA sequence
tcaatattgttaattaaccc

SEQ ID NO: 228143 - DNA, 20 bp, Artificial
  CRISPR gRNA sequence
aatattgttaattaacccat

SEQ ID NO: 228144 - DNA, 20 bp, Artificial
  CRISPR gRNA sequence
ttaattaacccattatttcc

SEQ ID NO: 228145 - DNA, 20 bp, Artificial
  CRISPR gRNA sequence
attaacccattatttcccat

SEQ ID NO: 228146 - DNA, 20 bp, Artificial
  CRISPR gRNA sequence
acccattatttcccattagt

SEQ ID NO: 228147 - DNA, 20 bp, Artificial
  CRISPR gRNA sequence
tttcccattagtattatgta

SEQ ID NO: 228148 - DNA, 20 bp, Artificial
  CRISPR gRNA sequence
cccattagtattatgtacat

SEQ ID NO: 228149 - DNA, 20 bp, Artificial
  CRISPR gRNA sequence
ccattagtattatgtacatc

SEQ ID NO: 228150 - DNA, 20 bp, Artificial
  CRISPR gRNA sequence
gtattatgtacatcagtgtt

SEQ ID NO: 228151 - DNA, 20 bp, Artificial
  CRISPR gRNA sequence
tgtacatcagtgttgtgttg

SEQ ID NO: 228152 - DNA, 20 bp, Artificial
  CRISPR gRNA sequence
tgttgtcacttggagtggtt

SEQ ID NO: 228153 - DNA, 20 bp, Artificial
  CRISPR gRNA sequence
tcacttggagtggttttgct

SEQ ID NO: 228154 - DNA, 20 bp, Artificial
  CRISPR gRNA sequence
ggagtggttttgctcatcgg

SEQ ID NO: 228155 - DNA, 20 bp, Artificial
  CRISPR gRNA sequence
gagtggttttgctcatcggg

SEQ ID NO: 228156 - DNA, 20 bp, Artificial
  CRISPR gRNA sequence
tgctcatcgggggcattgac

SEQ ID NO: 228157 - DNA, 20 bp, Artificial
  CRISPR gRNA sequence
gctcatcgggggcattgaca

SEQ ID NO: 228158 - DNA, 20 bp, Artificial
  CRISPR gRNA sequence
ctcatcgggggcattgacaa

SEQ ID NO: 228159 - DNA, 20 bp, Artificial
  CRISPR gRNA sequence
atcgggggcattgacaatgt

SEQ ID NO: 228160 - DNA, 20 bp, Artificial
  CRISPR gRNA sequence
acaatgtctgaaaacagttt

SEQ ID NO: 228161 - DNA, 20 bp, Artificial
  CRISPR gRNA sequence
aaaacagtttgattaacata

SEQ ID NO: 228162 - DNA, 20 bp, Artificial
  CRISPR gRNA sequence
gattaacataactggcatct

SEQ ID NO: 228163 - DNA, 20 bp, Artificial
  CRISPR gRNA sequence
attaacataactggcatcta

SEQ ID NO: 228164 - DNA, 20 bp, Artificial
  CRISPR gRNA sequence
acataactggcatctagtta

SEQ ID NO: 228165 - DNA, 20 bp, Artificial
  CRISPR gRNA sequence
gcatctagttactagcatct

SEQ ID NO: 228166 - DNA, 20 bp, Artificial
  CRISPR gRNA sequence
gttactagcatctagtatgt

SEQ ID NO: 228167 - DNA, 20 bp, Artificial
  CRISPR gRNA sequence
ctagcatctagtatgtagag

SEQ ID NO: 228168 - DNA, 20 bp, Artificial
  CRISPR gRNA sequence
gcatctagtatgtagaggcc

SEQ ID NO: 228169 - DNA, 20 bp, Artificial
  CRISPR gRNA sequence
gtatgtagaggccagggatg

SEQ ID NO: 228170 - DNA, 20 bp, Artificial
  CRISPR gRNA sequence
ctcaacattctatattatgc

SEQ ID NO: 228171 - DNA, 20 bp, Artificial
  CRISPR gRNA sequence
aacattctatattatgcaga

SEQ ID NO: 228172 - DNA, 20 bp, Artificial
  CRISPR gRNA sequence
tatattatgcagagcagtgt

SEQ ID NO: 228173 - DNA, 20 bp, Artificial
  CRISPR gRNA sequence
tattatgcagagcagtgtcc

SEQ ID NO: 228174 - DNA, 20 bp, Artificial
  CRISPR gRNA sequence
tgcagagcagtgtcccccct

SEQ ID NO: 228175 - DNA, 20 bp, Artificial
  CRISPR gRNA sequence
cccccaaaaacttatctagc

SEQ ID NO: 228176 - DNA, 20 bp, Artificial
  CRISPR gRNA sequence
atctagctcaatttattagt

SEQ ID NO: 228177 - DNA, 20 bp, Artificial
  CRISPR gRNA sequence
tctagctcaatttattagta

SEQ ID NO: 228178 - DNA, 20 bp, Artificial
  CRISPR gRNA sequence
gctcaatttattagtaatac

SEQ ID NO: 228179 - DNA, 20 bp, Artificial
  CRISPR gRNA sequence
aatttattagtaatacatca

SEQ ID NO: 228180 - DNA, 20 bp, Artificial
  CRISPR gRNA sequence
attagtaatacatcaaccga

SEQ ID NO: 228181 - DNA, 20 bp, Artificial
  CRISPR gRNA sequence
ttagtaatacatcaaccgag

SEQ ID NO: 228182 - DNA, 20 bp, Artificial
  CRISPR gRNA sequence
gtaatacatcaaccgagaaa

SEQ ID NO: 228183 - DNA, 20 bp, Artificial
  CRISPR gRNA sequence
atgtatagaacctcatttgt

SEQ ID NO: 228184 - DNA, 20 bp, Artificial
  CRISPR gRNA sequence
atttgttagtgtaggaaaat

SEQ ID NO: 228185 - DNA, 20 bp, Artificial
  CRISPR gRNA sequence
gttagtgtaggaaaataagg

SEQ ID NO: 228186 - DNA, 20 bp, Artificial
  CRISPR gRNA sequence
ttagtgtaggaaaataaggt

SEQ ID NO: 228187 - DNA, 20 bp, Artificial
  CRISPR gRNA sequence
gtgtaggaaaataaggtgtc

SEQ ID NO: 228188 - DNA, 20 bp, Artificial
  CRISPR gRNA sequence
taaattcaccatccatattt

SEQ ID NO: 228189 - DNA, 20 bp, Artificial
  CRISPR gRNA sequence
accatccatatttatactgc

SEQ ID NO: 228190 - DNA, 20 bp, Artificial
  CRISPR gRNA sequence
atactgccgtgacgttatcc

SEQ ID NO: 228191 - DNA, 20 bp, Artificial
  CRISPR gRNA sequence
tactgccgtgacgttatcca

SEQ ID NO: 228192 - DNA, 20 bp, Artificial
  CRISPR gRNA sequence
ccgtgacgttatccatttgc

SEQ ID NO: 228193 - DNA, 20 bp, Artificial
  CRISPR gRNA sequence
tccatttgcttatgaaagag

SEQ ID NO: 228194 - DNA, 20 bp, Artificial
  CRISPR gRNA sequence
gcttatgaaagagatgtgag

SEQ ID NO: 228195 - DNA, 20 bp, Artificial
  CRISPR gRNA sequence
cttatgaaagagatgtgagg

SEQ ID NO: 228196 - DNA, 20 bp, Artificial
  CRISPR gRNA sequence
atgaaagagatgtgaggtga

SEQ ID NO: 228197 - DNA, 20 bp, Artificial
  CRISPR gRNA sequence
tgaaagagatgtgaggtgac

SEQ ID NO: 228198 - DNA, 20 bp, Artificial
  CRISPR gRNA sequence
gatgatattaaggagttgtt

SEQ ID NO: 228199 - DNA, 20 bp, Artificial
  CRISPR gRNA sequence
atgatattaaggagttgttc

SEQ ID NO: 228200 - DNA, 20 bp, Artificial
  CRISPR gRNA sequence
aggagttgttcctcataagt

SEQ ID NO: 228201 - DNA, 20 bp, Artificial
  CRISPR gRNA sequence
ttcctcataagttattacat

SEQ ID NO: 228202 - DNA, 20 bp, Artificial
  CRISPR gRNA sequence
ctcataagttattacattat

SEQ ID NO: 228203 - DNA, 20 bp, Artificial
  CRISPR gRNA sequence
ataagttattacattatagt

SEQ ID NO: 228204 - DNA, 20 bp, Artificial
  CRISPR gRNA sequence
ttacattatagtacttctgt

SEQ ID NO: 228205 - DNA, 20 bp, Artificial
  CRISPR gRNA sequence
cattatagtacttctgtcag

SEQ ID NO: 228206 - DNA, 20 bp, Artificial
  CRISPR gRNA sequence
tagtacttctgtcagtttgt

SEQ ID NO: 228207 - DNA, 20 bp, Artificial
  CRISPR gRNA sequence
ctgtcagtttgtctctgtac

SEQ ID NO: 228208 - DNA, 20 bp, Artificial
  CRISPR gRNA sequence
tgtcagtttgtctctgtacc

SEQ ID NO: 228209 - DNA, 20 bp, Artificial
  CRISPR gRNA sequence
tcagtttgtctctgtacctt

SEQ ID NO: 228210 - DNA, 20 bp, Artificial
  CRISPR gRNA sequence
gtctctgtaccttacaagtt

SEQ ID NO: 228211 - DNA, 20 bp, Artificial
  CRISPR gRNA sequence
tctctgtaccttacaagtta

SEQ ID NO: 228212 - DNA, 20 bp, Artificial
  CRISPR gRNA sequence
tgtaccttacaagttattaa

SEQ ID NO: 228213 - DNA, 20 bp, Artificial
  CRISPR gRNA sequence
taccttacaagttattaaaa

SEQ ID NO: 228214 - DNA, 20 bp, Artificial
  CRISPR gRNA sequence
acaagttattaaaatggctt

SEQ ID NO: 228215 - DNA, 20 bp, Artificial
  CRISPR gRNA sequence
caagttattaaaatggcttc

SEQ ID NO: 228216 - DNA, 20 bp, Artificial
  CRISPR gRNA sequence
ttaaaatggcttcacttgtg

SEQ ID NO: 228217 - DNA, 20 bp, Artificial
  CRISPR gRNA sequence
aaatggcttcacttgtgatt

SEQ ID NO: 228218 - DNA, 20 bp, Artificial
  CRISPR gRNA sequence
cacttgtgattgagttcata

SEQ ID NO: 228219 - DNA, 20 bp, Artificial
  CRISPR gRNA sequence
acttgtgattgagttcatat

SEQ ID NO: 228220 - DNA, 20 bp, Artificial
  CRISPR gRNA sequence
gtgattgagttcatataatt

SEQ ID NO: 228221 - DNA, 20 bp, Artificial
  CRISPR gRNA sequence
tgattgagttcatataattc

SEQ ID NO: 228222 - DNA, 20 bp, Artificial
  CRISPR gRNA sequence
agttcatataattctttgtt

SEQ ID NO: 228223 - DNA, 20 bp, Artificial
  CRISPR gRNA sequence
atataattctttgtttttct

SEQ ID NO: 228224 - DNA, 20 bp, Artificial
  CRISPR gRNA sequence
tttgtttttcttttttaagc

SEQ ID NO: 228225 - DNA, 20 bp, Artificial
  CRISPR gRNA sequence
tgtttttcttttttaagcac

SEQ ID NO: 228226 - DNA, 20 bp, Artificial
  CRISPR gRNA sequence
gtttttcttttttaagcact

SEQ ID NO: 228227 - DNA, 20 bp, Artificial
  CRISPR gRNA sequence
tttttcttttttaagcactt

SEQ ID NO: 228228 - DNA, 20 bp, Artificial
  CRISPR gRNA sequence
ttcttttttaagcacttaaa

SEQ ID NO: 228229 - DNA, 20 bp, Artificial
  CRISPR gRNA sequence
tcttttttaagcacttaaat

SEQ ID NO: 228230 - DNA, 20 bp, Artificial
  CRISPR gRNA sequence
cttttttaagcacttaaata

SEQ ID NO: 228231 - DNA, 20 bp, Artificial
  CRISPR gRNA sequence
ttttttaagcacttaaatat

SEQ ID NO: 228232 - DNA, 20 bp, Artificial
  CRISPR gRNA sequence
ttttaagcacttaaatatag

SEQ ID NO: 228233 - DNA, 20 bp, Artificial
  CRISPR gRNA sequence
tttaagcacttaaatataga

SEQ ID NO: 228234 - DNA, 20 bp, Artificial
  CRISPR gRNA sequence
ttaagcacttaaatatagat

SEQ ID NO: 228235 - DNA, 20 bp, Artificial
  CRISPR gRNA sequence
taagcacttaaatatagatc

SEQ ID NO: 228236 - DNA, 20 bp, Artificial
  CRISPR gRNA sequence
aagcacttaaatatagatcc

SEQ ID NO: 228237 - DNA, 20 bp, Artificial
  CRISPR gRNA sequence
agcacttaaatatagatccg

SEQ ID NO: 228238 - DNA, 20 bp, Artificial
  CRISPR gRNA sequence
aaatatagatccggtggtat

SEQ ID NO: 228239 - DNA, 20 bp, Artificial
  CRISPR gRNA sequence
aatatagatccggtggtatg

SEQ ID NO: 228240 - DNA, 20 bp, Artificial
  CRISPR gRNA sequence
ctttacttgttgctggacta

SEQ ID NO: 228241 - DNA, 20 bp, Artificial
  CRISPR gRNA sequence
tacttgttgctggactagtg

SEQ ID NO: 228242 - DNA, 20 bp, Artificial
  CRISPR gRNA sequence
acttgttgctggactagtga

SEQ ID NO: 228243 - DNA, 20 bp, Artificial
  CRISPR gRNA sequence
cttgttgctggactagtgat

SEQ ID NO: 228244 - DNA, 20 bp, Artificial
  CRISPR gRNA sequence
gttgctggactagtgatcac

SEQ ID NO: 228245 - DNA, 20 bp, Artificial
  CRISPR gRNA sequence
ttgctggactagtgatcact

SEQ ID NO: 228246 - DNA, 20 bp, Artificial
  CRISPR gRNA sequence
ctggactagtgatcactgtc

SEQ ID NO: 228247 - DNA, 20 bp, Artificial
  CRISPR gRNA sequence
gactagtgatcactgtcatt

SEQ ID NO: 228248 - DNA, 20 bp, Artificial
  CRISPR gRNA sequence
gtgatcactgtcattgtcat

SEQ ID NO: 228249 - DNA, 20 bp, Artificial
  CRISPR gRNA sequence
tcattgtcattgttggagcc

SEQ ID NO: 228250 - DNA, 20 bp, Artificial
  CRISPR gRNA sequence
tcattgttggagccattctt

SEQ ID NO: 228251 - DNA, 20 bp, Artificial
  CRISPR gRNA sequence
ttggagccattcttttcgtc

SEQ ID NO: 228252 - DNA, 20 bp, Artificial
  CRISPR gRNA sequence
gagccattcttttcgtccca

SEQ ID NO: 228253 - DNA, 20 bp, Artificial
  CRISPR gRNA sequence
ttttcgtcccaggtaagatg

SEQ ID NO: 228254 - DNA, 20 bp, Artificial
  CRISPR gRNA sequence
ttcgtcccaggtaagatgtg

SEQ ID NO: 228255 - DNA, 20 bp, Artificial
  CRISPR gRNA sequence
tcgtcccaggtaagatgtgc

SEQ ID NO: 228256 - DNA, 20 bp, Artificial
  CRISPR gRNA sequence
cgtcccaggtaagatgtgca

SEQ ID NO: 228257 - DNA, 20 bp, Artificial
  CRISPR gRNA sequence
gtcccaggtaagatgtgcag

SEQ ID NO: 228258 - DNA, 20 bp, Artificial
  CRISPR gRNA sequence
ctaggcaggaacgcaggagg

SEQ ID NO: 228259 - DNA, 20 bp, Artificial
  CRISPR gRNA sequence
ggcaggaacgcaggaggtag

SEQ ID NO: 228260 - DNA, 20 bp, Artificial
  CRISPR gRNA sequence
caaggtgaggagggctgcat

SEQ ID NO: 228261 - DNA, 20 bp, Artificial
  CRISPR gRNA sequence
cattagtttcctagggctgt

SEQ ID NO: 228262 - DNA, 20 bp, Artificial
  CRISPR gRNA sequence
gtttcctagggctgttggaa

SEQ ID NO: 228263 - DNA, 20 bp, Artificial
  CRISPR gRNA sequence
cctagggctgttggaacaga

SEQ ID NO: 228264 - DNA, 20 bp, Artificial
  CRISPR gRNA sequence
ctagggctgttggaacagat

SEQ ID NO: 228265 - DNA, 20 bp, Artificial
  CRISPR gRNA sequence
gggctgttggaacagatgac

SEQ ID NO: 228266 - DNA, 20 bp, Artificial
  CRISPR gRNA sequence
ttggaacagatgaccacaaa

SEQ ID NO: 228267 - DNA, 20 bp, Artificial
  CRISPR gRNA sequence
gaacagatgaccacaaactg

SEQ ID NO: 228268 - DNA, 20 bp, Artificial
  CRISPR gRNA sequence
ggtggcttaaacaatagcaa

SEQ ID NO: 228269 - DNA, 20 bp, Artificial
  CRISPR gRNA sequence
aaacaatagcaattcccttt

SEQ ID NO: 228270 - DNA, 20 bp, Artificial
  CRISPR gRNA sequence
aacaatagcaattccctttc

SEQ ID NO: 228271 - DNA, 20 bp, Artificial
  CRISPR gRNA sequence
cctttccatgctggaggcca

SEQ ID NO: 228272 - DNA, 20 bp, Artificial
  CRISPR gRNA sequence
tccatgctggaggccataag

SEQ ID NO: 228273 - DNA, 20 bp, Artificial
  CRISPR gRNA sequence
ccatgctggaggccataagt

SEQ ID NO: 228274 - DNA, 20 bp, Artificial
  CRISPR gRNA sequence
catgctggaggccataagtc

SEQ ID NO: 228275 - DNA, 20 bp, Artificial
  CRISPR gRNA sequence
gaggccataagtctgaaatc

SEQ ID NO: 228276 - DNA, 20 bp, Artificial
  CRISPR gRNA sequence
aaatcaggacgtcatcaggg

SEQ ID NO: 228277 - DNA, 20 bp, Artificial
  CRISPR gRNA sequence
cctctcaaggctgtatggaa

SEQ ID NO: 228278 - DNA, 20 bp, Artificial
  CRISPR gRNA sequence
tcaaggctgtatggaagaat

SEQ ID NO: 228279 - DNA, 20 bp, Artificial
  CRISPR gRNA sequence
aaggctgtatggaagaatcc

SEQ ID NO: 228280 - DNA, 20 bp, Artificial
  CRISPR gRNA sequence
tatggaagaatccatttctt

SEQ ID NO: 228281 - DNA, 20 bp, Artificial
  CRISPR gRNA sequence
cttggctcttctagcttctg

SEQ ID NO: 228282 - DNA, 20 bp, Artificial
  CRISPR gRNA sequence
ttggctcttctagcttctgg

SEQ ID NO: 228283 - DNA, 20 bp, Artificial
  CRISPR gRNA sequence
ggctcttctagcttctggaa

SEQ ID NO: 228284 - DNA, 20 bp, Artificial
  CRISPR gRNA sequence
gctcttctagcttctggaat

SEQ ID NO: 228285 - DNA, 20 bp, Artificial
  CRISPR gRNA sequence
ttctagcttctggaatttgc

SEQ ID NO: 228286 - DNA, 20 bp, Artificial
  CRISPR gRNA sequence
ctagcttctggaatttgctg

SEQ ID NO: 228287 - DNA, 20 bp, Artificial
  CRISPR gRNA sequence
tagcttctggaatttgctga

SEQ ID NO: 228288 - DNA, 20 bp, Artificial
  CRISPR gRNA sequence
gcttctggaatttgctgaag

SEQ ID NO: 228289 - DNA, 20 bp, Artificial
  CRISPR gRNA sequence
ctggaatttgctgaagaatg

SEQ ID NO: 228290 - DNA, 20 bp, Artificial
  CRISPR gRNA sequence
tggaatttgctgaagaatga

SEQ ID NO: 228291 - DNA, 20 bp, Artificial
  CRISPR gRNA sequence
gaatttgctgaagaatgaca

SEQ ID NO: 228292 - DNA, 20 bp, Artificial
  CRISPR gRNA sequence
gctgaagaatgacagtgttt

SEQ ID NO: 228293 - DNA, 20 bp, Artificial
  CRISPR gRNA sequence
ctgaagaatgacagtgttta

SEQ ID NO: 228294 - DNA, 20 bp, Artificial
  CRISPR gRNA sequence
aagaatgacagtgtttatca

SEQ ID NO: 228295 - DNA, 20 bp, Artificial
  CRISPR gRNA sequence
atcattccttagtttgcggc

SEQ ID NO: 228296 - DNA, 20 bp, Artificial
  CRISPR gRNA sequence
tcattccttagtttgcggca

SEQ ID NO: 228297 - DNA, 20 bp, Artificial
  CRISPR gRNA sequence
cttagtttgcggcagcataa

SEQ ID NO: 228298 - DNA, 20 bp, Artificial
  CRISPR gRNA sequence
agtttgcggcagcataactc

SEQ ID NO: 228299 - DNA, 20 bp, Artificial
  CRISPR gRNA sequence
gtttgcggcagcataactcc

SEQ ID NO: 228300 - DNA, 20 bp, Artificial
  CRISPR gRNA sequence
gcggcagcataactccaccc

SEQ ID NO: 228301 - DNA, 20 bp, Artificial
  CRISPR gRNA sequence
cggcagcataactccaccct

SEQ ID NO: 228302 - DNA, 20 bp, Artificial
  CRISPR gRNA sequence
caccctctgcctctctggtc

SEQ ID NO: 228303 - DNA, 20 bp, Artificial
  CRISPR gRNA sequence
tgcctctctggtcacattgc

SEQ ID NO: 228304 - DNA, 20 bp, Artificial
  CRISPR gRNA sequence
cctctctggtcacattgcct

SEQ ID NO: 228305 - DNA, 20 bp, Artificial
  CRISPR gRNA sequence
tctggtcacattgcctcctc

SEQ ID NO: 228306 - DNA, 20 bp, Artificial
  CRISPR gRNA sequence
tggtcacattgcctcctcct

SEQ ID NO: 228307 - DNA, 20 bp, Artificial
  CRISPR gRNA sequence
gtcacattgcctcctccttc

SEQ ID NO: 228308 - DNA, 20 bp, Artificial
  CRISPR gRNA sequence
cctcctccttcctctatgtc

SEQ ID NO: 228309 - DNA, 20 bp, Artificial
  CRISPR gRNA sequence
ctccttcctctatgtctttg

SEQ ID NO: 228310 - DNA, 20 bp, Artificial
  CRISPR gRNA sequence
cttcctctatgtctttgcct

SEQ ID NO: 228311 - DNA, 20 bp, Artificial
  CRISPR gRNA sequence
cctctatgtctttgcctctg

SEQ ID NO: 228312 - DNA, 20 bp, Artificial
  CRISPR gRNA sequence
ctctatgtctttgcctctgt

SEQ ID NO: 228313 - DNA, 20 bp, Artificial
  CRISPR gRNA sequence
tatgtctttgcctctgtgtt

SEQ ID NO: 228314 - DNA, 20 bp, Artificial
  CRISPR gRNA sequence
tgtctttgcctctgtgtttt

SEQ ID NO: 228315 - DNA, 20 bp, Artificial
  CRISPR gRNA sequence
tgcctctgtgtttttgttaa

SEQ ID NO: 228316 - DNA, 20 bp, Artificial
  CRISPR gRNA sequence
gcctctgtgtttttgttaaa

SEQ ID NO: 228317 - DNA, 20 bp, Artificial
  CRISPR gRNA sequence
cctctgtgtttttgttaaat

SEQ ID NO: 228318 - DNA, 20 bp, Artificial
  CRISPR gRNA sequence
tgtgtttttgttaaatctcc

SEQ ID NO: 228319 - DNA, 20 bp, Artificial
  CRISPR gRNA sequence
tgtttttgttaaatctccct

SEQ ID NO: 228320 - DNA, 20 bp, Artificial
  CRISPR gRNA sequence
ttgttaaatctccctcagcc

SEQ ID NO: 228321 - DNA, 20 bp, Artificial
  CRISPR gRNA sequence
tgttaaatctccctcagcct

SEQ ID NO: 228322 - DNA, 20 bp, Artificial
  CRISPR gRNA sequence
gttaaatctccctcagcctc

SEQ ID NO: 228323 - DNA, 20 bp, Artificial
  CRISPR gRNA sequence
ttaaatctccctcagcctct

SEQ ID NO: 228324 - DNA, 20 bp, Artificial
  CRISPR gRNA sequence
aatctccctcagcctctctc

SEQ ID NO: 228325 - DNA, 20 bp, Artificial
  CRISPR gRNA sequence
cctcagcctctctcttatga

SEQ ID NO: 228326 - DNA, 20 bp, Artificial
  CRISPR gRNA sequence
agcctctctcttatgagcac

SEQ ID NO: 228327 - DNA, 20 bp, Artificial
  CRISPR gRNA sequence
tctcttatgagcacatttgt

SEQ ID NO: 228328 - DNA, 20 bp, Artificial
  CRISPR gRNA sequence
tcttatgagcacatttgtca

SEQ ID NO: 228329 - DNA, 20 bp, Artificial
  CRISPR gRNA sequence
ttatgagcacatttgtcatt

SEQ ID NO: 228330 - DNA, 20 bp, Artificial
  CRISPR gRNA sequence
atgagcacatttgtcattgg

SEQ ID NO: 228331 - DNA, 20 bp, Artificial
  CRISPR gRNA sequence
tgagcacatttgtcattgga

SEQ ID NO: 228332 - DNA, 20 bp, Artificial
  CRISPR gRNA sequence
gtcattggaattagagccca

SEQ ID NO: 228333 - DNA, 20 bp, Artificial
  CRISPR gRNA sequence
tcattggaattagagcccac

SEQ ID NO: 228334 - DNA, 20 bp, Artificial
  CRISPR gRNA sequence
gaattagagcccactcatat

SEQ ID NO: 228335 - DNA, 20 bp, Artificial
  CRISPR gRNA sequence
gagcccactcatataatcca

SEQ ID NO: 228336 - DNA, 20 bp, Artificial
  CRISPR gRNA sequence
atataatccagggtaagctc

SEQ ID NO: 228337 - DNA, 20 bp, Artificial
  CRISPR gRNA sequence
ctcctttcagatccttaact

SEQ ID NO: 228338 - DNA, 20 bp, Artificial
  CRISPR gRNA sequence
ctttcagatccttaacttca

SEQ ID NO: 228339 - DNA, 20 bp, Artificial
  CRISPR gRNA sequence
tcagatccttaacttcatca

SEQ ID NO: 228340 - DNA, 20 bp, Artificial
  CRISPR gRNA sequence
cagatccttaacttcatcat

SEQ ID NO: 228341 - DNA, 20 bp, Artificial
  CRISPR gRNA sequence
agatccttaacttcatcata

SEQ ID NO: 228342 - DNA, 20 bp, Artificial
  CRISPR gRNA sequence
aacttcatcatatcttttgc

SEQ ID NO: 228343 - DNA, 20 bp, Artificial
  CRISPR gRNA sequence
acttcatcatatcttttgcc

SEQ ID NO: 228344 - DNA, 20 bp, Artificial
  CRISPR gRNA sequence
catcatatcttttgccatat

SEQ ID NO: 228345 - DNA, 20 bp, Artificial
  CRISPR gRNA sequence
atcatatcttttgccatata

SEQ ID NO: 228346 - DNA, 20 bp, Artificial
  CRISPR gRNA sequence
ttgccatataatgcagtatt

SEQ ID NO: 228347 - DNA, 20 bp, Artificial
  CRISPR gRNA sequence
tgccatataatgcagtattc

SEQ ID NO: 228348 - DNA, 20 bp, Artificial
  CRISPR gRNA sequence
gccatataatgcagtattca

SEQ ID NO: 228349 - DNA, 20 bp, Artificial
  CRISPR gRNA sequence
ccatataatgcagtattcac

SEQ ID NO: 228350 - DNA, 20 bp, Artificial
  CRISPR gRNA sequence
actcttttgctgtattaggt

SEQ ID NO: 228351 - DNA, 20 bp, Artificial
  CRISPR gRNA sequence
ttttgctgtattaggtaata

SEQ ID NO: 228352 - DNA, 20 bp, Artificial
  CRISPR gRNA sequence
ttgctgtattaggtaatatt

SEQ ID NO: 228353 - DNA, 20 bp, Artificial
  CRISPR gRNA sequence
tgctgtattaggtaatattc

SEQ ID NO: 228354 - DNA, 20 bp, Artificial
  CRISPR gRNA sequence
gctgtattaggtaatattca

SEQ ID NO: 228355 - DNA, 20 bp, Artificial
  CRISPR gRNA sequence
ctgtattaggtaatattcac

SEQ ID NO: 228356 - DNA, 20 bp, Artificial
  CRISPR gRNA sequence
tattaggtaatattcacagg

SEQ ID NO: 228357 - DNA, 20 bp, Artificial
  CRISPR gRNA sequence
ggtaatattcacaggtttta

SEQ ID NO: 228358 - DNA, 20 bp, Artificial
  CRISPR gRNA sequence
acaggttttagggattagga

SEQ ID NO: 228359 - DNA, 20 bp, Artificial
  CRISPR gRNA sequence
tagggattaggaggtagaaa

SEQ ID NO: 228360 - DNA, 20 bp, Artificial
  CRISPR gRNA sequence
agggattaggaggtagaaat

SEQ ID NO: 228361 - DNA, 20 bp, Artificial
  CRISPR gRNA sequence
gggattaggaggtagaaata

SEQ ID NO: 228362 - DNA, 20 bp, Artificial
  CRISPR gRNA sequence
ggaggtagaaataattttag

SEQ ID NO: 228363 - DNA, 20 bp, Artificial
  CRISPR gRNA sequence
tagggccatcattcaactca

SEQ ID NO: 228364 - DNA, 20 bp, Artificial
  CRISPR gRNA sequence
agggccatcattcaactcac

SEQ ID NO: 228365 - DNA, 20 bp, Artificial
  CRISPR gRNA sequence
gggccatcattcaactcact

SEQ ID NO: 228366 - DNA, 20 bp, Artificial
  CRISPR gRNA sequence
aactcactacagaggcaaac

SEQ ID NO: 228367 - DNA, 20 bp, Artificial
  CRISPR gRNA sequence
actacagaggcaaacttcat

SEQ ID NO: 228368 - DNA, 20 bp, Artificial
  CRISPR gRNA sequence
cagaggcaaacttcattggc

SEQ ID NO: 228369 - DNA, 20 bp, Artificial
  CRISPR gRNA sequence
cattggccaagacatgaaag

SEQ ID NO: 228370 - DNA, 20 bp, Artificial
  CRISPR gRNA sequence
attggccaagacatgaaagt

SEQ ID NO: 228371 - DNA, 20 bp, Artificial
  CRISPR gRNA sequence
gccaagacatgaaagtagaa

SEQ ID NO: 228372 - DNA, 20 bp, Artificial
  CRISPR gRNA sequence
gaaattggcagttgcatttg

SEQ ID NO: 228373 - DNA, 20 bp, Artificial
  CRISPR gRNA sequence
gcagttgcatttggaggatg

SEQ ID NO: 228374 - DNA, 20 bp, Artificial
  CRISPR gRNA sequence
catttggaggatgggaatgt

SEQ ID NO: 228375 - DNA, 20 bp, Artificial
  CRISPR gRNA sequence
ggaggatgggaatgtgagtg

SEQ ID NO: 228376 - DNA, 20 bp, Artificial
  CRISPR gRNA sequence
gaggatgggaatgtgagtgg

SEQ ID NO: 228377 - DNA, 20 bp, Artificial
  CRISPR gRNA sequence
ggactcaacctaataactat

SEQ ID NO: 228378 - DNA, 20 bp, Artificial
  CRISPR gRNA sequence
aacctaataactatagcaca

SEQ ID NO: 228379 - DNA, 20 bp, Artificial
  CRISPR gRNA sequence
ataactatagcacaccatcg

SEQ ID NO: 228380 - DNA, 20 bp, Artificial
  CRISPR gRNA sequence
tagcacaccatcgtttgtgg

SEQ ID NO: 228381 - DNA, 20 bp, Artificial
  CRISPR gRNA sequence
gtggagaagaatgcagtgca

SEQ ID NO: 228382 - DNA, 20 bp, Artificial
  CRISPR gRNA sequence
tggagaagaatgcagtgcag

SEQ ID NO: 228383 - DNA, 20 bp, Artificial
  CRISPR gRNA sequence
aggaacatgggcttggcagc

SEQ ID NO: 228384 - DNA, 20 bp, Artificial
  CRISPR gRNA sequence
ggaacatgggcttggcagct

SEQ ID NO: 228385 - DNA, 20 bp, Artificial
  CRISPR gRNA sequence
ggcagctctattggtatctg

SEQ ID NO: 228386 - DNA, 20 bp, Artificial
  CRISPR gRNA sequence
gcagctctattggtatctga

SEQ ID NO: 228387 - DNA, 20 bp, Artificial
  CRISPR gRNA sequence
tattggtatctgaagttagt

SEQ ID NO: 228388 - DNA, 20 bp, Artificial
  CRISPR gRNA sequence
ttggtatctgaagttagtga

SEQ ID NO: 228389 - DNA, 20 bp, Artificial
  CRISPR gRNA sequence
gtatctgaagttagtgaaga

SEQ ID NO: 228390 - DNA, 20 bp, Artificial
  CRISPR gRNA sequence
aagttagtgaagacagcagg

SEQ ID NO: 228391 - DNA, 20 bp, Artificial
  CRISPR gRNA sequence
gtgaagacagcaggaagaag

SEQ ID NO: 228392 - DNA, 20 bp, Artificial
  CRISPR gRNA sequence
agaagacaacttgaaggaac

SEQ ID NO: 228393 - DNA, 20 bp, Artificial
  CRISPR gRNA sequence
gaaggaacaattgatttgac

SEQ ID NO: 228394 - DNA, 20 bp, Artificial
  CRISPR gRNA sequence
aaggaacaattgatttgact

SEQ ID NO: 228395 - DNA, 20 bp, Artificial
  CRISPR gRNA sequence
atttgactttggggcatact

SEQ ID NO: 228396 - DNA, 20 bp, Artificial
  CRISPR gRNA sequence
gactttggggcatactgaat

SEQ ID NO: 228397 - DNA, 20 bp, Artificial
  CRISPR gRNA sequence
actttggggcatactgaata

SEQ ID NO: 228398 - DNA, 20 bp, Artificial
  CRISPR gRNA sequence
tggggcatactgaatacagc

SEQ ID NO: 228399 - DNA, 20 bp, Artificial
  CRISPR gRNA sequence
ggggcatactgaatacagca

SEQ ID NO: 228400 - DNA, 20 bp, Artificial
  CRISPR gRNA sequence
gggcatactgaatacagcag

SEQ ID NO: 228401 - DNA, 20 bp, Artificial
  CRISPR gRNA sequence
aatacagcagatgaagggaa

SEQ ID NO: 228402 - DNA, 20 bp, Artificial
  CRISPR gRNA sequence
ctcactggaattctgtaaac

SEQ ID NO: 228403 - DNA, 20 bp, Artificial
  CRISPR gRNA sequence
tcactggaattctgtaaact

SEQ ID NO: 228404 - DNA, 20 bp, Artificial
  CRISPR gRNA sequence
actggaattctgtaaactag

SEQ ID NO: 228405 - DNA, 20 bp, Artificial
  CRISPR gRNA sequence
gaattctgtaaactagttaa

SEQ ID NO: 228406 - DNA, 20 bp, Artificial
  CRISPR gRNA sequence
tgtaaactagttaagaagga

SEQ ID NO: 228407 - DNA, 20 bp, Artificial
  CRISPR gRNA sequence
taaactagttaagaaggagg

SEQ ID NO: 228408 - DNA, 20 bp, Artificial
  CRISPR gRNA sequence
gttaagaaggaggcagagcc

SEQ ID NO: 228409 - DNA, 20 bp, Artificial
  CRISPR gRNA sequence
agaaggaggcagagccaatt

SEQ ID NO: 228410 - DNA, 20 bp, Artificial
  CRISPR gRNA sequence
aaggtttcagcatgttgaaa

SEQ ID NO: 228411 - DNA, 20 bp, Artificial
  CRISPR gRNA sequence
cagcatgttgaaacttaaat

SEQ ID NO: 228412 - DNA, 20 bp, Artificial
  CRISPR gRNA sequence
agcatgttgaaacttaaatg

SEQ ID NO: 228413 - DNA, 20 bp, Artificial
  CRISPR gRNA sequence
aaacttaaatgttgagattt

SEQ ID NO: 228414 - DNA, 20 bp, Artificial
  CRISPR gRNA sequence
aaatgttgagatttagatgt

SEQ ID NO: 228415 - DNA, 20 bp, Artificial
  CRISPR gRNA sequence
aatgttgagatttagatgtc

SEQ ID NO: 228416 - DNA, 20 bp, Artificial
  CRISPR gRNA sequence
agatttagatgtcttaagtt

SEQ ID NO: 228417 - DNA, 20 bp, Artificial
  CRISPR gRNA sequence
agatgtcttaagtttggtct

SEQ ID NO: 228418 - DNA, 20 bp, Artificial
  CRISPR gRNA sequence
gatgtcttaagtttggtctt

SEQ ID NO: 228419 - DNA, 20 bp, Artificial
  CRISPR gRNA sequence
aagtttggtcttaatcaaaa

SEQ ID NO: 228420 - DNA, 20 bp, Artificial
  CRISPR gRNA sequence
agtttggtcttaatcaaaaa

SEQ ID NO: 228421 - DNA, 20 bp, Artificial
  CRISPR gRNA sequence
ggtcttaatcaaaaaatagt

SEQ ID NO: 228422 - DNA, 20 bp, Artificial
  CRISPR gRNA sequence
gtcttaatcaaaaaatagtc

SEQ ID NO: 228423 - DNA, 20 bp, Artificial
  CRISPR gRNA sequence
aatcaaaaaatagtcactaa

SEQ ID NO: 228424 - DNA, 20 bp, Artificial
  CRISPR gRNA sequence
atcaaaaaatagtcactaat

SEQ ID NO: 228425 - DNA, 20 bp, Artificial
  CRISPR gRNA sequence
attttgtgtgaggttttcag

SEQ ID NO: 228426 - DNA, 20 bp, Artificial
  CRISPR gRNA sequence
tgtgtgaggttttcagggaa

SEQ ID NO: 228427 - DNA, 20 bp, Artificial
  CRISPR gRNA sequence
gtgtgaggttttcagggaaa

SEQ ID NO: 228428 - DNA, 20 bp, Artificial
  CRISPR gRNA sequence
tgtgaggttttcagggaaac

SEQ ID NO: 228429 - DNA, 20 bp, Artificial
  CRISPR gRNA sequence
tcagggaaacgtatattttt

SEQ ID NO: 228430 - DNA, 20 bp, Artificial
  CRISPR gRNA sequence
cagggaaacgtatattttta

SEQ ID NO: 228431 - DNA, 20 bp, Artificial
  CRISPR gRNA sequence
agggaaacgtatatttttaa

SEQ ID NO: 228432 - DNA, 20 bp, Artificial
  CRISPR gRNA sequence
ttaaaattttcacagttgtc

SEQ ID NO: 228433 - DNA, 20 bp, Artificial
  CRISPR gRNA sequence
taaaattttcacagttgtca

SEQ ID NO: 228434 - DNA, 20 bp, Artificial
  CRISPR gRNA sequence
aaaattttcacagttgtcaa

SEQ ID NO: 228435 - DNA, 20 bp, Artificial
  CRISPR gRNA sequence
aaattttcacagttgtcaag

SEQ ID NO: 228436 - DNA, 20 bp, Artificial
  CRISPR gRNA sequence
tcacagttgtcaagcacaga

SEQ ID NO: 228437 - DNA, 20 bp, Artificial
  CRISPR gRNA sequence
cacagttgtcaagcacagaa

SEQ ID NO: 228438 - DNA, 20 bp, Artificial
  CRISPR gRNA sequence
acagttgtcaagcacagaat

SEQ ID NO: 228439 - DNA, 20 bp, Artificial
  CRISPR gRNA sequence
tcaagcacagaatttagatt

SEQ ID NO: 228440 - DNA, 20 bp, Artificial
  CRISPR gRNA sequence
agattagtacatttaaaaag

SEQ ID NO: 228441 - DNA, 20 bp, Artificial
  CRISPR gRNA sequence
gattagtacatttaaaaagt

SEQ ID NO: 228442 - DNA, 20 bp, Artificial
  CRISPR gRNA sequence
gtacatttaaaaagtatgta

SEQ ID NO: 228443 - DNA, 20 bp, Artificial
  CRISPR gRNA sequence
aaaaagtatgtaggaaaata

SEQ ID NO: 228444 - DNA, 20 bp, Artificial
  CRISPR gRNA sequence
aaaagtatgtaggaaaatat

SEQ ID NO: 228445 - DNA, 20 bp, Artificial
  CRISPR gRNA sequence
taaatgtttttatttattga

SEQ ID NO: 228446 - DNA, 20 bp, Artificial
  CRISPR gRNA sequence
aaatgtttttatttattgac

SEQ ID NO: 228447 - DNA, 20 bp, Artificial
  CRISPR gRNA sequence
aatgtttttatttattgaca

SEQ ID NO: 228448 - DNA, 20 bp, Artificial
  CRISPR gRNA sequence
ttatttattgacaggtgaat

SEQ ID NO: 228449 - DNA, 20 bp, Artificial
  CRISPR gRNA sequence
tatttattgacaggtgaata

SEQ ID NO: 228450 - DNA, 20 bp, Artificial
  CRISPR gRNA sequence
atttattgacaggtgaatat

SEQ ID NO: 228451 - DNA, 20 bp, Artificial
  CRISPR gRNA sequence
tttattgacaggtgaatatt

SEQ ID NO: 228452 - DNA, 20 bp, Artificial
  CRISPR gRNA sequence
attgacaggtgaatattcat

SEQ ID NO: 228453 - DNA, 20 bp, Artificial
  CRISPR gRNA sequence
ttgacaggtgaatattcatt

SEQ ID NO: 228454 - DNA, 20 bp, Artificial
  CRISPR gRNA sequence
acaggtgaatattcattaaa

SEQ ID NO: 228455 - DNA, 20 bp, Artificial
  CRISPR gRNA sequence
attaaagaatgctactggcc

SEQ ID NO: 228456 - DNA, 20 bp, Artificial
  CRISPR gRNA sequence
aagaatgctactggccttgg

SEQ ID NO: 228457 - DNA, 20 bp, Artificial
  CRISPR gRNA sequence
ctggccttggtttaattgtg

SEQ ID NO: 228458 - DNA, 20 bp, Artificial
  CRISPR gRNA sequence
gccttggtttaattgtgact

SEQ ID NO: 228459 - DNA, 20 bp, Artificial
  CRISPR gRNA sequence
ggtttaattgtgacttctac

SEQ ID NO: 228460 - DNA, 20 bp, Artificial
  CRISPR gRNA sequence
gtttaattgtgacttctaca

SEQ ID NO: 228461 - DNA, 20 bp, Artificial
  CRISPR gRNA sequence
aattgtgacttctacaggga

SEQ ID NO: 228462 - DNA, 20 bp, Artificial
  CRISPR gRNA sequence
attgtgacttctacagggat

SEQ ID NO: 228463 - DNA, 20 bp, Artificial
  CRISPR gRNA sequence
tgacttctacagggatatta

SEQ ID NO: 228464 - DNA, 20 bp, Artificial
  CRISPR gRNA sequence
ctacagggatattaatatta

SEQ ID NO: 228465 - DNA, 20 bp, Artificial
  CRISPR gRNA sequence
tacagggatattaatattac

SEQ ID NO: 228466 - DNA, 20 bp, Artificial
  CRISPR gRNA sequence
cagggatattaatattactt

SEQ ID NO: 228467 - DNA, 20 bp, Artificial
  CRISPR gRNA sequence
atattacttcactactatgt

SEQ ID NO: 228468 - DNA, 20 bp, Artificial
  CRISPR gRNA sequence
cttcactactatgtgtttag

SEQ ID NO: 228469 - DNA, 20 bp, Artificial
  CRISPR gRNA sequence
cactactatgtgtttagtac

SEQ ID NO: 228470 - DNA, 20 bp, Artificial
  CRISPR gRNA sequence
actactatgtgtttagtaca

SEQ ID NO: 228471 - DNA, 20 bp, Artificial
  CRISPR gRNA sequence
ctatgtgtttagtacaggtg

SEQ ID NO: 228472 - DNA, 20 bp, Artificial
  CRISPR gRNA sequence
tgtgtttagtacaggtgagt

SEQ ID NO: 228473 - DNA, 20 bp, Artificial
  CRISPR gRNA sequence
agtacaggtgagttttcatt

SEQ ID NO: 228474 - DNA, 20 bp, Artificial
  CRISPR gRNA sequence
gtacaggtgagttttcattg

SEQ ID NO: 228475 - DNA, 20 bp, Artificial
  CRISPR gRNA sequence
tcattgttacagtatgattt

SEQ ID NO: 228476 - DNA, 20 bp, Artificial
  CRISPR gRNA sequence
cattgttacagtatgatttt

SEQ ID NO: 228477 - DNA, 20 bp, Artificial
  CRISPR gRNA sequence
attgttacagtatgattttg

SEQ ID NO: 228478 - DNA, 20 bp, Artificial
  CRISPR gRNA sequence
ttacagtatgattttgtcta

SEQ ID NO: 228479 - DNA, 20 bp, Artificial
  CRISPR gRNA sequence
cagtatgattttgtctacct

SEQ ID NO: 228480 - DNA, 20 bp, Artificial
  CRISPR gRNA sequence
tgtctacctttttcatttac

SEQ ID NO: 228481 - DNA, 20 bp, Artificial
  CRISPR gRNA sequence
gtctacctttttcatttaca

SEQ ID NO: 228482 - DNA, 20 bp, Artificial
  CRISPR gRNA sequence
tctacctttttcatttacaa

SEQ ID NO: 228483 - DNA, 20 bp, Artificial
  CRISPR gRNA sequence
cctttttcatttacaaaaca

SEQ ID NO: 228484 - DNA, 20 bp, Artificial
  CRISPR gRNA sequence
tttcatttacaaaacagcag

SEQ ID NO: 228485 - DNA, 20 bp, Artificial
  CRISPR gRNA sequence
ttcatttacaaaacagcagt

SEQ ID NO: 228486 - DNA, 20 bp, Artificial
  CRISPR gRNA sequence
tcatttacaaaacagcagtt

SEQ ID NO: 228487 - DNA, 20 bp, Artificial
  CRISPR gRNA sequence
catttacaaaacagcagttt

SEQ ID NO: 228488 - DNA, 20 bp, Artificial
  CRISPR gRNA sequence
atttacaaaacagcagtttt

SEQ ID NO: 228489 - DNA, 20 bp, Artificial
  CRISPR gRNA sequence
acaaaacagcagttttggtg

SEQ ID NO: 228490 - DNA, 20 bp, Artificial
  CRISPR gRNA sequence
caaaacagcagttttggtga

SEQ ID NO: 228491 - DNA, 20 bp, Artificial
  CRISPR gRNA sequence
tggtgaaaatgctcatataa

SEQ ID NO: 228492 - DNA, 20 bp, Artificial
  CRISPR gRNA sequence
ggtgaaaatgctcatataaa

SEQ ID NO: 228493 - DNA, 20 bp, Artificial
  CRISPR gRNA sequence
gtgaaaatgctcatataaat

SEQ ID NO: 228494 - DNA, 20 bp, Artificial
  CRISPR gRNA sequence
atataaattttttacaactc

SEQ ID NO: 228495 - DNA, 20 bp, Artificial
  CRISPR gRNA sequence
tttacaactcaataagagta

SEQ ID NO: 228496 - DNA, 20 bp, Artificial
  CRISPR gRNA sequence
ttacaactcaataagagtag

SEQ ID NO: 228497 - DNA, 20 bp, Artificial
  CRISPR gRNA sequence
tacaactcaataagagtagg

SEQ ID NO: 228498 - DNA, 20 bp, Artificial
  CRISPR gRNA sequence
acaactcaataagagtaggt

SEQ ID NO: 228499 - DNA, 20 bp, Artificial
  CRISPR gRNA sequence
caactcaataagagtaggtt

SEQ ID NO: 228500 - DNA, 20 bp, Artificial
  CRISPR gRNA sequence
aataagagtaggtttattaa

SEQ ID NO: 228501 - DNA, 20 bp, Artificial
  CRISPR gRNA sequence
attaaaagatttttcatgct

SEQ ID NO: 228502 - DNA, 20 bp, Artificial
  CRISPR gRNA sequence
ttaaaagatttttcatgcta

SEQ ID NO: 228503 - DNA, 20 bp, Artificial
  CRISPR gRNA sequence
aaagatttttcatgctattc

SEQ ID NO: 228504 - DNA, 20 bp, Artificial
  CRISPR gRNA sequence
ttcatgctattcttagtgac

SEQ ID NO: 228505 - DNA, 20 bp, Artificial
  CRISPR gRNA sequence
tcatgctattcttagtgaca

SEQ ID NO: 228506 - DNA, 20 bp, Artificial
  CRISPR gRNA sequence
catgctattcttagtgacat

SEQ ID NO: 228507 - DNA, 20 bp, Artificial
  CRISPR gRNA sequence
atgctattcttagtgacatt

SEQ ID NO: 228508 - DNA, 20 bp, Artificial
  CRISPR gRNA sequence
ttcttagtgacattttccca

SEQ ID NO: 228509 - DNA, 20 bp, Artificial
  CRISPR gRNA sequence
ttagtgacattttcccattc

SEQ ID NO: 228510 - DNA, 20 bp, Artificial
  CRISPR gRNA sequence
agtgacattttcccattcat

SEQ ID NO: 228511 - DNA, 20 bp, Artificial
  CRISPR gRNA sequence
gtgacattttcccattcata

SEQ ID NO: 228512 - DNA, 20 bp, Artificial
  CRISPR gRNA sequence
tcccattcatattaatttta

SEQ ID NO: 228513 - DNA, 20 bp, Artificial
  CRISPR gRNA sequence
cccattcatattaattttaa

SEQ ID NO: 228514 - DNA, 20 bp, Artificial
  CRISPR gRNA sequence
ccattcatattaattttaag

SEQ ID NO: 228515 - DNA, 20 bp, Artificial
  CRISPR gRNA sequence
atattaattttaaggttatt

SEQ ID NO: 228516 - DNA, 20 bp, Artificial
  CRISPR gRNA sequence
attttaaggttattctaggt

SEQ ID NO: 228517 - DNA, 20 bp, Artificial
  CRISPR gRNA sequence
taaggttattctaggttagc

SEQ ID NO: 228518 - DNA, 20 bp, Artificial
  CRISPR gRNA sequence
aaggttattctaggttagct

SEQ ID NO: 228519 - DNA, 20 bp, Artificial
  CRISPR gRNA sequence
aggttattctaggttagctg

SEQ ID NO: 228520 - DNA, 20 bp, Artificial
  CRISPR gRNA sequence
ttctaggttagctgttttgt

SEQ ID NO: 228521 - DNA, 20 bp, Artificial
  CRISPR gRNA sequence
taggttagctgttttgtaaa

SEQ ID NO: 228522 - DNA, 20 bp, Artificial
  CRISPR gRNA sequence
ggttagctgttttgtaaaaa

SEQ ID NO: 228523 - DNA, 20 bp, Artificial
  CRISPR gRNA sequence
gctgttttgtaaaaagtgac

SEQ ID NO: 228524 - DNA, 20 bp, Artificial
  CRISPR gRNA sequence
ttttgtaaaaagtgactttc

SEQ ID NO: 228525 - DNA, 20 bp, Artificial
  CRISPR gRNA sequence
tgtaaaaagtgactttcata

SEQ ID NO: 228526 - DNA, 20 bp, Artificial
  CRISPR gRNA sequence
gtaaaaagtgactttcatat

SEQ ID NO: 228527 - DNA, 20 bp, Artificial
  CRISPR gRNA sequence
taaaaagtgactttcatatg

SEQ ID NO: 228528 - DNA, 20 bp, Artificial
  CRISPR gRNA sequence
tcatatgtatttgatgccaa

SEQ ID NO: 228529 - DNA, 20 bp, Artificial
  CRISPR gRNA sequence
catatgtatttgatgccaat

SEQ ID NO: 228530 - DNA, 20 bp, Artificial
  CRISPR gRNA sequence
atatgtatttgatgccaatc

SEQ ID NO: 228531 - DNA, 20 bp, Artificial
  CRISPR gRNA sequence
gatgccaatcagcataattt

SEQ ID NO: 228532 - DNA, 20 bp, Artificial
  CRISPR gRNA sequence
atgccaatcagcataatttt

SEQ ID NO: 228533 - DNA, 20 bp, Artificial
  CRISPR gRNA sequence
taaattatgccatataactt

SEQ ID NO: 228534 - DNA, 20 bp, Artificial
  CRISPR gRNA sequence
aaattatgccatataacttc

SEQ ID NO: 228535 - DNA, 20 bp, Artificial
  CRISPR gRNA sequence
aattatgccatataacttct

SEQ ID NO: 228536 - DNA, 20 bp, Artificial
  CRISPR gRNA sequence
tgccatataacttcttaatg

SEQ ID NO: 228537 - DNA, 20 bp, Artificial
  CRISPR gRNA sequence
cttaatgattattttcatat

SEQ ID NO: 228538 - DNA, 20 bp, Artificial
  CRISPR gRNA sequence
ttaatgattattttcatatt

SEQ ID NO: 228539 - DNA, 20 bp, Artificial
  CRISPR gRNA sequence
aatgattattttcatattct

SEQ ID NO: 228540 - DNA, 20 bp, Artificial
  CRISPR gRNA sequence
atgattattttcatattcta

SEQ ID NO: 228541 - DNA, 20 bp, Artificial
  CRISPR gRNA sequence
ttttcatattctaatttcag

SEQ ID NO: 228542 - DNA, 20 bp, Artificial
  CRISPR gRNA sequence
tcatattctaatttcagttt

SEQ ID NO: 228543 - DNA, 20 bp, Artificial
  CRISPR gRNA sequence
catattctaatttcagtttt

SEQ ID NO: 228544 - DNA, 20 bp, Artificial
  CRISPR gRNA sequence
atattctaatttcagttttt

SEQ ID NO: 228545 - DNA, 20 bp, Artificial
  CRISPR gRNA sequence
taatttcagttttttgaagt

SEQ ID NO: 228546 - DNA, 20 bp, Artificial
  CRISPR gRNA sequence
atttcagttttttgaagtta

SEQ ID NO: 228547 - DNA, 20 bp, Artificial
  CRISPR gRNA sequence
cagttttttgaagttataag

SEQ ID NO: 228548 - DNA, 20 bp, Artificial
  CRISPR gRNA sequence
agttttttgaagttataagt

SEQ ID NO: 228549 - DNA, 20 bp, Artificial
  CRISPR gRNA sequence
tttgaagttataagtggatg

SEQ ID NO: 228550 - DNA, 20 bp, Artificial
  CRISPR gRNA sequence
ttgaagttataagtggatgt

SEQ ID NO: 228551 - DNA, 20 bp, Artificial
  CRISPR gRNA sequence
tgaagttataagtggatgtt

SEQ ID NO: 228552 - DNA, 20 bp, Artificial
  CRISPR gRNA sequence
gaagttataagtggatgtta

SEQ ID NO: 228553 - DNA, 20 bp, Artificial
  CRISPR gRNA sequence
aagttataagtggatgttaa

SEQ ID NO: 228554 - DNA, 20 bp, Artificial
  CRISPR gRNA sequence
taagtggatgttaaacgcag

SEQ ID NO: 228555 - DNA, 20 bp, Artificial
  CRISPR gRNA sequence
aacgcagtctttctcttctt

SEQ ID NO: 228556 - DNA, 20 bp, Artificial
  CRISPR gRNA sequence
tctcttcttttgctaagctt

SEQ ID NO: 228557 - DNA, 20 bp, Artificial
  CRISPR gRNA sequence
ctcttcttttgctaagcttc

SEQ ID NO: 228558 - DNA, 20 bp, Artificial
  CRISPR gRNA sequence
tcttcttttgctaagcttct

SEQ ID NO: 228559 - DNA, 20 bp, Artificial
  CRISPR gRNA sequence
ttcttttgctaagcttctgc

SEQ ID NO: 228560 - DNA, 20 bp, Artificial
  CRISPR gRNA sequence
cttttgctaagcttctgctt

SEQ ID NO: 228561 - DNA, 20 bp, Artificial
  CRISPR gRNA sequence
ttttgctaagcttctgcttc

SEQ ID NO: 228562 - DNA, 20 bp, Artificial
  CRISPR gRNA sequence
ttgctaagcttctgcttctg

SEQ ID NO: 228563 - DNA, 20 bp, Artificial
  CRISPR gRNA sequence
tgctaagcttctgcttctgc

SEQ ID NO: 228564 - DNA, 20 bp, Artificial
  CRISPR gRNA sequence
gctaagcttctgcttctgca

SEQ ID NO: 228565 - DNA, 20 bp, Artificial
  CRISPR gRNA sequence
ctaagcttctgcttctgcat

SEQ ID NO: 228566 - DNA, 20 bp, Artificial
  CRISPR gRNA sequence
agcttctgcttctgcattaa

SEQ ID NO: 228567 - DNA, 20 bp, Artificial
  CRISPR gRNA sequence
ctgcttctgcattaagaaga

SEQ ID NO: 228568 - DNA, 20 bp, Artificial
  CRISPR gRNA sequence
tgcttctgcattaagaagac

SEQ ID NO: 228569 - DNA, 20 bp, Artificial
  CRISPR gRNA sequence
cttctgcattaagaagactg

SEQ ID NO: 228570 - DNA, 20 bp, Artificial
  CRISPR gRNA sequence
ctgcattaagaagactggtt

SEQ ID NO: 228571 - DNA, 20 bp, Artificial
  CRISPR gRNA sequence
tgcattaagaagactggttc

SEQ ID NO: 228572 - DNA, 20 bp, Artificial
  CRISPR gRNA sequence
cattaagaagactggttcta

SEQ ID NO: 228573 - DNA, 20 bp, Artificial
  CRISPR gRNA sequence
agaagactggttctataaaa

SEQ ID NO: 228574 - DNA, 20 bp, Artificial
  CRISPR gRNA sequence
gttctataaaatggaattat

SEQ ID NO: 228575 - DNA, 20 bp, Artificial
  CRISPR gRNA sequence
tataaaatggaattatgaat

SEQ ID NO: 228576 - DNA, 20 bp, Artificial
  CRISPR gRNA sequence
taaaatggaattatgaatca

SEQ ID NO: 228577 - DNA, 20 bp, Artificial
  CRISPR gRNA sequence
tgaatcacaaatagtagaaa

SEQ ID NO: 228578 - DNA, 20 bp, Artificial
  CRISPR gRNA sequence
gttttaattattagcaaacc

SEQ ID NO: 228579 - DNA, 20 bp, Artificial
  CRISPR gRNA sequence
ttttaattattagcaaacct

SEQ ID NO: 228580 - DNA, 20 bp, Artificial
  CRISPR gRNA sequence
taattattagcaaaccttaa

SEQ ID NO: 228581 - DNA, 20 bp, Artificial
  CRISPR gRNA sequence
aattattagcaaaccttaat

SEQ ID NO: 228582 - DNA, 20 bp, Artificial
  CRISPR gRNA sequence
attattagcaaaccttaata

SEQ ID NO: 228583 - DNA, 20 bp, Artificial
  CRISPR gRNA sequence
ttagcaaaccttaatactgt

SEQ ID NO: 228584 - DNA, 20 bp, Artificial
  CRISPR gRNA sequence
gcaaaccttaatactgtagt

SEQ ID NO: 228585 - DNA, 20 bp, Artificial
  CRISPR gRNA sequence
aatactgtagttttaagaga

SEQ ID NO: 228586 - DNA, 20 bp, Artificial
  CRISPR gRNA sequence
atactgtagttttaagagat

SEQ ID NO: 228587 - DNA, 20 bp, Artificial
  CRISPR gRNA sequence
tagttttaagagatggtatg

SEQ ID NO: 228588 - DNA, 20 bp, Artificial
  CRISPR gRNA sequence
taagagatggtatggaaatc

SEQ ID NO: 228589 - DNA, 20 bp, Artificial
  CRISPR gRNA sequence
aagagatggtatggaaatcc

SEQ ID NO: 228590 - DNA, 20 bp, Artificial
  CRISPR gRNA sequence
agagatggtatggaaatcca

SEQ ID NO: 228591 - DNA, 20 bp, Artificial
  CRISPR gRNA sequence
taatcagtatcattttcact

SEQ ID NO: 228592 - DNA, 20 bp, Artificial
  CRISPR gRNA sequence
tcactgcattttgaaagtag

SEQ ID NO: 228593 - DNA, 20 bp, Artificial
  CRISPR gRNA sequence
cactgcattttgaaagtaga

SEQ ID NO: 228594 - DNA, 20 bp, Artificial
  CRISPR gRNA sequence
actgcattttgaaagtagat

SEQ ID NO: 228595 - DNA, 20 bp, Artificial
  CRISPR gRNA sequence
cattttgaaagtagatcact

SEQ ID NO: 228596 - DNA, 20 bp, Artificial
  CRISPR gRNA sequence
tgaaagtagatcactaccat

SEQ ID NO: 228597 - DNA, 20 bp, Artificial
  CRISPR gRNA sequence
gaaagtagatcactaccata

SEQ ID NO: 228598 - DNA, 20 bp, Artificial
  CRISPR gRNA sequence
aaagtagatcactaccatat

SEQ ID NO: 228599 - DNA, 20 bp, Artificial
  CRISPR gRNA sequence
ccatatttagttattactat

SEQ ID NO: 228600 - DNA, 20 bp, Artificial
  CRISPR gRNA sequence
agttattactattaaagagt

SEQ ID NO: 228601 - DNA, 20 bp, Artificial
  CRISPR gRNA sequence
gttattactattaaagagtc

SEQ ID NO: 228602 - DNA, 20 bp, Artificial
  CRISPR gRNA sequence
ttactattaaagagtcacat

SEQ ID NO: 228603 - DNA, 20 bp, Artificial
  CRISPR gRNA sequence
ctattaaagagtcacattta

SEQ ID NO: 228604 - DNA, 20 bp, Artificial
  CRISPR gRNA sequence
ttaaagagtcacatttaaca

SEQ ID NO: 228605 - DNA, 20 bp, Artificial
  CRISPR gRNA sequence
aagagtcacatttaacactt

SEQ ID NO: 228606 - DNA, 20 bp, Artificial
  CRISPR gRNA sequence
aacacttggtcttagagcct

SEQ ID NO: 228607 - DNA, 20 bp, Artificial
  CRISPR gRNA sequence
acacttggtcttagagccta

SEQ ID NO: 228608 - DNA, 20 bp, Artificial
  CRISPR gRNA sequence
ggtcttagagcctatctctg

SEQ ID NO: 228609 - DNA, 20 bp, Artificial
  CRISPR gRNA sequence
gtcttagagcctatctctgg

SEQ ID NO: 228610 - DNA, 20 bp, Artificial
  CRISPR gRNA sequence
agagcctatctctggctcgt

SEQ ID NO: 228611 - DNA, 20 bp, Artificial
  CRISPR gRNA sequence
gagcctatctctggctcgtt

SEQ ID NO: 228612 - DNA, 20 bp, Artificial
  CRISPR gRNA sequence
tctctggctcgttgtacatt

SEQ ID NO: 228613 - DNA, 20 bp, Artificial
  CRISPR gRNA sequence
tggctcgttgtacattggaa

SEQ ID NO: 228614 - DNA, 20 bp, Artificial
  CRISPR gRNA sequence
gctcgttgtacattggaaag

SEQ ID NO: 228615 - DNA, 20 bp, Artificial
  CRISPR gRNA sequence
gttgtacattggaaaggtat

SEQ ID NO: 228616 - DNA, 20 bp, Artificial
  CRISPR gRNA sequence
tacattggaaaggtattagt

SEQ ID NO: 228617 - DNA, 20 bp, Artificial
  CRISPR gRNA sequence
gaaaggtattagtttgttat

SEQ ID NO: 228618 - DNA, 20 bp, Artificial
  CRISPR gRNA sequence
gtttgttataaaatgacatc

SEQ ID NO: 228619 - DNA, 20 bp, Artificial
  CRISPR gRNA sequence
gttataaaatgacatctaga

SEQ ID NO: 228620 - DNA, 20 bp, Artificial
  CRISPR gRNA sequence
ttataaaatgacatctagag

SEQ ID NO: 228621 - DNA, 20 bp, Artificial
  CRISPR gRNA sequence
taaaatgacatctagagata

SEQ ID NO: 228622 - DNA, 20 bp, Artificial
  CRISPR gRNA sequence
gagatagagagcatgatgtt

SEQ ID NO: 228623 - DNA, 20 bp, Artificial
  CRISPR gRNA sequence
acagtcaggtatttgcataa

SEQ ID NO: 228624 - DNA, 20 bp, Artificial
  CRISPR gRNA sequence
cagtcaggtatttgcataat

SEQ ID NO: 228625 - DNA, 20 bp, Artificial
  CRISPR gRNA sequence
gcataatggttccctcagca

SEQ ID NO: 228626 - DNA, 20 bp, Artificial
  CRISPR gRNA sequence
cataatggttccctcagcaa

SEQ ID NO: 228627 - DNA, 20 bp, Artificial
  CRISPR gRNA sequence
cctcagcaagagcaattcca

SEQ ID NO: 228628 - DNA, 20 bp, Artificial
  CRISPR gRNA sequence
agcaagagcaattccatgtg

SEQ ID NO: 228629 - DNA, 20 bp, Artificial
  CRISPR gRNA sequence
catgtgcatgtggagaagac

SEQ ID NO: 228630 - DNA, 20 bp, Artificial
  CRISPR gRNA sequence
ataatagccattcatattgt

SEQ ID NO: 228631 - DNA, 20 bp, Artificial
  CRISPR gRNA sequence
atattgtaaaatgcacaagt

SEQ ID NO: 228632 - DNA, 20 bp, Artificial
  CRISPR gRNA sequence
taaaatgcacaagtgtggta

SEQ ID NO: 228633 - DNA, 20 bp, Artificial
  CRISPR gRNA sequence
ttctaagatttagggtaaaa

SEQ ID NO: 228634 - DNA, 20 bp, Artificial
  CRISPR gRNA sequence
taagatttagggtaaaaact

SEQ ID NO: 228635 - DNA, 20 bp, Artificial
  CRISPR gRNA sequence
agatttagggtaaaaacttc

SEQ ID NO: 228636 - DNA, 20 bp, Artificial
  CRISPR gRNA sequence
agggtaaaaacttccagtcc

SEQ ID NO: 228637 - DNA, 20 bp, Artificial
  CRISPR gRNA sequence
gggtaaaaacttccagtcca

SEQ ID NO: 228638 - DNA, 20 bp, Artificial
  CRISPR gRNA sequence
ccagtccagcttagctgact

SEQ ID NO: 228639 - DNA, 20 bp, Artificial
  CRISPR gRNA sequence
cagtccagcttagctgactg

SEQ ID NO: 228640 - DNA, 20 bp, Artificial
  CRISPR gRNA sequence
agctgactgtgaaaattaaa

SEQ ID NO: 228641 - DNA, 20 bp, Artificial
  CRISPR gRNA sequence
gctgactgtgaaaattaaag

SEQ ID NO: 228642 - DNA, 20 bp, Artificial
  CRISPR gRNA sequence
actgtgaaaattaaaggctg

SEQ ID NO: 228643 - DNA, 20 bp, Artificial
  CRISPR gRNA sequence
tgaaaattaaaggctgccga

SEQ ID NO: 228644 - DNA, 20 bp, Artificial
  CRISPR gRNA sequence
aaggctgccgaatgtgtgaa

SEQ ID NO: 228645 - DNA, 20 bp, Artificial
  CRISPR gRNA sequence
ccgaatgtgtgaatttggag

SEQ ID NO: 228646 - DNA, 20 bp, Artificial
  CRISPR gRNA sequence
ggagctgactacttgtgtgg

SEQ ID NO: 228647 - DNA, 20 bp, Artificial
  CRISPR gRNA sequence
gagctgactacttgtgtgga

SEQ ID NO: 228648 - DNA, 20 bp, Artificial
  CRISPR gRNA sequence
actacttgtgtggaagggtt

SEQ ID NO: 228649 - DNA, 20 bp, Artificial
  CRISPR gRNA sequence
cttgtgtggaagggttagat

SEQ ID NO: 228650 - DNA, 20 bp, Artificial
  CRISPR gRNA sequence
gtgtggaagggttagatcac

SEQ ID NO: 228651 - DNA, 20 bp, Artificial
  CRISPR gRNA sequence
tgtggaagggttagatcact

SEQ ID NO: 228652 - DNA, 20 bp, Artificial
  CRISPR gRNA sequence
gatcactgagttaacatcta

SEQ ID NO: 228653 - DNA, 20 bp, Artificial
  CRISPR gRNA sequence
agttaacatctaccgtcaaa

SEQ ID NO: 228654 - DNA, 20 bp, Artificial
  CRISPR gRNA sequence
acatctaccgtcaaacaatg

SEQ ID NO: 228655 - DNA, 20 bp, Artificial
  CRISPR gRNA sequence
ccgtcaaacaatgaactcca

SEQ ID NO: 228656 - DNA, 20 bp, Artificial
  CRISPR gRNA sequence
cagagtcagtctttggtctt

SEQ ID NO: 228657 - DNA, 20 bp, Artificial
  CRISPR gRNA sequence
tggtcttaggagatccctga

SEQ ID NO: 228658 - DNA, 20 bp, Artificial
  CRISPR gRNA sequence
ggtcttaggagatccctgat

SEQ ID NO: 228659 - DNA, 20 bp, Artificial
  CRISPR gRNA sequence
gtcttaggagatccctgatt

SEQ ID NO: 228660 - DNA, 20 bp, Artificial
  CRISPR gRNA sequence
aggagatccctgattatacc

SEQ ID NO: 228661 - DNA, 20 bp, Artificial
  CRISPR gRNA sequence
ggagatccctgattatacca

SEQ ID NO: 228662 - DNA, 20 bp, Artificial
  CRISPR gRNA sequence
attataccaaatgcaagtgg

SEQ ID NO: 228663 - DNA, 20 bp, Artificial
  CRISPR gRNA sequence
taccaaatgcaagtggaagt

SEQ ID NO: 228664 - DNA, 20 bp, Artificial
  CRISPR gRNA sequence
ttgctttttaaatactcttg

SEQ ID NO: 228665 - DNA, 20 bp, Artificial
  CRISPR gRNA sequence
ctttttaaatactcttgaca

SEQ ID NO: 228666 - DNA, 20 bp, Artificial
  CRISPR gRNA sequence
tttaaatactcttgacatgc

SEQ ID NO: 228667 - DNA, 20 bp, Artificial
  CRISPR gRNA sequence
ttaaatactcttgacatgct

SEQ ID NO: 228668 - DNA, 20 bp, Artificial
  CRISPR gRNA sequence
taaatactcttgacatgctt

SEQ ID NO: 228669 - DNA, 20 bp, Artificial
  CRISPR gRNA sequence
aaatactcttgacatgcttc

SEQ ID NO: 228670 - DNA, 20 bp, Artificial
  CRISPR gRNA sequence
aatactcttgacatgcttct

SEQ ID NO: 228671 - DNA, 20 bp, Artificial
  CRISPR gRNA sequence
ttgacatgcttctgttacat

SEQ ID NO: 228672 - DNA, 20 bp, Artificial
  CRISPR gRNA sequence
gacatgcttctgttacatcc

SEQ ID NO: 228673 - DNA, 20 bp, Artificial
  CRISPR gRNA sequence
acatgcttctgttacatcct

SEQ ID NO: 228674 - DNA, 20 bp, Artificial
  CRISPR gRNA sequence
ctgttacatccttttccttc

SEQ ID NO: 228675 - DNA, 20 bp, Artificial
  CRISPR gRNA sequence
tgttacatccttttccttcc

SEQ ID NO: 228676 - DNA, 20 bp, Artificial
  CRISPR gRNA sequence
ttacatccttttccttcctc

SEQ ID NO: 228677 - DNA, 20 bp, Artificial
  CRISPR gRNA sequence
catccttttccttcctccag

SEQ ID NO: 228678 - DNA, 20 bp, Artificial
  CRISPR gRNA sequence
ttccttcctccagcgattgg

SEQ ID NO: 228679 - DNA, 20 bp, Artificial
  CRISPR gRNA sequence
tccttcctccagcgattgga

SEQ ID NO: 228680 - DNA, 20 bp, Artificial
  CRISPR gRNA sequence
ccttcctccagcgattggat

SEQ ID NO: 228681 - DNA, 20 bp, Artificial
  CRISPR gRNA sequence
cttcctccagcgattggatt

SEQ ID NO: 228682 - DNA, 20 bp, Artificial
  CRISPR gRNA sequence
cctccagcgattggattaac

SEQ ID NO: 228683 - DNA, 20 bp, Artificial
  CRISPR gRNA sequence
ctccagcgattggattaacc

SEQ ID NO: 228684 - DNA, 20 bp, Artificial
  CRISPR gRNA sequence
cagcgattggattaacctcc

SEQ ID NO: 228685 - DNA, 20 bp, Artificial
  CRISPR gRNA sequence
gattaacctccttcgtcatt

SEQ ID NO: 228686 - DNA, 20 bp, Artificial
  CRISPR gRNA sequence
acctccttcgtcattgccat

SEQ ID NO: 228687 - DNA, 20 bp, Artificial
  CRISPR gRNA sequence
cttcgtcattgccatattgg

SEQ ID NO: 228688 - DNA, 20 bp, Artificial
  CRISPR gRNA sequence
cgtcattgccatattggtta

SEQ ID NO: 228689 - DNA, 20 bp, Artificial
  CRISPR gRNA sequence
gtcattgccatattggttat

SEQ ID NO: 228690 - DNA, 20 bp, Artificial
  CRISPR gRNA sequence
ccatattggttattcaggtg

SEQ ID NO: 228691 - DNA, 20 bp, Artificial
  CRISPR gRNA sequence
gttattcaggtgatagccta

SEQ ID NO: 228692 - DNA, 20 bp, Artificial
  CRISPR gRNA sequence
ttcaggtgatagcctatatc

SEQ ID NO: 228693 - DNA, 20 bp, Artificial
  CRISPR gRNA sequence
aggtgatagcctatatcctc

SEQ ID NO: 228694 - DNA, 20 bp, Artificial
  CRISPR gRNA sequence
tatcctcgctgtggttggac

SEQ ID NO: 228695 - DNA, 20 bp, Artificial
  CRISPR gRNA sequence
gctgtggttggactgagtct

SEQ ID NO: 228696 - DNA, 20 bp, Artificial
  CRISPR gRNA sequence
tggttggactgagtctctgt

SEQ ID NO: 228697 - DNA, 20 bp, Artificial
  CRISPR gRNA sequence
gactgagtctctgtattgcg

SEQ ID NO: 228698 - DNA, 20 bp, Artificial
  CRISPR gRNA sequence
agtctctgtattgcgggtaa

SEQ ID NO: 228699 - DNA, 20 bp, Artificial
  CRISPR gRNA sequence
tgtattgcgggtaagagtca

SEQ ID NO: 228700 - DNA, 20 bp, Artificial
  CRISPR gRNA sequence
tattgcgggtaagagtcatc

SEQ ID NO: 228701 - DNA, 20 bp, Artificial
  CRISPR gRNA sequence
cgggtaagagtcatctttct

SEQ ID NO: 228702 - DNA, 20 bp, Artificial
  CRISPR gRNA sequence
tctgtagacctaatttgggt

SEQ ID NO: 228703 - DNA, 20 bp, Artificial
  CRISPR gRNA sequence
ctgtagacctaatttgggtt

SEQ ID NO: 228704 - DNA, 20 bp, Artificial
  CRISPR gRNA sequence
tgtagacctaatttgggtta

SEQ ID NO: 228705 - DNA, 20 bp, Artificial
  CRISPR gRNA sequence
tagacctaatttgggttact

SEQ ID NO: 228706 - DNA, 20 bp, Artificial
  CRISPR gRNA sequence
atttgggttacttttggaca

SEQ ID NO: 228707 - DNA, 20 bp, Artificial
  CRISPR gRNA sequence
gggttacttttggacagagc

SEQ ID NO: 228708 - DNA, 20 bp, Artificial
  CRISPR gRNA sequence
ggttacttttggacagagct

SEQ ID NO: 228709 - DNA, 20 bp, Artificial
  CRISPR gRNA sequence
cttttggacagagctcttct

SEQ ID NO: 228710 - DNA, 20 bp, Artificial
  CRISPR gRNA sequence
ttggacagagctcttcttcc

SEQ ID NO: 228711 - DNA, 20 bp, Artificial
  CRISPR gRNA sequence
tggacagagctcttcttcct

SEQ ID NO: 228712 - DNA, 20 bp, Artificial
  CRISPR gRNA sequence
ggacagagctcttcttcctt

SEQ ID NO: 228713 - DNA, 20 bp, Artificial
  CRISPR gRNA sequence
gacagagctcttcttccttt

SEQ ID NO: 228714 - DNA, 20 bp, Artificial
  CRISPR gRNA sequence
ttcttcctttttctttttct

SEQ ID NO: 228715 - DNA, 20 bp, Artificial
  CRISPR gRNA sequence
cttcctttttctttttcttt

SEQ ID NO: 228716 - DNA, 20 bp, Artificial
  CRISPR gRNA sequence
ttcctttttctttttctttc

SEQ ID NO: 228717 - DNA, 20 bp, Artificial
  CRISPR gRNA sequence
cctttttctttttctttctc

SEQ ID NO: 228718 - DNA, 20 bp, Artificial
  CRISPR gRNA sequence
ctttttctttttctttctct

SEQ ID NO: 228719 - DNA, 20 bp, Artificial
  CRISPR gRNA sequence
tttctttttctttctctctt

SEQ ID NO: 228720 - DNA, 20 bp, Artificial
  CRISPR gRNA sequence
ttctttttctttctctcttt

SEQ ID NO: 228721 - DNA, 20 bp, Artificial
  CRISPR gRNA sequence
tctttttctttctctctttt

SEQ ID NO: 228722 - DNA, 20 bp, Artificial
  CRISPR gRNA sequence
ctttttctttctctcttttt

SEQ ID NO: 228723 - DNA, 20 bp, Artificial
  CRISPR gRNA sequence
tttttctttctctcttttta

SEQ ID NO: 228724 - DNA, 20 bp, Artificial
  CRISPR gRNA sequence
tttctttctctctttttaaa

SEQ ID NO: 228725 - DNA, 20 bp, Artificial
  CRISPR gRNA sequence
ttctttctctctttttaaaa

SEQ ID NO: 228726 - DNA, 20 bp, Artificial
  CRISPR gRNA sequence
tctttctctctttttaaaaa

SEQ ID NO: 228727 - DNA, 20 bp, Artificial
  CRISPR gRNA sequence
ctttctctctttttaaaaat

SEQ ID NO: 228728 - DNA, 20 bp, Artificial
  CRISPR gRNA sequence
tttctctctttttaaaaata

SEQ ID NO: 228729 - DNA, 20 bp, Artificial
  CRISPR gRNA sequence
tctctctttttaaaaatata

SEQ ID NO: 228730 - DNA, 20 bp, Artificial
  CRISPR gRNA sequence
ctctctttttaaaaatatat

SEQ ID NO: 228731 - DNA, 20 bp, Artificial
  CRISPR gRNA sequence
tctctttttaaaaatatata

SEQ ID NO: 228732 - DNA, 20 bp, Artificial
  CRISPR gRNA sequence
tctttttaaaaatatataga

SEQ ID NO: 228733 - DNA, 20 bp, Artificial
  CRISPR gRNA sequence
tttttaaaaatatatagact

SEQ ID NO: 228734 - DNA, 20 bp, Artificial
  CRISPR gRNA sequence
tttaaaaatatatagacttg

SEQ ID NO: 228735 - DNA, 20 bp, Artificial
  CRISPR gRNA sequence
ttaaaaatatatagacttga

SEQ ID NO: 228736 - DNA, 20 bp, Artificial
  CRISPR gRNA sequence
taaaaatatatagacttgat

SEQ ID NO: 228737 - DNA, 20 bp, Artificial
  CRISPR gRNA sequence
aaaaatatatagacttgatt

SEQ ID NO: 228738 - DNA, 20 bp, Artificial
  CRISPR gRNA sequence
aaaatatatagacttgattt

SEQ ID NO: 228739 - DNA, 20 bp, Artificial
  CRISPR gRNA sequence
gatttttttttttagtgcag

SEQ ID NO: 228740 - DNA, 20 bp, Artificial
  CRISPR gRNA sequence
atttttttttttagtgcagt

SEQ ID NO: 228741 - DNA, 20 bp, Artificial
  CRISPR gRNA sequence
ttttttttagtgcagttttt

SEQ ID NO: 228742 - DNA, 20 bp, Artificial
  CRISPR gRNA sequence
tttttttagtgcagtttttg

SEQ ID NO: 228743 - DNA, 20 bp, Artificial
  CRISPR gRNA sequence
ttttttagtgcagtttttgg

SEQ ID NO: 228744 - DNA, 20 bp, Artificial
  CRISPR gRNA sequence
tttttagtgcagtttttggt

SEQ ID NO: 228745 - DNA, 20 bp, Artificial
  CRISPR gRNA sequence
ttttagtgcagtttttggtt

SEQ ID NO: 228746 - DNA, 20 bp, Artificial
  CRISPR gRNA sequence
tttagtgcagtttttggttc

SEQ ID NO: 228747 - DNA, 20 bp, Artificial
  CRISPR gRNA sequence
ttagtgcagtttttggttca

SEQ ID NO: 228748 - DNA, 20 bp, Artificial
  CRISPR gRNA sequence
tagtgcagtttttggttcat

SEQ ID NO: 228749 - DNA, 20 bp, Artificial
  CRISPR gRNA sequence
agtgcagtttttggttcatg

SEQ ID NO: 228750 - DNA, 20 bp, Artificial
  CRISPR gRNA sequence
gtgcagtttttggttcatgg

SEQ ID NO: 228751 - DNA, 20 bp, Artificial
  CRISPR gRNA sequence
ttggttcatggcaaaattga

SEQ ID NO: 228752 - DNA, 20 bp, Artificial
  CRISPR gRNA sequence
tggttcatggcaaaattgag

SEQ ID NO: 228753 - DNA, 20 bp, Artificial
  CRISPR gRNA sequence
ggttcatggcaaaattgagt

SEQ ID NO: 228754 - DNA, 20 bp, Artificial
  CRISPR gRNA sequence
gttcatggcaaaattgagtg

SEQ ID NO: 228755 - DNA, 20 bp, Artificial
  CRISPR gRNA sequence
atggcaaaattgagtggaaa

SEQ ID NO: 228756 - DNA, 20 bp, Artificial
  CRISPR gRNA sequence
agtggaaagtacattcacat

SEQ ID NO: 228757 - DNA, 20 bp, Artificial
  CRISPR gRNA sequence
acatggatatttttatgtgg

SEQ ID NO: 228758 - DNA, 20 bp, Artificial
  CRISPR gRNA sequence
ttatgtggacataagttttc

SEQ ID NO: 228759 - DNA, 20 bp, Artificial
  CRISPR gRNA sequence
tatgtggacataagttttca

SEQ ID NO: 228760 - DNA, 20 bp, Artificial
  CRISPR gRNA sequence
atgtggacataagttttcaa

SEQ ID NO: 228761 - DNA, 20 bp, Artificial
  CRISPR gRNA sequence
tgtggacataagttttcaat

SEQ ID NO: 228762 - DNA, 20 bp, Artificial
  CRISPR gRNA sequence
tcaattccatttgggcaaat

SEQ ID NO: 228763 - DNA, 20 bp, Artificial
  CRISPR gRNA sequence
caattccatttgggcaaata

SEQ ID NO: 228764 - DNA, 20 bp, Artificial
  CRISPR gRNA sequence
aattccatttgggcaaatac

SEQ ID NO: 228765 - DNA, 20 bp, Artificial
  CRISPR gRNA sequence
catttgggcaaataccaagg

SEQ ID NO: 228766 - DNA, 20 bp, Artificial
  CRISPR gRNA sequence
gggcaaataccaaggagtgc

SEQ ID NO: 228767 - DNA, 20 bp, Artificial
  CRISPR gRNA sequence
ggcaaataccaaggagtgca

SEQ ID NO: 228768 - DNA, 20 bp, Artificial
  CRISPR gRNA sequence
cgggactgtaaagagtatgt

SEQ ID NO: 228769 - DNA, 20 bp, Artificial
  CRISPR gRNA sequence
taaagagtatgttgaaataa

SEQ ID NO: 228770 - DNA, 20 bp, Artificial
  CRISPR gRNA sequence
aaataaactgccaaactctc

SEQ ID NO: 228771 - DNA, 20 bp, Artificial
  CRISPR gRNA sequence
ccaaactctctgtatcaaaa

SEQ ID NO: 228772 - DNA, 20 bp, Artificial
  CRISPR gRNA sequence
tctgtatcaaaatagctgta

SEQ ID NO: 228773 - DNA, 20 bp, Artificial
  CRISPR gRNA sequence
tgtatcaaaatagctgtacc

SEQ ID NO: 228774 - DNA, 20 bp, Artificial
  CRISPR gRNA sequence
tatcaaaatagctgtaccat

SEQ ID NO: 228775 - DNA, 20 bp, Artificial
  CRISPR gRNA sequence
taccattttgtattatcacc

SEQ ID NO: 228776 - DNA, 20 bp, Artificial
  CRISPR gRNA sequence
tgtattatcaccaccaataa

SEQ ID NO: 228777 - DNA, 20 bp, Artificial
  CRISPR gRNA sequence
gtattatcaccaccaataaa

SEQ ID NO: 228778 - DNA, 20 bp, Artificial
  CRISPR gRNA sequence
tattatcaccaccaataaat

SEQ ID NO: 228779 - DNA, 20 bp, Artificial
  CRISPR gRNA sequence
tcaccaccaataaataagag

SEQ ID NO: 228780 - DNA, 20 bp, Artificial
  CRISPR gRNA sequence
ttgttcattcatatacttga

SEQ ID NO: 228781 - DNA, 20 bp, Artificial
  CRISPR gRNA sequence
tgttcattcatatacttgac

SEQ ID NO: 228782 - DNA, 20 bp, Artificial
  CRISPR gRNA sequence
gttcattcatatacttgaca

SEQ ID NO: 228783 - DNA, 20 bp, Artificial
  CRISPR gRNA sequence
ttcattcatatacttgacag

SEQ ID NO: 228784 - DNA, 20 bp, Artificial
  CRISPR gRNA sequence
attcatatacttgacagcat

SEQ ID NO: 228785 - DNA, 20 bp, Artificial
  CRISPR gRNA sequence
atatacttgacagcatttag

SEQ ID NO: 228786 - DNA, 20 bp, Artificial
  CRISPR gRNA sequence
gacagcatttagcattctga

SEQ ID NO: 228787 - DNA, 20 bp, Artificial
  CRISPR gRNA sequence
acagcatttagcattctgag

SEQ ID NO: 228788 - DNA, 20 bp, Artificial
  CRISPR gRNA sequence
agcattctgagcttttcttt

SEQ ID NO: 228789 - DNA, 20 bp, Artificial
  CRISPR gRNA sequence
gcattctgagcttttctttt

SEQ ID NO: 228790 - DNA, 20 bp, Artificial
  CRISPR gRNA sequence
tgagcttttctttttaaact

SEQ ID NO: 228791 - DNA, 20 bp, Artificial
  CRISPR gRNA sequence
agcttttctttttaaacttc

SEQ ID NO: 228792 - DNA, 20 bp, Artificial
  CRISPR gRNA sequence
ttctttttaaacttccaatt

SEQ ID NO: 228793 - DNA, 20 bp, Artificial
  CRISPR gRNA sequence
tctttttaaacttccaattt

SEQ ID NO: 228794 - DNA, 20 bp, Artificial
  CRISPR gRNA sequence
ctttttaaacttccaattta

SEQ ID NO: 228795 - DNA, 20 bp, Artificial
  CRISPR gRNA sequence
tttttaaacttccaatttac

SEQ ID NO: 228796 - DNA, 20 bp, Artificial
  CRISPR gRNA sequence
tttaaacttccaatttaccc

SEQ ID NO: 228797 - DNA, 20 bp, Artificial
  CRISPR gRNA sequence
ttaaacttccaatttacccc

SEQ ID NO: 228798 - DNA, 20 bp, Artificial
  CRISPR gRNA sequence
taaacttccaatttacccca

SEQ ID NO: 228799 - DNA, 20 bp, Artificial
  CRISPR gRNA sequence
aaacttccaatttaccccag

SEQ ID NO: 228800 - DNA, 20 bp, Artificial
  CRISPR gRNA sequence
aacttccaatttaccccagt

SEQ ID NO: 228801 - DNA, 20 bp, Artificial
  CRISPR gRNA sequence
ccaatttaccccagtggtaa

SEQ ID NO: 228802 - DNA, 20 bp, Artificial
  CRISPR gRNA sequence
caatttaccccagtggtaat

SEQ ID NO: 228803 - DNA, 20 bp, Artificial
  CRISPR gRNA sequence
accccagtggtaatagtgct

SEQ ID NO: 228804 - DNA, 20 bp, Artificial
  CRISPR gRNA sequence
ccccagtggtaatagtgctt

SEQ ID NO: 228805 - DNA, 20 bp, Artificial
  CRISPR gRNA sequence
tcctcctcgctacaaagata

SEQ ID NO: 228806 - DNA, 20 bp, Artificial
  CRISPR gRNA sequence
cctcctcgctacaaagatat

SEQ ID NO: 228807 - DNA, 20 bp, Artificial
  CRISPR gRNA sequence
ctcctcgctacaaagatatt

SEQ ID NO: 228808 - DNA, 20 bp, Artificial
  CRISPR gRNA sequence
ctcgctacaaagatattagc

SEQ ID NO: 228809 - DNA, 20 bp, Artificial
  CRISPR gRNA sequence
gctacaaagatattagctgt

SEQ ID NO: 228810 - DNA, 20 bp, Artificial
  CRISPR gRNA sequence
caaagatattagctgtatat

SEQ ID NO: 228811 - DNA, 20 bp, Artificial
  CRISPR gRNA sequence
gctgtatatatggcttggtg

SEQ ID NO: 228812 - DNA, 20 bp, Artificial
  CRISPR gRNA sequence
tatatatggcttggtggctg

SEQ ID NO: 228813 - DNA, 20 bp, Artificial
  CRISPR gRNA sequence
ggtggctgattgttctagca

SEQ ID NO: 228814 - DNA, 20 bp, Artificial
  CRISPR gRNA sequence
gtggctgattgttctagcac

SEQ ID NO: 228815 - DNA, 20 bp, Artificial
  CRISPR gRNA sequence
attgttctagcacccaaact

SEQ ID NO: 228816 - DNA, 20 bp, Artificial
  CRISPR gRNA sequence
ttctagcacccaaactgata

SEQ ID NO: 228817 - DNA, 20 bp, Artificial
  CRISPR gRNA sequence
tagcacccaaactgatatgc

SEQ ID NO: 228818 - DNA, 20 bp, Artificial
  CRISPR gRNA sequence
gcacccaaactgatatgcct

SEQ ID NO: 228819 - DNA, 20 bp, Artificial
  CRISPR gRNA sequence
atatgcctgtatttgtggaa

SEQ ID NO: 228820 - DNA, 20 bp, Artificial
  CRISPR gRNA sequence
tatttgtggaagagctttta

SEQ ID NO: 228821 - DNA, 20 bp, Artificial
  CRISPR gRNA sequence
gtggaagagcttttaaaata

SEQ ID NO: 228822 - DNA, 20 bp, Artificial
  CRISPR gRNA sequence
tggaagagcttttaaaataa

SEQ ID NO: 228823 - DNA, 20 bp, Artificial
  CRISPR gRNA sequence
ttaaaataactgggctcaaa

SEQ ID NO: 228824 - DNA, 20 bp, Artificial
  CRISPR gRNA sequence
taaaataactgggctcaaat

SEQ ID NO: 228825 - DNA, 20 bp, Artificial
  CRISPR gRNA sequence
aaaataactgggctcaaatt

SEQ ID NO: 228826 - DNA, 20 bp, Artificial
  CRISPR gRNA sequence
aaataactgggctcaaattg

SEQ ID NO: 228827 - DNA, 20 bp, Artificial
  CRISPR gRNA sequence
ggctcaaattggttggagcc

SEQ ID NO: 228828 - DNA, 20 bp, Artificial
  CRISPR gRNA sequence
aaattggttggagccttaga

SEQ ID NO: 228829 - DNA, 20 bp, Artificial
  CRISPR gRNA sequence
gttggagccttagacttgaa

SEQ ID NO: 228830 - DNA, 20 bp, Artificial
  CRISPR gRNA sequence
gagccttagacttgaaacac

SEQ ID NO: 228831 - DNA, 20 bp, Artificial
  CRISPR gRNA sequence
agacttgaaacaccagttcc

SEQ ID NO: 228832 - DNA, 20 bp, Artificial
  CRISPR gRNA sequence
gacttgaaacaccagttccc

SEQ ID NO: 228833 - DNA, 20 bp, Artificial
  CRISPR gRNA sequence
gaaacaccagttcccatttc

SEQ ID NO: 228834 - DNA, 20 bp, Artificial
  CRISPR gRNA sequence
aaacaccagttcccatttct

SEQ ID NO: 228835 - DNA, 20 bp, Artificial
  CRISPR gRNA sequence
ccatttcttgatatgataag

SEQ ID NO: 228836 - DNA, 20 bp, Artificial
  CRISPR gRNA sequence
cttgatatgataaggtatgt

SEQ ID NO: 228837 - DNA, 20 bp, Artificial
  CRISPR gRNA sequence
ttgatatgataaggtatgtg

SEQ ID NO: 228838 - DNA, 20 bp, Artificial
  CRISPR gRNA sequence
gatatgataaggtatgtgtt

SEQ ID NO: 228839 - DNA, 20 bp, Artificial
  CRISPR gRNA sequence
atatgataaggtatgtgtta

SEQ ID NO: 228840 - DNA, 20 bp, Artificial
  CRISPR gRNA sequence
tgcaaaggagggctttgttc

SEQ ID NO: 228841 - DNA, 20 bp, Artificial
  CRISPR gRNA sequence
tgttcttctaataattttga

SEQ ID NO: 228842 - DNA, 20 bp, Artificial
  CRISPR gRNA sequence
gttcttctaataattttgag

SEQ ID NO: 228843 - DNA, 20 bp, Artificial
  CRISPR gRNA sequence
ttcttctaataattttgagt

SEQ ID NO: 228844 - DNA, 20 bp, Artificial
  CRISPR gRNA sequence
ttctaataattttgagtcat

SEQ ID NO: 228845 - DNA, 20 bp, Artificial
  CRISPR gRNA sequence
ctaataattttgagtcattt

SEQ ID NO: 228846 - DNA, 20 bp, Artificial
  CRISPR gRNA sequence
taataattttgagtcatttt

SEQ ID NO: 228847 - DNA, 20 bp, Artificial
  CRISPR gRNA sequence
ataattttgagtcattttac

SEQ ID NO: 228848 - DNA, 20 bp, Artificial
  CRISPR gRNA sequence
tgagtcattttactggttaa

SEQ ID NO: 228849 - DNA, 20 bp, Artificial
  CRISPR gRNA sequence
gagtcattttactggttaag

SEQ ID NO: 228850 - DNA, 20 bp, Artificial
  CRISPR gRNA sequence
agtcattttactggttaagt

SEQ ID NO: 228851 - DNA, 20 bp, Artificial
  CRISPR gRNA sequence
tactggttaagttaataaac

SEQ ID NO: 228852 - DNA, 20 bp, Artificial
  CRISPR gRNA sequence
actggttaagttaataaaca

SEQ ID NO: 228853 - DNA, 20 bp, Artificial
  CRISPR gRNA sequence
ctggttaagttaataaacat

SEQ ID NO: 228854 - DNA, 20 bp, Artificial
  CRISPR gRNA sequence
gttaagttaataaacatata

SEQ ID NO: 228855 - DNA, 20 bp, Artificial
  CRISPR gRNA sequence
agttaataaacatatatgga

SEQ ID NO: 228856 - DNA, 20 bp, Artificial
  CRISPR gRNA sequence
ataaacatatatggataatt

SEQ ID NO: 228857 - DNA, 20 bp, Artificial
  CRISPR gRNA sequence
ttgttttttgatcgttagaa

SEQ ID NO: 228858 - DNA, 20 bp, Artificial
  CRISPR gRNA sequence
tgttttttgatcgttagaat

SEQ ID NO: 228859 - DNA, 20 bp, Artificial
  CRISPR gRNA sequence
gttttttgatcgttagaata

SEQ ID NO: 228860 - DNA, 20 bp, Artificial
  CRISPR gRNA sequence
ttttttgatcgttagaataa

SEQ ID NO: 228861 - DNA, 20 bp, Artificial
  CRISPR gRNA sequence
tttgatcgttagaataactc

SEQ ID NO: 228862 - DNA, 20 bp, Artificial
  CRISPR gRNA sequence
ttgatcgttagaataactct

SEQ ID NO: 228863 - DNA, 20 bp, Artificial
  CRISPR gRNA sequence
tgatcgttagaataactctc

SEQ ID NO: 228864 - DNA, 20 bp, Artificial
  CRISPR gRNA sequence
gatcgttagaataactctct

SEQ ID NO: 228865 - DNA, 20 bp, Artificial
  CRISPR gRNA sequence
atcgttagaataactctctt

SEQ ID NO: 228866 - DNA, 20 bp, Artificial
  CRISPR gRNA sequence
gaataactctcttaaaactt

SEQ ID NO: 228867 - DNA, 20 bp, Artificial
  CRISPR gRNA sequence
tcttaaaacttgggattatt

SEQ ID NO: 228868 - DNA, 20 bp, Artificial
  CRISPR gRNA sequence
ttaaaacttgggattattac

SEQ ID NO: 228869 - DNA, 20 bp, Artificial
  CRISPR gRNA sequence
aaaacttgggattattactg

SEQ ID NO: 228870 - DNA, 20 bp, Artificial
  CRISPR gRNA sequence
aaacttgggattattactgt

SEQ ID NO: 228871 - DNA, 20 bp, Artificial
  CRISPR gRNA sequence
gggattattactgtttttta

SEQ ID NO: 228872 - DNA, 20 bp, Artificial
  CRISPR gRNA sequence
ggattattactgttttttag

SEQ ID NO: 228873 - DNA, 20 bp, Artificial
  CRISPR gRNA sequence
ttactgttttttagtaagtt

SEQ ID NO: 228874 - DNA, 20 bp, Artificial
  CRISPR gRNA sequence
ctgttttttagtaagttatt

SEQ ID NO: 228875 - DNA, 20 bp, Artificial
  CRISPR gRNA sequence
ttttttagtaagttatttca

SEQ ID NO: 228876 - DNA, 20 bp, Artificial
  CRISPR gRNA sequence
tttagtaagttatttcatat

SEQ ID NO: 228877 - DNA, 20 bp, Artificial
  CRISPR gRNA sequence
ttagtaagttatttcatatg

SEQ ID NO: 228878 - DNA, 20 bp, Artificial
  CRISPR gRNA sequence
tagtaagttatttcatatgc

SEQ ID NO: 228879 - DNA, 20 bp, Artificial
  CRISPR gRNA sequence
agtaagttatttcatatgct

SEQ ID NO: 228880 - DNA, 20 bp, Artificial
  CRISPR gRNA sequence
gtaagttatttcatatgctt

SEQ ID NO: 228881 - DNA, 20 bp, Artificial
  CRISPR gRNA sequence
tttcatatgcttttctaata

SEQ ID NO: 228882 - DNA, 20 bp, Artificial
  CRISPR gRNA sequence
catatgcttttctaatacag

SEQ ID NO: 228883 - DNA, 20 bp, Artificial
  CRISPR gRNA sequence
atatgcttttctaatacaga

SEQ ID NO: 228884 - DNA, 20 bp, Artificial
  CRISPR gRNA sequence
ttctaatacagaattttatt

SEQ ID NO: 228885 - DNA, 20 bp, Artificial
  CRISPR gRNA sequence
tctaatacagaattttattt

SEQ ID NO: 228886 - DNA, 20 bp, Artificial
  CRISPR gRNA sequence
ctaatacagaattttatttg

SEQ ID NO: 228887 - DNA, 20 bp, Artificial
  CRISPR gRNA sequence
taatacagaattttatttgt

SEQ ID NO: 228888 - DNA, 20 bp, Artificial
  CRISPR gRNA sequence
atacagaattttatttgttt

SEQ ID NO: 228889 - DNA, 20 bp, Artificial
  CRISPR gRNA sequence
tatttgtttttacagcgtgt

SEQ ID NO: 228890 - DNA, 20 bp, Artificial
  CRISPR gRNA sequence
atttgtttttacagcgtgta

SEQ ID NO: 228891 - DNA, 20 bp, Artificial
  CRISPR gRNA sequence
tttgtttttacagcgtgtat

SEQ ID NO: 228892 - DNA, 20 bp, Artificial
  CRISPR gRNA sequence
gtttttacagcgtgtatacc

SEQ ID NO: 228893 - DNA, 20 bp, Artificial
  CRISPR gRNA sequence
tttttacagcgtgtatacca

SEQ ID NO: 228894 - DNA, 20 bp, Artificial
  CRISPR gRNA sequence
ttacagcgtgtataccaatg

SEQ ID NO: 228895 - DNA, 20 bp, Artificial
  CRISPR gRNA sequence
tacagcgtgtataccaatgc

SEQ ID NO: 228896 - DNA, 20 bp, Artificial
  CRISPR gRNA sequence
acagcgtgtataccaatgca

SEQ ID NO: 228897 - DNA, 20 bp, Artificial
  CRISPR gRNA sequence
cagcgtgtataccaatgcat

SEQ ID NO: 228898 - DNA, 20 bp, Artificial
  CRISPR gRNA sequence
ttctgatttcaggtttgagt

SEQ ID NO: 228899 - DNA, 20 bp, Artificial
  CRISPR gRNA sequence
ctgatttcaggtttgagtat

SEQ ID NO: 228900 - DNA, 20 bp, Artificial
  CRISPR gRNA sequence
tgatttcaggtttgagtatc

SEQ ID NO: 228901 - DNA, 20 bp, Artificial
  CRISPR gRNA sequence
atttcaggtttgagtatctt

SEQ ID NO: 228902 - DNA, 20 bp, Artificial
  CRISPR gRNA sequence
caggtttgagtatcttagct

SEQ ID NO: 228903 - DNA, 20 bp, Artificial
  CRISPR gRNA sequence
aggtttgagtatcttagctc

SEQ ID NO: 228904 - DNA, 20 bp, Artificial
  CRISPR gRNA sequence
gagtatcttagctctagcac

SEQ ID NO: 228905 - DNA, 20 bp, Artificial
  CRISPR gRNA sequence
agtatcttagctctagcaca

SEQ ID NO: 228906 - DNA, 20 bp, Artificial
  CRISPR gRNA sequence
agctctagcacaattacttg

SEQ ID NO: 228907 - DNA, 20 bp, Artificial
  CRISPR gRNA sequence
gctctagcacaattacttgg

SEQ ID NO: 228908 - DNA, 20 bp, Artificial
  CRISPR gRNA sequence
tagcacaattacttggacta

SEQ ID NO: 228909 - DNA, 20 bp, Artificial
  CRISPR gRNA sequence
gcacaattacttggactagt

SEQ ID NO: 228910 - DNA, 20 bp, Artificial
  CRISPR gRNA sequence
cttggactagtttatatgaa

SEQ ID NO: 228911 - DNA, 20 bp, Artificial
  CRISPR gRNA sequence
ggactagtttatatgaaatt

SEQ ID NO: 228912 - DNA, 20 bp, Artificial
  CRISPR gRNA sequence
gactagtttatatgaaattt

SEQ ID NO: 228913 - DNA, 20 bp, Artificial
  CRISPR gRNA sequence
gtttatatgaaatttgtggg

SEQ ID NO: 228914 - DNA, 20 bp, Artificial
  CRISPR gRNA sequence
atatgaaatttgtgggtaag

SEQ ID NO: 228915 - DNA, 20 bp, Artificial
  CRISPR gRNA sequence
tatgaaatttgtgggtaagt

SEQ ID NO: 228916 - DNA, 20 bp, Artificial
  CRISPR gRNA sequence
gtgggtaagtcaatcttatt

SEQ ID NO: 228917 - DNA, 20 bp, Artificial
  CRISPR gRNA sequence
tgggtaagtcaatcttattt

SEQ ID NO: 228918 - DNA, 20 bp, Artificial
  CRISPR gRNA sequence
attttcattaacctatgcca

SEQ ID NO: 228919 - DNA, 20 bp, Artificial
  CRISPR gRNA sequence
ttttcattaacctatgccaa

SEQ ID NO: 228920 - DNA, 20 bp, Artificial
  CRISPR gRNA sequence
tcattaacctatgccaataa

SEQ ID NO: 228921 - DNA, 20 bp, Artificial
  CRISPR gRNA sequence
cattaacctatgccaataat

SEQ ID NO: 228922 - DNA, 20 bp, Artificial
  CRISPR gRNA sequence
attaacctatgccaataatt

SEQ ID NO: 228923 - DNA, 20 bp, Artificial
  CRISPR gRNA sequence
acctatgccaataatttcag

SEQ ID NO: 228924 - DNA, 20 bp, Artificial
  CRISPR gRNA sequence
tgccaataatttcagatata

SEQ ID NO: 228925 - DNA, 20 bp, Artificial
  CRISPR gRNA sequence
cagatatatcacttagaaaa

SEQ ID NO: 228926 - DNA, 20 bp, Artificial
  CRISPR gRNA sequence
agatatatcacttagaaaat

SEQ ID NO: 228927 - DNA, 20 bp, Artificial
  CRISPR gRNA sequence
agaaaatgctttttagtttg

SEQ ID NO: 228928 - DNA, 20 bp, Artificial
  CRISPR gRNA sequence
gaaaatgctttttagtttgt

SEQ ID NO: 228929 - DNA, 20 bp, Artificial
  CRISPR gRNA sequence
tttagtttgttcttccagtt

SEQ ID NO: 228930 - DNA, 20 bp, Artificial
  CRISPR gRNA sequence
ttagtttgttcttccagttt

SEQ ID NO: 228931 - DNA, 20 bp, Artificial
  CRISPR gRNA sequence
tagtttgttcttccagttta

SEQ ID NO: 228932 - DNA, 20 bp, Artificial
  CRISPR gRNA sequence
agtttgttcttccagtttag

SEQ ID NO: 228933 - DNA, 20 bp, Artificial
  CRISPR gRNA sequence
gtttgttcttccagtttagg

SEQ ID NO: 228934 - DNA, 20 bp, Artificial
  CRISPR gRNA sequence
gttcttccagtttaggacca

SEQ ID NO: 228935 - DNA, 20 bp, Artificial
  CRISPR gRNA sequence
ttcttccagtttaggaccaa

SEQ ID NO: 228936 - DNA, 20 bp, Artificial
  CRISPR gRNA sequence
ttccagtttaggaccaaaaa

SEQ ID NO: 228937 - DNA, 20 bp, Artificial
  CRISPR gRNA sequence
ccagtttaggaccaaaaatg

SEQ ID NO: 228938 - DNA, 20 bp, Artificial
  CRISPR gRNA sequence
cagtttaggaccaaaaatga

SEQ ID NO: 228939 - DNA, 20 bp, Artificial
  CRISPR gRNA sequence
aggaccaaaaatgagaaaat

SEQ ID NO: 228940 - DNA, 20 bp, Artificial
  CRISPR gRNA sequence
ggaccaaaaatgagaaaata

SEQ ID NO: 228941 - DNA, 20 bp, Artificial
  CRISPR gRNA sequence
gagtgattcgaggataatta

SEQ ID NO: 228942 - DNA, 20 bp, Artificial
  CRISPR gRNA sequence
gaggataattaaagagggta

SEQ ID NO: 228943 - DNA, 20 bp, Artificial
  CRISPR gRNA sequence
aagagggtagaagacatata

SEQ ID NO: 228944 - DNA, 20 bp, Artificial
  CRISPR gRNA sequence
ttagttggttcttccagttt

SEQ ID NO: 228945 - DNA, 20 bp, Artificial
  CRISPR gRNA sequence
tagttggttcttccagttta

SEQ ID NO: 228946 - DNA, 20 bp, Artificial
  CRISPR gRNA sequence
agttggttcttccagtttaa

SEQ ID NO: 228947 - DNA, 20 bp, Artificial
  CRISPR gRNA sequence
gttggttcttccagtttaag

SEQ ID NO: 228948 - DNA, 20 bp, Artificial
  CRISPR gRNA sequence
gttcttccagtttaagacca

SEQ ID NO: 228949 - DNA, 20 bp, Artificial
  CRISPR gRNA sequence
ttccagtttaagaccagaag

SEQ ID NO: 228950 - DNA, 20 bp, Artificial
  CRISPR gRNA sequence
ccagtttaagaccagaagtc

SEQ ID NO: 228951 - DNA, 20 bp, Artificial
  CRISPR gRNA sequence
cagtttaagaccagaagtca

SEQ ID NO: 228952 - DNA, 20 bp, Artificial
  CRISPR gRNA sequence
aagaccagaagtcagaaaat

SEQ ID NO: 228953 - DNA, 20 bp, Artificial
  CRISPR gRNA sequence
agaccagaagtcagaaaata

SEQ ID NO: 228954 - DNA, 20 bp, Artificial
  CRISPR gRNA sequence
gaatgatttgagggtaatta

SEQ ID NO: 228955 - DNA, 20 bp, Artificial
  CRISPR gRNA sequence
gagggtaattaaagagggta

SEQ ID NO: 228956 - DNA, 20 bp, Artificial
  CRISPR gRNA sequence
agggtaattaaagagggtag

SEQ ID NO: 228957 - DNA, 20 bp, Artificial
  CRISPR gRNA sequence
aagagggtagaagacatata

SEQ ID NO: 228958 - DNA, 20 bp, Artificial
  CRISPR gRNA sequence
atgaaaatttggtttccaaa

SEQ ID NO: 228959 - DNA, 20 bp, Artificial
  CRISPR gRNA sequence
ggtttccaaagtagtttaaa

SEQ ID NO: 228960 - DNA, 20 bp, Artificial
  CRISPR gRNA sequence
gtttccaaagtagtttaaag

SEQ ID NO: 228961 - DNA, 20 bp, Artificial
  CRISPR gRNA sequence
ccaaagtagtttaaaggaaa

SEQ ID NO: 228962 - DNA, 20 bp, Artificial
  CRISPR gRNA sequence
caaagtagtttaaaggaaaa

SEQ ID NO: 228963 - DNA, 20 bp, Artificial
  CRISPR gRNA sequence
aaaggaaaatggctttatct

SEQ ID NO: 228964 - DNA, 20 bp, Artificial
  CRISPR gRNA sequence
aaggaaaatggctttatcta

SEQ ID NO: 228965 - DNA, 20 bp, Artificial
  CRISPR gRNA sequence
tatctattagaatgtgtacc

SEQ ID NO: 228966 - DNA, 20 bp, Artificial
  CRISPR gRNA sequence
atctattagaatgtgtacct

SEQ ID NO: 228967 - DNA, 20 bp, Artificial
  CRISPR gRNA sequence
tctattagaatgtgtacctt

SEQ ID NO: 228968 - DNA, 20 bp, Artificial
  CRISPR gRNA sequence
ttagaatgtgtaccttttta

SEQ ID NO: 228969 - DNA, 20 bp, Artificial
  CRISPR gRNA sequence
gaatgtgtacctttttatac

SEQ ID NO: 228970 - DNA, 20 bp, Artificial
  CRISPR gRNA sequence
tttatactaagtaaaagggg

SEQ ID NO: 228971 - DNA, 20 bp, Artificial
  CRISPR gRNA sequence
ttatactaagtaaaagggga

SEQ ID NO: 228972 - DNA, 20 bp, Artificial
  CRISPR gRNA sequence
tatactaagtaaaaggggag

SEQ ID NO: 228973 - DNA, 20 bp, Artificial
  CRISPR gRNA sequence
atactaagtaaaaggggaga

SEQ ID NO: 228974 - DNA, 20 bp, Artificial
  CRISPR gRNA sequence
tactaagtaaaaggggagag

SEQ ID NO: 228975 - DNA, 20 bp, Artificial
  CRISPR gRNA sequence
agtaaaaggggagagatctt

SEQ ID NO: 228976 - DNA, 20 bp, Artificial
  CRISPR gRNA sequence
tgaggatccattttaagtaa

SEQ ID NO: 228977 - DNA, 20 bp, Artificial
  CRISPR gRNA sequence
gaggatccattttaagtaat

SEQ ID NO: 228978 - DNA, 20 bp, Artificial
  CRISPR gRNA sequence
aggatccattttaagtaata

SEQ ID NO: 228979 - DNA, 20 bp, Artificial
  CRISPR gRNA sequence
taagtaatagaataggattt

SEQ ID NO: 228980 - DNA, 20 bp, Artificial
  CRISPR gRNA sequence
aagtaatagaataggatttt

SEQ ID NO: 228981 - DNA, 20 bp, Artificial
  CRISPR gRNA sequence
agtaatagaataggattttt

SEQ ID NO: 228982 - DNA, 20 bp, Artificial
  CRISPR gRNA sequence
ttaattgttccagtgtttct

SEQ ID NO: 228983 - DNA, 20 bp, Artificial
  CRISPR gRNA sequence
taattgttccagtgtttctg

SEQ ID NO: 228984 - DNA, 20 bp, Artificial
  CRISPR gRNA sequence
aattgttccagtgtttctgt

SEQ ID NO: 228985 - DNA, 20 bp, Artificial
  CRISPR gRNA sequence
attgttccagtgtttctgtg

SEQ ID NO: 228986 - DNA, 20 bp, Artificial
  CRISPR gRNA sequence
ttccagtgtttctgtgatag

SEQ ID NO: 228987 - DNA, 20 bp, Artificial
  CRISPR gRNA sequence
cagtgtttctgtgatagagc

SEQ ID NO: 228988 - DNA, 20 bp, Artificial
  CRISPR gRNA sequence
ctgtgatagagctgtcctgc

SEQ ID NO: 228989 - DNA, 20 bp, Artificial
  CRISPR gRNA sequence
tgtgatagagctgtcctgca

SEQ ID NO: 228990 - DNA, 20 bp, Artificial
  CRISPR gRNA sequence
tgatagagctgtcctgcaca

SEQ ID NO: 228991 - DNA, 20 bp, Artificial
  CRISPR gRNA sequence
tcctgcacagacctgtttgt

SEQ ID NO: 228992 - DNA, 20 bp, Artificial
  CRISPR gRNA sequence
cacagacctgtttgtttgtc

SEQ ID NO: 228993 - DNA, 20 bp, Artificial
  CRISPR gRNA sequence
tttgtttgtcacttgctctt

SEQ ID NO: 228994 - DNA, 20 bp, Artificial
  CRISPR gRNA sequence
gtttgtcacttgctcttttt

SEQ ID NO: 228995 - DNA, 20 bp, Artificial
  CRISPR gRNA sequence
tttgtcacttgctctttttc

SEQ ID NO: 228996 - DNA, 20 bp, Artificial
  CRISPR gRNA sequence
gtcacttgctctttttcttg

SEQ ID NO: 228997 - DNA, 20 bp, Artificial
  CRISPR gRNA sequence
tcacttgctctttttcttgc

SEQ ID NO: 228998 - DNA, 20 bp, Artificial
  CRISPR gRNA sequence
gctctttttcttgcagacat

SEQ ID NO: 228999 - DNA, 20 bp, Artificial
  CRISPR gRNA sequence
ctctttttcttgcagacata

SEQ ID NO: 229000 - DNA, 20 bp, Artificial
  CRISPR gRNA sequence
tttttcttgcagacatagac

SEQ ID NO: 229001 - DNA, 20 bp, Artificial
  CRISPR gRNA sequence
tttcttgcagacatagacac

SEQ ID NO: 229002 - DNA, 20 bp, Artificial
  CRISPR gRNA sequence
ttcttgcagacatagacacc

SEQ ID NO: 229003 - DNA, 20 bp, Artificial
  CRISPR gRNA sequence
tcttgcagacatagacaccc

SEQ ID NO: 229004 - DNA, 20 bp, Artificial
  CRISPR gRNA sequence
cttgcagacatagacacccc

SEQ ID NO: 229005 - DNA, 20 bp, Artificial
  CRISPR gRNA sequence
ttgcagacatagacacccca

SEQ ID NO: 229006 - DNA, 20 bp, Artificial
  CRISPR gRNA sequence
gcagacatagacaccccaga

SEQ ID NO: 229007 - DNA, 20 bp, Artificial
  CRISPR gRNA sequence
cagacatagacaccccagac

SEQ ID NO: 229008 - DNA, 20 bp, Artificial
  CRISPR gRNA sequence
aaattcacaatctatcaatt

SEQ ID NO: 229009 - DNA, 20 bp, Artificial
  CRISPR gRNA sequence
acaatctatcaattttgttc

SEQ ID NO: 229010 - DNA, 20 bp, Artificial
  CRISPR gRNA sequence
tcaattttgttcatttaaag

SEQ ID NO: 229011 - DNA, 20 bp, Artificial
  CRISPR gRNA sequence
tgttcatttaaagagcagtg

SEQ ID NO: 229012 - DNA, 20 bp, Artificial
  CRISPR gRNA sequence
gttcatttaaagagcagtga

SEQ ID NO: 229013 - DNA, 20 bp, Artificial
  CRISPR gRNA sequence
ttcatttaaagagcagtgac

SEQ ID NO: 229014 - DNA, 20 bp, Artificial
  CRISPR gRNA sequence
atttaaagagcagtgacctc

SEQ ID NO: 229015 - DNA, 20 bp, Artificial
  CRISPR gRNA sequence
aaagagcagtgacctctaat

SEQ ID NO: 229016 - DNA, 20 bp, Artificial
  CRISPR gRNA sequence
aagagcagtgacctctaatg

SEQ ID NO: 229017 - DNA, 20 bp, Artificial
  CRISPR gRNA sequence
taatgcatgactttaaaaca

SEQ ID NO: 229018 - DNA, 20 bp, Artificial
  CRISPR gRNA sequence
atgcatgactttaaaacagt

SEQ ID NO: 229019 - DNA, 20 bp, Artificial
  CRISPR gRNA sequence
taaaacagttctagttaaaa

SEQ ID NO: 229020 - DNA, 20 bp, Artificial
  CRISPR gRNA sequence
aaaacagttctagttaaaac

SEQ ID NO: 229021 - DNA, 20 bp, Artificial
  CRISPR gRNA sequence
aaacagttctagttaaaacc

SEQ ID NO: 229022 - DNA, 20 bp, Artificial
  CRISPR gRNA sequence
tagttaaaaccaatataatg

SEQ ID NO: 229023 - DNA, 20 bp, Artificial
  CRISPR gRNA sequence
gttaaaaccaatataatgaa

SEQ ID NO: 229024 - DNA, 20 bp, Artificial
  CRISPR gRNA sequence
aaaccaatataatgaaaaca

SEQ ID NO: 229025 - DNA, 20 bp, Artificial
  CRISPR gRNA sequence
agtttcaaaatttaggcttt

SEQ ID NO: 229026 - DNA, 20 bp, Artificial
  CRISPR gRNA sequence
caaaatttaggcttttactc

SEQ ID NO: 229027 - DNA, 20 bp, Artificial
  CRISPR gRNA sequence
aaaatttaggcttttactcc

SEQ ID NO: 229028 - DNA, 20 bp, Artificial
  CRISPR gRNA sequence
aggcttttactccttttaaa

SEQ ID NO: 229029 - DNA, 20 bp, Artificial
  CRISPR gRNA sequence
ggcttttactccttttaaaa

SEQ ID NO: 229030 - DNA, 20 bp, Artificial
  CRISPR gRNA sequence
ttactccttttaaaatcaat

SEQ ID NO: 229031 - DNA, 20 bp, Artificial
  CRISPR gRNA sequence
tactccttttaaaatcaatt

SEQ ID NO: 229032 - DNA, 20 bp, Artificial
  CRISPR gRNA sequence
actccttttaaaatcaatta

SEQ ID NO: 229033 - DNA, 20 bp, Artificial
  CRISPR gRNA sequence
ctccttttaaaatcaattat

SEQ ID NO: 229034 - DNA, 20 bp, Artificial
  CRISPR gRNA sequence
cttttaaaatcaattattag

SEQ ID NO: 229035 - DNA, 20 bp, Artificial
  CRISPR gRNA sequence
ttaaaatcaattattagtaa

SEQ ID NO: 229036 - DNA, 20 bp, Artificial
  CRISPR gRNA sequence
taaaatcaattattagtaag

SEQ ID NO: 229037 - DNA, 20 bp, Artificial
  CRISPR gRNA sequence
aaaatcaattattagtaagt

SEQ ID NO: 229038 - DNA, 20 bp, Artificial
  CRISPR gRNA sequence
aaatcaattattagtaagta

SEQ ID NO: 229039 - DNA, 20 bp, Artificial
  CRISPR gRNA sequence
ttagtaagtatggaatttac

SEQ ID NO: 229040 - DNA, 20 bp, Artificial
  CRISPR gRNA sequence
gtaagtatggaatttacttc

SEQ ID NO: 229041 - DNA, 20 bp, Artificial
  CRISPR gRNA sequence
acttcattgtttctaacttg

SEQ ID NO: 229042 - DNA, 20 bp, Artificial
  CRISPR gRNA sequence
cttcattgtttctaacttgt

SEQ ID NO: 229043 - DNA, 20 bp, Artificial
  CRISPR gRNA sequence
cattgtttctaacttgtata

SEQ ID NO: 229044 - DNA, 20 bp, Artificial
  CRISPR gRNA sequence
attgtttctaacttgtatat

SEQ ID NO: 229045 - DNA, 20 bp, Artificial
  CRISPR gRNA sequence
tttctaacttgtatatttaa

SEQ ID NO: 229046 - DNA, 20 bp, Artificial
  CRISPR gRNA sequence
ctaacttgtatatttaatct

SEQ ID NO: 229047 - DNA, 20 bp, Artificial
  CRISPR gRNA sequence
taacttgtatatttaatctg

SEQ ID NO: 229048 - DNA, 20 bp, Artificial
  CRISPR gRNA sequence
acttgtatatttaatctgcc

SEQ ID NO: 229049 - DNA, 20 bp, Artificial
  CRISPR gRNA sequence
gtatatttaatctgccaatt

SEQ ID NO: 229050 - DNA, 20 bp, Artificial
  CRISPR gRNA sequence
tatatttaatctgccaattt

SEQ ID NO: 229051 - DNA, 20 bp, Artificial
  CRISPR gRNA sequence
aatctgccaattttcaagta

SEQ ID NO: 229052 - DNA, 20 bp, Artificial
  CRISPR gRNA sequence
atctgccaattttcaagtaa

SEQ ID NO: 229053 - DNA, 20 bp, Artificial
  CRISPR gRNA sequence
ccaattttcaagtaacattt

SEQ ID NO: 229054 - DNA, 20 bp, Artificial
  CRISPR gRNA sequence
tcaagtaacatttctgcata

SEQ ID NO: 229055 - DNA, 20 bp, Artificial
  CRISPR gRNA sequence
caagtaacatttctgcataa

SEQ ID NO: 229056 - DNA, 20 bp, Artificial
  CRISPR gRNA sequence
aagtaacatttctgcataaa

SEQ ID NO: 229057 - DNA, 20 bp, Artificial
  CRISPR gRNA sequence
ctgcataaattcttattttt

SEQ ID NO: 229058 - DNA, 20 bp, Artificial
  CRISPR gRNA sequence
tgcataaattcttatttttt

SEQ ID NO: 229059 - DNA, 20 bp, Artificial
  CRISPR gRNA sequence
cataaattcttattttttat

SEQ ID NO: 229060 - DNA, 20 bp, Artificial
  CRISPR gRNA sequence
ttattttttattgagatata

SEQ ID NO: 229061 - DNA, 20 bp, Artificial
  CRISPR gRNA sequence
attttttattgagatatatg

SEQ ID NO: 229062 - DNA, 20 bp, Artificial
  CRISPR gRNA sequence
ttttttattgagatatatgt

SEQ ID NO: 229063 - DNA, 20 bp, Artificial
  CRISPR gRNA sequence
tttattgagatatatgtaca

SEQ ID NO: 229064 - DNA, 20 bp, Artificial
  CRISPR gRNA sequence
ttattgagatatatgtacac

SEQ ID NO: 229065 - DNA, 20 bp, Artificial
  CRISPR gRNA sequence
tattgagatatatgtacaca

SEQ ID NO: 229066 - DNA, 20 bp, Artificial
  CRISPR gRNA sequence
attgagatatatgtacacag

SEQ ID NO: 229067 - DNA, 20 bp, Artificial
  CRISPR gRNA sequence
ttgagatatatgtacacaga

SEQ ID NO: 229068 - DNA, 20 bp, Artificial
  CRISPR gRNA sequence
agatatatgtacacagagag

SEQ ID NO: 229069 - DNA, 20 bp, Artificial
  CRISPR gRNA sequence
tcaattgtgcctgaaactaa

SEQ ID NO: 229070 - DNA, 20 bp, Artificial
  CRISPR gRNA sequence
caattgtgcctgaaactaat

SEQ ID NO: 229071 - DNA, 20 bp, Artificial
  CRISPR gRNA sequence
aattgtgcctgaaactaatg

SEQ ID NO: 229072 - DNA, 20 bp, Artificial
  CRISPR gRNA sequence
tgcctgaaactaatgttatc

SEQ ID NO: 229073 - DNA, 20 bp, Artificial
  CRISPR gRNA sequence
aaactaatgttatcttacct

SEQ ID NO: 229074 - DNA, 20 bp, Artificial
  CRISPR gRNA sequence
atgttatcttacctaagctc

SEQ ID NO: 229075 - DNA, 20 bp, Artificial
  CRISPR gRNA sequence
tcttacctaagctcaagatg

SEQ ID NO: 229076 - DNA, 20 bp, Artificial
  CRISPR gRNA sequence
acctaagctcaagatgttcc

SEQ ID NO: 229077 - DNA, 20 bp, Artificial
  CRISPR gRNA sequence
cctaagctcaagatgttccc

SEQ ID NO: 229078 - DNA, 20 bp, Artificial
  CRISPR gRNA sequence
agctcaagatgttcccaata

SEQ ID NO: 229079 - DNA, 20 bp, Artificial
  CRISPR gRNA sequence
aagatgttcccaataatgta

SEQ ID NO: 229080 - DNA, 20 bp, Artificial
  CRISPR gRNA sequence
ccaataatgtaatttatatt

SEQ ID NO: 229081 - DNA, 20 bp, Artificial
  CRISPR gRNA sequence
atattagtttccgtttttta

SEQ ID NO: 229082 - DNA, 20 bp, Artificial
  CRISPR gRNA sequence
tattagtttccgttttttaa

SEQ ID NO: 229083 - DNA, 20 bp, Artificial
  CRISPR gRNA sequence
gtttccgttttttaaaaaaa

SEQ ID NO: 229084 - DNA, 20 bp, Artificial
  CRISPR gRNA sequence
ccgttttttaaaaaaattat

SEQ ID NO: 229085 - DNA, 20 bp, Artificial
  CRISPR gRNA sequence
cgttttttaaaaaaattata

SEQ ID NO: 229086 - DNA, 20 bp, Artificial
  CRISPR gRNA sequence
tttaaaaaaattatattttt

SEQ ID NO: 229087 - DNA, 20 bp, Artificial
  CRISPR gRNA sequence
ttaaaaaaattatattttta

SEQ ID NO: 229088 - DNA, 20 bp, Artificial
  CRISPR gRNA sequence
taaaaaaattatatttttat

SEQ ID NO: 229089 - DNA, 20 bp, Artificial
  CRISPR gRNA sequence
aaaaaaattatatttttatg

SEQ ID NO: 229090 - DNA, 20 bp, Artificial
  CRISPR gRNA sequence
aaaaaattatatttttatga

SEQ ID NO: 229091 - DNA, 20 bp, Artificial
  CRISPR gRNA sequence
tatttttatgaaataaaaca

SEQ ID NO: 229092 - DNA, 20 bp, Artificial
  CRISPR gRNA sequence
ttatgaaataaaacatactc

SEQ ID NO: 229093 - DNA, 20 bp, Artificial
  CRISPR gRNA sequence
tatgaaataaaacatactct

SEQ ID NO: 229094 - DNA, 20 bp, Artificial
  CRISPR gRNA sequence
atgaaataaaacatactctt

SEQ ID NO: 229095 - DNA, 20 bp, Artificial
  CRISPR gRNA sequence
tgaaataaaacatactctta

SEQ ID NO: 229096 - DNA, 20 bp, Artificial
  CRISPR gRNA sequence
ttaaccacctatcaaaataa

SEQ ID NO: 229097 - DNA, 20 bp, Artificial
  CRISPR gRNA sequence
aaccacctatcaaaataatc

SEQ ID NO: 229098 - DNA, 20 bp, Artificial
  CRISPR gRNA sequence
accacctatcaaaataatca

SEQ ID NO: 229099 - DNA, 20 bp, Artificial
  CRISPR gRNA sequence
tcaaaataatcaaaagttat

SEQ ID NO: 229100 - DNA, 20 bp, Artificial
  CRISPR gRNA sequence
taaattaatggagtaaaaaa

SEQ ID NO: 229101 - DNA, 20 bp, Artificial
  CRISPR gRNA sequence
atggagtaaaaaaatagtgt

SEQ ID NO: 229102 - DNA, 20 bp, Artificial
  CRISPR gRNA sequence
ctgctttgctttaggtaaac

SEQ ID NO: 229103 - DNA, 20 bp, Artificial
  CRISPR gRNA sequence
tgctttgctttaggtaaact

SEQ ID NO: 229104 - DNA, 20 bp, Artificial
  CRISPR gRNA sequence
ctttgctttaggtaaacttt

SEQ ID NO: 229105 - DNA, 20 bp, Artificial
  CRISPR gRNA sequence
tgctttaggtaaactttgct

SEQ ID NO: 229106 - DNA, 20 bp, Artificial
  CRISPR gRNA sequence
gctttaggtaaactttgctg

SEQ ID NO: 229107 - DNA, 20 bp, Artificial
  CRISPR gRNA sequence
ctttaggtaaactttgctgt

SEQ ID NO: 229108 - DNA, 20 bp, Artificial
  CRISPR gRNA sequence
taggtaaactttgctgtatg

SEQ ID NO: 229109 - DNA, 20 bp, Artificial
  CRISPR gRNA sequence
aggtaaactttgctgtatgt

SEQ ID NO: 229110 - DNA, 20 bp, Artificial
  CRISPR gRNA sequence
ggtaaactttgctgtatgtg

SEQ ID NO: 229111 - DNA, 20 bp, Artificial
  CRISPR gRNA sequence
tgctgtatgtgtttctaaaa

SEQ ID NO: 229112 - DNA, 20 bp, Artificial
  CRISPR gRNA sequence
gctgtatgtgtttctaaaac

SEQ ID NO: 229113 - DNA, 20 bp, Artificial
  CRISPR gRNA sequence
ctgtatgtgtttctaaaact

SEQ ID NO: 229114 - DNA, 20 bp, Artificial
  CRISPR gRNA sequence
tatgtgtttctaaaacttaa

SEQ ID NO: 229115 - DNA, 20 bp, Artificial
  CRISPR gRNA sequence
ctaaaacttaatacgaaact

SEQ ID NO: 229116 - DNA, 20 bp, Artificial
  CRISPR gRNA sequence
taaaacttaatacgaaactt

SEQ ID NO: 229117 - DNA, 20 bp, Artificial
  CRISPR gRNA sequence
aaacttaatacgaaacttga

SEQ ID NO: 229118 - DNA, 20 bp, Artificial
  CRISPR gRNA sequence
aatacgaaacttgaattgtt

SEQ ID NO: 229119 - DNA, 20 bp, Artificial
  CRISPR gRNA sequence
atacgaaacttgaattgtta

SEQ ID NO: 229120 - DNA, 20 bp, Artificial
  CRISPR gRNA sequence
gaattgttatagtcaaataa

SEQ ID NO: 229121 - DNA, 20 bp, Artificial
  CRISPR gRNA sequence
aattgttatagtcaaataat

SEQ ID NO: 229122 - DNA, 20 bp, Artificial
  CRISPR gRNA sequence
ttatagtcaaataatttctc

SEQ ID NO: 229123 - DNA, 20 bp, Artificial
  CRISPR gRNA sequence
tagtcaaataatttctcata

SEQ ID NO: 229124 - DNA, 20 bp, Artificial
  CRISPR gRNA sequence
ctcatatgactcacataata

SEQ ID NO: 229125 - DNA, 20 bp, Artificial
  CRISPR gRNA sequence
tcatatgactcacataatag

SEQ ID NO: 229126 - DNA, 20 bp, Artificial
  CRISPR gRNA sequence
atatgactcacataatagtt

SEQ ID NO: 229127 - DNA, 20 bp, Artificial
  CRISPR gRNA sequence
acataatagtttcaaaaaac

SEQ ID NO: 229128 - DNA, 20 bp, Artificial
  CRISPR gRNA sequence
caaaaaacttttacctttat

SEQ ID NO: 229129 - DNA, 20 bp, Artificial
  CRISPR gRNA sequence
aaaaaacttttacctttatt

SEQ ID NO: 229130 - DNA, 20 bp, Artificial
  CRISPR gRNA sequence
ttacctttatttctgaactt

SEQ ID NO: 229131 - DNA, 20 bp, Artificial
  CRISPR gRNA sequence
tacctttatttctgaacttt

SEQ ID NO: 229132 - DNA, 20 bp, Artificial
  CRISPR gRNA sequence
acctttatttctgaactttg

SEQ ID NO: 229133 - DNA, 20 bp, Artificial
  CRISPR gRNA sequence
cctttatttctgaactttgg

SEQ ID NO: 229134 - DNA, 20 bp, Artificial
  CRISPR gRNA sequence
tatttctgaactttggttct

SEQ ID NO: 229135 - DNA, 20 bp, Artificial
  CRISPR gRNA sequence
atttctgaactttggttctt

SEQ ID NO: 229136 - DNA, 20 bp, Artificial
  CRISPR gRNA sequence
tttctgaactttggttcttg

SEQ ID NO: 229137 - DNA, 20 bp, Artificial
  CRISPR gRNA sequence
ctgaactttggttcttgatg

SEQ ID NO: 229138 - DNA, 20 bp, Artificial
  CRISPR gRNA sequence
tgaactttggttcttgatga

SEQ ID NO: 229139 - DNA, 20 bp, Artificial
  CRISPR gRNA sequence
aactttggttcttgatgatt

SEQ ID NO: 229140 - DNA, 20 bp, Artificial
  CRISPR gRNA sequence
tggttcttgatgattgttaa

SEQ ID NO: 229141 - DNA, 20 bp, Artificial
  CRISPR gRNA sequence
ggttcttgatgattgttaat

SEQ ID NO: 229142 - DNA, 20 bp, Artificial
  CRISPR gRNA sequence
gttcttgatgattgttaatt

SEQ ID NO: 229143 - DNA, 20 bp, Artificial
  CRISPR gRNA sequence
ttgatgattgttaattgaat

SEQ ID NO: 229144 - DNA, 20 bp, Artificial
  CRISPR gRNA sequence
gatgattgttaattgaattc

SEQ ID NO: 229145 - DNA, 20 bp, Artificial
  CRISPR gRNA sequence
atgattgttaattgaattca

SEQ ID NO: 229146 - DNA, 20 bp, Artificial
  CRISPR gRNA sequence
ttaattgaattcaattctgt

SEQ ID NO: 229147 - DNA, 20 bp, Artificial
  CRISPR gRNA sequence
attgaattcaattctgtcat

SEQ ID NO: 229148 - DNA, 20 bp, Artificial
  CRISPR gRNA sequence
aattcaattctgtcatatat

SEQ ID NO: 229149 - DNA, 20 bp, Artificial
  CRISPR gRNA sequence
aattctgtcatatattctgt

SEQ ID NO: 229150 - DNA, 20 bp, Artificial
  CRISPR gRNA sequence
tgtcatatattctgtgtctt

SEQ ID NO: 229151 - DNA, 20 bp, Artificial
  CRISPR gRNA sequence
tcatatattctgtgtctttc

SEQ ID NO: 229152 - DNA, 20 bp, Artificial
  CRISPR gRNA sequence
tgtgtctttctttaattaat

SEQ ID NO: 229153 - DNA, 20 bp, Artificial
  CRISPR gRNA sequence
tgtctttctttaattaatgc

SEQ ID NO: 229154 - DNA, 20 bp, Artificial
  CRISPR gRNA sequence
tctttaattaatgcttatta

SEQ ID NO: 229155 - DNA, 20 bp, Artificial
  CRISPR gRNA sequence
ctttaattaatgcttattag

SEQ ID NO: 229156 - DNA, 20 bp, Artificial
  CRISPR gRNA sequence
tttaattaatgcttattaga

SEQ ID NO: 229157 - DNA, 20 bp, Artificial
  CRISPR gRNA sequence
taattaatgcttattagata

SEQ ID NO: 229158 - DNA, 20 bp, Artificial
  CRISPR gRNA sequence
aattaatgcttattagataa

SEQ ID NO: 229159 - DNA, 20 bp, Artificial
  CRISPR gRNA sequence
attaatgcttattagataaa

SEQ ID NO: 229160 - DNA, 20 bp, Artificial
  CRISPR gRNA sequence
atgcttattagataaataat

SEQ ID NO: 229161 - DNA, 20 bp, Artificial
  CRISPR gRNA sequence
attagataaataattaaaat

SEQ ID NO: 229162 - DNA, 20 bp, Artificial
  CRISPR gRNA sequence
ttagataaataattaaaata

SEQ ID NO: 229163 - DNA, 20 bp, Artificial
  CRISPR gRNA sequence
gataaataattaaaatactt

SEQ ID NO: 229164 - DNA, 20 bp, Artificial
  CRISPR gRNA sequence
aaatacttaactaaaatctg

SEQ ID NO: 229165 - DNA, 20 bp, Artificial
  CRISPR gRNA sequence
aactaaaatctgcgtatcct

SEQ ID NO: 229166 - DNA, 20 bp, Artificial
  CRISPR gRNA sequence
actaaaatctgcgtatcctt

SEQ ID NO: 229167 - DNA, 20 bp, Artificial
  CRISPR gRNA sequence
aaatctgcgtatccttagca

SEQ ID NO: 229168 - DNA, 20 bp, Artificial
  CRISPR gRNA sequence
cgtatccttagcatatgagt

SEQ ID NO: 229169 - DNA, 20 bp, Artificial
  CRISPR gRNA sequence
agcatatgagttcataagtc

SEQ ID NO: 229170 - DNA, 20 bp, Artificial
  CRISPR gRNA sequence
gcatatgagttcataagtct

SEQ ID NO: 229171 - DNA, 20 bp, Artificial
  CRISPR gRNA sequence
ataagtcttagttgttgctc

SEQ ID NO: 229172 - DNA, 20 bp, Artificial
  CRISPR gRNA sequence
agttgttgctcaatgaaatt

SEQ ID NO: 229173 - DNA, 20 bp, Artificial
  CRISPR gRNA sequence
gttgttgctcaatgaaattt

SEQ ID NO: 229174 - DNA, 20 bp, Artificial
  CRISPR gRNA sequence
ttgctcaatgaaattttcta

SEQ ID NO: 229175 - DNA, 20 bp, Artificial
  CRISPR gRNA sequence
ctcaatgaaattttctaatt

SEQ ID NO: 229176 - DNA, 20 bp, Artificial
  CRISPR gRNA sequence
aatgaaattttctaatttta

SEQ ID NO: 229177 - DNA, 20 bp, Artificial
  CRISPR gRNA sequence
tctaattttataccacataa

SEQ ID NO: 229178 - DNA, 20 bp, Artificial
  CRISPR gRNA sequence
ctaattttataccacataat

SEQ ID NO: 229179 - DNA, 20 bp, Artificial
  CRISPR gRNA sequence
taattttataccacataatg

SEQ ID NO: 229180 - DNA, 20 bp, Artificial
  CRISPR gRNA sequence
attttataccacataatgcc

SEQ ID NO: 229181 - DNA, 20 bp, Artificial
  CRISPR gRNA sequence
tataccacataatgccataa

SEQ ID NO: 229182 - DNA, 20 bp, Artificial
  CRISPR gRNA sequence
ataccacataatgccataaa

SEQ ID NO: 229183 - DNA, 20 bp, Artificial
  CRISPR gRNA sequence
taccacataatgccataaaa

SEQ ID NO: 229184 - DNA, 20 bp, Artificial
  CRISPR gRNA sequence
aagcagaatggaattcatgt

SEQ ID NO: 229185 - DNA, 20 bp, Artificial
  CRISPR gRNA sequence
atgtggtagctacagtgaac

SEQ ID NO: 229186 - DNA, 20 bp, Artificial
  CRISPR gRNA sequence
cagtgaacatcttgaatgtt

SEQ ID NO: 229187 - DNA, 20 bp, Artificial
  CRISPR gRNA sequence
gaatgttggtgcatattcta

SEQ ID NO: 229188 - DNA, 20 bp, Artificial
  CRISPR gRNA sequence
aatgttggtgcatattctat

SEQ ID NO: 229189 - DNA, 20 bp, Artificial
  CRISPR gRNA sequence
gtgcatattctatttttgtt

SEQ ID NO: 229190 - DNA, 20 bp, Artificial
  CRISPR gRNA sequence
tatttttgttacatcttcca

SEQ ID NO: 229191 - DNA, 20 bp, Artificial
  CRISPR gRNA sequence
tttttgttacatcttccaat

SEQ ID NO: 229192 - DNA, 20 bp, Artificial
  CRISPR gRNA sequence
ttgttacatcttccaatcac

SEQ ID NO: 229193 - DNA, 20 bp, Artificial
  CRISPR gRNA sequence
tgttacatcttccaatcacc

SEQ ID NO: 229194 - DNA, 20 bp, Artificial
  CRISPR gRNA sequence
gttacatcttccaatcacca

SEQ ID NO: 229195 - DNA, 20 bp, Artificial
  CRISPR gRNA sequence
ttacatcttccaatcaccat

SEQ ID NO: 229196 - DNA, 20 bp, Artificial
  CRISPR gRNA sequence
catcttccaatcaccatgtg

SEQ ID NO: 229197 - DNA, 20 bp, Artificial
  CRISPR gRNA sequence
ccaatcaccatgtgtctggt

SEQ ID NO: 229198 - DNA, 20 bp, Artificial
  CRISPR gRNA sequence
caatcaccatgtgtctggtt

SEQ ID NO: 229199 - DNA, 20 bp, Artificial
  CRISPR gRNA sequence
gttctggaagatgacactcc

SEQ ID NO: 229200 - DNA, 20 bp, Artificial
  CRISPR gRNA sequence
tggaagatgacactcctggt

SEQ ID NO: 229201 - DNA, 20 bp, Artificial
  CRISPR gRNA sequence
gaagatgacactcctggttt

SEQ ID NO: 229202 - DNA, 20 bp, Artificial
  CRISPR gRNA sequence
ctggttttgttgctccccac

SEQ ID NO: 229203 - DNA, 20 bp, Artificial
  CRISPR gRNA sequence
gttttgttgctccccacaaa

SEQ ID NO: 229204 - DNA, 20 bp, Artificial
  CRISPR gRNA sequence
tgttgctccccacaaatgcc

SEQ ID NO: 229205 - DNA, 20 bp, Artificial
  CRISPR gRNA sequence
gttgctccccacaaatgcct

SEQ ID NO: 229206 - DNA, 20 bp, Artificial
  CRISPR gRNA sequence
ttgctccccacaaatgcctg

SEQ ID NO: 229207 - DNA, 20 bp, Artificial
  CRISPR gRNA sequence
ctccccacaaatgcctgaga

SEQ ID NO: 229208 - DNA, 20 bp, Artificial
  CRISPR gRNA sequence
cccacaaatgcctgagaata

SEQ ID NO: 229209 - DNA, 20 bp, Artificial
  CRISPR gRNA sequence
agaatagtgtgtgatttgca

SEQ ID NO: 229210 - DNA, 20 bp, Artificial
  CRISPR gRNA sequence
gcagtatccatacaactctg

SEQ ID NO: 229211 - DNA, 20 bp, Artificial
  CRISPR gRNA sequence
cagtatccatacaactctgg

SEQ ID NO: 229212 - DNA, 20 bp, Artificial
  CRISPR gRNA sequence
tggtgaagtagtatgagata

SEQ ID NO: 229213 - DNA, 20 bp, Artificial
  CRISPR gRNA sequence
gtgaagtagtatgagatacc

SEQ ID NO: 229214 - DNA, 20 bp, Artificial
  CRISPR gRNA sequence
tggctgacgggcagcacgct

SEQ ID NO: 229215 - DNA, 20 bp, Artificial
  CRISPR gRNA sequence
ggctgacgggcagcacgctc

SEQ ID NO: 229216 - DNA, 20 bp, Artificial
  CRISPR gRNA sequence
gctgacgggcagcacgctct

SEQ ID NO: 229217 - DNA, 20 bp, Artificial
  CRISPR gRNA sequence
acgggcagcacgctcttatt

SEQ ID NO: 229218 - DNA, 20 bp, Artificial
  CRISPR gRNA sequence
ttattttttcctcactatct

SEQ ID NO: 229219 - DNA, 20 bp, Artificial
  CRISPR gRNA sequence
attttttcctcactatctgg

SEQ ID NO: 229220 - DNA, 20 bp, Artificial
  CRISPR gRNA sequence
ttttttcctcactatctggg

SEQ ID NO: 229221 - DNA, 20 bp, Artificial
  CRISPR gRNA sequence
tttcctcactatctgggttg

SEQ ID NO: 229222 - DNA, 20 bp, Artificial
  CRISPR gRNA sequence
ttcctcactatctgggttgt

SEQ ID NO: 229223 - DNA, 20 bp, Artificial
  CRISPR gRNA sequence
tcctcactatctgggttgtc

SEQ ID NO: 229224 - DNA, 20 bp, Artificial
  CRISPR gRNA sequence
cctcactatctgggttgtcc

SEQ ID NO: 229225 - DNA, 20 bp, Artificial
  CRISPR gRNA sequence
ctcactatctgggttgtcct

SEQ ID NO: 229226 - DNA, 20 bp, Artificial
  CRISPR gRNA sequence
actatctgggttgtcctccc

SEQ ID NO: 229227 - DNA, 20 bp, Artificial
  CRISPR gRNA sequence
tctgggttgtcctccctttt

SEQ ID NO: 229228 - DNA, 20 bp, Artificial
  CRISPR gRNA sequence
ggttgtcctcccttttactc

SEQ ID NO: 229229 - DNA, 20 bp, Artificial
  CRISPR gRNA sequence
tcctcccttttactcccatg

SEQ ID NO: 229230 - DNA, 20 bp, Artificial
  CRISPR gRNA sequence
ccttttactcccatgccacc

SEQ ID NO: 229231 - DNA, 20 bp, Artificial
  CRISPR gRNA sequence
ttactcccatgccaccccat

SEQ ID NO: 229232 - DNA, 20 bp, Artificial
  CRISPR gRNA sequence
tactcccatgccaccccatg

SEQ ID NO: 229233 - DNA, 20 bp, Artificial
  CRISPR gRNA sequence
actcccatgccaccccatgc

SEQ ID NO: 229234 - DNA, 20 bp, Artificial
  CRISPR gRNA sequence
ctcccatgccaccccatgcc

SEQ ID NO: 229235 - DNA, 20 bp, Artificial
  CRISPR gRNA sequence
ccatgccaccccatgccttc

SEQ ID NO: 229236 - DNA, 20 bp, Artificial
  CRISPR gRNA sequence
ccatatctagcatagaatga

SEQ ID NO: 229237 - DNA, 20 bp, Artificial
  CRISPR gRNA sequence
catatctagcatagaatgat

SEQ ID NO: 229238 - DNA, 20 bp, Artificial
  CRISPR gRNA sequence
gcatagaatgatcttcagta

SEQ ID NO: 229239 - DNA, 20 bp, Artificial
  CRISPR gRNA sequence
cagtacagttgccagcaggt

SEQ ID NO: 229240 - DNA, 20 bp, Artificial
  CRISPR gRNA sequence
agtacagttgccagcaggtc

SEQ ID NO: 229241 - DNA, 20 bp, Artificial
  CRISPR gRNA sequence
ccagcaggtctggtgacaat

SEQ ID NO: 229242 - DNA, 20 bp, Artificial
  CRISPR gRNA sequence
gtgacaatgtctcaagtgga

SEQ ID NO: 229243 - DNA, 20 bp, Artificial
  CRISPR gRNA sequence
aagtggaactaagcattgtc

SEQ ID NO: 229244 - DNA, 20 bp, Artificial
  CRISPR gRNA sequence
agcattgtctatctgccacc

SEQ ID NO: 229245 - DNA, 20 bp, Artificial
  CRISPR gRNA sequence
tctatctgccacctccttaa

SEQ ID NO: 229246 - DNA, 20 bp, Artificial
  CRISPR gRNA sequence
tctgccacctccttaacttc

SEQ ID NO: 229247 - DNA, 20 bp, Artificial
  CRISPR gRNA sequence
ccacctccttaacttcactc

SEQ ID NO: 229248 - DNA, 20 bp, Artificial
  CRISPR gRNA sequence
cttaacttcactctcctgcc

SEQ ID NO: 229249 - DNA, 20 bp, Artificial
  CRISPR gRNA sequence
aacttcactctcctgccttc

SEQ ID NO: 229250 - DNA, 20 bp, Artificial
  CRISPR gRNA sequence
acttcactctcctgccttct

SEQ ID NO: 229251 - DNA, 20 bp, Artificial
  CRISPR gRNA sequence
cactctcctgccttctccat

SEQ ID NO: 229252 - DNA, 20 bp, Artificial
  CRISPR gRNA sequence
actctcctgccttctccatc

SEQ ID NO: 229253 - DNA, 20 bp, Artificial
  CRISPR gRNA sequence
tcctgccttctccatcactt

SEQ ID NO: 229254 - DNA, 20 bp, Artificial
  CRISPR gRNA sequence
ctgccttctccatcacttac

SEQ ID NO: 229255 - DNA, 20 bp, Artificial
  CRISPR gRNA sequence
ccttctccatcacttacgtt

SEQ ID NO: 229256 - DNA, 20 bp, Artificial
  CRISPR gRNA sequence
ctccatcacttacgttcctc

SEQ ID NO: 229257 - DNA, 20 bp, Artificial
  CRISPR gRNA sequence
tccatcacttacgttcctcc

SEQ ID NO: 229258 - DNA, 20 bp, Artificial
  CRISPR gRNA sequence
catcacttacgttcctccaa

SEQ ID NO: 229259 - DNA, 20 bp, Artificial
  CRISPR gRNA sequence
acgttcctccaagcctgtga

SEQ ID NO: 229260 - DNA, 20 bp, Artificial
  CRISPR gRNA sequence
cgttcctccaagcctgtgaa

SEQ ID NO: 229261 - DNA, 20 bp, Artificial
  CRISPR gRNA sequence
ctccaagcctgtgaaaccac

SEQ ID NO: 229262 - DNA, 20 bp, Artificial
  CRISPR gRNA sequence
caagcctgtgaaaccactgt

SEQ ID NO: 229263 - DNA, 20 bp, Artificial
  CRISPR gRNA sequence
tgaaaccactgtactgtacc

SEQ ID NO: 229264 - DNA, 20 bp, Artificial
  CRISPR gRNA sequence
tactgtacctgtcactgttc

SEQ ID NO: 229265 - DNA, 20 bp, Artificial
  CRISPR gRNA sequence
tacctgtcactgttctgaca

SEQ ID NO: 229266 - DNA, 20 bp, Artificial
  CRISPR gRNA sequence
tcactgttctgacattaaaa

SEQ ID NO: 229267 - DNA, 20 bp, Artificial
  CRISPR gRNA sequence
ttctgacattaaaattaaaa

SEQ ID NO: 229268 - DNA, 20 bp, Artificial
  CRISPR gRNA sequence
tgacattaaaattaaaatga

SEQ ID NO: 229269 - DNA, 20 bp, Artificial
  CRISPR gRNA sequence
acattaaaattaaaatgact

SEQ ID NO: 229270 - DNA, 20 bp, Artificial
  CRISPR gRNA sequence
aaattaaaatgacttaaatc

SEQ ID NO: 229271 - DNA, 20 bp, Artificial
  CRISPR gRNA sequence
aaatgacttaaatcttgaca

SEQ ID NO: 229272 - DNA, 20 bp, Artificial
  CRISPR gRNA sequence
aaatcttgacaagtacccca

SEQ ID NO: 229273 - DNA, 20 bp, Artificial
  CRISPR gRNA sequence
aatcttgacaagtaccccaa

SEQ ID NO: 229274 - DNA, 20 bp, Artificial
  CRISPR gRNA sequence
gacaagtaccccaaattatt

SEQ ID NO: 229275 - DNA, 20 bp, Artificial
  CRISPR gRNA sequence
acaagtaccccaaattattt

SEQ ID NO: 229276 - DNA, 20 bp, Artificial
  CRISPR gRNA sequence
ttttttctttgtcataggtt

SEQ ID NO: 229277 - DNA, 20 bp, Artificial
  CRISPR gRNA sequence
tttctttgtcataggttagc

SEQ ID NO: 229278 - DNA, 20 bp, Artificial
  CRISPR gRNA sequence
ttctttgtcataggttagca

SEQ ID NO: 229279 - DNA, 20 bp, Artificial
  CRISPR gRNA sequence
tctttgtcataggttagcat

SEQ ID NO: 229280 - DNA, 20 bp, Artificial
  CRISPR gRNA sequence
ctttgtcataggttagcata

SEQ ID NO: 229281 - DNA, 20 bp, Artificial
  CRISPR gRNA sequence
tttgtcataggttagcatat

SEQ ID NO: 229282 - DNA, 20 bp, Artificial
  CRISPR gRNA sequence
tgtcataggttagcatataa

SEQ ID NO: 229283 - DNA, 20 bp, Artificial
  CRISPR gRNA sequence
gtcataggttagcatataag

SEQ ID NO: 229284 - DNA, 20 bp, Artificial
  CRISPR gRNA sequence
tcataggttagcatataagt

SEQ ID NO: 229285 - DNA, 20 bp, Artificial
  CRISPR gRNA sequence
gcatataagtatactatatg

SEQ ID NO: 229286 - DNA, 20 bp, Artificial
  CRISPR gRNA sequence
tatgctaaaatttatgctat

SEQ ID NO: 229287 - DNA, 20 bp, Artificial
  CRISPR gRNA sequence
aaatttatgctatatgttta

SEQ ID NO: 229288 - DNA, 20 bp, Artificial
  CRISPR gRNA sequence
atgctatatgtttaaaattt

SEQ ID NO: 229289 - DNA, 20 bp, Artificial
  CRISPR gRNA sequence
tgctatatgtttaaaattta

SEQ ID NO: 229290 - DNA, 20 bp, Artificial
  CRISPR gRNA sequence
tatgtttaaaatttagtgca

SEQ ID NO: 229291 - DNA, 20 bp, Artificial
  CRISPR gRNA sequence
aaaatttagtgcaattttat

SEQ ID NO: 229292 - DNA, 20 bp, Artificial
  CRISPR gRNA sequence
aaatttagtgcaattttatt

SEQ ID NO: 229293 - DNA, 20 bp, Artificial
  CRISPR gRNA sequence
agtgcaattttattgatagt

SEQ ID NO: 229294 - DNA, 20 bp, Artificial
  CRISPR gRNA sequence
gtgcaattttattgatagtg

SEQ ID NO: 229295 - DNA, 20 bp, Artificial
  CRISPR gRNA sequence
tattgatagtgtcctaattt

SEQ ID NO: 229296 - DNA, 20 bp, Artificial
  CRISPR gRNA sequence
attgatagtgtcctaatttt

SEQ ID NO: 229297 - DNA, 20 bp, Artificial
  CRISPR gRNA sequence
ttgatagtgtcctaatttta

SEQ ID NO: 229298 - DNA, 20 bp, Artificial
  CRISPR gRNA sequence
atagtgtcctaattttattg

SEQ ID NO: 229299 - DNA, 20 bp, Artificial
  CRISPR gRNA sequence
attttattgatagtatccta

SEQ ID NO: 229300 - DNA, 20 bp, Artificial
  CRISPR gRNA sequence
tattgatagtatcctaaatt

SEQ ID NO: 229301 - DNA, 20 bp, Artificial
  CRISPR gRNA sequence
attgatagtatcctaaatta

SEQ ID NO: 229302 - DNA, 20 bp, Artificial
  CRISPR gRNA sequence
ttgatagtatcctaaattaa

SEQ ID NO: 229303 - DNA, 20 bp, Artificial
  CRISPR gRNA sequence
atagtatcctaaattaactt

SEQ ID NO: 229304 - DNA, 20 bp, Artificial
  CRISPR gRNA sequence
aattaactttttaaatcaac

SEQ ID NO: 229305 - DNA, 20 bp, Artificial
  CRISPR gRNA sequence
actttttaaatcaacttgtc

SEQ ID NO: 229306 - DNA, 20 bp, Artificial
  CRISPR gRNA sequence
tttaaatcaacttgtctgat

SEQ ID NO: 229307 - DNA, 20 bp, Artificial
  CRISPR gRNA sequence
ttaaatcaacttgtctgatg

SEQ ID NO: 229308 - DNA, 20 bp, Artificial
  CRISPR gRNA sequence
taaatcaacttgtctgatgc

SEQ ID NO: 229309 - DNA, 20 bp, Artificial
  CRISPR gRNA sequence
aaatcaacttgtctgatgcc

SEQ ID NO: 229310 - DNA, 20 bp, Artificial
  CRISPR gRNA sequence
aatcaacttgtctgatgcca

SEQ ID NO: 229311 - DNA, 20 bp, Artificial
  CRISPR gRNA sequence
gtctgatgccagggttcaga

SEQ ID NO: 229312 - DNA, 20 bp, Artificial
  CRISPR gRNA sequence
tctgatgccagggttcagag

SEQ ID NO: 229313 - DNA, 20 bp, Artificial
  CRISPR gRNA sequence
atgccagggttcagagggac

SEQ ID NO: 229314 - DNA, 20 bp, Artificial
  CRISPR gRNA sequence
agagggacacctacagtcag

SEQ ID NO: 229315 - DNA, 20 bp, Artificial
  CRISPR gRNA sequence
cagtcagttgaaaggcaaga

SEQ ID NO: 229316 - DNA, 20 bp, Artificial
  CRISPR gRNA sequence
aaaggcaagaagagacaagg

SEQ ID NO: 229317 - DNA, 20 bp, Artificial
  CRISPR gRNA sequence
ctctttagataacatggtag

SEQ ID NO: 229318 - DNA, 20 bp, Artificial
  CRISPR gRNA sequence
tttagataacatggtagact

SEQ ID NO: 229319 - DNA, 20 bp, Artificial
  CRISPR gRNA sequence
tagataacatggtagactag

SEQ ID NO: 229320 - DNA, 20 bp, Artificial
  CRISPR gRNA sequence
agataacatggtagactagg

SEQ ID NO: 229321 - DNA, 20 bp, Artificial
  CRISPR gRNA sequence
gataacatggtagactagga

SEQ ID NO: 229322 - DNA, 20 bp, Artificial
  CRISPR gRNA sequence
ggaggaacattaatatggtt

SEQ ID NO: 229323 - DNA, 20 bp, Artificial
  CRISPR gRNA sequence
atatggtttgcttatataat

SEQ ID NO: 229324 - DNA, 20 bp, Artificial
  CRISPR gRNA sequence
gcttatataatctgactgtg

SEQ ID NO: 229325 - DNA, 20 bp, Artificial
  CRISPR gRNA sequence
cttatataatctgactgtgt

SEQ ID NO: 229326 - DNA, 20 bp, Artificial
  CRISPR gRNA sequence
atataatctgactgtgtaaa

SEQ ID NO: 229327 - DNA, 20 bp, Artificial
  CRISPR gRNA sequence
tataatctgactgtgtaaat

SEQ ID NO: 229328 - DNA, 20 bp, Artificial
  CRISPR gRNA sequence
actgtgtaaatctgaatcta

SEQ ID NO: 229329 - DNA, 20 bp, Artificial
  CRISPR gRNA sequence
tgtaaatctgaatctatgta

SEQ ID NO: 229330 - DNA, 20 bp, Artificial
  CRISPR gRNA sequence
aatctatgtaacattaaggt

SEQ ID NO: 229331 - DNA, 20 bp, Artificial
  CRISPR gRNA sequence
tgtaacattaaggttgcaaa

SEQ ID NO: 229332 - DNA, 20 bp, Artificial
  CRISPR gRNA sequence
aggttgcaaatttgagcgtt

SEQ ID NO: 229333 - DNA, 20 bp, Artificial
  CRISPR gRNA sequence
caaatttgagcgtttatatt

SEQ ID NO: 229334 - DNA, 20 bp, Artificial
  CRISPR gRNA sequence
gagcgtttatattaggaagt

SEQ ID NO: 229335 - DNA, 20 bp, Artificial
  CRISPR gRNA sequence
agcgtttatattaggaagtt

SEQ ID NO: 229336 - DNA, 20 bp, Artificial
  CRISPR gRNA sequence
atattaggaagttaaaattt

SEQ ID NO: 229337 - DNA, 20 bp, Artificial
  CRISPR gRNA sequence
tattaggaagttaaaatttt

SEQ ID NO: 229338 - DNA, 20 bp, Artificial
  CRISPR gRNA sequence
ggaagttaaaattttaagtg

SEQ ID NO: 229339 - DNA, 20 bp, Artificial
  CRISPR gRNA sequence
aaattttaagtgtctccaaa

SEQ ID NO: 229340 - DNA, 20 bp, Artificial
  CRISPR gRNA sequence
taagtgtctccaaaataatt

SEQ ID NO: 229341 - DNA, 20 bp, Artificial
  CRISPR gRNA sequence
aagtgtctccaaaataattt

SEQ ID NO: 229342 - DNA, 20 bp, Artificial
  CRISPR gRNA sequence
agtgtctccaaaataatttt

SEQ ID NO: 229343 - DNA, 20 bp, Artificial
  CRISPR gRNA sequence
caaaataatttttactcatt

SEQ ID NO: 229344 - DNA, 20 bp, Artificial
  CRISPR gRNA sequence
ttactcattgcacgtgttct

SEQ ID NO: 229345 - DNA, 20 bp, Artificial
  CRISPR gRNA sequence
tactcattgcacgtgttctg

SEQ ID NO: 229346 - DNA, 20 bp, Artificial
  CRISPR gRNA sequence
actcattgcacgtgttctgt

SEQ ID NO: 229347 - DNA, 20 bp, Artificial
  CRISPR gRNA sequence
ctcattgcacgtgttctgtt

SEQ ID NO: 229348 - DNA, 20 bp, Artificial
  CRISPR gRNA sequence
attgcacgtgttctgtttta

SEQ ID NO: 229349 - DNA, 20 bp, Artificial
  CRISPR gRNA sequence
cacgtgttctgttttagaaa

SEQ ID NO: 229350 - DNA, 20 bp, Artificial
  CRISPR gRNA sequence
tgttttagaaaagcctaatg

SEQ ID NO: 229351 - DNA, 20 bp, Artificial
  CRISPR gRNA sequence
ttttagaaaagcctaatgat

SEQ ID NO: 229352 - DNA, 20 bp, Artificial
  CRISPR gRNA sequence
tagaaaagcctaatgattgt

SEQ ID NO: 229353 - DNA, 20 bp, Artificial
  CRISPR gRNA sequence
agaaaagcctaatgattgtg

SEQ ID NO: 229354 - DNA, 20 bp, Artificial
  CRISPR gRNA sequence
gaaaagcctaatgattgtgt

SEQ ID NO: 229355 - DNA, 20 bp, Artificial
  CRISPR gRNA sequence
atgattgtgttttgatttaa

SEQ ID NO: 229356 - DNA, 20 bp, Artificial
  CRISPR gRNA sequence
tgttttgatttaaatgcaat

SEQ ID NO: 229357 - DNA, 20 bp, Artificial
  CRISPR gRNA sequence
tgatttaaatgcaataaaat

SEQ ID NO: 229358 - DNA, 20 bp, Artificial
  CRISPR gRNA sequence
gatttaaatgcaataaaatc

SEQ ID NO: 229359 - DNA, 20 bp, Artificial
  CRISPR gRNA sequence
atttaaatgcaataaaatcc

SEQ ID NO: 229360 - DNA, 20 bp, Artificial
  CRISPR gRNA sequence
aaatgcaataaaatcctcaa

SEQ ID NO: 229361 - DNA, 20 bp, Artificial
  CRISPR gRNA sequence
aatgcaataaaatcctcaaa

SEQ ID NO: 229362 - DNA, 20 bp, Artificial
  CRISPR gRNA sequence
aaatagttaaaaatccaagc

SEQ ID NO: 229363 - DNA, 20 bp, Artificial
  CRISPR gRNA sequence
aaaatccaagctttctcttc

SEQ ID NO: 229364 - DNA, 20 bp, Artificial
  CRISPR gRNA sequence
tctcttcaagaagaagttaa

SEQ ID NO: 229365 - DNA, 20 bp, Artificial
  CRISPR gRNA sequence
ctcttcaagaagaagttaat

SEQ ID NO: 229366 - DNA, 20 bp, Artificial
  CRISPR gRNA sequence
tcttcaagaagaagttaatg

SEQ ID NO: 229367 - DNA, 20 bp, Artificial
  CRISPR gRNA sequence
ttcaagaagaagttaatgtc

SEQ ID NO: 229368 - DNA, 20 bp, Artificial
  CRISPR gRNA sequence
caagaagaagttaatgtcgc

SEQ ID NO: 229369 - DNA, 20 bp, Artificial
  CRISPR gRNA sequence
aagaagaagttaatgtcgct

SEQ ID NO: 229370 - DNA, 20 bp, Artificial
  CRISPR gRNA sequence
atgtcgctatgagattttta

SEQ ID NO: 229371 - DNA, 20 bp, Artificial
  CRISPR gRNA sequence
tgagatttttaacttttata

SEQ ID NO: 229372 - DNA, 20 bp, Artificial
  CRISPR gRNA sequence
ttaacttttataatttttat

SEQ ID NO: 229373 - DNA, 20 bp, Artificial
  CRISPR gRNA sequence
taacttttataatttttatt

SEQ ID NO: 229374 - DNA, 20 bp, Artificial
  CRISPR gRNA sequence
aacttttataatttttatta

SEQ ID NO: 229375 - DNA, 20 bp, Artificial
  CRISPR gRNA sequence
acttttataatttttattat

SEQ ID NO: 229376 - DNA, 20 bp, Artificial
  CRISPR gRNA sequence
ttataatttttattatttcc

SEQ ID NO: 229377 - DNA, 20 bp, Artificial
  CRISPR gRNA sequence
tataatttttattatttcca

SEQ ID NO: 229378 - DNA, 20 bp, Artificial
  CRISPR gRNA sequence
ataatttttattatttccaa

SEQ ID NO: 229379 - DNA, 20 bp, Artificial
  CRISPR gRNA sequence
taatttttattatttccaac

SEQ ID NO: 229380 - DNA, 20 bp, Artificial
  CRISPR gRNA sequence
ttattatttccaactttaaa

SEQ ID NO: 229381 - DNA, 20 bp, Artificial
  CRISPR gRNA sequence
tattatttccaactttaaat

SEQ ID NO: 229382 - DNA, 20 bp, Artificial
  CRISPR gRNA sequence
attatttccaactttaaatt

SEQ ID NO: 229383 - DNA, 20 bp, Artificial
  CRISPR gRNA sequence
ttatttccaactttaaattt

SEQ ID NO: 229384 - DNA, 20 bp, Artificial
  CRISPR gRNA sequence
tttccaactttaaatttgta

SEQ ID NO: 229385 - DNA, 20 bp, Artificial
  CRISPR gRNA sequence
ccaactttaaatttgtagcc

SEQ ID NO: 229386 - DNA, 20 bp, Artificial
  CRISPR gRNA sequence
caactttaaatttgtagcct

SEQ ID NO: 229387 - DNA, 20 bp, Artificial
  CRISPR gRNA sequence
taaatttgtagccttaattt

SEQ ID NO: 229388 - DNA, 20 bp, Artificial
  CRISPR gRNA sequence
aaatttgtagccttaatttg

SEQ ID NO: 229389 - DNA, 20 bp, Artificial
  CRISPR gRNA sequence
aatttgtagccttaatttgc

SEQ ID NO: 229390 - DNA, 20 bp, Artificial
  CRISPR gRNA sequence
gtagccttaatttgctattt

SEQ ID NO: 229391 - DNA, 20 bp, Artificial
  CRISPR gRNA sequence
tagccttaatttgctatttt

SEQ ID NO: 229392 - DNA, 20 bp, Artificial
  CRISPR gRNA sequence
aatttgctattttaaagagt

SEQ ID NO: 229393 - DNA, 20 bp, Artificial
  CRISPR gRNA sequence
atttgctattttaaagagta

SEQ ID NO: 229394 - DNA, 20 bp, Artificial
  CRISPR gRNA sequence
gctattttaaagagtaggcc

SEQ ID NO: 229395 - DNA, 20 bp, Artificial
  CRISPR gRNA sequence
ctattttaaagagtaggcct

SEQ ID NO: 229396 - DNA, 20 bp, Artificial
  CRISPR gRNA sequence
ttttaaagagtaggcctttc

SEQ ID NO: 229397 - DNA, 20 bp, Artificial
  CRISPR gRNA sequence
taaagagtaggcctttcact

SEQ ID NO: 229398 - DNA, 20 bp, Artificial
  CRISPR gRNA sequence
aaagagtaggcctttcactt

SEQ ID NO: 229399 - DNA, 20 bp, Artificial
  CRISPR gRNA sequence
aagagtaggcctttcacttt

SEQ ID NO: 229400 - DNA, 20 bp, Artificial
  CRISPR gRNA sequence
tcactttctacaactttctg

SEQ ID NO: 229401 - DNA, 20 bp, Artificial
  CRISPR gRNA sequence
cactttctacaactttctgt

SEQ ID NO: 229402 - DNA, 20 bp, Artificial
  CRISPR gRNA sequence
actttctacaactttctgtg

SEQ ID NO: 229403 - DNA, 20 bp, Artificial
  CRISPR gRNA sequence
tctacaactttctgtgaaag

SEQ ID NO: 229404 - DNA, 20 bp, Artificial
  CRISPR gRNA sequence
ctacaactttctgtgaaagt

SEQ ID NO: 229405 - DNA, 20 bp, Artificial
  CRISPR gRNA sequence
tacaactttctgtgaaagtg

SEQ ID NO: 229406 - DNA, 20 bp, Artificial
  CRISPR gRNA sequence
caactttctgtgaaagtgac

SEQ ID NO: 229407 - DNA, 20 bp, Artificial
  CRISPR gRNA sequence
tctgtgaaagtgactttcac

SEQ ID NO: 229408 - DNA, 20 bp, Artificial
  CRISPR gRNA sequence
ctgtgaaagtgactttcact

SEQ ID NO: 229409 - DNA, 20 bp, Artificial
  CRISPR gRNA sequence
tgtgaaagtgactttcactt

SEQ ID NO: 229410 - DNA, 20 bp, Artificial
  CRISPR gRNA sequence
tgaaagtgactttcactttc

SEQ ID NO: 229411 - DNA, 20 bp, Artificial
  CRISPR gRNA sequence
tcactttctattttttaact

SEQ ID NO: 229412 - DNA, 20 bp, Artificial
  CRISPR gRNA sequence
cactttctattttttaactt

SEQ ID NO: 229413 - DNA, 20 bp, Artificial
  CRISPR gRNA sequence
actttctattttttaacttt

SEQ ID NO: 229414 - DNA, 20 bp, Artificial
  CRISPR gRNA sequence
tctattttttaactttttaa

SEQ ID NO: 229415 - DNA, 20 bp, Artificial
  CRISPR gRNA sequence
ctattttttaactttttaaa

SEQ ID NO: 229416 - DNA, 20 bp, Artificial
  CRISPR gRNA sequence
tattttttaactttttaaac

SEQ ID NO: 229417 - DNA, 20 bp, Artificial
  CRISPR gRNA sequence
ttttttaactttttaaactg

SEQ ID NO: 229418 - DNA, 20 bp, Artificial
  CRISPR gRNA sequence
tttaactttttaaactgtgt

SEQ ID NO: 229419 - DNA, 20 bp, Artificial
  CRISPR gRNA sequence
ttaactttttaaactgtgtt

SEQ ID NO: 229420 - DNA, 20 bp, Artificial
  CRISPR gRNA sequence
taactttttaaactgtgttg

SEQ ID NO: 229421 - DNA, 20 bp, Artificial
  CRISPR gRNA sequence
aactttttaaactgtgttgt

SEQ ID NO: 229422 - DNA, 20 bp, Artificial
  CRISPR gRNA sequence
actttttaaactgtgttgta

SEQ ID NO: 229423 - DNA, 20 bp, Artificial
  CRISPR gRNA sequence
tttaaactgtgttgtatttt

SEQ ID NO: 229424 - DNA, 20 bp, Artificial
  CRISPR gRNA sequence
ttaaactgtgttgtattttt

SEQ ID NO: 229425 - DNA, 20 bp, Artificial
  CRISPR gRNA sequence
taaactgtgttgtatttttt

SEQ ID NO: 229426 - DNA, 20 bp, Artificial
  CRISPR gRNA sequence
aaactgtgttgtattttttt

SEQ ID NO: 229427 - DNA, 20 bp, Artificial
  CRISPR gRNA sequence
aactgtgttgtatttttttt

SEQ ID NO: 229428 - DNA, 20 bp, Artificial
  CRISPR gRNA sequence
tgttgtattttttttctttt

SEQ ID NO: 229429 - DNA, 20 bp, Artificial
  CRISPR gRNA sequence
tattttttttcttttattgg

SEQ ID NO: 229430 - DNA, 20 bp, Artificial
  CRISPR gRNA sequence
tttttcttttattggaagca

SEQ ID NO: 229431 - DNA, 20 bp, Artificial
  CRISPR gRNA sequence
ttttcttttattggaagcat

SEQ ID NO: 229432 - DNA, 20 bp, Artificial
  CRISPR gRNA sequence
tttcttttattggaagcatt

SEQ ID NO: 229433 - DNA, 20 bp, Artificial
  CRISPR gRNA sequence
ttcttttattggaagcattt

SEQ ID NO: 229434 - DNA, 20 bp, Artificial
  CRISPR gRNA sequence
tcttttattggaagcatttt

SEQ ID NO: 229435 - DNA, 20 bp, Artificial
  CRISPR gRNA sequence
cttttattggaagcatttta

SEQ ID NO: 229436 - DNA, 20 bp, Artificial
  CRISPR gRNA sequence
ttttattggaagcattttaa

SEQ ID NO: 229437 - DNA, 20 bp, Artificial
  CRISPR gRNA sequence
ttattggaagcattttaatt

SEQ ID NO: 229438 - DNA, 20 bp, Artificial
  CRISPR gRNA sequence
tattggaagcattttaattt

SEQ ID NO: 229439 - DNA, 20 bp, Artificial
  CRISPR gRNA sequence
attggaagcattttaatttt

SEQ ID NO: 229440 - DNA, 20 bp, Artificial
  CRISPR gRNA sequence
ttggaagcattttaatttta

SEQ ID NO: 229441 - DNA, 20 bp, Artificial
  CRISPR gRNA sequence
gaagcattttaattttataa

SEQ ID NO: 229442 - DNA, 20 bp, Artificial
  CRISPR gRNA sequence
taattttataagatgagaaa

SEQ ID NO: 229443 - DNA, 20 bp, Artificial
  CRISPR gRNA sequence
aattttataagatgagaaaa

SEQ ID NO: 229444 - DNA, 20 bp, Artificial
  CRISPR gRNA sequence
attttataagatgagaaaaa

SEQ ID NO: 229445 - DNA, 20 bp, Artificial
  CRISPR gRNA sequence
tataagatgagaaaaaggac

SEQ ID NO: 229446 - DNA, 20 bp, Artificial
  CRISPR gRNA sequence
ataagatgagaaaaaggact

SEQ ID NO: 229447 - DNA, 20 bp, Artificial
  CRISPR gRNA sequence
taagatgagaaaaaggactg

SEQ ID NO: 229448 - DNA, 20 bp, Artificial
  CRISPR gRNA sequence
ggcacaataacttaatgtga

SEQ ID NO: 229449 - DNA, 20 bp, Artificial
  CRISPR gRNA sequence
aatgtgaaagcatagaaaag

SEQ ID NO: 229450 - DNA, 20 bp, Artificial
  CRISPR gRNA sequence
atgtgaaagcatagaaaaga

SEQ ID NO: 229451 - DNA, 20 bp, Artificial
  CRISPR gRNA sequence
caagaacctaaccaaactca

SEQ ID NO: 229452 - DNA, 20 bp, Artificial
  CRISPR gRNA sequence
accaaactcactaaagttgg

SEQ ID NO: 229453 - DNA, 20 bp, Artificial
  CRISPR gRNA sequence
actaaagttgggcttgttgt

SEQ ID NO: 229454 - DNA, 20 bp, Artificial
  CRISPR gRNA sequence
aagttgggcttgttgtttgt

SEQ ID NO: 229455 - DNA, 20 bp, Artificial
  CRISPR gRNA sequence
ggcttgttgtttgtagagaa

SEQ ID NO: 229456 - DNA, 20 bp, Artificial
  CRISPR gRNA sequence
gttgtttgtagagaacgttt

SEQ ID NO: 229457 - DNA, 20 bp, Artificial
  CRISPR gRNA sequence
ttgtttgtagagaacgttta

SEQ ID NO: 229458 - DNA, 20 bp, Artificial
  CRISPR gRNA sequence
tttgtagagaacgtttatat

SEQ ID NO: 229459 - DNA, 20 bp, Artificial
  CRISPR gRNA sequence
gtagagaacgtttatataat

SEQ ID NO: 229460 - DNA, 20 bp, Artificial
  CRISPR gRNA sequence
tagagaacgtttatataatt

SEQ ID NO: 229461 - DNA, 20 bp, Artificial
  CRISPR gRNA sequence
atataattataaggatcaat

SEQ ID NO: 229462 - DNA, 20 bp, Artificial
  CRISPR gRNA sequence
tataattataaggatcaata

SEQ ID NO: 229463 - DNA, 20 bp, Artificial
  CRISPR gRNA sequence
taaggatcaatactttctca

SEQ ID NO: 229464 - DNA, 20 bp, Artificial
  CRISPR gRNA sequence
tctcatttttaaagccatta

SEQ ID NO: 229465 - DNA, 20 bp, Artificial
  CRISPR gRNA sequence
ctcatttttaaagccattac

SEQ ID NO: 229466 - DNA, 20 bp, Artificial
  CRISPR gRNA sequence
tcatttttaaagccattacc

SEQ ID NO: 229467 - DNA, 20 bp, Artificial
  CRISPR gRNA sequence
atttttaaagccattaccag

SEQ ID NO: 229468 - DNA, 20 bp, Artificial
  CRISPR gRNA sequence
ttaaagccattaccagttag

SEQ ID NO: 229469 - DNA, 20 bp, Artificial
  CRISPR gRNA sequence
taaagccattaccagttagt

SEQ ID NO: 229470 - DNA, 20 bp, Artificial
  CRISPR gRNA sequence
aaagccattaccagttagtt

SEQ ID NO: 229471 - DNA, 20 bp, Artificial
  CRISPR gRNA sequence
aagccattaccagttagttc

SEQ ID NO: 229472 - DNA, 20 bp, Artificial
  CRISPR gRNA sequence
ccagttagttcaatataagg

SEQ ID NO: 229473 - DNA, 20 bp, Artificial
  CRISPR gRNA sequence
gttcaatataagggcatata

SEQ ID NO: 229474 - DNA, 20 bp, Artificial
  CRISPR gRNA sequence
aatataagggcatatagtgt

SEQ ID NO: 229475 - DNA, 20 bp, Artificial
  CRISPR gRNA sequence
tgatacaaatcaatctggta

SEQ ID NO: 229476 - DNA, 20 bp, Artificial
  CRISPR gRNA sequence
gatacaaatcaatctggtag

SEQ ID NO: 229477 - DNA, 20 bp, Artificial
  CRISPR gRNA sequence
atacaaatcaatctggtagc

SEQ ID NO: 229478 - DNA, 20 bp, Artificial
  CRISPR gRNA sequence
gtagcagtaagtaccatatt

SEQ ID NO: 229479 - DNA, 20 bp, Artificial
  CRISPR gRNA sequence
accacaacatcccagatatt

SEQ ID NO: 229480 - DNA, 20 bp, Artificial
  CRISPR gRNA sequence
ccacaacatcccagatattt

SEQ ID NO: 229481 - DNA, 20 bp, Artificial
  CRISPR gRNA sequence
tagaatgatgcagatgcaga

SEQ ID NO: 229482 - DNA, 20 bp, Artificial
  CRISPR gRNA sequence
agaatgatgcagatgcagaa

SEQ ID NO: 229483 - DNA, 20 bp, Artificial
  CRISPR gRNA sequence
gaatgatgcagatgcagaat

SEQ ID NO: 229484 - DNA, 20 bp, Artificial
  CRISPR gRNA sequence
atatctatgtatagatacaa

SEQ ID NO: 229485 - DNA, 20 bp, Artificial
  CRISPR gRNA sequence
tatctatgtatagatacaaa

SEQ ID NO: 229486 - DNA, 20 bp, Artificial
  CRISPR gRNA sequence
tgtatagatacaaattcaga

SEQ ID NO: 229487 - DNA, 20 bp, Artificial
  CRISPR gRNA sequence
agatattttcttgttcaatt

SEQ ID NO: 229488 - DNA, 20 bp, Artificial
  CRISPR gRNA sequence
tcttgttcaatttaaggaga

SEQ ID NO: 229489 - DNA, 20 bp, Artificial
  CRISPR gRNA sequence
cttgttcaatttaaggagag

SEQ ID NO: 229490 - DNA, 20 bp, Artificial
  CRISPR gRNA sequence
ttgttcaatttaaggagagg

SEQ ID NO: 229491 - DNA, 20 bp, Artificial
  CRISPR gRNA sequence
gttcaatttaaggagaggta

SEQ ID NO: 229492 - DNA, 20 bp, Artificial
  CRISPR gRNA sequence
ttcaatttaaggagaggtaa

SEQ ID NO: 229493 - DNA, 20 bp, Artificial
  CRISPR gRNA sequence
aatttaaggagaggtaaatt

SEQ ID NO: 229494 - DNA, 20 bp, Artificial
  CRISPR gRNA sequence
aaggagaggtaaatttggta

SEQ ID NO: 229495 - DNA, 20 bp, Artificial
  CRISPR gRNA sequence
aggagaggtaaatttggtat

SEQ ID NO: 229496 - DNA, 20 bp, Artificial
  CRISPR gRNA sequence
ggtatcaatagaaaaaatgt

SEQ ID NO: 229497 - DNA, 20 bp, Artificial
  CRISPR gRNA sequence
gtatcaatagaaaaaatgtt

SEQ ID NO: 229498 - DNA, 20 bp, Artificial
  CRISPR gRNA sequence
ctgaaaaatttaaaccctgg

SEQ ID NO: 229499 - DNA, 20 bp, Artificial
  CRISPR gRNA sequence
tgaaaaatttaaaccctgga

SEQ ID NO: 229500 - DNA, 20 bp, Artificial
  CRISPR gRNA sequence
aaaaatttaaaccctggaaa

SEQ ID NO: 229501 - DNA, 20 bp, Artificial
  CRISPR gRNA sequence
aaaccctggaaatgtattta

SEQ ID NO: 229502 - DNA, 20 bp, Artificial
  CRISPR gRNA sequence
aaccctggaaatgtatttat

SEQ ID NO: 229503 - DNA, 20 bp, Artificial
  CRISPR gRNA sequence
gaaatgtatttatggcatgg

SEQ ID NO: 229504 - DNA, 20 bp, Artificial
  CRISPR gRNA sequence
atggcatggagtcagatgtt

SEQ ID NO: 229505 - DNA, 20 bp, Artificial
  CRISPR gRNA sequence
tggcatggagtcagatgttt

SEQ ID NO: 229506 - DNA, 20 bp, Artificial
  CRISPR gRNA sequence
cagggagagaagaacaaatc

SEQ ID NO: 229507 - DNA, 20 bp, Artificial
  CRISPR gRNA sequence
agggagagaagaacaaatca

SEQ ID NO: 229508 - DNA, 20 bp, Artificial
  CRISPR gRNA sequence
caagtatgctcatatggaat

SEQ ID NO: 229509 - DNA, 20 bp, Artificial
  CRISPR gRNA sequence
atatggaatgcttaaggctt

SEQ ID NO: 229510 - DNA, 20 bp, Artificial
  CRISPR gRNA sequence
aaggcttgtggttaaaaaat

SEQ ID NO: 229511 - DNA, 20 bp, Artificial
  CRISPR gRNA sequence
aggcttgtggttaaaaaata

SEQ ID NO: 229512 - DNA, 20 bp, Artificial
  CRISPR gRNA sequence
gtggttaaaaaatatatata

SEQ ID NO: 229513 - DNA, 20 bp, Artificial
  CRISPR gRNA sequence
tggttaaaaaatatatatat

SEQ ID NO: 229514 - DNA, 20 bp, Artificial
  CRISPR gRNA sequence
aaaaatatatatatatggct

SEQ ID NO: 229515 - DNA, 20 bp, Artificial
  CRISPR gRNA sequence
tcaatgtcttaggctcatgg

SEQ ID NO: 229516 - DNA, 20 bp, Artificial
  CRISPR gRNA sequence
aggctcatggtagcagcaga

SEQ ID NO: 229517 - DNA, 20 bp, Artificial
  CRISPR gRNA sequence
ggctcatggtagcagcagaa

SEQ ID NO: 229518 - DNA, 20 bp, Artificial
  CRISPR gRNA sequence
atggtagcagcagaaatcgt

SEQ ID NO: 229519 - DNA, 20 bp, Artificial
  CRISPR gRNA sequence
ttttgtcacatgggttatat

SEQ ID NO: 229520 - DNA, 20 bp, Artificial
  CRISPR gRNA sequence
ttgtcacatgggttatatcc

SEQ ID NO: 229521 - DNA, 20 bp, Artificial
  CRISPR gRNA sequence
tgtcacatgggttatatcca

SEQ ID NO: 229522 - DNA, 20 bp, Artificial
  CRISPR gRNA sequence
gtcacatgggttatatccat

SEQ ID NO: 229523 - DNA, 20 bp, Artificial
  CRISPR gRNA sequence
tcacatgggttatatccata

SEQ ID NO: 229524 - DNA, 20 bp, Artificial
  CRISPR gRNA sequence
tatccatattggagagaatt

SEQ ID NO: 229525 - DNA, 20 bp, Artificial
  CRISPR gRNA sequence
gagagaattaactcaggtga

SEQ ID NO: 229526 - DNA, 20 bp, Artificial
  CRISPR gRNA sequence
actcaggtgaaattaacttg

SEQ ID NO: 229527 - DNA, 20 bp, Artificial
  CRISPR gRNA sequence
aggtgaaattaacttgtaca

SEQ ID NO: 229528 - DNA, 20 bp, Artificial
  CRISPR gRNA sequence
acttgtacactgtttggttt

SEQ ID NO: 229529 - DNA, 20 bp, Artificial
  CRISPR gRNA sequence
gtacactgtttggttttata

SEQ ID NO: 229530 - DNA, 20 bp, Artificial
  CRISPR gRNA sequence
tacactgtttggttttataa

SEQ ID NO: 229531 - DNA, 20 bp, Artificial
  CRISPR gRNA sequence
tttggttttataatatttag

SEQ ID NO: 229532 - DNA, 20 bp, Artificial
  CRISPR gRNA sequence
ggttttataatatttagagg

SEQ ID NO: 229533 - DNA, 20 bp, Artificial
  CRISPR gRNA sequence
gttttataatatttagaggg

SEQ ID NO: 229534 - DNA, 20 bp, Artificial
  CRISPR gRNA sequence
tataatatttagagggatca

SEQ ID NO: 229535 - DNA, 20 bp, Artificial
  CRISPR gRNA sequence
ataatatttagagggatcac

SEQ ID NO: 229536 - DNA, 20 bp, Artificial
  CRISPR gRNA sequence
taatatttagagggatcaca

SEQ ID NO: 229537 - DNA, 20 bp, Artificial
  CRISPR gRNA sequence
agagggatcacaactgactg

SEQ ID NO: 229538 - DNA, 20 bp, Artificial
  CRISPR gRNA sequence
gagggatcacaactgactga

SEQ ID NO: 229539 - DNA, 20 bp, Artificial
  CRISPR gRNA sequence
actgatgtccctttgaagta

SEQ ID NO: 229540 - DNA, 20 bp, Artificial
  CRISPR gRNA sequence
atgtccctttgaagtaccat

SEQ ID NO: 229541 - DNA, 20 bp, Artificial
  CRISPR gRNA sequence
tgaagtaccattcttcataa

SEQ ID NO: 229542 - DNA, 20 bp, Artificial
  CRISPR gRNA sequence
gaagtaccattcttcataaa

SEQ ID NO: 229543 - DNA, 20 bp, Artificial
  CRISPR gRNA sequence
aagtaccattcttcataaat

SEQ ID NO: 229544 - DNA, 20 bp, Artificial
  CRISPR gRNA sequence
ttcataaatctttttttttc

SEQ ID NO: 229545 - DNA, 20 bp, Artificial
  CRISPR gRNA sequence
cataaatctttttttttcag

SEQ ID NO: 229546 - DNA, 20 bp, Artificial
  CRISPR gRNA sequence
ataaatctttttttttcaga

SEQ ID NO: 229547 - DNA, 20 bp, Artificial
  CRISPR gRNA sequence
tttttttcagaatgggccag

SEQ ID NO: 229548 - DNA, 20 bp, Artificial
  CRISPR gRNA sequence
ttttttcagaatgggccagc

SEQ ID NO: 229549 - DNA, 20 bp, Artificial
  CRISPR gRNA sequence
tttttcagaatgggccagcc

SEQ ID NO: 229550 - DNA, 20 bp, Artificial
  CRISPR gRNA sequence
ttttcagaatgggccagcca

SEQ ID NO: 229551 - DNA, 20 bp, Artificial
  CRISPR gRNA sequence
tttcagaatgggccagccaa

SEQ ID NO: 229552 - DNA, 20 bp, Artificial
  CRISPR gRNA sequence
ttcagaatgggccagccaac

SEQ ID NO: 229553 - DNA, 20 bp, Artificial
  CRISPR gRNA sequence
tcagaatgggccagccaact

SEQ ID NO: 229554 - DNA, 20 bp, Artificial
  CRISPR gRNA sequence
cagaatgggccagccaactg

SEQ ID NO: 229555 - DNA, 20 bp, Artificial
  CRISPR gRNA sequence
agaatgggccagccaactgt

SEQ ID NO: 229556 - DNA, 20 bp, Artificial
  CRISPR gRNA sequence
tgacatcccttggatcggag

SEQ ID NO: 229557 - DNA, 20 bp, Artificial
  CRISPR gRNA sequence
ggatcggagatttagaacta

SEQ ID NO: 229558 - DNA, 20 bp, Artificial
  CRISPR gRNA sequence
gatcggagatttagaactag

SEQ ID NO: 229559 - DNA, 20 bp, Artificial
  CRISPR gRNA sequence
agaactagaaagtattcttt

SEQ ID NO: 229560 - DNA, 20 bp, Artificial
  CRISPR gRNA sequence
gaactagaaagtattctttc

SEQ ID NO: 229561 - DNA, 20 bp, Artificial
  CRISPR gRNA sequence
gaaagtattctttctacatt

SEQ ID NO: 229562 - DNA, 20 bp, Artificial
  CRISPR gRNA sequence
tttctacattattagggaag

SEQ ID NO: 229563 - DNA, 20 bp, Artificial
  CRISPR gRNA sequence
tctacattattagggaagaa

SEQ ID NO: 229564 - DNA, 20 bp, Artificial
  CRISPR gRNA sequence
ctacattattagggaagaaa

SEQ ID NO: 229565 - DNA, 20 bp, Artificial
  CRISPR gRNA sequence
tacattattagggaagaaaa

SEQ ID NO: 229566 - DNA, 20 bp, Artificial
  CRISPR gRNA sequence
cattattagggaagaaaagg

SEQ ID NO: 229567 - DNA, 20 bp, Artificial
  CRISPR gRNA sequence
ttagggaagaaaaggagtta

SEQ ID NO: 229568 - DNA, 20 bp, Artificial
  CRISPR gRNA sequence
gggaagaaaaggagttactt

SEQ ID NO: 229569 - DNA, 20 bp, Artificial
  CRISPR gRNA sequence
cttggcggttagcaatattc

SEQ ID NO: 229570 - DNA, 20 bp, Artificial
  CRISPR gRNA sequence
ggcggttagcaatattctat

SEQ ID NO: 229571 - DNA, 20 bp, Artificial
  CRISPR gRNA sequence
gcggttagcaatattctatt

SEQ ID NO: 229572 - DNA, 20 bp, Artificial
  CRISPR gRNA sequence
gcaatattctattttgtttt

SEQ ID NO: 229573 - DNA, 20 bp, Artificial
  CRISPR gRNA sequence
tattttgttttgttttgttt

SEQ ID NO: 229574 - DNA, 20 bp, Artificial
  CRISPR gRNA sequence
ttttgttttgttttgttttt

SEQ ID NO: 229575 - DNA, 20 bp, Artificial
  CRISPR gRNA sequence
tgttttgttttgtttttaga

SEQ ID NO: 229576 - DNA, 20 bp, Artificial
  CRISPR gRNA sequence
gttttgttttgtttttagag

SEQ ID NO: 229577 - DNA, 20 bp, Artificial
  CRISPR gRNA sequence
ttttgttttgtttttagaga

SEQ ID NO: 229578 - DNA, 20 bp, Artificial
  CRISPR gRNA sequence
tgttttgtttttagagacag

SEQ ID NO: 229579 - DNA, 20 bp, Artificial
  CRISPR gRNA sequence
gttttgtttttagagacagg

SEQ ID NO: 229580 - DNA, 20 bp, Artificial
  CRISPR gRNA sequence
ttttgtttttagagacaggg

SEQ ID NO: 229581 - DNA, 20 bp, Artificial
  CRISPR gRNA sequence
tgtttttagagacagggtct

SEQ ID NO: 229582 - DNA, 20 bp, Artificial
  CRISPR gRNA sequence
gtttttagagacagggtctc

SEQ ID NO: 229583 - DNA, 20 bp, Artificial
  CRISPR gRNA sequence
tttttagagacagggtctca

SEQ ID NO: 229584 - DNA, 20 bp, Artificial
  CRISPR gRNA sequence
ttagagacagggtctcatta

SEQ ID NO: 229585 - DNA, 20 bp, Artificial
  CRISPR gRNA sequence
tagagacagggtctcattat

SEQ ID NO: 229586 - DNA, 20 bp, Artificial
  CRISPR gRNA sequence
agagacagggtctcattatg

SEQ ID NO: 229587 - DNA, 20 bp, Artificial
  CRISPR gRNA sequence
gagacagggtctcattatgt

SEQ ID NO: 229588 - DNA, 20 bp, Artificial
  CRISPR gRNA sequence
attatgttgaccaggctggc

SEQ ID NO: 229589 - DNA, 20 bp, Artificial
  CRISPR gRNA sequence
tgttgaccaggctggcctcg

SEQ ID NO: 229590 - DNA, 20 bp, Artificial
  CRISPR gRNA sequence
accaggctggcctcgagctc

SEQ ID NO: 229591 - DNA, 20 bp, Artificial
  CRISPR gRNA sequence
gcctcgagctcctgggctca

SEQ ID NO: 229592 - DNA, 20 bp, Artificial
  CRISPR gRNA sequence
gagctcctgggctcaagcaa

SEQ ID NO: 229593 - DNA, 20 bp, Artificial
  CRISPR gRNA sequence
ctgggctcaagcaatgctcc

SEQ ID NO: 229594 - DNA, 20 bp, Artificial
  CRISPR gRNA sequence
ggctcaagcaatgctcccac

SEQ ID NO: 229595 - DNA, 20 bp, Artificial
  CRISPR gRNA sequence
aagcaatgctcccacctcag

SEQ ID NO: 229596 - DNA, 20 bp, Artificial
  CRISPR gRNA sequence
ccacctcagcctcccaagta

SEQ ID NO: 229597 - DNA, 20 bp, Artificial
  CRISPR gRNA sequence
agcctcccaagtagctggga

SEQ ID NO: 229598 - DNA, 20 bp, Artificial
  CRISPR gRNA sequence
ccaagtagctgggactacag

SEQ ID NO: 229599 - DNA, 20 bp, Artificial
  CRISPR gRNA sequence
ggactacaggcatgtgccac

SEQ ID NO: 229600 - DNA, 20 bp, Artificial
  CRISPR gRNA sequence
caggcatgtgccactacacc

SEQ ID NO: 229601 - DNA, 20 bp, Artificial
  CRISPR gRNA sequence
cacctggcagtgtttattct

SEQ ID NO: 229602 - DNA, 20 bp, Artificial
  CRISPR gRNA sequence
gcagtgtttattctgataaa

SEQ ID NO: 229603 - DNA, 20 bp, Artificial
  CRISPR gRNA sequence
attctgataaatacatttat

SEQ ID NO: 229604 - DNA, 20 bp, Artificial
  CRISPR gRNA sequence
ttctgataaatacatttatg

SEQ ID NO: 229605 - DNA, 20 bp, Artificial
  CRISPR gRNA sequence
tgataaatacatttatgagc

SEQ ID NO: 229606 - DNA, 20 bp, Artificial
  CRISPR gRNA sequence
ataaatacatttatgagctc

SEQ ID NO: 229607 - DNA, 20 bp, Artificial
  CRISPR gRNA sequence
atgagctcaaaaatgtaact

SEQ ID NO: 229608 - DNA, 20 bp, Artificial
  CRISPR gRNA sequence
tgagctcaaaaatgtaactc

SEQ ID NO: 229609 - DNA, 20 bp, Artificial
  CRISPR gRNA sequence
aaaaatgtaactctaaaacc

SEQ ID NO: 229610 - DNA, 20 bp, Artificial
  CRISPR gRNA sequence
taaaaccttatctctgaact

SEQ ID NO: 229611 - DNA, 20 bp, Artificial
  CRISPR gRNA sequence
aaaccttatctctgaacttc

SEQ ID NO: 229612 - DNA, 20 bp, Artificial
  CRISPR gRNA sequence
atctctgaacttccatatta

SEQ ID NO: 229613 - DNA, 20 bp, Artificial
  CRISPR gRNA sequence
tctctgaacttccatattac

SEQ ID NO: 229614 - DNA, 20 bp, Artificial
  CRISPR gRNA sequence
tgaacttccatattaccatc

SEQ ID NO: 229615 - DNA, 20 bp, Artificial
  CRISPR gRNA sequence
aacttccatattaccatcag

SEQ ID NO: 229616 - DNA, 20 bp, Artificial
  CRISPR gRNA sequence
ccatattaccatcagaaatt

SEQ ID NO: 229617 - DNA, 20 bp, Artificial
  CRISPR gRNA sequence
catattaccatcagaaattt

SEQ ID NO: 229618 - DNA, 20 bp, Artificial
  CRISPR gRNA sequence
ccatcagaaatttagatagt

SEQ ID NO: 229619 - DNA, 20 bp, Artificial
  CRISPR gRNA sequence
agatagttgtttagttctct

SEQ ID NO: 229620 - DNA, 20 bp, Artificial
  CRISPR gRNA sequence
gatagttgtttagttctctt

SEQ ID NO: 229621 - DNA, 20 bp, Artificial
  CRISPR gRNA sequence
tttagttctctttttctttg

SEQ ID NO: 229622 - DNA, 20 bp, Artificial
  CRISPR gRNA sequence
agttctctttttctttgtag

SEQ ID NO: 229623 - DNA, 20 bp, Artificial
  CRISPR gRNA sequence
gttctctttttctttgtaga

SEQ ID NO: 229624 - DNA, 20 bp, Artificial
  CRISPR gRNA sequence
tctttttctttgtagaacat

SEQ ID NO: 229625 - DNA, 20 bp, Artificial
  CRISPR gRNA sequence
tttttctttgtagaacatag

SEQ ID NO: 229626 - DNA, 20 bp, Artificial
  CRISPR gRNA sequence
tttctttgtagaacatagat

SEQ ID NO: 229627 - DNA, 20 bp, Artificial
  CRISPR gRNA sequence
ttctttgtagaacatagata

SEQ ID NO: 229628 - DNA, 20 bp, Artificial
  CRISPR gRNA sequence
tctttgtagaacatagatat

SEQ ID NO: 229629 - DNA, 20 bp, Artificial
  CRISPR gRNA sequence
ctttgtagaacatagatata

SEQ ID NO: 229630 - DNA, 20 bp, Artificial
  CRISPR gRNA sequence
tttgtagaacatagatataa

SEQ ID NO: 229631 - DNA, 20 bp, Artificial
  CRISPR gRNA sequence
tgtagaacatagatataagg

SEQ ID NO: 229632 - DNA, 20 bp, Artificial
  CRISPR gRNA sequence
gtagaacatagatataaggc

SEQ ID NO: 229633 - DNA, 20 bp, Artificial
  CRISPR gRNA sequence
tagaacatagatataaggca

SEQ ID NO: 229634 - DNA, 20 bp, Artificial
  CRISPR gRNA sequence
cattgaagtcagttgtatat

SEQ ID NO: 229635 - DNA, 20 bp, Artificial
  CRISPR gRNA sequence
attgaagtcagttgtatata

SEQ ID NO: 229636 - DNA, 20 bp, Artificial
  CRISPR gRNA sequence
aagtcagttgtatatacatg

SEQ ID NO: 229637 - DNA, 20 bp, Artificial
  CRISPR gRNA sequence
tatatacatgtaactatcct

SEQ ID NO: 229638 - DNA, 20 bp, Artificial
  CRISPR gRNA sequence
tcctgatgttcccaaataaa

SEQ ID NO: 229639 - DNA, 20 bp, Artificial
  CRISPR gRNA sequence
atgttcccaaataaagctct

SEQ ID NO: 229640 - DNA, 20 bp, Artificial
  CRISPR gRNA sequence
ccaaataaagctctgtattt

SEQ ID NO: 229641 - DNA, 20 bp, Artificial
  CRISPR gRNA sequence
tgtatttctgcttagtttat

SEQ ID NO: 229642 - DNA, 20 bp, Artificial
  CRISPR gRNA sequence
tatttctgcttagtttattg

SEQ ID NO: 229643 - DNA, 20 bp, Artificial
  CRISPR gRNA sequence
ctgcttagtttattggggag

SEQ ID NO: 229644 - DNA, 20 bp, Artificial
  CRISPR gRNA sequence
tgcttagtttattggggagg

SEQ ID NO: 229645 - DNA, 20 bp, Artificial
  CRISPR gRNA sequence
cttagtttattggggaggct

SEQ ID NO: 229646 - DNA, 20 bp, Artificial
  CRISPR gRNA sequence
agtttattggggaggctgct

SEQ ID NO: 229647 - DNA, 20 bp, Artificial
  CRISPR gRNA sequence
gtttattggggaggctgcta

SEQ ID NO: 229648 - DNA, 20 bp, Artificial
  CRISPR gRNA sequence
attggggaggctgctaaatg

SEQ ID NO: 229649 - DNA, 20 bp, Artificial
  CRISPR gRNA sequence
ttggggaggctgctaaatgt

SEQ ID NO: 229650 - DNA, 20 bp, Artificial
  CRISPR gRNA sequence
gggaggctgctaaatgtagt

SEQ ID NO: 229651 - DNA, 20 bp, Artificial
  CRISPR gRNA sequence
ctaaatgtagtgcatcccaa

SEQ ID NO: 229652 - DNA, 20 bp, Artificial
  CRISPR gRNA sequence
aatgtagtgcatcccaaccc

SEQ ID NO: 229653 - DNA, 20 bp, Artificial
  CRISPR gRNA sequence
taccctgttctactttaaaa

SEQ ID NO: 229654 - DNA, 20 bp, Artificial
  CRISPR gRNA sequence
accctgttctactttaaaaa

SEQ ID NO: 229655 - DNA, 20 bp, Artificial
  CRISPR gRNA sequence
ccctgttctactttaaaaag

SEQ ID NO: 229656 - DNA, 20 bp, Artificial
  CRISPR gRNA sequence
ttctactttaaaaagaggtt

SEQ ID NO: 229657 - DNA, 20 bp, Artificial
  CRISPR gRNA sequence
tactttaaaaagaggttggc

SEQ ID NO: 229658 - DNA, 20 bp, Artificial
  CRISPR gRNA sequence
ctttaaaaagaggttggctt

SEQ ID NO: 229659 - DNA, 20 bp, Artificial
  CRISPR gRNA sequence
taaaaagaggttggcttctt

SEQ ID NO: 229660 - DNA, 20 bp, Artificial
  CRISPR gRNA sequence
aaaaagaggttggcttcttg

SEQ ID NO: 229661 - DNA, 20 bp, Artificial
  CRISPR gRNA sequence
aaaagaggttggcttcttgt

SEQ ID NO: 229662 - DNA, 20 bp, Artificial
  CRISPR gRNA sequence
gcttcttgtttggatacaag

SEQ ID NO: 229663 - DNA, 20 bp, Artificial
  CRISPR gRNA sequence
cttgtttggatacaaggacc

SEQ ID NO: 229664 - DNA, 20 bp, Artificial
  CRISPR gRNA sequence
ttgtttggatacaaggacca

SEQ ID NO: 229665 - DNA, 20 bp, Artificial
  CRISPR gRNA sequence
gtttggatacaaggaccaag

SEQ ID NO: 229666 - DNA, 20 bp, Artificial
  CRISPR gRNA sequence
tttggatacaaggaccaagt

SEQ ID NO: 229667 - DNA, 20 bp, Artificial
  CRISPR gRNA sequence
ggatacaaggaccaagtcac

SEQ ID NO: 229668 - DNA, 20 bp, Artificial
  CRISPR gRNA sequence
gatacaaggaccaagtcact

SEQ ID NO: 229669 - DNA, 20 bp, Artificial
  CRISPR gRNA sequence
ccccaggttcctccacagta

SEQ ID NO: 229670 - DNA, 20 bp, Artificial
  CRISPR gRNA sequence
ctccacagtaagggaggcct

SEQ ID NO: 229671 - DNA, 20 bp, Artificial
  CRISPR gRNA sequence
cacagtaagggaggcctatt

SEQ ID NO: 229672 - DNA, 20 bp, Artificial
  CRISPR gRNA sequence
tttaaagccgcccatggcac

SEQ ID NO: 229673 - DNA, 20 bp, Artificial
  CRISPR gRNA sequence
aaagccgcccatggcactaa

SEQ ID NO: 229674 - DNA, 20 bp, Artificial
  CRISPR gRNA sequence
aagccgcccatggcactaac

SEQ ID NO: 229675 - DNA, 20 bp, Artificial
  CRISPR gRNA sequence
acagaaactggactcctatg

SEQ ID NO: 229676 - DNA, 20 bp, Artificial
  CRISPR gRNA sequence
gactcctatgagctcagata

SEQ ID NO: 229677 - DNA, 20 bp, Artificial
  CRISPR gRNA sequence
ctatgagctcagatacataa

SEQ ID NO: 229678 - DNA, 20 bp, Artificial
  CRISPR gRNA sequence
tgagctcagatacataactg

SEQ ID NO: 229679 - DNA, 20 bp, Artificial
  CRISPR gRNA sequence
agatacataactgggcctca

SEQ ID NO: 229680 - DNA, 20 bp, Artificial
  CRISPR gRNA sequence
ggcctcacaggggtgggaca

SEQ ID NO: 229681 - DNA, 20 bp, Artificial
  CRISPR gRNA sequence
acaggggtgggacagtatgt

SEQ ID NO: 229682 - DNA, 20 bp, Artificial
  CRISPR gRNA sequence
ggaattggaaggatccattc

SEQ ID NO: 229683 - DNA, 20 bp, Artificial
  CRISPR gRNA sequence
gaaggatccattccatatca

SEQ ID NO: 229684 - DNA, 20 bp, Artificial
  CRISPR gRNA sequence
catatcaaagaactgaagca

SEQ ID NO: 229685 - DNA, 20 bp, Artificial
  CRISPR gRNA sequence
aagcatcgtgttgccctctc

SEQ ID NO: 229686 - DNA, 20 bp, Artificial
  CRISPR gRNA sequence
ccctctcagcagcaagagta

SEQ ID NO: 229687 - DNA, 20 bp, Artificial
  CRISPR gRNA sequence
tcagcagcaagagtaaggtg

SEQ ID NO: 229688 - DNA, 20 bp, Artificial
  CRISPR gRNA sequence
agcagcaagagtaaggtgat

SEQ ID NO: 229689 - DNA, 20 bp, Artificial
  CRISPR gRNA sequence
tcagttatagttcctgagtt

SEQ ID NO: 229690 - DNA, 20 bp, Artificial
  CRISPR gRNA sequence
tagttcctgagttcctctgt

SEQ ID NO: 229691 - DNA, 20 bp, Artificial
  CRISPR gRNA sequence
ctgagttcctctgtctttga

SEQ ID NO: 229692 - DNA, 20 bp, Artificial
  CRISPR gRNA sequence
agttcctctgtctttgattc

SEQ ID NO: 229693 - DNA, 20 bp, Artificial
  CRISPR gRNA sequence
ctctgtctttgattctttgc

SEQ ID NO: 229694 - DNA, 20 bp, Artificial
  CRISPR gRNA sequence
tgtctttgattctttgccta

SEQ ID NO: 229695 - DNA, 20 bp, Artificial
  CRISPR gRNA sequence
tctttgattctttgcctatt

SEQ ID NO: 229696 - DNA, 20 bp, Artificial
  CRISPR gRNA sequence
tgattctttgcctattagcc

SEQ ID NO: 229697 - DNA, 20 bp, Artificial
  CRISPR gRNA sequence
gattctttgcctattagcca

SEQ ID NO: 229698 - DNA, 20 bp, Artificial
  CRISPR gRNA sequence
attctttgcctattagccag

SEQ ID NO: 229699 - DNA, 20 bp, Artificial
  CRISPR gRNA sequence
tttgcctattagccagctag

SEQ ID NO: 229700 - DNA, 20 bp, Artificial
  CRISPR gRNA sequence
tgcctattagccagctagct

SEQ ID NO: 229701 - DNA, 20 bp, Artificial
  CRISPR gRNA sequence
gcctattagccagctagctc

SEQ ID NO: 229702 - DNA, 20 bp, Artificial
  CRISPR gRNA sequence
cctattagccagctagctca

SEQ ID NO: 229703 - DNA, 20 bp, Artificial
  CRISPR gRNA sequence
ttagccagctagctcaccct

SEQ ID NO: 229704 - DNA, 20 bp, Artificial
  CRISPR gRNA sequence
gccagctagctcaccctctt

SEQ ID NO: 229705 - DNA, 20 bp, Artificial
  CRISPR gRNA sequence
gctcaccctcttgtttatgc

SEQ ID NO: 229706 - DNA, 20 bp, Artificial
  CRISPR gRNA sequence
accctcttgtttatgccact

SEQ ID NO: 229707 - DNA, 20 bp, Artificial
  CRISPR gRNA sequence
ttgtttatgccactgttttt

SEQ ID NO: 229708 - DNA, 20 bp, Artificial
  CRISPR gRNA sequence
gtttatgccactgtttttta

SEQ ID NO: 229709 - DNA, 20 bp, Artificial
  CRISPR gRNA sequence
tttatgccactgttttttat

SEQ ID NO: 229710 - DNA, 20 bp, Artificial
  CRISPR gRNA sequence
atgccactgttttttatcct

SEQ ID NO: 229711 - DNA, 20 bp, Artificial
  CRISPR gRNA sequence
tgccactgttttttatccta

SEQ ID NO: 229712 - DNA, 20 bp, Artificial
  CRISPR gRNA sequence
ttttttatcctattcatgcc

SEQ ID NO: 229713 - DNA, 20 bp, Artificial
  CRISPR gRNA sequence
tttatcctattcatgccttc

SEQ ID NO: 229714 - DNA, 20 bp, Artificial
  CRISPR gRNA sequence
ttatcctattcatgccttct

SEQ ID NO: 229715 - DNA, 20 bp, Artificial
  CRISPR gRNA sequence
tatcctattcatgccttctc

SEQ ID NO: 229716 - DNA, 20 bp, Artificial
  CRISPR gRNA sequence
atcctattcatgccttctca

SEQ ID NO: 229717 - DNA, 20 bp, Artificial
  CRISPR gRNA sequence
tcctattcatgccttctcac

SEQ ID NO: 229718 - DNA, 20 bp, Artificial
  CRISPR gRNA sequence
ttcatgccttctcacagaca

SEQ ID NO: 229719 - DNA, 20 bp, Artificial
  CRISPR gRNA sequence
atgccttctcacagacaact

SEQ ID NO: 229720 - DNA, 20 bp, Artificial
  CRISPR gRNA sequence
ctcacagacaacttttctta

SEQ ID NO: 229721 - DNA, 20 bp, Artificial
  CRISPR gRNA sequence
tcacagacaacttttcttac

SEQ ID NO: 229722 - DNA, 20 bp, Artificial
  CRISPR gRNA sequence
acagacaacttttcttacct

SEQ ID NO: 229723 - DNA, 20 bp, Artificial
  CRISPR gRNA sequence
ttcttacctacagctttgga

SEQ ID NO: 229724 - DNA, 20 bp, Artificial
  CRISPR gRNA sequence
tcttacctacagctttggac

SEQ ID NO: 229725 - DNA, 20 bp, Artificial
  CRISPR gRNA sequence
cttacctacagctttggact

SEQ ID NO: 229726 - DNA, 20 bp, Artificial
  CRISPR gRNA sequence
ttacctacagctttggactc

SEQ ID NO: 229727 - DNA, 20 bp, Artificial
  CRISPR gRNA sequence
acctacagctttggactcat

SEQ ID NO: 229728 - DNA, 20 bp, Artificial
  CRISPR gRNA sequence
cctacagctttggactcatc

SEQ ID NO: 229729 - DNA, 20 bp, Artificial
  CRISPR gRNA sequence
cagctttggactcatccttg

SEQ ID NO: 229730 - DNA, 20 bp, Artificial
  CRISPR gRNA sequence
tggactcatccttgtctcct

SEQ ID NO: 229731 - DNA, 20 bp, Artificial
  CRISPR gRNA sequence
ggactcatccttgtctcctt

SEQ ID NO: 229732 - DNA, 20 bp, Artificial
  CRISPR gRNA sequence
gactcatccttgtctccttt

SEQ ID NO: 229733 - DNA, 20 bp, Artificial
  CRISPR gRNA sequence
atccttgtctcctttctgtt

SEQ ID NO: 229734 - DNA, 20 bp, Artificial
  CRISPR gRNA sequence
gtctcctttctgtttctttt

SEQ ID NO: 229735 - DNA, 20 bp, Artificial
  CRISPR gRNA sequence
tctcctttctgtttcttttt

SEQ ID NO: 229736 - DNA, 20 bp, Artificial
  CRISPR gRNA sequence
ctttctgtttctttttcact

SEQ ID NO: 229737 - DNA, 20 bp, Artificial
  CRISPR gRNA sequence
tctgtttctttttcactttc

SEQ ID NO: 229738 - DNA, 20 bp, Artificial
  CRISPR gRNA sequence
ctgtttctttttcactttcc

SEQ ID NO: 229739 - DNA, 20 bp, Artificial
  CRISPR gRNA sequence
tgtttctttttcactttccc

SEQ ID NO: 229740 - DNA, 20 bp, Artificial
  CRISPR gRNA sequence
tttctttttcactttccctt

SEQ ID NO: 229741 - DNA, 20 bp, Artificial
  CRISPR gRNA sequence
ctttttcactttcccttccc

SEQ ID NO: 229742 - DNA, 20 bp, Artificial
  CRISPR gRNA sequence
tttttcactttcccttccca

SEQ ID NO: 229743 - DNA, 20 bp, Artificial
  CRISPR gRNA sequence
tttcactttcccttcccatc

SEQ ID NO: 229744 - DNA, 20 bp, Artificial
  CRISPR gRNA sequence
ttcactttcccttcccatca

SEQ ID NO: 229745 - DNA, 20 bp, Artificial
  CRISPR gRNA sequence
tcactttcccttcccatcac

SEQ ID NO: 229746 - DNA, 20 bp, Artificial
  CRISPR gRNA sequence
cactttcccttcccatcacc

SEQ ID NO: 229747 - DNA, 20 bp, Artificial
  CRISPR gRNA sequence
actttcccttcccatcacca

SEQ ID NO: 229748 - DNA, 20 bp, Artificial
  CRISPR gRNA sequence
tcccttcccatcaccaactt

SEQ ID NO: 229749 - DNA, 20 bp, Artificial
  CRISPR gRNA sequence
cccttcccatcaccaacttt

SEQ ID NO: 229750 - DNA, 20 bp, Artificial
  CRISPR gRNA sequence
ccttcccatcaccaactttc

SEQ ID NO: 229751 - DNA, 20 bp, Artificial
  CRISPR gRNA sequence
cccatcaccaactttctggg

SEQ ID NO: 229752 - DNA, 20 bp, Artificial
  CRISPR gRNA sequence
ccatcaccaactttctgggt

SEQ ID NO: 229753 - DNA, 20 bp, Artificial
  CRISPR gRNA sequence
tctgggtttttttctgtttc

SEQ ID NO: 229754 - DNA, 20 bp, Artificial
  CRISPR gRNA sequence
ctgggtttttttctgtttct

SEQ ID NO: 229755 - DNA, 20 bp, Artificial
  CRISPR gRNA sequence
tgggtttttttctgtttctt

SEQ ID NO: 229756 - DNA, 20 bp, Artificial
  CRISPR gRNA sequence
ggtttttttctgtttcttct

SEQ ID NO: 229757 - DNA, 20 bp, Artificial
  CRISPR gRNA sequence
ttttctgtttcttcttagag

SEQ ID NO: 229758 - DNA, 20 bp, Artificial
  CRISPR gRNA sequence
tttctgtttcttcttagagt

SEQ ID NO: 229759 - DNA, 20 bp, Artificial
  CRISPR gRNA sequence
ttctgtttcttcttagagtc

SEQ ID NO: 229760 - DNA, 20 bp, Artificial
  CRISPR gRNA sequence
tctgtttcttcttagagtcc

SEQ ID NO: 229761 - DNA, 20 bp, Artificial
  CRISPR gRNA sequence
ctgtttcttcttagagtcca

SEQ ID NO: 229762 - DNA, 20 bp, Artificial
  CRISPR gRNA sequence
tgtttcttcttagagtccag

SEQ ID NO: 229763 - DNA, 20 bp, Artificial
  CRISPR gRNA sequence
tttcttcttagagtccagtg

SEQ ID NO: 229764 - DNA, 20 bp, Artificial
  CRISPR gRNA sequence
cttcttagagtccagtggca

SEQ ID NO: 229765 - DNA, 20 bp, Artificial
  CRISPR gRNA sequence
ttcttagagtccagtggcag

SEQ ID NO: 229766 - DNA, 20 bp, Artificial
  CRISPR gRNA sequence
cttagagtccagtggcaggg

SEQ ID NO: 229767 - DNA, 20 bp, Artificial
  CRISPR gRNA sequence
ttagagtccagtggcaggga

SEQ ID NO: 229768 - DNA, 20 bp, Artificial
  CRISPR gRNA sequence
agagtccagtggcagggaga

SEQ ID NO: 229769 - DNA, 20 bp, Artificial
  CRISPR gRNA sequence
gagtccagtggcagggagaa

SEQ ID NO: 229770 - DNA, 20 bp, Artificial
  CRISPR gRNA sequence
gtcagtccagtctgttgcca

SEQ ID NO: 229771 - DNA, 20 bp, Artificial
  CRISPR gRNA sequence
tcagtccagtctgttgccat

SEQ ID NO: 229772 - DNA, 20 bp, Artificial
  CRISPR gRNA sequence
ttgccatttttcctgtttga

SEQ ID NO: 229773 - DNA, 20 bp, Artificial
  CRISPR gRNA sequence
ccatttttcctgtttgagaa

SEQ ID NO: 229774 - DNA, 20 bp, Artificial
  CRISPR gRNA sequence
ttcctgtttgagaaagactc

SEQ ID NO: 229775 - DNA, 20 bp, Artificial
  CRISPR gRNA sequence
tcctgtttgagaaagactca

SEQ ID NO: 229776 - DNA, 20 bp, Artificial
  CRISPR gRNA sequence
cctgtttgagaaagactcac

SEQ ID NO: 229777 - DNA, 20 bp, Artificial
  CRISPR gRNA sequence
ctgtttgagaaagactcacc

SEQ ID NO: 229778 - DNA, 20 bp, Artificial
  CRISPR gRNA sequence
tttgagaaagactcaccagc

SEQ ID NO: 229779 - DNA, 20 bp, Artificial
  CRISPR gRNA sequence
gagaaagactcaccagcttt

SEQ ID NO: 229780 - DNA, 20 bp, Artificial
  CRISPR gRNA sequence
agaaagactcaccagctttt

SEQ ID NO: 229781 - DNA, 20 bp, Artificial
  CRISPR gRNA sequence
accagcttttggctggctca

SEQ ID NO: 229782 - DNA, 20 bp, Artificial
  CRISPR gRNA sequence
ttggctggctcacagattgg

SEQ ID NO: 229783 - DNA, 20 bp, Artificial
  CRISPR gRNA sequence
tggctggctcacagattggc

SEQ ID NO: 229784 - DNA, 20 bp, Artificial
  CRISPR gRNA sequence
ggctggctcacagattggct

SEQ ID NO: 229785 - DNA, 20 bp, Artificial
  CRISPR gRNA sequence
gctggctcacagattggctt

SEQ ID NO: 229786 - DNA, 20 bp, Artificial
  CRISPR gRNA sequence
gctcacagattggctttcct

SEQ ID NO: 229787 - DNA, 20 bp, Artificial
  CRISPR gRNA sequence
acagattggctttccttggg

SEQ ID NO: 229788 - DNA, 20 bp, Artificial
  CRISPR gRNA sequence
gctttccttgggtcaggacc

SEQ ID NO: 229789 - DNA, 20 bp, Artificial
  CRISPR gRNA sequence
tccttgggtcaggacccacc

SEQ ID NO: 229790 - DNA, 20 bp, Artificial
  CRISPR gRNA sequence
ccttgggtcaggacccaccc

SEQ ID NO: 229791 - DNA, 20 bp, Artificial
  CRISPR gRNA sequence
cttgggtcaggacccaccct

SEQ ID NO: 229792 - DNA, 20 bp, Artificial
  CRISPR gRNA sequence
gggtcaggacccaccctttt

SEQ ID NO: 229793 - DNA, 20 bp, Artificial
  CRISPR gRNA sequence
ggtcaggacccacccttttc

SEQ ID NO: 229794 - DNA, 20 bp, Artificial
  CRISPR gRNA sequence
ttccctgccagctttggaag

SEQ ID NO: 229795 - DNA, 20 bp, Artificial
  CRISPR gRNA sequence
tccctgccagctttggaagc

SEQ ID NO: 229796 - DNA, 20 bp, Artificial
  CRISPR gRNA sequence
ccctgccagctttggaagct

SEQ ID NO: 229797 - DNA, 20 bp, Artificial
  CRISPR gRNA sequence
cctgccagctttggaagctt

SEQ ID NO: 229798 - DNA, 20 bp, Artificial
  CRISPR gRNA sequence
ccagctttggaagcttgaca

SEQ ID NO: 229799 - DNA, 20 bp, Artificial
  CRISPR gRNA sequence
tggaagcttgacagaattcg

SEQ ID NO: 229800 - DNA, 20 bp, Artificial
  CRISPR gRNA sequence
ggaagcttgacagaattcga

SEQ ID NO: 229801 - DNA, 20 bp, Artificial
  CRISPR gRNA sequence
gaagcttgacagaattcgag

SEQ ID NO: 229802 - DNA, 20 bp, Artificial
  CRISPR gRNA sequence
gacagaattcgagtgtgcag

SEQ ID NO: 229803 - DNA, 20 bp, Artificial
  CRISPR gRNA sequence
acagaattcgagtgtgcagt

SEQ ID NO: 229804 - DNA, 20 bp, Artificial
  CRISPR gRNA sequence
gagtgtgcagtggtggtaaa

SEQ ID NO: 229805 - DNA, 20 bp, Artificial
  CRISPR gRNA sequence
gaggcgtgcctccatctgct

SEQ ID NO: 229806 - DNA, 20 bp, Artificial
  CRISPR gRNA sequence
catctgctgatgagaaaatc

SEQ ID NO: 229807 - DNA, 20 bp, Artificial
  CRISPR gRNA sequence
ctgatgagaaaatccagtgc

SEQ ID NO: 229808 - DNA, 20 bp, Artificial
  CRISPR gRNA sequence
atgagaaaatccagtgctgt

SEQ ID NO: 229809 - DNA, 20 bp, Artificial
  CRISPR gRNA sequence
tcatccagcccaggtcccag

SEQ ID NO: 229810 - DNA, 20 bp, Artificial
  CRISPR gRNA sequence
tctgttcagtaggatccccc

SEQ ID NO: 229811 - DNA, 20 bp, Artificial
  CRISPR gRNA sequence
tgttcagtaggatccccctc

SEQ ID NO: 229812 - DNA, 20 bp, Artificial
  CRISPR gRNA sequence
ttcagtaggatccccctcct

SEQ ID NO: 229813 - DNA, 20 bp, Artificial
  CRISPR gRNA sequence
agtaggatccccctcctgct

SEQ ID NO: 229814 - DNA, 20 bp, Artificial
  CRISPR gRNA sequence
ctgctgagtggttcatggca

SEQ ID NO: 229815 - DNA, 20 bp, Artificial
  CRISPR gRNA sequence
ctgagtggttcatggcatgt

SEQ ID NO: 229816 - DNA, 20 bp, Artificial
  CRISPR gRNA sequence
agtggttcatggcatgtttc

SEQ ID NO: 229817 - DNA, 20 bp, Artificial
  CRISPR gRNA sequence
atggcatgtttctgttcaac

SEQ ID NO: 229818 - DNA, 20 bp, Artificial
  CRISPR gRNA sequence
ctgttcaacgcttttccatc

SEQ ID NO: 229819 - DNA, 20 bp, Artificial
  CRISPR gRNA sequence
tgttcaacgcttttccatct

SEQ ID NO: 229820 - DNA, 20 bp, Artificial
  CRISPR gRNA sequence
ttcaacgcttttccatctgt

SEQ ID NO: 229821 - DNA, 20 bp, Artificial
  CRISPR gRNA sequence
aacgcttttccatctgtagg

SEQ ID NO: 229822 - DNA, 20 bp, Artificial
  CRISPR gRNA sequence
ttccatctgtaggattctta

SEQ ID NO: 229823 - DNA, 20 bp, Artificial
  CRISPR gRNA sequence
tccatctgtaggattcttat

SEQ ID NO: 229824 - DNA, 20 bp, Artificial
  CRISPR gRNA sequence
ccatctgtaggattcttatt

SEQ ID NO: 229825 - DNA, 20 bp, Artificial
  CRISPR gRNA sequence
catctgtaggattcttattc

SEQ ID NO: 229826 - DNA, 20 bp, Artificial
  CRISPR gRNA sequence
taggattcttattctgtatt

SEQ ID NO: 229827 - DNA, 20 bp, Artificial
  CRISPR gRNA sequence
ttattctgtatttatttgtt

SEQ ID NO: 229828 - DNA, 20 bp, Artificial
  CRISPR gRNA sequence
attctgtatttatttgtttt

SEQ ID NO: 229829 - DNA, 20 bp, Artificial
  CRISPR gRNA sequence
ttctgtatttatttgttttt

SEQ ID NO: 229830 - DNA, 20 bp, Artificial
  CRISPR gRNA sequence
tgtatttatttgtttttttg

SEQ ID NO: 229831 - DNA, 20 bp, Artificial
  CRISPR gRNA sequence
tatttatttgtttttttggg

SEQ ID NO: 229832 - DNA, 20 bp, Artificial
  CRISPR gRNA sequence
atttgtttttttgggttttt

SEQ ID NO: 229833 - DNA, 20 bp, Artificial
  CRISPR gRNA sequence
tttgtttttttgggtttttt

SEQ ID NO: 229834 - DNA, 20 bp, Artificial
  CRISPR gRNA sequence
gtttttttgggtttttttat

SEQ ID NO: 229835 - DNA, 20 bp, Artificial
  CRISPR gRNA sequence
tttttttgggtttttttatt

SEQ ID NO: 229836 - DNA, 20 bp, Artificial
  CRISPR gRNA sequence
ttttgggtttttttattttt

SEQ ID NO: 229837 - DNA, 20 bp, Artificial
  CRISPR gRNA sequence
tttgggtttttttatttttt

SEQ ID NO: 229838 - DNA, 20 bp, Artificial
  CRISPR gRNA sequence
ttgggtttttttattttttg

SEQ ID NO: 229839 - DNA, 20 bp, Artificial
  CRISPR gRNA sequence
tgggtttttttattttttga

SEQ ID NO: 229840 - DNA, 20 bp, Artificial
  CRISPR gRNA sequence
gggtttttttattttttgag

SEQ ID NO: 229841 - DNA, 20 bp, Artificial
  CRISPR gRNA sequence
ggtttttttattttttgaga

SEQ ID NO: 229842 - DNA, 20 bp, Artificial
  CRISPR gRNA sequence
ttttattttttgagatggag

SEQ ID NO: 229843 - DNA, 20 bp, Artificial
  CRISPR gRNA sequence
tttattttttgagatggagt

SEQ ID NO: 229844 - DNA, 20 bp, Artificial
  CRISPR gRNA sequence
ttattttttgagatggagtc

SEQ ID NO: 229845 - DNA, 20 bp, Artificial
  CRISPR gRNA sequence
tattttttgagatggagtct

SEQ ID NO: 229846 - DNA, 20 bp, Artificial
  CRISPR gRNA sequence
attttttgagatggagtctc

SEQ ID NO: 229847 - DNA, 20 bp, Artificial
  CRISPR gRNA sequence
ttttttgagatggagtctcg

SEQ ID NO: 229848 - DNA, 20 bp, Artificial
  CRISPR gRNA sequence
tttgagatggagtctcgctc

SEQ ID NO: 229849 - DNA, 20 bp, Artificial
  CRISPR gRNA sequence
ttgagatggagtctcgctct

SEQ ID NO: 229850 - DNA, 20 bp, Artificial
  CRISPR gRNA sequence
tgagatggagtctcgctctg

SEQ ID NO: 229851 - DNA, 20 bp, Artificial
  CRISPR gRNA sequence
gagatggagtctcgctctgt

SEQ ID NO: 229852 - DNA, 20 bp, Artificial
  CRISPR gRNA sequence
agatggagtctcgctctgtc

SEQ ID NO: 229853 - DNA, 20 bp, Artificial
  CRISPR gRNA sequence
gctctgtcgcccaggctgga

SEQ ID NO: 229854 - DNA, 20 bp, Artificial
  CRISPR gRNA sequence
tgtcgcccaggctggagtgc

SEQ ID NO: 229855 - DNA, 20 bp, Artificial
  CRISPR gRNA sequence
tcgcccaggctggagtgcag

SEQ ID NO: 229856 - DNA, 20 bp, Artificial
  CRISPR gRNA sequence
gagtgcagtggcacgacccc

SEQ ID NO: 229857 - DNA, 20 bp, Artificial
  CRISPR gRNA sequence
gctgcagcctctgcctccca

SEQ ID NO: 229858 - DNA, 20 bp, Artificial
  CRISPR gRNA sequence
cagcctctgcctcccaggac

SEQ ID NO: 229859 - DNA, 20 bp, Artificial
  CRISPR gRNA sequence
tgcctcccaggacgagggag

SEQ ID NO: 229860 - DNA, 20 bp, Artificial
  CRISPR gRNA sequence
cctcccaggacgagggagat

SEQ ID NO: 229861 - DNA, 20 bp, Artificial
  CRISPR gRNA sequence
ccaggacgagggagatcctc

SEQ ID NO: 229862 - DNA, 20 bp, Artificial
  CRISPR gRNA sequence
ccacctcagccttccacgta

SEQ ID NO: 229863 - DNA, 20 bp, Artificial
  CRISPR gRNA sequence
agccttccacgtagctggga

SEQ ID NO: 229864 - DNA, 20 bp, Artificial
  CRISPR gRNA sequence
ccacgtagctgggactacag

SEQ ID NO: 229865 - DNA, 20 bp, Artificial
  CRISPR gRNA sequence
cacgtagctgggactacagg

SEQ ID NO: 229866 - DNA, 20 bp, Artificial
  CRISPR gRNA sequence
ggactacaggcatgcaccac

SEQ ID NO: 229867 - DNA, 20 bp, Artificial
  CRISPR gRNA sequence
caggcatgcaccacaggcat

SEQ ID NO: 229868 - DNA, 20 bp, Artificial
  CRISPR gRNA sequence
atttttgtatttttggtaga

SEQ ID NO: 229869 - DNA, 20 bp, Artificial
  CRISPR gRNA sequence
ttgtatttttggtagagaca

SEQ ID NO: 229870 - DNA, 20 bp, Artificial
  CRISPR gRNA sequence
tgtatttttggtagagacag

SEQ ID NO: 229871 - DNA, 20 bp, Artificial
  CRISPR gRNA sequence
gtatttttggtagagacagg

SEQ ID NO: 229872 - DNA, 20 bp, Artificial
  CRISPR gRNA sequence
tatttttggtagagacaggg

SEQ ID NO: 229873 - DNA, 20 bp, Artificial
  CRISPR gRNA sequence
ttggtagagacagggttgca

SEQ ID NO: 229874 - DNA, 20 bp, Artificial
  CRISPR gRNA sequence
tggtagagacagggttgcat

SEQ ID NO: 229875 - DNA, 20 bp, Artificial
  CRISPR gRNA sequence
ggtagagacagggttgcatc

SEQ ID NO: 229876 - DNA, 20 bp, Artificial
  CRISPR gRNA sequence
gtagagacagggttgcatca

SEQ ID NO: 229877 - DNA, 20 bp, Artificial
  CRISPR gRNA sequence
catcatgttgcccaggctgg

SEQ ID NO: 229878 - DNA, 20 bp, Artificial
  CRISPR gRNA sequence
cccaggctggtcttgaatgc

SEQ ID NO: 229879 - DNA, 20 bp, Artificial
  CRISPR gRNA sequence
gtcttgaatgcctgagctca

SEQ ID NO: 229880 - DNA, 20 bp, Artificial
  CRISPR gRNA sequence
gaatgcctgagctcaagcaa

SEQ ID NO: 229881 - DNA, 20 bp, Artificial
  CRISPR gRNA sequence
aatgcctgagctcaagcaat

SEQ ID NO: 229882 - DNA, 20 bp, Artificial
  CRISPR gRNA sequence
agctcaagcaatctatttgc

SEQ ID NO: 229883 - DNA, 20 bp, Artificial
  CRISPR gRNA sequence
aagcaatctatttgccttgg

SEQ ID NO: 229884 - DNA, 20 bp, Artificial
  CRISPR gRNA sequence
tttgccttggcctcccaaag

SEQ ID NO: 229885 - DNA, 20 bp, Artificial
  CRISPR gRNA sequence
gccttggcctcccaaagtgc

SEQ ID NO: 229886 - DNA, 20 bp, Artificial
  CRISPR gRNA sequence
ccttggcctcccaaagtgct

SEQ ID NO: 229887 - DNA, 20 bp, Artificial
  CRISPR gRNA sequence
ggcctcccaaagtgctggga

SEQ ID NO: 229888 - DNA, 20 bp, Artificial
  CRISPR gRNA sequence
gcctcccaaagtgctgggat

SEQ ID NO: 229889 - DNA, 20 bp, Artificial
  CRISPR gRNA sequence
ccaaagtgctgggattacag

SEQ ID NO: 229890 - DNA, 20 bp, Artificial
  CRISPR gRNA sequence
ggattacaggcatgagccac

SEQ ID NO: 229891 - DNA, 20 bp, Artificial
  CRISPR gRNA sequence
caggcatgagccaccacggc

SEQ ID NO: 229892 - DNA, 20 bp, Artificial
  CRISPR gRNA sequence
ctcatttgttttttttataa

SEQ ID NO: 229893 - DNA, 20 bp, Artificial
  CRISPR gRNA sequence
tcatttgttttttttataag

SEQ ID NO: 229894 - DNA, 20 bp, Artificial
  CRISPR gRNA sequence
atttgttttttttataagga

SEQ ID NO: 229895 - DNA, 20 bp, Artificial
  CRISPR gRNA sequence
gttttttttataaggaagct

SEQ ID NO: 229896 - DNA, 20 bp, Artificial
  CRISPR gRNA sequence
ttttttttataaggaagcta

SEQ ID NO: 229897 - DNA, 20 bp, Artificial
  CRISPR gRNA sequence
tttttataaggaagctatct

SEQ ID NO: 229898 - DNA, 20 bp, Artificial
  CRISPR gRNA sequence
ttttataaggaagctatctc

SEQ ID NO: 229899 - DNA, 20 bp, Artificial
  CRISPR gRNA sequence
tttataaggaagctatctct

SEQ ID NO: 229900 - DNA, 20 bp, Artificial
  CRISPR gRNA sequence
ttataaggaagctatctctt

SEQ ID NO: 229901 - DNA, 20 bp, Artificial
  CRISPR gRNA sequence
tataaggaagctatctcttc

SEQ ID NO: 229902 - DNA, 20 bp, Artificial
  CRISPR gRNA sequence
ataaggaagctatctcttct

SEQ ID NO: 229903 - DNA, 20 bp, Artificial
  CRISPR gRNA sequence
taaggaagctatctcttctt

SEQ ID NO: 229904 - DNA, 20 bp, Artificial
  CRISPR gRNA sequence
tctcttcttccctccccaac

SEQ ID NO: 229905 - DNA, 20 bp, Artificial
  CRISPR gRNA sequence
ttcttccctccccaactagg

SEQ ID NO: 229906 - DNA, 20 bp, Artificial
  CRISPR gRNA sequence
cttccctccccaactagggt

SEQ ID NO: 229907 - DNA, 20 bp, Artificial
  CRISPR gRNA sequence
ttccctccccaactagggta

SEQ ID NO: 229908 - DNA, 20 bp, Artificial
  CRISPR gRNA sequence
ccctccccaactagggtatt

SEQ ID NO: 229909 - DNA, 20 bp, Artificial
  CRISPR gRNA sequence
cctccccaactagggtattc

SEQ ID NO: 229910 - DNA, 20 bp, Artificial
  CRISPR gRNA sequence
cccaactagggtattctttt

SEQ ID NO: 229911 - DNA, 20 bp, Artificial
  CRISPR gRNA sequence
gggtattctttttccctttc

SEQ ID NO: 229912 - DNA, 20 bp, Artificial
  CRISPR gRNA sequence
tttttccctttcgtcacttt

SEQ ID NO: 229913 - DNA, 20 bp, Artificial
  CRISPR gRNA sequence
tttccctttcgtcactttgc

SEQ ID NO: 229914 - DNA, 20 bp, Artificial
  CRISPR gRNA sequence
ttccctttcgtcactttgct

SEQ ID NO: 229915 - DNA, 20 bp, Artificial
  CRISPR gRNA sequence
tccctttcgtcactttgctc

SEQ ID NO: 229916 - DNA, 20 bp, Artificial
  CRISPR gRNA sequence
ccctttcgtcactttgctca

SEQ ID NO: 229917 - DNA, 20 bp, Artificial
  CRISPR gRNA sequence
cctttcgtcactttgctcat

SEQ ID NO: 229918 - DNA, 20 bp, Artificial
  CRISPR gRNA sequence
tcgtcactttgctcatgtac

SEQ ID NO: 229919 - DNA, 20 bp, Artificial
  CRISPR gRNA sequence
cgtcactttgctcatgtact

SEQ ID NO: 229920 - DNA, 20 bp, Artificial
  CRISPR gRNA sequence
gtcactttgctcatgtactg

SEQ ID NO: 229921 - DNA, 20 bp, Artificial
  CRISPR gRNA sequence
tgctcatgtactgtattcct

SEQ ID NO: 229922 - DNA, 20 bp, Artificial
  CRISPR gRNA sequence
gctcatgtactgtattcctt

SEQ ID NO: 229923 - DNA, 20 bp, Artificial
  CRISPR gRNA sequence
ctcatgtactgtattccttc

SEQ ID NO: 229924 - DNA, 20 bp, Artificial
  CRISPR gRNA sequence
atgtactgtattccttcaac

SEQ ID NO: 229925 - DNA, 20 bp, Artificial
  CRISPR gRNA sequence
tattccttcaacttcattaa

SEQ ID NO: 229926 - DNA, 20 bp, Artificial
  CRISPR gRNA sequence
cttcaacttcattaatgaat

SEQ ID NO: 229927 - DNA, 20 bp, Artificial
  CRISPR gRNA sequence
caacttcattaatgaatcca

SEQ ID NO: 229928 - DNA, 20 bp, Artificial
  CRISPR gRNA sequence
aacttcattaatgaatccat

SEQ ID NO: 229929 - DNA, 20 bp, Artificial
  CRISPR gRNA sequence
cattaatgaatccatttgga

SEQ ID NO: 229930 - DNA, 20 bp, Artificial
  CRISPR gRNA sequence
attaatgaatccatttggaa

SEQ ID NO: 229931 - DNA, 20 bp, Artificial
  CRISPR gRNA sequence
atgaatccatttggaagcag

SEQ ID NO: 229932 - DNA, 20 bp, Artificial
  CRISPR gRNA sequence
ggaagcagtgaaaaaggcaa

SEQ ID NO: 229933 - DNA, 20 bp, Artificial
  CRISPR gRNA sequence
gaagcagtgaaaaaggcaac

SEQ ID NO: 229934 - DNA, 20 bp, Artificial
  CRISPR gRNA sequence
agaaagctaagaagaaatag

SEQ ID NO: 229935 - DNA, 20 bp, Artificial
  CRISPR gRNA sequence
agaagaaatagatagaggaa

SEQ ID NO: 229936 - DNA, 20 bp, Artificial
  CRISPR gRNA sequence
agagctatctgagtattttc

SEQ ID NO: 229937 - DNA, 20 bp, Artificial
  CRISPR gRNA sequence
tctgagtattttctttagtt

SEQ ID NO: 229938 - DNA, 20 bp, Artificial
  CRISPR gRNA sequence
agtattttctttagtttgtt

SEQ ID NO: 229939 - DNA, 20 bp, Artificial
  CRISPR gRNA sequence
tctttagtttgttagctctt

SEQ ID NO: 229940 - DNA, 20 bp, Artificial
  CRISPR gRNA sequence
ctttagtttgttagctcttt

SEQ ID NO: 229941 - DNA, 20 bp, Artificial
  CRISPR gRNA sequence
tttagtttgttagctctttg

SEQ ID NO: 229942 - DNA, 20 bp, Artificial
  CRISPR gRNA sequence
tagtttgttagctctttgga

SEQ ID NO: 229943 - DNA, 20 bp, Artificial
  CRISPR gRNA sequence
agtttgttagctctttggag

SEQ ID NO: 229944 - DNA, 20 bp, Artificial
  CRISPR gRNA sequence
gtttgttagctctttggagc

SEQ ID NO: 229945 - DNA, 20 bp, Artificial
  CRISPR gRNA sequence
gttagctctttggagctttg

SEQ ID NO: 229946 - DNA, 20 bp, Artificial
  CRISPR gRNA sequence
ttagctctttggagctttga

SEQ ID NO: 229947 - DNA, 20 bp, Artificial
  CRISPR gRNA sequence
gctctttggagctttgaaac

SEQ ID NO: 229948 - DNA, 20 bp, Artificial
  CRISPR gRNA sequence
tttggagctttgaaactgga

SEQ ID NO: 229949 - DNA, 20 bp, Artificial
  CRISPR gRNA sequence
tggagctttgaaactggaaa

SEQ ID NO: 229950 - DNA, 20 bp, Artificial
  CRISPR gRNA sequence
ggagctttgaaactggaaag

SEQ ID NO: 229951 - DNA, 20 bp, Artificial
  CRISPR gRNA sequence
gagctttgaaactggaaaga

SEQ ID NO: 229952 - DNA, 20 bp, Artificial
  CRISPR gRNA sequence
tgaaactggaaagacccagg

SEQ ID NO: 229953 - DNA, 20 bp, Artificial
  CRISPR gRNA sequence
gaaactggaaagacccaggg

SEQ ID NO: 229954 - DNA, 20 bp, Artificial
  CRISPR gRNA sequence
aaactggaaagacccaggga

SEQ ID NO: 229955 - DNA, 20 bp, Artificial
  CRISPR gRNA sequence
gaaagacccagggagtgatg

SEQ ID NO: 229956 - DNA, 20 bp, Artificial
  CRISPR gRNA sequence
agcttgtaagacacaggagc

SEQ ID NO: 229957 - DNA, 20 bp, Artificial
  CRISPR gRNA sequence
gtaagacacaggagcagtga

SEQ ID NO: 229958 - DNA, 20 bp, Artificial
  CRISPR gRNA sequence
taagacacaggagcagtgag

SEQ ID NO: 229959 - DNA, 20 bp, Artificial
  CRISPR gRNA sequence
agggagatggagtagtgggg

SEQ ID NO: 229960 - DNA, 20 bp, Artificial
  CRISPR gRNA sequence
tggcacattctgtctacact

SEQ ID NO: 229961 - DNA, 20 bp, Artificial
  CRISPR gRNA sequence
gcacattctgtctacactct

SEQ ID NO: 229962 - DNA, 20 bp, Artificial
  CRISPR gRNA sequence
tgtctacactctgggtagat

SEQ ID NO: 229963 - DNA, 20 bp, Artificial
  CRISPR gRNA sequence
tctacactctgggtagatag

SEQ ID NO: 229964 - DNA, 20 bp, Artificial
  CRISPR gRNA sequence
cactctgggtagatagagga

SEQ ID NO: 229965 - DNA, 20 bp, Artificial
  CRISPR gRNA sequence
tgggtagatagaggagggag

SEQ ID NO: 229966 - DNA, 20 bp, Artificial
  CRISPR gRNA sequence
ggtagatagaggagggagga

SEQ ID NO: 229967 - DNA, 20 bp, Artificial
  CRISPR gRNA sequence
gtgacagcattttcccacca

SEQ ID NO: 229968 - DNA, 20 bp, Artificial
  CRISPR gRNA sequence
tcccaccagccagtgtaaca

SEQ ID NO: 229969 - DNA, 20 bp, Artificial
  CRISPR gRNA sequence
cccaccagccagtgtaacaa

SEQ ID NO: 229970 - DNA, 20 bp, Artificial
  CRISPR gRNA sequence
ccaccagccagtgtaacaag

SEQ ID NO: 229971 - DNA, 20 bp, Artificial
  CRISPR gRNA sequence
atttgggggaaagatggcat

SEQ ID NO: 229972 - DNA, 20 bp, Artificial
  CRISPR gRNA sequence
gggggaaagatggcataaac

SEQ ID NO: 229973 - DNA, 20 bp, Artificial
  CRISPR gRNA sequence
ggggaaagatggcataaaca

SEQ ID NO: 229974 - DNA, 20 bp, Artificial
  CRISPR gRNA sequence
actatttgatgtagatgggt

SEQ ID NO: 229975 - DNA, 20 bp, Artificial
  CRISPR gRNA sequence
ctatttgatgtagatgggtt

SEQ ID NO: 229976 - DNA, 20 bp, Artificial
  CRISPR gRNA sequence
tttgatgtagatgggttatt

SEQ ID NO: 229977 - DNA, 20 bp, Artificial
  CRISPR gRNA sequence
gatgtagatgggttatttgc

SEQ ID NO: 229978 - DNA, 20 bp, Artificial
  CRISPR gRNA sequence
atgtagatgggttatttgct

SEQ ID NO: 229979 - DNA, 20 bp, Artificial
  CRISPR gRNA sequence
tttgcttcatttttcaaatc

SEQ ID NO: 229980 - DNA, 20 bp, Artificial
  CRISPR gRNA sequence
gcttcatttttcaaatcagt

SEQ ID NO: 229981 - DNA, 20 bp, Artificial
  CRISPR gRNA sequence
cttcatttttcaaatcagtg

SEQ ID NO: 229982 - DNA, 20 bp, Artificial
  CRISPR gRNA sequence
catttttcaaatcagtgtat

SEQ ID NO: 229983 - DNA, 20 bp, Artificial
  CRISPR gRNA sequence
atttttcaaatcagtgtata

SEQ ID NO: 229984 - DNA, 20 bp, Artificial
  CRISPR gRNA sequence
ttcaaatcagtgtatataat

SEQ ID NO: 229985 - DNA, 20 bp, Artificial
  CRISPR gRNA sequence
tcaaatcagtgtatataatc

SEQ ID NO: 229986 - DNA, 20 bp, Artificial
  CRISPR gRNA sequence
caaatcagtgtatataatca

SEQ ID NO: 229987 - DNA, 20 bp, Artificial
  CRISPR gRNA sequence
aaatcagtgtatataatcaa

SEQ ID NO: 229988 - DNA, 20 bp, Artificial
  CRISPR gRNA sequence
agcatgtttgaatagactgt

SEQ ID NO: 229989 - DNA, 20 bp, Artificial
  CRISPR gRNA sequence
gaatagactgtcagagctgg

SEQ ID NO: 229990 - DNA, 20 bp, Artificial
  CRISPR gRNA sequence
aatagactgtcagagctgga

SEQ ID NO: 229991 - DNA, 20 bp, Artificial
  CRISPR gRNA sequence
tcagagctggaactctttca

SEQ ID NO: 229992 - DNA, 20 bp, Artificial
  CRISPR gRNA sequence
gaactctttcattaacatct

SEQ ID NO: 229993 - DNA, 20 bp, Artificial
  CRISPR gRNA sequence
tttcattaacatctctggca

SEQ ID NO: 229994 - DNA, 20 bp, Artificial
  CRISPR gRNA sequence
tcattaacatctctggcacc

SEQ ID NO: 229995 - DNA, 20 bp, Artificial
  CRISPR gRNA sequence
cattaacatctctggcacct

SEQ ID NO: 229996 - DNA, 20 bp, Artificial
  CRISPR gRNA sequence
attaacatctctggcacctt

SEQ ID NO: 229997 - DNA, 20 bp, Artificial
  CRISPR gRNA sequence
acatctctggcacctttagt

SEQ ID NO: 229998 - DNA, 20 bp, Artificial
  CRISPR gRNA sequence
tggcacctttagttttagcc

SEQ ID NO: 229999 - DNA, 20 bp, Artificial
  CRISPR gRNA sequence
gcacctttagttttagccct

SEQ ID NO: 230000 - DNA, 20 bp, Artificial
  CRISPR gRNA sequence
tagttttagccctgaacatt

SEQ ID NO: 230001 - DNA, 20 bp, Artificial
  CRISPR gRNA sequence
agttttagccctgaacattt

SEQ ID NO: 230002 - DNA, 20 bp, Artificial
  CRISPR gRNA sequence
gttttagccctgaacatttt

SEQ ID NO: 230003 - DNA, 20 bp, Artificial
  CRISPR gRNA sequence
tagccctgaacattttatct

SEQ ID NO: 230004 - DNA, 20 bp, Artificial
  CRISPR gRNA sequence
agccctgaacattttatctt

SEQ ID NO: 230005 - DNA, 20 bp, Artificial
  CRISPR gRNA sequence
gccctgaacattttatctta

SEQ ID NO: 230006 - DNA, 20 bp, Artificial
  CRISPR gRNA sequence
aacattttatcttaaaatta

SEQ ID NO: 230007 - DNA, 20 bp, Artificial
  CRISPR gRNA sequence
tatcttaaaattaaacatta

SEQ ID NO: 230008 - DNA, 20 bp, Artificial
  CRISPR gRNA sequence
atcttaaaattaaacattac

SEQ ID NO: 230009 - DNA, 20 bp, Artificial
  CRISPR gRNA sequence
tcttaaaattaaacattacc

SEQ ID NO: 230010 - DNA, 20 bp, Artificial
  CRISPR gRNA sequence
aaaattaaacattaccaaat

SEQ ID NO: 230011 - DNA, 20 bp, Artificial
  CRISPR gRNA sequence
aaattaaacattaccaaatg

SEQ ID NO: 230012 - DNA, 20 bp, Artificial
  CRISPR gRNA sequence
aacattaccaaatgccttag

SEQ ID NO: 230013 - DNA, 20 bp, Artificial
  CRISPR gRNA sequence
ccaaatgccttagtttattt

SEQ ID NO: 230014 - DNA, 20 bp, Artificial
  CRISPR gRNA sequence
agtttatttcatttattaaa

SEQ ID NO: 230015 - DNA, 20 bp, Artificial
  CRISPR gRNA sequence
gtttatttcatttattaaat

SEQ ID NO: 230016 - DNA, 20 bp, Artificial
  CRISPR gRNA sequence
atttcatttattaaatttat

SEQ ID NO: 230017 - DNA, 20 bp, Artificial
  CRISPR gRNA sequence
tttcatttattaaatttata

SEQ ID NO: 230018 - DNA, 20 bp, Artificial
  CRISPR gRNA sequence
catttattaaatttatattc

SEQ ID NO: 230019 - DNA, 20 bp, Artificial
  CRISPR gRNA sequence
atttattaaatttatattct

SEQ ID NO: 230020 - DNA, 20 bp, Artificial
  CRISPR gRNA sequence
attaaatttatattcttatt

SEQ ID NO: 230021 - DNA, 20 bp, Artificial
  CRISPR gRNA sequence
ttaaatttatattcttattt

SEQ ID NO: 230022 - DNA, 20 bp, Artificial
  CRISPR gRNA sequence
aatttatattcttatttgtt

SEQ ID NO: 230023 - DNA, 20 bp, Artificial
  CRISPR gRNA sequence
atattcttatttgttattta

SEQ ID NO: 230024 - DNA, 20 bp, Artificial
  CRISPR gRNA sequence
tattcttatttgttatttat

SEQ ID NO: 230025 - DNA, 20 bp, Artificial
  CRISPR gRNA sequence
ttatttgttatttatatcag

SEQ ID NO: 230026 - DNA, 20 bp, Artificial
  CRISPR gRNA sequence
atttgttatttatatcagct

SEQ ID NO: 230027 - DNA, 20 bp, Artificial
  CRISPR gRNA sequence
tttgttatttatatcagctt

SEQ ID NO: 230028 - DNA, 20 bp, Artificial
  CRISPR gRNA sequence
gttatttatatcagcttcca

SEQ ID NO: 230029 - DNA, 20 bp, Artificial
  CRISPR gRNA sequence
ttatttatatcagcttccaa

SEQ ID NO: 230030 - DNA, 20 bp, Artificial
  CRISPR gRNA sequence
tttatatcagcttccaatca

SEQ ID NO: 230031 - DNA, 20 bp, Artificial
  CRISPR gRNA sequence
atatcagcttccaatcagaa

SEQ ID NO: 230032 - DNA, 20 bp, Artificial
  CRISPR gRNA sequence
tatcagcttccaatcagaag

SEQ ID NO: 230033 - DNA, 20 bp, Artificial
  CRISPR gRNA sequence
ccaatcagaagactatacaa

SEQ ID NO: 230034 - DNA, 20 bp, Artificial
  CRISPR gRNA sequence
caatcagaagactatacaac

SEQ ID NO: 230035 - DNA, 20 bp, Artificial
  CRISPR gRNA sequence
tacaacctcctagggtaagt

SEQ ID NO: 230036 - DNA, 20 bp, Artificial
  CRISPR gRNA sequence
ctagggtaagttaaagttta

SEQ ID NO: 230037 - DNA, 20 bp, Artificial
  CRISPR gRNA sequence
gggtaagttaaagtttatta

SEQ ID NO: 230038 - DNA, 20 bp, Artificial
  CRISPR gRNA sequence
aagtttattaaatgaattgt

SEQ ID NO: 230039 - DNA, 20 bp, Artificial
  CRISPR gRNA sequence
attaaatgaattgtgaatga

SEQ ID NO: 230040 - DNA, 20 bp, Artificial
  CRISPR gRNA sequence
ttaaatgaattgtgaatgat

SEQ ID NO: 230041 - DNA, 20 bp, Artificial
  CRISPR gRNA sequence
aatgaattgtgaatgatcat

SEQ ID NO: 230042 - DNA, 20 bp, Artificial
  CRISPR gRNA sequence
tgaatgatcatttgagggat

SEQ ID NO: 230043 - DNA, 20 bp, Artificial
  CRISPR gRNA sequence
gagggattagactgaggaac

SEQ ID NO: 230044 - DNA, 20 bp, Artificial
  CRISPR gRNA sequence
agggattagactgaggaact

SEQ ID NO: 230045 - DNA, 20 bp, Artificial
  CRISPR gRNA sequence
gactgaggaacttggtaatt

SEQ ID NO: 230046 - DNA, 20 bp, Artificial
  CRISPR gRNA sequence
aggaacttggtaattgagat

SEQ ID NO: 230047 - DNA, 20 bp, Artificial
  CRISPR gRNA sequence
ggtaattgagatattttgct

SEQ ID NO: 230048 - DNA, 20 bp, Artificial
  CRISPR gRNA sequence
gtaattgagatattttgcta

SEQ ID NO: 230049 - DNA, 20 bp, Artificial
  CRISPR gRNA sequence
agatattttgctatctgttt

SEQ ID NO: 230050 - DNA, 20 bp, Artificial
  CRISPR gRNA sequence
tgctatctgttttgtctcac

SEQ ID NO: 230051 - DNA, 20 bp, Artificial
  CRISPR gRNA sequence
gctatctgttttgtctcacg

SEQ ID NO: 230052 - DNA, 20 bp, Artificial
  CRISPR gRNA sequence
ctatctgttttgtctcacgt

SEQ ID NO: 230053 - DNA, 20 bp, Artificial
  CRISPR gRNA sequence
tctgttttgtctcacgtcaa

SEQ ID NO: 230054 - DNA, 20 bp, Artificial
  CRISPR gRNA sequence
ttttgtctcacgtcaaatta

SEQ ID NO: 230055 - DNA, 20 bp, Artificial
  CRISPR gRNA sequence
tgtctcacgtcaaattaaga

SEQ ID NO: 230056 - DNA, 20 bp, Artificial
  CRISPR gRNA sequence
gtctcacgtcaaattaagag

SEQ ID NO: 230057 - DNA, 20 bp, Artificial
  CRISPR gRNA sequence
tctcacgtcaaattaagaga

SEQ ID NO: 230058 - DNA, 20 bp, Artificial
  CRISPR gRNA sequence
acgtcaaattaagagaatgt

SEQ ID NO: 230059 - DNA, 20 bp, Artificial
  CRISPR gRNA sequence
agagaatgttgaagtcattg

SEQ ID NO: 230060 - DNA, 20 bp, Artificial
  CRISPR gRNA sequence
aagtcattgcatgacctttg

SEQ ID NO: 230061 - DNA, 20 bp, Artificial
  CRISPR gRNA sequence
catgacctttgcatgaatgg

SEQ ID NO: 230062 - DNA, 20 bp, Artificial
  CRISPR gRNA sequence
tgcatgaatgggtccagttc

SEQ ID NO: 230063 - DNA, 20 bp, Artificial
  CRISPR gRNA sequence
gcatgaatgggtccagttct

SEQ ID NO: 230064 - DNA, 20 bp, Artificial
  CRISPR gRNA sequence
catgaatgggtccagttcta

SEQ ID NO: 230065 - DNA, 20 bp, Artificial
  CRISPR gRNA sequence
tattttaaaacctgtgtttg

SEQ ID NO: 230066 - DNA, 20 bp, Artificial
  CRISPR gRNA sequence
ttttaaaacctgtgtttggt

SEQ ID NO: 230067 - DNA, 20 bp, Artificial
  CRISPR gRNA sequence
taaaacctgtgtttggtcat

SEQ ID NO: 230068 - DNA, 20 bp, Artificial
  CRISPR gRNA sequence
aaaacctgtgtttggtcatt

SEQ ID NO: 230069 - DNA, 20 bp, Artificial
  CRISPR gRNA sequence
aaacctgtgtttggtcattt

SEQ ID NO: 230070 - DNA, 20 bp, Artificial
  CRISPR gRNA sequence
tgtttggtcattttagtgtc

SEQ ID NO: 230071 - DNA, 20 bp, Artificial
  CRISPR gRNA sequence
ggtcattttagtgtcaatgg

SEQ ID NO: 230072 - DNA, 20 bp, Artificial
  CRISPR gRNA sequence
gtcattttagtgtcaatggg

SEQ ID NO: 230073 - DNA, 20 bp, Artificial
  CRISPR gRNA sequence
tagtgtcaatgggatggaat

SEQ ID NO: 230074 - DNA, 20 bp, Artificial
  CRISPR gRNA sequence
agtgtcaatgggatggaata

SEQ ID NO: 230075 - DNA, 20 bp, Artificial
  CRISPR gRNA sequence
gtgtcaatgggatggaataa

SEQ ID NO: 230076 - DNA, 20 bp, Artificial
  CRISPR gRNA sequence
cttaagattgtactgacttc

SEQ ID NO: 230077 - DNA, 20 bp, Artificial
  CRISPR gRNA sequence
ttaagattgtactgacttct

SEQ ID NO: 230078 - DNA, 20 bp, Artificial
  CRISPR gRNA sequence
aagattgtactgacttctca

SEQ ID NO: 230079 - DNA, 20 bp, Artificial
  CRISPR gRNA sequence
agattgtactgacttctcac

SEQ ID NO: 230080 - DNA, 20 bp, Artificial
  CRISPR gRNA sequence
tactgacttctcacacccaa

SEQ ID NO: 230081 - DNA, 20 bp, Artificial
  CRISPR gRNA sequence
acttctcacacccaaaactg

SEQ ID NO: 230082 - DNA, 20 bp, Artificial
  CRISPR gRNA sequence
ctcacacccaaaactggaaa

SEQ ID NO: 230083 - DNA, 20 bp, Artificial
  CRISPR gRNA sequence
tcacacccaaaactggaaag

SEQ ID NO: 230084 - DNA, 20 bp, Artificial
  CRISPR gRNA sequence
acacccaaaactggaaagta

SEQ ID NO: 230085 - DNA, 20 bp, Artificial
  CRISPR gRNA sequence
gaaagtaggaataatggcta

SEQ ID NO: 230086 - DNA, 20 bp, Artificial
  CRISPR gRNA sequence
tattatctctgcaatcagaa

SEQ ID NO: 230087 - DNA, 20 bp, Artificial
  CRISPR gRNA sequence
tctctgcaatcagaaggaag

SEQ ID NO: 230088 - DNA, 20 bp, Artificial
  CRISPR gRNA sequence
tgcaatcagaaggaagctga

SEQ ID NO: 230089 - DNA, 20 bp, Artificial
  CRISPR gRNA sequence
caatcagaaggaagctgatt

SEQ ID NO: 230090 - DNA, 20 bp, Artificial
  CRISPR gRNA sequence
attccaatatatcacctcac

SEQ ID NO: 230091 - DNA, 20 bp, Artificial
  CRISPR gRNA sequence
caatatatcacctcacctgt

SEQ ID NO: 230092 - DNA, 20 bp, Artificial
  CRISPR gRNA sequence
acctgttggattcattggat

SEQ ID NO: 230093 - DNA, 20 bp, Artificial
  CRISPR gRNA sequence
ttggattcattggatgtgca

SEQ ID NO: 230094 - DNA, 20 bp, Artificial
  CRISPR gRNA sequence
gattcattggatgtgcatac

SEQ ID NO: 230095 - DNA, 20 bp, Artificial
  CRISPR gRNA sequence
attggatgtgcatacacaga

SEQ ID NO: 230096 - DNA, 20 bp, Artificial
  CRISPR gRNA sequence
gatgtgcatacacagaatga

SEQ ID NO: 230097 - DNA, 20 bp, Artificial
  CRISPR gRNA sequence
caggcttaaaaatgaggaga

SEQ ID NO: 230098 - DNA, 20 bp, Artificial
  CRISPR gRNA sequence
aggcttaaaaatgaggagaa

SEQ ID NO: 230099 - DNA, 20 bp, Artificial
  CRISPR gRNA sequence
aaaaatgaggagaaatctat

SEQ ID NO: 230100 - DNA, 20 bp, Artificial
  CRISPR gRNA sequence
aaaatgaggagaaatctata

SEQ ID NO: 230101 - DNA, 20 bp, Artificial
  CRISPR gRNA sequence
tactaagttgacatcactga

SEQ ID NO: 230102 - DNA, 20 bp, Artificial
  CRISPR gRNA sequence
agttgacatcactgataatt

SEQ ID NO: 230103 - DNA, 20 bp, Artificial
  CRISPR gRNA sequence
acatcactgataattataat

SEQ ID NO: 230104 - DNA, 20 bp, Artificial
  CRISPR gRNA sequence
ataattataatctataaaat

SEQ ID NO: 230105 - DNA, 20 bp, Artificial
  CRISPR gRNA sequence
taatctataaaataaatgta

SEQ ID NO: 230106 - DNA, 20 bp, Artificial
  CRISPR gRNA sequence
taaaataaatgtaaatattg

SEQ ID NO: 230107 - DNA, 20 bp, Artificial
  CRISPR gRNA sequence
ctgaaaacatctgttcggag

SEQ ID NO: 230108 - DNA, 20 bp, Artificial
  CRISPR gRNA sequence
aaaacatctgttcggagtta

SEQ ID NO: 230109 - DNA, 20 bp, Artificial
  CRISPR gRNA sequence
ttcggagttatgattcgatc

SEQ ID NO: 230110 - DNA, 20 bp, Artificial
  CRISPR gRNA sequence
ggagttatgattcgatcctc

SEQ ID NO: 230111 - DNA, 20 bp, Artificial
  CRISPR gRNA sequence
tgattcgatcctctcccata

SEQ ID NO: 230112 - DNA, 20 bp, Artificial
  CRISPR gRNA sequence
gatcctctcccatacaaatg

SEQ ID NO: 230113 - DNA, 20 bp, Artificial
  CRISPR gRNA sequence
tcccatacaaatgttttata

SEQ ID NO: 230114 - DNA, 20 bp, Artificial
  CRISPR gRNA sequence
ccatacaaatgttttataaa

SEQ ID NO: 230115 - DNA, 20 bp, Artificial
  CRISPR gRNA sequence
tataaacattttttccctta

SEQ ID NO: 230116 - DNA, 20 bp, Artificial
  CRISPR gRNA sequence
ataaacattttttcccttaa

SEQ ID NO: 230117 - DNA, 20 bp, Artificial
  CRISPR gRNA sequence
taaacattttttcccttaaa

SEQ ID NO: 230118 - DNA, 20 bp, Artificial
  CRISPR gRNA sequence
tttcccttaaaactgtgctt

SEQ ID NO: 230119 - DNA, 20 bp, Artificial
  CRISPR gRNA sequence
ttcccttaaaactgtgctta

SEQ ID NO: 230120 - DNA, 20 bp, Artificial
  CRISPR gRNA sequence
tcccttaaaactgtgcttaa

SEQ ID NO: 230121 - DNA, 20 bp, Artificial
  CRISPR gRNA sequence
cccttaaaactgtgcttaag

SEQ ID NO: 230122 - DNA, 20 bp, Artificial
  CRISPR gRNA sequence
ccttaaaactgtgcttaagg

SEQ ID NO: 230123 - DNA, 20 bp, Artificial
  CRISPR gRNA sequence
aaaactgtgcttaaggtttc

SEQ ID NO: 230124 - DNA, 20 bp, Artificial
  CRISPR gRNA sequence
aaactgtgcttaaggtttca

SEQ ID NO: 230125 - DNA, 20 bp, Artificial
  CRISPR gRNA sequence
tgcttaaggtttcattgtac

SEQ ID NO: 230126 - DNA, 20 bp, Artificial
  CRISPR gRNA sequence
aaggtttcattgtaccttag

SEQ ID NO: 230127 - DNA, 20 bp, Artificial
  CRISPR gRNA sequence
aggtttcattgtaccttaga

SEQ ID NO: 230128 - DNA, 20 bp, Artificial
  CRISPR gRNA sequence
cattgtaccttagatacctt

SEQ ID NO: 230129 - DNA, 20 bp, Artificial
  CRISPR gRNA sequence
attgtaccttagatacctta

SEQ ID NO: 230130 - DNA, 20 bp, Artificial
  CRISPR gRNA sequence
taccttagataccttattaa

SEQ ID NO: 230131 - DNA, 20 bp, Artificial
  CRISPR gRNA sequence
agataccttattaagccatc

SEQ ID NO: 230132 - DNA, 20 bp, Artificial
  CRISPR gRNA sequence
gataccttattaagccatct

SEQ ID NO: 230133 - DNA, 20 bp, Artificial
  CRISPR gRNA sequence
attaagccatctgaggaaat

SEQ ID NO: 230134 - DNA, 20 bp, Artificial
  CRISPR gRNA sequence
ttaagccatctgaggaaatt

SEQ ID NO: 230135 - DNA, 20 bp, Artificial
  CRISPR gRNA sequence
agccatctgaggaaattgca

SEQ ID NO: 230136 - DNA, 20 bp, Artificial
  CRISPR gRNA sequence
aggaaattgcaagaaaggag

SEQ ID NO: 230137 - DNA, 20 bp, Artificial
  CRISPR gRNA sequence
caagaaaggagtaattttag

SEQ ID NO: 230138 - DNA, 20 bp, Artificial
  CRISPR gRNA sequence
taggagggcataaatgaaga

SEQ ID NO: 230139 - DNA, 20 bp, Artificial
  CRISPR gRNA sequence
aggagggcataaatgaagag

SEQ ID NO: 230140 - DNA, 20 bp, Artificial
  CRISPR gRNA sequence
ggagggcataaatgaagaga

SEQ ID NO: 230141 - DNA, 20 bp, Artificial
  CRISPR gRNA sequence
ataaacatagacttatcaca

SEQ ID NO: 230142 - DNA, 20 bp, Artificial
  CRISPR gRNA sequence
taaacatagacttatcacag

SEQ ID NO: 230143 - DNA, 20 bp, Artificial
  CRISPR gRNA sequence
atcacagtgacaggcccaag

SEQ ID NO: 230144 - DNA, 20 bp, Artificial
  CRISPR gRNA sequence
tcacagtgacaggcccaaga

SEQ ID NO: 230145 - DNA, 20 bp, Artificial
  CRISPR gRNA sequence
tggacataagctctggaaag

SEQ ID NO: 230146 - DNA, 20 bp, Artificial
  CRISPR gRNA sequence
tggaaaggattatattgtac

SEQ ID NO: 230147 - DNA, 20 bp, Artificial
  CRISPR gRNA sequence
gaaaggattatattgtactt

SEQ ID NO: 230148 - DNA, 20 bp, Artificial
  CRISPR gRNA sequence
tattgtacttagcttcctat

SEQ ID NO: 230149 - DNA, 20 bp, Artificial
  CRISPR gRNA sequence
tacttagcttcctataacgg

SEQ ID NO: 230150 - DNA, 20 bp, Artificial
  CRISPR gRNA sequence
agcttcctataacggagtga

SEQ ID NO: 230151 - DNA, 20 bp, Artificial
  CRISPR gRNA sequence
gcttcctataacggagtgat

SEQ ID NO: 230152 - DNA, 20 bp, Artificial
  CRISPR gRNA sequence
cctataacggagtgatgata

SEQ ID NO: 230153 - DNA, 20 bp, Artificial
  CRISPR gRNA sequence
ctataacggagtgatgatag

SEQ ID NO: 230154 - DNA, 20 bp, Artificial
  CRISPR gRNA sequence
taacggagtgatgatagatg

SEQ ID NO: 230155 - DNA, 20 bp, Artificial
  CRISPR gRNA sequence
gaatgccaaagagagtcttc

SEQ ID NO: 230156 - DNA, 20 bp, Artificial
  CRISPR gRNA sequence
ctgtctgtggccggaggtag

SEQ ID NO: 230157 - DNA, 20 bp, Artificial
  CRISPR gRNA sequence
tgtctgtggccggaggtaga

SEQ ID NO: 230158 - DNA, 20 bp, Artificial
  CRISPR gRNA sequence
tctgtggccggaggtagagg

SEQ ID NO: 230159 - DNA, 20 bp, Artificial
  CRISPR gRNA sequence
tggccggaggtagaggtcac

SEQ ID NO: 230160 - DNA, 20 bp, Artificial
  CRISPR gRNA sequence
ctaagtctgacaagcctcat

SEQ ID NO: 230161 - DNA, 20 bp, Artificial
  CRISPR gRNA sequence
taagtctgacaagcctcatt

SEQ ID NO: 230162 - DNA, 20 bp, Artificial
  CRISPR gRNA sequence
agtctgacaagcctcattgt

SEQ ID NO: 230163 - DNA, 20 bp, Artificial
  CRISPR gRNA sequence
acaagcctcattgtgcctaa

SEQ ID NO: 230164 - DNA, 20 bp, Artificial
  CRISPR gRNA sequence
attgtgcctaaagggcaggt

SEQ ID NO: 230165 - DNA, 20 bp, Artificial
  CRISPR gRNA sequence
tgcctaaagggcaggtgggg

SEQ ID NO: 230166 - DNA, 20 bp, Artificial
  CRISPR gRNA sequence
aagggcaggtggggcgggta

SEQ ID NO: 230167 - DNA, 20 bp, Artificial
  CRISPR gRNA sequence
ccacaggggtatattctaga

SEQ ID NO: 230168 - DNA, 20 bp, Artificial
  CRISPR gRNA sequence
tagaaagattggtgccatag

SEQ ID NO: 230169 - DNA, 20 bp, Artificial
  CRISPR gRNA sequence
gaaagattggtgccatagct

SEQ ID NO: 230170 - DNA, 20 bp, Artificial
  CRISPR gRNA sequence
gtgccatagctatgttggtc

SEQ ID NO: 230171 - DNA, 20 bp, Artificial
  CRISPR gRNA sequence
tgttggtcacaagaggccag

SEQ ID NO: 230172 - DNA, 20 bp, Artificial
  CRISPR gRNA sequence
gtcacaagaggccagcaact

SEQ ID NO: 230173 - DNA, 20 bp, Artificial
  CRISPR gRNA sequence
aactggacctgtgaatccta

SEQ ID NO: 230174 - DNA, 20 bp, Artificial
  CRISPR gRNA sequence
actggacctgtgaatcctaa

SEQ ID NO: 230175 - DNA, 20 bp, Artificial
  CRISPR gRNA sequence
gacctgtgaatcctaacaca

SEQ ID NO: 230176 - DNA, 20 bp, Artificial
  CRISPR gRNA sequence
tgaatcctaacacattttct

SEQ ID NO: 230177 - DNA, 20 bp, Artificial
  CRISPR gRNA sequence
acacattttctttcccagtt

SEQ ID NO: 230178 - DNA, 20 bp, Artificial
  CRISPR gRNA sequence
tctttcccagttactgagtt

SEQ ID NO: 230179 - DNA, 20 bp, Artificial
  CRISPR gRNA sequence
ctttcccagttactgagttc

SEQ ID NO: 230180 - DNA, 20 bp, Artificial
  CRISPR gRNA sequence
tttcccagttactgagttca

SEQ ID NO: 230181 - DNA, 20 bp, Artificial
  CRISPR gRNA sequence
tcccagttactgagttcaat

SEQ ID NO: 230182 - DNA, 20 bp, Artificial
  CRISPR gRNA sequence
cccagttactgagttcaatt

SEQ ID NO: 230183 - DNA, 20 bp, Artificial
  CRISPR gRNA sequence
ccagttactgagttcaattt

SEQ ID NO: 230184 - DNA, 20 bp, Artificial
  CRISPR gRNA sequence
ctgagttcaatttgcgatac

SEQ ID NO: 230185 - DNA, 20 bp, Artificial
  CRISPR gRNA sequence
agttcaatttgcgatactta

SEQ ID NO: 230186 - DNA, 20 bp, Artificial
  CRISPR gRNA sequence
aatttgcgatacttaaagat

SEQ ID NO: 230187 - DNA, 20 bp, Artificial
  CRISPR gRNA sequence
gcgatacttaaagatgattc

SEQ ID NO: 230188 - DNA, 20 bp, Artificial
  CRISPR gRNA sequence
cgatacttaaagatgattct

SEQ ID NO: 230189 - DNA, 20 bp, Artificial
  CRISPR gRNA sequence
aaagatgattctgttttgct

SEQ ID NO: 230190 - DNA, 20 bp, Artificial
  CRISPR gRNA sequence
aagatgattctgttttgctt

SEQ ID NO: 230191 - DNA, 20 bp, Artificial
  CRISPR gRNA sequence
tgttttgcttccacctcttc

SEQ ID NO: 230192 - DNA, 20 bp, Artificial
  CRISPR gRNA sequence
ttttgcttccacctcttcac

SEQ ID NO: 230193 - DNA, 20 bp, Artificial
  CRISPR gRNA sequence
tgcttccacctcttcactgt

SEQ ID NO: 230194 - DNA, 20 bp, Artificial
  CRISPR gRNA sequence
gcttccacctcttcactgtg

SEQ ID NO: 230195 - DNA, 20 bp, Artificial
  CRISPR gRNA sequence
cttccacctcttcactgtgt

SEQ ID NO: 230196 - DNA, 20 bp, Artificial
  CRISPR gRNA sequence
ccacctcttcactgtgttat

SEQ ID NO: 230197 - DNA, 20 bp, Artificial
  CRISPR gRNA sequence
cacctcttcactgtgttatt

SEQ ID NO: 230198 - DNA, 20 bp, Artificial
  CRISPR gRNA sequence
ttcactgtgttatttattct

SEQ ID NO: 230199 - DNA, 20 bp, Artificial
  CRISPR gRNA sequence
cactgtgttatttattctgt

SEQ ID NO: 230200 - DNA, 20 bp, Artificial
  CRISPR gRNA sequence
actgtgttatttattctgtt

SEQ ID NO: 230201 - DNA, 20 bp, Artificial
  CRISPR gRNA sequence
tgttatttattctgttgttg

SEQ ID NO: 230202 - DNA, 20 bp, Artificial
  CRISPR gRNA sequence
tttattctgttgttgctatt

SEQ ID NO: 230203 - DNA, 20 bp, Artificial
  CRISPR gRNA sequence
attctgttgttgctatttat

SEQ ID NO: 230204 - DNA, 20 bp, Artificial
  CRISPR gRNA sequence
ttctgttgttgctatttatg

SEQ ID NO: 230205 - DNA, 20 bp, Artificial
  CRISPR gRNA sequence
tgttgttgctatttatgctt

SEQ ID NO: 230206 - DNA, 20 bp, Artificial
  CRISPR gRNA sequence
ttgttgctatttatgcttgc

SEQ ID NO: 230207 - DNA, 20 bp, Artificial
  CRISPR gRNA sequence
ttgctatttatgcttgcact

SEQ ID NO: 230208 - DNA, 20 bp, Artificial
  CRISPR gRNA sequence
ctatttatgcttgcactttc

SEQ ID NO: 230209 - DNA, 20 bp, Artificial
  CRISPR gRNA sequence
tttatgcttgcactttcata

SEQ ID NO: 230210 - DNA, 20 bp, Artificial
  CRISPR gRNA sequence
atgcttgcactttcatattt

SEQ ID NO: 230211 - DNA, 20 bp, Artificial
  CRISPR gRNA sequence
tgcttgcactttcatatttt

SEQ ID NO: 230212 - DNA, 20 bp, Artificial
  CRISPR gRNA sequence
gcactttcatatttttagaa

SEQ ID NO: 230213 - DNA, 20 bp, Artificial
  CRISPR gRNA sequence
cactttcatatttttagaag

SEQ ID NO: 230214 - DNA, 20 bp, Artificial
  CRISPR gRNA sequence
tcatatttttagaagttaga

SEQ ID NO: 230215 - DNA, 20 bp, Artificial
  CRISPR gRNA sequence
catatttttagaagttagaa

SEQ ID NO: 230216 - DNA, 20 bp, Artificial
  CRISPR gRNA sequence
atatttttagaagttagaat

SEQ ID NO: 230217 - DNA, 20 bp, Artificial
  CRISPR gRNA sequence
ttagaagttagaatttcttg

SEQ ID NO: 230218 - DNA, 20 bp, Artificial
  CRISPR gRNA sequence
tagaagttagaatttcttga

SEQ ID NO: 230219 - DNA, 20 bp, Artificial
  CRISPR gRNA sequence
agaagttagaatttcttgag

SEQ ID NO: 230220 - DNA, 20 bp, Artificial
  CRISPR gRNA sequence
gaagttagaatttcttgagc

SEQ ID NO: 230221 - DNA, 20 bp, Artificial
  CRISPR gRNA sequence
gaatttcttgagctgagagt

SEQ ID NO: 230222 - DNA, 20 bp, Artificial
  CRISPR gRNA sequence
cttgagctgagagtggtgaa

SEQ ID NO: 230223 - DNA, 20 bp, Artificial
  CRISPR gRNA sequence
ttgagctgagagtggtgaag

SEQ ID NO: 230224 - DNA, 20 bp, Artificial
  CRISPR gRNA sequence
gagctgagagtggtgaagtg

SEQ ID NO: 230225 - DNA, 20 bp, Artificial
  CRISPR gRNA sequence
agctgagagtggtgaagtgg

SEQ ID NO: 230226 - DNA, 20 bp, Artificial
  CRISPR gRNA sequence
agagtggtgaagtgggaaat

SEQ ID NO: 230227 - DNA, 20 bp, Artificial
  CRISPR gRNA sequence
tgtttagaaaaataatatta

SEQ ID NO: 230228 - DNA, 20 bp, Artificial
  CRISPR gRNA sequence
tttagaaaaataatattaag

SEQ ID NO: 230229 - DNA, 20 bp, Artificial
  CRISPR gRNA sequence
agaaaaataatattaagaga

SEQ ID NO: 230230 - DNA, 20 bp, Artificial
  CRISPR gRNA sequence
gaaaaataatattaagagaa

SEQ ID NO: 230231 - DNA, 20 bp, Artificial
  CRISPR gRNA sequence
agagaataatacagttatta

SEQ ID NO: 230232 - DNA, 20 bp, Artificial
  CRISPR gRNA sequence
ttattaaactattaacccga

SEQ ID NO: 230233 - DNA, 20 bp, Artificial
  CRISPR gRNA sequence
ttaaactattaacccgactt

SEQ ID NO: 230234 - DNA, 20 bp, Artificial
  CRISPR gRNA sequence
aactattaacccgacttggc

SEQ ID NO: 230235 - DNA, 20 bp, Artificial
  CRISPR gRNA sequence
ttaacccgacttggcaagct

SEQ ID NO: 230236 - DNA, 20 bp, Artificial
  CRISPR gRNA sequence
acccgacttggcaagctttg

SEQ ID NO: 230237 - DNA, 20 bp, Artificial
  CRISPR gRNA sequence
ggcaagctttgctttaacat

SEQ ID NO: 230238 - DNA, 20 bp, Artificial
  CRISPR gRNA sequence
gcaagctttgctttaacatt

SEQ ID NO: 230239 - DNA, 20 bp, Artificial
  CRISPR gRNA sequence
tgctttaacatttacaggct

SEQ ID NO: 230240 - DNA, 20 bp, Artificial
  CRISPR gRNA sequence
gctttaacatttacaggctt

SEQ ID NO: 230241 - DNA, 20 bp, Artificial
  CRISPR gRNA sequence
ctttaacatttacaggctta

SEQ ID NO: 230242 - DNA, 20 bp, Artificial
  CRISPR gRNA sequence
taacatttacaggcttattt

SEQ ID NO: 230243 - DNA, 20 bp, Artificial
  CRISPR gRNA sequence
aacatttacaggcttatttc

SEQ ID NO: 230244 - DNA, 20 bp, Artificial
  CRISPR gRNA sequence
acatttacaggcttatttcg

SEQ ID NO: 230245 - DNA, 20 bp, Artificial
  CRISPR gRNA sequence
acaggcttatttcgttgttt

SEQ ID NO: 230246 - DNA, 20 bp, Artificial
  CRISPR gRNA sequence
caggcttatttcgttgtttt

SEQ ID NO: 230247 - DNA, 20 bp, Artificial
  CRISPR gRNA sequence
atttcgttgttttgtttttt

SEQ ID NO: 230248 - DNA, 20 bp, Artificial
  CRISPR gRNA sequence
tttcgttgttttgttttttc

SEQ ID NO: 230249 - DNA, 20 bp, Artificial
  CRISPR gRNA sequence
cgttgttttgttttttcttt

SEQ ID NO: 230250 - DNA, 20 bp, Artificial
  CRISPR gRNA sequence
gttgttttgttttttctttt

SEQ ID NO: 230251 - DNA, 20 bp, Artificial
  CRISPR gRNA sequence
ttttgttttttctttttttt

SEQ ID NO: 230252 - DNA, 20 bp, Artificial
  CRISPR gRNA sequence
tgttttttcttttttttttg

SEQ ID NO: 230253 - DNA, 20 bp, Artificial
  CRISPR gRNA sequence
gttttttcttttttttttga

SEQ ID NO: 230254 - DNA, 20 bp, Artificial
  CRISPR gRNA sequence
ttttttcttttttttttgac

SEQ ID NO: 230255 - DNA, 20 bp, Artificial
  CRISPR gRNA sequence
tttcttttttttttgactgt

SEQ ID NO: 230256 - DNA, 20 bp, Artificial
  CRISPR gRNA sequence
ttcttttttttttgactgta

SEQ ID NO: 230257 - DNA, 20 bp, Artificial
  CRISPR gRNA sequence
tcttttttttttgactgtag

SEQ ID NO: 230258 - DNA, 20 bp, Artificial
  CRISPR gRNA sequence
cttttttttttgactgtagg

SEQ ID NO: 230259 - DNA, 20 bp, Artificial
  CRISPR gRNA sequence
ttttttttttgactgtagga

SEQ ID NO: 230260 - DNA, 20 bp, Artificial
  CRISPR gRNA sequence
ttttttttgactgtaggatt

SEQ ID NO: 230261 - DNA, 20 bp, Artificial
  CRISPR gRNA sequence
tttttttgactgtaggattt

SEQ ID NO: 230262 - DNA, 20 bp, Artificial
  CRISPR gRNA sequence
ttttttgactgtaggattta

SEQ ID NO: 230263 - DNA, 20 bp, Artificial
  CRISPR gRNA sequence
tttttgactgtaggatttac

SEQ ID NO: 230264 - DNA, 20 bp, Artificial
  CRISPR gRNA sequence
ttttgactgtaggatttact

SEQ ID NO: 230265 - DNA, 20 bp, Artificial
  CRISPR gRNA sequence
tttgactgtaggatttactg

SEQ ID NO: 230266 - DNA, 20 bp, Artificial
  CRISPR gRNA sequence
ttgactgtaggatttactgc

SEQ ID NO: 230267 - DNA, 20 bp, Artificial
  CRISPR gRNA sequence
tgactgtaggatttactgct

SEQ ID NO: 230268 - DNA, 20 bp, Artificial
  CRISPR gRNA sequence
gactgtaggatttactgctt

SEQ ID NO: 230269 - DNA, 20 bp, Artificial
  CRISPR gRNA sequence
actgtaggatttactgctta

SEQ ID NO: 230270 - DNA, 20 bp, Artificial
  CRISPR gRNA sequence
taggatttactgcttactac

SEQ ID NO: 230271 - DNA, 20 bp, Artificial
  CRISPR gRNA sequence
actgcttactacgtaattta

SEQ ID NO: 230272 - DNA, 20 bp, Artificial
  CRISPR gRNA sequence
ctgcttactacgtaatttaa

SEQ ID NO: 230273 - DNA, 20 bp, Artificial
  CRISPR gRNA sequence
cttactacgtaatttaaata

SEQ ID NO: 230274 - DNA, 20 bp, Artificial
  CRISPR gRNA sequence
actacgtaatttaaatatta

SEQ ID NO: 230275 - DNA, 20 bp, Artificial
  CRISPR gRNA sequence
ctacgtaatttaaatattag

SEQ ID NO: 230276 - DNA, 20 bp, Artificial
  CRISPR gRNA sequence
cgtaatttaaatattagcat

SEQ ID NO: 230277 - DNA, 20 bp, Artificial
  CRISPR gRNA sequence
aaatattagcatatataagt

SEQ ID NO: 230278 - DNA, 20 bp, Artificial
  CRISPR gRNA sequence
aatattagcatatataagtt

SEQ ID NO: 230279 - DNA, 20 bp, Artificial
  CRISPR gRNA sequence
gcatatataagttttactat

SEQ ID NO: 230280 - DNA, 20 bp, Artificial
  CRISPR gRNA sequence
tactataaaatgacatgaca

SEQ ID NO: 230281 - DNA, 20 bp, Artificial
  CRISPR gRNA sequence
actataaaatgacatgacat

SEQ ID NO: 230282 - DNA, 20 bp, Artificial
  CRISPR gRNA sequence
ctataaaatgacatgacata

SEQ ID NO: 230283 - DNA, 20 bp, Artificial
  CRISPR gRNA sequence
taaaatgacatgacataaat

SEQ ID NO: 230284 - DNA, 20 bp, Artificial
  CRISPR gRNA sequence
tatttttatgtaaatatatt

SEQ ID NO: 230285 - DNA, 20 bp, Artificial
  CRISPR gRNA sequence
ttatgtaaatatattttaaa

SEQ ID NO: 230286 - DNA, 20 bp, Artificial
  CRISPR gRNA sequence
tatgtaaatatattttaaat

SEQ ID NO: 230287 - DNA, 20 bp, Artificial
  CRISPR gRNA sequence
atgtaaatatattttaaata

SEQ ID NO: 230288 - DNA, 20 bp, Artificial
  CRISPR gRNA sequence
tgtaaatatattttaaatat

SEQ ID NO: 230289 - DNA, 20 bp, Artificial
  CRISPR gRNA sequence
taaatatttttcagaaagct

SEQ ID NO: 230290 - DNA, 20 bp, Artificial
  CRISPR gRNA sequence
aaatatttttcagaaagctg

SEQ ID NO: 230291 - DNA, 20 bp, Artificial
  CRISPR gRNA sequence
aatatttttcagaaagctgt

SEQ ID NO: 230292 - DNA, 20 bp, Artificial
  CRISPR gRNA sequence
ttcagaaagctgtagaggaa

SEQ ID NO: 230293 - DNA, 20 bp, Artificial
  CRISPR gRNA sequence
tcagaaagctgtagaggaac

SEQ ID NO: 230294 - DNA, 20 bp, Artificial
  CRISPR gRNA sequence
cagaaagctgtagaggaacc

SEQ ID NO: 230295 - DNA, 20 bp, Artificial
  CRISPR gRNA sequence
agaaagctgtagaggaaccc

SEQ ID NO: 230296 - DNA, 20 bp, Artificial
  CRISPR gRNA sequence
tagaggaaccccttaatggt

SEQ ID NO: 230297 - DNA, 20 bp, Artificial
  CRISPR gRNA sequence
aatggtatgtggttatttca

SEQ ID NO: 230298 - DNA, 20 bp, Artificial
  CRISPR gRNA sequence
atggtatgtggttatttcac

SEQ ID NO: 230299 - DNA, 20 bp, Artificial
  CRISPR gRNA sequence
tttcactcttaatcctttac

SEQ ID NO: 230300 - DNA, 20 bp, Artificial
  CRISPR gRNA sequence
cactcttaatcctttaccag

SEQ ID NO: 230301 - DNA, 20 bp, Artificial
  CRISPR gRNA sequence
actcttaatcctttaccaga

SEQ ID NO: 230302 - DNA, 20 bp, Artificial
  CRISPR gRNA sequence
ttaatcctttaccagatcat

SEQ ID NO: 230303 - DNA, 20 bp, Artificial
  CRISPR gRNA sequence
aatcctttaccagatcataa

SEQ ID NO: 230304 - DNA, 20 bp, Artificial
  CRISPR gRNA sequence
atcctttaccagatcataat

SEQ ID NO: 230305 - DNA, 20 bp, Artificial
  CRISPR gRNA sequence
taccagatcataatttgatc

SEQ ID NO: 230306 - DNA, 20 bp, Artificial
  CRISPR gRNA sequence
accagatcataatttgatct

SEQ ID NO: 230307 - DNA, 20 bp, Artificial
  CRISPR gRNA sequence
ccagatcataatttgatctg

SEQ ID NO: 230308 - DNA, 20 bp, Artificial
  CRISPR gRNA sequence
gatctggcccgcaaaacagt

SEQ ID NO: 230309 - DNA, 20 bp, Artificial
  CRISPR gRNA sequence
atctggcccgcaaaacagtt

SEQ ID NO: 230310 - DNA, 20 bp, Artificial
  CRISPR gRNA sequence
gcccgcaaaacagttagaat

SEQ ID NO: 230311 - DNA, 20 bp, Artificial
  CRISPR gRNA sequence
gaatgccctgtctatgcctt

SEQ ID NO: 230312 - DNA, 20 bp, Artificial
  CRISPR gRNA sequence
tctatgccttaggaagaatc

SEQ ID NO: 230313 - DNA, 20 bp, Artificial
  CRISPR gRNA sequence
tgccttaggaagaatctagg

SEQ ID NO: 230314 - DNA, 20 bp, Artificial
  CRISPR gRNA sequence
aggaagaatctaggtttttt

SEQ ID NO: 230315 - DNA, 20 bp, Artificial
  CRISPR gRNA sequence
ggaagaatctaggttttttt

SEQ ID NO: 230316 - DNA, 20 bp, Artificial
  CRISPR gRNA sequence
ggtttttttcctcttttttt

SEQ ID NO: 230317 - DNA, 20 bp, Artificial
  CRISPR gRNA sequence
ttttcctctttttttctttc

SEQ ID NO: 230318 - DNA, 20 bp, Artificial
  CRISPR gRNA sequence
tttcctctttttttctttcc

SEQ ID NO: 230319 - DNA, 20 bp, Artificial
  CRISPR gRNA sequence
ttcctctttttttctttcct

SEQ ID NO: 230320 - DNA, 20 bp, Artificial
  CRISPR gRNA sequence
tcctctttttttctttcctt

SEQ ID NO: 230321 - DNA, 20 bp, Artificial
  CRISPR gRNA sequence
cctctttttttctttccttg

SEQ ID NO: 230322 - DNA, 20 bp, Artificial
  CRISPR gRNA sequence
ctctttttttctttccttgg

SEQ ID NO: 230323 - DNA, 20 bp, Artificial
  CRISPR gRNA sequence
tttttttctttccttggcat

SEQ ID NO: 230324 - DNA, 20 bp, Artificial
  CRISPR gRNA sequence
tttttctttccttggcatct

SEQ ID NO: 230325 - DNA, 20 bp, Artificial
  CRISPR gRNA sequence
ttttctttccttggcatctc

SEQ ID NO: 230326 - DNA, 20 bp, Artificial
  CRISPR gRNA sequence
tttctttccttggcatctct

SEQ ID NO: 230327 - DNA, 20 bp, Artificial
  CRISPR gRNA sequence
ttctttccttggcatctcta

SEQ ID NO: 230328 - DNA, 20 bp, Artificial
  CRISPR gRNA sequence
tctttccttggcatctctac

SEQ ID NO: 230329 - DNA, 20 bp, Artificial
  CRISPR gRNA sequence
ctttccttggcatctctact

SEQ ID NO: 230330 - DNA, 20 bp, Artificial
  CRISPR gRNA sequence
tttccttggcatctctactc

SEQ ID NO: 230331 - DNA, 20 bp, Artificial
  CRISPR gRNA sequence
tccttggcatctctactctt

SEQ ID NO: 230332 - DNA, 20 bp, Artificial
  CRISPR gRNA sequence
ccttggcatctctactcttg

SEQ ID NO: 230333 - DNA, 20 bp, Artificial
  CRISPR gRNA sequence
cttggcatctctactcttga

SEQ ID NO: 230334 - DNA, 20 bp, Artificial
  CRISPR gRNA sequence
ggcatctctactcttgatta

SEQ ID NO: 230335 - DNA, 20 bp, Artificial
  CRISPR gRNA sequence
gcatctctactcttgattat

SEQ ID NO: 230336 - DNA, 20 bp, Artificial
  CRISPR gRNA sequence
tactcttgattattcatcaa

SEQ ID NO: 230337 - DNA, 20 bp, Artificial
  CRISPR gRNA sequence
ctcttgattattcatcaaga

SEQ ID NO: 230338 - DNA, 20 bp, Artificial
  CRISPR gRNA sequence
ttgattattcatcaagaatt

SEQ ID NO: 230339 - DNA, 20 bp, Artificial
  CRISPR gRNA sequence
gattattcatcaagaattat

SEQ ID NO: 230340 - DNA, 20 bp, Artificial
  CRISPR gRNA sequence
attattcatcaagaattatg

SEQ ID NO: 230341 - DNA, 20 bp, Artificial
  CRISPR gRNA sequence
ttcatcaagaattatgggct

SEQ ID NO: 230342 - DNA, 20 bp, Artificial
  CRISPR gRNA sequence
atcaagaattatgggctggg

SEQ ID NO: 230343 - DNA, 20 bp, Artificial
  CRISPR gRNA sequence
tgggctgggtgcggtggctc

SEQ ID NO: 230344 - DNA, 20 bp, Artificial
  CRISPR gRNA sequence
ggtgcggtggctcacgcttg

SEQ ID NO: 230345 - DNA, 20 bp, Artificial
  CRISPR gRNA sequence
acgcttgcgatcccggcacc

SEQ ID NO: 230346 - DNA, 20 bp, Artificial
  CRISPR gRNA sequence
gcgatcccggcaccttggga

SEQ ID NO: 230347 - DNA, 20 bp, Artificial
  CRISPR gRNA sequence
cgatcccggcaccttgggag

SEQ ID NO: 230348 - DNA, 20 bp, Artificial
  CRISPR gRNA sequence
gggaggccaaggcgggcaga

SEQ ID NO: 230349 - DNA, 20 bp, Artificial
  CRISPR gRNA sequence
ggaggccaaggcgggcagat

SEQ ID NO: 230350 - DNA, 20 bp, Artificial
  CRISPR gRNA sequence
agaccatcctggccaacatg

SEQ ID NO: 230351 - DNA, 20 bp, Artificial
  CRISPR gRNA sequence
gccaacatgttgaaaccctg

SEQ ID NO: 230352 - DNA, 20 bp, Artificial
  CRISPR gRNA sequence
aaaccctgtctctactgaaa

SEQ ID NO: 230353 - DNA, 20 bp, Artificial
  CRISPR gRNA sequence
tctctactgaaaatacaaaa

SEQ ID NO: 230354 - DNA, 20 bp, Artificial
  CRISPR gRNA sequence
tactgaaaatacaaaaatta

SEQ ID NO: 230355 - DNA, 20 bp, Artificial
  CRISPR gRNA sequence
ctgaaaatacaaaaattacc

SEQ ID NO: 230356 - DNA, 20 bp, Artificial
  CRISPR gRNA sequence
aaaatacaaaaattacctgg

SEQ ID NO: 230357 - DNA, 20 bp, Artificial
  CRISPR gRNA sequence
cctgggcatggtggtgtgta

SEQ ID NO: 230358 - DNA, 20 bp, Artificial
  CRISPR gRNA sequence
ggcatggtggtgtgtatctg

SEQ ID NO: 230359 - DNA, 20 bp, Artificial
  CRISPR gRNA sequence
cagtcccagctactcgggag

SEQ ID NO: 230360 - DNA, 20 bp, Artificial
  CRISPR gRNA sequence
ctcgggaggctgaggcagga

SEQ ID NO: 230361 - DNA, 20 bp, Artificial
  CRISPR gRNA sequence
gggaggctgaggcaggagaa

SEQ ID NO: 230362 - DNA, 20 bp, Artificial
  CRISPR gRNA sequence
aggcaggagaattgcttgaa

SEQ ID NO: 230363 - DNA, 20 bp, Artificial
  CRISPR gRNA sequence
cttgaacccggaaggcagat

SEQ ID NO: 230364 - DNA, 20 bp, Artificial
  CRISPR gRNA sequence
gaacccggaaggcagatgtt

SEQ ID NO: 230365 - DNA, 20 bp, Artificial
  CRISPR gRNA sequence
aacccggaaggcagatgttg

SEQ ID NO: 230366 - DNA, 20 bp, Artificial
  CRISPR gRNA sequence
cagtgagttgagatcatgcc

SEQ ID NO: 230367 - DNA, 20 bp, Artificial
  CRISPR gRNA sequence
agatcatgccaccgcactcc

SEQ ID NO: 230368 - DNA, 20 bp, Artificial
  CRISPR gRNA sequence
cagcctggtgacagagtgag

SEQ ID NO: 230369 - DNA, 20 bp, Artificial
  CRISPR gRNA sequence
gtgacagagtgagactctgt

SEQ ID NO: 230370 - DNA, 20 bp, Artificial
  CRISPR gRNA sequence
tgtctcaaaaaaaataaaaa

SEQ ID NO: 230371 - DNA, 20 bp, Artificial
  CRISPR gRNA sequence
tctcaaaaaaaataaaaaag

SEQ ID NO: 230372 - DNA, 20 bp, Artificial
  CRISPR gRNA sequence
aaaaaaaataaaaaagaatt

SEQ ID NO: 230373 - DNA, 20 bp, Artificial
  CRISPR gRNA sequence
tgaatattacttttataata

SEQ ID NO: 230374 - DNA, 20 bp, Artificial
  CRISPR gRNA sequence
cttttataatattctcacca

SEQ ID NO: 230375 - DNA, 20 bp, Artificial
  CRISPR gRNA sequence
ttataatattctcaccactg

SEQ ID NO: 230376 - DNA, 20 bp, Artificial
  CRISPR gRNA sequence
tataatattctcaccactgg

SEQ ID NO: 230377 - DNA, 20 bp, Artificial
  CRISPR gRNA sequence
ataatattctcaccactggg

SEQ ID NO: 230378 - DNA, 20 bp, Artificial
  CRISPR gRNA sequence
taatattctcaccactggga

SEQ ID NO: 230379 - DNA, 20 bp, Artificial
  CRISPR gRNA sequence
tcaccactgggaaaaatgca

SEQ ID NO: 230380 - DNA, 20 bp, Artificial
  CRISPR gRNA sequence
accactgggaaaaatgcact

SEQ ID NO: 230381 - DNA, 20 bp, Artificial
  CRISPR gRNA sequence
ggaaaaatgcactattctgt

SEQ ID NO: 230382 - DNA, 20 bp, Artificial
  CRISPR gRNA sequence
ttctgtgtctaagtagctgc

SEQ ID NO: 230383 - DNA, 20 bp, Artificial
  CRISPR gRNA sequence
tgtgtctaagtagctgctta

SEQ ID NO: 230384 - DNA, 20 bp, Artificial
  CRISPR gRNA sequence
tgtctaagtagctgcttacc

SEQ ID NO: 230385 - DNA, 20 bp, Artificial
  CRISPR gRNA sequence
agtagctgcttaccttaacc

SEQ ID NO: 230386 - DNA, 20 bp, Artificial
  CRISPR gRNA sequence
cttaccttaaccaagtgata

SEQ ID NO: 230387 - DNA, 20 bp, Artificial
  CRISPR gRNA sequence
accttaaccaagtgatattt

SEQ ID NO: 230388 - DNA, 20 bp, Artificial
  CRISPR gRNA sequence
ccttaaccaagtgatatttg

SEQ ID NO: 230389 - DNA, 20 bp, Artificial
  CRISPR gRNA sequence
aaccaagtgatatttgggca

SEQ ID NO: 230390 - DNA, 20 bp, Artificial
  CRISPR gRNA sequence
accaagtgatatttgggcaa

SEQ ID NO: 230391 - DNA, 20 bp, Artificial
  CRISPR gRNA sequence
gggcaaggggatcgttgcct

SEQ ID NO: 230392 - DNA, 20 bp, Artificial
  CRISPR gRNA sequence
ggcaaggggatcgttgcctt

SEQ ID NO: 230393 - DNA, 20 bp, Artificial
  CRISPR gRNA sequence
ccttttgctactggttgaga

SEQ ID NO: 230394 - DNA, 20 bp, Artificial
  CRISPR gRNA sequence
ttgctactggttgagacgaa

SEQ ID NO: 230395 - DNA, 20 bp, Artificial
  CRISPR gRNA sequence
tgctactggttgagacgaag

SEQ ID NO: 230396 - DNA, 20 bp, Artificial
  CRISPR gRNA sequence
gctactggttgagacgaagc

SEQ ID NO: 230397 - DNA, 20 bp, Artificial
  CRISPR gRNA sequence
ctactggttgagacgaagca

SEQ ID NO: 230398 - DNA, 20 bp, Artificial
  CRISPR gRNA sequence
ctggttgagacgaagcatgg

SEQ ID NO: 230399 - DNA, 20 bp, Artificial
  CRISPR gRNA sequence
gttgagacgaagcatggcac

SEQ ID NO: 230400 - DNA, 20 bp, Artificial
  CRISPR gRNA sequence
agacgaagcatggcaccccc

SEQ ID NO: 230401 - DNA, 20 bp, Artificial
  CRISPR gRNA sequence
gtagagaaggatcccaatta

SEQ ID NO: 230402 - DNA, 20 bp, Artificial
  CRISPR gRNA sequence
cttccaatttgtgatgtaca

SEQ ID NO: 230403 - DNA, 20 bp, Artificial
  CRISPR gRNA sequence
ccaatttgtgatgtacacat

SEQ ID NO: 230404 - DNA, 20 bp, Artificial
  CRISPR gRNA sequence
caatttgtgatgtacacatt

SEQ ID NO: 230405 - DNA, 20 bp, Artificial
  CRISPR gRNA sequence
gtgatgtacacattttagaa

SEQ ID NO: 230406 - DNA, 20 bp, Artificial
  CRISPR gRNA sequence
tgatgtacacattttagaaa

SEQ ID NO: 230407 - DNA, 20 bp, Artificial
  CRISPR gRNA sequence
tagaaagatacaggctattg

SEQ ID NO: 230408 - DNA, 20 bp, Artificial
  CRISPR gRNA sequence
agaaagatacaggctattgc

SEQ ID NO: 230409 - DNA, 20 bp, Artificial
  CRISPR gRNA sequence
gaaagatacaggctattgcc

SEQ ID NO: 230410 - DNA, 20 bp, Artificial
  CRISPR gRNA sequence
ttgccacagagatagaccaa

SEQ ID NO: 230411 - DNA, 20 bp, Artificial
  CRISPR gRNA sequence
ccacagagatagaccaaaac

SEQ ID NO: 230412 - DNA, 20 bp, Artificial
  CRISPR gRNA sequence
attttctttctttgtaaacc

SEQ ID NO: 230413 - DNA, 20 bp, Artificial
  CRISPR gRNA sequence
tctttctttgtaaacctaga

SEQ ID NO: 230414 - DNA, 20 bp, Artificial
  CRISPR gRNA sequence
ctttctttgtaaacctagat

SEQ ID NO: 230415 - DNA, 20 bp, Artificial
  CRISPR gRNA sequence
tttctttgtaaacctagatc

SEQ ID NO: 230416 - DNA, 20 bp, Artificial
  CRISPR gRNA sequence
tctttgtaaacctagatctg

SEQ ID NO: 230417 - DNA, 20 bp, Artificial
  CRISPR gRNA sequence
ctttgtaaacctagatctga

SEQ ID NO: 230418 - DNA, 20 bp, Artificial
  CRISPR gRNA sequence
tttgtaaacctagatctgat

SEQ ID NO: 230419 - DNA, 20 bp, Artificial
  CRISPR gRNA sequence
tgtaaacctagatctgattt

SEQ ID NO: 230420 - DNA, 20 bp, Artificial
  CRISPR gRNA sequence
gtaaacctagatctgatttc

SEQ ID NO: 230421 - DNA, 20 bp, Artificial
  CRISPR gRNA sequence
taaacctagatctgatttcc

SEQ ID NO: 230422 - DNA, 20 bp, Artificial
  CRISPR gRNA sequence
gatctgatttcccaactaag

SEQ ID NO: 230423 - DNA, 20 bp, Artificial
  CRISPR gRNA sequence
atttcccaactaagtctgtt

SEQ ID NO: 230424 - DNA, 20 bp, Artificial
  CRISPR gRNA sequence
cccaactaagtctgtttcct

SEQ ID NO: 230425 - DNA, 20 bp, Artificial
  CRISPR gRNA sequence
ccaactaagtctgtttcctt

SEQ ID NO: 230426 - DNA, 20 bp, Artificial
  CRISPR gRNA sequence
agtctgtttcctttgtgaat

SEQ ID NO: 230427 - DNA, 20 bp, Artificial
  CRISPR gRNA sequence
tttcctttgtgaatgctgtg

SEQ ID NO: 230428 - DNA, 20 bp, Artificial
  CRISPR gRNA sequence
cctttgtgaatgctgtgggt

SEQ ID NO: 230429 - DNA, 20 bp, Artificial
  CRISPR gRNA sequence
ctttgtgaatgctgtgggta

SEQ ID NO: 230430 - DNA, 20 bp, Artificial
  CRISPR gRNA sequence
tgtgaatgctgtgggtatga

SEQ ID NO: 230431 - DNA, 20 bp, Artificial
  CRISPR gRNA sequence
gtgaatgctgtgggtatgat

SEQ ID NO: 230432 - DNA, 20 bp, Artificial
  CRISPR gRNA sequence
tgaatgctgtgggtatgatc

SEQ ID NO: 230433 - DNA, 20 bp, Artificial
  CRISPR gRNA sequence
tgggtatgatccacagaaag

SEQ ID NO: 230434 - DNA, 20 bp, Artificial
  CRISPR gRNA sequence
cataatgaaatgatagcttt

SEQ ID NO: 230435 - DNA, 20 bp, Artificial
  CRISPR gRNA sequence
tacaattaatttggctgtag

SEQ ID NO: 230436 - DNA, 20 bp, Artificial
  CRISPR gRNA sequence
acaattaatttggctgtaga

SEQ ID NO: 230437 - DNA, 20 bp, Artificial
  CRISPR gRNA sequence
caattaatttggctgtagag

SEQ ID NO: 230438 - DNA, 20 bp, Artificial
  CRISPR gRNA sequence
atttggctgtagagttgtag

SEQ ID NO: 230439 - DNA, 20 bp, Artificial
  CRISPR gRNA sequence
ggctgtagagttgtagacta

SEQ ID NO: 230440 - DNA, 20 bp, Artificial
  CRISPR gRNA sequence
gctgtagagttgtagactag

SEQ ID NO: 230441 - DNA, 20 bp, Artificial
  CRISPR gRNA sequence
tagagttgtagactagttag

SEQ ID NO: 230442 - DNA, 20 bp, Artificial
  CRISPR gRNA sequence
tagactagttagcatatcat

SEQ ID NO: 230443 - DNA, 20 bp, Artificial
  CRISPR gRNA sequence
gttagcatatcattgcatat

SEQ ID NO: 230444 - DNA, 20 bp, Artificial
  CRISPR gRNA sequence
gcatatcattgcatatttgt

SEQ ID NO: 230445 - DNA, 20 bp, Artificial
  CRISPR gRNA sequence
catatttgtttatttagaaa

SEQ ID NO: 230446 - DNA, 20 bp, Artificial
  CRISPR gRNA sequence
gtttatttagaaatgatttc

SEQ ID NO: 230447 - DNA, 20 bp, Artificial
  CRISPR gRNA sequence
tttatttagaaatgatttcc

SEQ ID NO: 230448 - DNA, 20 bp, Artificial
  CRISPR gRNA sequence
atttagaaatgatttccaat

SEQ ID NO: 230449 - DNA, 20 bp, Artificial
  CRISPR gRNA sequence
tttagaaatgatttccaatt

SEQ ID NO: 230450 - DNA, 20 bp, Artificial
  CRISPR gRNA sequence
agaaatgatttccaattgtg

SEQ ID NO: 230451 - DNA, 20 bp, Artificial
  CRISPR gRNA sequence
gaaatgatttccaattgtgg

SEQ ID NO: 230452 - DNA, 20 bp, Artificial
  CRISPR gRNA sequence
ccaattgtggaacctcacta

SEQ ID NO: 230453 - DNA, 20 bp, Artificial
  CRISPR gRNA sequence
caattgtggaacctcactaa

SEQ ID NO: 230454 - DNA, 20 bp, Artificial
  CRISPR gRNA sequence
tggaacctcactaactgcct

SEQ ID NO: 230455 - DNA, 20 bp, Artificial
  CRISPR gRNA sequence
actaactgcctgcttggctt

SEQ ID NO: 230456 - DNA, 20 bp, Artificial
  CRISPR gRNA sequence
actgcctgcttggcttgtta

SEQ ID NO: 230457 - DNA, 20 bp, Artificial
  CRISPR gRNA sequence
cctgcttggcttgttactaa

SEQ ID NO: 230458 - DNA, 20 bp, Artificial
  CRISPR gRNA sequence
cttggcttgttactaatcct

SEQ ID NO: 230459 - DNA, 20 bp, Artificial
  CRISPR gRNA sequence
ggcttgttactaatcctagc

SEQ ID NO: 230460 - DNA, 20 bp, Artificial
  CRISPR gRNA sequence
gcttgttactaatcctagca

SEQ ID NO: 230461 - DNA, 20 bp, Artificial
  CRISPR gRNA sequence
gttactaatcctagcattca

SEQ ID NO: 230462 - DNA, 20 bp, Artificial
  CRISPR gRNA sequence
ttactaatcctagcattcaa

SEQ ID NO: 230463 - DNA, 20 bp, Artificial
  CRISPR gRNA sequence
ctaatcctagcattcaaaga

SEQ ID NO: 230464 - DNA, 20 bp, Artificial
  CRISPR gRNA sequence
atcctagcattcaaagaatc

SEQ ID NO: 230465 - DNA, 20 bp, Artificial
  CRISPR gRNA sequence
gcattcaaagaatcaaaagg

SEQ ID NO: 230466 - DNA, 20 bp, Artificial
  CRISPR gRNA sequence
aaagaatcaaaaggaatgat

SEQ ID NO: 230467 - DNA, 20 bp, Artificial
  CRISPR gRNA sequence
aataattatagatcagttaa

SEQ ID NO: 230468 - DNA, 20 bp, Artificial
  CRISPR gRNA sequence
ataattatagatcagttaaa

SEQ ID NO: 230469 - DNA, 20 bp, Artificial
  CRISPR gRNA sequence
tagatcagttaaaacatgga

SEQ ID NO: 230470 - DNA, 20 bp, Artificial
  CRISPR gRNA sequence
aaacatggacattggaaaac

SEQ ID NO: 230471 - DNA, 20 bp, Artificial
  CRISPR gRNA sequence
gaaaacaaaaaagcttcttg

SEQ ID NO: 230472 - DNA, 20 bp, Artificial
  CRISPR gRNA sequence
cttgaaaatgtggctctttt

SEQ ID NO: 230473 - DNA, 20 bp, Artificial
  CRISPR gRNA sequence
ttgaaaatgtggctcttttt

SEQ ID NO: 230474 - DNA, 20 bp, Artificial
  CRISPR gRNA sequence
gaaaatgtggctctttttta

SEQ ID NO: 230475 - DNA, 20 bp, Artificial
  CRISPR gRNA sequence
aaaatgtggctcttttttag

SEQ ID NO: 230476 - DNA, 20 bp, Artificial
  CRISPR gRNA sequence
ttttttagtaaaagggacac

SEQ ID NO: 230477 - DNA, 20 bp, Artificial
  CRISPR gRNA sequence
ttttagtaaaagggacactg

SEQ ID NO: 230478 - DNA, 20 bp, Artificial
  CRISPR gRNA sequence
tttagtaaaagggacactgt

SEQ ID NO: 230479 - DNA, 20 bp, Artificial
  CRISPR gRNA sequence
ttagtaaaagggacactgtc

SEQ ID NO: 230480 - DNA, 20 bp, Artificial
  CRISPR gRNA sequence
tagtaaaagggacactgtca

SEQ ID NO: 230481 - DNA, 20 bp, Artificial
  CRISPR gRNA sequence
agtaaaagggacactgtcag

SEQ ID NO: 230482 - DNA, 20 bp, Artificial
  CRISPR gRNA sequence
gtaaaagggacactgtcaga

SEQ ID NO: 230483 - DNA, 20 bp, Artificial
  CRISPR gRNA sequence
tcagatgataaaggttcaca

SEQ ID NO: 230484 - DNA, 20 bp, Artificial
  CRISPR gRNA sequence
acatttcttgatgtatacaa

SEQ ID NO: 230485 - DNA, 20 bp, Artificial
  CRISPR gRNA sequence
cttgatgtatacaacttaaa

SEQ ID NO: 230486 - DNA, 20 bp, Artificial
  CRISPR gRNA sequence
ttgatgtatacaacttaaat

SEQ ID NO: 230487 - DNA, 20 bp, Artificial
  CRISPR gRNA sequence
gatgtatacaacttaaatct

SEQ ID NO: 230488 - DNA, 20 bp, Artificial
  CRISPR gRNA sequence
atgtatacaacttaaatcta

SEQ ID NO: 230489 - DNA, 20 bp, Artificial
  CRISPR gRNA sequence
aaatctactttgctaaaaat

SEQ ID NO: 230490 - DNA, 20 bp, Artificial
  CRISPR gRNA sequence
aatctactttgctaaaaatt

SEQ ID NO: 230491 - DNA, 20 bp, Artificial
  CRISPR gRNA sequence
ctttgctaaaaattgcaaaa

SEQ ID NO: 230492 - DNA, 20 bp, Artificial
  CRISPR gRNA sequence
tgctaaaaattgcaaaacta

SEQ ID NO: 230493 - DNA, 20 bp, Artificial
  CRISPR gRNA sequence
gctaaaaattgcaaaactac

SEQ ID NO: 230494 - DNA, 20 bp, Artificial
  CRISPR gRNA sequence
ctaaaaattgcaaaactact

SEQ ID NO: 230495 - DNA, 20 bp, Artificial
  CRISPR gRNA sequence
aaaattgcaaaactactact

SEQ ID NO: 230496 - DNA, 20 bp, Artificial
  CRISPR gRNA sequence
caaaactactactgtaaaaa

SEQ ID NO: 230497 - DNA, 20 bp, Artificial
  CRISPR gRNA sequence
ctactgtaaaaactgtaggg

SEQ ID NO: 230498 - DNA, 20 bp, Artificial
  CRISPR gRNA sequence
ctgtaaaaactgtagggtgt

SEQ ID NO: 230499 - DNA, 20 bp, Artificial
  CRISPR gRNA sequence
taaaaactgtagggtgtcac

SEQ ID NO: 230500 - DNA, 20 bp, Artificial
  CRISPR gRNA sequence
tagggtgtcacgaatcagac

SEQ ID NO: 230501 - DNA, 20 bp, Artificial
  CRISPR gRNA sequence
cagtcatatggctcccagca

SEQ ID NO: 230502 - DNA, 20 bp, Artificial
  CRISPR gRNA sequence
ccagcaaagagaaattacca

SEQ ID NO: 230503 - DNA, 20 bp, Artificial
  CRISPR gRNA sequence
ccactttttgtaaaatgttt

SEQ ID NO: 230504 - DNA, 20 bp, Artificial
  CRISPR gRNA sequence
tttgtaaaatgtttttcaga

SEQ ID NO: 230505 - DNA, 20 bp, Artificial
  CRISPR gRNA sequence
ttgtaaaatgtttttcagat

SEQ ID NO: 230506 - DNA, 20 bp, Artificial
  CRISPR gRNA sequence
tgtaaaatgtttttcagatt

SEQ ID NO: 230507 - DNA, 20 bp, Artificial
  CRISPR gRNA sequence
gtaaaatgtttttcagattc

SEQ ID NO: 230508 - DNA, 20 bp, Artificial
  CRISPR gRNA sequence
taaaatgtttttcagattcc

SEQ ID NO: 230509 - DNA, 20 bp, Artificial
  CRISPR gRNA sequence
ttcagattccgtgtctggtg

SEQ ID NO: 230510 - DNA, 20 bp, Artificial
  CRISPR gRNA sequence
tcagattccgtgtctggtga

SEQ ID NO: 230511 - DNA, 20 bp, Artificial
  CRISPR gRNA sequence
cagattccgtgtctggtgac

SEQ ID NO: 230512 - DNA, 20 bp, Artificial
  CRISPR gRNA sequence
agattccgtgtctggtgact

SEQ ID NO: 230513 - DNA, 20 bp, Artificial
  CRISPR gRNA sequence
cgtgtctggtgactgtaact

SEQ ID NO: 230514 - DNA, 20 bp, Artificial
  CRISPR gRNA sequence
gtgactgtaactttaagatg

SEQ ID NO: 230515 - DNA, 20 bp, Artificial
  CRISPR gRNA sequence
taactttaagatgcctttta

SEQ ID NO: 230516 - DNA, 20 bp, Artificial
  CRISPR gRNA sequence
taagatgccttttataaggc

SEQ ID NO: 230517 - DNA, 20 bp, Artificial
  CRISPR gRNA sequence
aagatgccttttataaggca

SEQ ID NO: 230518 - DNA, 20 bp, Artificial
  CRISPR gRNA sequence
agatgccttttataaggcac

SEQ ID NO: 230519 - DNA, 20 bp, Artificial
  CRISPR gRNA sequence
ttataaggcacataaataat

SEQ ID NO: 230520 - DNA, 20 bp, Artificial
  CRISPR gRNA sequence
tataaggcacataaataatc

SEQ ID NO: 230521 - DNA, 20 bp, Artificial
  CRISPR gRNA sequence
ataaggcacataaataatct

SEQ ID NO: 230522 - DNA, 20 bp, Artificial
  CRISPR gRNA sequence
taaggcacataaataatctg

SEQ ID NO: 230523 - DNA, 20 bp, Artificial
  CRISPR gRNA sequence
gcacaaatctttatcatttt

SEQ ID NO: 230524 - DNA, 20 bp, Artificial
  CRISPR gRNA sequence
tatcattttgacagagtttc

SEQ ID NO: 230525 - DNA, 20 bp, Artificial
  CRISPR gRNA sequence
atcattttgacagagtttct

SEQ ID NO: 230526 - DNA, 20 bp, Artificial
  CRISPR gRNA sequence
tcattttgacagagtttctt

SEQ ID NO: 230527 - DNA, 20 bp, Artificial
  CRISPR gRNA sequence
tgacagagtttcttttatgc

SEQ ID NO: 230528 - DNA, 20 bp, Artificial
  CRISPR gRNA sequence
gacagagtttcttttatgct

SEQ ID NO: 230529 - DNA, 20 bp, Artificial
  CRISPR gRNA sequence
acagagtttcttttatgctt

SEQ ID NO: 230530 - DNA, 20 bp, Artificial
  CRISPR gRNA sequence
cttttatgcttgtgttggtg

SEQ ID NO: 230531 - DNA, 20 bp, Artificial
  CRISPR gRNA sequence
ttttatgcttgtgttggtga

SEQ ID NO: 230532 - DNA, 20 bp, Artificial
  CRISPR gRNA sequence
ttatgcttgtgttggtgatt

SEQ ID NO: 230533 - DNA, 20 bp, Artificial
  CRISPR gRNA sequence
tatgcttgtgttggtgattt

SEQ ID NO: 230534 - DNA, 20 bp, Artificial
  CRISPR gRNA sequence
atgcttgtgttggtgatttt

SEQ ID NO: 230535 - DNA, 20 bp, Artificial
  CRISPR gRNA sequence
tgcttgtgttggtgattttg

SEQ ID NO: 230536 - DNA, 20 bp, Artificial
  CRISPR gRNA sequence
gtgttggtgattttgttgca

SEQ ID NO: 230537 - DNA, 20 bp, Artificial
  CRISPR gRNA sequence
tgttggtgattttgttgcat

SEQ ID NO: 230538 - DNA, 20 bp, Artificial
  CRISPR gRNA sequence
gtgattttgttgcatttaac

SEQ ID NO: 230539 - DNA, 20 bp, Artificial
  CRISPR gRNA sequence
tgttgcatttaacccatggg

SEQ ID NO: 230540 - DNA, 20 bp, Artificial
  CRISPR gRNA sequence
gttgcatttaacccatgggg

SEQ ID NO: 230541 - DNA, 20 bp, Artificial
  CRISPR gRNA sequence
ttgcatttaacccatgggga

SEQ ID NO: 230542 - DNA, 20 bp, Artificial
  CRISPR gRNA sequence
catttaacccatggggactt

SEQ ID NO: 230543 - DNA, 20 bp, Artificial
  CRISPR gRNA sequence
aacccatggggacttaacat

SEQ ID NO: 230544 - DNA, 20 bp, Artificial
  CRISPR gRNA sequence
acccatggggacttaacatc

SEQ ID NO: 230545 - DNA, 20 bp, Artificial
  CRISPR gRNA sequence
aacatctctgcttttccaat

SEQ ID NO: 230546 - DNA, 20 bp, Artificial
  CRISPR gRNA sequence
acatctctgcttttccaatc

SEQ ID NO: 230547 - DNA, 20 bp, Artificial
  CRISPR gRNA sequence
tgcttttccaatcaggagct

SEQ ID NO: 230548 - DNA, 20 bp, Artificial
  CRISPR gRNA sequence
cttttccaatcaggagcttg

SEQ ID NO: 230549 - DNA, 20 bp, Artificial
  CRISPR gRNA sequence
ttccaatcaggagcttggtt

SEQ ID NO: 230550 - DNA, 20 bp, Artificial
  CRISPR gRNA sequence
tccaatcaggagcttggttc

SEQ ID NO: 230551 - DNA, 20 bp, Artificial
  CRISPR gRNA sequence
ccaatcaggagcttggttct

SEQ ID NO: 230552 - DNA, 20 bp, Artificial
  CRISPR gRNA sequence
caatcaggagcttggttcta

SEQ ID NO: 230553 - DNA, 20 bp, Artificial
  CRISPR gRNA sequence
ggttctaaccttttgggaga

SEQ ID NO: 230554 - DNA, 20 bp, Artificial
  CRISPR gRNA sequence
gttctaaccttttgggagat

SEQ ID NO: 230555 - DNA, 20 bp, Artificial
  CRISPR gRNA sequence
taaccttttgggagatgatt

SEQ ID NO: 230556 - DNA, 20 bp, Artificial
  CRISPR gRNA sequence
accttttgggagatgattaa

SEQ ID NO: 230557 - DNA, 20 bp, Artificial
  CRISPR gRNA sequence
ttgggagatgattaaagaga

SEQ ID NO: 230558 - DNA, 20 bp, Artificial
  CRISPR gRNA sequence
tgggagatgattaaagagag

SEQ ID NO: 230559 - DNA, 20 bp, Artificial
  CRISPR gRNA sequence
gggagatgattaaagagaga

SEQ ID NO: 230560 - DNA, 20 bp, Artificial
  CRISPR gRNA sequence
ggagatgattaaagagagag

SEQ ID NO: 230561 - DNA, 20 bp, Artificial
  CRISPR gRNA sequence
aagagagaggttgagagaga

SEQ ID NO: 230562 - DNA, 20 bp, Artificial
  CRISPR gRNA sequence
agagagagagagagagagag

SEQ ID NO: 230563 - DNA, 20 bp, Artificial
  CRISPR gRNA sequence
cgtcctcagcttttgcttcc

SEQ ID NO: 230564 - DNA, 20 bp, Artificial
  CRISPR gRNA sequence
gtcctcagcttttgcttcca

SEQ ID NO: 230565 - DNA, 20 bp, Artificial
  CRISPR gRNA sequence
agcttttgcttccatttttt

SEQ ID NO: 230566 - DNA, 20 bp, Artificial
  CRISPR gRNA sequence
ttgcttccatttttttttta

SEQ ID NO: 230567 - DNA, 20 bp, Artificial
  CRISPR gRNA sequence
tgcttccattttttttttaa

SEQ ID NO: 230568 - DNA, 20 bp, Artificial
  CRISPR gRNA sequence
gcttccattttttttttaag

SEQ ID NO: 230569 - DNA, 20 bp, Artificial
  CRISPR gRNA sequence
cttccattttttttttaaga

SEQ ID NO: 230570 - DNA, 20 bp, Artificial
  CRISPR gRNA sequence
ccattttttttttaagaact

SEQ ID NO: 230571 - DNA, 20 bp, Artificial
  CRISPR gRNA sequence
cattttttttttaagaactc

SEQ ID NO: 230572 - DNA, 20 bp, Artificial
  CRISPR gRNA sequence
tttttttaagaactctgggc

SEQ ID NO: 230573 - DNA, 20 bp, Artificial
  CRISPR gRNA sequence
ttttttaagaactctgggct

SEQ ID NO: 230574 - DNA, 20 bp, Artificial
  CRISPR gRNA sequence
tttttaagaactctgggcta

SEQ ID NO: 230575 - DNA, 20 bp, Artificial
  CRISPR gRNA sequence
ttttaagaactctgggctaa

SEQ ID NO: 230576 - DNA, 20 bp, Artificial
  CRISPR gRNA sequence
tttaagaactctgggctaat

SEQ ID NO: 230577 - DNA, 20 bp, Artificial
  CRISPR gRNA sequence
ttaagaactctgggctaata

SEQ ID NO: 230578 - DNA, 20 bp, Artificial
  CRISPR gRNA sequence
taagaactctgggctaataa

SEQ ID NO: 230579 - DNA, 20 bp, Artificial
  CRISPR gRNA sequence
aagaactctgggctaataac

SEQ ID NO: 230580 - DNA, 20 bp, Artificial
  CRISPR gRNA sequence
agaactctgggctaataact

SEQ ID NO: 230581 - DNA, 20 bp, Artificial
  CRISPR gRNA sequence
tgggctaataacttctaatc

SEQ ID NO: 230582 - DNA, 20 bp, Artificial
  CRISPR gRNA sequence
ggctaataacttctaatctt

SEQ ID NO: 230583 - DNA, 20 bp, Artificial
  CRISPR gRNA sequence
ataacttctaatctttatag

SEQ ID NO: 230584 - DNA, 20 bp, Artificial
  CRISPR gRNA sequence
ctaatctttatagaatattt

SEQ ID NO: 230585 - DNA, 20 bp, Artificial
  CRISPR gRNA sequence
taatctttatagaatatttc

SEQ ID NO: 230586 - DNA, 20 bp, Artificial
  CRISPR gRNA sequence
atctttatagaatatttcaa

SEQ ID NO: 230587 - DNA, 20 bp, Artificial
  CRISPR gRNA sequence
tatagaatatttcaaagaaa

SEQ ID NO: 230588 - DNA, 20 bp, Artificial
  CRISPR gRNA sequence
atagaatatttcaaagaaat

SEQ ID NO: 230589 - DNA, 20 bp, Artificial
  CRISPR gRNA sequence
tagaatatttcaaagaaata

SEQ ID NO: 230590 - DNA, 20 bp, Artificial
  CRISPR gRNA sequence
caaagaaatatatttgttct

SEQ ID NO: 230591 - DNA, 20 bp, Artificial
  CRISPR gRNA sequence
aaagaaatatatttgttctt

SEQ ID NO: 230592 - DNA, 20 bp, Artificial
  CRISPR gRNA sequence
gttcttaaagatacataggt

SEQ ID NO: 230593 - DNA, 20 bp, Artificial
  CRISPR gRNA sequence
ttcttaaagatacataggtt

SEQ ID NO: 230594 - DNA, 20 bp, Artificial
  CRISPR gRNA sequence
ttaaagatacataggtttga

SEQ ID NO: 230595 - DNA, 20 bp, Artificial
  CRISPR gRNA sequence
aaagatacataggtttgaga

SEQ ID NO: 230596 - DNA, 20 bp, Artificial
  CRISPR gRNA sequence
aagatacataggtttgagat

SEQ ID NO: 230597 - DNA, 20 bp, Artificial
  CRISPR gRNA sequence
gagatattgagtgctacaag

SEQ ID NO: 230598 - DNA, 20 bp, Artificial
  CRISPR gRNA sequence
agatattgagtgctacaagc

SEQ ID NO: 230599 - DNA, 20 bp, Artificial
  CRISPR gRNA sequence
agtgctacaagcatttattt

SEQ ID NO: 230600 - DNA, 20 bp, Artificial
  CRISPR gRNA sequence
caagcatttattttggtttt

SEQ ID NO: 230601 - DNA, 20 bp, Artificial
  CRISPR gRNA sequence
attttggttttaccttaaca

SEQ ID NO: 230602 - DNA, 20 bp, Artificial
  CRISPR gRNA sequence
ttttggttttaccttaacat

SEQ ID NO: 230603 - DNA, 20 bp, Artificial
  CRISPR gRNA sequence
tggttttaccttaacatatt

SEQ ID NO: 230604 - DNA, 20 bp, Artificial
  CRISPR gRNA sequence
ggttttaccttaacatatta

SEQ ID NO: 230605 - DNA, 20 bp, Artificial
  CRISPR gRNA sequence
gttttaccttaacatattat

SEQ ID NO: 230606 - DNA, 20 bp, Artificial
  CRISPR gRNA sequence
taccttaacatattatgatt

SEQ ID NO: 230607 - DNA, 20 bp, Artificial
  CRISPR gRNA sequence
accttaacatattatgattc

SEQ ID NO: 230608 - DNA, 20 bp, Artificial
  CRISPR gRNA sequence
ccttaacatattatgattcc

SEQ ID NO: 230609 - DNA, 20 bp, Artificial
  CRISPR gRNA sequence
aacatattatgattcctcag

SEQ ID NO: 230610 - DNA, 20 bp, Artificial
  CRISPR gRNA sequence
acatattatgattcctcagt

SEQ ID NO: 230611 - DNA, 20 bp, Artificial
  CRISPR gRNA sequence
tgattcctcagttttgttgg

SEQ ID NO: 230612 - DNA, 20 bp, Artificial
  CRISPR gRNA sequence
ctcagttttgttggcattta

SEQ ID NO: 230613 - DNA, 20 bp, Artificial
  CRISPR gRNA sequence
agttttgttggcatttagta

SEQ ID NO: 230614 - DNA, 20 bp, Artificial
  CRISPR gRNA sequence
tgttggcatttagtaattat

SEQ ID NO: 230615 - DNA, 20 bp, Artificial
  CRISPR gRNA sequence
gttggcatttagtaattatg

SEQ ID NO: 230616 - DNA, 20 bp, Artificial
  CRISPR gRNA sequence
ttggcatttagtaattatgt

SEQ ID NO: 230617 - DNA, 20 bp, Artificial
  CRISPR gRNA sequence
gcatttagtaattatgttta

SEQ ID NO: 230618 - DNA, 20 bp, Artificial
  CRISPR gRNA sequence
agtaattatgtttatgtttt

SEQ ID NO: 230619 - DNA, 20 bp, Artificial
  CRISPR gRNA sequence
gtaattatgtttatgttttt

SEQ ID NO: 230620 - DNA, 20 bp, Artificial
  CRISPR gRNA sequence
tgtttatgtttttatcttat

SEQ ID NO: 230621 - DNA, 20 bp, Artificial
  CRISPR gRNA sequence
atgtttttatcttatcaaaa

SEQ ID NO: 230622 - DNA, 20 bp, Artificial
  CRISPR gRNA sequence
tgtttttatcttatcaaaaa

SEQ ID NO: 230623 - DNA, 20 bp, Artificial
  CRISPR gRNA sequence
ttatcttatcaaaaaatgtc

SEQ ID NO: 230624 - DNA, 20 bp, Artificial
  CRISPR gRNA sequence
tatcttatcaaaaaatgtct

SEQ ID NO: 230625 - DNA, 20 bp, Artificial
  CRISPR gRNA sequence
atcttatcaaaaaatgtctt

SEQ ID NO: 230626 - DNA, 20 bp, Artificial
  CRISPR gRNA sequence
tcttatcaaaaaatgtcttc

SEQ ID NO: 230627 - DNA, 20 bp, Artificial
  CRISPR gRNA sequence
atcaaaaaatgtcttcttac

SEQ ID NO: 230628 - DNA, 20 bp, Artificial
  CRISPR gRNA sequence
tcaaaaaatgtcttcttacc

SEQ ID NO: 230629 - DNA, 20 bp, Artificial
  CRISPR gRNA sequence
cttacctttgatatttataa

SEQ ID NO: 230630 - DNA, 20 bp, Artificial
  CRISPR gRNA sequence
ttacctttgatatttataat

SEQ ID NO: 230631 - DNA, 20 bp, Artificial
  CRISPR gRNA sequence
acctttgatatttataatca

SEQ ID NO: 230632 - DNA, 20 bp, Artificial
  CRISPR gRNA sequence
cctttgatatttataatcac

SEQ ID NO: 230633 - DNA, 20 bp, Artificial
  CRISPR gRNA sequence
tgatatttataatcactcct

SEQ ID NO: 230634 - DNA, 20 bp, Artificial
  CRISPR gRNA sequence
gatatttataatcactcctc

SEQ ID NO: 230635 - DNA, 20 bp, Artificial
  CRISPR gRNA sequence
atatttataatcactcctcg

SEQ ID NO: 230636 - DNA, 20 bp, Artificial
  CRISPR gRNA sequence
ataatcactcctcggtcatg

SEQ ID NO: 230637 - DNA, 20 bp, Artificial
  CRISPR gRNA sequence
taatcactcctcggtcatgt

SEQ ID NO: 230638 - DNA, 20 bp, Artificial
  CRISPR gRNA sequence
ctcggtcatgtaaatagttt

SEQ ID NO: 230639 - DNA, 20 bp, Artificial
  CRISPR gRNA sequence
ggtcatgtaaatagtttgct

SEQ ID NO: 230640 - DNA, 20 bp, Artificial
  CRISPR gRNA sequence
gctttatattttactgtttt

SEQ ID NO: 230641 - DNA, 20 bp, Artificial
  CRISPR gRNA sequence
ctttatattttactgtttta

SEQ ID NO: 230642 - DNA, 20 bp, Artificial
  CRISPR gRNA sequence
tatattttactgttttaaag

SEQ ID NO: 230643 - DNA, 20 bp, Artificial
  CRISPR gRNA sequence
atattttactgttttaaagt

SEQ ID NO: 230644 - DNA, 20 bp, Artificial
  CRISPR gRNA sequence
tattttactgttttaaagtc

SEQ ID NO: 230645 - DNA, 20 bp, Artificial
  CRISPR gRNA sequence
tactgttttaaagtctgtga

SEQ ID NO: 230646 - DNA, 20 bp, Artificial
  CRISPR gRNA sequence
actgttttaaagtctgtgac

SEQ ID NO: 230647 - DNA, 20 bp, Artificial
  CRISPR gRNA sequence
ctgttttaaagtctgtgacc

SEQ ID NO: 230648 - DNA, 20 bp, Artificial
  CRISPR gRNA sequence
ttttaaagtctgtgacctta

SEQ ID NO: 230649 - DNA, 20 bp, Artificial
  CRISPR gRNA sequence
taaagtctgtgaccttacct

SEQ ID NO: 230650 - DNA, 20 bp, Artificial
  CRISPR gRNA sequence
aaagtctgtgaccttacctg

SEQ ID NO: 230651 - DNA, 20 bp, Artificial
  CRISPR gRNA sequence
aagtctgtgaccttacctgc

SEQ ID NO: 230652 - DNA, 20 bp, Artificial
  CRISPR gRNA sequence
tgaccttacctgccctcttc

SEQ ID NO: 230653 - DNA, 20 bp, Artificial
  CRISPR gRNA sequence
acctgccctcttctgtagca

SEQ ID NO: 230654 - DNA, 20 bp, Artificial
  CRISPR gRNA sequence
cctgccctcttctgtagcaa

SEQ ID NO: 230655 - DNA, 20 bp, Artificial
  CRISPR gRNA sequence
ccctcttctgtagcaaagtg

SEQ ID NO: 230656 - DNA, 20 bp, Artificial
  CRISPR gRNA sequence
ttctgtagcaaagtgcagca

SEQ ID NO: 230657 - DNA, 20 bp, Artificial
  CRISPR gRNA sequence
ctgtagcaaagtgcagcatt

SEQ ID NO: 230658 - DNA, 20 bp, Artificial
  CRISPR gRNA sequence
tgtagcaaagtgcagcattt

SEQ ID NO: 230659 - DNA, 20 bp, Artificial
  CRISPR gRNA sequence
tagcaaagtgcagcatttaa

SEQ ID NO: 230660 - DNA, 20 bp, Artificial
  CRISPR gRNA sequence
aactcaggaagctatattcc

SEQ ID NO: 230661 - DNA, 20 bp, Artificial
  CRISPR gRNA sequence
actcaggaagctatattccc

SEQ ID NO: 230662 - DNA, 20 bp, Artificial
  CRISPR gRNA sequence
aggaagctatattcccccca

SEQ ID NO: 230663 - DNA, 20 bp, Artificial
  CRISPR gRNA sequence
tattccccccaagtgtcatt

SEQ ID NO: 230664 - DNA, 20 bp, Artificial
  CRISPR gRNA sequence
cccccaagtgtcattaatat

SEQ ID NO: 230665 - DNA, 20 bp, Artificial
  CRISPR gRNA sequence
atatttgcataagattaaaa

SEQ ID NO: 230666 - DNA, 20 bp, Artificial
  CRISPR gRNA sequence
gcataagattaaaaacactc

SEQ ID NO: 230667 - DNA, 20 bp, Artificial
  CRISPR gRNA sequence
cataagattaaaaacactcc

SEQ ID NO: 230668 - DNA, 20 bp, Artificial
  CRISPR gRNA sequence
aaaacactccagtcggccgg

SEQ ID NO: 230669 - DNA, 20 bp, Artificial
  CRISPR gRNA sequence
cagtcggccgggcgcggtgg

SEQ ID NO: 230670 - DNA, 20 bp, Artificial
  CRISPR gRNA sequence
acgcctgtaatcccagcact

SEQ ID NO: 230671 - DNA, 20 bp, Artificial
  CRISPR gRNA sequence
taatcccagcactttgggag

SEQ ID NO: 230672 - DNA, 20 bp, Artificial
  CRISPR gRNA sequence
tgggaggccgaggcgggcgg

SEQ ID NO: 230673 - DNA, 20 bp, Artificial
  CRISPR gRNA sequence
gggaggccgaggcgggcgga

SEQ ID NO: 230674 - DNA, 20 bp, Artificial
  CRISPR gRNA sequence
ggaggccgaggcgggcggat

SEQ ID NO: 230675 - DNA, 20 bp, Artificial
  CRISPR gRNA sequence
gctaacacggtgaaaccccg

SEQ ID NO: 230676 - DNA, 20 bp, Artificial
  CRISPR gRNA sequence
acacggtgaaaccccgtctc

SEQ ID NO: 230677 - DNA, 20 bp, Artificial
  CRISPR gRNA sequence
tactaaaactacaaaaaatt

SEQ ID NO: 230678 - DNA, 20 bp, Artificial
  CRISPR gRNA sequence
ctaaaactacaaaaaattag

SEQ ID NO: 230679 - DNA, 20 bp, Artificial
  CRISPR gRNA sequence
aaactacaaaaaattagccg

SEQ ID NO: 230680 - DNA, 20 bp, Artificial
  CRISPR gRNA sequence
caaaaaattagccgggcatg

SEQ ID NO: 230681 - DNA, 20 bp, Artificial
  CRISPR gRNA sequence
gccgggcatggtggcgggca

SEQ ID NO: 230682 - DNA, 20 bp, Artificial
  CRISPR gRNA sequence
tggtcccagctacttgggag

SEQ ID NO: 230683 - DNA, 20 bp, Artificial
  CRISPR gRNA sequence
cttgggaggctgaggcagga

SEQ ID NO: 230684 - DNA, 20 bp, Artificial
  CRISPR gRNA sequence
gggaggctgaggcaggagaa

SEQ ID NO: 230685 - DNA, 20 bp, Artificial
  CRISPR gRNA sequence
ggaggctgaggcaggagaat

SEQ ID NO: 230686 - DNA, 20 bp, Artificial
  CRISPR gRNA sequence
aggcaggagaatggcgtgaa

SEQ ID NO: 230687 - DNA, 20 bp, Artificial
  CRISPR gRNA sequence
gcagtgagccaagatcgtgc

SEQ ID NO: 230688 - DNA, 20 bp, Artificial
  CRISPR gRNA sequence
cagtgagccaagatcgtgcc

SEQ ID NO: 230689 - DNA, 20 bp, Artificial
  CRISPR gRNA sequence
cactccagcctgggtgacag

SEQ ID NO: 230690 - DNA, 20 bp, Artificial
  CRISPR gRNA sequence
cagcctgggtgacagagcaa

SEQ ID NO: 230691 - DNA, 20 bp, Artificial
  CRISPR gRNA sequence
ggtgacagagcaagactccg

SEQ ID NO: 230692 - DNA, 20 bp, Artificial
  CRISPR gRNA sequence
cgtctcaagaaaaaaaaaaa

SEQ ID NO: 230693 - DNA, 20 bp, Artificial
  CRISPR gRNA sequence
aagaaaaaaaaaaaaaaaaa

SEQ ID NO: 230694 - DNA, 20 bp, Artificial
  CRISPR gRNA sequence
cagtcatgcattggtgaaca

SEQ ID NO: 230695 - DNA, 20 bp, Artificial
  CRISPR gRNA sequence
gtgaacaaagtttaaaacaa

SEQ ID NO: 230696 - DNA, 20 bp, Artificial
  CRISPR gRNA sequence
aaaacaacgtgtattcagca

SEQ ID NO: 230697 - DNA, 20 bp, Artificial
  CRISPR gRNA sequence
aaacaacgtgtattcagcat

SEQ ID NO: 230698 - DNA, 20 bp, Artificial
  CRISPR gRNA sequence
agcatggagtcacagaatga

SEQ ID NO: 230699 - DNA, 20 bp, Artificial
  CRISPR gRNA sequence
cttttgtatgtttgtgtcac

SEQ ID NO: 230700 - DNA, 20 bp, Artificial
  CRISPR gRNA sequence
ttgtatgtttgtgtcacagc

SEQ ID NO: 230701 - DNA, 20 bp, Artificial
  CRISPR gRNA sequence
tgtatgtttgtgtcacagcc

SEQ ID NO: 230702 - DNA, 20 bp, Artificial
  CRISPR gRNA sequence
gtatgtttgtgtcacagcct

SEQ ID NO: 230703 - DNA, 20 bp, Artificial
  CRISPR gRNA sequence
tatgtttgtgtcacagcctt

SEQ ID NO: 230704 - DNA, 20 bp, Artificial
  CRISPR gRNA sequence
gtgtcacagcctttaaaagc

SEQ ID NO: 230705 - DNA, 20 bp, Artificial
  CRISPR gRNA sequence
tgtcacagcctttaaaagca

SEQ ID NO: 230706 - DNA, 20 bp, Artificial
  CRISPR gRNA sequence
taaaagcatgtcttgttata

SEQ ID NO: 230707 - DNA, 20 bp, Artificial
  CRISPR gRNA sequence
aaaagcatgtcttgttatat

SEQ ID NO: 230708 - DNA, 20 bp, Artificial
  CRISPR gRNA sequence
aaagcatgtcttgttatata

SEQ ID NO: 230709 - DNA, 20 bp, Artificial
  CRISPR gRNA sequence
gttatataagccattaccct

SEQ ID NO: 230710 - DNA, 20 bp, Artificial
  CRISPR gRNA sequence
ttatataagccattaccctc

SEQ ID NO: 230711 - DNA, 20 bp, Artificial
  CRISPR gRNA sequence
tataagccattaccctccta

SEQ ID NO: 230712 - DNA, 20 bp, Artificial
  CRISPR gRNA sequence
ccctcctaaaaaagactata

SEQ ID NO: 230713 - DNA, 20 bp, Artificial
  CRISPR gRNA sequence
ctaaaaaagactatagttca

SEQ ID NO: 230714 - DNA, 20 bp, Artificial
  CRISPR gRNA sequence
aaaaagactatagttcacag

SEQ ID NO: 230715 - DNA, 20 bp, Artificial
  CRISPR gRNA sequence
tagttcacaggaataagtta

SEQ ID NO: 230716 - DNA, 20 bp, Artificial
  CRISPR gRNA sequence
acaggaataagttaaaagac

SEQ ID NO: 230717 - DNA, 20 bp, Artificial
  CRISPR gRNA sequence
aaagacataacaaaacataa

SEQ ID NO: 230718 - DNA, 20 bp, Artificial
  CRISPR gRNA sequence
gtaccaggaattgtgaccat

SEQ ID NO: 230719 - DNA, 20 bp, Artificial
  CRISPR gRNA sequence
tgaccatggtttgttctggt

SEQ ID NO: 230720 - DNA, 20 bp, Artificial
  CRISPR gRNA sequence
gttctggtaactgtggcatg

SEQ ID NO: 230721 - DNA, 20 bp, Artificial
  CRISPR gRNA sequence
ttctggtaactgtggcatgg

SEQ ID NO: 230722 - DNA, 20 bp, Artificial
  CRISPR gRNA sequence
tggtaactgtggcatggcat

SEQ ID NO: 230723 - DNA, 20 bp, Artificial
  CRISPR gRNA sequence
gtaactgtggcatggcatgg

SEQ ID NO: 230724 - DNA, 20 bp, Artificial
  CRISPR gRNA sequence
tggcatggcatggtttgttc

SEQ ID NO: 230725 - DNA, 20 bp, Artificial
  CRISPR gRNA sequence
gttccaggaattgtggcatg

SEQ ID NO: 230726 - DNA, 20 bp, Artificial
  CRISPR gRNA sequence
ttccaggaattgtggcatgg

SEQ ID NO: 230727 - DNA, 20 bp, Artificial
  CRISPR gRNA sequence
caggaattgtggcatggttt

SEQ ID NO: 230728 - DNA, 20 bp, Artificial
  CRISPR gRNA sequence
tggcatggtttgttcatgtt

SEQ ID NO: 230729 - DNA, 20 bp, Artificial
  CRISPR gRNA sequence
gttcatgtttacattctgat

SEQ ID NO: 230730 - DNA, 20 bp, Artificial
  CRISPR gRNA sequence
ttcatgtttacattctgatg

SEQ ID NO: 230731 - DNA, 20 bp, Artificial
  CRISPR gRNA sequence
atgtttacattctgatgtcc

SEQ ID NO: 230732 - DNA, 20 bp, Artificial
  CRISPR gRNA sequence
acattctgatgtcctatttt

SEQ ID NO: 230733 - DNA, 20 bp, Artificial
  CRISPR gRNA sequence
cattctgatgtcctattttt

SEQ ID NO: 230734 - DNA, 20 bp, Artificial
  CRISPR gRNA sequence
tgatgtcctatttttttttt

SEQ ID NO: 230735 - DNA, 20 bp, Artificial
  CRISPR gRNA sequence
atgtcctatttttttttttt

SEQ ID NO: 230736 - DNA, 20 bp, Artificial
  CRISPR gRNA sequence
ttttttttttttaatttcta

SEQ ID NO: 230737 - DNA, 20 bp, Artificial
  CRISPR gRNA sequence
tttttttttaatttctatgt

SEQ ID NO: 230738 - DNA, 20 bp, Artificial
  CRISPR gRNA sequence
ttttttttaatttctatgtc

SEQ ID NO: 230739 - DNA, 20 bp, Artificial
  CRISPR gRNA sequence
tttttttaatttctatgtcc

SEQ ID NO: 230740 - DNA, 20 bp, Artificial
  CRISPR gRNA sequence
ttttttaatttctatgtcct

SEQ ID NO: 230741 - DNA, 20 bp, Artificial
  CRISPR gRNA sequence
tttttaatttctatgtcctt

SEQ ID NO: 230742 - DNA, 20 bp, Artificial
  CRISPR gRNA sequence
ttttaatttctatgtccttt

SEQ ID NO: 230743 - DNA, 20 bp, Artificial
  CRISPR gRNA sequence
tttaatttctatgtcctttc

SEQ ID NO: 230744 - DNA, 20 bp, Artificial
  CRISPR gRNA sequence
ttaatttctatgtcctttcc

SEQ ID NO: 230745 - DNA, 20 bp, Artificial
  CRISPR gRNA sequence
taatttctatgtcctttcct

SEQ ID NO: 230746 - DNA, 20 bp, Artificial
  CRISPR gRNA sequence
aatttctatgtcctttcctt

SEQ ID NO: 230747 - DNA, 20 bp, Artificial
  CRISPR gRNA sequence
atttctatgtcctttccttt

SEQ ID NO: 230748 - DNA, 20 bp, Artificial
  CRISPR gRNA sequence
ctatgtcctttccttttcct

SEQ ID NO: 230749 - DNA, 20 bp, Artificial
  CRISPR gRNA sequence
tatgtcctttccttttcctt

SEQ ID NO: 230750 - DNA, 20 bp, Artificial
  CRISPR gRNA sequence
tgtcctttccttttccttgg

SEQ ID NO: 230751 - DNA, 20 bp, Artificial
  CRISPR gRNA sequence
tccttttccttggtggtgtc

SEQ ID NO: 230752 - DNA, 20 bp, Artificial
  CRISPR gRNA sequence
ccttttccttggtggtgtca

SEQ ID NO: 230753 - DNA, 20 bp, Artificial
  CRISPR gRNA sequence
cttttccttggtggtgtcat

SEQ ID NO: 230754 - DNA, 20 bp, Artificial
  CRISPR gRNA sequence
ttccttggtggtgtcattgt

SEQ ID NO: 230755 - DNA, 20 bp, Artificial
  CRISPR gRNA sequence
tccttggtggtgtcattgtt

SEQ ID NO: 230756 - DNA, 20 bp, Artificial
  CRISPR gRNA sequence
ccttggtggtgtcattgttc

SEQ ID NO: 230757 - DNA, 20 bp, Artificial
  CRISPR gRNA sequence
cttggtggtgtcattgttct

SEQ ID NO: 230758 - DNA, 20 bp, Artificial
  CRISPR gRNA sequence
ggtggtgtcattgttctgta

SEQ ID NO: 230759 - DNA, 20 bp, Artificial
  CRISPR gRNA sequence
gtggtgtcattgttctgtag

SEQ ID NO: 230760 - DNA, 20 bp, Artificial
  CRISPR gRNA sequence
ttctgtagctgtatgaagaa

SEQ ID NO: 230761 - DNA, 20 bp, Artificial
  CRISPR gRNA sequence
tgtagctgtatgaagaaact

SEQ ID NO: 230762 - DNA, 20 bp, Artificial
  CRISPR gRNA sequence
tagctgtatgaagaaactaa

SEQ ID NO: 230763 - DNA, 20 bp, Artificial
  CRISPR gRNA sequence
tatgaagaaactaaactttt

SEQ ID NO: 230764 - DNA, 20 bp, Artificial
  CRISPR gRNA sequence
aacttttctccattttcagg

SEQ ID NO: 230765 - DNA, 20 bp, Artificial
  CRISPR gRNA sequence
ttctccattttcaggaaagc

SEQ ID NO: 230766 - DNA, 20 bp, Artificial
  CRISPR gRNA sequence
tctccattttcaggaaagca

SEQ ID NO: 230767 - DNA, 20 bp, Artificial
  CRISPR gRNA sequence
ctccattttcaggaaagcaa

SEQ ID NO: 230768 - DNA, 20 bp, Artificial
  CRISPR gRNA sequence
tccattttcaggaaagcaat

SEQ ID NO: 230769 - DNA, 20 bp, Artificial
  CRISPR gRNA sequence
cattttcaggaaagcaatct

SEQ ID NO: 230770 - DNA, 20 bp, Artificial
  CRISPR gRNA sequence
tcaggaaagcaatctaagaa

SEQ ID NO: 230771 - DNA, 20 bp, Artificial
  CRISPR gRNA sequence
caggaaagcaatctaagaat

SEQ ID NO: 230772 - DNA, 20 bp, Artificial
  CRISPR gRNA sequence
aggaaagcaatctaagaatc

SEQ ID NO: 230773 - DNA, 20 bp, Artificial
  CRISPR gRNA sequence
agaatcttgagtgcctcttc

SEQ ID NO: 230774 - DNA, 20 bp, Artificial
  CRISPR gRNA sequence
gagtgcctcttcctttgtta

SEQ ID NO: 230775 - DNA, 20 bp, Artificial
  CRISPR gRNA sequence
agtgcctcttcctttgttaa

SEQ ID NO: 230776 - DNA, 20 bp, Artificial
  CRISPR gRNA sequence
ttcctttgttaatttctctt

SEQ ID NO: 230777 - DNA, 20 bp, Artificial
  CRISPR gRNA sequence
cctttgttaatttctcttaa

SEQ ID NO: 230778 - DNA, 20 bp, Artificial
  CRISPR gRNA sequence
ctttgttaatttctcttaag

SEQ ID NO: 230779 - DNA, 20 bp, Artificial
  CRISPR gRNA sequence
tgttaatttctcttaagatg

SEQ ID NO: 230780 - DNA, 20 bp, Artificial
  CRISPR gRNA sequence
gttaatttctcttaagatgt

SEQ ID NO: 230781 - DNA, 20 bp, Artificial
  CRISPR gRNA sequence
ttaatttctcttaagatgtg

SEQ ID NO: 230782 - DNA, 20 bp, Artificial
  CRISPR gRNA sequence
atttctcttaagatgtgact

SEQ ID NO: 230783 - DNA, 20 bp, Artificial
  CRISPR gRNA sequence
ctcttaagatgtgacttttt

SEQ ID NO: 230784 - DNA, 20 bp, Artificial
  CRISPR gRNA sequence
tcttaagatgtgactttttt

SEQ ID NO: 230785 - DNA, 20 bp, Artificial
  CRISPR gRNA sequence
ttaagatgtgacttttttaa

SEQ ID NO: 230786 - DNA, 20 bp, Artificial
  CRISPR gRNA sequence
aagatgtgacttttttaaac

SEQ ID NO: 230787 - DNA, 20 bp, Artificial
  CRISPR gRNA sequence
agatgtgacttttttaaact

SEQ ID NO: 230788 - DNA, 20 bp, Artificial
  CRISPR gRNA sequence
ttttaaactactgcatcagg

SEQ ID NO: 230789 - DNA, 20 bp, Artificial
  CRISPR gRNA sequence
tttaaactactgcatcagga

SEQ ID NO: 230790 - DNA, 20 bp, Artificial
  CRISPR gRNA sequence
ttaaactactgcatcaggaa

SEQ ID NO: 230791 - DNA, 20 bp, Artificial
  CRISPR gRNA sequence
taaactactgcatcaggaaa

SEQ ID NO: 230792 - DNA, 20 bp, Artificial
  CRISPR gRNA sequence
aaactactgcatcaggaaat

SEQ ID NO: 230793 - DNA, 20 bp, Artificial
  CRISPR gRNA sequence
aactactgcatcaggaaata

SEQ ID NO: 230794 - DNA, 20 bp, Artificial
  CRISPR gRNA sequence
ctgcatcaggaaatattgta

SEQ ID NO: 230795 - DNA, 20 bp, Artificial
  CRISPR gRNA sequence
catcaggaaatattgtaaaa

SEQ ID NO: 230796 - DNA, 20 bp, Artificial
  CRISPR gRNA sequence
taaaacagttttgccttgaa

SEQ ID NO: 230797 - DNA, 20 bp, Artificial
  CRISPR gRNA sequence
tgccttgaatatttgtgatg

SEQ ID NO: 230798 - DNA, 20 bp, Artificial
  CRISPR gRNA sequence
gccttgaatatttgtgatga

SEQ ID NO: 230799 - DNA, 20 bp, Artificial
  CRISPR gRNA sequence
ccttgaatatttgtgatgaa

SEQ ID NO: 230800 - DNA, 20 bp, Artificial
  CRISPR gRNA sequence
gaatatttgtgatgaaatct

SEQ ID NO: 230801 - DNA, 20 bp, Artificial
  CRISPR gRNA sequence
aatatttgtgatgaaatcta

SEQ ID NO: 230802 - DNA, 20 bp, Artificial
  CRISPR gRNA sequence
gtgatgaaatctacgatgat

SEQ ID NO: 230803 - DNA, 20 bp, Artificial
  CRISPR gRNA sequence
tgatgaaatctacgatgatc

SEQ ID NO: 230804 - DNA, 20 bp, Artificial
  CRISPR gRNA sequence
cgatgatcttcaagattctc

SEQ ID NO: 230805 - DNA, 20 bp, Artificial
  CRISPR gRNA sequence
caagattctcttaattttgc

SEQ ID NO: 230806 - DNA, 20 bp, Artificial
  CRISPR gRNA sequence
aagattctcttaattttgct

SEQ ID NO: 230807 - DNA, 20 bp, Artificial
  CRISPR gRNA sequence
tcttaattttgctaatattc

SEQ ID NO: 230808 - DNA, 20 bp, Artificial
  CRISPR gRNA sequence
ttaattttgctaatattcag

SEQ ID NO: 230809 - DNA, 20 bp, Artificial
  CRISPR gRNA sequence
aattttgctaatattcagct

SEQ ID NO: 230810 - DNA, 20 bp, Artificial
  CRISPR gRNA sequence
attttgctaatattcagctg

SEQ ID NO: 230811 - DNA, 20 bp, Artificial
  CRISPR gRNA sequence
tgctaatattcagctgatca

SEQ ID NO: 230812 - DNA, 20 bp, Artificial
  CRISPR gRNA sequence
gctaatattcagctgatcag

SEQ ID NO: 230813 - DNA, 20 bp, Artificial
  CRISPR gRNA sequence
ctaatattcagctgatcaga

SEQ ID NO: 230814 - DNA, 20 bp, Artificial
  CRISPR gRNA sequence
atattcagctgatcagaatt

SEQ ID NO: 230815 - DNA, 20 bp, Artificial
  CRISPR gRNA sequence
agctgatcagaatttgtttt

SEQ ID NO: 230816 - DNA, 20 bp, Artificial
  CRISPR gRNA sequence
atcagaatttgtttttaaaa

SEQ ID NO: 230817 - DNA, 20 bp, Artificial
  CRISPR gRNA sequence
gtttttaaaatgtctggctg

SEQ ID NO: 230818 - DNA, 20 bp, Artificial
  CRISPR gRNA sequence
tttttaaaatgtctggctgg

SEQ ID NO: 230819 - DNA, 20 bp, Artificial
  CRISPR gRNA sequence
ttaaaatgtctggctggtgg

SEQ ID NO: 230820 - DNA, 20 bp, Artificial
  CRISPR gRNA sequence
taaaatgtctggctggtggg

SEQ ID NO: 230821 - DNA, 20 bp, Artificial
  CRISPR gRNA sequence
aaaatgtctggctggtgggt

SEQ ID NO: 230822 - DNA, 20 bp, Artificial
  CRISPR gRNA sequence
aaatgtctggctggtgggta

SEQ ID NO: 230823 - DNA, 20 bp, Artificial
  CRISPR gRNA sequence
gctggtgggtacttcccact

SEQ ID NO: 230824 - DNA, 20 bp, Artificial
  CRISPR gRNA sequence
gtgggtacttcccactgaca

SEQ ID NO: 230825 - DNA, 20 bp, Artificial
  CRISPR gRNA sequence
cccactgacaactgcttatt

SEQ ID NO: 230826 - DNA, 20 bp, Artificial
  CRISPR gRNA sequence
ccactgacaactgcttattg

SEQ ID NO: 230827 - DNA, 20 bp, Artificial
  CRISPR gRNA sequence
acaactgcttattgcttaca

SEQ ID NO: 230828 - DNA, 20 bp, Artificial
  CRISPR gRNA sequence
cttattgcttacagtatgtc

SEQ ID NO: 230829 - DNA, 20 bp, Artificial
  CRISPR gRNA sequence
attgcttacagtatgtctgc

SEQ ID NO: 230830 - DNA, 20 bp, Artificial
  CRISPR gRNA sequence
ttgcttacagtatgtctgcc

SEQ ID NO: 230831 - DNA, 20 bp, Artificial
  CRISPR gRNA sequence
cttacagtatgtctgccttg

SEQ ID NO: 230832 - DNA, 20 bp, Artificial
  CRISPR gRNA sequence
acagtatgtctgccttgtca

SEQ ID NO: 230833 - DNA, 20 bp, Artificial
  CRISPR gRNA sequence
cagtatgtctgccttgtcaa

SEQ ID NO: 230834 - DNA, 20 bp, Artificial
  CRISPR gRNA sequence
ccttgtcaatgaatgaggtt

SEQ ID NO: 230835 - DNA, 20 bp, Artificial
  CRISPR gRNA sequence
gtcaatgaatgaggttcagg

SEQ ID NO: 230836 - DNA, 20 bp, Artificial
  CRISPR gRNA sequence
tcaatgaatgaggttcaggg

SEQ ID NO: 230837 - DNA, 20 bp, Artificial
  CRISPR gRNA sequence
agggtgcttcctagggatca

SEQ ID NO: 230838 - DNA, 20 bp, Artificial
  CRISPR gRNA sequence
cctagggatcagagtcagta

SEQ ID NO: 230839 - DNA, 20 bp, Artificial
  CRISPR gRNA sequence
ctagggatcagagtcagtac

SEQ ID NO: 230840 - DNA, 20 bp, Artificial
  CRISPR gRNA sequence
gggatcagagtcagtaccat

SEQ ID NO: 230841 - DNA, 20 bp, Artificial
  CRISPR gRNA sequence
ttctctttcatctacagctg

SEQ ID NO: 230842 - DNA, 20 bp, Artificial
  CRISPR gRNA sequence
tctctttcatctacagctga

SEQ ID NO: 230843 - DNA, 20 bp, Artificial
  CRISPR gRNA sequence
ctctttcatctacagctgat

SEQ ID NO: 230844 - DNA, 20 bp, Artificial
  CRISPR gRNA sequence
tctttcatctacagctgatc

SEQ ID NO: 230845 - DNA, 20 bp, Artificial
  CRISPR gRNA sequence
tttcatctacagctgatcag

SEQ ID NO: 230846 - DNA, 20 bp, Artificial
  CRISPR gRNA sequence
tcatctacagctgatcagat

SEQ ID NO: 230847 - DNA, 20 bp, Artificial
  CRISPR gRNA sequence
catctacagctgatcagatg

SEQ ID NO: 230848 - DNA, 20 bp, Artificial
  CRISPR gRNA sequence
atctacagctgatcagatgt

SEQ ID NO: 230849 - DNA, 20 bp, Artificial
  CRISPR gRNA sequence
cagctgatcagatgtttatt

SEQ ID NO: 230850 - DNA, 20 bp, Artificial
  CRISPR gRNA sequence
atcagatgtttattttactt

SEQ ID NO: 230851 - DNA, 20 bp, Artificial
  CRISPR gRNA sequence
attttacttacattaaatga

SEQ ID NO: 230852 - DNA, 20 bp, Artificial
  CRISPR gRNA sequence
ttttacttacattaaatgaa

SEQ ID NO: 230853 - DNA, 20 bp, Artificial
  CRISPR gRNA sequence
tacttacattaaatgaatga

SEQ ID NO: 230854 - DNA, 20 bp, Artificial
  CRISPR gRNA sequence
acttacattaaatgaatgat

SEQ ID NO: 230855 - DNA, 20 bp, Artificial
  CRISPR gRNA sequence
cttacattaaatgaatgatg

SEQ ID NO: 230856 - DNA, 20 bp, Artificial
  CRISPR gRNA sequence
acattaaatgaatgatggag

SEQ ID NO: 230857 - DNA, 20 bp, Artificial
  CRISPR gRNA sequence
cattaaatgaatgatggaga

SEQ ID NO: 230858 - DNA, 20 bp, Artificial
  CRISPR gRNA sequence
aatgaatgatggagatccaa

SEQ ID NO: 230859 - DNA, 20 bp, Artificial
  CRISPR gRNA sequence
tagaatattattctaggatc

SEQ ID NO: 230860 - DNA, 20 bp, Artificial
  CRISPR gRNA sequence
ttctaggatcaacatctttt

SEQ ID NO: 230861 - DNA, 20 bp, Artificial
  CRISPR gRNA sequence
taggatcaacatcttttgct

SEQ ID NO: 230862 - DNA, 20 bp, Artificial
  CRISPR gRNA sequence
ggatcaacatcttttgcttt

SEQ ID NO: 230863 - DNA, 20 bp, Artificial
  CRISPR gRNA sequence
ttgctttgaaaaatcaacat

SEQ ID NO: 230864 - DNA, 20 bp, Artificial
  CRISPR gRNA sequence
tgctttgaaaaatcaacatc

SEQ ID NO: 230865 - DNA, 20 bp, Artificial
  CRISPR gRNA sequence
gctttgaaaaatcaacatct

SEQ ID NO: 230866 - DNA, 20 bp, Artificial
  CRISPR gRNA sequence
ctttgaaaaatcaacatctc

SEQ ID NO: 230867 - DNA, 20 bp, Artificial
  CRISPR gRNA sequence
tgaaaaatcaacatctcttg

SEQ ID NO: 230868 - DNA, 20 bp, Artificial
  CRISPR gRNA sequence
gaaaaatcaacatctcttgg

SEQ ID NO: 230869 - DNA, 20 bp, Artificial
  CRISPR gRNA sequence
aaaaatcaacatctcttggc

SEQ ID NO: 230870 - DNA, 20 bp, Artificial
  CRISPR gRNA sequence
ttggcttttcctcagccaac

SEQ ID NO: 230871 - DNA, 20 bp, Artificial
  CRISPR gRNA sequence
ggcttttcctcagccaaccc

SEQ ID NO: 230872 - DNA, 20 bp, Artificial
  CRISPR gRNA sequence
gcttttcctcagccaaccca

SEQ ID NO: 230873 - DNA, 20 bp, Artificial
  CRISPR gRNA sequence
ttcctcagccaacccagcaa

SEQ ID NO: 230874 - DNA, 20 bp, Artificial
  CRISPR gRNA sequence
tcctcagccaacccagcaaa

SEQ ID NO: 230875 - DNA, 20 bp, Artificial
  CRISPR gRNA sequence
cctcagccaacccagcaaac

SEQ ID NO: 230876 - DNA, 20 bp, Artificial
  CRISPR gRNA sequence
ctcagccaacccagcaaaca

SEQ ID NO: 230877 - DNA, 20 bp, Artificial
  CRISPR gRNA sequence
agccaacccagcaaacagag

SEQ ID NO: 230878 - DNA, 20 bp, Artificial
  CRISPR gRNA sequence
tcagactctgttgatttttt

SEQ ID NO: 230879 - DNA, 20 bp, Artificial
  CRISPR gRNA sequence
tgttgattttttactttcat

SEQ ID NO: 230880 - DNA, 20 bp, Artificial
  CRISPR gRNA sequence
ttgattttttactttcattt

SEQ ID NO: 230881 - DNA, 20 bp, Artificial
  CRISPR gRNA sequence
attttttactttcatttggc

SEQ ID NO: 230882 - DNA, 20 bp, Artificial
  CRISPR gRNA sequence
tttactttcatttggcattg

SEQ ID NO: 230883 - DNA, 20 bp, Artificial
  CRISPR gRNA sequence
ttactttcatttggcattgg

SEQ ID NO: 230884 - DNA, 20 bp, Artificial
  CRISPR gRNA sequence
tactttcatttggcattggc

SEQ ID NO: 230885 - DNA, 20 bp, Artificial
  CRISPR gRNA sequence
actttcatttggcattggcc

SEQ ID NO: 230886 - DNA, 20 bp, Artificial
  CRISPR gRNA sequence
ctttcatttggcattggcct

SEQ ID NO: 230887 - DNA, 20 bp, Artificial
  CRISPR gRNA sequence
tcatttggcattggcctttt

SEQ ID NO: 230888 - DNA, 20 bp, Artificial
  CRISPR gRNA sequence
catttggcattggccttttt

SEQ ID NO: 230889 - DNA, 20 bp, Artificial
  CRISPR gRNA sequence
atttggcattggcctttttc

SEQ ID NO: 230890 - DNA, 20 bp, Artificial
  CRISPR gRNA sequence
ggcattggcctttttcttac

SEQ ID NO: 230891 - DNA, 20 bp, Artificial
  CRISPR gRNA sequence
gcattggcctttttcttact

SEQ ID NO: 230892 - DNA, 20 bp, Artificial
  CRISPR gRNA sequence
gcctttttcttactgaaatt

SEQ ID NO: 230893 - DNA, 20 bp, Artificial
  CRISPR gRNA sequence
tttcttactgaaattaaaaa

SEQ ID NO: 230894 - DNA, 20 bp, Artificial
  CRISPR gRNA sequence
ttcttactgaaattaaaaag

SEQ ID NO: 230895 - DNA, 20 bp, Artificial
  CRISPR gRNA sequence
tcttactgaaattaaaaagg

SEQ ID NO: 230896 - DNA, 20 bp, Artificial
  CRISPR gRNA sequence
cttactgaaattaaaaaggc

SEQ ID NO: 230897 - DNA, 20 bp, Artificial
  CRISPR gRNA sequence
ttactgaaattaaaaaggct

SEQ ID NO: 230898 - DNA, 20 bp, Artificial
  CRISPR gRNA sequence
actgaaattaaaaaggctaa

SEQ ID NO: 230899 - DNA, 20 bp, Artificial
  CRISPR gRNA sequence
ctgaaattaaaaaggctaat

SEQ ID NO: 230900 - DNA, 20 bp, Artificial
  CRISPR gRNA sequence
aaattaaaaaggctaatgat

SEQ ID NO: 230901 - DNA, 20 bp, Artificial
  CRISPR gRNA sequence
aaaaggctaatgatttgcct

SEQ ID NO: 230902 - DNA, 20 bp, Artificial
  CRISPR gRNA sequence
atgatttgcctggtttctgt

SEQ ID NO: 230903 - DNA, 20 bp, Artificial
  CRISPR gRNA sequence
gcctggtttctgtctctgac

SEQ ID NO: 230904 - DNA, 20 bp, Artificial
  CRISPR gRNA sequence
cctggtttctgtctctgacc

SEQ ID NO: 230905 - DNA, 20 bp, Artificial
  CRISPR gRNA sequence
gtttctgtctctgacctttg

SEQ ID NO: 230906 - DNA, 20 bp, Artificial
  CRISPR gRNA sequence
ctgtctctgacctttgcagg

SEQ ID NO: 230907 - DNA, 20 bp, Artificial
  CRISPR gRNA sequence
tgtctctgacctttgcaggt

SEQ ID NO: 230908 - DNA, 20 bp, Artificial
  CRISPR gRNA sequence
tctctgacctttgcaggtct

SEQ ID NO: 230909 - DNA, 20 bp, Artificial
  CRISPR gRNA sequence
tgacctttgcaggtctattt

SEQ ID NO: 230910 - DNA, 20 bp, Artificial
  CRISPR gRNA sequence
acctttgcaggtctattttc

SEQ ID NO: 230911 - DNA, 20 bp, Artificial
  CRISPR gRNA sequence
tgcaggtctattttcttaat

SEQ ID NO: 230912 - DNA, 20 bp, Artificial
  CRISPR gRNA sequence
gcaggtctattttcttaatt

SEQ ID NO: 230913 - DNA, 20 bp, Artificial
  CRISPR gRNA sequence
caggtctattttcttaattt

SEQ ID NO: 230914 - DNA, 20 bp, Artificial
  CRISPR gRNA sequence
ttttcttaatttttagatac

SEQ ID NO: 230915 - DNA, 20 bp, Artificial
  CRISPR gRNA sequence
tcttaatttttagatactat

SEQ ID NO: 230916 - DNA, 20 bp, Artificial
  CRISPR gRNA sequence
cttaatttttagatactata

SEQ ID NO: 230917 - DNA, 20 bp, Artificial
  CRISPR gRNA sequence
ttaatttttagatactatat

SEQ ID NO: 230918 - DNA, 20 bp, Artificial
  CRISPR gRNA sequence
aatttttagatactatatat

SEQ ID NO: 230919 - DNA, 20 bp, Artificial
  CRISPR gRNA sequence
atttttagatactatatatc

SEQ ID NO: 230920 - DNA, 20 bp, Artificial
  CRISPR gRNA sequence
ttagatactatatatctgaa

SEQ ID NO: 230921 - DNA, 20 bp, Artificial
  CRISPR gRNA sequence
tagatactatatatctgaaa

SEQ ID NO: 230922 - DNA, 20 bp, Artificial
  CRISPR gRNA sequence
agatactatatatctgaaac

SEQ ID NO: 230923 - DNA, 20 bp, Artificial
  CRISPR gRNA sequence
gatactatatatctgaaact

SEQ ID NO: 230924 - DNA, 20 bp, Artificial
  CRISPR gRNA sequence
tatatctgaaacttttttta

SEQ ID NO: 230925 - DNA, 20 bp, Artificial
  CRISPR gRNA sequence
aaactttttttaatgtgtca

SEQ ID NO: 230926 - DNA, 20 bp, Artificial
  CRISPR gRNA sequence
tttttaatgtgtcaactttt

SEQ ID NO: 230927 - DNA, 20 bp, Artificial
  CRISPR gRNA sequence
ttttaatgtgtcaacttttt

SEQ ID NO: 230928 - DNA, 20 bp, Artificial
  CRISPR gRNA sequence
tttaatgtgtcaacttttta

SEQ ID NO: 230929 - DNA, 20 bp, Artificial
  CRISPR gRNA sequence
ttaatgtgtcaactttttaa

SEQ ID NO: 230930 - DNA, 20 bp, Artificial
  CRISPR gRNA sequence
taatgtgtcaactttttaat

SEQ ID NO: 230931 - DNA, 20 bp, Artificial
  CRISPR gRNA sequence
aatgtgtcaactttttaatg

SEQ ID NO: 230932 - DNA, 20 bp, Artificial
  CRISPR gRNA sequence
atgtgtcaactttttaatgg

SEQ ID NO: 230933 - DNA, 20 bp, Artificial
  CRISPR gRNA sequence
tttaatggatagaaaataga

SEQ ID NO: 230934 - DNA, 20 bp, Artificial
  CRISPR gRNA sequence
ttaatggatagaaaatagac

SEQ ID NO: 230935 - DNA, 20 bp, Artificial
  CRISPR gRNA sequence
taatggatagaaaatagaca

SEQ ID NO: 230936 - DNA, 20 bp, Artificial
  CRISPR gRNA sequence
aatggatagaaaatagacac

SEQ ID NO: 230937 - DNA, 20 bp, Artificial
  CRISPR gRNA sequence
atggatagaaaatagacacg

SEQ ID NO: 230938 - DNA, 20 bp, Artificial
  CRISPR gRNA sequence
tgtgttcatttttcaatttt

SEQ ID NO: 230939 - DNA, 20 bp, Artificial
  CRISPR gRNA sequence
atttttcaattttccagaat

SEQ ID NO: 230940 - DNA, 20 bp, Artificial
  CRISPR gRNA sequence
ttcaattttccagaataact

SEQ ID NO: 230941 - DNA, 20 bp, Artificial
  CRISPR gRNA sequence
tcaattttccagaataactg

SEQ ID NO: 230942 - DNA, 20 bp, Artificial
  CRISPR gRNA sequence
caattttccagaataactga

SEQ ID NO: 230943 - DNA, 20 bp, Artificial
  CRISPR gRNA sequence
aattttccagaataactgaa

SEQ ID NO: 230944 - DNA, 20 bp, Artificial
  CRISPR gRNA sequence
tccagaataactgaagtgaa

SEQ ID NO: 230945 - DNA, 20 bp, Artificial
  CRISPR gRNA sequence
ccagaataactgaagtgaag

SEQ ID NO: 230946 - DNA, 20 bp, Artificial
  CRISPR gRNA sequence
cagaataactgaagtgaagt

SEQ ID NO: 230947 - DNA, 20 bp, Artificial
  CRISPR gRNA sequence
aagtgaagtgatggactccg

SEQ ID NO: 230948 - DNA, 20 bp, Artificial
  CRISPR gRNA sequence
cgatttggagagtagtaaga

SEQ ID NO: 230949 - DNA, 20 bp, Artificial
  CRISPR gRNA sequence
ggagagtagtaagacgtgaa

SEQ ID NO: 230950 - DNA, 20 bp, Artificial
  CRISPR gRNA sequence
gagagtagtaagacgtgaaa

SEQ ID NO: 230951 - DNA, 20 bp, Artificial
  CRISPR gRNA sequence
gtgtttaagcaccatggcct

SEQ ID NO: 230952 - DNA, 20 bp, Artificial
  CRISPR gRNA sequence
tgtttaagcaccatggcctt

SEQ ID NO: 230953 - DNA, 20 bp, Artificial
  CRISPR gRNA sequence
aagcaccatggccttgatga

SEQ ID NO: 230954 - DNA, 20 bp, Artificial
  CRISPR gRNA sequence
agcaccatggccttgatgat

SEQ ID NO: 230955 - DNA, 20 bp, Artificial
  CRISPR gRNA sequence
gatgattcactgttggggag

SEQ ID NO: 230956 - DNA, 20 bp, Artificial
  CRISPR gRNA sequence
atgattcactgttggggaga

SEQ ID NO: 230957 - DNA, 20 bp, Artificial
  CRISPR gRNA sequence
actgttggggagaagaaaca

SEQ ID NO: 230958 - DNA, 20 bp, Artificial
  CRISPR gRNA sequence
ttggggagaagaaacaagaa

SEQ ID NO: 230959 - DNA, 20 bp, Artificial
  CRISPR gRNA sequence
gggagaagaaacaagaaaag

SEQ ID NO: 230960 - DNA, 20 bp, Artificial
  CRISPR gRNA sequence
gttgtcacctatgagaccct

SEQ ID NO: 230961 - DNA, 20 bp, Artificial
  CRISPR gRNA sequence
tcacctatgagacccttacg

SEQ ID NO: 230962 - DNA, 20 bp, Artificial
  CRISPR gRNA sequence
tgagacccttacgtgattgt

SEQ ID NO: 230963 - DNA, 20 bp, Artificial
  CRISPR gRNA sequence
acgtgattgttagttaagtt

SEQ ID NO: 230964 - DNA, 20 bp, Artificial
  CRISPR gRNA sequence
cgtgattgttagttaagttt

SEQ ID NO: 230965 - DNA, 20 bp, Artificial
  CRISPR gRNA sequence
ttagttaagtttttattcaa

SEQ ID NO: 230966 - DNA, 20 bp, Artificial
  CRISPR gRNA sequence
gttaagtttttattcaaagc

SEQ ID NO: 230967 - DNA, 20 bp, Artificial
  CRISPR gRNA sequence
agtttttattcaaagcagct

SEQ ID NO: 230968 - DNA, 20 bp, Artificial
  CRISPR gRNA sequence
ttattcaaagcagctgtaat

SEQ ID NO: 230969 - DNA, 20 bp, Artificial
  CRISPR gRNA sequence
tattcaaagcagctgtaatt

SEQ ID NO: 230970 - DNA, 20 bp, Artificial
  CRISPR gRNA sequence
attcaaagcagctgtaattt

SEQ ID NO: 230971 - DNA, 20 bp, Artificial
  CRISPR gRNA sequence
ttcaaagcagctgtaattta

SEQ ID NO: 230972 - DNA, 20 bp, Artificial
  CRISPR gRNA sequence
aaagcagctgtaatttagtt

SEQ ID NO: 230973 - DNA, 20 bp, Artificial
  CRISPR gRNA sequence
taatttagttaataaaataa

SEQ ID NO: 230974 - DNA, 20 bp, Artificial
  CRISPR gRNA sequence
agttaataaaataattatga

SEQ ID NO: 230975 - DNA, 20 bp, Artificial
  CRISPR gRNA sequence
gttaataaaataattatgat

SEQ ID NO: 230976 - DNA, 20 bp, Artificial
  CRISPR gRNA sequence
ataaaataattatgatctat

SEQ ID NO: 230977 - DNA, 20 bp, Artificial
  CRISPR gRNA sequence
tgatctatgttgtttgccca

SEQ ID NO: 230978 - DNA, 20 bp, Artificial
  CRISPR gRNA sequence
tgttgtttgcccaattgaga

SEQ ID NO: 230979 - DNA, 20 bp, Artificial
  CRISPR gRNA sequence
tttgcccaattgagatccag

SEQ ID NO: 230980 - DNA, 20 bp, Artificial
  CRISPR gRNA sequence
gcccaattgagatccagttt

SEQ ID NO: 230981 - DNA, 20 bp, Artificial
  CRISPR gRNA sequence
cccaattgagatccagtttt

SEQ ID NO: 230982 - DNA, 20 bp, Artificial
  CRISPR gRNA sequence
agatccagttttttgttgtt

SEQ ID NO: 230983 - DNA, 20 bp, Artificial
  CRISPR gRNA sequence
tttgttgttatttttaatca

SEQ ID NO: 230984 - DNA, 20 bp, Artificial
  CRISPR gRNA sequence
ttgttgttatttttaatcaa

SEQ ID NO: 230985 - DNA, 20 bp, Artificial
  CRISPR gRNA sequence
tgttgttatttttaatcaat

SEQ ID NO: 230986 - DNA, 20 bp, Artificial
  CRISPR gRNA sequence
gttgttatttttaatcaatt

SEQ ID NO: 230987 - DNA, 20 bp, Artificial
  CRISPR gRNA sequence
ttgttatttttaatcaatta

SEQ ID NO: 230988 - DNA, 20 bp, Artificial
  CRISPR gRNA sequence
ttatttttaatcaattaggg

SEQ ID NO: 230989 - DNA, 20 bp, Artificial
  CRISPR gRNA sequence
tttttaatcaattaggggca

SEQ ID NO: 230990 - DNA, 20 bp, Artificial
  CRISPR gRNA sequence
ttaatcaattaggggcaata

SEQ ID NO: 230991 - DNA, 20 bp, Artificial
  CRISPR gRNA sequence
taatcaattaggggcaatag

SEQ ID NO: 230992 - DNA, 20 bp, Artificial
  CRISPR gRNA sequence
aatcaattaggggcaatagt

SEQ ID NO: 230993 - DNA, 20 bp, Artificial
  CRISPR gRNA sequence
atcaattaggggcaatagta

SEQ ID NO: 230994 - DNA, 20 bp, Artificial
  CRISPR gRNA sequence
ggggcaatagtagaatggac

SEQ ID NO: 230995 - DNA, 20 bp, Artificial
  CRISPR gRNA sequence
ccaagaatgatgcctttcag

SEQ ID NO: 230996 - DNA, 20 bp, Artificial
  CRISPR gRNA sequence
caagaatgatgcctttcagg

SEQ ID NO: 230997 - DNA, 20 bp, Artificial
  CRISPR gRNA sequence
tcaggtcctagggcctctgg

SEQ ID NO: 230998 - DNA, 20 bp, Artificial
  CRISPR gRNA sequence
caggtcctagggcctctggc

SEQ ID NO: 230999 - DNA, 20 bp, Artificial
  CRISPR gRNA sequence
aggtcctagggcctctggcc

SEQ ID NO: 231000 - DNA, 20 bp, Artificial
  CRISPR gRNA sequence
gggcctctggcctctaggta

SEQ ID NO: 231001 - DNA, 20 bp, Artificial
  CRISPR gRNA sequence
tggcctctaggtaaccagtt

SEQ ID NO: 231002 - DNA, 20 bp, Artificial
  CRISPR gRNA sequence
gcctctaggtaaccagttta

SEQ ID NO: 231003 - DNA, 20 bp, Artificial
  CRISPR gRNA sequence
taggtaaccagtttaaattg

SEQ ID NO: 231004 - DNA, 20 bp, Artificial
  CRISPR gRNA sequence
ggtaaccagtttaaattggt

SEQ ID NO: 231005 - DNA, 20 bp, Artificial
  CRISPR gRNA sequence
aaattggttcagggtgataa

SEQ ID NO: 231006 - DNA, 20 bp, Artificial
  CRISPR gRNA sequence
aattggttcagggtgataac

SEQ ID NO: 231007 - DNA, 20 bp, Artificial
  CRISPR gRNA sequence
gttcagggtgataactactt

SEQ ID NO: 231008 - DNA, 20 bp, Artificial
  CRISPR gRNA sequence
agggtgataactacttagca

SEQ ID NO: 231009 - DNA, 20 bp, Artificial
  CRISPR gRNA sequence
cttagcactgccctggtgat

SEQ ID NO: 231010 - DNA, 20 bp, Artificial
  CRISPR gRNA sequence
agcactgccctggtgattac

SEQ ID NO: 231011 - DNA, 20 bp, Artificial
  CRISPR gRNA sequence
gcactgccctggtgattacc

SEQ ID NO: 231012 - DNA, 20 bp, Artificial
  CRISPR gRNA sequence
ccctggtgattacccagaga

SEQ ID NO: 231013 - DNA, 20 bp, Artificial
  CRISPR gRNA sequence
gtgattacccagagatatct

SEQ ID NO: 231014 - DNA, 20 bp, Artificial
  CRISPR gRNA sequence
cccagagatatctatgaaaa

SEQ ID NO: 231015 - DNA, 20 bp, Artificial
  CRISPR gRNA sequence
tgaaaaccagtggcttccat

SEQ ID NO: 231016 - DNA, 20 bp, Artificial
  CRISPR gRNA sequence
ccatcaaacctttgccaact

SEQ ID NO: 231017 - DNA, 20 bp, Artificial
  CRISPR gRNA sequence
catcaaacctttgccaactc

SEQ ID NO: 231018 - DNA, 20 bp, Artificial
  CRISPR gRNA sequence
tgccaactcaggttcacagc

SEQ ID NO: 231019 - DNA, 20 bp, Artificial
  CRISPR gRNA sequence
gccaactcaggttcacagca

SEQ ID NO: 231020 - DNA, 20 bp, Artificial
  CRISPR gRNA sequence
ccaactcaggttcacagcag

SEQ ID NO: 231021 - DNA, 20 bp, Artificial
  CRISPR gRNA sequence
aggttcacagcagctttggg

SEQ ID NO: 231022 - DNA, 20 bp, Artificial
  CRISPR gRNA sequence
acagcagctttgggcagtta

SEQ ID NO: 231023 - DNA, 20 bp, Artificial
  CRISPR gRNA sequence
tgggcagttatggcagtatg

SEQ ID NO: 231024 - DNA, 20 bp, Artificial
  CRISPR gRNA sequence
gggcagttatggcagtatgg

SEQ ID NO: 231025 - DNA, 20 bp, Artificial
  CRISPR gRNA sequence
ggcagttatggcagtatggc

SEQ ID NO: 231026 - DNA, 20 bp, Artificial
  CRISPR gRNA sequence
tggcagtatggcattagctg

SEQ ID NO: 231027 - DNA, 20 bp, Artificial
  CRISPR gRNA sequence
gctgagaggtgtctgccact

SEQ ID NO: 231028 - DNA, 20 bp, Artificial
  CRISPR gRNA sequence
agaggtgtctgccacttctg

SEQ ID NO: 231029 - DNA, 20 bp, Artificial
  CRISPR gRNA sequence
ccacttctgggtcaatggaa

SEQ ID NO: 231030 - DNA, 20 bp, Artificial
  CRISPR gRNA sequence
ctgggtcaatggaataataa

SEQ ID NO: 231031 - DNA, 20 bp, Artificial
  CRISPR gRNA sequence
tgggtcaatggaataataaa

SEQ ID NO: 231032 - DNA, 20 bp, Artificial
  CRISPR gRNA sequence
ggtcaatggaataataaatt

SEQ ID NO: 231033 - DNA, 20 bp, Artificial
  CRISPR gRNA sequence
agtacaggcaggaatttggt

SEQ ID NO: 231034 - DNA, 20 bp, Artificial
  CRISPR gRNA sequence
ggttgggagcatcttgtatg

SEQ ID NO: 231035 - DNA, 20 bp, Artificial
  CRISPR gRNA sequence
gttgggagcatcttgtatga

SEQ ID NO: 231036 - DNA, 20 bp, Artificial
  CRISPR gRNA sequence
ggagcatcttgtatgatctc

SEQ ID NO: 231037 - DNA, 20 bp, Artificial
  CRISPR gRNA sequence
gtatgatctccgtatgatgt

SEQ ID NO: 231038 - DNA, 20 bp, Artificial
  CRISPR gRNA sequence
tatgatctccgtatgatgtg

SEQ ID NO: 231039 - DNA, 20 bp, Artificial
  CRISPR gRNA sequence
cgtatgatgtgatattgatg

SEQ ID NO: 231040 - DNA, 20 bp, Artificial
  CRISPR gRNA sequence
atggagatagtggtcctcat

SEQ ID NO: 231041 - DNA, 20 bp, Artificial
  CRISPR gRNA sequence
attcttgggggttgccattc

SEQ ID NO: 231042 - DNA, 20 bp, Artificial
  CRISPR gRNA sequence
ttgggggttgccattcccac

SEQ ID NO: 231043 - DNA, 20 bp, Artificial
  CRISPR gRNA sequence
gggggttgccattcccacat

SEQ ID NO: 231044 - DNA, 20 bp, Artificial
  CRISPR gRNA sequence
ggggttgccattcccacatt

SEQ ID NO: 231045 - DNA, 20 bp, Artificial
  CRISPR gRNA sequence
ccattcccacattccccctt

SEQ ID NO: 231046 - DNA, 20 bp, Artificial
  CRISPR gRNA sequence
ccacattcccccttcaacaa

SEQ ID NO: 231047 - DNA, 20 bp, Artificial
  CRISPR gRNA sequence
ccccttcaacaaacagtgta

SEQ ID NO: 231048 - DNA, 20 bp, Artificial
  CRISPR gRNA sequence
caacaaacagtgtaacaggt

SEQ ID NO: 231049 - DNA, 20 bp, Artificial
  CRISPR gRNA sequence
aacaaacagtgtaacaggtc

SEQ ID NO: 231050 - DNA, 20 bp, Artificial
  CRISPR gRNA sequence
cccagatttagggtactttt

SEQ ID NO: 231051 - DNA, 20 bp, Artificial
  CRISPR gRNA sequence
ccagatttagggtactttta

SEQ ID NO: 231052 - DNA, 20 bp, Artificial
  CRISPR gRNA sequence
agggtacttttattgatgga

SEQ ID NO: 231053 - DNA, 20 bp, Artificial
  CRISPR gRNA sequence
gggtacttttattgatggat

SEQ ID NO: 231054 - DNA, 20 bp, Artificial
  CRISPR gRNA sequence
ttattgatggatatgttttc

SEQ ID NO: 231055 - DNA, 20 bp, Artificial
  CRISPR gRNA sequence
tattgatggatatgttttcc

SEQ ID NO: 231056 - DNA, 20 bp, Artificial
  CRISPR gRNA sequence
attgatggatatgttttcct

SEQ ID NO: 231057 - DNA, 20 bp, Artificial
  CRISPR gRNA sequence
ttgatggatatgttttcctt

SEQ ID NO: 231058 - DNA, 20 bp, Artificial
  CRISPR gRNA sequence
atggatatgttttcctttta

SEQ ID NO: 231059 - DNA, 20 bp, Artificial
  CRISPR gRNA sequence
tccttttattcacataaccc

SEQ ID NO: 231060 - DNA, 20 bp, Artificial
  CRISPR gRNA sequence
ccttttattcacataacccc

SEQ ID NO: 231061 - DNA, 20 bp, Artificial
  CRISPR gRNA sequence
cttttattcacataacccct

SEQ ID NO: 231062 - DNA, 20 bp, Artificial
  CRISPR gRNA sequence
ttattcacataaccccttga

SEQ ID NO: 231063 - DNA, 20 bp, Artificial
  CRISPR gRNA sequence
tattcacataaccccttgaa

SEQ ID NO: 231064 - DNA, 20 bp, Artificial
  CRISPR gRNA sequence
attcacataaccccttgaaa

SEQ ID NO: 231065 - DNA, 20 bp, Artificial
  CRISPR gRNA sequence
ttcacataaccccttgaaac

SEQ ID NO: 231066 - DNA, 20 bp, Artificial
  CRISPR gRNA sequence
acataaccccttgaaaccct

SEQ ID NO: 231067 - DNA, 20 bp, Artificial
  CRISPR gRNA sequence
gaaaccctgtcttgtcctcc

SEQ ID NO: 231068 - DNA, 20 bp, Artificial
  CRISPR gRNA sequence
aaaccctgtcttgtcctcct

SEQ ID NO: 231069 - DNA, 20 bp, Artificial
  CRISPR gRNA sequence
tcttgtcctcctgttacttg

SEQ ID NO: 231070 - DNA, 20 bp, Artificial
  CRISPR gRNA sequence
gtcctcctgttacttgcttc

SEQ ID NO: 231071 - DNA, 20 bp, Artificial
  CRISPR gRNA sequence
tcctcctgttacttgcttct

SEQ ID NO: 231072 - DNA, 20 bp, Artificial
  CRISPR gRNA sequence
ctgttacttgcttctgctgt

SEQ ID NO: 231073 - DNA, 20 bp, Artificial
  CRISPR gRNA sequence
ttacttgcttctgctgtaca

SEQ ID NO: 231074 - DNA, 20 bp, Artificial
  CRISPR gRNA sequence
cttgcttctgctgtacaaga

SEQ ID NO: 231075 - DNA, 20 bp, Artificial
  CRISPR gRNA sequence
gcttctgctgtacaagatgt

SEQ ID NO: 231076 - DNA, 20 bp, Artificial
  CRISPR gRNA sequence
cttctgctgtacaagatgta

SEQ ID NO: 231077 - DNA, 20 bp, Artificial
  CRISPR gRNA sequence
ctgctgtacaagatgtagca

SEQ ID NO: 231078 - DNA, 20 bp, Artificial
  CRISPR gRNA sequence
tgctgtacaagatgtagcac

SEQ ID NO: 231079 - DNA, 20 bp, Artificial
  CRISPR gRNA sequence
ctgtacaagatgtagcacct

SEQ ID NO: 231080 - DNA, 20 bp, Artificial
  CRISPR gRNA sequence
tacaagatgtagcacctttt

SEQ ID NO: 231081 - DNA, 20 bp, Artificial
  CRISPR gRNA sequence
ttctcctctttgaacatggt

SEQ ID NO: 231082 - DNA, 20 bp, Artificial
  CRISPR gRNA sequence
tctcctctttgaacatggtc

SEQ ID NO: 231083 - DNA, 20 bp, Artificial
  CRISPR gRNA sequence
ctcctctttgaacatggtct

SEQ ID NO: 231084 - DNA, 20 bp, Artificial
  CRISPR gRNA sequence
tcctctttgaacatggtcta

SEQ ID NO: 231085 - DNA, 20 bp, Artificial
  CRISPR gRNA sequence
ctctttgaacatggtctagt

SEQ ID NO: 231086 - DNA, 20 bp, Artificial
  CRISPR gRNA sequence
tttgaacatggtctagtgac

SEQ ID NO: 231087 - DNA, 20 bp, Artificial
  CRISPR gRNA sequence
tgaacatggtctagtgacac

SEQ ID NO: 231088 - DNA, 20 bp, Artificial
  CRISPR gRNA sequence
gaacatggtctagtgacacg

SEQ ID NO: 231089 - DNA, 20 bp, Artificial
  CRISPR gRNA sequence
aacatggtctagtgacacgg

SEQ ID NO: 231090 - DNA, 20 bp, Artificial
  CRISPR gRNA sequence
gtgacacggtagcaccagtt

SEQ ID NO: 231091 - DNA, 20 bp, Artificial
  CRISPR gRNA sequence
caggaaggagccagacttgt

SEQ ID NO: 231092 - DNA, 20 bp, Artificial
  CRISPR gRNA sequence
gttctcagagcactgtgttc

SEQ ID NO: 231093 - DNA, 20 bp, Artificial
  CRISPR gRNA sequence
ttctcagagcactgtgttca

SEQ ID NO: 231094 - DNA, 20 bp, Artificial
  CRISPR gRNA sequence
tcagagcactgtgttcacac

SEQ ID NO: 231095 - DNA, 20 bp, Artificial
  CRISPR gRNA sequence
agagcactgtgttcacactt

SEQ ID NO: 231096 - DNA, 20 bp, Artificial
  CRISPR gRNA sequence
tgttcacacttttcagcaaa

SEQ ID NO: 231097 - DNA, 20 bp, Artificial
  CRISPR gRNA sequence
acacttttcagcaaaaatag

SEQ ID NO: 231098 - DNA, 20 bp, Artificial
  CRISPR gRNA sequence
ttcagcaaaaatagctatgg

SEQ ID NO: 231099 - DNA, 20 bp, Artificial
  CRISPR gRNA sequence
tcagcaaaaatagctatggt

SEQ ID NO: 231100 - DNA, 20 bp, Artificial
  CRISPR gRNA sequence
cagcaaaaatagctatggtt

SEQ ID NO: 231101 - DNA, 20 bp, Artificial
  CRISPR gRNA sequence
agcaaaaatagctatggttg

SEQ ID NO: 231102 - DNA, 20 bp, Artificial
  CRISPR gRNA sequence
tggttgtaacatatgtattc

SEQ ID NO: 231103 - DNA, 20 bp, Artificial
  CRISPR gRNA sequence
taacatatgtattcccttcc

SEQ ID NO: 231104 - DNA, 20 bp, Artificial
  CRISPR gRNA sequence
ccttcctctgatttgaaggc

SEQ ID NO: 231105 - DNA, 20 bp, Artificial
  CRISPR gRNA sequence
cctctgatttgaaggcaaaa

SEQ ID NO: 231106 - DNA, 20 bp, Artificial
  CRISPR gRNA sequence
ctctgatttgaaggcaaaaa

SEQ ID NO: 231107 - DNA, 20 bp, Artificial
  CRISPR gRNA sequence
tgatttgaaggcaaaaatct

SEQ ID NO: 231108 - DNA, 20 bp, Artificial
  CRISPR gRNA sequence
atttgaaggcaaaaatctac

SEQ ID NO: 231109 - DNA, 20 bp, Artificial
  CRISPR gRNA sequence
gaaggcaaaaatctacagtg

SEQ ID NO: 231110 - DNA, 20 bp, Artificial
  CRISPR gRNA sequence
aaggcaaaaatctacagtgt

SEQ ID NO: 231111 - DNA, 20 bp, Artificial
  CRISPR gRNA sequence
cagtgtttcttcacttcttt

SEQ ID NO: 231112 - DNA, 20 bp, Artificial
  CRISPR gRNA sequence
cttcacttcttttctgatct

SEQ ID NO: 231113 - DNA, 20 bp, Artificial
  CRISPR gRNA sequence
ttcacttcttttctgatctg

SEQ ID NO: 231114 - DNA, 20 bp, Artificial
  CRISPR gRNA sequence
cacttcttttctgatctggg

SEQ ID NO: 231115 - DNA, 20 bp, Artificial
  CRISPR gRNA sequence
acttcttttctgatctgggg

SEQ ID NO: 231116 - DNA, 20 bp, Artificial
  CRISPR gRNA sequence
cttttctgatctggggcatg

SEQ ID NO: 231117 - DNA, 20 bp, Artificial
  CRISPR gRNA sequence
ttttctgatctggggcatga

SEQ ID NO: 231118 - DNA, 20 bp, Artificial
  CRISPR gRNA sequence
ttctgatctggggcatgaaa

SEQ ID NO: 231119 - DNA, 20 bp, Artificial
  CRISPR gRNA sequence
tctgatctggggcatgaaaa

SEQ ID NO: 231120 - DNA, 20 bp, Artificial
  CRISPR gRNA sequence
ctgatctggggcatgaaaaa

SEQ ID NO: 231121 - DNA, 20 bp, Artificial
  CRISPR gRNA sequence
tgatctggggcatgaaaaaa

SEQ ID NO: 231122 - DNA, 20 bp, Artificial
  CRISPR gRNA sequence
atctggggcatgaaaaaagc

SEQ ID NO: 231123 - DNA, 20 bp, Artificial
  CRISPR gRNA sequence
gggcatgaaaaaagcaagat

SEQ ID NO: 231124 - DNA, 20 bp, Artificial
  CRISPR gRNA sequence
aaatttgaactatgagtctc

SEQ ID NO: 231125 - DNA, 20 bp, Artificial
  CRISPR gRNA sequence
gaactatgagtctcctgcat

SEQ ID NO: 231126 - DNA, 20 bp, Artificial
  CRISPR gRNA sequence
aactatgagtctcctgcatg

SEQ ID NO: 231127 - DNA, 20 bp, Artificial
  CRISPR gRNA sequence
tgagtctcctgcatggcaac

SEQ ID NO: 231128 - DNA, 20 bp, Artificial
  CRISPR gRNA sequence
ctgcatggcaacaaaatgtg

SEQ ID NO: 231129 - DNA, 20 bp, Artificial
  CRISPR gRNA sequence
catggcaacaaaatgtgtgt

SEQ ID NO: 231130 - DNA, 20 bp, Artificial
  CRISPR gRNA sequence
gaatggggatttattactgt

SEQ ID NO: 231131 - DNA, 20 bp, Artificial
  CRISPR gRNA sequence
aatggggatttattactgtt

SEQ ID NO: 231132 - DNA, 20 bp, Artificial
  CRISPR gRNA sequence
attactgttgtatctatgtt

SEQ ID NO: 231133 - DNA, 20 bp, Artificial
  CRISPR gRNA sequence
ttactgttgtatctatgttg

SEQ ID NO: 231134 - DNA, 20 bp, Artificial
  CRISPR gRNA sequence
ctgttgtatctatgttgcat

SEQ ID NO: 231135 - DNA, 20 bp, Artificial
  CRISPR gRNA sequence
ttgtatctatgttgcatgat

SEQ ID NO: 231136 - DNA, 20 bp, Artificial
  CRISPR gRNA sequence
tatctatgttgcatgataaa

SEQ ID NO: 231137 - DNA, 20 bp, Artificial
  CRISPR gRNA sequence
tgttgcatgataaacattca

SEQ ID NO: 231138 - DNA, 20 bp, Artificial
  CRISPR gRNA sequence
catgataaacattcatcacc

SEQ ID NO: 231139 - DNA, 20 bp, Artificial
  CRISPR gRNA sequence
atcaccttcctcctgtagtc

SEQ ID NO: 231140 - DNA, 20 bp, Artificial
  CRISPR gRNA sequence
cctcctgtagtcctgcctcg

SEQ ID NO: 231141 - DNA, 20 bp, Artificial
  CRISPR gRNA sequence
ctcctgtagtcctgcctcgt

SEQ ID NO: 231142 - DNA, 20 bp, Artificial
  CRISPR gRNA sequence
ctgtagtcctgcctcgtact

SEQ ID NO: 231143 - DNA, 20 bp, Artificial
  CRISPR gRNA sequence
tagtcctgcctcgtactccc

SEQ ID NO: 231144 - DNA, 20 bp, Artificial
  CRISPR gRNA sequence
cctcgtactccccttcccct

SEQ ID NO: 231145 - DNA, 20 bp, Artificial
  CRISPR gRNA sequence
gtactccccttcccctatga

SEQ ID NO: 231146 - DNA, 20 bp, Artificial
  CRISPR gRNA sequence
cccttcccctatgattgaaa

SEQ ID NO: 231147 - DNA, 20 bp, Artificial
  CRISPR gRNA sequence
cccctatgattgaaaagtaa

SEQ ID NO: 231148 - DNA, 20 bp, Artificial
  CRISPR gRNA sequence
ccctatgattgaaaagtaaa

SEQ ID NO: 231149 - DNA, 20 bp, Artificial
  CRISPR gRNA sequence
tgattgaaaagtaaacaaaa

SEQ ID NO: 231150 - DNA, 20 bp, Artificial
  CRISPR gRNA sequence
aaaagtaaacaaaacccaca

SEQ ID NO: 231151 - DNA, 20 bp, Artificial
  CRISPR gRNA sequence
cctatcctggttagaagaaa

SEQ ID NO: 231152 - DNA, 20 bp, Artificial
  CRISPR gRNA sequence
ctatcctggttagaagaaaa

SEQ ID NO: 231153 - DNA, 20 bp, Artificial
  CRISPR gRNA sequence
tcctggttagaagaaaatta

SEQ ID NO: 231154 - DNA, 20 bp, Artificial
  CRISPR gRNA sequence
gttagaagaaaattaatgtt

SEQ ID NO: 231155 - DNA, 20 bp, Artificial
  CRISPR gRNA sequence
gaagaaaattaatgttctga

SEQ ID NO: 231156 - DNA, 20 bp, Artificial
  CRISPR gRNA sequence
atgttctgacagttgtgatc

SEQ ID NO: 231157 - DNA, 20 bp, Artificial
  CRISPR gRNA sequence
tgacagttgtgatcgcctgg

SEQ ID NO: 231158 - DNA, 20 bp, Artificial
  CRISPR gRNA sequence
acagttgtgatcgcctggag

SEQ ID NO: 231159 - DNA, 20 bp, Artificial
  CRISPR gRNA sequence
tgatcgcctggagtactttt

SEQ ID NO: 231160 - DNA, 20 bp, Artificial
  CRISPR gRNA sequence
gagtacttttagacttttag

SEQ ID NO: 231161 - DNA, 20 bp, Artificial
  CRISPR gRNA sequence
ttagacttttagcattcgtt

SEQ ID NO: 231162 - DNA, 20 bp, Artificial
  CRISPR gRNA sequence
tagacttttagcattcgttt

SEQ ID NO: 231163 - DNA, 20 bp, Artificial
  CRISPR gRNA sequence
agacttttagcattcgtttt

SEQ ID NO: 231164 - DNA, 20 bp, Artificial
  CRISPR gRNA sequence
gacttttagcattcgttttt

SEQ ID NO: 231165 - DNA, 20 bp, Artificial
  CRISPR gRNA sequence
ttagcattcgttttttacct

SEQ ID NO: 231166 - DNA, 20 bp, Artificial
  CRISPR gRNA sequence
tagcattcgttttttacctg

SEQ ID NO: 231167 - DNA, 20 bp, Artificial
  CRISPR gRNA sequence
agcattcgttttttacctgt

SEQ ID NO: 231168 - DNA, 20 bp, Artificial
  CRISPR gRNA sequence
gcattcgttttttacctgtt

SEQ ID NO: 231169 - DNA, 20 bp, Artificial
  CRISPR gRNA sequence
gttttttacctgtttgtgga

SEQ ID NO: 231170 - DNA, 20 bp, Artificial
  CRISPR gRNA sequence
tttacctgtttgtggatgtg

SEQ ID NO: 231171 - DNA, 20 bp, Artificial
  CRISPR gRNA sequence
ttacctgtttgtggatgtgt

SEQ ID NO: 231172 - DNA, 20 bp, Artificial
  CRISPR gRNA sequence
tacctgtttgtggatgtgtg

SEQ ID NO: 231173 - DNA, 20 bp, Artificial
  CRISPR gRNA sequence
acctgtttgtggatgtgtgt

SEQ ID NO: 231174 - DNA, 20 bp, Artificial
  CRISPR gRNA sequence
cctgtttgtggatgtgtgtt

SEQ ID NO: 231175 - DNA, 20 bp, Artificial
  CRISPR gRNA sequence
tttgtggatgtgtgtttgta

SEQ ID NO: 231176 - DNA, 20 bp, Artificial
  CRISPR gRNA sequence
gtggatgtgtgtttgtatgt

SEQ ID NO: 231177 - DNA, 20 bp, Artificial
  CRISPR gRNA sequence
tggatgtgtgtttgtatgtg

SEQ ID NO: 231178 - DNA, 20 bp, Artificial
  CRISPR gRNA sequence
gtatgtgcatacgtatgaga

SEQ ID NO: 231179 - DNA, 20 bp, Artificial
  CRISPR gRNA sequence
tatgtgcatacgtatgagat

SEQ ID NO: 231180 - DNA, 20 bp, Artificial
  CRISPR gRNA sequence
ctgtatggacaaaggtgggg

SEQ ID NO: 231181 - DNA, 20 bp, Artificial
  CRISPR gRNA sequence
tgtatggacaaaggtggggt

SEQ ID NO: 231182 - DNA, 20 bp, Artificial
  CRISPR gRNA sequence
tatggacaaaggtggggtac

SEQ ID NO: 231183 - DNA, 20 bp, Artificial
  CRISPR gRNA sequence
caggagagcaaaggttaatt

SEQ ID NO: 231184 - DNA, 20 bp, Artificial
  CRISPR gRNA sequence
attttgtgcttttagtaaaa

SEQ ID NO: 231185 - DNA, 20 bp, Artificial
  CRISPR gRNA sequence
tgtgcttttagtaaaaacat

SEQ ID NO: 231186 - DNA, 20 bp, Artificial
  CRISPR gRNA sequence
gtgcttttagtaaaaacatt

SEQ ID NO: 231187 - DNA, 20 bp, Artificial
  CRISPR gRNA sequence
tgcttttagtaaaaacattt

SEQ ID NO: 231188 - DNA, 20 bp, Artificial
  CRISPR gRNA sequence
ttagtaaaaacatttaaata

SEQ ID NO: 231189 - DNA, 20 bp, Artificial
  CRISPR gRNA sequence
tagtaaaaacatttaaatac

SEQ ID NO: 231190 - DNA, 20 bp, Artificial
  CRISPR gRNA sequence
agtaaaaacatttaaataca

SEQ ID NO: 231191 - DNA, 20 bp, Artificial
  CRISPR gRNA sequence
gtaaaaacatttaaatacaa

SEQ ID NO: 231192 - DNA, 20 bp, Artificial
  CRISPR gRNA sequence
aaatacaaagttctttattg

SEQ ID NO: 231193 - DNA, 20 bp, Artificial
  CRISPR gRNA sequence
aatacaaagttctttattgg

SEQ ID NO: 231194 - DNA, 20 bp, Artificial
  CRISPR gRNA sequence
tttattgggtggaattatat

SEQ ID NO: 231195 - DNA, 20 bp, Artificial
  CRISPR gRNA sequence
tattgggtggaattatattt

SEQ ID NO: 231196 - DNA, 20 bp, Artificial
  CRISPR gRNA sequence
attgggtggaattatatttg

SEQ ID NO: 231197 - DNA, 20 bp, Artificial
  CRISPR gRNA sequence
ttgggtggaattatatttga

SEQ ID NO: 231198 - DNA, 20 bp, Artificial
  CRISPR gRNA sequence
ggtggaattatatttgatgc

SEQ ID NO: 231199 - DNA, 20 bp, Artificial
  CRISPR gRNA sequence
tatttgatgcaaatatttga

SEQ ID NO: 231200 - DNA, 20 bp, Artificial
  CRISPR gRNA sequence
gatgcaaatatttgatcact

SEQ ID NO: 231201 - DNA, 20 bp, Artificial
  CRISPR gRNA sequence
atgcaaatatttgatcactt

SEQ ID NO: 231202 - DNA, 20 bp, Artificial
  CRISPR gRNA sequence
gatcacttaaaacttttaaa

SEQ ID NO: 231203 - DNA, 20 bp, Artificial
  CRISPR gRNA sequence
atcacttaaaacttttaaaa

SEQ ID NO: 231204 - DNA, 20 bp, Artificial
  CRISPR gRNA sequence
aaaacttttaaaacttctag

SEQ ID NO: 231205 - DNA, 20 bp, Artificial
  CRISPR gRNA sequence
aaacttttaaaacttctagg

SEQ ID NO: 231206 - DNA, 20 bp, Artificial
  CRISPR gRNA sequence
ttaaaacttctaggtaattt

SEQ ID NO: 231207 - DNA, 20 bp, Artificial
  CRISPR gRNA sequence
taaaacttctaggtaatttg

SEQ ID NO: 231208 - DNA, 20 bp, Artificial
  CRISPR gRNA sequence
aaaacttctaggtaatttgc

SEQ ID NO: 231209 - DNA, 20 bp, Artificial
  CRISPR gRNA sequence
aaacttctaggtaatttgcc

SEQ ID NO: 231210 - DNA, 20 bp, Artificial
  CRISPR gRNA sequence
ctaggtaatttgccacgctt

SEQ ID NO: 231211 - DNA, 20 bp, Artificial
  CRISPR gRNA sequence
taggtaatttgccacgcttt

SEQ ID NO: 231212 - DNA, 20 bp, Artificial
  CRISPR gRNA sequence
ggtaatttgccacgcttttt

SEQ ID NO: 231213 - DNA, 20 bp, Artificial
  CRISPR gRNA sequence
gccacgctttttgactgctc

SEQ ID NO: 231214 - DNA, 20 bp, Artificial
  CRISPR gRNA sequence
ccacgctttttgactgctca

SEQ ID NO: 231215 - DNA, 20 bp, Artificial
  CRISPR gRNA sequence
tttgactgctcaccaatacc

SEQ ID NO: 231216 - DNA, 20 bp, Artificial
  CRISPR gRNA sequence
ttgactgctcaccaataccc

SEQ ID NO: 231217 - DNA, 20 bp, Artificial
  CRISPR gRNA sequence
tgactgctcaccaataccct

SEQ ID NO: 231218 - DNA, 20 bp, Artificial
  CRISPR gRNA sequence
gactgctcaccaataccctg

SEQ ID NO: 231219 - DNA, 20 bp, Artificial
  CRISPR gRNA sequence
actgctcaccaataccctgt

SEQ ID NO: 231220 - DNA, 20 bp, Artificial
  CRISPR gRNA sequence
ctcaccaataccctgtaaaa

SEQ ID NO: 231221 - DNA, 20 bp, Artificial
  CRISPR gRNA sequence
accaataccctgtaaaaata

SEQ ID NO: 231222 - DNA, 20 bp, Artificial
  CRISPR gRNA sequence
taaaaatacgtaattcttcc

SEQ ID NO: 231223 - DNA, 20 bp, Artificial
  CRISPR gRNA sequence
ttcctgtttgtgtaataaga

SEQ ID NO: 231224 - DNA, 20 bp, Artificial
  CRISPR gRNA sequence
cctgtttgtgtaataagata

SEQ ID NO: 231225 - DNA, 20 bp, Artificial
  CRISPR gRNA sequence
ctgtttgtgtaataagatat

SEQ ID NO: 231226 - DNA, 20 bp, Artificial
  CRISPR gRNA sequence
tttgtgtaataagatattca

SEQ ID NO: 231227 - DNA, 20 bp, Artificial
  CRISPR gRNA sequence
gtgtaataagatattcatat

SEQ ID NO: 231228 - DNA, 20 bp, Artificial
  CRISPR gRNA sequence
tgtaataagatattcatatt

SEQ ID NO: 231229 - DNA, 20 bp, Artificial
  CRISPR gRNA sequence
atatttgtagttgcattaat

SEQ ID NO: 231230 - DNA, 20 bp, Artificial
  CRISPR gRNA sequence
gtagttgcattaataatagt

SEQ ID NO: 231231 - DNA, 20 bp, Artificial
  CRISPR gRNA sequence
tagttgcattaataatagtt

SEQ ID NO: 231232 - DNA, 20 bp, Artificial
  CRISPR gRNA sequence
cattaataatagttatttct

SEQ ID NO: 231233 - DNA, 20 bp, Artificial
  CRISPR gRNA sequence
ataatagttatttcttagtc

SEQ ID NO: 231234 - DNA, 20 bp, Artificial
  CRISPR gRNA sequence
tttcttagtccatcagatgt

SEQ ID NO: 231235 - DNA, 20 bp, Artificial
  CRISPR gRNA sequence
cttagtccatcagatgttcc

SEQ ID NO: 231236 - DNA, 20 bp, Artificial
  CRISPR gRNA sequence
ttagtccatcagatgttccc

SEQ ID NO: 231237 - DNA, 20 bp, Artificial
  CRISPR gRNA sequence
agtccatcagatgttcccgt

SEQ ID NO: 231238 - DNA, 20 bp, Artificial
  CRISPR gRNA sequence
gtccatcagatgttcccgtg

SEQ ID NO: 231239 - DNA, 20 bp, Artificial
  CRISPR gRNA sequence
ccgtgtgcctcttttatgcc

SEQ ID NO: 231240 - DNA, 20 bp, Artificial
  CRISPR gRNA sequence
ttttatgccaaattgattgt

SEQ ID NO: 231241 - DNA, 20 bp, Artificial
  CRISPR gRNA sequence
ttatgccaaattgattgtca

SEQ ID NO: 231242 - DNA, 20 bp, Artificial
  CRISPR gRNA sequence
tatgccaaattgattgtcat

SEQ ID NO: 231243 - DNA, 20 bp, Artificial
  CRISPR gRNA sequence
atgccaaattgattgtcata

SEQ ID NO: 231244 - DNA, 20 bp, Artificial
  CRISPR gRNA sequence
tgccaaattgattgtcatat

SEQ ID NO: 231245 - DNA, 20 bp, Artificial
  CRISPR gRNA sequence
attgtcatatttcatgttgg

SEQ ID NO: 231246 - DNA, 20 bp, Artificial
  CRISPR gRNA sequence
tcatatttcatgttgggacc

SEQ ID NO: 231247 - DNA, 20 bp, Artificial
  CRISPR gRNA sequence
catgttgggaccaagtagtt

SEQ ID NO: 231248 - DNA, 20 bp, Artificial
  CRISPR gRNA sequence
atgttgggaccaagtagttt

SEQ ID NO: 231249 - DNA, 20 bp, Artificial
  CRISPR gRNA sequence
ggaccaagtagtttgcccat

SEQ ID NO: 231250 - DNA, 20 bp, Artificial
  CRISPR gRNA sequence
gcccatggcaaacctaaatt

SEQ ID NO: 231251 - DNA, 20 bp, Artificial
  CRISPR gRNA sequence
cccatggcaaacctaaattt

SEQ ID NO: 231252 - DNA, 20 bp, Artificial
  CRISPR gRNA sequence
aatttatgacctgctgaggc

SEQ ID NO: 231253 - DNA, 20 bp, Artificial
  CRISPR gRNA sequence
atgacctgctgaggcctctc

SEQ ID NO: 231254 - DNA, 20 bp, Artificial
  CRISPR gRNA sequence
tgacctgctgaggcctctca

SEQ ID NO: 231255 - DNA, 20 bp, Artificial
  CRISPR gRNA sequence
ctgaggcctctcagaaaact

SEQ ID NO: 231256 - DNA, 20 bp, Artificial
  CRISPR gRNA sequence
aggcctctcagaaaactgag

SEQ ID NO: 231257 - DNA, 20 bp, Artificial
  CRISPR gRNA sequence
tcagaaaactgagcatacta

SEQ ID NO: 231258 - DNA, 20 bp, Artificial
  CRISPR gRNA sequence
agaaaactgagcatactagc

SEQ ID NO: 231259 - DNA, 20 bp, Artificial
  CRISPR gRNA sequence
agcatactagcaagacagct

SEQ ID NO: 231260 - DNA, 20 bp, Artificial
  CRISPR gRNA sequence
gcaagacagctcttcttgaa

SEQ ID NO: 231261 - DNA, 20 bp, Artificial
  CRISPR gRNA sequence
ttcttgaaaaaaaaaatatg

SEQ ID NO: 231262 - DNA, 20 bp, Artificial
  CRISPR gRNA sequence
cttgaaaaaaaaaatatgta

SEQ ID NO: 231263 - DNA, 20 bp, Artificial
  CRISPR gRNA sequence
ttgaaaaaaaaaatatgtat

SEQ ID NO: 231264 - DNA, 20 bp, Artificial
  CRISPR gRNA sequence
gaaaaaaaaaatatgtatac

SEQ ID NO: 231265 - DNA, 20 bp, Artificial
  CRISPR gRNA sequence
aaaaaaaaaatatgtataca

SEQ ID NO: 231266 - DNA, 20 bp, Artificial
  CRISPR gRNA sequence
tatatacgtatgtatataca

SEQ ID NO: 231267 - DNA, 20 bp, Artificial
  CRISPR gRNA sequence
ttccttgattgtgtagctgt

SEQ ID NO: 231268 - DNA, 20 bp, Artificial
  CRISPR gRNA sequence
ccttgattgtgtagctgtcc

SEQ ID NO: 231269 - DNA, 20 bp, Artificial
  CRISPR gRNA sequence
cttgattgtgtagctgtcca

SEQ ID NO: 231270 - DNA, 20 bp, Artificial
  CRISPR gRNA sequence
gattgtgtagctgtccaaaa

SEQ ID NO: 231271 - DNA, 20 bp, Artificial
  CRISPR gRNA sequence
attgtgtagctgtccaaaat

SEQ ID NO: 231272 - DNA, 20 bp, Artificial
  CRISPR gRNA sequence
tgtagctgtccaaaataata

SEQ ID NO: 231273 - DNA, 20 bp, Artificial
  CRISPR gRNA sequence
tccaaaataataacatatat

SEQ ID NO: 231274 - DNA, 20 bp, Artificial
  CRISPR gRNA sequence
tattcctttatacaaatctg

SEQ ID NO: 231275 - DNA, 20 bp, Artificial
  CRISPR gRNA sequence
ctttatacaaatctgatggc

SEQ ID NO: 231276 - DNA, 20 bp, Artificial
  CRISPR gRNA sequence
tatacaaatctgatggctcc

SEQ ID NO: 231277 - DNA, 20 bp, Artificial
  CRISPR gRNA sequence
atacaaatctgatggctcct

SEQ ID NO: 231278 - DNA, 20 bp, Artificial
  CRISPR gRNA sequence
tacaaatctgatggctcctg

SEQ ID NO: 231279 - DNA, 20 bp, Artificial
  CRISPR gRNA sequence
atggctcctgcagcactttt

SEQ ID NO: 231280 - DNA, 20 bp, Artificial
  CRISPR gRNA sequence
ctgcagcactttttccttct

SEQ ID NO: 231281 - DNA, 20 bp, Artificial
  CRISPR gRNA sequence
cagcactttttccttctgaa

SEQ ID NO: 231282 - DNA, 20 bp, Artificial
  CRISPR gRNA sequence
tttccttctgaaaatattta

SEQ ID NO: 231283 - DNA, 20 bp, Artificial
  CRISPR gRNA sequence
ttccttctgaaaatatttac

SEQ ID NO: 231284 - DNA, 20 bp, Artificial
  CRISPR gRNA sequence
tccttctgaaaatatttaca

SEQ ID NO: 231285 - DNA, 20 bp, Artificial
  CRISPR gRNA sequence
ccttctgaaaatatttacat

SEQ ID NO: 231286 - DNA, 20 bp, Artificial
  CRISPR gRNA sequence
cttctgaaaatatttacatt

SEQ ID NO: 231287 - DNA, 20 bp, Artificial
  CRISPR gRNA sequence
ctgaaaatatttacattttg

SEQ ID NO: 231288 - DNA, 20 bp, Artificial
  CRISPR gRNA sequence
tgaaaatatttacattttgc

SEQ ID NO: 231289 - DNA, 20 bp, Artificial
  CRISPR gRNA sequence
aaaatatttacattttgcta

SEQ ID NO: 231290 - DNA, 20 bp, Artificial
  CRISPR gRNA sequence
acattttgctaacctagttt

SEQ ID NO: 231291 - DNA, 20 bp, Artificial
  CRISPR gRNA sequence
cattttgctaacctagtttg

SEQ ID NO: 231292 - DNA, 20 bp, Artificial
  CRISPR gRNA sequence
tgctaacctagtttgttact

SEQ ID NO: 231293 - DNA, 20 bp, Artificial
  CRISPR gRNA sequence
gctaacctagtttgttactt

SEQ ID NO: 231294 - DNA, 20 bp, Artificial
  CRISPR gRNA sequence
ctaacctagtttgttacttt

SEQ ID NO: 231295 - DNA, 20 bp, Artificial
  CRISPR gRNA sequence
acctagtttgttactttaaa

SEQ ID NO: 231296 - DNA, 20 bp, Artificial
  CRISPR gRNA sequence
gtttgttactttaaaaatca

SEQ ID NO: 231297 - DNA, 20 bp, Artificial
  CRISPR gRNA sequence
gttactttaaaaatcagttt

SEQ ID NO: 231298 - DNA, 20 bp, Artificial
  CRISPR gRNA sequence
ttactttaaaaatcagtttt

SEQ ID NO: 231299 - DNA, 20 bp, Artificial
  CRISPR gRNA sequence
ctttaaaaatcagttttgat

SEQ ID NO: 231300 - DNA, 20 bp, Artificial
  CRISPR gRNA sequence
taaaaatcagttttgatgaa

SEQ ID NO: 231301 - DNA, 20 bp, Artificial
  CRISPR gRNA sequence
aaaaatcagttttgatgaaa

SEQ ID NO: 231302 - DNA, 20 bp, Artificial
  CRISPR gRNA sequence
aaaatcagttttgatgaaag

SEQ ID NO: 231303 - DNA, 20 bp, Artificial
  CRISPR gRNA sequence
tgatgaaaggagggaaaagc

SEQ ID NO: 231304 - DNA, 20 bp, Artificial
  CRISPR gRNA sequence
gatgaaaggagggaaaagca

SEQ ID NO: 231305 - DNA, 20 bp, Artificial
  CRISPR gRNA sequence
atgaaaggagggaaaagcag

SEQ ID NO: 231306 - DNA, 20 bp, Artificial
  CRISPR gRNA sequence
gaaaaagatccaagctccta

SEQ ID NO: 231307 - DNA, 20 bp, Artificial
  CRISPR gRNA sequence
aaaaagatccaagctcctat

SEQ ID NO: 231308 - DNA, 20 bp, Artificial
  CRISPR gRNA sequence
ctattagaaaaggtatgaaa

SEQ ID NO: 231309 - DNA, 20 bp, Artificial
  CRISPR gRNA sequence
ttagaaaaggtatgaaaatc

SEQ ID NO: 231310 - DNA, 20 bp, Artificial
  CRISPR gRNA sequence
gaaaaggtatgaaaatcttt

SEQ ID NO: 231311 - DNA, 20 bp, Artificial
  CRISPR gRNA sequence
tatagtaaaattttttataa

SEQ ID NO: 231312 - DNA, 20 bp, Artificial
  CRISPR gRNA sequence
atagtaaaattttttataaa

SEQ ID NO: 231313 - DNA, 20 bp, Artificial
  CRISPR gRNA sequence
tagtaaaattttttataaac

SEQ ID NO: 231314 - DNA, 20 bp, Artificial
  CRISPR gRNA sequence
tttataaactaaagttgtac

SEQ ID NO: 231315 - DNA, 20 bp, Artificial
  CRISPR gRNA sequence
ttataaactaaagttgtacc

SEQ ID NO: 231316 - DNA, 20 bp, Artificial
  CRISPR gRNA sequence
tataaactaaagttgtacct

SEQ ID NO: 231317 - DNA, 20 bp, Artificial
  CRISPR gRNA sequence
ataaactaaagttgtacctt

SEQ ID NO: 231318 - DNA, 20 bp, Artificial
  CRISPR gRNA sequence
taaactaaagttgtaccttt

SEQ ID NO: 231319 - DNA, 20 bp, Artificial
  CRISPR gRNA sequence
aagttgtaccttttaatatg

SEQ ID NO: 231320 - DNA, 20 bp, Artificial
  CRISPR gRNA sequence
taccttttaatatgtagtaa

SEQ ID NO: 231321 - DNA, 20 bp, Artificial
  CRISPR gRNA sequence
ttaatatgtagtaaactctc

SEQ ID NO: 231322 - DNA, 20 bp, Artificial
  CRISPR gRNA sequence
taatatgtagtaaactctca

SEQ ID NO: 231323 - DNA, 20 bp, Artificial
  CRISPR gRNA sequence
aatatgtagtaaactctcat

SEQ ID NO: 231324 - DNA, 20 bp, Artificial
  CRISPR gRNA sequence
atatgtagtaaactctcatt

SEQ ID NO: 231325 - DNA, 20 bp, Artificial
  CRISPR gRNA sequence
tcatttatttggggttcgct

SEQ ID NO: 231326 - DNA, 20 bp, Artificial
  CRISPR gRNA sequence
atttatttggggttcgctct

SEQ ID NO: 231327 - DNA, 20 bp, Artificial
  CRISPR gRNA sequence
atttggggttcgctcttgga

SEQ ID NO: 231328 - DNA, 20 bp, Artificial
  CRISPR gRNA sequence
tttggggttcgctcttggat

SEQ ID NO: 231329 - DNA, 20 bp, Artificial
  CRISPR gRNA sequence
ggggttcgctcttggatctc

SEQ ID NO: 231330 - DNA, 20 bp, Artificial
  CRISPR gRNA sequence
gggttcgctcttggatctca

SEQ ID NO: 231331 - DNA, 20 bp, Artificial
  CRISPR gRNA sequence
gctcttggatctcatccatc

SEQ ID NO: 231332 - DNA, 20 bp, Artificial
  CRISPR gRNA sequence
ttggatctcatccatccatt

SEQ ID NO: 231333 - DNA, 20 bp, Artificial
  CRISPR gRNA sequence
ggatctcatccatccattgt

SEQ ID NO: 231334 - DNA, 20 bp, Artificial
  CRISPR gRNA sequence
gatctcatccatccattgtg

SEQ ID NO: 231335 - DNA, 20 bp, Artificial
  CRISPR gRNA sequence
atccatccattgtgttctct

SEQ ID NO: 231336 - DNA, 20 bp, Artificial
  CRISPR gRNA sequence
tgttctctttaatgctgcct

SEQ ID NO: 231337 - DNA, 20 bp, Artificial
  CRISPR gRNA sequence
tctttaatgctgcctgcctt

SEQ ID NO: 231338 - DNA, 20 bp, Artificial
  CRISPR gRNA sequence
tttaatgctgcctgcctttt

SEQ ID NO: 231339 - DNA, 20 bp, Artificial
  CRISPR gRNA sequence
taatgctgcctgccttttga

SEQ ID NO: 231340 - DNA, 20 bp, Artificial
  CRISPR gRNA sequence
aatgctgcctgccttttgag

SEQ ID NO: 231341 - DNA, 20 bp, Artificial
  CRISPR gRNA sequence
atgctgcctgccttttgagg

SEQ ID NO: 231342 - DNA, 20 bp, Artificial
  CRISPR gRNA sequence
cctgccttttgaggcattca

SEQ ID NO: 231343 - DNA, 20 bp, Artificial
  CRISPR gRNA sequence
ccttttgaggcattcactgc

SEQ ID NO: 231344 - DNA, 20 bp, Artificial
  CRISPR gRNA sequence
ttgaggcattcactgcccta

SEQ ID NO: 231345 - DNA, 20 bp, Artificial
  CRISPR gRNA sequence
tgaggcattcactgccctag

SEQ ID NO: 231346 - DNA, 20 bp, Artificial
  CRISPR gRNA sequence
gaggcattcactgccctaga

SEQ ID NO: 231347 - DNA, 20 bp, Artificial
  CRISPR gRNA sequence
aggcattcactgccctagac

SEQ ID NO: 231348 - DNA, 20 bp, Artificial
  CRISPR gRNA sequence
actgccctagacaatgccac

SEQ ID NO: 231349 - DNA, 20 bp, Artificial
  CRISPR gRNA sequence
ccctagacaatgccaccaga

SEQ ID NO: 231350 - DNA, 20 bp, Artificial
  CRISPR gRNA sequence
gacaatgccaccagagatag

SEQ ID NO: 231351 - DNA, 20 bp, Artificial
  CRISPR gRNA sequence
ttgctctcactagttgtcag

SEQ ID NO: 231352 - DNA, 20 bp, Artificial
  CRISPR gRNA sequence
gctctcactagttgtcagct

SEQ ID NO: 231353 - DNA, 20 bp, Artificial
  CRISPR gRNA sequence
ctctcactagttgtcagctt

SEQ ID NO: 231354 - DNA, 20 bp, Artificial
  CRISPR gRNA sequence
tcactagttgtcagcttctc

SEQ ID NO: 231355 - DNA, 20 bp, Artificial
  CRISPR gRNA sequence
actagttgtcagcttctctg

SEQ ID NO: 231356 - DNA, 20 bp, Artificial
  CRISPR gRNA sequence
gttgtcagcttctctggata

SEQ ID NO: 231357 - DNA, 20 bp, Artificial
  CRISPR gRNA sequence
tcagcttctctggataagtg

SEQ ID NO: 231358 - DNA, 20 bp, Artificial
  CRISPR gRNA sequence
ctctggataagtgaccacag

SEQ ID NO: 231359 - DNA, 20 bp, Artificial
  CRISPR gRNA sequence
tctggataagtgaccacaga

SEQ ID NO: 231360 - DNA, 20 bp, Artificial
  CRISPR gRNA sequence
tggataagtgaccacagaag

SEQ ID NO: 231361 - DNA, 20 bp, Artificial
  CRISPR gRNA sequence
gataagtgaccacagaagca

SEQ ID NO: 231362 - DNA, 20 bp, Artificial
  CRISPR gRNA sequence
ctgcttgggcatcattgggc

SEQ ID NO: 231363 - DNA, 20 bp, Artificial
  CRISPR gRNA sequence
cttgggcatcattgggccag

SEQ ID NO: 231364 - DNA, 20 bp, Artificial
  CRISPR gRNA sequence
gggcatcattgggccagttc

SEQ ID NO: 231365 - DNA, 20 bp, Artificial
  CRISPR gRNA sequence
ggcatcattgggccagttcc

SEQ ID NO: 231366 - DNA, 20 bp, Artificial
  CRISPR gRNA sequence
ggccagttccttctctttaa

SEQ ID NO: 231367 - DNA, 20 bp, Artificial
  CRISPR gRNA sequence
cttctctttaaatcagattt

SEQ ID NO: 231368 - DNA, 20 bp, Artificial
  CRISPR gRNA sequence
ctctttaaatcagatttgta

SEQ ID NO: 231369 - DNA, 20 bp, Artificial
  CRISPR gRNA sequence
tctttaaatcagatttgtaa

SEQ ID NO: 231370 - DNA, 20 bp, Artificial
  CRISPR gRNA sequence
tttaaatcagatttgtaatg

SEQ ID NO: 231371 - DNA, 20 bp, Artificial
  CRISPR gRNA sequence
taaatcagatttgtaatggc

SEQ ID NO: 231372 - DNA, 20 bp, Artificial
  CRISPR gRNA sequence
aaatcagatttgtaatggct

SEQ ID NO: 231373 - DNA, 20 bp, Artificial
  CRISPR gRNA sequence
aatcagatttgtaatggctc

SEQ ID NO: 231374 - DNA, 20 bp, Artificial
  CRISPR gRNA sequence
gtaatggctcccaaattcca

SEQ ID NO: 231375 - DNA, 20 bp, Artificial
  CRISPR gRNA sequence
taatggctcccaaattccat

SEQ ID NO: 231376 - DNA, 20 bp, Artificial
  CRISPR gRNA sequence
ccaaattccatcacatcaca

SEQ ID NO: 231377 - DNA, 20 bp, Artificial
  CRISPR gRNA sequence
catcacatcacatttaaatt

SEQ ID NO: 231378 - DNA, 20 bp, Artificial
  CRISPR gRNA sequence
aaattgcagacagtgttttg

SEQ ID NO: 231379 - DNA, 20 bp, Artificial
  CRISPR gRNA sequence
aattgcagacagtgttttgc

SEQ ID NO: 231380 - DNA, 20 bp, Artificial
  CRISPR gRNA sequence
cagacagtgttttgcacatc

SEQ ID NO: 231381 - DNA, 20 bp, Artificial
  CRISPR gRNA sequence
tgcacatcatgtatctgttt

SEQ ID NO: 231382 - DNA, 20 bp, Artificial
  CRISPR gRNA sequence
gcacatcatgtatctgtttt

SEQ ID NO: 231383 - DNA, 20 bp, Artificial
  CRISPR gRNA sequence
cacatcatgtatctgttttg

SEQ ID NO: 231384 - DNA, 20 bp, Artificial
  CRISPR gRNA sequence
ttttgtcccataatatgctt

SEQ ID NO: 231385 - DNA, 20 bp, Artificial
  CRISPR gRNA sequence
tgtcccataatatgcttttt

SEQ ID NO: 231386 - DNA, 20 bp, Artificial
  CRISPR gRNA sequence
gtcccataatatgcttttta

SEQ ID NO: 231387 - DNA, 20 bp, Artificial
  CRISPR gRNA sequence
tcccataatatgctttttac

SEQ ID NO: 231388 - DNA, 20 bp, Artificial
  CRISPR gRNA sequence
tttactccctgatcccagtt

SEQ ID NO: 231389 - DNA, 20 bp, Artificial
  CRISPR gRNA sequence
ttactccctgatcccagttt

SEQ ID NO: 231390 - DNA, 20 bp, Artificial
  CRISPR gRNA sequence
tactccctgatcccagtttc

SEQ ID NO: 231391 - DNA, 20 bp, Artificial
  CRISPR gRNA sequence
actccctgatcccagtttct

SEQ ID NO: 231392 - DNA, 20 bp, Artificial
  CRISPR gRNA sequence
ctccctgatcccagtttctg

SEQ ID NO: 231393 - DNA, 20 bp, Artificial
  CRISPR gRNA sequence
cctgatcccagtttctgctg

SEQ ID NO: 231394 - DNA, 20 bp, Artificial
  CRISPR gRNA sequence
atcccagtttctgctgttga

SEQ ID NO: 231395 - DNA, 20 bp, Artificial
  CRISPR gRNA sequence
ctgctgttgactcttccatt

SEQ ID NO: 231396 - DNA, 20 bp, Artificial
  CRISPR gRNA sequence
tgctgttgactcttccattc

SEQ ID NO: 231397 - DNA, 20 bp, Artificial
  CRISPR gRNA sequence
ctgttgactcttccattcag

SEQ ID NO: 231398 - DNA, 20 bp, Artificial
  CRISPR gRNA sequence
ttgactcttccattcagttt

SEQ ID NO: 231399 - DNA, 20 bp, Artificial
  CRISPR gRNA sequence
actcttccattcagttttat

SEQ ID NO: 231400 - DNA, 20 bp, Artificial
  CRISPR gRNA sequence
ttccattcagttttatttat

SEQ ID NO: 231401 - DNA, 20 bp, Artificial
  CRISPR gRNA sequence
ccattcagttttatttattg

SEQ ID NO: 231402 - DNA, 20 bp, Artificial
  CRISPR gRNA sequence
cattcagttttatttattgt

SEQ ID NO: 231403 - DNA, 20 bp, Artificial
  CRISPR gRNA sequence
agttttatttattgtgtgtt

SEQ ID NO: 231404 - DNA, 20 bp, Artificial
  CRISPR gRNA sequence
tatttattgtgtgttctcac

SEQ ID NO: 231405 - DNA, 20 bp, Artificial
  CRISPR gRNA sequence
atttattgtgtgttctcaca

SEQ ID NO: 231406 - DNA, 20 bp, Artificial
  CRISPR gRNA sequence
tttattgtgtgttctcacag

SEQ ID NO: 231407 - DNA, 20 bp, Artificial
  CRISPR gRNA sequence
attgtgtgttctcacagtga

SEQ ID NO: 231408 - DNA, 20 bp, Artificial
  CRISPR gRNA sequence
ttgtgtgttctcacagtgac

SEQ ID NO: 231409 - DNA, 20 bp, Artificial
  CRISPR gRNA sequence
tgtgttctcacagtgacacc

SEQ ID NO: 231410 - DNA, 20 bp, Artificial
  CRISPR gRNA sequence
tcacagtgacaccatttgtc

SEQ ID NO: 231411 - DNA, 20 bp, Artificial
  CRISPR gRNA sequence
acagtgacaccatttgtcct

SEQ ID NO: 231412 - DNA, 20 bp, Artificial
  CRISPR gRNA sequence
gtccttttctgcaacaacct

SEQ ID NO: 231413 - DNA, 20 bp, Artificial
  CRISPR gRNA sequence
tccttttctgcaacaacctt

SEQ ID NO: 231414 - DNA, 20 bp, Artificial
  CRISPR gRNA sequence
ttctgcaacaacctttccag

SEQ ID NO: 231415 - DNA, 20 bp, Artificial
  CRISPR gRNA sequence
tctgcaacaacctttccagc

SEQ ID NO: 231416 - DNA, 20 bp, Artificial
  CRISPR gRNA sequence
ctgcaacaacctttccagct

SEQ ID NO: 231417 - DNA, 20 bp, Artificial
  CRISPR gRNA sequence
tgcaacaacctttccagcta

SEQ ID NO: 231418 - DNA, 20 bp, Artificial
  CRISPR gRNA sequence
caacaacctttccagctact

SEQ ID NO: 231419 - DNA, 20 bp, Artificial
  CRISPR gRNA sequence
tccagctacttttgccaaat

SEQ ID NO: 231420 - DNA, 20 bp, Artificial
  CRISPR gRNA sequence
ccagctacttttgccaaatt

SEQ ID NO: 231421 - DNA, 20 bp, Artificial
  CRISPR gRNA sequence
cagctacttttgccaaattc

SEQ ID NO: 231422 - DNA, 20 bp, Artificial
  CRISPR gRNA sequence
cttttgccaaattctatttg

SEQ ID NO: 231423 - DNA, 20 bp, Artificial
  CRISPR gRNA sequence
ttgccaaattctatttgtct

SEQ ID NO: 231424 - DNA, 20 bp, Artificial
  CRISPR gRNA sequence
tgccaaattctatttgtctt

SEQ ID NO: 231425 - DNA, 20 bp, Artificial
  CRISPR gRNA sequence
gccaaattctatttgtcttc

SEQ ID NO: 231426 - DNA, 20 bp, Artificial
  CRISPR gRNA sequence
ccaaattctatttgtcttct

SEQ ID NO: 231427 - DNA, 20 bp, Artificial
  CRISPR gRNA sequence
tatttgtcttctccttcaaa

SEQ ID NO: 231428 - DNA, 20 bp, Artificial
  CRISPR gRNA sequence
tttgtcttctccttcaaaac

SEQ ID NO: 231429 - DNA, 20 bp, Artificial
  CRISPR gRNA sequence
gtcttctccttcaaaacatt

SEQ ID NO: 231430 - DNA, 20 bp, Artificial
  CRISPR gRNA sequence
tcttctccttcaaaacattc

SEQ ID NO: 231431 - DNA, 20 bp, Artificial
  CRISPR gRNA sequence
ctccttcaaaacattctcct

SEQ ID NO: 231432 - DNA, 20 bp, Artificial
  CRISPR gRNA sequence
tccttcaaaacattctcctt

SEQ ID NO: 231433 - DNA, 20 bp, Artificial
  CRISPR gRNA sequence
cttcaaaacattctcctttg

SEQ ID NO: 231434 - DNA, 20 bp, Artificial
  CRISPR gRNA sequence
caaaacattctcctttgcag

SEQ ID NO: 231435 - DNA, 20 bp, Artificial
  CRISPR gRNA sequence
aaaacattctcctttgcagt

SEQ ID NO: 231436 - DNA, 20 bp, Artificial
  CRISPR gRNA sequence
tcctttgcagttcctcttca

SEQ ID NO: 231437 - DNA, 20 bp, Artificial
  CRISPR gRNA sequence
ctttgcagttcctcttcatc

SEQ ID NO: 231438 - DNA, 20 bp, Artificial
  CRISPR gRNA sequence
tgcagttcctcttcatctgt

SEQ ID NO: 231439 - DNA, 20 bp, Artificial
  CRISPR gRNA sequence
gcagttcctcttcatctgtg

SEQ ID NO: 231440 - DNA, 20 bp, Artificial
  CRISPR gRNA sequence
cagttcctcttcatctgtgt

SEQ ID NO: 231441 - DNA, 20 bp, Artificial
  CRISPR gRNA sequence
ctcttcatctgtgtagctgc

SEQ ID NO: 231442 - DNA, 20 bp, Artificial
  CRISPR gRNA sequence
ttcatctgtgtagctgctct

SEQ ID NO: 231443 - DNA, 20 bp, Artificial
  CRISPR gRNA sequence
catctgtgtagctgctcttt

SEQ ID NO: 231444 - DNA, 20 bp, Artificial
  CRISPR gRNA sequence
atctgtgtagctgctctttt

SEQ ID NO: 231445 - DNA, 20 bp, Artificial
  CRISPR gRNA sequence
tgtagctgctcttttgtctc

SEQ ID NO: 231446 - DNA, 20 bp, Artificial
  CRISPR gRNA sequence
ctcttttgtctcttaactta

SEQ ID NO: 231447 - DNA, 20 bp, Artificial
  CRISPR gRNA sequence
ttttgtctcttaacttacca

SEQ ID NO: 231448 - DNA, 20 bp, Artificial
  CRISPR gRNA sequence
ttgtctcttaacttaccatt

SEQ ID NO: 231449 - DNA, 20 bp, Artificial
  CRISPR gRNA sequence
tgtctcttaacttaccattc

SEQ ID NO: 231450 - DNA, 20 bp, Artificial
  CRISPR gRNA sequence
gtctcttaacttaccattcc

SEQ ID NO: 231451 - DNA, 20 bp, Artificial
  CRISPR gRNA sequence
tctcttaacttaccattcct

SEQ ID NO: 231452 - DNA, 20 bp, Artificial
  CRISPR gRNA sequence
ttaacttaccattcctatag

SEQ ID NO: 231453 - DNA, 20 bp, Artificial
  CRISPR gRNA sequence
aacttaccattcctatagta

SEQ ID NO: 231454 - DNA, 20 bp, Artificial
  CRISPR gRNA sequence
acttaccattcctatagtac

SEQ ID NO: 231455 - DNA, 20 bp, Artificial
  CRISPR gRNA sequence
accattcctatagtacttta

SEQ ID NO: 231456 - DNA, 20 bp, Artificial
  CRISPR gRNA sequence
ccattcctatagtactttat

SEQ ID NO: 231457 - DNA, 20 bp, Artificial
  CRISPR gRNA sequence
ctatagtactttatgcatct

SEQ ID NO: 231458 - DNA, 20 bp, Artificial
  CRISPR gRNA sequence
tagtactttatgcatctctg

SEQ ID NO: 231459 - DNA, 20 bp, Artificial
  CRISPR gRNA sequence
tatgcatctctgcttagttc

SEQ ID NO: 231460 - DNA, 20 bp, Artificial
  CRISPR gRNA sequence
atgcatctctgcttagttct

SEQ ID NO: 231461 - DNA, 20 bp, Artificial
  CRISPR gRNA sequence
tgcatctctgcttagttcta

SEQ ID NO: 231462 - DNA, 20 bp, Artificial
  CRISPR gRNA sequence
tgcttagttctattagtttt

SEQ ID NO: 231463 - DNA, 20 bp, Artificial
  CRISPR gRNA sequence
cttagttctattagtttttt

SEQ ID NO: 231464 - DNA, 20 bp, Artificial
  CRISPR gRNA sequence
agttctattagttttttggc

SEQ ID NO: 231465 - DNA, 20 bp, Artificial
  CRISPR gRNA sequence
gttctattagttttttggcc

SEQ ID NO: 231466 - DNA, 20 bp, Artificial
  CRISPR gRNA sequence
tattagttttttggccttgc

SEQ ID NO: 231467 - DNA, 20 bp, Artificial
  CRISPR gRNA sequence
ttagttttttggccttgctc

SEQ ID NO: 231468 - DNA, 20 bp, Artificial
  CRISPR gRNA sequence
gttttttggccttgctcttc

SEQ ID NO: 231469 - DNA, 20 bp, Artificial
  CRISPR gRNA sequence
tttggccttgctcttctcct

SEQ ID NO: 231470 - DNA, 20 bp, Artificial
  CRISPR gRNA sequence
ttggccttgctcttctcctt

SEQ ID NO: 231471 - DNA, 20 bp, Artificial
  CRISPR gRNA sequence
tggccttgctcttctccttg

SEQ ID NO: 231472 - DNA, 20 bp, Artificial
  CRISPR gRNA sequence
ggccttgctcttctccttga

SEQ ID NO: 231473 - DNA, 20 bp, Artificial
  CRISPR gRNA sequence
gccttgctcttctccttgat

SEQ ID NO: 231474 - DNA, 20 bp, Artificial
  CRISPR gRNA sequence
gctcttctccttgattttaa

SEQ ID NO: 231475 - DNA, 20 bp, Artificial
  CRISPR gRNA sequence
ctcttctccttgattttaaa

SEQ ID NO: 231476 - DNA, 20 bp, Artificial
  CRISPR gRNA sequence
ttctccttgattttaaaatt

SEQ ID NO: 231477 - DNA, 20 bp, Artificial
  CRISPR gRNA sequence
ctccttgattttaaaattcc

SEQ ID NO: 231478 - DNA, 20 bp, Artificial
  CRISPR gRNA sequence
tccttgattttaaaattcct

SEQ ID NO: 231479 - DNA, 20 bp, Artificial
  CRISPR gRNA sequence
cttgattttaaaattccttc

SEQ ID NO: 231480 - DNA, 20 bp, Artificial
  CRISPR gRNA sequence
gattttaaaattccttctat

SEQ ID NO: 231481 - DNA, 20 bp, Artificial
  CRISPR gRNA sequence
attttaaaattccttctata

SEQ ID NO: 231482 - DNA, 20 bp, Artificial
  CRISPR gRNA sequence
taaaattccttctatagcta

SEQ ID NO: 231483 - DNA, 20 bp, Artificial
  CRISPR gRNA sequence
aaaattccttctatagctag

SEQ ID NO: 231484 - DNA, 20 bp, Artificial
  CRISPR gRNA sequence
aaattccttctatagctaga

SEQ ID NO: 231485 - DNA, 20 bp, Artificial
  CRISPR gRNA sequence
cttctatagctagagctttt

SEQ ID NO: 231486 - DNA, 20 bp, Artificial
  CRISPR gRNA sequence
ctatagctagagcttttctt

SEQ ID NO: 231487 - DNA, 20 bp, Artificial
  CRISPR gRNA sequence
tatagctagagcttttcttt

SEQ ID NO: 231488 - DNA, 20 bp, Artificial
  CRISPR gRNA sequence
tagctagagcttttctttct

SEQ ID NO: 231489 - DNA, 20 bp, Artificial
  CRISPR gRNA sequence
gagcttttctttctttcatt

SEQ ID NO: 231490 - DNA, 20 bp, Artificial
  CRISPR gRNA sequence
ttctttctttcattctctct

SEQ ID NO: 231491 - DNA, 20 bp, Artificial
  CRISPR gRNA sequence
tctttctttcattctctctt

SEQ ID NO: 231492 - DNA, 20 bp, Artificial
  CRISPR gRNA sequence
ctttctttcattctctcttc

SEQ ID NO: 231493 - DNA, 20 bp, Artificial
  CRISPR gRNA sequence
tttctttcattctctcttcc

SEQ ID NO: 231494 - DNA, 20 bp, Artificial
  CRISPR gRNA sequence
tctttcattctctcttcctg

SEQ ID NO: 231495 - DNA, 20 bp, Artificial
  CRISPR gRNA sequence
ctttcattctctcttcctgc

SEQ ID NO: 231496 - DNA, 20 bp, Artificial
  CRISPR gRNA sequence
tttcattctctcttcctgca

SEQ ID NO: 231497 - DNA, 20 bp, Artificial
  CRISPR gRNA sequence
tcattctctcttcctgcagt

SEQ ID NO: 231498 - DNA, 20 bp, Artificial
  CRISPR gRNA sequence
cattctctcttcctgcagtg

SEQ ID NO: 231499 - DNA, 20 bp, Artificial
  CRISPR gRNA sequence
attctctcttcctgcagtgt

SEQ ID NO: 231500 - DNA, 20 bp, Artificial
  CRISPR gRNA sequence
tctcttcctgcagtgttttg

SEQ ID NO: 231501 - DNA, 20 bp, Artificial
  CRISPR gRNA sequence
tcttcctgcagtgttttgca

SEQ ID NO: 231502 - DNA, 20 bp, Artificial
  CRISPR gRNA sequence
ttcctgcagtgttttgcata

SEQ ID NO: 231503 - DNA, 20 bp, Artificial
  CRISPR gRNA sequence
cctgcagtgttttgcataca

SEQ ID NO: 231504 - DNA, 20 bp, Artificial
  CRISPR gRNA sequence
ctgcagtgttttgcatacat

SEQ ID NO: 231505 - DNA, 20 bp, Artificial
  CRISPR gRNA sequence
cagtgttttgcatacatcag

SEQ ID NO: 231506 - DNA, 20 bp, Artificial
  CRISPR gRNA sequence
tgcatacatcagaagctagg

SEQ ID NO: 231507 - DNA, 20 bp, Artificial
  CRISPR gRNA sequence
gcatacatcagaagctaggt

SEQ ID NO: 231508 - DNA, 20 bp, Artificial
  CRISPR gRNA sequence
catacatcagaagctaggta

SEQ ID NO: 231509 - DNA, 20 bp, Artificial
  CRISPR gRNA sequence
ggtacataagttaaatgatt

SEQ ID NO: 231510 - DNA, 20 bp, Artificial
  CRISPR gRNA sequence
aatgattgagagttggctgt

SEQ ID NO: 231511 - DNA, 20 bp, Artificial
  CRISPR gRNA sequence
agagttggctgtatttagat

SEQ ID NO: 231512 - DNA, 20 bp, Artificial
  CRISPR gRNA sequence
gctgtatttagatttatcac

SEQ ID NO: 231513 - DNA, 20 bp, Artificial
  CRISPR gRNA sequence
tatttagatttatcactttt

SEQ ID NO: 231514 - DNA, 20 bp, Artificial
  CRISPR gRNA sequence
agatttatcactttttaata

SEQ ID NO: 231515 - DNA, 20 bp, Artificial
  CRISPR gRNA sequence
gatttatcactttttaatag

SEQ ID NO: 231516 - DNA, 20 bp, Artificial
  CRISPR gRNA sequence
atcactttttaatagggtga

SEQ ID NO: 231517 - DNA, 20 bp, Artificial
  CRISPR gRNA sequence
tcactttttaatagggtgag

SEQ ID NO: 231518 - DNA, 20 bp, Artificial
  CRISPR gRNA sequence
tttaatagggtgagcttgag

SEQ ID NO: 231519 - DNA, 20 bp, Artificial
  CRISPR gRNA sequence
ttaatagggtgagcttgaga

SEQ ID NO: 231520 - DNA, 20 bp, Artificial
  CRISPR gRNA sequence
taatagggtgagcttgagag

SEQ ID NO: 231521 - DNA, 20 bp, Artificial
  CRISPR gRNA sequence
aatagggtgagcttgagagt

SEQ ID NO: 231522 - DNA, 20 bp, Artificial
  CRISPR gRNA sequence
atagggtgagcttgagagtt

SEQ ID NO: 231523 - DNA, 20 bp, Artificial
  CRISPR gRNA sequence
gagagttttctttctttctg

SEQ ID NO: 231524 - DNA, 20 bp, Artificial
  CRISPR gRNA sequence
agagttttctttctttctgt

SEQ ID NO: 231525 - DNA, 20 bp, Artificial
  CRISPR gRNA sequence
tctttctttctgtttttttt

SEQ ID NO: 231526 - DNA, 20 bp, Artificial
  CRISPR gRNA sequence
ctttctttctgttttttttt

SEQ ID NO: 231527 - DNA, 20 bp, Artificial
  CRISPR gRNA sequence
tttctttctgtttttttttt

SEQ ID NO: 231528 - DNA, 20 bp, Artificial
  CRISPR gRNA sequence
tctttctgtttttttttttt

SEQ ID NO: 231529 - DNA, 20 bp, Artificial
  CRISPR gRNA sequence
ctttctgttttttttttttg

SEQ ID NO: 231530 - DNA, 20 bp, Artificial
  CRISPR gRNA sequence
tttctgttttttttttttgt

SEQ ID NO: 231531 - DNA, 20 bp, Artificial
  CRISPR gRNA sequence
tctgttttttttttttgttt

SEQ ID NO: 231532 - DNA, 20 bp, Artificial
  CRISPR gRNA sequence
ctgttttttttttttgtttt

SEQ ID NO: 231533 - DNA, 20 bp, Artificial
  CRISPR gRNA sequence
tgttttttttttttgttttt

SEQ ID NO: 231534 - DNA, 20 bp, Artificial
  CRISPR gRNA sequence
ttttttttttttgttttttt

SEQ ID NO: 231535 - DNA, 20 bp, Artificial
  CRISPR gRNA sequence
tttttttttgtttttttttt

SEQ ID NO: 231536 - DNA, 20 bp, Artificial
  CRISPR gRNA sequence
ttttttttgttttttttttt

SEQ ID NO: 231537 - DNA, 20 bp, Artificial
  CRISPR gRNA sequence
tttttttgtttttttttttt

SEQ ID NO: 231538 - DNA, 20 bp, Artificial
  CRISPR gRNA sequence
ttttttgttttttttttttt

SEQ ID NO: 231539 - DNA, 20 bp, Artificial
  CRISPR gRNA sequence
tttttgtttttttttttttt

SEQ ID NO: 231540 - DNA, 20 bp, Artificial
  CRISPR gRNA sequence
ttttgttttttttttttttt

SEQ ID NO: 231541 - DNA, 20 bp, Artificial
  CRISPR gRNA sequence
tttgtttttttttttttttt

SEQ ID NO: 231542 - DNA, 20 bp, Artificial
  CRISPR gRNA sequence
ttgttttttttttttttttt

SEQ ID NO: 231543 - DNA, 20 bp, Artificial
  CRISPR gRNA sequence
tgtttttttttttttttttt

SEQ ID NO: 231544 - DNA, 20 bp, Artificial
  CRISPR gRNA sequence
gttttttttttttttttttt

SEQ ID NO: 231545 - DNA, 20 bp, Artificial
  CRISPR gRNA sequence
tttttttttttttttttttt

SEQ ID NO: 231546 - DNA, 20 bp, Artificial
  CRISPR gRNA sequence
tttttttttttttttttttt

SEQ ID NO: 231547 - DNA, 20 bp, Artificial
  CRISPR gRNA sequence
tttttttttttttttttttt

SEQ ID NO: 231548 - DNA, 20 bp, Artificial
  CRISPR gRNA sequence
tttttttttttttttttttt

SEQ ID NO: 231549 - DNA, 20 bp, Artificial
  CRISPR gRNA sequence
tttttttttttttttttttt

SEQ ID NO: 231550 - DNA, 20 bp, Artificial
  CRISPR gRNA sequence
tttttttttttttttttttt

SEQ ID NO: 231551 - DNA, 20 bp, Artificial
  CRISPR gRNA sequence
tttttttttttttttttttt

SEQ ID NO: 231552 - DNA, 20 bp, Artificial
  CRISPR gRNA sequence
tttttttttttttttttttt

SEQ ID NO: 231553 - DNA, 20 bp, Artificial
  CRISPR gRNA sequence
tttttttttttttttttttt

SEQ ID NO: 231554 - DNA, 20 bp, Artificial
  CRISPR gRNA sequence
tttttttttttttttttttt

SEQ ID NO: 231555 - DNA, 20 bp, Artificial
  CRISPR gRNA sequence
tttttttttttttttttttt

SEQ ID NO: 231556 - DNA, 20 bp, Artificial
  CRISPR gRNA sequence
tttttttttttttttttttg

SEQ ID NO: 231557 - DNA, 20 bp, Artificial
  CRISPR gRNA sequence
ttttttttttttttttttga

SEQ ID NO: 231558 - DNA, 20 bp, Artificial
  CRISPR gRNA sequence
tttttttttttttttttgac

SEQ ID NO: 231559 - DNA, 20 bp, Artificial
  CRISPR gRNA sequence
ttttttttttttttttgact

SEQ ID NO: 231560 - DNA, 20 bp, Artificial
  CRISPR gRNA sequence
tttttttttttttttgacta

SEQ ID NO: 231561 - DNA, 20 bp, Artificial
  CRISPR gRNA sequence
ttttttttttttttgactaa

SEQ ID NO: 231562 - DNA, 20 bp, Artificial
  CRISPR gRNA sequence
tttttttttttttgactaat

SEQ ID NO: 231563 - DNA, 20 bp, Artificial
  CRISPR gRNA sequence
ttttttttttttgactaatt

SEQ ID NO: 231564 - DNA, 20 bp, Artificial
  CRISPR gRNA sequence
tttttttttttgactaattt

SEQ ID NO: 231565 - DNA, 20 bp, Artificial
  CRISPR gRNA sequence
ttttttttttgactaatttc

SEQ ID NO: 231566 - DNA, 20 bp, Artificial
  CRISPR gRNA sequence
tttttttttgactaatttca

SEQ ID NO: 231567 - DNA, 20 bp, Artificial
  CRISPR gRNA sequence
ttttttttgactaatttcac

SEQ ID NO: 231568 - DNA, 20 bp, Artificial
  CRISPR gRNA sequence
tttttttgactaatttcaca

SEQ ID NO: 231569 - DNA, 20 bp, Artificial
  CRISPR gRNA sequence
ttttttgactaatttcacat

SEQ ID NO: 231570 - DNA, 20 bp, Artificial
  CRISPR gRNA sequence
tttttgactaatttcacatg

SEQ ID NO: 231571 - DNA, 20 bp, Artificial
  CRISPR gRNA sequence
ttttgactaatttcacatgc

SEQ ID NO: 231572 - DNA, 20 bp, Artificial
  CRISPR gRNA sequence
tttgactaatttcacatgct

SEQ ID NO: 231573 - DNA, 20 bp, Artificial
  CRISPR gRNA sequence
ttgactaatttcacatgctc

SEQ ID NO: 231574 - DNA, 20 bp, Artificial
  CRISPR gRNA sequence
tgactaatttcacatgctct

SEQ ID NO: 231575 - DNA, 20 bp, Artificial
  CRISPR gRNA sequence
gactaatttcacatgctcta

SEQ ID NO: 231576 - DNA, 20 bp, Artificial
  CRISPR gRNA sequence
actaatttcacatgctctaa

SEQ ID NO: 231577 - DNA, 20 bp, Artificial
  CRISPR gRNA sequence
atttcacatgctctaaaaac

SEQ ID NO: 231578 - DNA, 20 bp, Artificial
  CRISPR gRNA sequence
cacatgctctaaaaaccttc

SEQ ID NO: 231579 - DNA, 20 bp, Artificial
  CRISPR gRNA sequence
acatgctctaaaaaccttca

SEQ ID NO: 231580 - DNA, 20 bp, Artificial
  CRISPR gRNA sequence
taaaaaccttcaaaggtgat

SEQ ID NO: 231581 - DNA, 20 bp, Artificial
  CRISPR gRNA sequence
aaaaccttcaaaggtgatta

SEQ ID NO: 231582 - DNA, 20 bp, Artificial
  CRISPR gRNA sequence
caaaggtgattatttttctc

SEQ ID NO: 231583 - DNA, 20 bp, Artificial
  CRISPR gRNA sequence
aaaggtgattatttttctcc

SEQ ID NO: 231584 - DNA, 20 bp, Artificial
  CRISPR gRNA sequence
tttttctcctggaaactcca

SEQ ID NO: 231585 - DNA, 20 bp, Artificial
  CRISPR gRNA sequence
ttctcctggaaactccaggt

SEQ ID NO: 231586 - DNA, 20 bp, Artificial
  CRISPR gRNA sequence
tctcctggaaactccaggtc

SEQ ID NO: 231587 - DNA, 20 bp, Artificial
  CRISPR gRNA sequence
ctcctggaaactccaggtcc

SEQ ID NO: 231588 - DNA, 20 bp, Artificial
  CRISPR gRNA sequence
tcctggaaactccaggtcca

SEQ ID NO: 231589 - DNA, 20 bp, Artificial
  CRISPR gRNA sequence
ctggaaactccaggtccatt

SEQ ID NO: 231590 - DNA, 20 bp, Artificial
  CRISPR gRNA sequence
gaaactccaggtccattctg

SEQ ID NO: 231591 - DNA, 20 bp, Artificial
  CRISPR gRNA sequence
caggtccattctgtttaaat

SEQ ID NO: 231592 - DNA, 20 bp, Artificial
  CRISPR gRNA sequence
tgtttaaatccctaagaatg

SEQ ID NO: 231593 - DNA, 20 bp, Artificial
  CRISPR gRNA sequence
tttaaatccctaagaatgtc

SEQ ID NO: 231594 - DNA, 20 bp, Artificial
  CRISPR gRNA sequence
aaatccctaagaatgtcaga

SEQ ID NO: 231595 - DNA, 20 bp, Artificial
  CRISPR gRNA sequence
aatccctaagaatgtcagaa

SEQ ID NO: 231596 - DNA, 20 bp, Artificial
  CRISPR gRNA sequence
agaatgtcagaattaaaata

SEQ ID NO: 231597 - DNA, 20 bp, Artificial
  CRISPR gRNA sequence
aaataacagggctatcccgt

SEQ ID NO: 231598 - DNA, 20 bp, Artificial
  CRISPR gRNA sequence
tcccgtaattggaaatattt

SEQ ID NO: 231599 - DNA, 20 bp, Artificial
  CRISPR gRNA sequence
gaaatatttcttttttcagg

SEQ ID NO: 231600 - DNA, 20 bp, Artificial
  CRISPR gRNA sequence
cttttttcaggatgctatag

SEQ ID NO: 231601 - DNA, 20 bp, Artificial
  CRISPR gRNA sequence
ttttttcaggatgctatagt

SEQ ID NO: 231602 - DNA, 20 bp, Artificial
  CRISPR gRNA sequence
ttttcaggatgctatagtca

SEQ ID NO: 231603 - DNA, 20 bp, Artificial
  CRISPR gRNA sequence
tttcaggatgctatagtcaa

SEQ ID NO: 231604 - DNA, 20 bp, Artificial
  CRISPR gRNA sequence
ttcaggatgctatagtcaat

SEQ ID NO: 231605 - DNA, 20 bp, Artificial
  CRISPR gRNA sequence
tcaggatgctatagtcaatt

SEQ ID NO: 231606 - DNA, 20 bp, Artificial
  CRISPR gRNA sequence
caggatgctatagtcaattt

SEQ ID NO: 231607 - DNA, 20 bp, Artificial
  CRISPR gRNA sequence
aggatgctatagtcaattta

SEQ ID NO: 231608 - DNA, 20 bp, Artificial
  CRISPR gRNA sequence
tagtcaatttagtaagtgac

SEQ ID NO: 231609 - DNA, 20 bp, Artificial
  CRISPR gRNA sequence
agtaagtgaccaccaaattg

SEQ ID NO: 231610 - DNA, 20 bp, Artificial
  CRISPR gRNA sequence
gtaagtgaccaccaaattgt

SEQ ID NO: 231611 - DNA, 20 bp, Artificial
  CRISPR gRNA sequence
ttatttgcactaacaaagct

SEQ ID NO: 231612 - DNA, 20 bp, Artificial
  CRISPR gRNA sequence
tttgcactaacaaagctcaa

SEQ ID NO: 231613 - DNA, 20 bp, Artificial
  CRISPR gRNA sequence
gcactaacaaagctcaaaac

SEQ ID NO: 231614 - DNA, 20 bp, Artificial
  CRISPR gRNA sequence
cactaacaaagctcaaaaca

SEQ ID NO: 231615 - DNA, 20 bp, Artificial
  CRISPR gRNA sequence
acaaagctcaaaacacgata

SEQ ID NO: 231616 - DNA, 20 bp, Artificial
  CRISPR gRNA sequence
aaaacacgataagtttactc

SEQ ID NO: 231617 - DNA, 20 bp, Artificial
  CRISPR gRNA sequence
actcctccatctcagtaata

SEQ ID NO: 231618 - DNA, 20 bp, Artificial
  CRISPR gRNA sequence
ctcctccatctcagtaataa

SEQ ID NO: 231619 - DNA, 20 bp, Artificial
  CRISPR gRNA sequence
ctccatctcagtaataaaaa

SEQ ID NO: 231620 - DNA, 20 bp, Artificial
  CRISPR gRNA sequence
catctcagtaataaaaatta

SEQ ID NO: 231621 - DNA, 20 bp, Artificial
  CRISPR gRNA sequence
agtaataaaaattaagctgt

SEQ ID NO: 231622 - DNA, 20 bp, Artificial
  CRISPR gRNA sequence
agctgtaatcaaccttctag

SEQ ID NO: 231623 - DNA, 20 bp, Artificial
  CRISPR gRNA sequence
taatcaaccttctaggtttc

SEQ ID NO: 231624 - DNA, 20 bp, Artificial
  CRISPR gRNA sequence
ctaggtttctcttgtcttaa

SEQ ID NO: 231625 - DNA, 20 bp, Artificial
  CRISPR gRNA sequence
taggtttctcttgtcttaaa

SEQ ID NO: 231626 - DNA, 20 bp, Artificial
  CRISPR gRNA sequence
ggtttctcttgtcttaaaat

SEQ ID NO: 231627 - DNA, 20 bp, Artificial
  CRISPR gRNA sequence
ctcttgtcttaaaatgggta

SEQ ID NO: 231628 - DNA, 20 bp, Artificial
  CRISPR gRNA sequence
tcttgtcttaaaatgggtat

SEQ ID NO: 231629 - DNA, 20 bp, Artificial
  CRISPR gRNA sequence
ttgtcttaaaatgggtattc

SEQ ID NO: 231630 - DNA, 20 bp, Artificial
  CRISPR gRNA sequence
gtcttaaaatgggtattcaa

SEQ ID NO: 231631 - DNA, 20 bp, Artificial
  CRISPR gRNA sequence
tcttaaaatgggtattcaaa

SEQ ID NO: 231632 - DNA, 20 bp, Artificial
  CRISPR gRNA sequence
aaaatgggtattcaaaaatg

SEQ ID NO: 231633 - DNA, 20 bp, Artificial
  CRISPR gRNA sequence
aaatgggtattcaaaaatgg

SEQ ID NO: 231634 - DNA, 20 bp, Artificial
  CRISPR gRNA sequence
aaaaatggggatctgtggtg

SEQ ID NO: 231635 - DNA, 20 bp, Artificial
  CRISPR gRNA sequence
tggtgtatgtatggaaacac

SEQ ID NO: 231636 - DNA, 20 bp, Artificial
  CRISPR gRNA sequence
cttaatttacctgttgttgg

SEQ ID NO: 231637 - DNA, 20 bp, Artificial
  CRISPR gRNA sequence
aatttacctgttgttggaaa

SEQ ID NO: 231638 - DNA, 20 bp, Artificial
  CRISPR gRNA sequence
atttacctgttgttggaaac

SEQ ID NO: 231639 - DNA, 20 bp, Artificial
  CRISPR gRNA sequence
acctgttgttggaaactgga

SEQ ID NO: 231640 - DNA, 20 bp, Artificial
  CRISPR gRNA sequence
cctgttgttggaaactggag

SEQ ID NO: 231641 - DNA, 20 bp, Artificial
  CRISPR gRNA sequence
ttgttggaaactggagaaat

SEQ ID NO: 231642 - DNA, 20 bp, Artificial
  CRISPR gRNA sequence
ttggaaactggagaaatgat

SEQ ID NO: 231643 - DNA, 20 bp, Artificial
  CRISPR gRNA sequence
gaaactggagaaatgattgt

SEQ ID NO: 231644 - DNA, 20 bp, Artificial
  CRISPR gRNA sequence
gagaaatgattgtcgggcaa

SEQ ID NO: 231645 - DNA, 20 bp, Artificial
  CRISPR gRNA sequence
tcgggcaaccgtttattttt

SEQ ID NO: 231646 - DNA, 20 bp, Artificial
  CRISPR gRNA sequence
attttttattgtattttatt

SEQ ID NO: 231647 - DNA, 20 bp, Artificial
  CRISPR gRNA sequence
ttttttattgtattttattt

SEQ ID NO: 231648 - DNA, 20 bp, Artificial
  CRISPR gRNA sequence
tttattgtattttatttggt

SEQ ID NO: 231649 - DNA, 20 bp, Artificial
  CRISPR gRNA sequence
ttattgtattttatttggtt

SEQ ID NO: 231650 - DNA, 20 bp, Artificial
  CRISPR gRNA sequence
tattgtattttatttggttg

SEQ ID NO: 231651 - DNA, 20 bp, Artificial
  CRISPR gRNA sequence
attgtattttatttggttga

SEQ ID NO: 231652 - DNA, 20 bp, Artificial
  CRISPR gRNA sequence
ttgtattttatttggttgag

SEQ ID NO: 231653 - DNA, 20 bp, Artificial
  CRISPR gRNA sequence
tattttatttggttgaggga

SEQ ID NO: 231654 - DNA, 20 bp, Artificial
  CRISPR gRNA sequence
tatttggttgagggattttt

SEQ ID NO: 231655 - DNA, 20 bp, Artificial
  CRISPR gRNA sequence
atttggttgagggatttttt

SEQ ID NO: 231656 - DNA, 20 bp, Artificial
  CRISPR gRNA sequence
tttggttgagggattttttt

SEQ ID NO: 231657 - DNA, 20 bp, Artificial
  CRISPR gRNA sequence
ggttgagggatttttttata

SEQ ID NO: 231658 - DNA, 20 bp, Artificial
  CRISPR gRNA sequence
gttgagggatttttttataa

SEQ ID NO: 231659 - DNA, 20 bp, Artificial
  CRISPR gRNA sequence
agggatttttttataaacag

SEQ ID NO: 231660 - DNA, 20 bp, Artificial
  CRISPR gRNA sequence
ttttataaacagttttactt

SEQ ID NO: 231661 - DNA, 20 bp, Artificial
  CRISPR gRNA sequence
tttataaacagttttacttg

SEQ ID NO: 231662 - DNA, 20 bp, Artificial
  CRISPR gRNA sequence
ttataaacagttttacttgt

SEQ ID NO: 231663 - DNA, 20 bp, Artificial
  CRISPR gRNA sequence
tataaacagttttacttgtg

SEQ ID NO: 231664 - DNA, 20 bp, Artificial
  CRISPR gRNA sequence
ataaacagttttacttgtgt

SEQ ID NO: 231665 - DNA, 20 bp, Artificial
  CRISPR gRNA sequence
taaacagttttacttgtgtc

SEQ ID NO: 231666 - DNA, 20 bp, Artificial
  CRISPR gRNA sequence
tacttgtgtcatattttaaa

SEQ ID NO: 231667 - DNA, 20 bp, Artificial
  CRISPR gRNA sequence
acttgtgtcatattttaaaa

SEQ ID NO: 231668 - DNA, 20 bp, Artificial
  CRISPR gRNA sequence
cttgtgtcatattttaaaat

SEQ ID NO: 231669 - DNA, 20 bp, Artificial
  CRISPR gRNA sequence
gtgtcatattttaaaattac

SEQ ID NO: 231670 - DNA, 20 bp, Artificial
  CRISPR gRNA sequence
tgtcatattttaaaattact

SEQ ID NO: 231671 - DNA, 20 bp, Artificial
  CRISPR gRNA sequence
taaaattactaactgccatc

SEQ ID NO: 231672 - DNA, 20 bp, Artificial
  CRISPR gRNA sequence
aaaattactaactgccatca

SEQ ID NO: 231673 - DNA, 20 bp, Artificial
  CRISPR gRNA sequence
aaattactaactgccatcac

SEQ ID NO: 231674 - DNA, 20 bp, Artificial
  CRISPR gRNA sequence
ctaactgccatcacctgctg

SEQ ID NO: 231675 - DNA, 20 bp, Artificial
  CRISPR gRNA sequence
actgccatcacctgctgggg

SEQ ID NO: 231676 - DNA, 20 bp, Artificial
  CRISPR gRNA sequence
ccatcacctgctggggtcct

SEQ ID NO: 231677 - DNA, 20 bp, Artificial
  CRISPR gRNA sequence
ctggggtcctttgttaggtc

SEQ ID NO: 231678 - DNA, 20 bp, Artificial
  CRISPR gRNA sequence
gggtcctttgttaggtcatt

SEQ ID NO: 231679 - DNA, 20 bp, Artificial
  CRISPR gRNA sequence
tgttaggtcattttcagtga

SEQ ID NO: 231680 - DNA, 20 bp, Artificial
  CRISPR gRNA sequence
gttaggtcattttcagtgac

SEQ ID NO: 231681 - DNA, 20 bp, Artificial
  CRISPR gRNA sequence
ttaggtcattttcagtgact

SEQ ID NO: 231682 - DNA, 20 bp, Artificial
  CRISPR gRNA sequence
ggtcattttcagtgactaat

SEQ ID NO: 231683 - DNA, 20 bp, Artificial
  CRISPR gRNA sequence
tcagtgactaatagggataa

SEQ ID NO: 231684 - DNA, 20 bp, Artificial
  CRISPR gRNA sequence
cagtgactaatagggataat

SEQ ID NO: 231685 - DNA, 20 bp, Artificial
  CRISPR gRNA sequence
agtgactaatagggataatc

SEQ ID NO: 231686 - DNA, 20 bp, Artificial
  CRISPR gRNA sequence
atagggataatccaggtaac

SEQ ID NO: 231687 - DNA, 20 bp, Artificial
  CRISPR gRNA sequence
tgaagagatgagcagtgagt

SEQ ID NO: 231688 - DNA, 20 bp, Artificial
  CRISPR gRNA sequence
gaagagatgagcagtgagtg

SEQ ID NO: 231689 - DNA, 20 bp, Artificial
  CRISPR gRNA sequence
aagagatgagcagtgagtga

SEQ ID NO: 231690 - DNA, 20 bp, Artificial
  CRISPR gRNA sequence
ttctgcctttagctttgaca

SEQ ID NO: 231691 - DNA, 20 bp, Artificial
  CRISPR gRNA sequence
tctgcctttagctttgacag

SEQ ID NO: 231692 - DNA, 20 bp, Artificial
  CRISPR gRNA sequence
ctgcctttagctttgacagt

SEQ ID NO: 231693 - DNA, 20 bp, Artificial
  CRISPR gRNA sequence
tgcctttagctttgacagtt

SEQ ID NO: 231694 - DNA, 20 bp, Artificial
  CRISPR gRNA sequence
cctttagctttgacagttct

SEQ ID NO: 231695 - DNA, 20 bp, Artificial
  CRISPR gRNA sequence
tagctttgacagttcttaat

SEQ ID NO: 231696 - DNA, 20 bp, Artificial
  CRISPR gRNA sequence
agctttgacagttcttaatt

SEQ ID NO: 231697 - DNA, 20 bp, Artificial
  CRISPR gRNA sequence
gctttgacagttcttaatta

SEQ ID NO: 231698 - DNA, 20 bp, Artificial
  CRISPR gRNA sequence
tgacagttcttaattaagat

SEQ ID NO: 231699 - DNA, 20 bp, Artificial
  CRISPR gRNA sequence
gacagttcttaattaagatc

SEQ ID NO: 231700 - DNA, 20 bp, Artificial
  CRISPR gRNA sequence
acagttcttaattaagatca

SEQ ID NO: 231701 - DNA, 20 bp, Artificial
  CRISPR gRNA sequence
ttaattaagatcattgaaga

SEQ ID NO: 231702 - DNA, 20 bp, Artificial
  CRISPR gRNA sequence
aattaagatcattgaagacc

SEQ ID NO: 231703 - DNA, 20 bp, Artificial
  CRISPR gRNA sequence
attaagatcattgaagacca

SEQ ID NO: 231704 - DNA, 20 bp, Artificial
  CRISPR gRNA sequence
agatcattgaagaccagctt

SEQ ID NO: 231705 - DNA, 20 bp, Artificial
  CRISPR gRNA sequence
aagaccagctttctcataaa

SEQ ID NO: 231706 - DNA, 20 bp, Artificial
  CRISPR gRNA sequence
tctcataaatttctcttttt

SEQ ID NO: 231707 - DNA, 20 bp, Artificial
  CRISPR gRNA sequence
ctcataaatttctctttttg

SEQ ID NO: 231708 - DNA, 20 bp, Artificial
  CRISPR gRNA sequence
tcataaatttctctttttga

SEQ ID NO: 231709 - DNA, 20 bp, Artificial
  CRISPR gRNA sequence
ataaatttctctttttgaaa

SEQ ID NO: 231710 - DNA, 20 bp, Artificial
  CRISPR gRNA sequence
ctctttttgaaaaaaagaaa

SEQ ID NO: 231711 - DNA, 20 bp, Artificial
  CRISPR gRNA sequence
tctttttgaaaaaaagaaag

SEQ ID NO: 231712 - DNA, 20 bp, Artificial
  CRISPR gRNA sequence
tttttgaaaaaaagaaagca

SEQ ID NO: 231713 - DNA, 20 bp, Artificial
  CRISPR gRNA sequence
tttgaaaaaaagaaagcatt

SEQ ID NO: 231714 - DNA, 20 bp, Artificial
  CRISPR gRNA sequence
ttgaaaaaaagaaagcattt

SEQ ID NO: 231715 - DNA, 20 bp, Artificial
  CRISPR gRNA sequence
tgaaaaaaagaaagcatttg

SEQ ID NO: 231716 - DNA, 20 bp, Artificial
  CRISPR gRNA sequence
gaaaaaaagaaagcatttgt

SEQ ID NO: 231717 - DNA, 20 bp, Artificial
  CRISPR gRNA sequence
aaaaaaagaaagcatttgta

SEQ ID NO: 231718 - DNA, 20 bp, Artificial
  CRISPR gRNA sequence
gtactaagctcctctgtaag

SEQ ID NO: 231719 - DNA, 20 bp, Artificial
  CRISPR gRNA sequence
tactaagctcctctgtaaga

SEQ ID NO: 231720 - DNA, 20 bp, Artificial
  CRISPR gRNA sequence
agctcctctgtaagacaaca

SEQ ID NO: 231721 - DNA, 20 bp, Artificial
  CRISPR gRNA sequence
ctctgtaagacaacatctta

SEQ ID NO: 231722 - DNA, 20 bp, Artificial
  CRISPR gRNA sequence
tgtaagacaacatcttaaat

SEQ ID NO: 231723 - DNA, 20 bp, Artificial
  CRISPR gRNA sequence
taagacaacatcttaaatct

SEQ ID NO: 231724 - DNA, 20 bp, Artificial
  CRISPR gRNA sequence
aaatcttaaaagtgttgtta

SEQ ID NO: 231725 - DNA, 20 bp, Artificial
  CRISPR gRNA sequence
aatcttaaaagtgttgttat

SEQ ID NO: 231726 - DNA, 20 bp, Artificial
  CRISPR gRNA sequence
aaaagtgttgttatcatgac

SEQ ID NO: 231727 - DNA, 20 bp, Artificial
  CRISPR gRNA sequence
aaagtgttgttatcatgact

SEQ ID NO: 231728 - DNA, 20 bp, Artificial
  CRISPR gRNA sequence
ttatcatgactggtgagaga

SEQ ID NO: 231729 - DNA, 20 bp, Artificial
  CRISPR gRNA sequence
tcatgactggtgagagaaga

SEQ ID NO: 231730 - DNA, 20 bp, Artificial
  CRISPR gRNA sequence
gtgagagaagaaaacatttt

SEQ ID NO: 231731 - DNA, 20 bp, Artificial
  CRISPR gRNA sequence
tgtttttattaaatggagca

SEQ ID NO: 231732 - DNA, 20 bp, Artificial
  CRISPR gRNA sequence
gtttttattaaatggagcat

SEQ ID NO: 231733 - DNA, 20 bp, Artificial
  CRISPR gRNA sequence
tttttattaaatggagcatt

SEQ ID NO: 231734 - DNA, 20 bp, Artificial
  CRISPR gRNA sequence
ttattaaatggagcattatt

SEQ ID NO: 231735 - DNA, 20 bp, Artificial
  CRISPR gRNA sequence
tattaaatggagcattattt

SEQ ID NO: 231736 - DNA, 20 bp, Artificial
  CRISPR gRNA sequence
attaaatggagcattattta

SEQ ID NO: 231737 - DNA, 20 bp, Artificial
  CRISPR gRNA sequence
ttaaatggagcattatttac

SEQ ID NO: 231738 - DNA, 20 bp, Artificial
  CRISPR gRNA sequence
aatggagcattatttacaaa

SEQ ID NO: 231739 - DNA, 20 bp, Artificial
  CRISPR gRNA sequence
tttacaaaaagccattgttg

SEQ ID NO: 231740 - DNA, 20 bp, Artificial
  CRISPR gRNA sequence
acaaaaagccattgttgaga

SEQ ID NO: 231741 - DNA, 20 bp, Artificial
  CRISPR gRNA sequence
caaaaagccattgttgagaa

SEQ ID NO: 231742 - DNA, 20 bp, Artificial
  CRISPR gRNA sequence
ttgagaattagatcccacat

SEQ ID NO: 231743 - DNA, 20 bp, Artificial
  CRISPR gRNA sequence
agaattagatcccacatcgt

SEQ ID NO: 231744 - DNA, 20 bp, Artificial
  CRISPR gRNA sequence
gatcccacatcgtataaata

SEQ ID NO: 231745 - DNA, 20 bp, Artificial
  CRISPR gRNA sequence
ttaaccattctaaataaaga

SEQ ID NO: 231746 - DNA, 20 bp, Artificial
  CRISPR gRNA sequence
accattctaaataaagagaa

SEQ ID NO: 231747 - DNA, 20 bp, Artificial
  CRISPR gRNA sequence
taaataaagagaactccagt

SEQ ID NO: 231748 - DNA, 20 bp, Artificial
  CRISPR gRNA sequence
aataaagagaactccagtgt

SEQ ID NO: 231749 - DNA, 20 bp, Artificial
  CRISPR gRNA sequence
cagtgttgctatgtgcaaga

SEQ ID NO: 231750 - DNA, 20 bp, Artificial
  CRISPR gRNA sequence
ctatgtgcaagatcctctct

SEQ ID NO: 231751 - DNA, 20 bp, Artificial
  CRISPR gRNA sequence
tgtgcaagatcctctcttgg

SEQ ID NO: 231752 - DNA, 20 bp, Artificial
  CRISPR gRNA sequence
tcttggagcttttttgcata

SEQ ID NO: 231753 - DNA, 20 bp, Artificial
  CRISPR gRNA sequence
ttggagcttttttgcatagc

SEQ ID NO: 231754 - DNA, 20 bp, Artificial
  CRISPR gRNA sequence
ggagcttttttgcatagcaa

SEQ ID NO: 231755 - DNA, 20 bp, Artificial
  CRISPR gRNA sequence
gagcttttttgcatagcaat

SEQ ID NO: 231756 - DNA, 20 bp, Artificial
  CRISPR gRNA sequence
ttttgcatagcaattaaagg

SEQ ID NO: 231757 - DNA, 20 bp, Artificial
  CRISPR gRNA sequence
tttgcatagcaattaaaggt

SEQ ID NO: 231758 - DNA, 20 bp, Artificial
  CRISPR gRNA sequence
ttgcatagcaattaaaggtg

SEQ ID NO: 231759 - DNA, 20 bp, Artificial
  CRISPR gRNA sequence
tgcatagcaattaaaggtgt

SEQ ID NO: 231760 - DNA, 20 bp, Artificial
  CRISPR gRNA sequence
gcatagcaattaaaggtgtg

SEQ ID NO: 231761 - DNA, 20 bp, Artificial
  CRISPR gRNA sequence
catagcaattaaaggtgtgc

SEQ ID NO: 231762 - DNA, 20 bp, Artificial
  CRISPR gRNA sequence
aaggtgtgctatttgtcagt

SEQ ID NO: 231763 - DNA, 20 bp, Artificial
  CRISPR gRNA sequence
tttgtcagtagccatttttt

SEQ ID NO: 231764 - DNA, 20 bp, Artificial
  CRISPR gRNA sequence
gtcagtagccatttttttgc

SEQ ID NO: 231765 - DNA, 20 bp, Artificial
  CRISPR gRNA sequence
tcagtagccatttttttgca

SEQ ID NO: 231766 - DNA, 20 bp, Artificial
  CRISPR gRNA sequence
ttttgcagtgatttgaagac

SEQ ID NO: 231767 - DNA, 20 bp, Artificial
  CRISPR gRNA sequence
tttgcagtgatttgaagacc

SEQ ID NO: 231768 - DNA, 20 bp, Artificial
  CRISPR gRNA sequence
ttgcagtgatttgaagacca

SEQ ID NO: 231769 - DNA, 20 bp, Artificial
  CRISPR gRNA sequence
tgcagtgatttgaagaccaa

SEQ ID NO: 231770 - DNA, 20 bp, Artificial
  CRISPR gRNA sequence
gcagtgatttgaagaccaaa

SEQ ID NO: 231771 - DNA, 20 bp, Artificial
  CRISPR gRNA sequence
cagtgatttgaagaccaaag

SEQ ID NO: 231772 - DNA, 20 bp, Artificial
  CRISPR gRNA sequence
gaagaccaaagttgttttac

SEQ ID NO: 231773 - DNA, 20 bp, Artificial
  CRISPR gRNA sequence
aagaccaaagttgttttaca

SEQ ID NO: 231774 - DNA, 20 bp, Artificial
  CRISPR gRNA sequence
ttttacagctgtgttaccgt

SEQ ID NO: 231775 - DNA, 20 bp, Artificial
  CRISPR gRNA sequence
tacagctgtgttaccgttaa

SEQ ID NO: 231776 - DNA, 20 bp, Artificial
  CRISPR gRNA sequence
acagctgtgttaccgttaaa

SEQ ID NO: 231777 - DNA, 20 bp, Artificial
  CRISPR gRNA sequence
cagctgtgttaccgttaaag

SEQ ID NO: 231778 - DNA, 20 bp, Artificial
  CRISPR gRNA sequence
tgttaccgttaaaggttttt

SEQ ID NO: 231779 - DNA, 20 bp, Artificial
  CRISPR gRNA sequence
ccgttaaaggtttttttttt

SEQ ID NO: 231780 - DNA, 20 bp, Artificial
  CRISPR gRNA sequence
aaggtttttttttttatatg

SEQ ID NO: 231781 - DNA, 20 bp, Artificial
  CRISPR gRNA sequence
ttttttttatatgtattaaa

SEQ ID NO: 231782 - DNA, 20 bp, Artificial
  CRISPR gRNA sequence
tttttttatatgtattaaat

SEQ ID NO: 231783 - DNA, 20 bp, Artificial
  CRISPR gRNA sequence
ttttttatatgtattaaatc

SEQ ID NO: 231784 - DNA, 20 bp, Artificial
  CRISPR gRNA sequence
tttttatatgtattaaatca

SEQ ID NO: 231785 - DNA, 20 bp, Artificial
  CRISPR gRNA sequence
ttttatatgtattaaatcaa

SEQ ID NO: 231786 - DNA, 20 bp, Artificial
  CRISPR gRNA sequence
tttatatgtattaaatcaat

SEQ ID NO: 231787 - DNA, 20 bp, Artificial
  CRISPR gRNA sequence
ttatatgtattaaatcaatt

SEQ ID NO: 231788 - DNA, 20 bp, Artificial
  CRISPR gRNA sequence
tatatgtattaaatcaattt

SEQ ID NO: 231789 - DNA, 20 bp, Artificial
  CRISPR gRNA sequence
atatgtattaaatcaattta

SEQ ID NO: 231790 - DNA, 20 bp, Artificial
  CRISPR gRNA sequence
tatgtattaaatcaatttat

SEQ ID NO: 231791 - DNA, 20 bp, Artificial
  CRISPR gRNA sequence
aatcaatttatcactgttta

SEQ ID NO: 231792 - DNA, 20 bp, Artificial
  CRISPR gRNA sequence
atcactgtttaaagctttga

SEQ ID NO: 231793 - DNA, 20 bp, Artificial
  CRISPR gRNA sequence
tcactgtttaaagctttgaa

SEQ ID NO: 231794 - DNA, 20 bp, Artificial
  CRISPR gRNA sequence
tttaaagctttgaatatctg

SEQ ID NO: 231795 - DNA, 20 bp, Artificial
  CRISPR gRNA sequence
aaagctttgaatatctgcaa

SEQ ID NO: 231796 - DNA, 20 bp, Artificial
  CRISPR gRNA sequence
aagctttgaatatctgcaat

SEQ ID NO: 231797 - DNA, 20 bp, Artificial
  CRISPR gRNA sequence
tgaatatctgcaatctttgc

SEQ ID NO: 231798 - DNA, 20 bp, Artificial
  CRISPR gRNA sequence
gaatatctgcaatctttgcc

SEQ ID NO: 231799 - DNA, 20 bp, Artificial
  CRISPR gRNA sequence
aatatctgcaatctttgcca

SEQ ID NO: 231800 - DNA, 20 bp, Artificial
  CRISPR gRNA sequence
caatctttgccaaggtactt

SEQ ID NO: 231801 - DNA, 20 bp, Artificial
  CRISPR gRNA sequence
tgccaaggtacttttttatt

SEQ ID NO: 231802 - DNA, 20 bp, Artificial
  CRISPR gRNA sequence
gccaaggtacttttttattt

SEQ ID NO: 231803 - DNA, 20 bp, Artificial
  CRISPR gRNA sequence
ccaaggtacttttttattta

SEQ ID NO: 231804 - DNA, 20 bp, Artificial
  CRISPR gRNA sequence
ttttatttaaaaaaaaacat

SEQ ID NO: 231805 - DNA, 20 bp, Artificial
  CRISPR gRNA sequence
tttatttaaaaaaaaacata

SEQ ID NO: 231806 - DNA, 20 bp, Artificial
  CRISPR gRNA sequence
ttatttaaaaaaaaacataa

SEQ ID NO: 231807 - DNA, 20 bp, Artificial
  CRISPR gRNA sequence
tatttaaaaaaaaacataac

SEQ ID NO: 231808 - DNA, 20 bp, Artificial
  CRISPR gRNA sequence
atttaaaaaaaaacataact

SEQ ID NO: 231809 - DNA, 20 bp, Artificial
  CRISPR gRNA sequence
tttaaaaaaaaacataactt

SEQ ID NO: 231810 - DNA, 20 bp, Artificial
  CRISPR gRNA sequence
aaaaaaaaacataactttgt

SEQ ID NO: 231811 - DNA, 20 bp, Artificial
  CRISPR gRNA sequence
aaaaaaaacataactttgta

SEQ ID NO: 231812 - DNA, 20 bp, Artificial
  CRISPR gRNA sequence
tgtaaatattaccctgtaat

SEQ ID NO: 231813 - DNA, 20 bp, Artificial
  CRISPR gRNA sequence
gtaaatattaccctgtaata

SEQ ID NO: 231814 - DNA, 20 bp, Artificial
  CRISPR gRNA sequence
taaatattaccctgtaatat

SEQ ID NO: 231815 - DNA, 20 bp, Artificial
  CRISPR gRNA sequence
ccctgtaatattatatatac

SEQ ID NO: 231816 - DNA, 20 bp, Artificial
  CRISPR gRNA sequence
taatattatatatacttaat

SEQ ID NO: 231817 - DNA, 20 bp, Artificial
  CRISPR gRNA sequence
tatatacttaataaaacatt

SEQ ID NO: 231818 - DNA, 20 bp, Artificial
  CRISPR gRNA sequence
aataaaacattttaagctat

SEQ ID NO: 231819 - DNA, 20 bp, Artificial
  CRISPR gRNA sequence
ataaaacattttaagctatt

SEQ ID NO: 231820 - DNA, 20 bp, Artificial
  CRISPR gRNA sequence
taagctattttgttgggcta

SEQ ID NO: 231821 - DNA, 20 bp, Artificial
  CRISPR gRNA sequence
aagctattttgttgggctat

SEQ ID NO: 231822 - DNA, 20 bp, Artificial
  CRISPR gRNA sequence
agctattttgttgggctatt

SEQ ID NO: 231823 - DNA, 20 bp, Artificial
  CRISPR gRNA sequence
ttttgttgggctatttctat

SEQ ID NO: 231824 - DNA, 20 bp, Artificial
  CRISPR gRNA sequence
tgttgggctatttctattgc

SEQ ID NO: 231825 - DNA, 20 bp, Artificial
  CRISPR gRNA sequence
gttgggctatttctattgct

SEQ ID NO: 231826 - DNA, 20 bp, Artificial
  CRISPR gRNA sequence
ttgggctatttctattgctg

SEQ ID NO: 231827 - DNA, 20 bp, Artificial
  CRISPR gRNA sequence
ggctatttctattgctgcta

SEQ ID NO: 231828 - DNA, 20 bp, Artificial
  CRISPR gRNA sequence
tttctattgctgctacagca

SEQ ID NO: 231829 - DNA, 20 bp, Artificial
  CRISPR gRNA sequence
ctattgctgctacagcagac

SEQ ID NO: 231830 - DNA, 20 bp, Artificial
  CRISPR gRNA sequence
tattgctgctacagcagacc

SEQ ID NO: 231831 - DNA, 20 bp, Artificial
  CRISPR gRNA sequence
ttgctgctacagcagaccac

SEQ ID NO: 231832 - DNA, 20 bp, Artificial
  CRISPR gRNA sequence
ctgctacagcagaccacaag

SEQ ID NO: 231833 - DNA, 20 bp, Artificial
  CRISPR gRNA sequence
ctacagcagaccacaagcac

SEQ ID NO: 231834 - DNA, 20 bp, Artificial
  CRISPR gRNA sequence
cagcagaccacaagcacatt

SEQ ID NO: 231835 - DNA, 20 bp, Artificial
  CRISPR gRNA sequence
ctgaaaaatttaatttatta

SEQ ID NO: 231836 - DNA, 20 bp, Artificial
  CRISPR gRNA sequence
tgaaaaatttaatttattaa

SEQ ID NO: 231837 - DNA, 20 bp, Artificial
  CRISPR gRNA sequence
aaaaatttaatttattaatg

SEQ ID NO: 231838 - DNA, 20 bp, Artificial
  CRISPR gRNA sequence
aatttattaatgtattttta

SEQ ID NO: 231839 - DNA, 20 bp, Artificial
  CRISPR gRNA sequence
atttattaatgtatttttaa

SEQ ID NO: 231840 - DNA, 20 bp, Artificial
  CRISPR gRNA sequence
attaatgtatttttaagttg

SEQ ID NO: 231841 - DNA, 20 bp, Artificial
  CRISPR gRNA sequence
ttaatgtatttttaagttgc

SEQ ID NO: 231842 - DNA, 20 bp, Artificial
  CRISPR gRNA sequence
atgtatttttaagttgctta

SEQ ID NO: 231843 - DNA, 20 bp, Artificial
  CRISPR gRNA sequence
ttaagttgcttatattctag

SEQ ID NO: 231844 - DNA, 20 bp, Artificial
  CRISPR gRNA sequence
taagttgcttatattctagg

SEQ ID NO: 231845 - DNA, 20 bp, Artificial
  CRISPR gRNA sequence
aagttgcttatattctaggt

SEQ ID NO: 231846 - DNA, 20 bp, Artificial
  CRISPR gRNA sequence
agttgcttatattctaggta

SEQ ID NO: 231847 - DNA, 20 bp, Artificial
  CRISPR gRNA sequence
cttatattctaggtaacaat

SEQ ID NO: 231848 - DNA, 20 bp, Artificial
  CRISPR gRNA sequence
atattctaggtaacaatgta

SEQ ID NO: 231849 - DNA, 20 bp, Artificial
  CRISPR gRNA sequence
tattctaggtaacaatgtaa

SEQ ID NO: 231850 - DNA, 20 bp, Artificial
  CRISPR gRNA sequence
taggtaacaatgtaaagaat

SEQ ID NO: 231851 - DNA, 20 bp, Artificial
  CRISPR gRNA sequence
ggtaacaatgtaaagaatga

SEQ ID NO: 231852 - DNA, 20 bp, Artificial
  CRISPR gRNA sequence
aaaatattaattatgaattt

SEQ ID NO: 231853 - DNA, 20 bp, Artificial
  CRISPR gRNA sequence
aaatattaattatgaatttt

SEQ ID NO: 231854 - DNA, 20 bp, Artificial
  CRISPR gRNA sequence
attatgaattttttgagtat

SEQ ID NO: 231855 - DNA, 20 bp, Artificial
  CRISPR gRNA sequence
tgaattttttgagtataata

SEQ ID NO: 231856 - DNA, 20 bp, Artificial
  CRISPR gRNA sequence
tttgagtataatacccaata

SEQ ID NO: 231857 - DNA, 20 bp, Artificial
  CRISPR gRNA sequence
ttgagtataatacccaataa

SEQ ID NO: 231858 - DNA, 20 bp, Artificial
  CRISPR gRNA sequence
tgagtataatacccaataag

SEQ ID NO: 231859 - DNA, 20 bp, Artificial
  CRISPR gRNA sequence
gagtataatacccaataagc

SEQ ID NO: 231860 - DNA, 20 bp, Artificial
  CRISPR gRNA sequence
agtataatacccaataagct

SEQ ID NO: 231861 - DNA, 20 bp, Artificial
  CRISPR gRNA sequence
ttaattagagcagagtttta

SEQ ID NO: 231862 - DNA, 20 bp, Artificial
  CRISPR gRNA sequence
taattagagcagagttttaa

SEQ ID NO: 231863 - DNA, 20 bp, Artificial
  CRISPR gRNA sequence
aattagagcagagttttaat

SEQ ID NO: 231864 - DNA, 20 bp, Artificial
  CRISPR gRNA sequence
attagagcagagttttaatt

SEQ ID NO: 231865 - DNA, 20 bp, Artificial
  CRISPR gRNA sequence
gagcagagttttaattaaaa

SEQ ID NO: 231866 - DNA, 20 bp, Artificial
  CRISPR gRNA sequence
taattaaaagttttaaatca

SEQ ID NO: 231867 - DNA, 20 bp, Artificial
  CRISPR gRNA sequence
aattaaaagttttaaatcag

SEQ ID NO: 231868 - DNA, 20 bp, Artificial
  CRISPR gRNA sequence
attaaaagttttaaatcagt

SEQ ID NO: 231869 - DNA, 20 bp, Artificial
  CRISPR gRNA sequence
aaagttttaaatcagtccaa

SEQ ID NO: 231870 - DNA, 20 bp, Artificial
  CRISPR gRNA sequence
taaatcagtccaatgtgttt

SEQ ID NO: 231871 - DNA, 20 bp, Artificial
  CRISPR gRNA sequence
aaatcagtccaatgtgtttc

SEQ ID NO: 231872 - DNA, 20 bp, Artificial
  CRISPR gRNA sequence
aatcagtccaatgtgtttca

SEQ ID NO: 231873 - DNA, 20 bp, Artificial
  CRISPR gRNA sequence
cataattattttttaatttt

SEQ ID NO: 231874 - DNA, 20 bp, Artificial
  CRISPR gRNA sequence
ataattattttttaattttc

SEQ ID NO: 231875 - DNA, 20 bp, Artificial
  CRISPR gRNA sequence
ttttttaattttctccatgg

SEQ ID NO: 231876 - DNA, 20 bp, Artificial
  CRISPR gRNA sequence
tttaattttctccatggtgc

SEQ ID NO: 231877 - DNA, 20 bp, Artificial
  CRISPR gRNA sequence
ttaattttctccatggtgca

SEQ ID NO: 231878 - DNA, 20 bp, Artificial
  CRISPR gRNA sequence
taattttctccatggtgcag

SEQ ID NO: 231879 - DNA, 20 bp, Artificial
  CRISPR gRNA sequence
aattttctccatggtgcagt

SEQ ID NO: 231880 - DNA, 20 bp, Artificial
  CRISPR gRNA sequence
attttctccatggtgcagtg

SEQ ID NO: 231881 - DNA, 20 bp, Artificial
  CRISPR gRNA sequence
tctccatggtgcagtgaaaa

SEQ ID NO: 231882 - DNA, 20 bp, Artificial
  CRISPR gRNA sequence
ctccatggtgcagtgaaaac

SEQ ID NO: 231883 - DNA, 20 bp, Artificial
  CRISPR gRNA sequence
tccatggtgcagtgaaaaca

SEQ ID NO: 231884 - DNA, 20 bp, Artificial
  CRISPR gRNA sequence
catggtgcagtgaaaacatc

SEQ ID NO: 231885 - DNA, 20 bp, Artificial
  CRISPR gRNA sequence
ggtgctagtcctggctacac

SEQ ID NO: 231886 - DNA, 20 bp, Artificial
  CRISPR gRNA sequence
gggcacggcccaagcctccc

SEQ ID NO: 231887 - DNA, 20 bp, Artificial
  CRISPR gRNA sequence
agcctcccaagacccctctc

SEQ ID NO: 231888 - DNA, 20 bp, Artificial
  CRISPR gRNA sequence
tcccaagacccctctccagt

SEQ ID NO: 231889 - DNA, 20 bp, Artificial
  CRISPR gRNA sequence
ccaagacccctctccagtca

SEQ ID NO: 231890 - DNA, 20 bp, Artificial
  CRISPR gRNA sequence
caagacccctctccagtcag

SEQ ID NO: 231891 - DNA, 20 bp, Artificial
  CRISPR gRNA sequence
gacccctctccagtcagagg

SEQ ID NO: 231892 - DNA, 20 bp, Artificial
  CRISPR gRNA sequence
acccctctccagtcagaggc

SEQ ID NO: 231893 - DNA, 20 bp, Artificial
  CRISPR gRNA sequence
tctccagtcagaggcgggca

SEQ ID NO: 231894 - DNA, 20 bp, Artificial
  CRISPR gRNA sequence
gtcagaggcgggcacggccc

SEQ ID NO: 231895 - DNA, 20 bp, Artificial
  CRISPR gRNA sequence
cggcccaagcctccatgcca

SEQ ID NO: 231896 - DNA, 20 bp, Artificial
  CRISPR gRNA sequence
ggcccaagcctccatgccac

SEQ ID NO: 231897 - DNA, 20 bp, Artificial
  CRISPR gRNA sequence
gcctccatgccacaggtgtg

SEQ ID NO: 231898 - DNA, 20 bp, Artificial
  CRISPR gRNA sequence
tgccacaggtgtgcagccca

SEQ ID NO: 231899 - DNA, 20 bp, Artificial
  CRISPR gRNA sequence
aggtgtgcagcccacagtgc

SEQ ID NO: 231900 - DNA, 20 bp, Artificial
  CRISPR gRNA sequence
gtgcagcccacagtgccggt

SEQ ID NO: 231901 - DNA, 20 bp, Artificial
  CRISPR gRNA sequence
gcagcccacagtgccggtcg

SEQ ID NO: 231902 - DNA, 20 bp, Artificial
  CRISPR gRNA sequence
gtcggagactcccgtctgcc

SEQ ID NO: 231903 - DNA, 20 bp, Artificial
  CRISPR gRNA sequence
tcggagactcccgtctgcca

SEQ ID NO: 231904 - DNA, 20 bp, Artificial
  CRISPR gRNA sequence
gtctgccaaggtttttattg

SEQ ID NO: 231905 - DNA, 20 bp, Artificial
  CRISPR gRNA sequence
aggtttttattgtggtcccg

SEQ ID NO: 231906 - DNA, 20 bp, Artificial
  CRISPR gRNA sequence
ggtttttattgtggtcccgc

SEQ ID NO: 231907 - DNA, 20 bp, Artificial
  CRISPR gRNA sequence
gtttttattgtggtcccgcg

SEQ ID NO: 231908 - DNA, 20 bp, Artificial
  CRISPR gRNA sequence
tttattgtggtcccgcgggg
